United States Patent 8,461,315 (MICRORNAS AND USES THEREOF) - sequence listing, part 17

SEQ ID NO: 468370 - RNA, 64 nt, Homo Sapiens; identical to SEQ ID NO: 87463

SEQ ID NO: 468371 - RNA, 64 nt, Homo Sapiens; identical to SEQ ID NO: 87464

SEQ ID NO: 468372 - RNA, 64 nt, Homo Sapiens; identical to SEQ ID NO: 87465

SEQ ID NO: 468373 - RNA, 64 nt, Homo Sapiens; identical to SEQ ID NO: 87466

SEQ ID NO: 468374 - RNA, 64 nt, Homo Sapiens; identical to SEQ ID NO: 87467

SEQ ID NO: 468375 - RNA, 64 nt, Homo Sapiens; identical to SEQ ID NO: 87468

SEQ ID NO: 468376 - RNA, 64 nt, Homo Sapiens; identical to SEQ ID NO: 87469

SEQ ID NO: 468377 - RNA, 64 nt, Homo Sapiens; identical to SEQ ID NO: 87470

SEQ ID NO: 468378 - RNA, 64 nt, Homo Sapiens; identical to SEQ ID NO: 87471

SEQ ID NO: 468379 - RNA, 64 nt, Homo Sapiens; identical to SEQ ID NO: 87472

SEQ ID NO: 468380 - RNA, 64 nt, Homo Sapiens; identical to SEQ ID NO: 87473

SEQ ID NO: 468381 - RNA, 64 nt, Homo Sapiens; identical to SEQ ID NO: 87474

SEQ ID NO: 468382 - RNA, 64 nt, Homo Sapiens; identical to SEQ ID NO: 87475

SEQ ID NO: 468383 - RNA, 64 nt, Homo Sapiens; identical to SEQ ID NO: 87476

SEQ ID NO: 468384 - RNA, 64 nt, Homo Sapiens; identical to SEQ ID NO: 87477

SEQ ID NO: 468385 - RNA, 64 nt, Homo Sapiens; identical to SEQ ID NO: 87478

SEQ ID NO: 468386 - RNA, 64 nt, Homo Sapiens; identical to SEQ ID NO: 87479

SEQ ID NO: 468387 - RNA, 64 nt, Homo Sapiens
cauuuuuguguuuguuuuguucuuuucugucacugauccguauuaccacuuuuggaaaaaaaua

SEQ ID NO: 468388 - RNA, 64 nt, Homo Sapiens
uauaccacgaaucguuaauuuugacaguucuacugauccguaaaugauaaccacugcaaauuuu

SEQ ID NO: 468389 - RNA, 64 nt, Homo Sapiens
aauaaauucucagaggacuccccguugcugcugugauccguagugucuggcgccgcccuucccg

SEQ ID NO: 468390 - RNA, 64 nt, Homo Sapiens
cagaacguccaggagagacgcaggaggccugagcgauccguacuaccacuccuuuuggagacgg

SEQ ID NO: 468391 - RNA, 64 nt, Homo Sapiens
auugucaggagugcaccucugcacaugagauauagauccguagauagucacauauauaagcacu

SEQ ID NO: 468392 - RNA, 64 nt, Homo Sapiens
aguggaagagaggcagaucaccaauugaucaccggauccguaaagcuggauuaucugggugugc

SEQ ID NO: 468393 - RNA, 64 nt, Homo Sapiens
ccccugggugugcacacagguguuuuuucacacugauccguauugugucucuguugcacagauc

SEQ ID NO: 468394 - RNA, 64 nt, Homo Sapiens
agcauaaaguuccucuuauuuucaguaucuuuaggauccguaauaauguccccucuuuuauucu

SEQ ID NO: 468395 - RNA, 64 nt, Homo Sapiens
uucaauguuuaugcaaggaaaaacaccaaaaagggauccguacaguuuccugagaagugucuaa

SEQ ID NO: 468396 - RNA, 64 nt, Homo Sapiens
ggauguccuaagagcugcaccaagagacugggaggauccguaaguuccuccaggcuucucuuca

SEQ ID NO: 468397 - RNA, 64 nt, Homo Sapiens
uaaaaauacaucucagacgguccaggcucuccuggauccguaccucaccuggauccccaggauc

SEQ ID NO: 468398 - RNA, 64 nt, Homo Sapiens
aaccgggucaucgagguguggagcuggaagagaagauccguagcuugccuccaggucguucucg

SEQ ID NO: 468399 - RNA, 64 nt, Homo Sapiens
ugauguguuaaggugcuucagccacauuguccuugauccguaagaagagaaauacuuccauuau

SEQ ID NO: 468400 - RNA, 64 nt, Homo Sapiens
gccggcggcucggggcccccuccuauuccccugugauccguaagccaccccccggccacacgug

SEQ ID NO: 468401 - RNA, 64 nt, Homo Sapiens
cugguucguagauugauacgaguauagaauaaaagauccguauguuaucuuuguuagcaguagu

SEQ ID NO: 468402 - RNA, 64 nt, Homo Sapiens
guuucuuggaaguuaugcuguagaggcagccugugauccguaguaugcuagggugugacagcag

SEQ ID NO: 468403 - RNA, 64 nt, Homo Sapiens
uuuuaacauacagugcuugaauauacagccuuaacaauguuaaucaucuccuuggaucauuaua

SEQ ID NO: 468404 - RNA, 64 nt, Homo Sapiens
cuuguuaauuuuuauuuguuauacaauggaagcacaauguuauaaggaaagguaauuuuaagcu

SEQ ID NO: 468405 - RNA, 64 nt, Homo Sapiens
auauaggauuauuugggaaguuauaaaccauuuccaauguuagucaugcgacuguaaagccucu

SEQ ID NO: 468406 - RNA, 64 nt, Homo Sapiens
aauuaagcuguugucaaacauaagagcagacuuucaauguuagccuuguacuuuuccucaacug

SEQ ID NO: 468407 - RNA, 64 nt, Homo Sapiens
uuuauaauuucauggauuuaucucacagacguaccaauguuauuccucuacccggaacacaccc

SEQ ID NO: 468408 - RNA, 64 nt, Homo Sapiens
uccuguuagguugauuuuuuuuggaaucaauaugcaauguuaaacacuuuuuuaauguaaucau

SEQ ID NO: 468409 - RNA, 64 nt, Homo Sapiens
auaaguuuucagucagucaggaugacaucacucccaauguuaugcagacauacagacgguuggc

SEQ ID NO: 468410 - RNA, 64 nt, Homo Sapiens
cacaccuaugcugcuuguugcaguaacuaaccaccaauguuaacaucuucauauuuuauauucc

SEQ ID NO: 468411 - RNA, 64 nt, Homo Sapiens
uuuacauuguuaaauguuccuuaccccuaaaggucaauguuaaguacaacauucugaaaauaca

SEQ ID NO: 468412 - RNA, 64 nt, Homo Sapiens
uccauguguucucauuguuauacgaacauuuuaacaauguuaauucuugcagaccaugaacaua

SEQ ID NO: 468413 - RNA, 64 nt, Homo Sapiens
cccauuuauaugcgucuuguucaauuucauucaucaauguuauaaagauuuuagugcagagaua

SEQ ID NO: 468414 - RNA, 64 nt, Homo Sapiens
ccaaggcucugauguauuucagcaugguccccuacaauguuauacacgucuaaagcaguuucac

SEQ ID NO: 468415 - RNA, 64 nt, Homo Sapiens
augauuaauuuaugcuauuuguugucaaaaauaccaauguuaauccuuaaauugguuauuucau

SEQ ID NO: 468416 - RNA, 64 nt, Homo Sapiens
ccgccugagagccagcuuccgcguuggaggcacguguucagagagcugcugagcgccacccucu

SEQ ID NO: 468417 - RNA, 64 nt, Homo Sapiens
aucauaaaaauagccccagaaagagccuaagcuauguucagauagaagccucgaaauuccugua

SEQ ID NO: 468418 - RNA, 64 nt, Homo Sapiens
uugcugugcaauuguuggggcuugucaccagauguguucagacaagaccacuuuacaaauuguu

SEQ ID NO: 468419 - RNA, 64 nt, Homo Sapiens
ccaacaaaacaguuuguugccugaagaaguauuauguucagaagcaucucaccagccccucccu

SEQ ID NO: 468420 - RNA, 64 nt, Homo Sapiens
uaggaccaaacgaugccaucgugaagacuggauguguucagaacuauuugggaggcagcaagau

SEQ ID NO: 468421 - RNA, 64 nt, Homo Sapiens
ucggggcuuucauacuccugaagucucaggauccuguucagauaaucuucucucaucuauggca

SEQ ID NO: 468422 - RNA, 64 nt, Homo Sapiens
accugcagccaguggucauuucaaaaucuuuuuauguucagauacugagccuucauaaggguug

SEQ ID NO: 468423 - RNA, 64 nt, Homo Sapiens
acuuccuggaacacacugcugaaaagaacugauguguucagaucaucuguguagggcugugauu

SEQ ID NO: 468424 - RNA, 64 nt, Homo Sapiens
aauuugucgacugucuguuuugguugaugaauuuuguucagaguuucauccuaauccagaugua

SEQ ID NO: 468425 - RNA, 64 nt, Homo Sapiens
ugaucucaguuauaaucuaaauuaccacaaguuauguucagauuuucaagaggauauuguauuu

SEQ ID NO: 468426 - RNA, 64 nt, Homo Sapiens
uaggagaauauauccaauaaccuucaaaaagcuguguucagagugcguuagaguuuuuguuggg

SEQ ID NO: 468427 - RNA, 64 nt, Homo Sapiens
ccgcuugccgcggggcccacaacccucuugaagcuguucagaagauacguguguuugcuccgcg

SEQ ID NO: 468428 - RNA, 64 nt, Homo Sapiens
ucccucuuuguuuuuuuuuuacuuuuuuauugcauguucagaugauuauuuucacugugaauuc

SEQ ID NO: 468429 - RNA, 64 nt, Homo Sapiens
cccagaugcauuuuuauaacuauguuucccucuuuguucagaaguaaucuguuaucauuuuucc

SEQ ID NO: 468430 - RNA, 64 nt, Homo Sapiens
gcaggaaauuugauauggguuaaauuaugcauuuuguucagauuuuggaaauugguaugcauua

SEQ ID NO: 468431 - RNA, 64 nt, Homo Sapiens
cuucaauauacuagaaguucuaguagguuaauauuguucagaagauuuuuacaaauuaaaaacu

SEQ ID NO: 468432 - RNA, 64 nt, Homo Sapiens
auaaugcguggcagagacugcaacagggauuguguguucagagaucauaugcauauguguaggg

SEQ ID NO: 468433 - RNA, 64 nt, Homo Sapiens
cagucccagugugcgagccccacuuggacacaaguguucagagaggucccccucugccacuuga

SEQ ID NO: 468434 - RNA, 64 nt, Homo Sapiens
ucaagggaccuucugggagcaggugcuaacauaguguucagaaucaauaugugagaugaaaagg

SEQ ID NO: 468435 - RNA, 64 nt, Homo Sapiens
gaugaaaaggauccccuccaggaggauccugagcuguucagaaaucauuuaaguuuacagcguu

SEQ ID NO: 468436 - RNA, 64 nt, Homo Sapiens
ucuuggcccaaccugcucaccaacucuguccagguguucagaccgccugggcaggaaccucucc

SEQ ID NO: 468437 - RNA, 64 nt, Homo Sapiens
ccccuuaugcuccaaggccucgcuggaagccuucuguucagacaccuuggcucuaggauuccgc

SEQ ID NO: 468438 - RNA, 64 nt, Homo Sapiens
uaggauuaguuuguacuuauuuacaaaacagucuuguucagauuuuuacagaaauugaguuaag

SEQ ID NO: 468439 - RNA, 64 nt, Homo Sapiens
aagcuucauucaaaguguuuuucauugucucuaguguucagaaguuuggcugugaugugcgugg

SEQ ID NO: 468440 - RNA, 64 nt, Homo Sapiens
gcacuuguacauaacuauacaguaguguccagaauguucagacauucggaguguacauaaaaca

SEQ ID NO: 468441 - RNA, 64 nt, Homo Sapiens
acaaacccaagaaacgcauccccauugugugauguguucagaugcaucuggcaccaauuaggua

SEQ ID NO: 468442 - RNA, 64 nt, Homo Sapiens
ugaaagcacagauucauugacuacaguacacuguuguucagaaaagaaggcugcaaaugacuuc

SEQ ID NO: 468443 - RNA, 64 nt, Homo Sapiens
cuuauccaguuagaacauugauuuauuuacaugauguucagauuuuccagugaaaaauacccuu

SEQ ID NO: 468444 - RNA, 64 nt, Homo Sapiens
uucaccccaaaggcucuuuucgccaccugagagguugcgcaacgcgggccuaggagggcuaucu

SEQ ID NO: 468445 - RNA, 64 nt, Homo Sapiens
uuccaaaaaaguguuaaauaggcuugagggguuguugcgcaauggccgcuucagaugacagaug

SEQ ID NO: 468446 - RNA, 64 nt, Homo Sapiens
gacgaggacagcggaaagugcaaaaacugaagguuugcgcaagauggccuccuuggauuuaucg

SEQ ID NO: 468447 - RNA, 64 nt, Homo Sapiens
uuuaacagguuuucuucuaaggaagcuauuuccuuugcgcaaaccaacaaacacugugauguug

SEQ ID NO: 468448 - RNA, 64 nt, Homo Sapiens
ugagccugagcaacuggaaauaugcuuccugccauugcgcaaucggggaguuuuuagcaccuaa

SEQ ID NO: 468449 - RNA, 64 nt, Homo Sapiens
auggugguuguuucuuccaagacuccagcccugauugcgcaaaacugaaaggcaugugaaggga

SEQ ID NO: 468450 - RNA, 64 nt, Homo Sapiens
guggacacuuucaauggugcacagaggacuuuuuuugcgcaacuaaaagacccccccuuuuuuu

SEQ ID NO: 468451 - RNA, 64 nt, Homo Sapiens
ccacauuuccuaagcacacuggcuuggccugugauugcgcaaacagcuuccccgaggaccccca

SEQ ID NO: 468452 - RNA, 64 nt, Homo Sapiens
uaaugugcaggccaugugccugugaacuugaaguuugcgcaaaauguggaaagaaagaagacau

SEQ ID NO: 468453 - RNA, 64 nt, Homo Sapiens
uccuucaggguugggggacuacuuuaggguauuuuugcgcaaacaccuccccaccuccuggaaa

SEQ ID NO: 468454 - RNA, 64 nt, Homo Sapiens
uccuaaacaaaucaucuuugucaguuaaguauaguugcgcaaaaauuguuaaauccuuugucuu

SEQ ID NO: 468455 - RNA, 64 nt, Homo Sapiens
uugagaaacaaaucaaucaugguuucuucuagcguugcgcaaacacugacccagcuucugggua

SEQ ID NO: 468456 - RNA, 64 nt, Homo Sapiens
cucccccagucagguggcgguagugcccuggggguugcgcaaagugcugaacuggcugaaguuc

SEQ ID NO: 468457 - RNA, 64 nt, Homo Sapiens
gaaguuucauuuugguuacugauuuuggaaucuauugcgcaaaaucuuguugauuauaaauccu

SEQ ID NO: 468458 - RNA, 64 nt, Homo Sapiens
ugcucuaaauacaguguaccuucuacucuaccaguugcgcaagaaagaagucacuguuacagag

SEQ ID NO: 468459 - RNA, 64 nt, Homo Sapiens
cuuauagguaaaccuugcaaauauguaaccuguguugcgcaaaugccgcauaaauuugagugau

SEQ ID NO: 468460 - RNA, 64 nt, Homo Sapiens
acaaucuuaucuucuuuccuguaguuuuaguuuuuugcgcaaacauaaaauuuuggaacuaauu

SEQ ID NO: 468461 - RNA, 64 nt, Homo Sapiens
gcugcgggaaauguugaagcgccaggagagacuuuugcgcaacgaguaagcuggggucccgcgg

SEQ ID NO: 468462 - RNA, 64 nt, Homo Sapiens
ucucaaaacgaugaaagucauuccuauugcuuccuugcgcaacuuuagaacaaagcuaaggcaa

SEQ ID NO: 468463 - RNA, 64 nt, Homo Sapiens
ccaagaacucugggcacuuuugaacucacgagccuugcgcaaaacccagaagauguauucagag

SEQ ID NO: 468464 - RNA, 64 nt, Homo Sapiens
uuuuuacauauggugaggugcacaauaaguuaacuugcgcaaacgaaaauaauaaaauuuaucu

SEQ ID NO: 468465 - RNA, 64 nt, Homo Sapiens
aauguuaccgaccaugacccccccggccucagaguugcgcaauaaaucuccccagcuggguccg

SEQ ID NO: 468466 - RNA, 64 nt, Homo Sapiens
gaccucccucuugcacucuaucuccuccaugccuuugcgcaaaggcccuaaaccuaaauucaaa

SEQ ID NO: 468467 - RNA, 64 nt, Homo Sapiens
ugugggucuguggauucacguuucaaagaacuauuugcgcaaucuuuuccugcuuccuggucac

SEQ ID NO: 468468 - RNA, 64 nt, Homo Sapiens
guucgcagcgauugcgcagugcgaugcuguuagguugcgcaagcgauguuugcgcucgcauuac

SEQ ID NO: 468469 - RNA, 63 nt, Homo Sapiens; identical to SEQ ID NO: 354303

SEQ ID NO: 468470 - RNA, 63 nt, Homo Sapiens; identical to SEQ ID NO: 354304

SEQ ID NO: 468471 - RNA, 63 nt, Homo Sapiens; identical to SEQ ID NO: 354305

SEQ ID NO: 468472 - RNA, 63 nt, Homo Sapiens; identical to SEQ ID NO: 354306

SEQ ID NO: 468473 - RNA, 63 nt, Homo Sapiens; identical to SEQ ID NO: 354307

SEQ ID NO: 468474 - RNA, 63 nt, Homo Sapiens; identical to SEQ ID NO: 354308

SEQ ID NO: 468475 - RNA, 63 nt, Homo Sapiens; identical to SEQ ID NO: 354309

SEQ ID NO: 468476 - RNA, 63 nt, Homo Sapiens; identical to SEQ ID NO: 354310

SEQ ID NO: 468477 - RNA, 64 nt, Homo Sapiens
gaggguuaaacuuugaggaacugaguggaauaacuuguuagaauugcuacuuuguuagaaaaua

SEQ ID NO: 468478 - RNA, 64 nt, Homo Sapiens
auacugaguggaauaacuuggcauuugugcuacuuuguuagaaauuccuuccaaagacuguuag

SEQ ID NO: 468479 - RNA, 64 nt, Homo Sapiens
aggugagcaccacuguaccuggcuagcuacuucuuuguuagaggauugagaaugaaauuucugc

SEQ ID NO: 468480 - RNA, 64 nt, Homo Sapiens
cuauuuaauugcauugaaaaugucauccuuucuguuguuagauaauuggggucuuccccugaua

SEQ ID NO: 468481 - RNA, 64 nt, Homo Sapiens
uaaacagcagauuucagauccaaugaggaagauuuuguuagacuucaaagcaaguuucaucagu

SEQ ID NO: 468482 - RNA, 64 nt, Homo Sapiens
cagaggagcggccagaagauagucuacccagcccuuguuagauuccaagucuucucaagauccg

SEQ ID NO: 468483 - RNA, 64 nt, Homo Sapiens
uuaaauguauuauugaccuguaucuuuccaaacuuuguuagauuuuaagauaauuuaaugauac

SEQ ID NO: 468484 - RNA, 64 nt, Homo Sapiens
caacuuugcuuuuguuuagcagaacucuuucagcuuguuagaccuucagaauagguuuuugagc

SEQ ID NO: 468485 - RNA, 64 nt, Homo Sapiens
cugggcuagauacagcuuggagaaccugcuggccuuguuagacagcacuugggccuuugccagc

SEQ ID NO: 468486 - RNA, 64 nt, Homo Sapiens
cuuccgcaccuccugaggcccuggaugauucuaauuguuagaaauucuaauuguuagaaauccu

SEQ ID NO: 468487 - RNA, 64 nt, Homo Sapiens
ggcccuggaugauucuaauuguuagaaauucuaauuguuagaaauccuuccuuauaaugaauga

SEQ ID NO: 468488 - RNA, 64 nt, Homo Sapiens
uggaauugcuacagaggagugcuuuucuucucaauuguuagaagaauuuauguuaaacuuuaag

SEQ ID NO: 468489 - RNA, 64 nt, Homo Sapiens
auuuuugagauaagguuuuuauuuauguuuauuauuguuagagugaguugcaaugugggaagaa

SEQ ID NO: 468490 - RNA, 64 nt, Homo Sapiens
uuauugcaaugaugccuaccaaauuuguuagaauuuguuagauuuugaguuuuacauaaaauag

SEQ ID NO: 468491 - RNA, 64 nt, Homo Sapiens
uuguuagauuuuauugcaaucauaaaauagaaauuuguuagaauaauccauaauuugaguuuua

SEQ ID NO: 468492 - RNA, 64 nt, Homo Sapiens
uugacgauguguuuguuccauuuuugagaaacgauuguuagaaaacuuauuuacucagcuuacc

SEQ ID NO: 468493 - RNA, 64 nt, Homo Sapiens
gaauacauuuauauuaggaccauccagaaggguuuuguuagaauuuaaaaaguaaagaaaguug

SEQ ID NO: 468494 - RNA, 64 nt, Homo Sapiens
auuauaaaaucuguuucaaguaugcaguuuucuuuuguuagaaauuguuagagaauagagagug

SEQ ID NO: 468495 - RNA, 64 nt, Homo Sapiens
cuguuucaaguaugcaguuuucuuuuguuagaaauuguuagagaauagagagugguaauucaga

SEQ ID NO: 468496 - RNA, 64 nt, Homo Sapiens
auuagggauuaugcugaauuuguaugguuuauaguuguuagaguuugagguguuaauucuaauu

SEQ ID NO: 468497 - RNA, 64 nt, Homo Sapiens
gauuuggcaguauaaauucuggcuauauuuuuuguuguuagauuuauuuggcuguuaaguauug

SEQ ID NO: 468498 - RNA, 64 nt, Homo Sapiens
uucauaugccuacccaucagucaaauaaguugguuuguuagacaugugugugaaaaagcugggu

SEQ ID NO: 468499 - RNA, 64 nt, Homo Sapiens
cuugcauguugauuacuaaaguuaucuccagcuuuuguuagaauuaaauuaucuggcauaagca

SEQ ID NO: 468500 - RNA, 64 nt, Homo Sapiens
cuugugaaaacaagguuguuuuugucuuuaucguuuguuagaguuauagauuuaugauuucaua

SEQ ID NO: 468501 - RNA, 64 nt, Homo Sapiens
gcccccuuuaaugaguacaagaaaaacucuuggcuuguuagaagaaaguauauucuuucuagaa

SEQ ID NO: 468502 - RNA, 64 nt, Homo Sapiens
gauaucuauggauauagaucuagccacaaacccauuguuagauaguguucuuaagcauaauuuu

SEQ ID NO: 468503 - RNA, 64 nt, Homo Sapiens
uguucuuaagcauaauuuuuuugcagcuuuagguuuguuagaugccuacauuaacauuaugucu

SEQ ID NO: 468504 - RNA, 64 nt, Homo Sapiens; identical to SEQ ID NO: 282391

SEQ ID NO: 468505 - RNA, 64 nt, Homo Sapiens; identical to SEQ ID NO: 282392

SEQ ID NO: 468506 - RNA, 64 nt, Homo Sapiens; identical to SEQ ID NO: 216966

SEQ ID NO: 468507 - RNA, 64 nt, Homo Sapiens; identical to SEQ ID NO: 216967

SEQ ID NO: 468508 - RNA, 64 nt, Homo Sapiens; identical to SEQ ID NO: 216968

SEQ ID NO: 468509 - RNA, 64 nt, Homo Sapiens; identical to SEQ ID NO: 216969

SEQ ID NO: 468510 - RNA, 64 nt, Homo Sapiens; identical to SEQ ID NO: 216970

SEQ ID NO: 468511 - RNA, 64 nt, Homo Sapiens; identical to SEQ ID NO: 216971

SEQ ID NO: 468512 - RNA, 64 nt, Homo Sapiens; identical to SEQ ID NO: 216972

SEQ ID NO: 468513 - RNA, 64 nt, Homo Sapiens; identical to SEQ ID NO: 216973

SEQ ID NO: 468514 - RNA, 64 nt, Homo Sapiens; identical to SEQ ID NO: 216974

SEQ ID NO: 468515 - RNA, 64 nt, Homo Sapiens; identical to SEQ ID NO: 216975

SEQ ID NO: 468516 - RNA, 64 nt, Homo Sapiens; identical to SEQ ID NO: 216976

SEQ ID NO: 468517 - RNA, 64 nt, Homo Sapiens; identical to SEQ ID NO: 216977

SEQ ID NO: 468518 - RNA, 64 nt, Homo Sapiens; identical to SEQ ID NO: 216978

SEQ ID NO: 468519 - RNA, 64 nt, Homo Sapiens; identical to SEQ ID NO: 216979

SEQ ID NO: 468520 - RNA, 56 nt, Homo Sapiens; identical to SEQ ID NO: 216980

SEQ ID NO: 468521 - RNA, 64 nt, Homo Sapiens; identical to SEQ ID NO: 216981

SEQ ID NO: 468522 - RNA, 64 nt, Homo Sapiens; identical to SEQ ID NO: 216982

SEQ ID NO: 468523 - RNA, 64 nt, Homo Sapiens; identical to SEQ ID NO: 216983

SEQ ID NO: 468524 - RNA, 64 nt, Homo Sapiens; identical to SEQ ID NO: 216984

SEQ ID NO: 468525 - RNA, 64 nt, Homo Sapiens; identical to SEQ ID NO: 216985

SEQ ID NO: 468526 - RNA, 64 nt, Homo Sapiens; identical to SEQ ID NO: 216986

SEQ ID NO: 468527 - RNA, 64 nt, Homo Sapiens; identical to SEQ ID NO: 216987

SEQ ID NO: 468528 - RNA, 64 nt, Homo Sapiens; identical to SEQ ID NO: 216988

SEQ ID NO: 468529 - RNA, 64 nt, Homo Sapiens; identical to SEQ ID NO: 216989

SEQ ID NO: 468530 - RNA, 64 nt, Homo Sapiens; identical to SEQ ID NO: 216990

SEQ ID NO: 468531 - RNA, 64 nt, Homo Sapiens; identical to SEQ ID NO: 216991

SEQ ID NO: 468532 - RNA, 64 nt, Homo Sapiens; identical to SEQ ID NO: 216992

SEQ ID NO: 468533 - RNA, 64 nt, Homo Sapiens; identical to SEQ ID NO: 216993

SEQ ID NO: 468534 - RNA, 64 nt, Homo Sapiens; identical to SEQ ID NO: 216994

SEQ ID NO: 468535 - RNA, 64 nt, Homo Sapiens; identical to SEQ ID NO: 216995

SEQ ID NO: 468536 - RNA, 64 nt, Homo Sapiens; identical to SEQ ID NO: 216996

SEQ ID NO: 468537 - RNA, 64 nt, Homo Sapiens; identical to SEQ ID NO: 216997

SEQ ID NO: 468538 - RNA, 64 nt, Homo Sapiens; identical to SEQ ID NO: 216998

SEQ ID NO: 468539 - RNA, 64 nt, Homo Sapiens; identical to SEQ ID NO: 216999

SEQ ID NO: 468540 - RNA, 64 nt, Homo Sapiens; identical to SEQ ID NO: 217000

SEQ ID NO: 468541 - RNA, 64 nt, Homo Sapiens; identical to SEQ ID NO: 217001

SEQ ID NO: 468542 - RNA, 64 nt, Homo Sapiens; identical to SEQ ID NO: 217002

SEQ ID NO: 468543 - RNA, 64 nt, Homo Sapiens; identical to SEQ ID NO: 217003

SEQ ID NO: 468544 - RNA, 64 nt, Homo Sapiens; identical to SEQ ID NO: 217004

SEQ ID NO: 468545 - RNA, 64 nt, Homo Sapiens; identical to SEQ ID NO: 217005

SEQ ID NO: 468546 - RNA, 64 nt, Homo Sapiens; identical to SEQ ID NO: 217006

SEQ ID NO: 468547 - RNA, 64 nt, Homo Sapiens; identical to SEQ ID NO: 217007

SEQ ID NO: 468548 - RNA, 64 nt, Homo Sapiens; identical to SEQ ID NO: 217008

SEQ ID NO: 468549 - RNA, 64 nt, Homo Sapiens; identical to SEQ ID NO: 217009

SEQ ID NO: 468550 - RNA, 64 nt, Homo Sapiens; identical to SEQ ID NO: 217010

SEQ ID NO: 468551 - RNA, 64 nt, Homo Sapiens; identical to SEQ ID NO: 217011

SEQ ID NO: 468552 - RNA, 64 nt, Homo Sapiens; identical to SEQ ID NO: 217012

SEQ ID NO: 468553 - RNA, 64 nt, Homo Sapiens; identical to SEQ ID NO: 217013

SEQ ID NO: 468554 - RNA, 64 nt, Homo Sapiens; identical to SEQ ID NO: 217014

SEQ ID NO: 468555 - RNA, 64 nt, Homo Sapiens; identical to SEQ ID NO: 217015

SEQ ID NO: 468556 - RNA, 64 nt, Homo Sapiens; identical to SEQ ID NO: 217016

SEQ ID NO: 468557 - RNA, 64 nt, Homo Sapiens; identical to SEQ ID NO: 217017

SEQ ID NO: 468558 - RNA, 64 nt, Homo Sapiens; identical to SEQ ID NO: 217018

SEQ ID NO: 468559 - RNA, 64 nt, Homo Sapiens; identical to SEQ ID NO: 217019

SEQ ID NO: 468560 - RNA, 64 nt, Homo Sapiens; identical to SEQ ID NO: 217020

SEQ ID NO: 468561 - RNA, 64 nt, Homo Sapiens; identical to SEQ ID NO: 217021

SEQ ID NO: 468562 - RNA, 64 nt, Homo Sapiens; identical to SEQ ID NO: 217022

SEQ ID NO: 468563 - RNA, 64 nt, Homo Sapiens; identical to SEQ ID NO: 217023

SEQ ID NO: 468564 - RNA, 64 nt, Homo Sapiens; identical to SEQ ID NO: 217024

SEQ ID NO: 468565 - RNA, 64 nt, Homo Sapiens; identical to SEQ ID NO: 217025

SEQ ID NO: 468566 - RNA, 64 nt, Homo Sapiens; identical to SEQ ID NO: 217026

SEQ ID NO: 468567 - RNA, 64 nt, Homo Sapiens; identical to SEQ ID NO: 217027

SEQ ID NO: 468568 - RNA, 64 nt, Homo Sapiens; identical to SEQ ID NO: 217028

SEQ ID NO: 468569 - RNA, 64 nt, Homo Sapiens; identical to SEQ ID NO: 217029

SEQ ID NO: 468570 - RNA, 64 nt, Homo Sapiens
cuaggcgcucucaugauccaaucccagacgaggacuggcugaggccuaucccccuaucccaggc

SEQ ID NO: 468571 - RNA, 64 nt, Homo Sapiens
ccaaugcugugaagcuccacucugacugcaagcccuggcugagguauaccaugcgggucugagc

SEQ ID NO: 468572 - RNA, 64 nt, Homo Sapiens
uggggauuuggggacccuugggguccacaugcaccuggcugaccuggcugaaagccgcugucuc

SEQ ID NO: 468573 - RNA, 64 nt, Homo Sapiens
ggggacccuugggguccacaugcaccuggcugaccuggcugaaagccgcugucucggagccccc

SEQ ID NO: 468574 - RNA, 64 nt, Homo Sapiens
gagagaagacccuagaugaaguuggaaaagagcucuggcugacuccacccacuguccccaagca

SEQ ID NO: 468575 - RNA, 64 nt, Homo Sapiens
caggaaggcaggugguggugcagaaacaugaugccuggcugauuuucguggcuaaagggguagg

SEQ ID NO: 468576 - RNA, 64 nt, Homo Sapiens
agaauaaucacauagcauguacaauauauuuaugcuggcugaaaagacagaaucugggaauaau

SEQ ID NO: 468577 - RNA, 64 nt, Homo Sapiens
auggucuggucaguauuggucuggucaguauugccuggcugacgugaaauguaaacuaguaggc

SEQ ID NO: 468578 - RNA, 64 nt, Homo Sapiens
uagggccuagccuugagcagagccucccuggcugcuggcugagcggagcuagggaagagacccu

SEQ ID NO: 468579 - RNA, 64 nt, Homo Sapiens
gguggggagaccgaaucccucuaggauucucucccuggcugacauaggcuugaugacccagaau

SEQ ID NO: 468580 - RNA, 64 nt, Homo Sapiens
cccuggagugcaguuuccaaucccauagaugggucuggcugagcugaacccauuuugagugacu

SEQ ID NO: 468581 - RNA, 64 nt, Homo Sapiens
uggccaggcacccccuggagagaaguuucuggcccuggcugaccccaaagagccuggagaagcu

SEQ ID NO: 468582 - RNA, 64 nt, Homo Sapiens
uguuuuaaaaucauauccagcacaaaaacuauuucuggcugaauagcacagaaaaguauuuuaa

SEQ ID NO: 468583 - RNA, 64 nt, Homo Sapiens
uuuguauuguucuacuuuuucagcccuuuacuuucuggcugaagcauccccuuggagugccaug

SEQ ID NO: 468584 - RNA, 64 nt, Homo Sapiens
agcuaccaucaucgcuggugcauauaggagcccacuggcugagugccauucugacguguaaccg

SEQ ID NO: 468585 - RNA, 64 nt, Homo Sapiens
accuugagcaacuuacuuaacgcucugacccuugcuggcugaucgagauguuaccaaucccguu

SEQ ID NO: 468586 - RNA, 64 nt, Homo Sapiens
cucuguuuuucucucuaggaagacuaaugacauccuggcugagcauuccccgaggugcgaccuc

SEQ ID NO: 468587 - RNA, 64 nt, Homo Sapiens
ugaaugaugucacucaugguagaugccaagcucccuggcugagcaagcaucgagcuccaagccc

SEQ ID NO: 468588 - RNA, 64 nt, Homo Sapiens
ggcugagagaguuuuggaauuugacauuggcuggcuggcugagcccauuuucggcucuggagau

SEQ ID NO: 468589 - RNA, 64 nt, Homo Sapiens
ucggcucuggagauuauccaugggugaugagggacuggcugaaccaaagaaacaauuuucuucu

SEQ ID NO: 468590 - RNA, 64 nt, Homo Sapiens
cgguagugcccuggggguugcgcaaagugcugaacuggcugaaguucaaguacggagaccuccc

SEQ ID NO: 468591 - RNA, 64 nt, Homo Sapiens
cacuauuucuccucugcuucuucaguccagcagccuggcugaccucuggccuucuggcucaugg

SEQ ID NO: 468592 - RNA, 64 nt, Homo Sapiens
aaacucaagcucacaccugugcuugcgcucagggcuggcugaucaagauugugcugagcgcuga

SEQ ID NO: 468593 - RNA, 64 nt, Homo Sapiens
ugcugcugccccagcucuacacugcgcccuggugcuggcugaccacccccugcccuccugccgg

SEQ ID NO: 468594 - RNA, 64 nt, Homo Sapiens
cccauacuccacggagaggagccccaugcccagccuggcugagcccgagauucgcuccuccccc

SEQ ID NO: 468595 - RNA, 64 nt, Homo Sapiens
gaagucggagcccucacucugcccuguccuggggcuggcugagggcgaacgccccaccucacuu

SEQ ID NO: 468596 - RNA, 64 nt, Homo Sapiens
gggcagcugugccgugggcagggcaugcgcuccccuggcugagcaccccagagauucuccugca

SEQ ID NO: 468597 - RNA, 64 nt, Homo Sapiens
aagcaagggugcuggggccccauggccuucagcccuggcugagcaacugggcuguagggcaggg

SEQ ID NO: 468598 - RNA, 64 nt, Homo Sapiens
caggucuugguaggugccugcaucugucugccuucuggcugacaauccuggaaaucuguucucc

SEQ ID NO: 468599 - RNA, 64 nt, Homo Sapiens
agccgcugcugggagacagcuggugcugucccugcuggcugaggcacucacugcgucaaagggc

SEQ ID NO: 468600 - RNA, 64 nt, Homo Sapiens
aaugcacucacagcaccccuuggcaaccuguguccuggcugaggcaggaguucgaggugcaguu

SEQ ID NO: 468601 - RNA, 64 nt, Homo Sapiens; identical to SEQ ID NO: 437656

SEQ ID NO: 468602 - RNA, 64 nt, Homo Sapiens; identical to SEQ ID NO: 437657

SEQ ID NO: 468603 - RNA, 64 nt, Homo Sapiens; identical to SEQ ID NO: 437658

SEQ ID NO: 468604 - RNA, 64 nt, Homo Sapiens; identical to SEQ ID NO: 437659

SEQ ID NO: 468605 - RNA, 64 nt, Homo Sapiens; identical to SEQ ID NO: 437660

SEQ ID NO: 468606 - RNA, 64 nt, Homo Sapiens; identical to SEQ ID NO: 437661

SEQ ID NO: 468607 - RNA, 64 nt, Homo Sapiens; identical to SEQ ID NO: 437662

SEQ ID NO: 468608 - RNA, 64 nt, Homo Sapiens; identical to SEQ ID NO: 437663

SEQ ID NO: 468609 - RNA, 64 nt, Homo Sapiens; identical to SEQ ID NO: 437664

SEQ ID NO: 468610 - RNA, 64 nt, Homo Sapiens; identical to SEQ ID NO: 437665

SEQ ID NO: 468611 - RNA, 64 nt, Homo Sapiens; identical to SEQ ID NO: 437666

SEQ ID NO: 468612 - RNA, 64 nt, Homo Sapiens; identical to SEQ ID NO: 437667

SEQ ID NO: 468613 - RNA, 64 nt, Homo Sapiens; identical to SEQ ID NO: 437668

SEQ ID NO: 468614 - RNA, 64 nt, Homo Sapiens; identical to SEQ ID NO: 437669

SEQ ID NO: 468615 - RNA, 64 nt, Homo Sapiens; identical to SEQ ID NO: 437670

SEQ ID NO: 468616 - RNA, 64 nt, Homo Sapiens; identical to SEQ ID NO: 437671

SEQ ID NO: 468617 - RNA, 64 nt, Homo Sapiens; identical to SEQ ID NO: 437672

SEQ ID NO: 468618 - RNA, 64 nt, Homo Sapiens; identical to SEQ ID NO: 437673

SEQ ID NO: 468619 - RNA, 64 nt, Homo Sapiens; identical to SEQ ID NO: 437674

SEQ ID NO: 468620 - RNA, 64 nt, Homo Sapiens; identical to SEQ ID NO: 437675

SEQ ID NO: 468621 - RNA, 64 nt, Homo Sapiens
aagcaugcauccgccguacucuuuggggcagcuggucccggagaggccucgacccaccccagug

SEQ ID NO: 468622 - RNA, 64 nt, Homo Sapiens
ccaccucuucccugccgccccgggcuccguggcugucccggaccggcggccucgcgggugacuc

SEQ ID NO: 468623 - RNA, 64 nt, Homo Sapiens
gcaacagcacagcucugccuguaaugaucugcaagucccggagacucauccuacaguugguuug

SEQ ID NO: 468624 - RNA, 64 nt, Homo Sapiens
cugggguggggcagaaauauugcucuuuauuuuggucccggauccucagugaagggggccugcu

SEQ ID NO: 468625 - RNA, 64 nt, Homo Sapiens
gacagagcgggccgcacugucugucuguccgucugucccggaaagaacuauaaagcgcuggaag

SEQ ID NO: 468626 - RNA, 64 nt, Homo Sapiens
ugucuagaaaugagcagguugguucgcagcgagagucccggacuaucagcagugauagaugaag

SEQ ID NO: 468627 - RNA, 64 nt, Homo Sapiens
ggauuuguggaccucucuuguucuaggucuccaggucccggagggcccucuuucacuuuuuuuc

SEQ ID NO: 468628 - RNA, 64 nt, Homo Sapiens
ccguggcccgcugggacuggaccagcaggcggcugucccggaggugcccacgugcccacgcccc

SEQ ID NO: 468629 - RNA, 64 nt, Homo Sapiens
gcuccccuggagccagcagggcugugaugggcgagucccggagccccacccagaccugaaugcu

SEQ ID NO: 468630 - RNA, 64 nt, Homo Sapiens
gaggagagcgcacacccaggggaagcgccugggagucccggaaguccagguaccugcacaagca

SEQ ID NO: 468631 - RNA, 64 nt, Homo Sapiens
acaucuguuuaaaaacaagcacuuauagccuauggucccggauguaaugaaaaaaucugaaacu

SEQ ID NO: 468632 - RNA, 64 nt, Homo Sapiens
agugaggcuuuuuauuagaaaaauuacaaaaugagucccggaaggucaguaagugcaacaugaa

SEQ ID NO: 468633 - RNA, 64 nt, Homo Sapiens
cccaccccaguuuuuguugcuugaaaauauuguugucccggauuuuuguuaauauucauuuuug

SEQ ID NO: 468634 - RNA, 64 nt, Homo Sapiens
ggccaacgcgccguaauuaagacgccgcuccccggucccggaacccucccuucgccacccucca

SEQ ID NO: 468635 - RNA, 64 nt, Homo Sapiens
ccuucccuuuacagcucuccguuucacgaguguagucccggaggcagggcccccacaggggaug

SEQ ID NO: 468636 - RNA, 64 nt, Homo Sapiens
ggauccggccccccagacaccgaccccacaggccgucccggaucucagcggacacaggcaggag

SEQ ID NO: 468637 - RNA, 64 nt, Homo Sapiens
gacuugcauccccauugcgggcagugcuggacgugucccggagacccaccgggagggcgccgcc

SEQ ID NO: 468638 - RNA, 64 nt, Homo Sapiens
ccagccuggcaggagugggaagcaacacgcaggggucccggaccucuccagccuugcccucacg

SEQ ID NO: 468639 - RNA, 64 nt, Homo Sapiens
cuggugugugggcgucggccugcagaccccaugcgucccggagccggccagcacccucuccacg

SEQ ID NO: 468640 - RNA, 64 nt, Homo Sapiens
uguggggccccagagagggggcuccuccaggcacgucccggaccacccugccaggcccccgcug

SEQ ID NO: 468641 - RNA, 64 nt, Homo Sapiens
acuuucuuggcagcuuaagugaaaacccuuaagagucccggauuugcaaaugagacucccgcac

SEQ ID NO: 468642 - RNA, 64 nt, Homo Sapiens
ggaagugaagcaacagcccaggggggacccccaggucccggaggaggccuggggaugagggugg

SEQ ID NO: 468643 - RNA, 64 nt, Homo Sapiens
gaccccccugcauagccuaagugcuauaucgaucgucccggaugugccuuaagaaccgugaccu

SEQ ID NO: 468644 - RNA, 64 nt, Homo Sapiens
gagaguaacuaggaacaugguagaaguggagagagucccggacaugccgacucaggacaggugg

SEQ ID NO: 468645 - RNA, 64 nt, Homo Sapiens
aguguggggcugggcagaggcggucagccugggagucccggaggccaggcugcacaccuggugg

SEQ ID NO: 468646 - RNA, 64 nt, Homo Sapiens
acugcuuccugccuacccggccaguaccucguaggucccggagggugccuccccugcugcacaa

SEQ ID NO: 468647 - RNA, 64 nt, Homo Sapiens
aaggcugggugguggaggggaucuucccuucccugucccggaggcccuaccaauugggagaaau

SEQ ID NO: 468648 - RNA, 64 nt, Homo Sapiens
cuggaggcuuccugagcccuccacaggcagcugcgucccggauggaggugggcccccacagagc

SEQ ID NO: 468649 - RNA, 64 nt, Homo Sapiens
uguguauuuuguaaauguucuaaagauacugcuugucccggaguuuuucagaaccugacauugu

SEQ ID NO: 468650 - RNA, 64 nt, Homo Sapiens
cccuuuguccacuggagcugaccagcucccaaaggucccggagggaugagacucaggcugauac

SEQ ID NO: 468651 - RNA, 64 nt, Homo Sapiens
gugcccgagaaucacucgcuaaccccuaugcccggucccggaccgacauccuggagccgccugu

SEQ ID NO: 468652 - RNA, 64 nt, Homo Sapiens
ccagaaggucacguggaaaugucucgggacuugggucccggagugcccgugaagcguguuuuug

SEQ ID NO: 468653 - RNA, 64 nt, Homo Sapiens
uuuuccacuuuucuauguccuccuuccaccccaagucccggaucacucgcuguuuucuggcuag

SEQ ID NO: 468654 - RNA, 64 nt, Homo Sapiens
caucuacgcugaggacggaguccccucguccugcgucccggaccccgccaucccugaagccauc

SEQ ID NO: 468655 - RNA, 64 nt, Homo Sapiens
ucaggcccuggugaggggcuccugguccugcacugucccggagcgagggcccuucccaaccucc

SEQ ID NO: 468656 - RNA, 64 nt, Homo Sapiens
uucuaccuagcgggauggggcucccccaggggcugucccggaggcggugggccugguuaaauaa

SEQ ID NO: 468657 - RNA, 64 nt, Homo Sapiens
aggcgggaagaaggaggcaucguccaguaagaccgucccggacgggaagcuggugaaagguaug

SEQ ID NO: 468658 - RNA, 64 nt, Homo Sapiens
uccgaggcgggaugcaaacccaaacgcccugagagucccggauguugccaggugggggugggau

SEQ ID NO: 468659 - RNA, 64 nt, Homo Sapiens
aggcuuuccuucgcgccuccuugcucgccaagcggucccggagcccuccuguccucgcggugcc

SEQ ID NO: 468660 - RNA, 64 nt, Homo Sapiens
gagacacggggaacgggauugaaggggcuucccugucccggaggcuccccuuuaccccuccaga

SEQ ID NO: 468661 - RNA, 64 nt, Homo Sapiens
caaggagggagaaauccugcugcacacuggcuuugucccggagucggauucccuccugccugca

SEQ ID NO: 468662 - RNA, 64 nt, Homo Sapiens
cggugcccucacaggccaauccucccaggucagggucccggagcggcacccccaccacucgcug

SEQ ID NO: 468663 - RNA, 64 nt, Homo Sapiens
uuauguuuguuuguuuuuucagaaggggggaggggucccggauuugcucugugacuuuaagaga

SEQ ID NO: 468664 - RNA, 64 nt, Homo Sapiens
gcauccaucacaaucccaaacaccucucagaggggucccggauuccuaguagaagcucacuugc

SEQ ID NO: 468665 - RNA, 64 nt, Homo Sapiens
ggcucagccugccccuccuguucgccuugagcaggucccggagacuggaggcugccaagggcgc

SEQ ID NO: 468666 - RNA, 64 nt, Homo Sapiens
gaggcaagagaaagagaaagcgggcgguggaggggucccggaagagcugguccccgugguugag

SEQ ID NO: 468667 - RNA, 64 nt, Homo Sapiens
aagguauguccgacauuuaacgcgggcugcgucggucccggacuuuucuaauuuauuaaaaaca

SEQ ID NO: 468668 - RNA, 64 nt, Homo Sapiens
uucaggcagagcucuggccaggcugugccagugugucccggacgcaucacuaaggaagagagag

SEQ ID NO: 468669 - RNA, 64 nt, Homo Sapiens
cccagcgcugguccagagccgauccuugauccgggucccggaucguggauccggccgccuaggg

SEQ ID NO: 468670 - RNA, 64 nt, Homo Sapiens
cccaaccccugcuggcuccucugggagcauccaugucccggagaggggucccucaacagucagc

SEQ ID NO: 468671 - RNA, 64 nt, Homo Sapiens
acguuccucacauacaggcaagaggcacugccgggucccggacggcuccgggugacaccagccc

SEQ ID NO: 468672 - RNA, 64 nt, Homo Sapiens
ugugcuauaugaaacauucucaguggaaugaguggucccggagauuggucauuaucuucuacag

SEQ ID NO: 468673 - RNA, 64 nt, Homo Sapiens
cguaggagaguggaggccccacucccaguugggcgucccggagcucagggacugagccccaaga

SEQ ID NO: 468674 - RNA, 64 nt, Homo Sapiens
ccgcgcucucggaggcugucuucugucgccaagggucccggaccgaguacacaguggcagcugg

SEQ ID NO: 468675 - RNA, 64 nt, Homo Sapiens
uuuggaggugggggcuggggaaugaggggcugaggucccggaagggauuuuauuuuuuugaauu

SEQ ID NO: 468676 - RNA, 64 nt, Homo Sapiens
gacccucugcccugcccaccgcaggucccccggggucccggaagccccuucuggcugcaccugc

SEQ ID NO: 468677 - RNA, 64 nt, Homo Sapiens
ggaacggugccucccacugcacacccgccacguggucccggaguaagguggcagacauuuaugg

SEQ ID NO: 468678 - RNA, 64 nt, Homo Sapiens
ucaaaacguccgcucaaaacggaggugagacguugucccggagaagugacucugaaggacucug

SEQ ID NO: 468679 - RNA, 64 nt, Homo Sapiens
cggagcccgaaggccugccagcccugcaccgccugucccggagacggacgcugcauaccaauuu

SEQ ID NO: 468680 - RNA, 64 nt, Homo Sapiens
cccccucucaacccgcuccucagagcuccaugaggucccggagcgucgagguggaggucacgug

SEQ ID NO: 468681 - RNA, 64 nt, Homo Sapiens
cuugggucuccaagaagucuaggaggggacuggggucccggauuggacuccuggguccccgagg

SEQ ID NO: 468682 - RNA, 64 nt, Homo Sapiens
uuagugguggugucucacucuuucuucucucuuugucccggauaggcuaaucaauacccuuggc

SEQ ID NO: 468683 - RNA, 64 nt, Homo Sapiens
uugaugucauuaauguguugggaaaaaggccucugucccggaagagucaugggaggugaaaggg

SEQ ID NO: 468684 - RNA, 64 nt, Homo Sapiens
agugccacagccucgucuggaaaaaggaccaggggucccggaggaacccauuugugcucugcuu

SEQ ID NO: 468685 - RNA, 64 nt, Homo Sapiens
aacuucucuccaggcugaagcgagagggugggaggucccggaguagcagagccggagagagaga

SEQ ID NO: 468686 - RNA, 64 nt, Homo Sapiens
caggcugccuagacucacaggccuggcuuugggggucccggaggggugugugcuguggugcacc

SEQ ID NO: 468687 - RNA, 64 nt, Homo Sapiens
ggaacauccggaacagccaaagaaacucagaagagucccggagcucaaggaucagaguaacaca

SEQ ID NO: 468688 - RNA, 64 nt, Homo Sapiens
cugggagaagcgugcggaggaccguggcgucggcgucccggaugugucggucgugcccggggag

SEQ ID NO: 468689 - RNA, 64 nt, Homo Sapiens
ugucagacauguuugauuuugggcuguggaacgggucccggaaccuggcacagcguggcccgag

SEQ ID NO: 468690 - RNA, 64 nt, Homo Sapiens
ugcccugcucaggccuugcccccaaaccuguacugucccggaggagguugggagguggaggccc

SEQ ID NO: 468691 - RNA, 64 nt, Homo Sapiens
ggggcugcaggacacagcaagugugaacccaggugucccggaaaguuauguaagcuaaaaagcu

SEQ ID NO: 468692 - RNA, 64 nt, Homo Sapiens; identical to SEQ ID NO: 282498

SEQ ID NO: 468693 - RNA, 64 nt, Homo Sapiens; identical to SEQ ID NO: 282499

SEQ ID NO: 468694 - RNA, 64 nt, Homo Sapiens; identical to SEQ ID NO: 282500

SEQ ID NO: 468695 - RNA, 64 nt, Homo Sapiens; identical to SEQ ID NO: 282501

SEQ ID NO: 468696 - RNA, 64 nt, Homo Sapiens; identical to SEQ ID NO: 282502

SEQ ID NO: 468697 - RNA, 64 nt, Homo Sapiens; identical to SEQ ID NO: 282503

SEQ ID NO: 468698 - RNA, 64 nt, Homo Sapiens; identical to SEQ ID NO: 282504

SEQ ID NO: 468699 - RNA, 64 nt, Homo Sapiens; identical to SEQ ID NO: 282505

SEQ ID NO: 468700 - RNA, 64 nt, Homo Sapiens; identical to SEQ ID NO: 282506

SEQ ID NO: 468701 - RNA, 64 nt, Homo Sapiens; identical to SEQ ID NO: 282507

SEQ ID NO: 468702 - RNA, 64 nt, Homo Sapiens; identical to SEQ ID NO: 282508

SEQ ID NO: 468703 - RNA, 64 nt, Homo Sapiens; identical to SEQ ID NO: 282509

SEQ ID NO: 468704 - RNA, 64 nt, Homo Sapiens; identical to SEQ ID NO: 282510

SEQ ID NO: 468705 - RNA, 64 nt, Homo Sapiens; identical to SEQ ID NO: 282511

SEQ ID NO: 468706 - RNA, 64 nt, Homo Sapiens; identical to SEQ ID NO: 282512

SEQ ID NO: 468707 - RNA, 64 nt, Homo Sapiens; identical to SEQ ID NO: 282513

SEQ ID NO: 468708 - RNA, 64 nt, Homo Sapiens; identical to SEQ ID NO: 282514

SEQ ID NO: 468709 - RNA, 64 nt, Homo Sapiens; identical to SEQ ID NO: 282515

SEQ ID NO: 468710 - RNA, 64 nt, Homo Sapiens; identical to SEQ ID NO: 282516

SEQ ID NO: 468711 - RNA, 64 nt, Homo Sapiens; identical to SEQ ID NO: 282517

SEQ ID NO: 468712 - RNA, 64 nt, Homo Sapiens; identical to SEQ ID NO: 282518

SEQ ID NO: 468713 - RNA, 64 nt, Homo Sapiens; identical to SEQ ID NO: 282519

SEQ ID NO: 468714 - RNA, 64 nt, Homo Sapiens; identical to SEQ ID NO: 282520

SEQ ID NO: 468715 - RNA, 64 nt, Homo Sapiens; identical to SEQ ID NO: 282521

SEQ ID NO: 468716 - RNA, 64 nt, Homo Sapiens; identical to SEQ ID NO: 282522

SEQ ID NO: 468717 - RNA, 64 nt, Homo Sapiens; identical to SEQ ID NO: 282523

SEQ ID NO: 468718 - RNA, 64 nt, Homo Sapiens; identical to SEQ ID NO: 282524

SEQ ID NO: 468719 - RNA, 64 nt, Homo Sapiens; identical to SEQ ID NO: 282525

SEQ ID NO: 468720 - RNA, 64 nt, Homo Sapiens; identical to SEQ ID NO: 282526

SEQ ID NO: 468721 - RNA, 64 nt, Homo Sapiens; identical to SEQ ID NO: 282527

SEQ ID NO: 468722 - RNA, 64 nt, Homo Sapiens; identical to SEQ ID NO: 282528

SEQ ID NO: 468723 - RNA, 64 nt, Homo Sapiens; identical to SEQ ID NO: 282529

SEQ ID NO: 468724 - RNA, 64 nt, Homo Sapiens; identical to SEQ ID NO: 282530

SEQ ID NO: 468725 - RNA, 64 nt, Homo Sapiens; identical to SEQ ID NO: 282531

SEQ ID NO: 468726 - RNA, 64 nt, Homo Sapiens; identical to SEQ ID NO: 282532

SEQ ID NO: 468727 - RNA, 64 nt, Homo Sapiens; identical to SEQ ID NO: 282533

SEQ ID NO: 468728 - RNA, 64 nt, Homo Sapiens; identical to SEQ ID NO: 282534

SEQ ID NO: 468729 - RNA, 64 nt, Homo Sapiens; identical to SEQ ID NO: 282535

SEQ ID NO: 468730 - RNA, 64 nt, Homo Sapiens; identical to SEQ ID NO: 282536

SEQ ID NO: 468731 - RNA, 64 nt, Homo Sapiens; identical to SEQ ID NO: 282537

SEQ ID NO: 468732 - RNA, 64 nt, Homo Sapiens; identical to SEQ ID NO: 282538

SEQ ID NO: 468733 - RNA, 64 nt, Homo Sapiens; identical to SEQ ID NO: 282539

SEQ ID NO: 468734 - RNA, 64 nt, Homo Sapiens; identical to SEQ ID NO: 282540

SEQ ID NO: 468735 - RNA, 64 nt, Homo Sapiens; identical to SEQ ID NO: 282541

SEQ ID NO: 468736 - RNA, 64 nt, Homo Sapiens; identical to SEQ ID NO: 282542

SEQ ID NO: 468737 - RNA, 64 nt, Homo Sapiens; identical to SEQ ID NO: 282543

SEQ ID NO: 468738 - RNA, 64 nt, Homo Sapiens; identical to SEQ ID NO: 282544

SEQ ID NO: 468739 - RNA, 64 nt, Homo Sapiens; identical to SEQ ID NO: 282545

SEQ ID NO: 468740 - RNA, 64 nt, Homo Sapiens; identical to SEQ ID NO: 282546

SEQ ID NO: 468741 - RNA, 64 nt, Homo Sapiens; identical to SEQ ID NO: 282547

SEQ ID NO: 468742 - RNA, 64 nt, Homo Sapiens; identical to SEQ ID NO: 282548

SEQ ID NO: 468743 - RNA, 64 nt, Homo Sapiens; identical to SEQ ID NO: 282549

SEQ ID NO: 468744 - RNA, 64 nt, Homo Sapiens; identical to SEQ ID NO: 282550

SEQ ID NO: 468745 - RNA, 64 nt, Homo Sapiens; identical to SEQ ID NO: 282551

SEQ ID NO: 468746 - RNA, 64 nt, Homo Sapiens; identical to SEQ ID NO: 282552

SEQ ID NO: 468747 - RNA, 64 nt, Homo Sapiens; identical to SEQ ID NO: 282553

SEQ ID NO: 468748 - RNA, 64 nt, Homo Sapiens; identical to SEQ ID NO: 282554

SEQ ID NO: 468749 - RNA, 64 nt, Homo Sapiens; identical to SEQ ID NO: 282555

SEQ ID NO: 468750 - RNA, 64 nt, Homo Sapiens; identical to SEQ ID NO: 282556

SEQ ID NO: 468751 - RNA, 64 nt, Homo Sapiens; identical to SEQ ID NO: 282557

SEQ ID NO: 468752 - RNA, 64 nt, Homo Sapiens; identical to SEQ ID NO: 282558

SEQ ID NO: 468753 - RNA, 64 nt, Homo Sapiens; identical to SEQ ID NO: 282559

SEQ ID NO: 468754 - RNA, 64 nt, Homo Sapiens; identical to SEQ ID NO: 282560

SEQ ID NO: 468755 - RNA, 64 nt, Homo Sapiens; identical to SEQ ID NO: 282561

SEQ ID NO: 468756 - RNA, 64 nt, Homo Sapiens; identical to SEQ ID NO: 282562

SEQ ID NO: 468757 - RNA, 64 nt, Homo Sapiens; identical to SEQ ID NO: 282563

SEQ ID NO: 468758 - RNA, 64 nt, Homo Sapiens; identical to SEQ ID NO: 282564

SEQ ID NO: 468759 - RNA, 64 nt, Homo Sapiens; identical to SEQ ID NO: 282565

SEQ ID NO: 468760 - RNA, 64 nt, Homo Sapiens; identical to SEQ ID NO: 282566

SEQ ID NO: 468761 - RNA, 64 nt, Homo Sapiens; identical to SEQ ID NO: 282567

SEQ ID NO: 468762 - RNA, 64 nt, Homo Sapiens; identical to SEQ ID NO: 282568

SEQ ID NO: 468763 - RNA, 64 nt, Homo Sapiens; identical to SEQ ID NO: 282569

SEQ ID NO: 468764 - RNA, 64 nt, Homo Sapiens; identical to SEQ ID NO: 282570

SEQ ID NO: 468765 - RNA, 64 nt, Homo Sapiens; identical to SEQ ID NO: 282571

SEQ ID NO: 468766 - RNA, 64 nt, Homo Sapiens; identical to SEQ ID NO: 282572

SEQ ID NO: 468767 - RNA, 64 nt, Homo Sapiens; identical to SEQ ID NO: 282573

SEQ ID NO: 468768 - RNA, 64 nt, Homo Sapiens; identical to SEQ ID NO: 282574

SEQ ID NO: 468769 - RNA, 64 nt, Homo Sapiens; identical to SEQ ID NO: 282575

SEQ ID NO: 468770 - RNA, 64 nt, Homo Sapiens; identical to SEQ ID NO: 282576

SEQ ID NO: 468771 - RNA, 64 nt, Homo Sapiens; identical to SEQ ID NO: 282577

SEQ ID NO: 468772 - RNA, 64 nt, Homo Sapiens; identical to SEQ ID NO: 282578

SEQ ID NO: 468773 - RNA, 64 nt, Homo Sapiens; identical to SEQ ID NO: 282579

SEQ ID NO: 468774 - RNA, 64 nt, Homo Sapiens; identical to SEQ ID NO: 282580

SEQ ID NO: 468775 - RNA, 64 nt, Homo Sapiens; identical to SEQ ID NO: 282581

SEQ ID NO: 468776 - RNA, 64 nt, Homo Sapiens; identical to SEQ ID NO: 282582

SEQ ID NO: 468777 - RNA, 64 nt, Homo Sapiens; identical to SEQ ID NO: 282583

SEQ ID NO: 468778 - RNA, 64 nt, Homo Sapiens; identical to SEQ ID NO: 282584

SEQ ID NO: 468779 - RNA, 64 nt, Homo Sapiens; identical to SEQ ID NO: 282585

SEQ ID NO: 468780 - RNA, 64 nt, Homo Sapiens; identical to SEQ ID NO: 282586

SEQ ID NO: 468781 - RNA, 64 nt, Homo Sapiens; identical to SEQ ID NO: 282587

SEQ ID NO: 468782 - RNA, 64 nt, Homo Sapiens; identical to SEQ ID NO: 282588

SEQ ID NO: 468783 - RNA, 64 nt, Homo Sapiens; identical to SEQ ID NO: 282589

SEQ ID NO: 468784 - RNA, 64 nt, Homo Sapiens; identical to SEQ ID NO: 282590

SEQ ID NO: 468785 - RNA, 64 nt, Homo Sapiens; identical to SEQ ID NO: 282591

SEQ ID NO: 468786 - RNA, 64 nt, Homo Sapiens; identical to SEQ ID NO: 282592

SEQ ID NO: 468787 - RNA, 64 nt, Homo Sapiens; identical to SEQ ID NO: 282593

SEQ ID NO: 468788 - RNA, 64 nt, Homo Sapiens; identical to SEQ ID NO: 282594

SEQ ID NO: 468789 - RNA, 64 nt, Homo Sapiens; identical to SEQ ID NO: 282595

SEQ ID NO: 468790 - RNA, 64 nt, Homo Sapiens; identical to SEQ ID NO: 282596

SEQ ID NO: 468791 - RNA, 64 nt, Homo Sapiens; identical to SEQ ID NO: 282597

SEQ ID NO: 468792 - RNA, 64 nt, Homo Sapiens; identical to SEQ ID NO: 282598

SEQ ID NO: 468793 - RNA, 64 nt, Homo Sapiens; identical to SEQ ID NO: 282599

SEQ ID NO: 468794 - RNA, 64 nt, Homo Sapiens; identical to SEQ ID NO: 282600

SEQ ID NO: 468795 - RNA, 64 nt, Homo Sapiens; identical to SEQ ID NO: 282601

SEQ ID NO: 468796 - RNA, 64 nt, Homo Sapiens; identical to SEQ ID NO: 282602

SEQ ID NO: 468797 - RNA, 64 nt, Homo Sapiens; identical to SEQ ID NO: 223465

SEQ ID NO: 468798 - RNA, 64 nt, Homo Sapiens; identical to SEQ ID NO: 223466

SEQ ID NO: 468799 - RNA, 64 nt, Homo Sapiens; identical to SEQ ID NO: 223467

SEQ ID NO: 468800 - RNA, 64 nt, Homo Sapiens; identical to SEQ ID NO: 223468

SEQ ID NO: 468801 - RNA, 64 nt, Homo Sapiens; identical to SEQ ID NO: 223469

SEQ ID NO: 468802 - RNA, 64 nt, Homo Sapiens; identical to SEQ ID NO: 223470

SEQ ID NO: 468803 - RNA, 64 nt, Homo Sapiens; identical to SEQ ID NO: 223471

SEQ ID NO: 468804 - RNA, 64 nt, Homo Sapiens; identical to SEQ ID NO: 223472

SEQ ID NO: 468805 - RNA, 64 nt, Homo Sapiens; identical to SEQ ID NO: 223473

SEQ ID NO: 468806 - RNA, 64 nt, Homo Sapiens; identical to SEQ ID NO: 223474

SEQ ID NO: 468807 - RNA, 64 nt, Homo Sapiens; identical to SEQ ID NO: 223475

SEQ ID NO: 468808 - RNA, 64 nt, Homo Sapiens; identical to SEQ ID NO: 223476

SEQ ID NO: 468809 - RNA, 64 nt, Homo Sapiens; identical to SEQ ID NO: 223477

SEQ ID NO: 468810 - RNA, 64 nt, Homo Sapiens; identical to SEQ ID NO: 223478

SEQ ID NO: 468811 - RNA, 64 nt, Homo Sapiens; identical to SEQ ID NO: 223479

SEQ ID NO: 468812 - RNA, 64 nt, Homo Sapiens; identical to SEQ ID NO: 223480

SEQ ID NO: 468813 - RNA, 64 nt, Homo Sapiens; identical to SEQ ID NO: 223481

SEQ ID NO: 468814 - RNA, 64 nt, Homo Sapiens; identical to SEQ ID NO: 223482

SEQ ID NO: 468815 - RNA, 64 nt, Homo Sapiens; identical to SEQ ID NO: 223483

SEQ ID NO: 468816 - RNA, 64 nt, Homo Sapiens; identical to SEQ ID NO: 223484

SEQ ID NO: 468817 - RNA, 64 nt, Homo Sapiens; identical to SEQ ID NO: 223485

SEQ ID NO: 468818 - RNA, 64 nt, Homo Sapiens; identical to SEQ ID NO: 223486

SEQ ID NO: 468819 - RNA, 64 nt, Homo Sapiens; identical to SEQ ID NO: 223487

SEQ ID NO: 468820 - RNA, 64 nt, Homo Sapiens; identical to SEQ ID NO: 223488

SEQ ID NO: 468821 - RNA, 64 nt, Homo Sapiens; identical to SEQ ID NO: 223489

SEQ ID NO: 468822 - RNA, 64 nt, Homo Sapiens; identical to SEQ ID NO: 223490

SEQ ID NO: 468823 - RNA, 64 nt, Homo Sapiens; identical to SEQ ID NO: 223491

SEQ ID NO: 468824 - RNA, 64 nt, Homo Sapiens; identical to SEQ ID NO: 223492

SEQ ID NO: 468825 - RNA, 64 nt, Homo Sapiens; identical to SEQ ID NO: 223493

SEQ ID NO: 468826 - RNA, 64 nt, Homo Sapiens; identical to SEQ ID NO: 223494

SEQ ID NO: 468827 - RNA, 64 nt, Homo Sapiens; identical to SEQ ID NO: 223495

SEQ ID NO: 468828 - RNA, 64 nt, Homo Sapiens; identical to SEQ ID NO: 223496

SEQ ID NO: 468829 - RNA, 64 nt, Homo Sapiens; identical to SEQ ID NO: 223497

SEQ ID NO: 468830 - RNA, 64 nt, Homo Sapiens; identical to SEQ ID NO: 223498

SEQ ID NO: 468831 - RNA, 64 nt, Homo Sapiens; identical to SEQ ID NO: 223499

SEQ ID NO: 468832 - RNA, 64 nt, Homo Sapiens; identical to SEQ ID NO: 223500

SEQ ID NO: 468833 - RNA, 64 nt, Homo Sapiens; identical to SEQ ID NO: 223501

SEQ ID NO: 468834 - RNA, 64 nt, Homo Sapiens; identical to SEQ ID NO: 223502

SEQ ID NO: 468835 - RNA, 64 nt, Homo Sapiens; identical to SEQ ID NO: 223503

SEQ ID NO: 468836 - RNA, 64 nt, Homo Sapiens; identical to SEQ ID NO: 223504

SEQ ID NO: 468837 - RNA, 64 nt, Homo Sapiens; identical to SEQ ID NO: 223505

SEQ ID NO: 468838 - RNA, 64 nt, Homo Sapiens; identical to SEQ ID NO: 223506

SEQ ID NO: 468839 - RNA, 64 nt, Homo Sapiens; identical to SEQ ID NO: 223507

SEQ ID NO: 468840 - RNA, 64 nt, Homo Sapiens; identical to SEQ ID NO: 223508

SEQ ID NO: 468841 - RNA, 64 nt, Homo Sapiens; identical to SEQ ID NO: 223509

SEQ ID NO: 468842 - RNA, 64 nt, Homo Sapiens; identical to SEQ ID NO: 223510

SEQ ID NO: 468843 - RNA, 64 nt, Homo Sapiens; identical to SEQ ID NO: 223511

SEQ ID NO: 468844 - RNA, 64 nt, Homo Sapiens; identical to SEQ ID NO: 223512

SEQ ID NO: 468845 - RNA, 64 nt, Homo Sapiens; identical to SEQ ID NO: 223513

SEQ ID NO: 468846 - RNA, 64 nt, Homo Sapiens; identical to SEQ ID NO: 223514

SEQ ID NO: 468847 - RNA, 64 nt, Homo Sapiens; identical to SEQ ID NO: 223515

SEQ ID NO: 468848 - RNA, 64 nt, Homo Sapiens; identical to SEQ ID NO: 223516

SEQ ID NO: 468849 - RNA, 64 nt, Homo Sapiens; identical to SEQ ID NO: 223517

SEQ ID NO: 468850 - RNA, 64 nt, Homo Sapiens; identical to SEQ ID NO: 223518

SEQ ID NO: 468851 - RNA, 64 nt, Homo Sapiens; identical to SEQ ID NO: 223519

SEQ ID NO: 468852 - RNA, 64 nt, Homo Sapiens; identical to SEQ ID NO: 223520

SEQ ID NO: 468853 - RNA, 64 nt, Homo Sapiens; identical to SEQ ID NO: 223521

SEQ ID NO: 468854 - RNA, 64 nt, Homo Sapiens; identical to SEQ ID NO: 223522

SEQ ID NO: 468855 - RNA, 64 nt, Homo Sapiens; identical to SEQ ID NO: 223523

SEQ ID NO: 468856 - RNA, 64 nt, Homo Sapiens; identical to SEQ ID NO: 223524

SEQ ID NO: 468857 - RNA, 64 nt, Homo Sapiens; identical to SEQ ID NO: 223525

SEQ ID NO: 468858 - RNA, 64 nt, Homo Sapiens; identical to SEQ ID NO: 223526

SEQ ID NO: 468859 - RNA, 64 nt, Homo Sapiens; identical to SEQ ID NO: 223527

SEQ ID NO: 468860 - RNA, 64 nt, Homo Sapiens; identical to SEQ ID NO: 223528

SEQ ID NO: 468861 - RNA, 64 nt, Homo Sapiens; identical to SEQ ID NO: 223529

SEQ ID NO: 468862 - RNA, 64 nt, Homo Sapiens; identical to SEQ ID NO: 223530

SEQ ID NO: 468863 - RNA, 64 nt, Homo Sapiens; identical to SEQ ID NO: 223531

SEQ ID NO: 468864 - RNA, 64 nt, Homo Sapiens; identical to SEQ ID NO: 223532

SEQ ID NO: 468865 - RNA, 64 nt, Homo Sapiens; identical to SEQ ID NO: 223533

SEQ ID NO: 468866 - RNA, 64 nt, Homo Sapiens; identical to SEQ ID NO: 223534

SEQ ID NO: 468867 - RNA, 64 nt, Homo Sapiens; identical to SEQ ID NO: 223535

SEQ ID NO: 468868 - RNA, 64 nt, Homo Sapiens; identical to SEQ ID NO: 223536

SEQ ID NO: 468869 - RNA, 64 nt, Homo Sapiens; identical to SEQ ID NO: 223537

SEQ ID NO: 468870 - RNA, 64 nt, Homo Sapiens; identical to SEQ ID NO: 223538

SEQ ID NO: 468871 - RNA, 64 nt, Homo Sapiens; identical to SEQ ID NO: 223539

SEQ ID NO: 468872 - RNA, 64 nt, Homo Sapiens; identical to SEQ ID NO: 223540

SEQ ID NO: 468873 - RNA, 64 nt, Homo Sapiens; identical to SEQ ID NO: 223541

SEQ ID NO: 468874 - RNA, 64 nt, Homo Sapiens; identical to SEQ ID NO: 223542

SEQ ID NO: 468875 - RNA, 64 nt, Homo Sapiens; identical to SEQ ID NO: 223543

SEQ ID NO: 468876 - RNA, 64 nt, Homo Sapiens; identical to SEQ ID NO: 223544

SEQ ID NO: 468877 - RNA, 64 nt, Homo Sapiens; identical to SEQ ID NO: 223545

SEQ ID NO: 468878 - RNA, 64 nt, Homo Sapiens; identical to SEQ ID NO: 223546

SEQ ID NO: 468879 - RNA, 64 nt, Homo Sapiens; identical to SEQ ID NO: 223547

SEQ ID NO: 468880 - RNA, 64 nt, Homo Sapiens; identical to SEQ ID NO: 223548

SEQ ID NO: 468881 - RNA, 64 nt, Homo Sapiens; identical to SEQ ID NO: 223549

SEQ ID NO: 468882 - RNA, 64 nt, Homo Sapiens; identical to SEQ ID NO: 223550

SEQ ID NO: 468883 - RNA, 64 nt, Homo Sapiens; identical to SEQ ID NO: 223551

SEQ ID NO: 468884 - RNA, 64 nt, Homo Sapiens; identical to SEQ ID NO: 223552

SEQ ID NO: 468885 - RNA, 64 nt, Homo Sapiens; identical to SEQ ID NO: 223553

SEQ ID NO: 468886 - RNA, 64 nt, Homo Sapiens; identical to SEQ ID NO: 223554

SEQ ID NO: 468887 - RNA, 64 nt, Homo Sapiens; identical to SEQ ID NO: 223555

SEQ ID NO: 468888 - RNA, 64 nt, Homo Sapiens; identical to SEQ ID NO: 223556

SEQ ID NO: 468889 - RNA, 64 nt, Homo Sapiens; identical to SEQ ID NO: 223557

SEQ ID NO: 468890 - RNA, 64 nt, Homo Sapiens; identical to SEQ ID NO: 223558

SEQ ID NO: 468891 - RNA, 64 nt, Homo Sapiens; identical to SEQ ID NO: 223559

SEQ ID NO: 468892 - RNA, 64 nt, Homo Sapiens; identical to SEQ ID NO: 223560

SEQ ID NO: 468893 - RNA, 64 nt, Homo Sapiens; identical to SEQ ID NO: 223561

SEQ ID NO: 468894 - RNA, 64 nt, Homo Sapiens; identical to SEQ ID NO: 223562

SEQ ID NO: 468895 - RNA, 64 nt, Homo Sapiens; identical to SEQ ID NO: 223563

SEQ ID NO: 468896 - RNA, 64 nt, Homo Sapiens; identical to SEQ ID NO: 223564

SEQ ID NO: 468897 - RNA, 64 nt, Homo Sapiens; identical to SEQ ID NO: 223565

SEQ ID NO: 468898 - RNA, 64 nt, Homo Sapiens; identical to SEQ ID NO: 223566

SEQ ID NO: 468899 - RNA, 64 nt, Homo Sapiens; identical to SEQ ID NO: 223567

SEQ ID NO: 468900 - RNA, 64 nt, Homo Sapiens; identical to SEQ ID NO: 223568

SEQ ID NO: 468901 - RNA, 64 nt, Homo Sapiens; identical to SEQ ID NO: 223569

SEQ ID NO: 468902 - RNA, 64 nt, Homo Sapiens; identical to SEQ ID NO: 223570

SEQ ID NO: 468903 - RNA, 64 nt, Homo Sapiens; identical to SEQ ID NO: 223571

SEQ ID NO: 468904 - RNA, 64 nt, Homo Sapiens; identical to SEQ ID NO: 172960

SEQ ID NO: 468905 - RNA, 64 nt, Homo Sapiens; identical to SEQ ID NO: 172961

SEQ ID NO: 468906 - RNA, 64 nt, Homo Sapiens; identical to SEQ ID NO: 172962

SEQ ID NO: 468907 - RNA, 64 nt, Homo Sapiens; identical to SEQ ID NO: 172963

SEQ ID NO: 468908 - RNA, 64 nt, Homo Sapiens; identical to SEQ ID NO: 172964

SEQ ID NO: 468909 - RNA, 64 nt, Homo Sapiens; identical to SEQ ID NO: 172965

SEQ ID NO: 468910 - RNA, 64 nt, Homo Sapiens
cacaccaggcccaacccugugcuggucaagccagggcagucacagcugcuuggggcccacagca

SEQ ID NO: 468911 - RNA, 64 nt, Homo Sapiens
uaaagucagagucucugaggaaggaaugugauuuggcagucaggguacuaagcaugggugggaa

SEQ ID NO: 468912 - RNA, 64 nt, Homo Sapiens
gcuguuggauguauggggagcuggcagagcagguggcagucacugggacaaggagggacuugcc

SEQ ID NO: 468913 - RNA, 64 nt, Homo Sapiens
cuguggaaauugggucuugggcuggguggcaucuggcagucauggguaacacuugcuuuuccag

SEQ ID NO: 468914 - RNA, 64 nt, Homo Sapiens
ccucgguuucagacugccuacauuaggaaacaauggcagucaaacccauggcuuuggagaaagu

SEQ ID NO: 468915 - RNA, 64 nt, Homo Sapiens
ccuggccuggcccacccugcuccuccaggugcugggcagucacucugcuaagagucccucccug

SEQ ID NO: 468916 - RNA, 64 nt, Homo Sapiens
ggaguuggaagaggagggauuagaaacaggaggaggcagucauccucuccuugccaaaagauuu

SEQ ID NO: 468917 - RNA, 64 nt, Homo Sapiens
cacugaggacaaugcggcuauagcagauggccauggcagucaguggcagcagaaagaggcagca

SEQ ID NO: 468918 - RNA, 64 nt, Homo Sapiens
cugagugaggagaccgccagccccagaagcagagggcagucaaggucaagagccugugguccag

SEQ ID NO: 468919 - RNA, 64 nt, Homo Sapiens
agggcugccucauaagcucccaaucucagacacuggcagucagggagaaucaaacugccugucu

SEQ ID NO: 468920 - RNA, 64 nt, Homo Sapiens
ccagaaugaggauacgugagaaauagacccggcaggcagucagacugaaugggagcuggaauca

SEQ ID NO: 468921 - RNA, 64 nt, Homo Sapiens
auugccuuuagaaacugaguccuguucuuguuacggcagucacacugcugggaaguggcuuaau

SEQ ID NO: 468922 - RNA, 64 nt, Homo Sapiens
uggcccguccuuggugaguggucuuggggagaugggcagucaggcagcugccacagggagggag

SEQ ID NO: 468923 - RNA, 64 nt, Homo Sapiens
agccccugcagagccuggaacacaggagcccccaggcagucagcccagcugcaacagcugcgug

SEQ ID NO: 468924 - RNA, 64 nt, Homo Sapiens
ucuccauccaucccccucuucaccuuccccuccgggcagucagcguuggaccccagcuucuugc

SEQ ID NO: 468925 - RNA, 64 nt, Homo Sapiens
ggcccgccuccauccaaaauaccggcagcagcuaggcagucaccaaaaaaugucccuuacagga

SEQ ID NO: 468926 - RNA, 64 nt, Homo Sapiens
uucuuaggcccgggaaaaugugcgucucccugcaggcagucaccucucccuaacccaccacccc

SEQ ID NO: 468927 - RNA, 64 nt, Homo Sapiens
ggcccugaggccccuccugcgaguguccccuccaggcagucaugcauauguccucagagaggcu

SEQ ID NO: 468928 - RNA, 64 nt, Homo Sapiens
uuaagacacuaacuuggcccgaguccccauucaaggcagucaaguacauucuuccuggggucca

SEQ ID NO: 468929 - RNA, 64 nt, Homo Sapiens
ggcaaggacuguuggaggaggacaaagccaucugggcagucaggugcccuuugggcaagguugg

SEQ ID NO: 468930 - RNA, 64 nt, Homo Sapiens
gauagggaccacagagauucuggggccagccaggggcagucaaauuggcaccuacuggcucuga

SEQ ID NO: 468931 - RNA, 64 nt, Homo Sapiens
aauggacucauggcuuagaaaucuuuauucuuagggcagucaguaguauucuaaagcuuucuga

SEQ ID NO: 468932 - RNA, 64 nt, Homo Sapiens
cuggcuccccuuuuacaaguucucccugaaagagggcagucacaagaggugugaagaguagcag

SEQ ID NO: 468933 - RNA, 64 nt, Homo Sapiens
aacaccccauggacugugacucgaguauccaacaggcagucagagcucucccggucugaaaguu

SEQ ID NO: 468934 - RNA, 64 nt, Homo Sapiens
ggagaucucagggccucuguuggauccuuuggguggcagucaggugguugaucagaggcaagug

SEQ ID NO: 468935 - RNA, 64 nt, Homo Sapiens
acagggacuguuugucaguaagcaauaauaaaauggcagucauacacaauuuuguggaugauuu

SEQ ID NO: 468936 - RNA, 64 nt, Homo Sapiens
aucugaugucuuucuggucucuugagcaaaacagggcagucaggucaugccacucauuucagaa

SEQ ID NO: 468937 - RNA, 64 nt, Homo Sapiens
aaagagaaaggaguagcuuuauguaagcagccauggcagucauuuuugugcauagcccuucucu

SEQ ID NO: 468938 - RNA, 64 nt, Homo Sapiens
ugguguuuguuuuuaucaaagcauuaucuuaaaaggcagucaaaguagcauacuuggagaaacu

SEQ ID NO: 468939 - RNA, 64 nt, Homo Sapiens
cugaugcucagugcuuugugacccuccccaaagaggcagucagguggaacccucccuguuugga

SEQ ID NO: 468940 - RNA, 64 nt, Homo Sapiens
auuaaugaaacucauguuuaugccagaugccgggggcagucagccccggccacccugggaggcu

SEQ ID NO: 468941 - RNA, 64 nt, Homo Sapiens
gucuaaaugaaaccgaaacgugaccacgcacaaaggcagucacugccucgaggggugcagaccg

SEQ ID NO: 468942 - RNA, 64 nt, Homo Sapiens
ucucuagcccaucauuaccugugaacugcaguggggcagucauggcaaauagaauugggcuggg

SEQ ID NO: 468943 - RNA, 64 nt, Homo Sapiens
ccaaguuagaauucaugauacugguuuauggggaggcagucauaccuguucagagaaccaggaa

SEQ ID NO: 468944 - RNA, 60 nt, Homo Sapiens
guuacggagccgauggcugacguauuucauggcagucaaguccaauggcagcgucuucgu

SEQ ID NO: 468945 - RNA, 64 nt, Homo Sapiens
uuuaaggcacuucugaaagucaaucccuggacaaggcagucaucacauaagaacagcuaccuuc

SEQ ID NO: 468946 - RNA, 64 nt, Homo Sapiens
acacacauccaucucaagaggaacauuuauaccaggcagucagagcuggaaguguauggagagc

SEQ ID NO: 468947 - RNA, 64 nt, Homo Sapiens
aggaguuuaggguauaauuugccuugugauguuuggcagucacuguuuauacuuuaaagguuau

SEQ ID NO: 468948 - RNA, 64 nt, Homo Sapiens
uauuucuugcagaaucaccacacgagaccaucccggcagucaugguuuugcuuuaguuuuccaa

SEQ ID NO: 468949 - RNA, 64 nt, Homo Sapiens
ggaacaugugagggaaaaauauuuaaaaaaagauggcagucaucuagacauguaaaaugccaag

SEQ ID NO: 468950 - RNA, 64 nt, Homo Sapiens
agcucuguuucccccucucccuuugguucagaggggcagucauauaucuuuuaacauuaagugc

SEQ ID NO: 468951 - RNA, 64 nt, Homo Sapiens
gcaucaugcuuugagguuugcaaggaacucacuuggcagucagacaaagagaugcugaggguaa

SEQ ID NO: 468952 - RNA, 64 nt, Homo Sapiens
uucccagacagacuauagacaaacugcccugucuggcagucagcgucagcuagguaaagaugac

SEQ ID NO: 468953 - RNA, 64 nt, Homo Sapiens
auggcaguuucagcguucaaagucuccccagaccggcagucaucgccaagcaugcgauauucag

SEQ ID NO: 468954 - RNA, 64 nt, Homo Sapiens
cacgaugguuuugugccagcuuuacaucaagagaggcagucauuuguaauaauauuuuuaaaaa

SEQ ID NO: 468955 - RNA, 64 nt, Homo Sapiens
acagcuguuccccacuccguucuagaaaaaggggggcagucagaaucugaaauauuaccccuug

SEQ ID NO: 468956 - RNA, 64 nt, Homo Sapiens
caaagcuacccaucugccagugcucgccacagugggcagucacaucuagggaccagcaauacag

SEQ ID NO: 468957 - RNA, 64 nt, Homo Sapiens
agcagaggacgauccuccgacaccaccagcugugggcagucaguauuuggcuccucagccccag

SEQ ID NO: 468958 - RNA, 64 nt, Homo Sapiens
ccugugcugagccccaguggguugcaccuccaccggcagucagcgagcuggggcugcacugugc

SEQ ID NO: 468959 - RNA, 64 nt, Homo Sapiens
uaggugauggcaguccauguggcugccaggccaaggcagucacaggggcccugaccccaggcca

SEQ ID NO: 468960 - RNA, 64 nt, Homo Sapiens
caccccugcuucagcgaaagggacucucuaacagggcagucacuguugacucuauucugaauuu

SEQ ID NO: 468961 - RNA, 64 nt, Homo Sapiens
agggcagccuucugccaccugugucgccuccacuggcagucacgccaccagagccacccuggcu

SEQ ID NO: 468962 - RNA, 64 nt, Homo Sapiens
accccagugaggaccucgaucucagcaucagcguggcagucacccugaaggggcuuggcuucca

SEQ ID NO: 468963 - RNA, 64 nt, Homo Sapiens
uuuuuaaaguuuuguacaaagaggcaguugacggggcagucagagccugaguccuggucccucu

SEQ ID NO: 468964 - RNA, 64 nt, Homo Sapiens
auguugguuuuuuugggaguguucuguaauucugggcagucaucugaagaguuuuguguccgua

SEQ ID NO: 468965 - RNA, 64 nt, Homo Sapiens
ggcugcagggcuggcaaaccaauccugcugauguggcagucaaugcuuuucaagguaucuuucc

SEQ ID NO: 468966 - RNA, 64 nt, Homo Sapiens
gaauaaacuacaguguaaacuaguauauuuugggggcagucaagcuuccaagagcuucuuagag

SEQ ID NO: 468967 - RNA, 64 nt, Homo Sapiens
cuuaaugaaugauacaucagucagauuuuaggaaggcagucaauuauggauauuuuaauguugg

SEQ ID NO: 468968 - RNA, 64 nt, Homo Sapiens
gagucaccauggaagcagcauccugaccacagcuggcagucaagccacagcuggagggucagcc

SEQ ID NO: 468969 - RNA, 64 nt, Homo Sapiens
cuugcacuagugaaauugucuaaagaaacuaaagggcagucaugcccuguuugcaguaauuuuu

SEQ ID NO: 468970 - RNA, 64 nt, Homo Sapiens
gcugagguucuucugcccugagcccugcagcagcggcagucacagcuuccagaugaggggggau

SEQ ID NO: 468971 - RNA, 64 nt, Homo Sapiens
gucacuucugggaugugcccugcuggaagaggagggcagucagucugcacagcaccuuggcuga

SEQ ID NO: 468972 - RNA, 64 nt, Homo Sapiens
ggacacucuauagcaagguuaaucuacaucacugggcagucacacccuccugggguaggagcau

SEQ ID NO: 468973 - RNA, 64 nt, Homo Sapiens
ccgggugaugguguuccugccagaccugggacuuggcagucauguccucccgcuggcuuccaga

SEQ ID NO: 468974 - RNA, 64 nt, Homo Sapiens
aucauuuuuuuccagugaggagcacuucagaugaggcagucaaaauuucagagggccaggcaag

SEQ ID NO: 468975 - RNA, 64 nt, Homo Sapiens
guggaggagaggagacuguuugaugugguacaggggcagucaguggagggcgagugguuucgga

SEQ ID NO: 468976 - RNA, 64 nt, Homo Sapiens
gaaaaaaacuaauguuugaagacaaaaauauuuuggcagucacaauaccagaacuggauugcau

SEQ ID NO: 468977 - RNA, 64 nt, Homo Sapiens
cuggcucuucucucggggcgaccccucagugcucggcagucauacuggggugcgagagaggugg

SEQ ID NO: 468978 - RNA, 64 nt, Homo Sapiens
cacuacuuuuuccuccucugugagugaccauccaggcagucaccauaacugcuggagugucugg

SEQ ID NO: 468979 - RNA, 64 nt, Homo Sapiens
agcaccaggaagaaggugguggcugaggcugaggggcagucaccgaagagggaccagcacauga

SEQ ID NO: 468980 - RNA, 64 nt, Homo Sapiens
ucucugugugcagauaauaaaugcuuuagagggaggcagucauaacucccucucccaaauagua

SEQ ID NO: 468981 - RNA, 64 nt, Homo Sapiens
ugcugaguuaaaacucaggggaaccucuuaucugggcagucauggaaagagaugcugggacaua

SEQ ID NO: 468982 - RNA, 64 nt, Homo Sapiens
ucaaaggguaaagaaagauguaccaucugcugaaggcagucauaauuacuuuuucauauauuuu

SEQ ID NO: 468983 - RNA, 64 nt, Homo Sapiens
cccucugcuucuuuucucuucugcccuccuugugggcagucaugaaaaucaauucagacugugu

SEQ ID NO: 468984 - RNA, 64 nt, Homo Sapiens
acgguagauggcguaugauuucugccauggaguuggcagucaucuuuuugaaucccagaaaggg

SEQ ID NO: 468985 - RNA, 64 nt, Homo Sapiens
uuuaaagaacauuuuauuuuaucuuucaagagagggcagucaucacccuuuuaauauagcacuc

SEQ ID NO: 468986 - RNA, 64 nt, Homo Sapiens
gagggcacccuuggcaaaccgagcaagccacacgggcagucacaccgacccgggccgcaucccu

SEQ ID NO: 468987 - RNA, 64 nt, Homo Sapiens
aauggcugccaaaaccauuaaaauuauggauaugggcagucaucaauguaauuuuccccuaaua

SEQ ID NO: 468988 - RNA, 64 nt, Homo Sapiens
cuuacuuacucccauuuuccguaagucugacuauggcagucagacccucuacuccaugcacaua

SEQ ID NO: 468989 - RNA, 64 nt, Homo Sapiens
agucaucaggugugcucaggggugguugggugugggcagucaucggcacugguuguugaugguc

SEQ ID NO: 468990 - RNA, 64 nt, Homo Sapiens
acaucgcaccaacaauucucuucaggucuaggauggcagucacuauucaugccggauaauagag

SEQ ID NO: 468991 - RNA, 64 nt, Homo Sapiens
aauauacuguauuuugagaaauggcacaaaaacaggcagucaucuuuaagggcuaugccuaggc

SEQ ID NO: 468992 - RNA, 64 nt, Homo Sapiens
ccuguucucggcaccuuaaauuauuagaccccggggcagucaggugcuccggacacccgaaggc

SEQ ID NO: 468993 - RNA, 64 nt, Homo Sapiens
aaaaaaaauaccuuuuguaauagaagaaagaauuggcagucaaaaccagaauuggcccauacca

SEQ ID NO: 468994 - RNA, 64 nt, Homo Sapiens
aaauucaucauaaagacaugagaaucagagguugggcagucaucaguuucccugccccuguuaa

SEQ ID NO: 468995 - RNA, 64 nt, Homo Sapiens
agucaugauuuuuaucuuaguaauaauguugaguggcagucaaagugugcaauauuggugcaug

SEQ ID NO: 468996 - RNA, 63 nt, Homo Sapiens
ccagagaugcuggcccucgcgcccucccugaugggcagucaguagcagcuggcugaggccuaa

SEQ ID NO: 468997 - RNA, 64 nt, Homo Sapiens
aucaccagcaauaccacaggcuuggggugggcaaggcagucagcauaggacucuccuaguccaa

SEQ ID NO: 468998 - RNA, 64 nt, Homo Sapiens
ucccuauggggcccagaguuugccuuuucugccaggcagucaccaugcuucccuaccccagccu

SEQ ID NO: 468999 - RNA, 64 nt, Homo Sapiens
cccaugcaaaaaggaaagagaaaaauuaaguuagggcagucaguaaagugagcuuuagaaagaa

SEQ ID NO: 469000 - RNA, 64 nt, Homo Sapiens
aacucuccuuuauucuauauggaaauaaaaaggaggcagucauguuagcaaaugacacguuaau

SEQ ID NO: 469001 - RNA, 64 nt, Homo Sapiens
ccucagaacuuuguguaaugccuggagcauaguaggcagucauauguuguaucgugaauaaauu

SEQ ID NO: 469002 - RNA, 64 nt, Homo Sapiens
guuccuccuccugguuuggacagcaccagagccaggcagucacugccaguugagccagcgacaa

SEQ ID NO: 469003 - RNA, 64 nt, Homo Sapiens
cuccagggcccuaugccaacccaaagugggccugggcagucaggagugauagcugcuccccauc

SEQ ID NO: 469004 - RNA, 64 nt, Homo Sapiens
cugcguccccuuuaaagaaccuuucuccccuccuggcagucagggcgcauuggcugggccgacu

SEQ ID NO: 469005 - RNA, 64 nt, Homo Sapiens
gaaggcaaauggucugacuugcucugcccucugaggcagucagcuccccuuguaggugacacau

SEQ ID NO: 469006 - RNA, 64 nt, Homo Sapiens
auguuaacccuggauccaucgagcccagugaaauggcagucagacuuauaggggagagggaaca

SEQ ID NO: 469007 - RNA, 64 nt, Homo Sapiens
gccuguuccccacugccugugaacggugggggugggcagucacuuuugcagggucagggaggag

SEQ ID NO: 469008 - RNA, 64 nt, Homo Sapiens
uccacaccuauguccagggcgccagccuuuuuugggcagucagggagauuucagccaaggcugg

SEQ ID NO: 469009 - RNA, 64 nt, Homo Sapiens
gagccccccaacacccccguuccugugcccugggggcagucacaagaauccguuccugagcagc

SEQ ID NO: 469010 - RNA, 61 nt, Homo Sapiens
gccucguccagcaguccuaaccguucaacgaggcagucaccgccgucggaaggcgcuggag

SEQ ID NO: 469011 - RNA, 64 nt, Homo Sapiens
agccugccuggcaggcugucuggccaggccucuuggcagucacaucucuuccuccgaggccagu

SEQ ID NO: 469012 - RNA, 64 nt, Homo Sapiens
auuuguuuucauuguuuguauguacuacuuuuauggcagucauaugaaccauuaucuuagcaug

SEQ ID NO: 469013 - RNA, 64 nt, Homo Sapiens
ugugugugggguaccugggaaaggguguggcugaggcagucauaaugcaguaucuuccccugac

SEQ ID NO: 469014 - RNA, 64 nt, Homo Sapiens
uuaucagucugagaaaauauuuuuuucuaaagaaggcagucaguggaucuuaaaaugacaaucu

SEQ ID NO: 469015 - RNA, 64 nt, Homo Sapiens
guaacagggcccaugcaaguccaaaauucagcagggcagucaaauuuuaaaccuccaaaaugau

SEQ ID NO: 469016 - RNA, 64 nt, Homo Sapiens
caggaaccugugcaugccacccaccgccuggacaggcagucauccugccucugaugugaaucag

SEQ ID NO: 469017 - RNA, 64 nt, Homo Sapiens
aaacaaugcugauagacucagaaaaggaguggggggcagucaccacugcugggcguggcauccg

SEQ ID NO: 469018 - RNA, 64 nt, Homo Sapiens
aaaugagaugguucacuugacuucucuugagaauggcagucaaggaaaucucgcgaggguuaau

SEQ ID NO: 469019 - RNA, 64 nt, Homo Sapiens
auccagguaauccaagauauugaguuuucaguggggcagucauuucucacuauaccaguauaau

SEQ ID NO: 469020 - RNA, 64 nt, Homo Sapiens
aucugcaccuuuaaugcuauucauaaugaagaggggcagucaaucuuuuuaaggggugggccaa

SEQ ID NO: 469021 - RNA, 64 nt, Homo Sapiens
cauugcuucucuguaaauuagggagcuuucgugaggcagucaguacuaggaagugugacagcag

SEQ ID NO: 469022 - RNA, 64 nt, Homo Sapiens
cuucucacugaguuuuuguuauaggaugugagagggcagucauuauuaguaguuuuacuuuacc

SEQ ID NO: 469023 - RNA, 64 nt, Homo Sapiens
uuuuuggaagagaagugugcgauggcaucaguugggcagucaucuugggauaucugcucucugg

SEQ ID NO: 469024 - RNA, 64 nt, Homo Sapiens
uauuuguagaacucaauugaugggcuaggccugaggcagucaccccccauaugaaucugggaaa

SEQ ID NO: 469025 - RNA, 64 nt, Homo Sapiens
gagcaugaguggaugccagaacuguagguuauaaggcagucacuuuuucucucuacucccaccc

SEQ ID NO: 469026 - RNA, 61 nt, Homo Sapiens
agaaaaagaccacggagugacugagcuugcuggcagucacgucaguuauguagauacugca

SEQ ID NO: 469027 - RNA, 64 nt, Homo Sapiens
uaaaaauacaaaaaaaaaauuagcugggugugguggcagucaccuguagucccagcuacuuggg

SEQ ID NO: 469028 - RNA, 64 nt, Homo Sapiens
aggggcaggggcuccucugccagccugugggcauggcagucauuccuggaaggggcaggaccuc

SEQ ID NO: 469029 - RNA, 64 nt, Homo Sapiens
ugugucuagccccaguggcucacugaacuuucagggcagucaggggguccugcuuagaagccag

SEQ ID NO: 469030 - RNA, 64 nt, Homo Sapiens
uuggcacgugaccaaaauucacaucccuccucauggcagucauucaguauguguacuuguacaa

SEQ ID NO: 469031 - RNA, 64 nt, Homo Sapiens
cggcaguucucaaacuuuagagcucaccaugcagggcagucaccccuuagccagcguucaauca

SEQ ID NO: 469032 - RNA, 64 nt, Homo Sapiens
guucacucaggaccuaggaucugagauguaaacuggcagucaguccuccacgcucccuacacac

SEQ ID NO: 469033 - RNA, 64 nt, Homo Sapiens
ugcuuuucuggugcaugaaacauuaauugcaaagggcagucacauccaacuuuaauaaaauaug

SEQ ID NO: 469034 - RNA, 64 nt, Homo Sapiens
aaaaaauccuuguacuuaucaauuuugccccuuaggcagucaguuuuguugagaacuguguccu

SEQ ID NO: 469035 - RNA, 64 nt, Homo Sapiens
ucccagauuguaccagcaaaguccaucagaaauuggcagucacuuuuucucugacagucaagua

SEQ ID NO: 469036 - RNA, 64 nt, Homo Sapiens
uauuaaggauucaacucguggaaauuuucuuuguggcagucauuccuaaaaagauuugcuguua

SEQ ID NO: 469037 - RNA, 64 nt, Homo Sapiens
aaauacaugagaaauucagccuuugaaccuaggaggcagucaauugucugcaugcagcacagaa

SEQ ID NO: 469038 - RNA, 64 nt, Homo Sapiens
acucuuuuuagaucuuugugcuguucuggaucugggcagucagcaacaaagguguuaaguaccu

SEQ ID NO: 469039 - RNA, 64 nt, Homo Sapiens
ggaagucugggaagaauccuaguggaccauaauuggcagucacuauugcacauauuaguaaccc

SEQ ID NO: 469040 - RNA, 64 nt, Homo Sapiens
uuagcacaaagcaauacuagguagcagaugagagggcagucaguuuaaugggcuuugucaugaa

SEQ ID NO: 469041 - RNA, 57 nt, Homo Sapiens
acugaaauuauagcucuggacaggaguggcagucaaaagaagaugacaguugaauag

SEQ ID NO: 469042 - RNA, 64 nt, Homo Sapiens
cucaacucagagccauggagauuuuuauacagaaggcagucaagagcauuucaugaaggauaac

SEQ ID NO: 469043 - RNA, 64 nt, Homo Sapiens
aggccugauggggggccccuagccuguagccaacggcagucacacuucacagcuggccacaacg

SEQ ID NO: 469044 - RNA, 64 nt, Homo Sapiens
gaaaaggggacagcaguuuucccaguuuuggccaggcagucaagccuuuaacagcucaugcaca

SEQ ID NO: 469045 - RNA, 64 nt, Homo Sapiens
gcaccacauacaauagugugaaguagguaugaggggcagucauuguauucuauaguuuuuuuau

SEQ ID NO: 469046 - RNA, 64 nt, Homo Sapiens
aaaaaaaaaaaagaggcuguguuuugucacacagggcagucauucagcaccagagcacgugaug

SEQ ID NO: 469047 - RNA, 64 nt, Homo Sapiens
uguuaaccacucacuuaguauccuagguuuucuaggcagucagcaacccagagggaccaggccu

SEQ ID NO: 469048 - RNA, 64 nt, Homo Sapiens
gccuagcuugaggggucugcaguccaguagggcaggcagucagguccaugugcacugcaaugcc

SEQ ID NO: 469049 - RNA, 64 nt, Homo Sapiens
uuuaauuccugucaagagaccuaggucuacugauggcagucacugcauuguacauuauuccagu

SEQ ID NO: 469050 - RNA, 64 nt, Homo Sapiens
aagucugaguaaagcuguuucuaaaggaggacauggcagucaaaguagccaaacuguaguccuu

SEQ ID NO: 469051 - RNA, 64 nt, Homo Sapiens
ccccagcgugccuccaucccucuccagcagagcaggcagucaggaucugccauccauucugcag

SEQ ID NO: 469052 - RNA, 64 nt, Homo Sapiens
auuuuccucaguguauuuagccuuuugguuaaauggcagucaaagaaaugaagaaaucacgcag

SEQ ID NO: 469053 - RNA, 64 nt, Homo Sapiens
uaugcccggaugcccccgcgagccccagcgcccuggcagucagcagggauggccgccugcuggc

SEQ ID NO: 469054 - RNA, 64 nt, Homo Sapiens
aaggguggaacaggagggguggggaggaagccggggcagucaccgagugaccaccaagaggaag

SEQ ID NO: 469055 - RNA, 64 nt, Homo Sapiens
gccuuccucugccuggggcccacugcaucugauuggcagucacuucccaugagggccuggccca

SEQ ID NO: 469056 - RNA, 64 nt, Homo Sapiens
cuacuggacaauguuacgcuagaauaaacaccaaggcagucaguuaaggcagcuaugguuugga

SEQ ID NO: 469057 - RNA, 64 nt, Homo Sapiens
gggggaggagauggugucguuuagaucaggguaaggcagucaggcggguguucaccacugccuu

SEQ ID NO: 469058 - RNA, 64 nt, Homo Sapiens
aaaauaaagcccuccuggggacuuggaaucagucggcagucaugcugggucuccacguggugug

SEQ ID NO: 469059 - RNA, 64 nt, Homo Sapiens
gggcccaggaccaugccacucaagaagggcagagggcagucaugugacccacacgcugcaguga

SEQ ID NO: 469060 - RNA, 64 nt, Homo Sapiens
aaggcugcaggcacugguugcagacgucuuuauaggcagucaccauguugucaaaccuuaauaa

SEQ ID NO: 469061 - RNA, 64 nt, Homo Sapiens
ccagaggaagcgguccgggggccacagggccuauggcagucagacaaaagcugggcuuccuggg

SEQ ID NO: 469062 - RNA, 64 nt, Homo Sapiens
acccagcccuuccuugggcgugugugcccaagugggcagucaccguuugugaacgcugugaugc

SEQ ID NO: 469063 - RNA, 64 nt, Homo Sapiens
aaccauaggugacuaaauuagugcucuccgauguggcagucagugccuccauuucucuagaucu

SEQ ID NO: 469064 - RNA, 64 nt, Homo Sapiens
gaauuccauuuuuucaagguugucuuuccuagauggcagucacuaugcugcuggacaguaucac

SEQ ID NO: 469065 - RNA, 64 nt, Homo Sapiens
gcaccaaagccaccagacugcaucagccuguguaggcagucaugggugacaaccgaguggcugu

SEQ ID NO: 469066 - RNA, 64 nt, Homo Sapiens
gcaccaaagccaccagacugcaucggccuguguaggcagucaugggugacaaccgaguggcugu

SEQ ID NO: 469067 - RNA, 64 nt, Homo Sapiens
ccauuugccuuccuaguacugguaccuuguuccaggcagucagugggauuccuggguuucccug

SEQ ID NO: 469068 - RNA, 64 nt, Homo Sapiens
ugcccagaucccagaaggacguccugccaccuggggcagucaccagucuaagauggguggggac

SEQ ID NO: 469069 - RNA, 64 nt, Homo Sapiens
auucacaauucagacagcccaucucuggugggcuggcagucauaucugccugcugggaucuguu

SEQ ID NO: 469070 - RNA, 64 nt, Homo Sapiens
gaucauaauaagugaaaugauauauccacuagguggcagucauuuauagagauuugaggaaagu

SEQ ID NO: 469071 - RNA, 64 nt, Homo Sapiens
ccuuuuuaaccuguguuguccuagacccugucggggcagucaggggacacuagagauuugaucu

SEQ ID NO: 469072 - RNA, 64 nt, Homo Sapiens
auuagggacuagaauguauaacuuuaagaaaaugggcagucagacucagccuaaauuuacaguu

SEQ ID NO: 469073 - RNA, 64 nt, Homo Sapiens
ugugugaccuuggggaaaggcagugcccucucugggcagucagauccacccagugcuuaauagc

SEQ ID NO: 469074 - RNA, 64 nt, Homo Sapiens
agccauucuaggcggggcuggggccaggguggggggcagucacugugggaggucccagcuccag

SEQ ID NO: 469075 - RNA, 64 nt, Homo Sapiens
guggaaacccggucagguaaugauaguggcaggaggcagucaaaugcccaggcagauaggggug

SEQ ID NO: 469076 - RNA, 64 nt, Homo Sapiens
aucccaacuuagccacgucuggccuguguccuugggcagucacacuaccucucugauuuuguuu

SEQ ID NO: 469077 - RNA, 64 nt, Homo Sapiens
uggcauuuucugggguugugagggaaacggggauggcagucagacucaaacccgugacacucca

SEQ ID NO: 469078 - RNA, 64 nt, Homo Sapiens
cccuucuugguccacagucugcccucaucccucuggcagucacgcugucuucccugcaugcugu

SEQ ID NO: 469079 - RNA, 64 nt, Homo Sapiens
uuauuuuuaaacagugcauucuugaaagcaguauggcagucauaaaaauuuuggaaccaaaaca

SEQ ID NO: 469080 - RNA, 64 nt, Homo Sapiens
acaaacucugucugccgccagaaggaaugcugggggcagucaugucccaggucccgugcuccuu

SEQ ID NO: 469081 - RNA, 64 nt, Homo Sapiens
gucucuuacaugaaugugacuggugcccccaggaggcagucaccgugcugucucugccccacau

SEQ ID NO: 469082 - RNA, 64 nt, Homo Sapiens
ugguggucacuccuggauguagagucucggccugggcagucacgugcuccuguugcuuucacgu

SEQ ID NO: 469083 - RNA, 64 nt, Homo Sapiens
gggggccugugucacagugcuucaacacgcugauggcagucacaggcuccaccagcugcagaau

SEQ ID NO: 469084 - RNA, 64 nt, Homo Sapiens
gaaggagggucgcccggaucggacgggguggcugggcagucaggucgccgccaggacagagaag

SEQ ID NO: 469085 - RNA, 64 nt, Homo Sapiens
acuuauucaccaucaagcaacaaagccuuuagugggcagucaccuacaagugcaaugagugugg

SEQ ID NO: 469086 - RNA, 64 nt, Homo Sapiens
acuuauucaccaucaagcaacaaacccuuuagugggcagucaccuacaagugcaaugagugugg

SEQ ID NO: 469087 - RNA, 64 nt, Homo Sapiens
uaccuucaccuuaugaaauggcaggauauuuguaggcagucaguaacucacauacgaaaagguu

SEQ ID NO: 469088 - RNA, 64 nt, Homo Sapiens
ugcccaaguucuaguaguauucaaaacuucaaacggcagucauuuguucuccucggcucugugg

SEQ ID NO: 469089 - RNA, 64 nt, Homo Sapiens
ccaguuaaacaaacuacccauccaugagcugccaggcagucaaaaacagaagcuuccccgacuu

SEQ ID NO: 469090 - RNA, 64 nt, Homo Sapiens
acgcaggugcuuaaagggacgcgaugaugagggaggcagucaucuccuugaaagaugaucaaaa

SEQ ID NO: 469091 - RNA, 64 nt, Homo Sapiens
accagccucagcaacugugcgagaggacccugcaggcagucagcguguccguauguaaggccuu

SEQ ID NO: 469092 - RNA, 64 nt, Homo Sapiens
agagggugacauccuggggcuggaagcuuuuccuggcagucaaguggagcuucuuugguaauuc

SEQ ID NO: 469093 - RNA, 64 nt, Homo Sapiens
gcacugcccauggacaggcuggcuccagaugcagggcagucauuggcugucuccuaggaaaccc

SEQ ID NO: 469094 - RNA, 64 nt, Homo Sapiens
gaucaagcacccuaccccaguucuuucugguuuuggcagucacuggaucaggauccaggggagg

SEQ ID NO: 469095 - RNA, 64 nt, Homo Sapiens
caaguacuucauagcaaucuuugcccugaauuuaggcagucacuuugagauccaucagccuaaa

SEQ ID NO: 469096 - RNA, 64 nt, Homo Sapiens
ucaggucuucugccuucugaguuggcucauccugggcagucacagacuguccugccugcacggc

SEQ ID NO: 469097 - RNA, 64 nt, Homo Sapiens
gacuuuggcauaugccagccuguuccugccacagggcagucacugccgccuacccugaaauaaa

SEQ ID NO: 469098 - RNA, 64 nt, Homo Sapiens
gcaaagguggucagggugaugggccgcacagcgaggcagucaaggccagcucccugggagaagc

SEQ ID NO: 469099 - RNA, 64 nt, Homo Sapiens
agacuuauacacuaagggcaaagaaucuuccagaggcagucaaccuuaaaguacaguguuauuu

SEQ ID NO: 469100 - RNA, 64 nt, Homo Sapiens
ucuggcauaaucauaauaaauuccuggaagcaaaggcagucacauagcuuauguuuuagggacu

SEQ ID NO: 469101 - RNA, 64 nt, Homo Sapiens
gaggaaggagagacauuaggucaaucacggaagaggcagucaaguccgugcuuagcuuauucua

SEQ ID NO: 469102 - RNA, 64 nt, Homo Sapiens
gagggagggagugucccaccccaacccaggugugggcagucaggugcccuccccuccaacucag

SEQ ID NO: 469103 - RNA, 64 nt, Homo Sapiens
aggaagcuggccauccguggcagccgggcuugggggcagucaggucgacgcgaagugcuuaaca

SEQ ID NO: 469104 - RNA, 64 nt, Homo Sapiens
guugaagcaaauuuugcauuuugugguuaaagagggcagucacuguuccaaggagugaaggacu

SEQ ID NO: 469105 - RNA, 60 nt, Homo Sapiens
uuguucacaacuucagguagaggaaugcauggcagucagaggggccuugcaaggaggggc

SEQ ID NO: 469106 - RNA, 64 nt, Homo Sapiens
ccuccuuuaaggggcaaugcucuagguuuuugguggcagucaauuugguauuauauaugaucau

SEQ ID NO: 469107 - RNA, 64 nt, Homo Sapiens
ccaucccggcagacccuuaucaaaaaugcaaaaaggcagucaucuuugucccacugacuuaaga

SEQ ID NO: 469108 - RNA, 64 nt, Homo Sapiens
uugcagaggcuaugggaagaaggcuuaauggaugggcagucauugaaugagacuggcuugcccu

SEQ ID NO: 469109 - RNA, 64 nt, Homo Sapiens
uuuuuuuggcuuccaaaccucuuuguucucagugggcagucagaccuucuucccuauccaaaua

SEQ ID NO: 469110 - RNA, 64 nt, Homo Sapiens
gggcaagaggaaagauaagucgaacuaccauucaggcagucagucacgcgcacaugggcgcgca

SEQ ID NO: 469111 - RNA, 64 nt, Homo Sapiens
gagaccucuggccaggggaugugcugaguccagaggcagucacaauccucccaagcugcugcac

SEQ ID NO: 469112 - RNA, 64 nt, Homo Sapiens
cccaugauagucagugcaguggauagaucaaauuggcagucaggagauugugucuucuuuauga

SEQ ID NO: 469113 - RNA, 64 nt, Homo Sapiens
uuugugccacugacuuuagauaaaaaugcaaaagggcagucauccugucccagcagacccuucu

SEQ ID NO: 469114 - RNA, 64 nt, Homo Sapiens
auauaagugcaauauauuuuugaaggucuguaaauguguacauacaugucuuauauaaauauau

SEQ ID NO: 469115 - RNA, 64 nt, Homo Sapiens
cuuauauaaauauauaauauauaaauauggugucuguguacauauagugaagauaugcaguaag

SEQ ID NO: 469116 - RNA, 64 nt, Homo Sapiens
accugaggcugcuuucuguucccaaagcuugaccuguguacagagauaauuccuuggcaauguu

SEQ ID NO: 469117 - RNA, 64 nt, Homo Sapiens
cugacggugguauugcuucucugcauguuaucaguguguacaucuggugcuuuucaugugucau

SEQ ID NO: 469118 - RNA, 64 nt, Homo Sapiens
gaaaauugucuuuacuguauuccuuucuuuaagcuguguacaguacacuccuccuccccuuuuu

SEQ ID NO: 469119 - RNA, 64 nt, Homo Sapiens
uaaaccuuaacaagacuacaugcugugaccagcguguguacacaaugagggcauuuuaucugcu

SEQ ID NO: 469120 - RNA, 64 nt, Homo Sapiens
uaagacgcauauaggguuuuccucauagcuauacuguguacacauccucaaaauaagaucuguu

SEQ ID NO: 469121 - RNA, 64 nt, Homo Sapiens
cgcucugucuuuaaugacagguuguguguguauguguguacacagcaguuuaauugaggaccgu

SEQ ID NO: 469122 - RNA, 64 nt, Homo Sapiens
guguaaaguguaaauccuuugaagguauuccuuuuguguacaguuccccacucccuggcucuca

SEQ ID NO: 469123 - RNA, 64 nt, Homo Sapiens
aagguuaccaacuaccuagaaaggaugucccggguguguacaccggggccugggcuguggacag

SEQ ID NO: 469124 - RNA, 64 nt, Homo Sapiens
aaugguagaugguauuuuaagauauauaaugcuuuguguacaaaugauauauauguaggccuuu

SEQ ID NO: 469125 - RNA, 64 nt, Homo Sapiens
ucuuugccuguucccaccccagucuuaauuuucauguguacacccaccaguguuaaaauuuugg

SEQ ID NO: 469126 - RNA, 64 nt, Homo Sapiens
ggguggaggaggccccagcacagccucaucuccauguguacacguguguacguguguaugcgug

SEQ ID NO: 469127 - RNA, 64 nt, Homo Sapiens
uguguaugcguguguguacgcguguguacgcgcguguguacacaugcguggccgccuguggugu

SEQ ID NO: 469128 - RNA, 64 nt, Homo Sapiens
uugaaguacugggcuuauauuucauuggaauacauguguacagcaauaagcagguuuccaaauc

SEQ ID NO: 469129 - RNA, 64 nt, Homo Sapiens
gcaauaagcagguuuccaaauccgguacuuaguuuguguacaaauguaauuauguucauugugu

SEQ ID NO: 469130 - RNA, 64 nt, Homo Sapiens
acugguuguuuuaguugggcuucuucuagaggcuuguguacacugaaaucauauuaaaagugaa

SEQ ID NO: 469131 - RNA, 64 nt, Homo Sapiens
auuuuuaagugaaaauuagucagagguuauaaaauguguacagccagguuuuuaaauuuaaauu

SEQ ID NO: 469132 - RNA, 64 nt, Homo Sapiens
gagcaauguugguuuuuuauuuucuuacccagauuguguacauaaaaacaagaaagaaauggcu

SEQ ID NO: 469133 - RNA, 64 nt, Homo Sapiens
uauguauaauauauaucuacgugcgugguauacauguguacauaguguguguaugugugagugg

SEQ ID NO: 469134 - RNA, 64 nt, Homo Sapiens
auugguaguauggcccacggugaccauuuuuuuguguguacagcgucauauaggcuuugccuuu

SEQ ID NO: 469135 - RNA, 64 nt, Homo Sapiens
ugagaauagaaguuaugugauuucagugaguugauguguacagcauggcugugcuccaucugau

SEQ ID NO: 469136 - RNA, 64 nt, Homo Sapiens
gauguggugcagugaaguauuuuaggcccaggucuguguacacauuuuauagaagaaugaagua

SEQ ID NO: 469137 - RNA, 64 nt, Homo Sapiens
agagauagaaguuaugacauauguaauacacaucuguguacacagaaaccggcaccugccagac

SEQ ID NO: 469138 - RNA, 64 nt, Homo Sapiens
ccugaggguaauuuuauacgauauuuuaaauaguuguguacaugaagcaugguuugugguaacu

SEQ ID NO: 469139 - RNA, 64 nt, Homo Sapiens
gacaccuguaugaaaaugugaugauugaacucccuguguacagcgagugaauuaaaaugucugc

SEQ ID NO: 469140 - RNA, 64 nt, Homo Sapiens
ccacuuaauagacucuaugugugcugaauguuccuguguacauauguguguuaaauaaaacaau

SEQ ID NO: 469141 - RNA, 64 nt, Homo Sapiens
gugcccgaggggcgggcggcggugucuguauguauguguacauaugcacauagaccuuagagug

SEQ ID NO: 469142 - RNA, 64 nt, Homo Sapiens
uagcauauauuuuuacauguacuauaucuagguguguguacaaguguguguaaaaauauauacc

SEQ ID NO: 469143 - RNA, 64 nt, Homo Sapiens
ccgcccgugguguuauuuaaagaagaaacgucuauguguacagaugaaugauaaacucucugcu

SEQ ID NO: 469144 - RNA, 64 nt, Homo Sapiens
guugaugcaaucgguuuaaacauggcugaacgcguguguacacgggacugacgcaacccacgug

SEQ ID NO: 469145 - RNA, 64 nt, Homo Sapiens
uauaauacauacaaacacauaaaaaguauagguauguguacauaaaaggcauugcuuuaaagga

SEQ ID NO: 469146 - RNA, 64 nt, Homo Sapiens
guuggacuauguguauauugacaccacuauuugauguguacagaugcacugauaucuucacaaa

SEQ ID NO: 469147 - RNA, 63 nt, Homo Sapiens
agugccaggcauggugcugagguuacauguguguguguacagugcgugugauucccaugucca

SEQ ID NO: 469148 - RNA, 64 nt, Homo Sapiens
ccagugccauucuguguucaggugcccauuuccuuguguacauccugucccugccacauccaua

SEQ ID NO: 469149 - RNA, 64 nt, Homo Sapiens
gagcaaugauagcaaauaauguacgaauguuuuuugcauucaaaggacauccacaucuguugga

SEQ ID NO: 469150 - RNA, 64 nt, Homo Sapiens
auuuguuuuuaaaaaucuauuuggucaaucuaaaugcauucauucuaaaaaauuuuuugaacca

SEQ ID NO: 469151 - RNA, 64 nt, Homo Sapiens
aaaacugguuuguagcaguuuugaaagaauagaaugcauucaaauguaaggcugcuucuggauc

SEQ ID NO: 469152 - RNA, 64 nt, Homo Sapiens
gagaauuagaggauggugguaguaaugaaaaugaugcauucaguuuaacaaguuuaauuugaga

SEQ ID NO: 469153 - RNA, 64 nt, Homo Sapiens
aacaacauugucuuucuuuucuagcacagaguuaugcauucaaagaugcauaccuaguuaguuu

SEQ ID NO: 469154 - RNA, 64 nt, Homo Sapiens
aaagccuuuuacaaaauuaaaaaaaaaauagaugugcauucaguuuuuaagaauggaaucaucc

SEQ ID NO: 469155 - RNA, 64 nt, Homo Sapiens
uucauuuauuugagaaaaaaacaauacaaagaaaugcauucauaucaaaauuggaauagaaagg

SEQ ID NO: 469156 - RNA, 64 nt, Homo Sapiens
agugcuaucccaauauuuucaauaaaggacuuuaugcauucagugauuuucuuucccaaagauu

SEQ ID NO: 469157 - RNA, 64 nt, Homo Sapiens
uacuacccucagucuacacuccccccaucuccauugcauucaugucuccauuucugcucagauu

SEQ ID NO: 469158 - RNA, 64 nt, Homo Sapiens
gcuacgugugccccucucaugcucucgggugcccugcauucacacuucauguucagucacaugu

SEQ ID NO: 469159 - RNA, 64 nt, Homo Sapiens
uccucauuacauuccacauucuuagaauaagaagugcauucaauccuaggagaaugauaauccu

SEQ ID NO: 469160 - RNA, 64 nt, Homo Sapiens
cacuuugucaugugguuacaaguaaaacaacuguugcauucacuguuucaacauguguacaugu

SEQ ID NO: 469161 - RNA, 64 nt, Homo Sapiens
cccagucacaauggucuccagaagaacaaaugugugcauucaccaaagaaugagucucuguaug

SEQ ID NO: 469162 - RNA, 64 nt, Homo Sapiens
ugaauuuucagcugaggcuccuggauuaguaaugugcauucaggguucccucuuggugccuaac

SEQ ID NO: 469163 - RNA, 64 nt, Homo Sapiens
acuuuuuauaaagcucuuaauuguugugcaguauugcauucauuacaaaaguguuugugguugg

SEQ ID NO: 469164 - RNA, 64 nt, Homo Sapiens
accuuguuguacuguugguaaaauucugucuugaugcauucaaaaugguugacauaauuaauga

SEQ ID NO: 469165 - RNA, 64 nt, Homo Sapiens
uaagggcgggaaacugaccuucccagcauccaucugcauucagcaccaucucaccauauccauc

SEQ ID NO: 469166 - RNA, 64 nt, Homo Sapiens
ucuaggauacagugugaaaagacacuguauuuuaugcauucaugcucucugcauuaucccgcca

SEQ ID NO: 469167 - RNA, 64 nt, Homo Sapiens
gaagaaauggacauuaaaauuaauaauuucaaaaugcauucacuucuuuuuaaauuguuaauuc

SEQ ID NO: 469168 - RNA, 64 nt, Homo Sapiens
aaucugauauaaagugccagugcgcacacacacuugcauucaugccucucuauguaagcacaca

SEQ ID NO: 469169 - RNA, 64 nt, Homo Sapiens
aguaaugaaucuaacagacacagaauugucacugugcauucaaaauucuaucauguacaguuuc

SEQ ID NO: 469170 - RNA, 64 nt, Homo Sapiens
uucucguguaacacuuguugcaaggaagauuugaugcauucagaggucgcgaagaaaucacagc

SEQ ID NO: 469171 - RNA, 64 nt, Homo Sapiens
ucuagaugacagagcaagacacgaugccacucgcugcauucaagugagccugcagugagcuaug

SEQ ID NO: 469172 - RNA, 64 nt, Homo Sapiens
cucuuguucccuagaaagccguucucgucgagagugcauucacauugucgaacaggggggcgug

SEQ ID NO: 469173 - RNA, 64 nt, Homo Sapiens
cuuaccaaaaaaaaaaaaaaccaaaaaccaaaagugcauucaaccuuugaccaaccgaacauga

SEQ ID NO: 469174 - RNA, 64 nt, Homo Sapiens
ucucaaacuuaguuuuuaucauauuuuuuuccuuugcauucaucuuucacauggacuuuggaaa

SEQ ID NO: 469175 - RNA, 64 nt, Homo Sapiens
ucugucuccggcccgcagcaggagcagccagcagugcauucaccccacuuuuguaaacugcucu

SEQ ID NO: 469176 - RNA, 64 nt, Homo Sapiens
aucuggaagauuggguguauuuuuuggugacugcugcauucaucagcaaugaacaguuuccacu

SEQ ID NO: 469177 - RNA, 64 nt, Homo Sapiens
gaaguguuauuaugccacagguuaaauacuauugugcauucaguauauucaaccuuuuuaacau

SEQ ID NO: 469178 - RNA, 64 nt, Homo Sapiens
guaugcuuaacuuuuugaaauuuuuugcaguuauugcauucaaauauaacuuuaaaaguagaaa

SEQ ID NO: 469179 - RNA, 64 nt, Homo Sapiens
agcgaaagagccaguagugaauccccucauuuugugcauucacuuugaagaaaaagguuucuca

SEQ ID NO: 469180 - RNA, 64 nt, Homo Sapiens
uguguuuguuuuuaaguuagagaguagucccucuugcauucaaaccuccuucaaaacuccuuac

SEQ ID NO: 469181 - RNA, 62 nt, Homo Sapiens
cacccaccacugaaaaagccgcggagaugcgcagcgcguacacugacuuuggggccugggug

SEQ ID NO: 469182 - RNA, 62 nt, Homo Sapiens
uugguguaagacaucacaaucccauuauucagagcgcguauggaguggaaacgcuuguaagg

SEQ ID NO: 469183 - RNA, 62 nt, Homo Sapiens
gaguggaaacgcuuguagggcccauuauucagagcgcguauguugguguaagacaucacaau

SEQ ID NO: 469184 - RNA, 62 nt, Homo Sapiens; identical to SEQ ID NO: 469183

SEQ ID NO: 469185 - RNA, 62 nt, Homo Sapiens; identical to SEQ ID NO: 469183

SEQ ID NO: 469186 - RNA, 63 nt, Homo Sapiens
gcacccaccacugaaaaagccgcggagaugcgcagcgcguacacugacuuuggggccugggug

SEQ ID NO: 469187 - RNA, 63 nt, Homo Sapiens
auugguguaagacaucacaaucccauuauucagagcgcguauggaguggaaacgcuuguaagg

SEQ ID NO: 469188 - RNA, 63 nt, Homo Sapiens
gaguggaaacgcuuguagggucccauuauucagagcgcguaugauugguguaagacaucacaa

SEQ ID NO: 469189 - RNA, 63 nt, Homo Sapiens; identical to SEQ ID NO: 469188

SEQ ID NO: 469190 - RNA, 63 nt, Homo Sapiens; identical to SEQ ID NO: 469188

SEQ ID NO: 469191 - RNA, 62 nt, Homo Sapiens; identical to SEQ ID NO: 253135

SEQ ID NO: 469192 - RNA, 62 nt, Homo Sapiens; identical to SEQ ID NO: 253136

SEQ ID NO: 469193 - RNA, 62 nt, Homo Sapiens; identical to SEQ ID NO: 253137

SEQ ID NO: 469194 - RNA, 62 nt, Homo Sapiens; identical to SEQ ID NO: 253138

SEQ ID NO: 469195 - RNA, 62 nt, Homo Sapiens; identical to SEQ ID NO: 253139

SEQ ID NO: 469196 - RNA, 62 nt, Homo Sapiens; identical to SEQ ID NO: 253140

SEQ ID NO: 469197 - RNA, 62 nt, Homo Sapiens; identical to SEQ ID NO: 253141

SEQ ID NO: 469198 - RNA, 62 nt, Homo Sapiens; identical to SEQ ID NO: 253142

SEQ ID NO: 469199 - RNA, 62 nt, Homo Sapiens; identical to SEQ ID NO: 253143

SEQ ID NO: 469200 - RNA, 62 nt, Homo Sapiens; identical to SEQ ID NO: 253144

SEQ ID NO: 469201 - RNA, 62 nt, Homo Sapiens; identical to SEQ ID NO: 253145

SEQ ID NO: 469202 - RNA, 58 nt, Homo Sapiens; identical to SEQ ID NO: 102991

SEQ ID NO: 469203 - RNA, 62 nt, Homo Sapiens; identical to SEQ ID NO: 253147

SEQ ID NO: 469204 - RNA, 62 nt, Homo Sapiens; identical to SEQ ID NO: 253148

SEQ ID NO: 469205 - RNA, 62 nt, Homo Sapiens; identical to SEQ ID NO: 253149

SEQ ID NO: 469206 - RNA, 62 nt, Homo Sapiens; identical to SEQ ID NO: 253150

SEQ ID NO: 469207 - RNA, 62 nt, Homo Sapiens; identical to SEQ ID NO: 253151

SEQ ID NO: 469208 - RNA, 62 nt, Homo Sapiens; identical to SEQ ID NO: 253152

SEQ ID NO: 469209 - RNA, 62 nt, Homo Sapiens; identical to SEQ ID NO: 253153

SEQ ID NO: 469210 - RNA, 62 nt, Homo Sapiens; identical to SEQ ID NO: 253154

SEQ ID NO: 469211 - RNA, 62 nt, Homo Sapiens; identical to SEQ ID NO: 253155

SEQ ID NO: 469212 - RNA, 62 nt, Homo Sapiens; identical to SEQ ID NO: 253156

SEQ ID NO: 469213 - RNA, 62 nt, Homo Sapiens; identical to SEQ ID NO: 253157

SEQ ID NO: 469214 - RNA, 62 nt, Homo Sapiens; identical to SEQ ID NO: 253158

SEQ ID NO: 469215 - RNA, 62 nt, Homo Sapiens; identical to SEQ ID NO: 253159

SEQ ID NO: 469216 - RNA, 62 nt, Homo Sapiens; identical to SEQ ID NO: 253160

SEQ ID NO: 469217 - RNA, 62 nt, Homo Sapiens; identical to SEQ ID NO: 253161

SEQ ID NO: 469218 - RNA, 62 nt, Homo Sapiens; identical to SEQ ID NO: 253162

SEQ ID NO: 469219 - RNA, 62 nt, Homo Sapiens; identical to SEQ ID NO: 253163

SEQ ID NO: 469220 - RNA, 62 nt, Homo Sapiens; identical to SEQ ID NO: 253164

SEQ ID NO: 469221 - RNA, 62 nt, Homo Sapiens; identical to SEQ ID NO: 253165

SEQ ID NO: 469222 - RNA, 62 nt, Homo Sapiens; identical to SEQ ID NO: 253166

SEQ ID NO: 469223 - RNA, 62 nt, Homo Sapiens; identical to SEQ ID NO: 253167

SEQ ID NO: 469224 - RNA, 62 nt, Homo Sapiens; identical to SEQ ID NO: 253168

SEQ ID NO: 469225 - RNA, 53 nt, Homo Sapiens; identical to SEQ ID NO: 103014

SEQ ID NO: 469226 - RNA, 62 nt, Homo Sapiens; identical to SEQ ID NO: 253170

SEQ ID NO: 469227 - RNA, 62 nt, Homo Sapiens; identical to SEQ ID NO: 253171

SEQ ID NO: 469228 - RNA, 62 nt, Homo Sapiens; identical to SEQ ID NO: 253172

SEQ ID NO: 469229 - RNA, 62 nt, Homo Sapiens; identical to SEQ ID NO: 253173

SEQ ID NO: 469230 - RNA, 62 nt, Homo Sapiens; identical to SEQ ID NO: 253174

SEQ ID NO: 469231 - RNA, 62 nt, Homo Sapiens; identical to SEQ ID NO: 253175

SEQ ID NO: 469232 - RNA, 62 nt, Homo Sapiens; identical to SEQ ID NO: 253176

SEQ ID NO: 469233 - RNA, 62 nt, Homo Sapiens; identical to SEQ ID NO: 253177

SEQ ID NO: 469234 - RNA, 62 nt, Homo Sapiens; identical to SEQ ID NO: 253178

SEQ ID NO: 469235 - RNA, 62 nt, Homo Sapiens; identical to SEQ ID NO: 253179

SEQ ID NO: 469236 - RNA, 62 nt, Homo Sapiens; identical to SEQ ID NO: 253180

SEQ ID NO: 469237 - RNA, 62 nt, Homo Sapiens; identical to SEQ ID NO: 253181

SEQ ID NO: 469238 - RNA, 62 nt, Homo Sapiens; identical to SEQ ID NO: 253182

SEQ ID NO: 469239 - RNA, 62 nt, Homo Sapiens; identical to SEQ ID NO: 253183

SEQ ID NO: 469240 - RNA, 62 nt, Homo Sapiens; identical to SEQ ID NO: 253184

SEQ ID NO: 469241 - RNA, 62 nt, Homo Sapiens; identical to SEQ ID NO: 253185

SEQ ID NO: 469242 - RNA, 62 nt, Homo Sapiens; identical to SEQ ID NO: 253186

SEQ ID NO: 469243 - RNA, 62 nt, Homo Sapiens; identical to SEQ ID NO: 253187

SEQ ID NO: 469244 - RNA, 62 nt, Homo Sapiens; identical to SEQ ID NO: 253188

SEQ ID NO: 469245 - RNA, 62 nt, Homo Sapiens; identical to SEQ ID NO: 253189

SEQ ID NO: 469246 - RNA, 62 nt, Homo Sapiens; identical to SEQ ID NO: 253190

SEQ ID NO: 469247 - RNA, 62 nt, Homo Sapiens; identical to SEQ ID NO: 253191

SEQ ID NO: 469248 - RNA, 62 nt, Homo Sapiens; identical to SEQ ID NO: 253192

SEQ ID NO: 469249 - RNA, 62 nt, Homo Sapiens; identical to SEQ ID NO: 253193

SEQ ID NO: 469250 - RNA, 62 nt, Homo Sapiens; identical to SEQ ID NO: 253194

SEQ ID NO: 469251 - RNA, 62 nt, Homo Sapiens; identical to SEQ ID NO: 253195

SEQ ID NO: 469252 - RNA, 62 nt, Homo Sapiens; identical to SEQ ID NO: 253196

SEQ ID NO: 469253 - RNA, 62 nt, Homo Sapiens; identical to SEQ ID NO: 253197

SEQ ID NO: 469254 - RNA, 62 nt, Homo Sapiens; identical to SEQ ID NO: 253198

SEQ ID NO: 469255 - RNA, 62 nt, Homo Sapiens; identical to SEQ ID NO: 253199

SEQ ID NO: 469256 - RNA, 62 nt, Homo Sapiens; identical to SEQ ID NO: 253200

SEQ ID NO: 469257 - RNA, 62 nt, Homo Sapiens; identical to SEQ ID NO: 253201

SEQ ID NO: 469258 - RNA, 62 nt, Homo Sapiens; identical to SEQ ID NO: 253202

SEQ ID NO: 469259 - RNA, 62 nt, Homo Sapiens; identical to SEQ ID NO: 253203

SEQ ID NO: 469260 - RNA, 62 nt, Homo Sapiens; identical to SEQ ID NO: 253204

SEQ ID NO: 469261 - RNA, 62 nt, Homo Sapiens; identical to SEQ ID NO: 253205

SEQ ID NO: 469262 - RNA, 62 nt, Homo Sapiens; identical to SEQ ID NO: 253206

SEQ ID NO: 469263 - RNA, 62 nt, Homo Sapiens; identical to SEQ ID NO: 253207

SEQ ID NO: 469264 - RNA, 62 nt, Homo Sapiens; identical to SEQ ID NO: 253208

SEQ ID NO: 469265 - RNA, 62 nt, Homo Sapiens; identical to SEQ ID NO: 253209

SEQ ID NO: 469266 - RNA, 62 nt, Homo Sapiens; identical to SEQ ID NO: 253210

SEQ ID NO: 469267 - RNA, 62 nt, Homo Sapiens; identical to SEQ ID NO: 253211

SEQ ID NO: 469268 - RNA, 62 nt, Homo Sapiens; identical to SEQ ID NO: 253212

SEQ ID NO: 469269 - RNA, 62 nt, Homo Sapiens; identical to SEQ ID NO: 253213

SEQ ID NO: 469270 - RNA, 62 nt, Homo Sapiens; identical to SEQ ID NO: 253214

SEQ ID NO: 469271 - RNA, 62 nt, Homo Sapiens; identical to SEQ ID NO: 253215

SEQ ID NO: 469272 - RNA, 62 nt, Homo Sapiens; identical to SEQ ID NO: 253216

SEQ ID NO: 469273 - RNA, 62 nt, Homo Sapiens; identical to SEQ ID NO: 253217

SEQ ID NO: 469274 - RNA, 62 nt, Homo Sapiens; identical to SEQ ID NO: 253218

SEQ ID NO: 469275 - RNA, 62 nt, Homo Sapiens; identical to SEQ ID NO: 253219

SEQ ID NO: 469276 - RNA, 62 nt, Homo Sapiens; identical to SEQ ID NO: 253220

SEQ ID NO: 469277 - RNA, 62 nt, Homo Sapiens; identical to SEQ ID NO: 253221

SEQ ID NO: 469278 - RNA, 62 nt, Homo Sapiens; identical to SEQ ID NO: 253222

SEQ ID NO: 469279 - RNA, 62 nt, Homo Sapiens; identical to SEQ ID NO: 253223

SEQ ID NO: 469280 - RNA, 62 nt, Homo Sapiens; identical to SEQ ID NO: 253224

SEQ ID NO: 469281 - RNA, 62 nt, Homo Sapiens; identical to SEQ ID NO: 253225

SEQ ID NO: 469282 - RNA, 62 nt, Homo Sapiens; identical to SEQ ID NO: 253226

SEQ ID NO: 469283 - RNA, 62 nt, Homo Sapiens; identical to SEQ ID NO: 253227

SEQ ID NO: 469284 - RNA, 62 nt, Homo Sapiens; identical to SEQ ID NO: 253228

SEQ ID NO: 469285 - RNA, 62 nt, Homo Sapiens; identical to SEQ ID NO: 253229

SEQ ID NO: 469286 - RNA, 62 nt, Homo Sapiens; identical to SEQ ID NO: 253230

SEQ ID NO: 469287 - RNA, 62 nt, Homo Sapiens; identical to SEQ ID NO: 253231

SEQ ID NO: 469288 - RNA, 62 nt, Homo Sapiens; identical to SEQ ID NO: 253232

SEQ ID NO: 469289 - RNA, 62 nt, Homo Sapiens; identical to SEQ ID NO: 253233

SEQ ID NO: 469290 - RNA, 62 nt, Homo Sapiens; identical to SEQ ID NO: 253234

SEQ ID NO: 469291 - RNA, 62 nt, Homo Sapiens; identical to SEQ ID NO: 253235

SEQ ID NO: 469292 - RNA, 62 nt, Homo Sapiens; identical to SEQ ID NO: 253236

SEQ ID NO: 469293 - RNA, 62 nt, Homo Sapiens; identical to SEQ ID NO: 253237

SEQ ID NO: 469294 - RNA, 62 nt, Homo Sapiens; identical to SEQ ID NO: 253238

SEQ ID NO: 469295 - RNA, 62 nt, Homo Sapiens; identical to SEQ ID NO: 253239

SEQ ID NO: 469296 - RNA, 62 nt, Homo Sapiens; identical to SEQ ID NO: 253240

SEQ ID NO: 469297 - RNA, 62 nt, Homo Sapiens; identical to SEQ ID NO: 253241

SEQ ID NO: 469298 - RNA, 62 nt, Homo Sapiens; identical to SEQ ID NO: 253242

SEQ ID NO: 469299 - RNA, 62 nt, Homo Sapiens; identical to SEQ ID NO: 253243

SEQ ID NO: 469300 - RNA, 62 nt, Homo Sapiens; identical to SEQ ID NO: 253244

SEQ ID NO: 469301 - RNA, 62 nt, Homo Sapiens; identical to SEQ ID NO: 253245

SEQ ID NO: 469302 - RNA, 62 nt, Homo Sapiens; identical to SEQ ID NO: 253246

SEQ ID NO: 469303 - RNA, 62 nt, Homo Sapiens; identical to SEQ ID NO: 253247

SEQ ID NO: 469304 - RNA, 62 nt, Homo Sapiens; identical to SEQ ID NO: 253248

SEQ ID NO: 469305 - RNA, 62 nt, Homo Sapiens; identical to SEQ ID NO: 253249

SEQ ID NO: 469306 - RNA, 62 nt, Homo Sapiens; identical to SEQ ID NO: 253250

SEQ ID NO: 469307 - RNA, 62 nt, Homo Sapiens; identical to SEQ ID NO: 253251

SEQ ID NO: 469308 - RNA, 62 nt, Homo Sapiens; identical to SEQ ID NO: 253252

SEQ ID NO: 469309 - RNA, 60 nt, Homo Sapiens; identical to SEQ ID NO: 103098

SEQ ID NO: 469310 - RNA, 62 nt, Homo Sapiens; identical to SEQ ID NO: 253254

SEQ ID NO: 469311 - RNA, 62 nt, Homo Sapiens; identical to SEQ ID NO: 253255

SEQ ID NO: 469312 - RNA, 62 nt, Homo Sapiens; identical to SEQ ID NO: 253256

SEQ ID NO: 469313 - RNA, 62 nt, Homo Sapiens; identical to SEQ ID NO: 253257

SEQ ID NO: 469314 - RNA, 62 nt, Homo Sapiens; identical to SEQ ID NO: 253258

SEQ ID NO: 469315 - RNA, 62 nt, Homo Sapiens; identical to SEQ ID NO: 253259

SEQ ID NO: 469316 - RNA, 62 nt, Homo Sapiens; identical to SEQ ID NO: 253260

SEQ ID NO: 469317 - RNA, 62 nt, Homo Sapiens; identical to SEQ ID NO: 253261

SEQ ID NO: 469318 - RNA, 62 nt, Homo Sapiens; identical to SEQ ID NO: 253262

SEQ ID NO: 469319 - RNA, 62 nt, Homo Sapiens; identical to SEQ ID NO: 253263

SEQ ID NO: 469320 - RNA, 62 nt, Homo Sapiens; identical to SEQ ID NO: 253264

SEQ ID NO: 469321 - RNA, 62 nt, Homo Sapiens; identical to SEQ ID NO: 253265

SEQ ID NO: 469322 - RNA, 62 nt, Homo Sapiens; identical to SEQ ID NO: 253266

SEQ ID NO: 469323 - RNA, 62 nt, Homo Sapiens; identical to SEQ ID NO: 253267

SEQ ID NO: 469324 - RNA, 62 nt, Homo Sapiens; identical to SEQ ID NO: 253268

SEQ ID NO: 469325 - RNA, 62 nt, Homo Sapiens; identical to SEQ ID NO: 253269

SEQ ID NO: 469326 - RNA, 62 nt, Homo Sapiens; identical to SEQ ID NO: 253270

SEQ ID NO: 469327 - RNA, 62 nt, Homo Sapiens; identical to SEQ ID NO: 253271

SEQ ID NO: 469328 - RNA, 62 nt, Homo Sapiens; identical to SEQ ID NO: 253272

SEQ ID NO: 469329 - RNA, 62 nt, Homo Sapiens; identical to SEQ ID NO: 253273

SEQ ID NO: 469330 - RNA, 62 nt, Homo Sapiens; identical to SEQ ID NO: 253274

SEQ ID NO: 469331 - RNA, 62 nt, Homo Sapiens; identical to SEQ ID NO: 253275

SEQ ID NO: 469332 - RNA, 62 nt, Homo Sapiens; identical to SEQ ID NO: 253276

SEQ ID NO: 469333 - RNA, 62 nt, Homo Sapiens; identical to SEQ ID NO: 253277

SEQ ID NO: 469334 - RNA, 62 nt, Homo Sapiens; identical to SEQ ID NO: 253278

SEQ ID NO: 469335 - RNA, 62 nt, Homo Sapiens; identical to SEQ ID NO: 253279

SEQ ID NO: 469336 - RNA, 62 nt, Homo Sapiens; identical to SEQ ID NO: 253280

SEQ ID NO: 469337 - RNA, 62 nt, Homo Sapiens; identical to SEQ ID NO: 253281

SEQ ID NO: 469338 - RNA, 62 nt, Homo Sapiens; identical to SEQ ID NO: 253282

SEQ ID NO: 469339 - RNA, 62 nt, Homo Sapiens; identical to SEQ ID NO: 253283

SEQ ID NO: 469340 - RNA, 62 nt, Homo Sapiens; identical to SEQ ID NO: 253284

SEQ ID NO: 469341 - RNA, 62 nt, Homo Sapiens; identical to SEQ ID NO: 253285

SEQ ID NO: 469342 - RNA, 62 nt, Homo Sapiens; identical to SEQ ID NO: 253286

SEQ ID NO: 469343 - RNA, 62 nt, Homo Sapiens; identical to SEQ ID NO: 253287

SEQ ID NO: 469344 - RNA, 62 nt, Homo Sapiens; identical to SEQ ID NO: 253288

SEQ ID NO: 469345 - RNA, 62 nt, Homo Sapiens; identical to SEQ ID NO: 253289

SEQ ID NO: 469346 - RNA, 62 nt, Homo Sapiens; identical to SEQ ID NO: 253290

SEQ ID NO: 469347 - RNA, 62 nt, Homo Sapiens; identical to SEQ ID NO: 253291

SEQ ID NO: 469348 - RNA, 62 nt, Homo Sapiens; identical to SEQ ID NO: 253292

SEQ ID NO: 469349 - RNA, 62 nt, Homo Sapiens; identical to SEQ ID NO: 253293

SEQ ID NO: 469350 - RNA, 62 nt, Homo Sapiens; identical to SEQ ID NO: 253294

SEQ ID NO: 469351 - RNA, 62 nt, Homo Sapiens; identical to SEQ ID NO: 253295

SEQ ID NO: 469352 - RNA, 62 nt, Homo Sapiens; identical to SEQ ID NO: 253296

SEQ ID NO: 469353 - RNA, 62 nt, Homo Sapiens; identical to SEQ ID NO: 253297

SEQ ID NO: 469354 - RNA, 62 nt, Homo Sapiens; identical to SEQ ID NO: 253298

SEQ ID NO: 469355 - RNA, 62 nt, Homo Sapiens; identical to SEQ ID NO: 253299

SEQ ID NO: 469356 - RNA, 62 nt, Homo Sapiens; identical to SEQ ID NO: 253300

SEQ ID NO: 469357 - RNA, 62 nt, Homo Sapiens; identical to SEQ ID NO: 253301

SEQ ID NO: 469358 - RNA, 62 nt, Homo Sapiens; identical to SEQ ID NO: 253302

SEQ ID NO: 469359 - RNA, 62 nt, Homo Sapiens; identical to SEQ ID NO: 253303

SEQ ID NO: 469360 - RNA, 62 nt, Homo Sapiens; identical to SEQ ID NO: 253304

SEQ ID NO: 469361 - RNA, 62 nt, Homo Sapiens; identical to SEQ ID NO: 253305

SEQ ID NO: 469362 - RNA, 62 nt, Homo Sapiens; identical to SEQ ID NO: 253306

SEQ ID NO: 469363 - RNA, 62 nt, Homo Sapiens; identical to SEQ ID NO: 253307

SEQ ID NO: 469364 - RNA, 62 nt, Homo Sapiens; identical to SEQ ID NO: 253308

SEQ ID NO: 469365 - RNA, 62 nt, Homo Sapiens; identical to SEQ ID NO: 253309

SEQ ID NO: 469366 - RNA, 62 nt, Homo Sapiens; identical to SEQ ID NO: 253310

SEQ ID NO: 469367 - RNA, 62 nt, Homo Sapiens; identical to SEQ ID NO: 253311

SEQ ID NO: 469368 - RNA, 62 nt, Homo Sapiens; identical to SEQ ID NO: 253312

SEQ ID NO: 469369 - RNA, 62 nt, Homo Sapiens; identical to SEQ ID NO: 253313

SEQ ID NO: 469370 - RNA, 62 nt, Homo Sapiens; identical to SEQ ID NO: 253314

SEQ ID NO: 469371 - RNA, 62 nt, Homo Sapiens; identical to SEQ ID NO: 253315

SEQ ID NO: 469372 - RNA, 62 nt, Homo Sapiens; identical to SEQ ID NO: 253316

SEQ ID NO: 469373 - RNA, 62 nt, Homo Sapiens; identical to SEQ ID NO: 253317

SEQ ID NO: 469374 - RNA, 62 nt, Homo Sapiens; identical to SEQ ID NO: 253318

SEQ ID NO: 469375 - RNA, 62 nt, Homo Sapiens; identical to SEQ ID NO: 253319

SEQ ID NO: 469376 - RNA, 62 nt, Homo Sapiens; identical to SEQ ID NO: 253320

SEQ ID NO: 469377 - RNA, 62 nt, Homo Sapiens; identical to SEQ ID NO: 253321

SEQ ID NO: 469378 - RNA, 62 nt, Homo Sapiens; identical to SEQ ID NO: 253322

SEQ ID NO: 469379 - RNA, 62 nt, Homo Sapiens; identical to SEQ ID NO: 253323

SEQ ID NO: 469380 - RNA, 62 nt, Homo Sapiens; identical to SEQ ID NO: 253324

SEQ ID NO: 469381 - RNA, 62 nt, Homo Sapiens; identical to SEQ ID NO: 253325

SEQ ID NO: 469382 - RNA, 62 nt, Homo Sapiens; identical to SEQ ID NO: 253326

SEQ ID NO: 469383 - RNA, 62 nt, Homo Sapiens; identical to SEQ ID NO: 253327

SEQ ID NO: 469384 - RNA, 62 nt, Homo Sapiens; identical to SEQ ID NO: 253328

SEQ ID NO: 469385 - RNA, 62 nt, Homo Sapiens; identical to SEQ ID NO: 253329

SEQ ID NO: 469386 - RNA, 62 nt, Homo Sapiens; identical to SEQ ID NO: 253330

SEQ ID NO: 469387 - RNA, 62 nt, Homo Sapiens; identical to SEQ ID NO: 253331

SEQ ID NO: 469388 - RNA, 62 nt, Homo Sapiens; identical to SEQ ID NO: 253332

SEQ ID NO: 469389 - RNA, 62 nt, Homo Sapiens; identical to SEQ ID NO: 253333

SEQ ID NO: 469390 - RNA, 62 nt, Homo Sapiens; identical to SEQ ID NO: 253334

SEQ ID NO: 469391 - RNA, 62 nt, Homo Sapiens; identical to SEQ ID NO: 253335

SEQ ID NO: 469392 - RNA, 62 nt, Homo Sapiens; identical to SEQ ID NO: 253336

SEQ ID NO: 469393 - RNA, 62 nt, Homo Sapiens; identical to SEQ ID NO: 253337

SEQ ID NO: 469394 - RNA, 62 nt, Homo Sapiens; identical to SEQ ID NO: 253338

SEQ ID NO: 469395 - RNA, 62 nt, Homo Sapiens; identical to SEQ ID NO: 253339

SEQ ID NO: 469396 - RNA, 62 nt, Homo Sapiens; identical to SEQ ID NO: 253340

SEQ ID NO: 469397 - RNA, 62 nt, Homo Sapiens; identical to SEQ ID NO: 253341

SEQ ID NO: 469398 - RNA, 62 nt, Homo Sapiens; identical to SEQ ID NO: 253342

SEQ ID NO: 469399 - RNA, 62 nt, Homo Sapiens; identical to SEQ ID NO: 253343

SEQ ID NO: 469400 - RNA, 62 nt, Homo Sapiens; identical to SEQ ID NO: 253344

SEQ ID NO: 469401 - RNA, 62 nt, Homo Sapiens; identical to SEQ ID NO: 253345

SEQ ID NO: 469402 - RNA, 62 nt, Homo Sapiens; identical to SEQ ID NO: 253346

SEQ ID NO: 469403 - RNA, 62 nt, Homo Sapiens; identical to SEQ ID NO: 253347

SEQ ID NO: 469404 - RNA, 62 nt, Homo Sapiens; identical to SEQ ID NO: 253348

SEQ ID NO: 469405 - RNA, 62 nt, Homo Sapiens; identical to SEQ ID NO: 253349

SEQ ID NO: 469406 - RNA, 62 nt, Homo Sapiens; identical to SEQ ID NO: 253350

SEQ ID NO: 469407 - RNA, 51 nt, Homo Sapiens; identical to SEQ ID NO: 103196

SEQ ID NO: 469408 - RNA, 62 nt, Homo Sapiens; identical to SEQ ID NO: 253352

SEQ ID NO: 469409 - RNA, 62 nt, Homo Sapiens; identical to SEQ ID NO: 253353

SEQ ID NO: 469410 - RNA, 62 nt, Homo Sapiens; identical to SEQ ID NO: 253354

SEQ ID NO: 469411 - RNA, 62 nt, Homo Sapiens; identical to SEQ ID NO: 253355

SEQ ID NO: 469412 - RNA, 62 nt, Homo Sapiens; identical to SEQ ID NO: 253356

SEQ ID NO: 469413 - RNA, 62 nt, Homo Sapiens; identical to SEQ ID NO: 253357

SEQ ID NO: 469414 - RNA, 62 nt, Homo Sapiens; identical to SEQ ID NO: 253358

SEQ ID NO: 469415 - RNA, 62 nt, Homo Sapiens; identical to SEQ ID NO: 253359

SEQ ID NO: 469416 - RNA, 62 nt, Homo Sapiens; identical to SEQ ID NO: 253360

SEQ ID NO: 469417 - RNA, 62 nt, Homo Sapiens; identical to SEQ ID NO: 253361

SEQ ID NO: 469418 - RNA, 62 nt, Homo Sapiens; identical to SEQ ID NO: 253362

SEQ ID NO: 469419 - RNA, 62 nt, Homo Sapiens; identical to SEQ ID NO: 253363

SEQ ID NO: 469420 - RNA, 62 nt, Homo Sapiens; identical to SEQ ID NO: 253364

SEQ ID NO: 469421 - RNA, 62 nt, Homo Sapiens; identical to SEQ ID NO: 253365

SEQ ID NO: 469422 - RNA, 62 nt, Homo Sapiens; identical to SEQ ID NO: 253366

SEQ ID NO: 469423 - RNA, 62 nt, Homo Sapiens; identical to SEQ ID NO: 253367

SEQ ID NO: 469424 - RNA, 62 nt, Homo Sapiens; identical to SEQ ID NO: 253368

SEQ ID NO: 469425 - RNA, 62 nt, Homo Sapiens; identical to SEQ ID NO: 253369

SEQ ID NO: 469426 - RNA, 62 nt, Homo Sapiens; identical to SEQ ID NO: 253370

SEQ ID NO: 469427 - RNA, 62 nt, Homo Sapiens; identical to SEQ ID NO: 253371

SEQ ID NO: 469428 - RNA, 62 nt, Homo Sapiens; identical to SEQ ID NO: 253372

SEQ ID NO: 469429 - RNA, 62 nt, Homo Sapiens; identical to SEQ ID NO: 253373

SEQ ID NO: 469430 - RNA, 62 nt, Homo Sapiens; identical to SEQ ID NO: 253374

SEQ ID NO: 469431 - RNA, 62 nt, Homo Sapiens; identical to SEQ ID NO: 253375

SEQ ID NO: 469432 - RNA, 62 nt, Homo Sapiens; identical to SEQ ID NO: 253376

SEQ ID NO: 469433 - RNA, 62 nt, Homo Sapiens; identical to SEQ ID NO: 253377

SEQ ID NO: 469434 - RNA, 62 nt, Homo Sapiens; identical to SEQ ID NO: 253378

SEQ ID NO: 469435 - RNA, 62 nt, Homo Sapiens; identical to SEQ ID NO: 253379

SEQ ID NO: 469436 - RNA, 62 nt, Homo Sapiens; identical to SEQ ID NO: 253380

SEQ ID NO: 469437 - RNA, 62 nt, Homo Sapiens; identical to SEQ ID NO: 253381

SEQ ID NO: 469438 - RNA, 62 nt, Homo Sapiens; identical to SEQ ID NO: 253382

SEQ ID NO: 469439 - RNA, 62 nt, Homo Sapiens; identical to SEQ ID NO: 253383

SEQ ID NO: 469440 - RNA, 62 nt, Homo Sapiens; identical to SEQ ID NO: 253384

SEQ ID NO: 469441 - RNA, 62 nt, Homo Sapiens; identical to SEQ ID NO: 253385

SEQ ID NO: 469442 - RNA, 62 nt, Homo Sapiens; identical to SEQ ID NO: 253386

SEQ ID NO: 469443 - RNA, 62 nt, Homo Sapiens; identical to SEQ ID NO: 253387

SEQ ID NO: 469444 - RNA, 62 nt, Homo Sapiens; identical to SEQ ID NO: 253388

SEQ ID NO: 469445 - RNA, 62 nt, Homo Sapiens; identical to SEQ ID NO: 253389

SEQ ID NO: 469446 - RNA, 62 nt, Homo Sapiens; identical to SEQ ID NO: 253390

SEQ ID NO: 469447 - RNA, 62 nt, Homo Sapiens; identical to SEQ ID NO: 253391

SEQ ID NO: 469448 - RNA, 62 nt, Homo Sapiens; identical to SEQ ID NO: 253392

SEQ ID NO: 469449 - RNA, 62 nt, Homo Sapiens; identical to SEQ ID NO: 253393

SEQ ID NO: 469450 - RNA, 62 nt, Homo Sapiens; identical to SEQ ID NO: 253394

SEQ ID NO: 469451 - RNA, 62 nt, Homo Sapiens; identical to SEQ ID NO: 253395

SEQ ID NO: 469452 - RNA, 62 nt, Homo Sapiens; identical to SEQ ID NO: 253396

SEQ ID NO: 469453 - RNA, 62 nt, Homo Sapiens; identical to SEQ ID NO: 253397

SEQ ID NO: 469454 - RNA, 62 nt, Homo Sapiens; identical to SEQ ID NO: 253398

SEQ ID NO: 469455 - RNA, 62 nt, Homo Sapiens; identical to SEQ ID NO: 253399

SEQ ID NO: 469456 - RNA, 62 nt, Homo Sapiens; identical to SEQ ID NO: 253400

SEQ ID NO: 469457 - RNA, 62 nt, Homo Sapiens; identical to SEQ ID NO: 253401

SEQ ID NO: 469458 - RNA, 62 nt, Homo Sapiens; identical to SEQ ID NO: 253402

SEQ ID NO: 469459 - RNA, 62 nt, Homo Sapiens; identical to SEQ ID NO: 253403

SEQ ID NO: 469460 - RNA, 62 nt, Homo Sapiens; identical to SEQ ID NO: 253404

SEQ ID NO: 469461 - RNA, 62 nt, Homo Sapiens; identical to SEQ ID NO: 253405

SEQ ID NO: 469462 - RNA, 62 nt, Homo Sapiens; identical to SEQ ID NO: 253406

SEQ ID NO: 469463 - RNA, 62 nt, Homo Sapiens; identical to SEQ ID NO: 253407

SEQ ID NO: 469464 - RNA, 62 nt, Homo Sapiens; identical to SEQ ID NO: 253408

SEQ ID NO: 469465 - RNA, 62 nt, Homo Sapiens; identical to SEQ ID NO: 253409

SEQ ID NO: 469466 - RNA, 62 nt, Homo Sapiens; identical to SEQ ID NO: 253410

SEQ ID NO: 469467 - RNA, 62 nt, Homo Sapiens; identical to SEQ ID NO: 253411

SEQ ID NO: 469468 - RNA, 62 nt, Homo Sapiens; identical to SEQ ID NO: 253412

SEQ ID NO: 469469 - RNA, 62 nt, Homo Sapiens; identical to SEQ ID NO: 253413

SEQ ID NO: 469470 - RNA, 62 nt, Homo Sapiens; identical to SEQ ID NO: 253414

SEQ ID NO: 469471 - RNA, 62 nt, Homo Sapiens; identical to SEQ ID NO: 253415

SEQ ID NO: 469472 - RNA, 62 nt, Homo Sapiens; identical to SEQ ID NO: 253416

SEQ ID NO: 469473 - RNA, 62 nt, Homo Sapiens; identical to SEQ ID NO: 253417

SEQ ID NO: 469474 - RNA, 62 nt, Homo Sapiens; identical to SEQ ID NO: 253418

SEQ ID NO: 469475 - RNA, 62 nt, Homo Sapiens; identical to SEQ ID NO: 253419

SEQ ID NO: 469476 - RNA, 62 nt, Homo Sapiens; identical to SEQ ID NO: 253420

SEQ ID NO: 469477 - RNA, 62 nt, Homo Sapiens; identical to SEQ ID NO: 253421

SEQ ID NO: 469478 - RNA, 62 nt, Homo Sapiens; identical to SEQ ID NO: 253422

SEQ ID NO: 469479 - RNA, 62 nt, Homo Sapiens; identical to SEQ ID NO: 253423

SEQ ID NO: 469480 - RNA, 62 nt, Homo Sapiens; identical to SEQ ID NO: 253424

SEQ ID NO: 469481 - RNA, 62 nt, Homo Sapiens; identical to SEQ ID NO: 253425

SEQ ID NO: 469482 - RNA, 62 nt, Homo Sapiens; identical to SEQ ID NO: 253426

SEQ ID NO: 469483 - RNA, 62 nt, Homo Sapiens; identical to SEQ ID NO: 253427

SEQ ID NO: 469484 - RNA, 62 nt, Homo Sapiens; identical to SEQ ID NO: 253428

SEQ ID NO: 469485 - RNA, 62 nt, Homo Sapiens; identical to SEQ ID NO: 253429

SEQ ID NO: 469486 - RNA, 62 nt, Homo Sapiens; identical to SEQ ID NO: 253430

SEQ ID NO: 469487 - RNA, 62 nt, Homo Sapiens; identical to SEQ ID NO: 253431

SEQ ID NO: 469488 - RNA, 62 nt, Homo Sapiens; identical to SEQ ID NO: 253432

SEQ ID NO: 469489 - RNA, 62 nt, Homo Sapiens; identical to SEQ ID NO: 253433

SEQ ID NO: 469490 - RNA, 62 nt, Homo Sapiens; identical to SEQ ID NO: 253434

SEQ ID NO: 469491 - RNA, 62 nt, Homo Sapiens; identical to SEQ ID NO: 253435

SEQ ID NO: 469492 - RNA, 62 nt, Homo Sapiens; identical to SEQ ID NO: 253436

SEQ ID NO: 469493 - RNA, 62 nt, Homo Sapiens; identical to SEQ ID NO: 253437

SEQ ID NO: 469494 - RNA, 62 nt, Homo Sapiens; identical to SEQ ID NO: 253438

SEQ ID NO: 469495 - RNA, 62 nt, Homo Sapiens; identical to SEQ ID NO: 253439

SEQ ID NO: 469496 - RNA, 62 nt, Homo Sapiens; identical to SEQ ID NO: 253440

SEQ ID NO: 469497 - RNA, 62 nt, Homo Sapiens; identical to SEQ ID NO: 253441

SEQ ID NO: 469498 - RNA, 62 nt, Homo Sapiens; identical to SEQ ID NO: 253442

SEQ ID NO: 469499 - RNA, 62 nt, Homo Sapiens; identical to SEQ ID NO: 253443

SEQ ID NO: 469500 - RNA, 66 nt, Homo Sapiens; identical to SEQ ID NO: 253444

SEQ ID NO: 469501 - RNA, 66 nt, Homo Sapiens; identical to SEQ ID NO: 253445

SEQ ID NO: 469502 - RNA, 66 nt, Homo Sapiens; identical to SEQ ID NO: 253446

SEQ ID NO: 469503 - RNA, 66 nt, Homo Sapiens; identical to SEQ ID NO: 253447

SEQ ID NO: 469504 - RNA, 66 nt, Homo Sapiens; identical to SEQ ID NO: 253448

SEQ ID NO: 469505 - RNA, 66 nt, Homo Sapiens; identical to SEQ ID NO: 253449

SEQ ID NO: 469506 - RNA, 66 nt, Homo Sapiens; identical to SEQ ID NO: 253450

SEQ ID NO: 469507 - RNA, 66 nt, Homo Sapiens; identical to SEQ ID NO: 253451

SEQ ID NO: 469508 - RNA, 66 nt, Homo Sapiens; identical to SEQ ID NO: 253452

SEQ ID NO: 469509 - RNA, 66 nt, Homo Sapiens; identical to SEQ ID NO: 253453

SEQ ID NO: 469510 - RNA, 66 nt, Homo Sapiens; identical to SEQ ID NO: 253454

SEQ ID NO: 469511 - RNA, 58 nt, Homo Sapiens; identical to SEQ ID NO: 102991

SEQ ID NO: 469512 - RNA, 66 nt, Homo Sapiens; identical to SEQ ID NO: 253456

SEQ ID NO: 469513 - RNA, 66 nt, Homo Sapiens; identical to SEQ ID NO: 253457

SEQ ID NO: 469514 - RNA, 66 nt, Homo Sapiens; identical to SEQ ID NO: 253458

SEQ ID NO: 469515 - RNA, 66 nt, Homo Sapiens; identical to SEQ ID NO: 253459

SEQ ID NO: 469516 - RNA, 66 nt, Homo Sapiens; identical to SEQ ID NO: 253460

SEQ ID NO: 469517 - RNA, 66 nt, Homo Sapiens; identical to SEQ ID NO: 253461

SEQ ID NO: 469518 - RNA, 66 nt, Homo Sapiens; identical to SEQ ID NO: 253462

SEQ ID NO: 469519 - RNA, 66 nt, Homo Sapiens; identical to SEQ ID NO: 253463

SEQ ID NO: 469520 - RNA, 66 nt, Homo Sapiens; identical to SEQ ID NO: 253464

SEQ ID NO: 469521 - RNA, 66 nt, Homo Sapiens; identical to SEQ ID NO: 253465

SEQ ID NO: 469522 - RNA, 66 nt, Homo Sapiens; identical to SEQ ID NO: 253466

SEQ ID NO: 469523 - RNA, 66 nt, Homo Sapiens; identical to SEQ ID NO: 253467

SEQ ID NO: 469524 - RNA, 66 nt, Homo Sapiens; identical to SEQ ID NO: 253468

SEQ ID NO: 469525 - RNA, 66 nt, Homo Sapiens; identical to SEQ ID NO: 253469

SEQ ID NO: 469526 - RNA, 66 nt, Homo Sapiens; identical to SEQ ID NO: 253470

SEQ ID NO: 469527 - RNA, 66 nt, Homo Sapiens; identical to SEQ ID NO: 253471

SEQ ID NO: 469528 - RNA, 66 nt, Homo Sapiens; identical to SEQ ID NO: 253472

SEQ ID NO: 469529 - RNA, 66 nt, Homo Sapiens; identical to SEQ ID NO: 253473

SEQ ID NO: 469530 - RNA, 66 nt, Homo Sapiens; identical to SEQ ID NO: 253474

SEQ ID NO: 469531 - RNA, 66 nt, Homo Sapiens; identical to SEQ ID NO: 253475

SEQ ID NO: 469532 - RNA, 66 nt, Homo Sapiens; identical to SEQ ID NO: 253476

SEQ ID NO: 469533 - RNA, 66 nt, Homo Sapiens; identical to SEQ ID NO: 253477

SEQ ID NO: 469534 - RNA, 53 nt, Homo Sapiens; identical to SEQ ID NO: 103014

SEQ ID NO: 469535 - RNA, 66 nt, Homo Sapiens; identical to SEQ ID NO: 253479

SEQ ID NO: 469536 - RNA, 66 nt, Homo Sapiens; identical to SEQ ID NO: 253480

SEQ ID NO: 469537 - RNA, 66 nt, Homo Sapiens; identical to SEQ ID NO: 253481

SEQ ID NO: 469538 - RNA, 66 nt, Homo Sapiens; identical to SEQ ID NO: 253482

SEQ ID NO: 469539 - RNA, 66 nt, Homo Sapiens; identical to SEQ ID NO: 253483

SEQ ID NO: 469540 - RNA, 66 nt, Homo Sapiens; identical to SEQ ID NO: 253484

SEQ ID NO: 469541 - RNA, 66 nt, Homo Sapiens; identical to SEQ ID NO: 253485

SEQ ID NO: 469542 - RNA, 66 nt, Homo Sapiens; identical to SEQ ID NO: 253486

SEQ ID NO: 469543 - RNA, 66 nt, Homo Sapiens; identical to SEQ ID NO: 253487

SEQ ID NO: 469544 - RNA, 66 nt, Homo Sapiens; identical to SEQ ID NO: 253488

SEQ ID NO: 469545 - RNA, 66 nt, Homo Sapiens; identical to SEQ ID NO: 253489

SEQ ID NO: 469546 - RNA, 66 nt, Homo Sapiens; identical to SEQ ID NO: 253490

SEQ ID NO: 469547 - RNA, 66 nt, Homo Sapiens; identical to SEQ ID NO: 253491

SEQ ID NO: 469548 - RNA, 66 nt, Homo Sapiens; identical to SEQ ID NO: 253492

SEQ ID NO: 469549 - RNA, 66 nt, Homo Sapiens; identical to SEQ ID NO: 253493

SEQ ID NO: 469550 - RNA, 66 nt, Homo Sapiens; identical to SEQ ID NO: 253494

SEQ ID NO: 469551 - RNA, 66 nt, Homo Sapiens; identical to SEQ ID NO: 253495

SEQ ID NO: 469552 - RNA, 66 nt, Homo Sapiens; identical to SEQ ID NO: 253496

SEQ ID NO: 469553 - RNA, 66 nt, Homo Sapiens; identical to SEQ ID NO: 253497

SEQ ID NO: 469554 - RNA, 66 nt, Homo Sapiens; identical to SEQ ID NO: 253498

SEQ ID NO: 469555 - RNA, 66 nt, Homo Sapiens; identical to SEQ ID NO: 253499

SEQ ID NO: 469556 - RNA, 66 nt, Homo Sapiens; identical to SEQ ID NO: 253500

SEQ ID NO: 469557 - RNA, 66 nt, Homo Sapiens; identical to SEQ ID NO: 253501

SEQ ID NO: 469558 - RNA, 66 nt, Homo Sapiens; identical to SEQ ID NO: 253502

SEQ ID NO: 469559 - RNA, 66 nt, Homo Sapiens; identical to SEQ ID NO: 253503

SEQ ID NO: 469560 - RNA, 66 nt, Homo Sapiens; identical to SEQ ID NO: 253504

SEQ ID NO: 469561 - RNA, 66 nt, Homo Sapiens; identical to SEQ ID NO: 253505

SEQ ID NO: 469562 - RNA, 66 nt, Homo Sapiens; identical to SEQ ID NO: 253506

SEQ ID NO: 469563 - RNA, 66 nt, Homo Sapiens; identical to SEQ ID NO: 253507

SEQ ID NO: 469564 - RNA, 66 nt, Homo Sapiens; identical to SEQ ID NO: 253508

SEQ ID NO: 469565 - RNA, 66 nt, Homo Sapiens; identical to SEQ ID NO: 253509

SEQ ID NO: 469566 - RNA, 66 nt, Homo Sapiens; identical to SEQ ID NO: 253510

SEQ ID NO: 469567 - RNA, 66 nt, Homo Sapiens; identical to SEQ ID NO: 253511

SEQ ID NO: 469568 - RNA, 66 nt, Homo Sapiens; identical to SEQ ID NO: 253512

SEQ ID NO: 469569 - RNA, 66 nt, Homo Sapiens; identical to SEQ ID NO: 253513

SEQ ID NO: 469570 - RNA, 66 nt, Homo Sapiens; identical to SEQ ID NO: 253514

SEQ ID NO: 469571 - RNA, 66 nt, Homo Sapiens; identical to SEQ ID NO: 253515

SEQ ID NO: 469572 - RNA, 66 nt, Homo Sapiens; identical to SEQ ID NO: 253516

SEQ ID NO: 469573 - RNA, 66 nt, Homo Sapiens; identical to SEQ ID NO: 253517

SEQ ID NO: 469574 - RNA, 66 nt, Homo Sapiens; identical to SEQ ID NO: 253518

SEQ ID NO: 469575 - RNA, 66 nt, Homo Sapiens; identical to SEQ ID NO: 253519

SEQ ID NO: 469576 - RNA, 66 nt, Homo Sapiens; identical to SEQ ID NO: 253520

SEQ ID NO: 469577 - RNA, 66 nt, Homo Sapiens; identical to SEQ ID NO: 253521

SEQ ID NO: 469578 - RNA, 66 nt, Homo Sapiens; identical to SEQ ID NO: 253522

SEQ ID NO: 469579 - RNA, 66 nt, Homo Sapiens; identical to SEQ ID NO: 253523

SEQ ID NO: 469580 - RNA, 66 nt, Homo Sapiens; identical to SEQ ID NO: 253524

SEQ ID NO: 469581 - RNA, 66 nt, Homo Sapiens; identical to SEQ ID NO: 253525

SEQ ID NO: 469582 - RNA, 66 nt, Homo Sapiens; identical to SEQ ID NO: 253526

SEQ ID NO: 469583 - RNA, 66 nt, Homo Sapiens; identical to SEQ ID NO: 253527

SEQ ID NO: 469584 - RNA, 66 nt, Homo Sapiens; identical to SEQ ID NO: 253528

SEQ ID NO: 469585 - RNA, 66 nt, Homo Sapiens; identical to SEQ ID NO: 253529

SEQ ID NO: 469586 - RNA, 66 nt, Homo Sapiens; identical to SEQ ID NO: 253530

SEQ ID NO: 469587 - RNA, 66 nt, Homo Sapiens; identical to SEQ ID NO: 253531

SEQ ID NO: 469588 - RNA, 66 nt, Homo Sapiens; identical to SEQ ID NO: 253532

SEQ ID NO: 469589 - RNA, 66 nt, Homo Sapiens; identical to SEQ ID NO: 253533

SEQ ID NO: 469590 - RNA, 66 nt, Homo Sapiens; identical to SEQ ID NO: 253534

SEQ ID NO: 469591 - RNA, 66 nt, Homo Sapiens; identical to SEQ ID NO: 253535

SEQ ID NO: 469592 - RNA, 66 nt, Homo Sapiens; identical to SEQ ID NO: 253536

SEQ ID NO: 469593 - RNA, 66 nt, Homo Sapiens; identical to SEQ ID NO: 253537

SEQ ID NO: 469594 - RNA, 66 nt, Homo Sapiens; identical to SEQ ID NO: 253538

SEQ ID NO: 469595 - RNA, 66 nt, Homo Sapiens; identical to SEQ ID NO: 253539

SEQ ID NO: 469596 - RNA, 66 nt, Homo Sapiens; identical to SEQ ID NO: 253540

SEQ ID NO: 469597 - RNA, 66 nt, Homo Sapiens; identical to SEQ ID NO: 253541

SEQ ID NO: 469598 - RNA, 66 nt, Homo Sapiens; identical to SEQ ID NO: 253542

SEQ ID NO: 469599 - RNA, 66 nt, Homo Sapiens; identical to SEQ ID NO: 253543

SEQ ID NO: 469600 - RNA, 66 nt, Homo Sapiens; identical to SEQ ID NO: 253544

SEQ ID NO: 469601 - RNA, 66 nt, Homo Sapiens; identical to SEQ ID NO: 253545

SEQ ID NO: 469602 - RNA, 66 nt, Homo Sapiens; identical to SEQ ID NO: 253546

SEQ ID NO: 469603 - RNA, 66 nt, Homo Sapiens; identical to SEQ ID NO: 253547

SEQ ID NO: 469604 - RNA, 66 nt, Homo Sapiens; identical to SEQ ID NO: 253548

SEQ ID NO: 469605 - RNA, 66 nt, Homo Sapiens; identical to SEQ ID NO: 253549

SEQ ID NO: 469606 - RNA, 66 nt, Homo Sapiens; identical to SEQ ID NO: 253550

SEQ ID NO: 469607 - RNA, 66 nt, Homo Sapiens; identical to SEQ ID NO: 253551

SEQ ID NO: 469608 - RNA, 66 nt, Homo Sapiens; identical to SEQ ID NO: 253552

SEQ ID NO: 469609 - RNA, 66 nt, Homo Sapiens; identical to SEQ ID NO: 253553

SEQ ID NO: 469610 - RNA, 66 nt, Homo Sapiens; identical to SEQ ID NO: 253554

SEQ ID NO: 469611 - RNA, 66 nt, Homo Sapiens; identical to SEQ ID NO: 253555

SEQ ID NO: 469612 - RNA, 66 nt, Homo Sapiens; identical to SEQ ID NO: 253556

SEQ ID NO: 469613 - RNA, 66 nt, Homo Sapiens; identical to SEQ ID NO: 253557

SEQ ID NO: 469614 - RNA, 66 nt, Homo Sapiens; identical to SEQ ID NO: 253558

SEQ ID NO: 469615 - RNA, 66 nt, Homo Sapiens; identical to SEQ ID NO: 253559

SEQ ID NO: 469616 - RNA, 66 nt, Homo Sapiens; identical to SEQ ID NO: 253560

SEQ ID NO: 469617 - RNA, 66 nt, Homo Sapiens; identical to SEQ ID NO: 253561

SEQ ID NO: 469618 - RNA, 60 nt, Homo Sapiens; identical to SEQ ID NO: 103098

SEQ ID NO: 469619 - RNA, 66 nt, Homo Sapiens; identical to SEQ ID NO: 253563

SEQ ID NO: 469620 - RNA, 66 nt, Homo Sapiens; identical to SEQ ID NO: 253564

SEQ ID NO: 469621 - RNA, 66 nt, Homo Sapiens; identical to SEQ ID NO: 253565

SEQ ID NO: 469622 - RNA, 66 nt, Homo Sapiens; identical to SEQ ID NO: 253566

SEQ ID NO: 469623 - RNA, 66 nt, Homo Sapiens; identical to SEQ ID NO: 253567

SEQ ID NO: 469624 - RNA, 66 nt, Homo Sapiens; identical to SEQ ID NO: 253568

SEQ ID NO: 469625 - RNA, 66 nt, Homo Sapiens; identical to SEQ ID NO: 253569

SEQ ID NO: 469626 - RNA, 66 nt, Homo Sapiens; identical to SEQ ID NO: 253570

SEQ ID NO: 469627 - RNA, 66 nt, Homo Sapiens; identical to SEQ ID NO: 253571

SEQ ID NO: 469628 - RNA, 66 nt, Homo Sapiens; identical to SEQ ID NO: 253572

SEQ ID NO: 469629 - RNA, 66 nt, Homo Sapiens; identical to SEQ ID NO: 253573

SEQ ID NO: 469630 - RNA, 66 nt, Homo Sapiens; identical to SEQ ID NO: 253574

SEQ ID NO: 469631 - RNA, 66 nt, Homo Sapiens; identical to SEQ ID NO: 253575

SEQ ID NO: 469632 - RNA, 66 nt, Homo Sapiens; identical to SEQ ID NO: 253576

SEQ ID NO: 469633 - RNA, 66 nt, Homo Sapiens; identical to SEQ ID NO: 253577

SEQ ID NO: 469634 - RNA, 66 nt, Homo Sapiens; identical to SEQ ID NO: 253578

SEQ ID NO: 469635 - RNA, 66 nt, Homo Sapiens; identical to SEQ ID NO: 253579

SEQ ID NO: 469636 - RNA, 66 nt, Homo Sapiens; identical to SEQ ID NO: 253580

SEQ ID NO: 469637 - RNA, 66 nt, Homo Sapiens; identical to SEQ ID NO: 253581

SEQ ID NO: 469638 - RNA, 66 nt, Homo Sapiens; identical to SEQ ID NO: 253582

SEQ ID NO: 469639 - RNA, 66 nt, Homo Sapiens; identical to SEQ ID NO: 253583

SEQ ID NO: 469640 - RNA, 66 nt, Homo Sapiens; identical to SEQ ID NO: 253584

SEQ ID NO: 469641 - RNA, 66 nt, Homo Sapiens; identical to SEQ ID NO: 253585

SEQ ID NO: 469642 - RNA, 66 nt, Homo Sapiens; identical to SEQ ID NO: 253586

SEQ ID NO: 469643 - RNA, 66 nt, Homo Sapiens; identical to SEQ ID NO: 253587

SEQ ID NO: 469644 - RNA, 66 nt, Homo Sapiens; identical to SEQ ID NO: 253588

SEQ ID NO: 469645 - RNA, 66 nt, Homo Sapiens; identical to SEQ ID NO: 253589

SEQ ID NO: 469646 - RNA, 66 nt, Homo Sapiens; identical to SEQ ID NO: 253590

SEQ ID NO: 469647 - RNA, 66 nt, Homo Sapiens; identical to SEQ ID NO: 253591

SEQ ID NO: 469648 - RNA, 66 nt, Homo Sapiens; identical to SEQ ID NO: 253592

SEQ ID NO: 469649 - RNA, 66 nt, Homo Sapiens; identical to SEQ ID NO: 253593

SEQ ID NO: 469650 - RNA, 66 nt, Homo Sapiens; identical to SEQ ID NO: 253594

SEQ ID NO: 469651 - RNA, 66 nt, Homo Sapiens; identical to SEQ ID NO: 253595

SEQ ID NO: 469652 - RNA, 66 nt, Homo Sapiens; identical to SEQ ID NO: 253596

SEQ ID NO: 469653 - RNA, 66 nt, Homo Sapiens; identical to SEQ ID NO: 253597

SEQ ID NO: 469654 - RNA, 66 nt, Homo Sapiens; identical to SEQ ID NO: 253598

SEQ ID NO: 469655 - RNA, 66 nt, Homo Sapiens; identical to SEQ ID NO: 253599

SEQ ID NO: 469656 - RNA, 66 nt, Homo Sapiens; identical to SEQ ID NO: 253600

SEQ ID NO: 469657 - RNA, 66 nt, Homo Sapiens; identical to SEQ ID NO: 253601

SEQ ID NO: 469658 - RNA, 66 nt, Homo Sapiens; identical to SEQ ID NO: 253602

SEQ ID NO: 469659 - RNA, 66 nt, Homo Sapiens; identical to SEQ ID NO: 253603

SEQ ID NO: 469660 - RNA, 66 nt, Homo Sapiens; identical to SEQ ID NO: 253604

SEQ ID NO: 469661 - RNA, 66 nt, Homo Sapiens; identical to SEQ ID NO: 253605

SEQ ID NO: 469662 - RNA, 66 nt, Homo Sapiens; identical to SEQ ID NO: 253606

SEQ ID NO: 469663 - RNA, 66 nt, Homo Sapiens; identical to SEQ ID NO: 253607

SEQ ID NO: 469664 - RNA, 66 nt, Homo Sapiens; identical to SEQ ID NO: 253608

SEQ ID NO: 469665 - RNA, 66 nt, Homo Sapiens; identical to SEQ ID NO: 253609

SEQ ID NO: 469666 - RNA, 66 nt, Homo Sapiens; identical to SEQ ID NO: 253610

SEQ ID NO: 469667 - RNA, 66 nt, Homo Sapiens; identical to SEQ ID NO: 253611

SEQ ID NO: 469668 - RNA, 66 nt, Homo Sapiens; identical to SEQ ID NO: 253612

SEQ ID NO: 469669 - RNA, 66 nt, Homo Sapiens; identical to SEQ ID NO: 253613

SEQ ID NO: 469670 - RNA, 66 nt, Homo Sapiens; identical to SEQ ID NO: 253614

SEQ ID NO: 469671 - RNA, 66 nt, Homo Sapiens; identical to SEQ ID NO: 253615

SEQ ID NO: 469672 - RNA, 66 nt, Homo Sapiens; identical to SEQ ID NO: 253616

SEQ ID NO: 469673 - RNA, 66 nt, Homo Sapiens; identical to SEQ ID NO: 253617

SEQ ID NO: 469674 - RNA, 66 nt, Homo Sapiens; identical to SEQ ID NO: 253618

SEQ ID NO: 469675 - RNA, 66 nt, Homo Sapiens; identical to SEQ ID NO: 253619

SEQ ID NO: 469676 - RNA, 66 nt, Homo Sapiens; identical to SEQ ID NO: 253620

SEQ ID NO: 469677 - RNA, 66 nt, Homo Sapiens; identical to SEQ ID NO: 253621

SEQ ID NO: 469678 - RNA, 66 nt, Homo Sapiens; identical to SEQ ID NO: 253622

SEQ ID NO: 469679 - RNA, 66 nt, Homo Sapiens; identical to SEQ ID NO: 253623

SEQ ID NO: 469680 - RNA, 66 nt, Homo Sapiens; identical to SEQ ID NO: 253624

SEQ ID NO: 469681 - RNA, 66 nt, Homo Sapiens; identical to SEQ ID NO: 253625

SEQ ID NO: 469682 - RNA, 66 nt, Homo Sapiens; identical to SEQ ID NO: 253626

SEQ ID NO: 469683 - RNA, 66 nt, Homo Sapiens; identical to SEQ ID NO: 253627

SEQ ID NO: 469684 - RNA, 66 nt, Homo Sapiens; identical to SEQ ID NO: 253628

SEQ ID NO: 469685 - RNA, 66 nt, Homo Sapiens; identical to SEQ ID NO: 253629

SEQ ID NO: 469686 - RNA, 66 nt, Homo Sapiens; identical to SEQ ID NO: 253630

SEQ ID NO: 469687 - RNA, 66 nt, Homo Sapiens; identical to SEQ ID NO: 253631

SEQ ID NO: 469688 - RNA, 66 nt, Homo Sapiens; identical to SEQ ID NO: 253632

SEQ ID NO: 469689 - RNA, 66 nt, Homo Sapiens; identical to SEQ ID NO: 253633

SEQ ID NO: 469690 - RNA, 66 nt, Homo Sapiens; identical to SEQ ID NO: 253634

SEQ ID NO: 469691 - RNA, 66 nt, Homo Sapiens; identical to SEQ ID NO: 253635

SEQ ID NO: 469692 - RNA, 66 nt, Homo Sapiens; identical to SEQ ID NO: 253636

SEQ ID NO: 469693 - RNA, 66 nt, Homo Sapiens; identical to SEQ ID NO: 253637

SEQ ID NO: 469694 - RNA, 66 nt, Homo Sapiens; identical to SEQ ID NO: 253638

SEQ ID NO: 469695 - RNA, 66 nt, Homo Sapiens; identical to SEQ ID NO: 253639

SEQ ID NO: 469696 - RNA, 66 nt, Homo Sapiens; identical to SEQ ID NO: 253640

SEQ ID NO: 469697 - RNA, 66 nt, Homo Sapiens; identical to SEQ ID NO: 253641

SEQ ID NO: 469698 - RNA, 66 nt, Homo Sapiens; identical to SEQ ID NO: 253642

SEQ ID NO: 469699 - RNA, 66 nt, Homo Sapiens; identical to SEQ ID NO: 253643

SEQ ID NO: 469700 - RNA, 66 nt, Homo Sapiens; identical to SEQ ID NO: 253644

SEQ ID NO: 469701 - RNA, 66 nt, Homo Sapiens; identical to SEQ ID NO: 253645

SEQ ID NO: 469702 - RNA, 66 nt, Homo Sapiens; identical to SEQ ID NO: 253646

SEQ ID NO: 469703 - RNA, 66 nt, Homo Sapiens; identical to SEQ ID NO: 253647

SEQ ID NO: 469704 - RNA, 66 nt, Homo Sapiens; identical to SEQ ID NO: 253648

SEQ ID NO: 469705 - RNA, 66 nt, Homo Sapiens; identical to SEQ ID NO: 253649

SEQ ID NO: 469706 - RNA, 66 nt, Homo Sapiens; identical to SEQ ID NO: 253650

SEQ ID NO: 469707 - RNA, 66 nt, Homo Sapiens; identical to SEQ ID NO: 253651

SEQ ID NO: 469708 - RNA, 66 nt, Homo Sapiens; identical to SEQ ID NO: 253652

SEQ ID NO: 469709 - RNA, 66 nt, Homo Sapiens; identical to SEQ ID NO: 253653

SEQ ID NO: 469710 - RNA, 66 nt, Homo Sapiens; identical to SEQ ID NO: 253654

SEQ ID NO: 469711 - RNA, 66 nt, Homo Sapiens; identical to SEQ ID NO: 253655

SEQ ID NO: 469712 - RNA, 66 nt, Homo Sapiens; identical to SEQ ID NO: 253656

SEQ ID NO: 469713 - RNA, 66 nt, Homo Sapiens; identical to SEQ ID NO: 253657

SEQ ID NO: 469714 - RNA, 66 nt, Homo Sapiens; identical to SEQ ID NO: 253658

SEQ ID NO: 469715 - RNA, 63 nt, Homo Sapiens; identical to SEQ ID NO: 103195

SEQ ID NO: 469716 - RNA, 51 nt, Homo Sapiens; identical to SEQ ID NO: 103196

SEQ ID NO: 469717 - RNA, 66 nt, Homo Sapiens; identical to SEQ ID NO: 253661

SEQ ID NO: 469718 - RNA, 66 nt, Homo Sapiens; identical to SEQ ID NO: 253662

SEQ ID NO: 469719 - RNA, 66 nt, Homo Sapiens; identical to SEQ ID NO: 253663

SEQ ID NO: 469720 - RNA, 66 nt, Homo Sapiens; identical to SEQ ID NO: 253664

SEQ ID NO: 469721 - RNA, 66 nt, Homo Sapiens; identical to SEQ ID NO: 253665

SEQ ID NO: 469722 - RNA, 66 nt, Homo Sapiens; identical to SEQ ID NO: 253666

SEQ ID NO: 469723 - RNA, 66 nt, Homo Sapiens; identical to SEQ ID NO: 253667

SEQ ID NO: 469724 - RNA, 66 nt, Homo Sapiens; identical to SEQ ID NO: 253668

SEQ ID NO: 469725 - RNA, 66 nt, Homo Sapiens; identical to SEQ ID NO: 253669

SEQ ID NO: 469726 - RNA, 66 nt, Homo Sapiens; identical to SEQ ID NO: 253670

SEQ ID NO: 469727 - RNA, 66 nt, Homo Sapiens; identical to SEQ ID NO: 253671

SEQ ID NO: 469728 - RNA, 66 nt, Homo Sapiens; identical to SEQ ID NO: 253672

SEQ ID NO: 469729 - RNA, 66 nt, Homo Sapiens; identical to SEQ ID NO: 253673

SEQ ID NO: 469730 - RNA, 66 nt, Homo Sapiens; identical to SEQ ID NO: 253674

SEQ ID NO: 469731 - RNA, 66 nt, Homo Sapiens; identical to SEQ ID NO: 253675

SEQ ID NO: 469732 - RNA, 66 nt, Homo Sapiens; identical to SEQ ID NO: 253676

SEQ ID NO: 469733 - RNA, 66 nt, Homo Sapiens; identical to SEQ ID NO: 253677

SEQ ID NO: 469734 - RNA, 66 nt, Homo Sapiens; identical to SEQ ID NO: 253678

SEQ ID NO: 469735 - RNA, 66 nt, Homo Sapiens; identical to SEQ ID NO: 253679

SEQ ID NO: 469736 - RNA, 66 nt, Homo Sapiens; identical to SEQ ID NO: 253680

SEQ ID NO: 469737 - RNA, 66 nt, Homo Sapiens; identical to SEQ ID NO: 253681

SEQ ID NO: 469738 - RNA, 66 nt, Homo Sapiens; identical to SEQ ID NO: 253682

SEQ ID NO: 469739 - RNA, 66 nt, Homo Sapiens; identical to SEQ ID NO: 253683

SEQ ID NO: 469740 - RNA, 66 nt, Homo Sapiens; identical to SEQ ID NO: 253684

SEQ ID NO: 469741 - RNA, 66 nt, Homo Sapiens; identical to SEQ ID NO: 253685

SEQ ID NO: 469742 - RNA, 66 nt, Homo Sapiens; identical to SEQ ID NO: 253686

SEQ ID NO: 469743 - RNA, 66 nt, Homo Sapiens; identical to SEQ ID NO: 253687

SEQ ID NO: 469744 - RNA, 66 nt, Homo Sapiens; identical to SEQ ID NO: 253688

SEQ ID NO: 469745 - RNA, 66 nt, Homo Sapiens; identical to SEQ ID NO: 253689

SEQ ID NO: 469746 - RNA, 66 nt, Homo Sapiens; identical to SEQ ID NO: 253690

SEQ ID NO: 469747 - RNA, 66 nt, Homo Sapiens; identical to SEQ ID NO: 253691

SEQ ID NO: 469748 - RNA, 66 nt, Homo Sapiens; identical to SEQ ID NO: 253692

SEQ ID NO: 469749 - RNA, 66 nt, Homo Sapiens; identical to SEQ ID NO: 253693

SEQ ID NO: 469750 - RNA, 66 nt, Homo Sapiens; identical to SEQ ID NO: 253694

SEQ ID NO: 469751 - RNA, 66 nt, Homo Sapiens; identical to SEQ ID NO: 253695

SEQ ID NO: 469752 - RNA, 66 nt, Homo Sapiens; identical to SEQ ID NO: 253696

SEQ ID NO: 469753 - RNA, 66 nt, Homo Sapiens; identical to SEQ ID NO: 253697

SEQ ID NO: 469754 - RNA, 66 nt, Homo Sapiens; identical to SEQ ID NO: 253698

SEQ ID NO: 469755 - RNA, 66 nt, Homo Sapiens; identical to SEQ ID NO: 253699

SEQ ID NO: 469756 - RNA, 66 nt, Homo Sapiens; identical to SEQ ID NO: 253700

SEQ ID NO: 469757 - RNA, 66 nt, Homo Sapiens; identical to SEQ ID NO: 253701

SEQ ID NO: 469758 - RNA, 66 nt, Homo Sapiens; identical to SEQ ID NO: 253702

SEQ ID NO: 469759 - RNA, 66 nt, Homo Sapiens; identical to SEQ ID NO: 253703

SEQ ID NO: 469760 - RNA, 66 nt, Homo Sapiens; identical to SEQ ID NO: 253704

SEQ ID NO: 469761 - RNA, 66 nt, Homo Sapiens; identical to SEQ ID NO: 253705

SEQ ID NO: 469762 - RNA, 66 nt, Homo Sapiens; identical to SEQ ID NO: 253706

SEQ ID NO: 469763 - RNA, 66 nt, Homo Sapiens; identical to SEQ ID NO: 253707

SEQ ID NO: 469764 - RNA, 66 nt, Homo Sapiens; identical to SEQ ID NO: 253708

SEQ ID NO: 469765 - RNA, 66 nt, Homo Sapiens; identical to SEQ ID NO: 253709

SEQ ID NO: 469766 - RNA, 66 nt, Homo Sapiens; identical to SEQ ID NO: 253710

SEQ ID NO: 469767 - RNA, 66 nt, Homo Sapiens; identical to SEQ ID NO: 253711

SEQ ID NO: 469768 - RNA, 66 nt, Homo Sapiens; identical to SEQ ID NO: 253712

SEQ ID NO: 469769 - RNA, 66 nt, Homo Sapiens; identical to SEQ ID NO: 253713

SEQ ID NO: 469770 - RNA, 66 nt, Homo Sapiens; identical to SEQ ID NO: 253714

SEQ ID NO: 469771 - RNA, 66 nt, Homo Sapiens; identical to SEQ ID NO: 253715

SEQ ID NO: 469772 - RNA, 66 nt, Homo Sapiens; identical to SEQ ID NO: 253716

SEQ ID NO: 469773 - RNA, 66 nt, Homo Sapiens; identical to SEQ ID NO: 253717

SEQ ID NO: 469774 - RNA, 66 nt, Homo Sapiens; identical to SEQ ID NO: 253718

SEQ ID NO: 469775 - RNA, 66 nt, Homo Sapiens; identical to SEQ ID NO: 253719

SEQ ID NO: 469776 - RNA, 66 nt, Homo Sapiens; identical to SEQ ID NO: 253720

SEQ ID NO: 469777 - RNA, 66 nt, Homo Sapiens; identical to SEQ ID NO: 253721

SEQ ID NO: 469778 - RNA, 66 nt, Homo Sapiens; identical to SEQ ID NO: 253722

SEQ ID NO: 469779 - RNA, 66 nt, Homo Sapiens; identical to SEQ ID NO: 253723

SEQ ID NO: 469780 - RNA, 66 nt, Homo Sapiens; identical to SEQ ID NO: 253724

SEQ ID NO: 469781 - RNA, 66 nt, Homo Sapiens; identical to SEQ ID NO: 253725

SEQ ID NO: 469782 - RNA, 66 nt, Homo Sapiens; identical to SEQ ID NO: 253726

SEQ ID NO: 469783 - RNA, 66 nt, Homo Sapiens; identical to SEQ ID NO: 253727

SEQ ID NO: 469784 - RNA, 66 nt, Homo Sapiens; identical to SEQ ID NO: 253728

SEQ ID NO: 469785 - RNA, 66 nt, Homo Sapiens; identical to SEQ ID NO: 253729

SEQ ID NO: 469786 - RNA, 66 nt, Homo Sapiens; identical to SEQ ID NO: 253730

SEQ ID NO: 469787 - RNA, 66 nt, Homo Sapiens; identical to SEQ ID NO: 253731

SEQ ID NO: 469788 - RNA, 66 nt, Homo Sapiens; identical to SEQ ID NO: 253732

SEQ ID NO: 469789 - RNA, 66 nt, Homo Sapiens; identical to SEQ ID NO: 253733

SEQ ID NO: 469790 - RNA, 66 nt, Homo Sapiens; identical to SEQ ID NO: 253734

SEQ ID NO: 469791 - RNA, 66 nt, Homo Sapiens; identical to SEQ ID NO: 253735

SEQ ID NO: 469792 - RNA, 66 nt, Homo Sapiens; identical to SEQ ID NO: 253736

SEQ ID NO: 469793 - RNA, 66 nt, Homo Sapiens; identical to SEQ ID NO: 253737

SEQ ID NO: 469794 - RNA, 66 nt, Homo Sapiens; identical to SEQ ID NO: 253738

SEQ ID NO: 469795 - RNA, 66 nt, Homo Sapiens; identical to SEQ ID NO: 253739

SEQ ID NO: 469796 - RNA, 66 nt, Homo Sapiens; identical to SEQ ID NO: 253740

SEQ ID NO: 469797 - RNA, 66 nt, Homo Sapiens; identical to SEQ ID NO: 253741

SEQ ID NO: 469798 - RNA, 66 nt, Homo Sapiens; identical to SEQ ID NO: 253742

SEQ ID NO: 469799 - RNA, 66 nt, Homo Sapiens; identical to SEQ ID NO: 253743

SEQ ID NO: 469800 - RNA, 66 nt, Homo Sapiens; identical to SEQ ID NO: 253744

SEQ ID NO: 469801 - RNA, 66 nt, Homo Sapiens; identical to SEQ ID NO: 253745

SEQ ID NO: 469802 - RNA, 66 nt, Homo Sapiens; identical to SEQ ID NO: 253746

SEQ ID NO: 469803 - RNA, 66 nt, Homo Sapiens; identical to SEQ ID NO: 253747

SEQ ID NO: 469804 - RNA, 66 nt, Homo Sapiens; identical to SEQ ID NO: 253748

SEQ ID NO: 469805 - RNA, 66 nt, Homo Sapiens; identical to SEQ ID NO: 253749

SEQ ID NO: 469806 - RNA, 66 nt, Homo Sapiens; identical to SEQ ID NO: 253750

SEQ ID NO: 469807 - RNA, 66 nt, Homo Sapiens; identical to SEQ ID NO: 253751

SEQ ID NO: 469808 - RNA, 66 nt, Homo Sapiens; identical to SEQ ID NO: 253752

SEQ ID NO: 469809 - RNA, 65 nt, Homo Sapiens
cgucugccuguuucgaaauggggaaagccgugcgugcgcguuauuuauuuaagugcgccugugug

SEQ ID NO: 469810 - RNA, 65 nt, Homo Sapiens
cuguucccuucucuauccuuugaggugcuguacacgcgcguuaacucccgucucaguggcuucuc

SEQ ID NO: 469811 - RNA, 65 nt, Homo Sapiens
ucuagggguggguaugaagaugcuucagagcucaugcgcguuacccacgauggcaugacuagcac

SEQ ID NO: 469812 - RNA, 65 nt, Homo Sapiens
uagagaagucuugguaguaaaagugcccgagcgcagcgcguuaagcccguguucccgaaguugcu

SEQ ID NO: 469813 - RNA, 65 nt, Homo Sapiens
cauguauugccuuucagcucgugggaguggggcgugcgcguuaucuuuacucuugcuaaauaaaa

SEQ ID NO: 469814 - RNA, 65 nt, Homo Sapiens
cuccggcuguuucacugcggacggcuggggcugcugcgcguuaccuugcugcaagcggggcgccu

SEQ ID NO: 469815 - RNA, 65 nt, Homo Sapiens
aacaccaacacauccuacaaagccuucagcgcagcgcgcguuacagcccguguccgucugcucgu

SEQ ID NO: 469816 - RNA, 65 nt, Homo Sapiens
aacucacccuagcuuguaacggauugcucauaccagcgcguuauguggaaggacgcuaaauaaua

SEQ ID NO: 469817 - RNA, 65 nt, Homo Sapiens
ccgggacagcugcuuugcugggcuuucugaacuuugcgcguuaagaaggccaucuggagacuccu

SEQ ID NO: 469818 - RNA, 63 nt, Homo Sapiens; identical to SEQ ID NO: 57615

SEQ ID NO: 469819 - RNA, 63 nt, Homo Sapiens; identical to SEQ ID NO: 57616

SEQ ID NO: 469820 - RNA, 63 nt, Homo Sapiens; identical to SEQ ID NO: 57617

SEQ ID NO: 469821 - RNA, 63 nt, Homo Sapiens; identical to SEQ ID NO: 57618

SEQ ID NO: 469822 - RNA, 63 nt, Homo Sapiens; identical to SEQ ID NO: 57619

SEQ ID NO: 469823 - RNA, 63 nt, Homo Sapiens; identical to SEQ ID NO: 57620

SEQ ID NO: 469824 - RNA, 50 nt, Homo Sapiens; identical to SEQ ID NO: 57621

SEQ ID NO: 469825 - RNA, 63 nt, Homo Sapiens; identical to SEQ ID NO: 57622

SEQ ID NO: 469826 - RNA, 63 nt, Homo Sapiens; identical to SEQ ID NO: 57623

SEQ ID NO: 469827 - RNA, 63 nt, Homo Sapiens; identical to SEQ ID NO: 57624

SEQ ID NO: 469828 - RNA, 63 nt, Homo Sapiens; identical to SEQ ID NO: 57625

SEQ ID NO: 469829 - RNA, 63 nt, Homo Sapiens; identical to SEQ ID NO: 57626

SEQ ID NO: 469830 - RNA, 63 nt, Homo Sapiens; identical to SEQ ID NO: 57627

SEQ ID NO: 469831 - RNA, 63 nt, Homo Sapiens; identical to SEQ ID NO: 57628

SEQ ID NO: 469832 - RNA, 63 nt, Homo Sapiens; identical to SEQ ID NO: 57629

SEQ ID NO: 469833 - RNA, 63 nt, Homo Sapiens; identical to SEQ ID NO: 57630

SEQ ID NO: 469834 - RNA, 63 nt, Homo Sapiens; identical to SEQ ID NO: 57631

SEQ ID NO: 469835 - RNA, 63 nt, Homo Sapiens; identical to SEQ ID NO: 57632

SEQ ID NO: 469836 - RNA, 63 nt, Homo Sapiens; identical to SEQ ID NO: 57633

SEQ ID NO: 469837 - RNA, 63 nt, Homo Sapiens; identical to SEQ ID NO: 102980

SEQ ID NO: 469838 - RNA, 63 nt, Homo Sapiens; identical to SEQ ID NO: 102981

SEQ ID NO: 469839 - RNA, 63 nt, Homo Sapiens; identical to SEQ ID NO: 102982

SEQ ID NO: 469840 - RNA, 63 nt, Homo Sapiens; identical to SEQ ID NO: 102983

SEQ ID NO: 469841 - RNA, 63 nt, Homo Sapiens; identical to SEQ ID NO: 102984

SEQ ID NO: 469842 - RNA, 63 nt, Homo Sapiens; identical to SEQ ID NO: 102985

SEQ ID NO: 469843 - RNA, 63 nt, Homo Sapiens; identical to SEQ ID NO: 102986

SEQ ID NO: 469844 - RNA, 63 nt, Homo Sapiens; identical to SEQ ID NO: 102987

SEQ ID NO: 469845 - RNA, 63 nt, Homo Sapiens; identical to SEQ ID NO: 102988

SEQ ID NO: 469846 - RNA, 63 nt, Homo Sapiens; identical to SEQ ID NO: 102989

SEQ ID NO: 469847 - RNA, 63 nt, Homo Sapiens; identical to SEQ ID NO: 102990

SEQ ID NO: 469848 - RNA, 58 nt, Homo Sapiens; identical to SEQ ID NO: 102991

SEQ ID NO: 469849 - RNA, 63 nt, Homo Sapiens; identical to SEQ ID NO: 102992

SEQ ID NO: 469850 - RNA, 63 nt, Homo Sapiens; identical to SEQ ID NO: 102993

SEQ ID NO: 469851 - RNA, 63 nt, Homo Sapiens; identical to SEQ ID NO: 102994

SEQ ID NO: 469852 - RNA, 63 nt, Homo Sapiens; identical to SEQ ID NO: 102995

SEQ ID NO: 469853 - RNA, 63 nt, Homo Sapiens; identical to SEQ ID NO: 102996

SEQ ID NO: 469854 - RNA, 63 nt, Homo Sapiens; identical to SEQ ID NO: 102997

SEQ ID NO: 469855 - RNA, 63 nt, Homo Sapiens; identical to SEQ ID NO: 102998

SEQ ID NO: 469856 - RNA, 63 nt, Homo Sapiens; identical to SEQ ID NO: 102999

SEQ ID NO: 469857 - RNA, 63 nt, Homo Sapiens; identical to SEQ ID NO: 103000

SEQ ID NO: 469858 - RNA, 63 nt, Homo Sapiens; identical to SEQ ID NO: 103001

SEQ ID NO: 469859 - RNA, 63 nt, Homo Sapiens; identical to SEQ ID NO: 103002

SEQ ID NO: 469860 - RNA, 63 nt, Homo Sapiens; identical to SEQ ID NO: 103003

SEQ ID NO: 469861 - RNA, 63 nt, Homo Sapiens; identical to SEQ ID NO: 103004

SEQ ID NO: 469862 - RNA, 63 nt, Homo Sapiens; identical to SEQ ID NO: 103005

SEQ ID NO: 469863 - RNA, 63 nt, Homo Sapiens; identical to SEQ ID NO: 103006

SEQ ID NO: 469864 - RNA, 63 nt, Homo Sapiens; identical to SEQ ID NO: 103007

SEQ ID NO: 469865 - RNA, 63 nt, Homo Sapiens; identical to SEQ ID NO: 103008

SEQ ID NO: 469866 - RNA, 63 nt, Homo Sapiens; identical to SEQ ID NO: 103009

SEQ ID NO: 469867 - RNA, 63 nt, Homo Sapiens; identical to SEQ ID NO: 103010

SEQ ID NO: 469868 - RNA, 63 nt, Homo Sapiens; identical to SEQ ID NO: 103011

SEQ ID NO: 469869 - RNA, 63 nt, Homo Sapiens; identical to SEQ ID NO: 103012

SEQ ID NO: 469870 - RNA, 63 nt, Homo Sapiens; identical to SEQ ID NO: 103013

SEQ ID NO: 469871 - RNA, 53 nt, Homo Sapiens; identical to SEQ ID NO: 103014

SEQ ID NO: 469872 - RNA, 63 nt, Homo Sapiens; identical to SEQ ID NO: 103015

SEQ ID NO: 469873 - RNA, 63 nt, Homo Sapiens; identical to SEQ ID NO: 103016

SEQ ID NO: 469874 - RNA, 63 nt, Homo Sapiens; identical to SEQ ID NO: 103017

SEQ ID NO: 469875 - RNA, 63 nt, Homo Sapiens; identical to SEQ ID NO: 103018

SEQ ID NO: 469876 - RNA, 63 nt, Homo Sapiens; identical to SEQ ID NO: 103019

SEQ ID NO: 469877 - RNA, 63 nt, Homo Sapiens; identical to SEQ ID NO: 103020

SEQ ID NO: 469878 - RNA, 63 nt, Homo Sapiens; identical to SEQ ID NO: 103021

SEQ ID NO: 469879 - RNA, 63 nt, Homo Sapiens; identical to SEQ ID NO: 103022

SEQ ID NO: 469880 - RNA, 63 nt, Homo Sapiens; identical to SEQ ID NO: 103023

SEQ ID NO: 469881 - RNA, 63 nt, Homo Sapiens; identical to SEQ ID NO: 103024

SEQ ID NO: 469882 - RNA, 63 nt, Homo Sapiens; identical to SEQ ID NO: 103025

SEQ ID NO: 469883 - RNA, 63 nt, Homo Sapiens; identical to SEQ ID NO: 103026

SEQ ID NO: 469884 - RNA, 63 nt, Homo Sapiens; identical to SEQ ID NO: 103027

SEQ ID NO: 469885 - RNA, 63 nt, Homo Sapiens; identical to SEQ ID NO: 103028

SEQ ID NO: 469886 - RNA, 63 nt, Homo Sapiens; identical to SEQ ID NO: 103029

SEQ ID NO: 469887 - RNA, 63 nt, Homo Sapiens; identical to SEQ ID NO: 103030

SEQ ID NO: 469888 - RNA, 63 nt, Homo Sapiens; identical to SEQ ID NO: 103031

SEQ ID NO: 469889 - RNA, 63 nt, Homo Sapiens; identical to SEQ ID NO: 103032

SEQ ID NO: 469890 - RNA, 63 nt, Homo Sapiens; identical to SEQ ID NO: 103033

SEQ ID NO: 469891 - RNA, 63 nt, Homo Sapiens; identical to SEQ ID NO: 103034

SEQ ID NO: 469892 - RNA, 63 nt, Homo Sapiens; identical to SEQ ID NO: 103035

SEQ ID NO: 469893 - RNA, 63 nt, Homo Sapiens; identical to SEQ ID NO: 103036

SEQ ID NO: 469894 - RNA, 63 nt, Homo Sapiens; identical to SEQ ID NO: 103037

SEQ ID NO: 469895 - RNA, 63 nt, Homo Sapiens; identical to SEQ ID NO: 103038

SEQ ID NO: 469896 - RNA, 63 nt, Homo Sapiens; identical to SEQ ID NO: 103039

SEQ ID NO: 469897 - RNA, 63 nt, Homo Sapiens; identical to SEQ ID NO: 103040

SEQ ID NO: 469898 - RNA, 63 nt, Homo Sapiens; identical to SEQ ID NO: 103041

SEQ ID NO: 469899 - RNA, 63 nt, Homo Sapiens; identical to SEQ ID NO: 103042

SEQ ID NO: 469900 - RNA, 63 nt, Homo Sapiens; identical to SEQ ID NO: 103043

SEQ ID NO: 469901 - RNA, 63 nt, Homo Sapiens; identical to SEQ ID NO: 103044

SEQ ID NO: 469902 - RNA, 63 nt, Homo Sapiens; identical to SEQ ID NO: 103045

SEQ ID NO: 469903 - RNA, 63 nt, Homo Sapiens; identical to SEQ ID NO: 103046

SEQ ID NO: 469904 - RNA, 63 nt, Homo Sapiens; identical to SEQ ID NO: 103047

SEQ ID NO: 469905 - RNA, 63 nt, Homo Sapiens; identical to SEQ ID NO: 103048

SEQ ID NO: 469906 - RNA, 63 nt, Homo Sapiens; identical to SEQ ID NO: 103049

SEQ ID NO: 469907 - RNA, 63 nt, Homo Sapiens; identical to SEQ ID NO: 103050

SEQ ID NO: 469908 - RNA, 63 nt, Homo Sapiens; identical to SEQ ID NO: 103051

SEQ ID NO: 469909 - RNA, 63 nt, Homo Sapiens; identical to SEQ ID NO: 103052

SEQ ID NO: 469910 - RNA, 63 nt, Homo Sapiens; identical to SEQ ID NO: 103053

SEQ ID NO: 469911 - RNA, 63 nt, Homo Sapiens; identical to SEQ ID NO: 103054

SEQ ID NO: 469912 - RNA, 63 nt, Homo Sapiens; identical to SEQ ID NO: 103055

SEQ ID NO: 469913 - RNA, 63 nt, Homo Sapiens; identical to SEQ ID NO: 103056

SEQ ID NO: 469914 - RNA, 63 nt, Homo Sapiens; identical to SEQ ID NO: 103057

SEQ ID NO: 469915 - RNA, 63 nt, Homo Sapiens; identical to SEQ ID NO: 103058

SEQ ID NO: 469916 - RNA, 63 nt, Homo Sapiens; identical to SEQ ID NO: 103059

SEQ ID NO: 469917 - RNA, 63 nt, Homo Sapiens; identical to SEQ ID NO: 103060

SEQ ID NO: 469918 - RNA, 63 nt, Homo Sapiens; identical to SEQ ID NO: 103061

SEQ ID NO: 469919 - RNA, 63 nt, Homo Sapiens; identical to SEQ ID NO: 103062

SEQ ID NO: 469920 - RNA, 63 nt, Homo Sapiens; identical to SEQ ID NO: 103063

SEQ ID NO: 469921 - RNA, 63 nt, Homo Sapiens; identical to SEQ ID NO: 103064

SEQ ID NO: 469922 - RNA, 63 nt, Homo Sapiens; identical to SEQ ID NO: 103065

SEQ ID NO: 469923 - RNA, 63 nt, Homo Sapiens; identical to SEQ ID NO: 103066

SEQ ID NO: 469924 - RNA, 63 nt, Homo Sapiens; identical to SEQ ID NO: 103067

SEQ ID NO: 469925 - RNA, 63 nt, Homo Sapiens; identical to SEQ ID NO: 103068

SEQ ID NO: 469926 - RNA, 63 nt, Homo Sapiens; identical to SEQ ID NO: 103069

SEQ ID NO: 469927 - RNA, 63 nt, Homo Sapiens; identical to SEQ ID NO: 103070

SEQ ID NO: 469928 - RNA, 63 nt, Homo Sapiens; identical to SEQ ID NO: 103071

SEQ ID NO: 469929 - RNA, 63 nt, Homo Sapiens; identical to SEQ ID NO: 103072

SEQ ID NO: 469930 - RNA, 63 nt, Homo Sapiens; identical to SEQ ID NO: 103073

SEQ ID NO: 469931 - RNA, 63 nt, Homo Sapiens; identical to SEQ ID NO: 103074

SEQ ID NO: 469932 - RNA, 63 nt, Homo Sapiens; identical to SEQ ID NO: 103075

SEQ ID NO: 469933 - RNA, 63 nt, Homo Sapiens; identical to SEQ ID NO: 103076

SEQ ID NO: 469934 - RNA, 63 nt, Homo Sapiens; identical to SEQ ID NO: 103077

SEQ ID NO: 469935 - RNA, 63 nt, Homo Sapiens; identical to SEQ ID NO: 103078

SEQ ID NO: 469936 - RNA, 63 nt, Homo Sapiens; identical to SEQ ID NO: 103079

SEQ ID NO: 469937 - RNA, 63 nt, Homo Sapiens; identical to SEQ ID NO: 103080

SEQ ID NO: 469938 - RNA, 63 nt, Homo Sapiens; identical to SEQ ID NO: 103081

SEQ ID NO: 469939 - RNA, 63 nt, Homo Sapiens; identical to SEQ ID NO: 103082

SEQ ID NO: 469940 - RNA, 63 nt, Homo Sapiens; identical to SEQ ID NO: 103083

SEQ ID NO: 469941 - RNA, 63 nt, Homo Sapiens; identical to SEQ ID NO: 103084

SEQ ID NO: 469942 - RNA, 63 nt, Homo Sapiens; identical to SEQ ID NO: 103085

SEQ ID NO: 469943 - RNA, 63 nt, Homo Sapiens; identical to SEQ ID NO: 103086

SEQ ID NO: 469944 - RNA, 63 nt, Homo Sapiens; identical to SEQ ID NO: 103087

SEQ ID NO: 469945 - RNA, 63 nt, Homo Sapiens; identical to SEQ ID NO: 103088

SEQ ID NO: 469946 - RNA, 63 nt, Homo Sapiens; identical to SEQ ID NO: 103089

SEQ ID NO: 469947 - RNA, 63 nt, Homo Sapiens; identical to SEQ ID NO: 103090

SEQ ID NO: 469948 - RNA, 63 nt, Homo Sapiens; identical to SEQ ID NO: 103091

SEQ ID NO: 469949 - RNA, 63 nt, Homo Sapiens; identical to SEQ ID NO: 103092

SEQ ID NO: 469950 - RNA, 63 nt, Homo Sapiens; identical to SEQ ID NO: 103093

SEQ ID NO: 469951 - RNA, 63 nt, Homo Sapiens; identical to SEQ ID NO: 103094

SEQ ID NO: 469952 - RNA, 63 nt, Homo Sapiens; identical to SEQ ID NO: 103095

SEQ ID NO: 469953 - RNA, 63 nt, Homo Sapiens; identical to SEQ ID NO: 103096

SEQ ID NO: 469954 - RNA, 63 nt, Homo Sapiens; identical to SEQ ID NO: 103097

SEQ ID NO: 469955 - RNA, 60 nt, Homo Sapiens; identical to SEQ ID NO: 103098

SEQ ID NO: 469956 - RNA, 63 nt, Homo Sapiens; identical to SEQ ID NO: 103099

SEQ ID NO: 469957 - RNA, 63 nt, Homo Sapiens; identical to SEQ ID NO: 103100

SEQ ID NO: 469958 - RNA, 63 nt, Homo Sapiens; identical to SEQ ID NO: 103101

SEQ ID NO: 469959 - RNA, 63 nt, Homo Sapiens; identical to SEQ ID NO: 103102

SEQ ID NO: 469960 - RNA, 63 nt, Homo Sapiens; identical to SEQ ID NO: 103103

SEQ ID NO: 469961 - RNA, 63 nt, Homo Sapiens; identical to SEQ ID NO: 103104

SEQ ID NO: 469962 - RNA, 63 nt, Homo Sapiens; identical to SEQ ID NO: 103105

SEQ ID NO: 469963 - RNA, 63 nt, Homo Sapiens; identical to SEQ ID NO: 103106

SEQ ID NO: 469964 - RNA, 63 nt, Homo Sapiens; identical to SEQ ID NO: 103107

SEQ ID NO: 469965 - RNA, 63 nt, Homo Sapiens; identical to SEQ ID NO: 103108

SEQ ID NO: 469966 - RNA, 63 nt, Homo Sapiens; identical to SEQ ID NO: 103109

SEQ ID NO: 469967 - RNA, 63 nt, Homo Sapiens; identical to SEQ ID NO: 103110

SEQ ID NO: 469968 - RNA, 63 nt, Homo Sapiens; identical to SEQ ID NO: 103111

SEQ ID NO: 469969 - RNA, 63 nt, Homo Sapiens; identical to SEQ ID NO: 103112

SEQ ID NO: 469970 - RNA, 63 nt, Homo Sapiens; identical to SEQ ID NO: 103113

SEQ ID NO: 469971 - RNA, 63 nt, Homo Sapiens; identical to SEQ ID NO: 103114

SEQ ID NO: 469972 - RNA, 63 nt, Homo Sapiens; identical to SEQ ID NO: 103115

SEQ ID NO: 469973 - RNA, 63 nt, Homo Sapiens; identical to SEQ ID NO: 103116

SEQ ID NO: 469974 - RNA, 63 nt, Homo Sapiens; identical to SEQ ID NO: 103117

SEQ ID NO: 469975 - RNA, 63 nt, Homo Sapiens; identical to SEQ ID NO: 103118

SEQ ID NO: 469976 - RNA, 63 nt, Homo Sapiens; identical to SEQ ID NO: 103119

SEQ ID NO: 469977 - RNA, 63 nt, Homo Sapiens; identical to SEQ ID NO: 103120

SEQ ID NO: 469978 - RNA, 63 nt, Homo Sapiens; identical to SEQ ID NO: 103121

SEQ ID NO: 469979 - RNA, 63 nt, Homo Sapiens; identical to SEQ ID NO: 103122

SEQ ID NO: 469980 - RNA, 63 nt, Homo Sapiens; identical to SEQ ID NO: 103123

SEQ ID NO: 469981 - RNA, 63 nt, Homo Sapiens; identical to SEQ ID NO: 103124

SEQ ID NO: 469982 - RNA, 63 nt, Homo Sapiens; identical to SEQ ID NO: 103125

SEQ ID NO: 469983 - RNA, 63 nt, Homo Sapiens; identical to SEQ ID NO: 103126

SEQ ID NO: 469984 - RNA, 63 nt, Homo Sapiens; identical to SEQ ID NO: 103127

SEQ ID NO: 469985 - RNA, 63 nt, Homo Sapiens; identical to SEQ ID NO: 103128

SEQ ID NO: 469986 - RNA, 63 nt, Homo Sapiens; identical to SEQ ID NO: 103129

SEQ ID NO: 469987 - RNA, 63 nt, Homo Sapiens; identical to SEQ ID NO: 103130

SEQ ID NO: 469988 - RNA, 63 nt, Homo Sapiens; identical to SEQ ID NO: 103131

SEQ ID NO: 469989 - RNA, 63 nt, Homo Sapiens; identical to SEQ ID NO: 103132

SEQ ID NO: 469990 - RNA, 63 nt, Homo Sapiens; identical to SEQ ID NO: 103133

SEQ ID NO: 469991 - RNA, 63 nt, Homo Sapiens; identical to SEQ ID NO: 103134

SEQ ID NO: 469992 - RNA, 63 nt, Homo Sapiens; identical to SEQ ID NO: 103135

SEQ ID NO: 469993 - RNA, 63 nt, Homo Sapiens; identical to SEQ ID NO: 103136

SEQ ID NO: 469994 - RNA, 63 nt, Homo Sapiens; identical to SEQ ID NO: 103137

SEQ ID NO: 469995 - RNA, 63 nt, Homo Sapiens; identical to SEQ ID NO: 103138

SEQ ID NO: 469996 - RNA, 63 nt, Homo Sapiens; identical to SEQ ID NO: 103139

SEQ ID NO: 469997 - RNA, 63 nt, Homo Sapiens; identical to SEQ ID NO: 103140

SEQ ID NO: 469998 - RNA, 63 nt, Homo Sapiens; identical to SEQ ID NO: 103141

SEQ ID NO: 469999 - RNA, 63 nt, Homo Sapiens; identical to SEQ ID NO: 103142

SEQ ID NO: 470000 - RNA, 63 nt, Homo Sapiens; identical to SEQ ID NO: 103143

SEQ ID NO: 470001 - RNA, 63 nt, Homo Sapiens; identical to SEQ ID NO: 103144

SEQ ID NO: 470002 - RNA, 63 nt, Homo Sapiens; identical to SEQ ID NO: 103145

SEQ ID NO: 470003 - RNA, 63 nt, Homo Sapiens; identical to SEQ ID NO: 103146

SEQ ID NO: 470004 - RNA, 63 nt, Homo Sapiens; identical to SEQ ID NO: 103147

SEQ ID NO: 470005 - RNA, 63 nt, Homo Sapiens; identical to SEQ ID NO: 103148

SEQ ID NO: 470006 - RNA, 63 nt, Homo Sapiens; identical to SEQ ID NO: 103149

SEQ ID NO: 470007 - RNA, 63 nt, Homo Sapiens; identical to SEQ ID NO: 103150

SEQ ID NO: 470008 - RNA, 63 nt, Homo Sapiens; identical to SEQ ID NO: 103151

SEQ ID NO: 470009 - RNA, 63 nt, Homo Sapiens; identical to SEQ ID NO: 103152

SEQ ID NO: 470010 - RNA, 63 nt, Homo Sapiens; identical to SEQ ID NO: 103153

SEQ ID NO: 470011 - RNA, 63 nt, Homo Sapiens; identical to SEQ ID NO: 103154

SEQ ID NO: 470012 - RNA, 63 nt, Homo Sapiens; identical to SEQ ID NO: 103155

SEQ ID NO: 470013 - RNA, 63 nt, Homo Sapiens; identical to SEQ ID NO: 103156

SEQ ID NO: 470014 - RNA, 63 nt, Homo Sapiens; identical to SEQ ID NO: 103157

SEQ ID NO: 470015 - RNA, 63 nt, Homo Sapiens; identical to SEQ ID NO: 103158

SEQ ID NO: 470016 - RNA, 63 nt, Homo Sapiens; identical to SEQ ID NO: 103159

SEQ ID NO: 470017 - RNA, 63 nt, Homo Sapiens; identical to SEQ ID NO: 103160

SEQ ID NO: 470018 - RNA, 63 nt, Homo Sapiens; identical to SEQ ID NO: 103161

SEQ ID NO: 470019 - RNA, 63 nt, Homo Sapiens; identical to SEQ ID NO: 103162

SEQ ID NO: 470020 - RNA, 63 nt, Homo Sapiens; identical to SEQ ID NO: 103163

SEQ ID NO: 470021 - RNA, 63 nt, Homo Sapiens; identical to SEQ ID NO: 103164

SEQ ID NO: 470022 - RNA, 63 nt, Homo Sapiens; identical to SEQ ID NO: 103165

SEQ ID NO: 470023 - RNA, 63 nt, Homo Sapiens; identical to SEQ ID NO: 103166

SEQ ID NO: 470024 - RNA, 63 nt, Homo Sapiens; identical to SEQ ID NO: 103167

SEQ ID NO: 470025 - RNA, 63 nt, Homo Sapiens; identical to SEQ ID NO: 103168

SEQ ID NO: 470026 - RNA, 63 nt, Homo Sapiens; identical to SEQ ID NO: 103169

SEQ ID NO: 470027 - RNA, 63 nt, Homo Sapiens; identical to SEQ ID NO: 103170

SEQ ID NO: 470028 - RNA, 63 nt, Homo Sapiens; identical to SEQ ID NO: 103171

SEQ ID NO: 470029 - RNA, 63 nt, Homo Sapiens; identical to SEQ ID NO: 103172

SEQ ID NO: 470030 - RNA, 63 nt, Homo Sapiens; identical to SEQ ID NO: 103173

SEQ ID NO: 470031 - RNA, 63 nt, Homo Sapiens; identical to SEQ ID NO: 103174

SEQ ID NO: 470032 - RNA, 63 nt, Homo Sapiens; identical to SEQ ID NO: 103175

SEQ ID NO: 470033 - RNA, 63 nt, Homo Sapiens; identical to SEQ ID NO: 103176

SEQ ID NO: 470034 - RNA, 63 nt, Homo Sapiens; identical to SEQ ID NO: 103177

SEQ ID NO: 470035 - RNA, 63 nt, Homo Sapiens; identical to SEQ ID NO: 103178

SEQ ID NO: 470036 - RNA, 63 nt, Homo Sapiens; identical to SEQ ID NO: 103179

SEQ ID NO: 470037 - RNA, 63 nt, Homo Sapiens; identical to SEQ ID NO: 103180

SEQ ID NO: 470038 - RNA, 63 nt, Homo Sapiens; identical to SEQ ID NO: 103181

SEQ ID NO: 470039 - RNA, 63 nt, Homo Sapiens; identical to SEQ ID NO: 103182

SEQ ID NO: 470040 - RNA, 63 nt, Homo Sapiens; identical to SEQ ID NO: 103183

SEQ ID NO: 470041 - RNA, 63 nt, Homo Sapiens; identical to SEQ ID NO: 103184

SEQ ID NO: 470042 - RNA, 63 nt, Homo Sapiens; identical to SEQ ID NO: 103185

SEQ ID NO: 470043 - RNA, 63 nt, Homo Sapiens; identical to SEQ ID NO: 103186

SEQ ID NO: 470044 - RNA, 63 nt, Homo Sapiens; identical to SEQ ID NO: 103187

SEQ ID NO: 470045 - RNA, 63 nt, Homo Sapiens; identical to SEQ ID NO: 103188

SEQ ID NO: 470046 - RNA, 63 nt, Homo Sapiens; identical to SEQ ID NO: 103189

SEQ ID NO: 470047 - RNA, 63 nt, Homo Sapiens; identical to SEQ ID NO: 103190

SEQ ID NO: 470048 - RNA, 63 nt, Homo Sapiens; identical to SEQ ID NO: 103191

SEQ ID NO: 470049 - RNA, 63 nt, Homo Sapiens; identical to SEQ ID NO: 103192

SEQ ID NO: 470050 - RNA, 63 nt, Homo Sapiens; identical to SEQ ID NO: 103193

SEQ ID NO: 470051 - RNA, 63 nt, Homo Sapiens; identical to SEQ ID NO: 103194

SEQ ID NO: 470052 - RNA, 63 nt, Homo Sapiens; identical to SEQ ID NO: 103195

SEQ ID NO: 470053 - RNA, 51 nt, Homo Sapiens; identical to SEQ ID NO: 103196

SEQ ID NO: 470054 - RNA, 63 nt, Homo Sapiens; identical to SEQ ID NO: 103197

SEQ ID NO: 470055 - RNA, 63 nt, Homo Sapiens; identical to SEQ ID NO: 103198

SEQ ID NO: 470056 - RNA, 63 nt, Homo Sapiens; identical to SEQ ID NO: 103199

SEQ ID NO: 470057 - RNA, 63 nt, Homo Sapiens; identical to SEQ ID NO: 103200

SEQ ID NO: 470058 - RNA, 63 nt, Homo Sapiens; identical to SEQ ID NO: 103201

SEQ ID NO: 470059 - RNA, 63 nt, Homo Sapiens; identical to SEQ ID NO: 103202

SEQ ID NO: 470060 - RNA, 63 nt, Homo Sapiens; identical to SEQ ID NO: 103203

SEQ ID NO: 470061 - RNA, 63 nt, Homo Sapiens; identical to SEQ ID NO: 103204

SEQ ID NO: 470062 - RNA, 63 nt, Homo Sapiens; identical to SEQ ID NO: 103205

SEQ ID NO: 470063 - RNA, 63 nt, Homo Sapiens; identical to SEQ ID NO: 103206

SEQ ID NO: 470064 - RNA, 63 nt, Homo Sapiens; identical to SEQ ID NO: 103207

SEQ ID NO: 470065 - RNA, 63 nt, Homo Sapiens; identical to SEQ ID NO: 103208

SEQ ID NO: 470066 - RNA, 63 nt, Homo Sapiens; identical to SEQ ID NO: 103209

SEQ ID NO: 470067 - RNA, 63 nt, Homo Sapiens; identical to SEQ ID NO: 103210

SEQ ID NO: 470068 - RNA, 63 nt, Homo Sapiens; identical to SEQ ID NO: 103211

SEQ ID NO: 470069 - RNA, 63 nt, Homo Sapiens; identical to SEQ ID NO: 103212

SEQ ID NO: 470070 - RNA, 63 nt, Homo Sapiens; identical to SEQ ID NO: 103213

SEQ ID NO: 470071 - RNA, 63 nt, Homo Sapiens; identical to SEQ ID NO: 103214

SEQ ID NO: 470072 - RNA, 63 nt, Homo Sapiens; identical to SEQ ID NO: 103215

SEQ ID NO: 470073 - RNA, 63 nt, Homo Sapiens; identical to SEQ ID NO: 103216

SEQ ID NO: 470074 - RNA, 63 nt, Homo Sapiens; identical to SEQ ID NO: 103217

SEQ ID NO: 470075 - RNA, 63 nt, Homo Sapiens; identical to SEQ ID NO: 103218

SEQ ID NO: 470076 - RNA, 63 nt, Homo Sapiens; identical to SEQ ID NO: 103219

SEQ ID NO: 470077 - RNA, 63 nt, Homo Sapiens; identical to SEQ ID NO: 103220

SEQ ID NO: 470078 - RNA, 63 nt, Homo Sapiens; identical to SEQ ID NO: 103221

SEQ ID NO: 470079 - RNA, 63 nt, Homo Sapiens; identical to SEQ ID NO: 103222

SEQ ID NO: 470080 - RNA, 63 nt, Homo Sapiens; identical to SEQ ID NO: 103223

SEQ ID NO: 470081 - RNA, 63 nt, Homo Sapiens; identical to SEQ ID NO: 103224

SEQ ID NO: 470082 - RNA, 63 nt, Homo Sapiens; identical to SEQ ID NO: 103225

SEQ ID NO: 470083 - RNA, 63 nt, Homo Sapiens; identical to SEQ ID NO: 103226

SEQ ID NO: 470084 - RNA, 63 nt, Homo Sapiens; identical to SEQ ID NO: 103227

SEQ ID NO: 470085 - RNA, 63 nt, Homo Sapiens; identical to SEQ ID NO: 103228

SEQ ID NO: 470086 - RNA, 63 nt, Homo Sapiens; identical to SEQ ID NO: 103229

SEQ ID NO: 470087 - RNA, 63 nt, Homo Sapiens; identical to SEQ ID NO: 103230

SEQ ID NO: 470088 - RNA, 63 nt, Homo Sapiens; identical to SEQ ID NO: 103231

SEQ ID NO: 470089 - RNA, 63 nt, Homo Sapiens; identical to SEQ ID NO: 103232

SEQ ID NO: 470090 - RNA, 63 nt, Homo Sapiens; identical to SEQ ID NO: 103233

SEQ ID NO: 470091 - RNA, 63 nt, Homo Sapiens; identical to SEQ ID NO: 103234

SEQ ID NO: 470092 - RNA, 63 nt, Homo Sapiens; identical to SEQ ID NO: 103235

SEQ ID NO: 470093 - RNA, 63 nt, Homo Sapiens; identical to SEQ ID NO: 103236

SEQ ID NO: 470094 - RNA, 63 nt, Homo Sapiens; identical to SEQ ID NO: 103237

SEQ ID NO: 470095 - RNA, 63 nt, Homo Sapiens; identical to SEQ ID NO: 103238

SEQ ID NO: 470096 - RNA, 63 nt, Homo Sapiens; identical to SEQ ID NO: 103239

SEQ ID NO: 470097 - RNA, 63 nt, Homo Sapiens; identical to SEQ ID NO: 103240

SEQ ID NO: 470098 - RNA, 63 nt, Homo Sapiens; identical to SEQ ID NO: 103241

SEQ ID NO: 470099 - RNA, 63 nt, Homo Sapiens; identical to SEQ ID NO: 103242

SEQ ID NO: 470100 - RNA, 63 nt, Homo Sapiens; identical to SEQ ID NO: 103243

SEQ ID NO: 470101 - RNA, 63 nt, Homo Sapiens; identical to SEQ ID NO: 103244

SEQ ID NO: 470102 - RNA, 63 nt, Homo Sapiens; identical to SEQ ID NO: 103245

SEQ ID NO: 470103 - RNA, 63 nt, Homo Sapiens; identical to SEQ ID NO: 103246

SEQ ID NO: 470104 - RNA, 63 nt, Homo Sapiens; identical to SEQ ID NO: 103247

SEQ ID NO: 470105 - RNA, 63 nt, Homo Sapiens; identical to SEQ ID NO: 103248

SEQ ID NO: 470106 - RNA, 63 nt, Homo Sapiens; identical to SEQ ID NO: 103249

SEQ ID NO: 470107 - RNA, 63 nt, Homo Sapiens; identical to SEQ ID NO: 103250

SEQ ID NO: 470108 - RNA, 63 nt, Homo Sapiens; identical to SEQ ID NO: 103251

SEQ ID NO: 470109 - RNA, 63 nt, Homo Sapiens; identical to SEQ ID NO: 103252

SEQ ID NO: 470110 - RNA, 63 nt, Homo Sapiens; identical to SEQ ID NO: 103253

SEQ ID NO: 470111 - RNA, 63 nt, Homo Sapiens; identical to SEQ ID NO: 103254

SEQ ID NO: 470112 - RNA, 63 nt, Homo Sapiens; identical to SEQ ID NO: 103255

SEQ ID NO: 470113 - RNA, 63 nt, Homo Sapiens; identical to SEQ ID NO: 103256

SEQ ID NO: 470114 - RNA, 63 nt, Homo Sapiens; identical to SEQ ID NO: 103257

SEQ ID NO: 470115 - RNA, 63 nt, Homo Sapiens; identical to SEQ ID NO: 103258

SEQ ID NO: 470116 - RNA, 63 nt, Homo Sapiens; identical to SEQ ID NO: 103259

SEQ ID NO: 470117 - RNA, 63 nt, Homo Sapiens; identical to SEQ ID NO: 103260

SEQ ID NO: 470118 - RNA, 63 nt, Homo Sapiens; identical to SEQ ID NO: 103261

SEQ ID NO: 470119 - RNA, 63 nt, Homo Sapiens; identical to SEQ ID NO: 103262

SEQ ID NO: 470120 - RNA, 63 nt, Homo Sapiens; identical to SEQ ID NO: 103263

SEQ ID NO: 470121 - RNA, 63 nt, Homo Sapiens; identical to SEQ ID NO: 103264

SEQ ID NO: 470122 - RNA, 63 nt, Homo Sapiens; identical to SEQ ID NO: 103265

SEQ ID NO: 470123 - RNA, 63 nt, Homo Sapiens; identical to SEQ ID NO: 103266

SEQ ID NO: 470124 - RNA, 63 nt, Homo Sapiens; identical to SEQ ID NO: 103267

SEQ ID NO: 470125 - RNA, 63 nt, Homo Sapiens; identical to SEQ ID NO: 103268

SEQ ID NO: 470126 - RNA, 63 nt, Homo Sapiens; identical to SEQ ID NO: 103269

SEQ ID NO: 470127 - RNA, 63 nt, Homo Sapiens; identical to SEQ ID NO: 103270

SEQ ID NO: 470128 - RNA, 63 nt, Homo Sapiens; identical to SEQ ID NO: 103271

SEQ ID NO: 470129 - RNA, 63 nt, Homo Sapiens; identical to SEQ ID NO: 103272

SEQ ID NO: 470130 - RNA, 63 nt, Homo Sapiens; identical to SEQ ID NO: 103273

SEQ ID NO: 470131 - RNA, 63 nt, Homo Sapiens; identical to SEQ ID NO: 103274

SEQ ID NO: 470132 - RNA, 63 nt, Homo Sapiens; identical to SEQ ID NO: 103275

SEQ ID NO: 470133 - RNA, 63 nt, Homo Sapiens; identical to SEQ ID NO: 103276

SEQ ID NO: 470134 - RNA, 63 nt, Homo Sapiens; identical to SEQ ID NO: 103277

SEQ ID NO: 470135 - RNA, 63 nt, Homo Sapiens; identical to SEQ ID NO: 103278

SEQ ID NO: 470136 - RNA, 63 nt, Homo Sapiens; identical to SEQ ID NO: 103279

SEQ ID NO: 470137 - RNA, 63 nt, Homo Sapiens; identical to SEQ ID NO: 103280

SEQ ID NO: 470138 - RNA, 63 nt, Homo Sapiens; identical to SEQ ID NO: 103281

SEQ ID NO: 470139 - RNA, 63 nt, Homo Sapiens; identical to SEQ ID NO: 103282

SEQ ID NO: 470140 - RNA, 63 nt, Homo Sapiens; identical to SEQ ID NO: 103283

SEQ ID NO: 470141 - RNA, 63 nt, Homo Sapiens; identical to SEQ ID NO: 103284

SEQ ID NO: 470142 - RNA, 63 nt, Homo Sapiens; identical to SEQ ID NO: 103285

SEQ ID NO: 470143 - RNA, 63 nt, Homo Sapiens; identical to SEQ ID NO: 103286

SEQ ID NO: 470144 - RNA, 63 nt, Homo Sapiens; identical to SEQ ID NO: 103287

SEQ ID NO: 470145 - RNA, 63 nt, Homo Sapiens; identical to SEQ ID NO: 103288

SEQ ID NO: 470146 - RNA, 65 nt, Homo Sapiens
gaagaccguacucaguaacaggccggaaaauugugcucuagaagaauaaaacugaaaaacucuag

SEQ ID NO: 470147 - RNA, 65 nt, Homo Sapiens
gucauaagguaaacauucuauauauucuaugccugcucuagaauugaaagacuucagcaguauua

SEQ ID NO: 470148 - RNA, 65 nt, Homo Sapiens
aacuccacaucugccuuaaaaccaaagagggcuuccucuagaagccaagggaaaggggugcuuuu

SEQ ID NO: 470149 - RNA, 65 nt, Homo Sapiens
gaaggaacauuauggagagaaaggguacugaggcacucuagaaucugccacauucauuuucaaau

SEQ ID NO: 470150 - RNA, 65 nt, Homo Sapiens
ugaggcagcuggaauuggaacucagauuuguugaacucuagaacuaaagaucauaauguugucuu

SEQ ID NO: 470151 - RNA, 65 nt, Homo Sapiens
guuucagaguucaaggaagaagcaaaauaucacaucucuagaaguguugggaaaaauauaauuuc

SEQ ID NO: 470152 - RNA, 65 nt, Homo Sapiens
uuacuccuaaguuauuucucauagaacccagccuacucuagaauuucagcagugacauuggagaa

SEQ ID NO: 470153 - RNA, 65 nt, Homo Sapiens
caaaauacaccagcucauuuggcugcucagucuaacucuagaauggaugcuuuugaauucauuuc

SEQ ID NO: 470154 - RNA, 65 nt, Homo Sapiens
guuagagaggaauuaacuuccuggucugugcccuucucuagaagaauauaagaugcuccuccucc

SEQ ID NO: 470155 - RNA, 65 nt, Homo Sapiens
uggcugggaggaaagugcugggcaucuuacaguaacucuagaaguuccuuugacuaggcugcaau

SEQ ID NO: 470156 - RNA, 65 nt, Homo Sapiens
cccugaagccauuggagagcugucuuccuguguaccucuagaaucccagcagcagagaaccauca

SEQ ID NO: 470157 - RNA, 58 nt, Homo Sapiens; identical to SEQ ID NO: 102991

SEQ ID NO: 470158 - RNA, 65 nt, Homo Sapiens
acauucucccuugcuugaugcuucuuuuccugucccucuagaagaagagaaguauguggacaucu

SEQ ID NO: 470159 - RNA, 65 nt, Homo Sapiens
agguuucacaaccgagaugcgggagcagggagaggcucuagaacaucuuaagauccucacagcac

SEQ ID NO: 470160 - RNA, 65 nt, Homo Sapiens
gccaucucaauugugcuuugguuugaagcugcugucucuagaaguaucucauuacccuuuucugg

SEQ ID NO: 470161 - RNA, 65 nt, Homo Sapiens
cccacuggccaguccuagagccaaccccagcuggccucuagaacaaguguccagaccauugucuu

SEQ ID NO: 470162 - RNA, 65 nt, Homo Sapiens
uccagaaagguggagggcugcugugcuacaauuaucucuagaaucuguguuaucaaggaauugua

SEQ ID NO: 470163 - RNA, 65 nt, Homo Sapiens
ucagguucccugccacacuagggcucccuggaggacucuagaagcugaguccugauccuaacccu

SEQ ID NO: 470164 - RNA, 65 nt, Homo Sapiens
gcaguauucaaccuuuuagcucccgcuuuuucuugcucuagaagagcucuguuuugcccaggggc

SEQ ID NO: 470165 - RNA, 65 nt, Homo Sapiens
uccauauuuauuuuuauguuucuaggccuucaggacucuagaauguccagacuauggauguguuc

SEQ ID NO: 470166 - RNA, 65 nt, Homo Sapiens
uugacauucucugugggggauguugcaguaacaaacucuagaauaugcaguaacaaacuccaguc

SEQ ID NO: 470167 - RNA, 65 nt, Homo Sapiens
cccacauuuccaccaacucauauauuagggcaguucucuagaacgcaucccucuuagcuguaguc

SEQ ID NO: 470168 - RNA, 65 nt, Homo Sapiens
uggauaauaaagaugcuuauaugcagagccauuuccucuagaauuagcuaguagguucugcuguu

SEQ ID NO: 470169 - RNA, 65 nt, Homo Sapiens
gaaugaaggauugaagaauuagcgaugaagaaugucucuagaagauaaugacaauguagcuugaa

SEQ ID NO: 470170 - RNA, 65 nt, Homo Sapiens
uagauuuucacuucuuuugaauuuuugaagagagucucuagaauaauugaauauauugguugcuc

SEQ ID NO: 470171 - RNA, 65 nt, Homo Sapiens
auaugauaugauaauccuaccaauuuucaagaagucucuagaaagagauaacacauggaaagacg

SEQ ID NO: 470172 - RNA, 65 nt, Homo Sapiens
aagccagccauauuacucuagucccuaccaaacugcucuagaaggucauuuccauuuuguuugug

SEQ ID NO: 470173 - RNA, 65 nt, Homo Sapiens
agauugaaaguaagaaaacggauuuaggaugaaaacucuagaacuacccuaugcuguuuauacug

SEQ ID NO: 470174 - RNA, 65 nt, Homo Sapiens
aacuacagucagauuuauagccagccaucuaucaccucuagaagguuccagagacagugaaacug

SEQ ID NO: 470175 - RNA, 65 nt, Homo Sapiens
gauccucuuuaaaaaaaaaaaaguuuuuguuauaucucuagaacauuucaagucuuuuccuuuuu

SEQ ID NO: 470176 - RNA, 65 nt, Homo Sapiens
gccacagaacguauagaguuaaccaaagugcucuucucuagaaucuuuacaccuccugugugguu

SEQ ID NO: 470177 - RNA, 65 nt, Homo Sapiens
cuaguccccuaaauuucuguucuaguuuuaaauuucucuagaacuugcaauaguuggggguuuua

SEQ ID NO: 470178 - RNA, 65 nt, Homo Sapiens
aagucucggccuccacauuaaccauaggauguugacucuagaaccuggacccacccagcgcgucc

SEQ ID NO: 470179 - RNA, 65 nt, Homo Sapiens
cuuuuaauuuucuugugagauaauauucuaagaggcucuagaaacaugaaauacucaguagugau

SEQ ID NO: 470180 - RNA, 53 nt, Homo Sapiens; identical to SEQ ID NO: 103014

SEQ ID NO: 470181 - RNA, 65 nt, Homo Sapiens
ugaggacaccauguacuauaaccaguuaaauggaacucuagaauaucaagggagcaagaggaagc

SEQ ID NO: 470182 - RNA, 65 nt, Homo Sapiens
guaaucaaaaacaaagaagcccuauaagaccauuucucuagaacagauguucuuaauauuuuucu

SEQ ID NO: 470183 - RNA, 65 nt, Homo Sapiens
uuuggagcauguggucuuuuuaaaaaauuguaacccucuagaaaauaucaaagaaaugaaccaga

SEQ ID NO: 470184 - RNA, 65 nt, Homo Sapiens
aaagaacacuaccacugcaaugcuuugacaguuaacucuagaaagacaguuacugagaauuguug

SEQ ID NO: 470185 - RNA, 65 nt, Homo Sapiens
uaguggcgggucugggcuggcugagagacacccuccucuagaauugaagaaaaaaguacugugac

SEQ ID NO: 470186 - RNA, 65 nt, Homo Sapiens
guuuuggagcucgagaucuuaaucaaaauggugggcucuagaaugaucugaaacacauguguaac

SEQ ID NO: 470187 - RNA, 65 nt, Homo Sapiens
uuacauugauuaaaauguuauguguuucagcaaaucucuagaaauauggucuccauucaggcaag

SEQ ID NO: 470188 - RNA, 65 nt, Homo Sapiens
uguaucuuuuuaugauuuaguuuggcagauaauuccucuagaaugucuuugauaauuguuauuuu

SEQ ID NO: 470189 - RNA, 65 nt, Homo Sapiens
ugggauggacuuacuauucucaugagcuaccucaucucuagaagcaaugacccaacauuucuuag

SEQ ID NO: 470190 - RNA, 65 nt, Homo Sapiens
gaauccugucuuaaaacuggacuguuguguaaugucucuagaaagcagaaacaccuuaaguguau

SEQ ID NO: 470191 - RNA, 65 nt, Homo Sapiens
uauuacuuuguucucccaugaaagaaauacuauugcucuagaauguccugcuaccuaaaggauau

SEQ ID NO: 470192 - RNA, 65 nt, Homo Sapiens
cuaguacacuggcaucaucuagauuaugccuacaucucuagaagaaaggccuagaaccaguuuua

SEQ ID NO: 470193 - RNA, 65 nt, Homo Sapiens
cugccugggcccaaggggugaugaggcauccuuuccucuagaagaccugagucuuccugaccgac

SEQ ID NO: 470194 - RNA, 65 nt, Homo Sapiens
uucuagacaaaaaccauuguugaugaggcagaugccucuagaagagacguuuaaaagccaucaaa

SEQ ID NO: 470195 - RNA, 65 nt, Homo Sapiens
agaaguuccacaucaucuuaucgaucaagaagcuacucuagaagucggagcagaggaugguacag

SEQ ID NO: 470196 - RNA, 65 nt, Homo Sapiens
auuguccuguugccaaacaaaagccagucauguaacucuagaagcagugacugguggggcuuucu

SEQ ID NO: 470197 - RNA, 65 nt, Homo Sapiens
uugugaugcuucuggggcacguugaccauaugcaccucuagaaccuaaccagggcuuccuucuac

SEQ ID NO: 470198 - RNA, 65 nt, Homo Sapiens
augagagcguuccuugaguccguacaccguccucccucuagaagcuggcaucacacucaugcugg

SEQ ID NO: 470199 - RNA, 65 nt, Homo Sapiens
aauaugaaguuccccaaggaaacgaacaaaaugaacucuagaauaucuagcaaauaguuaaagaa

SEQ ID NO: 470200 - RNA, 65 nt, Homo Sapiens
guugcauggaagagaacaccucuuuauggcuuacccucuagaauuucuaauuuauguguucuguu

SEQ ID NO: 470201 - RNA, 65 nt, Homo Sapiens
cuagcaccugggucccagcaucuagagcauggagccucuagaagccaugcucacccgcccacauu

SEQ ID NO: 470202 - RNA, 65 nt, Homo Sapiens
cacaucaggaaagagagcaccacgugauggaguuucucuagaagcuccagugauaagagauguug

SEQ ID NO: 470203 - RNA, 65 nt, Homo Sapiens
ggaagugugacucaaucuugccugccuucugggagcucuagaauuguucccaacccaguccaugg

SEQ ID NO: 470204 - RNA, 65 nt, Homo Sapiens
cgucccuuccccagagaccuucagugccauccugacucuagaaggccccccacagcagggcguag

SEQ ID NO: 470205 - RNA, 65 nt, Homo Sapiens
ggccuugaaagaaccgaagucuuucccauucacuucucuagaaagcugccaagacagaggcagaa

SEQ ID NO: 470206 - RNA, 65 nt, Homo Sapiens
cgaagggaggaggagcacaauccucugggaaguuacucuagaaaauuggcaggcuccaggcaggg

SEQ ID NO: 470207 - RNA, 65 nt, Homo Sapiens
gaauuugcaggcaaccauguuuuugcguuuacuuccucuagaaaagcaaaacauaaccauaugug

SEQ ID NO: 470208 - RNA, 65 nt, Homo Sapiens
auuucaaacaauuaaaauaaaaagagcuucuuuggcucuagaaaauuggaagaaacaacuucuuu

SEQ ID NO: 470209 - RNA, 65 nt, Homo Sapiens
ggagaccgauuuacaauuuauaagaaaauuguguacucuagaaauaagaaauaauuuuuuucaaa

SEQ ID NO: 470210 - RNA, 65 nt, Homo Sapiens
accaccaaacaugacuguuccaacugcugauguugcucuagaaaaauuacuccuccuccagauac

SEQ ID NO: 470211 - RNA, 65 nt, Homo Sapiens
cugaggacaguuucuuuugaugaaacccucuaggucucuagaacacugauuaggauuugauuucu

SEQ ID NO: 470212 - RNA, 65 nt, Homo Sapiens
aaauauuuaguaaagcuuuaagucaauagauguuucucuagaacaugggacuuuauuuucacaua

SEQ ID NO: 470213 - RNA, 65 nt, Homo Sapiens
uuaagugcuuuguaaugggaggaauauuccccuaucucuagaauuacuuaaaaaauguccaugau

SEQ ID NO: 470214 - RNA, 65 nt, Homo Sapiens
agguaauuuuacacaugcuggaaugacuguaauuacucuagaauuccaaguagaauacaauaacu

SEQ ID NO: 470215 - RNA, 65 nt, Homo Sapiens
aagauaacucuuaaaaaaccgucgagauuacaaugcucuagaaucagcauauaagaaaauaaaug

SEQ ID NO: 470216 - RNA, 65 nt, Homo Sapiens
auacaauauuacauuacagccuguauucauuuguucucuagaaguuuugucagaauuuugacuug

SEQ ID NO: 470217 - RNA, 65 nt, Homo Sapiens
cuauuguaacuacacugggcaucagaauaaaaggccucuagaaauugcugaacaaugguuaauua

SEQ ID NO: 470218 - RNA, 65 nt, Homo Sapiens
gcucucuccuucauuaauuuaaauauuuuuaucggcucuagaaaaugcauaagguuaguacaaga

SEQ ID NO: 470219 - RNA, 65 nt, Homo Sapiens
augaacaaagguuaauuuaauuuaauuauuuaaaacucuagaaaguucacucucugcacugacuu

SEQ ID NO: 470220 - RNA, 65 nt, Homo Sapiens
caucugucuguauugaucuuugagaacauuucugucucuagaagucaacuauucuguugugacua

SEQ ID NO: 470221 - RNA, 65 nt, Homo Sapiens
agaaagcaauuuuuaggcagccuguccuauauacccucuagaaacccauucuccuauuuaccagu

SEQ ID NO: 470222 - RNA, 65 nt, Homo Sapiens
ugugcgagcacaacacacacgaugaaagauuuuuacucuagaaacuaagugucacauuucucuaa

SEQ ID NO: 470223 - RNA, 65 nt, Homo Sapiens
agaaccagcucuacgagagucucguuucccuuuuccucuagaagcugcagcuuugggaaagcugc

SEQ ID NO: 470224 - RNA, 65 nt, Homo Sapiens
ugaaugcccugacucuaccagcgcccauaaaugaucucuagaaggacuguuaguaccaaucuguu

SEQ ID NO: 470225 - RNA, 65 nt, Homo Sapiens
acaaaauauaccauaggcuaaaacuaaggcuuucacucuagaaugcaaagcuguuuugcagcugu

SEQ ID NO: 470226 - RNA, 65 nt, Homo Sapiens
gauucccaucugcugcucuuuguagaaaagguuuccucuagaacugaauuccucuggaauugagu

SEQ ID NO: 470227 - RNA, 65 nt, Homo Sapiens
uguguaaacauugagcucaccuuuuauauauuaaccucuagaauuaaugggccuaugugguuuuu

SEQ ID NO: 470228 - RNA, 65 nt, Homo Sapiens
uaauugugcuuuuuuuuuuucuugguagguagcuucucuagaauuaauaaaauauuuagcccuuc

SEQ ID NO: 470229 - RNA, 65 nt, Homo Sapiens
gacauaaagguuuauggggaaucuuguaauauaugcucuagaaauuauacuuugccaaagcuguc

SEQ ID NO: 470230 - RNA, 65 nt, Homo Sapiens
gcagaaauuaggaaggugauucuuccuugaauuuucucuagaaauuagaaccugaaauauuguuu

SEQ ID NO: 470231 - RNA, 65 nt, Homo Sapiens
uaaagcugaaaucugcaaauaucuuuaaaauauaucucuagaacugggugaaucuuguuuuuuuu

SEQ ID NO: 470232 - RNA, 65 nt, Homo Sapiens
cuuagccugggcaccuggcugcccugucucccugucucuagaagccaaaccucaagggauuuagu

SEQ ID NO: 470233 - RNA, 65 nt, Homo Sapiens
gauuacuuaagacugugucaucuuacuauauacuucucuagaagaaaugaaaugggaaucagugg

SEQ ID NO: 470234 - RNA, 65 nt, Homo Sapiens
ggacuaaacuuauucucucaccgagaagguucuagcucuagaaagcccauggugggaaacagcca

SEQ ID NO: 470235 - RNA, 65 nt, Homo Sapiens
caguucuuacccaguuaacaugaagaaaccacugucucuagaagaaagcuuguuuugcaguauua

SEQ ID NO: 470236 - RNA, 65 nt, Homo Sapiens
gugaccaguugcacauguuuuccccuaaaagcuuacucuagaaaggauauuuuuuggagagggag

SEQ ID NO: 470237 - RNA, 65 nt, Homo Sapiens
uuccuuaucucccucagacgcagaguuuuuaguuucucuagaaauuuuguuucauauuaggaaua

SEQ ID NO: 470238 - RNA, 65 nt, Homo Sapiens
uggaucauuaagaugaagagaguaauucacauuuacucuagaaccuuuaacaagcacugaaagga

SEQ ID NO: 470239 - RNA, 65 nt, Homo Sapiens
ucugucacaggauuaauuaauugccgguuuucauacucuagaaggcugaaacugauguuuaucuu

SEQ ID NO: 470240 - RNA, 65 nt, Homo Sapiens
aauaauauauuucacaucuuuauuauugcaguuuucucuagaaagcucugagaagcuuucucugc

SEQ ID NO: 470241 - RNA, 65 nt, Homo Sapiens
uucauugaggaacuguugauuggcaggcacugauucucuagaacacugggcaugaggauguugca

SEQ ID NO: 470242 - RNA, 65 nt, Homo Sapiens
uuuacuuuucagguaauuauggaaaauauuuuaaacucuagaagcuucaauaaugaugugugauu

SEQ ID NO: 470243 - RNA, 65 nt, Homo Sapiens
uuucucugugugcuuugugguugcugucauauuugcucuagaagaaaaaaaaaaaaggaggggaa

SEQ ID NO: 470244 - RNA, 65 nt, Homo Sapiens
uacacauuuuauacuuuucauaaaccacaaagucucucuagaauuuuuucugccuucacuaaaau

SEQ ID NO: 470245 - RNA, 65 nt, Homo Sapiens
cagcuccugggcucaagugauccucuagacucagccucuagaauagcugggacuacaggcacaug

SEQ ID NO: 470246 - RNA, 65 nt, Homo Sapiens
ccaguccccuuucucgggguagcacaugauuugggcucuagaauucucagccuuuugggaauaau

SEQ ID NO: 470247 - RNA, 65 nt, Homo Sapiens
uuccuuggcacauauaaaaguuuuucucaaaaaugcucuagaacuucuuguucuucaguauuuug

SEQ ID NO: 470248 - RNA, 65 nt, Homo Sapiens
auuuaguuuguguuaacuauucauguaaucacauucucuagaaccucuuccaauaauguuagagu

SEQ ID NO: 470249 - RNA, 65 nt, Homo Sapiens
ggcacaagaauggcuaaagccagaugaaacuaaaucucuagaagaugaagaggucuugcagucuu

SEQ ID NO: 470250 - RNA, 65 nt, Homo Sapiens
aucagaaucaaguuguggguuguucuuaugaaugacucuagaaaaagaaaggauccacuacuucu

SEQ ID NO: 470251 - RNA, 65 nt, Homo Sapiens
ccaaaugccccgaguuaagaucuuuccaaaaggaacucuagaagaaacuucacuaaugaucacau

SEQ ID NO: 470252 - RNA, 65 nt, Homo Sapiens
ucacgugaaauauuuaaguauauaguauauuuauacucuagaacaugcacauuuauauauauaug

SEQ ID NO: 470253 - RNA, 65 nt, Homo Sapiens
aaaaaaccuaaacucuucaggcuaccuuugugugucucuagaagagaaaagcaucuaucuggaga

SEQ ID NO: 470254 - RNA, 65 nt, Homo Sapiens
acugaauaaacaucagaguauuuuaaaaaacaguucucuagaaagaacuguuauaauuaaaauga

SEQ ID NO: 470255 - RNA, 65 nt, Homo Sapiens
gaaaacuccugugcuuuugagcaaggacuuuugcccucuagaaagcaacugaggccaggugcggu

SEQ ID NO: 470256 - RNA, 65 nt, Homo Sapiens
auacugugucaaaaugauaauuuuguuauguuagccucuagaaaauuuaaguucagaaaaaugca

SEQ ID NO: 470257 - RNA, 65 nt, Homo Sapiens
cuugcuuauagaggcaaaccacaguaucauuuuaacucuagaauugggcuuguacagaaggauaa

SEQ ID NO: 470258 - RNA, 65 nt, Homo Sapiens
cuuauuguaauuuuccuacuguaauuuauagagaucucuagaauuggauuuugagucauaggucu

SEQ ID NO: 470259 - RNA, 65 nt, Homo Sapiens
uaccgcagaaauugaugugucucugucuggucuuccucuagaagguccuuucaacucuguugacc

SEQ ID NO: 470260 - RNA, 65 nt, Homo Sapiens
cugaguaccaugggcuacagugcuaggcuacccuccucuagaagguccacucagggcuucuccuc

SEQ ID NO: 470261 - RNA, 65 nt, Homo Sapiens
aucucgcaccaccaguuacaccuccuuuccccucucucuagaaucgagaagaccaaaccccacau

SEQ ID NO: 470262 - RNA, 65 nt, Homo Sapiens
guagggaaaauaaugcuuguuaaccugugugcauacucuagaagauuauugcauugcauucagag

SEQ ID NO: 470263 - RNA, 65 nt, Homo Sapiens
aagggaacagaaagucugccaaacacuaauaagagcucuagaaaacagggauuaaaaauaaggau

SEQ ID NO: 470264 - RNA, 60 nt, Homo Sapiens; identical to SEQ ID NO: 103098

SEQ ID NO: 470265 - RNA, 65 nt, Homo Sapiens
caauuagggauguuuguuacccuucccugcuuccucucuagaaucgcaugagccaccgcaccugg

SEQ ID NO: 470266 - RNA, 65 nt, Homo Sapiens
ucaaugucuuuguggacauuuguuacuguaguauucucuagaacuuccguuuucauugucaagaa

SEQ ID NO: 470267 - RNA, 65 nt, Homo Sapiens
uuuauccuaagcacuuguuugccaauauuccauuucucuagaaugguuuaauuuuuaagcucuuu

SEQ ID NO: 470268 - RNA, 65 nt, Homo Sapiens
acccagcuugcuaaauuaggcuauaccuagguaaucucuagaagacaacucugacagacucuuua

SEQ ID NO: 470269 - RNA, 65 nt, Homo Sapiens
uauuuuucaucaugcacgaauuaauaaucaucauacucuagaaucuugucugucacucacuacau

SEQ ID NO: 470270 - RNA, 65 nt, Homo Sapiens
uauuucuagguuuguaagugcagcaguuuuauuuccucuagaacucauccuguuucaagggaagu

SEQ ID NO: 470271 - RNA, 65 nt, Homo Sapiens
cucuaagaauuuuccacuucuucaaaaugaacuuacucuagaaagcuuacccuuggauaaccagu

SEQ ID NO: 470272 - RNA, 65 nt, Homo Sapiens
ggugcuggugaguauuaccuuucaucugugccaugcucuagaaccuugaccuugauaguucacca

SEQ ID NO: 470273 - RNA, 65 nt, Homo Sapiens
gugcuuaaugaucaaguguuacuuaucuaauaauccucuagaaagaacccuguuagaucuugguu

SEQ ID NO: 470274 - RNA, 65 nt, Homo Sapiens
gcccuucacuuucuccugguggggagggcacgaggcucuagaaaugcaggggaaacucuggugcc

SEQ ID NO: 470275 - RNA, 65 nt, Homo Sapiens
gaacucucuuucuucucuuggacacucccccugcucucuagaaagcuucuccaccugcccaccgg

SEQ ID NO: 470276 - RNA, 65 nt, Homo Sapiens
aaacgucuuuauuuaggagguaugauagauuugcucucuagaaggcucuucuaguuuugacauuu

SEQ ID NO: 470277 - RNA, 65 nt, Homo Sapiens
aucauauugaugaaaucguaccaacaucuuuaugacucuagaauaaaaugcagacucaaaccuuc

SEQ ID NO: 470278 - RNA, 65 nt, Homo Sapiens
gcggaccaaacuacuucauuuuuuuacccagacaacucuagaaauuuuuuguuuuuugguuuuuu

SEQ ID NO: 470279 - RNA, 65 nt, Homo Sapiens
cucuaaagaccauguuggaaaagucacagucguaucucuagaaagccagugcgugaagaccaaca

SEQ ID NO: 470280 - RNA, 65 nt, Homo Sapiens
uagucacaaguauuaauaauacauaauaugugaugcucuagaaaaugaauuccugcuuguuaauu

SEQ ID NO: 470281 - RNA, 65 nt, Homo Sapiens
ucuguauuguguagaaugauuauccuuuagaaaugcucuagaagacuuaagaccaaaaacuguaa

SEQ ID NO: 470282 - RNA, 65 nt, Homo Sapiens
gucugaugaaaggccgggaagggaaaaggagguuucucuagaagaaacaugauagccaaugguga

SEQ ID NO: 470283 - RNA, 65 nt, Homo Sapiens
uuaagcuuugucagguuaauguagcauguuaaggacucuagaaaaaaauaaacuaaggagacgag

SEQ ID NO: 470284 - RNA, 65 nt, Homo Sapiens
uuauauucggggauaugaaggauucaaugaaugaucucuagaaagauuuaaagaagaauauucag

SEQ ID NO: 470285 - RNA, 65 nt, Homo Sapiens
uggguuccacccuaacuuggggaaacaaaagccuucucuagaaucugaaggccaggcuuaccucu

SEQ ID NO: 470286 - RNA, 65 nt, Homo Sapiens
aauaggaaucaauaguuaguagugacauuggugcucucuagaaaucucagcaugagcugcuauag

SEQ ID NO: 470287 - RNA, 65 nt, Homo Sapiens
uaacaggccugcuagcucagccgacgcucuggacacucuagaaaucacuccucagugugaccucc

SEQ ID NO: 470288 - RNA, 65 nt, Homo Sapiens
uccuaguccugaguauaaauccugugcauagauuccucuagaaaggcaucaaaaggcucaacaga

SEQ ID NO: 470289 - RNA, 65 nt, Homo Sapiens
aaaaauggguucagggucuuguccuuagcuacuagcucuagaaaagucccaaaagcagcagaagg

SEQ ID NO: 470290 - RNA, 65 nt, Homo Sapiens
gacuuuggccuccccccaagaaagggugaagccaccucuagaaggaaacuggacuguuccuggga

SEQ ID NO: 470291 - RNA, 65 nt, Homo Sapiens
cuguugccacuuacgggggccacaccacugcaugucucuagaauguguuguguguaugguacuag

SEQ ID NO: 470292 - RNA, 65 nt, Homo Sapiens
aauuaucuuuuucucuuaauucaauacaguauucacucuagaaacacgugucuucuaagagcugu

SEQ ID NO: 470293 - RNA, 65 nt, Homo Sapiens
aggccaucucacuagaauagcucucaguuuccuaccucuagaaagauuaauaguaaagguaaaau

SEQ ID NO: 470294 - RNA, 65 nt, Homo Sapiens
ggagccaggacuaagugagaagcaauaaagaggaacucuagaacuaaccccaaacuuucaccaaa

SEQ ID NO: 470295 - RNA, 65 nt, Homo Sapiens
caguauaaacuuucagaggcgaaguccaaggaaagcucuagaaaaucaauucaggagcuuugaag

SEQ ID NO: 470296 - RNA, 65 nt, Homo Sapiens
uuaaucuucuagaagaaaaaucuccgaagagcucucucuagaaguccaaaauggcuagccauuau

SEQ ID NO: 470297 - RNA, 65 nt, Homo Sapiens
gguagcugaugucagcuucauguggauuuuaagcacucuagaaacaaugaagcuucuuggcauau

SEQ ID NO: 470298 - RNA, 65 nt, Homo Sapiens
acuccugccacuagguuucaccucccaaacccagccucuagaacagccagacccugcagaucccc

SEQ ID NO: 470299 - RNA, 65 nt, Homo Sapiens
aagacagugucuaaauauaagacaauauugaucagcucuagaauaacuuuaaagaaagacguguu

SEQ ID NO: 470300 - RNA, 65 nt, Homo Sapiens
aguucuuugcauuuggcucuacuuacuaacaaccccucuagaauacauuggugauuucauuuaaa

SEQ ID NO: 470301 - RNA, 65 nt, Homo Sapiens
cuuucuauuucuaaccuaugcuaauaauucuuguucucuagaaaguuuuguaguacauguuuuua

SEQ ID NO: 470302 - RNA, 65 nt, Homo Sapiens
guaacaaaucagccaauugguucauacaguucagccucuagaaugugugaaugguaguugagguc

SEQ ID NO: 470303 - RNA, 65 nt, Homo Sapiens
acacuagacagaugucuccucaccuccuaccccuacucuagaaacguaggaauugagcgguuccc

SEQ ID NO: 470304 - RNA, 65 nt, Homo Sapiens
ugccuuuuucaaauaucccuuaucuuugucuuuuccucuagaacccagcaggguucaguuucaug

SEQ ID NO: 470305 - RNA, 65 nt, Homo Sapiens
acaucuuuaaaccccuuacauuucccucuacgucucucuagaauguccugccacugucccaacuc

SEQ ID NO: 470306 - RNA, 65 nt, Homo Sapiens
aaggagauuuaguuuuacugcuuugacuggugggucucuagaagcaaaacugagugauaacucau

SEQ ID NO: 470307 - RNA, 65 nt, Homo Sapiens
uuccauaguuuuguuuugguuuauuuuuaacaacgcucuagaaacaaagucaaauuaaucacaaa

SEQ ID NO: 470308 - RNA, 65 nt, Homo Sapiens
ggucucuuuagaacuugauggcugggcacugccaucucuagaauugccacgagucucucucuucc

SEQ ID NO: 470309 - RNA, 65 nt, Homo Sapiens
ugggguguacuaguuacacaucuucaacagacccccucuagaaauuuuucagaugcuucugggag

SEQ ID NO: 470310 - RNA, 65 nt, Homo Sapiens
gcagcagcuguggucauuaaaccauuaguuuaccccucuagaacuggggucugcaaacucccacc

SEQ ID NO: 470311 - RNA, 65 nt, Homo Sapiens
agcuacagcacuaagagaagccccugagaaaaacccucuagaaaaacagcuguuccucugugugg

SEQ ID NO: 470312 - RNA, 65 nt, Homo Sapiens
uuuucccucuguggccuccuggcuugcacugcucccucuagaaagauuccuucaggucuggaggc

SEQ ID NO: 470313 - RNA, 65 nt, Homo Sapiens
ucucaguggacaguaugcacucagcugaccacucucucuagaaauagucaagauaugaacuaaga

SEQ ID NO: 470314 - RNA, 65 nt, Homo Sapiens
aacuccccuuaaaaugucuagauucuauuaaaagccucuagaaguucgccuuguuaugcacaaga

SEQ ID NO: 470315 - RNA, 65 nt, Homo Sapiens
uugaguucucauuuuuuuaacgagaagaguuauugcucuagaaagccgccuugugcuagugcccu

SEQ ID NO: 470316 - RNA, 65 nt, Homo Sapiens
gcaaagccggauuucuggaaacagaacacugaagacucuagaaaaggaucccggcggcaaggaga

SEQ ID NO: 470317 - RNA, 65 nt, Homo Sapiens
cuguccguggaugaguuuaggucagcguccugcugcucuagaagauacauacucugcuucucucu

SEQ ID NO: 470318 - RNA, 65 nt, Homo Sapiens
caggauguuccuucuauuguaccagcaagagucaacucuagaauucuaagcugaagguguacuuc

SEQ ID NO: 470319 - RNA, 65 nt, Homo Sapiens
aacacauaaaauuuagcaauuuaggucuggaacagcucuagaauguuuuuuccuuuuuuucuuga

SEQ ID NO: 470320 - RNA, 65 nt, Homo Sapiens
gaauugcuaccucuuguauguaauuuugagaccaucucuagaaaacaagugauuuugauguauuc

SEQ ID NO: 470321 - RNA, 65 nt, Homo Sapiens
uguuacaagggggagggaaguucuuuucacuaaaacucuagaaggcuuucacuucaagacuuucc

SEQ ID NO: 470322 - RNA, 65 nt, Homo Sapiens
cuccacccucaucucucugccaacuggcugucugccucuagaacuuguccuaggcccuagggauc

SEQ ID NO: 470323 - RNA, 65 nt, Homo Sapiens
cagcugguaaaggggugcuggaggccauggaggagcucuagaaacauuagcaugggcugaucuga

SEQ ID NO: 470324 - RNA, 65 nt, Homo Sapiens
uuuuauggcauaugucuccgauuuagaugguuauucucuagaaaauaguauuuaaagacauuuua

SEQ ID NO: 470325 - RNA, 65 nt, Homo Sapiens
accucauccccaccccaccucaccccaacaaacuccucuagaagaagccaagaauuucucucuau

SEQ ID NO: 470326 - RNA, 65 nt, Homo Sapiens
uccugaugcuuggaccccuuuuauugaucagagugcucuagaauaauggauggucuuggaugaug

SEQ ID NO: 470327 - RNA, 65 nt, Homo Sapiens
ugucauuauuuuaaugaaugugagcucuugacuuacucuagaauucuaauacagauacuuucugc

SEQ ID NO: 470328 - RNA, 65 nt, Homo Sapiens
gucuauuguuugaucuaguuauuuuaauaaaggaacucuagaaguuucaaguggccagugaagug

SEQ ID NO: 470329 - RNA, 65 nt, Homo Sapiens
ugaaauaaguaggacugaguauuuaugugaaaacucucuagaagguaaaaauaaagauaauucuu

SEQ ID NO: 470330 - RNA, 65 nt, Homo Sapiens
ugguuuucuguguaauuccagaugagucacuguaacucuagaagauuaaccuuccagccaaccua

SEQ ID NO: 470331 - RNA, 65 nt, Homo Sapiens
ccuccucgcccuuucuuaaagugcaguucuuagcccucuagaaacgaguuggugucuuucgucuc

SEQ ID NO: 470332 - RNA, 65 nt, Homo Sapiens
aaauguacucauuuagacaaucuacuccuuacagucucuagaauuaagccccaaagcauauaauc

SEQ ID NO: 470333 - RNA, 65 nt, Homo Sapiens
agaaauuauggagaaugauuauacaaagaagaaagcucuagaaagguacuaccuuacgugauagc

SEQ ID NO: 470334 - RNA, 65 nt, Homo Sapiens
cauguuuguuuguuuguuuuuacugacaacacaagcucuagaauuacacuuaccccacagcuggu

SEQ ID NO: 470335 - RNA, 65 nt, Homo Sapiens
uuggcaauguugacuaagaaagucaaaccuuuauccucuagaauuuuagaaaaauguggauaaac

SEQ ID NO: 470336 - RNA, 65 nt, Homo Sapiens
aaguagugaggccguuaauuaggguggagccaaaucucuagaaaugacauccugaagaaauggua

SEQ ID NO: 470337 - RNA, 65 nt, Homo Sapiens
cuagcagccuaacugcugcugagaacaaagaugaacucuagaacucuaacccugacugugggcuu

SEQ ID NO: 470338 - RNA, 65 nt, Homo Sapiens
cagaguugcuguuguuuuuuauuugguguuuuccccucuagaaaaacuaccauuugaauauuuuc

SEQ ID NO: 470339 - RNA, 65 nt, Homo Sapiens
ucuugccucauugaguguuuauuccuucuuuugggcucuagaaagcuccccagaucucuuccccc

SEQ ID NO: 470340 - RNA, 65 nt, Homo Sapiens
acuuuuaucaagaugaagacauuuuacccuaccuacucuagaaauauacaacaauguuauauuuu

SEQ ID NO: 470341 - RNA, 65 nt, Homo Sapiens
uagggcuaaugcugcauuuuucuacaacaucaugccucuagaagguuuaagcuagguaggcuuuc

SEQ ID NO: 470342 - RNA, 65 nt, Homo Sapiens
ugucugcguuuacucuuguucuucaccagacuuuucucuagaagcaaaucuauuaucaacugcug

SEQ ID NO: 470343 - RNA, 65 nt, Homo Sapiens
auaaagcaaagcacuauuccggaaauuacugcuuucucuagaaauugaggaacacugaacuaguu

SEQ ID NO: 470344 - RNA, 65 nt, Homo Sapiens
ugggcuuggaccagaucuaaccccucugcuuuuaacucuagaauuuuuuuuucagccacuaagaa

SEQ ID NO: 470345 - RNA, 65 nt, Homo Sapiens
cagcaggucacacugggggcaugggcugaaguguucucuagaaucguuggguuuucccuugccuu

SEQ ID NO: 470346 - RNA, 65 nt, Homo Sapiens
agagucugaggauguuaacuuuggaacucgcaguccucuagaacagcuucagauuauggcuuuuu

SEQ ID NO: 470347 - RNA, 65 nt, Homo Sapiens
uugcugcucuccaaugcuaacuuucugacacagugcucuagaacccugccugugguccugagcac

SEQ ID NO: 470348 - RNA, 65 nt, Homo Sapiens
aaaguugaggaaaugguugggaaucgcuguuagaacucuagaaauucuaaucugacuuugccacu

SEQ ID NO: 470349 - RNA, 65 nt, Homo Sapiens
aggccuggacagccaggggcuccucgggcccugugcucuagaaggcccauucuaugucugcuucg

SEQ ID NO: 470350 - RNA, 65 nt, Homo Sapiens
uagaaaagaaucugaacauuuaagugcgaaguuuucucuagaaauauauucaagauauguuuauu

SEQ ID NO: 470351 - RNA, 65 nt, Homo Sapiens
gauuuauuuugcucgugcuuagcuaaauaugucaucucuagaaaagaugugguuuguuuuggcac

SEQ ID NO: 470352 - RNA, 65 nt, Homo Sapiens
caccguucaaaugagcguagcccccugagucaucacucuagaagaaucuguacaucaucaggacu

SEQ ID NO: 470353 - RNA, 65 nt, Homo Sapiens
ucaugguguucacucuacauaucagguuauggugucucuagaaucuguuguuuguuuccuauaag

SEQ ID NO: 470354 - RNA, 65 nt, Homo Sapiens
aaaaugaagaccuacuuucaacuccuuuuuccccccucuagaagaaucaaauugaaucuuuuacu

SEQ ID NO: 470355 - RNA, 65 nt, Homo Sapiens
ugaaggugauugguuuucuuuacagacuccuuguucucuagaagggcuuuuuacuugaauaaaac

SEQ ID NO: 470356 - RNA, 65 nt, Homo Sapiens
auaauuaguguuauagucuucaugucaaaugcauccucuagaaaauuuuugugaaugagaguugg

SEQ ID NO: 470357 - RNA, 65 nt, Homo Sapiens
ucagcacugcacuguuagcuuuuccuguuucuuggcucuagaagagccacauagagccucucucu

SEQ ID NO: 470358 - RNA, 65 nt, Homo Sapiens
ggcugcugucauagugaacauaaugacauuaauaccucuagaaagucuggagaauuaucacaacc

SEQ ID NO: 470359 - RNA, 65 nt, Homo Sapiens
auuuucuuacaguagauaaggguauacauuccacccucuagaaguugaacuugcagguccagguu

SEQ ID NO: 470360 - RNA, 65 nt, Homo Sapiens
cugugaauuucaacauuauuacuauaacuauaaaucucuagaauucaaauuggugauacuucuaa

SEQ ID NO: 470361 - RNA, 63 nt, Homo Sapiens; identical to SEQ ID NO: 103195

SEQ ID NO: 470362 - RNA, 51 nt, Homo Sapiens; identical to SEQ ID NO: 103196

SEQ ID NO: 470363 - RNA, 65 nt, Homo Sapiens
ccguaggucuauccuuagagcuuuaaugguuuuugcucuagaauaacgauuuccuguagaaguag

SEQ ID NO: 470364 - RNA, 65 nt, Homo Sapiens
guguaccauccaauucgccagugacugggacccuacucuagaacucuccugccuccuggggucca

SEQ ID NO: 470365 - RNA, 65 nt, Homo Sapiens
agguuaaacugaagcaacuucugcauguacuaguccucuagaaauauucccuguaguugacaauu

SEQ ID NO: 470366 - RNA, 65 nt, Homo Sapiens
uccacgcacaugcgaccccgaggaaacgaaacccacucuagaaaacgcgaccuuggccgcaccua

SEQ ID NO: 470367 - RNA, 65 nt, Homo Sapiens
cuugucugcucccacagcaccaucuaagaccccuccucuagaaguggggaaggccagauguguag

SEQ ID NO: 470368 - RNA, 65 nt, Homo Sapiens
aaacuauguauauuuaaauuuaguaauuuucuaaucucuagaaaucucugcuguucaaaaggugg

SEQ ID NO: 470369 - RNA, 65 nt, Homo Sapiens
acauuucuaaaucccaucuugauauacuaugaauacucuagaaugauguaaagcagauaggaaug

SEQ ID NO: 470370 - RNA, 65 nt, Homo Sapiens
aucaaucauguacuuuaguuuaauguauaaagauccucuagaaaaugauaauauuguguauuaag

SEQ ID NO: 470371 - RNA, 65 nt, Homo Sapiens
uucucugguggucucaagacaagaacaagagcugacucuagaaucuucugccuggcugaccucug

SEQ ID NO: 470372 - RNA, 65 nt, Homo Sapiens
ugggucagugauggcaacaggauggccaaggauggcucuagaacacucuguccaugcgucacucc

SEQ ID NO: 470373 - RNA, 65 nt, Homo Sapiens
uccuguccuguccaaugcgggggcacugcagaacucucuagaaaugucaugauugagcuucagag

SEQ ID NO: 470374 - RNA, 65 nt, Homo Sapiens
uccacuuuggagaauacucauggagugacacuacacucuagaauuagaacugaauaaucuuugcc

SEQ ID NO: 470375 - RNA, 65 nt, Homo Sapiens
uuguuuugaacauccuuguacaucaauaaaguuuucucuagaauauauuuuauuuuguuuucaac

SEQ ID NO: 470376 - RNA, 65 nt, Homo Sapiens
cuguauggaaaugcacccucccuccugccgcuccucucuagaaccuucuagaaccugggcugugc

SEQ ID NO: 470377 - RNA, 65 nt, Homo Sapiens
auucuaagggugccaagagacugguuagucaaagccucuagaaggggauccucguugaaaggagc

SEQ ID NO: 470378 - RNA, 65 nt, Homo Sapiens
accauaucuauaaaacaaacauaguaucugucaaucucuagaaaccacaagaugauggagagguc

SEQ ID NO: 470379 - RNA, 65 nt, Homo Sapiens
agguguagggacccugccaaguggcaccugauuuacucuagaaaauaaaaguagaaaauacugag

SEQ ID NO: 470380 - RNA, 65 nt, Homo Sapiens
gugucccugaaguauuuaauaagaagcauuuugcacucuagaaaguauguuuguguugguuuuuu

SEQ ID NO: 470381 - RNA, 65 nt, Homo Sapiens
gugguagauuacuuaucagaaaacauauaugucaucucuagaacgaagaaaaagcauaguaguuc

SEQ ID NO: 470382 - RNA, 65 nt, Homo Sapiens
uggguaggguauaguaucacuccugaguuccacugcucuagaaucuaaccagaaauagaaaccua

SEQ ID NO: 470383 - RNA, 65 nt, Homo Sapiens
guggcguuggugaacggaccaaucagcucacugcucucuagaaacuccccugcucaccauuggag

SEQ ID NO: 470384 - RNA, 65 nt, Homo Sapiens
acuucugaugcaugaaaaaucucgugguucuggagcucuagaaacgcucaggacgugaugaggua

SEQ ID NO: 470385 - RNA, 65 nt, Homo Sapiens
ggugcagacaucccgucugauuuuuaacacagagucucuagaagaagaauguucagucggucgug

SEQ ID NO: 470386 - RNA, 65 nt, Homo Sapiens
ucuggcaaguguccagaugccagaaccuucuuuuccucuagaagggauggugcuugguaaccuua

SEQ ID NO: 470387 - RNA, 65 nt, Homo Sapiens
ccauguaugucgauugauaucgcugcuacaucagacucuagaaaaaagggcugagaggaagcaag

SEQ ID NO: 470388 - RNA, 65 nt, Homo Sapiens
acgauaauuccucaagcaugagaccuugcuaagcacucuagaauaaguuuuauguucugcucaca

SEQ ID NO: 470389 - RNA, 65 nt, Homo Sapiens
gcuacaaaagugcaaauuucucauuuccugugggucucuagaaacucucucaauauuuaaagcca

SEQ ID NO: 470390 - RNA, 65 nt, Homo Sapiens
ccugggcuugguaagugaauuuaugagauuuacugcucuagaaaguauagauggccaaaggaccg

SEQ ID NO: 470391 - RNA, 65 nt, Homo Sapiens
uauacauugauauuuauucuuguuguuuauuaucacucuagaaguauccaucugagauggggucc

SEQ ID NO: 470392 - RNA, 65 nt, Homo Sapiens
ccacugacuuuagugggucuaggacacuuagagcucucuagaaucugauuuuuguaacuuuacgc

SEQ ID NO: 470393 - RNA, 65 nt, Homo Sapiens
cuacuuacaguugaccaagcaccuuuuagccugcucucuagaaccgauaugcccauuugauccua

SEQ ID NO: 470394 - RNA, 65 nt, Homo Sapiens
uccuucuguuggaggcccuccaggcuuuuccuccucucuagaaccccaguacggcccccucuuug

SEQ ID NO: 470395 - RNA, 65 nt, Homo Sapiens
cugcucccucugcaggggguuggcuuccaccucagcucuagaagcgccucaggcccccagcccug

SEQ ID NO: 470396 - RNA, 65 nt, Homo Sapiens
uaaaucucuccugugucuuaaaaaaauauauaucacucuagaaaaaagaaaaaaagaaaaagaac

SEQ ID NO: 470397 - RNA, 65 nt, Homo Sapiens
aacgaguuauucacaccagcuuuuauuuauaagggcucuagaaaaugcaaacacuaacuggggga

SEQ ID NO: 470398 - RNA, 65 nt, Homo Sapiens
ugcugcuacuagaaaugucuaaggcuacacgagcucucuagaaacaaaaaaaaaaaguuuguuaa

SEQ ID NO: 470399 - RNA, 65 nt, Homo Sapiens
cgagccgucacaccucaggcgcagacaccaggccacucuagaagcguuggggccauuagaaugag

SEQ ID NO: 470400 - RNA, 65 nt, Homo Sapiens
cauuccccuggcaugaaacuuucagauuccccugccucuagaaauuguccugcccuccucaccac

SEQ ID NO: 470401 - RNA, 65 nt, Homo Sapiens
uuaacccaugguucucagcuggggugacacugcuccucuagaagcagguuugaaauuauggguau

SEQ ID NO: 470402 - RNA, 65 nt, Homo Sapiens
uguaaaggcccugucccaauauuaagcuguguucacucuagaaggguccuggcuuuuuguugauu

SEQ ID NO: 470403 - RNA, 65 nt, Homo Sapiens
caagguuuuguuuguuaauuuauaacuuccauguucucuagaaauccuacauucuccuugucugg

SEQ ID NO: 470404 - RNA, 65 nt, Homo Sapiens
cguacguaugcacccacagauuaugguaacuucuacucuagaauaauguuucuggugugugaacu

SEQ ID NO: 470405 - RNA, 65 nt, Homo Sapiens
uccagaacccagcccagaucggaggacaaguuccucucuagaacccaauccaauuuggagcccca

SEQ ID NO: 470406 - RNA, 65 nt, Homo Sapiens
uuggagccccagcccaacuccagaacccaacccuucucuagaauccagcccagaucugaggccaa

SEQ ID NO: 470407 - RNA, 65 nt, Homo Sapiens
aaugugguccaaaugcggaucacuggucagauggacucuagaagcacugagcucccugucucugg

SEQ ID NO: 470408 - RNA, 65 nt, Homo Sapiens
cuucaaaaagccucaugcauagcgggucauguagucucuagaaaauacauaaccugauggaaaug

SEQ ID NO: 470409 - RNA, 65 nt, Homo Sapiens
ugguuauuuauauccuauuuuuucucaccccaucucucuagaaacaccuauaaaggcuauuauug

SEQ ID NO: 470410 - RNA, 65 nt, Homo Sapiens
ucuuguauaagauccuagauccuaagggucgaaagcucuagaaucugcaauucaaaaguuccaag

SEQ ID NO: 470411 - RNA, 65 nt, Homo Sapiens
gggcugccgugauggauucuguuugacguauuguucucuagaaggccuggcucugauccagugac

SEQ ID NO: 470412 - RNA, 65 nt, Homo Sapiens
ugcugcugauggagaccaggccagcccucuggcgucucuagaaaccgguccccacccucugcccc

SEQ ID NO: 470413 - RNA, 65 nt, Homo Sapiens
ggagagagguccagauugcgcaaaagcagacaacacucuagaacuugcugacggaggaauuaaca

SEQ ID NO: 470414 - RNA, 65 nt, Homo Sapiens
agaugguaucugaaguccuuuuuggucagcuacgucucuagaauaacccagccccuccccuacuu

SEQ ID NO: 470415 - RNA, 65 nt, Homo Sapiens
aggauguuggggaaaaucccccucaguuuccccaucucuagaaugaaguuguuucucucccuggg

SEQ ID NO: 470416 - RNA, 65 nt, Homo Sapiens
uucucuaaaauuguacucaggacauuuuuauuuaucucuagaaguuuugaaauucaguaauauuu

SEQ ID NO: 470417 - RNA, 65 nt, Homo Sapiens
uaagcuuggugaaagaaggggccuaaauccauguucucuagaaugaaaaguacagugaugagcau

SEQ ID NO: 470418 - RNA, 65 nt, Homo Sapiens
uaauacuugguaauuauacucagagucacagaucacucuagaaucucuagacuguucugggguag

SEQ ID NO: 470419 - RNA, 65 nt, Homo Sapiens
gggguuacuucuccccugggucucccucuggucuacucuagaagaugcccccaggaauggggaac

SEQ ID NO: 470420 - RNA, 65 nt, Homo Sapiens
uucaaaucucucccaacucuaaauucaagguccuccucuagaagugcucccaucuccuuucagaa

SEQ ID NO: 470421 - RNA, 65 nt, Homo Sapiens
auauuggcugucaucaaagggaguuggagaaaccccucuagaaaccuaaggcccuggguucaaga

SEQ ID NO: 470422 - RNA, 65 nt, Homo Sapiens
uggaaauuccuuaacugagcuauacuugguacuugcucuagaacauuugggaaaugacaaacuca

SEQ ID NO: 470423 - RNA, 65 nt, Homo Sapiens
ccaucucuuccagcaccaucaggguuuuaauggcccucuagaauuaccacugagauacacuauuu

SEQ ID NO: 470424 - RNA, 65 nt, Homo Sapiens
ccacaguaggccucucuuugcagggguccuugggccucuagaaggggugaagaaucugggccaac

SEQ ID NO: 470425 - RNA, 65 nt, Homo Sapiens
guaagaaauaaauauuugcucuuggacuucccagccucuagaacugaaucugcuggugccuugau

SEQ ID NO: 470426 - RNA, 65 nt, Homo Sapiens
uaacccugggaaaagggcaugccuuaguuuggauccucuagaaacggcaagggcccaaggacagu

SEQ ID NO: 470427 - RNA, 65 nt, Homo Sapiens
uaaauuuaugaaaauacaaaauuaucuucuucucccucuagaauaacuguauaacuuauuuucuu

SEQ ID NO: 470428 - RNA, 65 nt, Homo Sapiens
ugcuuuguuuuguaagaacucagacacagugaaaucucuagaauccuugcguggaaggagcaaug

SEQ ID NO: 470429 - RNA, 65 nt, Homo Sapiens
cauccaggugucggagcuaaucucagccugucauucucuagaacaguaguuaaaccaaacuacag

SEQ ID NO: 470430 - RNA, 65 nt, Homo Sapiens
agcugggcucucagcuauuuaggacacccccuucucucuagaaagacagucagggacccccauaa

SEQ ID NO: 470431 - RNA, 65 nt, Homo Sapiens
cuaagacgggggcugcuucuccucuucaguauggacucuagaaagucuggcuacaugaauagauu

SEQ ID NO: 470432 - RNA, 65 nt, Homo Sapiens
ccagugcuaacuugggccagcgggguuugggguaucucuagaaaacagcaacugaacagagcucc

SEQ ID NO: 470433 - RNA, 65 nt, Homo Sapiens
gaggcgugacccaggccccuguagcccucagccuccucuagaagcuucuguacuccuuguaggau

SEQ ID NO: 470434 - RNA, 65 nt, Homo Sapiens
gcugccguggccacccccgcugcccagugucugcccucuagaaguaggcuguguuuccagguguu

SEQ ID NO: 470435 - RNA, 65 nt, Homo Sapiens
cauggaaauuaaguguuucguauuuucccauucuacucuagaaagacuaaacaggaaagucgcau

SEQ ID NO: 470436 - RNA, 65 nt, Homo Sapiens
auuuuuaagaaggagggaaucaaguuuuuuaguagcucuagaaacuaucaacuauuuuguaaaug

SEQ ID NO: 470437 - RNA, 65 nt, Homo Sapiens
aacauucugugucaccagcagggcuguccccugggcucuagaaagugugaccagcucagaggaug

SEQ ID NO: 470438 - RNA, 65 nt, Homo Sapiens
aggaagaggcugggggacuagaaagaggcccugcccucuagaaagcucagaucuuggcuucuguu

SEQ ID NO: 470439 - RNA, 65 nt, Homo Sapiens
ucucuuccaagaaugccucuguggugcuguuuggucucuagaaacagggucacuuuuuuaaugua

SEQ ID NO: 470440 - RNA, 65 nt, Homo Sapiens
cucgacugcugcuguuaaaaaacaugcauuagaaucucuagaacacgaggaaaaacagggucuug

SEQ ID NO: 470441 - RNA, 65 nt, Homo Sapiens
uauugugcaaugauuguuaaauuauacugaaguagcucuagaaagacacauguauacaaggcacu

SEQ ID NO: 470442 - RNA, 65 nt, Homo Sapiens
cagccguaguagauguucuacuuuguucugcuguucucuagaaagaauauuugguuuuccuguau

SEQ ID NO: 470443 - RNA, 65 nt, Homo Sapiens
aguacacaucagcauaugagaaucucugagagguccucuagaaaggagagaaaaagcaccucuuu

SEQ ID NO: 470444 - RNA, 65 nt, Homo Sapiens
cuggauucauauauuacaucaacuucccuuuuuaacucuagaaauucucaguaugggguuucccu

SEQ ID NO: 470445 - RNA, 65 nt, Homo Sapiens
ucuggguuccuauggccuuguuggagggggccaggcucuagaacgucuaacacaguggagaaccg

SEQ ID NO: 470446 - RNA, 65 nt, Homo Sapiens
auuugaucacgaucauauuguagucucucaaagugcucuagaaauugucagugguuuacaugaag

SEQ ID NO: 470447 - RNA, 65 nt, Homo Sapiens
aagaaaaguguuuuuagaaaguguuugagagugaccucuagaaaacaaacuauagugauauauca

SEQ ID NO: 470448 - RNA, 65 nt, Homo Sapiens
agcaagacugggccccacaugugagcuuuagcucucucuagaauggugccacccaguagcccaga

SEQ ID NO: 470449 - RNA, 65 nt, Homo Sapiens
uuaagccuuuguugaacugucuggugguuuucaaccucuagaauuacaguugugcaggagguagc

SEQ ID NO: 470450 - RNA, 65 nt, Homo Sapiens
cugucuaacauaccacaugaucauauaccugauuccucuagaaggauaguuuggaguaagggacu

SEQ ID NO: 470451 - RNA, 65 nt, Homo Sapiens
gauguugaaaucuuugccucaauacuguggcuagucucuagaauguaugauauauuacuacuuau

SEQ ID NO: 470452 - RNA, 65 nt, Homo Sapiens
caagccccaugagcagcagucuuagauggugagggcucuagaaacugagugaacugaggaaggug

SEQ ID NO: 470453 - RNA, 65 nt, Homo Sapiens
caaacuauagugauauaucaguguuugggagugaccucuagaaaaaagaaaacuguuuuuagaaa

SEQ ID NO: 470454 - RNA, 65 nt, Homo Sapiens
ggggcgcauugcgauccaacgauggccggggaaggcucuagaaaaccagccgcauccugccugua

SEQ ID NO: 470455 - RNA, 61 nt, Homo Sapiens
auccugcuuucucaaguacuauucuaacauugcgcuuuauaagggaugauauuucuaccac

SEQ ID NO: 470456 - RNA, 61 nt, Homo Sapiens
aaagcccaggaacuucuagaauaacccagaugcgcuuuaauuuuuuuuaauauguuuugau

SEQ ID NO: 470457 - RNA, 61 nt, Homo Sapiens
cuuaauauaucuauggcagacauuuaagaaugcgcuuuaucuagcucaugguaacuuugca

SEQ ID NO: 470458 - RNA, 61 nt, Homo Sapiens
cgguaguuaggaugcucaguugcuaaacacugcgcuuuauuuucuuaaccaguuguggugu

SEQ ID NO: 470459 - RNA, 61 nt, Homo Sapiens
augggauaaaaauaaucgauguauguuacgggcgcuuuaaccaucagcugccucucgaaug

SEQ ID NO: 470460 - RNA, 61 nt, Homo Sapiens
ucggagcgcaaugccaucuaccgccggcgcugcgcuuuauuguucaccuggguggcuggag

SEQ ID NO: 470461 - RNA, 61 nt, Homo Sapiens
uuaauuaccaaaacucuccuucucuguaccagcgcuuuaugguuucccuuaaugauacaag

SEQ ID NO: 470462 - RNA, 61 nt, Homo Sapiens
gaaguggcagaacacuggauuuguguguguggcgcuuuagggugcuggacuguauggcuga

SEQ ID NO: 470463 - RNA, 61 nt, Homo Sapiens
agauuagccugagaaauaauaaacacuuugagcgcuuuaagcccuccccuugcacuuguga

SEQ ID NO: 470464 - RNA, 61 nt, Homo Sapiens
agugacuguuuggcuuauaaacacauugaaugcgcuuuauugcccaugggauauguggugu

SEQ ID NO: 470465 - RNA, 61 nt, Homo Sapiens
aauaacaaguugucccuagcaaaaccgcugagcgcuuuauaauuuugugguguauuuuugu

SEQ ID NO: 470466 - RNA, 61 nt, Homo Sapiens
gaaaaugguuagacugaaaauuuuuaaauaagcgcuuuaauucaguuuuauaaggugauac

SEQ ID NO: 470467 - RNA, 61 nt, Homo Sapiens
cagacaucaguuccauggugcacauggggaagcgcuuuauaacauugucaugugacuggau

SEQ ID NO: 470468 - RNA, 61 nt, Homo Sapiens
aagcauuguuuuaguccaggggcugcagaaugcgcuuuagacucaccucacaggcacauca

SEQ ID NO: 470469 - RNA, 61 nt, Homo Sapiens
auuaguuaaucuuuugcaggcacagacuugagcgcuuuauuauugcaugagucaagucggc

SEQ ID NO: 470470 - RNA, 61 nt, Homo Sapiens
auuuuuaaacuucuaagugaaaguagucugagcgcuuuauaaaauucauauuauugugugu

SEQ ID NO: 470471 - RNA, 61 nt, Homo Sapiens
ugugggagaagagaggagaggccacuguucugcgcuuuaauccccagcacacacacucccu

SEQ ID NO: 470472 - RNA, 61 nt, Homo Sapiens
caugaugacaacacugccucgcguuucaauagcgcuuuauacuuuuuuaaguguuuucuau

SEQ ID NO: 470473 - RNA, 61 nt, Homo Sapiens
cauauuucuuuaaaaugcaaugguuuacaaugcgcuuuagauuugcuauuguaaauauuag

SEQ ID NO: 470474 - RNA, 61 nt, Homo Sapiens
auuugagugauucaauaguucaauugugagggcgcuuuagcguagcuaucuucaccugcgc

SEQ ID NO: 470475 - RNA, 61 nt, Homo Sapiens
uugagcgcauggcaagucacaguccccggcggcgcuuuaguggccgaggugggcuucagua

SEQ ID NO: 470476 - RNA, 61 nt, Homo Sapiens
aagauugaacuuaaaugccccccucccaacagcgcuuuaaaagcgaccucucuugagguag

SEQ ID NO: 470477 - RNA, 61 nt, Homo Sapiens
uuuuuaauagacaaaucacacuuuuucacaagcgcuuuauuugccgccaucucuuaguuuu

SEQ ID NO: 470478 - RNA, 61 nt, Homo Sapiens
auauuauucacagaugcauuuucaacacuaugcgcuuuauccuuggauuuaauuuaaaguc

SEQ ID NO: 470479 - RNA, 61 nt, Homo Sapiens
uccgugugcuuucaguuuuuugaauauuaaggcgcuuuacucaauccaacuugaagucaau

SEQ ID NO: 470480 - RNA, 61 nt, Homo Sapiens
cugccucagaaagcucugcgcuuuccagaaagcgcuuuacccugcaggguuuugcuaaccu

SEQ ID NO: 470481 - RNA, 61 nt, Homo Sapiens
gcuucucuuuggcauauccaacuuaaaggaggcgcuuuauauugagaaccuucacccuuuc

SEQ ID NO: 470482 - RNA, 61 nt, Homo Sapiens
ucauucucccccucucucccuccugugucuugcgcuuuauguuuucuuccguuugauaauu

SEQ ID NO: 470483 - RNA, 61 nt, Homo Sapiens
ccuagagaagccaugugauucccagagccaggcgcuuuacaccuaaaguaguuugacuuuc

SEQ ID NO: 470484 - RNA, 61 nt, Homo Sapiens
cuuguguguguagcuucuuguagcuuagaaagcgcuuuaugcccaugaugucauuucaggc

SEQ ID NO: 470485 - RNA, 62 nt, Homo Sapiens; identical to SEQ ID NO: 103289

SEQ ID NO: 470486 - RNA, 62 nt, Homo Sapiens; identical to SEQ ID NO: 103290

SEQ ID NO: 470487 - RNA, 62 nt, Homo Sapiens; identical to SEQ ID NO: 103291

SEQ ID NO: 470488 - RNA, 62 nt, Homo Sapiens; identical to SEQ ID NO: 103292

SEQ ID NO: 470489 - RNA, 62 nt, Homo Sapiens; identical to SEQ ID NO: 103293

SEQ ID NO: 470490 - RNA, 62 nt, Homo Sapiens; identical to SEQ ID NO: 103294

SEQ ID NO: 470491 - RNA, 62 nt, Homo Sapiens; identical to SEQ ID NO: 103295

SEQ ID NO: 470492 - RNA, 62 nt, Homo Sapiens; identical to SEQ ID NO: 103296

SEQ ID NO: 470493 - RNA, 62 nt, Homo Sapiens; identical to SEQ ID NO: 103297

SEQ ID NO: 470494 - RNA, 62 nt, Homo Sapiens; identical to SEQ ID NO: 103298

SEQ ID NO: 470495 - RNA, 62 nt, Homo Sapiens; identical to SEQ ID NO: 103299

SEQ ID NO: 470496 - RNA, 57 nt, Homo Sapiens; identical to SEQ ID NO: 103300

SEQ ID NO: 470497 - RNA, 62 nt, Homo Sapiens; identical to SEQ ID NO: 103301

SEQ ID NO: 470498 - RNA, 62 nt, Homo Sapiens; identical to SEQ ID NO: 103302

SEQ ID NO: 470499 - RNA, 62 nt, Homo Sapiens; identical to SEQ ID NO: 103303

SEQ ID NO: 470500 - RNA, 62 nt, Homo Sapiens; identical to SEQ ID NO: 103304

SEQ ID NO: 470501 - RNA, 62 nt, Homo Sapiens; identical to SEQ ID NO: 103305

SEQ ID NO: 470502 - RNA, 62 nt, Homo Sapiens; identical to SEQ ID NO: 103306

SEQ ID NO: 470503 - RNA, 62 nt, Homo Sapiens; identical to SEQ ID NO: 103307

SEQ ID NO: 470504 - RNA, 62 nt, Homo Sapiens; identical to SEQ ID NO: 103308

SEQ ID NO: 470505 - RNA, 62 nt, Homo Sapiens; identical to SEQ ID NO: 103309

SEQ ID NO: 470506 - RNA, 62 nt, Homo Sapiens; identical to SEQ ID NO: 103310

SEQ ID NO: 470507 - RNA, 62 nt, Homo Sapiens; identical to SEQ ID NO: 103311

SEQ ID NO: 470508 - RNA, 62 nt, Homo Sapiens; identical to SEQ ID NO: 103312

SEQ ID NO: 470509 - RNA, 62 nt, Homo Sapiens; identical to SEQ ID NO: 103313

SEQ ID NO: 470510 - RNA, 62 nt, Homo Sapiens; identical to SEQ ID NO: 103314

SEQ ID NO: 470511 - RNA, 62 nt, Homo Sapiens; identical to SEQ ID NO: 103315

SEQ ID NO: 470512 - RNA, 62 nt, Homo Sapiens; identical to SEQ ID NO: 103316

SEQ ID NO: 470513 - RNA, 62 nt, Homo Sapiens; identical to SEQ ID NO: 103317

SEQ ID NO: 470514 - RNA, 62 nt, Homo Sapiens; identical to SEQ ID NO: 103318

SEQ ID NO: 470515 - RNA, 62 nt, Homo Sapiens; identical to SEQ ID NO: 103319

SEQ ID NO: 470516 - RNA, 62 nt, Homo Sapiens; identical to SEQ ID NO: 103320

SEQ ID NO: 470517 - RNA, 62 nt, Homo Sapiens; identical to SEQ ID NO: 103321

SEQ ID NO: 470518 - RNA, 62 nt, Homo Sapiens; identical to SEQ ID NO: 103322

SEQ ID NO: 470519 - RNA, 62 nt, Homo Sapiens; identical to SEQ ID NO: 103323

SEQ ID NO: 470520 - RNA, 62 nt, Homo Sapiens; identical to SEQ ID NO: 103324

SEQ ID NO: 470521 - RNA, 62 nt, Homo Sapiens; identical to SEQ ID NO: 103325

SEQ ID NO: 470522 - RNA, 62 nt, Homo Sapiens; identical to SEQ ID NO: 103326

SEQ ID NO: 470523 - RNA, 62 nt, Homo Sapiens; identical to SEQ ID NO: 103327

SEQ ID NO: 470524 - RNA, 62 nt, Homo Sapiens; identical to SEQ ID NO: 103328

SEQ ID NO: 470525 - RNA, 62 nt, Homo Sapiens; identical to SEQ ID NO: 103329

SEQ ID NO: 470526 - RNA, 62 nt, Homo Sapiens; identical to SEQ ID NO: 103330

SEQ ID NO: 470527 - RNA, 62 nt, Homo Sapiens; identical to SEQ ID NO: 103331

SEQ ID NO: 470528 - RNA, 62 nt, Homo Sapiens; identical to SEQ ID NO: 103332

SEQ ID NO: 470529 - RNA, 62 nt, Homo Sapiens; identical to SEQ ID NO: 103333

SEQ ID NO: 470530 - RNA, 62 nt, Homo Sapiens; identical to SEQ ID NO: 103334

SEQ ID NO: 470531 - RNA, 62 nt, Homo Sapiens; identical to SEQ ID NO: 103335

SEQ ID NO: 470532 - RNA, 62 nt, Homo Sapiens; identical to SEQ ID NO: 103336

SEQ ID NO: 470533 - RNA, 62 nt, Homo Sapiens; identical to SEQ ID NO: 103337

SEQ ID NO: 470534 - RNA, 62 nt, Homo Sapiens; identical to SEQ ID NO: 103338

SEQ ID NO: 470535 - RNA, 62 nt, Homo Sapiens; identical to SEQ ID NO: 103339

SEQ ID NO: 470536 - RNA, 62 nt, Homo Sapiens; identical to SEQ ID NO: 103340

SEQ ID NO: 470537 - RNA, 62 nt, Homo Sapiens; identical to SEQ ID NO: 103341

SEQ ID NO: 470538 - RNA, 62 nt, Homo Sapiens; identical to SEQ ID NO: 103342

SEQ ID NO: 470539 - RNA, 62 nt, Homo Sapiens; identical to SEQ ID NO: 103343

SEQ ID NO: 470540 - RNA, 62 nt, Homo Sapiens; identical to SEQ ID NO: 103344

SEQ ID NO: 470541 - RNA, 62 nt, Homo Sapiens; identical to SEQ ID NO: 103345

SEQ ID NO: 470542 - RNA, 62 nt, Homo Sapiens; identical to SEQ ID NO: 103346

SEQ ID NO: 470543 - RNA, 62 nt, Homo Sapiens; identical to SEQ ID NO: 103347

SEQ ID NO: 470544 - RNA, 62 nt, Homo Sapiens; identical to SEQ ID NO: 103348

SEQ ID NO: 470545 - RNA, 62 nt, Homo Sapiens; identical to SEQ ID NO: 103349

SEQ ID NO: 470546 - RNA, 62 nt, Homo Sapiens; identical to SEQ ID NO: 103350

SEQ ID NO: 470547 - RNA, 62 nt, Homo Sapiens; identical to SEQ ID NO: 103351

SEQ ID NO: 470548 - RNA, 62 nt, Homo Sapiens; identical to SEQ ID NO: 103352

SEQ ID NO: 470549 - RNA, 62 nt, Homo Sapiens; identical to SEQ ID NO: 103353

SEQ ID NO: 470550 - RNA, 62 nt, Homo Sapiens; identical to SEQ ID NO: 103354

SEQ ID NO: 470551 - RNA, 62 nt, Homo Sapiens; identical to SEQ ID NO: 103355

SEQ ID NO: 470552 - RNA, 62 nt, Homo Sapiens; identical to SEQ ID NO: 103356

SEQ ID NO: 470553 - RNA, 62 nt, Homo Sapiens; identical to SEQ ID NO: 103357

SEQ ID NO: 470554 - RNA, 62 nt, Homo Sapiens; identical to SEQ ID NO: 103358

SEQ ID NO: 470555 - RNA, 62 nt, Homo Sapiens; identical to SEQ ID NO: 103359

SEQ ID NO: 470556 - RNA, 62 nt, Homo Sapiens; identical to SEQ ID NO: 103360

SEQ ID NO: 470557 - RNA, 62 nt, Homo Sapiens; identical to SEQ ID NO: 103361

SEQ ID NO: 470558 - RNA, 62 nt, Homo Sapiens; identical to SEQ ID NO: 103362

SEQ ID NO: 470559 - RNA, 62 nt, Homo Sapiens; identical to SEQ ID NO: 103363

SEQ ID NO: 470560 - RNA, 62 nt, Homo Sapiens; identical to SEQ ID NO: 103364

SEQ ID NO: 470561 - RNA, 62 nt, Homo Sapiens; identical to SEQ ID NO: 103365

SEQ ID NO: 470562 - RNA, 62 nt, Homo Sapiens; identical to SEQ ID NO: 103366

SEQ ID NO: 470563 - RNA, 62 nt, Homo Sapiens; identical to SEQ ID NO: 103367

SEQ ID NO: 470564 - RNA, 62 nt, Homo Sapiens; identical to SEQ ID NO: 103368

SEQ ID NO: 470565 - RNA, 62 nt, Homo Sapiens; identical to SEQ ID NO: 103369

SEQ ID NO: 470566 - RNA, 62 nt, Homo Sapiens; identical to SEQ ID NO: 103370

SEQ ID NO: 470567 - RNA, 62 nt, Homo Sapiens; identical to SEQ ID NO: 103371

SEQ ID NO: 470568 - RNA, 59 nt, Homo Sapiens; identical to SEQ ID NO: 103372

SEQ ID NO: 470569 - RNA, 62 nt, Homo Sapiens; identical to SEQ ID NO: 103373

SEQ ID NO: 470570 - RNA, 62 nt, Homo Sapiens; identical to SEQ ID NO: 103374

SEQ ID NO: 470571 - RNA, 62 nt, Homo Sapiens; identical to SEQ ID NO: 103375

SEQ ID NO: 470572 - RNA, 62 nt, Homo Sapiens; identical to SEQ ID NO: 103376

SEQ ID NO: 470573 - RNA, 62 nt, Homo Sapiens; identical to SEQ ID NO: 103377

SEQ ID NO: 470574 - RNA, 62 nt, Homo Sapiens; identical to SEQ ID NO: 103378

SEQ ID NO: 470575 - RNA, 62 nt, Homo Sapiens; identical to SEQ ID NO: 103379

SEQ ID NO: 470576 - RNA, 62 nt, Homo Sapiens; identical to SEQ ID NO: 103380

SEQ ID NO: 470577 - RNA, 62 nt, Homo Sapiens; identical to SEQ ID NO: 103381

SEQ ID NO: 470578 - RNA, 62 nt, Homo Sapiens; identical to SEQ ID NO: 103382

SEQ ID NO: 470579 - RNA, 62 nt, Homo Sapiens; identical to SEQ ID NO: 103383

SEQ ID NO: 470580 - RNA, 62 nt, Homo Sapiens; identical to SEQ ID NO: 103384

SEQ ID NO: 470581 - RNA, 62 nt, Homo Sapiens; identical to SEQ ID NO: 103385

SEQ ID NO: 470582 - RNA, 62 nt, Homo Sapiens; identical to SEQ ID NO: 103386

SEQ ID NO: 470583 - RNA, 62 nt, Homo Sapiens; identical to SEQ ID NO: 103387

SEQ ID NO: 470584 - RNA, 62 nt, Homo Sapiens; identical to SEQ ID NO: 103388

SEQ ID NO: 470585 - RNA, 62 nt, Homo Sapiens; identical to SEQ ID NO: 103389

SEQ ID NO: 470586 - RNA, 62 nt, Homo Sapiens; identical to SEQ ID NO: 103390

SEQ ID NO: 470587 - RNA, 62 nt, Homo Sapiens; identical to SEQ ID NO: 103391

SEQ ID NO: 470588 - RNA, 62 nt, Homo Sapiens; identical to SEQ ID NO: 103392

SEQ ID NO: 470589 - RNA, 60 nt, Homo Sapiens; identical to SEQ ID NO: 103393

SEQ ID NO: 470590 - RNA, 62 nt, Homo Sapiens; identical to SEQ ID NO: 103394

SEQ ID NO: 470591 - RNA, 62 nt, Homo Sapiens; identical to SEQ ID NO: 103395

SEQ ID NO: 470592 - RNA, 62 nt, Homo Sapiens; identical to SEQ ID NO: 103396

SEQ ID NO: 470593 - RNA, 62 nt, Homo Sapiens; identical to SEQ ID NO: 103397

SEQ ID NO: 470594 - RNA, 62 nt, Homo Sapiens; identical to SEQ ID NO: 103398

SEQ ID NO: 470595 - RNA, 62 nt, Homo Sapiens; identical to SEQ ID NO: 103399

SEQ ID NO: 470596 - RNA, 62 nt, Homo Sapiens; identical to SEQ ID NO: 103400

SEQ ID NO: 470597 - RNA, 62 nt, Homo Sapiens; identical to SEQ ID NO: 103401

SEQ ID NO: 470598 - RNA, 62 nt, Homo Sapiens; identical to SEQ ID NO: 103402

SEQ ID NO: 470599 - RNA, 62 nt, Homo Sapiens; identical to SEQ ID NO: 103403

SEQ ID NO: 470600 - RNA, 62 nt, Homo Sapiens; identical to SEQ ID NO: 103404

SEQ ID NO: 470601 - RNA, 62 nt, Homo Sapiens; identical to SEQ ID NO: 103405

SEQ ID NO: 470602 - RNA, 62 nt, Homo Sapiens; identical to SEQ ID NO: 103406

SEQ ID NO: 470603 - RNA, 62 nt, Homo Sapiens; identical to SEQ ID NO: 103407

SEQ ID NO: 470604 - RNA, 62 nt, Homo Sapiens; identical to SEQ ID NO: 103408

SEQ ID NO: 470605 - RNA, 62 nt, Homo Sapiens; identical to SEQ ID NO: 103409

SEQ ID NO: 470606 - RNA, 62 nt, Homo Sapiens; identical to SEQ ID NO: 103410

SEQ ID NO: 470607 - RNA, 62 nt, Homo Sapiens; identical to SEQ ID NO: 103411

SEQ ID NO: 470608 - RNA, 62 nt, Homo Sapiens; identical to SEQ ID NO: 103412

SEQ ID NO: 470609 - RNA, 62 nt, Homo Sapiens; identical to SEQ ID NO: 103413

SEQ ID NO: 470610 - RNA, 62 nt, Homo Sapiens; identical to SEQ ID NO: 103414

SEQ ID NO: 470611 - RNA, 62 nt, Homo Sapiens; identical to SEQ ID NO: 103415

SEQ ID NO: 470612 - RNA, 62 nt, Homo Sapiens; identical to SEQ ID NO: 103416

SEQ ID NO: 470613 - RNA, 62 nt, Homo Sapiens; identical to SEQ ID NO: 103417

SEQ ID NO: 470614 - RNA, 62 nt, Homo Sapiens; identical to SEQ ID NO: 103418

SEQ ID NO: 470615 - RNA, 62 nt, Homo Sapiens; identical to SEQ ID NO: 103419

SEQ ID NO: 470616 - RNA, 62 nt, Homo Sapiens; identical to SEQ ID NO: 103420

SEQ ID NO: 470617 - RNA, 62 nt, Homo Sapiens; identical to SEQ ID NO: 103421

SEQ ID NO: 470618 - RNA, 62 nt, Homo Sapiens; identical to SEQ ID NO: 103422

SEQ ID NO: 470619 - RNA, 62 nt, Homo Sapiens; identical to SEQ ID NO: 103423

SEQ ID NO: 470620 - RNA, 62 nt, Homo Sapiens; identical to SEQ ID NO: 103424

SEQ ID NO: 470621 - RNA, 62 nt, Homo Sapiens; identical to SEQ ID NO: 103425

SEQ ID NO: 470622 - RNA, 62 nt, Homo Sapiens; identical to SEQ ID NO: 103426

SEQ ID NO: 470623 - RNA, 62 nt, Homo Sapiens; identical to SEQ ID NO: 103427

SEQ ID NO: 470624 - RNA, 62 nt, Homo Sapiens; identical to SEQ ID NO: 103428

SEQ ID NO: 470625 - RNA, 62 nt, Homo Sapiens; identical to SEQ ID NO: 103429

SEQ ID NO: 470626 - RNA, 62 nt, Homo Sapiens; identical to SEQ ID NO: 103430

SEQ ID NO: 470627 - RNA, 62 nt, Homo Sapiens; identical to SEQ ID NO: 103431

SEQ ID NO: 470628 - RNA, 62 nt, Homo Sapiens; identical to SEQ ID NO: 103432

SEQ ID NO: 470629 - RNA, 62 nt, Homo Sapiens; identical to SEQ ID NO: 103433

SEQ ID NO: 470630 - RNA, 62 nt, Homo Sapiens; identical to SEQ ID NO: 103434

SEQ ID NO: 470631 - RNA, 62 nt, Homo Sapiens; identical to SEQ ID NO: 103435

SEQ ID NO: 470632 - RNA, 62 nt, Homo Sapiens; identical to SEQ ID NO: 103436

SEQ ID NO: 470633 - RNA, 62 nt, Homo Sapiens; identical to SEQ ID NO: 103437

SEQ ID NO: 470634 - RNA, 62 nt, Homo Sapiens; identical to SEQ ID NO: 103438

SEQ ID NO: 470635 - RNA, 62 nt, Homo Sapiens; identical to SEQ ID NO: 103439

SEQ ID NO: 470636 - RNA, 62 nt, Homo Sapiens; identical to SEQ ID NO: 103440

SEQ ID NO: 470637 - RNA, 62 nt, Homo Sapiens; identical to SEQ ID NO: 103441

SEQ ID NO: 470638 - RNA, 62 nt, Homo Sapiens; identical to SEQ ID NO: 103442

SEQ ID NO: 470639 - RNA, 62 nt, Homo Sapiens; identical to SEQ ID NO: 103443

SEQ ID NO: 470640 - RNA, 62 nt, Homo Sapiens; identical to SEQ ID NO: 103444

SEQ ID NO: 470641 - RNA, 62 nt, Homo Sapiens; identical to SEQ ID NO: 103445

SEQ ID NO: 470642 - RNA, 62 nt, Homo Sapiens; identical to SEQ ID NO: 103446

SEQ ID NO: 470643 - RNA, 62 nt, Homo Sapiens; identical to SEQ ID NO: 103447

SEQ ID NO: 470644 - RNA, 62 nt, Homo Sapiens; identical to SEQ ID NO: 103448

SEQ ID NO: 470645 - RNA, 62 nt, Homo Sapiens; identical to SEQ ID NO: 103449

SEQ ID NO: 470646 - RNA, 62 nt, Homo Sapiens; identical to SEQ ID NO: 103450

SEQ ID NO: 470647 - RNA, 62 nt, Homo Sapiens; identical to SEQ ID NO: 103451

SEQ ID NO: 470648 - RNA, 62 nt, Homo Sapiens; identical to SEQ ID NO: 103452

SEQ ID NO: 470649 - RNA, 62 nt, Homo Sapiens; identical to SEQ ID NO: 103453

SEQ ID NO: 470650 - RNA, 62 nt, Homo Sapiens; identical to SEQ ID NO: 103454

SEQ ID NO: 470651 - RNA, 62 nt, Homo Sapiens; identical to SEQ ID NO: 103455

SEQ ID NO: 470652 - RNA, 62 nt, Homo Sapiens; identical to SEQ ID NO: 103456

SEQ ID NO: 470653 - RNA, 62 nt, Homo Sapiens; identical to SEQ ID NO: 103457

SEQ ID NO: 470654 - RNA, 62 nt, Homo Sapiens; identical to SEQ ID NO: 103458

SEQ ID NO: 470655 - RNA, 62 nt, Homo Sapiens; identical to SEQ ID NO: 103459

SEQ ID NO: 470656 - RNA, 62 nt, Homo Sapiens; identical to SEQ ID NO: 103460

SEQ ID NO: 470657 - RNA, 62 nt, Homo Sapiens; identical to SEQ ID NO: 103461

SEQ ID NO: 470658 - RNA, 62 nt, Homo Sapiens; identical to SEQ ID NO: 103462

SEQ ID NO: 470659 - RNA, 62 nt, Homo Sapiens; identical to SEQ ID NO: 103463

SEQ ID NO: 470660 - RNA, 62 nt, Homo Sapiens; identical to SEQ ID NO: 103464

SEQ ID NO: 470661 - RNA, 62 nt, Homo Sapiens; identical to SEQ ID NO: 103465

SEQ ID NO: 470662 - RNA, 62 nt, Homo Sapiens; identical to SEQ ID NO: 103466

SEQ ID NO: 470663 - RNA, 62 nt, Homo Sapiens; identical to SEQ ID NO: 103467

SEQ ID NO: 470664 - RNA, 62 nt, Homo Sapiens; identical to SEQ ID NO: 103468

SEQ ID NO: 470665 - RNA, 62 nt, Homo Sapiens; identical to SEQ ID NO: 103469

SEQ ID NO: 470666 - RNA, 62 nt, Homo Sapiens; identical to SEQ ID NO: 103470

SEQ ID NO: 470667 - RNA, 62 nt, Homo Sapiens; identical to SEQ ID NO: 103471

SEQ ID NO: 470668 - RNA, 62 nt, Homo Sapiens; identical to SEQ ID NO: 103472

SEQ ID NO: 470669 - RNA, 62 nt, Homo Sapiens; identical to SEQ ID NO: 103473

SEQ ID NO: 470670 - RNA, 62 nt, Homo Sapiens; identical to SEQ ID NO: 103474

SEQ ID NO: 470671 - RNA, 62 nt, Homo Sapiens; identical to SEQ ID NO: 103475

SEQ ID NO: 470672 - RNA, 62 nt, Homo Sapiens; identical to SEQ ID NO: 103476

SEQ ID NO: 470673 - RNA, 62 nt, Homo Sapiens; identical to SEQ ID NO: 103477

SEQ ID NO: 470674 - RNA, 62 nt, Homo Sapiens; identical to SEQ ID NO: 103478

SEQ ID NO: 470675 - RNA, 62 nt, Homo Sapiens; identical to SEQ ID NO: 103479

SEQ ID NO: 470676 - RNA, 62 nt, Homo Sapiens; identical to SEQ ID NO: 103480

SEQ ID NO: 470677 - RNA, 62 nt, Homo Sapiens; identical to SEQ ID NO: 103481

SEQ ID NO: 470678 - RNA, 62 nt, Homo Sapiens; identical to SEQ ID NO: 103482

SEQ ID NO: 470679 - RNA, 62 nt, Homo Sapiens; identical to SEQ ID NO: 103483

SEQ ID NO: 470680 - RNA, 62 nt, Homo Sapiens; identical to SEQ ID NO: 103484

SEQ ID NO: 470681 - RNA, 62 nt, Homo Sapiens; identical to SEQ ID NO: 103485

SEQ ID NO: 470682 - RNA, 62 nt, Homo Sapiens; identical to SEQ ID NO: 103486

SEQ ID NO: 470683 - RNA, 62 nt, Homo Sapiens; identical to SEQ ID NO: 103487

SEQ ID NO: 470684 - RNA, 62 nt, Homo Sapiens; identical to SEQ ID NO: 103488

SEQ ID NO: 470685 - RNA, 62 nt, Homo Sapiens; identical to SEQ ID NO: 103489

SEQ ID NO: 470686 - RNA, 62 nt, Homo Sapiens; identical to SEQ ID NO: 103490

SEQ ID NO: 470687 - RNA, 62 nt, Homo Sapiens; identical to SEQ ID NO: 103491

SEQ ID NO: 470688 - RNA, 62 nt, Homo Sapiens; identical to SEQ ID NO: 103492

SEQ ID NO: 470689 - RNA, 62 nt, Homo Sapiens; identical to SEQ ID NO: 103493

SEQ ID NO: 470690 - RNA, 62 nt, Homo Sapiens; identical to SEQ ID NO: 103494

SEQ ID NO: 470691 - RNA, 62 nt, Homo Sapiens; identical to SEQ ID NO: 103495

SEQ ID NO: 470692 - RNA, 62 nt, Homo Sapiens; identical to SEQ ID NO: 103496

SEQ ID NO: 470693 - RNA, 62 nt, Homo Sapiens; identical to SEQ ID NO: 103497

SEQ ID NO: 470694 - RNA, 62 nt, Homo Sapiens; identical to SEQ ID NO: 103498

SEQ ID NO: 470695 - RNA, 62 nt, Homo Sapiens; identical to SEQ ID NO: 103499

SEQ ID NO: 470696 - RNA, 62 nt, Homo Sapiens; identical to SEQ ID NO: 103500

SEQ ID NO: 470697 - RNA, 62 nt, Homo Sapiens; identical to SEQ ID NO: 103501

SEQ ID NO: 470698 - RNA, 62 nt, Homo Sapiens; identical to SEQ ID NO: 103502

SEQ ID NO: 470699 - RNA, 62 nt, Homo Sapiens; identical to SEQ ID NO: 103503

SEQ ID NO: 470700 - RNA, 62 nt, Homo Sapiens; identical to SEQ ID NO: 103504

SEQ ID NO: 470701 - RNA, 62 nt, Homo Sapiens; identical to SEQ ID NO: 103505

SEQ ID NO: 470702 - RNA, 62 nt, Homo Sapiens; identical to SEQ ID NO: 103506

SEQ ID NO: 470703 - RNA, 62 nt, Homo Sapiens; identical to SEQ ID NO: 103507

SEQ ID NO: 470704 - RNA, 64 nt, Homo Sapiens; identical to SEQ ID NO: 257499

SEQ ID NO: 470705 - RNA, 64 nt, Homo Sapiens; identical to SEQ ID NO: 257500

SEQ ID NO: 470706 - RNA, 64 nt, Homo Sapiens; identical to SEQ ID NO: 257501

SEQ ID NO: 470707 - RNA, 64 nt, Homo Sapiens; identical to SEQ ID NO: 257502

SEQ ID NO: 470708 - RNA, 64 nt, Homo Sapiens
auacgaaauaucugcuuuuggaauaagcagaaugaggcuaaacauggguuauacaaaggguauc

SEQ ID NO: 470709 - RNA, 64 nt, Homo Sapiens
aaacaaugcauucuugcuuuaaaaaaaaaaaagaaggcuaaaaaauuaccucuuuuuaaauuau

SEQ ID NO: 470710 - RNA, 64 nt, Homo Sapiens
acauucagaaauguggcaaaaaaggcauagcuaaaggcuaaacauauggcuuuaguaguaacaa

SEQ ID NO: 470711 - RNA, 64 nt, Homo Sapiens
ucaacaauaagccacgucaaugcauaaguuguauaggcuaaauguugcuuguaggcuacauuaa

SEQ ID NO: 470712 - RNA, 64 nt, Homo Sapiens
uuuaacguagauauuuuuauaagcuauagcuuuuaggcuaaaauauugccuuuuuauaaaauug

SEQ ID NO: 470713 - RNA, 64 nt, Homo Sapiens
auccagcuuugggggaccuggaagccuucagaagaggcuaaaaucaagguacccagaauuuuua

SEQ ID NO: 470714 - RNA, 64 nt, Homo Sapiens
cugucuucuguugggaacagccaaagggauuccaaggcuaaaucuuuguaacagcucucuuucc

SEQ ID NO: 470715 - RNA, 64 nt, Homo Sapiens
gccagcucauuuccuucaauuuccuuugaccuauaggcuaaaaaagaaaggcucauuccagcca

SEQ ID NO: 470716 - RNA, 64 nt, Homo Sapiens; identical to SEQ ID NO: 454921

SEQ ID NO: 470717 - RNA, 64 nt, Homo Sapiens; identical to SEQ ID NO: 454922

SEQ ID NO: 470718 - RNA, 64 nt, Homo Sapiens; identical to SEQ ID NO: 454923

SEQ ID NO: 470719 - RNA, 64 nt, Homo Sapiens; identical to SEQ ID NO: 454924

SEQ ID NO: 470720 - RNA, 64 nt, Homo Sapiens; identical to SEQ ID NO: 454925

SEQ ID NO: 470721 - RNA, 64 nt, Homo Sapiens; identical to SEQ ID NO: 454926

SEQ ID NO: 470722 - RNA, 64 nt, Homo Sapiens; identical to SEQ ID NO: 454927

SEQ ID NO: 470723 - RNA, 64 nt, Homo Sapiens; identical to SEQ ID NO: 454928

SEQ ID NO: 470724 - RNA, 64 nt, Homo Sapiens; identical to SEQ ID NO: 454929

SEQ ID NO: 470725 - RNA, 64 nt, Homo Sapiens; identical to SEQ ID NO: 454930

SEQ ID NO: 470726 - RNA, 64 nt, Homo Sapiens; identical to SEQ ID NO: 454931

SEQ ID NO: 470727 - RNA, 64 nt, Homo Sapiens; identical to SEQ ID NO: 454932

SEQ ID NO: 470728 - RNA, 64 nt, Homo Sapiens; identical to SEQ ID NO: 454933

SEQ ID NO: 470729 - RNA, 64 nt, Homo Sapiens; identical to SEQ ID NO: 454934

SEQ ID NO: 470730 - RNA, 64 nt, Homo Sapiens; identical to SEQ ID NO: 454935

SEQ ID NO: 470731 - RNA, 64 nt, Homo Sapiens; identical to SEQ ID NO: 454936

SEQ ID NO: 470732 - RNA, 64 nt, Homo Sapiens; identical to SEQ ID NO: 454937

SEQ ID NO: 470733 - RNA, 64 nt, Homo Sapiens; identical to SEQ ID NO: 454938

SEQ ID NO: 470734 - RNA, 64 nt, Homo Sapiens; identical to SEQ ID NO: 454939

SEQ ID NO: 470735 - RNA, 64 nt, Homo Sapiens; identical to SEQ ID NO: 454940

SEQ ID NO: 470736 - RNA, 64 nt, Homo Sapiens; identical to SEQ ID NO: 454941

SEQ ID NO: 470737 - RNA, 64 nt, Homo Sapiens; identical to SEQ ID NO: 454942

SEQ ID NO: 470738 - RNA, 64 nt, Homo Sapiens; identical to SEQ ID NO: 454943

SEQ ID NO: 470739 - RNA, 64 nt, Homo Sapiens; identical to SEQ ID NO: 454944

SEQ ID NO: 470740 - RNA, 64 nt, Homo Sapiens; identical to SEQ ID NO: 454945

SEQ ID NO: 470741 - RNA, 64 nt, Homo Sapiens; identical to SEQ ID NO: 454946

SEQ ID NO: 470742 - RNA, 64 nt, Homo Sapiens; identical to SEQ ID NO: 454947

SEQ ID NO: 470743 - RNA, 64 nt, Homo Sapiens; identical to SEQ ID NO: 454948

SEQ ID NO: 470744 - RNA, 64 nt, Homo Sapiens; identical to SEQ ID NO: 454949

SEQ ID NO: 470745 - RNA, 64 nt, Homo Sapiens; identical to SEQ ID NO: 454950

SEQ ID NO: 470746 - RNA, 64 nt, Homo Sapiens; identical to SEQ ID NO: 454951

SEQ ID NO: 470747 - RNA, 64 nt, Homo Sapiens; identical to SEQ ID NO: 454952

SEQ ID NO: 470748 - RNA, 64 nt, Homo Sapiens; identical to SEQ ID NO: 454953

SEQ ID NO: 470749 - RNA, 64 nt, Homo Sapiens; identical to SEQ ID NO: 454954

SEQ ID NO: 470750 - RNA, 64 nt, Homo Sapiens; identical to SEQ ID NO: 454955

SEQ ID NO: 470751 - RNA, 64 nt, Homo Sapiens; identical to SEQ ID NO: 454956

SEQ ID NO: 470752 - RNA, 64 nt, Homo Sapiens; identical to SEQ ID NO: 454957

SEQ ID NO: 470753 - RNA, 64 nt, Homo Sapiens; identical to SEQ ID NO: 454958

SEQ ID NO: 470754 - RNA, 64 nt, Homo Sapiens; identical to SEQ ID NO: 454959

SEQ ID NO: 470755 - RNA, 64 nt, Homo Sapiens; identical to SEQ ID NO: 454960

SEQ ID NO: 470756 - RNA, 64 nt, Homo Sapiens; identical to SEQ ID NO: 454961

SEQ ID NO: 470757 - RNA, 64 nt, Homo Sapiens; identical to SEQ ID NO: 454962

SEQ ID NO: 470758 - RNA, 64 nt, Homo Sapiens; identical to SEQ ID NO: 454963

SEQ ID NO: 470759 - RNA, 64 nt, Homo Sapiens; identical to SEQ ID NO: 454964

SEQ ID NO: 470760 - RNA, 64 nt, Homo Sapiens; identical to SEQ ID NO: 454965

SEQ ID NO: 470761 - RNA, 64 nt, Homo Sapiens; identical to SEQ ID NO: 454966

SEQ ID NO: 470762 - RNA, 64 nt, Homo Sapiens; identical to SEQ ID NO: 454967

SEQ ID NO: 470763 - RNA, 64 nt, Homo Sapiens; identical to SEQ ID NO: 454968

SEQ ID NO: 470764 - RNA, 64 nt, Homo Sapiens; identical to SEQ ID NO: 454969

SEQ ID NO: 470765 - RNA, 64 nt, Homo Sapiens; identical to SEQ ID NO: 454970

SEQ ID NO: 470766 - RNA, 64 nt, Homo Sapiens; identical to SEQ ID NO: 454971

SEQ ID NO: 470767 - RNA, 64 nt, Homo Sapiens; identical to SEQ ID NO: 454972

SEQ ID NO: 470768 - RNA, 64 nt, Homo Sapiens; identical to SEQ ID NO: 454973

SEQ ID NO: 470769 - RNA, 64 nt, Homo Sapiens; identical to SEQ ID NO: 454974

SEQ ID NO: 470770 - RNA, 64 nt, Homo Sapiens; identical to SEQ ID NO: 454975

SEQ ID NO: 470771 - RNA, 64 nt, Homo Sapiens; identical to SEQ ID NO: 454976

SEQ ID NO: 470772 - RNA, 64 nt, Homo Sapiens; identical to SEQ ID NO: 454977

SEQ ID NO: 470773 - RNA, 64 nt, Homo Sapiens; identical to SEQ ID NO: 454978

SEQ ID NO: 470774 - RNA, 64 nt, Homo Sapiens; identical to SEQ ID NO: 454979

SEQ ID NO: 470775 - RNA, 64 nt, Homo Sapiens; identical to SEQ ID NO: 454980

SEQ ID NO: 470776 - RNA, 64 nt, Homo Sapiens; identical to SEQ ID NO: 454981

SEQ ID NO: 470777 - RNA, 64 nt, Homo Sapiens; identical to SEQ ID NO: 454982

SEQ ID NO: 470778 - RNA, 64 nt, Homo Sapiens; identical to SEQ ID NO: 454983

SEQ ID NO: 470779 - RNA, 64 nt, Homo Sapiens; identical to SEQ ID NO: 454984

SEQ ID NO: 470780 - RNA, 64 nt, Homo Sapiens; identical to SEQ ID NO: 454985

SEQ ID NO: 470781 - RNA, 62 nt, Homo Sapiens
uauugacugcagagucuauuuaagcaugugguuuuaaaaauagacaguauuuuuuaaaaauc

SEQ ID NO: 470782 - RNA, 62 nt, Homo Sapiens
uaagcaugugguuuuaaaaauagacaguauuuuuuaaaaaucaaaaaaugacuugcaaauug

SEQ ID NO: 470783 - RNA, 62 nt, Homo Sapiens
aaaagaagagaaaaaaaaugcccaaguugcccuuuaaaaaaaaagagcguaaauacaaacag

SEQ ID NO: 470784 - RNA, 62 nt, Homo Sapiens
ugaaauauuuuaagccaaaaaaaaauucccuuuuuaaaaaaggggguuuaaauacuguuggc

SEQ ID NO: 470785 - RNA, 62 nt, Homo Sapiens
agcuuguggauuaaacagaauaaauuucuaaauuuaaaaauuuugccacucuuacuuaguag

SEQ ID NO: 470786 - RNA, 62 nt, Homo Sapiens
ccauucauuuggaacuuuauugcauucuuuauuuuaaaaagcuuguuuuuacguaaucauag

SEQ ID NO: 470787 - RNA, 62 nt, Homo Sapiens
aggggagcauccauuauugauacaugugggcuuuuaaaaacuccauccuuuauaaauaguca

SEQ ID NO: 470788 - RNA, 62 nt, Homo Sapiens
auuuucuugaauacuuuuuucauaguuauuuguuuaaaaagauuuaaaaaucauugcacuuu

SEQ ID NO: 470789 - RNA, 62 nt, Homo Sapiens
auacuuuuuucauaguuauuuguuuaaaaagauuuaaaaaucauugcacuuuggucagaaaa

SEQ ID NO: 470790 - RNA, 62 nt, Homo Sapiens
ccaaaggaauauucuuuuacaccaauucuuccuuuaaaaaucucugaggaauuuguuuucgc

SEQ ID NO: 470791 - RNA, 62 nt, Homo Sapiens
augguauuuuuauguaaagccuugacccaauguuuaaaaauauaauuguauuuagaucuugu

SEQ ID NO: 470792 - RNA, 62 nt, Homo Sapiens
uucuagauuguuaaaauuggcaaaugaacuuuuuuaaaaaucaucuuccauguugcaguuag

SEQ ID NO: 470793 - RNA, 62 nt, Homo Sapiens
gauuacauaaguaaguauuccccauauaaucuuuuaaaaaguuguguaugauuauuuuaaaa

SEQ ID NO: 470794 - RNA, 62 nt, Homo Sapiens
uccauaaaguuucagccauuaugggcacugguuuuaaaaaauuuauuaguuugacuauuuga

SEQ ID NO: 470795 - RNA, 62 nt, Homo Sapiens
gacuauuugauguuuuuauagugauugccaacuuuaaaaaguaggcuguucauaagcacuga

SEQ ID NO: 470796 - RNA, 62 nt, Homo Sapiens
uuuuuuaaaaguuuugaaaugcugcacuuacauuuaaaaaaacaacaacaacauuuuuucaa

SEQ ID NO: 470797 - RNA, 62 nt, Homo Sapiens
uuuuauguuuuuuauuguuaaacuuguaucccuuuaaaaacugaaggaaauuaaaaaaaaaa

SEQ ID NO: 470798 - RNA, 62 nt, Homo Sapiens
gaacucuaaaacugcaacaucugacaaauagcuuuaaaaauacaaugauuauaaguauggaa

SEQ ID NO: 470799 - RNA, 62 nt, Homo Sapiens
uuauuucaaguaauaaaucugaauucuauuaguuuaaaaauuguaaaauucaaguuaaauga

SEQ ID NO: 470800 - RNA, 62 nt, Homo Sapiens
acuuuaaagcugucagacucuuuuaaggguauuuuaaaaauuaguaaauuugaaugaacuaa

SEQ ID NO: 470801 - RNA, 62 nt, Homo Sapiens
uuaugcuagcaugauuuuuuuauauauagaaguuuaaaaauaaaccaggucagguuuguaua

SEQ ID NO: 470802 - RNA, 62 nt, Homo Sapiens
uguugcaguguuggagaugccauuuucaccuuuuuaaaaagaugcauuuuauuugcagguuu

SEQ ID NO: 470803 - RNA, 62 nt, Homo Sapiens
auacauuuuaggaaauguuacuuuuguuaaucuuuaaaaaauacaccuaaugaaagacauuc

SEQ ID NO: 470804 - RNA, 62 nt, Homo Sapiens
cagccacuauaacuugauaagucauugcacuauuuaaaaaguuuuaguaauaucaugaauuu

SEQ ID NO: 470805 - RNA, 62 nt, Homo Sapiens
ucacucuguuucucuucugcuggauuauauaauuuaaaaauaauguguucccguauuuugua

SEQ ID NO: 470806 - RNA, 62 nt, Homo Sapiens
ugacauuauugucuccauaauugagugauagcuuuaaaaaaaagauuaguuuugcuuaagaa

SEQ ID NO: 470807 - RNA, 62 nt, Homo Sapiens
agugcauuuggaugagauagaagaaauuguuuuuuaaaaaguuuaaguaccaaagguagucu

SEQ ID NO: 470808 - RNA, 62 nt, Homo Sapiens
uacauuguaaaauaaaguugagcuuaguuuuuuuuaaaaaaaaaaacaaagcaacaaauuaa

SEQ ID NO: 470809 - RNA, 62 nt, Homo Sapiens
augcuaucacugucuuugacugugauuuuauguuuaaaaaguauguucuaaaauuauuauau

SEQ ID NO: 470810 - RNA, 62 nt, Homo Sapiens
aaaacaaagaaaugguaaaugaauuguuugcauuuaaaaaaaaaaacucuuaagaaaacugu

SEQ ID NO: 470811 - RNA, 62 nt, Homo Sapiens
uaaaguguauauuuuuguguccaguuauauuauuuaaaaaaguguuacuuuguaaaaauugu

SEQ ID NO: 470812 - RNA, 62 nt, Homo Sapiens
cuuucauucccacaaaaccaguauuacuuuuuuuuaaaaaaagaaagaaauuggaaaucugu

SEQ ID NO: 470813 - RNA, 62 nt, Homo Sapiens
aucuagaugaagggagcuuuuggaugugugccuuuaaaaacugauuauguauaaauacugau

SEQ ID NO: 470814 - RNA, 62 nt, Homo Sapiens
uuuuggaauuugguugaagucacuuugauuucuuuaaaaaacaucuuuucaaugaaaugugu

SEQ ID NO: 470815 - RNA, 62 nt, Homo Sapiens
cagugcaauuaaaccgagagaugucuuguuuuuuuaaaaagaauaguauuuaauagguuucu

SEQ ID NO: 470816 - RNA, 62 nt, Homo Sapiens
acaaaguuuuucagaaaagaggaaaaaaagaauuuaaaaaaggaucuccacucuucaugacu

SEQ ID NO: 470817 - RNA, 62 nt, Homo Sapiens
aauuuaacugguuuuuacuacugaugacuugauuuaaaaaaaauacaaagaugcuggaugcu

SEQ ID NO: 470818 - RNA, 62 nt, Homo Sapiens
agagagugaucuauccuaaugacauuuuacuguuuaaaaaaguuuccuagccaugaagcccu

SEQ ID NO: 470819 - RNA, 62 nt, Homo Sapiens
ucuaugaccaggccuuaagggaaggucaguuuuuuaaaaaaccaaguagugucuuccuaccu

SEQ ID NO: 470820 - RNA, 62 nt, Homo Sapiens
uuugucucucugacuugauuucuauaaaugcuuuuaaaaacaagugaagccccucuuuauuu

SEQ ID NO: 470821 - RNA, 62 nt, Homo Sapiens
uaauaagugcauguaggaauugcaaaaaauauuuuaaaaauuuauuacugaauuuaaaaaua

SEQ ID NO: 470822 - RNA, 62 nt, Homo Sapiens
ugcaaaaaauauuuuaaaaauuuauuacugaauuuaaaaauauuuuagaaguuuuguaaugg

SEQ ID NO: 470823 - RNA, 62 nt, Homo Sapiens
uuaccuuagucacuugccuagcaguguguggcuuuaaaaacuagagauuuuucagucuuagu

SEQ ID NO: 470824 - RNA, 62 nt, Homo Sapiens
cacaauuugcacuguguucauauuaauccucuuuuaaaaaaggaaauauacagaagacaaac

SEQ ID NO: 470825 - RNA, 62 nt, Homo Sapiens
ugggcaacauagaaaccugugucuacaaaaaauuuaaaaauuagccaaguauggugacaggc

SEQ ID NO: 470826 - RNA, 62 nt, Homo Sapiens
ugagccuggcaagaauguguuuaaacuugguuuuuaaaaaacugcugacuguuuucucuuga

SEQ ID NO: 470827 - RNA, 62 nt, Homo Sapiens
gaaagcccugagcuuucugcuaucaaagagguuuuaaaaaaaucccauuuaaaaaaaauccc

SEQ ID NO: 470828 - RNA, 62 nt, Homo Sapiens
ucugcuaucaaagagguuuuaaaaaaaucccauuuaaaaaaaaucccuuaccucggugccuu

SEQ ID NO: 470829 - RNA, 62 nt, Homo Sapiens
ucucauaguguagugaacuucaaccccaaaauuuuaaaaauguauuuccccccaguuuuaaa

SEQ ID NO: 470830 - RNA, 62 nt, Homo Sapiens
uauuuccccccaguuuuaaauugccuuugaaauuuaaaaaaaaaaaauuuagacuuaguacc

SEQ ID NO: 470831 - RNA, 62 nt, Homo Sapiens
caauagauguagcucuaucaugucuagcauaauuuaaaaaaucaguguuuuuaggauuuggg

SEQ ID NO: 470832 - RNA, 62 nt, Homo Sapiens
uauuuuauguccauuugaguagguagguagguuuuaaaaauacuaguuaaaaugccacaagc

SEQ ID NO: 470833 - RNA, 62 nt, Homo Sapiens
gaaaggcauucagaaauuaugguuucuaccuuuuuaaaaaguagaugggauugugucaaucu

SEQ ID NO: 470834 - RNA, 62 nt, Homo Sapiens
gugaugucgaugucucugucuuuuuuuuugucuuuaaaaaauaauuggcagcaacuguauuu

SEQ ID NO: 470835 - RNA, 53 nt, Homo Sapiens
cuacaaaggagcacaaaugagccuuuaaaaaccaauucugagacugaacuuuu

SEQ ID NO: 470836 - RNA, 62 nt, Homo Sapiens
ggacugcaauuauucaguauuuuuuucuuuccuuuaaaaaaauauaucugaaguuucuugug

SEQ ID NO: 470837 - RNA, 62 nt, Homo Sapiens
uuuucaugguauuuucuuccauaauaucucauuuuaaaaagaaguucuuuaugaacuuagug

SEQ ID NO: 470838 - RNA, 62 nt, Homo Sapiens
uagguauauuuccaacuuuauauaucacaguauuuaaaaagacauguuugcauugagaaauu

SEQ ID NO: 470839 - RNA, 62 nt, Homo Sapiens
ugcccucacgucaguuguacauggcauggaacuuuaaaaauuuuaauauaaacuuucaucca

SEQ ID NO: 470840 - RNA, 62 nt, Homo Sapiens
uuuuaaagauaccagugggacagauuugguuuuuuaaaaaucucauguguucaaauuaacau

SEQ ID NO: 470841 - RNA, 62 nt, Homo Sapiens
ccuuuaaacugaaauaugucaugugaaauuauuuuaaaaauguaaaaacaaaacuuucugcu

SEQ ID NO: 470842 - RNA, 62 nt, Homo Sapiens
aauguguguuacauggucuguaaauauuuguauuuaaaaaugccaugcauuaggcuuuggaa

SEQ ID NO: 470843 - RNA, 62 nt, Homo Sapiens
gaagcaauuucuguuuacauguccuugcuacuuuuaaaaacuugcauuuauuccucagauuu

SEQ ID NO: 470844 - RNA, 62 nt, Homo Sapiens
uacuuuuaaaaacuugcauuuauuccucagauuuuaaaaauaaauaaauaauucauuuaaga

SEQ ID NO: 470845 - RNA, 62 nt, Homo Sapiens
gcuaauuaaaaacuugcuuuaaagauauugaauuuaaaaaggcauaauaaucaaauacuuaa

SEQ ID NO: 470846 - RNA, 62 nt, Homo Sapiens
cagucuuuuucaucauccaaguuuguaguucauuuaaaaauacaacauuaaacacauuuugc

SEQ ID NO: 470847 - RNA, 62 nt, Homo Sapiens
gaacuaaugucucauaugauguauuuacuuauuuuaaaaaaaagaauaggaaugagaugucc

SEQ ID NO: 470848 - RNA, 62 nt, Homo Sapiens
gauagucaaauacacguuuagauuaaaacuaguuuaaaaaauuauaaaugaaucuaaucaaa

SEQ ID NO: 470849 - RNA, 62 nt, Homo Sapiens
aacacacacagaaugggcugguuucuuucaaguuuaaaaaaagcccccuucuccaugcacaa

SEQ ID NO: 470850 - RNA, 62 nt, Homo Sapiens
cacuccagccuaggagacaaaacgagacuucauuuaaaaaaaauaaaaauaaaaauaaaaau

SEQ ID NO: 470851 - RNA, 62 nt, Homo Sapiens
gggaaggaacaggcccaugggaagaaggggguuuuaaaaacaugucuucaacucagcagaga

SEQ ID NO: 470852 - RNA, 62 nt, Homo Sapiens
agguuuauguugauguuuacccacuacaauuuuuuaaaaauauaagcucacaugccuuuucc

SEQ ID NO: 470853 - RNA, 62 nt, Homo Sapiens
uguuuccccaaagggaagccagucauugaccauuuaaaaagucuccugcuaaguauggaaau

SEQ ID NO: 470854 - RNA, 62 nt, Homo Sapiens
auuuucuuuuuaaaugucuuucuuauauggguuuuaaaaaaaaguaauaaaagccuguugca

SEQ ID NO: 470855 - RNA, 62 nt, Homo Sapiens
ucacucaugucugucauuuuauaagcauaucauuuaaaaagcuucuaaaaagcuauuucgcc

SEQ ID NO: 470856 - RNA, 62 nt, Homo Sapiens
gggaacuuuaaaauuucaucucaaaaauaauuuuuaaaaagccugagguaugauauagcaua

SEQ ID NO: 470857 - RNA, 62 nt, Homo Sapiens
aaaauauauuucccuguaagcugaauuacucauuuaaaaauuuuaacuucuauaugggaccc

SEQ ID NO: 470858 - RNA, 62 nt, Homo Sapiens
ggauucauaaucacaaauauagagaauuccuauuuaaaaaaauagaaaaauagugaagacua

SEQ ID NO: 470859 - RNA, 62 nt, Homo Sapiens
aacauuguggauguguaaacaggcaccacugcuuuaaaaaacaauuaucccuuacagacuug

SEQ ID NO: 470860 - RNA, 62 nt, Homo Sapiens
aaaaaguucuguugcaaacguuucuuuauuucuuuaaaaaaaguagcgggauaagucacugu

SEQ ID NO: 470861 - RNA, 62 nt, Homo Sapiens
uugauuguuugccauauuggucuaaguuaaauuuuaaaaauuaaaauaaugaucucagacuu

SEQ ID NO: 470862 - RNA, 62 nt, Homo Sapiens
ugucaagagauuuauuuuuccaauuuucucgauuuaaaaaacugcugccaaggccacaucac

SEQ ID NO: 470863 - RNA, 62 nt, Homo Sapiens
cuuccucauaggaugcuuugcaucuauacaauuuuaaaaauaucugucccccacugcaugaa

SEQ ID NO: 470864 - RNA, 62 nt, Homo Sapiens
aaaaucuuuuauuuuaauacagagcuauaauuuuuaaaaaaagcauaggaauuuggaaucca

SEQ ID NO: 470865 - RNA, 62 nt, Homo Sapiens
cacaacuaaaaauguauccauuucuuuauauauuuaaaaaccaaaagaauaucuucuaaaga

SEQ ID NO: 470866 - RNA, 62 nt, Homo Sapiens
caaaaagaaauugacucaguauagaacaaauauuuaaaaaaaacuuuaaggcuuguaaauac

SEQ ID NO: 470867 - RNA, 62 nt, Homo Sapiens
aaaaagugcuacccugagaacuccaagaauuguuuaaaaaaaaaaugcuguggaccacagaa

SEQ ID NO: 470868 - RNA, 62 nt, Homo Sapiens
cacaauaguaaucaaaacauugcuucagaaaauuuaaaaaauuuucugccugccucucagcu

SEQ ID NO: 470869 - RNA, 62 nt, Homo Sapiens
uucacgucuucgccaaucacuuuaaguauuuuuuuaaaaaguaaaugaaacaaaagaaacaa

SEQ ID NO: 470870 - RNA, 62 nt, Homo Sapiens
aaaaaauagcuugguuuuaugccuaguuaauguuuaaaaagagaauaaauguucuuuauaca

SEQ ID NO: 470871 - RNA, 62 nt, Homo Sapiens
aaagaaaaaaaggaaaagguaaaaaaaaaagcuuuaaaaaaaucagggugguugguuuaaca

SEQ ID NO: 470872 - RNA, 62 nt, Homo Sapiens
caacuguguagcugggcgugcuugguuuauauuuuaaaaagaugugagccauggcacccggu

SEQ ID NO: 470873 - RNA, 62 nt, Homo Sapiens
uggcgacaaggucuugcucuaucucuuucuuuuuuaaaaauguucuucugguucauccagua

SEQ ID NO: 470874 - RNA, 62 nt, Homo Sapiens
uagcuggguguggugaugcauacaaaaacauuuuuaaaaaauacacagggagacccccucuc

SEQ ID NO: 470875 - RNA, 62 nt, Homo Sapiens
uaaaaugaccaggcacaguggcaauacaggcauuuaaaaaauugguugcucagccucugagg

SEQ ID NO: 470876 - RNA, 62 nt, Homo Sapiens
agaugaguucuauaaauaauuuauuaacauauuuuaaaaauccccucccccauuuagauuau

SEQ ID NO: 470877 - RNA, 62 nt, Homo Sapiens
auauuuacagaagauguuugccuuacucaucauuuaaaaacuugggggccaauggcacagua

SEQ ID NO: 470878 - RNA, 62 nt, Homo Sapiens
uuggacaucuucaaucuuaaguaauguccaguuuuaaaaauaaaauguucuaccuguauaug

SEQ ID NO: 470879 - RNA, 62 nt, Homo Sapiens
uuuuaagaauuguuugucacagugaaggaauuuuuaaaaaauugccacauuuauugauaaac

SEQ ID NO: 470880 - RNA, 62 nt, Homo Sapiens
aacuucucccgcuacacagaaauuuuaucuguuuuaaaaaugccauucacaccuaaagacug

SEQ ID NO: 470881 - RNA, 62 nt, Homo Sapiens
aauauugacaaaaauaauguuuccagagauuguuuaaaaauauuguuuuuaaauuucuuuuc

SEQ ID NO: 470882 - RNA, 62 nt, Homo Sapiens
cagcauaaaaugcuuaaaaaguagugacuauauuuaaaaaaacauaaaagcaaguacauaua

SEQ ID NO: 470883 - RNA, 62 nt, Homo Sapiens
aaaguccucuacacuugauuauauuuuuaacauuuaaaaaccgguaccuaucugcuccaauu

SEQ ID NO: 470884 - RNA, 62 nt, Homo Sapiens
aaaguacguauuuagauaaugcaauuccuuuauuuaaaaaaagaaagcacugaguugagcaa

SEQ ID NO: 470885 - RNA, 62 nt, Homo Sapiens
uuuuccaaaaacaauuagguauugugauucuuuuuaaaaauuaggugucuuggucaugauaa

SEQ ID NO: 470886 - RNA, 62 nt, Homo Sapiens
uaauguucuuuauugcaagaaucauaauagauuuuaaaaaucuuuacccuuuacauuuuugu

SEQ ID NO: 470887 - RNA, 62 nt, Homo Sapiens
cuacaauauuuaacuaaggccaauauacaaauuuuaaaaauaacagcucauuuugucuuuuu

SEQ ID NO: 470888 - RNA, 62 nt, Homo Sapiens
agguaaaugccguauaugauacuggcaagguuuuuaaaaaugagagcagcuuagauuucccu

SEQ ID NO: 470889 - RNA, 62 nt, Homo Sapiens
auauucuauaauaaauaauauugguuuuacaauuuaaaaaguuuuauggaaacuaauauagg

SEQ ID NO: 470890 - RNA, 62 nt, Homo Sapiens
guaaggauuucauuuauauucccauuuauuucuuuaaaaaauagaacaaaaagcacuuuuau

SEQ ID NO: 470891 - RNA, 62 nt, Homo Sapiens
uuuuuaaugaauagucuuaaauuaacgaguguuuuaaaaagggccuuaguuuguuuauugac

SEQ ID NO: 470892 - RNA, 62 nt, Homo Sapiens
aaccuuucacuagcuagcacuugcuacagguuuuuaaaaaagcuuucuaaucuguuuuauca

SEQ ID NO: 470893 - RNA, 62 nt, Homo Sapiens
aucaugaagagaaggcuguugcaacauuugcuuuuaaaaauacaaaguaaaauucuucucag

SEQ ID NO: 470894 - RNA, 62 nt, Homo Sapiens
aaacaaaaaaaaauaaaaaauucuuuuacugauuuaaaaacaugcagcuucuaggacccggu

SEQ ID NO: 470895 - RNA, 62 nt, Homo Sapiens
acaaaaauuuguauaggcaaaauauauuaucuuuuaaaaauuugaggaccauaugaggguag

SEQ ID NO: 470896 - RNA, 62 nt, Homo Sapiens
uaaauaaauuuaagaaaaccccucguguuauguuuaaaaaaauacaccaguuuuaacaccuu

SEQ ID NO: 470897 - RNA, 62 nt, Homo Sapiens
acauuuuguaaggccacacaaaccauagauuuuuuaaaaacuuuaacguguuacauuuagua

SEQ ID NO: 470898 - RNA, 62 nt, Homo Sapiens
aaaaagucuuccucuggaaagcuuuccuagaauuuaaaaauaauccaauuugaauaagucau

SEQ ID NO: 470899 - RNA, 62 nt, Homo Sapiens
guauuauucuuaucuguagucuauuauaguuuuuuaaaaaguucagcaacacuagcacuuca

SEQ ID NO: 470900 - RNA, 62 nt, Homo Sapiens
caaauugagaacaaguagacauauuuaguaaguuuaaaaagaagaauccaaauaaacccuga

SEQ ID NO: 470901 - RNA, 62 nt, Homo Sapiens
aauuaaaucagacaccacauaaaaugaucucuuuuaaaaagagguugaguaacuuagaacug

SEQ ID NO: 470902 - RNA, 62 nt, Homo Sapiens
caggccagauccuauuauaaaauggugugccauuuaaaaaucauguucccaaccacuuuuug

SEQ ID NO: 470903 - RNA, 62 nt, Homo Sapiens
caagaccacuuguugaaaucgaaguguugaacuuuaaaaagagccaggagcuaauuguucaa

SEQ ID NO: 470904 - RNA, 62 nt, Homo Sapiens
caugaaaccaccuuuaauuauaaaauuguggcuuuaaaaauguucuacagcaacccuagaua

SEQ ID NO: 470905 - RNA, 62 nt, Homo Sapiens
uuuuccccacaagucaucuuuuggaagcuuuuuuuaaaaaugcuuuucucucuuccacaaaa

SEQ ID NO: 470906 - RNA, 62 nt, Homo Sapiens
cuaaucuauccccucuaaccccccacccugcuuuuaaaaauucuuuguaaaauucucccuca

SEQ ID NO: 470907 - RNA, 62 nt, Homo Sapiens
ccagaaaaacgcuuuuuuuuuauuggagaaguuuuaaaaaaccgagaaaaaaaguuuuaaug

SEQ ID NO: 470908 - RNA, 62 nt, Homo Sapiens
uauauuauuuuguauaauauggguauguguuguuuaaaaauagcgcgcacguguguguaggu

SEQ ID NO: 470909 - RNA, 62 nt, Homo Sapiens
uucaucauaugaauguucuuauuuuaaguuauuuuaaaaaaaagguguacguaucauuucua

SEQ ID NO: 470910 - RNA, 62 nt, Homo Sapiens
agucaagagcaaucaaagcaagugaacuugauuuuaaaaaccgacuuuuuuucugauucaaa

SEQ ID NO: 470911 - RNA, 62 nt, Homo Sapiens
uuuagcuauaaauuauauaaaugaaauacaacuuuaaaaaauacauaagaguaagcucuauu

SEQ ID NO: 470912 - RNA, 62 nt, Homo Sapiens
aucaauaccucaaaagcaggggauucccuuuuuuuaaaaaaagaguuaaacuuuaggaaaaa

SEQ ID NO: 470913 - RNA, 62 nt, Homo Sapiens
aaaaaaaacccaaaaauaauauacauaucauuuuuaaaaauaaacaugacccauaguauuaa

SEQ ID NO: 470914 - RNA, 62 nt, Homo Sapiens
auguugacuaaauacaaagucaaccuaguuauuuuaaaaauucagaaaauuauguguaucca

SEQ ID NO: 470915 - RNA, 62 nt, Homo Sapiens
aaacuugauuuguuauuaacuucacuguuuuuuuuaaaaaaauaugcuuguauaaaacacug

SEQ ID NO: 470916 - RNA, 62 nt, Homo Sapiens
aaaccaaaugauaucuaaguugcccuuucuuauuuaaaaacauacguucccauucuaauuaa

SEQ ID NO: 470917 - RNA, 62 nt, Homo Sapiens
guauacacuuauuuuaagugaaaaaaggcccuuuuaaaaauauaagaagauuaaaagagaaa

SEQ ID NO: 470918 - RNA, 62 nt, Homo Sapiens
aaggaaaacaaaaaacuuuauuuuaugaaguuuuuaaaaauagaacaauguauacaaugcac

SEQ ID NO: 470919 - RNA, 62 nt, Homo Sapiens
acugagauauuauuuuaaauaaguauuuacuuuuuaaaaauacaucaaugcaguucucacga

SEQ ID NO: 470920 - RNA, 62 nt, Homo Sapiens
uguauaaggagauucugugucaaaacaaucuauuuaaaaaacauauaacaaaaaagguuucc

SEQ ID NO: 470921 - RNA, 62 nt, Homo Sapiens
auuaagguuuuaugaaguuguaugaaagcaauuuuaaaaauuuuuuauaauaauccaaacuc

SEQ ID NO: 470922 - RNA, 62 nt, Homo Sapiens
uaaucucuucucuuagaaguaauucucucauauuuaaaaacgaacuagauggaaauauaugu

SEQ ID NO: 470923 - RNA, 62 nt, Homo Sapiens
aaaaguuguuaguuugaauaauaauggauuuuuuuaaaaaaaagcacaguugaaguccuaga

SEQ ID NO: 470924 - RNA, 62 nt, Homo Sapiens
cauaucuuuaugauuuucauuucaaauugacuuuuaaaaauauacuguuagucuguuagucu

SEQ ID NO: 470925 - RNA, 62 nt, Homo Sapiens
aaccugcuaucauugcuauguuaauacuaagcuuuaaaaagauggggaaagauauuuaauau

SEQ ID NO: 470926 - RNA, 62 nt, Homo Sapiens
acuucuuugcugaagugagauucccaagugcuuuuaaaaauacugcgggguggaggaggaac

SEQ ID NO: 470927 - RNA, 62 nt, Homo Sapiens
aguauuuugagaaaaggugccaguucauuuucuuuaaaaaaaggagaugaguaguuguguua

SEQ ID NO: 470928 - RNA, 62 nt, Homo Sapiens
uguuagaagaaaaaaagcagucuuuuuaccuuuuuaaaaaucuucucccgcaauuuguuccu

SEQ ID NO: 470929 - RNA, 62 nt, Homo Sapiens
uacacucuaucacauauuuauuaagaacauguuuuaaaaagauaaugaccugcuaauauauu

SEQ ID NO: 470930 - RNA, 62 nt, Homo Sapiens
agcaaaagaaauucaauggaaaucagaauauauuuaaaaaaaugcauuauuuuacaugugca

SEQ ID NO: 470931 - RNA, 62 nt, Homo Sapiens
caaacagaugaaaaccucaggcuauaauuauuuuuaaaaaaagucuuuguacuaaagcauuu

SEQ ID NO: 470932 - RNA, 62 nt, Homo Sapiens
caguuuuaagaucucugguuauggcagcauuuuuuaaaaauuacaggcgggagccacugcac

SEQ ID NO: 470933 - RNA, 62 nt, Homo Sapiens
acugcacgggcuuuaggguacuaaaacguggauuuaaaaagacucacaaauaggaaauaaaa

SEQ ID NO: 470934 - RNA, 62 nt, Homo Sapiens
uuauuuuccagaaaguuuguuauauguaaguguuuaaaaagaugauucuauaagauuauuua

SEQ ID NO: 470935 - RNA, 62 nt, Homo Sapiens
acaacagaaaauacaacuccuuggcacaucccuuuaaaaauacugugauaggaguucagaaa

SEQ ID NO: 470936 - RNA, 62 nt, Homo Sapiens
uuuuguuucuucuuacaaauugaaggaagauuuuuaaaaaugaaugaaggacaaaugaaucc

SEQ ID NO: 470937 - RNA, 62 nt, Homo Sapiens
aauccucccuucccccuuucaaauagcuuuaguuuaaaaaaauccccuuuuuucuaaauuug

SEQ ID NO: 470938 - RNA, 62 nt, Homo Sapiens
uguuugaaaauuauacauucauucaccagcuuuuuaaaaaaguuuaauccuagcucuuuguu

SEQ ID NO: 470939 - RNA, 62 nt, Homo Sapiens
uuucuacuccaauuaagaauuuucacaguaauuuuaaaaacgucuggaaucucacucuuguu

SEQ ID NO: 470940 - RNA, 62 nt, Homo Sapiens
ggaguaaaagugaggcacauuuaaaaacacuuuuuaaaaagugagugcuucugaaguacagu

SEQ ID NO: 470941 - RNA, 62 nt, Homo Sapiens
cuuuuuaaaaaguggaguaaucugaaguacaguuuaaaaacaaucugaguuuucagagugcu

SEQ ID NO: 470942 - RNA, 62 nt, Homo Sapiens
aauuaagaaguauuuauaggacagcacaauuuuuuaaaaauaguugccccguaaaaggguua

SEQ ID NO: 470943 - RNA, 62 nt, Homo Sapiens
acugaacauguuuacagguuuuaaagauucucuuuaaaaaagucaauccugguaaccaaaua

SEQ ID NO: 470944 - RNA, 62 nt, Homo Sapiens
guuucuugacaagcugacuucacuauuuuauauuuaaaaauuacaaaaaaauaucagacaag

SEQ ID NO: 470945 - RNA, 62 nt, Homo Sapiens
guguuugguuauuaauauaugacaaacugcaauuuaaaaagucauuucuacaucuuagcagu

SEQ ID NO: 470946 - RNA, 62 nt, Homo Sapiens
ucauuucuacaucuuagcagggauacacaauuuuuaaaaaucgacuaauucaagaaguugca

SEQ ID NO: 470947 - RNA, 62 nt, Homo Sapiens
uaggggauauuguaacccagcaauaaaaagcauuuaaaaauuugggaaaugagaaguuauac

SEQ ID NO: 470948 - RNA, 62 nt, Homo Sapiens
uaguaaaagucauauuuaaaauuguauugacuuuuaaaaauauuaaaguagcaaagucaugg

SEQ ID NO: 470949 - RNA, 62 nt, Homo Sapiens
acauuuuugauacauaacagaccucagucuuuuuuaaaaauuaauauauuuucaggcguauu

SEQ ID NO: 470950 - RNA, 62 nt, Homo Sapiens
gcaugcaaguauguugguacguuauguccugguuuaaaaaggauuaaaauuuuaaaauaauc

SEQ ID NO: 470951 - RNA, 62 nt, Homo Sapiens
uaaaauaauccuugcaucuaaaggccuugugguuuaaaaaaaaaaagcaaacuuuuuuuugu

SEQ ID NO: 470952 - RNA, 62 nt, Homo Sapiens
uuuagcaaaaaagaaaaaaaaaaggcacauaguuuaaaaaguuucucauuuugugcaauaua

SEQ ID NO: 470953 - RNA, 62 nt, Homo Sapiens
aggcaaauauuguagcuauauuacagugggauuuuaaaaaucuuguuaaacauucuauaaag

SEQ ID NO: 470954 - RNA, 62 nt, Homo Sapiens
caaauuaaaaaaacauuuuuuucuugguagucuuuaaaaauuaggggauugaaaggauccag

SEQ ID NO: 470955 - RNA, 62 nt, Homo Sapiens
auuuugcauguguaaagcuucaugaaguucucuuuaaaaaauaccaaagcuuguuuauuucu

SEQ ID NO: 470956 - RNA, 62 nt, Homo Sapiens
cuucacaacuaggagagcaugccgucuugauguuuaaaaaacccagggucuccacccuuccu

SEQ ID NO: 470957 - RNA, 62 nt, Homo Sapiens
gcagcccauguucucuaaugccacugcucuguuuuaaaaacucagaggcaauuuuuacauau

SEQ ID NO: 470958 - RNA, 62 nt, Homo Sapiens
aagacacacauuccuuugaaauccacccaguguuuaaaaagcaacuuggaaauuuacacauu

SEQ ID NO: 470959 - RNA, 62 nt, Homo Sapiens
caccaucuaaagaaaagaggucuuguuuuuuguuuaaaaaaguuuguggggaggaaagacau

SEQ ID NO: 470960 - RNA, 61 nt, Homo Sapiens
caauggacugcuggugcagaagaauaaacaacuuuaaaaauaacagucugccuacuuuguu

SEQ ID NO: 470961 - RNA, 62 nt, Homo Sapiens
agacuugaaagaaagagccacuuaaauucuuguuuaaaaauaccaauuugccuccuccuucc

SEQ ID NO: 470962 - RNA, 62 nt, Homo Sapiens
auacuguauuuucuucuaaauuaacccuaauguuuaaaaacucacuuucccccuuuaauuga

SEQ ID NO: 470963 - RNA, 62 nt, Homo Sapiens
uacauuaaaaaggaauuuuagagauugauuguuuuaaaaaaaaauacgcacauuguccaauc

SEQ ID NO: 470964 - RNA, 62 nt, Homo Sapiens
ucauuaaauuuaaaggauggaaauuuaucauguuuaaaaauuauucaagcacucuuaaaacc

SEQ ID NO: 470965 - RNA, 62 nt, Homo Sapiens
uuuucuuuuucuuuucuuuuuuuuuuuuuuuuuuuaaaaaagcaccuuuuuuuguuguuucc

SEQ ID NO: 470966 - RNA, 62 nt, Homo Sapiens
uucaucugugugaaagccuuuuucuucuuugauuuaaaaaaauuaacuauacaguuaauggu

SEQ ID NO: 470967 - RNA, 62 nt, Homo Sapiens
uuuuuaagaucauuaugugcaaaacaccaaguuuuaaaaauaacucacagaauggccuuagu

SEQ ID NO: 470968 - RNA, 62 nt, Homo Sapiens
ccuuggcuacuguuuuucuuuuacuucaguuuuuuaaaaaucucaaaugaaaaagucuucga

SEQ ID NO: 470969 - RNA, 62 nt, Homo Sapiens
uuguaauauguaaaguaagcccaacaaaaauuuuuaaaaauuugaugauccccaauauaucu

SEQ ID NO: 470970 - RNA, 62 nt, Homo Sapiens
uuguugaagcucuagcuuaagaagaaacuuuuuuuaaaaagacuguuuggggauucuuuuuc

SEQ ID NO: 470971 - RNA, 62 nt, Homo Sapiens
acuaauuaacccauuugugcauugaguuuucuuuuaaaaaugcuuguugugaaagacacaga

SEQ ID NO: 470972 - RNA, 62 nt, Homo Sapiens
uguuguaaauacuuggacagagguugcugaacuuuaaaaaaaauuaauuuauuauuauaaug

SEQ ID NO: 470973 - RNA, 62 nt, Homo Sapiens
gccucucugggcccaauaaaacaacacacauuuuuaaaaaauauggguauugauguccggcu

SEQ ID NO: 470974 - RNA, 62 nt, Homo Sapiens
uuacaaagcuaguugccauauuucuauuuuauuuuaaaaaguaaacaugcggcugggcgugg

SEQ ID NO: 470975 - RNA, 62 nt, Homo Sapiens
ggucauuuugaccuugcuuuguuaauaauaucuuuaaaaacaaagacaauccuuaaagcuuu

SEQ ID NO: 470976 - RNA, 62 nt, Homo Sapiens
cuguggcaauguacuguucucacauuaagccuuuuaaaaauguuccauacuguauuagcauc

SEQ ID NO: 470977 - RNA, 62 nt, Homo Sapiens
ugaugacauucaguucucuuuuguuuuuauuuuuuaaaaacucagguguaauuauuaucugu

SEQ ID NO: 470978 - RNA, 62 nt, Homo Sapiens
ccuccaaaggugaaaaaacaaugcauucuugcuuuaaaaaaaaaaaagaaggcuaaaaaauu

SEQ ID NO: 470979 - RNA, 62 nt, Homo Sapiens
acucccuacaguccuucaauggaaaaguaacauuuaaaaauccuuuggguaauucgaauuac

SEQ ID NO: 470980 - RNA, 62 nt, Homo Sapiens
aauaauuacuggcaguagguuauaauuggugguuuaaaaauaacauuggaauacaggacuug

SEQ ID NO: 470981 - RNA, 62 nt, Homo Sapiens
augagucccucaggaaaaaaaaaaaauucuguuuuaaaaagcaaucugauucuuagcucuug

SEQ ID NO: 470982 - RNA, 62 nt, Homo Sapiens
ccaaggagcaucccuaauucuucauagggaccuuuaaaaagcaggaaauaccaacugaaguc

SEQ ID NO: 470983 - RNA, 62 nt, Homo Sapiens
guuauccauauuacguuguuucuuauagauuuuuuaaaaaaaaugugaaauuuuuccacacu

SEQ ID NO: 470984 - RNA, 62 nt, Homo Sapiens
cauucuaguauuaaauccucacuucaggagcuuuuaaaaauacugagacccccccauaacca

SEQ ID NO: 470985 - RNA, 62 nt, Homo Sapiens
aacauggugaaaccccaucucuacaaaaaauuuuuaaaaaguuggccaggcaugguaaugcg

SEQ ID NO: 470986 - RNA, 62 nt, Homo Sapiens
aaagaauagccacaauuagcugaaaaggcuauuuuaaaaacuuuuccaacugcguaucugug

SEQ ID NO: 470987 - RNA, 62 nt, Homo Sapiens
aaccuccagaacugugaaaaauaaauuuguuauuuaaaaagaaaaaaaaaaaaacaaaaacc

SEQ ID NO: 470988 - RNA, 62 nt, Homo Sapiens
ccgaaagcucacagauugcagaaauuagcuuuuuuaaaaaacaaaccccaguaaauauaauu

SEQ ID NO: 470989 - RNA, 61 nt, Homo Sapiens
ucauauuugcacaggaaaaauaaagaccuggauuuaaaaauaggaaugacucuugcuucag

SEQ ID NO: 470990 - RNA, 62 nt, Homo Sapiens
ggcacuucagaguagagggcuugggaagaucuuuuaaaaaggcaguaggcccgguguggugg

SEQ ID NO: 470991 - RNA, 62 nt, Homo Sapiens
acauguaacauagauuuauguaaugcuuuauguuuaaaaacauuccccaauuaucuuauuua

SEQ ID NO: 470992 - RNA, 62 nt, Homo Sapiens
cuaauuuuauauauagagaaagugaccuauuuuuuaaaaaaaucacacucuaaguucuauug

SEQ ID NO: 470993 - RNA, 62 nt, Homo Sapiens
aauuuugguaccauaccaacuggaauuuaggcuuuaaaaauaauguuucaaggccaggugug

SEQ ID NO: 470994 - RNA, 62 nt, Homo Sapiens
ugaaauuugcugcugauauguugaguuuguucuuuaaaaaauagcucauauaucucaucuuu

SEQ ID NO: 470995 - RNA, 62 nt, Homo Sapiens
guggaaaaaucuaaacauuuuuaucuucauaauuuaaaaaauauauauguauauauugcaua

SEQ ID NO: 470996 - RNA, 62 nt, Homo Sapiens
gguagagaugauuucaauccaaauacucuuacuuuaaaaaauuuccuuuccccaagaaucuc

SEQ ID NO: 470997 - RNA, 62 nt, Homo Sapiens
uaugccucccguggguauacguuuuuaccuuuuuuaaaaaacauuuuuguagaaaaaauaau

SEQ ID NO: 470998 - RNA, 62 nt, Homo Sapiens
uuccaauaaguaucuuaggaacuuauuuccuuuuuaaaaaauauuuuuuaaauuuuuaaaau

SEQ ID NO: 470999 - RNA, 62 nt, Homo Sapiens
cacugacuacaugcuggaaugacugugaagcuuuuaaaaaauguuagugcccacucuucccc

SEQ ID NO: 471000 - RNA, 62 nt, Homo Sapiens
uaaaaaacagaguauuuuauguaauuucuguuuuuaaaaagacauuauuaaaugggucaaag

SEQ ID NO: 471001 - RNA, 62 nt, Homo Sapiens
uaaaucuaggcaggauacugcauuuuugugguuuuaaaaaaguccuuaggacagacugaauu

SEQ ID NO: 471002 - RNA, 62 nt, Homo Sapiens
ugugguuuuauugaaugucuauuugaguaucauuuaaaaaguauuugccuuuuacugucauc

SEQ ID NO: 471003 - RNA, 62 nt, Homo Sapiens
gccaaauuauuucagcauauuccggugauaacuuuaaaaauuagauacauuuucuuaacauu

SEQ ID NO: 471004 - RNA, 62 nt, Homo Sapiens
gguuuuaaaauugucaagaguuauucuguuuguuuaaaaaguaagaaaccucuguaagcaau

SEQ ID NO: 471005 - RNA, 62 nt, Homo Sapiens
caagcaucucauuuaaauaaagguuugucaucuuuaaaaauacagcaauaugugacuuuuua

SEQ ID NO: 471006 - RNA, 62 nt, Homo Sapiens
gucaucuuuaaaaauacagcaauaugugacuuuuuaaaaaagcugucaaauaggugugaccc

SEQ ID NO: 471007 - RNA, 62 nt, Homo Sapiens
gugugacccuacuaauaauuauuagaaauacauuuaaaaacaucgaguaccucaagucaguu

SEQ ID NO: 471008 - RNA, 62 nt, Homo Sapiens
agucucauuuugauaaucauuugcuuccaguguuuaaaaauuaaaaaaagaauggggagaag

SEQ ID NO: 471009 - RNA, 62 nt, Homo Sapiens
auuccaaauucaccuagcaauaaaaucuaauuuuuaaaaaguauauaaauauaaaauguaua

SEQ ID NO: 471010 - RNA, 62 nt, Homo Sapiens
uauaugagacuugccagucaaaugcuauuugguuuaaaaaaauuauugcaaucucaaguuaa

SEQ ID NO: 471011 - RNA, 62 nt, Homo Sapiens
acugcugugaaaaacaauuuauguuugcaggguuuaaaaaucaguaaaaaugggaaugauug

SEQ ID NO: 471012 - RNA, 62 nt, Homo Sapiens
uuuugauauuggugaauuagucaccaguaaauuuuaaaaaagcacuugguugaaaauuguac

SEQ ID NO: 471013 - RNA, 62 nt, Homo Sapiens
uaacuuuuauaagucccauuuauaaacccacuuuuaaaaauaacagguccaaguuagaguga

SEQ ID NO: 471014 - RNA, 62 nt, Homo Sapiens
gaucuucacauuugcacuccaguuuuuuuuucuuuaaaaaagcgguuucuaccucucuaugu

SEQ ID NO: 471015 - RNA, 62 nt, Homo Sapiens
cuugaauguaaauauauacaguauguauauuuuuuaaaaagauuugcuugcaaugaccuuau

SEQ ID NO: 471016 - RNA, 62 nt, Homo Sapiens
cauguauucuuuguuauuugcuuuuaacaaccuuuaaaaaauauuaaaacgauucuuagcuc

SEQ ID NO: 471017 - RNA, 62 nt, Homo Sapiens
augcuaucccuaaccauauauuuauauuucguuuuaaaaacacccaugauguggcacaguaa

SEQ ID NO: 471018 - RNA, 62 nt, Homo Sapiens
uggggauaaaucacucugucauuccuaguuauuuuaaaaaaagaacuuuaugauuacggucc

SEQ ID NO: 471019 - RNA, 62 nt, Homo Sapiens
gucaauaccuuuauaagcaaaaccaugauaaauuuaaaaacaacagaaauguggcaugauua

SEQ ID NO: 471020 - RNA, 62 nt, Homo Sapiens
ccucaccuucacuauugaucuguaauuuuuauuuuaaaaacagcuuacuguaaaguagauca

SEQ ID NO: 471021 - RNA, 62 nt, Homo Sapiens
uuucauuauugaugugcugaugaaccuggacuuuuaaaaauauuuguuuccuauaccuuuac

SEQ ID NO: 471022 - RNA, 62 nt, Homo Sapiens
uuuaacagauagaauuuguauuuuuauuguacuuuaaaaagauuuauguaauagguauauau

SEQ ID NO: 471023 - RNA, 62 nt, Homo Sapiens
aucuauacuuucuuuuuucuuggagagaaccguuuaaaaaauuacaagauauauuuaaaaag

SEQ ID NO: 471024 - RNA, 62 nt, Homo Sapiens
ggagagaaccguuuaaaaaauuacaagauauauuuaaaaaguaaccagauaaaaguagcaca

SEQ ID NO: 471025 - RNA, 62 nt, Homo Sapiens
cuuaguacuguuuucccugcacguaggggucuuuuaaaaauauaaagcuugugauaaagaga

SEQ ID NO: 471026 - RNA, 62 nt, Homo Sapiens
auagagaucgaaccaaaaaaaaucauuuaaacuuuaaaaauauuuuaaauggacuuugggga

SEQ ID NO: 471027 - RNA, 62 nt, Homo Sapiens
gggguaggugaggguuuggagcauguggucuuuuuaaaaaauuguaacccucuagaaaauau

SEQ ID NO: 471028 - RNA, 62 nt, Homo Sapiens
uacaggggcccgccaccacaccuggcuaauuuuuuaaaaauauuuuuaguagagacaggguu

SEQ ID NO: 471029 - RNA, 62 nt, Homo Sapiens
uuuuuuaauaaaacaaaauuuguuugaaaucuuuuaaaaauucaaaugauuuuuacaaguuu

SEQ ID NO: 471030 - RNA, 62 nt, Homo Sapiens
auuuuuugcaucauuuaaacaugcagaagauguuuaaaaauaaaaaaaaaacugcuuuaucc

SEQ ID NO: 471031 - RNA, 62 nt, Homo Sapiens
uuuuuaauauugggaaaauuaugauaaaaugcuuuaaaaauuaauaugccagauuaaaauaa

SEQ ID NO: 471032 - RNA, 62 nt, Homo Sapiens
auaugacaggauguguaaugggcuaacguuuauuuaaaaaguucaggccaggugcaguggcu

SEQ ID NO: 471033 - RNA, 62 nt, Homo Sapiens
auggugaaaccccgucucuauuaaaaauauuuuuuaaaaauuaacugagcgugguggugggc

SEQ ID NO: 471034 - RNA, 62 nt, Homo Sapiens
auugaugggagaaaugaggaaaagaaaaucuuuuuaaaaaugauuucaagguuugugcugag

SEQ ID NO: 471035 - RNA, 62 nt, Homo Sapiens
cuuaaaaaaaaaaaaaaaagacuaagguggauuuuaaaaauuggaaacugacauaauguuag

SEQ ID NO: 471036 - RNA, 62 nt, Homo Sapiens
ggaacuucuuguuuaauagcauuuuuguuuauuuuaaaaagugaucagaaguaguaaacuau

SEQ ID NO: 471037 - RNA, 62 nt, Homo Sapiens
acuaaugugaugcuaaguuccacuuggccccuuuuaaaaacguguaugugccuuuugaagau

SEQ ID NO: 471038 - RNA, 62 nt, Homo Sapiens
ccccaaacuguaguaauuguuacaauuuucuauuuaaaaaaugaauaguacaugcagaaauu

SEQ ID NO: 471039 - RNA, 62 nt, Homo Sapiens
gcucugcucuguuuugcauggaguauuauuauuuuaaaaauugcauuuuuaccuuucaugug

SEQ ID NO: 471040 - RNA, 62 nt, Homo Sapiens
ugguaauaauaaagcagauauuuuuguccccauuuaaaaaaugaagaaauuaaugcuuaaua

SEQ ID NO: 471041 - RNA, 62 nt, Homo Sapiens
cuuggguuugucuggcuuuuguuuucuuuuucuuuaaaaauaaauguacaguaaaacuacaa

SEQ ID NO: 471042 - RNA, 62 nt, Homo Sapiens
uugguuauuugggggcuuuuuuacuuacuguauuuaaaaauacaaggguauugauaugaaau

SEQ ID NO: 471043 - RNA, 62 nt, Homo Sapiens
uguauggaugugugugagucagugguagcuuauuuaaaaagcaccuuauccuuucucccaua

SEQ ID NO: 471044 - RNA, 62 nt, Homo Sapiens
guucuuacaaaccauacugaaagaguccauuguuuaaaaaucuuaauguaucaaacuguaua

SEQ ID NO: 471045 - RNA, 62 nt, Homo Sapiens
uuuagauucacuuaacaaacaaauuuuucugcuuuaaaaaugucuuauugucccaaguguac

SEQ ID NO: 471046 - RNA, 62 nt, Homo Sapiens
cacugaucuuagcuuuaaacacaagagaagucuuuaaaaagccugcauuguguauuaaacac

SEQ ID NO: 471047 - RNA, 62 nt, Homo Sapiens
cugcaaaaggccuauuuuaacuauugauuuuuuuuaaaaaaaauugucuuugaauguauugg

SEQ ID NO: 471048 - RNA, 62 nt, Homo Sapiens
cgaacacaacucagaaacuuggaaucguuuuuuuuaaaaaugccucugagcaacccauauaa

SEQ ID NO: 471049 - RNA, 62 nt, Homo Sapiens
uuaaaaguuuuaucuuaaauugauuaaaacuuuuuaaaaagcuuugguauuaaaagagguaa

SEQ ID NO: 471050 - RNA, 62 nt, Homo Sapiens
cuggcucucuuucccccacaaaauucgacauauuuaaaaaucuccguguggcuuuaaaaaau

SEQ ID NO: 471051 - RNA, 62 nt, Homo Sapiens
aaauucgacauauuuaaaaaucuccguguggcuuuaaaaaaugguuuuuuguuuuuuuguuu

SEQ ID NO: 471052 - RNA, 62 nt, Homo Sapiens
caggauguuauugacauuauguuuuaagcaauuuuaaaaagguugcaugaucuuuaacaaau

SEQ ID NO: 471053 - RNA, 62 nt, Homo Sapiens
aauuuggaaacauguaacaaaaggaaauacuuuuuaaaaaaaucuggggaaggaucauaaga

SEQ ID NO: 471054 - RNA, 62 nt, Homo Sapiens
gccaacaaagugagucaccaaaugaagagggcuuuaaaaauucugaagaguaggaaguacau

SEQ ID NO: 471055 - RNA, 62 nt, Homo Sapiens
uuuuaucuuuauaugguuuccgagagugauuuuuuaaaaauuguaaauuuauuucuccaaau

SEQ ID NO: 471056 - RNA, 62 nt, Homo Sapiens
guuaaguuguauuuugauaauauuauuaauauuuuaaaaagauuaacaaucaacugcauaaa

SEQ ID NO: 471057 - RNA, 62 nt, Homo Sapiens
agaaaaaaaaaaaaaaggagcugaaucaguuuuuuaaaaaaaguaagcagccacugcaagcu

SEQ ID NO: 471058 - RNA, 62 nt, Homo Sapiens
cagacuugggggucauuguguuagccuguuaauuuaaaaaucucaauguguccuuaguuuuc

SEQ ID NO: 471059 - RNA, 62 nt, Homo Sapiens
uaucccauaucgauugccaauguccugugaauuuuaaaaagcgaaaguauauaaaaucuucc

SEQ ID NO: 471060 - RNA, 62 nt, Homo Sapiens
cugauuuuuuuuuaaccugcacuaaugcuauauuuaaaaacaaaacaguauuuguaaaugga

SEQ ID NO: 471061 - RNA, 62 nt, Homo Sapiens
auuuuuaaauaucuuccccaagcagccagcuauuuaaaaaauucuuuuuacauuucagcucc

SEQ ID NO: 471062 - RNA, 62 nt, Homo Sapiens
uggccaaaauuuaaacuguauuuaacaaauacuuuaaaaauuuaugucacaugcgggaacug

SEQ ID NO: 471063 - RNA, 62 nt, Homo Sapiens
acauuauuugaacauuuuaaugauuacacauuuuuaaaaaauuguuuucccguuuccuugaa

SEQ ID NO: 471064 - RNA, 62 nt, Homo Sapiens
auuuuucauuuuguuucucccacuguuuguuuuuuaaaaaaccaacucaugacaagagauac

SEQ ID NO: 471065 - RNA, 62 nt, Homo Sapiens
uuuaaggagacuuuuaacagauaggaaucauuuuuaaaaaucuaacaagacaccuagcaacu

SEQ ID NO: 471066 - RNA, 62 nt, Homo Sapiens
guaguggaaauucuaugccuacuuguuauccauuuaaaaaugugucuuggugguguuacaag

SEQ ID NO: 471067 - RNA, 62 nt, Homo Sapiens
acuucauuauguuuagggggagaaaaauuuuuuuuaaaaaacuuuuuuaaauauaaauguua

SEQ ID NO: 471068 - RNA, 62 nt, Homo Sapiens
aaaaaaaaaaaaacuuugccugaggagcauuuuuuaaaaacuaaaauugaacacaaucucau

SEQ ID NO: 471069 - RNA, 62 nt, Homo Sapiens
cuggcaccaaaagaaauagauaauaaugucuuuuuaaaaauauuuuaugaagauauuugcuu

SEQ ID NO: 471070 - RNA, 62 nt, Homo Sapiens
gaucauuuggguucacucagaaacuuccuuguuuuaaaaaauuuauuuuacuucaacugucg

SEQ ID NO: 471071 - RNA, 62 nt, Homo Sapiens
aaaacuuguugcuuagaagcuuucuuuugguuuuuaaaaaacauuacaaaacuguucugaau

SEQ ID NO: 471072 - RNA, 62 nt, Homo Sapiens
uuuaaauuaugggauguuuucuuuuauauuuauuuaaaaauugauggcuucuuuaggaauaa

SEQ ID NO: 471073 - RNA, 62 nt, Homo Sapiens
uugcaauguaucaugcuuguuguacauuuaauuuuaaaaagguagcuuuuuauuccuagugg

SEQ ID NO: 471074 - RNA, 62 nt, Homo Sapiens
cauugaaaauuugaaagguaguuauuauccuuuuuaaaaaugaugaaucccuaccagcagua

SEQ ID NO: 471075 - RNA, 62 nt, Homo Sapiens
agucaauaugaaaaucucaguaacuaccuuuauuuaaaaauauaauaucuuuuaguucucuu

SEQ ID NO: 471076 - RNA, 62 nt, Homo Sapiens
ugaaaaagaauaaaaacuuugcagugugccaguuuaaaaagauaccuggcgguguauaccag

SEQ ID NO: 471077 - RNA, 62 nt, Homo Sapiens
agaaacuuuucugaaugccuauaaauuguguauuuaaaaaaaaaugaaaucuucccaguauu

SEQ ID NO: 471078 - RNA, 62 nt, Homo Sapiens
caaaaaaaauuuuagcucuuuuuaacuuuuaauuuaaaaacauuugaagugcagcucauguu

SEQ ID NO: 471079 - RNA, 62 nt, Homo Sapiens
aucucauauaucucgucuuuuugaguuuguucuuuaaaaaauugaaauuugcugcugauaug

SEQ ID NO: 471080 - RNA, 62 nt, Homo Sapiens
auguuucaaggccagguguguggaauuuaggcuuuaaaaauaaauuuugguaccauaccaac

SEQ ID NO: 471081 - RNA, 62 nt, Homo Sapiens
ccuuuagagccuaauuacuccuaggcccccuuuuuaaaaacaucuuccuccucagcgaacca

SEQ ID NO: 471082 - RNA, 62 nt, Homo Sapiens
agagcgcucuagccacuacuuggggugcaguuuuuaaaaaucagauggcgaaacccugugug

SEQ ID NO: 471083 - RNA, 62 nt, Homo Sapiens
ccacagaggagaauuugcugaaauguaaauuuuuuaaaaagucugcaaaguagccuuuaaaa

SEQ ID NO: 471084 - RNA, 62 nt, Homo Sapiens
uguaaauuuuuuaaaaagucugcaaaguagccuuuaaaaaaaagcaucuuugaugaauacuc

SEQ ID NO: 471085 - RNA, 62 nt, Homo Sapiens
ugcccgcacuaccauacaucauauuaauacauuuuaaaaagguaaaaaacuaugucuaauuu

SEQ ID NO: 471086 - RNA, 62 nt, Homo Sapiens
uaugucuaauuuauauuaauaucacuacaaacuuuaaaaaacgaauugcacucuacuuaugu

SEQ ID NO: 471087 - RNA, 62 nt, Homo Sapiens
auccaaagcugcucucgauauuuuaaaaaacauuuaaaaaaaguuauuuacaaaauaauaau

SEQ ID NO: 471088 - RNA, 62 nt, Homo Sapiens
auuuaaaaaaaauccaaagcaaaauaauaauuuuuaaaaaacacaaaucuucuguuauuuac

SEQ ID NO: 471089 - RNA, 62 nt, Homo Sapiens
uacguggaagcaagauuucuuggacauuaguuuuuaaaaaguauucagauugggaaaaacaa

SEQ ID NO: 471090 - RNA, 62 nt, Homo Sapiens
ggaacauaaaauacaauguuccuuggacucauuuuaaaaaauuuaaaagaauauuuuaacuu

SEQ ID NO: 471091 - RNA, 62 nt, Homo Sapiens
aauacugauguuccuagugauguaaaugugcuuuuaaaaaaacaagggugaugggaaagcau

SEQ ID NO: 471092 - RNA, 62 nt, Homo Sapiens
uuugacgcuugcuuaggagaauagaaugauguuuuaaaaaaauaaaguuccuuaagcaucug

SEQ ID NO: 471093 - RNA, 62 nt, Homo Sapiens
uuuuuauaaauuacuaucugucccaaagcacuuuuaaaaaaaaguaaugauacuguguguuu

SEQ ID NO: 471094 - RNA, 62 nt, Homo Sapiens
cuuucauucuuacuuuucaggacuuugaaaauuuuaaaaauuauuuugaaauacuaagauca

SEQ ID NO: 471095 - RNA, 62 nt, Homo Sapiens
uaaaauuucugaaaaccaauaggcaucugauuuuuaaaaaauauaaacauacaacuuccaaa

SEQ ID NO: 471096 - RNA, 62 nt, Homo Sapiens
aauuuuuuuaaucucuagcaaaguguuggcuuuuuaaaaaaaaagguauaacaagcuuggca

SEQ ID NO: 471097 - RNA, 62 nt, Homo Sapiens
caugaccacauauguauaugcauuacuuguuuuuuaaaaacaaugguuuuguuuaaaauuac

SEQ ID NO: 471098 - RNA, 62 nt, Homo Sapiens
aaaaaaggcaagaugggcuuagaaaccucuuguuuaaaaaacuggaagauggaagcuagugc

SEQ ID NO: 471099 - RNA, 62 nt, Homo Sapiens
agaaaaugaggggccagguggcagccugaguuuuuaaaaaacugcuaucuauucugugugcu

SEQ ID NO: 471100 - RNA, 62 nt, Homo Sapiens
auuucaucagguuuuuuguagaauauaaacuuuuuaaaaauauaggaaacugaaacucugug

SEQ ID NO: 471101 - RNA, 62 nt, Homo Sapiens
uauuuuuaugauuuaauaucacauuuuuaucauuuaaaaaucuuuauuaacaacugaacaaa

SEQ ID NO: 471102 - RNA, 62 nt, Homo Sapiens
cauuuuugcaaaacaagauacuuuggaaaccuuuuaaaaaugcacuaugauuaucaagguga

SEQ ID NO: 471103 - RNA, 62 nt, Homo Sapiens
gaaauuuuuaauuuuuacuuuauuuuugguuuuuuaaaaacuuaaguguggaagcuuauuaa

SEQ ID NO: 471104 - RNA, 62 nt, Homo Sapiens
acaccacgaauuugguguggaauacaguaaaguuuaaaaaauuucuauuuaaaaaauaaaaa

SEQ ID NO: 471105 - RNA, 62 nt, Homo Sapiens
aaaaaaauacaguaaaguuuauagcucuucuauuuaaaaaaucaccuuauguauuauuuucu

SEQ ID NO: 471106 - RNA, 62 nt, Homo Sapiens
uguuuuaaaagucaguuugcguuuguauauauuuuaaaaaauagaagaauagaagaaaaaaa

SEQ ID NO: 471107 - RNA, 62 nt, Homo Sapiens
aauucuucaaguaugaagacaucuuaguuauuuuuaaaaacauagcuaauuuauuuuuuugc

SEQ ID NO: 471108 - RNA, 62 nt, Homo Sapiens
accauuugaauuuguauuucuuccaauucacuuuuaaaaaaucuguuuaaauuucccgcaua

SEQ ID NO: 471109 - RNA, 62 nt, Homo Sapiens
ccuuggaggcuggaagggguuaauugcauguuuuuaaaaauuguagccaaggaauacaaaca

SEQ ID NO: 471110 - RNA, 62 nt, Homo Sapiens
ugauauuccuguauggugcaguguucuguuuuuuuaaaaacucaauaccuuuuuaauacuca

SEQ ID NO: 471111 - RNA, 62 nt, Homo Sapiens
uugucagaagaucccagaaaauuuuaagauuuuuuaaaaaucggcuucacugaagaaaaggc

SEQ ID NO: 471112 - RNA, 62 nt, Homo Sapiens
acgugugcacagagaggucauacccucuccuuuuuaaaaauuagccucaguccccuucauau

SEQ ID NO: 471113 - RNA, 62 nt, Homo Sapiens
guucuuuuguaaugugguguuccuuuuuuauuuuuaaaaauauuuuuuuucuuuucccucaa

SEQ ID NO: 471114 - RNA, 62 nt, Homo Sapiens
uuaaaauguauucuuaaauuugauuaacuaauuuuaaaaaugaaaauagauaaauaaauaua

SEQ ID NO: 471115 - RNA, 62 nt, Homo Sapiens
ugaaaauacuuaggaaggaucaauaaauuuuuuuuaaaaaaccuugacuccuugugaugugg

SEQ ID NO: 471116 - RNA, 62 nt, Homo Sapiens
uuucccagaaguugguuccuauauuuuucuucuuuaaaaaucaguuuguauuuuucucucag

SEQ ID NO: 471117 - RNA, 62 nt, Homo Sapiens
agcccacugcucaguuuccacuggcaguaggauuuaaaaagcaacugaccuuuuaaaggcca

SEQ ID NO: 471118 - RNA, 62 nt, Homo Sapiens
ggagaugagaaagggaauacauucuacuucuguuuaaaaagguuuucacuaaauuguacagu

SEQ ID NO: 471119 - RNA, 62 nt, Homo Sapiens
gagcuaagauaaagacuguguuuaaguacauuuuuaaaaaaagcaaccagcaaauuaacuaa

SEQ ID NO: 471120 - RNA, 62 nt, Homo Sapiens
uccauuaaaguuauaacuagcaacuuucauaauuuaaaaaucgcaaguaagaauggccaacu

SEQ ID NO: 471121 - RNA, 62 nt, Homo Sapiens
uucuagacucuuugcaaaauaaagagauuucuuuuaaaaacuguuuucguguuacaucaccu

SEQ ID NO: 471122 - RNA, 62 nt, Homo Sapiens
aaauguaaagguguguuuugcaaaucaacauuuuuaaaaagaggacaguagccacuuacaaa

SEQ ID NO: 471123 - RNA, 62 nt, Homo Sapiens
caaggguucuauauugugagucuauauuuuucuuuaaaaagucaaauucugauugauuugaa

SEQ ID NO: 471124 - RNA, 62 nt, Homo Sapiens
aaauuugugaaaccuauagauggaaaaaauauuuuaaaaacaauuuucugcagcuuuuaguu

SEQ ID NO: 471125 - RNA, 62 nt, Homo Sapiens
acauugcuucauuacuuucacauguuguauguuuuaaaaacuaggaugauuagauugaaaca

SEQ ID NO: 471126 - RNA, 62 nt, Homo Sapiens
guucucuugauugauuucaugcguggcacaguuuuaaaaauauagaccauucauuugccuga

SEQ ID NO: 471127 - RNA, 62 nt, Homo Sapiens
aaaacagggaauaaaagcuuuuaaauacagcuuuuaaaaacacaucuacugggacuaggguu

SEQ ID NO: 471128 - RNA, 62 nt, Homo Sapiens
uaaaaccucucuugccagggaaugaaaacaauuuuaaaaaugggaaagugcaaauaagcaaa

SEQ ID NO: 471129 - RNA, 62 nt, Homo Sapiens
caauuauaaaaauaauaaaucagauguuuaguuuuaaaaauugaggacgugguacaggguug

SEQ ID NO: 471130 - RNA, 62 nt, Homo Sapiens
ccacuuuuguucuacuccuucccuaauagcuuuuuaaaaaaaucuccccaguagagaaacau

SEQ ID NO: 471131 - RNA, 62 nt, Homo Sapiens
cucauagugagaacccaucuauacaaaaaauuuuuaaaaauuagcauggcggcacacaucug

SEQ ID NO: 471132 - RNA, 62 nt, Homo Sapiens
uaacaaacacccaaacuguuuggauugauugcuuuaaaaaacaaaccuggcucuuaccuuug

SEQ ID NO: 471133 - RNA, 62 nt, Homo Sapiens
ccaagcuggaauuuaucuaaucuauuuuuguguuuaaaaaagcuguaccuaccaaauaaaua

SEQ ID NO: 471134 - RNA, 62 nt, Homo Sapiens
acuuaaagaaauucacuacugcaguuuuuauuuuuaaaaaacaguaauugagauauugaaga

SEQ ID NO: 471135 - RNA, 62 nt, Homo Sapiens
gguggacaaauuuaacaaguuuucuguuacuuuuuaaaaagaaaaaauccagaacauaagaa

SEQ ID NO: 471136 - RNA, 62 nt, Homo Sapiens
uucugaaggacuuuaaggaagggauacaugauuuuaaaaaagccuguaagaggugaaauaug

SEQ ID NO: 471137 - RNA, 62 nt, Homo Sapiens
uucuauauugaaagcauuuuuauguuuucuaauuuaaaaauuaauauuuucuuauagauauu

SEQ ID NO: 471138 - RNA, 62 nt, Homo Sapiens
uuguacugguacaaaauaguuuuaaauuauauuuuaaaaagcuuccaaucuugugguguguu

SEQ ID NO: 471139 - RNA, 62 nt, Homo Sapiens
aaaacauuuuacaguaaaguuauuaagguugguuuaaaaacaacugcauuagaaauaaugcg

SEQ ID NO: 471140 - RNA, 62 nt, Homo Sapiens
agaagauagagguuguuuucguuucuuuucuuuuuaaaaaaaaaaaaauuuauuugaccgac

SEQ ID NO: 471141 - RNA, 62 nt, Homo Sapiens
ugaaaguaugauuguaaaagggagugaauugguuuaaaaauauauguauauuuuaaacuuug

SEQ ID NO: 471142 - RNA, 62 nt, Homo Sapiens
caggcuuuauuucugguaugaaguuuauauuuuuuaaaaaaauccuauauuaucacaccaga

SEQ ID NO: 471143 - RNA, 62 nt, Homo Sapiens
uuuucagcuuacacauguguucaaaguggauuuuuaaaaaguguuuuagcaauacuccuuaa

SEQ ID NO: 471144 - RNA, 62 nt, Homo Sapiens
cuuuggggcuuauuuucuggguaaggcucaucuuuaaaaacuggcuucagaggggagagggg

SEQ ID NO: 471145 - RNA, 62 nt, Homo Sapiens
uuuaauuagcuguugcagaauaaguaauauauuuuaaaaaccuagcuccuuucauuauuuaa

SEQ ID NO: 471146 - RNA, 62 nt, Homo Sapiens
ugugaugagagaauucagauauacuuuaucuuuuuaaaaaaguguaaauaaaaucaaagaau

SEQ ID NO: 471147 - RNA, 62 nt, Homo Sapiens
aguaguacuuuaccagggugcuuuuaaguuacuuuaaaaaaagccuacaaaauauuuuuuuu

SEQ ID NO: 471148 - RNA, 62 nt, Homo Sapiens
uuuguguauucauguuuaaagaaaaaaagugauuuaaaaaugaucuuaccuguaccagaaaa

SEQ ID NO: 471149 - RNA, 62 nt, Homo Sapiens
gcuuuauauuugcuuauuuguuguagcuacauuuuaaaaaaaagauugaacuugaugacuua

SEQ ID NO: 471150 - RNA, 62 nt, Homo Sapiens
cuuaaugguguuagaaaucaacaaaacuccuuuuuaaaaagaaaagauauuaagccugccua

SEQ ID NO: 471151 - RNA, 62 nt, Homo Sapiens
caguagauaggaaaccaguuauuccuucuaccuuuaaaaauuuugagaacuugccaaccagg

SEQ ID NO: 471152 - RNA, 62 nt, Homo Sapiens
ucuuucaucaggaaaccuuauucaggaggguuuuuaaaaaguguuuaaaugucaaaugugaa

SEQ ID NO: 471153 - RNA, 62 nt, Homo Sapiens
auguuaguuuuccuuagcugauuuugaggguuuuuaaaaauaaagcaagguugacuaaccua

SEQ ID NO: 471154 - RNA, 62 nt, Homo Sapiens
auuauaugcuaaagaauaaaacuccaguuagauuuaaaaaaaucccauuuacaagcauugca

SEQ ID NO: 471155 - RNA, 62 nt, Homo Sapiens
cuugugaugucugacgcaugauggccuaugguuuuaaaaauaguauuguggaauauauuuuu

SEQ ID NO: 471156 - RNA, 62 nt, Homo Sapiens
cagauuuuuugaaccauccacuuacauauauuuuuaaaaaaugaaauccuuuuccuguucau

SEQ ID NO: 471157 - RNA, 62 nt, Homo Sapiens
auucuguauuggauauauaagagcaugaaauuuuuaaaaauacacuugugauuauaaaauua

SEQ ID NO: 471158 - RNA, 62 nt, Homo Sapiens
auuuuaaaacuauuuuuauauuuuuuuaaaucuuuaaaaauuuuaauuacugugauauugau

SEQ ID NO: 471159 - RNA, 62 nt, Homo Sapiens
guucuuuaaguguacaucguaauuugaccuaauuuaaaaauaauauauuuucgaaguaguag

SEQ ID NO: 471160 - RNA, 62 nt, Homo Sapiens
uacauuuuaugucguuuaauauaauuauuuacuuuaaaaauuguacuucagaacaucagauu

SEQ ID NO: 471161 - RNA, 62 nt, Homo Sapiens
cucucaaaaauuaauuuuuauuccuuaagcauuuuaaaaacauuuuaaaaaauguuuuguaa

SEQ ID NO: 471162 - RNA, 62 nt, Homo Sapiens
uaauuuuuauuccuuaagcauuuuaaaaacauuuuaaaaaauguuuuguaaauccaggugua

SEQ ID NO: 471163 - RNA, 62 nt, Homo Sapiens
gacuucagguaugcuaauuuggccauuaauuauuuaaaaacuaaauauucccucaaaagggc

SEQ ID NO: 471164 - RNA, 62 nt, Homo Sapiens
auguuuaauauauuuuauuuuuuaauugucuuuuuaaaaaauuuaguuuaugacuuugcagu

SEQ ID NO: 471165 - RNA, 62 nt, Homo Sapiens
uaaaauagaaaagaacaagugaauuguugcuauuuaaaaaaauuuuacaauucuuacuaagg

SEQ ID NO: 471166 - RNA, 62 nt, Homo Sapiens
uaauaaauuugacucauuaaaaaccuuuuuuuuuuaaaaaaaaaaaaaaagaaaaucucauu

SEQ ID NO: 471167 - RNA, 62 nt, Homo Sapiens
acuuaucuuugcagcugaguacuuaaauucuuuuuaaaaagauacccuuuggauugaucaca

SEQ ID NO: 471168 - RNA, 62 nt, Homo Sapiens
ccacaacaguuagggaaaugaugcuagagcacuuuaaaaaucagcaggacaacccugaggca

SEQ ID NO: 471169 - RNA, 62 nt, Homo Sapiens
aaauugaaugaaaaggagcuugugcaaaaaaauuuaaaaauggaugucaagauguuauguaa

SEQ ID NO: 471170 - RNA, 62 nt, Homo Sapiens
uuauacagaucauucauauguguacauaaaauuuuaaaaauaaagggaauugacugcuuugu

SEQ ID NO: 471171 - RNA, 62 nt, Homo Sapiens
aaacaacccccacacagaccccgcaauccuuuuuuaaaaaaucugccaauagacccaggacg

SEQ ID NO: 471172 - RNA, 62 nt, Homo Sapiens
cccaggacgaguaagagaggaagcaucaaccuuuuaaaaauuuccuuucgcuuucauuauuu

SEQ ID NO: 471173 - RNA, 62 nt, Homo Sapiens
aauacuguuucagaguucuaaaaaggcaguuuuuuaaaaaacuuaaguugauaaaaacugua

SEQ ID NO: 471174 - RNA, 62 nt, Homo Sapiens
uuaaacauggugugguauucuaaagccuuuuuuuuaaaaaaagagaucuuuuugagagaaac

SEQ ID NO: 471175 - RNA, 62 nt, Homo Sapiens
aaucuauaguaaaacauguagcuauaacauauuuuaaaaauaaaaucugaaaaccucagaaa

SEQ ID NO: 471176 - RNA, 62 nt, Homo Sapiens
ugagauuuuccuucuuacacuguuaaucuuauuuuaaaaaauauuacauucuuguauacuuu

SEQ ID NO: 471177 - RNA, 62 nt, Homo Sapiens
acuucauggaugagauugaugcagcccuugauuuuaaaaauguguccauuguugcauuuuau

SEQ ID NO: 471178 - RNA, 62 nt, Homo Sapiens
uuccuuucuucagugggccauuguuuuagauauuuaaaaaauccaacaguuucuaucauaau

SEQ ID NO: 471179 - RNA, 62 nt, Homo Sapiens
ccuacagaugaguaaugaaguuaucuuuuuuguuuaaaaaaaaaaaaaacacugcauuaaaa

SEQ ID NO: 471180 - RNA, 62 nt, Homo Sapiens
uauauuaccuauuaguuuuggaguucuuuauguuuaaaaauucagguguaaauuuuauugcc

SEQ ID NO: 471181 - RNA, 62 nt, Homo Sapiens
aaacuaggaaaagguuaaacuggauuuuuuuuuuuaaaaaaaagaaaaaaaaagaagaaaag

SEQ ID NO: 471182 - RNA, 62 nt, Homo Sapiens
guauuauuaaucuucugacauuuucuuauguuuuuaaaaagauaagagcaucuagugcauua

SEQ ID NO: 471183 - RNA, 62 nt, Homo Sapiens
agaaaauuauucaaauuuggacauuuuaauuguuuaaaaauuguacaaaaggaaaaaauuag

SEQ ID NO: 471184 - RNA, 62 nt, Homo Sapiens
auaaguacuggcgaaccaucucuguggucuuguuuaaaaagggcaaaaguuuuagacuguac

SEQ ID NO: 471185 - RNA, 62 nt, Homo Sapiens
aagaguaucuguaaauaaaaggguuccaaccuuuuaaaaaagaaggaaaaaacuuuuuggug

SEQ ID NO: 471186 - RNA, 62 nt, Homo Sapiens
aacuuuuuggugcuccaguguagggcuaucuuuuuaaaaaaugucaacaaagggaaaauaaa

SEQ ID NO: 471187 - RNA, 62 nt, Homo Sapiens
uuuugcucuuguauggcaaaauaauuagugaguuuaaaaaaaaucuauaguuuccaauaaac

SEQ ID NO: 471188 - RNA, 62 nt, Homo Sapiens
ucauucauuuauucauucauucaucgaguaacuuuaaaaaaaucauaugcuauguucccagu

SEQ ID NO: 471189 - RNA, 62 nt, Homo Sapiens
agaguaaauagcauucucuaucaauauauaaauuuaaaaaacuaucuuuuugcuuacaguuu

SEQ ID NO: 471190 - RNA, 62 nt, Homo Sapiens
ggauaugcuagaaaaggcauuuugggguuauguuuaaaaaaacauuauugucccacaauauu

SEQ ID NO: 471191 - RNA, 62 nt, Homo Sapiens
ccaaauuagccagacaugguggcaugcgcuuguuuaaaaaaacaaauaaauaaauaaucgac

SEQ ID NO: 471192 - RNA, 62 nt, Homo Sapiens
ucacuacuguuaucacaucccuuuguauaaguuuuaaaaagagauggagggagaucuucauu

SEQ ID NO: 471193 - RNA, 62 nt, Homo Sapiens
auauccaaacuuaauuuggcuaggacuucaauuuuaaaaaucaguguaccuaggcagugcac

SEQ ID NO: 471194 - RNA, 62 nt, Homo Sapiens
aacucuuauuuuuauuuuugaagguuuuuuuuuuuaaaaaaaaaaacguauaaaauaaugcc

SEQ ID NO: 471195 - RNA, 62 nt, Homo Sapiens
aucugauagggccuuggaggagaagguccaguuuuaaaaaaugacaguuuguguuuaauaaa

SEQ ID NO: 471196 - RNA, 62 nt, Homo Sapiens
auagagcuauucaugccauuuuuugggaaaacuuuaaaaauugccccaaauacugacauuga

SEQ ID NO: 471197 - RNA, 62 nt, Homo Sapiens
aauccuuguucaguucuuaaguuucgguuuuuuuuaaaaacaggaugcaacuuaaacuuuuc

SEQ ID NO: 471198 - RNA, 62 nt, Homo Sapiens
aaaaauaaacaaaaaaaauuaaaccaaugaacuuuaaaaaaucgauuuugagaauguacuaa

SEQ ID NO: 471199 - RNA, 62 nt, Homo Sapiens
gggcuaacgguuugaauagaaaaauaaaucaauuuaaaaaauauaacacaacaauaaggaga

SEQ ID NO: 471200 - RNA, 62 nt, Homo Sapiens
aaugaaauuauuuaaggguuguagguuguaacuuuaaaaauagacaagauguuaauuucucu

SEQ ID NO: 471201 - RNA, 62 nt, Homo Sapiens
cguguaugcugggauacccaucagagggggcuuuuaaaaaagauuuucaccaccucuggugu

SEQ ID NO: 471202 - RNA, 62 nt, Homo Sapiens
aucuguaguuuuuuuggugcugaauuuguccauuuaaaaaugcucagaaauugaaagcacua

SEQ ID NO: 471203 - RNA, 62 nt, Homo Sapiens
uauuuugaaaggucagaauucaaaaaaauguuuuuaaaaaccuaaaagcaaauacugauuuu

SEQ ID NO: 471204 - RNA, 62 nt, Homo Sapiens
ggcauuuuaaguguuuaaaacugcaaggauuuuuuaaaaauuugaaagaaacuaagauuuau

SEQ ID NO: 471205 - RNA, 62 nt, Homo Sapiens
ggaaaagaaaaugugaaacaguuacaugauuuuuuaaaaaaaacuuuuuuuucauucucauu

SEQ ID NO: 471206 - RNA, 62 nt, Homo Sapiens
aaaaagaaaaaaaagaguuuacuugccccuuauuuaaaaaaacuccacacugaucuuuggaa

SEQ ID NO: 471207 - RNA, 62 nt, Homo Sapiens
uguggcaucccauuguucauguuaaaaguuguuuuaaaaagcaugauacugaucuuauaucu

SEQ ID NO: 471208 - RNA, 62 nt, Homo Sapiens
uauacaaugccaguuugcaaauaacuucugaauuuaaaaaguauuaagcacccauaccauuu

SEQ ID NO: 471209 - RNA, 62 nt, Homo Sapiens
uuuguuuuagacugccuuguguucuucguauuuuuaaaaaaaaccucuucccuucaauaucu

SEQ ID NO: 471210 - RNA, 62 nt, Homo Sapiens
cuuguuccaaaguccugucuaguauuauacaauuuaaaaacuuauauucauagauccucuca

SEQ ID NO: 471211 - RNA, 62 nt, Homo Sapiens
ccugccuaaaguaaacacuuuugcugcuuuauuuuaaaaaauuugucuuaucugcgugggua

SEQ ID NO: 471212 - RNA, 62 nt, Homo Sapiens
gaaaaaggcugcuugauguaaggcaucucugauuuaaaaaaaguacaucuugaaauuugggg

SEQ ID NO: 471213 - RNA, 62 nt, Homo Sapiens
cagcugcuccaaaaucaucaauaaagcauuuuuuuaaaaaguugcucuuccucaccugucac

SEQ ID NO: 471214 - RNA, 62 nt, Homo Sapiens
uuguuucacugucacauaugaucaguuuuuuguuuaaaaaccguaaauuuuauuuuaauaaa

SEQ ID NO: 471215 - RNA, 62 nt, Homo Sapiens
uuauuauugacaucccaauagaaccagccauuuuuaaaaagguuuuauuuucucugucugaa

SEQ ID NO: 471216 - RNA, 62 nt, Homo Sapiens
ggucauauuaugagucaaaguauuuucuaauuuuuaaaaaaugcugugauauugauagcuuu

SEQ ID NO: 471217 - RNA, 62 nt, Homo Sapiens
aaaaagaaguggguaagaaacucggcuuuuaauuuaaaaaaauuuauuaucccagggacuac

SEQ ID NO: 471218 - RNA, 62 nt, Homo Sapiens
uaaguaaaucuaggcuauuuuuuuaaugagcauuuaaaaaaauuacuacauaguauacaagu

SEQ ID NO: 471219 - RNA, 62 nt, Homo Sapiens
uuuuugaaaauugcaauuuccuaaugcuaacuuuuaaaaauguacuaauuacuaacuuguua

SEQ ID NO: 471220 - RNA, 62 nt, Homo Sapiens
caaugcacauguugguuguggucacugauuuuuuuaaaaaaguuaauaugacauuugucauu

SEQ ID NO: 471221 - RNA, 62 nt, Homo Sapiens
caggcuuuguugggaggguauggugcaaugucuuuaaaaaaauugagcugcugagauuucag

SEQ ID NO: 471222 - RNA, 62 nt, Homo Sapiens
guuuucuccugcugcaguaaaaaaaaauguuguuuaaaaaauguucauacauuugaaaagaa

SEQ ID NO: 471223 - RNA, 62 nt, Homo Sapiens
aaacauuucacucaguugcagaaugauuaaaauuuaaaaaaaccucaguucaaaccuuuagg

SEQ ID NO: 471224 - RNA, 62 nt, Homo Sapiens
aaaaaaaaaaaaaaaaaaaagucacgcaagacuuuaaaaaaauguauaaagggcagucugug

SEQ ID NO: 471225 - RNA, 62 nt, Homo Sapiens
aaacccaaauucuaagcacuacuuuauaagacuuuaaaaaaauugagggauuuauuucuuua

SEQ ID NO: 471226 - RNA, 62 nt, Homo Sapiens
aaaccagagguuauauacaauuuaugccacaauuuaaaaauaaguguauauuaggauuuaaa

SEQ ID NO: 471227 - RNA, 62 nt, Homo Sapiens
cauauuuuaagugggauuugcauucauggcaauuuaaaaaguuuuacuuguuuuuaauuauu

SEQ ID NO: 471228 - RNA, 62 nt, Homo Sapiens
ugcuauuuccaguuaaugcauuugauuaagacuuuaaaaaaauuguuuuauccauuaucauc

SEQ ID NO: 471229 - RNA, 62 nt, Homo Sapiens
uaacagcuggaaacuuggaccaaauuauauuuuuuaaaaauugcuaaguucuaucagagacc

SEQ ID NO: 471230 - RNA, 62 nt, Homo Sapiens
uuuuuauuugcauggcuguaaugaccucugacuuuaaaaaaggaaauguucuacaucucuga

SEQ ID NO: 471231 - RNA, 62 nt, Homo Sapiens
uuuagaacuuuuuuaaaaucaagaccccauccuuuaaaaaauuccagccugggcaauauagc

SEQ ID NO: 471232 - RNA, 62 nt, Homo Sapiens
uaggauagaggguacagugguaauggugagcuuuuaaaaaugcuauaauaauuaguacuauu

SEQ ID NO: 471233 - RNA, 62 nt, Homo Sapiens
auacauguagcucaacuugagcaaaauaguuuuuuaaaaauuaaacaaaaaauuuuaccugu

SEQ ID NO: 471234 - RNA, 62 nt, Homo Sapiens
uaauuuaguaucaaggcuucuacuguguauuuuuuaaaaaaagcucaagcaugcaguaugaa

SEQ ID NO: 471235 - RNA, 62 nt, Homo Sapiens
guguaugaccauuaauguauuacuagauuuaguuuaaaaauuuauguuccauccucuguugu

SEQ ID NO: 471236 - RNA, 62 nt, Homo Sapiens
gcuuuaaggauaaagaauaacucccaguuuacuuuaaaaaugcauauauuacuaaguugccu

SEQ ID NO: 471237 - RNA, 62 nt, Homo Sapiens
aacauaacuuuguaaauauugguacuuuuuuauuuaaaaaaaauaucugcaaucuuugccaa

SEQ ID NO: 471238 - RNA, 62 nt, Homo Sapiens
aguuuugaugaaaggagggacuaguuuguuacuuuaaaaaucaauauuuacauuuugcuaac

SEQ ID NO: 471239 - RNA, 62 nt, Homo Sapiens
aaaaggcagaaaacccaccauuauuuaauuuguuuaaaaaaaacaaugacaaauaugccagu

SEQ ID NO: 471240 - RNA, 62 nt, Homo Sapiens
uauuuuuuacccuaauacuuaacaaaaauaauuuuaaaaagugaaugcuuuauguuuaggac

SEQ ID NO: 471241 - RNA, 62 nt, Homo Sapiens
uuucuuuuuuguuguuguuauuggaagauucuuuuaaaaauuaaaaaaugcuaauaagaaaa

SEQ ID NO: 471242 - RNA, 62 nt, Homo Sapiens
gcuaauaagaaaauuggaagaugguauuaccuuuuaaaaaauuucggaaaauuaagucagag

SEQ ID NO: 471243 - RNA, 62 nt, Homo Sapiens
gucuauuguuaaauuuugaggcaguuugguauuuuaaaaauugacgguuucuuuuaauuuug

SEQ ID NO: 471244 - RNA, 62 nt, Homo Sapiens
cgguuucuuuuaauuuuggcaaaacuuggauauuuaaaaagaaguagagccaaguuggccaa

SEQ ID NO: 471245 - RNA, 62 nt, Homo Sapiens
uguuaaugucaauaugaugaugagagacacuuuuuaaaaaugguuuuauuaaauauuacacu

SEQ ID NO: 471246 - RNA, 62 nt, Homo Sapiens
acauuuauagauugaucagauuggaacucucuuuuaaaaaguuuaccuauuauccaccucug

SEQ ID NO: 471247 - RNA, 62 nt, Homo Sapiens
aaaaucaaccagguuguggucugaaaucaguguuuaaaaaaaaguggauucagccauugugc

SEQ ID NO: 471248 - RNA, 62 nt, Homo Sapiens
cucccauuaaaaacaaaacaaaaaaagaaaacuuuaaaaaaauuucuuuuuuuuuuuuuuua

SEQ ID NO: 471249 - RNA, 62 nt, Homo Sapiens
gaaaacuuuaaaaaaacuccuuuuuuuuuuuuuuuaaaaaaagccguuuguccuuaacuuuc

SEQ ID NO: 471250 - RNA, 62 nt, Homo Sapiens
gcacguuuuggugauuuuuaaacauauacacauuuaaaaauacuguacuuuaaaaaaccaac

SEQ ID NO: 471251 - RNA, 62 nt, Homo Sapiens
caacaacauauacacauuuacuacuccuguacuuuaaaaaacuuucauauuuaauacuucua

SEQ ID NO: 471252 - RNA, 62 nt, Homo Sapiens
ucuuuaccuuuuccuugagcugauugcugcacuuuaaaaaauacauuagucacaagaauccc

SEQ ID NO: 471253 - RNA, 62 nt, Homo Sapiens
uguuguacgaaauuuuacuaugaauuugaaacuuuaaaaaaaaauuaaacauuuggaacauu

SEQ ID NO: 471254 - RNA, 62 nt, Homo Sapiens
caucccauaaaacaguagaaaagauuagcuuuuuuaaaaaaauuuuuauuuucuuggcacua

SEQ ID NO: 471255 - RNA, 62 nt, Homo Sapiens
auuuaaaucauguguauacaaaacuguuaaaauuuaaaaaaauacuuuauuaagauugccaa

SEQ ID NO: 471256 - RNA, 62 nt, Homo Sapiens
aauugcagaaguucauuuguucguucucugucuuuaaaaaucuagagaaguggcugugaaag

SEQ ID NO: 471257 - RNA, 62 nt, Homo Sapiens
ugcucauucaacuugaaucuccacccccaaaguuuaaaaauaugagaugggguggacuaaga

SEQ ID NO: 471258 - RNA, 62 nt, Homo Sapiens
uuuuuaaguacuugaauuuuauuuaauuauuuuuuaaaaaacuucauugagaugaguagugc

SEQ ID NO: 471259 - RNA, 62 nt, Homo Sapiens
gcaugggaagauuuuuauuuaauauuuucuuauuuaaaaaaaguacaaauaacaagacuaau

SEQ ID NO: 471260 - RNA, 62 nt, Homo Sapiens
uauauuugucucuuagaguuuuuaauuucuuuuuuaaaaaauuuagcauaagacgugauauu

SEQ ID NO: 471261 - RNA, 62 nt, Homo Sapiens
guaaaaguugcugcuuucuacuagcuuuuuuuuuuaaaaaaacucauuuuuacaugcugcua

SEQ ID NO: 471262 - RNA, 62 nt, Homo Sapiens
aaaaggcaggcagacagaaaauagucuucauuuuuaaaaacaaagacaaacuuguuucaaug

SEQ ID NO: 471263 - RNA, 62 nt, Homo Sapiens
aauaaaaauuucaaauguuucuggauuuuaaauuuaaaaaucaaacaauuuugugguuaaaa

SEQ ID NO: 471264 - RNA, 62 nt, Homo Sapiens
uuaauuuguccuuccuaagauuaaaaguuuaauuuaaaaaaucuguuagauguuguuauauu

SEQ ID NO: 471265 - RNA, 62 nt, Homo Sapiens
gucucuuuguuuuguacaguuuuggcaaguuguuuaaaaaauaaaacacacucauaaguaag

SEQ ID NO: 471266 - RNA, 62 nt, Homo Sapiens
auuguauggauaguaaaauuuuuaacuugagcuuuaaaaaucaccaaaugcuuuaaaaacua

SEQ ID NO: 471267 - RNA, 62 nt, Homo Sapiens
auuuaacuugagcuuuaaaaaguaccaaaugcuuuaaaaacuaaaacuguauugaugacagu

SEQ ID NO: 471268 - RNA, 62 nt, Homo Sapiens
ugccauaacuauuaaacaccauuuaauaugcauuuaaaaaaagauacagucuaacucaucug

SEQ ID NO: 471269 - RNA, 62 nt, Homo Sapiens
aaucuuguugcugauuugucauaauguacagauuuaaaaacacuauuguuugggccuugugg

SEQ ID NO: 471270 - RNA, 62 nt, Homo Sapiens
cauagucuuauuaaccauguuaaaauauaggcuuuaaaaaagauuaaaaaauaaaauaaaua

SEQ ID NO: 471271 - RNA, 62 nt, Homo Sapiens
uuguuuaaaguauacucuuaaucaacacacauuuuaaaaaauaaugaacaucuauaaaaugu

SEQ ID NO: 471272 - RNA, 62 nt, Homo Sapiens
uuuucuugaacuccuggccaagguuuauuauuuuuaaaaaaccaguuaggguaacacuuuag

SEQ ID NO: 471273 - RNA, 62 nt, Homo Sapiens
ccagcagaauguaauucaguuagucuagagccuuuaaaaaacggagacacaagauguuuuua

SEQ ID NO: 471274 - RNA, 62 nt, Homo Sapiens
uaagaugaaaaaagugcgcagagguauacuuauuuaaaaaacagaaggcaaagcagaaagaa

SEQ ID NO: 471275 - RNA, 62 nt, Homo Sapiens
cgcuaagaaggcaaagcagauaaauguguguuuuuaaaaaugacuggggggaguuaccaacu

SEQ ID NO: 471276 - RNA, 62 nt, Homo Sapiens
uggaaaaacaacccagacgaguauuuuauacauuuaaaaauaaaacaaauuuuaaaauuaaa

SEQ ID NO: 471277 - RNA, 62 nt, Homo Sapiens
aaugguuaaaagguuuuaugaagcuuaaaauguuuaaaaauauauuguuauauuucaauaag

SEQ ID NO: 471278 - RNA, 62 nt, Homo Sapiens
auaucuagaaugggcaagaaauuuuaucauaauuuaaaaaauugguaaauuuuguuauguau

SEQ ID NO: 471279 - RNA, 62 nt, Homo Sapiens
aaugaaauucugauaaauacauauuauuuagcuuuaaaaagggcuauaauacauacaaugga

SEQ ID NO: 471280 - RNA, 62 nt, Homo Sapiens
acaguuccuaguguuuuuaguauugucuuguuuuuaaaaaauuaaagcaagaaaaucugaag

SEQ ID NO: 471281 - RNA, 62 nt, Homo Sapiens
uauguaguucugugucaaaaguggauuaccaauuuaaaaauaagguuuuguguauaucuuau

SEQ ID NO: 471282 - RNA, 62 nt, Homo Sapiens
auaaauaaaaauuaaaaaaaccucuguuauuguuuaaaaaaaagguccacaucugugguuga

SEQ ID NO: 471283 - RNA, 62 nt, Homo Sapiens
uacaucaagagaggcagucauguaauaauauuuuuaaaaauuguuaguggggacuaugauac

SEQ ID NO: 471284 - RNA, 62 nt, Homo Sapiens
aaucucaaacaaaagacuuguugcuaccuuaguuuaaaaaacgccauuacauggcaaaaugu

SEQ ID NO: 471285 - RNA, 62 nt, Homo Sapiens
aaaccaauaaaauuuuuauuuuguuuauagguuuuaaaaaccaagugaucaaacuaagaaua

SEQ ID NO: 471286 - RNA, 62 nt, Homo Sapiens
ugaaaaauuacaggugagauuuugaaacagauuuuaaaaacuacgguuagaagaagcuaaua

SEQ ID NO: 471287 - RNA, 62 nt, Homo Sapiens
aacaaugauaacaacauaguucauaugcuguauuuaaaaagcacagguuaagagauccuguu

SEQ ID NO: 471288 - RNA, 62 nt, Homo Sapiens
acuucuacuugguuuuuugaguuuucaagacuuuuaaaaagccccauccuccugaagccuuc

SEQ ID NO: 471289 - RNA, 62 nt, Homo Sapiens
aaaaagaugacaaagaaaaaugaaaauguuuauuuaaaaaaagccuucuuuuggacaaaccu

SEQ ID NO: 471290 - RNA, 62 nt, Homo Sapiens
aaaaauguggaggaaaguagaugauuccuuucuuuaaaaaaaagccaucaauauucagcaaa

SEQ ID NO: 471291 - RNA, 62 nt, Homo Sapiens
ggauuauuggcuuguuuucuauuguuuuuuaauuuaaaaaaagcauuacucuuuuucaauaa

SEQ ID NO: 471292 - RNA, 62 nt, Homo Sapiens
gcuauacuaagggaaagaaugugguuuuguaauuuaaaaagugagauagaauacauguaagu

SEQ ID NO: 471293 - RNA, 62 nt, Homo Sapiens
uuuuaugcauguuaaguauguuaaguuuguauuuuaaaaauaacauucagaaucuggccaau

SEQ ID NO: 471294 - RNA, 62 nt, Homo Sapiens
uaccuuuaauacaauccuuagauuucuaagguuuuaaaaaguuauaacauuuaugugcuuaa

SEQ ID NO: 471295 - RNA, 55 nt, Homo Sapiens
ggaaaauaugaaaucuggugauuuuuuuaaaaaugaagauucacagaaauucuga

SEQ ID NO: 471296 - RNA, 62 nt, Homo Sapiens
uaaauauucuaauguagcuaucagagcaguuuuuuaaaaaaauuugguacacugggcagacu

SEQ ID NO: 471297 - RNA, 62 nt, Homo Sapiens
aaaagccaauugaacaacagugauuugauuuuuuuaaaaaucguagcucuuacaaaguuuau

SEQ ID NO: 471298 - RNA, 62 nt, Homo Sapiens
ccagaacaagugcugggucugucacagagaaguuuaaaaaagaaaacuaagauuauaaauua

SEQ ID NO: 471299 - RNA, 62 nt, Homo Sapiens
uuuuaaaaucaauagauucaucaccuuaguuuuuuaaaaaaaaucuauaaauaggguaauug

SEQ ID NO: 471300 - RNA, 62 nt, Homo Sapiens
aucuagguagcaugaacaaauuauaaaauuuguuuaaaaaagcaaacuugcaugcauuauug

SEQ ID NO: 471301 - RNA, 62 nt, Homo Sapiens
agcaaacuugcaugcauuauugugacuucaaguuuaaaaaaucgucuuacauguguacaaua

SEQ ID NO: 471302 - RNA, 62 nt, Homo Sapiens
ucaccaaauguaagacccauaagaaacccauauuuaaaaaucugaauuuuuuagaagaaugc

SEQ ID NO: 471303 - RNA, 62 nt, Homo Sapiens
cuaagcaaagcacccaacaaugguaaauguuuuuuaaaaaugcagaacuaagauuuuugacu

SEQ ID NO: 471304 - RNA, 62 nt, Homo Sapiens
caaaaguaugacuguggaggaaaaaaaaauacuuuaaaaauccacacuuuuuguuaagaagg

SEQ ID NO: 471305 - RNA, 62 nt, Homo Sapiens
caccaaaaaguugacuuugaauuuguuggacuuuuaaaaaaccaguuggaaauauagguugg

SEQ ID NO: 471306 - RNA, 62 nt, Homo Sapiens
ugaguugaccaauaaauaaaaauaccacuuucuuuaaaaaagccuagggaauugaagcucug

SEQ ID NO: 471307 - RNA, 62 nt, Homo Sapiens
aaaauuaaguaccaaaccuauuaggaaauuuuuuuaaaaaguggauuuaacuuaaauuacug

SEQ ID NO: 471308 - RNA, 62 nt, Homo Sapiens
uuuuugaccaguuucuuuucuuuuguuuuuuuuuuaaaaaagacauuuaaagacaaagacau

SEQ ID NO: 471309 - RNA, 62 nt, Homo Sapiens
guggagacauauuucagugauuuuuaguaaccuuuaaaaauguauaaugacuuuuaaaauuu

SEQ ID NO: 471310 - RNA, 62 nt, Homo Sapiens
uuuucuuuaugcauggaagcaucaauaaauuguuuaaaaaccauguauaguaaauucagcuu

SEQ ID NO: 471311 - RNA, 62 nt, Homo Sapiens
uccuuucaauauucugggaacccagggaaguuuuuaaaaaugucauuacuuucaaaggaaca

SEQ ID NO: 471312 - RNA, 62 nt, Homo Sapiens
aguacuugaaauguauugacugcugacuauauuuuaaaaacaaaaugaaauaauuugaguug

SEQ ID NO: 471313 - RNA, 62 nt, Homo Sapiens
ugauuucauugagcuucauugcagccugaaauuuuaaaaaaguuguguaauacgccaaccag

SEQ ID NO: 471314 - RNA, 62 nt, Homo Sapiens
gucugacuuuuguuaaauucaguaaugcaguuuuuaaaaaccuguaucugacccacuuugua

SEQ ID NO: 471315 - RNA, 62 nt, Homo Sapiens
caaacaguauuucugguguauauuuuaauguuuuuaaaaagaguaauuucauuuaaauaucu

SEQ ID NO: 471316 - RNA, 62 nt, Homo Sapiens
acuaggagcacuuugauguaaaccagaauagcuuuaaaaagacaaaaaggaucguagaucug

SEQ ID NO: 471317 - RNA, 62 nt, Homo Sapiens
guauuuuauauguaaaguaguauugcugacauuuuaaaaaaauacaaaauacaaaagaaacc

SEQ ID NO: 471318 - RNA, 62 nt, Homo Sapiens
uuguuuaucauaaaacauauuauguuccuaguuuuaaaaagacccaaaguaugauuaauaua

SEQ ID NO: 471319 - RNA, 62 nt, Homo Sapiens
uuugcugaauagguuuaagucagauaauagauuuuaaaaaagcaaaugaggcaaugugucaa

SEQ ID NO: 471320 - RNA, 62 nt, Homo Sapiens
aaagucaaaagaaacaaauagaagcuuuuuuuuuuaaaaaauguauugcuucugaacuuuuu

SEQ ID NO: 471321 - RNA, 62 nt, Homo Sapiens
gggcaggaagguaaugguuugaguagccuuuguuuaaaaaaaagacuaaauauauuuaaaag

SEQ ID NO: 471322 - RNA, 62 nt, Homo Sapiens
cugauaccuucaauuuguuacuuuucaagauuuuuaaaaauaacuaguguagcuuaucuuaa

SEQ ID NO: 471323 - RNA, 62 nt, Homo Sapiens
auugucaaacuaugguauuauuuuaauguuacuuuaaaaauccauaaucugcuaguuuugca

SEQ ID NO: 471324 - RNA, 62 nt, Homo Sapiens
aguuuugagaaauuauucagaagccuuguuauuuuaaaaaugaaauauuucaaagacugaau

SEQ ID NO: 471325 - RNA, 62 nt, Homo Sapiens
caguuugagaauacguuaauugcuauuuacuauuuaaaaaguuuuacugaaaucaguccaua

SEQ ID NO: 471326 - RNA, 62 nt, Homo Sapiens
uauaaaaaguguauaugcaguaugauaccacuuuuaaaaaaagauaaauuuauagaaaaaag

SEQ ID NO: 471327 - RNA, 62 nt, Homo Sapiens
auaauuaaaauaaauuguuagagaaaaguuacuuuaaaaauagcuauaacgcuuugcaauuu

SEQ ID NO: 471328 - RNA, 62 nt, Homo Sapiens
auuuaugggagccuauauaaacauaucuugcuuuuaaaaaguucuugagggaauagcaacuu

SEQ ID NO: 471329 - RNA, 62 nt, Homo Sapiens
ggggggauuguguuuaaaucaaauauauguauuuuaaaaauaaugacaugcucaaccuuccu

SEQ ID NO: 471330 - RNA, 62 nt, Homo Sapiens
auaauaguggcccugaaggaauaaauuccagcuuuaaaaaccaagucugaggaaauauuugg

SEQ ID NO: 471331 - RNA, 62 nt, Homo Sapiens
ccuuaaauuuuaucaauaacagaauuauuguauuuaaaaaaaaacuaauacuuaucuuuaaa

SEQ ID NO: 471332 - RNA, 62 nt, Homo Sapiens
acagagaauuuuaucaguaauaggugucaguuuuuaaaaaauugcuuguaggcugagcgcgg

SEQ ID NO: 471333 - RNA, 62 nt, Homo Sapiens
ucuuuuuguuucguuuuguuucuucuucugcauuuaaaaauuaaaagauugguuugaggaug

SEQ ID NO: 471334 - RNA, 62 nt, Homo Sapiens
uagaagaacggaucaugugccaacuguaguuuuuuaaaaaaaacgcuccuuuguaggguuuu

SEQ ID NO: 471335 - RNA, 62 nt, Homo Sapiens
agccaccacaccuggccuuucugcaacauuuuuuuaaaaaaaucuaauaaaucuuagauuuu

SEQ ID NO: 471336 - RNA, 62 nt, Homo Sapiens
uuuuuuuaaaaaaaucuaauaaaucuuagauuuuuaaaaaagaauuaaaaugugggaguucu

SEQ ID NO: 471337 - RNA, 62 nt, Homo Sapiens
uacuaauaucuacaugguccacacuuuucuauuuuaaaaaauuguguucucuuguuaaauag

SEQ ID NO: 471338 - RNA, 62 nt, Homo Sapiens
aucaaauacuaauaaacaauuagaaaucuuacuuuaaaaaacuuauaacucacuugucuuca

SEQ ID NO: 471339 - RNA, 62 nt, Homo Sapiens
aaucaucaucuagacuuguuaaguagaaaaauuuuaaaaauuugcuuaugaaaauauaaccc

SEQ ID NO: 471340 - RNA, 62 nt, Homo Sapiens
ucccaucaugccauuuuuuguucauuuuaaucuuuaaaaaauaaaaauuaggcauauuaauu

SEQ ID NO: 471341 - RNA, 62 nt, Homo Sapiens
ucauugucucccaaaguauuuaggagaagcccuuuaaaaagcugccuuccucuaccacuuug

SEQ ID NO: 471342 - RNA, 62 nt, Homo Sapiens
ugcauucuauuuucuauaugacccucuugauauuuaaaaaacacuauggauaacaauucuuc

SEQ ID NO: 471343 - RNA, 62 nt, Homo Sapiens
agggagaucauguuuucuuaaucaugcuggaauuuaaaaauuguuuuacuuguaucgaaauu

SEQ ID NO: 471344 - RNA, 62 nt, Homo Sapiens
cauuuaugguuuuuuauuacuauuauuaugguuuuaaaaagaguaacuuuauuucuuuuugu

SEQ ID NO: 471345 - RNA, 62 nt, Homo Sapiens
uuguuuuaauuuuuuauauauauguuuuuauuuuuaaaaaacauaccaguugaaugggguua

SEQ ID NO: 471346 - RNA, 62 nt, Homo Sapiens
uaauuacuaauuuuuaaagaacaaaucacacauuuaaaaaaucuguagaauuuauuuuaacu

SEQ ID NO: 471347 - RNA, 62 nt, Homo Sapiens
auugaugcuagagguaaaaaaaaauacuuguuuuuaaaaaauccuuuacgucuuguguaauu

SEQ ID NO: 471348 - RNA, 62 nt, Homo Sapiens
aucacugugucuguauuucaaguacaaauguuuuuaaaaaggauucuuuauacauaugugcu

SEQ ID NO: 471349 - RNA, 62 nt, Homo Sapiens
uggcuguuugcaggaaggcagacgagacaguguuuaaaaaguccacaagaaugaucaaguaa

SEQ ID NO: 471350 - RNA, 62 nt, Homo Sapiens
ugugauagagacaucucuaaaguauuuugaauuuuaaaaaaagauggcagauuuucugcauu

SEQ ID NO: 471351 - RNA, 62 nt, Homo Sapiens
uuagguuuaauauuuuuuuaguuagguagaguuuuaaaaaauacuugagccuguccgugaua

SEQ ID NO: 471352 - RNA, 62 nt, Homo Sapiens
ggaggaguauuuuuaguuugacaauuuaauaauuuaaaaacaagacaucuccagguaggaaa

SEQ ID NO: 471353 - RNA, 62 nt, Homo Sapiens
auccaaaugacauuaucugcacguuuuuaaaauuuaaaaacaaaggacuauuuaaaaauaca

SEQ ID NO: 471354 - RNA, 62 nt, Homo Sapiens
gcacguuuuuaaaauuuaaaaacaaaggacuauuuaaaaauacaguuuauuaacaaacguga

SEQ ID NO: 471355 - RNA, 62 nt, Homo Sapiens
agauuaacuucuuggucuccuuacccccuggguuuaaaaaucuucauaguuugagcugguau

SEQ ID NO: 471356 - RNA, 62 nt, Homo Sapiens
auguaagacuuugguucccauaaaauggcgccuuuaaaaaagcacuuguauucuuucuacug

SEQ ID NO: 471357 - RNA, 62 nt, Homo Sapiens
aguuuauuaucagauaucagaauuauuaaacauuuaaaaauuggcauuuuuaaacauuuaaa

SEQ ID NO: 471358 - RNA, 62 nt, Homo Sapiens
auuaaacauuuaaaaauuagcauuuuuaaacauuuaaaaauuuagaaauuaguuuuaucugg

SEQ ID NO: 471359 - RNA, 62 nt, Homo Sapiens
uuguaacacucagcagugcugcugauuauuaguuuaaaaaucaaagucugcugaaaagauuu

SEQ ID NO: 471360 - RNA, 62 nt, Homo Sapiens
aaucuuaaagccuguaauuucccauucuaccauuuaaaaaaauuggcuaacugcaugacaug

SEQ ID NO: 471361 - RNA, 62 nt, Homo Sapiens
uauuuauuuuaucuuuggggucaugaagguuauuuaaaaauggaaguauuuaacuaugaaua

SEQ ID NO: 471362 - RNA, 62 nt, Homo Sapiens
cuaugguagagaaugcugugauugaacauacuuuuaaaaacagaaauauuuguuaacagccc

SEQ ID NO: 471363 - RNA, 62 nt, Homo Sapiens
acaaaacugcaggacaguuuuaaauuagaauuuuuaaaaagcauuuauucuuuaaaucaaag

SEQ ID NO: 471364 - RNA, 62 nt, Homo Sapiens
uguauauaugugacugaaugauuuaaggagcauuuaaaaauaaaauuugucuaugcuuaggc

SEQ ID NO: 471365 - RNA, 62 nt, Homo Sapiens
ugaagcagaaccuuguaauuuuuuaaauuuuuuuuaaaaacugugcugcacaugggcugaau

SEQ ID NO: 471366 - RNA, 62 nt, Homo Sapiens
aguuggacuuuggcagcuuuaaaaaaucaauuuuuaaaaaauccagauuuuuauuaauguaa

SEQ ID NO: 471367 - RNA, 62 nt, Homo Sapiens
cuuccucuuucucuggggagagaaauaauuuuuuuaaaaaauguauaaguuucaccaccuug

SEQ ID NO: 471368 - RNA, 62 nt, Homo Sapiens
ucucuuuuguuaagaauaaaucaguuaauaguuuuaaaaaugcucacuggauguaaaaucua

SEQ ID NO: 471369 - RNA, 62 nt, Homo Sapiens
caucauguggccaaagaauguacauaugaagguuuaaaaauaaugauuuuuuuucuuaccuu

SEQ ID NO: 471370 - RNA, 62 nt, Homo Sapiens
aguguucuucuacaaaucuuucauuggcuuccuuuaaaaaaaagaaauaauuauuugguuau

SEQ ID NO: 471371 - RNA, 62 nt, Homo Sapiens
ugcccuaugaguaucaaccuagacuaugacauuuuaaaaaucuuucauugauauuugaaaac

SEQ ID NO: 471372 - RNA, 62 nt, Homo Sapiens
auaaaaggaagaugaguauuacuugcgugucuuuuaaaaauaaaguuggcauguuucguaaa

SEQ ID NO: 471373 - RNA, 62 nt, Homo Sapiens
gugauucucuaacagaccucaacuuugugcuuuuuaaaaaaaguacuuuucuugauacuguu

SEQ ID NO: 471374 - RNA, 62 nt, Homo Sapiens
uaauucagaugagacugagccaaaccaacacuuuuaaaaaaaaguuuuuucauuuaauaauu

SEQ ID NO: 471375 - RNA, 62 nt, Homo Sapiens
uuuucaguuucuucauuuuuuuauuuaaaauauuuaaaaaaauauauaaaucaaaguacaca

SEQ ID NO: 471376 - RNA, 62 nt, Homo Sapiens
aucugauuuuuaaaguaaauaauaaaauuuaauuuaaaaaguaauucuuaugucgcucaaaa

SEQ ID NO: 471377 - RNA, 62 nt, Homo Sapiens
aaaaauuagcugggcguggucuacaaaaaaauuuuaaaaaguagcauauugagacucugucu

SEQ ID NO: 471378 - RNA, 62 nt, Homo Sapiens
caguccugagagggauggacuuauuuuaugcauuuaaaaacauuauuuuaguccuauuugua

SEQ ID NO: 471379 - RNA, 62 nt, Homo Sapiens
acaaucuuaaggggauagacuuauuuugugcauuuaaaaaacuuauuucagcccuauuugua

SEQ ID NO: 471380 - RNA, 62 nt, Homo Sapiens
aaaacaaaaaauaccacagcgagauaggaauuuuuaaaaaucuugcuguauuugauuacuua

SEQ ID NO: 471381 - RNA, 62 nt, Homo Sapiens
aacuuuuuuuuuuugccuguuaaacgguuucauuuaaaaaguuuuuauucagcaguguucuu

SEQ ID NO: 471382 - RNA, 62 nt, Homo Sapiens
uggucuuuguuuuauaugauuccaggaucugauuuaaaaauauaaaauuuuuguuuaaacug

SEQ ID NO: 471383 - RNA, 62 nt, Homo Sapiens
uaaauuaauaucuaauuguauuauguucuacuuuuaaaaaaaacuguaguguuuauauaauu

SEQ ID NO: 471384 - RNA, 62 nt, Homo Sapiens
guauuguaauuccaugacccaggaaaguuauuuuuaaaaauuuuaacaaugucuauugguaa

SEQ ID NO: 471385 - RNA, 62 nt, Homo Sapiens
uuaagcuuuuugcucauuuguaaaaauuugguuuuaaaaauauaacuaguuucugagguauu

SEQ ID NO: 471386 - RNA, 62 nt, Homo Sapiens
ugguuuuaaaaauauuaagcguuucugagguauuuaaaaauuuaccucuuuugauauaacua

SEQ ID NO: 471387 - RNA, 62 nt, Homo Sapiens
auauaacauacuauauauguauaaaaguuauauuuaaaaaguuuuugucuucuuuuuaauau

SEQ ID NO: 471388 - RNA, 62 nt, Homo Sapiens
uuuuuuuggaccuaaauaauucuguugugauuuuuaaaaacuacauuuuauuuucucuuauu

SEQ ID NO: 471389 - RNA, 62 nt, Homo Sapiens
cuggaauaauuauaucuaucuaucuuuuaaguuuuaaaaaaauucuuaauucggcaauggaa

SEQ ID NO: 471390 - RNA, 62 nt, Homo Sapiens
aagcuaaugcuaguauauacgagaaaaaaaauuuuaaaaagagccuuuuaaaaaugcuuaua

SEQ ID NO: 471391 - RNA, 62 nt, Homo Sapiens
cuuauagagaaaaaaaauuuuuggguaugccuuuuaaaaaugauggugauuaaacaccucuu

SEQ ID NO: 471392 - RNA, 62 nt, Homo Sapiens
gucauuuuauuaagagugaauaauaaaacauuuuuaaaaauuuuuuuuuaaaagaagcuuug

SEQ ID NO: 471393 - RNA, 62 nt, Homo Sapiens
caaggcacagccuuugcccaauguacccauuuuuuaaaaaagaguuguuaaaaugagcauug

SEQ ID NO: 471394 - RNA, 62 nt, Homo Sapiens
auaaaguuuuauuccauucuuuauguguggaauuuaaaaagagggcuuuuucagcaucucgu

SEQ ID NO: 471395 - RNA, 62 nt, Homo Sapiens
aaaagcuggauaauauucucagagccauauucuuuaaaaaaaaacucaaaaucaauuuauua

SEQ ID NO: 471396 - RNA, 62 nt, Homo Sapiens
acauugaacuuagucuuuuuauuaaauauuacuuuaaaaagguguaaaugggaauucaugaa

SEQ ID NO: 471397 - RNA, 62 nt, Homo Sapiens
cacaguacuaauggguaacagcuucauccccauuuaaaaaaauacagguagugauuauuagu

SEQ ID NO: 471398 - RNA, 62 nt, Homo Sapiens
gaacuugucacuuuauauaaguaacugaauguuuuaaaaacaaaaaaaaucugcaagauaau

SEQ ID NO: 471399 - RNA, 62 nt, Homo Sapiens
aguacuguuuaaugcuaagucuguauacaugguuuaaaaaauuuauuaaucuugcuguugag

SEQ ID NO: 471400 - RNA, 62 nt, Homo Sapiens
gcuguuagucacagaguuuguguuuugccuuguuuaaaaauuaguccaaguaggaguugguu

SEQ ID NO: 471401 - RNA, 62 nt, Homo Sapiens
ccagcugccagagaccccaaucuaagugggccuuuaaaaaccucauuaagaaucuaaguucu

SEQ ID NO: 471402 - RNA, 62 nt, Homo Sapiens
ggaaggaaauacuacucauacuucugaaaauguuuaaaaauuugacugggguuugaucucag

SEQ ID NO: 471403 - RNA, 62 nt, Homo Sapiens
auacaauaaaguaaaaaccgguuucugaaggcuuuaaaaaaacagaaacucuuagguggaau

SEQ ID NO: 471404 - RNA, 62 nt, Homo Sapiens
augauaaucaucagguuuacccaaauuaaucuuuuaaaaauguaaacuacuuugaauagagg

SEQ ID NO: 471405 - RNA, 62 nt, Homo Sapiens
aguuuuauacauaaacaguuuaaaagguagguuuuaaaaauaauagagggguuuuagauuuu

SEQ ID NO: 471406 - RNA, 62 nt, Homo Sapiens
ugaauuggaauagaauugguauuaaucugcauuuuaaaaaacucguauggugcuagaguuag

SEQ ID NO: 471407 - RNA, 62 nt, Homo Sapiens
aacuauguugcuaugaauuaacaaaccugguuuuuaaaaaggaccagaacauucuauguacu

SEQ ID NO: 471408 - RNA, 62 nt, Homo Sapiens
aaacauuacuuuugucugcuggaacuuucgguuuuaaaaaagaguccaauguuucaucauca

SEQ ID NO: 471409 - RNA, 62 nt, Homo Sapiens
uaaacugcagggaauuucagggauuuaaaucauuuaaaaaacaugcuuuaaacaauaaagua

SEQ ID NO: 471410 - RNA, 62 nt, Homo Sapiens
aauaaaaagacauacuucuccuuaaaugaaaauuuaaaaauguugcucccaacugauuguca

SEQ ID NO: 471411 - RNA, 62 nt, Homo Sapiens
agcacaaccugcaacauacuggaugacaucuguuuaaaaacauacuuauagccuaugguccc

SEQ ID NO: 471412 - RNA, 62 nt, Homo Sapiens
uaagaguauuuugcauuaguagaaauacaacauuuaaaaaauacuauuaauauuuaaaaacg

SEQ ID NO: 471413 - RNA, 62 nt, Homo Sapiens
agaaauacaacauuuaaaaagaacuauuaauauuuaaaaacgcaugaaaaacuuagaauagu

SEQ ID NO: 471414 - RNA, 62 nt, Homo Sapiens
cuucaugagauacaauucacaguguuguuuuguuuaaaaagcuuuuuggucuaaguuacauc

SEQ ID NO: 471415 - RNA, 62 nt, Homo Sapiens
aaaaagacuacuacagguuauuuuauaaaaauuuuaaaaagauauuuugggaaauuagugua

SEQ ID NO: 471416 - RNA, 62 nt, Homo Sapiens
aaauacuuuacuuggauauucuguguguugaauuuaaaaaaaaaacaauguauauuauguuc

SEQ ID NO: 471417 - RNA, 62 nt, Homo Sapiens
aacaauguauauuauguuccauuaaccuuuuuuuuaaaaaaagaagaugaaaucauuccuaa

SEQ ID NO: 471418 - RNA, 62 nt, Homo Sapiens
ccauuugaagaccagagcuaguuaauuuucacuuuaaaaaagucuuugucuuaauaugcuaa

SEQ ID NO: 471419 - RNA, 62 nt, Homo Sapiens
auuuuguaauaaaauuaugugcauuucguuuuuuuaaaaaaauuuggguuuuuuaggauguu

SEQ ID NO: 471420 - RNA, 62 nt, Homo Sapiens
gcagguuguagcuuuuugauagagaaaauacuuuuaaaaaauuagcugauaagauucucugu

SEQ ID NO: 471421 - RNA, 62 nt, Homo Sapiens
aaagugcuucuuaucuuuguuguaagaguagguuuaaaaaaauaaggugcaauuucuaaauu

SEQ ID NO: 471422 - RNA, 62 nt, Homo Sapiens
aaaacgaaagugcuucucauaaccauccaaccuuuaaaaaacuguuuaacuaagggccaucc

SEQ ID NO: 471423 - RNA, 62 nt, Homo Sapiens
ugccuuagauucuauagugauuucagggguuauuuaaaaaucgauuccccgacuccauccuu

SEQ ID NO: 471424 - RNA, 62 nt, Homo Sapiens
agaacaacuguccuggcuggggaaguguucccuuuaaaaauaaagaguacagugcacuagag

SEQ ID NO: 471425 - RNA, 62 nt, Homo Sapiens
ggguuuuaaaucuucugucuagacuuccucaguuuaaaaaguuaaaugugcuaaguuauuug

SEQ ID NO: 471426 - RNA, 62 nt, Homo Sapiens
aguucaaaaauguucugcucuguuuuugacucuuuaaaaauaacuuagauucaaauuuauag

SEQ ID NO: 471427 - RNA, 62 nt, Homo Sapiens
aauaugcugaacauuagacauaauuaaaucuuuuuaaaaauugauaauuuaucucuguuuua

SEQ ID NO: 471428 - RNA, 62 nt, Homo Sapiens
guaagugcaauaauaugaaauagccuguacauuuuaaaaauguugucaccaaguuauauaaa

SEQ ID NO: 471429 - RNA, 62 nt, Homo Sapiens
cacaucucuguaaacaaccuuuuuuaaguaauuuuaaaaaaaauaaacacucugcuuacuac

SEQ ID NO: 471430 - RNA, 62 nt, Homo Sapiens
gcuuaaaacccuucaucaugauauccuguggauuuaaaaacucuaauuccauguuuucuucc

SEQ ID NO: 471431 - RNA, 62 nt, Homo Sapiens
aaauacuuuuuagguagccaugcuugagacuuuuuaaaaauauaacuuuuuccuuaaaguuu

SEQ ID NO: 471432 - RNA, 62 nt, Homo Sapiens
aauacuucauaauaugugaaaaacucggaucuuuuaaaaagcaucauagaucauuuuuccau

SEQ ID NO: 471433 - RNA, 62 nt, Homo Sapiens
agaucauuuuuccauaugacacugguuccgauuuuaaaaauuauuuuuaaauaaccgauuau

SEQ ID NO: 471434 - RNA, 62 nt, Homo Sapiens
auuuucaacuuuuucccucacuaauugguacuuuuaaaaacauaacauaaauuuuuugaagu

SEQ ID NO: 471435 - RNA, 62 nt, Homo Sapiens
aacccauaauugaaguguauaauauaaaaaauuuuaaaaaucuaagcagcuuauuguuucuc

SEQ ID NO: 471436 - RNA, 62 nt, Homo Sapiens
aauuucuacuucccuuaggcauuuuauaaaaauuuaaaaauuauuuuucuauuuuguuuaaa

SEQ ID NO: 471437 - RNA, 62 nt, Homo Sapiens
auuauuuucuuuauuguugguaaacuccauauuuuaaaaauuuaccuguauacauagugcuu

SEQ ID NO: 471438 - RNA, 62 nt, Homo Sapiens
aaaggcauucuuagauucauuuuaaccacauuuuuaaaaacucacaguugguuaacaugaug

SEQ ID NO: 471439 - RNA, 62 nt, Homo Sapiens
uuuuguuguuucuuaaauaagaaacuuuuuuauuuaaaaaacuaaaaacuagaggugagaaa

SEQ ID NO: 471440 - RNA, 62 nt, Homo Sapiens
aaucucaucucagugaagaauacuucucauuuuuuaaaaaagcuuaaaacuuugaaguuagc

SEQ ID NO: 471441 - RNA, 62 nt, Homo Sapiens
gagagauuuuucaaaagcaguaaucccucaauuuuaaaaaaggauugaaaauucuaaauguc

SEQ ID NO: 471442 - RNA, 62 nt, Homo Sapiens
auuuuuuaugccuccucaguaaccagaaauguuuuaaaaaacuaaguguuuaggauuucaag

SEQ ID NO: 471443 - RNA, 62 nt, Homo Sapiens
uuuuuguugaguaagcaaaauuacaaaguguuuuuaaaaaaaccuguacaaauauguuuaug

SEQ ID NO: 471444 - RNA, 62 nt, Homo Sapiens
uuuaucuaggauggaaaaucaggauagacucguuuaaaaacaaguauauuaaauggguuaaa

SEQ ID NO: 471445 - RNA, 62 nt, Homo Sapiens
ggacaaaguuccaaaaugccaaauucuuauuuuuuaaaaagcuaguucuauaaaauacuggu

SEQ ID NO: 471446 - RNA, 62 nt, Homo Sapiens
uauauguauauauaugcacauauauauauguauuuaaaaaaaucaaaacaaaaaaaaacuca

SEQ ID NO: 471447 - RNA, 62 nt, Homo Sapiens
guauuuuuuaaagcuacaaucuguucaauguuuuuaaaaaucuguuuauaugacauuguuaa

SEQ ID NO: 471448 - RNA, 62 nt, Homo Sapiens
uuaauaaaguauaagugauguuuuauaugauuuuuaaaaaaaauucucaagugcaauguguu

SEQ ID NO: 471449 - RNA, 62 nt, Homo Sapiens
ccauaugaguuuauauugauuuuuuuuuuccauuuaaaaauccacuaaugguguaaaagaga

SEQ ID NO: 471450 - RNA, 62 nt, Homo Sapiens
ugccacuuagaauagcauuugccacuuaguauuuuaaaaaauaauuguuggaguauuuauug

SEQ ID NO: 471451 - RNA, 62 nt, Homo Sapiens
aaugacuuuauacaacgauuguauuugugacuuuuaaaaauaauuauuuuauuguguaauug

SEQ ID NO: 471452 - RNA, 62 nt, Homo Sapiens
aggcuaaucauagaaaaaaaaccucuaguuuuuuuaaaaauagaauuuggaaacuuauuuuu

SEQ ID NO: 471453 - RNA, 62 nt, Homo Sapiens
uccugauucagaaauguguaugguuugcagcuuuuaaaaaccauuuuuuuaaaacuaauaaa

SEQ ID NO: 471454 - RNA, 62 nt, Homo Sapiens
aaugcaguagaaaguagugguaauaauuccuuuuuaaaaaaauuucgguagucauauaguaa

SEQ ID NO: 471455 - RNA, 62 nt, Homo Sapiens
auugugauauuagaggcuggaaauccuuauuuuuuaaaaaaucagauaggcauaaauaguua

SEQ ID NO: 471456 - RNA, 62 nt, Homo Sapiens
auuuaauaugaguuugagagagaaaauuguuuuuuaaaaauauaugugcauugaaaugaugg

SEQ ID NO: 471457 - RNA, 62 nt, Homo Sapiens
ggaacaguauucuuuauuuucuggguguuauauuuaaaaaagcaaguuuggauuuuuacacc

SEQ ID NO: 471458 - RNA, 62 nt, Homo Sapiens
uuuuuucauaguucuuguuuucauguuuuauuuuuaaaaagacauauaaagauugcauauuu

SEQ ID NO: 471459 - RNA, 62 nt, Homo Sapiens
uuauuaugacauuuccuaauaaaccccuuugauuuaaaaauguauuuuuaaaaauguuuaca

SEQ ID NO: 471460 - RNA, 62 nt, Homo Sapiens
ccuaauaaaccccuuugauuuaaaaauguauuuuuaaaaauguuuacauugaugaugaguaa

SEQ ID NO: 471461 - RNA, 62 nt, Homo Sapiens
uauauguguguguguguaacuaucauguggguuuuaaaaauccuuuuuuacagugguaucca

SEQ ID NO: 471462 - RNA, 62 nt, Homo Sapiens
uccaaggugcagugcacugugaaucuuuuauuuuuaaaaaaauuuguaggugcuuuuaugua

SEQ ID NO: 471463 - RNA, 62 nt, Homo Sapiens
uaaacaaacaauuugaaguuaaacauuucauuuuuaaaaacacugaauuacaguucuuauug

SEQ ID NO: 471464 - RNA, 62 nt, Homo Sapiens
caaaaaaccagugaaauucuacaagugucccuuuuaaaaauagugugugcuaacuaagggcu

SEQ ID NO: 471465 - RNA, 62 nt, Homo Sapiens
aaguucaaaauuuaaacaaguucauacaaguuuuuaaaaauucucaacugguagcuugcuug

SEQ ID NO: 471466 - RNA, 62 nt, Homo Sapiens
acuguguugcagaaguggcaaaagcgcuuauuuuuaaaaaugcaaaauauuuguacaaugua

SEQ ID NO: 471467 - RNA, 62 nt, Homo Sapiens
auaauguauguuagacagcaagaaaugaauacuuuaaaaagugauguauguuggaguuauaa

SEQ ID NO: 471468 - RNA, 62 nt, Homo Sapiens
auuuuuuuuuugcuaaauacuuuggaauucuauuuaaaaaauagaugaucaagaucuaaagg

SEQ ID NO: 471469 - RNA, 62 nt, Homo Sapiens
ggcuauuuugauuuggcaugacuacuuaauuuuuuaaaaaaauugugguuugugaauugcac

SEQ ID NO: 471470 - RNA, 62 nt, Homo Sapiens
uucuguacaaacaaaaaguauguaauacccauuuuaaaaaaccauuugaaaguagacaacuu

SEQ ID NO: 471471 - RNA, 62 nt, Homo Sapiens
cugaugcgacuuguuuugcugcuugguagcacuuuaaaaaauuuuuugauuaaugaagaaag

SEQ ID NO: 471472 - RNA, 62 nt, Homo Sapiens
aacauaauaagacuuuucucuacuuuaaauuuuuuaaaaaauuaguugggcauaguggcacu

SEQ ID NO: 471473 - RNA, 62 nt, Homo Sapiens
cuccagccugggugacagagcaauacccugucuuuaaaaauaaaagcuauuacuuggcaaau

SEQ ID NO: 471474 - RNA, 62 nt, Homo Sapiens
auauuuuaaauguccggauaauauucuagagguuuaaaaaauggaaauauuugaacuuucua

SEQ ID NO: 471475 - RNA, 62 nt, Homo Sapiens
aaaaaaaaaaaaagaaaaaaagaauguaaaauuuuaaaaauacaguuuaacagcuguaaaag

SEQ ID NO: 471476 - RNA, 62 nt, Homo Sapiens
acuuucauucuuuaaauauuauugacuuacaguuuaaaaauaaauaaauaaaagcauacuau

SEQ ID NO: 471477 - RNA, 62 nt, Homo Sapiens
augcuauauaucuuuuguaagacauuuccuuuuuuaaaaaaauuuuugcaaauaacugaucu

SEQ ID NO: 471478 - RNA, 62 nt, Homo Sapiens
auguauaggagauaaaauuugcuaguaagauuuuuaaaaacuggcuagugaaaggaaaguac

SEQ ID NO: 471479 - RNA, 62 nt, Homo Sapiens
ugucaguaauccauaagacagaaaucuguuuuuuuaaaaauaucuuuuucuccucucagcuc

SEQ ID NO: 471480 - RNA, 62 nt, Homo Sapiens
gcaagcuauuuguuuguuuucuaauuuauaguuuuaaaaacuucgcuuauugaguuuuuguu

SEQ ID NO: 471481 - RNA, 62 nt, Homo Sapiens
uauuugauacuugacagugcaaguuucuguaauuuaaaaagaugugguggccugacaccugc

SEQ ID NO: 471482 - RNA, 62 nt, Homo Sapiens
caccuuucgcuguuuguuguuucauagauuuauuuaaaaaaagagaaagucuauagcuauaa

SEQ ID NO: 471483 - RNA, 62 nt, Homo Sapiens
ggcauuaauauaaaagagguaggagucuguuauuuaaaaaaagcauuaaauuuaaaaaaaaa

SEQ ID NO: 471484 - RNA, 62 nt, Homo Sapiens
guaggagucuguuauuuaaaaaaagcauuaaauuuaaaaaaaaacugucuugucuacuuuua

SEQ ID NO: 471485 - RNA, 62 nt, Homo Sapiens
aaaauuugacaauuuugauucucacugguauguuuaaaaacugaauaaaaggaauagaauuu

SEQ ID NO: 471486 - RNA, 62 nt, Homo Sapiens
cuauuuaucuuugauuucagucuuggcaauuguuuaaaaaaaaaaucuagauuuguuuuauu

SEQ ID NO: 471487 - RNA, 62 nt, Homo Sapiens
gguaaauuauaaauguuucaugaagaaaaaauuuuaaaaaucuacgucuuuauuacacaaac

SEQ ID NO: 471488 - RNA, 62 nt, Homo Sapiens
auguauacuccauagaaacuaaacuaaaauaguuuaaaaauauucccuuuuucacccuauuu

SEQ ID NO: 471489 - RNA, 62 nt, Homo Sapiens
gcaguguaauucuuuguuuuuaauugcagacauuuaaaaaugucauuuucuacuguuaagag

SEQ ID NO: 471490 - RNA, 62 nt, Homo Sapiens
aaucuuucuacuaauguaaauuugagauuauuuuuaaaaauggaauaaaagagguuuugguc

SEQ ID NO: 471491 - RNA, 62 nt, Homo Sapiens
uucaaagacgauauaccagcccucacccagguuuuaaaaaagcacugguaggcauagaauag

SEQ ID NO: 471492 - RNA, 62 nt, Homo Sapiens
aaaauauacauaacgaugaaaaauaauacaaauuuaaaaaccaauacaguauaacaacuauu

SEQ ID NO: 471493 - RNA, 62 nt, Homo Sapiens
auuuaauucauagaaaaaauguaaaaggucuuuuuaaaaaucaugaaaaauaguugaauaua

SEQ ID NO: 471494 - RNA, 62 nt, Homo Sapiens
uaaaagaguaagcuucaauaugugaauuuucuuuuaaaaacagucacugaguuaauaaugua

SEQ ID NO: 471495 - RNA, 62 nt, Homo Sapiens
auuaaucuguuugugcaaacauaauaccaccauuuaaaaauguuagggagaugaguugcagu

SEQ ID NO: 471496 - RNA, 62 nt, Homo Sapiens
ucaaauuuuuuuuuaacguggcuuguagaauuuuuaaaaaagugaucuuagguuuguuuuuu

SEQ ID NO: 471497 - RNA, 62 nt, Homo Sapiens
cgaguucaccuaaguaaggcucagauccuaguuuuaaaaaccauuucccauuaaaaugaagu

SEQ ID NO: 471498 - RNA, 62 nt, Homo Sapiens
uccaugaguucaugcugauacucaaauuucuuuuuaaaaaggagaaacaggaagguuucuuu

SEQ ID NO: 471499 - RNA, 62 nt, Homo Sapiens
accuucagcuccguuucaaucacugacagacauuuaaaaacaauucgugauacgcguuucuc

SEQ ID NO: 471500 - RNA, 62 nt, Homo Sapiens
gaaaauuguuuuucuacuuccaugcagcauuuuuuaaaaaaucauuuagguacuucaggaaa

SEQ ID NO: 471501 - RNA, 62 nt, Homo Sapiens
uaaaccaguuuuuacaacuauuuguauuuauuuuuaaaaaaauaauguuuuauauuuauauu

SEQ ID NO: 471502 - RNA, 62 nt, Homo Sapiens
ugaagaaaaauuuuacaguagcaaaugaagcuuuuaaaaagguagguacauguccugcccuu

SEQ ID NO: 471503 - RNA, 62 nt, Homo Sapiens
auguuguggaaaaaagccagauauuguaucuuuuuaaaaaccauuaauuuuuuuugaagcuc

SEQ ID NO: 471504 - RNA, 62 nt, Homo Sapiens
auuuuauuuugugauacaguagacccacauuuuuuaaaaaucauuuacacuucuaagacuag

SEQ ID NO: 471505 - RNA, 62 nt, Homo Sapiens
gaaaaaugcuaacacccaaguaaauagcaugauuuaaaaaauguuucaaauguuaagaacac

SEQ ID NO: 471506 - RNA, 62 nt, Homo Sapiens
cagugcugucuuaccucuugagugaccugucuuuuaaaaagguaucuuauauucucuauuca

SEQ ID NO: 471507 - RNA, 62 nt, Homo Sapiens
uuccacaagaagaaaaauuauaagaaaggaaauuuaaaaacaccuaaggaagaauaauaaua

SEQ ID NO: 471508 - RNA, 62 nt, Homo Sapiens
guuaauuuuguaaacuuugcuaaauaggaccuuuuaaaaauugaagaaaaggaggaaccaau

SEQ ID NO: 471509 - RNA, 62 nt, Homo Sapiens
gaaaaauugaaaaacuguuuauuaugaacauuuuuaaaaacaugacuucccccccaaauuuu

SEQ ID NO: 471510 - RNA, 62 nt, Homo Sapiens
cauagcugcaggucuuugguaagauauauaaauuuaaaaaaaagaaaacuauaaaauacuua

SEQ ID NO: 471511 - RNA, 62 nt, Homo Sapiens
aauaaaagaauauccuuuuaaauauauacugcuuuaaaaaaguugccaaagugugcuucaga

SEQ ID NO: 471512 - RNA, 62 nt, Homo Sapiens
acuauguucagaacuucaucugagguauuauauuuaaaaaaaacuuuuauuauuaaauguau

SEQ ID NO: 471513 - RNA, 62 nt, Homo Sapiens
ccauaccucguguuucuuuuaaacuuauuuuuuuuaaaaaugaaaguaagugaaauguaaau

SEQ ID NO: 471514 - RNA, 62 nt, Homo Sapiens
uuuggccauuaguauuuuuaauugccuuaguuuuuaaaaaugcuacugaaauauagauaaag

SEQ ID NO: 471515 - RNA, 62 nt, Homo Sapiens
auacaaguuuuagaaaacaaaaucuauuuuuguuuaaaaacaguugugguucauucuuuuca

SEQ ID NO: 471516 - RNA, 62 nt, Homo Sapiens
auauuuguuauuuaaguuuuaauauacauucuuuuaaaaaguaauuaaauagaaacuuauug

SEQ ID NO: 471517 - RNA, 62 nt, Homo Sapiens
uuuuguggcagaauuaaauuucaguacuuugcuuuaaaaaaaaggaaucuuggauugggaau

SEQ ID NO: 471518 - RNA, 62 nt, Homo Sapiens
uuaaugcaggagaaaagauacuuuaucaguauuuuaaaaaugauuaguaauuuuuaaaaaca

SEQ ID NO: 471519 - RNA, 62 nt, Homo Sapiens
cuuuaucaguauuuuaaaaagcauuaguaauuuuuaaaaacagugagccacugagccagcca

SEQ ID NO: 471520 - RNA, 62 nt, Homo Sapiens
uuuuuuaguucuagcuacuauguuuagauaauuuuaaaaaugaguuuucuuugguaccaauu

SEQ ID NO: 471521 - RNA, 62 nt, Homo Sapiens
gccuuucuccugcaaauuuuauuauugugaaguuuaaaaauaauuauuuggcuuccuuuaga

SEQ ID NO: 471522 - RNA, 62 nt, Homo Sapiens
uauauguauauuauacauacauguguagcauauuuaaaaauaaagugccauagucuuuuuuu

SEQ ID NO: 471523 - RNA, 62 nt, Homo Sapiens
acuggguaugaggaauaugcuccacacagcuguuuaaaaaccgcuagucuaaaccaugcucu

SEQ ID NO: 471524 - RNA, 62 nt, Homo Sapiens
cacaaaauuauuuuuuuccaguacucuaggaauuuaaaaagaauugugauugaaguggagag

SEQ ID NO: 471525 - RNA, 62 nt, Homo Sapiens
uaaauuaaaaaaauuaaaaaagaauuaaaaauuuuaaaaauuuuaaaaauuuuaaauuuuaa

SEQ ID NO: 471526 - RNA, 62 nt, Homo Sapiens
uuaaauuuuaaagaauuaaaaaaacaggacaauuuaaaaauuauuacaaguauauuacaugu

SEQ ID NO: 471527 - RNA, 62 nt, Homo Sapiens
aauuagagguuuuuccauuuuguggcuuuuauuuuaaaaagucauaguaauuauuuaauuac

SEQ ID NO: 471528 - RNA, 62 nt, Homo Sapiens
aaaacugaugauuagauuagcgcuugccuucuuuuaaaaagacaucauggauaaaaacuaag

SEQ ID NO: 471529 - RNA, 62 nt, Homo Sapiens
uucagauuggcuaaauauuuguugggguaauuuuuaaaaauuaaagaaagaaggccacguau

SEQ ID NO: 471530 - RNA, 62 nt, Homo Sapiens
aacaguaaaaauauuaaucguauggagcuagcuuuaaaaaggaacacaggcaauauuccagc

SEQ ID NO: 471531 - RNA, 62 nt, Homo Sapiens
uacagaagcaggaaaaccaaaguauuuuauaauuuaaaaaaagccacacaugguuuauuuga

SEQ ID NO: 471532 - RNA, 62 nt, Homo Sapiens
augacucuugucuaauauuccccuuuuuuuaauuuaaaaaaacauaaagaaccucucuaugu

SEQ ID NO: 471533 - RNA, 62 nt, Homo Sapiens
ucugugaaauuaacaugcuuuauuaagaaucuuuuaaaaaaaguauuucuaauuauauaaaa

SEQ ID NO: 471534 - RNA, 62 nt, Homo Sapiens
uuuucaaaauauauuuucacuaauaacauaucuuuaaaaagcgaaaugauguuaaagcauaa

SEQ ID NO: 471535 - RNA, 62 nt, Homo Sapiens
caggguauaguaggcacuaauuuaggccuuuuuuuaaaaaauacugaccauuuuuaucauau

SEQ ID NO: 471536 - RNA, 62 nt, Homo Sapiens
cuaaaucauuuauguccauuuuuuucacucucuuuaaaaauaacaaaagcauaaaauaauga

SEQ ID NO: 471537 - RNA, 62 nt, Homo Sapiens
uugaauauuugcuucauuucaaauaauuucuguuuaaaaauaaauauucuagaaacuuucug

SEQ ID NO: 471538 - RNA, 62 nt, Homo Sapiens
caguuuagagcaaacugucacauauuauuguuuuuaaaaaaguccacaaaauccaaauuuac

SEQ ID NO: 471539 - RNA, 62 nt, Homo Sapiens
auccaaggaucagagucucuaauauggauuguuuuaaaaaauauacuuaggauuaaauaaau

SEQ ID NO: 471540 - RNA, 62 nt, Homo Sapiens
cuuaggauuaaauaaauaauaugauagcaguguuuaaaaauaccagaauuaggugaaguagc

SEQ ID NO: 471541 - RNA, 62 nt, Homo Sapiens
gagugaggguuauuauuuguauauaccaauguuuuaaaaauuuuucccaucaaacauuauca

SEQ ID NO: 471542 - RNA, 62 nt, Homo Sapiens
uuuuauuuugcacggcucuacuggccgacauuuuuaaaaaagacaggcgugagccaccgugc

SEQ ID NO: 471543 - RNA, 62 nt, Homo Sapiens
acagaucauuucauuauuuugugugcaguuauuuuaaaaacuagccaccaauguaauuaaug

SEQ ID NO: 471544 - RNA, 62 nt, Homo Sapiens
aauuauuuuuaauauagaguggcuucuuucucuuuaaaaaaauuuuaguuuuuaacuucaaa

SEQ ID NO: 471545 - RNA, 62 nt, Homo Sapiens
aaaaagaaaauugagguuuuguuggcuuaaauuuuaaaaaagagaagaaaaguugaauaaga

SEQ ID NO: 471546 - RNA, 62 nt, Homo Sapiens
cuauauauaguauaugccauuauauaaauauauuuaaaaaugauuucaugugcaaauaauua

SEQ ID NO: 471547 - RNA, 62 nt, Homo Sapiens
ucacugcugaucguagaaaaacuuagugaucauuuaaaaagcuugauaaucuucaggugaac

SEQ ID NO: 471548 - RNA, 62 nt, Homo Sapiens
cuucagugcaaauuguaucuguagguuaucuuuuuaaaaacuggcaaauuaacuguaugugu

SEQ ID NO: 471549 - RNA, 62 nt, Homo Sapiens
uagaaugcuuuguguuuccuacccuaaagugauuuaaaaauuucuguaguuucugguuagcu

SEQ ID NO: 471550 - RNA, 62 nt, Homo Sapiens
uuagauuuaaugucuacauggguaguugauauuuuaaaaacuuuaagacuacuuuucuuaua

SEQ ID NO: 471551 - RNA, 62 nt, Homo Sapiens
auucaaaaaaagacugacaauuuaguuuugucuuuaaaaagauuccaguucgaucuucuggg

SEQ ID NO: 471552 - RNA, 62 nt, Homo Sapiens
caaaaaaaaaagaauucauuaaaucaagaaaauuuaaaaagaaaacacaaauacauuuuuua

SEQ ID NO: 471553 - RNA, 62 nt, Homo Sapiens
uauuguaccaggaugugcuauugcuuuagucauuuaaaaagaacaaugaauugauguuuagu

SEQ ID NO: 471554 - RNA, 62 nt, Homo Sapiens
augaaugucauuagauccuuuguaaucaauaauuuaaaaaacacacagagcugaaugggcag

SEQ ID NO: 471555 - RNA, 62 nt, Homo Sapiens
caauagauacaagagauguuuuagaggugcuuuuuaaaaaucauaaauuugagcuauuuuuu

SEQ ID NO: 471556 - RNA, 62 nt, Homo Sapiens
uauauauuuucaacuaguaugguaaacaugccuuuaaaaauaagaaauagaaauacaagacu

SEQ ID NO: 471557 - RNA, 62 nt, Homo Sapiens
agaaauagaaauacaagacuuaccuauuuuuuuuuaaaaagcuccacccaaguguacauaug

SEQ ID NO: 471558 - RNA, 62 nt, Homo Sapiens
aaauauuauuuucugaauuuuuguuuuucuauuuuaaaaauacuuuaaaacacuuuuuuauu

SEQ ID NO: 471559 - RNA, 62 nt, Homo Sapiens
cacucugaaguguuauggauugcguguauauuuuuaaaaauuacugcucaguuaucuuugcc

SEQ ID NO: 471560 - RNA, 62 nt, Homo Sapiens
aaguaagcuacucuaaaucaaaguugcuacaauuuaaaaaucauuuaaaaagcuuucucuuu

SEQ ID NO: 471561 - RNA, 62 nt, Homo Sapiens
uuucucuuuaaguugcuacacuauuuauuaaauuuaaaaagcaagaugaaauauuauuuauc

SEQ ID NO: 471562 - RNA, 62 nt, Homo Sapiens
ccauauucaagggagucugccuuuuuuuuuuuuuuaaaaauaguagcuccagguagaugagc

SEQ ID NO: 471563 - RNA, 62 nt, Homo Sapiens
cuuaaaguugugcuguuccugaguaauuuguauuuaaaaaaccgggcauuugagggggcaug

SEQ ID NO: 471564 - RNA, 62 nt, Homo Sapiens
gagcuuggugagagcuuugcaugugcuugcauuuuaaaaagguggauuugaggcuuccuaag

SEQ ID NO: 471565 - RNA, 62 nt, Homo Sapiens
aaaaguaguaaauuagcagcgcuguauuuuuuuuuaaaaaaguauauucauuuauggaguua

SEQ ID NO: 471566 - RNA, 62 nt, Homo Sapiens
aaauuguugcuauuuccuagugccaaacucuuuuuaaaaaacuguccaagagaaaugguuuu

SEQ ID NO: 471567 - RNA, 62 nt, Homo Sapiens
ggaacuuuagcuuuauccauaacauuaauuuuuuuaaaaaauaaggucuuaauguuucauuu

SEQ ID NO: 471568 - RNA, 62 nt, Homo Sapiens
uguacuuaauuucuaaauauauaaaauccacauuuaaaaauuauaaaagcaaggacuuggga

SEQ ID NO: 471569 - RNA, 62 nt, Homo Sapiens
ucagauuuuggaaacugccguauagucacuguuuuaaaaaccccggaggggcuguauuaauu

SEQ ID NO: 471570 - RNA, 62 nt, Homo Sapiens
auuuuugaagagggugaaguuuggagaacaaauuuaaaaaccaucagucaugugagcagauu

SEQ ID NO: 471571 - RNA, 62 nt, Homo Sapiens
uaucaaaaaacccuucaauagcauccuuaagauuuaaaaaaaaaaaaaaaaaaaaggaaaaa

SEQ ID NO: 471572 - RNA, 62 nt, Homo Sapiens
auugagaaaccaagucaaucaagcaggaaucauuuaaaaaccagauaaagccauguuuuucu

SEQ ID NO: 471573 - RNA, 62 nt, Homo Sapiens
agaacauggcaaguauuuacuuuuaucuuuuuuuuaaaaacacucaugacagaaaacaguuu

SEQ ID NO: 471574 - RNA, 62 nt, Homo Sapiens
ugacuuuaaagagacuucaaaauauugaguauuuuaaaaauuuaaaaguaggucaguuuaua

SEQ ID NO: 471575 - RNA, 62 nt, Homo Sapiens
cuucagaagaaagcugacauuuuaaugaauuuuuuaaaaaauuaauaaacaaauugucuaaa

SEQ ID NO: 471576 - RNA, 62 nt, Homo Sapiens
acuaaucaguuuagcuuuguguuguaugcuaguuuaaaaaagaaaauauguaauauaaugua

SEQ ID NO: 471577 - RNA, 62 nt, Homo Sapiens
ggauucaaacgcaacucaaaucugugcuggacuuuaaaaaaacaauucaggaccaaauuuuu

SEQ ID NO: 471578 - RNA, 62 nt, Homo Sapiens
uuuuuuauauuuaaauguagacuuuugacacuuuuaaaaaacaaaaaaagacaagagagaug

SEQ ID NO: 471579 - RNA, 62 nt, Homo Sapiens
auaacagggcggcugguuaauaucucacacaguuuaaaaaaucagccccuaauuucuccaug

SEQ ID NO: 471580 - RNA, 62 nt, Homo Sapiens
uagcauauguguucagguuuauagcuguuguguuuaaaaauugaaaaaaguggaaaacaucu

SEQ ID NO: 471581 - RNA, 62 nt, Homo Sapiens
uuuuagaggcaggaucuugcuguccaauuuuuuuuaaaaagcuaaaauugccaacuuuagaa

SEQ ID NO: 471582 - RNA, 62 nt, Homo Sapiens
aaccccagcaauuuauacaacgcugucauauuuuuaaaaaaacaaaaguaagccauccucaa

SEQ ID NO: 471583 - RNA, 62 nt, Homo Sapiens
guguuacgggggcuuguaggauucuuugguucuuuaaaaaaauuuaaaaggagacuuaucua

SEQ ID NO: 471584 - RNA, 62 nt, Homo Sapiens
uuuuuaaauaaaguagccauauguaacgggauuuuaaaaauauauacauuuuacaacaugga

SEQ ID NO: 471585 - RNA, 62 nt, Homo Sapiens
cccuuguacauauaucuuuagagagaagauauuuuaaaaagaaauaccuuuuuaaaaauuau

SEQ ID NO: 471586 - RNA, 62 nt, Homo Sapiens
uagagagaagauauuuuaaaaagaaauaccuuuuuaaaaauuauuuuauuauuuuuuaauag

SEQ ID NO: 471587 - RNA, 62 nt, Homo Sapiens
aaauaaauaaaaaccaauaguacuaauuuugcuuuaaaaaaauuucuaauuuuuuucacaua

SEQ ID NO: 471588 - RNA, 62 nt, Homo Sapiens
aauauuaacucgaauuguaaauuaagcaaaaauuuaaaaaguauauguugaugggacaagaa

SEQ ID NO: 471589 - RNA, 62 nt, Homo Sapiens
auauugaacuauguguuaauucauuuguaucuuuuaaaaaauuaucacuguuaaagccauug

SEQ ID NO: 471590 - RNA, 56 nt, Homo Sapiens
aggagaaacacaggaaaugaaaaauuuuuaaaaaaagaaggaaaaauguuuuaaau

SEQ ID NO: 471591 - RNA, 62 nt, Homo Sapiens
uauauuagguagaauacacauacaaucaaaauuuuaaaaaaaaaagcuaaauaacuuaaaaa

SEQ ID NO: 471592 - RNA, 62 nt, Homo Sapiens
aacauuuuucaaaaucaggagauuuucguccauuuaaaaaauguauaggugcagauauugaa

SEQ ID NO: 471593 - RNA, 62 nt, Homo Sapiens
gcuuuaagaaauaacaauuacaauguguauuauuuaaaaaugggagaaauaguuuguucuau

SEQ ID NO: 471594 - RNA, 62 nt, Homo Sapiens
uaaaguuuaauaguuaucaaaaucaccuaauuuuuaaaaauagcuuucguuuugaguucugg

SEQ ID NO: 471595 - RNA, 62 nt, Homo Sapiens
acugucaaaaucaguauauacuauuaguuauauuuaaaaauauuuuuuuaaauucuuuacag

SEQ ID NO: 471596 - RNA, 62 nt, Homo Sapiens
cccagaggaacuuagggauuucaccccuggcuuuuaaaaaaaacgaaauaccgacaagccac

SEQ ID NO: 471597 - RNA, 62 nt, Homo Sapiens
gauuggaacacaaaaaaucuuuuuuuaaucuuuuuaaaaacugcugugguuuugcugcuaca

SEQ ID NO: 471598 - RNA, 62 nt, Homo Sapiens
uugggggacacaccuggcgagcaagcucgcuuuuuaaaaaugaaauuugggggcaggggaag

SEQ ID NO: 471599 - RNA, 62 nt, Homo Sapiens
uuacagauaauguugaugacauugacccuuuguuuaaaaaaagaaacuguaaauuugacaua

SEQ ID NO: 471600 - RNA, 62 nt, Homo Sapiens
uuucuaaaguaaguguguauaaaagucuccuuuuuaaaaagaucauauuuuuaaauaaagca

SEQ ID NO: 471601 - RNA, 62 nt, Homo Sapiens
uaaaccaccaaugugggagggggugcuaaaacuuuaaaaaaaaucucuacugugcaaauauc

SEQ ID NO: 471602 - RNA, 62 nt, Homo Sapiens
aacaucugugugccuuuuuaucuuugguuucuuuuaaaaaguauauuuaaugccuuuacaau

SEQ ID NO: 471603 - RNA, 62 nt, Homo Sapiens
gaauggagaugauaagugcuuuccccucuuuauuuaaaaaagauuaaaaggaauaaaagaaa

SEQ ID NO: 471604 - RNA, 62 nt, Homo Sapiens
guacauagucaaaacacaaugugaagaauuuguuuaaaaacauccuguagaaaguuuauaag

SEQ ID NO: 471605 - RNA, 62 nt, Homo Sapiens
ugguucauuugauuucuaaaaauaccaugaccuuuaaaaauucuuuuaauagaucauguuau

SEQ ID NO: 471606 - RNA, 62 nt, Homo Sapiens
cacuuaaagggaauauaugagguuuuuuuuuuuuuaaaaaaaaacuuuuauuuauuauuugu

SEQ ID NO: 471607 - RNA, 62 nt, Homo Sapiens
aauguauaacaaguacuauuuacauaucugcauuuaaaaaagcaauucuuagaauacuuccu

SEQ ID NO: 471608 - RNA, 62 nt, Homo Sapiens
gucuucuuggauuucacccaacuaaaaggauuuuuaaaaauaaauaacagucuuaccuaaau

SEQ ID NO: 471609 - RNA, 62 nt, Homo Sapiens
uagccaguuguuaauaucuuaaugcagauuuuuuuaaaaaaaacauaaaaugauuuaucugu

SEQ ID NO: 471610 - RNA, 62 nt, Homo Sapiens
cuuuucucgaucacuaaacauaugcauauauuuuuaaaaaucaguaaaagcauuacucuaag

SEQ ID NO: 471611 - RNA, 62 nt, Homo Sapiens
caaaccauuuuaugaguuuucuguuagcuugcuuuaaaaauuauuacuguaagaaauaguuu

SEQ ID NO: 471612 - RNA, 62 nt, Homo Sapiens
ugcugcauuuuuuuaaaguuggauugcugcuauuuaaaaaaaaaaaaaggacacagaucaaa

SEQ ID NO: 471613 - RNA, 62 nt, Homo Sapiens
uuuaaagaaccacuugaaaucggaucauuuuauuuaaaaauaaaaaauguuaaugccaguug

SEQ ID NO: 471614 - RNA, 62 nt, Homo Sapiens
ucaguuccacaccaagaaugaacugcauuuccuuuaaaaauuauuuuaaaacaccuuuauug

SEQ ID NO: 471615 - RNA, 62 nt, Homo Sapiens
cccuaauaucacagggcuugugcauucagauuuuuaaaaaauuaggauagauaaggaaacaa

SEQ ID NO: 471616 - RNA, 62 nt, Homo Sapiens
ugauguauuuuuuucaugcauuaguaugcauuuuuaaaaaauaaugcauguuucuuuaauaa

SEQ ID NO: 471617 - RNA, 62 nt, Homo Sapiens
guuguuuuuacuuuauuguguuguuuaaauauuuuaaaaauaucuuuagcguuuggucuuuu

SEQ ID NO: 471618 - RNA, 62 nt, Homo Sapiens
aauugcuucagcccaagaaagcuguguauuguuuuaaaaauuguaaaaauuauugugaugau

SEQ ID NO: 471619 - RNA, 62 nt, Homo Sapiens
uagacaaucacuauuggcuuuuuucuuuuauuuuuaaaaaacucacauagaggagacaauca

SEQ ID NO: 471620 - RNA, 62 nt, Homo Sapiens
ucacucuuugcaggcacucuucaaauuuuuauuuuaaaaauuauaaugcaaacaucuggcca

SEQ ID NO: 471621 - RNA, 62 nt, Homo Sapiens
gguucuuuuuaauguuuauacuuagauuuucuuuuaaaaaaauuaaaauaaaacaaaaaaaa

SEQ ID NO: 471622 - RNA, 62 nt, Homo Sapiens
ggcugauguugguauuggguguaggaacaugauuuaaaaaaaaacucuugccucugcuuucc

SEQ ID NO: 471623 - RNA, 62 nt, Homo Sapiens
uuuucagaugcagucuauauuuuaugcugaguuuuaaaaaugaaauacuuuaugcaaacagg

SEQ ID NO: 471624 - RNA, 62 nt, Homo Sapiens
ucaaaaacagcacaacccccucaaucugcccauuuaaaaauugguggagugaacaaagagca

SEQ ID NO: 471625 - RNA, 62 nt, Homo Sapiens
agggagaggagggcacauguaaucuguugcuauuuaaaaaucagacaccaacacuuacccag

SEQ ID NO: 471626 - RNA, 62 nt, Homo Sapiens
uuuuuugaucuuagucacugauuuuuuacuuuuuuaaaaaaauguuucccugccaucuugag

SEQ ID NO: 471627 - RNA, 62 nt, Homo Sapiens
uuauuauaaauuaaauucagagagagauguaauuuaaaaaguugauuuuaaaaaaaaaagag

SEQ ID NO: 471628 - RNA, 62 nt, Homo Sapiens
aaagagagagagauguaauuaagagccuugauuuuaaaaaaaaaaaaaagauuuugacauaa

SEQ ID NO: 471629 - RNA, 62 nt, Homo Sapiens
aguuuuauaaguagggagaaucuuuaaagugcuuuaaaaaaaauuuguggguuuugaaugca

SEQ ID NO: 471630 - RNA, 62 nt, Homo Sapiens
cuguucacacuuuauuaccauaucuuuaagcauuuaaaaauaugaagaugagcauauauuac

SEQ ID NO: 471631 - RNA, 62 nt, Homo Sapiens
caugcccacaauaccauuauuaauaaagacauuuuaaaaaacuauuuaguauaaucugugac

SEQ ID NO: 471632 - RNA, 62 nt, Homo Sapiens
uaaagcugaauuccuuuucuaggauauguguuuuuaaaaauccaccuaaauugcaagaucua

SEQ ID NO: 471633 - RNA, 62 nt, Homo Sapiens
ucuuucuauguguauuuauauguuguaugacauuuaaaaauuaauauuguuuuuuauauuau

SEQ ID NO: 471634 - RNA, 62 nt, Homo Sapiens
auacagcaauaccaaaauaaaugucauaaauauuuaaaaauaugauuaguucuuuauuaaau

SEQ ID NO: 471635 - RNA, 62 nt, Homo Sapiens
aaaaaucauuuagaugcacuaaagacauuguuuuuaaaaaaaaagucagcauaugaggaauu

SEQ ID NO: 471636 - RNA, 62 nt, Homo Sapiens
aaaucuguaggguugacaaacuaagcuuaauuuuuaaaaacaaaaauuuugacuuuuuagua

SEQ ID NO: 471637 - RNA, 62 nt, Homo Sapiens
aaaugcuucaugaauuucucacugcagaaaccuuuaaaaaaauaccuuugaacuuucauagc

SEQ ID NO: 471638 - RNA, 62 nt, Homo Sapiens
uuugauaacucuuaaagcauaaugcauuauuuuuuaaaaaguaaauguggaggcuccauauu

SEQ ID NO: 471639 - RNA, 62 nt, Homo Sapiens
acuugaguuuuccuaaguucuuugauagguguuuuaaaaauaagagaagcaucaugagccaa

SEQ ID NO: 471640 - RNA, 62 nt, Homo Sapiens
aaagugauuuugaaaaucucauuugaugaguuuuuaaaaaucucuuccccgccaugauucac

SEQ ID NO: 471641 - RNA, 62 nt, Homo Sapiens
aauuaacauguuuuuguuguugaaucaucauuuuuaaaaaaacuucccuucaaaucugccuu

SEQ ID NO: 471642 - RNA, 62 nt, Homo Sapiens
aaaucugaggaguguacaauaugaaaacuccuuuuaaaaauaccugaguuuccauaaggaaa

SEQ ID NO: 471643 - RNA, 62 nt, Homo Sapiens
cuggauguuuuuuauuuaguuucagcugugcuuuuaaaaaauuuguauauuuguacaaaugu

SEQ ID NO: 471644 - RNA, 62 nt, Homo Sapiens
uuuucugacacccuuuaaugaaguaaauacauuuuaaaaaauuccccagaugaaagaacucu

SEQ ID NO: 471645 - RNA, 62 nt, Homo Sapiens
aauugauuuuccuuugggguuguaaugaacuuuuuaaaaauugcauuuuauacagucaacuu

SEQ ID NO: 471646 - RNA, 62 nt, Homo Sapiens
auagacugcuuaucauaaaauagaaccucuuguuuaaaaauauuagaaucuaaagauguguu

SEQ ID NO: 471647 - RNA, 62 nt, Homo Sapiens
agggcccaaagcuuauuagucaugccuuaaaauuuaaaaagcuguuaugguagagaaacaca

SEQ ID NO: 471648 - RNA, 62 nt, Homo Sapiens
cuguaauccaaacuuuuuuuugugauucacaauuuaaaaacauaacaugauaggugcugaau

SEQ ID NO: 471649 - RNA, 62 nt, Homo Sapiens
aaaaacaagauuuggagucaagagaauagcguuuuaaaaaaguucugaacaguuuaguccca

SEQ ID NO: 471650 - RNA, 62 nt, Homo Sapiens
aggcuaaucaugugguccauuucuuguugcuuuuuaaaaaucguguaauaguugugucacca

SEQ ID NO: 471651 - RNA, 62 nt, Homo Sapiens
cagugcauguacgcccucuguuuguauuucaguuuaaaaaccccaauuucaaaauggcuuuc

SEQ ID NO: 471652 - RNA, 62 nt, Homo Sapiens
auaaagguuaacguccauaaaagaaauuuuauuuuaaaaaauuuuguggcacuguauauguu

SEQ ID NO: 471653 - RNA, 62 nt, Homo Sapiens
ccaggcaauggcauuaaacagcaaauuuuccuuuuaaaaaaugaaguuguguuacaacugua

SEQ ID NO: 471654 - RNA, 62 nt, Homo Sapiens
gaaaguuaucguagccagccauuugaauuuuuuuuaaaaaaaguggcuugauguugauacac

SEQ ID NO: 471655 - RNA, 62 nt, Homo Sapiens
aaaaaaccgacaaaguuacgaguuagaaaaacuuuaaaaaaauacugauucuggaacaaaac

SEQ ID NO: 471656 - RNA, 62 nt, Homo Sapiens
gaacacuuucugcucauauccucuccucuucuuuuaaaaaaauuguugccuuuccaagugac

SEQ ID NO: 471657 - RNA, 62 nt, Homo Sapiens
cuuuggcuuaugcugaauuaaguauugguuauuuuaaaaagguaaagauuucauaaaaugau

SEQ ID NO: 471658 - RNA, 62 nt, Homo Sapiens
uauguuccaaguaccucuauaaccauuuaaaauuuaaaaaauaaaauacuauuaaccuauau

SEQ ID NO: 471659 - RNA, 62 nt, Homo Sapiens
aaaaggcagccuuuacuauugcuaauaagcacuuuaaaaaggccauuguuuuuggauauaaa

SEQ ID NO: 471660 - RNA, 62 nt, Homo Sapiens
acuggauugcuuuauuauauuuucauaaguaauuuaaaaaucacaucuuauuuuugccuuua

SEQ ID NO: 471661 - RNA, 62 nt, Homo Sapiens
aaucaguuacaguaaagacuugaaaacuaacauuuaaaaauuaucucaaguagaaaaguuuu

SEQ ID NO: 471662 - RNA, 62 nt, Homo Sapiens
uauauuaaauuuauuaaaauaauaaguaucaguuuaaaaauuaaguuuuuuucaagaauuga

SEQ ID NO: 471663 - RNA, 62 nt, Homo Sapiens
uaaaaagaagcaggugaaaacuaguagcaacuuuuaaaaacacauaggucacuuuaaauguu

SEQ ID NO: 471664 - RNA, 62 nt, Homo Sapiens
guguuguaccuaaggccauauguuuuaggguuuuuaaaaaacacaaauauaacaaaguucau

SEQ ID NO: 471665 - RNA, 62 nt, Homo Sapiens
auucuuucugaacuuaucuaauuacaugcauuuuuaaaaacugcugauuauuguauaugcaa

SEQ ID NO: 471666 - RNA, 62 nt, Homo Sapiens
aaaaauuuuauuccauuugccuguugcaauacuuuaaaaauauuuguuacaaaccugugggc

SEQ ID NO: 471667 - RNA, 62 nt, Homo Sapiens
gcugucuugcuuuagcuauuacauuauuuuuuuuuaaaaaauaccacguguagcauuuugaa

SEQ ID NO: 471668 - RNA, 62 nt, Homo Sapiens
uuugcuacuuguuaagggagggcuucacacauuuuaaaaaugucuucugaaaacagacccuu

SEQ ID NO: 471669 - RNA, 62 nt, Homo Sapiens
auguuugaugcuauuuuguagaaaaaaauuauuuuaaaaaauaaagugacccagggaauuua

SEQ ID NO: 471670 - RNA, 62 nt, Homo Sapiens
uuuauuaaugugaauggaauuacaauuucuucuuuaaaaauacuaaugaagcuuuuaaaauc

SEQ ID NO: 471671 - RNA, 62 nt, Homo Sapiens
auuucuauucaaaauacauguucucucugacauuuaaaaauacaaguuggccaauaauagca

SEQ ID NO: 471672 - RNA, 62 nt, Homo Sapiens
ugaagacacugaaauacagaccaguucucucauuuaaaaaaaguacuuauauaaaaucuagu

SEQ ID NO: 471673 - RNA, 62 nt, Homo Sapiens
gugaaagucaaagaauuaagagcaauacacuuuuuaaaaaaucauaaaauguuuaugauccc

SEQ ID NO: 471674 - RNA, 62 nt, Homo Sapiens
gauguaccucacuacccacuaauggcccuucauuuaaaaaaacuggaguaaaauucauggga

SEQ ID NO: 471675 - RNA, 62 nt, Homo Sapiens
uauauuaauagauguuuuccggaaauauuugauuuaaaaacaagggacuuguaagcauuucu

SEQ ID NO: 471676 - RNA, 62 nt, Homo Sapiens
gaaauuucugaucucaccccauugaggaucucuuuaaaaaaugaucugugguuccuuagaau

SEQ ID NO: 471677 - RNA, 62 nt, Homo Sapiens
auaaaagggacuacuguucaaaauuccuuccuuuuaaaaaaugacuuuuauauuucuuuaaa

SEQ ID NO: 471678 - RNA, 62 nt, Homo Sapiens
uccuuccuuuuaaaaaauaucuuuuauauuucuuuaaaaaauuauuucacuuuuugacuuga

SEQ ID NO: 471679 - RNA, 62 nt, Homo Sapiens
ugggcugucaugugggaauauaagauaaccauuuuaaaaaauaaaauaaaacuggccugacu

SEQ ID NO: 471680 - RNA, 62 nt, Homo Sapiens
uauauuugaacauuggucuuauguagauuuuauuuaaaaaacacuuaauaaauuaucuguua

SEQ ID NO: 471681 - RNA, 62 nt, Homo Sapiens
gauggaugagaaaagaaagauauuugggauaauuuaaaaaauuauugacuuuuucucuuuuu

SEQ ID NO: 471682 - RNA, 62 nt, Homo Sapiens
aaaugcugcaaaaccaaaaaugagaccuugucuuuaaaaaaauuucagccugggggauacag

SEQ ID NO: 471683 - RNA, 62 nt, Homo Sapiens
agcuugguguggugcccucucuuuaccaaaaguuuaaaaauugcaacauggugaaauccugu

SEQ ID NO: 471684 - RNA, 62 nt, Homo Sapiens
augcaaucaggcacagugcccauuugguaaauuuuaaaaaauuccagauaaucagauuauuu

SEQ ID NO: 471685 - RNA, 62 nt, Homo Sapiens
aaaauaucuguuucucugcaugcacuugauaauuuaaaaauaguuuuuuucugucuugugaa

SEQ ID NO: 471686 - RNA, 62 nt, Homo Sapiens
aggcauuuuugaaaguguuggcuguguagaacuuuaaaaaaaaaaauugguaaacauguccc

SEQ ID NO: 471687 - RNA, 62 nt, Homo Sapiens
gcuuuucauauuuaagcacaaugucuuuacuuuuuaaaaaaggacuggcaacaauguuccca

SEQ ID NO: 471688 - RNA, 62 nt, Homo Sapiens
caucuuaacuccacgcuuuagccuguauauuuuuuaaaaacacagauccaagcauauaaaaa

SEQ ID NO: 471689 - RNA, 62 nt, Homo Sapiens
uuguuuuucaaaugucaccacauuaauaguauuuuaaaaaaagagaaacacagcauacuguu

SEQ ID NO: 471690 - RNA, 62 nt, Homo Sapiens
gaaauaaauauacaauuacauaaggaguguucuuuaaaaagaguuuguauauugaauuacau

SEQ ID NO: 471691 - RNA, 62 nt, Homo Sapiens
uaaggugacaaagcacauggaugcuaggugucuuuaaaaaaucacuagguugccacagaccu

SEQ ID NO: 471692 - RNA, 62 nt, Homo Sapiens
ccuuucuguacaggauuuuucaaauaaaagcauuuaaaaagaaaaucacccaaaacuuuugg

SEQ ID NO: 471693 - RNA, 62 nt, Homo Sapiens
ugaugggcuguuuuaagaccugugcaagcuaauuuaaaaacacuaggaaauuaguuguauuu

SEQ ID NO: 471694 - RNA, 62 nt, Homo Sapiens
ugaaauuuguuaucuuuguauguuuuaagacauuuaaaaacguauaaacauuacaacuaugu

SEQ ID NO: 471695 - RNA, 62 nt, Homo Sapiens
auccacaaagauguuuuuaugcaguuuaucguuuuaaaaauaaaaucauaaaguuugguaau

SEQ ID NO: 471696 - RNA, 62 nt, Homo Sapiens
aaauuugaauguacuauucuugacaaauuuguuuuaaaaaucaaaugcuguauuugaguuuc

SEQ ID NO: 471697 - RNA, 62 nt, Homo Sapiens
ucucauuuuuacaaagacuagucacuuaucuuuuuaaaaaacaccgucuuacuagacugaau

SEQ ID NO: 471698 - RNA, 62 nt, Homo Sapiens
cauugauuauuaucuagguuggugaagaaauuuuuaaaaauaauaggccuuucaguaacaca

SEQ ID NO: 471699 - RNA, 62 nt, Homo Sapiens
agagaauuagcauugugucuaaaaauaucuuuuuuaaaaaaggaacuuaaaacugcucuaaa

SEQ ID NO: 471700 - RNA, 62 nt, Homo Sapiens
caaauuuuaauuuuugcuuuuagaaaagggaguuuaaaaaugguaucaaaauuacauauacu

SEQ ID NO: 471701 - RNA, 62 nt, Homo Sapiens
caaagcacccauuucaauguguauaaauugucuuuaaaaacuguuuuagaccuauaauccuu

SEQ ID NO: 471702 - RNA, 62 nt, Homo Sapiens
aaauuauuuguaagauauuugcaguuuuucauuuuaaaaaguccauaccuuauauaugcacu

SEQ ID NO: 471703 - RNA, 62 nt, Homo Sapiens
uuggcacguguuguuuacauuuugcugugacauuuaaaaauauuucuuuaaaaauguuacug

SEQ ID NO: 471704 - RNA, 62 nt, Homo Sapiens
uuacauuuugcugugacauuuaaaaauauuucuuuaaaaauguuacugcuaaagauacauua

SEQ ID NO: 471705 - RNA, 62 nt, Homo Sapiens
aaaauguuacugcuaaagauacauuauccuuuuuuaaaaagucuccauucaaauuaaauuaa

SEQ ID NO: 471706 - RNA, 62 nt, Homo Sapiens
aggguuuggggucaacacgugaaguguugaauuuuaaaaaauacaaaaagcagacugaugua

SEQ ID NO: 471707 - RNA, 62 nt, Homo Sapiens
cuucccaucucuuaauaucauguguuaacauguuuaaaaagaccuuaguaguuugcaggcug

SEQ ID NO: 471708 - RNA, 62 nt, Homo Sapiens
gaucuugcccuccaaugaaaugacuuacauguuuuaaaaaaccgaguugguuuuauugaauu

SEQ ID NO: 471709 - RNA, 62 nt, Homo Sapiens
auguuuuaaaaaaccgaguugguuuuauugaauuuaaaaagauagguaacuaaguagcauuu

SEQ ID NO: 471710 - RNA, 62 nt, Homo Sapiens
cgacuugcuaauuucagaaauaauuauucauuuuuaaaaagccccuuuuaaagcaucuacuu

SEQ ID NO: 471711 - RNA, 62 nt, Homo Sapiens
acuggcuuccuaagaaauguuuaagacucagcuuuaaaaagaaguuaacauucauaucucug

SEQ ID NO: 471712 - RNA, 62 nt, Homo Sapiens
uacugcaugcauagcacuuaauaaaauggauuuuuaaaaaauccacuaguaauaucagaaug

SEQ ID NO: 471713 - RNA, 62 nt, Homo Sapiens
aaucagcagugaaucaucuugcagcuaugcaauuuaaaaaaaauacagauuaccaauuucaa

SEQ ID NO: 471714 - RNA, 62 nt, Homo Sapiens
gaacuuggaauuugagggagauuuuauauaccuuuaaaaacuguaauuuaauugggaugcca

SEQ ID NO: 471715 - RNA, 62 nt, Homo Sapiens
gcuaaauuugcauauaccaucuaaaauccuuuuuuaaaaaaauuuaauguaauaaagauuca

SEQ ID NO: 471716 - RNA, 62 nt, Homo Sapiens
guaaacauugcagguuuaaacauaaaggagucuuuaaaaaaaaaucauuuacguuggaauuu

SEQ ID NO: 471717 - RNA, 62 nt, Homo Sapiens
guucaaaguuugcuuaguuacaacaaagcaccuuuaaaaaaaauacauuuuaaaaaaacauu

SEQ ID NO: 471718 - RNA, 62 nt, Homo Sapiens
guuacaacaaagcaccuuuaaaaaaaauacauuuuaaaaaaacauuccaagccaauuggaag

SEQ ID NO: 471719 - RNA, 62 nt, Homo Sapiens
cagauuuccugaaaauaauugaaauaucuuacuuuaaaaauauuuucaucucugaaauaucu

SEQ ID NO: 471720 - RNA, 62 nt, Homo Sapiens
aucagauauaaauauauacuuaauuuuuuaauuuuaaaaauagauaccuguuugacuuugag

SEQ ID NO: 471721 - RNA, 62 nt, Homo Sapiens
cuggcugcaaagaagaaucaacagggacacuuuuuaaaaacacucuuaucagccugggcaac

SEQ ID NO: 471722 - RNA, 62 nt, Homo Sapiens
uuuuuauuuugcaauucucuguauucuaugucuuuaaaaauuugaucuugacauuuaauguc

SEQ ID NO: 471723 - RNA, 62 nt, Homo Sapiens
ucuugacauuuaaugucacaaaguuuuguuuuuuuaaaaagugauuuaaacuuaagauccga

SEQ ID NO: 471724 - RNA, 62 nt, Homo Sapiens
cuuugaaaauacuuuggauaauaaauuggaguuuuaaaaaugcaaauuugcuuaguaucuaa

SEQ ID NO: 471725 - RNA, 62 nt, Homo Sapiens
gagaucaaaaaaauauaugacagauuauuuuguuuaaaaaugcaguuuuaauuaucuuaguc

SEQ ID NO: 471726 - RNA, 62 nt, Homo Sapiens
aaaucauguacauuugaaaauauuugcacacauuuaaaaauaaauguaaaguugucuuuuaa

SEQ ID NO: 471727 - RNA, 62 nt, Homo Sapiens
uuaucuuuuguuuguguuaaaacuggagaguguuuaaaaauuuccuuuuggggggaagaaaa

SEQ ID NO: 471728 - RNA, 62 nt, Homo Sapiens
uguauuauccugaauacacuauuuugaaaauuuuuaaaaaugacuucuuuauuuugcuuuac

SEQ ID NO: 471729 - RNA, 62 nt, Homo Sapiens
cauugacaugugauuucaaaacacaguguucuuuuaaaaaucuauaauaugucaaaauacaa

SEQ ID NO: 471730 - RNA, 62 nt, Homo Sapiens
ugggaagaacuggcuucauuccuaguacaucuuuuaaaaaguuacuaauuuuccagcaguac

SEQ ID NO: 471731 - RNA, 62 nt, Homo Sapiens
aaagaaaaaaaacuuuuugauguuuuaggugauuuaaaaauauaccguguugguggugaaug

SEQ ID NO: 471732 - RNA, 62 nt, Homo Sapiens
aauaaacuucagcugaagauuuuauauaggacuuuaaaaagaagagaagagaaagaagaaac

SEQ ID NO: 471733 - RNA, 62 nt, Homo Sapiens
auugcaauuguauuagguguuaaaauaaaguuuuuaaaaaauuacuuguauuuauacuuuac

SEQ ID NO: 471734 - RNA, 62 nt, Homo Sapiens
ugcccugaguggaucuccaaggaccagguuauuuuaaaaagauuuguuuugucaagugucau

SEQ ID NO: 471735 - RNA, 62 nt, Homo Sapiens
gccacaucccuuugaaacaagauaacugagaauuuaaaaauaagaaaauacauaagaccaua

SEQ ID NO: 471736 - RNA, 62 nt, Homo Sapiens
ccgucuuaaaaaaaaaaaaaaaaaaguuuguuuuuaaaaaaaucuaaauaaaauaacuuugc

SEQ ID NO: 471737 - RNA, 62 nt, Homo Sapiens
uuuccuuucuuagacuucauaggagauagugcuuuaaaaaaaaaaaaaacuucuauuauuug

SEQ ID NO: 471738 - RNA, 62 nt, Homo Sapiens
auuauuuguuuaguauguuguaaguagaucauuuuaaaaaacugaaucuauauuauguuuaa

SEQ ID NO: 471739 - RNA, 62 nt, Homo Sapiens
guguaauaggaauaauauuuauccaaaagauuuuuaaaaauagggcuguguuuaaaaaaaaa

SEQ ID NO: 471740 - RNA, 62 nt, Homo Sapiens
uuauccaaaagauuuuuaaaaauagggcuguguuuaaaaaaaaaaaacaaaacaagaaaagc

SEQ ID NO: 471741 - RNA, 62 nt, Homo Sapiens
uggaguuaauuuguuuuacaggaauuuuguuuuuuaaaaaaauaggaucauucugaacuuug

SEQ ID NO: 471742 - RNA, 62 nt, Homo Sapiens
gaaaaaaaugugcaugaucucuuagcaaaauauuuaaaaacuagaggaaucuaguauuugca

SEQ ID NO: 471743 - RNA, 62 nt, Homo Sapiens
aaaaaaaaaaaacuaagauacaaaacucuaucuuuaaaaaaauccagccugagcaacaaaag

SEQ ID NO: 471744 - RNA, 62 nt, Homo Sapiens
uacacauaggugcugcauuuaauauuugauuuuuuaaaaauaaguauuugauuuuuuucccc

SEQ ID NO: 471745 - RNA, 62 nt, Homo Sapiens
aaaucacugccucauucuuauauauauaacccuuuaaaaaaauuacacugaucuaaaggaca

SEQ ID NO: 471746 - RNA, 62 nt, Homo Sapiens
aaauuuaaaauuuaacagcaguccaaccguuuuuuaaaaaauuauacuuuauaaugauagaa

SEQ ID NO: 471747 - RNA, 62 nt, Homo Sapiens
acauuucuaucagggauauaauuauguaauuuuuuaaaaaggugagccaccacgccuggcca

SEQ ID NO: 471748 - RNA, 62 nt, Homo Sapiens
cauccuggaaauccuuuaaaucugguggggaauuuaaaaauguuugaaguccuagucugagu

SEQ ID NO: 471749 - RNA, 62 nt, Homo Sapiens
aaaaaaaagaauuaccaagaagauaucccagcuuuaaaaagauaauuuuuccuuccucugua

SEQ ID NO: 471750 - RNA, 62 nt, Homo Sapiens
gagaaagaaaguaaaaaagggacuuuggcugauuuaaaaagugcagguuggcaaacgggcuu

SEQ ID NO: 471751 - RNA, 62 nt, Homo Sapiens
uagauuaugaugcagaauauaaauuaggcuuuuuuaaaaaaagggaaauaauuguguacaua

SEQ ID NO: 471752 - RNA, 62 nt, Homo Sapiens
ugguuuugcauggaaccugguggauccauuuuuuuaaaaaaacuaagaauacagaaccaaau

SEQ ID NO: 471753 - RNA, 62 nt, Homo Sapiens
ucaucgacuuagccugagucgccacagaaauguuuaaaaacugauccugucucuaaaaagaa

SEQ ID NO: 471754 - RNA, 62 nt, Homo Sapiens
aacaaaaaauuaucugaaugagacuccaucucuuuaaaaacaccagccugagugacagagcg

SEQ ID NO: 471755 - RNA, 62 nt, Homo Sapiens
uagaaauucuucaugaacauacuuucauuacuuuuaaaaaugacaauuauuaaauuguguac

SEQ ID NO: 471756 - RNA, 62 nt, Homo Sapiens
cuguuguuccaaauguguaucaaacuucauuuuuuaaaaaauuuaaaaugcugacauaacac

SEQ ID NO: 471757 - RNA, 62 nt, Homo Sapiens
cuacuuuugcuuuuuuauuuucucauauauauuuuaaaaacagugaaaaaaauuauucaugc

SEQ ID NO: 471758 - RNA, 62 nt, Homo Sapiens
auaaacuuuucuaugaucacguuuucuuuucuuuuaaaaauauucccuauaaccucuucauu

SEQ ID NO: 471759 - RNA, 62 nt, Homo Sapiens
uuuccuccauaaauauucauuaaccaaauauuuuuaaaaauaauaucuuaccuguuuguuau

SEQ ID NO: 471760 - RNA, 62 nt, Homo Sapiens
aaaaauggauggaucuucucaaaugcccaggcuuuaaaaauuaauucagaaucuguugugag

SEQ ID NO: 471761 - RNA, 62 nt, Homo Sapiens
auauucaguaaaagccugcugugaaauguauuuuuaaaaacuauaacugaaaagacuaugua

SEQ ID NO: 471762 - RNA, 62 nt, Homo Sapiens
auuuccaaauauuugugggugaacauuuuuaauuuaaaaaaaagcucaaagcaauuaagugg

SEQ ID NO: 471763 - RNA, 62 nt, Homo Sapiens
aauucagaagaacaguguggacaaaucacucauuuaaaaaguuuuaauaaaagugaaccaga

SEQ ID NO: 471764 - RNA, 62 nt, Homo Sapiens
auuuaucauacucuguauauuauuuucucucuuuuaaaaaauaccaaugauauuucaguaua

SEQ ID NO: 471765 - RNA, 62 nt, Homo Sapiens
uuuaagcuguacacuuucaauggaaggaauuuuuuaaaaaauagcagguacuacauuuauaa

SEQ ID NO: 471766 - RNA, 62 nt, Homo Sapiens
acacauagcagaguaucggaauguauucacacuuuaaaaaauuacauccauuuugauauacc

SEQ ID NO: 471767 - RNA, 62 nt, Homo Sapiens
auucauaaaacagugggcaagauuucuaaggcuuuaaaaauuugugacagauaaagauguau

SEQ ID NO: 471768 - RNA, 62 nt, Homo Sapiens
cacugcacugauucaucugacuacaaauugaauuuaaaaacuaaagacauuuuugcuagggc

SEQ ID NO: 471769 - RNA, 62 nt, Homo Sapiens
agaauagaaagccuuuauuuccucagauagauuuuaaaaaaacuauagguuuagggagugua

SEQ ID NO: 471770 - RNA, 62 nt, Homo Sapiens
aaauauauauucuaucguauuuacaucugcaguuuaaaaaguaaggccaacgguccaaggga

SEQ ID NO: 471771 - RNA, 62 nt, Homo Sapiens
agaguucaugaaaacugcaacuaaaaguaacuuuuaaaaagcuccuagauuacugucauugu

SEQ ID NO: 471772 - RNA, 62 nt, Homo Sapiens
uauuuugccauuaauccaaucacuuuccaucuuuuaaaaauaaaaaucauggcaacauaauu

SEQ ID NO: 471773 - RNA, 62 nt, Homo Sapiens
aaaucacaucaguauaggccaaaacaauuaucuuuaaaaaaaucaaguaaguguggguagca

SEQ ID NO: 471774 - RNA, 62 nt, Homo Sapiens
agauaaaacauggacaaugguuccccuacgguuuuaaaaaacuccccuugagaguauauauu

SEQ ID NO: 471775 - RNA, 62 nt, Homo Sapiens
gacgcgaauaaguuugcucccuugaaggaucauuuaaaaaggagauccagugcaguuuuucu

SEQ ID NO: 471776 - RNA, 62 nt, Homo Sapiens
gggggugauucugaggcacuccuccauucucuuuuaaaaaaaugcuuggccuccaguagcug

SEQ ID NO: 471777 - RNA, 62 nt, Homo Sapiens
aggucuguugaaagucuucuuguugaggguuuuuuaaaaauccuuucccuuaguauuagauu

SEQ ID NO: 471778 - RNA, 62 nt, Homo Sapiens
gacagcuaaucucucuagggacuauuuggugguuuaaaaaaagggucagacuuuuaaacacu

SEQ ID NO: 471779 - RNA, 62 nt, Homo Sapiens
uagagcuguguguugagcuaaaaauauaauuuuuuaaaaauugacuagcaaaaucuauggcc

SEQ ID NO: 471780 - RNA, 62 nt, Homo Sapiens
aucagaagaacauuguuguuugauuauauguuuuuaaaaaccugaagcuuuuuugguggcag

SEQ ID NO: 471781 - RNA, 62 nt, Homo Sapiens
uaccacauaguauuuuuauguuacccaucaucuuuaaaaacauuauaggcugggcauggugg

SEQ ID NO: 471782 - RNA, 62 nt, Homo Sapiens
auauaauaagcucuugugccuuguaugcacuauuuaaaaaaaguuuuuuuuauuugagucca

SEQ ID NO: 471783 - RNA, 62 nt, Homo Sapiens
uaacuuucauuuuagagcacguuuuggucauuuuuaaaaauaccuaaagugccagaccggaa

SEQ ID NO: 471784 - RNA, 62 nt, Homo Sapiens
uauuuauauaaaauuuaccuuuaaguauuuacuuuaaaaaauuuaauggcuuaacucgaacu

SEQ ID NO: 471785 - RNA, 62 nt, Homo Sapiens
cccaucagugauuggggaaucaaacauuuugguuuaaaaaacaugauuauuuaaaacuggaa

SEQ ID NO: 471786 - RNA, 62 nt, Homo Sapiens
gauagaaaauauuaguuucagaauuacccuccuuuaaaaaauaagagacuauuuguuuucuu

SEQ ID NO: 471787 - RNA, 62 nt, Homo Sapiens
uuuucuuuuaauuucuaugaauaaaagaaauuuuuaaaaacuuuaaaauuuuaaauauuagu

SEQ ID NO: 471788 - RNA, 62 nt, Homo Sapiens
ugaauugcccagagcugccuuuuucuuuucuuuuuaaaaauuuuaagaaguuuucuuugugg

SEQ ID NO: 471789 - RNA, 62 nt, Homo Sapiens
guuuauuuguuauuuuaaagguaaauugcacuuuuaaaaaaauaauugguugacuuaauaua

SEQ ID NO: 471790 - RNA, 62 nt, Homo Sapiens
uuugucuugucuaagguggaaaucuugugcuguuuaaaaagcagauuuuauucuuugccuuu

SEQ ID NO: 471791 - RNA, 62 nt, Homo Sapiens
augauuagucuuaguaugaauaucauuuaaucuuuaaaaaaucaaguaaaaauguuuaucug

SEQ ID NO: 471792 - RNA, 62 nt, Homo Sapiens
ugggcagaaugaaguauguuuguuuauuuuucuuuaaaaauaaaggauuuuggaacucugga

SEQ ID NO: 471793 - RNA, 62 nt, Homo Sapiens
aagguuugacuggccuccagauuccaguuauuuuuaaaaagcaacuuaccacuaaauccuug

SEQ ID NO: 471794 - RNA, 62 nt, Homo Sapiens
uaaaaaaacugacuguggcugaaagaauugcauuuaaaaauauuuaugugcaccuuguuacu

SEQ ID NO: 471795 - RNA, 62 nt, Homo Sapiens
aaauccuuuguuauuuuucuaaaaaaauaaaauuuaaaaagaaagaaaacuaaggaagaaca

SEQ ID NO: 471796 - RNA, 62 nt, Homo Sapiens
cuuuccgcccuaugaaaaucaagaaaaucuuuuuuaaaaauggaguccugcuauuuuccacu

SEQ ID NO: 471797 - RNA, 62 nt, Homo Sapiens
aggcaauguagugacaccucauuucuauuuauuuuaaaaaaaagagagaguaacuacagaag

SEQ ID NO: 471798 - RNA, 62 nt, Homo Sapiens
uuaaaaaaaagagagaguaacuacagaagaacuuuaaaaaauaaaaaauaagcuuaccuugg

SEQ ID NO: 471799 - RNA, 62 nt, Homo Sapiens
aaacuuguguuguuucuuuuuuaaaucaacuuuuuaaaaaaauaaaguguaaauuaaccgac

SEQ ID NO: 471800 - RNA, 62 nt, Homo Sapiens
agaauacauagcagcucugcaaaggaacaguuuuuaaaaaugggaacuucuacauugaaaag

SEQ ID NO: 471801 - RNA, 62 nt, Homo Sapiens
aauaugauucaguagucaacuugagggaaauuuuuaaaaaacuauucucaauuauauacgag

SEQ ID NO: 471802 - RNA, 62 nt, Homo Sapiens
acaaauuucauuuggcagcgccauaacauucauuuaaaaaguuuaugaaaacauucauuuga

SEQ ID NO: 471803 - RNA, 62 nt, Homo Sapiens
aaaucucaguuuaauauaaaaugagcuaaguuuuuaaaaauaaauuauaaacuuggagauua

SEQ ID NO: 471804 - RNA, 62 nt, Homo Sapiens
aaaaacuggucgaguaauuaucaauaauuuuuuuuaaaaagaggaucccaaacuguaaaaga

SEQ ID NO: 471805 - RNA, 62 nt, Homo Sapiens
ugaucuguagcaauuauuuaaugaauugaauauuuaaaaaauuuuuuauuugcugucuuugg

SEQ ID NO: 471806 - RNA, 62 nt, Homo Sapiens
uguaacuuguaaaaccaaaaguucuaaugguuuuuaaaaaccaguguugaguggaaaagugu

SEQ ID NO: 471807 - RNA, 62 nt, Homo Sapiens
ccuaaagaacaaaguaguaaaauaaaaaaaaauuuaaaaaauuaaaaaauaaaaaaaagagg

SEQ ID NO: 471808 - RNA, 62 nt, Homo Sapiens
caaguaaaaugaauucuaauguacaaguuuguuuuaaaaaguguaugucaagcuuuuauuua

SEQ ID NO: 471809 - RNA, 62 nt, Homo Sapiens
uuaacuaaacugucaugguuuaguuuacaauuuuuaaaaaguucuuaaaauacugaaaaugc

SEQ ID NO: 471810 - RNA, 62 nt, Homo Sapiens
caacucuucuuaguuacuaauacuuuguugacuuuaaaaaugaaaucauucacaaacuuuug

SEQ ID NO: 471811 - RNA, 62 nt, Homo Sapiens
uucagaacucugagcucagagagacuccagauuuuaaaaaauaauuugagugcuuggaaacu

SEQ ID NO: 471812 - RNA, 62 nt, Homo Sapiens
gcaaaccccaaaucuucaaaguuggaaggaacuuuaaaaaucauccgguccaaucucuuucc

SEQ ID NO: 471813 - RNA, 62 nt, Homo Sapiens
aaugaagaacaacuuuaucaaggaagcuaguauuuaaaaacaaauucaugagcaagcugcaa

SEQ ID NO: 471814 - RNA, 62 nt, Homo Sapiens
aguuguggaauucuuacuucauuaugaauguauuuaaaaaacaaacaccaaauaauuggaau

SEQ ID NO: 471815 - RNA, 62 nt, Homo Sapiens
gaaaagcuucauuucugaagaugaauuuuauuuuuaaaaaauacaugcacacucaaaacuuu

SEQ ID NO: 471816 - RNA, 62 nt, Homo Sapiens
uaacaugaaauguuaccuuuuaacagacuguuuuuaaaaauuaaaaauguauguauagguuu

SEQ ID NO: 471817 - RNA, 61 nt, Homo Sapiens
augaugaagcugacuccuaaaccaaaagugcuuuaaaaaccagccuggcgaggacagcccu

SEQ ID NO: 471818 - RNA, 62 nt, Homo Sapiens
ggccuugcuuacugccugcaaauuuugagaaauuuaaaaauaagcauucuaacacuuuuauu

SEQ ID NO: 471819 - RNA, 62 nt, Homo Sapiens
gagccaccaugccuggccuucauuaucucuuuuuuaaaaaugaaaaaguuuauaauuuacau

SEQ ID NO: 471820 - RNA, 62 nt, Homo Sapiens
gacaaaguaucuaugccaaacaauaaacauuuuuuaaaaaauacaguguaugucuauaaaaa

SEQ ID NO: 471821 - RNA, 62 nt, Homo Sapiens
uagaauauauuagagaacugguguucaucauauuuaaaaauaauaaaugaaaacauuuaauu

SEQ ID NO: 471822 - RNA, 62 nt, Homo Sapiens
cuaaaccuuguaucucacuuuucuccucauuauuuaaaaaugcucugagaucuauagucugu

SEQ ID NO: 471823 - RNA, 62 nt, Homo Sapiens
acuuuaaagguucuuuuguggcauaguuuaucuuuaaaaacaagcuucaguauaccauguuu

SEQ ID NO: 471824 - RNA, 62 nt, Homo Sapiens
aaaagucugugacaaaacgguccgugaauauauuuaaaaaaauuucaagaucuuucugguaa

SEQ ID NO: 471825 - RNA, 62 nt, Homo Sapiens
aauacaguuaacauagaguguucaaacuauuuuuuaaaaauaaaauugcauuuuauuaccau

SEQ ID NO: 471826 - RNA, 62 nt, Homo Sapiens
cacuuuuuuucccuugugaguuuuuucuuuuauuuaaaaaugguccuuuuaacugucuccgu

SEQ ID NO: 471827 - RNA, 62 nt, Homo Sapiens
gaaauauugaaaugguguaagaaaacagcauuuuuaaaaaccgccaauauaauauaguuaau

SEQ ID NO: 471828 - RNA, 62 nt, Homo Sapiens
aaaagcaacaaaagaaaauguaugucugcauguuuaaaaaaaugugcuauccagauuuuuua

SEQ ID NO: 471829 - RNA, 62 nt, Homo Sapiens
ucaguaaucguuuuagcuucuccauuauuuuauuuaaaaacccauuuguccuugugucacgu

SEQ ID NO: 471830 - RNA, 62 nt, Homo Sapiens
aaaaaagugguuuuaggaugacuccaucucaauuuaaaaagaagccucaucaacacagugaa

SEQ ID NO: 471831 - RNA, 62 nt, Homo Sapiens
cauagcauuaaaucccaaauuuauuucuuuccuuuaaaaauaauuuuuaaaacuagcaacuc

SEQ ID NO: 471832 - RNA, 62 nt, Homo Sapiens
uuugggggcagauucugaaucugucuugacuuuuuaaaaaagccgucuccccaaagcuuuau

SEQ ID NO: 471833 - RNA, 62 nt, Homo Sapiens
ugaaauguaauguuuuuacaguuaaaaaauuuuuuaaaaauguuccaaguauuauuuuuacu

SEQ ID NO: 471834 - RNA, 62 nt, Homo Sapiens
agaaacaaaaauauuuuuccaacauuuuauuuuuuaaaaaaacaauuuucucccauugugcg

SEQ ID NO: 471835 - RNA, 62 nt, Homo Sapiens
cuguacgugacagaauauuauucaguuacauuuuuaaaaaaucuuaaagacuuaccuaaaua

SEQ ID NO: 471836 - RNA, 62 nt, Homo Sapiens
auuucuauuugguccaugcaguuaaaacaauauuuaaaaaacagauuugaaaagacgauaga

SEQ ID NO: 471837 - RNA, 62 nt, Homo Sapiens
gaaggucaagcaaagaacugaacauagagaucuuuaaaaaggaauaccuaagcugcuucuuu

SEQ ID NO: 471838 - RNA, 62 nt, Homo Sapiens
auucuauauauacuguaaaaucagaauauuuuuuuaaaaaaaauuacuuauauaaaaacagu

SEQ ID NO: 471839 - RNA, 62 nt, Homo Sapiens
uaacauuugauuacuuauauaaaggaguuucauuuaaaaaaacauauccuccucuagccugu

SEQ ID NO: 471840 - RNA, 62 nt, Homo Sapiens
gagcuaccauaugugcugucuuaaaaaucaguuuuaaaaaauuagguagaaacgguguuuau

SEQ ID NO: 471841 - RNA, 62 nt, Homo Sapiens
aguuuuaaaaaaugagcuacaaacgguguuuauuuaaaaaucaacugucuguucuuagguag

SEQ ID NO: 471842 - RNA, 62 nt, Homo Sapiens
agagcuuggucaaccucuauggccaauauuuuuuuaaaaaauugagcaauacacauauuaua

SEQ ID NO: 471843 - RNA, 62 nt, Homo Sapiens
auauacugacugaaacaugaacaguagcgguuuuuaaaaaccgauauauuguguuaauuugg

SEQ ID NO: 471844 - RNA, 62 nt, Homo Sapiens
ggaguaccaggauuuauuaaauucacugcuaauuuaaaaaagcauuggccuuaguaggcugu

SEQ ID NO: 471845 - RNA, 62 nt, Homo Sapiens
aacagaaagaaaaauauuucaguauauaucucuuuaaaaaaagggugggagguuuuuagaag

SEQ ID NO: 471846 - RNA, 62 nt, Homo Sapiens
gauagguaaacaaagaaauguugggacugccauuuaaaaaagggaagcuucuuuugcaucau

SEQ ID NO: 471847 - RNA, 62 nt, Homo Sapiens
auuuaagaaauuuuacccuucucauuucuauuuuuaaaaauauauaaaauauuaaaauuaug

SEQ ID NO: 471848 - RNA, 62 nt, Homo Sapiens
aauauaagcuacagaaaccauuucauuccuuuuuuaaaaaauucauuccccauacucccuau

SEQ ID NO: 471849 - RNA, 62 nt, Homo Sapiens
uaaacuaaagauguuuuaagagaaaagaauuuuuuaaaaaauuaagauuuuaucugggggaa

SEQ ID NO: 471850 - RNA, 62 nt, Homo Sapiens
uuaugcuuacauaauauacuugcuaaggccuuuuuaaaaagcugcuucccucauuauugcau

SEQ ID NO: 471851 - RNA, 62 nt, Homo Sapiens
aucucaauuuauauaaaguaaauaaaucacuguuuaaaaaaguguuuuaccuuaagaaacac

SEQ ID NO: 471852 - RNA, 62 nt, Homo Sapiens
cauuuuaugguucucuuaaguuaagagaauuuuuuaaaaauaagaaggauuguuuucaguuu

SEQ ID NO: 471853 - RNA, 62 nt, Homo Sapiens
uauaaccguuuuuguucuauacaauuaccacuuuuaaaaaauuguuuauauacugcuaguua

SEQ ID NO: 471854 - RNA, 62 nt, Homo Sapiens
gauuaauguauuuuauaaauaacuaaguucuuuuuaaaaaguaugugaguuaaugauacuac

SEQ ID NO: 471855 - RNA, 62 nt, Homo Sapiens
uuucuuaguggucauugcucuucuguucagccuuuaaaaauauuaacuucauugccgcugga

SEQ ID NO: 471856 - RNA, 62 nt, Homo Sapiens
uuugcauguaagaauguacuuuguuucacugauuuaaaaaauugcaagaauugacauaaugu

SEQ ID NO: 471857 - RNA, 62 nt, Homo Sapiens
uaacaucugaaaagaaaugcguuucaaaugaguuuaaaaaaaucuauuucuaucugcaaaua

SEQ ID NO: 471858 - RNA, 62 nt, Homo Sapiens
aacauauucuugcuuucacaaguacacccaauuuuaaaaaauagucuaugcuuaggccaguc

SEQ ID NO: 471859 - RNA, 62 nt, Homo Sapiens
uuuaguuuuuccuaagugauuuguaccagccuuuuaaaaaguaauuguuuaaucaauggaau

SEQ ID NO: 471860 - RNA, 62 nt, Homo Sapiens
gaaacaaugugggaggaagaaaaaaauaacaguuuaaaaaggcucaacugcuccauggauug

SEQ ID NO: 471861 - RNA, 62 nt, Homo Sapiens
uguaagugaagauggaaggcggcuuaaucuuguuuaaaaaaaauuuaaucccuucaauuugg

SEQ ID NO: 471862 - RNA, 62 nt, Homo Sapiens
aaucauuuugcauuuuacaugcaguuugcauauuuaaaaauuuugauuauugagaaaaugua

SEQ ID NO: 471863 - RNA, 62 nt, Homo Sapiens
uuaucuugcagauaaagaaaguuguguaaucuuuuaaaaauaaguucuuaaagaaucaagaa

SEQ ID NO: 471864 - RNA, 62 nt, Homo Sapiens
ugguuacauuaguuuuaaaaauaguuucuuuuuuuaaaaaaaaaaaucauuuucuuguuuaa

SEQ ID NO: 471865 - RNA, 62 nt, Homo Sapiens
auuuucuuguuuaaauaguuuuacuuagaauuuuuaaaaauccuuugcuuguacuagauuuc

SEQ ID NO: 471866 - RNA, 62 nt, Homo Sapiens
acauuguuguaagagugauuuuauuuguuguauuuaaaaaauuugcuuugcugguuucauau

SEQ ID NO: 471867 - RNA, 62 nt, Homo Sapiens
aaaaaugcagggugauuucuaacuaguuuuaguuuaaaaagaauuuuguaacuuuacaguua

SEQ ID NO: 471868 - RNA, 62 nt, Homo Sapiens
auuaucaggggagaaaaauucaauuuuuaauuuuuaaaaauucuucaguccauucccuuagg

SEQ ID NO: 471869 - RNA, 62 nt, Homo Sapiens
uuuuuagaacuccaauacucuaacuucauuauuuuaaaaauaugcauguguauacauacaug

SEQ ID NO: 471870 - RNA, 62 nt, Homo Sapiens
gaagaaacugcugagcuugcugacugucgggcuuuaaaaaggucgacuauagaaaacuccac

SEQ ID NO: 471871 - RNA, 62 nt, Homo Sapiens
aagauauaggguagaaauaaagagggacuggguuuaaaaaaaugugcuuuauaaacuauauu

SEQ ID NO: 471872 - RNA, 62 nt, Homo Sapiens
agauuauucuaaaauauaaauuauuugcuuuuuuuaaaaaggugagagugcuuacucacagu

SEQ ID NO: 471873 - RNA, 62 nt, Homo Sapiens
gaaaauauuuuaaaauuauuaauugugugccauuuaaaaacugaaaaugaugugccagcuaa

SEQ ID NO: 471874 - RNA, 62 nt, Homo Sapiens
aauguccucgaugcuucuguacauguacccauuuuaaaaaacuuuagauucauuuuguccac

SEQ ID NO: 471875 - RNA, 62 nt, Homo Sapiens
uaugaaauauuuugauuucuauaccauaagcauuuaaaaacaaaauagacaauuuggcucuc

SEQ ID NO: 471876 - RNA, 62 nt, Homo Sapiens
ugagcuuauauauuguuuauaaguaugauaccuuuaaaaaggaauuauuucuauaugacaca

SEQ ID NO: 471877 - RNA, 62 nt, Homo Sapiens
uuuugaauaacuaucuuuugaagcaauucuuuuuuaaaaaaauaaaauacugagauuugggg

SEQ ID NO: 471878 - RNA, 62 nt, Homo Sapiens
ucuuaaagcacucuguaauauucuuuuacacguuuaaaaacuaugcacuaagcuuuuuuuuu

SEQ ID NO: 471879 - RNA, 62 nt, Homo Sapiens
aagcaauguaaagaccguaaacuguuaacuuuuuuaaaaaaguggguggcuuuuuucauacu

SEQ ID NO: 471880 - RNA, 62 nt, Homo Sapiens
gguggaaaauaggaacugucacuaaagcuuuuuuuaaaaaaaugaugcuuggaaauuaagag

SEQ ID NO: 471881 - RNA, 62 nt, Homo Sapiens
uguuuaguaucauuuuguguuaggacaucuuuuuuaaaaagcuuauuguggcuugaucuucu

SEQ ID NO: 471882 - RNA, 62 nt, Homo Sapiens
auaauagcagggaauucuuaaaugugaaaacauuuaaaaaugaaggguaaggcaguuuuaaa

SEQ ID NO: 471883 - RNA, 62 nt, Homo Sapiens
ugaaaacauuuaaaaaugauggguaaggcaguuuuaaaaauggaauccaaauacauccaaaa

SEQ ID NO: 471884 - RNA, 62 nt, Homo Sapiens
cuugaaagcuucaccuggccuacaacuuuuauuuuaaaaagaugaucaagaaaacuucaucu

SEQ ID NO: 471885 - RNA, 62 nt, Homo Sapiens
caagaaagauaaaccccugucucaaggaacauuuuaaaaagaacgucuguccccugugaugc

SEQ ID NO: 471886 - RNA, 62 nt, Homo Sapiens
cuuuacccuuccaucacuauauugauucuuuuuuuaaaaaauaugaacccaaacucccgccu

SEQ ID NO: 471887 - RNA, 62 nt, Homo Sapiens
aaagaaaauggaaaaaaacccacaaaacaaacuuuaaaaaaaaaaaaaaacaaauuugccaa

SEQ ID NO: 471888 - RNA, 62 nt, Homo Sapiens
ucuuauguuauuagcaagguuaagacaucuuuuuuaaaaaaauuauagcuucuaccaagaga

SEQ ID NO: 471889 - RNA, 62 nt, Homo Sapiens
guauuuaaacaauuuccgaugcccaugaugaguuuaaaaaccagcauugacaccauccccaa

SEQ ID NO: 471890 - RNA, 62 nt, Homo Sapiens
uucugaacuuggcaaaauuggaaauuaaaauuuuuaaaaauuacaaauauacaaaguuauuu

SEQ ID NO: 471891 - RNA, 62 nt, Homo Sapiens
caaaacaaaacaaaacaaacaaaugaaaaacguuuaaaaagaagaagaagaaaaaaaacaag

SEQ ID NO: 471892 - RNA, 62 nt, Homo Sapiens
agacgccauagcuggauuggaaacauugauguuuuaaaaauuuauuuuuuuuggaaauaguu

SEQ ID NO: 471893 - RNA, 62 nt, Homo Sapiens
uuucuggggaauccaauuauaguugcuuuguauuuaaaaacaagaacagccaaggguuguuc

SEQ ID NO: 471894 - RNA, 62 nt, Homo Sapiens
aaggagacaauuuuggagagcaagcaaaucuuuuuaaaaaauaguaugaaugugaauacuag

SEQ ID NO: 471895 - RNA, 62 nt, Homo Sapiens
aaaaauaguaugaaugugaauacuagaaaagauuuaaaaaauaguaugagugugaguacuag

SEQ ID NO: 471896 - RNA, 62 nt, Homo Sapiens
uuuuuaauaacuuagaggagauuuuaacuuuauuuaaaaauagguaaaauuauuguaccuaa

SEQ ID NO: 471897 - RNA, 62 nt, Homo Sapiens
uuuaugcgauaacuccuuuuuguuacaauuuuuuuaaaaaaagcuauuuuuguuaauguaaa

SEQ ID NO: 471898 - RNA, 62 nt, Homo Sapiens
uuuuucagaauauuugcaauaagagucuggauuuuaaaaaacacaugcauacacacaauuaa

SEQ ID NO: 471899 - RNA, 62 nt, Homo Sapiens
uacuaucuauuauuuaguucuaacacagaagcuuuaaaaauacauagucauccaagguuuuc

SEQ ID NO: 471900 - RNA, 62 nt, Homo Sapiens
uauacuauauaauauucucaauuacauuugaauuuaaaaauauugagcucuugauuacaauu

SEQ ID NO: 471901 - RNA, 62 nt, Homo Sapiens
cugucauugcaaaguaacaaaaauuuuaagcuuuuaaaaauguagauuuuucauauuuuuaa

SEQ ID NO: 471902 - RNA, 62 nt, Homo Sapiens
gucuuaaucugaagucuuuuucaugcccuuguuuuaaaaaaacuacuuuuuuuggccucaaa

SEQ ID NO: 471903 - RNA, 62 nt, Homo Sapiens
ucauggcaacacuggauaauggcuuugugaaauuuaaaaaauuuuuguagcgacuguaaaca

SEQ ID NO: 471904 - RNA, 62 nt, Homo Sapiens
uuaucagcaagucgugagucaaacugcugccuuuuaaaaaacccacaaaaugcugauucagu

SEQ ID NO: 471905 - RNA, 62 nt, Homo Sapiens
augccauccucuagucaaauuuuuuuucauuguuuaaaaauacggaaguguuccaauauaau

SEQ ID NO: 471906 - RNA, 62 nt, Homo Sapiens
auguaauuuaacaaauugcugcauguauuccauuuaaaaauauguuuaaauuguccuaaaac

SEQ ID NO: 471907 - RNA, 62 nt, Homo Sapiens
aagacccuaucucuaccccccuaauaaauuaauuuaaaaagccccccaaucugugguauuuu

SEQ ID NO: 471908 - RNA, 62 nt, Homo Sapiens
agaggcugggaggguugaggggaagauaaacuuuuaaaaagcucuuaucuuucauuucaauc

SEQ ID NO: 471909 - RNA, 62 nt, Homo Sapiens
uccauucuuggauucccuuucuuuccuuuuauuuuaaaaaagaacaguaccccucuuuuaag

SEQ ID NO: 471910 - RNA, 62 nt, Homo Sapiens
ugcacagaccaagaauucagugaaugucauuuuuuaaaaaacuaauuuguauugucugcucu

SEQ ID NO: 471911 - RNA, 62 nt, Homo Sapiens
uuugaaacaaaagaaaauaaugcauuguguuuuuuaaaaagaguaucuuauacauguauccu

SEQ ID NO: 471912 - RNA, 62 nt, Homo Sapiens
auuuauauaaaaauaauuuaucaaaaggauauuuuaaaaaagcuagucugucuugaaacuug

SEQ ID NO: 471913 - RNA, 62 nt, Homo Sapiens
ucaucgaucuuucaagaugauuucuucugauauuuaaaaaauggggaaaauuuuauuucccu

SEQ ID NO: 471914 - RNA, 62 nt, Homo Sapiens
uguuccguuuuuuucccagggucguuauugccuuuaaaaaucugaaacaagccgucuuacaa

SEQ ID NO: 471915 - RNA, 62 nt, Homo Sapiens
ggaaucuaaaggaugguugcucugagcagccauuuaaaaauuaaagaacucuauuggugucg

SEQ ID NO: 471916 - RNA, 62 nt, Homo Sapiens
uuacauaacucuucauuuuugauaaagugaauuuuaaaaaaguuuaacaaaauguaucauuc

SEQ ID NO: 471917 - RNA, 62 nt, Homo Sapiens
aaguccuugauuuaguuuuuggggagggaauguuuaaaaagaaauaacauuuuagggggaaa

SEQ ID NO: 471918 - RNA, 62 nt, Homo Sapiens
uuauguacucacagucuuuccccauauaucuuuuuaaaaaauuccauuagaauacugcaaaa

SEQ ID NO: 471919 - RNA, 62 nt, Homo Sapiens
cagcagcauaggagugaacaugcugcaacguuuuuaaaaaugauaaccuuuccuuuuaaaug

SEQ ID NO: 471920 - RNA, 62 nt, Homo Sapiens
aauccucugaacugggucgguaacccuuauccuuuaaaaagaaacacucauuuccaaggccc

SEQ ID NO: 471921 - RNA, 62 nt, Homo Sapiens
cacuuggugauucuuucaagagaaaaccgcuuuuuaaaaaaaaggccaauuuguuggccacc

SEQ ID NO: 471922 - RNA, 62 nt, Homo Sapiens
auucacuuguauaaaaauggguaagugucuuuuuuaaaaaaauaaacuauugccauacuuca

SEQ ID NO: 471923 - RNA, 62 nt, Homo Sapiens
gaaaaaaacauggucuuguuuuaaugcacauuuuuaaaaaaaucuauucauuuauguuagca

SEQ ID NO: 471924 - RNA, 62 nt, Homo Sapiens
agcagaaauacacaaugaucaagauaacuuuuuuuaaaaaaaaaucaugaaugauacacaug

SEQ ID NO: 471925 - RNA, 62 nt, Homo Sapiens
cauguucauggguuuaccacuggguaauuugguuuaaaaauaagagauugaacuccaagagg

SEQ ID NO: 471926 - RNA, 62 nt, Homo Sapiens
uguauguacuugacaauuccauauaauaaaguuuuaaaaauuuauguucaaauuguuuaugu

SEQ ID NO: 471927 - RNA, 62 nt, Homo Sapiens
cauauuuccaccucucucuguauaaaucuuguuuuaaaaauaaagugggcaucacaauuauc

SEQ ID NO: 471928 - RNA, 62 nt, Homo Sapiens
uagcacuugacuuuuugccaagauuuucuguuuuuaaaaaugguaaugcguuugauuguuug

SEQ ID NO: 471929 - RNA, 62 nt, Homo Sapiens
aaaucuucaguaggauguuucugacuuguauauuuaaaaaaaagaacuucuaucauuuuaaa

SEQ ID NO: 471930 - RNA, 62 nt, Homo Sapiens
aaauuguaaauggaguguguaguuuuuucugguuuaaaaaccuguuggauagauguuuuaac

SEQ ID NO: 471931 - RNA, 62 nt, Homo Sapiens
gaagugcaaaaaaaauuuuucacauuuaaaaauuuaaaaauuguaauugauauuaaaagugg

SEQ ID NO: 471932 - RNA, 62 nt, Homo Sapiens
uaaaaauugaagugcaaaaaaaaaguggcacauuuaaaaauuaguaguuuguaauugauauu

SEQ ID NO: 471933 - RNA, 62 nt, Homo Sapiens
aagaaaaguuguuuuaucuacuauugcagguguuuaaaaagacaaacugaauuuuugaaaga

SEQ ID NO: 471934 - RNA, 62 nt, Homo Sapiens
ugcacaauuuacuucccaaagcagcaacuuguuuuaaaaaaagcacuuagauggauauaaau

SEQ ID NO: 471935 - RNA, 62 nt, Homo Sapiens
acauuguagccuaagaucaacccugcauuguuuuuaaaaagccaauauucugauuuuccucu

SEQ ID NO: 471936 - RNA, 62 nt, Homo Sapiens
ucuguacuggcaaauggugggccucaguuugguuuaaaaacucuuugcucuuucugcuuuau

SEQ ID NO: 471937 - RNA, 62 nt, Homo Sapiens
ucaccuuuuauaguuggguguuauuguaauuuuuuaaaaacaugcaugcaucacuucugcau

SEQ ID NO: 471938 - RNA, 62 nt, Homo Sapiens
uccccccauguaauuauuguuauuguuggugguuuaaaaaaugaguggauuuuauuuuucgu

SEQ ID NO: 471939 - RNA, 62 nt, Homo Sapiens
caacauuccucugcuucauauaucugcuucuguuuaaaaagcguccugcaucuuuuuuuuuu

SEQ ID NO: 471940 - RNA, 62 nt, Homo Sapiens
cuaaguuuuuaaauaacuauauagacauguuuuuuaaaaaucgccuuaaacguuguauuuuu

SEQ ID NO: 471941 - RNA, 62 nt, Homo Sapiens
aauuaaaaguuuuaaacucaaaauaauuuauuuuuaaaaagauuauaaauuguaugcuucag

SEQ ID NO: 471942 - RNA, 62 nt, Homo Sapiens
cucugcacugccauguaugaugcaacuuuuuauuuaaaaaagguugccaugguguugaacaa

SEQ ID NO: 471943 - RNA, 62 nt, Homo Sapiens
ucuguaaaaacguguaguguauuauuaccugauuuaaaaauccauaugcuuuuuuuuuuuua

SEQ ID NO: 471944 - RNA, 62 nt, Homo Sapiens
acuguacuguaaauggaauguaucaagcauauuuuaaaaagauucgguauuuaacacuuugu

SEQ ID NO: 471945 - RNA, 62 nt, Homo Sapiens
ugaauagguguucucaggaguuuauuuugagcuuuaaaaagaagagauuugaggacauuauu

SEQ ID NO: 471946 - RNA, 62 nt, Homo Sapiens
agcuuauaauuccucguuauaugauuguuauuuuuaaaaaccauauuuauaauggauauuua

SEQ ID NO: 471947 - RNA, 62 nt, Homo Sapiens
aaaaucagaggccuaucuccaaccugcuaggauuuaaaaauaguagccucuuaaaaaaaaaa

SEQ ID NO: 471948 - RNA, 62 nt, Homo Sapiens
aauuggaagaauaaccaggaaaucucccaaaauuuaaaaacaccagguggaggagaaagggg

SEQ ID NO: 471949 - RNA, 62 nt, Homo Sapiens
aacucauuaguaucauaaacgggggugggguauuuaaaaauuagagcagagcaccucccacu

SEQ ID NO: 471950 - RNA, 62 nt, Homo Sapiens
ugugaaaugucaucuuguacaaggauucuuuuuuuaaaaaaauauuaggauauauucccaug

SEQ ID NO: 471951 - RNA, 62 nt, Homo Sapiens
aacccccauguaugccuauagaaguaaccaccuuuaaaaagcacugauaauaucacaaccca

SEQ ID NO: 471952 - RNA, 62 nt, Homo Sapiens
uuaaacacagacuucuaaaacucauuuguacuuuuaaaaaauccuuauacaacauuucuaaa

SEQ ID NO: 471953 - RNA, 62 nt, Homo Sapiens
aagggauuuuuuuuuuuuguauucaaguauauuuuaaaaaucaaaauaacucugaguuugau

SEQ ID NO: 471954 - RNA, 62 nt, Homo Sapiens
ugagugguucaguucauuccuuuaagugugauuuuaaaaaaaacuuuuuugcccaugugucu

SEQ ID NO: 471955 - RNA, 62 nt, Homo Sapiens
aagauuucuggaguagauuguuuguuuaacuuuuuaaaaaaugauucauuuuuauuuuuguc

SEQ ID NO: 471956 - RNA, 62 nt, Homo Sapiens
uauauucuagggucaggggaccuuuuuuuaacuuuaaaaaugauuaucauuugcguuuuuuu

SEQ ID NO: 471957 - RNA, 62 nt, Homo Sapiens
ucuauuaauauuccaucguaauucuacaacuuuuuaaaaaugcuuuuuuuauauuauuaaau

SEQ ID NO: 471958 - RNA, 62 nt, Homo Sapiens
aaaaaaaaggagacuuuuuuaagaagaaaagauuuaaaaaaacucaacuuuaaaaaaaaaaa

SEQ ID NO: 471959 - RNA, 62 nt, Homo Sapiens
aaaaaagaagaaaagauuuauuuuaccucaacuuuaaaaaaaagguuuccauacacugaagc

SEQ ID NO: 471960 - RNA, 62 nt, Homo Sapiens
uuugugguuuuuuaauauaguauaaaaauccuuuuaaaaaaacaacaaucugugugccucuc

SEQ ID NO: 471961 - RNA, 62 nt, Homo Sapiens
gguuuggagacauaaggaauauucugacccuuuuuaaaaaaggauuuucucauguuuuuauu

SEQ ID NO: 471962 - RNA, 62 nt, Homo Sapiens
uuuuauuauguguuuuguauaaaucccuaauauuuaaaaaaaaaaacaaaacaaaaaaaggu

SEQ ID NO: 471963 - RNA, 62 nt, Homo Sapiens
aucuuaagugcuaauuaaaaaaaaaauaaaauuuuaaaaaaaccuguaguuucauuaccuuu

SEQ ID NO: 471964 - RNA, 62 nt, Homo Sapiens
ugguuuccaacaccaugaugaagcucuugcuuuuuaaaaaguaguuaguaaauucugcauga

SEQ ID NO: 471965 - RNA, 62 nt, Homo Sapiens
aguuaguaaauucugcaugaauuuuaguaaacuuuaaaaaauagauuuuuucccuaagaaag

SEQ ID NO: 471966 - RNA, 62 nt, Homo Sapiens
uuccauuggcuaugauggaauuaauauuguauuuuaaaaaugcauauugaucacuauaauuc

SEQ ID NO: 471967 - RNA, 62 nt, Homo Sapiens
cuuuuacauauauugcuguuacuucugcuuucuuuaaaaauauaguaaaggauguuuuauga

SEQ ID NO: 471968 - RNA, 62 nt, Homo Sapiens
ucaaauccuauuaggcacaagucggaguuacauuuaaaaaaaauuaacagucuacaacaacu

SEQ ID NO: 471969 - RNA, 62 nt, Homo Sapiens
gggaccggcagaaauggaaguauccauacauuuuuaaaaagcaacaaguuugcacagcuaga

SEQ ID NO: 471970 - RNA, 62 nt, Homo Sapiens
uuccuggaggggcucuuauuauuuucucucuuuuuaaaaaacuuccaguagaaguaaagugg

SEQ ID NO: 471971 - RNA, 62 nt, Homo Sapiens
aauuucaaaaaaaaauuacaaaaguaugugaauuuaaaaaugagagcaguccucucacccua

SEQ ID NO: 471972 - RNA, 62 nt, Homo Sapiens
auauauacugcaguguaucucacguauuaauuuuuaaaaaucuuuuguuuuacuuaauucug

SEQ ID NO: 471973 - RNA, 62 nt, Homo Sapiens
gacaaagcucaccaacuuuaaaauauuaaguuuuuaaaaaaucaaauaugaaguauguucag

SEQ ID NO: 471974 - RNA, 62 nt, Homo Sapiens
cuguuuuugguuuacaguguaauaauaccucauuuaaaaaauaaaaaccacuacuguuacau

SEQ ID NO: 471975 - RNA, 62 nt, Homo Sapiens
aaauaaaaaccacuacuguuacauuuuauuaauuuaaaaagcuagaaaauucauguaguuac

SEQ ID NO: 471976 - RNA, 62 nt, Homo Sapiens
gaagaaagauuugguggagggaagcuuucugguuuaaaaauuaguaaggugugucuuuuugu

SEQ ID NO: 471977 - RNA, 62 nt, Homo Sapiens
auaugccauucuuguuauagaagaauaugccuuuuaaaaaagcuuauuaauaacacuuuccc

SEQ ID NO: 471978 - RNA, 62 nt, Homo Sapiens
aagcuuauuaauaacacuuucccaauuuauauuuuaaaaagcuaaagaacacuggauuaaua

SEQ ID NO: 471979 - RNA, 62 nt, Homo Sapiens
uguuuuuucuuaaguuauauuuguuuuuacuuuuuaaaaaagaagaggaaacaaagcccccu

SEQ ID NO: 471980 - RNA, 62 nt, Homo Sapiens
acuucuauuauuuguuuugguuagaaagugaauuuaaaaaacaaaccaaacucuaaacuuuc

SEQ ID NO: 471981 - RNA, 62 nt, Homo Sapiens
gauagauuugucaaaacgacauuuaagucauguuuaaaaagucauuugggcaguucuggaaa

SEQ ID NO: 471982 - RNA, 62 nt, Homo Sapiens
uuguccaaucuggugaaugucuaacccuaaaguuuaaaaauuucugccuccuaaguuuaugu

SEQ ID NO: 471983 - RNA, 62 nt, Homo Sapiens
ucccauuguuucagugggcauuaacagaaugcuuuaaaaacuucuaagacaagaaucuauag

SEQ ID NO: 471984 - RNA, 62 nt, Homo Sapiens
cuauagcauuaguauacacuggcacauaauuuuuuaaaaaguuuuaagaaaagauucauuug

SEQ ID NO: 471985 - RNA, 62 nt, Homo Sapiens
uaagaaaacuaccacuucuugauuuuuacagauuuaaaaaaaucuuuucagugaccuuucuu

SEQ ID NO: 471986 - RNA, 62 nt, Homo Sapiens
aguaaccugugaacuaugcuuuuccauaacuuuuuaaaaauauauauaucuaaaugaaugca

SEQ ID NO: 471987 - RNA, 62 nt, Homo Sapiens
gcauuuccagcuaaucucuucugcucuaaauauuuaaaaacaguucuucucaaacauuuuca

SEQ ID NO: 471988 - RNA, 62 nt, Homo Sapiens
uacuaauagaggaguagagauuguugaccauuuuuaaaaaacgauagccacucuuuuucuuu

SEQ ID NO: 471989 - RNA, 62 nt, Homo Sapiens
uuguuugaagcgaguuaauauucucaguugucuuuaaaaaucaguuacucuaauuccaggug

SEQ ID NO: 471990 - RNA, 62 nt, Homo Sapiens
aucauauuguguauaacuuggaaauggugcuguuuaaaaaaauuguguauuuauacaguaac

SEQ ID NO: 471991 - RNA, 62 nt, Homo Sapiens
auuuucucuacacacucacccucuuccaguucuuuaaaaacguuuaugauauuaagaucaaa

SEQ ID NO: 471992 - RNA, 62 nt, Homo Sapiens
ucucuuaugaaaaguauauguaaacacauucauuuaaaaauccuuggaacucaauguggaac

SEQ ID NO: 471993 - RNA, 62 nt, Homo Sapiens
aucuagggaguggccaaacuaaauauaauuucuuuaaaaaagaaagaaaaaggaaaaaucca

SEQ ID NO: 471994 - RNA, 62 nt, Homo Sapiens
gcauuaaaaaugcuuauuaauaacuuuggucauuuaaaaaaugcuacaaugacuuccuauua

SEQ ID NO: 471995 - RNA, 62 nt, Homo Sapiens
cugguauucuacuacuugugcaauauauauguuuuaaaaaacaaauuugagaauacauuuaa

SEQ ID NO: 471996 - RNA, 62 nt, Homo Sapiens
gguuaagauguauuagaauuauacaauaucaguuuaaaaaucuguaugcauaaagaaugcac

SEQ ID NO: 471997 - RNA, 62 nt, Homo Sapiens
agauacauuuuauggugguuucaguaggucauuuuaaaaaccaaugugcauuaguuuucaag

SEQ ID NO: 471998 - RNA, 62 nt, Homo Sapiens
auuuuaguaauuuaauaaaaggauaauguuuauuuaaaaaaccugacuuuuccagaguaauu

SEQ ID NO: 471999 - RNA, 62 nt, Homo Sapiens
guuaaaaugauaaauuuuacugcaacuguauauuuaaaaauagugaguguacuuaaugccac

SEQ ID NO: 472000 - RNA, 62 nt, Homo Sapiens
auuuuauaaacaaaucaagguggaauauucuuuuuaaaaacagaaacugauaaauauauaug

SEQ ID NO: 472001 - RNA, 62 nt, Homo Sapiens
gaguuaaagaugacuguguagcuaaagaagauuuuaaaaauuucucgugcaugaagcugaca

SEQ ID NO: 472002 - RNA, 62 nt, Homo Sapiens
aaugacaugccugaacaacuuuaaaagcaucauuuaaaaaaaauaaaaccaaagugcuauuu

SEQ ID NO: 472003 - RNA, 62 nt, Homo Sapiens
uuucugaaaaaacuuuugcauuauuaauuacauuuaaaaagugaaugacagauucagguggu

SEQ ID NO: 472004 - RNA, 62 nt, Homo Sapiens
auaaaagauaaugauuuauuucacugauuugcuuuaaaaaaaaaagguuuuuguccuuuccu

SEQ ID NO: 472005 - RNA, 62 nt, Homo Sapiens
auacuguuuguuuaaagcauuagauucucucauuuaaaaaaagcuggucagacuuuuuuugu

SEQ ID NO: 472006 - RNA, 62 nt, Homo Sapiens
auauguuuauaaaguuauuacugauaaauauauuuaaaaauuaaaauuuaaaguaucuugca

SEQ ID NO: 472007 - RNA, 62 nt, Homo Sapiens
cauaacagcaaccuugaaaaucaaacaaauguuuuaaaaauuagggggaaaaacacauaaag

SEQ ID NO: 472008 - RNA, 62 nt, Homo Sapiens
aauaaauaagggaaauuccucuagacuuuauguuuaaaaauagggaauggcaaacgauuuua

SEQ ID NO: 472009 - RNA, 62 nt, Homo Sapiens
aaaucaaccuugcuuugaugcacauaucgauuuuuaaaaauuuaaugugauauuauacauaa

SEQ ID NO: 472010 - RNA, 62 nt, Homo Sapiens
uuguauaucuuguuuuggugugacauuuuuaguuuaaaaaccuuaacuuaauugcuauguuu

SEQ ID NO: 472011 - RNA, 62 nt, Homo Sapiens
acaaaguagcauaauuuguuuuuaccuuacuuuuuaaaaacuuaacucacucauauaauaga

SEQ ID NO: 472012 - RNA, 62 nt, Homo Sapiens
uauuaaccucaucacuacuaucucguuuuuaauuuaaaaagacaaugaaaugcaguuuuuuu

SEQ ID NO: 472013 - RNA, 62 nt, Homo Sapiens
caaucauaggaggaaaagaaaaagagcaugauuuuaaaaaauuguuuauguugauguaugga

SEQ ID NO: 472014 - RNA, 62 nt, Homo Sapiens
ucuaauauuuuaucaaaucuaauacaaguauuuuuaaaaaugcaagcagaaaacucauaguc

SEQ ID NO: 472015 - RNA, 62 nt, Homo Sapiens
acugaacagaaauccuuagccagucggggguauuuaaaaaggauggugcucauaaaaggccc

SEQ ID NO: 472016 - RNA, 62 nt, Homo Sapiens
aacaaaucuuuaaaaucugcugcuagcuugauuuuaaaaaaaaauguuuguauaugcaaaac

SEQ ID NO: 472017 - RNA, 62 nt, Homo Sapiens
aaaucuaaaaauaguuaagccuuccuuuacaguuuaaaaaaacuucugucucuccuuccucc

SEQ ID NO: 472018 - RNA, 62 nt, Homo Sapiens
uaauuagaauuuccaaauaagagcagaacaguuuuaaaaaucauaaugcuuuuuguaaacaa

SEQ ID NO: 472019 - RNA, 62 nt, Homo Sapiens
agaugagagauucaaaaauaauuuaauacuuauuuaaaaagaugaucaacaccuuaaaauuc

SEQ ID NO: 472020 - RNA, 62 nt, Homo Sapiens
guguuuguucugaauguuggacauagaaauaauuuaaaaauaugcagaauuuuugcaugaca

SEQ ID NO: 472021 - RNA, 62 nt, Homo Sapiens
aaaggaauccauaccaugauaaaaaaagauuguuuaaaaaaaauuuaagaaaaaaaaaaaag

SEQ ID NO: 472022 - RNA, 62 nt, Homo Sapiens
uuuuuaaaacucucugagucacaaacuugaucuuuaaaaaugaagagccacauuuacaaaca

SEQ ID NO: 472023 - RNA, 62 nt, Homo Sapiens
aucauaauaguuaggauaguaucuaaacuuuuuuuaaaaaaaauuuguggcuagaaauuuua

SEQ ID NO: 472024 - RNA, 62 nt, Homo Sapiens
acuuauaauuaaucacuagcccaauuggauuguuuaaaaacuauugugaauacaauguaugu

SEQ ID NO: 472025 - RNA, 62 nt, Homo Sapiens
auaauaacaaaaggaaagcauuguuacaacaauuuaaaaauacuggggccaaacacaugaac

SEQ ID NO: 472026 - RNA, 62 nt, Homo Sapiens
aggaaauuucuacaaucaugacugaguuuuuguuuaaaaaccagagggcagucauucuucuc

SEQ ID NO: 472027 - RNA, 62 nt, Homo Sapiens
aaaauuguuuaaaguauuauuaaaauuuuauuuuuaaaaagggaagaguaauaccaaaugcc

SEQ ID NO: 472028 - RNA, 62 nt, Homo Sapiens
auuguaagauucuuucugugauucguaaacuuuuuaaaaaacuugaauauggcccgacacaa

SEQ ID NO: 472029 - RNA, 62 nt, Homo Sapiens
guuaugcaggcuuaacguguuaauuucaagauuuuaaaaaaucucaauuaaguguugggaac

SEQ ID NO: 472030 - RNA, 62 nt, Homo Sapiens
agccacauaucuagauuuuuaaucuucuguuuuuuaaaaauauugcaguguuuaagucagca

SEQ ID NO: 472031 - RNA, 62 nt, Homo Sapiens
auuuacuaaggauuagauuauaaucaacaucguuuaaaaauauaauguguuuuaacauuuuu

SEQ ID NO: 472032 - RNA, 62 nt, Homo Sapiens
augcaugaaaacaggugguaaaugacucaccuuuuaaaaauuuuaaaauauguaaugucaaa

SEQ ID NO: 472033 - RNA, 62 nt, Homo Sapiens
uggaaauggaaaaaaaaauaaucugugucuacuuuaaaaaacaucagcuuuauucuaagcaa

SEQ ID NO: 472034 - RNA, 62 nt, Homo Sapiens
aucugcaaccuuaauucagcuguguguuguauuuuaaaaauuuuuuaauauacuagucauga

SEQ ID NO: 472035 - RNA, 62 nt, Homo Sapiens
gaaacacuaaauaguguaauauuucuuuugcuuuuaaaaaaauuccugguagcaaaucaaga

SEQ ID NO: 472036 - RNA, 62 nt, Homo Sapiens
caagaauaaauaaaacaaacuuaaucuucaucuuuaaaaaaaagaaaaaagaaaccaaaaug

SEQ ID NO: 472037 - RNA, 62 nt, Homo Sapiens
uuuuuaaugcuuaauacauacauggugcaaaauuuaaaaagcgcaaauagguaucuagugga

SEQ ID NO: 472038 - RNA, 62 nt, Homo Sapiens
ugugauuaaauucauugugauugcacaaaaauuuuaaaaacacgugauguaaacuugcaagc

SEQ ID NO: 472039 - RNA, 62 nt, Homo Sapiens
uguuugggugguuggaauaauuuuauuuuucuuuuaaaaaagcuaacaucagaccccuuuau

SEQ ID NO: 472040 - RNA, 62 nt, Homo Sapiens
ccugcuacugcaaauauaaaacauaaaguuuguuuaaaaaaaugcaaaucauucuuuaccuu

SEQ ID NO: 472041 - RNA, 62 nt, Homo Sapiens
aauaugaacaaagaaaaaaauauauuuuaugauuuaaaaaauaaauauaauugggauuuuaa

SEQ ID NO: 472042 - RNA, 62 nt, Homo Sapiens
uuuaugauuuaaaaaauaaauauaauugggauuuuaaaaacaugagaaaugugaacugugau

SEQ ID NO: 472043 - RNA, 62 nt, Homo Sapiens
ucgggagaggauuagguuccauccuuuacguguuuaaaaaaaagcauaaaaacauuuuaaaa

SEQ ID NO: 472044 - RNA, 62 nt, Homo Sapiens
cuuuacguguuuaaaaaaaagcauaaaaacauuuuaaaaacauagaaaaauucagcaaacca

SEQ ID NO: 472045 - RNA, 62 nt, Homo Sapiens
guuccgaugaauucuuauccccugccccuuccuuuaaaaaacuuagugacaaaauagacaau

SEQ ID NO: 472046 - RNA, 62 nt, Homo Sapiens
gcuuugggccauguagcauuuuaagacucaauuuuaaaaaauuauuaaucuguugcugacuc

SEQ ID NO: 472047 - RNA, 62 nt, Homo Sapiens
uguggguguguauauaucugauuugggaagaauuuaaaaaacacauagcuuuuuaauuuguu

SEQ ID NO: 472048 - RNA, 62 nt, Homo Sapiens
aacaagauaaaacucacaggggaauguacuuuuuuaaaaaaaaaugaaaaagaaaaaaaaag

SEQ ID NO: 472049 - RNA, 62 nt, Homo Sapiens
uguauuuugaaaugaugugucaggaaaaguuuuuuaaaaacuuguauguuuuugcaaauccc

SEQ ID NO: 472050 - RNA, 62 nt, Homo Sapiens
aaguuguggcaaaggaaacuauacuuuucauuuuuaaaaauguaaauagaaaaguuuuuaac

SEQ ID NO: 472051 - RNA, 62 nt, Homo Sapiens
aaagaagagauaacuuccaaaagagugcuguuuuuaaaaauaauaauuaggaaauguuuauu

SEQ ID NO: 472052 - RNA, 62 nt, Homo Sapiens
ucuuugauguugacaucaaauaaaguaugugguuuaaaaaaaucuccaaauaccuuuuuuuc

SEQ ID NO: 472053 - RNA, 62 nt, Homo Sapiens
ucaugcacugaaaaaugcuguuaucuuuuguuuuuaaaaaaugcaauuaaaacuagaaauag

SEQ ID NO: 472054 - RNA, 62 nt, Homo Sapiens
aaugaagcuuauauuaauuguugcuucaauaguuuaaaaaauuuauggagauagguagguca

SEQ ID NO: 472055 - RNA, 62 nt, Homo Sapiens
ugccaaauauauguacauauauauuuauauauuuuaaaaauaaacauuuuuuaaaucgucag

SEQ ID NO: 472056 - RNA, 62 nt, Homo Sapiens
caaaggaggaaacaggaaaaauugccguccauuuuaaaaauuuagguuuguuguuuuaaacc

SEQ ID NO: 472057 - RNA, 62 nt, Homo Sapiens
uucuuuaaguaauuuaacaacagauuugcuaauuuaaaaaaaaaugaaaaaaaaaaucuuac

SEQ ID NO: 472058 - RNA, 62 nt, Homo Sapiens
uuuaagaugucuauuauauuuacuuauuaguuuuuaaaaauugcgcuacuugccugggaaac

SEQ ID NO: 472059 - RNA, 62 nt, Homo Sapiens
aacauagcagaccucguuucuacuaaaaauuuuuuaaaaaagaaaauuagggcaaggugugg

SEQ ID NO: 472060 - RNA, 62 nt, Homo Sapiens
caugaugugaaaacccaucucuacaaaaauuuuuuaaaaaauaagccagggauuguggcaug

SEQ ID NO: 472061 - RNA, 62 nt, Homo Sapiens
acuucugaauaagaugauagacgagaauuuuuuuuaaaaaaggaauuuaaaggaaucuugug

SEQ ID NO: 472062 - RNA, 62 nt, Homo Sapiens
cuuccaaacccaaucuaguaggauguucucauuuuaaaaacgaggggaaaagaccagaguuu

SEQ ID NO: 472063 - RNA, 62 nt, Homo Sapiens
aaguaauuuaagaauauccaaaaaaauuagacuuuaaaaaguuaucuugguacaacaccgug

SEQ ID NO: 472064 - RNA, 62 nt, Homo Sapiens
acagcaacugccaaugaaggaugaauccccuuuuuaaaaaguuguuguuguuguuguuuauu

SEQ ID NO: 472065 - RNA, 62 nt, Homo Sapiens
uuuugaguuaggagggauaauagagaaguccauuuaaaaauuauuuuuagaagcuaaagaaa

SEQ ID NO: 472066 - RNA, 62 nt, Homo Sapiens
auacaaucauguacucuuuaacagaaauugcuuuuaaaaaauaucuggaacuaucuuuaaaa

SEQ ID NO: 472067 - RNA, 62 nt, Homo Sapiens
gaaauugcuuuuaaaaaauaucuggaacuaucuuuaaaaaaacuuuauuaauaaucauguau

SEQ ID NO: 472068 - RNA, 62 nt, Homo Sapiens
uuacauuuuacugauuaacaaauaaauuggaauuuaaaaauaucgauaucaccaugauuuaa

SEQ ID NO: 472069 - RNA, 62 nt, Homo Sapiens
aauaagaguaaaaauaugugaaucuggauauauuuaaaaaaagaaauuugaugcccagauaa

SEQ ID NO: 472070 - RNA, 62 nt, Homo Sapiens
gaaaggccuuuuggagugugucuuucuguguguuuaaaaacagugggaaaauccacaccaca

SEQ ID NO: 472071 - RNA, 62 nt, Homo Sapiens
uucacauuaaguuccccuugcacacuuaccuauuuaaaaaacuaaacuugcacugcaacuga

SEQ ID NO: 472072 - RNA, 62 nt, Homo Sapiens
ugaggaccaaaccaugcacauaaagcuuguaguuuaaaaaagaaaagcaaaaaaauaauuau

SEQ ID NO: 472073 - RNA, 62 nt, Homo Sapiens
ggauuuuuugaugcuuugcucuaauggaacuguuuaaaaaauuuuuuuuucuuuuuaauauu

SEQ ID NO: 472074 - RNA, 62 nt, Homo Sapiens
uuucuuguuggauagaaccuuuguauuuguucuuuaaaaacauuuuuuuuaauguugguaac

SEQ ID NO: 472075 - RNA, 62 nt, Homo Sapiens
uuugggcugucuguauguuuuuauagcugguuuuuaaaaagcauaauaugccuauagcugaa

SEQ ID NO: 472076 - RNA, 62 nt, Homo Sapiens
auauugucauacaauguuaaauaaccuauuuuuuuaaaaaaguucaacuuaagguagaaguu

SEQ ID NO: 472077 - RNA, 62 nt, Homo Sapiens
cuacacaucagaccauaguugcuuaggaaaccuuuaaaaauuccaguuaagcaauguugaaa

SEQ ID NO: 472078 - RNA, 62 nt, Homo Sapiens
uuuuuuaauuaaauucaaguggagucguuuuuuuuaaaaaaaugaguaacacacauauagug

SEQ ID NO: 472079 - RNA, 62 nt, Homo Sapiens
aacuucccaugucuuccauuauuugucccccuuuuaaaaauauuauuuuugcuauucugauc

SEQ ID NO: 472080 - RNA, 62 nt, Homo Sapiens
agaauaacagauauauaaaaucauuuuauucauuuaaaaacuuucagguuauugaaaacuuu

SEQ ID NO: 472081 - RNA, 62 nt, Homo Sapiens
gcuaucauguauauuuacaccuauuuacaaguuuuaaaaauuuuguaauuuuguaaggccaa

SEQ ID NO: 472082 - RNA, 62 nt, Homo Sapiens
aaaaauuuuacuugauucccuaguccugugucuuuaaaaauugaagaagaaagaauaaagcu

SEQ ID NO: 472083 - RNA, 62 nt, Homo Sapiens
uauuuuaaaaugugauuuuccuguuaauauuuuuuaaaaaucaagcacaagauaaagaacag

SEQ ID NO: 472084 - RNA, 62 nt, Homo Sapiens
aucauuguccuccuccucuucucaaauauguuuuuaaaaaaucgugagccaccaugcccagc

SEQ ID NO: 472085 - RNA, 62 nt, Homo Sapiens
gcagaugagaaauauugucgugagaaagcauguuuaaaaauuaaaaauacguguuuguuauu

SEQ ID NO: 472086 - RNA, 62 nt, Homo Sapiens
ugauaccuggguccuauuccgccuggcagagcuuuaaaaaauucaaucuuagcuacauauua

SEQ ID NO: 472087 - RNA, 62 nt, Homo Sapiens
uugagaccaaaguaguauagauuaauugauguuuuaaaaauguuaaauuguaaauuuucaaa

SEQ ID NO: 472088 - RNA, 62 nt, Homo Sapiens
aaccccuccauccaggauauacaugccuccuuuuuaaaaaauuaaaaaacaaaguugugaaa

SEQ ID NO: 472089 - RNA, 62 nt, Homo Sapiens
aaaguugugaaaacaugccuugcuaauuuuauuuuaaaaaacaaaauauuuuuuggaagagc

SEQ ID NO: 472090 - RNA, 62 nt, Homo Sapiens
aaauuaaaagggugguuuuucuuauucuuaaguuuaaaaaagggucuuuuguguuuaucaaa

SEQ ID NO: 472091 - RNA, 62 nt, Homo Sapiens
uaauacugugcaggcaaggcuggguuuucuuuuuuaaaaacauuuaagcaauagauuuugcu

SEQ ID NO: 472092 - RNA, 62 nt, Homo Sapiens
aagaaaccucuuuaagcaauuuauucuguuuguuuaaaaaaugguuuuaaaauugucaagag

SEQ ID NO: 472093 - RNA, 62 nt, Homo Sapiens
agauacauuuucuuaacauuuccagugauaacuuuaaaaauugccaaaauauuucagcauau

SEQ ID NO: 472094 - RNA, 62 nt, Homo Sapiens
cagguuagaacaaaaauguccagcacauuuuuuuuaaaaacuuuuuuaaggguccuucuuuc

SEQ ID NO: 472095 - RNA, 62 nt, Homo Sapiens
aagagauauacagaugacuugggaauaaaaauuuuaaaaauuaaucuuuuuuuuauuuuuaa

SEQ ID NO: 472096 - RNA, 62 nt, Homo Sapiens
ugguuugagccuuaugcccacauuuccucuuuuuuaaaaauuggucaaauucuggaaguaag

SEQ ID NO: 472097 - RNA, 62 nt, Homo Sapiens
uuuuuauuuuuuaaagcauaaaugauagugccuuuaaaaauuacuucaacuugcauucucag

SEQ ID NO: 472098 - RNA, 62 nt, Homo Sapiens
uuacuaggauugacauuuuuuuuuaagaaguauuuaaaaaucacagaagcuaauuagcaagu

SEQ ID NO: 472099 - RNA, 62 nt, Homo Sapiens
aauuauuuacuacaguguaucaugaaagauauuuuaaaaacuagcccaauuaccagaaacau

SEQ ID NO: 472100 - RNA, 62 nt, Homo Sapiens
ucccccagcacuucccacaguuuuucucugcauuuaaaaaaagagauauggaaggaugccuu

SEQ ID NO: 472101 - RNA, 62 nt, Homo Sapiens
uauuuauaaggaaauuuuacaugagagcauaauuuaaaaauaaugggacacauggucuguca

SEQ ID NO: 472102 - RNA, 57 nt, Homo Sapiens
guuauuuaaauccugaagaggugucuuuuuaaaaauuauuccauuuugugguguuaa

SEQ ID NO: 472103 - RNA, 62 nt, Homo Sapiens
aaggacuguuccugauuagaauuuucaugaaguuuaaaaaucagaauggaauaucagaguac

SEQ ID NO: 472104 - RNA, 62 nt, Homo Sapiens
gcugauuaguuuucaaugucuuacuuaaaugcuuuaaaaauuuguuauaaugccauuagcag

SEQ ID NO: 472105 - RNA, 62 nt, Homo Sapiens
gguggaaucccucaaaaaauggaaggaugugcuuuaaaaaaacagauucaguguguggaaca

SEQ ID NO: 472106 - RNA, 62 nt, Homo Sapiens
uauauugccucugccaaacaacaucuuacauuuuuaaaaauuaaaggcuaauggcauuuuaa

SEQ ID NO: 472107 - RNA, 62 nt, Homo Sapiens
gugacacucuuaucguaaagauuccucugacuuuuaaaaauguccucuugccuuuuacuuaa

SEQ ID NO: 472108 - RNA, 62 nt, Homo Sapiens
accuauuugggaucauuugaauuaaagcccuuuuuaaaaagcauuugaacuacuuaaacagu

SEQ ID NO: 472109 - RNA, 62 nt, Homo Sapiens
cuucucucucuuuucuaaaaacugugccuacauuuaaaaauacugaauuugaacagcucacc

SEQ ID NO: 472110 - RNA, 62 nt, Homo Sapiens
caaucccaaguaaaaauuucuaaauacauguauuuaaaaaaaacugcaguucauccgcacug

SEQ ID NO: 472111 - RNA, 62 nt, Homo Sapiens
gucuucuuauuuugguuucauuuucuuuuucuuuuaaaaaauaacucuuucuuuccguuuuu

SEQ ID NO: 472112 - RNA, 62 nt, Homo Sapiens
guuuucuggggaaaggggacuaacugcugguuuuuaaaaaauugacugaacauuaguugcac

SEQ ID NO: 472113 - RNA, 62 nt, Homo Sapiens
ccaacuuuuuuuuuuuaauucugguuuugguuuuuaaaaagcagggacaucuuuggaaaacg

SEQ ID NO: 472114 - RNA, 62 nt, Homo Sapiens
caaaaacaaaacaacaacaacucccuaaauuuuuuaaaaagaccuuccccgugguggccccg

SEQ ID NO: 472115 - RNA, 62 nt, Homo Sapiens
aaugcaaaaaaauucuuaugugucgauguuuuuuuaaaaaaauagagauguagcgauguaag

SEQ ID NO: 472116 - RNA, 62 nt, Homo Sapiens
agaacugagguagcuuagagaagcaggugcuuuuuaaaaaucagcaagaugaaaaaaaggaa

SEQ ID NO: 472117 - RNA, 62 nt, Homo Sapiens
cacguuaacuucagaggaaggcguuuaugcuuuuuaaaaacaguuuauacacuggaaauguu

SEQ ID NO: 472118 - RNA, 62 nt, Homo Sapiens
auccaugaaaaagugucuuguguccaaucauuuuuaaaaaucaacagagaaagagacuaaug

SEQ ID NO: 472119 - RNA, 62 nt, Homo Sapiens
aaaucuuuaaacuggccuuuguuuaaacuuuuuuuaaaaaaaguuuaaucuuuuuaaaaaag

SEQ ID NO: 472120 - RNA, 62 nt, Homo Sapiens
guuuaaacuuuuuuuaaaaauuguuuaaucuuuuuaaaaaagguaccuuuuugcuagccuga

SEQ ID NO: 472121 - RNA, 62 nt, Homo Sapiens
ggaguacuuccuagugcagcaagcuggcuccauuuaaaaacuuauuuuacagggcuaacaua

SEQ ID NO: 472122 - RNA, 62 nt, Homo Sapiens
caacggucccuaauagaguacucaagguauuuuuuaaaaaagaugacuucuaaugcuuauau

SEQ ID NO: 472123 - RNA, 62 nt, Homo Sapiens
caagauaugcaaaaacaaugcaauaauauucauuuaaaaauacaauugugaguuguguuggc

SEQ ID NO: 472124 - RNA, 62 nt, Homo Sapiens
aauugugaguuguguuggcauuaaaacuguauuuuaaaaaaagacagaaauuuaagggaaaa

SEQ ID NO: 472125 - RNA, 62 nt, Homo Sapiens
cuguugggucuuggcugaaaaaaaaaaaugcuuuuaaaaaagauaaaaugaaaaggagagcu

SEQ ID NO: 472126 - RNA, 62 nt, Homo Sapiens
uacacaaauauuccaggauacaaaaaaaaacauuuaaaaauccgagacccagaacacuucug

SEQ ID NO: 472127 - RNA, 62 nt, Homo Sapiens
cuugaugaagcaaggaagauauacaugaaaauuuuaaaaauacauaucgcugacuucaugga

SEQ ID NO: 472128 - RNA, 62 nt, Homo Sapiens
uaaugucccuuucagagacagcugauacuucauuuaaaaaaaucacaaaaauuugaacacug

SEQ ID NO: 472129 - RNA, 62 nt, Homo Sapiens
cuaaaguuuguuagauagcugcauguggcuuuuuuaaaaaagcaacagaaaccuauccucac

SEQ ID NO: 472130 - RNA, 62 nt, Homo Sapiens
guuccacgauacauaaaucauuucucauuugcuuuaaaaaauuuaaaaguguaaaaauuaug

SEQ ID NO: 472131 - RNA, 62 nt, Homo Sapiens
auccauuugaucuauagcaaugugauuuuauuuuuaaaaagaaaagcaguguguuuucuuuu

SEQ ID NO: 472132 - RNA, 62 nt, Homo Sapiens
ggugguaguuguauucuaaaugauguagaagguuuaaaaauaauuacauuaugcuucuauuc

SEQ ID NO: 472133 - RNA, 62 nt, Homo Sapiens
cagauguuaaaccuuuuaauguuuugauuugcuuuaaaaauggccuuccuacacauuagcuc

SEQ ID NO: 472134 - RNA, 62 nt, Homo Sapiens
uaaauguuugagaaugcauaaaauuauaccaauuuaaaaauauaaauuuuugccacuguuuu

SEQ ID NO: 472135 - RNA, 62 nt, Homo Sapiens
uuuaaaaugucaaauauauaauauguaauuuuuuuaaaaaccaccagauacagaaaugugcu

SEQ ID NO: 472136 - RNA, 62 nt, Homo Sapiens
augaagacaauuucuguaaugguuuuaagagauuuaaaaagaaauucacugguucuuuacaa

SEQ ID NO: 472137 - RNA, 62 nt, Homo Sapiens
gagauuuucucaccccacaucgcuccccuuuuuuuaaaaaggacuguuuugcuagugugaua

SEQ ID NO: 472138 - RNA, 62 nt, Homo Sapiens
ucugaucucugagugaaucccuuuguucucuguuuaaaaaaaucuaaaaagaaaaaggaaaa

SEQ ID NO: 472139 - RNA, 62 nt, Homo Sapiens
auuuacaaaaccguuuaagcugguuugaauaauuuaaaaaaguuucagcacaccuauacccc

SEQ ID NO: 472140 - RNA, 62 nt, Homo Sapiens
uuucuauucaccguacuuauccaaaaaucucuuuuaaaaaguaaauuugugcaacaacguuu

SEQ ID NO: 472141 - RNA, 62 nt, Homo Sapiens
caguuugaaacuauucauuucuacacacuauuuuuaaaaauugccuacuaggugaaacauaa

SEQ ID NO: 472142 - RNA, 62 nt, Homo Sapiens
ccugugcugaaauuugggggaaguuuagguccuuuaaaaaaacauauuaaucauugacuaca

SEQ ID NO: 472143 - RNA, 62 nt, Homo Sapiens
uuaaaguagaaauuuaauuuguagauauaaccuuuaaaaauuuucucauuaagacaauguuu

SEQ ID NO: 472144 - RNA, 62 nt, Homo Sapiens
aguuuauuuauuugguucuuuagauggaggaauuuaaaaaaucaaauuuuucucuucaccuu

SEQ ID NO: 472145 - RNA, 62 nt, Homo Sapiens
uucagccuguuucuaaaagcugaaaaucucaguuuaaaaaucaaaauguuaacacaaagcua

SEQ ID NO: 472146 - RNA, 62 nt, Homo Sapiens
aaucguauuauuuuuuucuuaacagaaauauuuuuaaaaaugaaaaaguacucaaaagugag

SEQ ID NO: 472147 - RNA, 62 nt, Homo Sapiens
ucaccaucuccugaagaccuuucuuaccuuuuuuuaaaaacaaaaaaugaaauuauuuugca

SEQ ID NO: 472148 - RNA, 62 nt, Homo Sapiens
guauugaagauugaaaggguuuuucuuucuuuuuuaaaaaagaaaaacaaacuauugauugu

SEQ ID NO: 472149 - RNA, 62 nt, Homo Sapiens
uauuuuccucaauggcaaauuuuaaauuaguuuuuaaaaacuuacuuauuuggguaguuaaa

SEQ ID NO: 472150 - RNA, 62 nt, Homo Sapiens
auaucuauaaaucugaaguuuaacaugauuaauuuaaaaaguauuuagugcuugacaaagua

SEQ ID NO: 472151 - RNA, 62 nt, Homo Sapiens
accuuggaaaaguuauuucccuuuguaauaccuuuaaaaauccagaguauuauauucauuuu

SEQ ID NO: 472152 - RNA, 62 nt, Homo Sapiens
guaaauuauuuauuuauguuagcauuuaaaaguuuaaaaaaaaugcauuugaccaggauaaa

SEQ ID NO: 472153 - RNA, 62 nt, Homo Sapiens
ucauauaaugacuuuuuuuuaagagucucuuuuuuaaaaaaacuuaauucucuaaaaccgaa

SEQ ID NO: 472154 - RNA, 62 nt, Homo Sapiens
auucucuaaaaccgaaaugguucaugcuucuuuuuaaaaaugauuguauaaaauguauggaa

SEQ ID NO: 472155 - RNA, 62 nt, Homo Sapiens
gaagucaacauuuaugaaauauugccugacuauuuaaaaagaaaaaaguagcucuccauuau

SEQ ID NO: 472156 - RNA, 62 nt, Homo Sapiens
uaugcucuuuuuacuuaaguuuuaauuuguccuuuaaaaaaaggugaaacaaaccaagaaca

SEQ ID NO: 472157 - RNA, 62 nt, Homo Sapiens
cauuauauucuaaucuugaauauucuaccauauuuaaaaauaucucaagguuucuguucauu

SEQ ID NO: 472158 - RNA, 62 nt, Homo Sapiens
aucuuaaaauugcugaauuuacccucauauucuuuaaaaaacuuaaagcauuaugaauguag

SEQ ID NO: 472159 - RNA, 62 nt, Homo Sapiens
uugcauguuuuucagaugcuuucaaaucuuuuuuuaaaaaaauaguguaaaauauuuuaaua

SEQ ID NO: 472160 - RNA, 62 nt, Homo Sapiens
uauaguuaaaacauuuguucuacaaauuaaccuuuaaaaauauaauuacugcuaaaaauaga

SEQ ID NO: 472161 - RNA, 62 nt, Homo Sapiens
caucaaauaaaaauggaaaaaaugaucauggcuuuaaaaaaaaaacaaaaacacacacacau

SEQ ID NO: 472162 - RNA, 62 nt, Homo Sapiens
uuuaauuguaaaagccguuaauguagaaaacuuuuaaaaaaauuaauauggcagaauacgag

SEQ ID NO: 472163 - RNA, 62 nt, Homo Sapiens
augauuugccugugacuuauuuuuaaaacuuuuuuaaaaaagauuuagcuuuaaaauaguug

SEQ ID NO: 472164 - RNA, 62 nt, Homo Sapiens
ucuuagagguuuuuugcacucuuuaaauuugcuuuaaaaauauugugucugugugcauaguc

SEQ ID NO: 472165 - RNA, 62 nt, Homo Sapiens
ccugaucuuuccuaauccucacuuuuuucuuuuuuaaaaagcaguuucuccacugcuaaaug

SEQ ID NO: 472166 - RNA, 62 nt, Homo Sapiens
acuguuauaaaguauaacaacacacaucagguuuuaaaaagccuugaauggcccuugucuua

SEQ ID NO: 472167 - RNA, 62 nt, Homo Sapiens
uuuuugccuugguauacauuuuaaaauaugaauuuaaaaaauuuuuguaaaaauaaaauuca

SEQ ID NO: 472168 - RNA, 62 nt, Homo Sapiens
acaucagauuaaauaauuacacuguucaggcuuuuaaaaaaauaccacugugagaauaaagc

SEQ ID NO: 472169 - RNA, 62 nt, Homo Sapiens
uaaagcgcuagcaagauacaucacuuacugauuuuaaaaauacagaaagauuuugaguaaau

SEQ ID NO: 472170 - RNA, 62 nt, Homo Sapiens
uauguaaguuauuaaaugguuaaucauggccuuuuaaaaauaaaauaaagugauaccuuuac

SEQ ID NO: 472171 - RNA, 62 nt, Homo Sapiens
acauuaauuuuauuuuuucagacauacuguaauuuaaaaauuaaugugagcguuuguuuuaa

SEQ ID NO: 472172 - RNA, 62 nt, Homo Sapiens
caucuaauuuccugcuuaccuuaacugggaauuuuaaaaaguuggccuaaaaauguuccaug

SEQ ID NO: 472173 - RNA, 62 nt, Homo Sapiens
gcauuucuuaaaaaagaguaauaaaaaggauuuuuaaaaaguaauuccuuaaacauaccauc

SEQ ID NO: 472174 - RNA, 62 nt, Homo Sapiens
caauucaacacaucaucuguuacuaacgcagcuuuaaaaaaugcauaaacgauuauacuaca

SEQ ID NO: 472175 - RNA, 62 nt, Homo Sapiens
aaaugcauaaacgauuauacuacauuaauuuuuuuaaaaaguauccuguuuauggucugauu

SEQ ID NO: 472176 - RNA, 62 nt, Homo Sapiens
gcugggaugauggagaaagcucgaggugaaguuuuaaaaaaaaaguuguggaaaggaaaguu

SEQ ID NO: 472177 - RNA, 62 nt, Homo Sapiens
gaaagaauuaucuggcacauuagguauuggaguuuaaaaaaaaagccaaauuucacagucuu

SEQ ID NO: 472178 - RNA, 62 nt, Homo Sapiens
aaaagccaaauuucacagucuuaauaacuuuuuuuaaaaaaaacuaaaaggcgcuucauguc

SEQ ID NO: 472179 - RNA, 62 nt, Homo Sapiens
aaaacccccuuccaggagaggaugggcaggcauuuaaaaaguaccauuuuugugguuguuug

SEQ ID NO: 472180 - RNA, 62 nt, Homo Sapiens
auacuuuuauaagaugagcugaauccucuuacuuuaaaaacuggucuuuuuauuuacccucu

SEQ ID NO: 472181 - RNA, 62 nt, Homo Sapiens
acacuuaaucuuagcggauuacuucagauguuuuuaaaaaguauauuaagaugccuuuucac

SEQ ID NO: 472182 - RNA, 62 nt, Homo Sapiens
caacaggcgcucacugaaguguaugaauauuuuuuaaaaagguuuuugcaguaagcuagucu

SEQ ID NO: 472183 - RNA, 62 nt, Homo Sapiens
auucuuuauagaaaugugaacacugaauuuauuuuaaaaaauaauaauaaaaauuuaaaaaa

SEQ ID NO: 472184 - RNA, 62 nt, Homo Sapiens
acugaauuuauuuuaaaaaauaauaauaaaaauuuaaaaaaauuaaaaauaaaaaaaaccac

SEQ ID NO: 472185 - RNA, 62 nt, Homo Sapiens
auauuuuccaacagcugaaguagggauaguuuuuuaaaaaauuuaaugauggguaaucaaaa

SEQ ID NO: 472186 - RNA, 62 nt, Homo Sapiens
guaaucaaaacauucacauuuauucugcuggauuuaaaaauauguacuuuuuuuuuuuuuuu

SEQ ID NO: 472187 - RNA, 62 nt, Homo Sapiens
acuuuucccucucuauauagacuagaugauguuuuaaaaauuuucugcccucccuauuuuua

SEQ ID NO: 472188 - RNA, 62 nt, Homo Sapiens
uacuuuuucugcccucccuauuuagcuuguguuuuaaaaauccccugagugcucauguacca

SEQ ID NO: 472189 - RNA, 62 nt, Homo Sapiens
uguuaccacaauuaugagauccaaaggguuacuuuaaaaaucgguaucacguaaaauuuuuu

SEQ ID NO: 472190 - RNA, 62 nt, Homo Sapiens
uacauaaaaauuucaucuuauuaaaaaucagcuuuaaaaaaaaacccccuauuuucaggggg

SEQ ID NO: 472191 - RNA, 62 nt, Homo Sapiens
cccuuccugaguaauaaagauggguggguagauuuaaaaaauuuuugcccucuuuggggaag

SEQ ID NO: 472192 - RNA, 62 nt, Homo Sapiens
uauuauuuauuuuugcccucaccguagguuuuuuuaaaaaauuuauuaagacuggcuuuaga

SEQ ID NO: 472193 - RNA, 62 nt, Homo Sapiens
gcuaaauuacauagacuuaguguugaaguuuuuuuaaaaaaagccuuaaagacaaaaauccu

SEQ ID NO: 472194 - RNA, 62 nt, Homo Sapiens
acuuuuaaauauuaacucaaaacaaacucuuuuuuaaaaauuuugcuuuuguuucuuaagaa

SEQ ID NO: 472195 - RNA, 62 nt, Homo Sapiens
cuuacuaaggaauaaaaacuacuauuuugugauuuaaaaauuuauuaccuaaauauugccac

SEQ ID NO: 472196 - RNA, 62 nt, Homo Sapiens
uaaauacugucugugagaaagucuuaaauuauuuuaaaaaaagcuugguacaagcuuaugcu

SEQ ID NO: 472197 - RNA, 62 nt, Homo Sapiens
aagagaaacuucagccuuucaaagugaaaacauuuaaaaaggaaugauaguggauaauagac

SEQ ID NO: 472198 - RNA, 62 nt, Homo Sapiens
gaauauaauuugaggcacaguauauauguauauuuaaaaaguaauuugaauauacauauaua

SEQ ID NO: 472199 - RNA, 62 nt, Homo Sapiens
uaauagggaaaauauuuaauagauaguaaaaauuuaaaaaugaauguuuuauacauuuuugg

SEQ ID NO: 472200 - RNA, 62 nt, Homo Sapiens
uaaaucuaaaaugucuuauguuuauuuggcuauuuaaaaacaucugugacuugauauuuugu

SEQ ID NO: 472201 - RNA, 62 nt, Homo Sapiens
gacuuugcuaacuuacuaguguauuaguguccuuuaaaaauaaaagaaaaaauaaacuuuau

SEQ ID NO: 472202 - RNA, 62 nt, Homo Sapiens
aaaaauuaaauauuagaaugcagguaauaaaauuuaaaaaauauuuuacacaucauaccuag

SEQ ID NO: 472203 - RNA, 62 nt, Homo Sapiens
uaagucuuauaauuaugaccugagaguuuuauuuuaaaaagcauuaaaaggguagacacagu

SEQ ID NO: 472204 - RNA, 62 nt, Homo Sapiens
aaaaaaaaaauucauuuucuaugcuguuuucuuuuaaaaaaaaagaaaaucuuaagugauug

SEQ ID NO: 472205 - RNA, 62 nt, Homo Sapiens
aaauuggcaagacaacuauagacaauuuauuguuuaaaaaaaaaugcagugacuuauacuaa

SEQ ID NO: 472206 - RNA, 62 nt, Homo Sapiens
cauuaagugaauucuagguagaaugguugugguuuaaaaagacuaaggcaaauugaaaauua

SEQ ID NO: 472207 - RNA, 62 nt, Homo Sapiens
caaauaaaaacaguguuuuaugugcuuacauuuuuaaaaagagaaaagugacacuucaaaag

SEQ ID NO: 472208 - RNA, 62 nt, Homo Sapiens
auauucuucaaaaaugcauugcauuauguauauuuaaaaaauuuucaguuuggagcuuuuag

SEQ ID NO: 472209 - RNA, 62 nt, Homo Sapiens
uuuuacugcagccaaguuuugaaaucauggauuuuaaaaauauaaagagaaaaacucauuca

SEQ ID NO: 472210 - RNA, 62 nt, Homo Sapiens
uuuguauaaaacuggaagugugguuucuuuccuuuaaaaaaaucaaaugcaauacuuugggu

SEQ ID NO: 472211 - RNA, 62 nt, Homo Sapiens
gaaagaauaaaaaaaccuucucaugggcucacuuuaaaaaaaaaucugggaaagacaccaaa

SEQ ID NO: 472212 - RNA, 62 nt, Homo Sapiens
aaguaccuuaauucuuuauuggaaaugaggcuuuuaaaaauacuugaugcuccugucaaaag

SEQ ID NO: 472213 - RNA, 62 nt, Homo Sapiens
uuuuuuuauuuuuuacuuaucccaggcugcuuuuuaaaaauaaaacccacccacuucucuug

SEQ ID NO: 472214 - RNA, 62 nt, Homo Sapiens
aagugaggggaggccgggugagagaaauggguuuuaaaaauuuccaguugugaagcuggaga

SEQ ID NO: 472215 - RNA, 62 nt, Homo Sapiens
cuuuucuccucaucauugcccuuuguauauuuuuuaaaaaucgcaucccaaauguuuuuaau

SEQ ID NO: 472216 - RNA, 62 nt, Homo Sapiens
cgaaaaaaacaaaacaaaacacuaaugcuuuguuuaaaaaaacuaauagccaaauagauaac

SEQ ID NO: 472217 - RNA, 62 nt, Homo Sapiens
aaaaagcaaagcuuucugccuagauuuauuuuuuuaaaaaaaaagacacacuuguacgaaug

SEQ ID NO: 472218 - RNA, 62 nt, Homo Sapiens
auucauguucaaaggagcuucuagacuguaaguuuaaaaacauuuaaaaauuaggcuuauug

SEQ ID NO: 472219 - RNA, 62 nt, Homo Sapiens
aggcuuauugcuagacuguauaagcauucuguuuuaaaaauucugauuguacagggagaaau

SEQ ID NO: 472220 - RNA, 62 nt, Homo Sapiens
uauuuucagauuauaaaaggauuaaaggaagguuuaaaaauccauuaaagagaaaauuucac

SEQ ID NO: 472221 - RNA, 62 nt, Homo Sapiens
aaacuucauuguaguaaauuuccuacucuccauuuaaaaaacagguuaauaauguccucauc

SEQ ID NO: 472222 - RNA, 62 nt, Homo Sapiens
guaauugaauaagugugaaucagcaucauuuuuuuaaaaaauuaaaacauuaauaguuuaag

SEQ ID NO: 472223 - RNA, 62 nt, Homo Sapiens
aaacugguguguauucucauuaugugggauuuuuuaaaaagcuuaaaauuaugcagggcccc

SEQ ID NO: 472224 - RNA, 62 nt, Homo Sapiens
agcacaugauggcugggcaccauccaccucgcuuuaaaaauacagcucugggggaauggugu

SEQ ID NO: 472225 - RNA, 62 nt, Homo Sapiens
aaagaaaguugcauccagaaagucucuguguauuuaaaaaguauuuugcacaaacuauuugc

SEQ ID NO: 472226 - RNA, 62 nt, Homo Sapiens
uguuuguguuccugugguuaauauuucaugcuuuuaaaaagauuuuaguucuauggauggaa

SEQ ID NO: 472227 - RNA, 62 nt, Homo Sapiens
gaucaaguuagugugugucuaauaaaaaaaguuuuaaaaacuaacuuaaaaaaaauuuaaaa

SEQ ID NO: 472228 - RNA, 62 nt, Homo Sapiens
aaaaaaaguuuuaaaaacugacuuaaaaaaaauuuaaaaaauguagauaauauaaaauaaaa

SEQ ID NO: 472229 - RNA, 62 nt, Homo Sapiens
uaacuacaguauagcgcuggaugugaaguucauuuaaaaaaaauuugaaagaauacaaaaau

SEQ ID NO: 472230 - RNA, 62 nt, Homo Sapiens
cuuauuauguacuucuguguauggcaauagauuuuaaaaaauuuuugugcaaaaauaaauga

SEQ ID NO: 472231 - RNA, 62 nt, Homo Sapiens
auggcagcaaaggguaguuucuacaaaaaaacuuuaaaaaaaacacaaaaaauaaaaaaccc

SEQ ID NO: 472232 - RNA, 62 nt, Homo Sapiens
uugcagugcuauuuuuucuuuguaaaauugacuuuaaaaauauuuguaucuaauguguacag

SEQ ID NO: 472233 - RNA, 62 nt, Homo Sapiens
ugccuuuuuaaagcauuaauguggugggacuuuuuaaaaaaaguacuugaaguugagccuuu

SEQ ID NO: 472234 - RNA, 62 nt, Homo Sapiens
agaaccagcucaaguacaugaaucugggacuuuuuaaaaauaguggguuaccugaacuccau

SEQ ID NO: 472235 - RNA, 62 nt, Homo Sapiens
ccuguuauaaacguugaacuacuuuucuccauuuuaaaaagccuuuuuaaaaauuuuccaaa

SEQ ID NO: 472236 - RNA, 62 nt, Homo Sapiens
uuccaaaacuuuucuccauucauaaguuucuuuuuaaaaauugauccuguacucuaauaaau

SEQ ID NO: 472237 - RNA, 62 nt, Homo Sapiens
cuacuucaguaucaugaguauuuauuuuuuaauuuaaaaaaucuccauuuuaaaugacuacu

SEQ ID NO: 472238 - RNA, 62 nt, Homo Sapiens
aaagcuuaauagcuuccauauacaauucaguuuuuaaaaaaugacuuguucuacauuguaaa

SEQ ID NO: 472239 - RNA, 62 nt, Homo Sapiens
auuauuuuuaaauaguaucuuauauuuuacuauuuaaaaagcuuaugcucaggaaucucuug

SEQ ID NO: 472240 - RNA, 62 nt, Homo Sapiens
acguugauuuuuuacaaaugacaaaguguaacuuuaaaaagcgaaaggggucaccgugucug

SEQ ID NO: 472241 - RNA, 62 nt, Homo Sapiens
aaaacagaauguuguacguguucccugaggucuuuaaaaacauucccacaaccgaguucuag

SEQ ID NO: 472242 - RNA, 62 nt, Homo Sapiens
aaauauaaugcuaguccuagauuacuuauugauuuaaaaacaaaaaaaagauuacuuaauuu

SEQ ID NO: 472243 - RNA, 62 nt, Homo Sapiens
uuaaaaacaaaaaaaagauuacuuaauuuugauuuaaaaacaaaaaaucguaaaauacaaaa

SEQ ID NO: 472244 - RNA, 62 nt, Homo Sapiens
aauuuuuuuaauauauaggucuuaaguggugcuuuaaaaagaacccucacaaguuaaaaauu

SEQ ID NO: 472245 - RNA, 62 nt, Homo Sapiens
aaauauuagaaauagcacaaagucauggaguuuuuaaaaauuguuauaauuaaguaaaaaua

SEQ ID NO: 472246 - RNA, 62 nt, Homo Sapiens
aucuuuccaaauaacauuuaauuauaauguuuuuuaaaaaauauauuccucuucagucauug

SEQ ID NO: 472247 - RNA, 62 nt, Homo Sapiens
ucuuauacuuucuccuaggaaaacuuuaaaacuuuaaaaaggcaaaccuaccaauaggaaua

SEQ ID NO: 472248 - RNA, 62 nt, Homo Sapiens
agugaacugguacaauguggucccucucaauauuuaaaaauauaauuuguaacagugcuuac

SEQ ID NO: 472249 - RNA, 62 nt, Homo Sapiens
ucuuaggcagcucugcacuucauguucaguuuuuuaaaaauagacuguaguauccuuucauu

SEQ ID NO: 472250 - RNA, 62 nt, Homo Sapiens
aaaacacaacagucauuaucugugaaccauaauuuaaaaaucuuucuagaauaacaacagca

SEQ ID NO: 472251 - RNA, 62 nt, Homo Sapiens
uugguccuuuaauaaguaaagaaaauaauauguuuaaaaauguaaauguuuuacaaauuuga

SEQ ID NO: 472252 - RNA, 62 nt, Homo Sapiens
ucugacaucagaaaauaaaauugaggcugauuuuuaaaaauuucuaguagauuuuuggccuu

SEQ ID NO: 472253 - RNA, 62 nt, Homo Sapiens
aaauuucuaguagauuuuuggccuuuccuguuuuuaaaaaucaguuucauuuucauauuuca

SEQ ID NO: 472254 - RNA, 62 nt, Homo Sapiens
acuguuuucuuuuuagaaacccacuguuaaaauuuaaaaaggugcuuuaaaauaaaacgccu

SEQ ID NO: 472255 - RNA, 62 nt, Homo Sapiens
gugaaaacuuaaauuguaaaacauguugaaauuuuaaaaauuaauguuaauauggaaaugca

SEQ ID NO: 472256 - RNA, 62 nt, Homo Sapiens
ccauacucaggguguagggagaauacuuugcauuuaaaaacccuguccaccugucaccagca

SEQ ID NO: 472257 - RNA, 62 nt, Homo Sapiens
acaagauugaaaaucuuguguaaauccugccauuuaaaaaguuguagcagauuguuuccucu

SEQ ID NO: 472258 - RNA, 62 nt, Homo Sapiens
aggaaaaucacuuugucuaacucagaauuauuuuuaaaaagaaaucuggucuuguuagaaaa

SEQ ID NO: 472259 - RNA, 62 nt, Homo Sapiens
gggcagauauguauguuauauacaacuauuuuuuuaaaaaacuuauauccauguugggagua

SEQ ID NO: 472260 - RNA, 62 nt, Homo Sapiens
ggagaauguauuuuuguauuuauaaaucaacuuuuaaaaacugucucauucaaaagggaaua

SEQ ID NO: 472261 - RNA, 62 nt, Homo Sapiens
ucacaaauagccauugaacaaauguguggguuuuuaaaaauuauauacauauaugaguugcc

SEQ ID NO: 472262 - RNA, 62 nt, Homo Sapiens
uuuagagggaaggaauaaucauucaaaugaacuuuaaaaaagcaaauuucaugcacugauua

SEQ ID NO: 472263 - RNA, 62 nt, Homo Sapiens
accucuuacaauaagcuaaacgcaaugucauuuuuaaaaagaaggacuuagggugucguuuu

SEQ ID NO: 472264 - RNA, 62 nt, Homo Sapiens
aaauauguguuguaugucuuuuuugcuuuuuuuuuaaaaaaaagaauaacuuuuuuugccuc

SEQ ID NO: 472265 - RNA, 62 nt, Homo Sapiens
agugguguuuugaagaggguauuuuauuguuuuuuaaaaaaagguucuuaaacauuauuuga

SEQ ID NO: 472266 - RNA, 62 nt, Homo Sapiens
cuguauccuuccuucuaccuauuauucugauuuuuaaaaaugcaguuaauguaccauuuauu

SEQ ID NO: 472267 - RNA, 62 nt, Homo Sapiens
aauaucuauaaagcaaaaaauguagucucuuguuuaaaaaaucuggagcgggaaugcaagga

SEQ ID NO: 472268 - RNA, 62 nt, Homo Sapiens
guuagaccacccaauaaaucuagaaaucagcuuuuaaaaauauugucugaagucuaacaaaa

SEQ ID NO: 472269 - RNA, 62 nt, Homo Sapiens
gugugcuuuuggggagauacacuagcaauuuuuuuaaaaacuggaacagugugauaggaagc

SEQ ID NO: 472270 - RNA, 62 nt, Homo Sapiens
acuauguaaacaaaaaguagauaguuucacuuuuuaaaaaauccauuacuguuuugcauuuc

SEQ ID NO: 472271 - RNA, 62 nt, Homo Sapiens
uauacaguaccuacauaguuuuuaaauuauuguuuaaaaaacaaaacagcuguuauaaauga

SEQ ID NO: 472272 - RNA, 62 nt, Homo Sapiens
cugaccacuuacaauuaaaauauuuugucuucuuuaaaaaaauaaguaaaggagaaauauuu

SEQ ID NO: 472273 - RNA, 62 nt, Homo Sapiens
uauuugcuguagcagagcuuuauugcaggcauuuuaaaaauugaauaaccaugugaaauaau

SEQ ID NO: 472274 - RNA, 62 nt, Homo Sapiens
uacccauauuccagacucugagcuguuuccuuuuuaaaaaucauauagacaauuagcuguuu

SEQ ID NO: 472275 - RNA, 62 nt, Homo Sapiens
gguuguugauuuuguuacuucauacuggaacuuuuaaaaagauuucaucaaauaaaguuuug

SEQ ID NO: 472276 - RNA, 62 nt, Homo Sapiens
uuuuccuauuauguuugauaauuauauguauuuuuaaaaacugugagaggaaaaauuaguca

SEQ ID NO: 472277 - RNA, 62 nt, Homo Sapiens
ccuccauuuauauuuuguaucuuaaaauguaguuuaaaaauaggaccauguaugagacacuu

SEQ ID NO: 472278 - RNA, 62 nt, Homo Sapiens
uuuauugguacauugcaguuuuuuuuuugaaauuuaaaaauuucuguaaaacuuugucuuca

SEQ ID NO: 472279 - RNA, 62 nt, Homo Sapiens
cuucaaguaaucugacagcauuaaauauugcauuuaaaaauuauacuguagcaaauacauuu

SEQ ID NO: 472280 - RNA, 62 nt, Homo Sapiens
uugcauuuaaaaauuauacuguagcaaauacauuuaaaaauuaaucacaacguuaagaugaa

SEQ ID NO: 472281 - RNA, 62 nt, Homo Sapiens
aaaaaagcaaauauaaauuuuuaaugacuccauuuaaaaauaucacagggugggggcaagga

SEQ ID NO: 472282 - RNA, 62 nt, Homo Sapiens
cuuuuauucauuuauuuaacauacugucuaauuuuaaaaauagguuuuuaaagcuuucauuu

SEQ ID NO: 472283 - RNA, 62 nt, Homo Sapiens
ucacuaaacuuuuacacacucccaaacgucuuuuuaaaaauugcuugggaaauuauuaaaug

SEQ ID NO: 472284 - RNA, 62 nt, Homo Sapiens
gguuuucuaaaauuaaaaugcauuuaagaauuuuuaaaaauuacuauguucugaaaacacug

SEQ ID NO: 472285 - RNA, 62 nt, Homo Sapiens
ccuucuucagauuggaccaagacuaguuuuaguuuaaaaagaccugagguguaauuucauua

SEQ ID NO: 472286 - RNA, 62 nt, Homo Sapiens
acuuugaugcauuuauuuuuacguuucuguauuuuaaaaaauuaucagucauccagaaguac

SEQ ID NO: 472287 - RNA, 62 nt, Homo Sapiens
gagauuugauuauuuuucccaagaagguuuuuuuuaaaaaaaggacauuuaaccaagauacu

SEQ ID NO: 472288 - RNA, 62 nt, Homo Sapiens
uguauuugauaacauccugaaauggucaagcuuuuaaaaauucauuaggcaauuuaugcuuu

SEQ ID NO: 472289 - RNA, 62 nt, Homo Sapiens
aaguuuggaauuuuuuucagauuccugcaauuuuuaaaaaacuguugauaaaauacgaagaa

SEQ ID NO: 472290 - RNA, 62 nt, Homo Sapiens
uuacauuuuguuucaaauauaagugucugaacuuuaaaaaguguacuuuuaucugucuuuga

SEQ ID NO: 472291 - RNA, 62 nt, Homo Sapiens
aauaauaauacaauauuuaaacaaucucuuccuuuaaaaagguauuccacuccgcagugcaa

SEQ ID NO: 472292 - RNA, 62 nt, Homo Sapiens
aauggaauggcaaauaaugguacccauaaaaauuuaaaaagaaaauauauacaccuaccaug

SEQ ID NO: 472293 - RNA, 62 nt, Homo Sapiens
aaagaguguaauugggacguuaacuuuauacauuuaaaaauaagggugacuacagucaacaa

SEQ ID NO: 472294 - RNA, 62 nt, Homo Sapiens
guaaaguaaaugaaagcuauuaauugaagcuuuuuaaaaauuuuagauaaaauugaaguacu

SEQ ID NO: 472295 - RNA, 62 nt, Homo Sapiens
aaccagaucaaauuaauacaaagggggaauauuuuaaaaauaaaaggaagauguucuguagc

SEQ ID NO: 472296 - RNA, 62 nt, Homo Sapiens
cuaaaacguucuuucaaaaguuuuaaacucaguuuaaaaagaaaaauugcauuguuauuuuu

SEQ ID NO: 472297 - RNA, 62 nt, Homo Sapiens
gcauuguuauuuuuuuuuaauucaaaacaguguuuaaaaauuuauugcugcacuuuuaaguu

SEQ ID NO: 472298 - RNA, 62 nt, Homo Sapiens
uuuaaacuaaauaauuugugaaagaauauggauuuaaaaauugucugacccaguuauuaaug

SEQ ID NO: 472299 - RNA, 62 nt, Homo Sapiens
ucuugcuuucagcuuucagguuggugauguuuuuuaaaaaaagcaaaagucuaaaauaccca

SEQ ID NO: 472300 - RNA, 62 nt, Homo Sapiens
aaaaaaaacuacuucaucuauaaacagauaaguuuaaaaaaacaagaaacuugguuauugaa

SEQ ID NO: 472301 - RNA, 62 nt, Homo Sapiens
agguuugcuaaucugauaguaaaaacaaaaaauuuaaaaaaaaaaaguaaaaaaaacaaaaa

SEQ ID NO: 472302 - RNA, 62 nt, Homo Sapiens
guucugaaaucuugcuucuccaagcacuuguguuuaaaaaagacacauuguucaaacaaucu

SEQ ID NO: 472303 - RNA, 62 nt, Homo Sapiens
uaguuguauauaacauacauggauauaaguuuuuuaaaaaaauacccaucuacucccaacau

SEQ ID NO: 472304 - RNA, 62 nt, Homo Sapiens
uuugccggcuaggugcggugccccgccaaccauuuaaaaaagacucauuugauuucccccac

SEQ ID NO: 472305 - RNA, 61 nt, Homo Sapiens
ugaauucauuuucuuagauguacuauaaaucauuuaaaaacauuguuuuccuguuuuuccu

SEQ ID NO: 472306 - RNA, 62 nt, Homo Sapiens
uuucccuuucaauguuguuagaagaugugagauuuaaaaauuugcuguagaaaauauuccuu

SEQ ID NO: 472307 - RNA, 62 nt, Homo Sapiens
uguagacaauggugguuaaaacaaacuuaauuuuuaaaaaggaugacauuggacuuuuagua

SEQ ID NO: 472308 - RNA, 62 nt, Homo Sapiens
aaucucguacuguaucuuacuuuuuccuuguuuuuaaaaaugcaguguuuaaauuagugcua

SEQ ID NO: 472309 - RNA, 62 nt, Homo Sapiens
aucauauaguaaaugcaaacaguauaugcacauuuaaaaaauaaguuuguaccaucuguuug

SEQ ID NO: 472310 - RNA, 62 nt, Homo Sapiens
auaaagggagcaccauuguaguaaguaaaauuuuuaaaaaucuuuuggaauuacauaguuau

SEQ ID NO: 472311 - RNA, 62 nt, Homo Sapiens
caaauuuaaauaaauauagaaagcuuaccuauuuuaaaaagcuaaacaauaauugaaaugaa

SEQ ID NO: 472312 - RNA, 62 nt, Homo Sapiens
aauguaaacuugacauuuuaauucucuaugcauuuaaaaaaauagguuuucugaaauguuau

SEQ ID NO: 472313 - RNA, 62 nt, Homo Sapiens
uguuugauucaaaacuuuaaauucaguggcuuuuuaaaaaaaauuauuuauaauaaaauugc

SEQ ID NO: 472314 - RNA, 62 nt, Homo Sapiens
aaauuauuacauccuuuacaaaauauaauacuuuuaaaaagaacaugugccagcugaauuua

SEQ ID NO: 472315 - RNA, 62 nt, Homo Sapiens
cuacugagauucugcuguaauucuugggauauuuuaaaaaugugcucaaaguuuaauucuuc

SEQ ID NO: 472316 - RNA, 62 nt, Homo Sapiens
auacuuguauauguaguuauuggauuucaucauuuaaaaacccccuauagauuaauuacaau

SEQ ID NO: 472317 - RNA, 62 nt, Homo Sapiens
caacauagggagacccagucucuacaaaaaaauuuaaaaagccaggcauugguggugugugc

SEQ ID NO: 472318 - RNA, 62 nt, Homo Sapiens
acuccaaucuggcaacagagcgagaccuugucuuuaaaaauaaaaauaaaaacaucuuuaca

SEQ ID NO: 472319 - RNA, 62 nt, Homo Sapiens
caacuauuaaaagcgccauuuuauuuauuucauuuaaaaaauaaucuaugcagcauuucaag

SEQ ID NO: 472320 - RNA, 62 nt, Homo Sapiens
ugcuucuugaggugguaaugagaaaaaaguuuuuuaaaaaagugugccuugcuguauuucuu

SEQ ID NO: 472321 - RNA, 62 nt, Homo Sapiens
aaaguaaauugggaggacuuaauggaaggucuuuuaaaaaguuaacuuggagcuucuguaug

SEQ ID NO: 472322 - RNA, 62 nt, Homo Sapiens
auagggugguuuuuguuucuguuccuaauuccuuuaaaaaauagggggaauaguauuuuaga

SEQ ID NO: 472323 - RNA, 62 nt, Homo Sapiens
uuaaacuuaauuucuggccugugacuagaauguuuaaaaaaaaaaaagucggacuaaauguu

SEQ ID NO: 472324 - RNA, 62 nt, Homo Sapiens
auauacaugcacacacaccgauacauuuaccuuuuaaaaaaaugauuuauaagugaacuguu

SEQ ID NO: 472325 - RNA, 62 nt, Homo Sapiens
ucuagaaaagaugugguuuguuuuggcacuguuuuaaaaacucaaauauuuuaaacauuugu

SEQ ID NO: 472326 - RNA, 62 nt, Homo Sapiens
uuuccucucuauucgcuuucuccuguuuuuuuuuuaaaaaaaaagcaugaaaaaggaagaga

SEQ ID NO: 472327 - RNA, 62 nt, Homo Sapiens
uaauuuuacaugauccucaauaucaacuccaguuuaaaaaguguuauuuuuaaaacauuuga

SEQ ID NO: 472328 - RNA, 62 nt, Homo Sapiens
aggagauugccuaccaaggacaaaacaauaaauuuaaaaaucaaacgauuucuccauacgcu

SEQ ID NO: 472329 - RNA, 62 nt, Homo Sapiens
caauagaugacacugaugguuuuacuccuuuuuuuaaaaacacaugcgcgcgcacacacaca

SEQ ID NO: 472330 - RNA, 62 nt, Homo Sapiens
ccuuucuuauuacuuuccuaauuuuucuauauuuuaaaaacuacaguuuccaugauaaaagg

SEQ ID NO: 472331 - RNA, 62 nt, Homo Sapiens
gaagccccaaaaaagaaaagugccuugcaucauuuaaaaaaaauaauuaaauccucauggcc

SEQ ID NO: 472332 - RNA, 62 nt, Homo Sapiens
agccucaucauuagcaacuuuauauacacagcuuuaaaaaauuugcuuuaaacuguuucaga

SEQ ID NO: 472333 - RNA, 62 nt, Homo Sapiens
gagcugagguagaaaaaaaacaagaaaaaaauuuuaaaaauagcguuaaaaugcauuuuagg

SEQ ID NO: 472334 - RNA, 62 nt, Homo Sapiens
uuaaguauucaguaaaaugaugguuaacauguuuuaaaaaaucuuuaauggagaaguuaaau

SEQ ID NO: 472335 - RNA, 62 nt, Homo Sapiens
uauucuuaauaguaugugcagaaguuacaucauuuaaaaaacccuugcuguaaaguaggaua

SEQ ID NO: 472336 - RNA, 62 nt, Homo Sapiens
aaauacaguuuugaguuauuuugauguggcuuuuuaaaaaaguuaauggguagcuaauguug

SEQ ID NO: 472337 - RNA, 62 nt, Homo Sapiens
uuuaaauaaaacuucucuacuuuagucuuuacuuuaaaaauauguacuguuuccuuuuuugu

SEQ ID NO: 472338 - RNA, 62 nt, Homo Sapiens
aaacuguaaauaacuugcccugggggccuuuuuuuaaaaaacaaaaaccacaaaaauuccca

SEQ ID NO: 472339 - RNA, 62 nt, Homo Sapiens
cuguaauuuauacgguguacuauauaaugggauuuaaaaaaagugcuaucuuuucuauuuca

SEQ ID NO: 472340 - RNA, 62 nt, Homo Sapiens
gaucaauguuuggaaaauacaacaaugacuuauuuaaaaauuacccuuccugcuauuuagac

SEQ ID NO: 472341 - RNA, 62 nt, Homo Sapiens
cacaucaaagcuggccaaaauaaugaauuuuuuuuaaaaagcaauaccugguuuccaccuug

SEQ ID NO: 472342 - RNA, 62 nt, Homo Sapiens
cagugucaacacucugguuuagcaauaauggguuuaaaaacaaacaauuugauccaagcagg

SEQ ID NO: 472343 - RNA, 62 nt, Homo Sapiens
gcuaucugauuaaguguuuccuuacauuauuuuuuaaaaaccaaaucauuuuucuuuaacua

SEQ ID NO: 472344 - RNA, 62 nt, Homo Sapiens
caguugcauuaacuauuucaaaaauuacugccuuuaaaaaaaacaaccucaagcuauauuug

SEQ ID NO: 472345 - RNA, 62 nt, Homo Sapiens
aauuugucaguacauuuuacguguagaagcauuuuaaaaaucauuucuagcaagcacuugac

SEQ ID NO: 472346 - RNA, 62 nt, Homo Sapiens
uuuuucuuuuuuuuuucuuccagaaugucuuauuuaaaaagaaagcuaaaagcauacuucua

SEQ ID NO: 472347 - RNA, 62 nt, Homo Sapiens
uccacccaauuuugcuaugagccuaaaaccucuuuaaaaacggucaguuaacuaaaaaauaa

SEQ ID NO: 472348 - RNA, 62 nt, Homo Sapiens
gacaucugaaagagacguauuaaguuaacauuuuuaaaaauccaaaugaaaguaaauggaau

SEQ ID NO: 472349 - RNA, 62 nt, Homo Sapiens
uuuggaguaaaguuuuauuuaaaacuaacuuguuuaaaaauagguuuaccaugauuccaaac

SEQ ID NO: 472350 - RNA, 62 nt, Homo Sapiens
aaaaaaaagaaaaagaaaauaacuuauuuugcuuuaaaaaaaaugccacagauucccuuuua

SEQ ID NO: 472351 - RNA, 62 nt, Homo Sapiens
ccuuuaauuucuugcuugaauuacuuucauguuuuaaaaaucacuuuuccuaguuuucagua

SEQ ID NO: 472352 - RNA, 62 nt, Homo Sapiens
gaaguggaaauaaaaaaaucaaggugauguauuuuaaaaaagcccuuuaacacaaaaaaagc

SEQ ID NO: 472353 - RNA, 62 nt, Homo Sapiens
aaaauauaugaaaauauguaaaguuaugagaguuuaaaaaauuauuuuacugcuagcuugca

SEQ ID NO: 472354 - RNA, 62 nt, Homo Sapiens
aagggacuauaaaucaguuauuuccucauucuuuuaaaaaauuggaauuuuucauugaguua

SEQ ID NO: 472355 - RNA, 62 nt, Homo Sapiens
auucuaucuuaaggccaacuggaucuauuugguuuaaaaaguugauauuuuccagauuuguu

SEQ ID NO: 472356 - RNA, 62 nt, Homo Sapiens
aaguuuaccgcuguagugugcugcgguauuuuuuuaaaaaaacuuuaaaaaaaaaaaagaau

SEQ ID NO: 472357 - RNA, 62 nt, Homo Sapiens
aaaaagaaucugcgguauuuaguaguaccuucuuuaaaaaaaacuuguuaacuucuuacagc

SEQ ID NO: 472358 - RNA, 58 nt, Homo Sapiens
uaaguuuuguaagagcuuuagcugauuuuuuaaaaauuaacauggaaaaaauuuuuga

SEQ ID NO: 472359 - RNA, 62 nt, Homo Sapiens
uaacagaauuuuaacuguuguguuauugcaaguuuaaaaaggguauuuuuaaaaaugaaggu

SEQ ID NO: 472360 - RNA, 62 nt, Homo Sapiens
aagguuguuauugcaaguuuuacuacuguauuuuuaaaaaugaaagcugauaccucaaucuu

SEQ ID NO: 472361 - RNA, 62 nt, Homo Sapiens
gcuccuuguggagcaggacuaaacuuuuuuuuuuuaaaaacuugcuacauaaaacacuucuu

SEQ ID NO: 472362 - RNA, 62 nt, Homo Sapiens
agccugguaaggccgggugcaaaacgcauguuuuuaaaaauucagguaaauccugguaauua

SEQ ID NO: 472363 - RNA, 62 nt, Homo Sapiens
guauacauugaauaaggcugcuguguugcucauuuaaaaaaaaggaguuauaugucugcuau

SEQ ID NO: 472364 - RNA, 62 nt, Homo Sapiens
cuuuaaacagguauuuugauucacccaggaaguuuaaaaauuuuccagagagaagagaaaac

SEQ ID NO: 472365 - RNA, 62 nt, Homo Sapiens
ccaacuaucugcuugcauugucaacuucauauuuuaaaaauuaucugaaauuuguaauaaaa

SEQ ID NO: 472366 - RNA, 62 nt, Homo Sapiens
ccauuauuuuaugagacuuauacuuuugccuuuuuaaaaaagaauaucauuuagaguguaga

SEQ ID NO: 472367 - RNA, 62 nt, Homo Sapiens
uauuuuuagcagucguaaugccaccagugacauuuaaaaauacuuuggucauguuuauuaaa

SEQ ID NO: 472368 - RNA, 62 nt, Homo Sapiens
uuugcugcauaauaaagauaaaaaguuagcaauuuaaaaaaugaauaauucuacaugaaguu

SEQ ID NO: 472369 - RNA, 62 nt, Homo Sapiens
uaucaaaguagguuaaauuagaucuuccuuguuuuaaaaaacccauaguugcaaguccuuag

SEQ ID NO: 472370 - RNA, 62 nt, Homo Sapiens
ugagauuuuuaaaauuuuucaaugauuuuuuauuuaaaaauucauccauccugaauuuuaua

SEQ ID NO: 472371 - RNA, 62 nt, Homo Sapiens
aaaugauucuggaugguucuauaaauagucacuuuaaaaagguuaaggacauugaaagcgac

SEQ ID NO: 472372 - RNA, 62 nt, Homo Sapiens
agaauuguaugaaauuaagauuauguaucaguuuuaaaaauuugaaaauuuuaugacaucua

SEQ ID NO: 472373 - RNA, 62 nt, Homo Sapiens
cuuuuauaucaaaggugcauuuaauaauaaaguuuaaaaaugaauuccuaauguccugagua

SEQ ID NO: 472374 - RNA, 62 nt, Homo Sapiens
aaaaucggucuucaaagaucuucucacccucuuuuaaaaaaacuuugcaaacauaaucauug

SEQ ID NO: 472375 - RNA, 62 nt, Homo Sapiens
aauaaaccccguuuuuucaagacuauuugcaguuuaaaaaucaaaaaaaaacuuuuuguaac

SEQ ID NO: 472376 - RNA, 62 nt, Homo Sapiens
ugcaaaaaacuguuggauuaaugaaaaauuaauuuaaaaaaagguuauuuuauuuuaaaaaa

SEQ ID NO: 472377 - RNA, 62 nt, Homo Sapiens
ugaaaaauuaauuuaaaaaaugguuauuuuauuuuaaaaaaauuuguaacuuuacacuuuuu

SEQ ID NO: 472378 - RNA, 62 nt, Homo Sapiens
auaacaacaaaaaaaaaaugaugugacaucuuuuuaaaaaaagcuaaaguuccccaguucau

SEQ ID NO: 472379 - RNA, 62 nt, Homo Sapiens
cuguuacauauuaaaauaguguggcauccuuuuuuaaaaagacuuuuguguguuugcugccu

SEQ ID NO: 472380 - RNA, 62 nt, Homo Sapiens
aaagugauucuacucuucuauggccggaagucuuuaaaaaaucaggcgugaaccaccgugcc

SEQ ID NO: 472381 - RNA, 62 nt, Homo Sapiens
auuuuuuuucaaauuucuucgcuccuuuggcuuuuaaaaaaauucauuaggggcuuaagcua

SEQ ID NO: 472382 - RNA, 62 nt, Homo Sapiens
gcuucuagucuccauaacccgaaauccuuaccuuuaaaaaaauuuugcuuugcuuuggauaa

SEQ ID NO: 472383 - RNA, 62 nt, Homo Sapiens
aaggugacucacuuugcuuucuaaaucucaccuuuaaaaacgugcuucuaauccuuccuuug

SEQ ID NO: 472384 - RNA, 62 nt, Homo Sapiens
auauauauaaaauauuuuuuuuauaaugcuauuuuaaaaaauaaagucccuauaguauauga

SEQ ID NO: 472385 - RNA, 62 nt, Homo Sapiens
uauauaaaggcaaggaaauuagagcuuauuguuuuaaaaaguguuaaagguaugauuauaag

SEQ ID NO: 472386 - RNA, 62 nt, Homo Sapiens
ggacugcugugggccaaagcaugaccuuaacuuuuaaaaaagaggagagggagggaacagag

SEQ ID NO: 472387 - RNA, 62 nt, Homo Sapiens
cagguuguccaucccauuggccaacccuuagguuuaaaaaguaaaguaaucaucguucaggc

SEQ ID NO: 472388 - RNA, 62 nt, Homo Sapiens
caauuaauucguucccuaugaagauugcugcauuuaaaaauaugaugaaaacauuucauuaa

SEQ ID NO: 472389 - RNA, 62 nt, Homo Sapiens
uuucccguuggucucauuggaucuuuuaugcuuuuaaaaaugcucagcauaugccugaggcg

SEQ ID NO: 472390 - RNA, 62 nt, Homo Sapiens
gacuuuuuuuuuuagagcaguuaaaaauuguuuuuaaaaauaaucugagacgaauacaacuu

SEQ ID NO: 472391 - RNA, 62 nt, Homo Sapiens
guuuuuaaaaauagacuuuuacgaauacaacuuuuaaaaauugauaauauuuugaaucugag

SEQ ID NO: 472392 - RNA, 62 nt, Homo Sapiens
cuuaauguaagauaugaccaucuauuugauuuuuuaaaaaacccgauuuggaaccuuagaug

SEQ ID NO: 472393 - RNA, 62 nt, Homo Sapiens
uuuaauuccgauuuggaaccuaggugacuuguuuuaaaaauaaaacgaguuuuugagcaaau

SEQ ID NO: 472394 - RNA, 62 nt, Homo Sapiens
agaauauguagucuacggauuacugaagacauuuuaaaaaccuaaaauuucugucauaugua

SEQ ID NO: 472395 - RNA, 62 nt, Homo Sapiens
uauauguugucugcuuuaaacaauuuuuaaauuuuaaaaaugcauuaacgucuuuuuauauc

SEQ ID NO: 472396 - RNA, 62 nt, Homo Sapiens
ugagagaugaaucaauaaugaaacaugucuguuuuaaaaacuaccacaugugacuccuauuu

SEQ ID NO: 472397 - RNA, 62 nt, Homo Sapiens
uaguguaguuaugauguggauccuacguauuuuuuaaaaaacucuccagauaauuuugaugu

SEQ ID NO: 472398 - RNA, 62 nt, Homo Sapiens
uucugguuagcuaauugaacuuuugugaccuguuuaaaaacaaaucaaauuuauugaacaaa

SEQ ID NO: 472399 - RNA, 62 nt, Homo Sapiens
auacuuucagaauuguauuucaguuuugaagauuuaaaaaaaaugugaaaauaaauauauau

SEQ ID NO: 472400 - RNA, 62 nt, Homo Sapiens
ggacagcgggaaaaaucgaugagcgccaccucuuuaaaaacucacuuacguuuguccuuuuu

SEQ ID NO: 472401 - RNA, 62 nt, Homo Sapiens
ugcucuuuuaaauguuugguuuauauauuuucuuuaaaaauccugggcuggcacauugacug

SEQ ID NO: 472402 - RNA, 62 nt, Homo Sapiens
ugugauuauuuauauuuauguugaaagcggacuuuaaaaaaaauaaugugcuguaacacagu

SEQ ID NO: 472403 - RNA, 62 nt, Homo Sapiens
uuguagccuggauagcagacuguguucaacuuuuuaaaaagauguuuccuuucuaaagauua

SEQ ID NO: 472404 - RNA, 62 nt, Homo Sapiens
uaagcauauuacucuggagcuuuguauuauucuuuaaaaaugaaucuugcuucauuugauga

SEQ ID NO: 472405 - RNA, 62 nt, Homo Sapiens
agcugaagaccucacuggagugggucuuaauuuuuaaaaagugucucacuacauuuaagaca

SEQ ID NO: 472406 - RNA, 62 nt, Homo Sapiens
gcuaaucuuuaauauaauauuauacugcuauauuuaaaaagcugacuacuugauauaauuac

SEQ ID NO: 472407 - RNA, 62 nt, Homo Sapiens
uuaaugugcugcugcuuuuccauaaccaacauuuuaaaaauaaaugaaaaacaggaauuggg

SEQ ID NO: 472408 - RNA, 62 nt, Homo Sapiens
augucauguuauuaacaguuauuagguugucauuuaaaaauaaaguuccuuuauauuucugu

SEQ ID NO: 472409 - RNA, 62 nt, Homo Sapiens
uuauuuuaugagccccaguuuucugggcuuaguuuaaaaaaaaaaucaagucuaaacauugc

SEQ ID NO: 472410 - RNA, 62 nt, Homo Sapiens
aagcuuuuguucuuggauaaaaagucauacacuuuaaaaaaaaaaaaaacuuuuuccaggaa

SEQ ID NO: 472411 - RNA, 62 nt, Homo Sapiens
auucaguauucuuuuaucauaaauuuuuagcauuuaaaaauucacugauguacauuaagcca

SEQ ID NO: 472412 - RNA, 62 nt, Homo Sapiens
cuuaucuuuguuccucuuuacauaauguuccuuuuaaaaaaaaucacugauuaugaugugcc

SEQ ID NO: 472413 - RNA, 62 nt, Homo Sapiens
uugucucacagcucacuuguauucuguugacuuuuaaaaaauuaugcuuucuguuucacugu

SEQ ID NO: 472414 - RNA, 62 nt, Homo Sapiens
ccuccccaaaagaaaccaugacaaaccuagcuuuuaaaaaauauuuuaagaaagagaaugaa

SEQ ID NO: 472415 - RNA, 62 nt, Homo Sapiens
ccuuuguauuauaauuguugauauuuucccuuuuuaaaaaauaccauugaaaucagcaugac

SEQ ID NO: 472416 - RNA, 62 nt, Homo Sapiens
ugauucaguaucuuagaguuuacaguuuguguuuuaaaaaaacugaagguuuuuuuuuuaag

SEQ ID NO: 472417 - RNA, 62 nt, Homo Sapiens
guuuuuugguuuuuguuuuuuguuuucuuguuuuuaaaaaaaggauuucacagugagaaagu

SEQ ID NO: 472418 - RNA, 62 nt, Homo Sapiens
cacuucuuuuaagguuuaccccuguggugugguuuaaaaaucuauaggccugggaauuccga

SEQ ID NO: 472419 - RNA, 62 nt, Homo Sapiens
uauguuuucaucauucauuugauaguauuuauuuuaaaaaaugagcauauaacuucugauuu

SEQ ID NO: 472420 - RNA, 62 nt, Homo Sapiens
uuaaauccucucaauggaugacaacauuauuuuuuaaaaaucuuugugaacugagagcagca

SEQ ID NO: 472421 - RNA, 62 nt, Homo Sapiens
auauaccaacagaacuacucgccuuuugaguauuuaaaaaauuuauuacugcuugagguuga

SEQ ID NO: 472422 - RNA, 62 nt, Homo Sapiens
uaacgagggauaaauuuuugaauuuaaaaaauuuuaaaaauaggaaggaaaaaaaaagaaaa

SEQ ID NO: 472423 - RNA, 62 nt, Homo Sapiens
uuuaaaaauauaacgagggaaaaaagaaaaaauuuaaaaaauacaaaaaaaaggaaggaaaa

SEQ ID NO: 472424 - RNA, 62 nt, Homo Sapiens
aaccuagacuaugcaaaacaaauuuuuuguuuuuuaaaaaauaaggaauuuggguaauuuuu

SEQ ID NO: 472425 - RNA, 62 nt, Homo Sapiens
gcaugaacuguagugcuuuaucauucuccugcuuuaaaaaguaagaagcuuaggggcaaggu

SEQ ID NO: 472426 - RNA, 62 nt, Homo Sapiens
aaugcugauauuuauucuuuaaaauaaaaccauuuaaaaaguuauguucauuauuuguacau

SEQ ID NO: 472427 - RNA, 62 nt, Homo Sapiens
uccuguuuuuggaaaguagaaugugguuuucuuuuaaaaagcagcgccuuuuaaaaguuguu

SEQ ID NO: 472428 - RNA, 62 nt, Homo Sapiens
uguaaucuuuuuugaaauaauguguauccugguuuaaaaaaaacuguuacauuaagugcauc

SEQ ID NO: 472429 - RNA, 62 nt, Homo Sapiens
uaacaugauugcuuuucucacagacuuuucuuuuuaaaaauugacuugcuugagaguucugu

SEQ ID NO: 472430 - RNA, 62 nt, Homo Sapiens
uggugaaauuccauuacagaaaaguuaauaccuuuaaaaacugaugaauguuacagguuaau

SEQ ID NO: 472431 - RNA, 62 nt, Homo Sapiens
caguuauaacaguguuuaauuggaaaacuaaauuuaaaaaaaauaacuugaggacuguacca

SEQ ID NO: 472432 - RNA, 62 nt, Homo Sapiens
cuuugagagguaauuacuugaauaaugcguuuuuuaaaaaugauaauucauugguaaagugu

SEQ ID NO: 472433 - RNA, 62 nt, Homo Sapiens
acucaaaaauauguaaguuuaacuauuaaaacuuuaaaaaauuccauccuugaucagagaua

SEQ ID NO: 472434 - RNA, 62 nt, Homo Sapiens
aagacuuuacuuucuucugcgacaacuucuauuuuaaaaaacaaucuauauagucuaaugcu

SEQ ID NO: 472435 - RNA, 62 nt, Homo Sapiens
uguagguuuaacaaaccuucgaaacgugauauuuuaaaaacaauauauauauauauuuaucu

SEQ ID NO: 472436 - RNA, 62 nt, Homo Sapiens
acaucuuuccuaugcaagagcuucuucauuccuuuaaaaacuguagauguuuugccaaaaua

SEQ ID NO: 472437 - RNA, 62 nt, Homo Sapiens
auuaaggauuugaggucuagccacccugcccuuuuaaaaauauucccucuuaagccacuccc

SEQ ID NO: 472438 - RNA, 62 nt, Homo Sapiens
aauaaauauauauauauauauccccuggaguuuuuaaaaauauguuuacuaacuuugggaca

SEQ ID NO: 472439 - RNA, 62 nt, Homo Sapiens
agcacagcuuuuucaccuucuggguuuaaugguuuaaaaaaacaacuuuaagagaaaagaac

SEQ ID NO: 472440 - RNA, 62 nt, Homo Sapiens
gauuuuccauuuucuuacaaaucuuugcaugauuuaaaaacaauagaaaaaugcuuauuuaa

SEQ ID NO: 472441 - RNA, 62 nt, Homo Sapiens
ccauaaaugaggcccgcugaccucugcgggacuuuaaaaaucuauucagauauuuccgagua

SEQ ID NO: 472442 - RNA, 62 nt, Homo Sapiens
cuguacguuggggacugccuguauuuggaagauuuaaaaaccuagcauccuguucucacccu

SEQ ID NO: 472443 - RNA, 62 nt, Homo Sapiens
aaguucuguauucauuauagauguagcccuuauuuaaaaaagugaauuccauacuaaaacua

SEQ ID NO: 472444 - RNA, 62 nt, Homo Sapiens
aaaucauggaagauugcauaccugugugguauuuuaaaaacaaguugacuuuuucaguuucu

SEQ ID NO: 472445 - RNA, 62 nt, Homo Sapiens
cuuuuucaguuucuugaacgguuaaggguggauuuaaaaacuagacaguuuaguuuugggga

SEQ ID NO: 472446 - RNA, 62 nt, Homo Sapiens
uuugagaaaaaaaaauguuuacucuuccaucauuuaaaaaaaauguaaaagacaaaaaaaaa

SEQ ID NO: 472447 - RNA, 62 nt, Homo Sapiens
gagcaugguucucaggaaaaccaguuccccaguuuaaaaaaaaaaaaaaaaauuccuuguag

SEQ ID NO: 472448 - RNA, 62 nt, Homo Sapiens
cucuucaguuaagccuuuggaaacagcucgacuuuaaaaagcuccaaaugcagcuuuaaaaa

SEQ ID NO: 472449 - RNA, 62 nt, Homo Sapiens
acagcucgacuuuaaaaagcuccaaaugcagcuuuaaaaaauuaaucugggccagaauuuca

SEQ ID NO: 472450 - RNA, 62 nt, Homo Sapiens
uggugaugauccuucagaaaaggaugccucuguuuaaaaacaaauugcuuuugugucccuga

SEQ ID NO: 472451 - RNA, 62 nt, Homo Sapiens
aagaaaugggugaaugagcuugucaaugugauuuuaaaaaauugacuaccuggaggaaugau

SEQ ID NO: 472452 - RNA, 62 nt, Homo Sapiens
ucaaccaacugcaaauggaaaauacgauuuuuuuuaaaaaaaggaugguuacauccguauug

SEQ ID NO: 472453 - RNA, 62 nt, Homo Sapiens
uaucuaaaagaaaugucuauuaaggugauauauuuaaaaauauuuuuggguguuccuggcag

SEQ ID NO: 472454 - RNA, 62 nt, Homo Sapiens
uauuuaaaaauauuuuuggguguuccuggcaguuuaaaaaaauugguuggagaauuuagguu

SEQ ID NO: 472455 - RNA, 62 nt, Homo Sapiens
uuucuuccacuuuaauuuaaaaguucaugucauuuaaaaacaagucaagaaauuaaaauugu

SEQ ID NO: 472456 - RNA, 62 nt, Homo Sapiens
acaggcuggcuucuguuuuauucagggauuuuuuuaaaaagucaaucagaaaagggauacug

SEQ ID NO: 472457 - RNA, 62 nt, Homo Sapiens
aaauggacugaagucugaauaaggucauugcauuuaaaaagcauauaacuguacuugacuga

SEQ ID NO: 472458 - RNA, 62 nt, Homo Sapiens
uugcagauuuucuuaaggaauuuugucucacuuuuaaaaagaaggggagaagucagcuacuc

SEQ ID NO: 472459 - RNA, 62 nt, Homo Sapiens
acucuaguucuguuguuuuguguauauaauuuuuuaaaaaaaauuugugugcuucugcucau

SEQ ID NO: 472460 - RNA, 62 nt, Homo Sapiens
gccauaacagaauaauaaaccacaugugggguuuuaaaaaugaaauuuggcuaauaggagca

SEQ ID NO: 472461 - RNA, 62 nt, Homo Sapiens
cauucagcuuuaauaagguucauuuucuucuguuuaaaaagacacaaaacuugaaaaucagc

SEQ ID NO: 472462 - RNA, 62 nt, Homo Sapiens
cugagaucuugugguuccaugagaauuauuacuuuaaaaacaaaacaaaauauaaaaaacug

SEQ ID NO: 472463 - RNA, 62 nt, Homo Sapiens
uagccaaugcaaaucuguuuuaaaacaaauaguuuaaaaaaagaacaaguuuuuaagggcuu

SEQ ID NO: 472464 - RNA, 62 nt, Homo Sapiens
augaguuucaggaaugaaguagaagguaguuauuuaaaaauaaaaaacacaguccgucccua

SEQ ID NO: 472465 - RNA, 62 nt, Homo Sapiens
gaacaaccaaagaaggccugcucuuugcugcuuuuaaaaaaugacaauuaaaugugcagauu

SEQ ID NO: 472466 - RNA, 62 nt, Homo Sapiens
cuugaaacuuccagugugaguugaccccaucauuuaaaaauaaaguccccggguuccuuaau

SEQ ID NO: 472467 - RNA, 62 nt, Homo Sapiens
aggccccucgugcuaccaacacuuacccuguguuuaaaaagaucuuguaccaagccaacggc

SEQ ID NO: 472468 - RNA, 62 nt, Homo Sapiens
ugcuggucaggacauuaaaauauugaaguguuuuuaaaaauuaaagaagaagaaaaguaaaa

SEQ ID NO: 472469 - RNA, 62 nt, Homo Sapiens
gugacagucaugugcacacaugggcgggggcuuuuaaaaaccuuucaggaagucaaugauuu

SEQ ID NO: 472470 - RNA, 62 nt, Homo Sapiens
gcagauagcugcuucgauaaaggaauuuggaguuuaaaaaucaacuugugaaaacaagguug

SEQ ID NO: 472471 - RNA, 62 nt, Homo Sapiens
auaucuuuuuacuuuuaugcauuuuaauaagauuuaaaaauauuuagauuaaagcccccuuu

SEQ ID NO: 472472 - RNA, 62 nt, Homo Sapiens
ccgagcagggcaaugcaaguaaagagccauuuuuuaaaaaugcugacgugugaaauuuaagg

SEQ ID NO: 472473 - RNA, 62 nt, Homo Sapiens
aagauagaguaucuauuagaaucuuuuaccuuuuuaaaaaccaaaguagcuaauccagugua

SEQ ID NO: 472474 - RNA, 62 nt, Homo Sapiens
guaugugacauuaauaugccaaauauuuauauuuuaaaaacuauauuguaaaacagcuuuaa

SEQ ID NO: 472475 - RNA, 62 nt, Homo Sapiens
uuuauauuuuaaaaacuguauuguaaaacagcuuuaaaaauauggguguucuuguuaucaua

SEQ ID NO: 472476 - RNA, 62 nt, Homo Sapiens
auuagcugagugugguggugacuaaaaauaaauuuaaaaaaacauagugagacccugucucu

SEQ ID NO: 472477 - RNA, 62 nt, Homo Sapiens
caguuugcaaaaaauguuuugcaaaucauuuguuuaaaaaggcacaguauuuguaauuaaaa

SEQ ID NO: 472478 - RNA, 62 nt, Homo Sapiens
agucaacaguaaaccacugaaacacuaauauauuuaaaaauaaggaaacaguugcauguagu

SEQ ID NO: 472479 - RNA, 62 nt, Homo Sapiens
uagauaauacuuaaaauggcccacugugauuuuuuaaaaaaguuuucgccaugugaugaaga

SEQ ID NO: 472480 - RNA, 62 nt, Homo Sapiens
acugauaaauucggaucaaaaauuuuaaaaacuuuaaaaaauucagguuaagagaaaaacga

SEQ ID NO: 472481 - RNA, 62 nt, Homo Sapiens
uuaaaaaauacugauaaauugaaaaacgaaauuuuaaaaacucagguuuucucagguuaaga

SEQ ID NO: 472482 - RNA, 62 nt, Homo Sapiens
caaauguauuguggcuuccauuaauucaguuuuuuaaaaaaauauacuauuuuuuuccuuuu

SEQ ID NO: 472483 - RNA, 62 nt, Homo Sapiens
aaaaaaaaacuucauuggcuggggagaugaacuuuaaaaaaagcuaucaguuuuuuggggca

SEQ ID NO: 472484 - RNA, 62 nt, Homo Sapiens
cucaauucaagcuggauuagcaauuuuacuucuuuaaaaagucuucuuugaugaauguaacc

SEQ ID NO: 472485 - RNA, 62 nt, Homo Sapiens
aucuaggaggagcuaaaugaccauuucugguauuuaaaaaauucuuugggaaugcuacauac

SEQ ID NO: 472486 - RNA, 62 nt, Homo Sapiens
uccuuuaugacuucaggucaaaagacaucuguuuuaaaaaggacuucaaaggguucaagggc

SEQ ID NO: 472487 - RNA, 62 nt, Homo Sapiens
aucuuugauuugcacuguuagacaaaucugacuuuaaaaaaaacuugaaaaugggaagcgau

SEQ ID NO: 472488 - RNA, 62 nt, Homo Sapiens
auuuacauacguugucuagaaguaccauaggguuuaaaaaccugggcuggcauuggucacac

SEQ ID NO: 472489 - RNA, 62 nt, Homo Sapiens
auauugauuuaaacuguguuucacuuacaaguuuuaaaaaaaugacaggguuuaauggagcg

SEQ ID NO: 472490 - RNA, 62 nt, Homo Sapiens
uguuaagaguucacugaagauauugacacaauuuuaaaaaaucaguaaaggaauguauauaa

SEQ ID NO: 472491 - RNA, 62 nt, Homo Sapiens
acaagacuuacuccgaauacaagaggaaaagcuuuaaaaacaagauugcaucauaaccccca

SEQ ID NO: 472492 - RNA, 62 nt, Homo Sapiens
uuuuucucauaaaauagucugauaagcuaauuuuuaaaaagaaaugccauuaacuguguugu

SEQ ID NO: 472493 - RNA, 62 nt, Homo Sapiens
aaaauaauauuugauuuugaaucuuaaauguuuuuaaaaauuagacuugaaugggcacaaag

SEQ ID NO: 472494 - RNA, 62 nt, Homo Sapiens
aguauuuugcagagcuaucaauguccaaauaauuuaaaaaaaaaaauaaagguauuuaagca

SEQ ID NO: 472495 - RNA, 62 nt, Homo Sapiens
uguuaaccuuacguuuucugucuguauauuuuuuuaaaaaucugguaguuucuggaaaaaaa

SEQ ID NO: 472496 - RNA, 62 nt, Homo Sapiens
cauccaagacguagagcuugaaugugacguuauuuaaaaacaacaacaaagaaggcagagcc

SEQ ID NO: 472497 - RNA, 62 nt, Homo Sapiens
auacuaagggacaauuauuuuaagaccauggauuuaaaaaaaaaaaaaaaaacucuguuucu

SEQ ID NO: 472498 - RNA, 62 nt, Homo Sapiens
uugaacuucccuuccuuaaaguacucuaaaccuuuaaaaaaaaaucugauuuaugcagcaga

SEQ ID NO: 472499 - RNA, 62 nt, Homo Sapiens
ggcagggacagcagucagaaucgacauaaagcuuuaaaaacucaagguuuuuucaaccuacu

SEQ ID NO: 472500 - RNA, 62 nt, Homo Sapiens
gcugcagggcuuaauacauuagugguaacugguuuaaaaaacaaagacuguaagccugugug

SEQ ID NO: 472501 - RNA, 62 nt, Homo Sapiens
acugcuuccuugaaacauuuuugugcuauuguuuuaaaaaaauaauuaaaaaacaguuggcg

SEQ ID NO: 472502 - RNA, 62 nt, Homo Sapiens
cacaaccucuccuccagcacauuccagcucuauuuaaaaaguaaagacacccaccgacuccu

SEQ ID NO: 472503 - RNA, 62 nt, Homo Sapiens
auuguauaauagacaauugugucuacuacauguuuaaaaacacauugcuuguuauuuuugag

SEQ ID NO: 472504 - RNA, 62 nt, Homo Sapiens
cagugggaagaaaaauaaaauuuccuucagguuuuaaaaacaugcagagagguguuuuaauc

SEQ ID NO: 472505 - RNA, 62 nt, Homo Sapiens
gaggagagaaauaauaacuaaaaaauauacccuuuaaaaaaaccuauauuucucugucuaaa

SEQ ID NO: 472506 - RNA, 62 nt, Homo Sapiens
ucuuguguugguacauuggcagagacauaugcuuuaaaaacuuaaauauuucggaggcacau

SEQ ID NO: 472507 - RNA, 62 nt, Homo Sapiens
auacugagaacggcauaaagugaagaucgacauuuaaaaaaugaggugaaagaaagcuauag

SEQ ID NO: 472508 - RNA, 62 nt, Homo Sapiens
uuuuuguaaaacuuuugauauuucuguauacauuuaaaaaaucaauugccacuacaguaguu

SEQ ID NO: 472509 - RNA, 62 nt, Homo Sapiens
cuaaucauuuccuggguuccacuuacucuugauuuaaaaaaaaaaaaacaacaaaagaguuu

SEQ ID NO: 472510 - RNA, 62 nt, Homo Sapiens
uaauuuuugaauuuuaaaacuaaucuauuuuauuuaaaaaaaaucaaguacuuuggaaguga

SEQ ID NO: 472511 - RNA, 62 nt, Homo Sapiens
gauauuuucccuaccuaagaauuucacugucuuuuaaaaaacaaaaaguaaaguaaugcauu

SEQ ID NO: 472512 - RNA, 62 nt, Homo Sapiens
auauauauuuuugugaauuauacuuuguuguuuuuaaaaagaaaaucaguugauuaaguuaa

SEQ ID NO: 472513 - RNA, 62 nt, Homo Sapiens
caagccagcuggcuuaugcugguucucagcuguuuaaaaaaaaaaaaaaaaaggaauagaaa

SEQ ID NO: 472514 - RNA, 62 nt, Homo Sapiens
gugaucugggaacuuuuugcuguacaaaucuguuuaaaaaaaaaaaaaaguaacucauugaa

SEQ ID NO: 472515 - RNA, 62 nt, Homo Sapiens
acacuucagacacaggaaaaauaaacguggauuuuaaaaaaucaaucaauggugcaaaaaaa

SEQ ID NO: 472516 - RNA, 62 nt, Homo Sapiens
ucuaccuuccuuauauuuuuuuccucaacaguuuuaaaaagaaaaaaaggucuauuuuuuuu

SEQ ID NO: 472517 - RNA, 62 nt, Homo Sapiens
aucgauaaaaguucaucuuuggacagaaagccuuuaaaaaaaaaaucacucccucuuccccc

SEQ ID NO: 472518 - RNA, 62 nt, Homo Sapiens
aaaaagaaaaaaaaaauccuguuguauuaacauuuaaaaacagaauuguguuaugugaucag

SEQ ID NO: 472519 - RNA, 62 nt, Homo Sapiens
acugcuguggcuagagaguuugaggauugcuuuuuaaaaaagacagcaaacuuuuuuuuuua

SEQ ID NO: 472520 - RNA, 62 nt, Homo Sapiens
uuuuuaaaaaagacagcaaacuuuuuuuuuuauuuaaaaaaagauauauuaacaguuuuaga

SEQ ID NO: 472521 - RNA, 62 nt, Homo Sapiens
cauccuucaauuucuguauaaaagcagaucuuuuuaaaaagauacuucuguaacuuaagaaa

SEQ ID NO: 472522 - RNA, 62 nt, Homo Sapiens
cauauucaaaaauacccucacggugauuccaauuuaaaaaucuuuuuauagagcugcauugu

SEQ ID NO: 472523 - RNA, 62 nt, Homo Sapiens
ugaaaucuuucuuaacagggugagcuaccccuuuuaaaaaggacgcuaagcuguauuuuuag

SEQ ID NO: 472524 - RNA, 62 nt, Homo Sapiens
acuuauaucuaugcuagcugugugagaguaauuuuaaaaacgauacccauauuauggaacag

SEQ ID NO: 472525 - RNA, 62 nt, Homo Sapiens
uaaaacauauauacucuuagcaacaauauauguuuaaaaauuacauacuuccaccagcaguc

SEQ ID NO: 472526 - RNA, 62 nt, Homo Sapiens
uaaaaagaauccaaccccggaaaauuuaaaaauuuaaaaaaaagcgagacucagucucaaaa

SEQ ID NO: 472527 - RNA, 62 nt, Homo Sapiens
uaaaaaaauaaaaagaauccucucaaaaaaaauuuaaaaauugacgacagagcgagacucag

SEQ ID NO: 472528 - RNA, 62 nt, Homo Sapiens
uuuacaguagucauugaaagauauuagucuuuuuuaaaaaauccacuaauuuuuuuauuuug

SEQ ID NO: 472529 - RNA, 62 nt, Homo Sapiens
agagaacacaugcaaaugaauuuguuuugcacuuuaaaaaagaguggugguucuuuuccaug

SEQ ID NO: 472530 - RNA, 62 nt, Homo Sapiens
uuuaaguaaagccauucuuucuuuuaagggcauuuaaaaauuaagcauuaugcaaaaaguca

SEQ ID NO: 472531 - RNA, 62 nt, Homo Sapiens
ucaaaccucaaaaaagucauuaucauuuuuuauuuaaaaaaaaucuggauggcaagaccguu

SEQ ID NO: 472532 - RNA, 62 nt, Homo Sapiens
uacuuaaauuuguguguaaaauacuuauuuuuuuuaaaaacuagcaaaaaaauauagcguaa

SEQ ID NO: 472533 - RNA, 62 nt, Homo Sapiens
aaguugaauucaucucuaacaguuguaauugcuuuaaaaaaaagcuguccucagcccagcgu

SEQ ID NO: 472534 - RNA, 62 nt, Homo Sapiens
aggaacugagguucagaaugauugugaccuuuuuuaaaaaaauuaguagagcuuguucuugu

SEQ ID NO: 472535 - RNA, 62 nt, Homo Sapiens
ccaccauuuggagaauuacaaaguccaaccuauuuaaaaaccuuuuagaaaacagggaguug

SEQ ID NO: 472536 - RNA, 62 nt, Homo Sapiens
aaaauuagcagccaggugcauuaaaaacuuuauuuaaaaagacuacugaaaguuaauccuuu

SEQ ID NO: 472537 - RNA, 62 nt, Homo Sapiens
uuauuuaaaaagaaaaauuaaaguuaauccuuuuuaaaaacuuaauauguaaaaccuacuga

SEQ ID NO: 472538 - RNA, 62 nt, Homo Sapiens
gcaguuuuccaaacuuuucuaaauugccaauuuuuaaaaacuuaguuuuauuaagcauggag

SEQ ID NO: 472539 - RNA, 62 nt, Homo Sapiens
uauuucauugauaugcaucuuuuuuguaaauuuuuaaaaaaauuuuaaauagaaacuuuagu

SEQ ID NO: 472540 - RNA, 62 nt, Homo Sapiens
aucuacaaauuguguuuugcaaaaaaaaaaaauuuaaaaaaacauuguaguugacuuuuuaa

SEQ ID NO: 472541 - RNA, 62 nt, Homo Sapiens
aaaaaaauuuaaaaaaaaucuguaguugacuuuuuaaaaaaaaucccgauggaauauagcau

SEQ ID NO: 472542 - RNA, 62 nt, Homo Sapiens
uucaaaugaagagaaaaagaugugaggucuacuuuaaaaaaaugauacuuaaauaaagaaag

SEQ ID NO: 472543 - RNA, 62 nt, Homo Sapiens
uggcaaaaagacgucaggccuuuuuuuaaugcuuuaaaaaaaugaacacuggauaaccuaau

SEQ ID NO: 472544 - RNA, 62 nt, Homo Sapiens
auacaauauuagguugguuagcuuaaaaauaauuuaaaaaucccaacaugggucuauuuugu

SEQ ID NO: 472545 - RNA, 62 nt, Homo Sapiens
uaggaugaaggaaacaaggaacaguuuucauuuuuaaaaauuauaaacauucaauaaugauu

SEQ ID NO: 472546 - RNA, 62 nt, Homo Sapiens
aaaucaguguuuaaauaaaguguguguauauauuuaaaaaaaagccuugcugaacuaaguuu

SEQ ID NO: 472547 - RNA, 62 nt, Homo Sapiens
ccaaaacuuaccuauaaauugggggcguuggauuuaaaaauguggaacuuuaggggguggga

SEQ ID NO: 472548 - RNA, 62 nt, Homo Sapiens
uaaauauggaccugcucaaaaaaaauaaaauuuuuaaaaaucauuuacaaugaaaaguuuuu

SEQ ID NO: 472549 - RNA, 62 nt, Homo Sapiens
aaauuuuuaaaaaucuaaaucaaugaaaaguuuuuaaaaauauuuuucaugaaaguuauuua

SEQ ID NO: 472550 - RNA, 62 nt, Homo Sapiens
uggcuggguggaacauuucucuaauugggccuuuuaaaaacaguagccuuugugaaauuuuc

SEQ ID NO: 472551 - RNA, 62 nt, Homo Sapiens
aaagggcccuaaguagcucauugguccuauuuuuuaaaaagggucuuuaacucuuaaauugu

SEQ ID NO: 472552 - RNA, 62 nt, Homo Sapiens
gcugcccuauauaaagguggcagaaagacauuuuuaaaaagcuuauuauuucuugcauuauu

SEQ ID NO: 472553 - RNA, 62 nt, Homo Sapiens
auuuuuaaaaagcuuauuauuucuugcauuauuuuaaaaaguucagaguugaaaugccuuuc

SEQ ID NO: 472554 - RNA, 62 nt, Homo Sapiens
augguuauuaacacugugcuguuaagcauccauuuaaaaauauuuguuaucuucuuugccug

SEQ ID NO: 472555 - RNA, 62 nt, Homo Sapiens
aaauauuuguuaucuucuuugccugccuguauuuuaaaaagaaauacaaaguuguaaaagua

SEQ ID NO: 472556 - RNA, 62 nt, Homo Sapiens
acaacuauagacagucacuucugcagucccaauuuaaaaaugcagaacugcuuuauccaaga

SEQ ID NO: 472557 - RNA, 62 nt, Homo Sapiens
ugaaagaauuuuugccuuaucaagaguuguuuuuuaaaaauuuaauaaauucauaaaaaaga

SEQ ID NO: 472558 - RNA, 62 nt, Homo Sapiens
ugcauuagagcauguuggcagacugguagguauuuaaaaaguugagaaucugcuaacagcgc

SEQ ID NO: 472559 - RNA, 62 nt, Homo Sapiens
guaugcuguuuuauaauaaauuagcaauauacuuuaaaaaaaauccaguuucuccuauaaca

SEQ ID NO: 472560 - RNA, 62 nt, Homo Sapiens
guuaaguuguaaagacuuuggaauaaguuucuuuuaaaaauaugacauagccagugaugugu

SEQ ID NO: 472561 - RNA, 62 nt, Homo Sapiens
aacucuaaugaauauucaagauauuuuagccuuuuaaaaaguugagauuuagcucauggaua

SEQ ID NO: 472562 - RNA, 62 nt, Homo Sapiens
uuagagcuuugcacauuccuauucacugagauuuuaaaaauuucaccuuuauucgagggaag

SEQ ID NO: 472563 - RNA, 62 nt, Homo Sapiens
uuaaagggaaauuaaaccauucaugaauaaacuuuaaaaaugugaaguguccuuuuccuuuu

SEQ ID NO: 472564 - RNA, 62 nt, Homo Sapiens
ccugcuuacuacuaaacgcaauccaaaaggccuuuaaaaauacaguguauauuuuuuguacu

SEQ ID NO: 472565 - RNA, 62 nt, Homo Sapiens
auucaguacaacucugucauuucuuuguaauauuuaaaaaauauuaguaaaggagugaauua

SEQ ID NO: 472566 - RNA, 62 nt, Homo Sapiens
uguguauauaagaaugaguugggaccucugucuuuaaaaaucuauuuuuagguaauguucua

SEQ ID NO: 472567 - RNA, 62 nt, Homo Sapiens
aaacauuacuuucuguaauucacaauacuuguuuuaaaaacauagugucuucauuagugugc

SEQ ID NO: 472568 - RNA, 62 nt, Homo Sapiens
ccuugccugcuauggaauauugagagagauuuuuuaaaaaagauuuugcauuuuguccaaaa

SEQ ID NO: 472569 - RNA, 62 nt, Homo Sapiens
agauauuuuucuuccauguauacaauaauuuuuuuaaaaagugcaauuugcguugcagcaau

SEQ ID NO: 472570 - RNA, 62 nt, Homo Sapiens
ggauguccuauggaaaccuauuucaccagaguuuuaaaaauaaaaaggguauuguuuugucu

SEQ ID NO: 472571 - RNA, 62 nt, Homo Sapiens
aaguaugcuuuguguuuuaacuguuaaaauaauuuaaaaauuaauuauuuuacauaauuaaa

SEQ ID NO: 472572 - RNA, 62 nt, Homo Sapiens
aucagaucuaugcuguggcauauuuugcuuuauuuaaaaauuuuuuuuuagagaugaguucu

SEQ ID NO: 472573 - RNA, 62 nt, Homo Sapiens
cacugaacuaguagaugucaauaauuauuauuuuuaaaaauuuuuauuuguuggccgggcau

SEQ ID NO: 472574 - RNA, 62 nt, Homo Sapiens
guguugcccagccugggugucaauaauuauuuuuuaaaaaaaauuuuuaaaaagguuuuuug

SEQ ID NO: 472575 - RNA, 62 nt, Homo Sapiens
ugggugucaauaauuauuuuuuaaaaaaaauuuuuaaaaagguuuuuugagacagauucuug

SEQ ID NO: 472576 - RNA, 62 nt, Homo Sapiens
ugagaaauacauguuuaacauucaauaauaauuuuaaaaauuugagaaauaaacucucauaa

SEQ ID NO: 472577 - RNA, 62 nt, Homo Sapiens
gacuagugagauuucuguaauaauuuuaauucuuuaaaaagugaaagcuuguuguaaagaua

SEQ ID NO: 472578 - RNA, 62 nt, Homo Sapiens
gauuuguuuaaaauuuuguauaucaccaaauuuuuaaaaagugauagucacagugcuaaguu

SEQ ID NO: 472579 - RNA, 62 nt, Homo Sapiens
uugagcauuuucuuucaguuacauggguguaauuuaaaaaacagcuccuuuuuaagacuuuu

SEQ ID NO: 472580 - RNA, 62 nt, Homo Sapiens
guaaucuucuacuugcuucaagauuugauuuuuuuaaaaaagccugcgaccuauucaauaca

SEQ ID NO: 472581 - RNA, 62 nt, Homo Sapiens
ggaguggaauaauuucuucauuaaaaaauguuuuuaaaaacacuauaucuugggugguuuau

SEQ ID NO: 472582 - RNA, 62 nt, Homo Sapiens
cguugaaaccugcaacacauuagaaacuuauauuuaaaaacagaauuaaucacacugaccaa

SEQ ID NO: 472583 - RNA, 62 nt, Homo Sapiens
auuacagaggaauuguuauaacuacuaauguuuuuaaaaaauuuauuaaacauuauuaaacu

SEQ ID NO: 472584 - RNA, 62 nt, Homo Sapiens
ggugucaugucacuaaguuuaaugcugcuguuuuuaaaaaaaaaaaaaaguuuuuuuaaaaa

SEQ ID NO: 472585 - RNA, 62 nt, Homo Sapiens
ugcugcuguuuuuaaaaaaaaaaaaaaguuuuuuuaaaaagccaaucuauguacuaaauugc

SEQ ID NO: 472586 - RNA, 62 nt, Homo Sapiens
gucagcaaggugucuuggguuuauuuugguucuuuaaaaaagggaagucuugagguuuuaga

SEQ ID NO: 472587 - RNA, 62 nt, Homo Sapiens
uauacacugaagaugaguuuuuaaucucuuacuuuaaaaagauuuauuuagaaucgugaauu

SEQ ID NO: 472588 - RNA, 62 nt, Homo Sapiens
gauauauucugaauuuauucucucauucguuuuuuaaaaacuguuuuaguugcuauucauau

SEQ ID NO: 472589 - RNA, 62 nt, Homo Sapiens
agacuucguacugugaguauuuaaaagcccuuuuuaaaaacugcaaaguaagacccagcauu

SEQ ID NO: 472590 - RNA, 62 nt, Homo Sapiens
aaggucugugugaaacacaccaauaaacucuguuuaaaaaauauuuuauaauguauuaaaua

SEQ ID NO: 472591 - RNA, 62 nt, Homo Sapiens
caaaacaaacaaaacaccuuuuuuccuuuuuuuuuaaaaaaacuuuuuuccuuugucuuucu

SEQ ID NO: 472592 - RNA, 62 nt, Homo Sapiens
aucgaagagcuaaaaaauacgacucacucauguuuaaaaaaauuuaagagcaguuacagugu

SEQ ID NO: 472593 - RNA, 62 nt, Homo Sapiens
aguucgguuaacaaggaagucaaacaugucaguuuaaaaauaaagguaauaucaaccgucag

SEQ ID NO: 472594 - RNA, 62 nt, Homo Sapiens
uuauuggcaaaacuggggauacuuugcuuauuuuuaaaaaauaagcuuuuaaccccuuuacc

SEQ ID NO: 472595 - RNA, 62 nt, Homo Sapiens
ugaaguagugaugguuuuuggcaaggaugcaguuuaaaaaugcacauuuacaguucuguaau

SEQ ID NO: 472596 - RNA, 62 nt, Homo Sapiens
ugucucucuuuucuucucucgaauccaaauauuuuaaaaaucuaauuuccauaugggcuaaa

SEQ ID NO: 472597 - RNA, 62 nt, Homo Sapiens
auuacaaaccaagaauuuuuggcuuuaugacuuuuaaaaaaaauaagucucugaaagccagu

SEQ ID NO: 472598 - RNA, 62 nt, Homo Sapiens
uaaauacuuuagcaaaaacauacuacuaacauuuuaaaaauauucguuugcucaacaugguu

SEQ ID NO: 472599 - RNA, 62 nt, Homo Sapiens
acuuuuaaguauucuucaguccaccugagugguuuaaaaagggccagauaauugcauucucu

SEQ ID NO: 472600 - RNA, 62 nt, Homo Sapiens
aaucaagucaguuuuuuuaaaaaguaucuucauuuaaaaagacaguucagaagagccaaaaa

SEQ ID NO: 472601 - RNA, 62 nt, Homo Sapiens
agauguguugcaguuuugcagugugcaaauuguuuaaaaauuuauaugugauauaaauuaau

SEQ ID NO: 472602 - RNA, 62 nt, Homo Sapiens
acaacagcguaaauauuagcuuacaaugaugauuuaaaaaaaaaucuauaagucugcccuuu

SEQ ID NO: 472603 - RNA, 62 nt, Homo Sapiens
aauuacugcacauaaaaugaauuaaaaggauuuuuaaaaaguagugguuaucccuagauaaa

SEQ ID NO: 472604 - RNA, 62 nt, Homo Sapiens
agcucagaaagucuuuauaagaguuucauugcuuuaaaaagacaugggguuucuuuuggaaa

SEQ ID NO: 472605 - RNA, 62 nt, Homo Sapiens
gggggaaaagccauuuauuuugaauucagaauuuuaaaaauuuguuauucuacacauaauua

SEQ ID NO: 472606 - RNA, 62 nt, Homo Sapiens
cuaaucuauaaauaccguuuuauuuaucccuuuuuaaaaaagaugcuagaauuacuuccaca

SEQ ID NO: 472607 - RNA, 62 nt, Homo Sapiens
caaaacuaugcauauuauguccacuuucuccuuuuaaaaaaauacacaggucuguacuucug

SEQ ID NO: 472608 - RNA, 62 nt, Homo Sapiens
ccuauuugauacaauuaaauauauuuaguaauuuuaaaaauugaucuuccagcaacguuuau

SEQ ID NO: 472609 - RNA, 62 nt, Homo Sapiens
cgacaacuuccaucauuccagagaaaagccacuuuaaaaacagcugaagugaccuuagcaga

SEQ ID NO: 472610 - RNA, 62 nt, Homo Sapiens
uauuuuuuuaaagagaaaucaguuuaccuguuuuuaaaaaaauuaaaucuaguucaccuugc

SEQ ID NO: 472611 - RNA, 62 nt, Homo Sapiens
ggagggcugaaggaaacguucacauuuuagaguuuaaaaaaaacaccucgacauuuaaaaaa

SEQ ID NO: 472612 - RNA, 62 nt, Homo Sapiens
acauuuuagaguuuaaaaaaaacaccucgacauuuaaaaaaucaaccaacacaagaucaaaa

SEQ ID NO: 472613 - RNA, 62 nt, Homo Sapiens
caaacagauuugucuaaacauuuguauauaacuuuaaaaauagaauauuuuuuggaggguua

SEQ ID NO: 472614 - RNA, 62 nt, Homo Sapiens
aucuauacauuucugaguucugaauaaauauuuuuaaaaauuuuaauauauuuuucuuugaa

SEQ ID NO: 472615 - RNA, 62 nt, Homo Sapiens
uaugaaaguuaauccauuucugauacgugguuuuuaaaaauaugaaauggauuuauauauac

SEQ ID NO: 472616 - RNA, 62 nt, Homo Sapiens
aaacugaauaagcauuuagcuuuuuaaaucauuuuaaaaauuaagucuaauuuugaagcuuu

SEQ ID NO: 472617 - RNA, 62 nt, Homo Sapiens
gaauucuuuacaagcuguuguaaacauuuaguuuuaaaaagaaaagcaugcugaaacauguu

SEQ ID NO: 472618 - RNA, 62 nt, Homo Sapiens
cugcucuuccuacugacucaaauaguuuauuuuuuaaaaauacuuauauaauacaugcagag

SEQ ID NO: 472619 - RNA, 62 nt, Homo Sapiens
guccauaguaagugcucaguaaacuuagcuguuuuaaaaacuuuguauuugaacauugaaaa

SEQ ID NO: 472620 - RNA, 62 nt, Homo Sapiens
caugaaugaauaggccagcugggacaaaugaauuuaaaaaaucagaaaaaugcaagauuuau

SEQ ID NO: 472621 - RNA, 62 nt, Homo Sapiens
aagaauuagaaaacuuugcaagauuugacuuguuuaaaaaucacauuuauaagugaaccgua

SEQ ID NO: 472622 - RNA, 62 nt, Homo Sapiens
cugacuguuuuuguaugguccaugaucuagaauuuaaaaaaauuuuaaaggguugaaaaaag

SEQ ID NO: 472623 - RNA, 62 nt, Homo Sapiens
uacuuccccgcccgcaggaggcucacguggccuuuaaaaacccacagaagguacuaauguca

SEQ ID NO: 472624 - RNA, 62 nt, Homo Sapiens
aaaaaaaccuggcagagcccuuucaccaugauuuuaaaaauuugcacucaacuggaaccaau

SEQ ID NO: 472625 - RNA, 62 nt, Homo Sapiens
aaaaaggaaaaaaaaaaaagacacagaagagauuuaaaaaaaaagcaacaaaaaaagaaaac

SEQ ID NO: 472626 - RNA, 62 nt, Homo Sapiens
aaaaauuccaacagaagccauaguuuucuuucuuuaaaaaaagucuggacauugcaucgccc

SEQ ID NO: 472627 - RNA, 62 nt, Homo Sapiens
cccaaaaaagcgaaccgugaaggaggaacagguuuaaaaaucaccuagguggggccuggggu

SEQ ID NO: 472628 - RNA, 62 nt, Homo Sapiens
aacuauuuaauuuuuuaauuuuuuuuuuuuuuuuuaaaaaaaugguucuucucguuuuccuu

SEQ ID NO: 472629 - RNA, 62 nt, Homo Sapiens
ccuuuuaauuuucugguaauaaaaaaaaaaguuuuaaaaauaggaagccauuuguuaaaaaa

SEQ ID NO: 472630 - RNA, 62 nt, Homo Sapiens
uaauauugcugugauucaacaaguacagauuuuuuaaaaagcguucuuuuuuccuugaaaag

SEQ ID NO: 472631 - RNA, 62 nt, Homo Sapiens
cgaaaaaugugacaaaaucucuggugaggaacuuuaaaaauguaaacauaaaauaaaucaua

SEQ ID NO: 472632 - RNA, 62 nt, Homo Sapiens
uuaaguaucucaauuuuucaagacuuaguuauuuuaaaaaaguguaaaacacaagauucuga

SEQ ID NO: 472633 - RNA, 62 nt, Homo Sapiens
auuucuggcugggcccggugaaaaugaauuauuuuaaaaaaacaugaaauuauagccaguuu

SEQ ID NO: 472634 - RNA, 62 nt, Homo Sapiens
uuuuuaguagagacaggguuggcuaauuuuuuuuuaaaaauaaggugcaugccaacacgccc

SEQ ID NO: 472635 - RNA, 62 nt, Homo Sapiens
ucaugagaagaguaaucuguucacucagaagauuuaaaaaacuauauauuuucuacuuuuaa

SEQ ID NO: 472636 - RNA, 62 nt, Homo Sapiens
aaaaaauagaccaggugcuccguguuucuuaauuuaaaaaaaccaugagccaccaugaccaa

SEQ ID NO: 472637 - RNA, 62 nt, Homo Sapiens
uacauaugccccucccaaacuuacaaagauuuuuuaaaaagcuuuauuccuaaacaagauag

SEQ ID NO: 472638 - RNA, 62 nt, Homo Sapiens
gucaaaugacuuaauucuguugagacuuuucauuuaaaaaaauugguucaguaauaaauaug

SEQ ID NO: 472639 - RNA, 62 nt, Homo Sapiens
aauuauauaaaaauacuuuagcuccauuauuuuuuaaaaagaaccugaugcccuuauuugaa

SEQ ID NO: 472640 - RNA, 62 nt, Homo Sapiens
gaaguuauggccgggcgcggauccugucucuauuuaaaaaaaaaccugggcaauauagggag

SEQ ID NO: 472641 - RNA, 62 nt, Homo Sapiens
agccaggugugguagugugcuacaaacaauuuuuuaaaaaugacaugaugagaccccaucuc

SEQ ID NO: 472642 - RNA, 62 nt, Homo Sapiens
cauucgucaucaguuguucuugaacauggucuuuuaaaaacuagucagaugaauuguuuuca

SEQ ID NO: 472643 - RNA, 62 nt, Homo Sapiens
ucuuauuuuuuuccuaaaagauaauguuuauuuuuaaaaaggaaggaaggagcaagugaagu

SEQ ID NO: 472644 - RNA, 62 nt, Homo Sapiens
cacuacaaaaauacaauuacucaccaaaaagcuuuaaaaaauaaagcugugucuuuagggag

SEQ ID NO: 472645 - RNA, 62 nt, Homo Sapiens
acaagugagggcuuuuuaacuugauuaugccuuuuaaaaauacuauguauguaaaauauuua

SEQ ID NO: 472646 - RNA, 62 nt, Homo Sapiens
auauagagacuucuaaaucauaaucauccuuuuuuaaaaaaaagaauuuuaaaaaagaugga

SEQ ID NO: 472647 - RNA, 62 nt, Homo Sapiens
aaucauaaucauccuuuuuuaaaaaaaagaauuuuaaaaaagauggauuugacacacucacc

SEQ ID NO: 472648 - RNA, 62 nt, Homo Sapiens
gcugagauguuuaguagcugauaaagaaaccuuuuaaaaaaauaauauaaaugaaugaaaua

SEQ ID NO: 472649 - RNA, 62 nt, Homo Sapiens
uuuuauuccuuuuacauuuguugcuucugggauuuaaaaaauuacuaaauucauaagauagu

SEQ ID NO: 472650 - RNA, 62 nt, Homo Sapiens
aguuaaacuccuacuaauuuaaacuaagacaguuuaaaaaggaagccugaaaaagacucaua

SEQ ID NO: 472651 - RNA, 62 nt, Homo Sapiens
uuggcuguuucaugcaggacuuaauuauugcuuuuaaaaauucacaaugaaaagacgauucu

SEQ ID NO: 472652 - RNA, 62 nt, Homo Sapiens
gcuaugauucacauguaacauuuaaacauuaauuuaaaaagggaaccuuggagaauucuuuu

SEQ ID NO: 472653 - RNA, 62 nt, Homo Sapiens
acaaggucaguauuuaccaaaguguaucugauuuuaaaaauuccuuuagucuguaaaacucc

SEQ ID NO: 472654 - RNA, 62 nt, Homo Sapiens
ggaaugcuuuuccagggagagaggccaguuaauuuaaaaaaaacagucgcuaguuaacagcg

SEQ ID NO: 472655 - RNA, 62 nt, Homo Sapiens
caauagcuuucaauuguucuuucuggaagacuuuuaaaaaaauauaaauaugcauauauaua

SEQ ID NO: 472656 - RNA, 62 nt, Homo Sapiens
caggagccaaccucccccuuugcagggcugcauuuaaaaauuagguuugggacaguucuugu

SEQ ID NO: 472657 - RNA, 62 nt, Homo Sapiens
ccagauucuguuauuugcaauuaaagcaaguuuuuaaaaaaugcaagaggcaguuguuaguc

SEQ ID NO: 472658 - RNA, 62 nt, Homo Sapiens
aauuaguaguuaagucugauagccaaguaaguuuuaaaaaccaaagcauccaggaugcacac

SEQ ID NO: 472659 - RNA, 62 nt, Homo Sapiens
cugccuucaagaaacaaugaccugauucugucuuuaaaaaaaaaaaucucagaauucuuuuu

SEQ ID NO: 472660 - RNA, 62 nt, Homo Sapiens
ucacaugcuaaugugcagcugagugcacuuuauuuaaaaagaauggauaaaugcaauauucu

SEQ ID NO: 472661 - RNA, 62 nt, Homo Sapiens
cccuuugccuauaugguagagcaauaaugcuuuuuaaaaauaaacuucugaaaacccaaggc

SEQ ID NO: 472662 - RNA, 62 nt, Homo Sapiens
gauuauuuguuuagauguaggcauuuuaauuuuuuaaaaauuccucuaccagaacuaagcac

SEQ ID NO: 472663 - RNA, 62 nt, Homo Sapiens
auggggaaauaaacuuaaaaaaaaaucaggaauuuaaaaaaacgagcaauuugaagagaauc

SEQ ID NO: 472664 - RNA, 62 nt, Homo Sapiens
agaaauagaauggugcucuuaucuuucuugacuuuaaaaaaauuauuaaaaacaaaaaaaaa

SEQ ID NO: 472665 - RNA, 62 nt, Homo Sapiens
agaaugauauaaaggagauacauguuucuuccuuuaaaaaauaaacggaaguuacauuguua

SEQ ID NO: 472666 - RNA, 62 nt, Homo Sapiens
guuuuuucuuuguauugcuguuuauuuuauauuuuaaaaauauuuaaaaaaaugucgagaug

SEQ ID NO: 472667 - RNA, 62 nt, Homo Sapiens
uguauugcuguuuauuuuauauuuuaaaaauauuuaaaaaaaugucgagauggggucucacu

SEQ ID NO: 472668 - RNA, 62 nt, Homo Sapiens
aauuucauauguucuaaaaugacuagcaaugguuuaaaaaggaagaagaguggaagugaaga

SEQ ID NO: 472669 - RNA, 62 nt, Homo Sapiens
ucagagcuauccugaaacugaacagcugaaacuuuaaaaaauaauugguauuauuuugugcc

SEQ ID NO: 472670 - RNA, 62 nt, Homo Sapiens
gaauaauaauauucauauuugcuaugaauccuuuuaaaaaaaucuuuggauaaaugcugaca

SEQ ID NO: 472671 - RNA, 62 nt, Homo Sapiens
cauuaagaauaucuugaauguuguguauauauuuuaaaaagcacuuugcaaaauaguuugua

SEQ ID NO: 472672 - RNA, 62 nt, Homo Sapiens
aaauuugucuuguuauuugugaguacaguacauuuaaaaaacauccuuaucgguuauuuuuu

SEQ ID NO: 472673 - RNA, 62 nt, Homo Sapiens
aagucaauugugacugcaauuccaaguuaguauuuaaaaauagagaaauugcacuuccugga

SEQ ID NO: 472674 - RNA, 62 nt, Homo Sapiens
uuuguuauuuauucuuuuaauaauggaauuuuuuuaaaaaguauuuuguaacugaggaauuu

SEQ ID NO: 472675 - RNA, 62 nt, Homo Sapiens
caacaucuugagguuguguauuggcuaaaaauuuuaaaaaauucuaggcauaaaaauaaaag

SEQ ID NO: 472676 - RNA, 62 nt, Homo Sapiens
acagaauaauugugcuugcucugaauaaaacuuuuaaaaagugaaaaauuauggucuuauug

SEQ ID NO: 472677 - RNA, 62 nt, Homo Sapiens
gguuaugaaauaauguuccaauaaaauuuaauuuuaaaaaauuggcugaauggcugaaugag

SEQ ID NO: 472678 - RNA, 62 nt, Homo Sapiens
aaaaaaagaaaaaaucccugaaaaauccuguguuuaaaaaaguuuuaaauaagaauuuuaau

SEQ ID NO: 472679 - RNA, 62 nt, Homo Sapiens
aauaagaaaaugcuaaauauuuucuuccuuuuuuuaaaaaaacacuuuaaaaauacagagaa

SEQ ID NO: 472680 - RNA, 62 nt, Homo Sapiens
cagagaauuucuuccuuuuuaguggagaacacuuuaaaaauagucagccgucuucuaaagca

SEQ ID NO: 472681 - RNA, 62 nt, Homo Sapiens
aacauuuugugguguguuuaauuuauuuauucuuuaaaaauauuuccugcguuuccuuugcc

SEQ ID NO: 472682 - RNA, 62 nt, Homo Sapiens
gcaugggaucauauuuaaacuucugcauuuccuuuaaaaauagaaacccauacucuagucgu

SEQ ID NO: 472683 - RNA, 62 nt, Homo Sapiens
gucuaccuugguacgcagccauuaagguuuauuuuaaaaaguucagugagucccagggacua

SEQ ID NO: 472684 - RNA, 62 nt, Homo Sapiens
ccagauauuaaaaugucugguugggauaccuuuuuaaaaacauuugauuuaggcaggguagc

SEQ ID NO: 472685 - RNA, 62 nt, Homo Sapiens
auuuuccacccuugcaaaauggaaguggucacuuuaaaaauuaucuuuuggaaagaauuucu

SEQ ID NO: 472686 - RNA, 62 nt, Homo Sapiens
gaaacaguguuaagugaaauuauuaguggcuuuuuaaaaaauuaguuuggauguacaauuau

SEQ ID NO: 472687 - RNA, 62 nt, Homo Sapiens
ucuugaaaauguauucugugggaguuucaguuuuuaaaaaauuuuaucuuguucugggcauu

SEQ ID NO: 472688 - RNA, 62 nt, Homo Sapiens
guucauguuguuuggaugguuagguuagucaguuuaaaaauuuugguuugaccgccacgauu

SEQ ID NO: 472689 - RNA, 62 nt, Homo Sapiens
aaugucuccuucuguguucuuuuuagcucucuuuuaaaaauauaaggagaaaccccauaacu

SEQ ID NO: 472690 - RNA, 62 nt, Homo Sapiens
cuaauaguccggccaggcgcuuuuaagugccuuuuaaaaauaaguuggauuggaaaggaaua

SEQ ID NO: 472691 - RNA, 62 nt, Homo Sapiens
cagacuuacagcuuucaggcuccaauuucucuuuuaaaaaagaaaugaaaagucugcuuaac

SEQ ID NO: 472692 - RNA, 62 nt, Homo Sapiens
gaaauagaauacagcauggauacaaccagcauuuuaaaaaauuugaaaccaguuuaauggga

SEQ ID NO: 472693 - RNA, 62 nt, Homo Sapiens
acuuuucacaaaaauaguccaucuaaagauguuuuaaaaaacggguacauuuuugcacugaa

SEQ ID NO: 472694 - RNA, 62 nt, Homo Sapiens
uaccuucuuuggguggggauugguuucauuuuuuuaaaaaauuagaucucugguguucucuu

SEQ ID NO: 472695 - RNA, 62 nt, Homo Sapiens
uauaaaaugaucucuguuuuuccugucagagauuuaaaaaacugaaaagguauaccucaacc

SEQ ID NO: 472696 - RNA, 62 nt, Homo Sapiens
aagguuuguuuugguuuguuauggcuuccuuuuuuaaaaaauuacccuguagugccaguuua

SEQ ID NO: 472697 - RNA, 62 nt, Homo Sapiens
acggccuagagaguugacaaguugcuuguaguuuuaaaaaaauaauaaaguauacccuucug

SEQ ID NO: 472698 - RNA, 62 nt, Homo Sapiens
agguccuaaaaauacgggcaagcucuuaacuauuuaaaaaugaaauuacaggcccgggcacg

SEQ ID NO: 472699 - RNA, 62 nt, Homo Sapiens
cugcacuccagccuggugacagcgugagacucuuuaaaaaaagaaauuaaaagaguugagac

SEQ ID NO: 472700 - RNA, 62 nt, Homo Sapiens
acuagaaauuugcaacuuauaaaaaaguuacuuuuaaaaauauaaguuagggcuaggcacag

SEQ ID NO: 472701 - RNA, 62 nt, Homo Sapiens
aaagaaaauaaauuguuuuuauuugagcagaauuuaaaaaagauauaccauacacuuaagaa

SEQ ID NO: 472702 - RNA, 62 nt, Homo Sapiens
auaaaauucaccauagcaaugggaaacaaaauuuuaaaaauaaaugaaaugcuagggggcca

SEQ ID NO: 472703 - RNA, 62 nt, Homo Sapiens
uaccaaagguuuuuauucuuucguacaaaaauuuuaaaaaguaagcauggaaauuaaguguu

SEQ ID NO: 472704 - RNA, 62 nt, Homo Sapiens
guuuuauaauaagacuguuuuauuacuuuuccuuuaaaaaugguguuacuccccgugaaagu

SEQ ID NO: 472705 - RNA, 62 nt, Homo Sapiens
uuguaggagacuuucaauuuaaaaaaaaaacauuuaaaaaugugaaacuuaaagaucagugg

SEQ ID NO: 472706 - RNA, 62 nt, Homo Sapiens
aauaugaaaaaccccuaaauuuucuuuguauauuuaaaaauauauuucuauuaaugguuuaa

SEQ ID NO: 472707 - RNA, 62 nt, Homo Sapiens
agauauuuugucaaggggcuuaaauuaacauuuuuaaaaagcgcuuuuuuuuucuuguguau

SEQ ID NO: 472708 - RNA, 62 nt, Homo Sapiens
gcuuagggauuaauguccucuacuauuaauuguuuaaaaacauggauaggguugaagaaggu

SEQ ID NO: 472709 - RNA, 62 nt, Homo Sapiens
uauacuuacaaugugaaguaguguccuccuuauuuaaaaagguaacaaagcuuucuuuuuuc

SEQ ID NO: 472710 - RNA, 62 nt, Homo Sapiens
ggugauagaugucaaauccauacuuugcuaauuuuaaaaacuaagacuaaugggaugccuuu

SEQ ID NO: 472711 - RNA, 62 nt, Homo Sapiens
auuccucaugaacacuaagagcccaguuguguuuuaaaaacauuugucuggaugaaaguuuu

SEQ ID NO: 472712 - RNA, 62 nt, Homo Sapiens
uuuuuuuucgagauggaguuaguuuuuuuuuauuuaaaaaauucaagugcaaggauaucaga

SEQ ID NO: 472713 - RNA, 62 nt, Homo Sapiens
auauuccaguuuuaaucauuaccugcuuuguuuuuaaaaauuacuuuaaaaugacuuuucca

SEQ ID NO: 472714 - RNA, 62 nt, Homo Sapiens
ccuuuuagagacagucuuuuaugucagguguuuuuaaaaauuaggagaaaaaaugaguuaca

SEQ ID NO: 472715 - RNA, 62 nt, Homo Sapiens
agguuuucauuuauggcuuuuaaacuuuaaguuuuaaaaaauuguucuuuaacacugacuac

SEQ ID NO: 472716 - RNA, 62 nt, Homo Sapiens
acugguguuuugucuucacauaucuguuagauuuuaaaaaugaucuaaacauagguucugca

SEQ ID NO: 472717 - RNA, 62 nt, Homo Sapiens
auauuguuaaucaguaaaaauuucgaagauuuuuuaaaaauaccuaaaccuuuaugcuacau

SEQ ID NO: 472718 - RNA, 62 nt, Homo Sapiens
cgacgucacuaugcagggcacacguggcuugguuuaaaaaggucaucuuagauuuaucuuag

SEQ ID NO: 472719 - RNA, 62 nt, Homo Sapiens
auguuuucaaauaaaaucucccuaaagcaauauuuaaaaauuggucaaaacaaggucuggga

SEQ ID NO: 472720 - RNA, 62 nt, Homo Sapiens
aauuuaagauguucuaguucugcucucuuuguuuuaaaaaucacugcuucaaucuacuucaa

SEQ ID NO: 472721 - RNA, 62 nt, Homo Sapiens
caaaaucuucaaguuacauuuaacccauaagguuuaaaaaaaaggaaaaaaaacgguugugg

SEQ ID NO: 472722 - RNA, 62 nt, Homo Sapiens
uaaauucuccugacuccaguuuauaacauccuuuuaaaaaauuuaaaaacaaacagccacac

SEQ ID NO: 472723 - RNA, 62 nt, Homo Sapiens
cugacuccaguuuauaacauccuuuuaaaaaauuuaaaaacaaacagccacaccccuccucc

SEQ ID NO: 472724 - RNA, 62 nt, Homo Sapiens
uuuuuuucucugggugcaaagauguucauucuuuuaaaaaauguuuaaaaaaaaaaaaaaac

SEQ ID NO: 472725 - RNA, 62 nt, Homo Sapiens
gggugcaaagauguucauucuuuuaaaaaauguuuaaaaaaaaaaaaaaacugccuuucuuc

SEQ ID NO: 472726 - RNA, 62 nt, Homo Sapiens
aaaaagugaaaguuaggguuaggacauccuuuuuuaaaaauuacaaauuuaguccguuuugg

SEQ ID NO: 472727 - RNA, 62 nt, Homo Sapiens
gcaacauagcaagacccugucuguacacaaaauuuaaaaauuaguucaucgggguggcacac

SEQ ID NO: 472728 - RNA, 62 nt, Homo Sapiens
aaaccagacucuguucugaauuuccuucucuuuuuaaaaauaucacuagcauuuaucacuuu

SEQ ID NO: 472729 - RNA, 62 nt, Homo Sapiens
cuagacccucucuaaagacuauccuuacuuauuuuaaaaagauccucucuguuaguccccaa

SEQ ID NO: 472730 - RNA, 62 nt, Homo Sapiens
cagcaaagugguucccucucgcaguuggacuuuuuaaaaauuuaagcauaaaagaugaaaga

SEQ ID NO: 472731 - RNA, 62 nt, Homo Sapiens
cacauggcacagagauucugacaaucuuccuguuuaaaaaacaucuuaauacuaaggaacca

SEQ ID NO: 472732 - RNA, 62 nt, Homo Sapiens
uauguaaagugcagucuucuuuuucuuucuuuuuuaaaaaaacaugaaauugaguguuauuu

SEQ ID NO: 472733 - RNA, 62 nt, Homo Sapiens
gccuuaagcaaaaggauguugaaugaaacagcuuuaaaaauaucucgcuccccacgacccca

SEQ ID NO: 472734 - RNA, 62 nt, Homo Sapiens
uucucgcuccccacgaccccaaccccugaaguuuuaaaaacuaugguccuggcaaccucaga

SEQ ID NO: 472735 - RNA, 62 nt, Homo Sapiens
aaacuugucugccacaguaucucaaaaguuuuuuuaaaaaaguuaauuuaaagggggggaac

SEQ ID NO: 472736 - RNA, 62 nt, Homo Sapiens
agcgagagggauaaaaaauuaagaaaacaaacuuuaaaaaaaugggaaaauauaaacgaggg

SEQ ID NO: 472737 - RNA, 62 nt, Homo Sapiens
agaacaaaauauaagaggaauaacaaguaaauuuuaaaaaaaacaaaaaaagagaaaaaaca

SEQ ID NO: 472738 - RNA, 62 nt, Homo Sapiens
ugaaaaaaaaaaaacugaagauuacuuuguaauuuaaaaaacauuaaagagcaaagcuuuuu

SEQ ID NO: 472739 - RNA, 62 nt, Homo Sapiens
aaaaaaaaaaaaaaaaggcacacuguauuuucuuuaaaaaaacuucucccuucuagugucuu

SEQ ID NO: 472740 - RNA, 62 nt, Homo Sapiens
agaaaauuccugggcauuugcauuaaagaugauuuaaaaaaacaaaaaaauuauuaaaaaua

SEQ ID NO: 472741 - RNA, 62 nt, Homo Sapiens
uaccgagcagcaaaaggggaguaauuauuuuauuuaaaaaaaagggauggguugggggcggg

SEQ ID NO: 472742 - RNA, 62 nt, Homo Sapiens
cucaccauauaaacuugcaucuuuuuaaauccuuuaaaaacauauuaugcugauggagcaug

SEQ ID NO: 472743 - RNA, 62 nt, Homo Sapiens
uuuucaagggauaaggccuuaaagugcuaguguuuaaaaacauucuaccaguguuucaauuu

SEQ ID NO: 472744 - RNA, 62 nt, Homo Sapiens
uaaaaaacggguaacaugguaacuauagaaaauuuaaaaaauugacccugucucuaaagaaa

SEQ ID NO: 472745 - RNA, 62 nt, Homo Sapiens
uagcuggguguggugguacgugaaaaaacuuuuuuaaaaauuauaaugagaccuguccucua

SEQ ID NO: 472746 - RNA, 62 nt, Homo Sapiens
agccaagugugguggugugccucuacaaaaaauuuaaaaauugcaguauagugagaucuuuu

SEQ ID NO: 472747 - RNA, 62 nt, Homo Sapiens
aaacaaaaagauugaucaaauagagauuuuaguuuaaaaacagaaugggacauugguguguu

SEQ ID NO: 472748 - RNA, 62 nt, Homo Sapiens
aaagaggagaaauaaaaccuggaaaaacaaacuuuaaaaaaagagagaaacauauuuuuuca

SEQ ID NO: 472749 - RNA, 62 nt, Homo Sapiens
caaaaaacaaaaaaaaucaacaaacaguuuuauuuaaaaaaagggauaaaauagcuguuuca

SEQ ID NO: 472750 - RNA, 62 nt, Homo Sapiens
gaaaaaaguacaaaaaaaucaaauaucugaguuuuaaaaaaauuguaaauuguauaauuuuu

SEQ ID NO: 472751 - RNA, 62 nt, Homo Sapiens
aucagacauagagagcuuugugugauucauguuuuaaaaagaaccgaagaagccacaggcag

SEQ ID NO: 472752 - RNA, 62 nt, Homo Sapiens
aaagaucuuuuuuaaauaaucuuuuugcuguuuuuaaaaaauuaaacaaggcuuuguguucc

SEQ ID NO: 472753 - RNA, 62 nt, Homo Sapiens
gcuuuucuguuuuuuaaccuuuuguuccgccauuuaaaaaaagaaaaaaaaaaagcuuaugu

SEQ ID NO: 472754 - RNA, 62 nt, Homo Sapiens
caauuauuuucagaaaaacacugacugugucauuuaaaaagaaauaaaugauauguuauuau

SEQ ID NO: 472755 - RNA, 62 nt, Homo Sapiens
uuuuuggaaaggcggggaagaaggaugaaaccuuuaaaaacaaaaacaaaaacaucaaugag

SEQ ID NO: 472756 - RNA, 62 nt, Homo Sapiens
uugaagauugaaaagggucagcugggaaaauuuuuaaaaagacuguuuuuaaaaaggugcua

SEQ ID NO: 472757 - RNA, 62 nt, Homo Sapiens
ggucagcugggaaaauuuuuaaaaagacuguuuuuaaaaaggugcuacaaaauaaagugcua

SEQ ID NO: 472758 - RNA, 62 nt, Homo Sapiens
ucucaugauuugaaaaguacaccuugcaaaguuuuaaaaauaaaguuuuuaggcaaaugcga

SEQ ID NO: 472759 - RNA, 62 nt, Homo Sapiens
uagcagaguuucucuauuuuauauuucauagauuuaaaaaacccaaauaaagauggauuuaa

SEQ ID NO: 472760 - RNA, 62 nt, Homo Sapiens
aucuauguuguguaggggaaauuuuuucauuuuuuaaaaauucuacuuugguuuuguuguug

SEQ ID NO: 472761 - RNA, 62 nt, Homo Sapiens
uuguagaacuauguuauaguccagucuacuucuuuaaaaaccauuuaaacugcuagauagua

SEQ ID NO: 472762 - RNA, 62 nt, Homo Sapiens
uaguccaauagaaaauucauucuuuauaggucuuuaaaaauuacuuuuauuauauuguuuac

SEQ ID NO: 472763 - RNA, 62 nt, Homo Sapiens
uuuauucucacccgaaguauucacacaaucuuuuuaaaaaaaauuugaaauggcauuuugua

SEQ ID NO: 472764 - RNA, 62 nt, Homo Sapiens
gucuuucaagaaugacggaauaagagaccuguuuuaaaaaggaacugcagcaaucuuugaaa

SEQ ID NO: 472765 - RNA, 62 nt, Homo Sapiens
cauuauagacauugaggaccucauccaaacaauuuaaaaaugagugugaagggggaacaagu

SEQ ID NO: 472766 - RNA, 62 nt, Homo Sapiens
augaugguuacacuuuugguuccuaaauaaaauuuaaaaaauuaacagccaagucacaaagg

SEQ ID NO: 472767 - RNA, 62 nt, Homo Sapiens
uuaauguuuaaagaguuuucuauuguuugaguuuuaaaaaagacuuuauguacagugcccag

SEQ ID NO: 472768 - RNA, 62 nt, Homo Sapiens
cuaaaacuguagaagcccaaucaccagcaguuuuuaaaaaggugauaacuuuuauuagcucu

SEQ ID NO: 472769 - RNA, 62 nt, Homo Sapiens
uaauuuaccaggaagcagaggagagcuacuuguuuaaaaauccacauucuuggacccaaucc

SEQ ID NO: 472770 - RNA, 62 nt, Homo Sapiens
cucaggaauauaacauauaagggagauguuaauuuaaaaauuuccacuacacuuauuaucua

SEQ ID NO: 472771 - RNA, 62 nt, Homo Sapiens
cagucauuuggcuucugaauguuugaaacgauuuuaaaaaauaaguagugcuaugguuguuu

SEQ ID NO: 472772 - RNA, 62 nt, Homo Sapiens
aucuaguuuuagaagggaaacaguugaaacuguuuaaaaauagaugugccuuauuuauugca

SEQ ID NO: 472773 - RNA, 62 nt, Homo Sapiens
ugaacaaguaauuuuauauugugcuuuaauuuuuuaaaaaguauucuuuauucauauguaua

SEQ ID NO: 472774 - RNA, 62 nt, Homo Sapiens
uucucugggugaggcaucugguuacugguuauuuuaaaaagaauaaagacauuccuggaauc

SEQ ID NO: 472775 - RNA, 62 nt, Homo Sapiens
gggccuauaaauauagaacaaauucagggauuuuuaaaaaauuguguuacuacugauauaug

SEQ ID NO: 472776 - RNA, 62 nt, Homo Sapiens
auuuacacaauuauaaucaccagcagugugaguuuaaaaaacuucguuguuuuuacaccaaa

SEQ ID NO: 472777 - RNA, 62 nt, Homo Sapiens
uguaaacuuuguucuugcauuagacugaccaguuuaaaaauaugaacuaaaaccuaauggcu

SEQ ID NO: 472778 - RNA, 62 nt, Homo Sapiens
ucauuucaacuuggcuuuuugucuuuuaaauuuuuaaaaaaugcaguaguguguuagagacu

SEQ ID NO: 472779 - RNA, 62 nt, Homo Sapiens
gccuuaaaaguuaaaaacauuuucaguuuuuuuuuaaaaaacguacucuuauuaucuggaac

SEQ ID NO: 472780 - RNA, 62 nt, Homo Sapiens
auguuucccggggcuaccccuucauagcugcauuuaaaaaugguguucaggccacuauggcu

SEQ ID NO: 472781 - RNA, 62 nt, Homo Sapiens
caagcauggaucuccauauuucaaaggaaaguuuuaaaaauguuuuuaaaacuucaaauauc

SEQ ID NO: 472782 - RNA, 62 nt, Homo Sapiens
aaaauugcaauuuguuuaauucagaauguguauuuaaaaagaaaaggaauuuaacaauuugc

SEQ ID NO: 472783 - RNA, 62 nt, Homo Sapiens
uuacugaaccaacaaucaaaaaaugguucuguuuuaaaaaggauuuuguuugauuugaaauu

SEQ ID NO: 472784 - RNA, 62 nt, Homo Sapiens
uccagugcauccuuacuuagguauuauacuucuuuaaaaagcucugaagcugcuacaauaga

SEQ ID NO: 472785 - RNA, 62 nt, Homo Sapiens
uuccuuuuguccacuuauauaguuauuuucucuuuaaaaaaaaauuuuuuuuaauguauuag

SEQ ID NO: 472786 - RNA, 62 nt, Homo Sapiens
acuggauuauucaggcuuuaggcauaugcuucuuuaaaaaagcuauaaauuauauuccucuu

SEQ ID NO: 472787 - RNA, 62 nt, Homo Sapiens
uuguguguucacuaaacucugaauaagcacuuuuuaaaaaacuuucuacucauuuuaaugau

SEQ ID NO: 472788 - RNA, 62 nt, Homo Sapiens
uuagagaauaguuauauuuucuauuacacaaguuuaaaaauauuauuaacuuguauuuucuu

SEQ ID NO: 472789 - RNA, 62 nt, Homo Sapiens
gacuguaguuuaauacuuuuuacccaaauauguuuaaaaacuucgugcauuuguuacagcuc

SEQ ID NO: 472790 - RNA, 62 nt, Homo Sapiens
ucccauuuuucuugacaacaauaaauaccacuuuuaaaaaugacacauauuuaaacacuuag

SEQ ID NO: 472791 - RNA, 62 nt, Homo Sapiens
augacaaaaugaaaaugcuuaaacuacagaaauuuaaaaaugccauaacaaucuugcgagac

SEQ ID NO: 472792 - RNA, 62 nt, Homo Sapiens
uccucccaaccaggcuaauaaccuaacacauguuuaaaaaaaaucugccuaagccgggugug

SEQ ID NO: 472793 - RNA, 62 nt, Homo Sapiens
agccaaggcccauuagccaguuuagcauuuacuuuaaaaaugacaugaggcagauucuuauc

SEQ ID NO: 472794 - RNA, 62 nt, Homo Sapiens
gcaagaaaagaagaauaguuguuuaaauauuuuuuaaaaaacacuugaauaagaaucaguag

SEQ ID NO: 472795 - RNA, 62 nt, Homo Sapiens
ugaauaagaaucaguaggguauaaacuagaaguuuaaaaaugcuucauagaacguccagggu

SEQ ID NO: 472796 - RNA, 62 nt, Homo Sapiens
ccggcuaaaacauugcaaauuuaaaugagaguuuuaaaaauuaaauaaugacugcccuguuu

SEQ ID NO: 472797 - RNA, 62 nt, Homo Sapiens
uuggcuuuugaaucgauuauuucaugcuuuuuuuuaaaaaaaaaaaaaaacaaaauaacaau

SEQ ID NO: 472798 - RNA, 62 nt, Homo Sapiens
gguuucagaaauauauugaaaguuuaacaauguuuaaaaauagaaaagcaugaguguucaug

SEQ ID NO: 472799 - RNA, 62 nt, Homo Sapiens
aaaccacuggaaaguuuaugguuguauuauuuuuuaaaaaaauuccaagugauugaaaccua

SEQ ID NO: 472800 - RNA, 62 nt, Homo Sapiens
agguaaaagcaucacaugaacuuguaaaggaauuuaaaaauccuacuuucauaauaaguugc

SEQ ID NO: 472801 - RNA, 62 nt, Homo Sapiens
uguaaauuaucaagcuucaaaaagcuuuuuuuuuuaaaaaaaaacaugcauauucuaaaaau

SEQ ID NO: 472802 - RNA, 62 nt, Homo Sapiens
aucugcacaguuugguuuuugcacaaaagucauuuaaaaaaaucugaguaauugucaaauau

SEQ ID NO: 472803 - RNA, 62 nt, Homo Sapiens
auugagauauucugcagcugauagagcagcauuuuaaaaauguaacagguggaaaauuacac

SEQ ID NO: 472804 - RNA, 62 nt, Homo Sapiens
aaagaaaaaguguucuagaguguuguugcuuuuuuaaaaaaagcgcugaaguuagaccaagg

SEQ ID NO: 472805 - RNA, 62 nt, Homo Sapiens
gcugagaugagguuuuggaaaacccugacaccuuuaaaaagcaguuuuugaaagacaaaauu

SEQ ID NO: 472806 - RNA, 62 nt, Homo Sapiens
ccuaauuuuccagagaagccuauuuuuauauuuuuaaaaaacugacagggcccaguuaaaua

SEQ ID NO: 472807 - RNA, 62 nt, Homo Sapiens
gacaaaaucugauauauuggacuucuucaaaauuuaaaaacuugugauuuaagaagaggaaa

SEQ ID NO: 472808 - RNA, 62 nt, Homo Sapiens
auagugagacucuugucucuacaaaaaguuuuuuuaaaaaauuaacugggcaccaugacaca

SEQ ID NO: 472809 - RNA, 62 nt, Homo Sapiens
acauaaauccaugaguccauacuugagcacacuuuaaaaaguaauaaaaccauaaaugaaac

SEQ ID NO: 472810 - RNA, 62 nt, Homo Sapiens
auuaauaaaaccauaaaugaugaacauucuacuuuaaaaauuauaaaucauaguaauaauau

SEQ ID NO: 472811 - RNA, 62 nt, Homo Sapiens
ccuucugugacacauucaaagaauguacuguauuuaaaaaaaugacauugaaguuguuggag

SEQ ID NO: 472812 - RNA, 62 nt, Homo Sapiens
ugagcucaucaaaaauauuguaguauugacuguuuaaaaaaugagaaaaauauauccaguaa

SEQ ID NO: 472813 - RNA, 62 nt, Homo Sapiens
ugauugcucuaauaaagaauaauuuuuugaauuuuaaaaaugaugaucaaaaauauaguuau

SEQ ID NO: 472814 - RNA, 62 nt, Homo Sapiens
ggauauuccaggaauguuuuuguguuaaaauauuuaaaaaguauauugaaacccauuuccug

SEQ ID NO: 472815 - RNA, 62 nt, Homo Sapiens
ccuuugauugauagagaagguauugguaauguuuuaaaaauugucuuugugugcuagaauau

SEQ ID NO: 472816 - RNA, 62 nt, Homo Sapiens
aacaugccuauuaacugguuaauuuauuacuuuuuaaaaaauaaaaaugacaacauucacaa

SEQ ID NO: 472817 - RNA, 62 nt, Homo Sapiens
acaacauucacaaaauuuaucuguauaggauuuuuaaaaaugauucugacaguguugugauu

SEQ ID NO: 472818 - RNA, 62 nt, Homo Sapiens
cacauuucuuacaaaaaagagucuuauaaaaauuuaaaaagagcacugccuaguuaacagaa

SEQ ID NO: 472819 - RNA, 62 nt, Homo Sapiens
aaauuuacuccaaagacuugcuuuguugaaacuuuaaaaagcacauaucaaaugaauggaaa

SEQ ID NO: 472820 - RNA, 62 nt, Homo Sapiens
aaacaaaaacaaaaaaaccuacuccgacucuauuuaaaaaaaagccugggaaaugugguaaa

SEQ ID NO: 472821 - RNA, 62 nt, Homo Sapiens
acaaaugagcaaagauuuuuuguaguacauuuuuuaaaaacccacaaauaguaugugcucau

SEQ ID NO: 472822 - RNA, 62 nt, Homo Sapiens
gauuaucuuuuagagaaguaugguuauguuguuuuaaaaaauuaagaugugauaugguacug

SEQ ID NO: 472823 - RNA, 62 nt, Homo Sapiens
aggacuugcaucagcugccuagugaagguuuuuuuaaaaaaggcuauuagaggggaacacaa

SEQ ID NO: 472824 - RNA, 62 nt, Homo Sapiens
aauugcucuggucccaccucgauguggagcucuuuaaaaauauugcacccccacauccaaag

SEQ ID NO: 472825 - RNA, 62 nt, Homo Sapiens
aaagcaauauauacacagguuucuuuuuccuuuuuaaaaaguagaaucguuuguaaagcuuu

SEQ ID NO: 472826 - RNA, 62 nt, Homo Sapiens
auuuagauugauucuccccaucuuuaaaaauguuuaaaaauuuaucugcagcuggauacucu

SEQ ID NO: 472827 - RNA, 62 nt, Homo Sapiens
uuuaaaaauuauuuagauuguggauacucuucuuuaaaaauguaacugcugcuaucugcagc

SEQ ID NO: 472828 - RNA, 62 nt, Homo Sapiens
cuguucagaaugcuuuaauagauacuugauuuuuuaaaaauacuucaaauucuauccucuuu

SEQ ID NO: 472829 - RNA, 62 nt, Homo Sapiens
acaauuuagaucucugaaaaaucagaaauauuuuuaaaaaauuagugauccacugaucucua

SEQ ID NO: 472830 - RNA, 62 nt, Homo Sapiens
uccccuuuaaguuaugauggcauuaaaaauuuuuuaaaaauuaagugacuauuugauuaaca

SEQ ID NO: 472831 - RNA, 62 nt, Homo Sapiens
aacuaaagaaauaugucaccaagaguucauuauuuaaaaauaacauaguauuuuugcagccu

SEQ ID NO: 472832 - RNA, 62 nt, Homo Sapiens
cuuuugcuagcugugcuauuggacaccccugcuuuaaaaacccaaugccgcuacuuugcugu

SEQ ID NO: 472833 - RNA, 62 nt, Homo Sapiens
caaaaagugaaaaaaaaaaguggaggauuacauuuaaaaaagauauaaauuaccauuguuug

SEQ ID NO: 472834 - RNA, 62 nt, Homo Sapiens
uacuacaauauguacauuuccuaaaguuguacuuuaaaaauuacauacacaucagccaucaa

SEQ ID NO: 472835 - RNA, 62 nt, Homo Sapiens
agccuaagauauacuuguuuagaaauucuguuuuuaaaaauuuagcuguguuauuauagagc

SEQ ID NO: 472836 - RNA, 62 nt, Homo Sapiens
aauggaacacuuaaauguauuuuucugaugcauuuaaaaauacacagaucuaucauaauugc

SEQ ID NO: 472837 - RNA, 62 nt, Homo Sapiens
aaauacagcagaaccucacuguuaauuauuccuuuaaaaagaaacauuucaguuacuuuuca

SEQ ID NO: 472838 - RNA, 62 nt, Homo Sapiens
uuacauugaaacaucaaacuacgccuuaggauuuuaaaaaaaaaaauaguuugccuuagguc

SEQ ID NO: 472839 - RNA, 62 nt, Homo Sapiens
gaguggcacaucaaagaaauaaauauaauuuuuuuaaaaauuuacacacaugcacauauguc

SEQ ID NO: 472840 - RNA, 62 nt, Homo Sapiens
agcaugaacccucuacuuaucacuaauauuaauuuaaaaagccaggagaaguagcuuaaauu

SEQ ID NO: 472841 - RNA, 62 nt, Homo Sapiens
aaauacccuaaguacucugucaacuguuacuauuuaaaaaaaaaaaggcuuuuaaauuagua

SEQ ID NO: 472842 - RNA, 62 nt, Homo Sapiens
uuccagcccuaaguuuuuauaggaguugagaguuuaaaaauauuaacuuucuuuccaauuua

SEQ ID NO: 472843 - RNA, 62 nt, Homo Sapiens
uaauuggaagcacaagugcaaaacaaagcagcuuuaaaaaaauaacuauuucacaugaguca

SEQ ID NO: 472844 - RNA, 62 nt, Homo Sapiens
cuggauauuucaaucuuuuauuuaaucuuuuuuuuaaaaaaaaguagguauuaaucuuauug

SEQ ID NO: 472845 - RNA, 62 nt, Homo Sapiens
aaacagaaauggagaccugaaacagaaauuacuuuaaaaaauuguaauaacacauuguaaag

SEQ ID NO: 472846 - RNA, 62 nt, Homo Sapiens
cuaauagaaguagggugaccuagggguuuuuuuuuaaaaaacgguccagacaccaagaauca

SEQ ID NO: 472847 - RNA, 62 nt, Homo Sapiens
aaacuugaagccaggcaugguugcaaauauuguuuaaaaaccgaugccuauaaauguggguu

SEQ ID NO: 472848 - RNA, 62 nt, Homo Sapiens
uguaguuagacugugaggagcuuugcuuacuuuuuaaaaaaauguaaacuaguauguaugug

SEQ ID NO: 472849 - RNA, 62 nt, Homo Sapiens
auuuuaguagaauucaguacaguucuagaaaauuuaaaaaucugagcuuaauugcuuaaaua

SEQ ID NO: 472850 - RNA, 62 nt, Homo Sapiens
uucagcauaaauccagcagauuuucuggcagguuuaaaaauacaguauucccacuccuggca

SEQ ID NO: 472851 - RNA, 62 nt, Homo Sapiens; identical to SEQ ID NO: 472782

SEQ ID NO: 472852 - RNA, 62 nt, Homo Sapiens
uuacugaagcaacaaucgaaaaaugguucuguuuuaaaaaggauuuuguuugauuugaaauu

SEQ ID NO: 472853 - RNA, 62 nt, Homo Sapiens
ggacaacaucugaaggguauguugcaugcauuuuuaaaaaaaucaucucauaugcauuguau

SEQ ID NO: 472854 - RNA, 62 nt, Homo Sapiens
uggagaguuucuguuaggaaaagccauacauuuuuaaaaauguagcaaaaugucaagggaaa

SEQ ID NO: 472855 - RNA, 62 nt, Homo Sapiens
gauccgcagauucaugcagcauuccauauuuuuuuaaaaaaagguuacacugugcaccgacg

SEQ ID NO: 472856 - RNA, 62 nt, Homo Sapiens
aaucauaguaauaauauuauugaacauucuacuuuaaaaauuauuaauaaaaccauaaauga

SEQ ID NO: 472857 - RNA, 62 nt, Homo Sapiens
aauaaaaccauaaaugaaacacuugagcacacuuuaaaaaguacauaaacccaugaguccau

SEQ ID NO: 472858 - RNA, 62 nt, Homo Sapiens
augagcuaaaacauggaacaaucacugaauaauuuaaaaagaguuuaccuggcagagugugu

SEQ ID NO: 472859 - RNA, 62 nt, Homo Sapiens
acuuucugaaaaaauccacuccaauguuugaguuuaaaaaaguuaaauguuuaaaggguuuc

SEQ ID NO: 472860 - RNA, 62 nt, Homo Sapiens
guguacuauuaucugaggaaccucgaucagcuuuuaaaaaaugauagcaaauuuaaaucucu

SEQ ID NO: 472861 - RNA, 62 nt, Homo Sapiens
gacacuccccgaagucuuuucacagaaaccuuuuuaaaaauacuuuuacaacugccucgaaa

SEQ ID NO: 472862 - RNA, 62 nt, Homo Sapiens
aacuauggaucagaauagccuacuuuuuuuucuuuaaaaaacuuuuauacucuuucuguaua

SEQ ID NO: 472863 - RNA, 64 nt, Homo Sapiens; identical to SEQ ID NO: 154765

SEQ ID NO: 472864 - RNA, 64 nt, Homo Sapiens; identical to SEQ ID NO: 154766

SEQ ID NO: 472865 - RNA, 64 nt, Homo Sapiens; identical to SEQ ID NO: 154767

SEQ ID NO: 472866 - RNA, 64 nt, Homo Sapiens; identical to SEQ ID NO: 154768

SEQ ID NO: 472867 - RNA, 64 nt, Homo Sapiens; identical to SEQ ID NO: 154769

SEQ ID NO: 472868 - RNA, 64 nt, Homo Sapiens; identical to SEQ ID NO: 154770

SEQ ID NO: 472869 - RNA, 64 nt, Homo Sapiens; identical to SEQ ID NO: 154771

SEQ ID NO: 472870 - RNA, 64 nt, Homo Sapiens; identical to SEQ ID NO: 154772

SEQ ID NO: 472871 - RNA, 64 nt, Homo Sapiens; identical to SEQ ID NO: 154773

SEQ ID NO: 472872 - RNA, 64 nt, Homo Sapiens; identical to SEQ ID NO: 154774

SEQ ID NO: 472873 - RNA, 64 nt, Homo Sapiens; identical to SEQ ID NO: 154775

SEQ ID NO: 472874 - RNA, 64 nt, Homo Sapiens; identical to SEQ ID NO: 154776

SEQ ID NO: 472875 - RNA, 64 nt, Homo Sapiens; identical to SEQ ID NO: 96889

SEQ ID NO: 472876 - RNA, 64 nt, Homo Sapiens; identical to SEQ ID NO: 96890

SEQ ID NO: 472877 - RNA, 64 nt, Homo Sapiens; identical to SEQ ID NO: 96891

SEQ ID NO: 472878 - RNA, 64 nt, Homo Sapiens; identical to SEQ ID NO: 96892

SEQ ID NO: 472879 - RNA, 64 nt, Homo Sapiens; identical to SEQ ID NO: 96893

SEQ ID NO: 472880 - RNA, 64 nt, Homo Sapiens; identical to SEQ ID NO: 96894

SEQ ID NO: 472881 - RNA, 64 nt, Homo Sapiens; identical to SEQ ID NO: 96895

SEQ ID NO: 472882 - RNA, 64 nt, Homo Sapiens; identical to SEQ ID NO: 96896

SEQ ID NO: 472883 - RNA, 64 nt, Homo Sapiens; identical to SEQ ID NO: 96897

SEQ ID NO: 472884 - RNA, 64 nt, Homo Sapiens; identical to SEQ ID NO: 96898

SEQ ID NO: 472885 - RNA, 64 nt, Homo Sapiens; identical to SEQ ID NO: 96899

SEQ ID NO: 472886 - RNA, 64 nt, Homo Sapiens; identical to SEQ ID NO: 96900

SEQ ID NO: 472887 - RNA, 64 nt, Homo Sapiens; identical to SEQ ID NO: 96901

SEQ ID NO: 472888 - RNA, 64 nt, Homo Sapiens; identical to SEQ ID NO: 96902

SEQ ID NO: 472889 - RNA, 64 nt, Homo Sapiens; identical to SEQ ID NO: 96903

SEQ ID NO: 472890 - RNA, 64 nt, Homo Sapiens; identical to SEQ ID NO: 96904

SEQ ID NO: 472891 - RNA, 64 nt, Homo Sapiens; identical to SEQ ID NO: 96905

SEQ ID NO: 472892 - RNA, 64 nt, Homo Sapiens; identical to SEQ ID NO: 96906

SEQ ID NO: 472893 - RNA, 64 nt, Homo Sapiens; identical to SEQ ID NO: 96907

SEQ ID NO: 472894 - RNA, 64 nt, Homo Sapiens; identical to SEQ ID NO: 96908

SEQ ID NO: 472895 - RNA, 64 nt, Homo Sapiens; identical to SEQ ID NO: 96909

SEQ ID NO: 472896 - RNA, 64 nt, Homo Sapiens; identical to SEQ ID NO: 96910

SEQ ID NO: 472897 - RNA, 64 nt, Homo Sapiens; identical to SEQ ID NO: 96911

SEQ ID NO: 472898 - RNA, 64 nt, Homo Sapiens; identical to SEQ ID NO: 96912

SEQ ID NO: 472899 - RNA, 64 nt, Homo Sapiens; identical to SEQ ID NO: 96913

SEQ ID NO: 472900 - RNA, 64 nt, Homo Sapiens; identical to SEQ ID NO: 96914

SEQ ID NO: 472901 - RNA, 64 nt, Homo Sapiens; identical to SEQ ID NO: 96915

SEQ ID NO: 472902 - RNA, 64 nt, Homo Sapiens; identical to SEQ ID NO: 96916

SEQ ID NO: 472903 - RNA, 64 nt, Homo Sapiens
uuaugugccuuuuuguuuuuguaaaaaaggaacacccggaaagacugaaagaauacauuuuaua

SEQ ID NO: 472904 - RNA, 64 nt, Homo Sapiens
aggaaggauggagguggacucucaccccauuccccccggaaaugaacaaagccgggcccuuucc

SEQ ID NO: 472905 - RNA, 64 nt, Homo Sapiens
cgccagagccagcaggggcugaggggcaccccggcccggaaagagcuguccacggaacauggca

SEQ ID NO: 472906 - RNA, 64 nt, Homo Sapiens
ggagagcuagagccacucacccccauccuccuugcccggaaaagaauggcuuugacuaaauuac

SEQ ID NO: 472907 - RNA, 64 nt, Homo Sapiens
gcaaaaaacuucuuagcaaaggccaaaucuguaacccggaaacaggggcuguuuagaaauauau

SEQ ID NO: 472908 - RNA, 64 nt, Homo Sapiens
cagucuauuuauucuucagcgaggacagacauugcccggaaacuaacgcaguuuggaugucuuu

SEQ ID NO: 472909 - RNA, 50 nt, Homo Sapiens
gcguggagugcagcgucugacccggaaacccuuucacuucucugcucccg

SEQ ID NO: 472910 - RNA, 64 nt, Homo Sapiens
cagagcgggccgcacugucugucuguccgucugucccggaaagaacuauaaagcgcuggaagcg

SEQ ID NO: 472911 - RNA, 64 nt, Homo Sapiens
guccucagagcauugcgugugugucuugcuguagcccggaaaagguuuuguguaaagauucugg

SEQ ID NO: 472912 - RNA, 64 nt, Homo Sapiens
gauucccggccacacuuugcauuucaacacucagcccggaaagaugcucguucgguuguuggac

SEQ ID NO: 472913 - RNA, 64 nt, Homo Sapiens
ugguauggcuauucuugaagaagauuucacaauccccggaaaacugagugccucuguuuuccag

SEQ ID NO: 472914 - RNA, 64 nt, Homo Sapiens
cucggaccagaguguguggagccugggcagagggcccggaaaccaggagcucuccagccucggc

SEQ ID NO: 472915 - RNA, 64 nt, Homo Sapiens
guugcccacuucacagguccugcuauggacaguucccggaaacggaccuggucaccccagcaag

SEQ ID NO: 472916 - RNA, 64 nt, Homo Sapiens
ccaauaaagaguuagaaugaaauucuuagauuggcccggaaaggaaaacuaaaaaggaccagag

SEQ ID NO: 472917 - RNA, 64 nt, Homo Sapiens
gccaagggcaagugauuugacagguaucugagcucccggaaacgcuaucaaacccaaaggcucu

SEQ ID NO: 472918 - RNA, 64 nt, Homo Sapiens
gagaggaagauccauuaguuacucacuccaugcucccggaaaucccccccgcgcgcccacccac

SEQ ID NO: 472919 - RNA, 64 nt, Homo Sapiens
cccaacucugccacagcucauccucggaggcaaucccggaaaccucuuuuauaagugugauuuu

SEQ ID NO: 472920 - RNA, 64 nt, Homo Sapiens
ggccgugcgcacuguguuccgugcccuggggacccccggaaaagcagcccagucagauguggga

SEQ ID NO: 472921 - RNA, 64 nt, Homo Sapiens
uacgcaggugacgccuuagcagcuuuucagcaggcccggaaagggaugcauggaggauggugug

SEQ ID NO: 472922 - RNA, 64 nt, Homo Sapiens
gaaaugaaaagggaaaaccacauagaaggguaaucccggaaaugcuucaucugguggacugugg

SEQ ID NO: 472923 - RNA, 64 nt, Homo Sapiens
ccuuuccuuucccagaaaaacugaggaaacuggccccggaaaagcaugucuuugggguugguuc

SEQ ID NO: 472924 - RNA, 64 nt, Homo Sapiens
ccuggcccaugccuguucaggcagauguggggagcccggaaacaacacccggcccacgcgugcu

SEQ ID NO: 472925 - RNA, 64 nt, Homo Sapiens
gcuccugccccaccccaccuccuccgggcuuccucccggaaacucagcgccugcugcacuugcc

SEQ ID NO: 472926 - RNA, 62 nt, Homo Sapiens
guggccccuucguuccuuguaaauaaaucccgcccccggaaaugacgucuccaccuucgugg

SEQ ID NO: 472927 - RNA, 64 nt, Homo Sapiens
cuuggacaugggccccagauaccaugaugcugagcccggaaacuccacauccugugggaccugg

SEQ ID NO: 472928 - RNA, 64 nt, Homo Sapiens
agacacucaguugacacuuguuauaucaugggaccccggaaauuggagugaagcuagaaacaga

SEQ ID NO: 472929 - RNA, 64 nt, Homo Sapiens
ugugggaaaaagaaaacaaagaaaacaccccaaccccggaaaugacaaaugugucugagucuug

SEQ ID NO: 472930 - RNA, 64 nt, Homo Sapiens
ggggaaagggaggaagauauggcacuucuccaaccccggaaaacauugcuuuugaaaacugcug

SEQ ID NO: 472931 - RNA, 64 nt, Homo Sapiens
gcgggaaguaacuggaaagagccucaccacacggcccggaaacagacagaguagaagcuggagu

SEQ ID NO: 472932 - RNA, 64 nt, Homo Sapiens
ccaccuuuggagaguuaauucagcauugcccccacccggaaaccagggccugagcucucuuccc

SEQ ID NO: 472933 - RNA, 64 nt, Homo Sapiens
cuugccugugcugugcuuccaggucacagagccccccggaaacucacaggggcccucuucccag

SEQ ID NO: 472934 - RNA, 64 nt, Homo Sapiens
aguucuaauuaguugucuaauaggaaagguaggacccggaaagaauuaguuugucauaaaguuu

SEQ ID NO: 472935 - RNA, 64 nt, Homo Sapiens
uaagcucauggaaacauguuuuaggaguaauauacccggaaaucgcauuacuucuaccuuaggu

SEQ ID NO: 472936 - RNA, 64 nt, Homo Sapiens
aggccugaggagcccagagcacuugacugagcuucccggaaacuggcccuaaccugucugucuc

SEQ ID NO: 472937 - RNA, 64 nt, Homo Sapiens
cucggcucgcccucucccccggaggccgcgcccucccggaaaagccggguccuccagaccccga

SEQ ID NO: 472938 - RNA, 61 nt, Homo Sapiens
uaucuggacccuggacugcaaggugcuguaucccggaaaucguccuggccuggagguguga

SEQ ID NO: 472939 - RNA, 64 nt, Homo Sapiens
ucaguggacccagugcugagaaaagcccccacaucccggaaaacccacuuuccuuucacgaccc

SEQ ID NO: 472940 - RNA, 64 nt, Homo Sapiens
gcauguucauugcaaacagaagguuccuugagcacccggaaacggucacgagacccagaggaag

SEQ ID NO: 472941 - RNA, 64 nt, Homo Sapiens
gcacccgaauuucuguccguucccaaagaucggccccggaaaaagucugccccagaaacucuca

SEQ ID NO: 472942 - RNA, 64 nt, Homo Sapiens
cugacacugacacaggggcccuuugcccucacuccccggaaaaaucgccuaaccugguuucuag

SEQ ID NO: 472943 - RNA, 64 nt, Homo Sapiens
ucuaucugcccucccccacaccuggggccugggccccggaaaaaguggggggacaggagggggc

SEQ ID NO: 472944 - RNA, 64 nt, Homo Sapiens
gacaagcaacccaaacugaaaacuuuccccccaacccggaaacauggcucccucccacccaacc

SEQ ID NO: 472945 - RNA, 64 nt, Homo Sapiens
cagauccuguugaagaaagagcuuaccccuuucccccggaaaacuugcaauccuguaguuccca

SEQ ID NO: 472946 - RNA, 64 nt, Homo Sapiens
uuggccucugccguccacaggacgcccucuugcucccggaaacguguggucacccgccguccac

SEQ ID NO: 472947 - RNA, 64 nt, Homo Sapiens
caaaugagacuccuggaaacauuggacagcugcucccggaaauggggcagggugcugccuuccc

SEQ ID NO: 472948 - RNA, 64 nt, Homo Sapiens
gaucagggcagcugcucugugugcaaaucggagacccggaaacucugguguucuaagagccccc

SEQ ID NO: 472949 - RNA, 64 nt, Homo Sapiens
cacacacacacacaucaucaagaguauguggauacccggaaacagugaaugagugaggaagagc

SEQ ID NO: 472950 - RNA, 64 nt, Homo Sapiens
cuucccuucccuuagccuguggcaacuccuuccacccggaaauuucccggucccagucccacca

SEQ ID NO: 472951 - RNA, 64 nt, Homo Sapiens
ucacagggugggaaacgaaauucgagggaaauuccccggaaauaugagggaaaucucugcauug

SEQ ID NO: 472952 - RNA, 64 nt, Homo Sapiens
caaaacaaaacaaaacaaaugacaguaacccuuccccggaaagaaauagaacaaucauggagcc

SEQ ID NO: 472953 - RNA, 64 nt, Homo Sapiens
ggcugcaggacacagcaaaagugaacccaggugucccggaaagguauguaagcuaaaaagcugu

SEQ ID NO: 472954 - RNA, 64 nt, Homo Sapiens
ucuuuuaagugcugaacuuauuuuucaaccauuucacaaggaggacaaguugaauggaccuuuu

SEQ ID NO: 472955 - RNA, 64 nt, Homo Sapiens
cuauucccaccauggggagcgaaaacguuaaaaucacaaggaauugcccaaucuaagcagacuu

SEQ ID NO: 472956 - RNA, 64 nt, Homo Sapiens
agggagcugggagcgagcaagcugaggccacguccacaaggagcuuuucaugccccugugccgc

SEQ ID NO: 472957 - RNA, 64 nt, Homo Sapiens
aaggaucagggggccaggccagcagcucgggggccacaaggagauggauaaugugccuguuuuu

SEQ ID NO: 472958 - RNA, 64 nt, Homo Sapiens
gaugcuggcccagggcccagcaggacagaugccacacaaggauaauggugccccaggaccagcu

SEQ ID NO: 472959 - RNA, 64 nt, Homo Sapiens
uccuguccagcuccaaccugugggccagacaugccacaaggacugaaauccauucacaguucuu

SEQ ID NO: 472960 - RNA, 64 nt, Homo Sapiens
aaguuggacagaacauuggggugcucucuaguagcacaaggaggugacacaaggacuccacacu

SEQ ID NO: 472961 - RNA, 64 nt, Homo Sapiens
ccacacugugcucucuaguaccaaagcaccuugacacaaggacucagguggcuguucaggugga

SEQ ID NO: 472962 - RNA, 64 nt, Homo Sapiens
uuuuacauggaaaccgggcucaccuaugcccaccacaacagagacucuuuucuuuagauggugc

SEQ ID NO: 472963 - RNA, 55 nt, Homo Sapiens
cuucagaccauuuucuuuucgagccacaacagagguagggaaagaugaguuguga

SEQ ID NO: 472964 - RNA, 64 nt, Homo Sapiens
uuuauucucuuaacaguucccuggguggcuuuaaacaacagaaacuagaacaaauuaccacaaa

SEQ ID NO: 472965 - RNA, 64 nt, Homo Sapiens
guuuauuggauuuaguacuguaacauauauauacacaacagaaaauacuauauauguuacauac

SEQ ID NO: 472966 - RNA, 64 nt, Homo Sapiens
aaaugcguauacugggaacaggaugccuuagcccacaacagaaccagaaugaaucuuugaaggc

SEQ ID NO: 472967 - RNA, 64 nt, Homo Sapiens
ucuuuucacauggaugaaauaauuccugcuaccaacaacagagcuucaccaggaaguugaguuu

SEQ ID NO: 472968 - RNA, 64 nt, Homo Sapiens
caaagaauugaaacuccuagcacauccaguuuuuacaacagauuugcagcucauuccuuacccu

SEQ ID NO: 472969 - RNA, 64 nt, Homo Sapiens
cagcaggguguucucagcucccagcgaagccuccacaacagaauggggccacagggcagccggg

SEQ ID NO: 472970 - RNA, 64 nt, Homo Sapiens
cgcaaaaauaaagugggaaagaccaugaagauacacaacagacugagcaaaaaucucagaacuu

SEQ ID NO: 472971 - RNA, 64 nt, Homo Sapiens
gaguuggaucuuauuuauuuguccaggagugaauacaacagaaaugugaagugaauuucuauau

SEQ ID NO: 472972 - RNA, 63 nt, Homo Sapiens
acagcuuccggcccgaggcccuacccaagcccccugaacaaacaauguguacacgacuacuua

SEQ ID NO: 472973 - RNA, 63 nt, Homo Sapiens
auaacuugaucccugaugacggaauucaagacccugaacaagaaaugaaaaguacacacccau

SEQ ID NO: 472974 - RNA, 63 nt, Homo Sapiens
ccuacgcacauaccuucaugcagucuauuuccacugaacaaaacagugccuuccucucucuac

SEQ ID NO: 472975 - RNA, 63 nt, Homo Sapiens
ccuacacacauaccuucaugcagucuauuuccacugaacaaaacacugccuuccucucucuac

SEQ ID NO: 472976 - RNA, 63 nt, Homo Sapiens
ccuacacacguaccuucaugacugaagaagucacugaacaaaauuugcucagcuggcugagac

SEQ ID NO: 472977 - RNA, 63 nt, Homo Sapiens
ugcuagacuuucuggagugaguggucuguuugucugaacaaaguuauaucuuccuaauaaggu

SEQ ID NO: 472978 - RNA, 63 nt, Homo Sapiens
agagugugaaaugaaaauauugccuugccauuucugaacaaaagaaaacugaauuguaaagau

SEQ ID NO: 472979 - RNA, 63 nt, Homo Sapiens
agcaauuuagacuuaaguggugcuuugugguaucugaacaauucauaacauguaaauaaugug

SEQ ID NO: 472980 - RNA, 63 nt, Homo Sapiens
gucuccauuuuucaaguguguucccuuucuauucugaacaacugcuuaaacucuaauagcugu

SEQ ID NO: 472981 - RNA, 63 nt, Homo Sapiens
cuuguaaaguuccauuguauacuuuauuuuggucugaacaaacugugacugaauguaagauua

SEQ ID NO: 472982 - RNA, 63 nt, Homo Sapiens
ggugaucagauaaaauauauuuugggaaauuaacugaacaaauaaaaaguuuuugauauaacu

SEQ ID NO: 472983 - RNA, 63 nt, Homo Sapiens
ucauuucagucaaaucacugcagucaugaaauacugaacaauugccuuaagucuuugcuugac

SEQ ID NO: 472984 - RNA, 63 nt, Homo Sapiens
ggggaccaucaacauuguaguauuaaaacuugacugaacaaaacuguagaacaguuuuauuuu

SEQ ID NO: 472985 - RNA, 63 nt, Homo Sapiens
ugcaauuaacuguagaacaguuggaaauuuacacugaacaaagguuuaaccugcucuugguca

SEQ ID NO: 472986 - RNA, 63 nt, Homo Sapiens
ugacaguguaacagauaaggaccugugugccugcugaacaacuaauacagugugugugugugc

SEQ ID NO: 472987 - RNA, 63 nt, Homo Sapiens
ggcuuacuauccauggucuuaauucugagucuccugaacaaaaaguauuauucuuguuuucug

SEQ ID NO: 472988 - RNA, 63 nt, Homo Sapiens
uucuguggcuccagugagaacaaggcuuugaaacugaacaagauaacuucuagaaaugaacug

SEQ ID NO: 472989 - RNA, 63 nt, Homo Sapiens
aggauccaggaguauuuucuucuugggugggcccugaacaaagccaaaaauuguagaaaccag

SEQ ID NO: 472990 - RNA, 63 nt, Homo Sapiens
accaugacaacccugcaggugcucacccugcugcugaacaaauuuaggguaagccuggucagg

SEQ ID NO: 472991 - RNA, 63 nt, Homo Sapiens
guuuugaggaaagggcuuugaauuccccagauacugaacaauuuguguuugugacugauggag

SEQ ID NO: 472992 - RNA, 63 nt, Homo Sapiens
uuuccacuuuccacgugcuuaaaaaugacaugccugaacaacuuuuaaaagcaucauuuaaaa

SEQ ID NO: 472993 - RNA, 63 nt, Homo Sapiens
uguugcaugcucuugaggccaugaagacuaaaacugaacaagauaaaggguaguuguuuuaca

SEQ ID NO: 472994 - RNA, 63 nt, Homo Sapiens
auauuucccagauagcuggcauugcuguuggaacugaacaauagugucaaguuacucaaaguu

SEQ ID NO: 472995 - RNA, 63 nt, Homo Sapiens
cacuuuggaguaaauagcuauauagggaaagcacugaacaaaccauaauuaaagcaguugaac

SEQ ID NO: 472996 - RNA, 64 nt, Homo Sapiens
gacaacugcagcaguggggacaggcccacgggcacagggagagguuuucuucucagcugguccc

SEQ ID NO: 472997 - RNA, 64 nt, Homo Sapiens
gauuccauuuuucuucucagugacugccugucugcagggagaagcagugaacaucauugaagcg

SEQ ID NO: 472998 - RNA, 64 nt, Homo Sapiens
ccaaguaccaucuuuaucuaacaccagcggugugcagggagagagucugcuccuuguugggcag

SEQ ID NO: 472999 - RNA, 64 nt, Homo Sapiens
agauggcuuaguguuuagacuucugaagcuuuugcagggagagaaugugcuuccauacaguggu

SEQ ID NO: 473000 - RNA, 64 nt, Homo Sapiens
uaacccuucgauauacauggagucauguccuucacagggagaauugugugucucagucccugua

SEQ ID NO: 473001 - RNA, 64 nt, Homo Sapiens
gagauaacuuauugugaagggauuuucuuguauacagggagagucuaaucagugacuuaagaga

SEQ ID NO: 473002 - RNA, 64 nt, Homo Sapiens
gugaagcagguaucagagucgggaguugacaggccagggagaggugcccagaaguggaugaugu

SEQ ID NO: 473003 - RNA, 64 nt, Homo Sapiens
gugauccuugcucccugcagagcaacaucgaaaccagggagaaauggaacaugaaaaccuccac

SEQ ID NO: 473004 - RNA, 64 nt, Homo Sapiens
uuaguuuauuuuuagagauuacagaauuuuuaaacagggagacgugugauauacucccucccuu

SEQ ID NO: 473005 - RNA, 64 nt, Homo Sapiens
acacuggucagucauuucagaggcagcagaugcccagggagacccaagaaagagucagguuagg

SEQ ID NO: 473006 - RNA, 64 nt, Homo Sapiens
aggcccacaagccccuccccugggcucucccaggcagggagaauggggagagggaccuccuugu

SEQ ID NO: 473007 - RNA, 64 nt, Homo Sapiens
acagacauucccucaguguggggggcaggggacacagggagaggaugguugucccuggggaggg

SEQ ID NO: 473008 - RNA, 64 nt, Homo Sapiens
accuuagccccucagaacagggagucccaggacccagggagaguguggggacaggacagccugu

SEQ ID NO: 473009 - RNA, 64 nt, Homo Sapiens
uggguaauaauagguacuaauuuuucuggaaaaucagggagacaagaaaaaaaaacaugaauuc

SEQ ID NO: 473010 - RNA, 64 nt, Homo Sapiens
cugaguaaaccgagauccagagccugugacgcuacagggagagggcucaccuaggugagugcac

SEQ ID NO: 473011 - RNA, 64 nt, Homo Sapiens
gaaaguucccugugcucauggagcuuacauucuacagggagaaagagauagccaauacauagga

SEQ ID NO: 473012 - RNA, 64 nt, Homo Sapiens
aagugagaacuugcucuacguggucaggaaagagcagggagaccaagcagagucgugggcaggg

SEQ ID NO: 473013 - RNA, 64 nt, Homo Sapiens
agccugucuagaugugggacucauugccccaaaccagggagaggaagagcucccacagggagag

SEQ ID NO: 473014 - RNA, 64 nt, Homo Sapiens
cauugccccaaaccagggagaggaagagcucccacagggagagcccaggcucucuuugcagccu

SEQ ID NO: 473015 - RNA, 64 nt, Homo Sapiens
uugauguuuauuggcucauguggacagaaauguacagggagaauuacauuauuuuaacacacag

SEQ ID NO: 473016 - RNA, 64 nt, Homo Sapiens
agauuucuuguucuauggaagaggaagcugagcucagggagauaugagcuccacagccacagcu

SEQ ID NO: 473017 - RNA, 64 nt, Homo Sapiens
ugcccagaccugcgugucagcccuuggugguggccagggagaggcgcccggugcagauggcccc

SEQ ID NO: 473018 - RNA, 64 nt, Homo Sapiens
guguccccgcucggggagggcccggccgagcgggcagggagagccaguccugucggcugggccc

SEQ ID NO: 473019 - RNA, 64 nt, Homo Sapiens
cugcccugcugcagaccucgggcaaagucaggcucagggagacuggccaaacccaagaaggucu

SEQ ID NO: 473020 - RNA, 64 nt, Homo Sapiens
cagccuccacauucagaggcgagggacagagagacagggagagugcugcggccccgugggguag

SEQ ID NO: 473021 - RNA, 64 nt, Homo Sapiens
aagugccccagguugggagcggacucagccuguacagggagauguagauccaggacgcccugca

SEQ ID NO: 473022 - RNA, 64 nt, Homo Sapiens
aagcacccaguuugagagugccagugcucccgugcagggagaggccuccugaacuggccacucc

SEQ ID NO: 473023 - RNA, 64 nt, Homo Sapiens
ccucggcugucuccugucccgcagggugaagcaccagggagagguaggucaugaaggacacucu

SEQ ID NO: 473024 - RNA, 64 nt, Homo Sapiens
uugagcagguaucaacuaggcuccuggaaacagacagggagaagagaggucaucccuuccuccu

SEQ ID NO: 473025 - RNA, 53 nt, Homo Sapiens
aauucggccuccugaaaugacagcagggagacuugggucggccuccugaaaug

SEQ ID NO: 473026 - RNA, 64 nt, Homo Sapiens
cagggagacuugggucggccuccugaaaugacagcagggagacuugggugaccccccuuccagg

SEQ ID NO: 473027 - RNA, 64 nt, Homo Sapiens
ccugagcugcugugaaagccccugcacaaucagccagggagaacugggcggguuuaguggcccc

SEQ ID NO: 473028 - RNA, 64 nt, Homo Sapiens
agucuuaggccuacgaugccacacaaagguuguucagggagaagggggugcaggaggcagaggg

SEQ ID NO: 473029 - RNA, 64 nt, Homo Sapiens
ccgggcuccugggcccuguucuuaggaucaguggcagggagaaacggguaucucuuuucucucu

SEQ ID NO: 473030 - RNA, 64 nt, Homo Sapiens
ccacucugagguuuccccaagagaaccagauuggcagggagaagcauuguggggcaauuguucc

SEQ ID NO: 473031 - RNA, 64 nt, Homo Sapiens
ccgucucuacaaaauaaaaacagccuggguaucacagggagaccugagccgaggaguucaagac

SEQ ID NO: 473032 - RNA, 53 nt, Homo Sapiens
cccaucuccagcuggaacgucaacagggagaacaaacaggacuguugcuauga

SEQ ID NO: 473033 - RNA, 64 nt, Homo Sapiens
uacaggauguuggcugcuugcuggggaagggcaacagggagaccgcacggugaggccugacauc

SEQ ID NO: 473034 - RNA, 64 nt, Homo Sapiens
gagcagugucauugucagugcugacauuugaggacagggagauguaccugggugguugagggga

SEQ ID NO: 473035 - RNA, 64 nt, Homo Sapiens
gcaguggcauuguuucugcuguggugggaacuggcagggagagggucaccuccacucugguugg

SEQ ID NO: 473036 - RNA, 64 nt, Homo Sapiens
cuuuggugcacucaccguccaccguuccccaaggcagggagagggaguggcccgucccugggag

SEQ ID NO: 473037 - RNA, 64 nt, Homo Sapiens
ucaucugcggcuuaaacucaucucgcuugaagggcagggagaaacccaugaaucucaggcacgg

SEQ ID NO: 473038 - RNA, 64 nt, Homo Sapiens
ggcugggcuucuuucucucaaaguauacggacuccagggagagauucucuaacaaaucuguagu

SEQ ID NO: 473039 - RNA, 64 nt, Homo Sapiens
uccacugaaggaaaaaaccccucagugacagcagcagggagaaaccagagcgagcagcguggag

SEQ ID NO: 473040 - RNA, 64 nt, Homo Sapiens
ccaccaugcuucucugucacagggcccugaggggcagggagaugacuaaucagugggcacacca

SEQ ID NO: 473041 - RNA, 64 nt, Homo Sapiens
gugugccgcucguacuccuggcagggguaugaggcagggagagggagaccucgggagugaggac

SEQ ID NO: 473042 - RNA, 64 nt, Homo Sapiens
ccaucuuauucaccaugucccuggggucucuagccagggagaccuguguguuucucuacugagc

SEQ ID NO: 473043 - RNA, 64 nt, Homo Sapiens
gggcgcuagggguucuuaguaaguggugcagggacagggagaugauuuauucagggaggaggaa

SEQ ID NO: 473044 - RNA, 64 nt, Homo Sapiens
uccaaacgauggaguagccagugguaauacaaagcagggagaacagaaagguagaguuacuaag

SEQ ID NO: 473045 - RNA, 64 nt, Homo Sapiens
gaauauacuugagaaagcacuaguggcuuguguucagggagaggagcuggcaguuuuuaaccac

SEQ ID NO: 473046 - RNA, 64 nt, Homo Sapiens
gaggugggcaccggccccaagugcagagucaaggcagggagaggccggcuggagccaggccccc

SEQ ID NO: 473047 - RNA, 64 nt, Homo Sapiens
gacaugagucaggggcaccauggaccucacgugccagggagacuugaauguggcugucacucuu

SEQ ID NO: 473048 - RNA, 64 nt, Homo Sapiens
ggccuggcuucuccuuuggaagugaggcauugcacagggagacguacguaucagcggccccuug

SEQ ID NO: 473049 - RNA, 64 nt, Homo Sapiens
uuugagauggacacacugguguggauuaaccugccagggagacagagcucacaauaaaaauggc

SEQ ID NO: 473050 - RNA, 64 nt, Homo Sapiens
accucugugggcagggcuugaaggaggacacacucagggagaaguuaaaccucaucuuguacua

SEQ ID NO: 473051 - RNA, 64 nt, Homo Sapiens
cugcauguggggacacuguggugaucacacaccacagggagaaugauguaugggcaaagcuuuu

SEQ ID NO: 473052 - RNA, 64 nt, Homo Sapiens
gagucuggccccagcuuuuccggcgacacuaaugcagggagaggcggggaccucacaggcagga

SEQ ID NO: 473053 - RNA, 64 nt, Homo Sapiens
gaguagacagccuggccuggaggugcacucgccccagggagaugggaugcugccaggugacccg

SEQ ID NO: 473054 - RNA, 64 nt, Homo Sapiens
cugcuggcguuggcugugauccacugcuggaucccagggagaacuggggcagcccccagaagga

SEQ ID NO: 473055 - RNA, 64 nt, Homo Sapiens
agcacuucgucuagugaaacgaugucugugacuacagggagauugacacccucccccuggagcu

SEQ ID NO: 473056 - RNA, 64 nt, Homo Sapiens
cuggcccgugucacugccucgacccucccuggaacagggagaggaagagcugcagcuggagccu

SEQ ID NO: 473057 - RNA, 64 nt, Homo Sapiens
ugaagaugcagggcagaggaauugcccauggacagugacgcaaggacuaggcugggagggagcg

SEQ ID NO: 473058 - RNA, 64 nt, Homo Sapiens
gccuuuuuguugcuccgcucccaggagagugagggugacgcaauugauuaaaaccauuuuguuc

SEQ ID NO: 473059 - RNA, 64 nt, Homo Sapiens
cucaauagacuucauaagugcauuggagugaacagugacgcaaggcuuacaacuuauccccacu

SEQ ID NO: 473060 - RNA, 64 nt, Homo Sapiens
gagaagaagaugcugaugauauugauaagaugucgugacgcaaagaaauuggaaaacaugauga

SEQ ID NO: 473061 - RNA, 64 nt, Homo Sapiens
gcauggucuguuuauucucugacugcagcguggagugacgcacuguuggcagaugagcaccaau

SEQ ID NO: 473062 - RNA, 64 nt, Homo Sapiens
acccccuuaacuguauagcucuuuuccuagaauagugacgcaaaucugcaugaacagcuaauug

SEQ ID NO: 473063 - RNA, 64 nt, Homo Sapiens
auaguuuugcaauguguauaucauuuaaaaucaugugacgcagagguucauuuuuguauuuauu

SEQ ID NO: 473064 - RNA, 64 nt, Homo Sapiens
gaaacuugaguaauuccugucuggcuuagcuacagugacgcauucagcagaacaaaggaguuca

SEQ ID NO: 473065 - RNA, 64 nt, Homo Sapiens
auauugagauguaauucagauuaggacacagugugugacgcagauaacugguuacucagcuccc

SEQ ID NO: 473066 - RNA, 64 nt, Homo Sapiens
ggccuaggccuuguugaaggcuucaucaggaaaugugacgcagagauugugcugcugugcuuca

SEQ ID NO: 473067 - RNA, 64 nt, Homo Sapiens
gugaugagaaauaauuaauuggacgggagacagagugacgcacugacucaccuagaggcuggaa

SEQ ID NO: 473068 - RNA, 64 nt, Homo Sapiens
cuucggggcucagagaggugaugacgugcccaaggugacgcaacucgugaacagccgugccugc

SEQ ID NO: 473069 - RNA, 64 nt, Homo Sapiens
cagucacuauucaugccggauaauagagaacuaugugacgcaguccucucaggagucugaguuu

SEQ ID NO: 473070 - RNA, 64 nt, Homo Sapiens
gagaguaugugcugagaugcuuccgaccuuucaggugacgcaggaacacugggggagucugaau

SEQ ID NO: 473071 - RNA, 50 nt, Homo Sapiens
caauguuuacucgaacagaagugacgcaaugcugcuguguagcacacuga

SEQ ID NO: 473072 - RNA, 64 nt, Homo Sapiens
cuuacagcacaucaccucuuugcccccgacggcugugacgcagccggagggaggcacuagucac

SEQ ID NO: 473073 - RNA, 64 nt, Homo Sapiens
gccugaugucuaccagaagcccuguguguggauggugacgcagaggacgucucuaugccgguga

SEQ ID NO: 473074 - RNA, 64 nt, Homo Sapiens
agaaaaggcaucauuguccgcuccauuaagaacagugacgcaccugcuacuucccuucacagac

SEQ ID NO: 473075 - RNA, 64 nt, Homo Sapiens
uccaagccaaggaauuccaaaggcagagauuggagugacgcaucaggaggccguaugaagacag

SEQ ID NO: 473076 - RNA, 64 nt, Homo Sapiens
cccucaaucccagcuacucaauuagcugaguguagugacgcaugcucuacuaaaaauacaaaaa

SEQ ID NO: 473077 - RNA, 64 nt, Homo Sapiens
gcauuggauaggggaacagcaggcagggcucugggugacgcaugccucuggucuaauaaacugg

SEQ ID NO: 473078 - RNA, 64 nt, Homo Sapiens
gcacuccuguaacugucucacuccggccccuccugugacgcacaucugugaaccguagcagcgc

SEQ ID NO: 473079 - RNA, 64 nt, Homo Sapiens
ccuaacugacuguaaccucacaggcuggagugcagugacgcaaucggggucaaacacuguugcc

SEQ ID NO: 473080 - RNA, 64 nt, Homo Sapiens
aacucugucucaaaaaaaaaauuagccagauguggugacgcaugccuguaguccuagcuacuca

SEQ ID NO: 473081 - RNA, 64 nt, Homo Sapiens
cagaggggauggggauagagcacacagacuuucugugacgcagagaaggcugaacucuucagaa

SEQ ID NO: 473082 - RNA, 64 nt, Homo Sapiens
gagagcagcggacuccggaguggacuuccugccugugacgcacaccccaguggcugcagguagc

SEQ ID NO: 473083 - RNA, 64 nt, Homo Sapiens
aaaaaacuuuuccgacaucuguucuuggucuuuugugacgcagguugaagggggaggaauagaa

SEQ ID NO: 473084 - RNA, 64 nt, Homo Sapiens
ugauaggccuggcccacgccgccgcccccgcugagugacgcaaucgcaccacggggcugcgcuc

SEQ ID NO: 473085 - RNA, 64 nt, Homo Sapiens
agaaggcgugcuggcaggcaagacgcgagugcuggugacgcacggcauuagcuuccugccccag

SEQ ID NO: 473086 - RNA, 64 nt, Homo Sapiens
ucugaagagcucagcugucaagugaacgcugaaugugacgcauuguaguggaggaagcgaagga

SEQ ID NO: 473087 - RNA, 64 nt, Homo Sapiens
caccuccugggcaggguucugggacccucugugggugacgcacacccugggauggggcuaguag

SEQ ID NO: 473088 - RNA, 64 nt, Homo Sapiens
aaugugcaguuacaggcugggcauuucugaaucugugacgcaagaauccuugccucaagcaaaa

SEQ ID NO: 473089 - RNA, 64 nt, Homo Sapiens
ccuguaaucccagcuacucgauuagcugaggguggugacgcaugaucucuacuaaaaauacaaa

SEQ ID NO: 473090 - RNA, 64 nt, Homo Sapiens
agcugguucugggaguuaaaaucauucuccucuagugacgcagccugcccgggacaccaccauu

SEQ ID NO: 473091 - RNA, 64 nt, Homo Sapiens
ccuguauaaauuagguuaaauucaauuugccaucgugacgcagaaccagcuaaaucauggcacc

SEQ ID NO: 473092 - RNA, 64 nt, Homo Sapiens; identical to SEQ ID NO: 226265

SEQ ID NO: 473093 - RNA, 64 nt, Homo Sapiens; identical to SEQ ID NO: 226266

SEQ ID NO: 473094 - RNA, 64 nt, Homo Sapiens; identical to SEQ ID NO: 226267

SEQ ID NO: 473095 - RNA, 64 nt, Homo Sapiens; identical to SEQ ID NO: 226268

SEQ ID NO: 473096 - RNA, 64 nt, Homo Sapiens; identical to SEQ ID NO: 226269

SEQ ID NO: 473097 - RNA, 64 nt, Homo Sapiens; identical to SEQ ID NO: 226270

SEQ ID NO: 473098 - RNA, 64 nt, Homo Sapiens; identical to SEQ ID NO: 226271

SEQ ID NO: 473099 - RNA, 64 nt, Homo Sapiens; identical to SEQ ID NO: 226272

SEQ ID NO: 473100 - RNA, 64 nt, Homo Sapiens; identical to SEQ ID NO: 226273

SEQ ID NO: 473101 - RNA, 64 nt, Homo Sapiens; identical to SEQ ID NO: 226274

SEQ ID NO: 473102 - RNA, 64 nt, Homo Sapiens; identical to SEQ ID NO: 226275

SEQ ID NO: 473103 - RNA, 64 nt, Homo Sapiens; identical to SEQ ID NO: 226276

SEQ ID NO: 473104 - RNA, 64 nt, Homo Sapiens; identical to SEQ ID NO: 226277

SEQ ID NO: 473105 - RNA, 64 nt, Homo Sapiens; identical to SEQ ID NO: 226278

SEQ ID NO: 473106 - RNA, 64 nt, Homo Sapiens; identical to SEQ ID NO: 226279

SEQ ID NO: 473107 - RNA, 64 nt, Homo Sapiens; identical to SEQ ID NO: 226280

SEQ ID NO: 473108 - RNA, 64 nt, Homo Sapiens; identical to SEQ ID NO: 226281

SEQ ID NO: 473109 - RNA, 64 nt, Homo Sapiens; identical to SEQ ID NO: 226282

SEQ ID NO: 473110 - RNA, 64 nt, Homo Sapiens; identical to SEQ ID NO: 226283

SEQ ID NO: 473111 - RNA, 64 nt, Homo Sapiens; identical to SEQ ID NO: 226284

SEQ ID NO: 473112 - RNA, 64 nt, Homo Sapiens; identical to SEQ ID NO: 226285

SEQ ID NO: 473113 - RNA, 64 nt, Homo Sapiens; identical to SEQ ID NO: 226286

SEQ ID NO: 473114 - RNA, 64 nt, Homo Sapiens; identical to SEQ ID NO: 226287

SEQ ID NO: 473115 - RNA, 64 nt, Homo Sapiens; identical to SEQ ID NO: 226288

SEQ ID NO: 473116 - RNA, 64 nt, Homo Sapiens; identical to SEQ ID NO: 226289

SEQ ID NO: 473117 - RNA, 64 nt, Homo Sapiens; identical to SEQ ID NO: 226290

SEQ ID NO: 473118 - RNA, 64 nt, Homo Sapiens; identical to SEQ ID NO: 226291

SEQ ID NO: 473119 - RNA, 64 nt, Homo Sapiens; identical to SEQ ID NO: 226292

SEQ ID NO: 473120 - RNA, 64 nt, Homo Sapiens; identical to SEQ ID NO: 226293

SEQ ID NO: 473121 - RNA, 64 nt, Homo Sapiens; identical to SEQ ID NO: 226294

SEQ ID NO: 473122 - RNA, 64 nt, Homo Sapiens; identical to SEQ ID NO: 226295

SEQ ID NO: 473123 - RNA, 64 nt, Homo Sapiens; identical to SEQ ID NO: 226296

SEQ ID NO: 473124 - RNA, 64 nt, Homo Sapiens; identical to SEQ ID NO: 226297

SEQ ID NO: 473125 - RNA, 64 nt, Homo Sapiens; identical to SEQ ID NO: 226298

SEQ ID NO: 473126 - RNA, 64 nt, Homo Sapiens; identical to SEQ ID NO: 226299

SEQ ID NO: 473127 - RNA, 64 nt, Homo Sapiens; identical to SEQ ID NO: 226300

SEQ ID NO: 473128 - RNA, 64 nt, Homo Sapiens; identical to SEQ ID NO: 226301

SEQ ID NO: 473129 - RNA, 64 nt, Homo Sapiens; identical to SEQ ID NO: 226302

SEQ ID NO: 473130 - RNA, 64 nt, Homo Sapiens; identical to SEQ ID NO: 226303

SEQ ID NO: 473131 - RNA, 64 nt, Homo Sapiens; identical to SEQ ID NO: 226304

SEQ ID NO: 473132 - RNA, 64 nt, Homo Sapiens; identical to SEQ ID NO: 226305

SEQ ID NO: 473133 - RNA, 64 nt, Homo Sapiens; identical to SEQ ID NO: 226306

SEQ ID NO: 473134 - RNA, 64 nt, Homo Sapiens; identical to SEQ ID NO: 226307

SEQ ID NO: 473135 - RNA, 64 nt, Homo Sapiens; identical to SEQ ID NO: 226308

SEQ ID NO: 473136 - RNA, 64 nt, Homo Sapiens; identical to SEQ ID NO: 226309

SEQ ID NO: 473137 - RNA, 64 nt, Homo Sapiens; identical to SEQ ID NO: 226310

SEQ ID NO: 473138 - RNA, 64 nt, Homo Sapiens; identical to SEQ ID NO: 226311

SEQ ID NO: 473139 - RNA, 64 nt, Homo Sapiens; identical to SEQ ID NO: 226312

SEQ ID NO: 473140 - RNA, 64 nt, Homo Sapiens; identical to SEQ ID NO: 226313

SEQ ID NO: 473141 - RNA, 64 nt, Homo Sapiens
augacacuguuaauaguacuaguacuauuacuaguacuaguacucuaguacuauugcuauuacu

SEQ ID NO: 473142 - RNA, 64 nt, Homo Sapiens
aguacuaugacacuguuaauauuacuaguacuauuacuaguacucuaguacuaguacuauugcu

SEQ ID NO: 473143 - RNA, 64 nt, Homo Sapiens
auuacuaguacuaguacuauaguacuauugcuauuacuaguacuauaguacuauugcuaguacu

SEQ ID NO: 473144 - RNA, 64 nt, Homo Sapiens
auugcuauuacuaguacuauaguacuauugcuaguacuaguacuuuuaccuuuaaaauaauaau

SEQ ID NO: 473145 - RNA, 64 nt, Homo Sapiens
uaguguuaggaagugaaccuauugagagaccuuuuacuaguagcauuggcuggcuguaauuugc

SEQ ID NO: 473146 - RNA, 64 nt, Homo Sapiens
uguaaaauuucacauugaaguacuuuuauuuauguacuaguagauuugaaaagaguauacuuuu

SEQ ID NO: 473147 - RNA, 64 nt, Homo Sapiens; identical to SEQ ID NO: 108992

SEQ ID NO: 473148 - RNA, 64 nt, Homo Sapiens; identical to SEQ ID NO: 108993

SEQ ID NO: 473149 - RNA, 64 nt, Homo Sapiens; identical to SEQ ID NO: 108994

SEQ ID NO: 473150 - RNA, 64 nt, Homo Sapiens; identical to SEQ ID NO: 108995

SEQ ID NO: 473151 - RNA, 64 nt, Homo Sapiens; identical to SEQ ID NO: 108996

SEQ ID NO: 473152 - RNA, 64 nt, Homo Sapiens; identical to SEQ ID NO: 108997

SEQ ID NO: 473153 - RNA, 64 nt, Homo Sapiens; identical to SEQ ID NO: 108998

SEQ ID NO: 473154 - RNA, 64 nt, Homo Sapiens; identical to SEQ ID NO: 108999

SEQ ID NO: 473155 - RNA, 64 nt, Homo Sapiens; identical to SEQ ID NO: 109000

SEQ ID NO: 473156 - RNA, 64 nt, Homo Sapiens; identical to SEQ ID NO: 109001

SEQ ID NO: 473157 - RNA, 64 nt, Homo Sapiens; identical to SEQ ID NO: 109002

SEQ ID NO: 473158 - RNA, 64 nt, Homo Sapiens; identical to SEQ ID NO: 109003

SEQ ID NO: 473159 - RNA, 64 nt, Homo Sapiens; identical to SEQ ID NO: 109004

SEQ ID NO: 473160 - RNA, 64 nt, Homo Sapiens; identical to SEQ ID NO: 109005

SEQ ID NO: 473161 - RNA, 64 nt, Homo Sapiens; identical to SEQ ID NO: 109006

SEQ ID NO: 473162 - RNA, 64 nt, Homo Sapiens; identical to SEQ ID NO: 109007

SEQ ID NO: 473163 - RNA, 64 nt, Homo Sapiens; identical to SEQ ID NO: 109008

SEQ ID NO: 473164 - RNA, 64 nt, Homo Sapiens; identical to SEQ ID NO: 109009

SEQ ID NO: 473165 - RNA, 64 nt, Homo Sapiens; identical to SEQ ID NO: 109010

SEQ ID NO: 473166 - RNA, 64 nt, Homo Sapiens; identical to SEQ ID NO: 109011

SEQ ID NO: 473167 - RNA, 64 nt, Homo Sapiens; identical to SEQ ID NO: 109012

SEQ ID NO: 473168 - RNA, 64 nt, Homo Sapiens; identical to SEQ ID NO: 109013

SEQ ID NO: 473169 - RNA, 64 nt, Homo Sapiens; identical to SEQ ID NO: 109014

SEQ ID NO: 473170 - RNA, 64 nt, Homo Sapiens; identical to SEQ ID NO: 109015

SEQ ID NO: 473171 - RNA, 64 nt, Homo Sapiens; identical to SEQ ID NO: 109016

SEQ ID NO: 473172 - RNA, 64 nt, Homo Sapiens; identical to SEQ ID NO: 109017

SEQ ID NO: 473173 - RNA, 64 nt, Homo Sapiens; identical to SEQ ID NO: 109018

SEQ ID NO: 473174 - RNA, 64 nt, Homo Sapiens; identical to SEQ ID NO: 109019

SEQ ID NO: 473175 - RNA, 64 nt, Homo Sapiens; identical to SEQ ID NO: 109020

SEQ ID NO: 473176 - RNA, 64 nt, Homo Sapiens; identical to SEQ ID NO: 109021

SEQ ID NO: 473177 - RNA, 64 nt, Homo Sapiens; identical to SEQ ID NO: 109022

SEQ ID NO: 473178 - RNA, 64 nt, Homo Sapiens; identical to SEQ ID NO: 109023

SEQ ID NO: 473179 - RNA, 64 nt, Homo Sapiens; identical to SEQ ID NO: 109024

SEQ ID NO: 473180 - RNA, 64 nt, Homo Sapiens; identical to SEQ ID NO: 109025

SEQ ID NO: 473181 - RNA, 64 nt, Homo Sapiens; identical to SEQ ID NO: 109026

SEQ ID NO: 473182 - RNA, 64 nt, Homo Sapiens; identical to SEQ ID NO: 109027

SEQ ID NO: 473183 - RNA, 64 nt, Homo Sapiens; identical to SEQ ID NO: 109028

SEQ ID NO: 473184 - RNA, 64 nt, Homo Sapiens; identical to SEQ ID NO: 109029

SEQ ID NO: 473185 - RNA, 64 nt, Homo Sapiens; identical to SEQ ID NO: 109030

SEQ ID NO: 473186 - RNA, 64 nt, Homo Sapiens; identical to SEQ ID NO: 109031

SEQ ID NO: 473187 - RNA, 64 nt, Homo Sapiens; identical to SEQ ID NO: 109032

SEQ ID NO: 473188 - RNA, 64 nt, Homo Sapiens; identical to SEQ ID NO: 109033

SEQ ID NO: 473189 - RNA, 64 nt, Homo Sapiens; identical to SEQ ID NO: 109034

SEQ ID NO: 473190 - RNA, 64 nt, Homo Sapiens; identical to SEQ ID NO: 109035

SEQ ID NO: 473191 - RNA, 64 nt, Homo Sapiens; identical to SEQ ID NO: 109036

SEQ ID NO: 473192 - RNA, 64 nt, Homo Sapiens; identical to SEQ ID NO: 109037

SEQ ID NO: 473193 - RNA, 64 nt, Homo Sapiens; identical to SEQ ID NO: 109038

SEQ ID NO: 473194 - RNA, 64 nt, Homo Sapiens; identical to SEQ ID NO: 109039

SEQ ID NO: 473195 - RNA, 64 nt, Homo Sapiens; identical to SEQ ID NO: 109040

SEQ ID NO: 473196 - RNA, 64 nt, Homo Sapiens; identical to SEQ ID NO: 109041

SEQ ID NO: 473197 - RNA, 64 nt, Homo Sapiens; identical to SEQ ID NO: 109042

SEQ ID NO: 473198 - RNA, 64 nt, Homo Sapiens; identical to SEQ ID NO: 109043

SEQ ID NO: 473199 - RNA, 64 nt, Homo Sapiens; identical to SEQ ID NO: 109044

SEQ ID NO: 473200 - RNA, 64 nt, Homo Sapiens; identical to SEQ ID NO: 109045

SEQ ID NO: 473201 - RNA, 64 nt, Homo Sapiens; identical to SEQ ID NO: 109046

SEQ ID NO: 473202 - RNA, 64 nt, Homo Sapiens; identical to SEQ ID NO: 109047

SEQ ID NO: 473203 - RNA, 64 nt, Homo Sapiens; identical to SEQ ID NO: 109048

SEQ ID NO: 473204 - RNA, 64 nt, Homo Sapiens; identical to SEQ ID NO: 109049

SEQ ID NO: 473205 - RNA, 64 nt, Homo Sapiens; identical to SEQ ID NO: 109050

SEQ ID NO: 473206 - RNA, 64 nt, Homo Sapiens; identical to SEQ ID NO: 109051

SEQ ID NO: 473207 - RNA, 64 nt, Homo Sapiens; identical to SEQ ID NO: 109052

SEQ ID NO: 473208 - RNA, 64 nt, Homo Sapiens; identical to SEQ ID NO: 109053

SEQ ID NO: 473209 - RNA, 64 nt, Homo Sapiens; identical to SEQ ID NO: 109054

SEQ ID NO: 473210 - RNA, 64 nt, Homo Sapiens; identical to SEQ ID NO: 109055

SEQ ID NO: 473211 - RNA, 64 nt, Homo Sapiens; identical to SEQ ID NO: 109056

SEQ ID NO: 473212 - RNA, 64 nt, Homo Sapiens; identical to SEQ ID NO: 109057

SEQ ID NO: 473213 - RNA, 64 nt, Homo Sapiens; identical to SEQ ID NO: 109058

SEQ ID NO: 473214 - RNA, 64 nt, Homo Sapiens; identical to SEQ ID NO: 109059

SEQ ID NO: 473215 - RNA, 64 nt, Homo Sapiens; identical to SEQ ID NO: 109060

SEQ ID NO: 473216 - RNA, 64 nt, Homo Sapiens; identical to SEQ ID NO: 109061

SEQ ID NO: 473217 - RNA, 64 nt, Homo Sapiens; identical to SEQ ID NO: 109062

SEQ ID NO: 473218 - RNA, 64 nt, Homo Sapiens; identical to SEQ ID NO: 109063

SEQ ID NO: 473219 - RNA, 64 nt, Homo Sapiens; identical to SEQ ID NO: 109064

SEQ ID NO: 473220 - RNA, 64 nt, Homo Sapiens; identical to SEQ ID NO: 109065

SEQ ID NO: 473221 - RNA, 64 nt, Homo Sapiens; identical to SEQ ID NO: 109066

SEQ ID NO: 473222 - RNA, 64 nt, Homo Sapiens; identical to SEQ ID NO: 109067

SEQ ID NO: 473223 - RNA, 64 nt, Homo Sapiens; identical to SEQ ID NO: 109068

SEQ ID NO: 473224 - RNA, 64 nt, Homo Sapiens; identical to SEQ ID NO: 109069

SEQ ID NO: 473225 - RNA, 64 nt, Homo Sapiens; identical to SEQ ID NO: 109070

SEQ ID NO: 473226 - RNA, 64 nt, Homo Sapiens; identical to SEQ ID NO: 109071

SEQ ID NO: 473227 - RNA, 64 nt, Homo Sapiens; identical to SEQ ID NO: 109072

SEQ ID NO: 473228 - RNA, 64 nt, Homo Sapiens; identical to SEQ ID NO: 109073

SEQ ID NO: 473229 - RNA, 64 nt, Homo Sapiens; identical to SEQ ID NO: 109074

SEQ ID NO: 473230 - RNA, 64 nt, Homo Sapiens; identical to SEQ ID NO: 109075

SEQ ID NO: 473231 - RNA, 64 nt, Homo Sapiens; identical to SEQ ID NO: 109076

SEQ ID NO: 473232 - RNA, 64 nt, Homo Sapiens; identical to SEQ ID NO: 109077

SEQ ID NO: 473233 - RNA, 64 nt, Homo Sapiens; identical to SEQ ID NO: 109078

SEQ ID NO: 473234 - RNA, 64 nt, Homo Sapiens; identical to SEQ ID NO: 109079

SEQ ID NO: 473235 - RNA, 64 nt, Homo Sapiens; identical to SEQ ID NO: 109080

SEQ ID NO: 473236 - RNA, 64 nt, Homo Sapiens; identical to SEQ ID NO: 109081

SEQ ID NO: 473237 - RNA, 64 nt, Homo Sapiens; identical to SEQ ID NO: 109082

SEQ ID NO: 473238 - RNA, 64 nt, Homo Sapiens; identical to SEQ ID NO: 109083

SEQ ID NO: 473239 - RNA, 64 nt, Homo Sapiens; identical to SEQ ID NO: 109084

SEQ ID NO: 473240 - RNA, 64 nt, Homo Sapiens; identical to SEQ ID NO: 109085

SEQ ID NO: 473241 - RNA, 64 nt, Homo Sapiens; identical to SEQ ID NO: 109086

SEQ ID NO: 473242 - RNA, 64 nt, Homo Sapiens; identical to SEQ ID NO: 109087

SEQ ID NO: 473243 - RNA, 64 nt, Homo Sapiens; identical to SEQ ID NO: 109088

SEQ ID NO: 473244 - RNA, 64 nt, Homo Sapiens; identical to SEQ ID NO: 109089

SEQ ID NO: 473245 - RNA, 64 nt, Homo Sapiens; identical to SEQ ID NO: 109090

SEQ ID NO: 473246 - RNA, 64 nt, Homo Sapiens; identical to SEQ ID NO: 109091

SEQ ID NO: 473247 - RNA, 64 nt, Homo Sapiens; identical to SEQ ID NO: 109092

SEQ ID NO: 473248 - RNA, 64 nt, Homo Sapiens; identical to SEQ ID NO: 109093

SEQ ID NO: 473249 - RNA, 64 nt, Homo Sapiens; identical to SEQ ID NO: 109094

SEQ ID NO: 473250 - RNA, 64 nt, Homo Sapiens; identical to SEQ ID NO: 109095

SEQ ID NO: 473251 - RNA, 64 nt, Homo Sapiens; identical to SEQ ID NO: 109096

SEQ ID NO: 473252 - RNA, 64 nt, Homo Sapiens; identical to SEQ ID NO: 109097

SEQ ID NO: 473253 - RNA, 64 nt, Homo Sapiens; identical to SEQ ID NO: 109098

SEQ ID NO: 473254 - RNA, 64 nt, Homo Sapiens; identical to SEQ ID NO: 109099

SEQ ID NO: 473255 - RNA, 64 nt, Homo Sapiens; identical to SEQ ID NO: 109100

SEQ ID NO: 473256 - RNA, 64 nt, Homo Sapiens; identical to SEQ ID NO: 109101

SEQ ID NO: 473257 - RNA, 64 nt, Homo Sapiens; identical to SEQ ID NO: 109102

SEQ ID NO: 473258 - RNA, 64 nt, Homo Sapiens; identical to SEQ ID NO: 109103

SEQ ID NO: 473259 - RNA, 64 nt, Homo Sapiens; identical to SEQ ID NO: 109104

SEQ ID NO: 473260 - RNA, 64 nt, Homo Sapiens; identical to SEQ ID NO: 109105

SEQ ID NO: 473261 - RNA, 64 nt, Homo Sapiens; identical to SEQ ID NO: 109106

SEQ ID NO: 473262 - RNA, 64 nt, Homo Sapiens; identical to SEQ ID NO: 109107

SEQ ID NO: 473263 - RNA, 64 nt, Homo Sapiens; identical to SEQ ID NO: 109108

SEQ ID NO: 473264 - RNA, 64 nt, Homo Sapiens; identical to SEQ ID NO: 109109

SEQ ID NO: 473265 - RNA, 64 nt, Homo Sapiens; identical to SEQ ID NO: 109110

SEQ ID NO: 473266 - RNA, 64 nt, Homo Sapiens; identical to SEQ ID NO: 109111

SEQ ID NO: 473267 - RNA, 64 nt, Homo Sapiens; identical to SEQ ID NO: 109112

SEQ ID NO: 473268 - RNA, 64 nt, Homo Sapiens; identical to SEQ ID NO: 109113

SEQ ID NO: 473269 - RNA, 64 nt, Homo Sapiens; identical to SEQ ID NO: 109114

SEQ ID NO: 473270 - RNA, 64 nt, Homo Sapiens; identical to SEQ ID NO: 109115

SEQ ID NO: 473271 - RNA, 64 nt, Homo Sapiens; identical to SEQ ID NO: 109116

SEQ ID NO: 473272 - RNA, 64 nt, Homo Sapiens; identical to SEQ ID NO: 109117

SEQ ID NO: 473273 - RNA, 64 nt, Homo Sapiens; identical to SEQ ID NO: 109118

SEQ ID NO: 473274 - RNA, 64 nt, Homo Sapiens; identical to SEQ ID NO: 109119

SEQ ID NO: 473275 - RNA, 64 nt, Homo Sapiens; identical to SEQ ID NO: 109120

SEQ ID NO: 473276 - RNA, 64 nt, Homo Sapiens; identical to SEQ ID NO: 109121

SEQ ID NO: 473277 - RNA, 64 nt, Homo Sapiens; identical to SEQ ID NO: 109122

SEQ ID NO: 473278 - RNA, 64 nt, Homo Sapiens; identical to SEQ ID NO: 109123

SEQ ID NO: 473279 - RNA, 64 nt, Homo Sapiens; identical to SEQ ID NO: 109124

SEQ ID NO: 473280 - RNA, 64 nt, Homo Sapiens; identical to SEQ ID NO: 109125

SEQ ID NO: 473281 - RNA, 64 nt, Homo Sapiens; identical to SEQ ID NO: 109126

SEQ ID NO: 473282 - RNA, 64 nt, Homo Sapiens; identical to SEQ ID NO: 109127

SEQ ID NO: 473283 - RNA, 64 nt, Homo Sapiens; identical to SEQ ID NO: 109128

SEQ ID NO: 473284 - RNA, 64 nt, Homo Sapiens; identical to SEQ ID NO: 109129

SEQ ID NO: 473285 - RNA, 64 nt, Homo Sapiens; identical to SEQ ID NO: 109130

SEQ ID NO: 473286 - RNA, 64 nt, Homo Sapiens; identical to SEQ ID NO: 109131

SEQ ID NO: 473287 - RNA, 64 nt, Homo Sapiens; identical to SEQ ID NO: 109132

SEQ ID NO: 473288 - RNA, 64 nt, Homo Sapiens; identical to SEQ ID NO: 109133

SEQ ID NO: 473289 - RNA, 64 nt, Homo Sapiens; identical to SEQ ID NO: 109134

SEQ ID NO: 473290 - RNA, 64 nt, Homo Sapiens; identical to SEQ ID NO: 109135

SEQ ID NO: 473291 - RNA, 64 nt, Homo Sapiens; identical to SEQ ID NO: 109136

SEQ ID NO: 473292 - RNA, 64 nt, Homo Sapiens; identical to SEQ ID NO: 109137

SEQ ID NO: 473293 - RNA, 64 nt, Homo Sapiens; identical to SEQ ID NO: 109138

SEQ ID NO: 473294 - RNA, 64 nt, Homo Sapiens; identical to SEQ ID NO: 109139

SEQ ID NO: 473295 - RNA, 64 nt, Homo Sapiens; identical to SEQ ID NO: 109140

SEQ ID NO: 473296 - RNA, 64 nt, Homo Sapiens; identical to SEQ ID NO: 109141

SEQ ID NO: 473297 - RNA, 64 nt, Homo Sapiens; identical to SEQ ID NO: 109142

SEQ ID NO: 473298 - RNA, 64 nt, Homo Sapiens; identical to SEQ ID NO: 109143

SEQ ID NO: 473299 - RNA, 64 nt, Homo Sapiens; identical to SEQ ID NO: 109144

SEQ ID NO: 473300 - RNA, 64 nt, Homo Sapiens; identical to SEQ ID NO: 109145

SEQ ID NO: 473301 - RNA, 64 nt, Homo Sapiens; identical to SEQ ID NO: 109146

SEQ ID NO: 473302 - RNA, 64 nt, Homo Sapiens; identical to SEQ ID NO: 109147

SEQ ID NO: 473303 - RNA, 64 nt, Homo Sapiens; identical to SEQ ID NO: 109148

SEQ ID NO: 473304 - RNA, 64 nt, Homo Sapiens; identical to SEQ ID NO: 109149

SEQ ID NO: 473305 - RNA, 64 nt, Homo Sapiens; identical to SEQ ID NO: 109150

SEQ ID NO: 473306 - RNA, 64 nt, Homo Sapiens; identical to SEQ ID NO: 109151

SEQ ID NO: 473307 - RNA, 64 nt, Homo Sapiens; identical to SEQ ID NO: 109152

SEQ ID NO: 473308 - RNA, 64 nt, Homo Sapiens; identical to SEQ ID NO: 109153

SEQ ID NO: 473309 - RNA, 64 nt, Homo Sapiens; identical to SEQ ID NO: 109154

SEQ ID NO: 473310 - RNA, 64 nt, Homo Sapiens; identical to SEQ ID NO: 109155

SEQ ID NO: 473311 - RNA, 64 nt, Homo Sapiens; identical to SEQ ID NO: 109156

SEQ ID NO: 473312 - RNA, 64 nt, Homo Sapiens; identical to SEQ ID NO: 109157

SEQ ID NO: 473313 - RNA, 64 nt, Homo Sapiens; identical to SEQ ID NO: 109158

SEQ ID NO: 473314 - RNA, 64 nt, Homo Sapiens; identical to SEQ ID NO: 109159

SEQ ID NO: 473315 - RNA, 64 nt, Homo Sapiens; identical to SEQ ID NO: 109160

SEQ ID NO: 473316 - RNA, 64 nt, Homo Sapiens; identical to SEQ ID NO: 109161

SEQ ID NO: 473317 - RNA, 64 nt, Homo Sapiens; identical to SEQ ID NO: 109162

SEQ ID NO: 473318 - RNA, 64 nt, Homo Sapiens; identical to SEQ ID NO: 109163

SEQ ID NO: 473319 - RNA, 64 nt, Homo Sapiens; identical to SEQ ID NO: 109164

SEQ ID NO: 473320 - RNA, 64 nt, Homo Sapiens; identical to SEQ ID NO: 109165

SEQ ID NO: 473321 - RNA, 64 nt, Homo Sapiens; identical to SEQ ID NO: 109166

SEQ ID NO: 473322 - RNA, 64 nt, Homo Sapiens; identical to SEQ ID NO: 109167

SEQ ID NO: 473323 - RNA, 64 nt, Homo Sapiens; identical to SEQ ID NO: 109168

SEQ ID NO: 473324 - RNA, 64 nt, Homo Sapiens; identical to SEQ ID NO: 109169

SEQ ID NO: 473325 - RNA, 64 nt, Homo Sapiens; identical to SEQ ID NO: 109170

SEQ ID NO: 473326 - RNA, 64 nt, Homo Sapiens; identical to SEQ ID NO: 109171

SEQ ID NO: 473327 - RNA, 64 nt, Homo Sapiens; identical to SEQ ID NO: 109172

SEQ ID NO: 473328 - RNA, 63 nt, Homo Sapiens; identical to SEQ ID NO: 109173

SEQ ID NO: 473329 - RNA, 64 nt, Homo Sapiens; identical to SEQ ID NO: 109174

SEQ ID NO: 473330 - RNA, 64 nt, Homo Sapiens; identical to SEQ ID NO: 109175

SEQ ID NO: 473331 - RNA, 64 nt, Homo Sapiens; identical to SEQ ID NO: 109176

SEQ ID NO: 473332 - RNA, 64 nt, Homo Sapiens; identical to SEQ ID NO: 109177

SEQ ID NO: 473333 - RNA, 64 nt, Homo Sapiens; identical to SEQ ID NO: 109178

SEQ ID NO: 473334 - RNA, 64 nt, Homo Sapiens; identical to SEQ ID NO: 109179

SEQ ID NO: 473335 - RNA, 64 nt, Homo Sapiens; identical to SEQ ID NO: 109180

SEQ ID NO: 473336 - RNA, 64 nt, Homo Sapiens; identical to SEQ ID NO: 109181

SEQ ID NO: 473337 - RNA, 64 nt, Homo Sapiens; identical to SEQ ID NO: 109182

SEQ ID NO: 473338 - RNA, 64 nt, Homo Sapiens; identical to SEQ ID NO: 109183

SEQ ID NO: 473339 - RNA, 64 nt, Homo Sapiens; identical to SEQ ID NO: 109184

SEQ ID NO: 473340 - RNA, 64 nt, Homo Sapiens; identical to SEQ ID NO: 109185

SEQ ID NO: 473341 - RNA, 64 nt, Homo Sapiens; identical to SEQ ID NO: 109186

SEQ ID NO: 473342 - RNA, 64 nt, Homo Sapiens; identical to SEQ ID NO: 109187

SEQ ID NO: 473343 - RNA, 64 nt, Homo Sapiens; identical to SEQ ID NO: 109188

SEQ ID NO: 473344 - RNA, 64 nt, Homo Sapiens; identical to SEQ ID NO: 109189

SEQ ID NO: 473345 - RNA, 64 nt, Homo Sapiens; identical to SEQ ID NO: 109190

SEQ ID NO: 473346 - RNA, 64 nt, Homo Sapiens; identical to SEQ ID NO: 109191

SEQ ID NO: 473347 - RNA, 64 nt, Homo Sapiens; identical to SEQ ID NO: 109192

SEQ ID NO: 473348 - RNA, 64 nt, Homo Sapiens; identical to SEQ ID NO: 109193

SEQ ID NO: 473349 - RNA, 64 nt, Homo Sapiens; identical to SEQ ID NO: 109194

SEQ ID NO: 473350 - RNA, 64 nt, Homo Sapiens; identical to SEQ ID NO: 109195

SEQ ID NO: 473351 - RNA, 64 nt, Homo Sapiens; identical to SEQ ID NO: 109196

SEQ ID NO: 473352 - RNA, 64 nt, Homo Sapiens; identical to SEQ ID NO: 109197

SEQ ID NO: 473353 - RNA, 64 nt, Homo Sapiens; identical to SEQ ID NO: 109198

SEQ ID NO: 473354 - RNA, 64 nt, Homo Sapiens; identical to SEQ ID NO: 109199

SEQ ID NO: 473355 - RNA, 64 nt, Homo Sapiens; identical to SEQ ID NO: 109200

SEQ ID NO: 473356 - RNA, 64 nt, Homo Sapiens; identical to SEQ ID NO: 109201

SEQ ID NO: 473357 - RNA, 64 nt, Homo Sapiens; identical to SEQ ID NO: 109202

SEQ ID NO: 473358 - RNA, 64 nt, Homo Sapiens; identical to SEQ ID NO: 109203

SEQ ID NO: 473359 - RNA, 64 nt, Homo Sapiens; identical to SEQ ID NO: 109204

SEQ ID NO: 473360 - RNA, 64 nt, Homo Sapiens; identical to SEQ ID NO: 109205

SEQ ID NO: 473361 - RNA, 64 nt, Homo Sapiens; identical to SEQ ID NO: 109206

SEQ ID NO: 473362 - RNA, 64 nt, Homo Sapiens; identical to SEQ ID NO: 109207

SEQ ID NO: 473363 - RNA, 64 nt, Homo Sapiens; identical to SEQ ID NO: 109208

SEQ ID NO: 473364 - RNA, 64 nt, Homo Sapiens; identical to SEQ ID NO: 109209

SEQ ID NO: 473365 - RNA, 64 nt, Homo Sapiens; identical to SEQ ID NO: 109210

SEQ ID NO: 473366 - RNA, 64 nt, Homo Sapiens; identical to SEQ ID NO: 109211

SEQ ID NO: 473367 - RNA, 64 nt, Homo Sapiens; identical to SEQ ID NO: 109212

SEQ ID NO: 473368 - RNA, 64 nt, Homo Sapiens; identical to SEQ ID NO: 109213

SEQ ID NO: 473369 - RNA, 64 nt, Homo Sapiens; identical to SEQ ID NO: 109214

SEQ ID NO: 473370 - RNA, 64 nt, Homo Sapiens; identical to SEQ ID NO: 109215

SEQ ID NO: 473371 - RNA, 64 nt, Homo Sapiens; identical to SEQ ID NO: 109216

SEQ ID NO: 473372 - RNA, 64 nt, Homo Sapiens; identical to SEQ ID NO: 109217

SEQ ID NO: 473373 - RNA, 64 nt, Homo Sapiens; identical to SEQ ID NO: 109218

SEQ ID NO: 473374 - RNA, 64 nt, Homo Sapiens; identical to SEQ ID NO: 109219

SEQ ID NO: 473375 - RNA, 64 nt, Homo Sapiens; identical to SEQ ID NO: 109220

SEQ ID NO: 473376 - RNA, 64 nt, Homo Sapiens; identical to SEQ ID NO: 109221

SEQ ID NO: 473377 - RNA, 64 nt, Homo Sapiens; identical to SEQ ID NO: 109222

SEQ ID NO: 473378 - RNA, 64 nt, Homo Sapiens; identical to SEQ ID NO: 109223

SEQ ID NO: 473379 - RNA, 64 nt, Homo Sapiens; identical to SEQ ID NO: 109224

SEQ ID NO: 473380 - RNA, 64 nt, Homo Sapiens; identical to SEQ ID NO: 109225

SEQ ID NO: 473381 - RNA, 64 nt, Homo Sapiens; identical to SEQ ID NO: 109226

SEQ ID NO: 473382 - RNA, 64 nt, Homo Sapiens; identical to SEQ ID NO: 109227

SEQ ID NO: 473383 - RNA, 64 nt, Homo Sapiens; identical to SEQ ID NO: 109228

SEQ ID NO: 473384 - RNA, 64 nt, Homo Sapiens; identical to SEQ ID NO: 109229

SEQ ID NO: 473385 - RNA, 64 nt, Homo Sapiens; identical to SEQ ID NO: 109230

SEQ ID NO: 473386 - RNA, 64 nt, Homo Sapiens; identical to SEQ ID NO: 109231

SEQ ID NO: 473387 - RNA, 64 nt, Homo Sapiens; identical to SEQ ID NO: 109232

SEQ ID NO: 473388 - RNA, 64 nt, Homo Sapiens; identical to SEQ ID NO: 109233

SEQ ID NO: 473389 - RNA, 64 nt, Homo Sapiens; identical to SEQ ID NO: 109234

SEQ ID NO: 473390 - RNA, 64 nt, Homo Sapiens; identical to SEQ ID NO: 311703

SEQ ID NO: 473391 - RNA, 64 nt, Homo Sapiens; identical to SEQ ID NO: 311704

SEQ ID NO: 473392 - RNA, 64 nt, Homo Sapiens; identical to SEQ ID NO: 311705

SEQ ID NO: 473393 - RNA, 64 nt, Homo Sapiens; identical to SEQ ID NO: 311706

SEQ ID NO: 473394 - RNA, 64 nt, Homo Sapiens; identical to SEQ ID NO: 311707

SEQ ID NO: 473395 - RNA, 64 nt, Homo Sapiens; identical to SEQ ID NO: 311708

SEQ ID NO: 473396 - RNA, 64 nt, Homo Sapiens; identical to SEQ ID NO: 311709

SEQ ID NO: 473397 - RNA, 64 nt, Homo Sapiens; identical to SEQ ID NO: 311710

SEQ ID NO: 473398 - RNA, 64 nt, Homo Sapiens; identical to SEQ ID NO: 311711

SEQ ID NO: 473399 - RNA, 64 nt, Homo Sapiens; identical to SEQ ID NO: 311712

SEQ ID NO: 473400 - RNA, 64 nt, Homo Sapiens; identical to SEQ ID NO: 311713

SEQ ID NO: 473401 - RNA, 64 nt, Homo Sapiens; identical to SEQ ID NO: 311714

SEQ ID NO: 473402 - RNA, 64 nt, Homo Sapiens; identical to SEQ ID NO: 311713

SEQ ID NO: 473403 - RNA, 64 nt, Homo Sapiens; identical to SEQ ID NO: 311714

SEQ ID NO: 473404 - RNA, 64 nt, Homo Sapiens; identical to SEQ ID NO: 51753

SEQ ID NO: 473405 - RNA, 64 nt, Homo Sapiens; identical to SEQ ID NO: 51754

SEQ ID NO: 473406 - RNA, 64 nt, Homo Sapiens; identical to SEQ ID NO: 51755

SEQ ID NO: 473407 - RNA, 64 nt, Homo Sapiens; identical to SEQ ID NO: 51756

SEQ ID NO: 473408 - RNA, 64 nt, Homo Sapiens; identical to SEQ ID NO: 51757

SEQ ID NO: 473409 - RNA, 64 nt, Homo Sapiens; identical to SEQ ID NO: 51758

SEQ ID NO: 473410 - RNA, 64 nt, Homo Sapiens; identical to SEQ ID NO: 51759

SEQ ID NO: 473411 - RNA, 64 nt, Homo Sapiens; identical to SEQ ID NO: 51760

SEQ ID NO: 473412 - RNA, 64 nt, Homo Sapiens; identical to SEQ ID NO: 51761

SEQ ID NO: 473413 - RNA, 64 nt, Homo Sapiens; identical to SEQ ID NO: 51762

SEQ ID NO: 473414 - RNA, 64 nt, Homo Sapiens; identical to SEQ ID NO: 51763

SEQ ID NO: 473415 - RNA, 64 nt, Homo Sapiens; identical to SEQ ID NO: 51764

SEQ ID NO: 473416 - RNA, 63 nt, Homo Sapiens
auuggcuugaauuccauggacguaagaaggaaugcgaguaagguuuguucaguucguauacuu

SEQ ID NO: 473417 - RNA, 63 nt, Homo Sapiens
gggaccacguugcugccugugaaugcugagugagcgaguaagggaggaggggcgauugagggu

SEQ ID NO: 473418 - RNA, 63 nt, Homo Sapiens
uauuauguuucuucuugucagggggcauugccggcgaguaaagacauuuguggcagugcugaa

SEQ ID NO: 473419 - RNA, 63 nt, Homo Sapiens
gcaggucacugagugacuuccccagggugcacagcgaguaacagaucaggacccaaacuuggg

SEQ ID NO: 473420 - RNA, 63 nt, Homo Sapiens
cgaugcugcacgggcccgcccugguggggcucggcgaguaauguguuuuguccccaguuaacc

SEQ ID NO: 473421 - RNA, 63 nt, Homo Sapiens
agcagguguaaugauguguuuugaccuuugcaggcgaguaaccaggcaauggaguggaguguc

SEQ ID NO: 473422 - RNA, 63 nt, Homo Sapiens
uauuaacugucuuucuaaagaacugaauguugugcgaguaauuaccugacucugugugucugc

SEQ ID NO: 473423 - RNA, 63 nt, Homo Sapiens
aaaauuucaaauagcauuuuagugggguggguggcgaguaagugagggcgaugaauuaagagu

SEQ ID NO: 473424 - RNA, 63 nt, Homo Sapiens
ucaacuucgggagggucuggccaaaccaccugagcgaguaaugaugcuucucauuuuauauuu

SEQ ID NO: 473425 - RNA, 63 nt, Homo Sapiens
uuugauguuugcuuauuucaguugcagaaacuggcgaguaaaaaagauuuugcauuuacuuaa

SEQ ID NO: 473426 - RNA, 63 nt, Homo Sapiens
ucugggccaggcugugugugcguggggccgggagcgaguaaaggcggcaguguuccuugugcc

SEQ ID NO: 473427 - RNA, 63 nt, Homo Sapiens
gggcagacagaugguggauggucuggacaagaagcgaguaagccacugcgguuggucauacug

SEQ ID NO: 473428 - RNA, 63 nt, Homo Sapiens
auguuuuagaucaguaacagcuaauaggaauaugcgaguaaauucagaauugaaacaauuucu

SEQ ID NO: 473429 - RNA, 63 nt, Homo Sapiens
uuuggaggggcuggggugggcagagagcaagaggcgaguaaagagaauggugguuucagagau

SEQ ID NO: 473430 - RNA, 64 nt, Homo Sapiens; identical to SEQ ID NO: 133159

SEQ ID NO: 473431 - RNA, 64 nt, Homo Sapiens; identical to SEQ ID NO: 133160

SEQ ID NO: 473432 - RNA, 64 nt, Homo Sapiens; identical to SEQ ID NO: 133161

SEQ ID NO: 473433 - RNA, 64 nt, Homo Sapiens; identical to SEQ ID NO: 133162

SEQ ID NO: 473434 - RNA, 64 nt, Homo Sapiens; identical to SEQ ID NO: 133163

SEQ ID NO: 473435 - RNA, 64 nt, Homo Sapiens; identical to SEQ ID NO: 133164

SEQ ID NO: 473436 - RNA, 64 nt, Homo Sapiens; identical to SEQ ID NO: 133165

SEQ ID NO: 473437 - RNA, 64 nt, Homo Sapiens; identical to SEQ ID NO: 133166

SEQ ID NO: 473438 - RNA, 64 nt, Homo Sapiens; identical to SEQ ID NO: 133167

SEQ ID NO: 473439 - RNA, 64 nt, Homo Sapiens; identical to SEQ ID NO: 133168

SEQ ID NO: 473440 - RNA, 64 nt, Homo Sapiens; identical to SEQ ID NO: 133169

SEQ ID NO: 473441 - RNA, 64 nt, Homo Sapiens; identical to SEQ ID NO: 133170

SEQ ID NO: 473442 - RNA, 64 nt, Homo Sapiens; identical to SEQ ID NO: 133171

SEQ ID NO: 473443 - RNA, 64 nt, Homo Sapiens; identical to SEQ ID NO: 133172

SEQ ID NO: 473444 - RNA, 64 nt, Homo Sapiens; identical to SEQ ID NO: 133173

SEQ ID NO: 473445 - RNA, 64 nt, Homo Sapiens; identical to SEQ ID NO: 133174

SEQ ID NO: 473446 - RNA, 64 nt, Homo Sapiens; identical to SEQ ID NO: 133175

SEQ ID NO: 473447 - RNA, 64 nt, Homo Sapiens; identical to SEQ ID NO: 133176

SEQ ID NO: 473448 - RNA, 64 nt, Homo Sapiens; identical to SEQ ID NO: 133177

SEQ ID NO: 473449 - RNA, 64 nt, Homo Sapiens; identical to SEQ ID NO: 133178

SEQ ID NO: 473450 - RNA, 64 nt, Homo Sapiens; identical to SEQ ID NO: 133179

SEQ ID NO: 473451 - RNA, 64 nt, Homo Sapiens; identical to SEQ ID NO: 133180

SEQ ID NO: 473452 - RNA, 64 nt, Homo Sapiens; identical to SEQ ID NO: 133181

SEQ ID NO: 473453 - RNA, 64 nt, Homo Sapiens; identical to SEQ ID NO: 133182

SEQ ID NO: 473454 - RNA, 64 nt, Homo Sapiens; identical to SEQ ID NO: 133183

SEQ ID NO: 473455 - RNA, 64 nt, Homo Sapiens; identical to SEQ ID NO: 133184

SEQ ID NO: 473456 - RNA, 64 nt, Homo Sapiens; identical to SEQ ID NO: 133185

SEQ ID NO: 473457 - RNA, 64 nt, Homo Sapiens; identical to SEQ ID NO: 133186

SEQ ID NO: 473458 - RNA, 64 nt, Homo Sapiens; identical to SEQ ID NO: 133187

SEQ ID NO: 473459 - RNA, 64 nt, Homo Sapiens; identical to SEQ ID NO: 133188

SEQ ID NO: 473460 - RNA, 64 nt, Homo Sapiens; identical to SEQ ID NO: 133189

SEQ ID NO: 473461 - RNA, 64 nt, Homo Sapiens; identical to SEQ ID NO: 133190

SEQ ID NO: 473462 - RNA, 64 nt, Homo Sapiens; identical to SEQ ID NO: 133191

SEQ ID NO: 473463 - RNA, 64 nt, Homo Sapiens; identical to SEQ ID NO: 133192

SEQ ID NO: 473464 - RNA, 64 nt, Homo Sapiens; identical to SEQ ID NO: 133193

SEQ ID NO: 473465 - RNA, 64 nt, Homo Sapiens; identical to SEQ ID NO: 133194

SEQ ID NO: 473466 - RNA, 64 nt, Homo Sapiens; identical to SEQ ID NO: 133195

SEQ ID NO: 473467 - RNA, 64 nt, Homo Sapiens; identical to SEQ ID NO: 133196

SEQ ID NO: 473468 - RNA, 64 nt, Homo Sapiens; identical to SEQ ID NO: 133197

SEQ ID NO: 473469 - RNA, 64 nt, Homo Sapiens; identical to SEQ ID NO: 133198

SEQ ID NO: 473470 - RNA, 64 nt, Homo Sapiens; identical to SEQ ID NO: 133199

SEQ ID NO: 473471 - RNA, 64 nt, Homo Sapiens; identical to SEQ ID NO: 133200

SEQ ID NO: 473472 - RNA, 64 nt, Homo Sapiens; identical to SEQ ID NO: 133201

SEQ ID NO: 473473 - RNA, 64 nt, Homo Sapiens; identical to SEQ ID NO: 133202

SEQ ID NO: 473474 - RNA, 64 nt, Homo Sapiens; identical to SEQ ID NO: 133203

SEQ ID NO: 473475 - RNA, 64 nt, Homo Sapiens; identical to SEQ ID NO: 137832

SEQ ID NO: 473476 - RNA, 64 nt, Homo Sapiens; identical to SEQ ID NO: 137833

SEQ ID NO: 473477 - RNA, 64 nt, Homo Sapiens; identical to SEQ ID NO: 137834

SEQ ID NO: 473478 - RNA, 64 nt, Homo Sapiens; identical to SEQ ID NO: 137835

SEQ ID NO: 473479 - RNA, 64 nt, Homo Sapiens; identical to SEQ ID NO: 137836

SEQ ID NO: 473480 - RNA, 64 nt, Homo Sapiens; identical to SEQ ID NO: 137837

SEQ ID NO: 473481 - RNA, 64 nt, Homo Sapiens; identical to SEQ ID NO: 137838

SEQ ID NO: 473482 - RNA, 64 nt, Homo Sapiens; identical to SEQ ID NO: 137839

SEQ ID NO: 473483 - RNA, 64 nt, Homo Sapiens; identical to SEQ ID NO: 137840

SEQ ID NO: 473484 - RNA, 64 nt, Homo Sapiens; identical to SEQ ID NO: 137841

SEQ ID NO: 473485 - RNA, 64 nt, Homo Sapiens; identical to SEQ ID NO: 137842

SEQ ID NO: 473486 - RNA, 64 nt, Homo Sapiens; identical to SEQ ID NO: 137843

SEQ ID NO: 473487 - RNA, 64 nt, Homo Sapiens; identical to SEQ ID NO: 137844

SEQ ID NO: 473488 - RNA, 64 nt, Homo Sapiens; identical to SEQ ID NO: 137845

SEQ ID NO: 473489 - RNA, 64 nt, Homo Sapiens; identical to SEQ ID NO: 137846

SEQ ID NO: 473490 - RNA, 64 nt, Homo Sapiens; identical to SEQ ID NO: 137847

SEQ ID NO: 473491 - RNA, 64 nt, Homo Sapiens; identical to SEQ ID NO: 137848

SEQ ID NO: 473492 - RNA, 64 nt, Homo Sapiens; identical to SEQ ID NO: 137849

SEQ ID NO: 473493 - RNA, 64 nt, Homo Sapiens; identical to SEQ ID NO: 137850

SEQ ID NO: 473494 - RNA, 64 nt, Homo Sapiens; identical to SEQ ID NO: 137851

SEQ ID NO: 473495 - RNA, 64 nt, Homo Sapiens; identical to SEQ ID NO: 137852

SEQ ID NO: 473496 - RNA, 64 nt, Homo Sapiens; identical to SEQ ID NO: 137853

SEQ ID NO: 473497 - RNA, 64 nt, Homo Sapiens; identical to SEQ ID NO: 137854

SEQ ID NO: 473498 - RNA, 64 nt, Homo Sapiens; identical to SEQ ID NO: 137855

SEQ ID NO: 473499 - RNA, 64 nt, Homo Sapiens; identical to SEQ ID NO: 137856

SEQ ID NO: 473500 - RNA, 64 nt, Homo Sapiens; identical to SEQ ID NO: 137857

SEQ ID NO: 473501 - RNA, 64 nt, Homo Sapiens; identical to SEQ ID NO: 137858

SEQ ID NO: 473502 - RNA, 64 nt, Homo Sapiens; identical to SEQ ID NO: 137859

SEQ ID NO: 473503 - RNA, 64 nt, Homo Sapiens; identical to SEQ ID NO: 137860

SEQ ID NO: 473504 - RNA, 64 nt, Homo Sapiens; identical to SEQ ID NO: 137861

SEQ ID NO: 473505 - RNA, 64 nt, Homo Sapiens; identical to SEQ ID NO: 137862

SEQ ID NO: 473506 - RNA, 64 nt, Homo Sapiens; identical to SEQ ID NO: 137863

SEQ ID NO: 473507 - RNA, 64 nt, Homo Sapiens; identical to SEQ ID NO: 137864

SEQ ID NO: 473508 - RNA, 64 nt, Homo Sapiens; identical to SEQ ID NO: 137865

SEQ ID NO: 473509 - RNA, 64 nt, Homo Sapiens; identical to SEQ ID NO: 137866

SEQ ID NO: 473510 - RNA, 64 nt, Homo Sapiens; identical to SEQ ID NO: 137867

SEQ ID NO: 473511 - RNA, 64 nt, Homo Sapiens; identical to SEQ ID NO: 137868

SEQ ID NO: 473512 - RNA, 64 nt, Homo Sapiens; identical to SEQ ID NO: 137869

SEQ ID NO: 473513 - RNA, 64 nt, Homo Sapiens; identical to SEQ ID NO: 137870

SEQ ID NO: 473514 - RNA, 64 nt, Homo Sapiens; identical to SEQ ID NO: 137871

SEQ ID NO: 473515 - RNA, 64 nt, Homo Sapiens; identical to SEQ ID NO: 137872

SEQ ID NO: 473516 - RNA, 64 nt, Homo Sapiens; identical to SEQ ID NO: 137873

SEQ ID NO: 473517 - RNA, 64 nt, Homo Sapiens; identical to SEQ ID NO: 137874

SEQ ID NO: 473518 - RNA, 64 nt, Homo Sapiens; identical to SEQ ID NO: 137875

SEQ ID NO: 473519 - RNA, 64 nt, Homo Sapiens; identical to SEQ ID NO: 137876

SEQ ID NO: 473520 - RNA, 64 nt, Homo Sapiens; identical to SEQ ID NO: 137877

SEQ ID NO: 473521 - RNA, 64 nt, Homo Sapiens; identical to SEQ ID NO: 137878

SEQ ID NO: 473522 - RNA, 64 nt, Homo Sapiens; identical to SEQ ID NO: 137879

SEQ ID NO: 473523 - RNA, 64 nt, Homo Sapiens; identical to SEQ ID NO: 137880

SEQ ID NO: 473524 - RNA, 64 nt, Homo Sapiens; identical to SEQ ID NO: 137881

SEQ ID NO: 473525 - RNA, 64 nt, Homo Sapiens; identical to SEQ ID NO: 137882

SEQ ID NO: 473526 - RNA, 64 nt, Homo Sapiens; identical to SEQ ID NO: 137883

SEQ ID NO: 473527 - RNA, 64 nt, Homo Sapiens; identical to SEQ ID NO: 137884

SEQ ID NO: 473528 - RNA, 64 nt, Homo Sapiens; identical to SEQ ID NO: 137885

SEQ ID NO: 473529 - RNA, 64 nt, Homo Sapiens; identical to SEQ ID NO: 137886

SEQ ID NO: 473530 - RNA, 64 nt, Homo Sapiens; identical to SEQ ID NO: 137887

SEQ ID NO: 473531 - RNA, 64 nt, Homo Sapiens; identical to SEQ ID NO: 137888

SEQ ID NO: 473532 - RNA, 64 nt, Homo Sapiens; identical to SEQ ID NO: 137889

SEQ ID NO: 473533 - RNA, 64 nt, Homo Sapiens; identical to SEQ ID NO: 137890

SEQ ID NO: 473534 - RNA, 64 nt, Homo Sapiens; identical to SEQ ID NO: 137891

SEQ ID NO: 473535 - RNA, 64 nt, Homo Sapiens; identical to SEQ ID NO: 137892

SEQ ID NO: 473536 - RNA, 64 nt, Homo Sapiens; identical to SEQ ID NO: 137893

SEQ ID NO: 473537 - RNA, 64 nt, Homo Sapiens; identical to SEQ ID NO: 137894

SEQ ID NO: 473538 - RNA, 64 nt, Homo Sapiens; identical to SEQ ID NO: 137895

SEQ ID NO: 473539 - RNA, 64 nt, Homo Sapiens; identical to SEQ ID NO: 137896

SEQ ID NO: 473540 - RNA, 64 nt, Homo Sapiens; identical to SEQ ID NO: 115977

SEQ ID NO: 473541 - RNA, 64 nt, Homo Sapiens; identical to SEQ ID NO: 115978

SEQ ID NO: 473542 - RNA, 64 nt, Homo Sapiens; identical to SEQ ID NO: 115979

SEQ ID NO: 473543 - RNA, 64 nt, Homo Sapiens; identical to SEQ ID NO: 115980

SEQ ID NO: 473544 - RNA, 64 nt, Homo Sapiens; identical to SEQ ID NO: 115981

SEQ ID NO: 473545 - RNA, 64 nt, Homo Sapiens; identical to SEQ ID NO: 115982

SEQ ID NO: 473546 - RNA, 64 nt, Homo Sapiens; identical to SEQ ID NO: 115983

SEQ ID NO: 473547 - RNA, 64 nt, Homo Sapiens; identical to SEQ ID NO: 115984

SEQ ID NO: 473548 - RNA, 64 nt, Homo Sapiens; identical to SEQ ID NO: 115985

SEQ ID NO: 473549 - RNA, 64 nt, Homo Sapiens; identical to SEQ ID NO: 115986

SEQ ID NO: 473550 - RNA, 64 nt, Homo Sapiens; identical to SEQ ID NO: 115987

SEQ ID NO: 473551 - RNA, 64 nt, Homo Sapiens; identical to SEQ ID NO: 115988

SEQ ID NO: 473552 - RNA, 64 nt, Homo Sapiens; identical to SEQ ID NO: 115989

SEQ ID NO: 473553 - RNA, 64 nt, Homo Sapiens; identical to SEQ ID NO: 115990

SEQ ID NO: 473554 - RNA, 64 nt, Homo Sapiens; identical to SEQ ID NO: 115991

SEQ ID NO: 473555 - RNA, 64 nt, Homo Sapiens; identical to SEQ ID NO: 115992

SEQ ID NO: 473556 - RNA, 64 nt, Homo Sapiens; identical to SEQ ID NO: 115993

SEQ ID NO: 473557 - RNA, 64 nt, Homo Sapiens; identical to SEQ ID NO: 115994

SEQ ID NO: 473558 - RNA, 64 nt, Homo Sapiens; identical to SEQ ID NO: 115995

SEQ ID NO: 473559 - RNA, 64 nt, Homo Sapiens; identical to SEQ ID NO: 115996

SEQ ID NO: 473560 - RNA, 64 nt, Homo Sapiens; identical to SEQ ID NO: 115997

SEQ ID NO: 473561 - RNA, 64 nt, Homo Sapiens; identical to SEQ ID NO: 115998

SEQ ID NO: 473562 - RNA, 64 nt, Homo Sapiens; identical to SEQ ID NO: 115999

SEQ ID NO: 473563 - RNA, 64 nt, Homo Sapiens; identical to SEQ ID NO: 116000

SEQ ID NO: 473564 - RNA, 64 nt, Homo Sapiens; identical to SEQ ID NO: 116001

SEQ ID NO: 473565 - RNA, 64 nt, Homo Sapiens; identical to SEQ ID NO: 116002

SEQ ID NO: 473566 - RNA, 64 nt, Homo Sapiens; identical to SEQ ID NO: 116003

SEQ ID NO: 473567 - RNA, 64 nt, Homo Sapiens; identical to SEQ ID NO: 116004

SEQ ID NO: 473568 - RNA, 64 nt, Homo Sapiens; identical to SEQ ID NO: 116005

SEQ ID NO: 473569 - RNA, 64 nt, Homo Sapiens; identical to SEQ ID NO: 116006

SEQ ID NO: 473570 - RNA, 64 nt, Homo Sapiens; identical to SEQ ID NO: 116007

SEQ ID NO: 473571 - RNA, 64 nt, Homo Sapiens; identical to SEQ ID NO: 116008

SEQ ID NO: 473572 - RNA, 64 nt, Homo Sapiens; identical to SEQ ID NO: 116009

SEQ ID NO: 473573 - RNA, 64 nt, Homo Sapiens; identical to SEQ ID NO: 116010

SEQ ID NO: 473574 - RNA, 64 nt, Homo Sapiens; identical to SEQ ID NO: 116011

SEQ ID NO: 473575 - RNA, 64 nt, Homo Sapiens; identical to SEQ ID NO: 116012

SEQ ID NO: 473576 - RNA, 64 nt, Homo Sapiens; identical to SEQ ID NO: 116013

SEQ ID NO: 473577 - RNA, 64 nt, Homo Sapiens; identical to SEQ ID NO: 116014

SEQ ID NO: 473578 - RNA, 64 nt, Homo Sapiens; identical to SEQ ID NO: 116015

SEQ ID NO: 473579 - RNA, 64 nt, Homo Sapiens; identical to SEQ ID NO: 116016

SEQ ID NO: 473580 - RNA, 64 nt, Homo Sapiens; identical to SEQ ID NO: 116017

SEQ ID NO: 473581 - RNA, 64 nt, Homo Sapiens; identical to SEQ ID NO: 116018

SEQ ID NO: 473582 - RNA, 64 nt, Homo Sapiens; identical to SEQ ID NO: 116019

SEQ ID NO: 473583 - RNA, 64 nt, Homo Sapiens; identical to SEQ ID NO: 116020

SEQ ID NO: 473584 - RNA, 64 nt, Homo Sapiens; identical to SEQ ID NO: 116021

SEQ ID NO: 473585 - RNA, 64 nt, Homo Sapiens; identical to SEQ ID NO: 116022

SEQ ID NO: 473586 - RNA, 64 nt, Homo Sapiens; identical to SEQ ID NO: 116023

SEQ ID NO: 473587 - RNA, 64 nt, Homo Sapiens; identical to SEQ ID NO: 116024

SEQ ID NO: 473588 - RNA, 64 nt, Homo Sapiens; identical to SEQ ID NO: 116025

SEQ ID NO: 473589 - RNA, 64 nt, Homo Sapiens; identical to SEQ ID NO: 116026

SEQ ID NO: 473590 - RNA, 64 nt, Homo Sapiens; identical to SEQ ID NO: 116027

SEQ ID NO: 473591 - RNA, 64 nt, Homo Sapiens; identical to SEQ ID NO: 116028

SEQ ID NO: 473592 - RNA, 64 nt, Homo Sapiens; identical to SEQ ID NO: 116029

SEQ ID NO: 473593 - RNA, 64 nt, Homo Sapiens; identical to SEQ ID NO: 116030

SEQ ID NO: 473594 - RNA, 64 nt, Homo Sapiens; identical to SEQ ID NO: 116031

SEQ ID NO: 473595 - RNA, 64 nt, Homo Sapiens; identical to SEQ ID NO: 116032

SEQ ID NO: 473596 - RNA, 64 nt, Homo Sapiens; identical to SEQ ID NO: 116033

SEQ ID NO: 473597 - RNA, 64 nt, Homo Sapiens; identical to SEQ ID NO: 116034

SEQ ID NO: 473598 - RNA, 64 nt, Homo Sapiens; identical to SEQ ID NO: 116035

SEQ ID NO: 473599 - RNA, 64 nt, Homo Sapiens; identical to SEQ ID NO: 116036

SEQ ID NO: 473600 - RNA, 64 nt, Homo Sapiens; identical to SEQ ID NO: 116037

SEQ ID NO: 473601 - RNA, 64 nt, Homo Sapiens; identical to SEQ ID NO: 116038

SEQ ID NO: 473602 - RNA, 64 nt, Homo Sapiens; identical to SEQ ID NO: 116039

SEQ ID NO: 473603 - RNA, 64 nt, Homo Sapiens; identical to SEQ ID NO: 116040

SEQ ID NO: 473604 - RNA, 64 nt, Homo Sapiens; identical to SEQ ID NO: 116041

SEQ ID NO: 473605 - RNA, 64 nt, Homo Sapiens; identical to SEQ ID NO: 116042

SEQ ID NO: 473606 - RNA, 64 nt, Homo Sapiens; identical to SEQ ID NO: 116043

SEQ ID NO: 473607 - RNA, 64 nt, Homo Sapiens; identical to SEQ ID NO: 116044

SEQ ID NO: 473608 - RNA, 64 nt, Homo Sapiens; identical to SEQ ID NO: 116045

SEQ ID NO: 473609 - RNA, 64 nt, Homo Sapiens; identical to SEQ ID NO: 116046

SEQ ID NO: 473610 - RNA, 64 nt, Homo Sapiens; identical to SEQ ID NO: 116047

SEQ ID NO: 473611 - RNA, 64 nt, Homo Sapiens; identical to SEQ ID NO: 116048

SEQ ID NO: 473612 - RNA, 64 nt, Homo Sapiens; identical to SEQ ID NO: 116049

SEQ ID NO: 473613 - RNA, 64 nt, Homo Sapiens; identical to SEQ ID NO: 116050

SEQ ID NO: 473614 - RNA, 64 nt, Homo Sapiens; identical to SEQ ID NO: 116051

SEQ ID NO: 473615 - RNA, 64 nt, Homo Sapiens; identical to SEQ ID NO: 116052

SEQ ID NO: 473616 - RNA, 64 nt, Homo Sapiens; identical to SEQ ID NO: 116053

SEQ ID NO: 473617 - RNA, 64 nt, Homo Sapiens; identical to SEQ ID NO: 116054

SEQ ID NO: 473618 - RNA, 64 nt, Homo Sapiens; identical to SEQ ID NO: 116055

SEQ ID NO: 473619 - RNA, 64 nt, Homo Sapiens; identical to SEQ ID NO: 116056

SEQ ID NO: 473620 - RNA, 64 nt, Homo Sapiens; identical to SEQ ID NO: 116057

SEQ ID NO: 473621 - RNA, 64 nt, Homo Sapiens; identical to SEQ ID NO: 116058

SEQ ID NO: 473622 - RNA, 64 nt, Homo Sapiens; identical to SEQ ID NO: 116059

SEQ ID NO: 473623 - RNA, 64 nt, Homo Sapiens; identical to SEQ ID NO: 116060

SEQ ID NO: 473624 - RNA, 64 nt, Homo Sapiens; identical to SEQ ID NO: 116061

SEQ ID NO: 473625 - RNA, 64 nt, Homo Sapiens; identical to SEQ ID NO: 116062

SEQ ID NO: 473626 - RNA, 64 nt, Homo Sapiens; identical to SEQ ID NO: 116063

SEQ ID NO: 473627 - RNA, 64 nt, Homo Sapiens; identical to SEQ ID NO: 116064

SEQ ID NO: 473628 - RNA, 64 nt, Homo Sapiens; identical to SEQ ID NO: 116065

SEQ ID NO: 473629 - RNA, 64 nt, Homo Sapiens; identical to SEQ ID NO: 116066

SEQ ID NO: 473630 - RNA, 64 nt, Homo Sapiens; identical to SEQ ID NO: 116067

SEQ ID NO: 473631 - RNA, 64 nt, Homo Sapiens; identical to SEQ ID NO: 116068

SEQ ID NO: 473632 - RNA, 64 nt, Homo Sapiens; identical to SEQ ID NO: 116069

SEQ ID NO: 473633 - RNA, 64 nt, Homo Sapiens; identical to SEQ ID NO: 116070

SEQ ID NO: 473634 - RNA, 64 nt, Homo Sapiens; identical to SEQ ID NO: 116071

SEQ ID NO: 473635 - RNA, 64 nt, Homo Sapiens; identical to SEQ ID NO: 116072

SEQ ID NO: 473636 - RNA, 64 nt, Homo Sapiens; identical to SEQ ID NO: 116073

SEQ ID NO: 473637 - RNA, 64 nt, Homo Sapiens; identical to SEQ ID NO: 116074

SEQ ID NO: 473638 - RNA, 64 nt, Homo Sapiens; identical to SEQ ID NO: 116075

SEQ ID NO: 473639 - RNA, 64 nt, Homo Sapiens; identical to SEQ ID NO: 116076

SEQ ID NO: 473640 - RNA, 64 nt, Homo Sapiens; identical to SEQ ID NO: 116077

SEQ ID NO: 473641 - RNA, 64 nt, Homo Sapiens; identical to SEQ ID NO: 116078

SEQ ID NO: 473642 - RNA, 64 nt, Homo Sapiens; identical to SEQ ID NO: 116079

SEQ ID NO: 473643 - RNA, 64 nt, Homo Sapiens; identical to SEQ ID NO: 116080

SEQ ID NO: 473644 - RNA, 64 nt, Homo Sapiens; identical to SEQ ID NO: 116081

SEQ ID NO: 473645 - RNA, 64 nt, Homo Sapiens; identical to SEQ ID NO: 116082

SEQ ID NO: 473646 - RNA, 64 nt, Homo Sapiens; identical to SEQ ID NO: 116083

SEQ ID NO: 473647 - RNA, 64 nt, Homo Sapiens; identical to SEQ ID NO: 116084

SEQ ID NO: 473648 - RNA, 64 nt, Homo Sapiens; identical to SEQ ID NO: 116085

SEQ ID NO: 473649 - RNA, 64 nt, Homo Sapiens; identical to SEQ ID NO: 116086

SEQ ID NO: 473650 - RNA, 64 nt, Homo Sapiens; identical to SEQ ID NO: 116087

SEQ ID NO: 473651 - RNA, 64 nt, Homo Sapiens; identical to SEQ ID NO: 116088

SEQ ID NO: 473652 - RNA, 64 nt, Homo Sapiens; identical to SEQ ID NO: 116089

SEQ ID NO: 473653 - RNA, 64 nt, Homo Sapiens; identical to SEQ ID NO: 116090

SEQ ID NO: 473654 - RNA, 64 nt, Homo Sapiens; identical to SEQ ID NO: 116091

SEQ ID NO: 473655 - RNA, 64 nt, Homo Sapiens; identical to SEQ ID NO: 116092

SEQ ID NO: 473656 - RNA, 64 nt, Homo Sapiens; identical to SEQ ID NO: 116093

SEQ ID NO: 473657 - RNA, 64 nt, Homo Sapiens; identical to SEQ ID NO: 116094

SEQ ID NO: 473658 - RNA, 64 nt, Homo Sapiens; identical to SEQ ID NO: 116095

SEQ ID NO: 473659 - RNA, 64 nt, Homo Sapiens; identical to SEQ ID NO: 116096

SEQ ID NO: 473660 - RNA, 64 nt, Homo Sapiens; identical to SEQ ID NO: 116097

SEQ ID NO: 473661 - RNA, 64 nt, Homo Sapiens; identical to SEQ ID NO: 116098

SEQ ID NO: 473662 - RNA, 64 nt, Homo Sapiens; identical to SEQ ID NO: 116099

SEQ ID NO: 473663 - RNA, 64 nt, Homo Sapiens; identical to SEQ ID NO: 116100

SEQ ID NO: 473664 - RNA, 64 nt, Homo Sapiens; identical to SEQ ID NO: 116101

SEQ ID NO: 473665 - RNA, 64 nt, Homo Sapiens; identical to SEQ ID NO: 116102

SEQ ID NO: 473666 - RNA, 64 nt, Homo Sapiens; identical to SEQ ID NO: 116103

SEQ ID NO: 473667 - RNA, 64 nt, Homo Sapiens; identical to SEQ ID NO: 116104

SEQ ID NO: 473668 - RNA, 64 nt, Homo Sapiens; identical to SEQ ID NO: 116105

SEQ ID NO: 473669 - RNA, 64 nt, Homo Sapiens; identical to SEQ ID NO: 116106

SEQ ID NO: 473670 - RNA, 64 nt, Homo Sapiens; identical to SEQ ID NO: 116107

SEQ ID NO: 473671 - RNA, 64 nt, Homo Sapiens; identical to SEQ ID NO: 116108

SEQ ID NO: 473672 - RNA, 64 nt, Homo Sapiens; identical to SEQ ID NO: 116109

SEQ ID NO: 473673 - RNA, 64 nt, Homo Sapiens; identical to SEQ ID NO: 116110

SEQ ID NO: 473674 - RNA, 64 nt, Homo Sapiens; identical to SEQ ID NO: 116111

SEQ ID NO: 473675 - RNA, 64 nt, Homo Sapiens; identical to SEQ ID NO: 116112

SEQ ID NO: 473676 - RNA, 64 nt, Homo Sapiens; identical to SEQ ID NO: 116113

SEQ ID NO: 473677 - RNA, 64 nt, Homo Sapiens; identical to SEQ ID NO: 116114

SEQ ID NO: 473678 - RNA, 64 nt, Homo Sapiens; identical to SEQ ID NO: 116115

SEQ ID NO: 473679 - RNA, 64 nt, Homo Sapiens; identical to SEQ ID NO: 116116

SEQ ID NO: 473680 - RNA, 64 nt, Homo Sapiens; identical to SEQ ID NO: 116117

SEQ ID NO: 473681 - RNA, 64 nt, Homo Sapiens; identical to SEQ ID NO: 116118

SEQ ID NO: 473682 - RNA, 64 nt, Homo Sapiens; identical to SEQ ID NO: 116119

SEQ ID NO: 473683 - RNA, 64 nt, Homo Sapiens; identical to SEQ ID NO: 116120

SEQ ID NO: 473684 - RNA, 64 nt, Homo Sapiens; identical to SEQ ID NO: 116121

SEQ ID NO: 473685 - RNA, 64 nt, Homo Sapiens; identical to SEQ ID NO: 116122

SEQ ID NO: 473686 - RNA, 64 nt, Homo Sapiens; identical to SEQ ID NO: 116123

SEQ ID NO: 473687 - RNA, 64 nt, Homo Sapiens; identical to SEQ ID NO: 116124

SEQ ID NO: 473688 - RNA, 64 nt, Homo Sapiens; identical to SEQ ID NO: 116125

SEQ ID NO: 473689 - RNA, 64 nt, Homo Sapiens; identical to SEQ ID NO: 116126

SEQ ID NO: 473690 - RNA, 64 nt, Homo Sapiens; identical to SEQ ID NO: 116127

SEQ ID NO: 473691 - RNA, 64 nt, Homo Sapiens; identical to SEQ ID NO: 116128

SEQ ID NO: 473692 - RNA, 64 nt, Homo Sapiens; identical to SEQ ID NO: 116129

SEQ ID NO: 473693 - RNA, 64 nt, Homo Sapiens; identical to SEQ ID NO: 116130

SEQ ID NO: 473694 - RNA, 64 nt, Homo Sapiens; identical to SEQ ID NO: 116131

SEQ ID NO: 473695 - RNA, 64 nt, Homo Sapiens; identical to SEQ ID NO: 116132

SEQ ID NO: 473696 - RNA, 64 nt, Homo Sapiens; identical to SEQ ID NO: 116133

SEQ ID NO: 473697 - RNA, 64 nt, Homo Sapiens; identical to SEQ ID NO: 116134

SEQ ID NO: 473698 - RNA, 64 nt, Homo Sapiens; identical to SEQ ID NO: 116135

SEQ ID NO: 473699 - RNA, 64 nt, Homo Sapiens; identical to SEQ ID NO: 116136

SEQ ID NO: 473700 - RNA, 64 nt, Homo Sapiens; identical to SEQ ID NO: 116137

SEQ ID NO: 473701 - RNA, 64 nt, Homo Sapiens; identical to SEQ ID NO: 116138

SEQ ID NO: 473702 - RNA, 64 nt, Homo Sapiens; identical to SEQ ID NO: 116139

SEQ ID NO: 473703 - RNA, 64 nt, Homo Sapiens; identical to SEQ ID NO: 116140

SEQ ID NO: 473704 - RNA, 64 nt, Homo Sapiens; identical to SEQ ID NO: 116141

SEQ ID NO: 473705 - RNA, 64 nt, Homo Sapiens; identical to SEQ ID NO: 116142

SEQ ID NO: 473706 - RNA, 64 nt, Homo Sapiens; identical to SEQ ID NO: 116143

SEQ ID NO: 473707 - RNA, 64 nt, Homo Sapiens; identical to SEQ ID NO: 116144

SEQ ID NO: 473708 - RNA, 64 nt, Homo Sapiens; identical to SEQ ID NO: 116145

SEQ ID NO: 473709 - RNA, 64 nt, Homo Sapiens; identical to SEQ ID NO: 116146

SEQ ID NO: 473710 - RNA, 64 nt, Homo Sapiens; identical to SEQ ID NO: 116147

SEQ ID NO: 473711 - RNA, 64 nt, Homo Sapiens; identical to SEQ ID NO: 116148

SEQ ID NO: 473712 - RNA, 64 nt, Homo Sapiens; identical to SEQ ID NO: 116149

SEQ ID NO: 473713 - RNA, 64 nt, Homo Sapiens; identical to SEQ ID NO: 116150

SEQ ID NO: 473714 - RNA, 64 nt, Homo Sapiens; identical to SEQ ID NO: 116151

SEQ ID NO: 473715 - RNA, 64 nt, Homo Sapiens; identical to SEQ ID NO: 116152

SEQ ID NO: 473716 - RNA, 64 nt, Homo Sapiens; identical to SEQ ID NO: 116153

SEQ ID NO: 473717 - RNA, 64 nt, Homo Sapiens; identical to SEQ ID NO: 116154

SEQ ID NO: 473718 - RNA, 64 nt, Homo Sapiens; identical to SEQ ID NO: 116155

SEQ ID NO: 473719 - RNA, 64 nt, Homo Sapiens; identical to SEQ ID NO: 116156

SEQ ID NO: 473720 - RNA, 64 nt, Homo Sapiens; identical to SEQ ID NO: 116157

SEQ ID NO: 473721 - RNA, 64 nt, Homo Sapiens; identical to SEQ ID NO: 116158

SEQ ID NO: 473722 - RNA, 64 nt, Homo Sapiens; identical to SEQ ID NO: 116159

SEQ ID NO: 473723 - RNA, 64 nt, Homo Sapiens; identical to SEQ ID NO: 116160

SEQ ID NO: 473724 - RNA, 64 nt, Homo Sapiens; identical to SEQ ID NO: 116161

SEQ ID NO: 473725 - RNA, 64 nt, Homo Sapiens; identical to SEQ ID NO: 116162

SEQ ID NO: 473726 - RNA, 64 nt, Homo Sapiens; identical to SEQ ID NO: 116163

SEQ ID NO: 473727 - RNA, 64 nt, Homo Sapiens; identical to SEQ ID NO: 116164

SEQ ID NO: 473728 - RNA, 64 nt, Homo Sapiens; identical to SEQ ID NO: 116165

SEQ ID NO: 473729 - RNA, 64 nt, Homo Sapiens; identical to SEQ ID NO: 116166

SEQ ID NO: 473730 - RNA, 64 nt, Homo Sapiens; identical to SEQ ID NO: 116167

SEQ ID NO: 473731 - RNA, 64 nt, Homo Sapiens; identical to SEQ ID NO: 116168

SEQ ID NO: 473732 - RNA, 64 nt, Homo Sapiens; identical to SEQ ID NO: 116169

SEQ ID NO: 473733 - RNA, 64 nt, Homo Sapiens; identical to SEQ ID NO: 116170

SEQ ID NO: 473734 - RNA, 64 nt, Homo Sapiens; identical to SEQ ID NO: 116171

SEQ ID NO: 473735 - RNA, 64 nt, Homo Sapiens; identical to SEQ ID NO: 116172

SEQ ID NO: 473736 - RNA, 64 nt, Homo Sapiens; identical to SEQ ID NO: 116173

SEQ ID NO: 473737 - RNA, 64 nt, Homo Sapiens; identical to SEQ ID NO: 116174

SEQ ID NO: 473738 - RNA, 64 nt, Homo Sapiens; identical to SEQ ID NO: 116175

SEQ ID NO: 473739 - RNA, 64 nt, Homo Sapiens; identical to SEQ ID NO: 116176

SEQ ID NO: 473740 - RNA, 64 nt, Homo Sapiens; identical to SEQ ID NO: 116177

SEQ ID NO: 473741 - RNA, 64 nt, Homo Sapiens; identical to SEQ ID NO: 116178

SEQ ID NO: 473742 - RNA, 64 nt, Homo Sapiens; identical to SEQ ID NO: 116179

SEQ ID NO: 473743 - RNA, 64 nt, Homo Sapiens; identical to SEQ ID NO: 116180

SEQ ID NO: 473744 - RNA, 64 nt, Homo Sapiens; identical to SEQ ID NO: 116181

SEQ ID NO: 473745 - RNA, 64 nt, Homo Sapiens; identical to SEQ ID NO: 116182

SEQ ID NO: 473746 - RNA, 64 nt, Homo Sapiens; identical to SEQ ID NO: 116183

SEQ ID NO: 473747 - RNA, 64 nt, Homo Sapiens; identical to SEQ ID NO: 116184

SEQ ID NO: 473748 - RNA, 64 nt, Homo Sapiens; identical to SEQ ID NO: 116185

SEQ ID NO: 473749 - RNA, 64 nt, Homo Sapiens; identical to SEQ ID NO: 116186

SEQ ID NO: 473750 - RNA, 64 nt, Homo Sapiens; identical to SEQ ID NO: 116187

SEQ ID NO: 473751 - RNA, 64 nt, Homo Sapiens; identical to SEQ ID NO: 116188

SEQ ID NO: 473752 - RNA, 64 nt, Homo Sapiens; identical to SEQ ID NO: 116189

SEQ ID NO: 473753 - RNA, 64 nt, Homo Sapiens; identical to SEQ ID NO: 116190

SEQ ID NO: 473754 - RNA, 64 nt, Homo Sapiens; identical to SEQ ID NO: 116191

SEQ ID NO: 473755 - RNA, 64 nt, Homo Sapiens; identical to SEQ ID NO: 116192

SEQ ID NO: 473756 - RNA, 64 nt, Homo Sapiens; identical to SEQ ID NO: 116193

SEQ ID NO: 473757 - RNA, 64 nt, Homo Sapiens; identical to SEQ ID NO: 116194

SEQ ID NO: 473758 - RNA, 64 nt, Homo Sapiens; identical to SEQ ID NO: 116195

SEQ ID NO: 473759 - RNA, 64 nt, Homo Sapiens; identical to SEQ ID NO: 116196

SEQ ID NO: 473760 - RNA, 64 nt, Homo Sapiens; identical to SEQ ID NO: 116197

SEQ ID NO: 473761 - RNA, 64 nt, Homo Sapiens; identical to SEQ ID NO: 116198

SEQ ID NO: 473762 - RNA, 64 nt, Homo Sapiens; identical to SEQ ID NO: 116199

SEQ ID NO: 473763 - RNA, 64 nt, Homo Sapiens; identical to SEQ ID NO: 116200

SEQ ID NO: 473764 - RNA, 64 nt, Homo Sapiens; identical to SEQ ID NO: 116201

SEQ ID NO: 473765 - RNA, 64 nt, Homo Sapiens; identical to SEQ ID NO: 116202

SEQ ID NO: 473766 - RNA, 64 nt, Homo Sapiens; identical to SEQ ID NO: 116203

SEQ ID NO: 473767 - RNA, 64 nt, Homo Sapiens; identical to SEQ ID NO: 116204

SEQ ID NO: 473768 - RNA, 64 nt, Homo Sapiens; identical to SEQ ID NO: 116205

SEQ ID NO: 473769 - RNA, 64 nt, Homo Sapiens; identical to SEQ ID NO: 116206

SEQ ID NO: 473770 - RNA, 64 nt, Homo Sapiens; identical to SEQ ID NO: 116207

SEQ ID NO: 473771 - RNA, 64 nt, Homo Sapiens; identical to SEQ ID NO: 116208

SEQ ID NO: 473772 - RNA, 64 nt, Homo Sapiens; identical to SEQ ID NO: 116209

SEQ ID NO: 473773 - RNA, 64 nt, Homo Sapiens; identical to SEQ ID NO: 116210

SEQ ID NO: 473774 - RNA, 64 nt, Homo Sapiens; identical to SEQ ID NO: 116211

SEQ ID NO: 473775 - RNA, 64 nt, Homo Sapiens; identical to SEQ ID NO: 116212

SEQ ID NO: 473776 - RNA, 64 nt, Homo Sapiens; identical to SEQ ID NO: 116213

SEQ ID NO: 473777 - RNA, 64 nt, Homo Sapiens; identical to SEQ ID NO: 116214

SEQ ID NO: 473778 - RNA, 64 nt, Homo Sapiens; identical to SEQ ID NO: 116215

SEQ ID NO: 473779 - RNA, 64 nt, Homo Sapiens; identical to SEQ ID NO: 116216

SEQ ID NO: 473780 - RNA, 64 nt, Homo Sapiens; identical to SEQ ID NO: 116217

SEQ ID NO: 473781 - RNA, 64 nt, Homo Sapiens; identical to SEQ ID NO: 116218

SEQ ID NO: 473782 - RNA, 64 nt, Homo Sapiens; identical to SEQ ID NO: 116219

SEQ ID NO: 473783 - RNA, 64 nt, Homo Sapiens; identical to SEQ ID NO: 116220

SEQ ID NO: 473784 - RNA, 64 nt, Homo Sapiens; identical to SEQ ID NO: 116221

SEQ ID NO: 473785 - RNA, 64 nt, Homo Sapiens; identical to SEQ ID NO: 116222

SEQ ID NO: 473786 - RNA, 64 nt, Homo Sapiens; identical to SEQ ID NO: 116223

SEQ ID NO: 473787 - RNA, 64 nt, Homo Sapiens; identical to SEQ ID NO: 116224

SEQ ID NO: 473788 - RNA, 64 nt, Homo Sapiens; identical to SEQ ID NO: 116225

SEQ ID NO: 473789 - RNA, 64 nt, Homo Sapiens; identical to SEQ ID NO: 116226

SEQ ID NO: 473790 - RNA, 64 nt, Homo Sapiens; identical to SEQ ID NO: 116227

SEQ ID NO: 473791 - RNA, 64 nt, Homo Sapiens; identical to SEQ ID NO: 116228

SEQ ID NO: 473792 - RNA, 64 nt, Homo Sapiens; identical to SEQ ID NO: 116229

SEQ ID NO: 473793 - RNA, 64 nt, Homo Sapiens; identical to SEQ ID NO: 116230

SEQ ID NO: 473794 - RNA, 64 nt, Homo Sapiens; identical to SEQ ID NO: 116231

SEQ ID NO: 473795 - RNA, 64 nt, Homo Sapiens; identical to SEQ ID NO: 116232

SEQ ID NO: 473796 - RNA, 64 nt, Homo Sapiens; identical to SEQ ID NO: 116233

SEQ ID NO: 473797 - RNA, 64 nt, Homo Sapiens; identical to SEQ ID NO: 116234

SEQ ID NO: 473798 - RNA, 64 nt, Homo Sapiens; identical to SEQ ID NO: 116235

SEQ ID NO: 473799 - RNA, 64 nt, Homo Sapiens; identical to SEQ ID NO: 116236

SEQ ID NO: 473800 - RNA, 64 nt, Homo Sapiens; identical to SEQ ID NO: 116237

SEQ ID NO: 473801 - RNA, 64 nt, Homo Sapiens; identical to SEQ ID NO: 116238

SEQ ID NO: 473802 - RNA, 64 nt, Homo Sapiens; identical to SEQ ID NO: 116239

SEQ ID NO: 473803 - RNA, 64 nt, Homo Sapiens; identical to SEQ ID NO: 116240

SEQ ID NO: 473804 - RNA, 64 nt, Homo Sapiens; identical to SEQ ID NO: 116241

SEQ ID NO: 473805 - RNA, 64 nt, Homo Sapiens; identical to SEQ ID NO: 116242

SEQ ID NO: 473806 - RNA, 64 nt, Homo Sapiens; identical to SEQ ID NO: 116243

SEQ ID NO: 473807 - RNA, 64 nt, Homo Sapiens; identical to SEQ ID NO: 116244

SEQ ID NO: 473808 - RNA, 64 nt, Homo Sapiens; identical to SEQ ID NO: 116245

SEQ ID NO: 473809 - RNA, 64 nt, Homo Sapiens; identical to SEQ ID NO: 116246

SEQ ID NO: 473810 - RNA, 64 nt, Homo Sapiens; identical to SEQ ID NO: 116247

SEQ ID NO: 473811 - RNA, 64 nt, Homo Sapiens; identical to SEQ ID NO: 116248

SEQ ID NO: 473812 - RNA, 64 nt, Homo Sapiens; identical to SEQ ID NO: 116249

SEQ ID NO: 473813 - RNA, 64 nt, Homo Sapiens; identical to SEQ ID NO: 116250

SEQ ID NO: 473814 - RNA, 64 nt, Homo Sapiens; identical to SEQ ID NO: 116251

SEQ ID NO: 473815 - RNA, 64 nt, Homo Sapiens; identical to SEQ ID NO: 116252

SEQ ID NO: 473816 - RNA, 64 nt, Homo Sapiens; identical to SEQ ID NO: 116253

SEQ ID NO: 473817 - RNA, 64 nt, Homo Sapiens; identical to SEQ ID NO: 116254

SEQ ID NO: 473818 - RNA, 64 nt, Homo Sapiens; identical to SEQ ID NO: 116255

SEQ ID NO: 473819 - RNA, 64 nt, Homo Sapiens; identical to SEQ ID NO: 116256

SEQ ID NO: 473820 - RNA, 64 nt, Homo Sapiens; identical to SEQ ID NO: 116257

SEQ ID NO: 473821 - RNA, 64 nt, Homo Sapiens; identical to SEQ ID NO: 116258

SEQ ID NO: 473822 - RNA, 64 nt, Homo Sapiens; identical to SEQ ID NO: 116259

SEQ ID NO: 473823 - RNA, 64 nt, Homo Sapiens; identical to SEQ ID NO: 116260

SEQ ID NO: 473824 - RNA, 64 nt, Homo Sapiens; identical to SEQ ID NO: 116261

SEQ ID NO: 473825 - RNA, 64 nt, Homo Sapiens; identical to SEQ ID NO: 116262

SEQ ID NO: 473826 - RNA, 64 nt, Homo Sapiens; identical to SEQ ID NO: 116263

SEQ ID NO: 473827 - RNA, 64 nt, Homo Sapiens; identical to SEQ ID NO: 116264

SEQ ID NO: 473828 - RNA, 64 nt, Homo Sapiens; identical to SEQ ID NO: 116265

SEQ ID NO: 473829 - RNA, 64 nt, Homo Sapiens; identical to SEQ ID NO: 116266

SEQ ID NO: 473830 - RNA, 64 nt, Homo Sapiens; identical to SEQ ID NO: 116267

SEQ ID NO: 473831 - RNA, 64 nt, Homo Sapiens; identical to SEQ ID NO: 116268

SEQ ID NO: 473832 - RNA, 64 nt, Homo Sapiens; identical to SEQ ID NO: 116269

SEQ ID NO: 473833 - RNA, 64 nt, Homo Sapiens; identical to SEQ ID NO: 116270

SEQ ID NO: 473834 - RNA, 64 nt, Homo Sapiens; identical to SEQ ID NO: 116271

SEQ ID NO: 473835 - RNA, 64 nt, Homo Sapiens; identical to SEQ ID NO: 116272

SEQ ID NO: 473836 - RNA, 64 nt, Homo Sapiens; identical to SEQ ID NO: 116273

SEQ ID NO: 473837 - RNA, 64 nt, Homo Sapiens; identical to SEQ ID NO: 116274

SEQ ID NO: 473838 - RNA, 64 nt, Homo Sapiens; identical to SEQ ID NO: 116275

SEQ ID NO: 473839 - RNA, 64 nt, Homo Sapiens; identical to SEQ ID NO: 116276

SEQ ID NO: 473840 - RNA, 64 nt, Homo Sapiens; identical to SEQ ID NO: 116277

SEQ ID NO: 473841 - RNA, 64 nt, Homo Sapiens; identical to SEQ ID NO: 116278

SEQ ID NO: 473842 - RNA, 64 nt, Homo Sapiens; identical to SEQ ID NO: 116279

SEQ ID NO: 473843 - RNA, 64 nt, Homo Sapiens; identical to SEQ ID NO: 116280

SEQ ID NO: 473844 - RNA, 64 nt, Homo Sapiens; identical to SEQ ID NO: 116281

SEQ ID NO: 473845 - RNA, 64 nt, Homo Sapiens; identical to SEQ ID NO: 116282

SEQ ID NO: 473846 - RNA, 64 nt, Homo Sapiens; identical to SEQ ID NO: 116283

SEQ ID NO: 473847 - RNA, 64 nt, Homo Sapiens; identical to SEQ ID NO: 116284

SEQ ID NO: 473848 - RNA, 64 nt, Homo Sapiens; identical to SEQ ID NO: 116285

SEQ ID NO: 473849 - RNA, 64 nt, Homo Sapiens; identical to SEQ ID NO: 116286

SEQ ID NO: 473850 - RNA, 64 nt, Homo Sapiens; identical to SEQ ID NO: 116287

SEQ ID NO: 473851 - RNA, 64 nt, Homo Sapiens; identical to SEQ ID NO: 116288

SEQ ID NO: 473852 - RNA, 64 nt, Homo Sapiens; identical to SEQ ID NO: 116289

SEQ ID NO: 473853 - RNA, 64 nt, Homo Sapiens; identical to SEQ ID NO: 116290

SEQ ID NO: 473854 - RNA, 64 nt, Homo Sapiens; identical to SEQ ID NO: 116291

SEQ ID NO: 473855 - RNA, 64 nt, Homo Sapiens; identical to SEQ ID NO: 116292

SEQ ID NO: 473856 - RNA, 64 nt, Homo Sapiens; identical to SEQ ID NO: 116293

SEQ ID NO: 473857 - RNA, 64 nt, Homo Sapiens; identical to SEQ ID NO: 116294

SEQ ID NO: 473858 - RNA, 64 nt, Homo Sapiens; identical to SEQ ID NO: 116295

SEQ ID NO: 473859 - RNA, 64 nt, Homo Sapiens; identical to SEQ ID NO: 116296

SEQ ID NO: 473860 - RNA, 64 nt, Homo Sapiens; identical to SEQ ID NO: 116297

SEQ ID NO: 473861 - RNA, 64 nt, Homo Sapiens; identical to SEQ ID NO: 116298

SEQ ID NO: 473862 - RNA, 64 nt, Homo Sapiens; identical to SEQ ID NO: 116299

SEQ ID NO: 473863 - RNA, 64 nt, Homo Sapiens; identical to SEQ ID NO: 116300

SEQ ID NO: 473864 - RNA, 64 nt, Homo Sapiens; identical to SEQ ID NO: 116301

SEQ ID NO: 473865 - RNA, 64 nt, Homo Sapiens; identical to SEQ ID NO: 116302

SEQ ID NO: 473866 - RNA, 64 nt, Homo Sapiens; identical to SEQ ID NO: 116303

SEQ ID NO: 473867 - RNA, 64 nt, Homo Sapiens; identical to SEQ ID NO: 116304

SEQ ID NO: 473868 - RNA, 64 nt, Homo Sapiens; identical to SEQ ID NO: 116305

SEQ ID NO: 473869 - RNA, 64 nt, Homo Sapiens; identical to SEQ ID NO: 116306

SEQ ID NO: 473870 - RNA, 64 nt, Homo Sapiens; identical to SEQ ID NO: 116307

SEQ ID NO: 473871 - RNA, 64 nt, Homo Sapiens; identical to SEQ ID NO: 116308

SEQ ID NO: 473872 - RNA, 64 nt, Homo Sapiens; identical to SEQ ID NO: 116309

SEQ ID NO: 473873 - RNA, 64 nt, Homo Sapiens; identical to SEQ ID NO: 116310

SEQ ID NO: 473874 - RNA, 64 nt, Homo Sapiens; identical to SEQ ID NO: 116311

SEQ ID NO: 473875 - RNA, 64 nt, Homo Sapiens; identical to SEQ ID NO: 116312

SEQ ID NO: 473876 - RNA, 64 nt, Homo Sapiens; identical to SEQ ID NO: 116313

SEQ ID NO: 473877 - RNA, 64 nt, Homo Sapiens; identical to SEQ ID NO: 116314

SEQ ID NO: 473878 - RNA, 64 nt, Homo Sapiens; identical to SEQ ID NO: 116315

SEQ ID NO: 473879 - RNA, 64 nt, Homo Sapiens; identical to SEQ ID NO: 116316

SEQ ID NO: 473880 - RNA, 64 nt, Homo Sapiens; identical to SEQ ID NO: 116317

SEQ ID NO: 473881 - RNA, 64 nt, Homo Sapiens; identical to SEQ ID NO: 116318

SEQ ID NO: 473882 - RNA, 64 nt, Homo Sapiens; identical to SEQ ID NO: 116319

SEQ ID NO: 473883 - RNA, 64 nt, Homo Sapiens; identical to SEQ ID NO: 116320

SEQ ID NO: 473884 - RNA, 64 nt, Homo Sapiens; identical to SEQ ID NO: 116321

SEQ ID NO: 473885 - RNA, 64 nt, Homo Sapiens; identical to SEQ ID NO: 116322

SEQ ID NO: 473886 - RNA, 64 nt, Homo Sapiens; identical to SEQ ID NO: 116323

SEQ ID NO: 473887 - RNA, 64 nt, Homo Sapiens; identical to SEQ ID NO: 116324

SEQ ID NO: 473888 - RNA, 64 nt, Homo Sapiens; identical to SEQ ID NO: 116325

SEQ ID NO: 473889 - RNA, 64 nt, Homo Sapiens; identical to SEQ ID NO: 116326

SEQ ID NO: 473890 - RNA, 64 nt, Homo Sapiens; identical to SEQ ID NO: 116327

SEQ ID NO: 473891 - RNA, 64 nt, Homo Sapiens; identical to SEQ ID NO: 116328

SEQ ID NO: 473892 - RNA, 64 nt, Homo Sapiens; identical to SEQ ID NO: 116329

SEQ ID NO: 473893 - RNA, 64 nt, Homo Sapiens; identical to SEQ ID NO: 116330

SEQ ID NO: 473894 - RNA, 64 nt, Homo Sapiens; identical to SEQ ID NO: 116331

SEQ ID NO: 473895 - RNA, 64 nt, Homo Sapiens; identical to SEQ ID NO: 116332

SEQ ID NO: 473896 - RNA, 64 nt, Homo Sapiens; identical to SEQ ID NO: 116333

SEQ ID NO: 473897 - RNA, 64 nt, Homo Sapiens; identical to SEQ ID NO: 116334

SEQ ID NO: 473898 - RNA, 64 nt, Homo Sapiens; identical to SEQ ID NO: 116335

SEQ ID NO: 473899 - RNA, 64 nt, Homo Sapiens; identical to SEQ ID NO: 116336

SEQ ID NO: 473900 - RNA, 64 nt, Homo Sapiens; identical to SEQ ID NO: 116337

SEQ ID NO: 473901 - RNA, 64 nt, Homo Sapiens; identical to SEQ ID NO: 116338

SEQ ID NO: 473902 - RNA, 64 nt, Homo Sapiens; identical to SEQ ID NO: 116339

SEQ ID NO: 473903 - RNA, 64 nt, Homo Sapiens; identical to SEQ ID NO: 116340

SEQ ID NO: 473904 - RNA, 64 nt, Homo Sapiens; identical to SEQ ID NO: 116341

SEQ ID NO: 473905 - RNA, 64 nt, Homo Sapiens; identical to SEQ ID NO: 116342

SEQ ID NO: 473906 - RNA, 64 nt, Homo Sapiens; identical to SEQ ID NO: 116343

SEQ ID NO: 473907 - RNA, 64 nt, Homo Sapiens; identical to SEQ ID NO: 116344

SEQ ID NO: 473908 - RNA, 64 nt, Homo Sapiens; identical to SEQ ID NO: 116345

SEQ ID NO: 473909 - RNA, 64 nt, Homo Sapiens; identical to SEQ ID NO: 116346

SEQ ID NO: 473910 - RNA, 64 nt, Homo Sapiens; identical to SEQ ID NO: 116347

SEQ ID NO: 473911 - RNA, 64 nt, Homo Sapiens; identical to SEQ ID NO: 116348

SEQ ID NO: 473912 - RNA, 64 nt, Homo Sapiens; identical to SEQ ID NO: 116349

SEQ ID NO: 473913 - RNA, 64 nt, Homo Sapiens; identical to SEQ ID NO: 116350

SEQ ID NO: 473914 - RNA, 64 nt, Homo Sapiens; identical to SEQ ID NO: 116351

SEQ ID NO: 473915 - RNA, 64 nt, Homo Sapiens; identical to SEQ ID NO: 116352

SEQ ID NO: 473916 - RNA, 64 nt, Homo Sapiens; identical to SEQ ID NO: 116353

SEQ ID NO: 473917 - RNA, 64 nt, Homo Sapiens; identical to SEQ ID NO: 116354

SEQ ID NO: 473918 - RNA, 64 nt, Homo Sapiens; identical to SEQ ID NO: 116355

SEQ ID NO: 473919 - RNA, 64 nt, Homo Sapiens; identical to SEQ ID NO: 116356

SEQ ID NO: 473920 - RNA, 64 nt, Homo Sapiens; identical to SEQ ID NO: 116357

SEQ ID NO: 473921 - RNA, 64 nt, Homo Sapiens; identical to SEQ ID NO: 116358

SEQ ID NO: 473922 - RNA, 64 nt, Homo Sapiens; identical to SEQ ID NO: 116359

SEQ ID NO: 473923 - RNA, 64 nt, Homo Sapiens; identical to SEQ ID NO: 116360

SEQ ID NO: 473924 - RNA, 64 nt, Homo Sapiens; identical to SEQ ID NO: 116361

SEQ ID NO: 473925 - RNA, 64 nt, Homo Sapiens; identical to SEQ ID NO: 116362

SEQ ID NO: 473926 - RNA, 64 nt, Homo Sapiens; identical to SEQ ID NO: 116363

SEQ ID NO: 473927 - RNA, 64 nt, Homo Sapiens; identical to SEQ ID NO: 116364

SEQ ID NO: 473928 - RNA, 64 nt, Homo Sapiens; identical to SEQ ID NO: 116365

SEQ ID NO: 473929 - RNA, 64 nt, Homo Sapiens; identical to SEQ ID NO: 116366

SEQ ID NO: 473930 - RNA, 64 nt, Homo Sapiens; identical to SEQ ID NO: 116367

SEQ ID NO: 473931 - RNA, 64 nt, Homo Sapiens; identical to SEQ ID NO: 116368

SEQ ID NO: 473932 - RNA, 64 nt, Homo Sapiens
uuucauuccuuauugaacuuauuuugcacaauaguguuuacaaaucuuauacaucuuacuuuga

SEQ ID NO: 473933 - RNA, 64 nt, Homo Sapiens
augggggucuugacaaagcagaguaaaaauaugcuguuuacauuguuuacuuacaaguaaggag

SEQ ID NO: 473934 - RNA, 64 nt, Homo Sapiens
acuuuuauuaauucuucauuuuuuguaaaacuuauguuuacaagaagaaaacaaaucaaaacau

SEQ ID NO: 473935 - RNA, 64 nt, Homo Sapiens
uugccuaaaagaaaggacugacaagugugcaaaauguuuacaaucuuuugugaaauuguaguuu

SEQ ID NO: 473936 - RNA, 64 nt, Homo Sapiens
ugaucuuagcucacuuuccaauaacagaaggaguuguuuacagaugaauaguaucacaucauua

SEQ ID NO: 473937 - RNA, 64 nt, Homo Sapiens
augucuuuuguaaaacaaaaauuacaaaaaaauuuguuuacauuccacugguaccuuaauuuaa

SEQ ID NO: 473938 - RNA, 64 nt, Homo Sapiens
cuuuccccaacuacaaaaauguuuggcaacuuuguguuuacauuuaaagaucauuugcaccuuu

SEQ ID NO: 473939 - RNA, 64 nt, Homo Sapiens
cuuuuucaaggaaaaaaaguauugaguaaacaauuguuuacauauaucauuuaugcuuuuuucu

SEQ ID NO: 473940 - RNA, 64 nt, Homo Sapiens
auuucuucuguuuuauacaagcucuguuaaguuauguuuacaguaucuuguaucgcuguuuaca

SEQ ID NO: 473941 - RNA, 64 nt, Homo Sapiens
ucuguuaaguuauguuuacaguaucuuguaucgcuguuuacaaaucuugcauggacuccugcca

SEQ ID NO: 473942 - RNA, 64 nt, Homo Sapiens
uaggcuauuuuuuaauauagcuacagcuaaauuuuguuuacaauauccaaguugauuuuugugu

SEQ ID NO: 473943 - RNA, 64 nt, Homo Sapiens
aaauacaaaaauuagccaggguggcaaaaccgcguguuuacaaaucaagacuagccugggcaau

SEQ ID NO: 473944 - RNA, 64 nt, Homo Sapiens
aguucuuucaugguaagcucaauggacuuugaauuguuuacagugcuguauguccaauuguuaa

SEQ ID NO: 473945 - RNA, 64 nt, Homo Sapiens
agacuccaacggagggagccuguugguguuaaauuguuuacauuucuuuauacaaauaaugugc

SEQ ID NO: 473946 - RNA, 64 nt, Homo Sapiens
uuaagacauaugcagugguuaacaaauguaaauauguuuacauuaaaggcucaauaacaaauac

SEQ ID NO: 473947 - RNA, 64 nt, Homo Sapiens
cagucccaagaaauggauugugugaugucuuugcuguuuacauggucugcaaauuucaugaauu

SEQ ID NO: 473948 - RNA, 64 nt, Homo Sapiens
auguacaucuaccccagccccucaaaagaaaaacuguuuacauagaaauuccuacacauacguu

SEQ ID NO: 473949 - RNA, 64 nt, Homo Sapiens
uuuaaaacauaauugccaauugaaacccuaaauauguuuacauaccauuaagauaugauucaug

SEQ ID NO: 473950 - RNA, 64 nt, Homo Sapiens
ccaacaccagccccugccccagcccaaguccaaauguuuacagggagccuccugcccagucccc

SEQ ID NO: 473951 - RNA, 64 nt, Homo Sapiens
uuccaagugacuccgugccuugagugugucugcguguuuacacccgucccucugcuggccgccc

SEQ ID NO: 473952 - RNA, 64 nt, Homo Sapiens
ugauacuuacaauuuuuagcagguagcuuuuuaauguuuacagaaauuuuaauuuuuuucuauu

SEQ ID NO: 473953 - RNA, 64 nt, Homo Sapiens
auuuuaauuuuuuucuauuuugaaauuugaggcuuguuuacauugcuuagauaauuuagaauuu

SEQ ID NO: 473954 - RNA, 64 nt, Homo Sapiens
aaaacauaagugucucuggccaucaaagugaucuuguuuacagcagugcuuuugugaaacaauu

SEQ ID NO: 473955 - RNA, 64 nt, Homo Sapiens
agauaauuuuuuuuccuuugugaguuuuacacuuuguuuacaguuuguuuacaacucaaaacuu

SEQ ID NO: 473956 - RNA, 64 nt, Homo Sapiens
ucaaaacuuugaguuuuacaaaauguuuuuacuuuguuuacaacuuuacaaguccagauucaaa

SEQ ID NO: 473957 - RNA, 64 nt, Homo Sapiens
uccagauucaaaaaauguuuuaaaauuuuguuacuguuuacaagcuguccagaacugaagacuu

SEQ ID NO: 473958 - RNA, 64 nt, Homo Sapiens
auccuccguggcccuaggcagccacugccuccuauguuuacaggucaagacccagaauguaggu

SEQ ID NO: 473959 - RNA, 64 nt, Homo Sapiens
gcaaggcuucccugucucccagcagcugaugucguguuuacagaaugcuguggggugcuggugg

SEQ ID NO: 473960 - RNA, 64 nt, Homo Sapiens
guauguacuaagcaguaagcuaaaaugagaucguuguuuacaguuuuaugagaaaguucucauu

SEQ ID NO: 473961 - RNA, 64 nt, Homo Sapiens
agcccaauguaaugcauaggagauuuuaugcugcuguuuacaaauuuccuaaugucagaguaga

SEQ ID NO: 473962 - RNA, 64 nt, Homo Sapiens
uuucccuuucaguuaguauacaugacuuugguuuuguuuacauuaagcaagaugccauuuuccc

SEQ ID NO: 473963 - RNA, 64 nt, Homo Sapiens
gaaaggacugaacuuuuucuguugaguuucuuuguguuuacaagcuacuauuuuuaaaauuccu

SEQ ID NO: 473964 - RNA, 64 nt, Homo Sapiens
gugauuuuacaauaacauuaucaucugcaguuacuguuuacaagacugcuuuuaccuuaaacuu

SEQ ID NO: 473965 - RNA, 64 nt, Homo Sapiens
uuuacaagacugcuuuuaccuuaaacuuuguagauguuuacaucuuuuuguuguguuuuaagau

SEQ ID NO: 473966 - RNA, 64 nt, Homo Sapiens
agcagcuggucugacacuacgcgcagugcucgguuguuuacaaucaguggggaaaagggcagaa

SEQ ID NO: 473967 - RNA, 64 nt, Homo Sapiens
auuuuuuggaagugcaaaaaucucaauuugugucuguuuacagcucucucuccucacugcucac

SEQ ID NO: 473968 - RNA, 64 nt, Homo Sapiens
aauaauuagcaauacugagugauauugcaguuuuuguuuacaaguauccgcgagccugcuugcu

SEQ ID NO: 473969 - RNA, 64 nt, Homo Sapiens
uuuccgugccgggagcgcacuccucucuucugacuguuuacacccaaacaacaaagcagaagac

SEQ ID NO: 473970 - RNA, 64 nt, Homo Sapiens
cuucauauccauuucuaauccaucaaacagcuuauguuuacauaaaauuuuaucauucacaagg

SEQ ID NO: 473971 - RNA, 64 nt, Homo Sapiens
agagguuuugauaggaaguauguuuguuucuuaguguuuacaaauauuaaguacucuugauaca

SEQ ID NO: 473972 - RNA, 64 nt, Homo Sapiens
uuauuuuuuauaucuguagcucgcauuuuaaagguguuuacagaugucuuaaacuuuaauaaau

SEQ ID NO: 473973 - RNA, 64 nt, Homo Sapiens
aagauuauuuuguauuuaccuauaaucuaagaauuguuuacaaaauuaaacauucugcauuggg

SEQ ID NO: 473974 - RNA, 64 nt, Homo Sapiens
agauaaccuguauguguuccgagcuuuaauuuuuuguuuacaaauugaacaguguuacaugggc

SEQ ID NO: 473975 - RNA, 64 nt, Homo Sapiens
auaacaaaccuguuuuaugaaaauucacuggugcuguuuacauuggaauaaaaagcucuauaag

SEQ ID NO: 473976 - RNA, 64 nt, Homo Sapiens
uuaagaauauuauccugguuuaacaacagugcccuguuuacaacagauugugcccuaucucauc

SEQ ID NO: 473977 - RNA, 64 nt, Homo Sapiens
agguguuaacaucuguuucaggaacauggcaguauguuuacaugucagaaguuuuguuuaauuc

SEQ ID NO: 473978 - RNA, 64 nt, Homo Sapiens
ugagucgggaccaaagagaauauuuauagguaguuguuuacauaccuuacaaguauaugaguau

SEQ ID NO: 473979 - RNA, 64 nt, Homo Sapiens
guuaugugaauagauuagauuuaguaaauguacuuguuuacauauuuaugaacaugaagaaacu

SEQ ID NO: 473980 - RNA, 64 nt, Homo Sapiens
ugcccaggauuuugaagagcuauuuauaaguagauguuuacauauaaauaaauauuuauuuauu

SEQ ID NO: 473981 - RNA, 64 nt, Homo Sapiens
gguugccuggauacaaaucaugcacuuauuaggcuguuuacaugcauggaaaaacuuuaggaaa

SEQ ID NO: 473982 - RNA, 64 nt, Homo Sapiens
ucuaaauaaaauuugcuuauuuuuaauguuuacauguuuacaucaagauaaaauuuaguugagu

SEQ ID NO: 473983 - RNA, 64 nt, Homo Sapiens
uuuacaucucuaaauaaaauaguugaguuuuuaauguuuacaugucauaauaaagauaaaauuu

SEQ ID NO: 473984 - RNA, 64 nt, Homo Sapiens
gguuuaguuuuguaauaaggauuaaauuuaaacuuguuuacaaagugcaauuugguucuugaaa

SEQ ID NO: 473985 - RNA, 64 nt, Homo Sapiens
gaugucuucauucccaaggugaaacagcaggacuuguuuacaaauuccuauguuagcuguuaaa

SEQ ID NO: 473986 - RNA, 64 nt, Homo Sapiens
gaggaagaaugggacauggccccaugcuuauuuuuguuuacaacguaacauggcaugagagagg

SEQ ID NO: 473987 - RNA, 64 nt, Homo Sapiens
cuauaccaggcacaagauaaaacuccaaaauuucuguuuacauugaccuuuacauuuaaagcug

SEQ ID NO: 473988 - RNA, 64 nt, Homo Sapiens
gcaccuggcuccuaccuggaggacucaguuguucuguuuacauccugguggcaccucucacccu

SEQ ID NO: 473989 - RNA, 64 nt, Homo Sapiens
acuuuccccuugcucguuucucccuuguuguaaguguuuacaacuggcaugugcuuuuaaacau

SEQ ID NO: 473990 - RNA, 64 nt, Homo Sapiens
uuugaggcuucaaauaaguuaggcggcuggaggauguuuacagcaucugauuugggguuaaacu

SEQ ID NO: 473991 - RNA, 64 nt, Homo Sapiens
uuaucuguaauaagauaacugacauccugggacuuguuuacauuucaauuaccucccaugugug

SEQ ID NO: 473992 - RNA, 64 nt, Homo Sapiens
uuugugugcaacugcuucauuaaauguuuacauauguuuacauguucaaaggcaucacuauuuu

SEQ ID NO: 473993 - RNA, 64 nt, Homo Sapiens
uguuuacauguuugugugcaucacuauuuuuaaauguuuacauaccccuuacauuucaaaggca

SEQ ID NO: 473994 - RNA, 64 nt, Homo Sapiens
acuguaaguccuguuugguuuaauuuuuaaauaauguuuacauaaaagaguauuuauguuggaa

SEQ ID NO: 473995 - RNA, 64 nt, Homo Sapiens
auuuuagcaccucaagguauaguguagaggaugauguuuacauacuuggcacuuguucuagaga

SEQ ID NO: 473996 - RNA, 64 nt, Homo Sapiens
cccaaucagaauacggugguugagaaggaaccaguguuuacaaguaauaucagaaaguugaagg

SEQ ID NO: 473997 - RNA, 64 nt, Homo Sapiens
uuuacaaguaauaucagaaaguugaaggaaccaguguuuacaaguaauaccagaaaguugccaa

SEQ ID NO: 473998 - RNA, 64 nt, Homo Sapiens
ucagcauucaaucaggcugagcugaauguagugauguuuacauuguuuacauucuuuguacugu

SEQ ID NO: 473999 - RNA, 64 nt, Homo Sapiens
aaucaggcugagcugaauguagugauguuuacauuguuuacauucuuuguacugucuuccugcu

SEQ ID NO: 474000 - RNA, 64 nt, Homo Sapiens
uucuuucuuucuuucugccaacuuuguuuuccaguguuuacaaggugacaaauguuugacuuug

SEQ ID NO: 474001 - RNA, 64 nt, Homo Sapiens
ugcuuuagcacaggacaacuuuacaaaacaugauuguuuacagcugcucuuccccucuuuucug

SEQ ID NO: 474002 - RNA, 64 nt, Homo Sapiens
aacccaggacuaaaaauggacaggcugaccucaguguuuacaaauucagaauuuugauaggggu

SEQ ID NO: 474003 - RNA, 64 nt, Homo Sapiens
ccagugcugggugcagcuccaucacccucuuguguguuuacaugucucuuucuaugauaagagg

SEQ ID NO: 474004 - RNA, 64 nt, Homo Sapiens
uauaugccugucuagacaucaaauuguugguuauuguuuacaaucuagaaaugaugaagcucuu

SEQ ID NO: 474005 - RNA, 64 nt, Homo Sapiens
aucuagggugauugugucuggagacccuuaauuauguuuacaaagacccauguuccaaguaagu

SEQ ID NO: 474006 - RNA, 64 nt, Homo Sapiens
auuugaugugcaauagggugcauccccauagccauguuuacauggccucacugcuguucugggc

SEQ ID NO: 474007 - RNA, 64 nt, Homo Sapiens
ucaaucugccucacugcuguccugaucccaaaucuguuuacacacugggugacugggucuagcc

SEQ ID NO: 474008 - RNA, 64 nt, Homo Sapiens
uccccucuaccccgcuguauuguccccuccccucuguuuacauccucuuggggggucagggugc

SEQ ID NO: 474009 - RNA, 64 nt, Homo Sapiens
guggaauugaccccuuccucuauuuauuagcuuuuguuuacaccacccagaggaagccucuauu

SEQ ID NO: 474010 - RNA, 64 nt, Homo Sapiens
aaaacaauugagaugcuaacagggaggauuacaguguuuacagaacaaccuucagcgccgaccu

SEQ ID NO: 474011 - RNA, 64 nt, Homo Sapiens
cuagguagaauaaccgaguaugacaauucuuaauuguuuacauuuuauaacuuccuguccuuca

SEQ ID NO: 474012 - RNA, 64 nt, Homo Sapiens
gacccuugcagggcuuugcagcugcucaucuguuuguuuacaguuuguucuuucccuccuuccc

SEQ ID NO: 474013 - RNA, 64 nt, Homo Sapiens
uuuuguguuuuacuugaccaaaaccaaguguauauguuuacauguuuuuauccuguuuagcuug

SEQ ID NO: 474014 - RNA, 64 nt, Homo Sapiens
auagcagaugcugcugcugauacaacauagccaguguuuacagcgccuccuuccuugcaguguu

SEQ ID NO: 474015 - RNA, 64 nt, Homo Sapiens
auagccaguguuuacagcaucuccuuccuugcaguguuuacaaccucuggcccuuguuucuagc

SEQ ID NO: 474016 - RNA, 64 nt, Homo Sapiens
uuaagcuaauuucuguagucuacaggguuuaucauguuuacagauuauguaguaaauguauguu

SEQ ID NO: 474017 - RNA, 64 nt, Homo Sapiens
guuuaucauguuuacagauuauguaguaaauguauguuuacagguucuuuacacuuguacaauu

SEQ ID NO: 474018 - RNA, 64 nt, Homo Sapiens
uggggcuugcgcugggccguggugggaggcacaguguuuacaggcucugguggcagagcaguug

SEQ ID NO: 474019 - RNA, 64 nt, Homo Sapiens
uuauauauauuuuuugcaacuuggauuuccaguuuguuuacagaguagucuuagguaguagcaa

SEQ ID NO: 474020 - RNA, 64 nt, Homo Sapiens
aucuuugaaaggcauugugggucugucuuuaaaguguuuacaaaaaaaaauuauauaaaaaaaa

SEQ ID NO: 474021 - RNA, 64 nt, Homo Sapiens
aaagucuagugucgacugguguuuucccucgugauguuuacagcuugcuguuugcugcccagcc

SEQ ID NO: 474022 - RNA, 64 nt, Homo Sapiens
cugacugugcuuaaaaacaccaggaaugcugcacuguuuacaccgcugcucccacggaggggag

SEQ ID NO: 474023 - RNA, 64 nt, Homo Sapiens
aaauggggagaaagucaccggucccuggcaauucuguuuacaugaaacauauccacgguaaccg

SEQ ID NO: 474024 - RNA, 64 nt, Homo Sapiens
uugacaauaaaauggcuuuuaauuauuuguuauuuguuuacacccuauuccucaguuauuauua

SEQ ID NO: 474025 - RNA, 64 nt, Homo Sapiens
uucaaaacuauuuguucaaagaacccguuaguguuguuuacaggguuacaguuucucucacaug

SEQ ID NO: 474026 - RNA, 64 nt, Homo Sapiens
guggagucggggcuugcugaguuaacuggaguccuguuuacaagugaaccauuugguaccuggu

SEQ ID NO: 474027 - RNA, 64 nt, Homo Sapiens
ccgugaauccauucccaucaauugcagugaacacuguuuacacaaagcuguuagccuuagagug

SEQ ID NO: 474028 - RNA, 64 nt, Homo Sapiens
guaguuuggauguacaauuaggagguguguucuguguuuacacauuaguucacaagcauaauuu

SEQ ID NO: 474029 - RNA, 64 nt, Homo Sapiens
agacucacucaccaggauaagagcauugguugacuguuuacagaagcuugguuuccauaacaua

SEQ ID NO: 474030 - RNA, 64 nt, Homo Sapiens
gagcacuagaacauguuuggauuaauaguuaaaauguuuacauuuuaaggaaaauuaauaaauc

SEQ ID NO: 474031 - RNA, 64 nt, Homo Sapiens
uucuucauaaauacaugcauaauuucacaaccuauguuuacagauguucuauaguaguuacaac

SEQ ID NO: 474032 - RNA, 64 nt, Homo Sapiens
cuuuauaggucuuuaaaaauuacuuuuauuauauuguuuacaaauauauuucaugcaagaaaca

SEQ ID NO: 474033 - RNA, 64 nt, Homo Sapiens
ugaagaugcuguacccacuugaacaguccucagguguuuacauaaauacuauguuuuacaguuu

SEQ ID NO: 474034 - RNA, 64 nt, Homo Sapiens; identical to SEQ ID NO: 290000

SEQ ID NO: 474035 - RNA, 64 nt, Homo Sapiens; identical to SEQ ID NO: 290001

SEQ ID NO: 474036 - RNA, 64 nt, Homo Sapiens; identical to SEQ ID NO: 290002

SEQ ID NO: 474037 - RNA, 64 nt, Homo Sapiens; identical to SEQ ID NO: 290003

SEQ ID NO: 474038 - RNA, 64 nt, Homo Sapiens; identical to SEQ ID NO: 290004

SEQ ID NO: 474039 - RNA, 64 nt, Homo Sapiens; identical to SEQ ID NO: 290005

SEQ ID NO: 474040 - RNA, 64 nt, Homo Sapiens; identical to SEQ ID NO: 290006

SEQ ID NO: 474041 - RNA, 64 nt, Homo Sapiens; identical to SEQ ID NO: 290007

SEQ ID NO: 474042 - RNA, 64 nt, Homo Sapiens; identical to SEQ ID NO: 290008

SEQ ID NO: 474043 - RNA, 64 nt, Homo Sapiens; identical to SEQ ID NO: 290009

SEQ ID NO: 474044 - RNA, 64 nt, Homo Sapiens; identical to SEQ ID NO: 290010

SEQ ID NO: 474045 - RNA, 64 nt, Homo Sapiens; identical to SEQ ID NO: 290011

SEQ ID NO: 474046 - RNA, 64 nt, Homo Sapiens; identical to SEQ ID NO: 290012

SEQ ID NO: 474047 - RNA, 64 nt, Homo Sapiens; identical to SEQ ID NO: 290013

SEQ ID NO: 474048 - RNA, 64 nt, Homo Sapiens; identical to SEQ ID NO: 290014

SEQ ID NO: 474049 - RNA, 64 nt, Homo Sapiens; identical to SEQ ID NO: 290015

SEQ ID NO: 474050 - RNA, 64 nt, Homo Sapiens; identical to SEQ ID NO: 290016

SEQ ID NO: 474051 - RNA, 64 nt, Homo Sapiens; identical to SEQ ID NO: 290017

SEQ ID NO: 474052 - RNA, 64 nt, Homo Sapiens; identical to SEQ ID NO: 290018

SEQ ID NO: 474053 - RNA, 64 nt, Homo Sapiens; identical to SEQ ID NO: 290019

SEQ ID NO: 474054 - RNA, 64 nt, Homo Sapiens; identical to SEQ ID NO: 290020

SEQ ID NO: 474055 - RNA, 64 nt, Homo Sapiens; identical to SEQ ID NO: 290021

SEQ ID NO: 474056 - RNA, 64 nt, Homo Sapiens; identical to SEQ ID NO: 290022

SEQ ID NO: 474057 - RNA, 64 nt, Homo Sapiens; identical to SEQ ID NO: 290023

SEQ ID NO: 474058 - RNA, 64 nt, Homo Sapiens; identical to SEQ ID NO: 290024

SEQ ID NO: 474059 - RNA, 64 nt, Homo Sapiens; identical to SEQ ID NO: 290025

SEQ ID NO: 474060 - RNA, 64 nt, Homo Sapiens; identical to SEQ ID NO: 290026

SEQ ID NO: 474061 - RNA, 64 nt, Homo Sapiens; identical to SEQ ID NO: 290027

SEQ ID NO: 474062 - RNA, 64 nt, Homo Sapiens; identical to SEQ ID NO: 290028

SEQ ID NO: 474063 - RNA, 64 nt, Homo Sapiens; identical to SEQ ID NO: 290029

SEQ ID NO: 474064 - RNA, 56 nt, Homo Sapiens; identical to SEQ ID NO: 290030

SEQ ID NO: 474065 - RNA, 64 nt, Homo Sapiens; identical to SEQ ID NO: 290031

SEQ ID NO: 474066 - RNA, 64 nt, Homo Sapiens; identical to SEQ ID NO: 290032

SEQ ID NO: 474067 - RNA, 64 nt, Homo Sapiens; identical to SEQ ID NO: 290033

SEQ ID NO: 474068 - RNA, 64 nt, Homo Sapiens; identical to SEQ ID NO: 290034

SEQ ID NO: 474069 - RNA, 64 nt, Homo Sapiens; identical to SEQ ID NO: 290035

SEQ ID NO: 474070 - RNA, 64 nt, Homo Sapiens; identical to SEQ ID NO: 290036

SEQ ID NO: 474071 - RNA, 64 nt, Homo Sapiens; identical to SEQ ID NO: 290037

SEQ ID NO: 474072 - RNA, 64 nt, Homo Sapiens; identical to SEQ ID NO: 290038

SEQ ID NO: 474073 - RNA, 64 nt, Homo Sapiens; identical to SEQ ID NO: 290039

SEQ ID NO: 474074 - RNA, 64 nt, Homo Sapiens; identical to SEQ ID NO: 290040

SEQ ID NO: 474075 - RNA, 64 nt, Homo Sapiens
gaccaauugaagcaugaacguggauuguauuuaagacauaaacaaagacauugacagcaauuca

SEQ ID NO: 474076 - RNA, 64 nt, Homo Sapiens
cucccaaacugacaauuuuaccuauucugaaaaagacauaaaacagaauuugguagcacuuacc

SEQ ID NO: 474077 - RNA, 64 nt, Homo Sapiens
cuaauacagggagcacacuccuucaguucagcaagacauaaagccuuuugcuuuaugcuugagg

SEQ ID NO: 474078 - RNA, 64 nt, Homo Sapiens
uggcauuuaauuucaaccuaaauacugacugcuggacauaaaucacagaaaauuuaacuuaaga

SEQ ID NO: 474079 - RNA, 64 nt, Homo Sapiens
gaggggugugaacuuugguuacaugcguguaagggacauaaaugugcaaguuaauguacauuau

SEQ ID NO: 474080 - RNA, 64 nt, Homo Sapiens
uuuauggggaagcaaagagauaugcucuagaaaugacauaaaggaaagcugucaucuuguaaua

SEQ ID NO: 474081 - RNA, 64 nt, Homo Sapiens
aaugcccauucaccuccuccauagacuuaguuuugacauaaaacuuacaggagaggaccugugg

SEQ ID NO: 474082 - RNA, 64 nt, Homo Sapiens
guuaucauuuuaauugcaauaaaaaggcagauaagacauaaauauguaucugaauuuuaaaauu

SEQ ID NO: 474083 - RNA, 64 nt, Homo Sapiens
cuguucuuuuuccuaauuaauguagcuuucggaugacauaaauccaguaucucugcuuaugaca

SEQ ID NO: 474084 - RNA, 64 nt, Homo Sapiens
uuucggaugacauaaauccaguaucucugcuuaugacauaaauccaguaccucugcuuuucuuu

SEQ ID NO: 474085 - RNA, 64 nt, Homo Sapiens; identical to SEQ ID NO: 57588

SEQ ID NO: 474086 - RNA, 64 nt, Homo Sapiens; identical to SEQ ID NO: 57589

SEQ ID NO: 474087 - RNA, 64 nt, Homo Sapiens
ucuuucuuucuuuuucuuuuuaauuccauuuuuguaugcauaccugccagcucguaugccucug

SEQ ID NO: 474088 - RNA, 64 nt, Homo Sapiens
cuaaugcaugcaagaaucauuagguuggcagguauaugcauaagugaaaaaucuggaaguguaa

SEQ ID NO: 474089 - RNA, 64 nt, Homo Sapiens
uucuuuccucugcugcucaauaguuuuauauaucuaugcauacauauauacacacauauguaua

SEQ ID NO: 474090 - RNA, 64 nt, Homo Sapiens
gcuuauaguuuacaagugagacccgauaugucauuaugcauacuuauauuaucuuaagcaugug

SEQ ID NO: 474091 - RNA, 64 nt, Homo Sapiens
auaaacccauuuuaaugugcuugugguacaguaauaugcauaaaugugauuuguaauaaauuua

SEQ ID NO: 474092 - RNA, 64 nt, Homo Sapiens
cagagugaccccccccagcaauguucugugugaauaugcauaacugcuucccaauuguagcacc

SEQ ID NO: 474093 - RNA, 64 nt, Homo Sapiens
uguguuuguuuguguauguauaguuaugcauauauaugcauauauauauauguauagauacagc

SEQ ID NO: 474094 - RNA, 64 nt, Homo Sapiens
uaugcauauauguguuuguuuagauacagcuaguuaugcauauaucucuauaccuauauaugua

SEQ ID NO: 474095 - RNA, 64 nt, Homo Sapiens
guaguuccaaauguauuucacucacauugaguaauaugcauaauuuaaauacaaacauauuuuu

SEQ ID NO: 474096 - RNA, 64 nt, Homo Sapiens
aaaugguguguuaaaauuagaccugcacauuuguuaugcauacuuuuaaagauaaaacuuuaca

SEQ ID NO: 474097 - RNA, 64 nt, Homo Sapiens
agagaauuucuuuauauacacaaacauacaugaauaugcauaucuauaugcauagauguaccua

SEQ ID NO: 474098 - RNA, 64 nt, Homo Sapiens
uauauacacaaacauacaugaauaugcauaucuauaugcauagauguaccuauccugcacccaa

SEQ ID NO: 474099 - RNA, 64 nt, Homo Sapiens
uagauacaaggaugcacauaagauucacuuuguuuaugcauauggagaaagggcauacauccac

SEQ ID NO: 474100 - RNA, 64 nt, Homo Sapiens
aauuuuugcuuaacauuagauggugauguugaaauaugcauacuuuuugaaaaguauugguuac

SEQ ID NO: 474101 - RNA, 64 nt, Homo Sapiens
uauguagauauguuuauaucguauaugcuuuauguaugcauauguaaacuguguaugcauauaa

SEQ ID NO: 474102 - RNA, 64 nt, Homo Sapiens
aguauaugcuuuauguaugcaaauguaaacuguguaugcauauauuuucugaacacuggcuggg

SEQ ID NO: 474103 - RNA, 64 nt, Homo Sapiens; identical to SEQ ID NO: 288961

SEQ ID NO: 474104 - RNA, 64 nt, Homo Sapiens; identical to SEQ ID NO: 288962

SEQ ID NO: 474105 - RNA, 64 nt, Homo Sapiens; identical to SEQ ID NO: 288963

SEQ ID NO: 474106 - RNA, 64 nt, Homo Sapiens; identical to SEQ ID NO: 288964

SEQ ID NO: 474107 - RNA, 64 nt, Homo Sapiens; identical to SEQ ID NO: 288965

SEQ ID NO: 474108 - RNA, 64 nt, Homo Sapiens; identical to SEQ ID NO: 288966

SEQ ID NO: 474109 - RNA, 64 nt, Homo Sapiens; identical to SEQ ID NO: 288967

SEQ ID NO: 474110 - RNA, 64 nt, Homo Sapiens; identical to SEQ ID NO: 288968

SEQ ID NO: 474111 - RNA, 64 nt, Homo Sapiens; identical to SEQ ID NO: 288969

SEQ ID NO: 474112 - RNA, 64 nt, Homo Sapiens; identical to SEQ ID NO: 288970

SEQ ID NO: 474113 - RNA, 64 nt, Homo Sapiens; identical to SEQ ID NO: 288971

SEQ ID NO: 474114 - RNA, 64 nt, Homo Sapiens; identical to SEQ ID NO: 288972

SEQ ID NO: 474115 - RNA, 64 nt, Homo Sapiens; identical to SEQ ID NO: 288973

SEQ ID NO: 474116 - RNA, 64 nt, Homo Sapiens; identical to SEQ ID NO: 288974

SEQ ID NO: 474117 - RNA, 64 nt, Homo Sapiens; identical to SEQ ID NO: 288975

SEQ ID NO: 474118 - RNA, 64 nt, Homo Sapiens; identical to SEQ ID NO: 288976

SEQ ID NO: 474119 - RNA, 64 nt, Homo Sapiens; identical to SEQ ID NO: 288977

SEQ ID NO: 474120 - RNA, 64 nt, Homo Sapiens; identical to SEQ ID NO: 288978

SEQ ID NO: 474121 - RNA, 64 nt, Homo Sapiens; identical to SEQ ID NO: 288979

SEQ ID NO: 474122 - RNA, 52 nt, Homo Sapiens; identical to SEQ ID NO: 69449

SEQ ID NO: 474123 - RNA, 64 nt, Homo Sapiens; identical to SEQ ID NO: 288981

SEQ ID NO: 474124 - RNA, 64 nt, Homo Sapiens; identical to SEQ ID NO: 288982

SEQ ID NO: 474125 - RNA, 64 nt, Homo Sapiens; identical to SEQ ID NO: 288983

SEQ ID NO: 474126 - RNA, 64 nt, Homo Sapiens; identical to SEQ ID NO: 288984

SEQ ID NO: 474127 - RNA, 64 nt, Homo Sapiens; identical to SEQ ID NO: 288985

SEQ ID NO: 474128 - RNA, 64 nt, Homo Sapiens; identical to SEQ ID NO: 288986

SEQ ID NO: 474129 - RNA, 64 nt, Homo Sapiens; identical to SEQ ID NO: 288987

SEQ ID NO: 474130 - RNA, 64 nt, Homo Sapiens; identical to SEQ ID NO: 288988

SEQ ID NO: 474131 - RNA, 64 nt, Homo Sapiens; identical to SEQ ID NO: 288989

SEQ ID NO: 474132 - RNA, 64 nt, Homo Sapiens; identical to SEQ ID NO: 288990

SEQ ID NO: 474133 - RNA, 64 nt, Homo Sapiens; identical to SEQ ID NO: 288991

SEQ ID NO: 474134 - RNA, 64 nt, Homo Sapiens; identical to SEQ ID NO: 288992

SEQ ID NO: 474135 - RNA, 64 nt, Homo Sapiens; identical to SEQ ID NO: 288993

SEQ ID NO: 474136 - RNA, 64 nt, Homo Sapiens; identical to SEQ ID NO: 288994

SEQ ID NO: 474137 - RNA, 64 nt, Homo Sapiens; identical to SEQ ID NO: 288995

SEQ ID NO: 474138 - RNA, 64 nt, Homo Sapiens; identical to SEQ ID NO: 288996

SEQ ID NO: 474139 - RNA, 64 nt, Homo Sapiens; identical to SEQ ID NO: 288997

SEQ ID NO: 474140 - RNA, 64 nt, Homo Sapiens; identical to SEQ ID NO: 288998

SEQ ID NO: 474141 - RNA, 64 nt, Homo Sapiens; identical to SEQ ID NO: 288999

SEQ ID NO: 474142 - RNA, 64 nt, Homo Sapiens; identical to SEQ ID NO: 289000

SEQ ID NO: 474143 - RNA, 64 nt, Homo Sapiens; identical to SEQ ID NO: 289001

SEQ ID NO: 474144 - RNA, 64 nt, Homo Sapiens; identical to SEQ ID NO: 289002

SEQ ID NO: 474145 - RNA, 64 nt, Homo Sapiens; identical to SEQ ID NO: 289003

SEQ ID NO: 474146 - RNA, 64 nt, Homo Sapiens; identical to SEQ ID NO: 289004

SEQ ID NO: 474147 - RNA, 64 nt, Homo Sapiens; identical to SEQ ID NO: 289005

SEQ ID NO: 474148 - RNA, 64 nt, Homo Sapiens; identical to SEQ ID NO: 289006

SEQ ID NO: 474149 - RNA, 64 nt, Homo Sapiens; identical to SEQ ID NO: 289007

SEQ ID NO: 474150 - RNA, 64 nt, Homo Sapiens; identical to SEQ ID NO: 289008

SEQ ID NO: 474151 - RNA, 64 nt, Homo Sapiens
cccgucccauuugcagagcucuacuacuucauuuccacaguaagcauauauauaaugaucacuu

SEQ ID NO: 474152 - RNA, 64 nt, Homo Sapiens
cuccuaauugugugguaauuugcuuuuacuguuuccacaguauuucaggucuuugcucauucac

SEQ ID NO: 474153 - RNA, 64 nt, Homo Sapiens
cuagagacggguugcaaugagcuaguuucaauuaccacaguauugggagggggcgcagguacau

SEQ ID NO: 474154 - RNA, 64 nt, Homo Sapiens
ucuucagcaacucauugucucggcuuauuuuuauccacaguaaaugugagccaccacgccuggc

SEQ ID NO: 474155 - RNA, 64 nt, Homo Sapiens
ucgucuucaugugucuugcaaaaaacaacucaugccacaguaugcagcacaacaaauuaaaaac

SEQ ID NO: 474156 - RNA, 64 nt, Homo Sapiens
caccuaugucugugccucccuguaagauagucaaccacaguagugugucccaguacaaaaaggc

SEQ ID NO: 474157 - RNA, 64 nt, Homo Sapiens
gccagguaauuaauaaucugcacugauauuacauccacaguaccacaguauuuauguguaugaa

SEQ ID NO: 474158 - RNA, 64 nt, Homo Sapiens
auuaauaaucugcacugauauuacauccacaguaccacaguauuuauguguaugaauuaaggau

SEQ ID NO: 474159 - RNA, 64 nt, Homo Sapiens
aaucgcuauuguucauguauuauuuaccuuuguaccacaguauugcacaccaaacucuugucua

SEQ ID NO: 474160 - RNA, 64 nt, Homo Sapiens
ccacuccuugggauaaaguuaaauaaaauuugagccacaguauauaauccaaccaaaaauaaug

SEQ ID NO: 474161 - RNA, 64 nt, Homo Sapiens
ugaaggcaucugcuuucuuuacaguaucagaguccaagaacaggaugucaccauagauaaaagc

SEQ ID NO: 474162 - RNA, 64 nt, Homo Sapiens
gggucccuuccuuucuccuuuccucucuacugcucaagaacagauuugaggccaggugcggugc

SEQ ID NO: 474163 - RNA, 64 nt, Homo Sapiens
gcagugagaguugagcacagaguccuucacaaaccaagaacacacguaggccuucaacacaauu

SEQ ID NO: 474164 - RNA, 64 nt, Homo Sapiens
guaaagagaugaacgcaaugccaauaaaauugaacaagaacaaugaucaucugccuuugccaga

SEQ ID NO: 474165 - RNA, 64 nt, Homo Sapiens
auauaaaucuguauggcaccgugcauaugcugcacaagaacaaagaacagcagcaaguuuuuca

SEQ ID NO: 474166 - RNA, 64 nt, Homo Sapiens
accauauauggcaucagcuuuauagaguauaugccaagaacacuuguggaaguggucugaggca

SEQ ID NO: 474167 - RNA, 64 nt, Homo Sapiens
uugauaucauucagcugucccauaauugaauuuccaagaacaacuagucacuuguuuucauuau

SEQ ID NO: 474168 - RNA, 64 nt, Homo Sapiens
ucuugcacaagcaaaguauauugaaccaguuuuccaagaacaaaagaaagggcaaaaaauucau

SEQ ID NO: 474169 - RNA, 64 nt, Homo Sapiens
uggaauaaacuugaauuguguaaguuuuguguugcaagaacaaaugcuaaauaauacuguguuu

SEQ ID NO: 474170 - RNA, 64 nt, Homo Sapiens
cacccugguuaauaacaagugguuaaucuauuaucaagaacaguaacauagcauucuacagcag

SEQ ID NO: 474171 - RNA, 64 nt, Homo Sapiens
aagcaaacaaauccauaacaaccacaacaagcaacaagaacaagaacaacaacaagaagaaguu

SEQ ID NO: 474172 - RNA, 64 nt, Homo Sapiens
acaaauccauaacaaccacaacaagcaacaagaacaagaacaacaacaagaagaaguugcagua

SEQ ID NO: 474173 - RNA, 64 nt, Homo Sapiens
cagagcccgggccacuggcccgcugucuccucuccaagaacaaggcgcaucuccgugguuaucc

SEQ ID NO: 474174 - RNA, 64 nt, Homo Sapiens
caguagguucuucuccccugggggagacugacaccaagaacagccuggcgggggccucgugcaa

SEQ ID NO: 474175 - RNA, 64 nt, Homo Sapiens
cuuugcuauaauuguauaaauguacuuacagacacaagaacaauugagaagugccugauguuga

SEQ ID NO: 474176 - RNA, 64 nt, Homo Sapiens
aguguuccugauaagauuucuccuaaauguuuaacaagaacacaaucuucauuggcuugguauu

SEQ ID NO: 474177 - RNA, 64 nt, Homo Sapiens
ugugaucaacuguucagggucucucucuuacaaccaagaacauuaucuuaguggaagaugguac

SEQ ID NO: 474178 - RNA, 64 nt, Homo Sapiens
aggaaacaucuccacccaagacgucuuuggaauccaagaacaggaagccaagagagugagcagg

SEQ ID NO: 474179 - RNA, 64 nt, Homo Sapiens
auuuuauauuuccaauuguuaaagaaaaauauuucaagaacaaaucuucucucaggaaaauugc

SEQ ID NO: 474180 - RNA, 64 nt, Homo Sapiens
aauugccuuucucuauuuguuaagaauuuuuauacaagaacaccaauauacccccuuuauuuua

SEQ ID NO: 474181 - RNA, 64 nt, Homo Sapiens
uaacuucuucagauacauuuaaucaaaauuaggacaagaacagagaaauuggauuuuuauuuag

SEQ ID NO: 474182 - RNA, 64 nt, Homo Sapiens
gcacaaauauaaaaaaaguuggugagugguugaccaagaacacuucagauagacgcagaaaauu

SEQ ID NO: 474183 - RNA, 64 nt, Homo Sapiens
uuuuuucauggugaaaucaaggcucuuaaacgaucaagaacaauacaauagcaguacaccacua

SEQ ID NO: 474184 - RNA, 64 nt, Homo Sapiens
acuccaucuaaagaagaaaauccagccugggcaacaagaacaaaccaagaucaugccacugcac

SEQ ID NO: 474185 - RNA, 64 nt, Homo Sapiens
auauacgacauauacauuuuuucaacaugcuuuccaagaacaaugagaaacaccucacugcagu

SEQ ID NO: 474186 - RNA, 64 nt, Homo Sapiens
augguuugauuucauuaauggguucuggaccuuacaagaacaaguacagcuuuuaaaauauugu

SEQ ID NO: 474187 - RNA, 64 nt, Homo Sapiens; identical to SEQ ID NO: 80674

SEQ ID NO: 474188 - RNA, 64 nt, Homo Sapiens; identical to SEQ ID NO: 80675

SEQ ID NO: 474189 - RNA, 64 nt, Homo Sapiens; identical to SEQ ID NO: 80676

SEQ ID NO: 474190 - RNA, 64 nt, Homo Sapiens; identical to SEQ ID NO: 80677

SEQ ID NO: 474191 - RNA, 64 nt, Homo Sapiens; identical to SEQ ID NO: 80678

SEQ ID NO: 474192 - RNA, 64 nt, Homo Sapiens; identical to SEQ ID NO: 80679

SEQ ID NO: 474193 - RNA, 64 nt, Homo Sapiens; identical to SEQ ID NO: 80680

SEQ ID NO: 474194 - RNA, 64 nt, Homo Sapiens; identical to SEQ ID NO: 80681

SEQ ID NO: 474195 - RNA, 64 nt, Homo Sapiens; identical to SEQ ID NO: 80682

SEQ ID NO: 474196 - RNA, 64 nt, Homo Sapiens; identical to SEQ ID NO: 80683

SEQ ID NO: 474197 - RNA, 64 nt, Homo Sapiens; identical to SEQ ID NO: 80684

SEQ ID NO: 474198 - RNA, 64 nt, Homo Sapiens; identical to SEQ ID NO: 80685

SEQ ID NO: 474199 - RNA, 64 nt, Homo Sapiens
cugcgauuggaaauuuccagugaacgcgagcccaaagugccaguagaaucaggguccucgggca

SEQ ID NO: 474200 - RNA, 64 nt, Homo Sapiens
ucaucauaauucaaguguucgggccagagcccagaagugccaccggacgaggcccagcucagcu

SEQ ID NO: 474201 - RNA, 64 nt, Homo Sapiens
guucauguauguucagaagaaauucugucauagaaagugccagaaaguguuuaacuugucaaaa

SEQ ID NO: 474202 - RNA, 64 nt, Homo Sapiens
ugugacuggucagguauuucaguucuuaggaaggaagugccaaguuuguuuuuggguuccugga

SEQ ID NO: 474203 - RNA, 64 nt, Homo Sapiens
cugccauggaugcaguagaggaaaguggugguacaagugccaugauugauuagcaaugucugca

SEQ ID NO: 474204 - RNA, 64 nt, Homo Sapiens
aggagucugagacauguaugauugaaugggugccaagugccagggggcggaguccccagcagau

SEQ ID NO: 474205 - RNA, 64 nt, Homo Sapiens
ugucucuggaagugcaaccacccaaugucucuggaagugccaccuggaagugccaccuggaagu

SEQ ID NO: 474206 - RNA, 64 nt, Homo Sapiens
gcaaccacccaaugucucuggaagugccaccuggaagugccaccuggaagugucucuggaagag

SEQ ID NO: 474207 - RNA, 64 nt, Homo Sapiens
ucacuggccguuaacucagcacagggagggucagaagugccaagcuggcacagcugcagagugc

SEQ ID NO: 474208 - RNA, 64 nt, Homo Sapiens
cucuuuuaggcugugguuagucucccuugcuuagaagugccagcgggugcugggccuuggaccu

SEQ ID NO: 474209 - RNA, 64 nt, Homo Sapiens; identical to SEQ ID NO: 274737

SEQ ID NO: 474210 - RNA, 64 nt, Homo Sapiens; identical to SEQ ID NO: 274738

SEQ ID NO: 474211 - RNA, 64 nt, Homo Sapiens; identical to SEQ ID NO: 274739

SEQ ID NO: 474212 - RNA, 64 nt, Homo Sapiens; identical to SEQ ID NO: 274740

SEQ ID NO: 474213 - RNA, 64 nt, Homo Sapiens; identical to SEQ ID NO: 274741

SEQ ID NO: 474214 - RNA, 64 nt, Homo Sapiens; identical to SEQ ID NO: 274742

SEQ ID NO: 474215 - RNA, 64 nt, Homo Sapiens; identical to SEQ ID NO: 274743

SEQ ID NO: 474216 - RNA, 64 nt, Homo Sapiens; identical to SEQ ID NO: 182067

SEQ ID NO: 474217 - RNA, 64 nt, Homo Sapiens; identical to SEQ ID NO: 182068

SEQ ID NO: 474218 - RNA, 64 nt, Homo Sapiens; identical to SEQ ID NO: 182069

SEQ ID NO: 474219 - RNA, 64 nt, Homo Sapiens; identical to SEQ ID NO: 182070

SEQ ID NO: 474220 - RNA, 64 nt, Homo Sapiens; identical to SEQ ID NO: 182071

SEQ ID NO: 474221 - RNA, 64 nt, Homo Sapiens; identical to SEQ ID NO: 182072

SEQ ID NO: 474222 - RNA, 64 nt, Homo Sapiens; identical to SEQ ID NO: 182073

SEQ ID NO: 474223 - RNA, 64 nt, Homo Sapiens; identical to SEQ ID NO: 182074

SEQ ID NO: 474224 - RNA, 64 nt, Homo Sapiens; identical to SEQ ID NO: 182075

SEQ ID NO: 474225 - RNA, 64 nt, Homo Sapiens; identical to SEQ ID NO: 182076

SEQ ID NO: 474226 - RNA, 64 nt, Homo Sapiens; identical to SEQ ID NO: 182077

SEQ ID NO: 474227 - RNA, 64 nt, Homo Sapiens; identical to SEQ ID NO: 182078

SEQ ID NO: 474228 - RNA, 64 nt, Homo Sapiens; identical to SEQ ID NO: 182079

SEQ ID NO: 474229 - RNA, 64 nt, Homo Sapiens; identical to SEQ ID NO: 182080

SEQ ID NO: 474230 - RNA, 64 nt, Homo Sapiens; identical to SEQ ID NO: 182081

SEQ ID NO: 474231 - RNA, 64 nt, Homo Sapiens; identical to SEQ ID NO: 182082

SEQ ID NO: 474232 - RNA, 64 nt, Homo Sapiens; identical to SEQ ID NO: 182083

SEQ ID NO: 474233 - RNA, 64 nt, Homo Sapiens; identical to SEQ ID NO: 182084

SEQ ID NO: 474234 - RNA, 64 nt, Homo Sapiens; identical to SEQ ID NO: 182085

SEQ ID NO: 474235 - RNA, 64 nt, Homo Sapiens; identical to SEQ ID NO: 182086

SEQ ID NO: 474236 - RNA, 64 nt, Homo Sapiens; identical to SEQ ID NO: 182087

SEQ ID NO: 474237 - RNA, 64 nt, Homo Sapiens; identical to SEQ ID NO: 182088

SEQ ID NO: 474238 - RNA, 64 nt, Homo Sapiens; identical to SEQ ID NO: 182089

SEQ ID NO: 474239 - RNA, 64 nt, Homo Sapiens; identical to SEQ ID NO: 182090

SEQ ID NO: 474240 - RNA, 64 nt, Homo Sapiens; identical to SEQ ID NO: 182091

SEQ ID NO: 474241 - RNA, 64 nt, Homo Sapiens; identical to SEQ ID NO: 182092

SEQ ID NO: 474242 - RNA, 64 nt, Homo Sapiens; identical to SEQ ID NO: 182093

SEQ ID NO: 474243 - RNA, 64 nt, Homo Sapiens; identical to SEQ ID NO: 182094

SEQ ID NO: 474244 - RNA, 64 nt, Homo Sapiens; identical to SEQ ID NO: 182095

SEQ ID NO: 474245 - RNA, 64 nt, Homo Sapiens; identical to SEQ ID NO: 182096

SEQ ID NO: 474246 - RNA, 64 nt, Homo Sapiens; identical to SEQ ID NO: 182097

SEQ ID NO: 474247 - RNA, 64 nt, Homo Sapiens; identical to SEQ ID NO: 182098

SEQ ID NO: 474248 - RNA, 61 nt, Homo Sapiens
cccuuagggcaggaagggacgaugagcaagucugccacaccaccuggugacugggaagggc

SEQ ID NO: 474249 - RNA, 61 nt, Homo Sapiens
uguggguuucccagcuaacggacaagcuccccugccacacccagugcccacgcaugcucac

SEQ ID NO: 474250 - RNA, 61 nt, Homo Sapiens
gcccacacccaugcccaccacgucugcucaccugccacagaucauaccacaucaguguuuc

SEQ ID NO: 474251 - RNA, 61 nt, Homo Sapiens
gcgcuccggggccugagggcucuccucccaccugccacacaccagggcagccccaaccagg

SEQ ID NO: 474252 - RNA, 61 nt, Homo Sapiens
cccggcucuuccuguguggaggugaugguaccugccacaccacagcugcgcacacagcugc

SEQ ID NO: 474253 - RNA, 61 nt, Homo Sapiens
ggcacugugccagggcuggggccuucugcugcugccacacccagcucaggccugggccagc

SEQ ID NO: 474254 - RNA, 61 nt, Homo Sapiens
gcugcccugccucauagguaagcagggcuggcugccacaggccacuacaaacugaccccuc

SEQ ID NO: 474255 - RNA, 61 nt, Homo Sapiens
cuaggucuaagaguugaacgccuuguugcugcugccacauccucaguugagcugccucugg

SEQ ID NO: 474256 - RNA, 61 nt, Homo Sapiens
gagucuugccaugccuguguaaguugggucacugccacaugccuggacauuggacauugcu

SEQ ID NO: 474257 - RNA, 61 nt, Homo Sapiens
gagccacugucaugcaggucgugucuggacacugccacaugcugccacaucugggcauaca

SEQ ID NO: 474258 - RNA, 61 nt, Homo Sapiens
ugggcauacagugucuggacgugucuggacgcugccacauccugccacaucugggcauaca

SEQ ID NO: 474259 - RNA, 61 nt, Homo Sapiens
ugggcauacagugucuggaccuggacggaugcugccacaucccuggagggcagccacacag

SEQ ID NO: 474260 - RNA, 61 nt, Homo Sapiens
agcucauagcacaaaaaaaggauggaccagacugccacagcaaaaacacaguccugagagg

SEQ ID NO: 474261 - RNA, 61 nt, Homo Sapiens
aaaagaugaaauguaauuucugagcuauguacugccacaaaaagauaccauuauauuuaua

SEQ ID NO: 474262 - RNA, 61 nt, Homo Sapiens
agcccauggcacaacuaacagauagacuagacugccacagcaaaaaacacaaucuuaaggg

SEQ ID NO: 474263 - RNA, 61 nt, Homo Sapiens
gacuuuguucucauuaauauaggaauacgggcugccacauauuuuagccuuugaugguaag

SEQ ID NO: 474264 - RNA, 61 nt, Homo Sapiens
cgggauuucauuucugcuuuuuaaagagcaacugccacaugugcacugauauauauuuuuu

SEQ ID NO: 474265 - RNA, 61 nt, Homo Sapiens
gcacuggaauggacagcagggcccguggccccugccacagggccucgggcaggggucucag

SEQ ID NO: 474266 - RNA, 61 nt, Homo Sapiens
ccggaagccgcagggggcaccccccgacccccugccacaggcacggugaugcucgggucug

SEQ ID NO: 474267 - RNA, 61 nt, Homo Sapiens
ggccuccccagcugcuggccagacccuggcgcugccacaguccuggcacugcccaaggcca

SEQ ID NO: 474268 - RNA, 61 nt, Homo Sapiens
gugggaggagcgacugcccugcccaaaugaacugccacagcagggacagcuggaccgcaga

SEQ ID NO: 474269 - RNA, 61 nt, Homo Sapiens
caggggaaggcccugaggcgagaagaaguggcugccacaccucugccucagacguugccug

SEQ ID NO: 474270 - RNA, 61 nt, Homo Sapiens
cagaggagggcagagggagaguguggagacccugccacagcgagagacaggcagcccagca

SEQ ID NO: 474271 - RNA, 61 nt, Homo Sapiens
uguccuggccuuccucaugagguaagccgcucugccacacucugguacacugugccauggg

SEQ ID NO: 474272 - RNA, 61 nt, Homo Sapiens
gaaccauaucgaugaggucugguccgucaggcugccacacuucgcugcagcgcuugcugug

SEQ ID NO: 474273 - RNA, 61 nt, Homo Sapiens
cuacagggucacucaguauggagcccaggcccugccacaaccugcgggguccucauggggu

SEQ ID NO: 474274 - RNA, 61 nt, Homo Sapiens
gugaagaaggccuucaccuugauguuaguuucugccacaauagugcccaucuuccugaaag

SEQ ID NO: 474275 - RNA, 61 nt, Homo Sapiens
aggagagcaugcccauauuggcuuacuuugucugccacagacacagacagagggaguuggg

SEQ ID NO: 474276 - RNA, 61 nt, Homo Sapiens
caaacuccaccucuuggauuggcccuggcugcugccacacacauauccaagagcucagggc

SEQ ID NO: 474277 - RNA, 61 nt, Homo Sapiens
cccgacacuccugcuguccaacccaggccagcugccacaccgggcagacacagcuccaggg

SEQ ID NO: 474278 - RNA, 61 nt, Homo Sapiens
gaaguucauagccaggauagaguuuuuccaucugccacauguuucuugcugucuggaauuc

SEQ ID NO: 474279 - RNA, 61 nt, Homo Sapiens
ccuaaggcugagugagguguccgccaggcagcugccacaggccucucacucacuucuccac

SEQ ID NO: 474280 - RNA, 61 nt, Homo Sapiens
ggaugguggcucaggcgcucuacgccagcagcugccacaugaugccagcccgaggcacugc

SEQ ID NO: 474281 - RNA, 61 nt, Homo Sapiens
cagaauucgagacauacuuaagccgcaccaucugccacaaacgccgagggcugagcuccag

SEQ ID NO: 474282 - RNA, 61 nt, Homo Sapiens
agagacacggucacugauucacacccagucccugccacagaccgucucagacacgcacagu

SEQ ID NO: 474283 - RNA, 61 nt, Homo Sapiens
gugggccugcugcaugauucacacccagucccugccacagaccgucucagacacgcacagu

SEQ ID NO: 474284 - RNA, 61 nt, Homo Sapiens; identical to SEQ ID NO: 474283

SEQ ID NO: 474285 - RNA, 61 nt, Homo Sapiens
uccuuucccuccuggccugcgggcugcggcacugccacacaggcgccccgggugggcuuug

SEQ ID NO: 474286 - RNA, 61 nt, Homo Sapiens
gggagcuaagccggcccugggccuugcuugucugccacagcgccuucagugucacagcgug

SEQ ID NO: 474287 - RNA, 61 nt, Homo Sapiens
ccccuggaaaugcuaccuacgcuacacgucgcugccacaggcuggcaguagccucuuucca

SEQ ID NO: 474288 - RNA, 61 nt, Homo Sapiens
gccuggcaguagccucuuucgagggaacauccugccacaccggccaauccagggcagccca

SEQ ID NO: 474289 - RNA, 61 nt, Homo Sapiens
acugggcaacuauucaugagucccuaccugacugccacagaauuauaacauuuacuuuugc

SEQ ID NO: 474290 - RNA, 61 nt, Homo Sapiens
gcccggcuaauuuuuuguauacuacaggcgccugccacaaccagccuccugaguagcuggg

SEQ ID NO: 474291 - RNA, 61 nt, Homo Sapiens
gaagcucccaucacaagcuuggcauugcucucugccacacgugggcuuccucaggcuuguc

SEQ ID NO: 474292 - RNA, 61 nt, Homo Sapiens
cucugccacacgugggcuuccucaggcuugucugccacaagcuacuucucugagcucagaa

SEQ ID NO: 474293 - RNA, 57 nt, Homo Sapiens; identical to SEQ ID NO: 71857

SEQ ID NO: 474294 - RNA, 61 nt, Homo Sapiens
ggggcaggcgggagcaggcacgggggugaugcugccacagggggcuggugacacccagagc

SEQ ID NO: 474295 - RNA, 64 nt, Homo Sapiens; identical to SEQ ID NO: 232496

SEQ ID NO: 474296 - RNA, 64 nt, Homo Sapiens; identical to SEQ ID NO: 232497

SEQ ID NO: 474297 - RNA, 64 nt, Homo Sapiens; identical to SEQ ID NO: 232498

SEQ ID NO: 474298 - RNA, 64 nt, Homo Sapiens; identical to SEQ ID NO: 232499

SEQ ID NO: 474299 - RNA, 64 nt, Homo Sapiens; identical to SEQ ID NO: 232500

SEQ ID NO: 474300 - RNA, 64 nt, Homo Sapiens; identical to SEQ ID NO: 232501

SEQ ID NO: 474301 - RNA, 64 nt, Homo Sapiens; identical to SEQ ID NO: 232502

SEQ ID NO: 474302 - RNA, 64 nt, Homo Sapiens; identical to SEQ ID NO: 232503

SEQ ID NO: 474303 - RNA, 64 nt, Homo Sapiens; identical to SEQ ID NO: 232504

SEQ ID NO: 474304 - RNA, 64 nt, Homo Sapiens; identical to SEQ ID NO: 232505

SEQ ID NO: 474305 - RNA, 64 nt, Homo Sapiens; identical to SEQ ID NO: 232506

SEQ ID NO: 474306 - RNA, 64 nt, Homo Sapiens; identical to SEQ ID NO: 232507

SEQ ID NO: 474307 - RNA, 64 nt, Homo Sapiens; identical to SEQ ID NO: 232508

SEQ ID NO: 474308 - RNA, 64 nt, Homo Sapiens; identical to SEQ ID NO: 232509

SEQ ID NO: 474309 - RNA, 64 nt, Homo Sapiens; identical to SEQ ID NO: 232510

SEQ ID NO: 474310 - RNA, 64 nt, Homo Sapiens; identical to SEQ ID NO: 232511

SEQ ID NO: 474311 - RNA, 64 nt, Homo Sapiens; identical to SEQ ID NO: 232512

SEQ ID NO: 474312 - RNA, 64 nt, Homo Sapiens; identical to SEQ ID NO: 232513

SEQ ID NO: 474313 - RNA, 64 nt, Homo Sapiens; identical to SEQ ID NO: 395363

SEQ ID NO: 474314 - RNA, 64 nt, Homo Sapiens; identical to SEQ ID NO: 395364

SEQ ID NO: 474315 - RNA, 64 nt, Homo Sapiens; identical to SEQ ID NO: 395365

SEQ ID NO: 474316 - RNA, 64 nt, Homo Sapiens; identical to SEQ ID NO: 395366

SEQ ID NO: 474317 - RNA, 64 nt, Homo Sapiens; identical to SEQ ID NO: 395367

SEQ ID NO: 474318 - RNA, 64 nt, Homo Sapiens; identical to SEQ ID NO: 395368

SEQ ID NO: 474319 - RNA, 64 nt, Homo Sapiens; identical to SEQ ID NO: 395369

SEQ ID NO: 474320 - RNA, 64 nt, Homo Sapiens; identical to SEQ ID NO: 395370

SEQ ID NO: 474321 - RNA, 64 nt, Homo Sapiens; identical to SEQ ID NO: 395371

SEQ ID NO: 474322 - RNA, 64 nt, Homo Sapiens; identical to SEQ ID NO: 395372

SEQ ID NO: 474323 - RNA, 64 nt, Homo Sapiens; identical to SEQ ID NO: 395373

SEQ ID NO: 474324 - RNA, 64 nt, Homo Sapiens; identical to SEQ ID NO: 395374

SEQ ID NO: 474325 - RNA, 64 nt, Homo Sapiens; identical to SEQ ID NO: 395375

SEQ ID NO: 474326 - RNA, 64 nt, Homo Sapiens; identical to SEQ ID NO: 395376

SEQ ID NO: 474327 - RNA, 64 nt, Homo Sapiens; identical to SEQ ID NO: 395377

SEQ ID NO: 474328 - RNA, 64 nt, Homo Sapiens; identical to SEQ ID NO: 395378

SEQ ID NO: 474329 - RNA, 64 nt, Homo Sapiens; identical to SEQ ID NO: 395379

SEQ ID NO: 474330 - RNA, 64 nt, Homo Sapiens; identical to SEQ ID NO: 395380

SEQ ID NO: 474331 - RNA, 64 nt, Homo Sapiens; identical to SEQ ID NO: 395381

SEQ ID NO: 474332 - RNA, 64 nt, Homo Sapiens; identical to SEQ ID NO: 395382

SEQ ID NO: 474333 - RNA, 64 nt, Homo Sapiens; identical to SEQ ID NO: 395383

SEQ ID NO: 474334 - RNA, 64 nt, Homo Sapiens; identical to SEQ ID NO: 395384

SEQ ID NO: 474335 - RNA, 64 nt, Homo Sapiens; identical to SEQ ID NO: 395385

SEQ ID NO: 474336 - RNA, 64 nt, Homo Sapiens; identical to SEQ ID NO: 395386

SEQ ID NO: 474337 - RNA, 64 nt, Homo Sapiens; identical to SEQ ID NO: 395387

SEQ ID NO: 474338 - RNA, 64 nt, Homo Sapiens; identical to SEQ ID NO: 395388

SEQ ID NO: 474339 - RNA, 64 nt, Homo Sapiens; identical to SEQ ID NO: 395389

SEQ ID NO: 474340 - RNA, 64 nt, Homo Sapiens; identical to SEQ ID NO: 395390

SEQ ID NO: 474341 - RNA, 64 nt, Homo Sapiens; identical to SEQ ID NO: 395391

SEQ ID NO: 474342 - RNA, 64 nt, Homo Sapiens; identical to SEQ ID NO: 395392

SEQ ID NO: 474343 - RNA, 64 nt, Homo Sapiens; identical to SEQ ID NO: 395393

SEQ ID NO: 474344 - RNA, 64 nt, Homo Sapiens; identical to SEQ ID NO: 395394

SEQ ID NO: 474345 - RNA, 64 nt, Homo Sapiens; identical to SEQ ID NO: 395395

SEQ ID NO: 474346 - RNA, 64 nt, Homo Sapiens; identical to SEQ ID NO: 395396

SEQ ID NO: 474347 - RNA, 64 nt, Homo Sapiens; identical to SEQ ID NO: 395397

SEQ ID NO: 474348 - RNA, 64 nt, Homo Sapiens; identical to SEQ ID NO: 395398

SEQ ID NO: 474349 - RNA, 64 nt, Homo Sapiens; identical to SEQ ID NO: 395399

SEQ ID NO: 474350 - RNA, 64 nt, Homo Sapiens; identical to SEQ ID NO: 395400

SEQ ID NO: 474351 - RNA, 64 nt, Homo Sapiens; identical to SEQ ID NO: 395401

SEQ ID NO: 474352 - RNA, 64 nt, Homo Sapiens; identical to SEQ ID NO: 395402

SEQ ID NO: 474353 - RNA, 64 nt, Homo Sapiens; identical to SEQ ID NO: 395403

SEQ ID NO: 474354 - RNA, 64 nt, Homo Sapiens; identical to SEQ ID NO: 395404

SEQ ID NO: 474355 - RNA, 64 nt, Homo Sapiens; identical to SEQ ID NO: 395405

SEQ ID NO: 474356 - RNA, 64 nt, Homo Sapiens; identical to SEQ ID NO: 395406

SEQ ID NO: 474357 - RNA, 64 nt, Homo Sapiens; identical to SEQ ID NO: 395407

SEQ ID NO: 474358 - RNA, 64 nt, Homo Sapiens; identical to SEQ ID NO: 395408

SEQ ID NO: 474359 - RNA, 64 nt, Homo Sapiens; identical to SEQ ID NO: 395409

SEQ ID NO: 474360 - RNA, 64 nt, Homo Sapiens; identical to SEQ ID NO: 395410

SEQ ID NO: 474361 - RNA, 64 nt, Homo Sapiens; identical to SEQ ID NO: 395411

SEQ ID NO: 474362 - RNA, 64 nt, Homo Sapiens; identical to SEQ ID NO: 395412

SEQ ID NO: 474363 - RNA, 64 nt, Homo Sapiens; identical to SEQ ID NO: 395413

SEQ ID NO: 474364 - RNA, 64 nt, Homo Sapiens; identical to SEQ ID NO: 395414

SEQ ID NO: 474365 - RNA, 64 nt, Homo Sapiens; identical to SEQ ID NO: 395415

SEQ ID NO: 474366 - RNA, 64 nt, Homo Sapiens; identical to SEQ ID NO: 395416

SEQ ID NO: 474367 - RNA, 64 nt, Homo Sapiens; identical to SEQ ID NO: 395417

SEQ ID NO: 474368 - RNA, 64 nt, Homo Sapiens; identical to SEQ ID NO: 395418

SEQ ID NO: 474369 - RNA, 64 nt, Homo Sapiens; identical to SEQ ID NO: 395419

SEQ ID NO: 474370 - RNA, 64 nt, Homo Sapiens; identical to SEQ ID NO: 123308

SEQ ID NO: 474371 - RNA, 64 nt, Homo Sapiens; identical to SEQ ID NO: 123309

SEQ ID NO: 474372 - RNA, 64 nt, Homo Sapiens; identical to SEQ ID NO: 123310

SEQ ID NO: 474373 - RNA, 64 nt, Homo Sapiens; identical to SEQ ID NO: 123311

SEQ ID NO: 474374 - RNA, 64 nt, Homo Sapiens; identical to SEQ ID NO: 123312

SEQ ID NO: 474375 - RNA, 64 nt, Homo Sapiens; identical to SEQ ID NO: 123313

SEQ ID NO: 474376 - RNA, 64 nt, Homo Sapiens; identical to SEQ ID NO: 123314

SEQ ID NO: 474377 - RNA, 64 nt, Homo Sapiens; identical to SEQ ID NO: 123315

SEQ ID NO: 474378 - RNA, 64 nt, Homo Sapiens; identical to SEQ ID NO: 123316

SEQ ID NO: 474379 - RNA, 64 nt, Homo Sapiens; identical to SEQ ID NO: 123317

SEQ ID NO: 474380 - RNA, 64 nt, Homo Sapiens; identical to SEQ ID NO: 123318

SEQ ID NO: 474381 - RNA, 64 nt, Homo Sapiens; identical to SEQ ID NO: 123319

SEQ ID NO: 474382 - RNA, 64 nt, Homo Sapiens; identical to SEQ ID NO: 123320

SEQ ID NO: 474383 - RNA, 64 nt, Homo Sapiens; identical to SEQ ID NO: 123321

SEQ ID NO: 474384 - RNA, 64 nt, Homo Sapiens; identical to SEQ ID NO: 123322

SEQ ID NO: 474385 - RNA, 64 nt, Homo Sapiens; identical to SEQ ID NO: 123323

SEQ ID NO: 474386 - RNA, 64 nt, Homo Sapiens; identical to SEQ ID NO: 123324

SEQ ID NO: 474387 - RNA, 64 nt, Homo Sapiens; identical to SEQ ID NO: 123325

SEQ ID NO: 474388 - RNA, 64 nt, Homo Sapiens; identical to SEQ ID NO: 123326

SEQ ID NO: 474389 - RNA, 64 nt, Homo Sapiens; identical to SEQ ID NO: 123327

SEQ ID NO: 474390 - RNA, 64 nt, Homo Sapiens; identical to SEQ ID NO: 123328

SEQ ID NO: 474391 - RNA, 64 nt, Homo Sapiens; identical to SEQ ID NO: 123329

SEQ ID NO: 474392 - RNA, 64 nt, Homo Sapiens; identical to SEQ ID NO: 123330

SEQ ID NO: 474393 - RNA, 64 nt, Homo Sapiens; identical to SEQ ID NO: 123331

SEQ ID NO: 474394 - RNA, 64 nt, Homo Sapiens; identical to SEQ ID NO: 123332

SEQ ID NO: 474395 - RNA, 64 nt, Homo Sapiens; identical to SEQ ID NO: 123333

SEQ ID NO: 474396 - RNA, 64 nt, Homo Sapiens; identical to SEQ ID NO: 123334

SEQ ID NO: 474397 - RNA, 64 nt, Homo Sapiens; identical to SEQ ID NO: 123335

SEQ ID NO: 474398 - RNA, 64 nt, Homo Sapiens; identical to SEQ ID NO: 123336

SEQ ID NO: 474399 - RNA, 64 nt, Homo Sapiens; identical to SEQ ID NO: 123337

SEQ ID NO: 474400 - RNA, 64 nt, Homo Sapiens; identical to SEQ ID NO: 123338

SEQ ID NO: 474401 - RNA, 64 nt, Homo Sapiens; identical to SEQ ID NO: 123339

SEQ ID NO: 474402 - RNA, 64 nt, Homo Sapiens; identical to SEQ ID NO: 123340

SEQ ID NO: 474403 - RNA, 64 nt, Homo Sapiens; identical to SEQ ID NO: 123341

SEQ ID NO: 474404 - RNA, 61 nt, Homo Sapiens; identical to SEQ ID NO: 123342

SEQ ID NO: 474405 - RNA, 64 nt, Homo Sapiens; identical to SEQ ID NO: 123343

SEQ ID NO: 474406 - RNA, 64 nt, Homo Sapiens; identical to SEQ ID NO: 123344

SEQ ID NO: 474407 - RNA, 64 nt, Homo Sapiens; identical to SEQ ID NO: 123345

SEQ ID NO: 474408 - RNA, 64 nt, Homo Sapiens; identical to SEQ ID NO: 123346

SEQ ID NO: 474409 - RNA, 64 nt, Homo Sapiens; identical to SEQ ID NO: 123347

SEQ ID NO: 474410 - RNA, 64 nt, Homo Sapiens; identical to SEQ ID NO: 123348

SEQ ID NO: 474411 - RNA, 64 nt, Homo Sapiens; identical to SEQ ID NO: 123349

SEQ ID NO: 474412 - RNA, 64 nt, Homo Sapiens; identical to SEQ ID NO: 123350

SEQ ID NO: 474413 - RNA, 64 nt, Homo Sapiens; identical to SEQ ID NO: 123351

SEQ ID NO: 474414 - RNA, 64 nt, Homo Sapiens; identical to SEQ ID NO: 123352

SEQ ID NO: 474415 - RNA, 64 nt, Homo Sapiens; identical to SEQ ID NO: 123353

SEQ ID NO: 474416 - RNA, 64 nt, Homo Sapiens; identical to SEQ ID NO: 123354

SEQ ID NO: 474417 - RNA, 64 nt, Homo Sapiens; identical to SEQ ID NO: 123355

SEQ ID NO: 474418 - RNA, 64 nt, Homo Sapiens; identical to SEQ ID NO: 123356

SEQ ID NO: 474419 - RNA, 64 nt, Homo Sapiens; identical to SEQ ID NO: 123357

SEQ ID NO: 474420 - RNA, 64 nt, Homo Sapiens; identical to SEQ ID NO: 123358

SEQ ID NO: 474421 - RNA, 64 nt, Homo Sapiens; identical to SEQ ID NO: 123359

SEQ ID NO: 474422 - RNA, 64 nt, Homo Sapiens; identical to SEQ ID NO: 123360

SEQ ID NO: 474423 - RNA, 64 nt, Homo Sapiens; identical to SEQ ID NO: 123361

SEQ ID NO: 474424 - RNA, 64 nt, Homo Sapiens; identical to SEQ ID NO: 123362

SEQ ID NO: 474425 - RNA, 64 nt, Homo Sapiens; identical to SEQ ID NO: 123363

SEQ ID NO: 474426 - RNA, 64 nt, Homo Sapiens; identical to SEQ ID NO: 123364

SEQ ID NO: 474427 - RNA, 64 nt, Homo Sapiens; identical to SEQ ID NO: 123365

SEQ ID NO: 474428 - RNA, 64 nt, Homo Sapiens; identical to SEQ ID NO: 123366

SEQ ID NO: 474429 - RNA, 64 nt, Homo Sapiens; identical to SEQ ID NO: 123367

SEQ ID NO: 474430 - RNA, 64 nt, Homo Sapiens; identical to SEQ ID NO: 123368

SEQ ID NO: 474431 - RNA, 64 nt, Homo Sapiens; identical to SEQ ID NO: 123369

SEQ ID NO: 474432 - RNA, 63 nt, Homo Sapiens
uuuucuuuccacacaggauuccguuggugaaccuguaaaaacaaaacaaacaaaacaaaacaa

SEQ ID NO: 474433 - RNA, 63 nt, Homo Sapiens
acagagcaggacgcucuaggccaaaucuauuuuuguaaaaaugcucaugccuaugggugacug

SEQ ID NO: 474434 - RNA, 63 nt, Homo Sapiens
auuuauugagauugaauuaugccaccacguuuauguaaaaaugaagguggcaccguggugaga

SEQ ID NO: 474435 - RNA, 63 nt, Homo Sapiens
guggugagaccuaaugagaaauaguuacucaguuguaaaaauuuugauuuauucucuuucuuc

SEQ ID NO: 474436 - RNA, 63 nt, Homo Sapiens
cuuugucaucuguuagacucuguaugugugauuuguaaaaagcaggcugaaacuauggacaug

SEQ ID NO: 474437 - RNA, 63 nt, Homo Sapiens
uugaaccccuaggcuucaggaaaacugcucuuuuguaaaaagaauagcgaugacauuuucuaa

SEQ ID NO: 474438 - RNA, 63 nt, Homo Sapiens
cauuugcacuguucagacauauauauguauguauguaaaaauuauauauacacaaauuagcug

SEQ ID NO: 474439 - RNA, 63 nt, Homo Sapiens
gcuaaagagacuuggcaccagcuuuguucaaacuguaaaaauagcaauuugccccuacucgcu

SEQ ID NO: 474440 - RNA, 63 nt, Homo Sapiens
gccuuuuaaguuacugacaucagcuuccaccaguguaaaaauugaguaaaaccugaaguuuug

SEQ ID NO: 474441 - RNA, 63 nt, Homo Sapiens
auagauauauuccaagccgccugacgaucuaauuguaaaaaguaaagcauacaaauacuagaa

SEQ ID NO: 474442 - RNA, 63 nt, Homo Sapiens
gacaacuuuagauucugaggaucaagacuugauuguaaaaauuggcaagacagaaauaagaga

SEQ ID NO: 474443 - RNA, 63 nt, Homo Sapiens
gauguuucauccucugauugccuuuucaugacguguaaaaaaucagcguccuauaauccuaga

SEQ ID NO: 474444 - RNA, 63 nt, Homo Sapiens
ggagauuucagaagacgggccgguaggcacagguguaaaaaggguuguaaaaaggggagauuu

SEQ ID NO: 474445 - RNA, 63 nt, Homo Sapiens
ggagauuucgguaggcacaguaguaggcacaguuguaaaaagggacuuggaauaucagcagag

SEQ ID NO: 474446 - RNA, 63 nt, Homo Sapiens
aaaaaaaaaaaaaggcaaagcuuguaaaacuuauguaaaaaaaucacuguaaaaauguauuau

SEQ ID NO: 474447 - RNA, 63 nt, Homo Sapiens
uauuaucuuguaaaacuuaucacaucaggucacuguaaaaaugccaaguugcaaaguuguauc

SEQ ID NO: 474448 - RNA, 63 nt, Homo Sapiens
ugaaaaaaugaagaaaaauguauuuucccuuuauguaaaaauuagugaauaucuuaugaauua

SEQ ID NO: 474449 - RNA, 63 nt, Homo Sapiens
gggaacuugagagcuuuuacugugauucuucaauguaaaaaauaaacaacaaugucaaacugu

SEQ ID NO: 474450 - RNA, 63 nt, Homo Sapiens
auauauacaaguguaugaugcuuuuuaccucuguguaaaaaauuugauuuuuuuauaauaagc

SEQ ID NO: 474451 - RNA, 63 nt, Homo Sapiens
cuuccaaugccuaagugucuaaacaaggccauauguaaaaacccucauuuauacuuggggaaa

SEQ ID NO: 474452 - RNA, 63 nt, Homo Sapiens
aaauaaguuauaacuguuauuguauuuaaauauuguaaaaagaaauagcuggcgagugcuuuc

SEQ ID NO: 474453 - RNA, 63 nt, Homo Sapiens
aacagcaaacaaaaaggugacaaaggaaucuaguguaaaaaacuucauuaucuuuaaugaaga

SEQ ID NO: 474454 - RNA, 63 nt, Homo Sapiens
gcaguaaauauuuacuauuuaaaaugucuuucauguaaaaaguaccaacaacaauguguugua

SEQ ID NO: 474455 - RNA, 63 nt, Homo Sapiens
ucuuucauguaaaaagugcaaacaacaauguguuguaaaaauguuuguguugcagccucaacc

SEQ ID NO: 474456 - RNA, 63 nt, Homo Sapiens
agaucuagaguuuagagacaucucaaguguggcuguaaaaaucaguuuaaguuuacgucauug

SEQ ID NO: 474457 - RNA, 63 nt, Homo Sapiens
uuauuugaaaucuccuaaguuaaacaugagcgauguaaaaacuagcucagauugucgaguuag

SEQ ID NO: 474458 - RNA, 63 nt, Homo Sapiens
uuaaaagaccauaagcaaacugguuauuuaaaauguaaaaaggaauaugaaagucuuauuaaa

SEQ ID NO: 474459 - RNA, 63 nt, Homo Sapiens
uaaaggcauugauauuuuagaugcacccguguuuguaaaaauguagagcacaauggaauuaug

SEQ ID NO: 474460 - RNA, 63 nt, Homo Sapiens
uuaguguauuagagaaguuuuccagagaugucauguaaaaaagcauuucuuccauuaacugcu

SEQ ID NO: 474461 - RNA, 63 nt, Homo Sapiens
guugaguucuguuuaaagaauuuuuuuuaaaauuguaaaaauuggcuauuuuugagggaugua

SEQ ID NO: 474462 - RNA, 63 nt, Homo Sapiens
ugcaugggauauuugauuacccaccugaucaaauguaaaaacaaugaguccuugugauuaggc

SEQ ID NO: 474463 - RNA, 63 nt, Homo Sapiens
gggcugcauucuuguugguacuucugccuaacuuguaaaaaggucagcaagacuuuauaauuc

SEQ ID NO: 474464 - RNA, 63 nt, Homo Sapiens
aaggggaaauacuuuaauuuuuuuucuuaauaguguaaaaauucccugagcuaagcuaaaacc

SEQ ID NO: 474465 - RNA, 63 nt, Homo Sapiens
uucuucaaacacucuuaaauuuuucuuaaguaauguaaaaauggaacugccaauuuuauuucu

SEQ ID NO: 474466 - RNA, 63 nt, Homo Sapiens
uucuuauucauuaaaugaauucaacauuuucucuguaaaaacaauagaguuucaguacaugaa

SEQ ID NO: 474467 - RNA, 63 nt, Homo Sapiens
uaauguacauaaauguuacauuuguaaagaaaauguaaaaauguaacuauagcauaugaauug

SEQ ID NO: 474468 - RNA, 63 nt, Homo Sapiens
uacuacauuugaaauuauuuuuacaaaauuuccuguaaaaaaaaccaguaccuauuuuuacuc

SEQ ID NO: 474469 - RNA, 63 nt, Homo Sapiens
uuuguuuauauagaccuaucgaauaagaucauuuguaaaaaugaaggauaccuggagcacaag

SEQ ID NO: 474470 - RNA, 63 nt, Homo Sapiens
aguauauauacauaucuuuuuugugauguuacuuguaaaaaaagcaugugaagaugugaucau

SEQ ID NO: 474471 - RNA, 63 nt, Homo Sapiens
acuguagcuuauauucuuuaaucuguguuauuuuguaaaaauaaauuaacacaguauucauuc

SEQ ID NO: 474472 - RNA, 63 nt, Homo Sapiens
uucuucuucugagaaugugacuuuuucugguguuguaaaaaagaaaaaaaaaagaaugcucau

SEQ ID NO: 474473 - RNA, 63 nt, Homo Sapiens
uguuguaaaaaagaaaaaaaaaagaaugcucauuguaaaaauaaaaaaauaauaauaagcaag

SEQ ID NO: 474474 - RNA, 63 nt, Homo Sapiens
ugggaauuucuuuuccuacgggguacgugauuuuguaaaaaggaaguauuucucccaaaauug

SEQ ID NO: 474475 - RNA, 63 nt, Homo Sapiens
augcuaguuuaaaaaagaaaauauguaauauaauguaaaaaaaaacaaaaaaaagcuuuuaug

SEQ ID NO: 474476 - RNA, 63 nt, Homo Sapiens
ugaaaacguuugauuauuuucucaguguauuuuuguaaaaaauauauaaaggggguguuaauc

SEQ ID NO: 474477 - RNA, 63 nt, Homo Sapiens
cugccaccaguguccacccuccggcccccgucuuguaaaaaggggaggagaauuagccaaaca

SEQ ID NO: 474478 - RNA, 63 nt, Homo Sapiens
uacgucucacuugaaauugcuuuguauacauuuuguaaaaauauuuauaaaauguuuuguaaa

SEQ ID NO: 474479 - RNA, 63 nt, Homo Sapiens
uauacauuuuguaaaaauauuuauaaaauguuuuguaaaaaaaaaaaaacuauaacaaauugc

SEQ ID NO: 474480 - RNA, 63 nt, Homo Sapiens
ucugauaaaacucagaauuucuuuuuaagcaguuguaaaaauugucauguuguaauucauuac

SEQ ID NO: 474481 - RNA, 63 nt, Homo Sapiens
gugaaccucaugcaugaaagcagcacauuaaauuguaaaaauacaaacagaucgugugaucau

SEQ ID NO: 474482 - RNA, 63 nt, Homo Sapiens
uaauuaaagaaaugcaugugugugagaaaucuauguaaaaaaaacccaugaagcaagaauaga

SEQ ID NO: 474483 - RNA, 63 nt, Homo Sapiens
uccuuaugucugaugcuguccccaaauggccaguguaaaaaugagagugaauagauccuaagu

SEQ ID NO: 474484 - RNA, 63 nt, Homo Sapiens
auuguuuuuggauauaaagcaguauuauguauuuguaaaaaccugacuuuuugagcaccuuuc

SEQ ID NO: 474485 - RNA, 63 nt, Homo Sapiens
uuuaugguaacugguuucuuuuacauuuaucuuuguaaaaagauuuaaaaguaguaagccaca

SEQ ID NO: 474486 - RNA, 63 nt, Homo Sapiens
ucaccauggcuuucauccaauggguacagcuuuuguaaaaauggaggacguugaguggauucc

SEQ ID NO: 474487 - RNA, 63 nt, Homo Sapiens
guuuccuuagaagucauaaacuuuauuauuuauuguaaaaaaaucugcaaaucccaaaucuuu

SEQ ID NO: 474488 - RNA, 63 nt, Homo Sapiens
aagaguauuuauacuggaaagaaacccuacaaauguaaaaaacguggcaaugccuuuaacugg

SEQ ID NO: 474489 - RNA, 63 nt, Homo Sapiens
guaagaauccauacugaagaaaacuccuggaaguguaaaaaauguggcaacacuuuuaauaaa

SEQ ID NO: 474490 - RNA, 63 nt, Homo Sapiens
cagcccuauggaauuugcaaucugugauugccuuguaaaaaggagagugcauauggcacugca

SEQ ID NO: 474491 - RNA, 63 nt, Homo Sapiens
auagaaaauauaugaaccaaagugauuugaguuuguaaaaauguaaaauaguaugaacaaaau

SEQ ID NO: 474492 - RNA, 63 nt, Homo Sapiens
caaaaguuugcuuguuuaaaaugacaguugugauguaaaaaguuuaagaaauaugaaugugag

SEQ ID NO: 474493 - RNA, 63 nt, Homo Sapiens
uacuuuuuuaaagcugaguaguuaagaauucccuguaaaaacaaaacccuguaaauugagccu

SEQ ID NO: 474494 - RNA, 63 nt, Homo Sapiens
aaagcaaguguaauuaauucaaaguacuguuaauguaaaaaauuauuagagaacugugauuua

SEQ ID NO: 474495 - RNA, 63 nt, Homo Sapiens
ggaaauggugcaugucauugcaaggugguuuauuguaaaaacacacuuccaaaaacaagggaa

SEQ ID NO: 474496 - RNA, 63 nt, Homo Sapiens
cauuguagauaauugaauguaguuuuccccguuuguaaaaagagaugugccuguaaaccaagg

SEQ ID NO: 474497 - RNA, 63 nt, Homo Sapiens
aacggcuucucugauauuuaaagcagacgaugcuguaaaaacuaccuggucaacuuagcuuuu

SEQ ID NO: 474498 - RNA, 63 nt, Homo Sapiens
gccuauuuauauauguugaaauacaauuucaaauguaaaaacauaaaaguugugcaugggcuu

SEQ ID NO: 474499 - RNA, 63 nt, Homo Sapiens
caauuuaaauuuuaauacaguuaaaaaacaacuuguaaaaaugcaauguaaauagaacacuaa

SEQ ID NO: 474500 - RNA, 63 nt, Homo Sapiens
aaaauauuuuuuaauuuaauggucaguauauuuuguaaaaaucauguuaauuuauuucauagu

SEQ ID NO: 474501 - RNA, 63 nt, Homo Sapiens
uucugagcagcauuuugguauuuaaacauuucuuguaaaaagcugagacaguuuguaagaaaa

SEQ ID NO: 474502 - RNA, 63 nt, Homo Sapiens
uuagaggcuuaccccuguaaguguacauuuuuuuguaaaaaguuauauauccaaagauauagu

SEQ ID NO: 474503 - RNA, 63 nt, Homo Sapiens
aaaguguaaaauauguauauuuauuuguuaaauuguaaaaaaauagaggauguauuuauauaa

SEQ ID NO: 474504 - RNA, 63 nt, Homo Sapiens
auucuuaguuugugggccuuaaaagaaaaaagauguaaaaacccaagacucccucucaaaaga

SEQ ID NO: 474505 - RNA, 63 nt, Homo Sapiens
accugacuuaguaaugcgaaaaccauuuaaaaauguaaaaacggguauuuauaugaccuuugu

SEQ ID NO: 474506 - RNA, 63 nt, Homo Sapiens
uaaauauacuauugcacuaacaaccaaaauuacuguaaaaaaauccuuaaaucucuuguaugg

SEQ ID NO: 474507 - RNA, 63 nt, Homo Sapiens
gugguuuggccauuaauuugauauuuuagaaaauguaaaaauguggccugcugaggcugcccc

SEQ ID NO: 474508 - RNA, 63 nt, Homo Sapiens
aaaaaucucaguuauguuuuacuuuauguacaguguaaaaaaacccugugaaugccaaaguaa

SEQ ID NO: 474509 - RNA, 63 nt, Homo Sapiens
uuaaagaauaaaaauacuucgaaaaaauuaaaauguaaaaaaaaaaauuaaguucugaaaauu

SEQ ID NO: 474510 - RNA, 63 nt, Homo Sapiens
uguauuauacaucuguauuuacagcuucuugcuuguaaaaauauguaaaaaaaagucuuaaca

SEQ ID NO: 474511 - RNA, 63 nt, Homo Sapiens
agucuuaacaacagcuucuuuauaaacucuaaguguaaaaaaacuuccuuccugccccaaaau

SEQ ID NO: 474512 - RNA, 63 nt, Homo Sapiens
auuucuaagaauguuuuucuauaaauuacuaauuguaaaaagucuugcuuuuuaaaacaaguu

SEQ ID NO: 474513 - RNA, 63 nt, Homo Sapiens
ucuccuugaggauagggauagguaagguaaacuuguaaaaaggaugucacagaagucacuuuu

SEQ ID NO: 474514 - RNA, 63 nt, Homo Sapiens
uguaaagaggaugcugccuuaagaauugcauguuguaaaaaaucuuuuuggaaaauacagacu

SEQ ID NO: 474515 - RNA, 63 nt, Homo Sapiens
uuauuuaucaaaauuaugugagguuccaaaauauguaaaaaugauaauaauaaaaaaagauua

SEQ ID NO: 474516 - RNA, 63 nt, Homo Sapiens
aaguaguucagcaucuaucgaaagaacaaaaacuguaaaaaggggacuuauugagguaaauua

SEQ ID NO: 474517 - RNA, 63 nt, Homo Sapiens
uuuaauaauuggguggagaacccccaccgagcuuguaaaaaacuuugucucagggaaaaucuu

SEQ ID NO: 474518 - RNA, 63 nt, Homo Sapiens
uauacacaaaaaucagauuuaguaacuaaagguuguaaaaaauuguaaaacugguuguacaau

SEQ ID NO: 474519 - RNA, 63 nt, Homo Sapiens
acaauagaugucucacacagaacaauacaaauauguaaaaaaucuuucaccacauauucuugc

SEQ ID NO: 474520 - RNA, 63 nt, Homo Sapiens
cuugcugguuuauaccuauguucauuuauaugcuguaaaaaaguaguagcuucuucuacaaug

SEQ ID NO: 474521 - RNA, 63 nt, Homo Sapiens
uaugcuguaaaaaaguaguagcuucuucuacaauguaaaaauaaauguacauacaaaaaaaug

SEQ ID NO: 474522 - RNA, 63 nt, Homo Sapiens
aaaauuuaaaguuaaaugaucauauuuuugagauguaaaaaaagaagcucuaauuauugcaga

SEQ ID NO: 474523 - RNA, 63 nt, Homo Sapiens
uuaaaaagcuguuuccaaguacaucuucuuuacuguaaaaauacauuuucauuaugccccauc

SEQ ID NO: 474524 - RNA, 63 nt, Homo Sapiens
ugggaggaggcaaggucugcuaucaggaguuacuguaaaaacaagaacuggaagcucguguuu

SEQ ID NO: 474525 - RNA, 63 nt, Homo Sapiens
cuuguugcuuggcuuuuaaagaugguguauguuuguaaaaauauucuucugggcucaaaagcu

SEQ ID NO: 474526 - RNA, 63 nt, Homo Sapiens
cucgggcuuuaauuugcuaaagcugugcacauauguaaaaaaaaaaaaaaaaagauuauuuua

SEQ ID NO: 474527 - RNA, 63 nt, Homo Sapiens
uaagaugauaaagcauuugaaugguacaguagauguaaaaaaaauucaguuuaaaagaacauu

SEQ ID NO: 474528 - RNA, 63 nt, Homo Sapiens
uuuuucuccuauacuugggcuacauuuuuugauuguaaaaauauuugauggccuuuugaugaa

SEQ ID NO: 474529 - RNA, 63 nt, Homo Sapiens
acaccuaugcaauauggcuuaucuauauuuauuuguaaaaauccaagcauaguuuaaaauaug

SEQ ID NO: 474530 - RNA, 63 nt, Homo Sapiens
aaaaaaugaaaguuaugacauuagcuuuaaagguguaaaaaagauguuucacuaauguaacgg

SEQ ID NO: 474531 - RNA, 63 nt, Homo Sapiens
uuaauaaaaauguuaauuuuggaagugcaguuuuguaaaaaccuuuuucagucaaacaguaaa

SEQ ID NO: 474532 - RNA, 63 nt, Homo Sapiens
aaaaaaaaaaaaaagacaaaggugauaaaaaacuguaaaaaaaacgacagaguccauguugga

SEQ ID NO: 474533 - RNA, 63 nt, Homo Sapiens
gaaaaagaccucguggagaaaaaacucuauuuuuguaaaaaggaggggggugggaggggaaga

SEQ ID NO: 474534 - RNA, 63 nt, Homo Sapiens
gugggaaaacauacauuacugaaacaguaugaauguaaaaaaugaaaggaugcacacugcaaa

SEQ ID NO: 474535 - RNA, 63 nt, Homo Sapiens
guggaaaagcauuuagauacuaaacccuuugaguguaaaaaaugaaaguacucacacuggaga

SEQ ID NO: 474536 - RNA, 63 nt, Homo Sapiens
gugggaaaguguucguauauaaaacccuaugaauguaaaaaaugaaagaacucacacuggaga

SEQ ID NO: 474537 - RNA, 63 nt, Homo Sapiens
guagaaaauccuuuauugaugaaaccguaucaguguaaaaaaucagagaauucacacuaguga

SEQ ID NO: 474538 - RNA, 63 nt, Homo Sapiens
cuuuucuuuguuauucaacaugaauguaaagauuguaaaaaagcacacuggugacaaacccua

SEQ ID NO: 474539 - RNA, 63 nt, Homo Sapiens
aauguuguaaauauuuggcaauuuaagacauuguguaaaaagcaaucuguaaaaacaucucca

SEQ ID NO: 474540 - RNA, 63 nt, Homo Sapiens
uuggcaauuuaagacauuguguaaaaagcaaucuguaaaaacaucuccaggcuuugauuuuug

SEQ ID NO: 474541 - RNA, 63 nt, Homo Sapiens
gaagaaaguggcagguuuucgucgaaacugcauuguaaaaagaguuuacucuaccaauguuau

SEQ ID NO: 474542 - RNA, 63 nt, Homo Sapiens
gcaccuggaguuucaaaacacaguuuuaaucauuguaaaaaaauguuuuuaaaaauuauauuc

SEQ ID NO: 474543 - RNA, 63 nt, Homo Sapiens
uugacaucuuuuuuuuuaauugaaauauaugcauguaaaaacugguaggucuucagcauaagc

SEQ ID NO: 474544 - RNA, 63 nt, Homo Sapiens
acauuuaauuauaaacaauauauugaccugcaguguaaaaagcaauuuacuaaccaguuuuua

SEQ ID NO: 474545 - RNA, 63 nt, Homo Sapiens
aaaaaaauauauauauauauuggaauaacauuuuguaaaaaaacccaccaaaaugauccaguc

SEQ ID NO: 474546 - RNA, 63 nt, Homo Sapiens
cagaauugucaaccaauuucuuuaauugaacauuguaaaaaacaggaauaaguacuuuugugu

SEQ ID NO: 474547 - RNA, 63 nt, Homo Sapiens
uaaugcacaguaaauaugugaauuuuuccuagauguaaaaaaaaaaaucuuucauauaaagac

SEQ ID NO: 474548 - RNA, 63 nt, Homo Sapiens
aaaaaaagccaagauuucauaaccaaacauuuguguaaaaaaauaucacuaguguggcuaaau

SEQ ID NO: 474549 - RNA, 63 nt, Homo Sapiens
aaaauacuuguugaaaagccuuucauagcaacuuguaaaaaaugauauauauauaaauuuuaa

SEQ ID NO: 474550 - RNA, 63 nt, Homo Sapiens
gaauaacuguaugcagguuuugaauuguauagguguaaaaagguauaaaaacauugcuuuugu

SEQ ID NO: 474551 - RNA, 63 nt, Homo Sapiens
ucccuaauugauuauauagucucuucauuugucuguaaaaauuacuguaaagcuacuuguguu

SEQ ID NO: 474552 - RNA, 64 nt, Homo Sapiens
aucuacuugaccaagcaaaggggcugaaaaacugaauaaggaaacaacuuuauaagagaaacag

SEQ ID NO: 474553 - RNA, 64 nt, Homo Sapiens
uucauuuugaggaacuccaaagucaauucaaggaaauaaggaaugaccuggaacaggccuuaga

SEQ ID NO: 474554 - RNA, 64 nt, Homo Sapiens
agaacuugcccacaugauaacucauguuugcuuuaauaaggaaaauauguuauuugagguuaau

SEQ ID NO: 474555 - RNA, 64 nt, Homo Sapiens
cagggguuuuuaaucuacuucaaauaccacuaugaauaaggauucaccuguuuacaaaaagaau

SEQ ID NO: 474556 - RNA, 64 nt, Homo Sapiens
uauacaaucauaugagaacauugaguaaagaaacaauaaggaccacuccagagauuuuagaaau

SEQ ID NO: 474557 - RNA, 64 nt, Homo Sapiens
acaaacaagcaccuaccauagaccuggcagaauaaauaaggaaauccuuaaagaucuacaaguu

SEQ ID NO: 474558 - RNA, 64 nt, Homo Sapiens
ugacuuucugacuaaugcugccacccacacagagaauaaggaguagggccugcuggguguuuag

SEQ ID NO: 474559 - RNA, 64 nt, Homo Sapiens
agauugcaaagcaaugaacucaagaaggaauugaaauaaggagggacaugauggggaaggagua

SEQ ID NO: 474560 - RNA, 64 nt, Homo Sapiens
cuuaaacagaagcagcaaaugaaagaaccggacaaauaaggaagggcacaagccuacccgacuc

SEQ ID NO: 474561 - RNA, 64 nt, Homo Sapiens
acacaaacuucacaguaaggagugacaaguuuauaauaaggaagacaaaguuuaacaccuucac

SEQ ID NO: 474562 - RNA, 64 nt, Homo Sapiens
ucuuuaaauguauugaagcauugugcugucugaaaauaaggaauugcuuauaaaccagccacuu

SEQ ID NO: 474563 - RNA, 64 nt, Homo Sapiens
uuugaacauccccacuagguucuuuuccauugucaauaaggagcaucagccagugaaucuguuu

SEQ ID NO: 474564 - RNA, 64 nt, Homo Sapiens
cagaucaagaguuuuggagaucagguaccaaggaaauaaggacagucuagcugccucaagugag

SEQ ID NO: 474565 - RNA, 64 nt, Homo Sapiens
aucaauaacuaaugcuauguacuuggaaaauccaaauaaggaaguuuuagguuggugcauaacu

SEQ ID NO: 474566 - RNA, 64 nt, Homo Sapiens
gucuggauuaucuuccuuuucucauggccuaagaaauaaggaucaauaaggaaugauuugaaug

SEQ ID NO: 474567 - RNA, 64 nt, Homo Sapiens
ucuuccuuuucucauggccuaagaaauaaggaucaauaaggaaugauuugaauguaauuuugug

SEQ ID NO: 474568 - RNA, 64 nt, Homo Sapiens
acauuauggagagcucugauuccuacauaauaugaauaaggauggauaggccgggcgugguggc

SEQ ID NO: 474569 - RNA, 64 nt, Homo Sapiens
uggguaacagagcgagaccccgacucaauaaauaaauaaggauggauaaauuguagcguaugca

SEQ ID NO: 474570 - RNA, 64 nt, Homo Sapiens
cuuuauauuuauccacuacuccgugaaggcuucucuguucuacccguuccaaaagccaauggcu

SEQ ID NO: 474571 - RNA, 64 nt, Homo Sapiens
ccuucuggcagauucaaaucguuuauuucacacgcuguucuaauggcacuuaucauuagaaucu

SEQ ID NO: 474572 - RNA, 64 nt, Homo Sapiens
uuggguccgcgcgaagcccauaaaagcuucccgacuguucuacucaacauggcaaagcaaaugg

SEQ ID NO: 474573 - RNA, 64 nt, Homo Sapiens
aaaaguaggguguggacgcauccacccaaagauacuguucuacagauaaccucgaugauguaaa

SEQ ID NO: 474574 - RNA, 64 nt, Homo Sapiens
ccuccucuaguuaacuuagcaucuuucuuugaagcuguucuaguaaagaagacugacuagaugc

SEQ ID NO: 474575 - RNA, 64 nt, Homo Sapiens
guuuuaaaaguuccucucuauuuaccagggauaucuguucuacugaaaaaugagaaauucuacc

SEQ ID NO: 474576 - RNA, 64 nt, Homo Sapiens
agaggaguacaggguccugugagcuguuugaccacuguucuaagacuaugugugcccaaaagca

SEQ ID NO: 474577 - RNA, 64 nt, Homo Sapiens
uuuugaagucuuucuuuguacuuuaauguucucucuguucuaauaguugaaguaugagauguaa

SEQ ID NO: 474578 - RNA, 64 nt, Homo Sapiens
guuuuguguuuuuaaaacaguaauuucauagcaacuguucuaguauuaaagggaucauuaucag

SEQ ID NO: 474579 - RNA, 64 nt, Homo Sapiens
gccucagccuccugaguagccucucggguucaagcuguucuacuuggcucacugcaaucucugc

SEQ ID NO: 474580 - RNA, 64 nt, Homo Sapiens
guaucuguuugugaguugauccuggcuucucucucuguucuaguuuuggcugaaaacaaaacaa

SEQ ID NO: 474581 - RNA, 64 nt, Homo Sapiens
aggaguuuguuacauuuaaucaacacugugaagucuguucuacagcaauucagccauuacacag

SEQ ID NO: 474582 - RNA, 64 nt, Homo Sapiens
ucuuagaagugacauuguaacugagugugagacccuguucuaacccuccuggaccugaaggcau

SEQ ID NO: 474583 - RNA, 64 nt, Homo Sapiens
gugacaggcaccagaugggaaggaguggaguucucuguucuagaccuccaaacacugggcucug

SEQ ID NO: 474584 - RNA, 64 nt, Homo Sapiens
cacguguauuguccgggcucagaaugggaggacuccagaagaugagagaaaccucuuuauccaa

SEQ ID NO: 474585 - RNA, 64 nt, Homo Sapiens
ucaccacgugcaguaucucaagauauucagguggccagaagagcuugucagcaagaggaggaca

SEQ ID NO: 474586 - RNA, 64 nt, Homo Sapiens
ugcugggauuacaggcauaagccacugcgcccagccagaagaugcaugauuucuuaggaucaua

SEQ ID NO: 474587 - RNA, 64 nt, Homo Sapiens
uauuagauuucugacuugcaaauauguuuguacuccagaagaauuagaggaaaagcagauacua

SEQ ID NO: 474588 - RNA, 64 nt, Homo Sapiens
uuugccaucauuuuuuuaauuaaagaaaaaauuuccagaagaggaaaaaaaaacuacaaaaaac

SEQ ID NO: 474589 - RNA, 64 nt, Homo Sapiens
uuauaccaaagaugaagugacacccuauuacaguccagaagauagagguuguuuucguuucuuu

SEQ ID NO: 474590 - RNA, 64 nt, Homo Sapiens
uccagaaacuuccagaccagcccucucaccacacccagaagaggccuuucccaucuggagagaa

SEQ ID NO: 474591 - RNA, 64 nt, Homo Sapiens
gagagaaacuuccagaccagcccucucacuacagccagaagaggccuuucccaccgggagagga

SEQ ID NO: 474592 - RNA, 64 nt, Homo Sapiens
accauucuuaguggcacuggggaaaucuuggcacccagaagaauucaacugcgcucacugcaaa

SEQ ID NO: 474593 - RNA, 64 nt, Homo Sapiens
caguuaauccugugaaauaaauauugaacauaauccagaagaaucucucuguuucccuugggga

SEQ ID NO: 474594 - RNA, 64 nt, Homo Sapiens
uacaauuaguagaucauguaauucagaggagcggccagaagaucgucuacccagcccuuguuag

SEQ ID NO: 474595 - RNA, 64 nt, Homo Sapiens
ugaaaucauuggaccuguucacaaaaagccuuuuccagaagaucuguggaaauagaagcaaaug

SEQ ID NO: 474596 - RNA, 64 nt, Homo Sapiens
gcaugccucaagguuuauguggacuccacagcacccagaagacuugcacucaaguuuggccaag

SEQ ID NO: 474597 - RNA, 64 nt, Homo Sapiens
guuuuuaguagcuuauugugaauacaaucuuauuccagaagacuaugcauguuuagugagcacu

SEQ ID NO: 474598 - RNA, 64 nt, Homo Sapiens
gucagaauaaugcauucuguccaauuuuucuauuccagaagacaacuuccuucuuucauccuuu

SEQ ID NO: 474599 - RNA, 64 nt, Homo Sapiens
gaaauaaaaguccuaaauaauucuuuccuguuucccagaagagaugucucuucaguggaagaua

SEQ ID NO: 474600 - RNA, 64 nt, Homo Sapiens
aaggggacccacaaacaagagugcucuuguauguccagaagaaagagaaagaccaucaaucagg

SEQ ID NO: 474601 - RNA, 64 nt, Homo Sapiens
gggggucaggggaaggcaugggggggaccagaaaccagaagaacaaucaagacugcaaugaaaa

SEQ ID NO: 474602 - RNA, 64 nt, Homo Sapiens
auggggaccugucugcauauacacacggggaaugccagaagaaggcccagucugcaccaggcgu

SEQ ID NO: 474603 - RNA, 64 nt, Homo Sapiens
aaacaacccauaguaucucauucugucaucagauccagaagaaauauccugguuuuccagcaug

SEQ ID NO: 474604 - RNA, 64 nt, Homo Sapiens
ucuggugauaauggcuggcccuucacagccaggcccagaagaggucugaauaccaaaaacaggg

SEQ ID NO: 474605 - RNA, 64 nt, Homo Sapiens
uuagggggcaguaggcccccgugcugcaguaucaccagaagacaacaaacuauuuugauggacu

SEQ ID NO: 474606 - RNA, 64 nt, Homo Sapiens
agcacccucaaccugguagcugucucuccugaguccagaagaccgcugauauccucggcgaaca

SEQ ID NO: 474607 - RNA, 64 nt, Homo Sapiens
gcuuccugugcccucucaagccaguucuucucuuccagaagaauucagaguaugugucucagaa

SEQ ID NO: 474608 - RNA, 64 nt, Homo Sapiens
uuauucgcuccaagaaagaugcuaagucugagcuccagaagagacugugcuggguguggcuugg

SEQ ID NO: 474609 - RNA, 64 nt, Homo Sapiens
gaauucaugguaggaucacuggugugucacgcucccagaagacuuauagggcauuguucuggug

SEQ ID NO: 474610 - RNA, 64 nt, Homo Sapiens
agcagggaagugaaagguccucucagaaacgcggccagaagacaauguguguggggggcgugcc

SEQ ID NO: 474611 - RNA, 64 nt, Homo Sapiens
aguugcuuuucaaagaggaaaaagaauaugcaggccagaagaaauaauugccagcugucuacac

SEQ ID NO: 474612 - RNA, 64 nt, Homo Sapiens
ccauagaugaagaugaagauaugcuaagccaaauccagaagaacaauuuccccccaaaguagag

SEQ ID NO: 474613 - RNA, 64 nt, Homo Sapiens
gggucucuuucuguagaguuggagaggaaaugaaccagaagaguggaucccucggacauaccaa

SEQ ID NO: 474614 - RNA, 64 nt, Homo Sapiens
uccuauccaaagcggccuacagucuccugggcucccagaagaguggcaagcugccauccuccuc

SEQ ID NO: 474615 - RNA, 64 nt, Homo Sapiens; identical to SEQ ID NO: 179148

SEQ ID NO: 474616 - RNA, 64 nt, Homo Sapiens; identical to SEQ ID NO: 179149

SEQ ID NO: 474617 - RNA, 64 nt, Homo Sapiens; identical to SEQ ID NO: 179150

SEQ ID NO: 474618 - RNA, 64 nt, Homo Sapiens; identical to SEQ ID NO: 179151

SEQ ID NO: 474619 - RNA, 64 nt, Homo Sapiens; identical to SEQ ID NO: 179152

SEQ ID NO: 474620 - RNA, 64 nt, Homo Sapiens; identical to SEQ ID NO: 179153

SEQ ID NO: 474621 - RNA, 64 nt, Homo Sapiens; identical to SEQ ID NO: 153912

SEQ ID NO: 474622 - RNA, 64 nt, Homo Sapiens; identical to SEQ ID NO: 153913

SEQ ID NO: 474623 - RNA, 64 nt, Homo Sapiens; identical to SEQ ID NO: 153914

SEQ ID NO: 474624 - RNA, 64 nt, Homo Sapiens; identical to SEQ ID NO: 153915

SEQ ID NO: 474625 - RNA, 64 nt, Homo Sapiens; identical to SEQ ID NO: 153916

SEQ ID NO: 474626 - RNA, 64 nt, Homo Sapiens; identical to SEQ ID NO: 153917

SEQ ID NO: 474627 - RNA, 64 nt, Homo Sapiens; identical to SEQ ID NO: 153918

SEQ ID NO: 474628 - RNA, 64 nt, Homo Sapiens; identical to SEQ ID NO: 153919

SEQ ID NO: 474629 - RNA, 64 nt, Homo Sapiens; identical to SEQ ID NO: 153920

SEQ ID NO: 474630 - RNA, 64 nt, Homo Sapiens; identical to SEQ ID NO: 153921

SEQ ID NO: 474631 - RNA, 64 nt, Homo Sapiens; identical to SEQ ID NO: 153922

SEQ ID NO: 474632 - RNA, 64 nt, Homo Sapiens; identical to SEQ ID NO: 153923

SEQ ID NO: 474633 - RNA, 64 nt, Homo Sapiens; identical to SEQ ID NO: 153924

SEQ ID NO: 474634 - RNA, 64 nt, Homo Sapiens; identical to SEQ ID NO: 153925

SEQ ID NO: 474635 - RNA, 64 nt, Homo Sapiens; identical to SEQ ID NO: 153926

SEQ ID NO: 474636 - RNA, 64 nt, Homo Sapiens; identical to SEQ ID NO: 153927

SEQ ID NO: 474637 - RNA, 64 nt, Homo Sapiens; identical to SEQ ID NO: 153928

SEQ ID NO: 474638 - RNA, 64 nt, Homo Sapiens; identical to SEQ ID NO: 153929

SEQ ID NO: 474639 - RNA, 64 nt, Homo Sapiens; identical to SEQ ID NO: 153930

SEQ ID NO: 474640 - RNA, 64 nt, Homo Sapiens; identical to SEQ ID NO: 153931

SEQ ID NO: 474641 - RNA, 64 nt, Homo Sapiens; identical to SEQ ID NO: 153932

SEQ ID NO: 474642 - RNA, 64 nt, Homo Sapiens; identical to SEQ ID NO: 153933

SEQ ID NO: 474643 - RNA, 64 nt, Homo Sapiens
auaaccagcaauuaaacuuugaauuguauuucaagauucaaacaauaccaguaucaucagugaa

SEQ ID NO: 474644 - RNA, 64 nt, Homo Sapiens
ugacucauuuuuaccaauaacagauuuuaauagagauucaaaaacacagauuuguuuauguguu

SEQ ID NO: 474645 - RNA, 64 nt, Homo Sapiens
uacacucagagccuggucgccccccguuagcccagauucaaaaggugaacaucuguuugcagaa

SEQ ID NO: 474646 - RNA, 64 nt, Homo Sapiens
uccacugaacaaggcuaguuccugcaccacccaggauucaaaggaaagacgaagggagcagaac

SEQ ID NO: 474647 - RNA, 64 nt, Homo Sapiens
ggcaugcaacacaccuggagaggguuauuuugaggauucaaaaaaauuaaagaggauccacccc

SEQ ID NO: 474648 - RNA, 64 nt, Homo Sapiens
ccaaacuagaacuuuaaaaguuuuacuuuguuuugauucaaagaaaauggcuuuuauaaacauc

SEQ ID NO: 474649 - RNA, 64 nt, Homo Sapiens
uuuuuuuuguuuuuuguuuucuuuaggauuugacgauucaaauuuagauaauagcagccuaguu

SEQ ID NO: 474650 - RNA, 64 nt, Homo Sapiens
ugggaauuugagaaauauuucaacuuuuguuuaugauucaaauaaauuguuggauuuaaagagg

SEQ ID NO: 474651 - RNA, 64 nt, Homo Sapiens
ggaagggaaacauuuggguugaugaggcagaggggauucaaaugugugagaggcuagauucaaa

SEQ ID NO: 474652 - RNA, 64 nt, Homo Sapiens
ugaggcagaggggauucaaaugugugagaggcuagauucaaagacccucaguguucuauguuau

SEQ ID NO: 474653 - RNA, 64 nt, Homo Sapiens
uuuuaaaguaauaagggucaaagacuacaucagagauucaaauagguuuuuaaagaaaagcuaa

SEQ ID NO: 474654 - RNA, 64 nt, Homo Sapiens
ccaugacauuggaagaagguacagugauucaaaugauucaaaugaggaagugaauaagaagaug

SEQ ID NO: 474655 - RNA, 64 nt, Homo Sapiens
auucaaaugccaugacauugaagaagaugacagugauucaaaugguuuguuucaggaagugaau

SEQ ID NO: 474656 - RNA, 64 nt, Homo Sapiens
ccaugacauuggaaaaagguagagugauucaaaugauucaaauuaggaagugaauaagaagaug

SEQ ID NO: 474657 - RNA, 64 nt, Homo Sapiens
auucaaauuccaugacauugaagaagaugagagugauucaaaugguuuguuucaggaagugaau

SEQ ID NO: 474658 - RNA, 64 nt, Homo Sapiens; identical to SEQ ID NO: 60066

SEQ ID NO: 474659 - RNA, 64 nt, Homo Sapiens; identical to SEQ ID NO: 60067

SEQ ID NO: 474660 - RNA, 64 nt, Homo Sapiens; identical to SEQ ID NO: 60068

SEQ ID NO: 474661 - RNA, 64 nt, Homo Sapiens; identical to SEQ ID NO: 60069

SEQ ID NO: 474662 - RNA, 64 nt, Homo Sapiens; identical to SEQ ID NO: 60070

SEQ ID NO: 474663 - RNA, 64 nt, Homo Sapiens; identical to SEQ ID NO: 60071

SEQ ID NO: 474664 - RNA, 64 nt, Homo Sapiens; identical to SEQ ID NO: 60072

SEQ ID NO: 474665 - RNA, 64 nt, Homo Sapiens; identical to SEQ ID NO: 60073

SEQ ID NO: 474666 - RNA, 64 nt, Homo Sapiens; identical to SEQ ID NO: 60074

SEQ ID NO: 474667 - RNA, 64 nt, Homo Sapiens; identical to SEQ ID NO: 60075

SEQ ID NO: 474668 - RNA, 64 nt, Homo Sapiens; identical to SEQ ID NO: 60076

SEQ ID NO: 474669 - RNA, 64 nt, Homo Sapiens; identical to SEQ ID NO: 89720

SEQ ID NO: 474670 - RNA, 64 nt, Homo Sapiens; identical to SEQ ID NO: 89721

SEQ ID NO: 474671 - RNA, 64 nt, Homo Sapiens; identical to SEQ ID NO: 89722

SEQ ID NO: 474672 - RNA, 64 nt, Homo Sapiens; identical to SEQ ID NO: 89723

SEQ ID NO: 474673 - RNA, 64 nt, Homo Sapiens; identical to SEQ ID NO: 89724

SEQ ID NO: 474674 - RNA, 64 nt, Homo Sapiens; identical to SEQ ID NO: 89725

SEQ ID NO: 474675 - RNA, 64 nt, Homo Sapiens; identical to SEQ ID NO: 89726

SEQ ID NO: 474676 - RNA, 64 nt, Homo Sapiens; identical to SEQ ID NO: 89727

SEQ ID NO: 474677 - RNA, 64 nt, Homo Sapiens; identical to SEQ ID NO: 89728

SEQ ID NO: 474678 - RNA, 64 nt, Homo Sapiens; identical to SEQ ID NO: 89729

SEQ ID NO: 474679 - RNA, 64 nt, Homo Sapiens; identical to SEQ ID NO: 89730

SEQ ID NO: 474680 - RNA, 64 nt, Homo Sapiens; identical to SEQ ID NO: 89731

SEQ ID NO: 474681 - RNA, 64 nt, Homo Sapiens; identical to SEQ ID NO: 424201

SEQ ID NO: 474682 - RNA, 64 nt, Homo Sapiens; identical to SEQ ID NO: 424202

SEQ ID NO: 474683 - RNA, 64 nt, Homo Sapiens; identical to SEQ ID NO: 424203

SEQ ID NO: 474684 - RNA, 61 nt, Homo Sapiens; identical to SEQ ID NO: 424204

SEQ ID NO: 474685 - RNA, 64 nt, Homo Sapiens; identical to SEQ ID NO: 424205

SEQ ID NO: 474686 - RNA, 64 nt, Homo Sapiens; identical to SEQ ID NO: 424206

SEQ ID NO: 474687 - RNA, 64 nt, Homo Sapiens; identical to SEQ ID NO: 424207

SEQ ID NO: 474688 - RNA, 64 nt, Homo Sapiens; identical to SEQ ID NO: 424208

SEQ ID NO: 474689 - RNA, 64 nt, Homo Sapiens; identical to SEQ ID NO: 424209

SEQ ID NO: 474690 - RNA, 64 nt, Homo Sapiens; identical to SEQ ID NO: 424210

SEQ ID NO: 474691 - RNA, 64 nt, Homo Sapiens; identical to SEQ ID NO: 424211

SEQ ID NO: 474692 - RNA, 64 nt, Homo Sapiens; identical to SEQ ID NO: 424212

SEQ ID NO: 474693 - RNA, 64 nt, Homo Sapiens; identical to SEQ ID NO: 424213

SEQ ID NO: 474694 - RNA, 64 nt, Homo Sapiens; identical to SEQ ID NO: 424214

SEQ ID NO: 474695 - RNA, 64 nt, Homo Sapiens
gggcugggcuugggaaggggagguggaggccagguguccccagaccucuaacccuugccccuag

SEQ ID NO: 474696 - RNA, 64 nt, Homo Sapiens
gcacacaguuggugcgugauaugguuaagcuuuguguccccacccacaucucaucuugaauggu

SEQ ID NO: 474697 - RNA, 64 nt, Homo Sapiens
uggcaccaucuuggaucugagccggucgagccccuguccccacccuuccugaccuguccuuuuc

SEQ ID NO: 474698 - RNA, 64 nt, Homo Sapiens
uucaggucuccccccagcugucucacccccacuuuguccccacucuagagcagggaggcagugg

SEQ ID NO: 474699 - RNA, 64 nt, Homo Sapiens
cuggccauaccccggacugcccuccugugccugauguccccagcuggggucagucucaacagga

SEQ ID NO: 474700 - RNA, 64 nt, Homo Sapiens
agcucagccaggcucccuguguccugggaggaaguguccccaucccccaugccccuuaugggga

SEQ ID NO: 474701 - RNA, 64 nt, Homo Sapiens
gcugcccugucacuccucuaacacuucccuccccuguccccaacaugcccuguaauaaaauuag

SEQ ID NO: 474702 - RNA, 64 nt, Homo Sapiens
ugcucugccucccguuccaauuuccaggagggucuguccccagaucagcagugugcauagacca

SEQ ID NO: 474703 - RNA, 64 nt, Homo Sapiens
gaagaauccggcugccccugagcaggacagcuccuguccccagcuggcaugcuucugcugggug

SEQ ID NO: 474704 - RNA, 64 nt, Homo Sapiens
agcuuguaagauggugcagcaugcagaccagacuuguccccaaggucucagcgcugcggucuca

SEQ ID NO: 474705 - RNA, 64 nt, Homo Sapiens
aguugacuuguuuugcacacuuuucuuuacuucauguccccaucaacaaccguccugcucccca

SEQ ID NO: 474706 - RNA, 64 nt, Homo Sapiens
gagccucccuucuuuguuugccucccccagaagcuguccccagcugucucaaagcgguacccau

SEQ ID NO: 474707 - RNA, 64 nt, Homo Sapiens
caacugacucauaccuguuuagcucucuauuaccuguccccacuccauaaggccagccaguucu

SEQ ID NO: 474708 - RNA, 64 nt, Homo Sapiens
cucaggaagaagauagucacauguuuuucuuccuuguccccacggcccccagaacaacauucuc

SEQ ID NO: 474709 - RNA, 64 nt, Homo Sapiens
cccgcccugguggggcucggcgaguaauguguuuuguccccaguuaaccaccauucugcggccu

SEQ ID NO: 474710 - RNA, 64 nt, Homo Sapiens
ugcuacauuacaaacuuugggagaggagggcacauguccccauuguugcuauuuaaaaaucagg

SEQ ID NO: 474711 - RNA, 64 nt, Homo Sapiens
cccugccacacauggaagagguuggcagauaaacuguccccagacaccuucccuucugacucag

SEQ ID NO: 474712 - RNA, 64 nt, Homo Sapiens
gugcguuuucuuccauguagcauuuauucugaauuguccccagcgcaucagccacugugucuuu

SEQ ID NO: 474713 - RNA, 64 nt, Homo Sapiens
guacaguucuucaguggacacauuucugguuuucuguccccauaggauaccaguucagucucca

SEQ ID NO: 474714 - RNA, 64 nt, Homo Sapiens
uuccuccccacaccuacccagcucuccucccaucuguccccaucugggugaacccuggcucuga

SEQ ID NO: 474715 - RNA, 64 nt, Homo Sapiens
gaccaggggccccgaggccugagggccccuccccuguccccaccucagugccugcggggcccug

SEQ ID NO: 474716 - RNA, 64 nt, Homo Sapiens
gcccagccagcacucugcagggucacacgcaccguguccccacccaggacagcagacacccgcc

SEQ ID NO: 474717 - RNA, 64 nt, Homo Sapiens
gcccugagcagcuucacuuccccugcgccuuuuauguccccaccuugaggccuugcagaggcgc

SEQ ID NO: 474718 - RNA, 64 nt, Homo Sapiens
aacacuaaauguggaccaguaucaagaacccuccuguccccacgcaguguaaacccaguggcuu

SEQ ID NO: 474719 - RNA, 64 nt, Homo Sapiens
agaugcugccacccucuucugacccugcugcuguuguccccauccgccuucaccccucugcucu

SEQ ID NO: 474720 - RNA, 64 nt, Homo Sapiens
ggcugugggugagccaggccaacauuggugucccuguccccagagggaggagcaggcaggagag

SEQ ID NO: 474721 - RNA, 64 nt, Homo Sapiens
ugggagcccuguccucagccagaaagccuggccuuguccccauggcuggcuggaaccagaggcc

SEQ ID NO: 474722 - RNA, 64 nt, Homo Sapiens
cacuccaggagcacuggcuuggccucucuaccuguguccccacugagaugccuguggcugaggg

SEQ ID NO: 474723 - RNA, 64 nt, Homo Sapiens
aaggccaagaagugaaggccggcggggaggauacuguccccaggagcacccucccugcccgucu

SEQ ID NO: 474724 - RNA, 64 nt, Homo Sapiens
ccaugaccagugaggagaagcaacagagccugucuguccccaugagcggagucuguccucugcu

SEQ ID NO: 474725 - RNA, 64 nt, Homo Sapiens
cccaugaccuuccuucugcuaccguggccaggaguguccccagcacccagacucgggcaaccuc

SEQ ID NO: 474726 - RNA, 64 nt, Homo Sapiens
gggcacauacugguaaugggcaguaccacggggcuguccccacggcuacgucugcauucaagcu

SEQ ID NO: 474727 - RNA, 64 nt, Homo Sapiens
ccagccuguuuucauaauaacuuaucuguccccauguccccacaagccacccaaccuaaaugua

SEQ ID NO: 474728 - RNA, 64 nt, Homo Sapiens
uccccacaccagccuguuuuuaaauguacuuaucuguccccauguucaccugagccacccaacc

SEQ ID NO: 474729 - RNA, 64 nt, Homo Sapiens
cucuuugcccugaggcucagucucucucguauuuuguccccacccccaauuccuugagugguuu

SEQ ID NO: 474730 - RNA, 64 nt, Homo Sapiens
cucaaaucacugcauucauucugagcccccuuccuguccccaggggagguguauuguguaugua

SEQ ID NO: 474731 - RNA, 64 nt, Homo Sapiens
cauaucccuggauaggaaggaaaaucuacuccccuguccccagcaagacuuguuuuccagacag

SEQ ID NO: 474732 - RNA, 64 nt, Homo Sapiens
ggggaacaaagggaccucuguuagucccaugaucuguccccaaaauguuuccaugugccaaauc

SEQ ID NO: 474733 - RNA, 64 nt, Homo Sapiens
auccugccuaggcuggacuuaaccccuuccucccuguccccacgaccaacuguccccaguuacu

SEQ ID NO: 474734 - RNA, 64 nt, Homo Sapiens
acuuaaccccuuccucccuguccccacgaccaacuguccccaguuacucuaaccguuauuucau

SEQ ID NO: 474735 - RNA, 64 nt, Homo Sapiens
aggccccccaccagaagccaucucccccgcuguguguccccaggcgcaucauugcuccacucuc

SEQ ID NO: 474736 - RNA, 64 nt, Homo Sapiens
uccagaguauguagagagccaaaauguguggcccuguccccaagcucagcaccaccggccauga

SEQ ID NO: 474737 - RNA, 64 nt, Homo Sapiens
ggagcuccugucccugucagccuuugcuguccccuguccccaacggagacucugucaccccugg

SEQ ID NO: 474738 - RNA, 64 nt, Homo Sapiens
ccacaugugaccacugcaacgaagacacuccuucuguccccaccugcuccgaagacaaaccaac

SEQ ID NO: 474739 - RNA, 64 nt, Homo Sapiens
ccacgcccgagaaagccugggggacccagacaccuguccccacagucaaagccuggggacccag

SEQ ID NO: 474740 - RNA, 64 nt, Homo Sapiens
uccccacagucaaagccuggggacccagacauccuguccccacagucagccuccugucccugcu

SEQ ID NO: 474741 - RNA, 64 nt, Homo Sapiens
cucucccugcagccacaugucagccauacuugacuguccccaaaguccguggcuguccaccucc

SEQ ID NO: 474742 - RNA, 64 nt, Homo Sapiens
ugcaggagacgcccugaugucuguggccaucuuguguccccaacuuuaaugaagagcccgguca

SEQ ID NO: 474743 - RNA, 64 nt, Homo Sapiens
agcuaaaucaaggaccucagccuuauauaaucauuguccccaccacuaccauggacuggacacc

SEQ ID NO: 474744 - RNA, 64 nt, Homo Sapiens
cucuggagagagagccauuggcuggaguugagacuguccccagaacccuuggucuugccacucc

SEQ ID NO: 474745 - RNA, 64 nt, Homo Sapiens
gggugagagcacccacugaauugacaugacccucuguccccaggccuggcuccccgagggcuca

SEQ ID NO: 474746 - RNA, 64 nt, Homo Sapiens
guuucguggcagcacggcccggccccucacccucuguccccacgaggggacccaugggggcugu

SEQ ID NO: 474747 - RNA, 64 nt, Homo Sapiens
aggcgcuggggcuccuacgggucccuggggcagcuguccccaucaggccaagagcgagcgagag

SEQ ID NO: 474748 - RNA, 64 nt, Homo Sapiens
gcacacacaugcaggcggcguggucucccugcucuguccccacacguuccucacauacaggcaa

SEQ ID NO: 474749 - RNA, 64 nt, Homo Sapiens
ccaacccugggaccuauacaccaagcccuaagccuguccccagaguaaaaacccagcggcuuag

SEQ ID NO: 474750 - RNA, 64 nt, Homo Sapiens
ccccaguccccagcccugggagccacugggccccuguccccagucugggucuggaugggaggag

SEQ ID NO: 474751 - RNA, 64 nt, Homo Sapiens
cucauggcccuuuggucacuuacccgucccagccuguccccauuccccucuagugcuguccugg

SEQ ID NO: 474752 - RNA, 64 nt, Homo Sapiens
gguuaggugaggagggugagcguggcaggugauguguccccauuagcucccaucagccucauuc

SEQ ID NO: 474753 - RNA, 64 nt, Homo Sapiens
agcagcaacccugagucaauuguugggggguuaauguccccaggugcacugggcaagcuagaag

SEQ ID NO: 474754 - RNA, 64 nt, Homo Sapiens
ucccggcaugaaggacacuggcagugccugcccguguccccauguccgggguuagcagaugcca

SEQ ID NO: 474755 - RNA, 64 nt, Homo Sapiens
cugggaaagccccugccccucaggagcacggcucuguccccagcgcuggggucccagcagcugc

SEQ ID NO: 474756 - RNA, 64 nt, Homo Sapiens
agagagguuugcagucccaagugucucuuauggauguccccagcgacaacgugcucuuuguuuu

SEQ ID NO: 474757 - RNA, 64 nt, Homo Sapiens
gcaccaggaggggccagguggcgucggcagcaucuguccccagaaucaggcagaauccacuucc

SEQ ID NO: 474758 - RNA, 64 nt, Homo Sapiens
uuggugacaagguccugagaacacaguggccagguguccccaggcuccuggccccuccgacgac

SEQ ID NO: 474759 - RNA, 64 nt, Homo Sapiens
acuuggaugucaccacugucagccccugccuugauguccccauuuagccaucuccauggagcuc

SEQ ID NO: 474760 - RNA, 64 nt, Homo Sapiens
uugaauauaccccaccuggugguggccccuccgauguccccacugauggcucugacaccguguu

SEQ ID NO: 474761 - RNA, 64 nt, Homo Sapiens
agcaucuggcugggaugugaagggcagcacucccuguccccaugucccgggcuccacugggcac

SEQ ID NO: 474762 - RNA, 64 nt, Homo Sapiens
uauggagcuugcaguccagugagguggacagaccuguccccagacagugauggcccaaaauggu

SEQ ID NO: 474763 - RNA, 64 nt, Homo Sapiens
uaguccuccaccgucccgaagccaacuucacccauguccccauccccaaucuuguccccauucc

SEQ ID NO: 474764 - RNA, 64 nt, Homo Sapiens
aagccaacuucacccauguccccauccccaaucuuguccccauuccugacuccaaauccaaccc

SEQ ID NO: 474765 - RNA, 64 nt, Homo Sapiens
uccccuauucccuccacaaugguacgucccacccuguccccagacugugaccuccuguccccau

SEQ ID NO: 474766 - RNA, 64 nt, Homo Sapiens
guacgucccacccuguccccguucugugaccuccuguccccauggugugugugugugugugugu

SEQ ID NO: 474767 - RNA, 64 nt, Homo Sapiens
ucaaggcuagaaaacagcaaccaguucucacucauguccccaacaggguuacuccucaaaaccc

SEQ ID NO: 474768 - RNA, 64 nt, Homo Sapiens
agccugcugggacacacgggcugucugcuucacauguccccaucccaggggccaggcaggcugu

SEQ ID NO: 474769 - RNA, 64 nt, Homo Sapiens
ggccaggcaggcugucugucaaggucucacagcuuguccccagggagcaggggaguggcuuccc

SEQ ID NO: 474770 - RNA, 64 nt, Homo Sapiens
auugcagggaccagagaagaccaaagaugccagauguccccagaguuucuugagggcuggguuu

SEQ ID NO: 474771 - RNA, 64 nt, Homo Sapiens
gagggcuggguuucacgucuuugcuuguccuuuuuguccccacuugccugcaccgugccugacu

SEQ ID NO: 474772 - RNA, 64 nt, Homo Sapiens
ggcacauacacgugucugcaggccacaccgugcauguccccagaccugccgccuggcuucugga

SEQ ID NO: 474773 - RNA, 64 nt, Homo Sapiens
uugagcauccugaaggagccacugcagccgucacuguccccagagccuguggagauagagccug

SEQ ID NO: 474774 - RNA, 64 nt, Homo Sapiens
gagcugguggcugacaaagaccuguccccagcacuguccccaugucuggcaucaucucagguuc

SEQ ID NO: 474775 - RNA, 64 nt, Homo Sapiens
acuguccccauggagcuggucaucucagguucccuguccccagccucaggcugaaaucuggcau

SEQ ID NO: 474776 - RNA, 64 nt, Homo Sapiens; identical to SEQ ID NO: 47288

SEQ ID NO: 474777 - RNA, 64 nt, Homo Sapiens; identical to SEQ ID NO: 47289

SEQ ID NO: 474778 - RNA, 64 nt, Homo Sapiens; identical to SEQ ID NO: 47290

SEQ ID NO: 474779 - RNA, 64 nt, Homo Sapiens; identical to SEQ ID NO: 47291

SEQ ID NO: 474780 - RNA, 64 nt, Homo Sapiens; identical to SEQ ID NO: 47292

SEQ ID NO: 474781 - RNA, 64 nt, Homo Sapiens; identical to SEQ ID NO: 47293

SEQ ID NO: 474782 - RNA, 64 nt, Homo Sapiens; identical to SEQ ID NO: 47294

SEQ ID NO: 474783 - RNA, 64 nt, Homo Sapiens; identical to SEQ ID NO: 47295

SEQ ID NO: 474784 - RNA, 64 nt, Homo Sapiens; identical to SEQ ID NO: 47296

SEQ ID NO: 474785 - RNA, 64 nt, Homo Sapiens; identical to SEQ ID NO: 47297

SEQ ID NO: 474786 - RNA, 64 nt, Homo Sapiens; identical to SEQ ID NO: 47298

SEQ ID NO: 474787 - RNA, 64 nt, Homo Sapiens; identical to SEQ ID NO: 47299

SEQ ID NO: 474788 - RNA, 64 nt, Homo Sapiens; identical to SEQ ID NO: 47300

SEQ ID NO: 474789 - RNA, 64 nt, Homo Sapiens; identical to SEQ ID NO: 47301

SEQ ID NO: 474790 - RNA, 64 nt, Homo Sapiens; identical to SEQ ID NO: 47302

SEQ ID NO: 474791 - RNA, 64 nt, Homo Sapiens; identical to SEQ ID NO: 47303

SEQ ID NO: 474792 - RNA, 64 nt, Homo Sapiens; identical to SEQ ID NO: 138555

SEQ ID NO: 474793 - RNA, 64 nt, Homo Sapiens; identical to SEQ ID NO: 138556

SEQ ID NO: 474794 - RNA, 64 nt, Homo Sapiens; identical to SEQ ID NO: 138557

SEQ ID NO: 474795 - RNA, 64 nt, Homo Sapiens; identical to SEQ ID NO: 138558

SEQ ID NO: 474796 - RNA, 64 nt, Homo Sapiens; identical to SEQ ID NO: 138559

SEQ ID NO: 474797 - RNA, 64 nt, Homo Sapiens; identical to SEQ ID NO: 138560

SEQ ID NO: 474798 - RNA, 64 nt, Homo Sapiens; identical to SEQ ID NO: 138561

SEQ ID NO: 474799 - RNA, 64 nt, Homo Sapiens; identical to SEQ ID NO: 138562

SEQ ID NO: 474800 - RNA, 64 nt, Homo Sapiens; identical to SEQ ID NO: 138563

SEQ ID NO: 474801 - RNA, 64 nt, Homo Sapiens; identical to SEQ ID NO: 138564

SEQ ID NO: 474802 - RNA, 64 nt, Homo Sapiens; identical to SEQ ID NO: 138565

SEQ ID NO: 474803 - RNA, 64 nt, Homo Sapiens; identical to SEQ ID NO: 138566

SEQ ID NO: 474804 - RNA, 64 nt, Homo Sapiens; identical to SEQ ID NO: 138567

SEQ ID NO: 474805 - RNA, 64 nt, Homo Sapiens; identical to SEQ ID NO: 138568

SEQ ID NO: 474806 - RNA, 64 nt, Homo Sapiens; identical to SEQ ID NO: 138569

SEQ ID NO: 474807 - RNA, 64 nt, Homo Sapiens; identical to SEQ ID NO: 138570

SEQ ID NO: 474808 - RNA, 64 nt, Homo Sapiens; identical to SEQ ID NO: 138571

SEQ ID NO: 474809 - RNA, 64 nt, Homo Sapiens; identical to SEQ ID NO: 138572

SEQ ID NO: 474810 - RNA, 55 nt, Homo Sapiens; identical to SEQ ID NO: 138573

SEQ ID NO: 474811 - RNA, 64 nt, Homo Sapiens; identical to SEQ ID NO: 138574

SEQ ID NO: 474812 - RNA, 64 nt, Homo Sapiens; identical to SEQ ID NO: 138575

SEQ ID NO: 474813 - RNA, 64 nt, Homo Sapiens; identical to SEQ ID NO: 138576

SEQ ID NO: 474814 - RNA, 64 nt, Homo Sapiens; identical to SEQ ID NO: 138577

SEQ ID NO: 474815 - RNA, 64 nt, Homo Sapiens; identical to SEQ ID NO: 138578

SEQ ID NO: 474816 - RNA, 64 nt, Homo Sapiens; identical to SEQ ID NO: 138579

SEQ ID NO: 474817 - RNA, 64 nt, Homo Sapiens; identical to SEQ ID NO: 138580

SEQ ID NO: 474818 - RNA, 64 nt, Homo Sapiens; identical to SEQ ID NO: 138581

SEQ ID NO: 474819 - RNA, 64 nt, Homo Sapiens; identical to SEQ ID NO: 138582

SEQ ID NO: 474820 - RNA, 64 nt, Homo Sapiens; identical to SEQ ID NO: 138583

SEQ ID NO: 474821 - RNA, 64 nt, Homo Sapiens; identical to SEQ ID NO: 138584

SEQ ID NO: 474822 - RNA, 64 nt, Homo Sapiens
cuaccaccagaggccugcagccucccacaugccuuaaggggaccguggcccccaccagggacgu

SEQ ID NO: 474823 - RNA, 64 nt, Homo Sapiens
uguuuuuuuaauucauuaaccagugguuagcccuuaaggggaggaggacggauugauuccacau

SEQ ID NO: 474824 - RNA, 64 nt, Homo Sapiens
agggauacuggacuuucugacgcagaugaacaauuaaggggaaaagcuucccuuuucccucugu

SEQ ID NO: 474825 - RNA, 64 nt, Homo Sapiens
cauuguuuucuagguaaacuucacuacugguaauuaaggggaaggauaugaggaagcaguuuaa

SEQ ID NO: 474826 - RNA, 64 nt, Homo Sapiens
ugucuauaugucuagcucaucuaguuccucuucuuaaggggaugggggucaggggcuaggggag

SEQ ID NO: 474827 - RNA, 64 nt, Homo Sapiens
gaauucuugaguuuacaucaauaauauuguauauuaaggggaucagaaguaggaaggaaaaaau

SEQ ID NO: 474828 - RNA, 64 nt, Homo Sapiens
uuucuguuagucauuuccuggaaaaguaauauuuuaaggggaaauuauggaaacaaucuaauug

SEQ ID NO: 474829 - RNA, 64 nt, Homo Sapiens
uuauacuaaagaauccagaguugcuacaauaaaauaaggggaauaauaaacuugagagugaaua

SEQ ID NO: 474830 - RNA, 64 nt, Homo Sapiens
acucaauaguucuguuacuuuaaaucaguuuuguuaaggggaaagagugucuuaagccuaauau

SEQ ID NO: 474831 - RNA, 64 nt, Homo Sapiens
gaacagcuggaguuucuguugcucagagaacugcuaaggggaaacugggagucccaguggugag

SEQ ID NO: 474832 - RNA, 64 nt, Homo Sapiens
aauggugggauuugguuuaccacugauagcuuuuuaaggggaugucuugaguacaauggggagc

SEQ ID NO: 474833 - RNA, 64 nt, Homo Sapiens
ucauggcuuguucucuuuguuauaaacccuugguuaaggggaaaagaacugcugccuaggaaac

SEQ ID NO: 474834 - RNA, 64 nt, Homo Sapiens
aggggugcugaauuuuuaggaggugggacaaguauaaggggaagcuucauuaucccugugaagu

SEQ ID NO: 474835 - RNA, 64 nt, Homo Sapiens
guuggaucuuggguuuggucuacuuggugggaaguaaggggaaggggaaaguuguuuuugguac

SEQ ID NO: 474836 - RNA, 64 nt, Homo Sapiens
ccggggagucaguuucagacgggggugggggugguaaggggagauagggaaaagaaaauggggu

SEQ ID NO: 474837 - RNA, 64 nt, Homo Sapiens
gguucaucugaguaaacauagggauuguguccucuaaggggacggaguuggggggguugggggu

SEQ ID NO: 474838 - RNA, 64 nt, Homo Sapiens
auucauuccauagagcugaaauaaagacgggacauaaggggaaauaaaacaugcugagguugag

SEQ ID NO: 474839 - RNA, 64 nt, Homo Sapiens
cuccaaugucucucugaacuccccagauggacaguaaggggaacuccucugcuuccucuguugg

SEQ ID NO: 474840 - RNA, 64 nt, Homo Sapiens
uaggcuaguuuauagaaaaauuaaaugaucaguuuaaggggaaaaacaaauuacuauagaacau

SEQ ID NO: 474841 - RNA, 64 nt, Homo Sapiens
ucuaauuuauuuugucuuuuggcuucucaguagcuaaggggaaggcugaugucaggagagggag

SEQ ID NO: 474842 - RNA, 64 nt, Homo Sapiens
gcuugugcuuuauacaaagagaaagagguggucuuaaggggaugcuuccaggggggugaguuca

SEQ ID NO: 474843 - RNA, 64 nt, Homo Sapiens
ggacgaggccgggacuuggccgagcggauccuaauaaggggaaaaugguaaaugcaaacguccc

SEQ ID NO: 474844 - RNA, 64 nt, Homo Sapiens
uaccaucuuuucagacaagaauguacagcaaaaauaaggggaacaguaguauacugagagugug

SEQ ID NO: 474845 - RNA, 64 nt, Homo Sapiens
ucaaggccuugggcucuccccagggucuaacgguuaaggggacccacauaccagugccaagggg

SEQ ID NO: 474846 - RNA, 64 nt, Homo Sapiens
acaaaaaaaaagaugaaccuaggucuguguaaaguaaggggaguguuaggagcagccaggacug

SEQ ID NO: 474847 - RNA, 64 nt, Homo Sapiens
ucucccagagacuugacauucuugacugaaacuuuaaggggaucgucugugcucugauaugcuc

SEQ ID NO: 474848 - RNA, 53 nt, Homo Sapiens
aagauucccaucucuacaauaaauaaggggagggaaugccaggaaggauguag

SEQ ID NO: 474849 - RNA, 64 nt, Homo Sapiens
cacaaguauugcccuuuaacacagagacacaucuuaaggggaccauacacacacacacacacac

SEQ ID NO: 474850 - RNA, 64 nt, Homo Sapiens
acaucuuguaaugaaagucucaucccagcacuuauaaggggagcacaagagaauaaaaaugggc

SEQ ID NO: 474851 - RNA, 64 nt, Homo Sapiens
ugcaggaggugagcugauacgaaggaguuccugcuaaggggaggguggcaguccuuugccagug

SEQ ID NO: 474852 - RNA, 64 nt, Homo Sapiens
cuggguuuucagaagguccuucugauggcuaggcuaaggggaggaagaauuccugccaugcccc

SEQ ID NO: 474853 - RNA, 64 nt, Homo Sapiens
gcccuucuuccuggucugggugucucccugagucuaaggggaagauucucaaguccccugguga

SEQ ID NO: 474854 - RNA, 64 nt, Homo Sapiens
aaaauagucucuuuaaaaggaaagaaaacaucuuuaaggggaggaaccagagugcugaaggaau

SEQ ID NO: 474855 - RNA, 64 nt, Homo Sapiens
aauacagaugauuuguguaaccugaggccaggauuaaggggaggcaaucaaugcaccuagggaa

SEQ ID NO: 474856 - RNA, 64 nt, Homo Sapiens
uuaagucuaugugagcaagugagagaagguuagguaaggggagaggauggaaugcuugccucca

SEQ ID NO: 474857 - RNA, 64 nt, Homo Sapiens
gagcauuuccucaaaauugagauggaucaauauguaaggggaggugggagcguguguggaaggg

SEQ ID NO: 474858 - RNA, 64 nt, Homo Sapiens
aaaauauaauuauuacugaaauauguuuaauauuuaaggggaaaagagacuaauuucaguuaua

SEQ ID NO: 474859 - RNA, 64 nt, Homo Sapiens
cuucugcaacaagcaugcagcuuugcaaacccauuaaggggaagaaugaaagcuguuccuuggu

SEQ ID NO: 474860 - RNA, 64 nt, Homo Sapiens
uggauccuugguaauccucaagcaucagaugccauaaggggaaacuuaauucugcuaaauuaau

SEQ ID NO: 474861 - RNA, 64 nt, Homo Sapiens
agcugcuuucaaggccaccaagguucuagagacuuaaggggaaacugucuuaauuacucauggc

SEQ ID NO: 474862 - RNA, 64 nt, Homo Sapiens
guggcaaugggacccagcucugcuguuuauucuguaaggggaagcauucuaccucuuugugccc

SEQ ID NO: 474863 - RNA, 64 nt, Homo Sapiens
gcuccaggccggggccuguccagugucuacugaguaaggggacagguggagagaggggccucuu

SEQ ID NO: 474864 - RNA, 64 nt, Homo Sapiens
uuuuacguuuuagaaaauuuuauguauuuuaaaauaaggggaagagucauuuucacuuuuaaac

SEQ ID NO: 474865 - RNA, 64 nt, Homo Sapiens
auuuuaaaauuaagagagcauaagguuuaauaacuaaggggaaugguuuuuuugggaguuuuuu

SEQ ID NO: 474866 - RNA, 64 nt, Homo Sapiens
gacuagacugccacagcagcaaaaaacacaaucuuaaggggauauuguauuauuuugugcauuu

SEQ ID NO: 474867 - RNA, 64 nt, Homo Sapiens
aaaacuuguuuuguuagaggucucuuaugauuuauaaggggaaacuuccccauuuugccaucug

SEQ ID NO: 474868 - RNA, 64 nt, Homo Sapiens
cuaaaguccuaucauucauuuguuuuaaauaaauuaaggggacaacuuuugagucugguuucau

SEQ ID NO: 474869 - RNA, 64 nt, Homo Sapiens
uaauucauguuaagauuauguaugguuugcauuuuaaggggauuuauguuagguuaauuaguug

SEQ ID NO: 474870 - RNA, 64 nt, Homo Sapiens
uccugacaguccaggcaacacauuuugccuuuuuuaaggggaguuuaccucauuguugguuguu

SEQ ID NO: 474871 - RNA, 64 nt, Homo Sapiens
uaagugaggaugaaaaaauaacacuguacugcaauaaggggagaguaacccugucuaaugaaac

SEQ ID NO: 474872 - RNA, 64 nt, Homo Sapiens
gauaauauugucugucucuaugucuuaaaagauauaaggggaaaucuucuaaaacuugaguggc

SEQ ID NO: 474873 - RNA, 64 nt, Homo Sapiens
cugcuuucugcccuucucccuugugcugauaggguaaggggaggugggauuucaugggguuugg

SEQ ID NO: 474874 - RNA, 64 nt, Homo Sapiens
gguuguaaggguggcuaagucccaccauaacagcuaaggggaccugggagaugauggcucauuu

SEQ ID NO: 474875 - RNA, 64 nt, Homo Sapiens
guggggucugucucucccuuaagaauggggccucuaaggggaguggugcuaauuacauggcagg

SEQ ID NO: 474876 - RNA, 64 nt, Homo Sapiens
uacagacagacauacauagaguuuggaaagguucuaaggggaccaaaaucucuugauuauaaau

SEQ ID NO: 474877 - RNA, 64 nt, Homo Sapiens
ucgucaguugcucccaguauugaaauauaaacuguaaggggauuaugacuuuugcuggcagaac

SEQ ID NO: 474878 - RNA, 64 nt, Homo Sapiens
ugcagcaucuguguggauuucuccuuguaggggauaaggggaugcauuguggaagaucuccagc

SEQ ID NO: 474879 - RNA, 64 nt, Homo Sapiens
uuuaagaauggugcucuuucaugccuauuaucaguaaggggacuuguauuagagucagagucuu

SEQ ID NO: 474880 - RNA, 64 nt, Homo Sapiens
agucuggauauaaacguauuuucugucuuccuuauaaggggauucucccagcugcuaaauuuaa

SEQ ID NO: 474881 - RNA, 64 nt, Homo Sapiens
gaauuaaguuuuuuuuuaaaaaagaaacauuugguaaggggaauugaggacacugauauggguc

SEQ ID NO: 474882 - RNA, 64 nt, Homo Sapiens
acgugcagguuuguucuauacuuauauuuuaguuuaaggggaacuaacgaggauuuuauuuuaa

SEQ ID NO: 474883 - RNA, 64 nt, Homo Sapiens
cccagaagugcagagcugaggggagagucaggaauaaggggauccucuuccaggugggggaggg

SEQ ID NO: 474884 - RNA, 64 nt, Homo Sapiens
auagaccuguacauguauuuuuuucuucagaggcuaaggggaagaaugauaguggcaauaauau

SEQ ID NO: 474885 - RNA, 64 nt, Homo Sapiens
caucgugaaagaugggaaaaaucgugaugauggguaaggggaaaacuucccggaaggcaauggg

SEQ ID NO: 474886 - RNA, 64 nt, Homo Sapiens
cacaggacacagccuuauuacugcuggggugggauaaggggaaggagaagagggagaauggagc

SEQ ID NO: 474887 - RNA, 64 nt, Homo Sapiens
aggccaggagugaggggcucuuucuuaccguaaauaaggggaaaaggcaguuagcucaaggacu

SEQ ID NO: 474888 - RNA, 64 nt, Homo Sapiens
uuuaaaucucuaccacagccucacaagcaaaugcuaaggggaacauacauguaaaaagccagca

SEQ ID NO: 474889 - RNA, 64 nt, Homo Sapiens
guaauaugaucaaaguuaaguuuccaugcaauuauaaggggaggcaucugauauaccagaauua

SEQ ID NO: 474890 - RNA, 64 nt, Homo Sapiens
gugauuuuccaguucaaaaacagacaugcacuucuaaggggaagcaacagaauuugccaaaauu

SEQ ID NO: 474891 - RNA, 64 nt, Homo Sapiens
uuuguaccccauugauucuuaauccaccuuucucuaaggggaagagguuauaaguauuacaaaa

SEQ ID NO: 474892 - RNA, 64 nt, Homo Sapiens
gagugggagggcuuauauugguuuuuccagcuauuaaggggacauauugugucguugugcuuuu

SEQ ID NO: 474893 - RNA, 64 nt, Homo Sapiens
aaaguuuguaauuauuucaugcuuguuuguuuuuuaaggggaaauuuuguuuguguuuuguuug

SEQ ID NO: 474894 - RNA, 64 nt, Homo Sapiens
uuuguuuauaaauguguacaguuuuguuuucucguaaggggagcaucauaggguuacuuuauac

SEQ ID NO: 474895 - RNA, 64 nt, Homo Sapiens
cgaaccucgugggcuguaggaaagcaaauguagguaaggggagagcaaggaugcacagaaaaca

SEQ ID NO: 474896 - RNA, 64 nt, Homo Sapiens
gcacuaucacuuaguaccuguuugaccaagguguuaaggggauaguaccucccaauucaagcag

SEQ ID NO: 474897 - RNA, 64 nt, Homo Sapiens
caaaugaaaaagaaugaaagggaaagugaaaaauuaaggggacaaaagaugggaugugaaaaga

SEQ ID NO: 474898 - RNA, 64 nt, Homo Sapiens
acaaggcauuucugacauuuuauaaaccuacauuuaaggggaauuuuuaaaggaaauguuuuuu

SEQ ID NO: 474899 - RNA, 64 nt, Homo Sapiens
ggugaauaccugcuccucgcccagaaaagaagacuaaggggacaauacauguauuuuaguaaau

SEQ ID NO: 474900 - RNA, 64 nt, Homo Sapiens
aagauaaaauaaccccuauuguucuuguuuuuaauaaggggaaaguuuagaccuugguuuggua

SEQ ID NO: 474901 - RNA, 64 nt, Homo Sapiens
caaagugacaggggaaaaggaauuagucuaagaguaaggggaugauuauuauauugaggcuaaa

SEQ ID NO: 474902 - RNA, 64 nt, Homo Sapiens
aggggaugaucuuuugugguuccuuucuucucccuaaggggauggagcagaaacucuuaagaaa

SEQ ID NO: 474903 - RNA, 64 nt, Homo Sapiens
guuguuccagcuuugauccuggaauuuuuuuaaauaaggggaggcccugaugguuacuugcuau

SEQ ID NO: 474904 - RNA, 64 nt, Homo Sapiens
ggacccauagaggcuugccucuacccuaaaauucuaaggggaaggucuguagccuccucguucc

SEQ ID NO: 474905 - RNA, 64 nt, Homo Sapiens
uaguaucuuuaaaguuaaugauauaccuuuuaaauaaggggaaagcucgugccauguuaugauc

SEQ ID NO: 474906 - RNA, 64 nt, Homo Sapiens
ucuucaacauuaaggcaguacuaaaagacaaauuuaaggggagccaccaguuugacugugcuag

SEQ ID NO: 474907 - RNA, 64 nt, Homo Sapiens
ccuuggaaccugagcugccagccugaggccggcauaaggggaggcuacagagagggaagggaaa

SEQ ID NO: 474908 - RNA, 64 nt, Homo Sapiens
agagugauuaugggagcagcaagguugcugggauuaaggggauuuauauauuuuuuuuuggaug

SEQ ID NO: 474909 - RNA, 64 nt, Homo Sapiens
uggaaacugucaacuuacaaaggggucguaugaguaaggggauucccuucacaccccccuucac

SEQ ID NO: 474910 - RNA, 64 nt, Homo Sapiens
aaguuaugaaaaaauagacgucaacaaaaauguguaaggggauauuagguuugcuaaauucuuu

SEQ ID NO: 474911 - RNA, 64 nt, Homo Sapiens
auggaugucacucaacuaagaucaaaucaccauuuaaggggauggcauucuuuauaccuaaaca

SEQ ID NO: 474912 - RNA, 64 nt, Homo Sapiens
ggggaugguauauggcccuuuccccaccaggcgcuaaggggaacacccccuuccccaggucuuu

SEQ ID NO: 474913 - RNA, 64 nt, Homo Sapiens
gugcacauuuguuuggggaugggggagaagaagcuaaggggagaagucaacauuuaugaaauau

SEQ ID NO: 474914 - RNA, 64 nt, Homo Sapiens
aagggaccagggauugcaggccccaucuccaggcuaaggggaggagagcaucaucacuuuccau

SEQ ID NO: 474915 - RNA, 64 nt, Homo Sapiens
ggguucagcugcugcucccaauaccucagcaugguaaggggacagagcccagcagaucccagcu

SEQ ID NO: 474916 - RNA, 64 nt, Homo Sapiens
cggggacuucugaaauagagggguguuggcuggguaaggggagccauccucuuggguggguuuu

SEQ ID NO: 474917 - RNA, 64 nt, Homo Sapiens
acaaaguguuuauuuccccacaagggagauauuguaaggggaaaggaauccucaaacuucccuc

SEQ ID NO: 474918 - RNA, 64 nt, Homo Sapiens
acugucucaaauauguaggaguuacagaaucuauuaaggggaugcagagguagcaugugcccua

SEQ ID NO: 474919 - RNA, 64 nt, Homo Sapiens
agggccagcucucuggcaucccaccccaggagaguaaggggacgaaccccugcucccccugucc

SEQ ID NO: 474920 - RNA, 64 nt, Homo Sapiens
uuuuuuuuuuuuuuggcaaauguuuacauucaauuaaggggaaaaaguagaaccagcacaaaug

SEQ ID NO: 474921 - RNA, 64 nt, Homo Sapiens
caaaaacaucuugaaaagaccuuugagucacaauuaaggggaagauuucucucaauuugauuag

SEQ ID NO: 474922 - RNA, 64 nt, Homo Sapiens
uaagucuuuguagucugucaaauugguuuaaacauaaggggaauuaaugaaacacuggacauau

SEQ ID NO: 474923 - RNA, 64 nt, Homo Sapiens
acgcaaauaacaggacuauuaaugcauccaagguuaaggggaagcugagccuuuuuuuuuuucu

SEQ ID NO: 474924 - RNA, 64 nt, Homo Sapiens
cagauugcuucucuguauuaaauagucuagaaguuaaggggauggucacauuuaccauguauug

SEQ ID NO: 474925 - RNA, 64 nt, Homo Sapiens
ugaugguucugugauucccaaucuucugccauccuaaggggacaggagauugaggcugugccac

SEQ ID NO: 474926 - RNA, 64 nt, Homo Sapiens
agagagcacuuaguuucugaugccaacaccuuuuuaaggggaggcuuccuuggagaccugcauu

SEQ ID NO: 474927 - RNA, 64 nt, Homo Sapiens
agggaggguugcauaacagcuauccaaaacaaauuaaggggaaaucuaaauuccuuaagaaaga

SEQ ID NO: 474928 - RNA, 64 nt, Homo Sapiens
auuauuuaaaucggaaaggaaaaacaaaaaaaauuaaggggaaauaaaauucaaaacaagaaac

SEQ ID NO: 474929 - RNA, 64 nt, Homo Sapiens
auaagauuucugucuacuaacaugacaacuacuuuaaggggaagauauuaaaaagucuguaugg

SEQ ID NO: 474930 - RNA, 64 nt, Homo Sapiens
ccuucaggaacacggggagcagaggccaaagcacuaaggggagggcgcauacccgagacgauug

SEQ ID NO: 474931 - RNA, 64 nt, Homo Sapiens
uguguguguguguguguguguguguguguguguguaaggggaggaaagccaccuugacagccca

SEQ ID NO: 474932 - RNA, 64 nt, Homo Sapiens
aaccgaaggcucggucuuaauucccccaccugucuaaggggaacagaaaaccccugccaaaacu

SEQ ID NO: 474933 - RNA, 64 nt, Homo Sapiens
caucaguuagagcugacacaaaccugccuggguuuaaggggagaggaaauauugcuggggucau

SEQ ID NO: 474934 - RNA, 64 nt, Homo Sapiens
gcaagggggagagaucuagauaaacagcuuuuucuaaggggagacugcccuuaacuguuuucac

SEQ ID NO: 474935 - RNA, 64 nt, Homo Sapiens
uaaccagcaauggccagggucuuacggagagaaauaaggggaugcuuaagccaccuccccagga

SEQ ID NO: 474936 - RNA, 64 nt, Homo Sapiens
aagauauuaagacuuaauucacuaaaauuuauucuaaggggauauuuauacuuuuauacuuuuu

SEQ ID NO: 474937 - RNA, 64 nt, Homo Sapiens
ucuuucugagcuggcgaguuagaagaauggaagguaaggggaaggucugucaucuacccaggac

SEQ ID NO: 474938 - RNA, 64 nt, Homo Sapiens
ugaugacucuuuugguaaccagacaccaaucaaauaaggggaggagacgaaaauggaaugauuu

SEQ ID NO: 474939 - RNA, 64 nt, Homo Sapiens
uugcuuaaaggaaaaugaaauacaauuagcagaauaaggggaaacgaguggucugcucugcucg

SEQ ID NO: 474940 - RNA, 64 nt, Homo Sapiens
gaggcagaaucccggcugucaagggguguucaguuaaggggagcaacagaggacaugaaaaauu

SEQ ID NO: 474941 - RNA, 64 nt, Homo Sapiens
auugcuuuuuaaaaugcagugcuuuacuuuaaacuaaggggaacuuugcggaggugaaaaccuu

SEQ ID NO: 474942 - RNA, 64 nt, Homo Sapiens
cuguauuacugaaagcuaaauccucaaaaccuaguaaggggacuaaugauucauuaaaguaaau

SEQ ID NO: 474943 - RNA, 64 nt, Homo Sapiens
aaacaaccugagauggagaggccaggagagaguauaaggggauagcagcaaaccaccuaucugg

SEQ ID NO: 474944 - RNA, 64 nt, Homo Sapiens
gaggaaaacaaaaccaaccaguaggaggaaaaauuaaggggagacugugauauuuccaacgacu

SEQ ID NO: 474945 - RNA, 64 nt, Homo Sapiens
ugcacuggaauaggaaauguguacccaguuuauuuaaggggacaucuccuuccauaaugcuccu

SEQ ID NO: 474946 - RNA, 64 nt, Homo Sapiens
aaagaacgcauuugagauuuuaagaugucacuuauaaggggagaaguguucuuaaaaagucaac

SEQ ID NO: 474947 - RNA, 64 nt, Homo Sapiens
guuugggggcgggguguugggaguagagacaggguaaggggacgugagaaaggaaaaggcauga

SEQ ID NO: 474948 - RNA, 64 nt, Homo Sapiens
cuuuuuaaauuuggugccgauguugaacuuuuuuuaaggggagaaaauuaaaagaaauauacag

SEQ ID NO: 474949 - RNA, 64 nt, Homo Sapiens
cccagauagcuaggccagagcuggaagcagacaguaaggggaagagcugcucccacaggagagg

SEQ ID NO: 474950 - RNA, 64 nt, Homo Sapiens
cucucuccuuccccaucagacccuacccccaggguaaggggagcuacccccucccucuugucca

SEQ ID NO: 474951 - RNA, 64 nt, Homo Sapiens
ggaagaauuggagggcagcugucccuagcaccuuuaaggggaggucuaacaugugguccccuuu

SEQ ID NO: 474952 - RNA, 64 nt, Homo Sapiens
gggugggcauauucuggagaacuguguuaugggauaaggggagggucaggcucuccucuugacc

SEQ ID NO: 474953 - RNA, 64 nt, Homo Sapiens
gagagauugaucuggauggcuguguguguauauguaaggggaaauggguguuuuucagugugua

SEQ ID NO: 474954 - RNA, 64 nt, Homo Sapiens
ucccaaauggguguugcugguccaguggccauccuaaggggaacgugccaccaagacagccuuu

SEQ ID NO: 474955 - RNA, 64 nt, Homo Sapiens
gaagagagagggagcaggcgggagggaggaggaauaaggggaagggaaaggggugguagucaga

SEQ ID NO: 474956 - RNA, 64 nt, Homo Sapiens
caauugauuacccagcagcauauugacuuccggguaaggggaguaaguauaaauuaagacaccc

SEQ ID NO: 474957 - RNA, 64 nt, Homo Sapiens
cagagaagcuccccgucucucccuguccugccuguaaggggauaagugcuucugcaccccagcc

SEQ ID NO: 474958 - RNA, 64 nt, Homo Sapiens
uuguaguaugcuuaagcuuuggggaauuuuuuuuuaaggggaucuaaaaaaauguuuuuagaac

SEQ ID NO: 474959 - RNA, 64 nt, Homo Sapiens
uaauuucucagaggauuauaucuuaucuugacuuuaaggggaaaaaguacaguaaacacuauua

SEQ ID NO: 474960 - RNA, 64 nt, Homo Sapiens
agggaaauguacacuuuuuacacagauuuuuuuguaaggggaagaagggaauuuaauacuuuuc

SEQ ID NO: 474961 - RNA, 64 nt, Homo Sapiens
gacucucccagcauguucccagaaacagaauuccuaaggggauugugccugagaccccugccuu

SEQ ID NO: 474962 - RNA, 64 nt, Homo Sapiens
ccauccucagcuaccccgagagguagccccacucuaaggggagcagggggaccugacagcacac

SEQ ID NO: 474963 - RNA, 64 nt, Homo Sapiens
uagcccugggcuugccccauuuggggcagcuauuuaaggggaggggaugucucaccgggcuggg

SEQ ID NO: 474964 - RNA, 64 nt, Homo Sapiens
ggugauaggacuuacgcauccccaccuuuugggguaaggggagugcugcccugccauaaucccc

SEQ ID NO: 474965 - RNA, 64 nt, Homo Sapiens
gggauuuguaagacuuagaugagauagcgcauaauaaggggaagacuuuaaaguauaaaguaaa

SEQ ID NO: 474966 - RNA, 64 nt, Homo Sapiens
ccugucugagaccacccccggcucugacugagaguaaggggacugucagggccucgacuugcca

SEQ ID NO: 474967 - RNA, 64 nt, Homo Sapiens
aggagcgaacacugcacuaaaaucauguucuggguaaggggacguguguuuauguuaggaucug

SEQ ID NO: 474968 - RNA, 64 nt, Homo Sapiens
aauuauacuuuauucagguguuucucucucccgguaaggggacaaucaacuguugcaaaucccg

SEQ ID NO: 474969 - RNA, 64 nt, Homo Sapiens
gccaaagcuacacuggaggaaagagaugugaggguaaggggaaaagagaugugaaauguggcca

SEQ ID NO: 474970 - RNA, 64 nt, Homo Sapiens
uccuucccuuuucugacugagcagucugagccuuuaaggggaauccuuggaggaaauuccuuga

SEQ ID NO: 474971 - RNA, 64 nt, Homo Sapiens
gucugggugcccaggaguagagauuuuguuguuauaaggggagggugcauaauuguagaaauac

SEQ ID NO: 474972 - RNA, 64 nt, Homo Sapiens
guguuugauuaaaaaaaacacaucuaguaagacguaaggggaaaaucacauccucuuuggagau

SEQ ID NO: 474973 - RNA, 64 nt, Homo Sapiens
acaugcccaggugucagcucuacaguccuggggguaaggggaugaguagcuggucagggcugag

SEQ ID NO: 474974 - RNA, 64 nt, Homo Sapiens
cugugguuguuuucuugugcguacucauucauucuaaggggagucggugcaggaugccgcuucu

SEQ ID NO: 474975 - RNA, 64 nt, Homo Sapiens
cuugacucugaagggacuuuugaguuaaucagcguaaggggauuucuaaagcaggcaaucccug

SEQ ID NO: 474976 - RNA, 64 nt, Homo Sapiens
aggaaggcaugccuggacaauggaaguggcaauauaaggggauggauacaaaagaagaugaaaa

SEQ ID NO: 474977 - RNA, 64 nt, Homo Sapiens
uacagccagcggcauauacugguuauccaaauccuaaggggagcggccaucuggaaauccagcu

SEQ ID NO: 474978 - RNA, 64 nt, Homo Sapiens
agccugcacucuuuuguagacuuguccauuccuuuaaggggagcuuguuuuguaguguauauua

SEQ ID NO: 474979 - RNA, 64 nt, Homo Sapiens
agaaacauuuuuguucuuaugugguagucacuuguaaggggaacagcccuucauggguggugac

SEQ ID NO: 474980 - RNA, 64 nt, Homo Sapiens
uuuuuuuaaaaaacaacaaaaccaaaccaguucauaaggggaaugaaaguguuguaguugauug

SEQ ID NO: 474981 - RNA, 64 nt, Homo Sapiens
cugcuccccucagaucagucaggaggaagaugacuaaggggagggauccucugggugauggccu

SEQ ID NO: 474982 - RNA, 64 nt, Homo Sapiens
gggaagaagggacaagauucgcagaggccggugcuaaggggaugggacagaggugcccacgagg

SEQ ID NO: 474983 - RNA, 64 nt, Homo Sapiens
agggagugucaguggccuagugagucugugggauuaaggggauugcaagcguucccccaacugc

SEQ ID NO: 474984 - RNA, 64 nt, Homo Sapiens
aaguuugcuuaacugggcuugaguguguuugugguaaggggagaggagccggaauggagggcag

SEQ ID NO: 474985 - RNA, 64 nt, Homo Sapiens
acuucuuuuuacaauguaucaacauauuuuuauuuaaggggaauuaacaauugccagggaaacc

SEQ ID NO: 474986 - RNA, 64 nt, Homo Sapiens
ucugcuccaaccuucuauuuuaauuauuauuuuguaaggggaagaauaacauuugauaaauauu

SEQ ID NO: 474987 - RNA, 64 nt, Homo Sapiens
uccucuggguuuaagugauuuuauuuaagucaacuaaggggauuuaacaguggacuagagguaa

SEQ ID NO: 474988 - RNA, 64 nt, Homo Sapiens
uaaaaggaggacagggagggcuguccccugagguuaaggggaucccccucucuguuuacccucc

SEQ ID NO: 474989 - RNA, 64 nt, Homo Sapiens
uuuuauuagcuuaguaggaacauuacaaauaauauaaggggaagaguguacuauguuaugcaca

SEQ ID NO: 474990 - RNA, 64 nt, Homo Sapiens
ugaaggcccagagaagggaaaccuacuuacuccguaaggggaaauuagucaguaagacgauaua

SEQ ID NO: 474991 - RNA, 62 nt, Homo Sapiens
gagcuagguuuucucagaggggccugccauccaccccucagggcucagggguuggucugaga

SEQ ID NO: 474992 - RNA, 62 nt, Homo Sapiens
gcucacucagaccccaaggaauuaaggacuccaccccucagaguuauugaaggggaugguuc

SEQ ID NO: 474993 - RNA, 62 nt, Homo Sapiens
auccuuccucaggacuuggccccucaccccucaccccucacccugcccaccucguuccccag

SEQ ID NO: 474994 - RNA, 62 nt, Homo Sapiens
ccucaccauccuuccucagguccccagcccucaccccucaccccaucagcugcccaccucgu

SEQ ID NO: 474995 - RNA, 62 nt, Homo Sapiens
acuguggggaucauucucucuucagagugcugaccccucaucuugucuggcgucaacuggcu

SEQ ID NO: 474996 - RNA, 62 nt, Homo Sapiens
cccucuguccucauuguuugggcccuggacacaccccucagcuuccugcugaggugggacug

SEQ ID NO: 474997 - RNA, 62 nt, Homo Sapiens
gcaucauggagacccgcaggcggggcuuagccaccccucaaacccagggcccccuggcaccu

SEQ ID NO: 474998 - RNA, 62 nt, Homo Sapiens
ccuuggauauuucccaagaaccccccacauacaccccucacaagccaccccuccugagaggc

SEQ ID NO: 474999 - RNA, 62 nt, Homo Sapiens
cuguccuccggacuuaggaaagggaauagcucaccccucauuugacuuccgcaggaauugag

SEQ ID NO: 475000 - RNA, 62 nt, Homo Sapiens
gcuuccguucuuacugccuugucuucagcugcaccccucaccaguggggugcagcccuggcg

SEQ ID NO: 475001 - RNA, 62 nt, Homo Sapiens
cauuuucucccugagcuguaggguggaccuggaccccucagagaugcucgacugcagggucc

SEQ ID NO: 475002 - RNA, 62 nt, Homo Sapiens
ccguccagugucacccacacauugguccggggaccccucagugcagagccugaaguuggggg

SEQ ID NO: 475003 - RNA, 62 nt, Homo Sapiens
gguuuaagagaccaggucuuugugugggguuuaccccucacaugguguuucucucuguaauu

SEQ ID NO: 475004 - RNA, 62 nt, Homo Sapiens
gguuucauuguuuccuucugucuuuuguggugaccccucagggggguucagcggggccucug

SEQ ID NO: 475005 - RNA, 62 nt, Homo Sapiens
uuucccucucccuucuucccggcaaaauuuacaccccucacgcacugucuuaagugagccag

SEQ ID NO: 475006 - RNA, 62 nt, Homo Sapiens
caugucgcaaaaugaaccaaguuucucuaaggaccccucaaacagaccucagggaggguuga

SEQ ID NO: 475007 - RNA, 62 nt, Homo Sapiens
cuucugcccauagacggggaugacucagcacuaccccucaacagagaugacuuugaugacuc

SEQ ID NO: 475008 - RNA, 62 nt, Homo Sapiens
cagggaugacucagcagggaugacucagcaccaccccucaacagggaugacucagcagggau

SEQ ID NO: 475009 - RNA, 62 nt, Homo Sapiens
ggggacagggccaguguuggaugggggcucggaccccucacuuugucuauucagacgcuggu

SEQ ID NO: 475010 - RNA, 62 nt, Homo Sapiens
caacagccgcccccgcaggccuccagaggcccaccccucauggcagcacacucaucccgcgc

SEQ ID NO: 475011 - RNA, 62 nt, Homo Sapiens
cagagacuuccuucauuaacccuuagauuccaaccccucaauccccauggucacccugaagc

SEQ ID NO: 475012 - RNA, 62 nt, Homo Sapiens
gcagauucccagauuaacagucccuauccccaaccccucagagaguagcaccuucaggcuag

SEQ ID NO: 475013 - RNA, 64 nt, Homo Sapiens
aaaauguuaauaaaaaaugcaauugauguaaaccacgugagaggaacuuauguagauuauuaua

SEQ ID NO: 475014 - RNA, 64 nt, Homo Sapiens
aggcuaugggaaggcugcaaagcucgcugaggcaacgugagaaccagggagccccacagcccca

SEQ ID NO: 475015 - RNA, 64 nt, Homo Sapiens; identical to SEQ ID NO: 170734

SEQ ID NO: 475016 - RNA, 64 nt, Homo Sapiens; identical to SEQ ID NO: 170735

SEQ ID NO: 475017 - RNA, 64 nt, Homo Sapiens; identical to SEQ ID NO: 170736

SEQ ID NO: 475018 - RNA, 64 nt, Homo Sapiens; identical to SEQ ID NO: 170737

SEQ ID NO: 475019 - RNA, 64 nt, Homo Sapiens; identical to SEQ ID NO: 170738

SEQ ID NO: 475020 - RNA, 64 nt, Homo Sapiens; identical to SEQ ID NO: 170739

SEQ ID NO: 475021 - RNA, 64 nt, Homo Sapiens; identical to SEQ ID NO: 170740

SEQ ID NO: 475022 - RNA, 64 nt, Homo Sapiens; identical to SEQ ID NO: 170741

SEQ ID NO: 475023 - RNA, 64 nt, Homo Sapiens; identical to SEQ ID NO: 170742

SEQ ID NO: 475024 - RNA, 64 nt, Homo Sapiens; identical to SEQ ID NO: 170743

SEQ ID NO: 475025 - RNA, 64 nt, Homo Sapiens; identical to SEQ ID NO: 170744

SEQ ID NO: 475026 - RNA, 64 nt, Homo Sapiens; identical to SEQ ID NO: 170745

SEQ ID NO: 475027 - RNA, 64 nt, Homo Sapiens; identical to SEQ ID NO: 170746

SEQ ID NO: 475028 - RNA, 64 nt, Homo Sapiens; identical to SEQ ID NO: 170747

SEQ ID NO: 475029 - RNA, 64 nt, Homo Sapiens; identical to SEQ ID NO: 170748

SEQ ID NO: 475030 - RNA, 64 nt, Homo Sapiens; identical to SEQ ID NO: 170749

SEQ ID NO: 475031 - RNA, 64 nt, Homo Sapiens; identical to SEQ ID NO: 170750

SEQ ID NO: 475032 - RNA, 64 nt, Homo Sapiens; identical to SEQ ID NO: 170751

SEQ ID NO: 475033 - RNA, 64 nt, Homo Sapiens; identical to SEQ ID NO: 170752

SEQ ID NO: 475034 - RNA, 64 nt, Homo Sapiens; identical to SEQ ID NO: 170753

SEQ ID NO: 475035 - RNA, 64 nt, Homo Sapiens; identical to SEQ ID NO: 170754

SEQ ID NO: 475036 - RNA, 64 nt, Homo Sapiens; identical to SEQ ID NO: 170755

SEQ ID NO: 475037 - RNA, 64 nt, Homo Sapiens; identical to SEQ ID NO: 170756

SEQ ID NO: 475038 - RNA, 64 nt, Homo Sapiens; identical to SEQ ID NO: 170757

SEQ ID NO: 475039 - RNA, 64 nt, Homo Sapiens; identical to SEQ ID NO: 170758

SEQ ID NO: 475040 - RNA, 64 nt, Homo Sapiens; identical to SEQ ID NO: 80183

SEQ ID NO: 475041 - RNA, 64 nt, Homo Sapiens; identical to SEQ ID NO: 80184

SEQ ID NO: 475042 - RNA, 64 nt, Homo Sapiens; identical to SEQ ID NO: 80185

SEQ ID NO: 475043 - RNA, 64 nt, Homo Sapiens; identical to SEQ ID NO: 80186

SEQ ID NO: 475044 - RNA, 64 nt, Homo Sapiens; identical to SEQ ID NO: 80187

SEQ ID NO: 475045 - RNA, 64 nt, Homo Sapiens; identical to SEQ ID NO: 80188

SEQ ID NO: 475046 - RNA, 64 nt, Homo Sapiens; identical to SEQ ID NO: 80189

SEQ ID NO: 475047 - RNA, 64 nt, Homo Sapiens; identical to SEQ ID NO: 80190

SEQ ID NO: 475048 - RNA, 64 nt, Homo Sapiens; identical to SEQ ID NO: 80191

SEQ ID NO: 475049 - RNA, 64 nt, Homo Sapiens; identical to SEQ ID NO: 80192

SEQ ID NO: 475050 - RNA, 64 nt, Homo Sapiens; identical to SEQ ID NO: 80193

SEQ ID NO: 475051 - RNA, 64 nt, Homo Sapiens; identical to SEQ ID NO: 80194

SEQ ID NO: 475052 - RNA, 64 nt, Homo Sapiens; identical to SEQ ID NO: 80195

SEQ ID NO: 475053 - RNA, 64 nt, Homo Sapiens; identical to SEQ ID NO: 80196

SEQ ID NO: 475054 - RNA, 64 nt, Homo Sapiens; identical to SEQ ID NO: 80197

SEQ ID NO: 475055 - RNA, 64 nt, Homo Sapiens; identical to SEQ ID NO: 80198

SEQ ID NO: 475056 - RNA, 63 nt, Homo Sapiens
cuaguuuugaauaagucugggugaccgcaccuaaaaugguaagcaguacccuccggcuuuuuc

SEQ ID NO: 475057 - RNA, 63 nt, Homo Sapiens
uauuacucagcagcaguaacaugguaacacuuaaaaugguacucggggaccuccaaagacuaa

SEQ ID NO: 475058 - RNA, 63 nt, Homo Sapiens
uaaaacuuugaauaucccagcgaagaaauggauaaaugguacagugccuguggauaguacagu

SEQ ID NO: 475059 - RNA, 63 nt, Homo Sapiens
caucuacucaagguauuuuacagauuaccauggaaaugguagauacaguuuaaaagugcuuac

SEQ ID NO: 475060 - RNA, 63 nt, Homo Sapiens
auaaagaaauuauuuucaauaaagcaaaaggacaaaugguaauuuccuagaaaagauuuaagu

SEQ ID NO: 475061 - RNA, 63 nt, Homo Sapiens
acgcuguugcucauuuuaaaguuucuuuuguuaaaaugguauauaagaaaauuauaagcugag

SEQ ID NO: 475062 - RNA, 63 nt, Homo Sapiens
uuauaggguggguauagaugaacccauuucugaaaaugguacacccuuagaaagucuucugca

SEQ ID NO: 475063 - RNA, 63 nt, Homo Sapiens
uuuuguuauguauauuuuauauaaaaaugguuaaaaugguaaaaaugccacuaaauuguaccc

SEQ ID NO: 475064 - RNA, 63 nt, Homo Sapiens
aauagucaguuuucuagaaccuacuuuuaggguaaaugguacauuauuuaauauuauauuaaa

SEQ ID NO: 475065 - RNA, 63 nt, Homo Sapiens
aaaccuccuauagcguggauuguagaccaaaggaaaugguacaauuucugagaauauauguug

SEQ ID NO: 475066 - RNA, 63 nt, Homo Sapiens
aucgccaaugcaggaugcuccuuagaaaagaaaaaaugguaaagaauggcauuuaacgauuca

SEQ ID NO: 475067 - RNA, 63 nt, Homo Sapiens
ucccaacaacugcacuuuagaauaccagcagugaaaugguauuacuguuucccucugagugaa

SEQ ID NO: 475068 - RNA, 63 nt, Homo Sapiens
aaaaaaacaaagauauucaaacugcuuggguucaaaugguauacaauuugccagcuguuacug

SEQ ID NO: 475069 - RNA, 63 nt, Homo Sapiens
auauuguuggugagauaauauuuaauagguauaaaaugguaaaauaccuaguuuucuauuuag

SEQ ID NO: 475070 - RNA, 63 nt, Homo Sapiens
aaaacaaagauggacuuguucugggaaaagguaaaaugguaaucaaauagauuguguuccagg

SEQ ID NO: 475071 - RNA, 63 nt, Homo Sapiens
augggcuguccaguccugauuauagagaggaagaaaugguaacaguauggcagauaagaauua

SEQ ID NO: 475072 - RNA, 63 nt, Homo Sapiens
aaguuuuucauauuucauggacaacaaaagagaaaaugguaugaacacuguacaaacuuugau

SEQ ID NO: 475073 - RNA, 63 nt, Homo Sapiens
aauggaaagaagaacaaaauauugcaauauuugaaaugguaaaagugguuuauggugggcaau

SEQ ID NO: 475074 - RNA, 63 nt, Homo Sapiens
uggagcuccugauucaaauugacucaccuuuuuaaaugguacuaaacacugaugguuuuuaaa

SEQ ID NO: 475075 - RNA, 63 nt, Homo Sapiens
gauuuuuuuuucaaacacaguuacucagcuaaaaaaugguagaggcacagaaagguuaaauga

SEQ ID NO: 475076 - RNA, 63 nt, Homo Sapiens
gaugauaacuaacauuuuuuuuuagaaggauaaaaaugguaauaacaaaguaaaugauucuau

SEQ ID NO: 475077 - RNA, 63 nt, Homo Sapiens
uagcaacuagggcuagucuugggcaauaggguuaaaugguagucuacagugcuguguacccug

SEQ ID NO: 475078 - RNA, 63 nt, Homo Sapiens
aucaauaaaggacaggcuggaaagaguccagguaaaugguauguuagauuguguuccugaaga

SEQ ID NO: 475079 - RNA, 63 nt, Homo Sapiens
uugaaaaagaguuucauuguggagagaaaaagcaaaugguaugccacaagaucacucugauuu

SEQ ID NO: 475080 - RNA, 63 nt, Homo Sapiens
caauggaaaugcuauacguuuuugacauuuauuaaaugguaccaauaaaguauuuuauuacca

SEQ ID NO: 475081 - RNA, 63 nt, Homo Sapiens
agcguccucuuaaaagaugcgacuucccaagauaaaugguaccgucaacgcaacgucuaacug

SEQ ID NO: 475082 - RNA, 63 nt, Homo Sapiens
acguuaauuuauuaauaaauuugcuuucagggaaaaugguauagcagagguggaaaaauacuu

SEQ ID NO: 475083 - RNA, 63 nt, Homo Sapiens
uucccugcaguccaaagaugauuuuuucaccacaaaugguaagggaugcccaccuacuuuuau

SEQ ID NO: 475084 - RNA, 63 nt, Homo Sapiens
ccaggugccaacugcuaagcagauauauuccaaaaaugguaacugucaugugcacacuguugg

SEQ ID NO: 475085 - RNA, 63 nt, Homo Sapiens
ugugauuagugccuaggggucuccauuuagcagaaaugguaaugacagugauauaaugccugg

SEQ ID NO: 475086 - RNA, 63 nt, Homo Sapiens
guuguuguuuuuuuaagcuucccuugagagaauaaaugguaauggagagaacuauuuaacaag

SEQ ID NO: 475087 - RNA, 63 nt, Homo Sapiens
ccacauauuucagugagggucaugguuuccaaaaaaugguacuaauauugccauuaugcuuga

SEQ ID NO: 475088 - RNA, 63 nt, Homo Sapiens
ucauucgcuacuaugauuuagauuguaauauguaaaugguaugcccccuguuucagaggcuca

SEQ ID NO: 475089 - RNA, 63 nt, Homo Sapiens
gugggucaaauauuauaaaauaggcaaacaccaaaaugguauuaaauauugaacuccugaccu

SEQ ID NO: 475090 - RNA, 63 nt, Homo Sapiens
cagaaauggaacacuguaucuuuauauuccuaaaaaugguacuuuuggcauaauuaagaaauu

SEQ ID NO: 475091 - RNA, 63 nt, Homo Sapiens
cccuuuuaaaccuguuaacuugaaggagaacagaaaugguauuacuucaauagugguagauuu

SEQ ID NO: 475092 - RNA, 63 nt, Homo Sapiens
cuaacuauaaauguaaugaauuauaauaauuauaaaugguauaaaugcauucuacaaugugau

SEQ ID NO: 475093 - RNA, 63 nt, Homo Sapiens
ucugaucauaucuacauguacucuucccccuaaaaaugguaaaauaaauacaccuuuuuuucc

SEQ ID NO: 475094 - RNA, 63 nt, Homo Sapiens
cugaacccaaauuuguauaauaccuucagaucuaaaugguaauguaaauuuguauauguuauu

SEQ ID NO: 475095 - RNA, 52 nt, Homo Sapiens
gucugggaauccgagacacagaaaaugguaauaaggagcgguguccucuuaa

SEQ ID NO: 475096 - RNA, 63 nt, Homo Sapiens
aucugcuaaacaggacuucagguaagugaggugaaaugguagccagugacccguuaggagcuc

SEQ ID NO: 475097 - RNA, 63 nt, Homo Sapiens
gguguuucauacagaaugucuucauaucaucugaaaugguauggcugaaguucauuuguuuac

SEQ ID NO: 475098 - RNA, 64 nt, Homo Sapiens
ucuaaaagaacaacauugucuuucuuuucuagcacagaguuaugcauucaaagaugcauaccua

SEQ ID NO: 475099 - RNA, 64 nt, Homo Sapiens
gacagacugagcaaaauugcuugcaaaaguggcacagaguuagcacuccauaccccuucaaaca

SEQ ID NO: 475100 - RNA, 64 nt, Homo Sapiens
aaggcacauucuccaccacuaccaugguaauggacagaguuauccccugugguccggcagugcu

SEQ ID NO: 475101 - RNA, 64 nt, Homo Sapiens
gaggcacauacuucaccacuaccacgguaauggacagaguuaucgccuugggagcagcagugcu

SEQ ID NO: 475102 - RNA, 64 nt, Homo Sapiens
gaggcacauacuucaccaccaccauggaaauggacagaguuaucgccuucaauguaggagugcu

SEQ ID NO: 475103 - RNA, 64 nt, Homo Sapiens
uuguacacagggaauguaaauaaggauaacugaucagaguuauccacuguauuuauaaggaaga

SEQ ID NO: 475104 - RNA, 64 nt, Homo Sapiens
cagaaaaauagaaaaugcacagcuuuaaaaugggcagaguuaaaaucuauucccagcuuuauca

SEQ ID NO: 475105 - RNA, 64 nt, Homo Sapiens
cgggggccacgcgggccggcgcaggugcugcagccagaguuacgcugcccggagucgcccggga

SEQ ID NO: 475106 - RNA, 64 nt, Homo Sapiens
aagaagacuaacuuuucaaguuuuaucacugauucagaguuaaaacucuuuugcaaauuaacaa

SEQ ID NO: 475107 - RNA, 64 nt, Homo Sapiens; identical to SEQ ID NO: 443317

SEQ ID NO: 475108 - RNA, 64 nt, Homo Sapiens; identical to SEQ ID NO: 443318

SEQ ID NO: 475109 - RNA, 64 nt, Homo Sapiens; identical to SEQ ID NO: 443319

SEQ ID NO: 475110 - RNA, 64 nt, Homo Sapiens; identical to SEQ ID NO: 443320

SEQ ID NO: 475111 - RNA, 64 nt, Homo Sapiens; identical to SEQ ID NO: 443321

SEQ ID NO: 475112 - RNA, 64 nt, Homo Sapiens; identical to SEQ ID NO: 443322

SEQ ID NO: 475113 - RNA, 64 nt, Homo Sapiens; identical to SEQ ID NO: 443323

SEQ ID NO: 475114 - RNA, 64 nt, Homo Sapiens; identical to SEQ ID NO: 443324

SEQ ID NO: 475115 - RNA, 64 nt, Homo Sapiens; identical to SEQ ID NO: 443325

SEQ ID NO: 475116 - RNA, 64 nt, Homo Sapiens; identical to SEQ ID NO: 443326

SEQ ID NO: 475117 - RNA, 64 nt, Homo Sapiens; identical to SEQ ID NO: 443327

SEQ ID NO: 475118 - RNA, 64 nt, Homo Sapiens; identical to SEQ ID NO: 443328

SEQ ID NO: 475119 - RNA, 64 nt, Homo Sapiens; identical to SEQ ID NO: 443329

SEQ ID NO: 475120 - RNA, 64 nt, Homo Sapiens; identical to SEQ ID NO: 443330

SEQ ID NO: 475121 - RNA, 64 nt, Homo Sapiens; identical to SEQ ID NO: 443331

SEQ ID NO: 475122 - RNA, 64 nt, Homo Sapiens; identical to SEQ ID NO: 443332

SEQ ID NO: 475123 - RNA, 64 nt, Homo Sapiens; identical to SEQ ID NO: 443333

SEQ ID NO: 475124 - RNA, 64 nt, Homo Sapiens; identical to SEQ ID NO: 443334

SEQ ID NO: 475125 - RNA, 64 nt, Homo Sapiens; identical to SEQ ID NO: 443335

SEQ ID NO: 475126 - RNA, 64 nt, Homo Sapiens; identical to SEQ ID NO: 443336

SEQ ID NO: 475127 - RNA, 64 nt, Homo Sapiens; identical to SEQ ID NO: 443337

SEQ ID NO: 475128 - RNA, 64 nt, Homo Sapiens; identical to SEQ ID NO: 443338

SEQ ID NO: 475129 - RNA, 64 nt, Homo Sapiens; identical to SEQ ID NO: 443339

SEQ ID NO: 475130 - RNA, 64 nt, Homo Sapiens; identical to SEQ ID NO: 443340

SEQ ID NO: 475131 - RNA, 64 nt, Homo Sapiens; identical to SEQ ID NO: 443341

SEQ ID NO: 475132 - RNA, 64 nt, Homo Sapiens; identical to SEQ ID NO: 443342

SEQ ID NO: 475133 - RNA, 64 nt, Homo Sapiens; identical to SEQ ID NO: 443343

SEQ ID NO: 475134 - RNA, 64 nt, Homo Sapiens; identical to SEQ ID NO: 443344

SEQ ID NO: 475135 - RNA, 64 nt, Homo Sapiens
uugguccacuaaaacaagaugaaaaauacaagagugacucuauaacucuggucuuuaagaaagc

SEQ ID NO: 475136 - RNA, 64 nt, Homo Sapiens
uucucuagauauuuaauacagagaguguauagacugacucuaaguuaauaaugugcaaaauauc

SEQ ID NO: 475137 - RNA, 64 nt, Homo Sapiens
ucccuuucuuugguuaauaaguuguaauuucugaugacucuaagauguauuaugaaaaaauaaa

SEQ ID NO: 475138 - RNA, 64 nt, Homo Sapiens
uuuaugagaauugcagaacucccugaauuccaucugacucuaauuuuccaaaacuugcacgugu

SEQ ID NO: 475139 - RNA, 64 nt, Homo Sapiens
aaucacauuucaaauucaccagcaugugcugcauugacucuauuaaaacucuguaucuguuucu

SEQ ID NO: 475140 - RNA, 64 nt, Homo Sapiens
aauucucucuucuggaaucgucuacuccucccucugacucuaaguuuuuaaauaucuuuuuccu

SEQ ID NO: 475141 - RNA, 64 nt, Homo Sapiens
agaaaaacccauaaccaccucagauggaucugacguggcuaagggacaaacagcaaauauuuca

SEQ ID NO: 475142 - RNA, 64 nt, Homo Sapiens
gugugugugugugugugugugugugcacguguguguggcuaaauuaagucauacugucaaccac

SEQ ID NO: 475143 - RNA, 64 nt, Homo Sapiens
uaauuaguugcuuucacuauuuccgaauauaccuguggcuaaguuuuuauugaaacacucaaaa

SEQ ID NO: 475144 - RNA, 64 nt, Homo Sapiens
uuuugccaaggcugcuugugcuaccaguuugcugguggcuaacggcuugugcuugaaagucuuc

SEQ ID NO: 475145 - RNA, 64 nt, Homo Sapiens; identical to SEQ ID NO: 223145

SEQ ID NO: 475146 - RNA, 64 nt, Homo Sapiens; identical to SEQ ID NO: 223146

SEQ ID NO: 475147 - RNA, 64 nt, Homo Sapiens; identical to SEQ ID NO: 223147

SEQ ID NO: 475148 - RNA, 64 nt, Homo Sapiens; identical to SEQ ID NO: 223148

SEQ ID NO: 475149 - RNA, 64 nt, Homo Sapiens; identical to SEQ ID NO: 223149

SEQ ID NO: 475150 - RNA, 64 nt, Homo Sapiens; identical to SEQ ID NO: 223150

SEQ ID NO: 475151 - RNA, 64 nt, Homo Sapiens; identical to SEQ ID NO: 223151

SEQ ID NO: 475152 - RNA, 64 nt, Homo Sapiens; identical to SEQ ID NO: 223152

SEQ ID NO: 475153 - RNA, 64 nt, Homo Sapiens; identical to SEQ ID NO: 223153

SEQ ID NO: 475154 - RNA, 64 nt, Homo Sapiens; identical to SEQ ID NO: 223154

SEQ ID NO: 475155 - RNA, 64 nt, Homo Sapiens; identical to SEQ ID NO: 223155

SEQ ID NO: 475156 - RNA, 64 nt, Homo Sapiens; identical to SEQ ID NO: 223156

SEQ ID NO: 475157 - RNA, 64 nt, Homo Sapiens; identical to SEQ ID NO: 223157

SEQ ID NO: 475158 - RNA, 64 nt, Homo Sapiens; identical to SEQ ID NO: 223158

SEQ ID NO: 475159 - RNA, 64 nt, Homo Sapiens; identical to SEQ ID NO: 223159

SEQ ID NO: 475160 - RNA, 64 nt, Homo Sapiens; identical to SEQ ID NO: 223160

SEQ ID NO: 475161 - RNA, 64 nt, Homo Sapiens; identical to SEQ ID NO: 223161

SEQ ID NO: 475162 - RNA, 64 nt, Homo Sapiens; identical to SEQ ID NO: 223162

SEQ ID NO: 475163 - RNA, 64 nt, Homo Sapiens; identical to SEQ ID NO: 223163

SEQ ID NO: 475164 - RNA, 64 nt, Homo Sapiens; identical to SEQ ID NO: 223164

SEQ ID NO: 475165 - RNA, 64 nt, Homo Sapiens; identical to SEQ ID NO: 223165

SEQ ID NO: 475166 - RNA, 64 nt, Homo Sapiens; identical to SEQ ID NO: 223166

SEQ ID NO: 475167 - RNA, 64 nt, Homo Sapiens; identical to SEQ ID NO: 223167

SEQ ID NO: 475168 - RNA, 64 nt, Homo Sapiens; identical to SEQ ID NO: 223168

SEQ ID NO: 475169 - RNA, 64 nt, Homo Sapiens; identical to SEQ ID NO: 223169

SEQ ID NO: 475170 - RNA, 64 nt, Homo Sapiens; identical to SEQ ID NO: 223170

SEQ ID NO: 475171 - RNA, 64 nt, Homo Sapiens; identical to SEQ ID NO: 223171

SEQ ID NO: 475172 - RNA, 64 nt, Homo Sapiens; identical to SEQ ID NO: 223172

SEQ ID NO: 475173 - RNA, 64 nt, Homo Sapiens; identical to SEQ ID NO: 223173

SEQ ID NO: 475174 - RNA, 64 nt, Homo Sapiens; identical to SEQ ID NO: 223174

SEQ ID NO: 475175 - RNA, 64 nt, Homo Sapiens; identical to SEQ ID NO: 223175

SEQ ID NO: 475176 - RNA, 64 nt, Homo Sapiens; identical to SEQ ID NO: 223176

SEQ ID NO: 475177 - RNA, 64 nt, Homo Sapiens; identical to SEQ ID NO: 223177

SEQ ID NO: 475178 - RNA, 64 nt, Homo Sapiens; identical to SEQ ID NO: 223178

SEQ ID NO: 475179 - RNA, 64 nt, Homo Sapiens; identical to SEQ ID NO: 223179

SEQ ID NO: 475180 - RNA, 64 nt, Homo Sapiens; identical to SEQ ID NO: 223180

SEQ ID NO: 475181 - RNA, 64 nt, Homo Sapiens; identical to SEQ ID NO: 223181

SEQ ID NO: 475182 - RNA, 64 nt, Homo Sapiens; identical to SEQ ID NO: 223182

SEQ ID NO: 475183 - RNA, 64 nt, Homo Sapiens; identical to SEQ ID NO: 223183

SEQ ID NO: 475184 - RNA, 64 nt, Homo Sapiens; identical to SEQ ID NO: 223184

SEQ ID NO: 475185 - RNA, 64 nt, Homo Sapiens; identical to SEQ ID NO: 223185

SEQ ID NO: 475186 - RNA, 64 nt, Homo Sapiens; identical to SEQ ID NO: 223186

SEQ ID NO: 475187 - RNA, 64 nt, Homo Sapiens; identical to SEQ ID NO: 223187

SEQ ID NO: 475188 - RNA, 64 nt, Homo Sapiens; identical to SEQ ID NO: 223188

SEQ ID NO: 475189 - RNA, 64 nt, Homo Sapiens; identical to SEQ ID NO: 223189

SEQ ID NO: 475190 - RNA, 64 nt, Homo Sapiens; identical to SEQ ID NO: 223190

SEQ ID NO: 475191 - RNA, 64 nt, Homo Sapiens; identical to SEQ ID NO: 223191

SEQ ID NO: 475192 - RNA, 64 nt, Homo Sapiens; identical to SEQ ID NO: 223192

SEQ ID NO: 475193 - RNA, 64 nt, Homo Sapiens; identical to SEQ ID NO: 223193

SEQ ID NO: 475194 - RNA, 64 nt, Homo Sapiens; identical to SEQ ID NO: 223194

SEQ ID NO: 475195 - RNA, 64 nt, Homo Sapiens; identical to SEQ ID NO: 223195

SEQ ID NO: 475196 - RNA, 57 nt, Homo Sapiens; identical to SEQ ID NO: 223196

SEQ ID NO: 475197 - RNA, 64 nt, Homo Sapiens; identical to SEQ ID NO: 223197

SEQ ID NO: 475198 - RNA, 54 nt, Homo Sapiens; identical to SEQ ID NO: 223198

SEQ ID NO: 475199 - RNA, 64 nt, Homo Sapiens; identical to SEQ ID NO: 426665

SEQ ID NO: 475200 - RNA, 64 nt, Homo Sapiens; identical to SEQ ID NO: 426666

SEQ ID NO: 475201 - RNA, 64 nt, Homo Sapiens; identical to SEQ ID NO: 426667

SEQ ID NO: 475202 - RNA, 64 nt, Homo Sapiens; identical to SEQ ID NO: 426668

SEQ ID NO: 475203 - RNA, 64 nt, Homo Sapiens; identical to SEQ ID NO: 426669

SEQ ID NO: 475204 - RNA, 64 nt, Homo Sapiens; identical to SEQ ID NO: 426670

SEQ ID NO: 475205 - RNA, 64 nt, Homo Sapiens; identical to SEQ ID NO: 426671

SEQ ID NO: 475206 - RNA, 64 nt, Homo Sapiens; identical to SEQ ID NO: 426672

SEQ ID NO: 475207 - RNA, 64 nt, Homo Sapiens; identical to SEQ ID NO: 426673

SEQ ID NO: 475208 - RNA, 64 nt, Homo Sapiens; identical to SEQ ID NO: 426674

SEQ ID NO: 475209 - RNA, 64 nt, Homo Sapiens; identical to SEQ ID NO: 426675

SEQ ID NO: 475210 - RNA, 64 nt, Homo Sapiens; identical to SEQ ID NO: 426676

SEQ ID NO: 475211 - RNA, 64 nt, Homo Sapiens; identical to SEQ ID NO: 426677

SEQ ID NO: 475212 - RNA, 64 nt, Homo Sapiens; identical to SEQ ID NO: 426678

SEQ ID NO: 475213 - RNA, 64 nt, Homo Sapiens; identical to SEQ ID NO: 426679

SEQ ID NO: 475214 - RNA, 64 nt, Homo Sapiens; identical to SEQ ID NO: 426680

SEQ ID NO: 475215 - RNA, 64 nt, Homo Sapiens; identical to SEQ ID NO: 426681

SEQ ID NO: 475216 - RNA, 64 nt, Homo Sapiens; identical to SEQ ID NO: 426682

SEQ ID NO: 475217 - RNA, 64 nt, Homo Sapiens
cccugcccacaaaaaauugcagaaugugcuuuguaagauccaccuaauauucucuccgccauug

SEQ ID NO: 475218 - RNA, 64 nt, Homo Sapiens
aaagaagugaaaauagccaggccugaagcaacugaagauccacaugcacguauacacccagaug

SEQ ID NO: 475219 - RNA, 64 nt, Homo Sapiens
guccauggaaacauucccaccuauagcaucuguuaagauccaguuguguguaguuuuguaaaca

SEQ ID NO: 475220 - RNA, 64 nt, Homo Sapiens
cauuaauuuguuuuuauuuacauaaaaaacuuucaagauccaaagccaggggaagaagcaucuu

SEQ ID NO: 475221 - RNA, 64 nt, Homo Sapiens
ugccaauccacagccccacccuggcugacaauggaagauccagguaaacugagcaaaacugcag

SEQ ID NO: 475222 - RNA, 64 nt, Homo Sapiens
acucgagugguuaaagcuuaucaagagaggccccaagauccacaaauuguuugguaaccccuaa

SEQ ID NO: 475223 - RNA, 64 nt, Homo Sapiens
uucccaacuaguauucucuuccuucaaccacuugaagauccaaaaauaccacccauguaacauu

SEQ ID NO: 475224 - RNA, 64 nt, Homo Sapiens
ugcauaagauuguacaaggcacaguaaaaacaguaagauccauaaucuaugaaggcaaaaggug

SEQ ID NO: 475225 - RNA, 64 nt, Homo Sapiens; identical to SEQ ID NO: 77572

SEQ ID NO: 475226 - RNA, 64 nt, Homo Sapiens; identical to SEQ ID NO: 77573

SEQ ID NO: 475227 - RNA, 64 nt, Homo Sapiens; identical to SEQ ID NO: 77574

SEQ ID NO: 475228 - RNA, 64 nt, Homo Sapiens; identical to SEQ ID NO: 77575

SEQ ID NO: 475229 - RNA, 64 nt, Homo Sapiens; identical to SEQ ID NO: 77576

SEQ ID NO: 475230 - RNA, 64 nt, Homo Sapiens; identical to SEQ ID NO: 77577

SEQ ID NO: 475231 - RNA, 64 nt, Homo Sapiens; identical to SEQ ID NO: 77578

SEQ ID NO: 475232 - RNA, 64 nt, Homo Sapiens; identical to SEQ ID NO: 77579

SEQ ID NO: 475233 - RNA, 64 nt, Homo Sapiens; identical to SEQ ID NO: 77580

SEQ ID NO: 475234 - RNA, 64 nt, Homo Sapiens; identical to SEQ ID NO: 77581

SEQ ID NO: 475235 - RNA, 64 nt, Homo Sapiens; identical to SEQ ID NO: 77582

SEQ ID NO: 475236 - RNA, 64 nt, Homo Sapiens; identical to SEQ ID NO: 77583

SEQ ID NO: 475237 - RNA, 64 nt, Homo Sapiens; identical to SEQ ID NO: 77584

SEQ ID NO: 475238 - RNA, 64 nt, Homo Sapiens; identical to SEQ ID NO: 77585

SEQ ID NO: 475239 - RNA, 64 nt, Homo Sapiens; identical to SEQ ID NO: 77586

SEQ ID NO: 475240 - RNA, 64 nt, Homo Sapiens; identical to SEQ ID NO: 77587

SEQ ID NO: 475241 - RNA, 64 nt, Homo Sapiens; identical to SEQ ID NO: 77588

SEQ ID NO: 475242 - RNA, 64 nt, Homo Sapiens; identical to SEQ ID NO: 77589

SEQ ID NO: 475243 - RNA, 56 nt, Homo Sapiens; identical to SEQ ID NO: 77590

SEQ ID NO: 475244 - RNA, 64 nt, Homo Sapiens; identical to SEQ ID NO: 77591

SEQ ID NO: 475245 - RNA, 64 nt, Homo Sapiens; identical to SEQ ID NO: 77592

SEQ ID NO: 475246 - RNA, 64 nt, Homo Sapiens; identical to SEQ ID NO: 77593

SEQ ID NO: 475247 - RNA, 64 nt, Homo Sapiens; identical to SEQ ID NO: 77594

SEQ ID NO: 475248 - RNA, 64 nt, Homo Sapiens; identical to SEQ ID NO: 77595

SEQ ID NO: 475249 - RNA, 64 nt, Homo Sapiens; identical to SEQ ID NO: 77596

SEQ ID NO: 475250 - RNA, 64 nt, Homo Sapiens; identical to SEQ ID NO: 77597

SEQ ID NO: 475251 - RNA, 64 nt, Homo Sapiens; identical to SEQ ID NO: 77598

SEQ ID NO: 475252 - RNA, 64 nt, Homo Sapiens; identical to SEQ ID NO: 77599

SEQ ID NO: 475253 - RNA, 64 nt, Homo Sapiens; identical to SEQ ID NO: 77600

SEQ ID NO: 475254 - RNA, 64 nt, Homo Sapiens; identical to SEQ ID NO: 77601

SEQ ID NO: 475255 - RNA, 64 nt, Homo Sapiens; identical to SEQ ID NO: 77602

SEQ ID NO: 475256 - RNA, 64 nt, Homo Sapiens; identical to SEQ ID NO: 77603

SEQ ID NO: 475257 - RNA, 64 nt, Homo Sapiens; identical to SEQ ID NO: 77604

SEQ ID NO: 475258 - RNA, 64 nt, Homo Sapiens; identical to SEQ ID NO: 77605

SEQ ID NO: 475259 - RNA, 64 nt, Homo Sapiens; identical to SEQ ID NO: 77606

SEQ ID NO: 475260 - RNA, 64 nt, Homo Sapiens; identical to SEQ ID NO: 77607

SEQ ID NO: 475261 - RNA, 64 nt, Homo Sapiens; identical to SEQ ID NO: 77608

SEQ ID NO: 475262 - RNA, 64 nt, Homo Sapiens; identical to SEQ ID NO: 77609

SEQ ID NO: 475263 - RNA, 64 nt, Homo Sapiens; identical to SEQ ID NO: 77610

SEQ ID NO: 475264 - RNA, 64 nt, Homo Sapiens; identical to SEQ ID NO: 77611

SEQ ID NO: 475265 - RNA, 64 nt, Homo Sapiens; identical to SEQ ID NO: 77612

SEQ ID NO: 475266 - RNA, 64 nt, Homo Sapiens; identical to SEQ ID NO: 77613

SEQ ID NO: 475267 - RNA, 64 nt, Homo Sapiens; identical to SEQ ID NO: 77614

SEQ ID NO: 475268 - RNA, 64 nt, Homo Sapiens; identical to SEQ ID NO: 77615

SEQ ID NO: 475269 - RNA, 64 nt, Homo Sapiens; identical to SEQ ID NO: 77616

SEQ ID NO: 475270 - RNA, 64 nt, Homo Sapiens; identical to SEQ ID NO: 77617

SEQ ID NO: 475271 - RNA, 64 nt, Homo Sapiens; identical to SEQ ID NO: 77618

SEQ ID NO: 475272 - RNA, 64 nt, Homo Sapiens; identical to SEQ ID NO: 77619

SEQ ID NO: 475273 - RNA, 64 nt, Homo Sapiens; identical to SEQ ID NO: 77620

SEQ ID NO: 475274 - RNA, 64 nt, Homo Sapiens; identical to SEQ ID NO: 77621

SEQ ID NO: 475275 - RNA, 64 nt, Homo Sapiens; identical to SEQ ID NO: 77622

SEQ ID NO: 475276 - RNA, 64 nt, Homo Sapiens; identical to SEQ ID NO: 77623

SEQ ID NO: 475277 - RNA, 64 nt, Homo Sapiens; identical to SEQ ID NO: 77624

SEQ ID NO: 475278 - RNA, 64 nt, Homo Sapiens; identical to SEQ ID NO: 77625

SEQ ID NO: 475279 - RNA, 64 nt, Homo Sapiens; identical to SEQ ID NO: 77626

SEQ ID NO: 475280 - RNA, 64 nt, Homo Sapiens; identical to SEQ ID NO: 77627

SEQ ID NO: 475281 - RNA, 64 nt, Homo Sapiens; identical to SEQ ID NO: 77628

SEQ ID NO: 475282 - RNA, 64 nt, Homo Sapiens; identical to SEQ ID NO: 77629

SEQ ID NO: 475283 - RNA, 64 nt, Homo Sapiens; identical to SEQ ID NO: 77630

SEQ ID NO: 475284 - RNA, 64 nt, Homo Sapiens; identical to SEQ ID NO: 77631

SEQ ID NO: 475285 - RNA, 64 nt, Homo Sapiens; identical to SEQ ID NO: 77632

SEQ ID NO: 475286 - RNA, 64 nt, Homo Sapiens; identical to SEQ ID NO: 77633

SEQ ID NO: 475287 - RNA, 64 nt, Homo Sapiens; identical to SEQ ID NO: 77634

SEQ ID NO: 475288 - RNA, 64 nt, Homo Sapiens; identical to SEQ ID NO: 77635

SEQ ID NO: 475289 - RNA, 64 nt, Homo Sapiens; identical to SEQ ID NO: 77636

SEQ ID NO: 475290 - RNA, 64 nt, Homo Sapiens; identical to SEQ ID NO: 77637

SEQ ID NO: 475291 - RNA, 64 nt, Homo Sapiens; identical to SEQ ID NO: 77638

SEQ ID NO: 475292 - RNA, 64 nt, Homo Sapiens; identical to SEQ ID NO: 77639

SEQ ID NO: 475293 - RNA, 64 nt, Homo Sapiens; identical to SEQ ID NO: 77640

SEQ ID NO: 475294 - RNA, 64 nt, Homo Sapiens; identical to SEQ ID NO: 77641

SEQ ID NO: 475295 - RNA, 64 nt, Homo Sapiens; identical to SEQ ID NO: 77642

SEQ ID NO: 475296 - RNA, 64 nt, Homo Sapiens; identical to SEQ ID NO: 77643

SEQ ID NO: 475297 - RNA, 64 nt, Homo Sapiens; identical to SEQ ID NO: 77644

SEQ ID NO: 475298 - RNA, 64 nt, Homo Sapiens; identical to SEQ ID NO: 77645

SEQ ID NO: 475299 - RNA, 64 nt, Homo Sapiens; identical to SEQ ID NO: 77646

SEQ ID NO: 475300 - RNA, 64 nt, Homo Sapiens; identical to SEQ ID NO: 77647

SEQ ID NO: 475301 - RNA, 64 nt, Homo Sapiens; identical to SEQ ID NO: 77648

SEQ ID NO: 475302 - RNA, 64 nt, Homo Sapiens; identical to SEQ ID NO: 77649

SEQ ID NO: 475303 - RNA, 64 nt, Homo Sapiens; identical to SEQ ID NO: 77650

SEQ ID NO: 475304 - RNA, 64 nt, Homo Sapiens; identical to SEQ ID NO: 77651

SEQ ID NO: 475305 - RNA, 64 nt, Homo Sapiens; identical to SEQ ID NO: 77652

SEQ ID NO: 475306 - RNA, 64 nt, Homo Sapiens; identical to SEQ ID NO: 77653

SEQ ID NO: 475307 - RNA, 64 nt, Homo Sapiens; identical to SEQ ID NO: 77654

SEQ ID NO: 475308 - RNA, 64 nt, Homo Sapiens; identical to SEQ ID NO: 77655

SEQ ID NO: 475309 - RNA, 64 nt, Homo Sapiens; identical to SEQ ID NO: 77656

SEQ ID NO: 475310 - RNA, 64 nt, Homo Sapiens; identical to SEQ ID NO: 77657

SEQ ID NO: 475311 - RNA, 64 nt, Homo Sapiens; identical to SEQ ID NO: 77658

SEQ ID NO: 475312 - RNA, 64 nt, Homo Sapiens; identical to SEQ ID NO: 77659

SEQ ID NO: 475313 - RNA, 64 nt, Homo Sapiens; identical to SEQ ID NO: 77660

SEQ ID NO: 475314 - RNA, 63 nt, Homo Sapiens; identical to SEQ ID NO: 77661

SEQ ID NO: 475315 - RNA, 64 nt, Homo Sapiens; identical to SEQ ID NO: 77662

SEQ ID NO: 475316 - RNA, 64 nt, Homo Sapiens; identical to SEQ ID NO: 77663

SEQ ID NO: 475317 - RNA, 64 nt, Homo Sapiens; identical to SEQ ID NO: 77664

SEQ ID NO: 475318 - RNA, 64 nt, Homo Sapiens; identical to SEQ ID NO: 77665

SEQ ID NO: 475319 - RNA, 64 nt, Homo Sapiens; identical to SEQ ID NO: 77666

SEQ ID NO: 475320 - RNA, 64 nt, Homo Sapiens; identical to SEQ ID NO: 77667

SEQ ID NO: 475321 - RNA, 64 nt, Homo Sapiens; identical to SEQ ID NO: 77668

SEQ ID NO: 475322 - RNA, 64 nt, Homo Sapiens; identical to SEQ ID NO: 77669

SEQ ID NO: 475323 - RNA, 64 nt, Homo Sapiens; identical to SEQ ID NO: 77670

SEQ ID NO: 475324 - RNA, 64 nt, Homo Sapiens; identical to SEQ ID NO: 77671

SEQ ID NO: 475325 - RNA, 64 nt, Homo Sapiens; identical to SEQ ID NO: 77672

SEQ ID NO: 475326 - RNA, 64 nt, Homo Sapiens; identical to SEQ ID NO: 77673

SEQ ID NO: 475327 - RNA, 64 nt, Homo Sapiens; identical to SEQ ID NO: 77674

SEQ ID NO: 475328 - RNA, 64 nt, Homo Sapiens; identical to SEQ ID NO: 77675

SEQ ID NO: 475329 - RNA, 64 nt, Homo Sapiens; identical to SEQ ID NO: 77676

SEQ ID NO: 475330 - RNA, 64 nt, Homo Sapiens; identical to SEQ ID NO: 77677

SEQ ID NO: 475331 - RNA, 64 nt, Homo Sapiens; identical to SEQ ID NO: 77678

SEQ ID NO: 475332 - RNA, 64 nt, Homo Sapiens; identical to SEQ ID NO: 77679

SEQ ID NO: 475333 - RNA, 64 nt, Homo Sapiens; identical to SEQ ID NO: 77680

SEQ ID NO: 475334 - RNA, 64 nt, Homo Sapiens; identical to SEQ ID NO: 77681

SEQ ID NO: 475335 - RNA, 64 nt, Homo Sapiens; identical to SEQ ID NO: 77682

SEQ ID NO: 475336 - RNA, 64 nt, Homo Sapiens; identical to SEQ ID NO: 77683

SEQ ID NO: 475337 - RNA, 57 nt, Homo Sapiens; identical to SEQ ID NO: 77684

SEQ ID NO: 475338 - RNA, 64 nt, Homo Sapiens; identical to SEQ ID NO: 77685

SEQ ID NO: 475339 - RNA, 64 nt, Homo Sapiens; identical to SEQ ID NO: 77686

SEQ ID NO: 475340 - RNA, 64 nt, Homo Sapiens; identical to SEQ ID NO: 77687

SEQ ID NO: 475341 - RNA, 64 nt, Homo Sapiens; identical to SEQ ID NO: 77688

SEQ ID NO: 475342 - RNA, 64 nt, Homo Sapiens; identical to SEQ ID NO: 77689

SEQ ID NO: 475343 - RNA, 64 nt, Homo Sapiens; identical to SEQ ID NO: 77690

SEQ ID NO: 475344 - RNA, 64 nt, Homo Sapiens; identical to SEQ ID NO: 77691

SEQ ID NO: 475345 - RNA, 64 nt, Homo Sapiens; identical to SEQ ID NO: 77692

SEQ ID NO: 475346 - RNA, 64 nt, Homo Sapiens; identical to SEQ ID NO: 77693

SEQ ID NO: 475347 - RNA, 64 nt, Homo Sapiens; identical to SEQ ID NO: 77694

SEQ ID NO: 475348 - RNA, 64 nt, Homo Sapiens; identical to SEQ ID NO: 77695

SEQ ID NO: 475349 - RNA, 64 nt, Homo Sapiens; identical to SEQ ID NO: 77696

SEQ ID NO: 475350 - RNA, 64 nt, Homo Sapiens; identical to SEQ ID NO: 77697

SEQ ID NO: 475351 - RNA, 64 nt, Homo Sapiens; identical to SEQ ID NO: 77698

SEQ ID NO: 475352 - RNA, 64 nt, Homo Sapiens; identical to SEQ ID NO: 77699

SEQ ID NO: 475353 - RNA, 64 nt, Homo Sapiens; identical to SEQ ID NO: 77700

SEQ ID NO: 475354 - RNA, 64 nt, Homo Sapiens; identical to SEQ ID NO: 77701

SEQ ID NO: 475355 - RNA, 64 nt, Homo Sapiens; identical to SEQ ID NO: 77702

SEQ ID NO: 475356 - RNA, 63 nt, Homo Sapiens; identical to SEQ ID NO: 77703

SEQ ID NO: 475357 - RNA, 64 nt, Homo Sapiens; identical to SEQ ID NO: 77704

SEQ ID NO: 475358 - RNA, 64 nt, Homo Sapiens; identical to SEQ ID NO: 77705

SEQ ID NO: 475359 - RNA, 64 nt, Homo Sapiens; identical to SEQ ID NO: 77706

SEQ ID NO: 475360 - RNA, 64 nt, Homo Sapiens; identical to SEQ ID NO: 77707

SEQ ID NO: 475361 - RNA, 64 nt, Homo Sapiens; identical to SEQ ID NO: 77708

SEQ ID NO: 475362 - RNA, 64 nt, Homo Sapiens; identical to SEQ ID NO: 77709

SEQ ID NO: 475363 - RNA, 64 nt, Homo Sapiens; identical to SEQ ID NO: 77710

SEQ ID NO: 475364 - RNA, 64 nt, Homo Sapiens; identical to SEQ ID NO: 77711

SEQ ID NO: 475365 - RNA, 64 nt, Homo Sapiens; identical to SEQ ID NO: 77712

SEQ ID NO: 475366 - RNA, 64 nt, Homo Sapiens; identical to SEQ ID NO: 77713

SEQ ID NO: 475367 - RNA, 64 nt, Homo Sapiens; identical to SEQ ID NO: 77714

SEQ ID NO: 475368 - RNA, 64 nt, Homo Sapiens; identical to SEQ ID NO: 77715

SEQ ID NO: 475369 - RNA, 64 nt, Homo Sapiens; identical to SEQ ID NO: 77716

SEQ ID NO: 475370 - RNA, 64 nt, Homo Sapiens; identical to SEQ ID NO: 77717

SEQ ID NO: 475371 - RNA, 64 nt, Homo Sapiens; identical to SEQ ID NO: 77718

SEQ ID NO: 475372 - RNA, 64 nt, Homo Sapiens; identical to SEQ ID NO: 77719

SEQ ID NO: 475373 - RNA, 64 nt, Homo Sapiens; identical to SEQ ID NO: 77720

SEQ ID NO: 475374 - RNA, 64 nt, Homo Sapiens; identical to SEQ ID NO: 77721

SEQ ID NO: 475375 - RNA, 64 nt, Homo Sapiens; identical to SEQ ID NO: 77722

SEQ ID NO: 475376 - RNA, 64 nt, Homo Sapiens; identical to SEQ ID NO: 77723

SEQ ID NO: 475377 - RNA, 64 nt, Homo Sapiens; identical to SEQ ID NO: 77724

SEQ ID NO: 475378 - RNA, 64 nt, Homo Sapiens; identical to SEQ ID NO: 77725

SEQ ID NO: 475379 - RNA, 64 nt, Homo Sapiens; identical to SEQ ID NO: 77726

SEQ ID NO: 475380 - RNA, 64 nt, Homo Sapiens; identical to SEQ ID NO: 77727

SEQ ID NO: 475381 - RNA, 64 nt, Homo Sapiens; identical to SEQ ID NO: 77728

SEQ ID NO: 475382 - RNA, 64 nt, Homo Sapiens; identical to SEQ ID NO: 77729

SEQ ID NO: 475383 - RNA, 64 nt, Homo Sapiens; identical to SEQ ID NO: 77730

SEQ ID NO: 475384 - RNA, 64 nt, Homo Sapiens; identical to SEQ ID NO: 77731

SEQ ID NO: 475385 - RNA, 64 nt, Homo Sapiens; identical to SEQ ID NO: 77732

SEQ ID NO: 475386 - RNA, 64 nt, Homo Sapiens; identical to SEQ ID NO: 77733

SEQ ID NO: 475387 - RNA, 64 nt, Homo Sapiens; identical to SEQ ID NO: 77734

SEQ ID NO: 475388 - RNA, 64 nt, Homo Sapiens; identical to SEQ ID NO: 77735

SEQ ID NO: 475389 - RNA, 50 nt, Homo Sapiens; identical to SEQ ID NO: 77736

SEQ ID NO: 475390 - RNA, 64 nt, Homo Sapiens; identical to SEQ ID NO: 77737

SEQ ID NO: 475391 - RNA, 64 nt, Homo Sapiens; identical to SEQ ID NO: 77738

SEQ ID NO: 475392 - RNA, 64 nt, Homo Sapiens; identical to SEQ ID NO: 77739

SEQ ID NO: 475393 - RNA, 64 nt, Homo Sapiens; identical to SEQ ID NO: 77740

SEQ ID NO: 475394 - RNA, 64 nt, Homo Sapiens; identical to SEQ ID NO: 77741

SEQ ID NO: 475395 - RNA, 64 nt, Homo Sapiens; identical to SEQ ID NO: 77742

SEQ ID NO: 475396 - RNA, 64 nt, Homo Sapiens; identical to SEQ ID NO: 77743

SEQ ID NO: 475397 - RNA, 64 nt, Homo Sapiens; identical to SEQ ID NO: 77744

SEQ ID NO: 475398 - RNA, 64 nt, Homo Sapiens
aacagugauuuuuuuuuuuuacuuucaugguuagagcuacaaaggggauauuuuuguugcuuuu

SEQ ID NO: 475399 - RNA, 53 nt, Homo Sapiens
auagcuguuuccuggauuccaggagcuacaaugaccaaaguacugaugaauag

SEQ ID NO: 475400 - RNA, 64 nt, Homo Sapiens
uguuuuagcugguuucucuguuguuuauuuuaaaagcuacaauuauaauaaauaacgggcuuua

SEQ ID NO: 475401 - RNA, 64 nt, Homo Sapiens
uguccacaucuuauauccccgugccaucuccucaagcuacaaaacuuaauucucuuuucccuag

SEQ ID NO: 475402 - RNA, 64 nt, Homo Sapiens
agaggcugaacaccugcggacgagguggagcagcagcuacaagcgagcccccagcagggcccuc

SEQ ID NO: 475403 - RNA, 64 nt, Homo Sapiens
agaggcugaacaccugcggacgagguggaacagcagcuacaagcgagcccccagcagggcccuc

SEQ ID NO: 475404 - RNA, 64 nt, Homo Sapiens
uucacagggccaaauauucucaugucuggugaaaagcuacaaggccccaccuucuccuuuuugg

SEQ ID NO: 475405 - RNA, 64 nt, Homo Sapiens
ccauccuuauuucuuauucaagaacuuauaaugaagcuacaaauggggagaacauuucugaaaa

SEQ ID NO: 475406 - RNA, 64 nt, Homo Sapiens; identical to SEQ ID NO: 418163

SEQ ID NO: 475407 - RNA, 64 nt, Homo Sapiens; identical to SEQ ID NO: 418164

SEQ ID NO: 475408 - RNA, 64 nt, Homo Sapiens
uagcauuauaagucauuccauauuuucucuuugccuggaguaaaucaagauccuaugucuguug

SEQ ID NO: 475409 - RNA, 57 nt, Homo Sapiens
uagaccagugucgucgugagggccugucuggaguacgaggacagcaagaagaacuga

SEQ ID NO: 475410 - RNA, 65 nt, Homo Sapiens
gucauuuuguaauauuugaauuuuuacauuuguuguacaaucaggaaaagcaauaaagauuuuuc

SEQ ID NO: 475411 - RNA, 65 nt, Homo Sapiens
ugauuuuuagcagguuuagaggcugcagcuugagcuacaaucaggagggaaauuggaaggauuag

SEQ ID NO: 475412 - RNA, 65 nt, Homo Sapiens
caacuacuuuuaaaguagaaaagcuauccauuuuauacaaucacugauacagucuaugucaaaaa

SEQ ID NO: 475413 - RNA, 65 nt, Homo Sapiens
uuaucuuaaagucacugucuauuuaagauuaaacauacaaucacauaaccuuaaagaauaccguu

SEQ ID NO: 475414 - RNA, 65 nt, Homo Sapiens
uuuaagaaacaaaacauaguaucuuauggauuguuuacaaucacaaggacauagauaccuaucag

SEQ ID NO: 475415 - RNA, 65 nt, Homo Sapiens
aauaacuugaauuuauagacaaaugcuacucacaguacaaucaauuguauuauaccaugagaaaa

SEQ ID NO: 475416 - RNA, 65 nt, Homo Sapiens
uagaauauugauugguaauaguaaaucguucuccuuacaaucaaguucuugacccuauucggccu

SEQ ID NO: 475417 - RNA, 65 nt, Homo Sapiens
gccccucucaccuuguaaagugcccgagcuuuccuuacaaucagagacgugcaaaagucuagccu

SEQ ID NO: 475418 - RNA, 65 nt, Homo Sapiens
gugcucccugggggagauccucccacucucugaacuacaaucacuagaugauuacgaagaucaca

SEQ ID NO: 475419 - RNA, 65 nt, Homo Sapiens
acagauuaauauauguaaagggaggaguagguacauacaaucagcuauguccaugcuguguccaa

SEQ ID NO: 475420 - RNA, 65 nt, Homo Sapiens
auguugaccugcaaagcagucuagauuuuguuuucuacaaucaaaauguaacagaugauuguuug

SEQ ID NO: 475421 - RNA, 65 nt, Homo Sapiens
agcaaauccccauuuuccuuggaucugcaaagaccuacaaucaaaauuaucacucaggaaccagc

SEQ ID NO: 475422 - RNA, 65 nt, Homo Sapiens
gguccugguuucaacauggaccagauuuucagacuuacaaucagucugguuaugggguaggacac

SEQ ID NO: 475423 - RNA, 65 nt, Homo Sapiens
aaguucucauugcaugcaauaggccagaucaaugcuacaaucaugucaucaagcaguccagagcu

SEQ ID NO: 475424 - RNA, 65 nt, Homo Sapiens
gauuuuuuuuuguuaugucaaacuguguuuaagccuacaaucauuauuaggacacuaugguuaua

SEQ ID NO: 475425 - RNA, 65 nt, Homo Sapiens
acaagguuagcuuuuuuaauuuuuuauaauguaauuacaaucaccuagauuuaugcauguggaca

SEQ ID NO: 475426 - RNA, 65 nt, Homo Sapiens
uagggacuacuuaauaggugucucuccaguguuucuacaaucagcuguguauggccugaagcucu

SEQ ID NO: 475427 - RNA, 65 nt, Homo Sapiens
agcccuccccaucccaaucccaggcagcuuguguguacaaucagcuucucuagcaacucuguauc

SEQ ID NO: 475428 - RNA, 65 nt, Homo Sapiens
guacaaucucucagggguuucauaguuuaaaaagcuacaaucacaucauguuguaacuacguaaa

SEQ ID NO: 475429 - RNA, 65 nt, Homo Sapiens
guaucauugccaauuaucaucauauuuacauuuucuacaaucaugugcuuauuaacauauuggaa

SEQ ID NO: 475430 - RNA, 65 nt, Homo Sapiens
guaggguaugcugauccucuuuuaaaaacccaagauacaaucaaaaucccagaugcuggucucua

SEQ ID NO: 475431 - RNA, 65 nt, Homo Sapiens
agucuccuaacauuugucucuagccuuugccuuuguacaaucacagauauccuauggagauuuaa

SEQ ID NO: 475432 - RNA, 65 nt, Homo Sapiens
agcuuuuaaaacaacagcuauucacuagccaucacuacaaucacccuggggucugcuuccauuua

SEQ ID NO: 475433 - RNA, 65 nt, Homo Sapiens
accucguggagaccaccgggcuauaccuagcauaguacaaucagagaaaagugaagagugguuac

SEQ ID NO: 475434 - RNA, 65 nt, Homo Sapiens
aaaccuccauugacacaucagagugguacauuuguuacaaucaauacuaucaguaucccacacca

SEQ ID NO: 475435 - RNA, 65 nt, Homo Sapiens
ucacaggucucuuggccucacuccugacuuagagauacaaucacgucacucgcccagucuucagu

SEQ ID NO: 475436 - RNA, 65 nt, Homo Sapiens
auuuuggucccuuccagcuucccacaaauauuuauuacaaucagugcccagucaguacaaggagg

SEQ ID NO: 475437 - RNA, 65 nt, Homo Sapiens
uuauauuuuuuuacaugauuauuagaugguuauauuacaaucauuuaaaacuccauauguuaaug

SEQ ID NO: 475438 - RNA, 65 nt, Homo Sapiens
ucaccugaucaucugugaauaucuguaaucacugcuacaaucagcuaggacuuuauuuucaugau

SEQ ID NO: 475439 - RNA, 65 nt, Homo Sapiens
aagaaaaaagaucccuauuagauacacuucuuaaauacaaucacauuaacauuuugagcuauuuc

SEQ ID NO: 475440 - RNA, 65 nt, Homo Sapiens
gaaggucguuucacauucuguaguaaaaauaccccuacaaucauuuugguagggucuucugucuu

SEQ ID NO: 475441 - RNA, 65 nt, Homo Sapiens
gcaugaacagcuaauuguaccauaguguucauugauacaaucauagcauugucuauuuuucucuu

SEQ ID NO: 475442 - RNA, 65 nt, Homo Sapiens
aggauggcuacaauaaaaagaaugagauuccaguuuacaaucacugaaaugcaagucaaaaucac

SEQ ID NO: 475443 - RNA, 65 nt, Homo Sapiens
uuaggggaaaaauaaccaaacuuuuacuuucuaaauacaaucauaccauugcacccagccauguu

SEQ ID NO: 475444 - RNA, 65 nt, Homo Sapiens
uuuaaagcuacaucuguauaugucuuccuuugguuuacaaucaauaauaauugauguuugcaaug

SEQ ID NO: 475445 - RNA, 65 nt, Homo Sapiens
gauagacauucuggugaugaaauauugagcuuuaguacaaucaugcaaaucccuuaagccucuca

SEQ ID NO: 475446 - RNA, 65 nt, Homo Sapiens
aggaaaaaaaauuacacaauguucaaaaugccuuauacaaucaagguaggaaagacguuuuucca

SEQ ID NO: 475447 - RNA, 65 nt, Homo Sapiens
ugugaagugguggugucagguauucauuuauccuguacaaucaucguacgaagauacaauacugu

SEQ ID NO: 475448 - RNA, 65 nt, Homo Sapiens
guucauugcagccucaaccuagaguacaggucugguacaaucacaaauaguaugauaaagauuuc

SEQ ID NO: 475449 - RNA, 65 nt, Homo Sapiens
aagauagauccaacuggccacgugccggaccuuccuacaaucaggucucccguagagaagcaggu

SEQ ID NO: 475450 - RNA, 65 nt, Homo Sapiens
gccacugcuacaucucccagccugugaauuacugcuacaaucaagugugucagaaccaguccugc

SEQ ID NO: 475451 - RNA, 65 nt, Homo Sapiens
ccagcagggugggcaacuccgagagccaguguuuguacaaucagauggucugccauugcaaugca

SEQ ID NO: 475452 - RNA, 65 nt, Homo Sapiens
guauuuuaaaacugacaguagccugaucaaagugauacaaucaauuucaaaacaaucuuccagag

SEQ ID NO: 475453 - RNA, 65 nt, Homo Sapiens
guuauuaaacucuuuaaauaugucauagaaaauaauacaaucauguaaugagucuugucuuacaa

SEQ ID NO: 475454 - RNA, 65 nt, Homo Sapiens
augagcaugaagcccaguggcaccaaauggcuggguacaaucaagugauauuuuguagcaccuca

SEQ ID NO: 475455 - RNA, 65 nt, Homo Sapiens
aaaaaaaaaaauacuugucaauauuuaaacaugguuacaaucauugcugaaaaugguauuuuccc

SEQ ID NO: 475456 - RNA, 65 nt, Homo Sapiens
uugccgaagaccuuuuacugauugaacaguugugcuacaaucaacuuuucauaguacaugaccug

SEQ ID NO: 475457 - RNA, 65 nt, Homo Sapiens
aauuuguacuguucauggcacuauuaacaaaacuauacaaucauauuuucucuucuaucuuugaa

SEQ ID NO: 475458 - RNA, 65 nt, Homo Sapiens
uauuuuauguccuauuauaauuucauauuugauauuacaaucauuauuccacucaacagacaaua

SEQ ID NO: 475459 - RNA, 65 nt, Homo Sapiens
uuugcuggaaacauuguaucugagucgcgagaacauacaaucaaggaacuuggccaaggaacaac

SEQ ID NO: 475460 - RNA, 65 nt, Homo Sapiens
aacuuuccuuuguacauauuaaguaauaaaaucaguacaaucacuaacauaaaauggcuugguaa

SEQ ID NO: 475461 - RNA, 65 nt, Homo Sapiens
ucugaauacagaaguuguggcuuagguuuuaauuuuacaaucauuauaugguguacaguuuuuaa

SEQ ID NO: 475462 - RNA, 65 nt, Homo Sapiens
gugucuccugaacuagcacaauucucaaguccuuuuacaaucaguuuuuuagccuuaaaguuuau

SEQ ID NO: 475463 - RNA, 65 nt, Homo Sapiens
cuucagugugcaaccuuuuuauuguagccugaguauacaaucaagggguuacaucagugcugguc

SEQ ID NO: 475464 - RNA, 65 nt, Homo Sapiens
ggaaaauaguaauguuuuauuuuucuguugaaguuuacaaucaaacaaaauucuuaaguauguua

SEQ ID NO: 475465 - RNA, 65 nt, Homo Sapiens
aaaauguuaucucaauaagauacuuauaugagaacuacaaucaccgaaucuacuguauucaauau

SEQ ID NO: 475466 - RNA, 65 nt, Homo Sapiens
uuugcggaggucagguucauaccaauggacacuaauacaaucaguguucccaaggcugugcaggg

SEQ ID NO: 475467 - RNA, 65 nt, Homo Sapiens
uaaaaguuaaguauaauuauuuuaaugcaaucuaauacaaucagauuacucaguugccuuaccuc

SEQ ID NO: 475468 - RNA, 65 nt, Homo Sapiens
aaaauggaggggaaaaaggccacagcaaucuguacuacaaucaacuuuauuuugaaaucauguaa

SEQ ID NO: 475469 - RNA, 65 nt, Homo Sapiens
guaauuacaugaauaaaauuaagaaaauagccauauacaaucaaauacacuauggcauuuuuauu

SEQ ID NO: 475470 - RNA, 65 nt, Homo Sapiens
agcuggucugacacuacgcgcagugcucgguuguuuacaaucaguggggaaaagggcagaaccag

SEQ ID NO: 475471 - RNA, 65 nt, Homo Sapiens
uuuaccaaaguggccauuggcacuguuugcuuuuuuacaaucauguggacacaagcauaaguaaa

SEQ ID NO: 475472 - RNA, 65 nt, Homo Sapiens
cucuucauuacuauaaauauuguuucuucagugauuacaaucauaggugggaaaaggggaaaaac

SEQ ID NO: 475473 - RNA, 65 nt, Homo Sapiens
ugagaacaaaaauaugaaauaacaauaaggaccuauacaaucauauuuagaaauuugaguaaaga

SEQ ID NO: 475474 - RNA, 65 nt, Homo Sapiens
acucaccguagccucaaacuguuggaguacagugguacaaucacacgaucucacucugucaccag

SEQ ID NO: 475475 - RNA, 65 nt, Homo Sapiens
acucaccuaauucugauaaaaguugauagagcuuuuacaaucaauagucaucaaauaagagcaag

SEQ ID NO: 475476 - RNA, 65 nt, Homo Sapiens
ucuccugcugauuucacuuuuaaaagguagagucuuacaaucaaaaaccaagugugcucuuuuuu

SEQ ID NO: 475477 - RNA, 65 nt, Homo Sapiens
uggcuuuggaagaauuauauuagguagaauacacauacaaucaaaauuuuaaaaaaaaaagcuaa

SEQ ID NO: 475478 - RNA, 65 nt, Homo Sapiens
gaaaauacuuguuuuuccaaauuccgguguuuuauuacaaucaaagaagaggaaagcaagguauu

SEQ ID NO: 475479 - RNA, 65 nt, Homo Sapiens
uuuugauguggugucauagaauagcauguuguagauacaaucagcugcuuuguuaccuuaaaacu

SEQ ID NO: 475480 - RNA, 65 nt, Homo Sapiens
aucaaccuguagguaccacagaagagcuguagucauacaaucacauaacuuuuacaaauauagug

SEQ ID NO: 475481 - RNA, 65 nt, Homo Sapiens
auuuaauuuuagaugcaaaagaaaaaggucuaacguacaaucagccaauuagaauuugccugaaa

SEQ ID NO: 475482 - RNA, 65 nt, Homo Sapiens
acaacacaagaauuauuuuauuaucaaaaauuguauacaaucaagcacugugucaucuucuggag

SEQ ID NO: 475483 - RNA, 65 nt, Homo Sapiens
agucuaguucuuuucauuugcuccuuauccuacaguacaaucagcacugcagcuuuacugccuuc

SEQ ID NO: 475484 - RNA, 65 nt, Homo Sapiens
uuggaccuucuuucuguucucagagcagaaaguaguacaaucauguucuguccauagcacagaaa

SEQ ID NO: 475485 - RNA, 65 nt, Homo Sapiens
ucuucaguuuaaugcaagagaacauuuuacuguuguacaaucauguucuggugguuugauuguuu

SEQ ID NO: 475486 - RNA, 65 nt, Homo Sapiens
ucugauaauaguaacaagguauauuauacuuucauuacaaucaaauuauagaaauuacuugugua

SEQ ID NO: 475487 - RNA, 65 nt, Homo Sapiens
aauacauuggcaauacagcugcuuuugcucugagcuacaaucauggcuuuucauguuacuuacca

SEQ ID NO: 475488 - RNA, 65 nt, Homo Sapiens
uuugacaauauagaaauuuauuuaaaauuugaguauacaaucaugaguaaguguucccuucacau

SEQ ID NO: 475489 - RNA, 65 nt, Homo Sapiens
aacagcucugagauccuggaauuccccauuuccuguacaaucaugauccuuugugagccuaugau

SEQ ID NO: 475490 - RNA, 65 nt, Homo Sapiens
uuauuuucauuaaagaacguauaauauuaaaaaauuacaaucaauugucuuauauuucucagauu

SEQ ID NO: 475491 - RNA, 65 nt, Homo Sapiens
caaaucaauagucagucuuggagaucuccguagacuacaaucaauaccgcaaaaauucacuccug

SEQ ID NO: 475492 - RNA, 65 nt, Homo Sapiens
cauaugaaaaaauuguuuucgcucauguugguaaauacaaucaccgcauucuucuguagacauuu

SEQ ID NO: 475493 - RNA, 65 nt, Homo Sapiens
acaucuugauuguuuuaaccauuaacuugucaaauuacaaucacaguuaagaaaaugauguaaaa

SEQ ID NO: 475494 - RNA, 65 nt, Homo Sapiens
acuugguuuugauuaccagugaaaagaaaacacaauacaaucaggaguuuucaaauuuuugauuc

SEQ ID NO: 475495 - RNA, 65 nt, Homo Sapiens
gagcaggaaaaggcacauacucaguuuuuuaaauguacaaucaacaaguaaaaauaaccucaugu

SEQ ID NO: 475496 - RNA, 65 nt, Homo Sapiens
cuucaacggagaguuugcuucugaguggggaugaauacaaucaggacuuugauucaaccaauuuu

SEQ ID NO: 475497 - RNA, 65 nt, Homo Sapiens
agagcgauuugcugaaggaacauuuuagcaucaacuacaaucaaaccacagauugcaaagcauag

SEQ ID NO: 475498 - RNA, 65 nt, Homo Sapiens
aaagcaaacagagagccugucgaggguggacucccuacaaucaacuccuacugucacacagguca

SEQ ID NO: 475499 - RNA, 65 nt, Homo Sapiens
aaaaguucuuauuuuuuuuaccaaacuguauacauuacaaucauugcagggguuugccaaacagc

SEQ ID NO: 475500 - RNA, 65 nt, Homo Sapiens
uauuauguuuuuaaaccaagaagccaaauuaauccuacaaucagggcugcagaugggcuaaauaa

SEQ ID NO: 475501 - RNA, 65 nt, Homo Sapiens
ugaaauuuaggcagaguucgcucuuacguuuaacauacaaucaugcaaacugucuaaaaauuuuu

SEQ ID NO: 475502 - RNA, 65 nt, Homo Sapiens
uaaaagugucaagggcuggguuugccucugaugaguacaaucaguuccagaagacuggguaaguc

SEQ ID NO: 475503 - RNA, 65 nt, Homo Sapiens
auucucaaguuaucacaaaauuucccacaaaaauuuacaaucagcaaaauaguuuccuuauuucu

SEQ ID NO: 475504 - RNA, 65 nt, Homo Sapiens
aacaaaacuaugcuguuuauauugucauuaaauuauacaaucaaacaaaugccaaaugaauugcc

SEQ ID NO: 475505 - RNA, 65 nt, Homo Sapiens
uugggagauguggcuggaaaguacuuuggaaaauauacaaucaagauaucucauggcauauuaaa

SEQ ID NO: 475506 - RNA, 65 nt, Homo Sapiens
ggcugugaagguauuuuguagaugugauuaacaucuacaaucaguugacuuuaagugaaagagau

SEQ ID NO: 475507 - RNA, 65 nt, Homo Sapiens
aauucccuuaagguugaaacagcaauugcagcacuuacaaucacuaagaaagaagauaauagacc

SEQ ID NO: 475508 - RNA, 65 nt, Homo Sapiens
uugcuuugauuuuguguauauaauacaauuuauaguacaaucacacaugauucuucauagagugg

SEQ ID NO: 475509 - RNA, 65 nt, Homo Sapiens
gucaaguucccaacugagucccagccagaaagcacuacaaucauguucccgaugagggaaggagc

SEQ ID NO: 475510 - RNA, 65 nt, Homo Sapiens
auugaguaggaacugaggcugugcuucagguaugguacaaucaagugggggauuuucaugcugaa

SEQ ID NO: 475511 - RNA, 65 nt, Homo Sapiens
uccggcgacaccgguucucuaucaacggccacuucuacaaucauaaggugaugccccagccuggc

SEQ ID NO: 475512 - RNA, 65 nt, Homo Sapiens
aaaaauauuuuauuuguauuguuguauaaaauauuuacaaucauauagaauauauagaguuacau

SEQ ID NO: 475513 - RNA, 65 nt, Homo Sapiens
guaaagccauaucacaaugaauuuuguucucuacauacaaucaauauugccuuaauucuaauuuu

SEQ ID NO: 475514 - RNA, 65 nt, Homo Sapiens
uuacuguauuuauuaauuuguagaauguuuccuuuuacaaucaaauuucuacuaaaauguccaag

SEQ ID NO: 475515 - RNA, 65 nt, Homo Sapiens
gagacagauuuuaauuugcaaaaccaggaaauuucuacaaucaugcucacugaguuuuuguuuaa

SEQ ID NO: 475516 - RNA, 65 nt, Homo Sapiens
uuuauuaaacagauaauguccuuguuuauugcuuuuacaaucauauaguguaauguauaauugcu

SEQ ID NO: 475517 - RNA, 65 nt, Homo Sapiens
uuugcuaucuguguagaaaauaauuucaugacauuuacaaucaggacugaaguaaguucuucaca

SEQ ID NO: 475518 - RNA, 65 nt, Homo Sapiens
cauuugggaugccagggaacagagagugagacaccuacaaucaccagucucaaaugcgcuauugu

SEQ ID NO: 475519 - RNA, 65 nt, Homo Sapiens
ucaccccauuuucuuuuuaaccucgcccccuuuucuacaaucaaauccauucauuauugcgcccu

SEQ ID NO: 475520 - RNA, 65 nt, Homo Sapiens
uuccuacuagaacauuuuauuuuccuuguucaccauacaaucauguacucuuuaacagaaauugc

SEQ ID NO: 475521 - RNA, 65 nt, Homo Sapiens
ugcuugucacagcugaaagaucugaaaucugucauuacaaucaagauauuuuucaguauucagac

SEQ ID NO: 475522 - RNA, 65 nt, Homo Sapiens
gcuguggaaucaugauaccauguggcucacugucuuacaaucacuuucacguuuucccauuuccc

SEQ ID NO: 475523 - RNA, 65 nt, Homo Sapiens
gccaggcuuggaguuuggcccccauccauuacugcuacaaucaagcuggugugaugaugggcuug

SEQ ID NO: 475524 - RNA, 65 nt, Homo Sapiens
cuagaucugaagcauaauuugccacacagaaauuauacaaucaaagauauaucuuaauuacuaau

SEQ ID NO: 475525 - RNA, 65 nt, Homo Sapiens
gcccacugacccucucccagaaggccuaaucauguuacaaucacucacagccgccaucugcaagg

SEQ ID NO: 475526 - RNA, 65 nt, Homo Sapiens
uuuaggguuauuguaaucaagugccguuucaacguuacaaucauuugaccuuuuuuguaaacuaa

SEQ ID NO: 475527 - RNA, 65 nt, Homo Sapiens
guuauucguuucuaaacuuggauggaauuagagaauacaaucaaacuuuaccacuuggaggacac

SEQ ID NO: 475528 - RNA, 65 nt, Homo Sapiens
aaagaaaucuuuuuggucaagaugguaguuggaacuacaaucaucugaaggccugacaagaguug

SEQ ID NO: 475529 - RNA, 65 nt, Homo Sapiens
ucugguaaaguuacacuuuuauuuccuguauguuguacaaucaaaacacacuacuaccucuuaag

SEQ ID NO: 475530 - RNA, 65 nt, Homo Sapiens
guuuaaacuuacuguauauuuauuguugcauuuaguacaaucaguguguuccauuugcuucuuug

SEQ ID NO: 475531 - RNA, 65 nt, Homo Sapiens
uuucccaguacuuuucacaauuuuuucaaauuucauacaaucauaauuuagggauugugaaauuu

SEQ ID NO: 475532 - RNA, 65 nt, Homo Sapiens
cuauucuuacacuugcuauuuucaaacaguaguuuuacaaucauguuuuguacuguuuauaagcc

SEQ ID NO: 475533 - RNA, 65 nt, Homo Sapiens
uaaaucuuuggauuugaucacuacaaguauuauuuuacaaucaacaaaauggucauccaaacuca

SEQ ID NO: 475534 - RNA, 65 nt, Homo Sapiens
gacuaauggcacaggaaaaaccuauucauaaguuuuacaaucaaguauagaggggucuucagcua

SEQ ID NO: 475535 - RNA, 65 nt, Homo Sapiens
guuuuaauguuccaguugcugugaaauagaacuccuacaaucaaaagacaguuuuaggaagucuu

SEQ ID NO: 475536 - RNA, 65 nt, Homo Sapiens
agguuucgaaauguaaauauaccagaucaaauuaauacaaucagaggggaauauuuuaaaaauaa

SEQ ID NO: 475537 - RNA, 65 nt, Homo Sapiens
ccucuuguacuuggaugcguaguacaucauauguauacaaucagauaaaagcauagaaguaaauc

SEQ ID NO: 475538 - RNA, 65 nt, Homo Sapiens
ucaagguugcagugaaugaugcucacuuguugcaguacaaucaucggguuaaaaaacucaaugaa

SEQ ID NO: 475539 - RNA, 65 nt, Homo Sapiens
cauagguguuauuuuuaguugcauaggguauuugauacaaucauuaauggaucauacacaauagg

SEQ ID NO: 475540 - RNA, 65 nt, Homo Sapiens
uauaaugaaucaauguuccaaugaucauuuuauuuuacaaucauuagauuaauuuggcauuugaa

SEQ ID NO: 475541 - RNA, 65 nt, Homo Sapiens
accuggacccuaaagaacagggaagacuuggaguuuacaaucagaaguaaguacaguaauguaaa

SEQ ID NO: 475542 - RNA, 65 nt, Homo Sapiens
ugcucaucccaggaauaguucagaccagguucggauacaaucaucacuuggggucaggaccucgu

SEQ ID NO: 475543 - RNA, 65 nt, Homo Sapiens
uguaaguuauauauauuuguuuugaacguuggccuuacaaucaaagagcucaucucauuuuuacu

SEQ ID NO: 475544 - RNA, 65 nt, Homo Sapiens
ggaucuuuuguccauuccaugauuguauuuaaagguacaaucaaaauuaugaaaucauaguauau

SEQ ID NO: 475545 - RNA, 65 nt, Homo Sapiens
auaugcuuucuuggaccaugugacuggucaguugcuacaaucagauuguaaguggaacucuggau

SEQ ID NO: 475546 - RNA, 65 nt, Homo Sapiens
gaaccuacucugaaacaucacaaugguacauuuguuacaaucaaugcuaucaguauccugcacca

SEQ ID NO: 475547 - RNA, 65 nt, Homo Sapiens
ggugaaugucaguguauuaucaggaaacaugucuauacaaucacagaguuauauuuccucacaaa

SEQ ID NO: 475548 - RNA, 65 nt, Homo Sapiens
gcacaacuuccuuuccuuucaguucugccaaaugcuacaaucagaagugcaguaucuuuugugcu

SEQ ID NO: 475549 - RNA, 65 nt, Homo Sapiens
uaacuaaagguuguaaaaaauuguaaaacugguuguacaaucaugauguuaguaacaguaauuuu

SEQ ID NO: 475550 - RNA, 65 nt, Homo Sapiens
aaauuacaaaaauguuucuguuuugaaacuugaucuacaaucaguaaaaguuugauaaucaguau

SEQ ID NO: 475551 - RNA, 65 nt, Homo Sapiens
uuuggaaaaguguacuuuauuaaagauucuugugauacaaucauugucaacuuuaaaguaaacau

SEQ ID NO: 475552 - RNA, 65 nt, Homo Sapiens
gaguuauauuuccucacaaacaggaaacaugucuauacaaucacaggugaaugucaguguauuau

SEQ ID NO: 475553 - RNA, 65 nt, Homo Sapiens
aggugcuuugugcugaccgucuuuguaaaguguuauacaaucagaagaugagaaagcaaaaagua

SEQ ID NO: 475554 - RNA, 65 nt, Homo Sapiens
ucauuuuguauuuaauaucauauauuauuauuuuuuacaaucauuuaauaagcucuuugaaugug

SEQ ID NO: 475555 - RNA, 64 nt, Homo Sapiens
aauuuuaguggaauuguuauugagaauaaaauuuuuacaaucauaacuggcuuuuuccaaguaa

SEQ ID NO: 475556 - RNA, 65 nt, Homo Sapiens
auggcacugcgugauuuuauuuuaaugaaguguuauacaaucaagaaaugggggcaagggccugc

SEQ ID NO: 475557 - RNA, 65 nt, Homo Sapiens
uacuuucucgcucccagaagguugaucagauauucuacaaucacagaguagcaaggacguuugag

SEQ ID NO: 475558 - RNA, 65 nt, Homo Sapiens
ugccaauuucacacuuguaucuucagcagggacauuacaaucaaacaccaauuccugguuaauga

SEQ ID NO: 475559 - RNA, 65 nt, Homo Sapiens
ggaaggucuuugacggcaccaucuggaaggacaucuacaaucaggagugguggaaccucaggugg

SEQ ID NO: 475560 - RNA, 65 nt, Homo Sapiens
cacauucuagguaggggcccaguuaaggguuaguuuacaaucagcgauguaagaaauguucuugc

SEQ ID NO: 475561 - RNA, 65 nt, Homo Sapiens
cucugugggggguggcccuggcugaagauguuuauuacaaucacuaugcacaucauguagauuaa

SEQ ID NO: 475562 - RNA, 65 nt, Homo Sapiens
aacccccaacccucugggucuaaacauuuaaauuauacaaucaucuaagcuauguuguugcacuu

SEQ ID NO: 475563 - RNA, 65 nt, Homo Sapiens
cuauacuuaaagguuaaauauugaaaucuaauuuauacaaucauuaucgcuaauuguccuuucag

SEQ ID NO: 475564 - RNA, 65 nt, Homo Sapiens
gcaugagggaaauacacuguugcuaauacugaaauuacaaucaaguaacuaaggccuugaguuca

SEQ ID NO: 475565 - RNA, 65 nt, Homo Sapiens
uaggagauuuuucaguucuccauauaauaauuuucuacaaucagaucuaugcuguggcauauuuu

SEQ ID NO: 475566 - RNA, 65 nt, Homo Sapiens
auaacucaagguuguaaaaauggcauggugacucuuacaaucauaucacagugggccucuccaac

SEQ ID NO: 475567 - RNA, 65 nt, Homo Sapiens
ggcccugccguuuccccuccuuggcuuuaugcaaauacaaucagcccagugcaaacggcucgucu

SEQ ID NO: 475568 - RNA, 65 nt, Homo Sapiens
augucagccaaagcuauaguucucaugccuuuacuuacaaucaaguguaguuacacugcaggauc

SEQ ID NO: 475569 - RNA, 65 nt, Homo Sapiens
ucacuccagcauggugucugccucauuaccucuuuuacaaucaccgaaacaguuucuggagaucu

SEQ ID NO: 475570 - RNA, 65 nt, Homo Sapiens
uacaguccaaaauugcuuuucuuccucaaacuacuuacaaucacccccagacaguugcuuugauu

SEQ ID NO: 475571 - RNA, 65 nt, Homo Sapiens
uuuuccaucuuguacacgagauacaccaacauagcuacaaucaaacaggccuggguaucugaggc

SEQ ID NO: 475572 - RNA, 65 nt, Homo Sapiens
auuguugcuaugcugcuuugaccucaggcaagugcuacaaucacgcuacguugguugugaccaca

SEQ ID NO: 475573 - RNA, 65 nt, Homo Sapiens
caaggaggaugaaacgccggucucaugaaaaucaguacaaucacaauguaaagaaguaacuugug

SEQ ID NO: 475574 - RNA, 65 nt, Homo Sapiens
uuuacccauuaagacuuacauuugucaguuucaguuacaaucaucccuugagcaauaguuguuuc

SEQ ID NO: 475575 - RNA, 65 nt, Homo Sapiens
ugccucacagaguuuagacaugacuagccagcuccuacaaucacugaagucaauuccuugcaaua

SEQ ID NO: 475576 - RNA, 65 nt, Homo Sapiens
gaguuacaagccccuggaaaagggagcaggucccauacaaucagccuuucuccucuucucuucuu

SEQ ID NO: 475577 - RNA, 65 nt, Homo Sapiens
caaugaaauccacccucaaagaggacuacuucggauacaaucacagcaacccuggccucggcccu

SEQ ID NO: 475578 - RNA, 65 nt, Homo Sapiens
gguuuuguauucagaauguuuuagugaaggaggaauacaaucaagagggucaugaacuuuuuucu

SEQ ID NO: 475579 - RNA, 51 nt, Homo Sapiens; identical to SEQ ID NO: 147092

SEQ ID NO: 475580 - RNA, 65 nt, Homo Sapiens
agaggaagccuuugguccuaacgagaagagauaauuacaaucaggcuaccaaaggaagcacuaac

SEQ ID NO: 475581 - RNA, 65 nt, Homo Sapiens
gaagaaaugcucaauacauacuuugaaagcaaaaauacaaucaaacacauugacacguauauaaa

SEQ ID NO: 475582 - RNA, 65 nt, Homo Sapiens
gugaaucuccuaauuuuagcaucuuuuuuuuuuuuuacaaucauucagauugugaauucaggcuc

SEQ ID NO: 475583 - RNA, 65 nt, Homo Sapiens
aguguuuuuacauauagcuuugcaaccuuguacuuuacaaucaugccuacauuagugagauuuag

SEQ ID NO: 475584 - RNA, 65 nt, Homo Sapiens
ggugguaagaugccuuuggcgccuuuguuuaaaaguacaaucagaucaggaacuaggcauaucau

SEQ ID NO: 475585 - RNA, 65 nt, Homo Sapiens
uuacuagauuuuuuaaagagucugauguugcauaauacaaucaaaguauaauuuguaccugcaga

SEQ ID NO: 475586 - RNA, 65 nt, Homo Sapiens
uaacuuagcaaauucuguaaacaaugauuuuugcuuacaaucacuuucagggaugacacaagcac

SEQ ID NO: 475587 - RNA, 64 nt, Homo Sapiens; identical to SEQ ID NO: 270569

SEQ ID NO: 475588 - RNA, 64 nt, Homo Sapiens; identical to SEQ ID NO: 270570

SEQ ID NO: 475589 - RNA, 64 nt, Homo Sapiens; identical to SEQ ID NO: 270571

SEQ ID NO: 475590 - RNA, 64 nt, Homo Sapiens; identical to SEQ ID NO: 270572

SEQ ID NO: 475591 - RNA, 64 nt, Homo Sapiens; identical to SEQ ID NO: 270573

SEQ ID NO: 475592 - RNA, 64 nt, Homo Sapiens; identical to SEQ ID NO: 270574

SEQ ID NO: 475593 - RNA, 64 nt, Homo Sapiens; identical to SEQ ID NO: 270575

SEQ ID NO: 475594 - RNA, 64 nt, Homo Sapiens; identical to SEQ ID NO: 270576

SEQ ID NO: 475595 - RNA, 64 nt, Homo Sapiens; identical to SEQ ID NO: 270577

SEQ ID NO: 475596 - RNA, 64 nt, Homo Sapiens; identical to SEQ ID NO: 270578

SEQ ID NO: 475597 - RNA, 64 nt, Homo Sapiens; identical to SEQ ID NO: 270579

SEQ ID NO: 475598 - RNA, 55 nt, Homo Sapiens; identical to SEQ ID NO: 270580

SEQ ID NO: 475599 - RNA, 64 nt, Homo Sapiens; identical to SEQ ID NO: 270581

SEQ ID NO: 475600 - RNA, 64 nt, Homo Sapiens; identical to SEQ ID NO: 270582

SEQ ID NO: 475601 - RNA, 64 nt, Homo Sapiens; identical to SEQ ID NO: 270583

SEQ ID NO: 475602 - RNA, 64 nt, Homo Sapiens; identical to SEQ ID NO: 270584

SEQ ID NO: 475603 - RNA, 64 nt, Homo Sapiens; identical to SEQ ID NO: 270585

SEQ ID NO: 475604 - RNA, 64 nt, Homo Sapiens; identical to SEQ ID NO: 270586

SEQ ID NO: 475605 - RNA, 64 nt, Homo Sapiens; identical to SEQ ID NO: 270587

SEQ ID NO: 475606 - RNA, 64 nt, Homo Sapiens; identical to SEQ ID NO: 270588

SEQ ID NO: 475607 - RNA, 64 nt, Homo Sapiens; identical to SEQ ID NO: 270589

SEQ ID NO: 475608 - RNA, 64 nt, Homo Sapiens; identical to SEQ ID NO: 270590

SEQ ID NO: 475609 - RNA, 64 nt, Homo Sapiens; identical to SEQ ID NO: 270591

SEQ ID NO: 475610 - RNA, 64 nt, Homo Sapiens; identical to SEQ ID NO: 270592

SEQ ID NO: 475611 - RNA, 64 nt, Homo Sapiens; identical to SEQ ID NO: 270593

SEQ ID NO: 475612 - RNA, 64 nt, Homo Sapiens; identical to SEQ ID NO: 270594

SEQ ID NO: 475613 - RNA, 64 nt, Homo Sapiens; identical to SEQ ID NO: 165107

SEQ ID NO: 475614 - RNA, 64 nt, Homo Sapiens; identical to SEQ ID NO: 165108

SEQ ID NO: 475615 - RNA, 64 nt, Homo Sapiens; identical to SEQ ID NO: 165109

SEQ ID NO: 475616 - RNA, 64 nt, Homo Sapiens; identical to SEQ ID NO: 165110

SEQ ID NO: 475617 - RNA, 64 nt, Homo Sapiens; identical to SEQ ID NO: 165111

SEQ ID NO: 475618 - RNA, 64 nt, Homo Sapiens; identical to SEQ ID NO: 165112

SEQ ID NO: 475619 - RNA, 64 nt, Homo Sapiens; identical to SEQ ID NO: 165113

SEQ ID NO: 475620 - RNA, 64 nt, Homo Sapiens; identical to SEQ ID NO: 165114

SEQ ID NO: 475621 - RNA, 64 nt, Homo Sapiens; identical to SEQ ID NO: 165115

SEQ ID NO: 475622 - RNA, 64 nt, Homo Sapiens; identical to SEQ ID NO: 165116

SEQ ID NO: 475623 - RNA, 64 nt, Homo Sapiens; identical to SEQ ID NO: 165117

SEQ ID NO: 475624 - RNA, 64 nt, Homo Sapiens; identical to SEQ ID NO: 165118

SEQ ID NO: 475625 - RNA, 64 nt, Homo Sapiens; identical to SEQ ID NO: 165119

SEQ ID NO: 475626 - RNA, 64 nt, Homo Sapiens; identical to SEQ ID NO: 165120

SEQ ID NO: 475627 - RNA, 64 nt, Homo Sapiens; identical to SEQ ID NO: 165121

SEQ ID NO: 475628 - RNA, 64 nt, Homo Sapiens; identical to SEQ ID NO: 165122

SEQ ID NO: 475629 - RNA, 64 nt, Homo Sapiens; identical to SEQ ID NO: 165123

SEQ ID NO: 475630 - RNA, 64 nt, Homo Sapiens; identical to SEQ ID NO: 165124

SEQ ID NO: 475631 - RNA, 64 nt, Homo Sapiens; identical to SEQ ID NO: 165125

SEQ ID NO: 475632 - RNA, 64 nt, Homo Sapiens; identical to SEQ ID NO: 165126

SEQ ID NO: 475633 - RNA, 64 nt, Homo Sapiens; identical to SEQ ID NO: 165127

SEQ ID NO: 475634 - RNA, 64 nt, Homo Sapiens; identical to SEQ ID NO: 165128

SEQ ID NO: 475635 - RNA, 64 nt, Homo Sapiens; identical to SEQ ID NO: 165129

SEQ ID NO: 475636 - RNA, 64 nt, Homo Sapiens; identical to SEQ ID NO: 165130

SEQ ID NO: 475637 - RNA, 64 nt, Homo Sapiens; identical to SEQ ID NO: 165131

SEQ ID NO: 475638 - RNA, 64 nt, Homo Sapiens; identical to SEQ ID NO: 165132

SEQ ID NO: 475639 - RNA, 64 nt, Homo Sapiens; identical to SEQ ID NO: 165133

SEQ ID NO: 475640 - RNA, 64 nt, Homo Sapiens; identical to SEQ ID NO: 165134

SEQ ID NO: 475641 - RNA, 64 nt, Homo Sapiens; identical to SEQ ID NO: 165135

SEQ ID NO: 475642 - RNA, 64 nt, Homo Sapiens; identical to SEQ ID NO: 165136

SEQ ID NO: 475643 - RNA, 64 nt, Homo Sapiens; identical to SEQ ID NO: 165137

SEQ ID NO: 475644 - RNA, 64 nt, Homo Sapiens; identical to SEQ ID NO: 165138

SEQ ID NO: 475645 - RNA, 64 nt, Homo Sapiens; identical to SEQ ID NO: 165139

SEQ ID NO: 475646 - RNA, 64 nt, Homo Sapiens; identical to SEQ ID NO: 165140

SEQ ID NO: 475647 - RNA, 64 nt, Homo Sapiens; identical to SEQ ID NO: 165141

SEQ ID NO: 475648 - RNA, 64 nt, Homo Sapiens; identical to SEQ ID NO: 165142

SEQ ID NO: 475649 - RNA, 64 nt, Homo Sapiens; identical to SEQ ID NO: 165143

SEQ ID NO: 475650 - RNA, 64 nt, Homo Sapiens; identical to SEQ ID NO: 165144

SEQ ID NO: 475651 - RNA, 64 nt, Homo Sapiens; identical to SEQ ID NO: 165145

SEQ ID NO: 475652 - RNA, 64 nt, Homo Sapiens; identical to SEQ ID NO: 165146

SEQ ID NO: 475653 - RNA, 64 nt, Homo Sapiens; identical to SEQ ID NO: 165147

SEQ ID NO: 475654 - RNA, 64 nt, Homo Sapiens; identical to SEQ ID NO: 165148

SEQ ID NO: 475655 - RNA, 64 nt, Homo Sapiens; identical to SEQ ID NO: 165149

SEQ ID NO: 475656 - RNA, 64 nt, Homo Sapiens; identical to SEQ ID NO: 165150

SEQ ID NO: 475657 - RNA, 64 nt, Homo Sapiens; identical to SEQ ID NO: 165151

SEQ ID NO: 475658 - RNA, 64 nt, Homo Sapiens; identical to SEQ ID NO: 165152

SEQ ID NO: 475659 - RNA, 64 nt, Homo Sapiens; identical to SEQ ID NO: 165153

SEQ ID NO: 475660 - RNA, 64 nt, Homo Sapiens; identical to SEQ ID NO: 165154

SEQ ID NO: 475661 - RNA, 64 nt, Homo Sapiens; identical to SEQ ID NO: 165155

SEQ ID NO: 475662 - RNA, 64 nt, Homo Sapiens; identical to SEQ ID NO: 165156

SEQ ID NO: 475663 - RNA, 64 nt, Homo Sapiens; identical to SEQ ID NO: 462980

SEQ ID NO: 475664 - RNA, 64 nt, Homo Sapiens; identical to SEQ ID NO: 462981

SEQ ID NO: 475665 - RNA, 64 nt, Homo Sapiens; identical to SEQ ID NO: 462982

SEQ ID NO: 475666 - RNA, 64 nt, Homo Sapiens; identical to SEQ ID NO: 462983

SEQ ID NO: 475667 - RNA, 64 nt, Homo Sapiens; identical to SEQ ID NO: 462984

SEQ ID NO: 475668 - RNA, 64 nt, Homo Sapiens; identical to SEQ ID NO: 462985

SEQ ID NO: 475669 - RNA, 64 nt, Homo Sapiens; identical to SEQ ID NO: 462986

SEQ ID NO: 475670 - RNA, 64 nt, Homo Sapiens; identical to SEQ ID NO: 462987

SEQ ID NO: 475671 - RNA, 64 nt, Homo Sapiens; identical to SEQ ID NO: 462988

SEQ ID NO: 475672 - RNA, 64 nt, Homo Sapiens; identical to SEQ ID NO: 462989

SEQ ID NO: 475673 - RNA, 64 nt, Homo Sapiens; identical to SEQ ID NO: 462990

SEQ ID NO: 475674 - RNA, 64 nt, Homo Sapiens; identical to SEQ ID NO: 462991

SEQ ID NO: 475675 - RNA, 64 nt, Homo Sapiens; identical to SEQ ID NO: 462992

SEQ ID NO: 475676 - RNA, 64 nt, Homo Sapiens; identical to SEQ ID NO: 462993

SEQ ID NO: 475677 - RNA, 64 nt, Homo Sapiens; identical to SEQ ID NO: 462994

SEQ ID NO: 475678 - RNA, 64 nt, Homo Sapiens; identical to SEQ ID NO: 133159

SEQ ID NO: 475679 - RNA, 64 nt, Homo Sapiens; identical to SEQ ID NO: 133160

SEQ ID NO: 475680 - RNA, 64 nt, Homo Sapiens; identical to SEQ ID NO: 133161

SEQ ID NO: 475681 - RNA, 64 nt, Homo Sapiens; identical to SEQ ID NO: 133162

SEQ ID NO: 475682 - RNA, 64 nt, Homo Sapiens; identical to SEQ ID NO: 133163

SEQ ID NO: 475683 - RNA, 64 nt, Homo Sapiens; identical to SEQ ID NO: 133164

SEQ ID NO: 475684 - RNA, 64 nt, Homo Sapiens; identical to SEQ ID NO: 133165

SEQ ID NO: 475685 - RNA, 64 nt, Homo Sapiens; identical to SEQ ID NO: 133166

SEQ ID NO: 475686 - RNA, 64 nt, Homo Sapiens; identical to SEQ ID NO: 133167

SEQ ID NO: 475687 - RNA, 64 nt, Homo Sapiens; identical to SEQ ID NO: 133168

SEQ ID NO: 475688 - RNA, 64 nt, Homo Sapiens; identical to SEQ ID NO: 133169

SEQ ID NO: 475689 - RNA, 64 nt, Homo Sapiens; identical to SEQ ID NO: 133170

SEQ ID NO: 475690 - RNA, 64 nt, Homo Sapiens; identical to SEQ ID NO: 133171

SEQ ID NO: 475691 - RNA, 64 nt, Homo Sapiens; identical to SEQ ID NO: 133172

SEQ ID NO: 475692 - RNA, 64 nt, Homo Sapiens; identical to SEQ ID NO: 133173

SEQ ID NO: 475693 - RNA, 64 nt, Homo Sapiens; identical to SEQ ID NO: 133174

SEQ ID NO: 475694 - RNA, 64 nt, Homo Sapiens; identical to SEQ ID NO: 133175

SEQ ID NO: 475695 - RNA, 64 nt, Homo Sapiens; identical to SEQ ID NO: 133176

SEQ ID NO: 475696 - RNA, 64 nt, Homo Sapiens; identical to SEQ ID NO: 133177

SEQ ID NO: 475697 - RNA, 64 nt, Homo Sapiens; identical to SEQ ID NO: 133178

SEQ ID NO: 475698 - RNA, 64 nt, Homo Sapiens; identical to SEQ ID NO: 133179

SEQ ID NO: 475699 - RNA, 64 nt, Homo Sapiens; identical to SEQ ID NO: 133180

SEQ ID NO: 475700 - RNA, 64 nt, Homo Sapiens; identical to SEQ ID NO: 133181

SEQ ID NO: 475701 - RNA, 64 nt, Homo Sapiens; identical to SEQ ID NO: 133182

SEQ ID NO: 475702 - RNA, 64 nt, Homo Sapiens; identical to SEQ ID NO: 133183

SEQ ID NO: 475703 - RNA, 64 nt, Homo Sapiens; identical to SEQ ID NO: 133184

SEQ ID NO: 475704 - RNA, 64 nt, Homo Sapiens; identical to SEQ ID NO: 133185

SEQ ID NO: 475705 - RNA, 64 nt, Homo Sapiens; identical to SEQ ID NO: 133186

SEQ ID NO: 475706 - RNA, 64 nt, Homo Sapiens; identical to SEQ ID NO: 133187

SEQ ID NO: 475707 - RNA, 64 nt, Homo Sapiens; identical to SEQ ID NO: 133188

SEQ ID NO: 475708 - RNA, 64 nt, Homo Sapiens; identical to SEQ ID NO: 133189

SEQ ID NO: 475709 - RNA, 64 nt, Homo Sapiens; identical to SEQ ID NO: 133190

SEQ ID NO: 475710 - RNA, 64 nt, Homo Sapiens; identical to SEQ ID NO: 133191

SEQ ID NO: 475711 - RNA, 64 nt, Homo Sapiens; identical to SEQ ID NO: 133192

SEQ ID NO: 475712 - RNA, 64 nt, Homo Sapiens; identical to SEQ ID NO: 133193

SEQ ID NO: 475713 - RNA, 64 nt, Homo Sapiens; identical to SEQ ID NO: 133194

SEQ ID NO: 475714 - RNA, 64 nt, Homo Sapiens; identical to SEQ ID NO: 133195

SEQ ID NO: 475715 - RNA, 64 nt, Homo Sapiens; identical to SEQ ID NO: 133196

SEQ ID NO: 475716 - RNA, 64 nt, Homo Sapiens; identical to SEQ ID NO: 133197

SEQ ID NO: 475717 - RNA, 64 nt, Homo Sapiens; identical to SEQ ID NO: 133198

SEQ ID NO: 475718 - RNA, 64 nt, Homo Sapiens; identical to SEQ ID NO: 133199

SEQ ID NO: 475719 - RNA, 64 nt, Homo Sapiens; identical to SEQ ID NO: 133200

SEQ ID NO: 475720 - RNA, 64 nt, Homo Sapiens; identical to SEQ ID NO: 133201

SEQ ID NO: 475721 - RNA, 64 nt, Homo Sapiens; identical to SEQ ID NO: 133202

SEQ ID NO: 475722 - RNA, 64 nt, Homo Sapiens; identical to SEQ ID NO: 133203

SEQ ID NO: 475723 - RNA, 64 nt, Homo Sapiens
gucaggggugagaccugaagagaaauugaauugggggagucaugaaaaaaaaaaaaaaaaaaaa

SEQ ID NO: 475724 - RNA, 64 nt, Homo Sapiens
caugucacugaaauugaaugggcauggguggguggggagucaguucugaaaagggcaucucaau

SEQ ID NO: 475725 - RNA, 64 nt, Homo Sapiens
cggaacggagaaagguggacuggaaggggcccgugggagucaucucaaccauccccuccguggc

SEQ ID NO: 475726 - RNA, 64 nt, Homo Sapiens
gcucccuaccaccuccccagccuuugaucagguggggagucagggaccccugcccuugucccac

SEQ ID NO: 475727 - RNA, 64 nt, Homo Sapiens
uccaccaagccagcaccccaccaucccuuugcaggggagucaaagggccagaacuccuuggggg

SEQ ID NO: 475728 - RNA, 64 nt, Homo Sapiens
ccuggugugggccagcugguguuggguggccccagggagucacacagucuguacccggccccga

SEQ ID NO: 475729 - RNA, 64 nt, Homo Sapiens
aguguggcuccccuucugauucaguauuuugcauggggguuagagaagguuugagguagacucu

SEQ ID NO: 475730 - RNA, 64 nt, Homo Sapiens
agggcugucccaagucaauggaaagggaaaggguggggguuaggggaagguuggggggacccag

SEQ ID NO: 475731 - RNA, 64 nt, Homo Sapiens
gugucguguugcagcagagugacgauggggguugggggguuauuuauuuugccuguccuuaucc

SEQ ID NO: 475732 - RNA, 64 nt, Homo Sapiens
uaggacugaugaugcauuuuagcuuugagcuuuuggggguuauucuaccaacaaacaguccauu

SEQ ID NO: 475733 - RNA, 64 nt, Homo Sapiens
uucaguccuucaggucauuuuaagguccacugcaggggguuagugagaaaggguauacuuugug

SEQ ID NO: 475734 - RNA, 64 nt, Homo Sapiens
ugcugucuucgugcucugugugaaggggaagcugggggguuagcaugaagucuggccuugugug

SEQ ID NO: 475735 - RNA, 64 nt, Homo Sapiens
aagauuucuaaaauuuaccagaacaguuuagccuggggguuaauaguuaagucuugaggcuaag

SEQ ID NO: 475736 - RNA, 64 nt, Homo Sapiens
auuuuuuuuuuccuuggggaaacuggcaggcaauggggguuagggagguuggggcggugggggc

SEQ ID NO: 475737 - RNA, 64 nt, Homo Sapiens
aaaaaaaccuuguaaauucuagaagaguggcuagggggguuauucauuuguauucaacuaagga

SEQ ID NO: 475738 - RNA, 64 nt, Homo Sapiens
gaaaggacuggacugccuugauugacauggggaaggggguuaguagacuauguggauugcggca

SEQ ID NO: 475739 - RNA, 64 nt, Homo Sapiens
aggauuggugguuuuguuuugacggggcaaggagggggguuauucccucuccgcacagcgugga

SEQ ID NO: 475740 - RNA, 64 nt, Homo Sapiens
aacugcaauagagacuguagaggggggagggggaggggguuacaucgaucucauucaguauuaa

SEQ ID NO: 475741 - RNA, 64 nt, Homo Sapiens
ggaacugggucugggauuauggugggagagggagggggguuaauugguaccccugacuguaagu

SEQ ID NO: 475742 - RNA, 64 nt, Homo Sapiens
gguggaguccgccaaaggccccgggcgggggaucggggguuaggaagaaauagcgguuagcggg

SEQ ID NO: 475743 - RNA, 64 nt, Homo Sapiens
acuggcucucguucucaccgcaaaaaggugguauggggguuagcugguggggcucucugugggg

SEQ ID NO: 475744 - RNA, 64 nt, Homo Sapiens
uucguuccaggugggugaccgcagccgggggcggggggguuagccccacaagucucugggcugg

SEQ ID NO: 475745 - RNA, 64 nt, Homo Sapiens
gggcauuuuacuaaggcagcccacugggacugacggggguuaaacacugcuggcaguggguggg

SEQ ID NO: 475746 - RNA, 64 nt, Homo Sapiens
uauucaugggaccuuuaauuugguggggcugggaggggguuaugaaccaugcaaaauugagcuu

SEQ ID NO: 475747 - RNA, 64 nt, Homo Sapiens
ugaggggagguggcaggagagaauucuacauuuaggggguuaggcugaaaaguguucaauuagc

SEQ ID NO: 475748 - RNA, 64 nt, Homo Sapiens
aaggcccucugagaaaggaagcugcuuagagccaggggguuagugggugaggggagcgagugcu

SEQ ID NO: 475749 - RNA, 64 nt, Homo Sapiens
gccacacaccgguauuccaaaccuuaacaaugaaggggguuagucucuuuuauuugauucuuaa

SEQ ID NO: 475750 - RNA, 64 nt, Homo Sapiens
ucaucuucaugagggaacugaggucuugggggguggggguuacccaaauagguucacagaagaa

SEQ ID NO: 475751 - RNA, 64 nt, Homo Sapiens
ucauggaaauuuggaauuacaaaauaaacguccuggggguuacccagaauacagauuuaaaagu

SEQ ID NO: 475752 - RNA, 64 nt, Homo Sapiens
aaauaaccaagucaaaaccauguacuaucuccuuggggguuagggaugcuaagaagagcccaca

SEQ ID NO: 475753 - RNA, 64 nt, Homo Sapiens
cagauaaagccaaacuugcuggguuacauuccuuggggguuagacacccuucaucacaagaugu

SEQ ID NO: 475754 - RNA, 64 nt, Homo Sapiens
cucuuuccuucaggaaaugaugggaggugguggcggggguuauuucugccugaaauggggggug

SEQ ID NO: 475755 - RNA, 64 nt, Homo Sapiens
cacucaugaaauuuacuucaguuaauaugagacuggggguuaaguuguaacuaauaugcaaaau

SEQ ID NO: 475756 - RNA, 64 nt, Homo Sapiens
aucuuggauuuucuaaaaguaggacagugguuuuggggguuauccacuuuuauuuuuuugaaac

SEQ ID NO: 475757 - RNA, 64 nt, Homo Sapiens
uuuucccugcauuuuuucccaacaaaauuuuguuggggguuauguuacugaagaaugaacagau

SEQ ID NO: 475758 - RNA, 64 nt, Homo Sapiens
uauuugcuacaaagaagcacguuuuauucauaaaggggguuaauuaaaagcuuugacauuuuau

SEQ ID NO: 475759 - RNA, 64 nt, Homo Sapiens
guggucucagcggcaggugguuggauaucugcuaggggguuagaucagccuuccuggcuggcuu

SEQ ID NO: 475760 - RNA, 64 nt, Homo Sapiens
aaaaauaucccuuuuucacaauucucugauguuuggggguuaccccuuucccauuucguguaau

SEQ ID NO: 475761 - RNA, 64 nt, Homo Sapiens
ccaguugcuucuuuaggaugauucuguauccccuggggguuauccuaugauuuuuacaauucug

SEQ ID NO: 475762 - RNA, 64 nt, Homo Sapiens
aaacccaccucacaggguugcaucgguaaacaguggggguuauguacauagccucugugagccu

SEQ ID NO: 475763 - RNA, 64 nt, Homo Sapiens
caaauagaauauauaauauugaauuuaagauuugggggguuaaaaaagaaaacuuaacuuuaua

SEQ ID NO: 475764 - RNA, 64 nt, Homo Sapiens
ucagugcuggucauuguagcgacuuagcagauauggggguuacaucagacuaaagcuacccaag

SEQ ID NO: 475765 - RNA, 64 nt, Homo Sapiens
guguuugggucacaguuccuacaaauacggaaaaggggguuaaaaagcagugcuuucaugaaug

SEQ ID NO: 475766 - RNA, 64 nt, Homo Sapiens
uuuuuuuuuuuccccuccuacacauguaccuucaggggguuaucgggcucuaccacugcauuuu

SEQ ID NO: 475767 - RNA, 64 nt, Homo Sapiens
aaacaaggaaaacccaauaauuccgaggaacauuggggguuaaauaccaagaauaaaaauuggu

SEQ ID NO: 475768 - RNA, 64 nt, Homo Sapiens
ccaucuauuacaucuacagcugacccuugaacauggggguuaggggagcugacaauucgugggu

SEQ ID NO: 475769 - RNA, 64 nt, Homo Sapiens
cucccaaaggacccccuccuaauaccaucacauuggggguuaggguuucaacauaugaauugcg

SEQ ID NO: 475770 - RNA, 64 nt, Homo Sapiens
cacuuauuugaggugggggugaaagagcagguguggggguuaaggcuuggggcaauugguaaag

SEQ ID NO: 475771 - RNA, 64 nt, Homo Sapiens
gcaagggguuccucuggauuaaggccugacuuugggggguuagggaaaaauuaacaaaagacag

SEQ ID NO: 475772 - RNA, 64 nt, Homo Sapiens
agcuugauccacuguugcucuucugaguguugauggggguuacccuaaaauacccaugcugcuu

SEQ ID NO: 475773 - RNA, 64 nt, Homo Sapiens
ggaggggugaagauuggggcccagaguggccccaggggguuagacaugggguggggagcuucuc

SEQ ID NO: 475774 - RNA, 64 nt, Homo Sapiens
gaaugagccugcgguugggagggaauggggcgugggggguuagagcaggaccacagccugguga

SEQ ID NO: 475775 - RNA, 64 nt, Homo Sapiens
uaucuuuauauuucugucucaaaaaugaagagaaggggguuauggguuaaguugcugccuuuua

SEQ ID NO: 475776 - RNA, 64 nt, Homo Sapiens
auuaguaaggugaacuguucuguugugugcguguggggguuaggaggguguguuuuuuuuaacc

SEQ ID NO: 475777 - RNA, 64 nt, Homo Sapiens
uuuuuggugugugugugugugguuguguuucuggggggguuauuuuaagagcuuuaaauaugag

SEQ ID NO: 475778 - RNA, 64 nt, Homo Sapiens
aaguagagaaccuccuuucucagcggugggggauggggguuaaacccccacugcaaauagagaa

SEQ ID NO: 475779 - RNA, 64 nt, Homo Sapiens
uucgaaagcuguguucuuuuugaauaccgugcauggggguuaagcugauguuaaaacaguuugc

SEQ ID NO: 475780 - RNA, 64 nt, Homo Sapiens
caaaguucuguagcugauggucauuuaauugcauggggguuauuuuaucuuucaugauuguggu

SEQ ID NO: 475781 - RNA, 64 nt, Homo Sapiens
gucuauguguggaaggccaccagguuugugggauggggguuagcgcucccagagccuuuggugc

SEQ ID NO: 475782 - RNA, 64 nt, Homo Sapiens
gagaaaucugucuccauauucuugaucuucuucuggggguuaggugcucuacacuacuguuuga

SEQ ID NO: 475783 - RNA, 64 nt, Homo Sapiens
ggaaagagaaggggcagcuuccggauuuucuuuuggggguuagaaggucagguguggagacugc

SEQ ID NO: 475784 - RNA, 64 nt, Homo Sapiens
guuuuauauuuaggcauugggggauggggugggaggggguuauaguucaugaggguuuucuaag

SEQ ID NO: 475785 - RNA, 64 nt, Homo Sapiens
gaagauuacuuaagaauguguugacacauuuggaggggguuaauuuaccaguuaucauuuacua

SEQ ID NO: 475786 - RNA, 64 nt, Homo Sapiens
ggcuucucuugagucacacucuagggaagcucagggggguuacucaugacaagcauuuugugaa

SEQ ID NO: 475787 - RNA, 64 nt, Homo Sapiens
gaggaaggaggauuugggguagaccaugcaagacggggguuaguacugcguccugggcuuuacg

SEQ ID NO: 475788 - RNA, 64 nt, Homo Sapiens
uuagcuuuuuuaaaaaaaaaaaaaaaaaaauuggggggguuaauuuaucauucagaaaucuugc

SEQ ID NO: 475789 - RNA, 64 nt, Homo Sapiens
cuacaagggcauggcucacaaaagguuaauggauggggguuaccuagcccuggcuaauuccccu

SEQ ID NO: 475790 - RNA, 64 nt, Homo Sapiens
uuaagccauguguuccaaggcauuuuagcggggaggggguuaucaaaaaaaaaaaaaugugacu

SEQ ID NO: 475791 - RNA, 64 nt, Homo Sapiens
gaguggcaggccuaggccccuccgauugucccuuggggguuaccccucagcccaccucacuaug

SEQ ID NO: 475792 - RNA, 64 nt, Homo Sapiens
gcuuuugaauuuuugguuauuuuuguguuucuuuggggguuagaccacuuucugauuagccgcc

SEQ ID NO: 475793 - RNA, 64 nt, Homo Sapiens
gaaaccauaugauaacacaaauucacauauaauuggggguuagucccauacucuauaacagacu

SEQ ID NO: 475794 - RNA, 64 nt, Homo Sapiens
uuuucuuucauccaccccuuuccuuuuuuuggaaggggguuauauaugagaguucauugaagaa

SEQ ID NO: 475795 - RNA, 64 nt, Homo Sapiens
augugacuaccaaucaguuugauacucaaggaaaggggguuauucaagaaauugaaaauuucau

SEQ ID NO: 475796 - RNA, 64 nt, Homo Sapiens
ccugcuggguguuuuuuuuuaaaaggccauuuugggggguuauuuauuuuuuaagaaaaaaagc

SEQ ID NO: 475797 - RNA, 64 nt, Homo Sapiens
aaucagcuuuaaaaaaauacacccccuauuuucaggggguuaaacuaucaguguucuuguuaua

SEQ ID NO: 475798 - RNA, 64 nt, Homo Sapiens
aucccuuuggcuuaaagccauucuuuugggggaaggggguuacuuaguauggaauugauuguga

SEQ ID NO: 475799 - RNA, 64 nt, Homo Sapiens
cagccaaaauuaccguuuuagcaaaguuagauuuggggguuauuaauuaauuauaaagccuaaa

SEQ ID NO: 475800 - RNA, 64 nt, Homo Sapiens
guggaggaaauaaaauccugucauaaauggaucuggggguuagacugccauccucacucacuuc

SEQ ID NO: 475801 - RNA, 64 nt, Homo Sapiens
uggaggaggagagcagcgugauaugaagggagauggggguuagguuggguuccuguguuugugc

SEQ ID NO: 475802 - RNA, 64 nt, Homo Sapiens
guuccuuuggcuuaaagccauucuuuuuggggaaggggguuauuuaguauggaauugguuguga

SEQ ID NO: 475803 - RNA, 64 nt, Homo Sapiens
uggggggagguugguuuuguuuuuuuguuuguuuggggguuauuguaaauuuuauuuaaucugu

SEQ ID NO: 475804 - RNA, 64 nt, Homo Sapiens
ggguggggguggggacucaguuacacgcaugaauggggguuaugacagugugccugucccacug

SEQ ID NO: 475805 - RNA, 64 nt, Homo Sapiens
gccacagagggauaggcacagccacucggccccaggggguuaugcacuagagcugcagguacca

SEQ ID NO: 475806 - RNA, 64 nt, Homo Sapiens
uauaaacacaaggugguuggggcacuggggguggggggguuauuagaagauguggaugaauuca

SEQ ID NO: 475807 - RNA, 50 nt, Homo Sapiens
ugggccacucccgggggugaggggguuaccccuucccaguguuuuuuauu

SEQ ID NO: 475808 - RNA, 64 nt, Homo Sapiens
uucuuaccuagcugucacuuuuuuaaaugccucuggggguuauuuuugcuuuccuuggccccca

SEQ ID NO: 475809 - RNA, 64 nt, Homo Sapiens
cgggaugguucagccagggcgguggccccugccuggggguuauugcagcccagccccaucggca

SEQ ID NO: 475810 - RNA, 64 nt, Homo Sapiens
auaaagcaucugaauacagugauggugggggagaggggguuagacaccccccugcagcaacuaa

SEQ ID NO: 475811 - RNA, 64 nt, Homo Sapiens
gauguccugaaauuccaccacgggggucacccugggggguuagggaccuauuuuuaacacuagg

SEQ ID NO: 475812 - RNA, 64 nt, Homo Sapiens
caccacgcccagccuucccuugcacuuuuaaugaggggguuaaguucacuguuuucucuuucua

SEQ ID NO: 475813 - RNA, 64 nt, Homo Sapiens
acuggagggugcugagccgaagggacggugggagggggguuauggugcaaguguugggggggag

SEQ ID NO: 475814 - RNA, 64 nt, Homo Sapiens
guaaaauuacaacaaaaggcauuauaauuuuguuggggguuaauuuuaugaaaauuaugcucaa

SEQ ID NO: 475815 - RNA, 64 nt, Homo Sapiens
uuucuuaggagcaagaagaaaauguggcccuaaaggggguuaguugagggguaggggguaguga

SEQ ID NO: 475816 - RNA, 64 nt, Homo Sapiens
uggggucuggucgugggcaggauggugcccagaaggggguuagguugucccagugaaaauucug

SEQ ID NO: 475817 - RNA, 64 nt, Homo Sapiens
uuuaaaaacagaauuguguuaugugaucaguuuuggggguuaacuuugcuuaauuccucaggcu

SEQ ID NO: 475818 - RNA, 64 nt, Homo Sapiens
auagaguuucuuacauuuuuuuauaagccuuuuuggggguuaaauuauuuuuagcuuuguuuuu

SEQ ID NO: 475819 - RNA, 64 nt, Homo Sapiens
aaauauuuuggccucagaauuuugucuuucuuauggggguuaccaacaaauucuucaaccuuuc

SEQ ID NO: 475820 - RNA, 64 nt, Homo Sapiens
gcugggacugugcccccacacugggggcugggcuggggguuagggaucuccauccacuuuucuc

SEQ ID NO: 475821 - RNA, 64 nt, Homo Sapiens
guccccaggagcagcaacccagcuagaaguguugggggguuaaucucagucagugcacugggca

SEQ ID NO: 475822 - RNA, 64 nt, Homo Sapiens
ucgguuuuuucucuguugcagucacguccuguuuggggguuaauccauccccccuucccuuccc

SEQ ID NO: 475823 - RNA, 64 nt, Homo Sapiens
ugcuuggcagccugccugccgucuggcacuugauggggguuaguacucucagaacacugggagg

SEQ ID NO: 475824 - RNA, 64 nt, Homo Sapiens
auaggaagaacuuucucggugaagccagugauauggggguuagguucccucagugugguuuccu

SEQ ID NO: 475825 - RNA, 64 nt, Homo Sapiens
uguuuauuucugaguaaggggcuuuguugaaagaggggguuagagagagcaagacagcacuuga

SEQ ID NO: 475826 - RNA, 64 nt, Homo Sapiens
uguacauccuggggcauuaacagguguggaauauggggguuaucaccugacaaaaaaaaaguuc

SEQ ID NO: 475827 - RNA, 64 nt, Homo Sapiens
acuucaauauauaaauuuugcagucugaggugcuggggguuaggucuuauguccacaaaaguca

SEQ ID NO: 475828 - RNA, 64 nt, Homo Sapiens
uccucuuggguccccucaagcagacggggcucaaggggguuacauuuaauaaaaggaugaagau

SEQ ID NO: 475829 - RNA, 64 nt, Homo Sapiens
auuuguucagugacuauucucggggcccuguguaggggguuauugccucugaaaugccucuucu

SEQ ID NO: 475830 - RNA, 64 nt, Homo Sapiens
uuauuuuuguucaucugcugcuguuuacauucugggggguuagggggagucccccucccucccu

SEQ ID NO: 475831 - RNA, 64 nt, Homo Sapiens
caauuaaggguggggggcggggguugggggguugggggguuagggcagggaggggacuggggaa

SEQ ID NO: 475832 - RNA, 64 nt, Homo Sapiens
gaggagugagugggacucaagugcccugguugagggggguuaggcgcugcauccggaagucgcu

SEQ ID NO: 475833 - RNA, 64 nt, Homo Sapiens
ggggcgggaggguagacugaaugucuauagcagaggggguuauggaguaauauauacccagagu

SEQ ID NO: 475834 - RNA, 64 nt, Homo Sapiens
gaaccagaguucaaaguccuaugcaaccuuaggaggggguuagagagucuguuuugauugaugu

SEQ ID NO: 475835 - RNA, 64 nt, Homo Sapiens
cccuauauccugaagaagaacgcggcagagucauggggguuaauugugggaggauguucagcag

SEQ ID NO: 475836 - RNA, 64 nt, Homo Sapiens
uaaauauauuuaauuuaaugaucauuauauauguggggguuaauauguuguuuuucugucccuu

SEQ ID NO: 475837 - RNA, 64 nt, Homo Sapiens
uaaugaaaaacaugcuauguuuuugaauuucuuuggggguuauuucagagcugccaucaucacu

SEQ ID NO: 475838 - RNA, 64 nt, Homo Sapiens
uuuuauauccuauaauacaaacauuccacagaugggggguuagucugucucgggugucagcuua

SEQ ID NO: 475839 - RNA, 64 nt, Homo Sapiens
uuggggaggggggggugcguuuucagggugggcaggggguuagugggcgggggacaucucgggg

SEQ ID NO: 475840 - RNA, 64 nt, Homo Sapiens
uccaggggcugaguucccacgauuucaaaccaaaggggguuacgcuagcaagugauggagccca

SEQ ID NO: 475841 - RNA, 64 nt, Homo Sapiens; identical to SEQ ID NO: 475723

SEQ ID NO: 475842 - RNA, 64 nt, Homo Sapiens; identical to SEQ ID NO: 475724

SEQ ID NO: 475843 - RNA, 64 nt, Homo Sapiens; identical to SEQ ID NO: 475725

SEQ ID NO: 475844 - RNA, 64 nt, Homo Sapiens; identical to SEQ ID NO: 475726

SEQ ID NO: 475845 - RNA, 64 nt, Homo Sapiens; identical to SEQ ID NO: 475727

SEQ ID NO: 475846 - RNA, 64 nt, Homo Sapiens; identical to SEQ ID NO: 475728

SEQ ID NO: 475847 - RNA, 64 nt, Homo Sapiens; identical to SEQ ID NO: 475729

SEQ ID NO: 475848 - RNA, 64 nt, Homo Sapiens; identical to SEQ ID NO: 475730

SEQ ID NO: 475849 - RNA, 64 nt, Homo Sapiens; identical to SEQ ID NO: 475731

SEQ ID NO: 475850 - RNA, 64 nt, Homo Sapiens; identical to SEQ ID NO: 475732

SEQ ID NO: 475851 - RNA, 64 nt, Homo Sapiens; identical to SEQ ID NO: 475733

SEQ ID NO: 475852 - RNA, 64 nt, Homo Sapiens; identical to SEQ ID NO: 475734

SEQ ID NO: 475853 - RNA, 64 nt, Homo Sapiens; identical to SEQ ID NO: 475735

SEQ ID NO: 475854 - RNA, 64 nt, Homo Sapiens; identical to SEQ ID NO: 475736

SEQ ID NO: 475855 - RNA, 64 nt, Homo Sapiens; identical to SEQ ID NO: 475737

SEQ ID NO: 475856 - RNA, 64 nt, Homo Sapiens; identical to SEQ ID NO: 475738

SEQ ID NO: 475857 - RNA, 64 nt, Homo Sapiens; identical to SEQ ID NO: 475739

SEQ ID NO: 475858 - RNA, 64 nt, Homo Sapiens; identical to SEQ ID NO: 475740

SEQ ID NO: 475859 - RNA, 64 nt, Homo Sapiens; identical to SEQ ID NO: 475741

SEQ ID NO: 475860 - RNA, 64 nt, Homo Sapiens; identical to SEQ ID NO: 475742

SEQ ID NO: 475861 - RNA, 64 nt, Homo Sapiens; identical to SEQ ID NO: 475743

SEQ ID NO: 475862 - RNA, 64 nt, Homo Sapiens; identical to SEQ ID NO: 475744

SEQ ID NO: 475863 - RNA, 64 nt, Homo Sapiens; identical to SEQ ID NO: 475745

SEQ ID NO: 475864 - RNA, 64 nt, Homo Sapiens; identical to SEQ ID NO: 475746

SEQ ID NO: 475865 - RNA, 64 nt, Homo Sapiens; identical to SEQ ID NO: 475747

SEQ ID NO: 475866 - RNA, 64 nt, Homo Sapiens; identical to SEQ ID NO: 475748

SEQ ID NO: 475867 - RNA, 64 nt, Homo Sapiens; identical to SEQ ID NO: 475749

SEQ ID NO: 475868 - RNA, 64 nt, Homo Sapiens; identical to SEQ ID NO: 475750

SEQ ID NO: 475869 - RNA, 64 nt, Homo Sapiens; identical to SEQ ID NO: 475751

SEQ ID NO: 475870 - RNA, 64 nt, Homo Sapiens; identical to SEQ ID NO: 475752

SEQ ID NO: 475871 - RNA, 64 nt, Homo Sapiens; identical to SEQ ID NO: 475753

SEQ ID NO: 475872 - RNA, 64 nt, Homo Sapiens; identical to SEQ ID NO: 475754

SEQ ID NO: 475873 - RNA, 64 nt, Homo Sapiens; identical to SEQ ID NO: 475755

SEQ ID NO: 475874 - RNA, 64 nt, Homo Sapiens; identical to SEQ ID NO: 475756

SEQ ID NO: 475875 - RNA, 64 nt, Homo Sapiens; identical to SEQ ID NO: 475757

SEQ ID NO: 475876 - RNA, 64 nt, Homo Sapiens; identical to SEQ ID NO: 475758

SEQ ID NO: 475877 - RNA, 64 nt, Homo Sapiens; identical to SEQ ID NO: 475759

SEQ ID NO: 475878 - RNA, 64 nt, Homo Sapiens; identical to SEQ ID NO: 475760

SEQ ID NO: 475879 - RNA, 64 nt, Homo Sapiens; identical to SEQ ID NO: 475761

SEQ ID NO: 475880 - RNA, 64 nt, Homo Sapiens; identical to SEQ ID NO: 475762

SEQ ID NO: 475881 - RNA, 64 nt, Homo Sapiens; identical to SEQ ID NO: 475763

SEQ ID NO: 475882 - RNA, 64 nt, Homo Sapiens; identical to SEQ ID NO: 475764

SEQ ID NO: 475883 - RNA, 64 nt, Homo Sapiens; identical to SEQ ID NO: 475765

SEQ ID NO: 475884 - RNA, 64 nt, Homo Sapiens; identical to SEQ ID NO: 475766

SEQ ID NO: 475885 - RNA, 64 nt, Homo Sapiens; identical to SEQ ID NO: 475767

SEQ ID NO: 475886 - RNA, 64 nt, Homo Sapiens; identical to SEQ ID NO: 475768

SEQ ID NO: 475887 - RNA, 64 nt, Homo Sapiens; identical to SEQ ID NO: 475769

SEQ ID NO: 475888 - RNA, 64 nt, Homo Sapiens; identical to SEQ ID NO: 475770

SEQ ID NO: 475889 - RNA, 64 nt, Homo Sapiens; identical to SEQ ID NO: 475771

SEQ ID NO: 475890 - RNA, 64 nt, Homo Sapiens; identical to SEQ ID NO: 475772

SEQ ID NO: 475891 - RNA, 64 nt, Homo Sapiens; identical to SEQ ID NO: 475773

SEQ ID NO: 475892 - RNA, 64 nt, Homo Sapiens; identical to SEQ ID NO: 475774

SEQ ID NO: 475893 - RNA, 64 nt, Homo Sapiens; identical to SEQ ID NO: 475775

SEQ ID NO: 475894 - RNA, 64 nt, Homo Sapiens; identical to SEQ ID NO: 475776

SEQ ID NO: 475895 - RNA, 64 nt, Homo Sapiens; identical to SEQ ID NO: 475777

SEQ ID NO: 475896 - RNA, 64 nt, Homo Sapiens; identical to SEQ ID NO: 475778

SEQ ID NO: 475897 - RNA, 64 nt, Homo Sapiens; identical to SEQ ID NO: 475779

SEQ ID NO: 475898 - RNA, 64 nt, Homo Sapiens; identical to SEQ ID NO: 475780

SEQ ID NO: 475899 - RNA, 64 nt, Homo Sapiens; identical to SEQ ID NO: 475781

SEQ ID NO: 475900 - RNA, 64 nt, Homo Sapiens; identical to SEQ ID NO: 475782

SEQ ID NO: 475901 - RNA, 64 nt, Homo Sapiens; identical to SEQ ID NO: 475783

SEQ ID NO: 475902 - RNA, 64 nt, Homo Sapiens; identical to SEQ ID NO: 475784

SEQ ID NO: 475903 - RNA, 64 nt, Homo Sapiens; identical to SEQ ID NO: 475785

SEQ ID NO: 475904 - RNA, 64 nt, Homo Sapiens; identical to SEQ ID NO: 475786

SEQ ID NO: 475905 - RNA, 64 nt, Homo Sapiens; identical to SEQ ID NO: 475787

SEQ ID NO: 475906 - RNA, 64 nt, Homo Sapiens; identical to SEQ ID NO: 475788

SEQ ID NO: 475907 - RNA, 64 nt, Homo Sapiens; identical to SEQ ID NO: 475789

SEQ ID NO: 475908 - RNA, 64 nt, Homo Sapiens; identical to SEQ ID NO: 475790

SEQ ID NO: 475909 - RNA, 64 nt, Homo Sapiens; identical to SEQ ID NO: 475791

SEQ ID NO: 475910 - RNA, 64 nt, Homo Sapiens; identical to SEQ ID NO: 475792

SEQ ID NO: 475911 - RNA, 64 nt, Homo Sapiens; identical to SEQ ID NO: 475793

SEQ ID NO: 475912 - RNA, 64 nt, Homo Sapiens; identical to SEQ ID NO: 475794

SEQ ID NO: 475913 - RNA, 64 nt, Homo Sapiens; identical to SEQ ID NO: 475795

SEQ ID NO: 475914 - RNA, 64 nt, Homo Sapiens; identical to SEQ ID NO: 475796

SEQ ID NO: 475915 - RNA, 64 nt, Homo Sapiens; identical to SEQ ID NO: 475797

SEQ ID NO: 475916 - RNA, 64 nt, Homo Sapiens; identical to SEQ ID NO: 475798

SEQ ID NO: 475917 - RNA, 64 nt, Homo Sapiens; identical to SEQ ID NO: 475799

SEQ ID NO: 475918 - RNA, 64 nt, Homo Sapiens; identical to SEQ ID NO: 475800

SEQ ID NO: 475919 - RNA, 64 nt, Homo Sapiens; identical to SEQ ID NO: 475801

SEQ ID NO: 475920 - RNA, 64 nt, Homo Sapiens; identical to SEQ ID NO: 475802

SEQ ID NO: 475921 - RNA, 64 nt, Homo Sapiens; identical to SEQ ID NO: 475803

SEQ ID NO: 475922 - RNA, 64 nt, Homo Sapiens; identical to SEQ ID NO: 475804

SEQ ID NO: 475923 - RNA, 64 nt, Homo Sapiens; identical to SEQ ID NO: 475805

SEQ ID NO: 475924 - RNA, 64 nt, Homo Sapiens; identical to SEQ ID NO: 475806

SEQ ID NO: 475925 - RNA, 50 nt, Homo Sapiens; identical to SEQ ID NO: 475807

SEQ ID NO: 475926 - RNA, 64 nt, Homo Sapiens; identical to SEQ ID NO: 475808

SEQ ID NO: 475927 - RNA, 64 nt, Homo Sapiens; identical to SEQ ID NO: 475809

SEQ ID NO: 475928 - RNA, 64 nt, Homo Sapiens; identical to SEQ ID NO: 475810

SEQ ID NO: 475929 - RNA, 64 nt, Homo Sapiens; identical to SEQ ID NO: 475811

SEQ ID NO: 475930 - RNA, 64 nt, Homo Sapiens; identical to SEQ ID NO: 475812

SEQ ID NO: 475931 - RNA, 64 nt, Homo Sapiens; identical to SEQ ID NO: 475813

SEQ ID NO: 475932 - RNA, 64 nt, Homo Sapiens; identical to SEQ ID NO: 475814

SEQ ID NO: 475933 - RNA, 64 nt, Homo Sapiens; identical to SEQ ID NO: 475815

SEQ ID NO: 475934 - RNA, 64 nt, Homo Sapiens; identical to SEQ ID NO: 475816

SEQ ID NO: 475935 - RNA, 64 nt, Homo Sapiens; identical to SEQ ID NO: 475817

SEQ ID NO: 475936 - RNA, 64 nt, Homo Sapiens; identical to SEQ ID NO: 475818

SEQ ID NO: 475937 - RNA, 64 nt, Homo Sapiens; identical to SEQ ID NO: 475819

SEQ ID NO: 475938 - RNA, 64 nt, Homo Sapiens; identical to SEQ ID NO: 475820

SEQ ID NO: 475939 - RNA, 64 nt, Homo Sapiens; identical to SEQ ID NO: 475821

SEQ ID NO: 475940 - RNA, 64 nt, Homo Sapiens; identical to SEQ ID NO: 475822

SEQ ID NO: 475941 - RNA, 64 nt, Homo Sapiens; identical to SEQ ID NO: 475823

SEQ ID NO: 475942 - RNA, 64 nt, Homo Sapiens; identical to SEQ ID NO: 475824

SEQ ID NO: 475943 - RNA, 64 nt, Homo Sapiens; identical to SEQ ID NO: 475825

SEQ ID NO: 475944 - RNA, 64 nt, Homo Sapiens; identical to SEQ ID NO: 475826

SEQ ID NO: 475945 - RNA, 64 nt, Homo Sapiens; identical to SEQ ID NO: 475827

SEQ ID NO: 475946 - RNA, 64 nt, Homo Sapiens; identical to SEQ ID NO: 475828

SEQ ID NO: 475947 - RNA, 64 nt, Homo Sapiens; identical to SEQ ID NO: 475829

SEQ ID NO: 475948 - RNA, 64 nt, Homo Sapiens; identical to SEQ ID NO: 475830

SEQ ID NO: 475949 - RNA, 64 nt, Homo Sapiens; identical to SEQ ID NO: 475831

SEQ ID NO: 475950 - RNA, 64 nt, Homo Sapiens; identical to SEQ ID NO: 475832

SEQ ID NO: 475951 - RNA, 64 nt, Homo Sapiens; identical to SEQ ID NO: 475833

SEQ ID NO: 475952 - RNA, 64 nt, Homo Sapiens; identical to SEQ ID NO: 475834

SEQ ID NO: 475953 - RNA, 64 nt, Homo Sapiens; identical to SEQ ID NO: 475835

SEQ ID NO: 475954 - RNA, 64 nt, Homo Sapiens; identical to SEQ ID NO: 475836

SEQ ID NO: 475955 - RNA, 64 nt, Homo Sapiens; identical to SEQ ID NO: 475837

SEQ ID NO: 475956 - RNA, 64 nt, Homo Sapiens; identical to SEQ ID NO: 475838

SEQ ID NO: 475957 - RNA, 64 nt, Homo Sapiens; identical to SEQ ID NO: 475839

SEQ ID NO: 475958 - RNA, 64 nt, Homo Sapiens; identical to SEQ ID NO: 475840

SEQ ID NO: 475959 - RNA, 64 nt, Homo Sapiens
uuucuguuuuuagcagagacaugcaacaacaacacacacgcacacacgcacacacacacacgua

SEQ ID NO: 475960 - RNA, 64 nt, Homo Sapiens
uuuagcagagacaugcaacaacaacacacacgcacacacgcacacacacacacguacacacaca

SEQ ID NO: 475961 - RNA, 64 nt, Homo Sapiens
caugcgugugcacccgcgcacacgcacacacacacacacgcacacacuucuucagcaccacaca

SEQ ID NO: 475962 - RNA, 64 nt, Homo Sapiens
cacacacacacgcacacaugucuucagcaccacacacacgcacaaaggccaagcaaccuccacu

SEQ ID NO: 475963 - RNA, 64 nt, Homo Sapiens
aacacacacacuauggggugcauaccccacugggcacacgcacagaaacuggacucacauucga

SEQ ID NO: 475964 - RNA, 64 nt, Homo Sapiens
ggugccaaaaccaggccucuugggacagggaggccacacgcacucugggcuccccccaguggga

SEQ ID NO: 475965 - RNA, 64 nt, Homo Sapiens
gcgcacacgugcucccugaaggcacacguacgcacacacgcacaugcacagauaugccgccugg

SEQ ID NO: 475966 - RNA, 64 nt, Homo Sapiens
gccugggcacacagauaagcugcccaaaugcacgcacacgcacagagacaugccagaacauaca

SEQ ID NO: 475967 - RNA, 64 nt, Homo Sapiens
gccagaacauacaaggacaugcugccugaacauacacacgcacacccaugcgcagaugugcugc

SEQ ID NO: 475968 - RNA, 64 nt, Homo Sapiens
acacacgugcacaggcgcagauaugcugccuggacacacgcagauaugcugucuagucacacac

SEQ ID NO: 475969 - RNA, 64 nt, Homo Sapiens
cuggacacacgcagauaugcugucuagucacacacacacgcagacaugcuguccggacacacac

SEQ ID NO: 475970 - RNA, 64 nt, Homo Sapiens
ucacacacacacgcagacaugcuguccggacacacacacgcaugcacagauaugcuguccggac

SEQ ID NO: 475971 - RNA, 64 nt, Homo Sapiens
acacacgcaugcacagauaugcuguccggacacacacacgcacgcagauaugcugccuggacac

SEQ ID NO: 475972 - RNA, 64 nt, Homo Sapiens
acaugcacacacgugcagauaugcuguccggauacacacgcacgcacacaugcagauaugcugc

SEQ ID NO: 475973 - RNA, 64 nt, Homo Sapiens
acaugcacacacaggugcagauaugcugccuggacacacgcagacugacgugcuuuugggaggg

SEQ ID NO: 475974 - RNA, 64 nt, Homo Sapiens
gccugugcaaauucugaugauggccccacccccgcacacgcacacgcacaucaugcuuuuccag

SEQ ID NO: 475975 - RNA, 64 nt, Homo Sapiens
gcaaauucugaugauggccccacccccgcacacgcacacgcacaucaugcuuuuccagcucauc

SEQ ID NO: 475976 - RNA, 64 nt, Homo Sapiens
ucaugcuuuuccagcucauccacccccgcacacgcacacgcacagcaaauucugaugaugaccc

SEQ ID NO: 475977 - RNA, 64 nt, Homo Sapiens
cgcacaucaugcuuuuccagugaccccacccccgcacacgcacagccugugcaaauucugauga

SEQ ID NO: 475978 - RNA, 64 nt, Homo Sapiens
aaaugggagcuagaggguugugacccuucauacacacacgcacgcacgcacacaaacaugcaca

SEQ ID NO: 475979 - RNA, 64 nt, Homo Sapiens
cauacacacacgcacgcacgcacacaaacaugcacacacgcaugcacacacacaaagccuuaag

SEQ ID NO: 475980 - RNA, 64 nt, Homo Sapiens
uggucuccaugccugugcccucacacagguguagcacacgcaugugcagauggcaccacggccg

SEQ ID NO: 475981 - RNA, 64 nt, Homo Sapiens
acaccagaaucuuccagaagcccagcuccacccgcacacgcagcuucccauccaguccuucaac

SEQ ID NO: 475982 - RNA, 64 nt, Homo Sapiens
caucuuaccucucaugcgugcacacacacgcacgcacacgcacacacacacacacacacacaca

SEQ ID NO: 475983 - RNA, 64 nt, Homo Sapiens
cacacgcacacaucuuaccucacacacacacacacacacgcacgcagccugggacacacacaca

SEQ ID NO: 475984 - RNA, 64 nt, Homo Sapiens
cagccugguuuuguccucaucgccccugcacacgcacacgcacacaggaaugaaccgaggccgu

SEQ ID NO: 475985 - RNA, 64 nt, Homo Sapiens
cgcacacagccugguuuuguggccgucgccccugcacacgcacauuuccccaggaaugaaccga

SEQ ID NO: 475986 - RNA, 64 nt, Homo Sapiens
gucccucuaacaagaacuugucucagcacaugcgcacacgcacacucggacucacacgaaguca

SEQ ID NO: 475987 - RNA, 64 nt, Homo Sapiens
caugcgcacacgcacacucggacucacacgaagucacacgcacacaugcacgcacacacacaua

SEQ ID NO: 475988 - RNA, 64 nt, Homo Sapiens
cacacaguggcagaagggaucacgcacaaacacacacacgcacguaugcucaugugugggcaca

SEQ ID NO: 475989 - RNA, 64 nt, Homo Sapiens
aacacacacacgcacgcacacucaugugugggcacacacgcacauuucugugaauuaaaauaug

SEQ ID NO: 475990 - RNA, 64 nt, Homo Sapiens
acccaggaugaugguuucaccaaguaacaccacacacacgcagcaggagcgaaccggucagcac

SEQ ID NO: 475991 - RNA, 64 nt, Homo Sapiens
cugcagagccgccgccgccgaauacuccacguugcacacgcagugccucuuuuuccccuaguga

SEQ ID NO: 475992 - RNA, 64 nt, Homo Sapiens
cgugggaauucugggagauaucccccugggucugucccacaacagcccccaugauucaauuacc

SEQ ID NO: 475993 - RNA, 64 nt, Homo Sapiens
cgugggaauucugguagauauccccuugggucucucccacaacagcccccaugauucaauuacc

SEQ ID NO: 475994 - RNA, 64 nt, Homo Sapiens
gcauuuugggguuauguuuaaaaaaacauuauugucccacaauauuaccuuaagauuuuucuuu

SEQ ID NO: 475995 - RNA, 64 nt, Homo Sapiens
uuggacugagauuucuuaaaucuuucuucaaaucucccacaaguauauacuuuuaaauuaugga

SEQ ID NO: 475996 - RNA, 64 nt, Homo Sapiens
ggcccccaugauucaauuaccucccccgggucccucccacaacacaugggaauucugagagaua

SEQ ID NO: 475997 - RNA, 64 nt, Homo Sapiens
gccccccugauucgaugaccucccccugggucccucccacaacaugugggaauuccagaagaua

SEQ ID NO: 475998 - RNA, 64 nt, Homo Sapiens
gugcccuccaagcaucuaauggcuuauuaaauuaucccacaaguggguuuuaggcuccuuuuuu

SEQ ID NO: 475999 - RNA, 64 nt, Homo Sapiens
agucccuuacugcaaauguguuagcucuaacaucucccacaagcuagaggaacuugcgaguaua

SEQ ID NO: 476000 - RNA, 64 nt, Homo Sapiens
ugcugguggaggaagaagauagaaacgugaugugucccacaaaccuucagcuguagcacuuggc

SEQ ID NO: 476001 - RNA, 64 nt, Homo Sapiens
aaaugaauccagcguggaggugugcugcccucccucccacaaacgcagaugggacugucaaagu

SEQ ID NO: 476002 - RNA, 64 nt, Homo Sapiens; identical to SEQ ID NO: 106200

SEQ ID NO: 476003 - RNA, 64 nt, Homo Sapiens; identical to SEQ ID NO: 106201

SEQ ID NO: 476004 - RNA, 64 nt, Homo Sapiens; identical to SEQ ID NO: 106202

SEQ ID NO: 476005 - RNA, 64 nt, Homo Sapiens; identical to SEQ ID NO: 106203

SEQ ID NO: 476006 - RNA, 64 nt, Homo Sapiens; identical to SEQ ID NO: 106204

SEQ ID NO: 476007 - RNA, 64 nt, Homo Sapiens; identical to SEQ ID NO: 106205

SEQ ID NO: 476008 - RNA, 64 nt, Homo Sapiens; identical to SEQ ID NO: 106206

SEQ ID NO: 476009 - RNA, 64 nt, Homo Sapiens; identical to SEQ ID NO: 106207

SEQ ID NO: 476010 - RNA, 64 nt, Homo Sapiens; identical to SEQ ID NO: 211358

SEQ ID NO: 476011 - RNA, 64 nt, Homo Sapiens; identical to SEQ ID NO: 211359

SEQ ID NO: 476012 - RNA, 64 nt, Homo Sapiens; identical to SEQ ID NO: 211360

SEQ ID NO: 476013 - RNA, 64 nt, Homo Sapiens; identical to SEQ ID NO: 211361

SEQ ID NO: 476014 - RNA, 64 nt, Homo Sapiens; identical to SEQ ID NO: 211362

SEQ ID NO: 476015 - RNA, 64 nt, Homo Sapiens; identical to SEQ ID NO: 211363

SEQ ID NO: 476016 - RNA, 64 nt, Homo Sapiens; identical to SEQ ID NO: 211364

SEQ ID NO: 476017 - RNA, 64 nt, Homo Sapiens; identical to SEQ ID NO: 211365

SEQ ID NO: 476018 - RNA, 64 nt, Homo Sapiens; identical to SEQ ID NO: 211366

SEQ ID NO: 476019 - RNA, 64 nt, Homo Sapiens; identical to SEQ ID NO: 211367

SEQ ID NO: 476020 - RNA, 64 nt, Homo Sapiens; identical to SEQ ID NO: 211368

SEQ ID NO: 476021 - RNA, 64 nt, Homo Sapiens; identical to SEQ ID NO: 211369

SEQ ID NO: 476022 - RNA, 64 nt, Homo Sapiens; identical to SEQ ID NO: 211370

SEQ ID NO: 476023 - RNA, 64 nt, Homo Sapiens; identical to SEQ ID NO: 211371

SEQ ID NO: 476024 - RNA, 64 nt, Homo Sapiens; identical to SEQ ID NO: 211372

SEQ ID NO: 476025 - RNA, 64 nt, Homo Sapiens; identical to SEQ ID NO: 211373

SEQ ID NO: 476026 - RNA, 64 nt, Homo Sapiens; identical to SEQ ID NO: 211374

SEQ ID NO: 476027 - RNA, 64 nt, Homo Sapiens; identical to SEQ ID NO: 211375

SEQ ID NO: 476028 - RNA, 50 nt, Homo Sapiens; identical to SEQ ID NO: 178066

SEQ ID NO: 476029 - RNA, 64 nt, Homo Sapiens; identical to SEQ ID NO: 211377

SEQ ID NO: 476030 - RNA, 64 nt, Homo Sapiens; identical to SEQ ID NO: 211378

SEQ ID NO: 476031 - RNA, 64 nt, Homo Sapiens; identical to SEQ ID NO: 211379

SEQ ID NO: 476032 - RNA, 64 nt, Homo Sapiens; identical to SEQ ID NO: 211380

SEQ ID NO: 476033 - RNA, 64 nt, Homo Sapiens; identical to SEQ ID NO: 211381

SEQ ID NO: 476034 - RNA, 64 nt, Homo Sapiens; identical to SEQ ID NO: 211382

SEQ ID NO: 476035 - RNA, 64 nt, Homo Sapiens; identical to SEQ ID NO: 211383

SEQ ID NO: 476036 - RNA, 64 nt, Homo Sapiens; identical to SEQ ID NO: 211384

SEQ ID NO: 476037 - RNA, 64 nt, Homo Sapiens; identical to SEQ ID NO: 211385

SEQ ID NO: 476038 - RNA, 64 nt, Homo Sapiens; identical to SEQ ID NO: 211386

SEQ ID NO: 476039 - RNA, 64 nt, Homo Sapiens; identical to SEQ ID NO: 211387

SEQ ID NO: 476040 - RNA, 64 nt, Homo Sapiens; identical to SEQ ID NO: 211388

SEQ ID NO: 476041 - RNA, 64 nt, Homo Sapiens; identical to SEQ ID NO: 211389

SEQ ID NO: 476042 - RNA, 64 nt, Homo Sapiens; identical to SEQ ID NO: 211390

SEQ ID NO: 476043 - RNA, 64 nt, Homo Sapiens; identical to SEQ ID NO: 211391

SEQ ID NO: 476044 - RNA, 64 nt, Homo Sapiens; identical to SEQ ID NO: 211392

SEQ ID NO: 476045 - RNA, 64 nt, Homo Sapiens; identical to SEQ ID NO: 211393

SEQ ID NO: 476046 - RNA, 64 nt, Homo Sapiens; identical to SEQ ID NO: 211394

SEQ ID NO: 476047 - RNA, 64 nt, Homo Sapiens; identical to SEQ ID NO: 211395

SEQ ID NO: 476048 - RNA, 64 nt, Homo Sapiens; identical to SEQ ID NO: 211396

SEQ ID NO: 476049 - RNA, 64 nt, Homo Sapiens; identical to SEQ ID NO: 211397

SEQ ID NO: 476050 - RNA, 64 nt, Homo Sapiens; identical to SEQ ID NO: 211398

SEQ ID NO: 476051 - RNA, 64 nt, Homo Sapiens; identical to SEQ ID NO: 211399

SEQ ID NO: 476052 - RNA, 64 nt, Homo Sapiens; identical to SEQ ID NO: 211400

SEQ ID NO: 476053 - RNA, 64 nt, Homo Sapiens; identical to SEQ ID NO: 211401

SEQ ID NO: 476054 - RNA, 64 nt, Homo Sapiens; identical to SEQ ID NO: 211402

SEQ ID NO: 476055 - RNA, 64 nt, Homo Sapiens; identical to SEQ ID NO: 211403

SEQ ID NO: 476056 - RNA, 64 nt, Homo Sapiens; identical to SEQ ID NO: 211404

SEQ ID NO: 476057 - RNA, 64 nt, Homo Sapiens; identical to SEQ ID NO: 211405

SEQ ID NO: 476058 - RNA, 64 nt, Homo Sapiens; identical to SEQ ID NO: 211406

SEQ ID NO: 476059 - RNA, 64 nt, Homo Sapiens; identical to SEQ ID NO: 211407

SEQ ID NO: 476060 - RNA, 64 nt, Homo Sapiens; identical to SEQ ID NO: 211408

SEQ ID NO: 476061 - RNA, 64 nt, Homo Sapiens; identical to SEQ ID NO: 211409

SEQ ID NO: 476062 - RNA, 64 nt, Homo Sapiens; identical to SEQ ID NO: 211410

SEQ ID NO: 476063 - RNA, 64 nt, Homo Sapiens; identical to SEQ ID NO: 211411

SEQ ID NO: 476064 - RNA, 64 nt, Homo Sapiens; identical to SEQ ID NO: 211412

SEQ ID NO: 476065 - RNA, 64 nt, Homo Sapiens; identical to SEQ ID NO: 211413

SEQ ID NO: 476066 - RNA, 64 nt, Homo Sapiens; identical to SEQ ID NO: 211414

SEQ ID NO: 476067 - RNA, 64 nt, Homo Sapiens; identical to SEQ ID NO: 211415

SEQ ID NO: 476068 - RNA, 64 nt, Homo Sapiens; identical to SEQ ID NO: 211416

SEQ ID NO: 476069 - RNA, 64 nt, Homo Sapiens; identical to SEQ ID NO: 211417

SEQ ID NO: 476070 - RNA, 64 nt, Homo Sapiens; identical to SEQ ID NO: 211418

SEQ ID NO: 476071 - RNA, 64 nt, Homo Sapiens; identical to SEQ ID NO: 211419

SEQ ID NO: 476072 - RNA, 64 nt, Homo Sapiens; identical to SEQ ID NO: 211420

SEQ ID NO: 476073 - RNA, 64 nt, Homo Sapiens; identical to SEQ ID NO: 211421

SEQ ID NO: 476074 - RNA, 64 nt, Homo Sapiens; identical to SEQ ID NO: 211422

SEQ ID NO: 476075 - RNA, 64 nt, Homo Sapiens; identical to SEQ ID NO: 211423

SEQ ID NO: 476076 - RNA, 64 nt, Homo Sapiens; identical to SEQ ID NO: 211424

SEQ ID NO: 476077 - RNA, 64 nt, Homo Sapiens; identical to SEQ ID NO: 211425

SEQ ID NO: 476078 - RNA, 64 nt, Homo Sapiens; identical to SEQ ID NO: 211426

SEQ ID NO: 476079 - RNA, 64 nt, Homo Sapiens; identical to SEQ ID NO: 211427

SEQ ID NO: 476080 - RNA, 64 nt, Homo Sapiens; identical to SEQ ID NO: 211428

SEQ ID NO: 476081 - RNA, 64 nt, Homo Sapiens; identical to SEQ ID NO: 211429

SEQ ID NO: 476082 - RNA, 64 nt, Homo Sapiens; identical to SEQ ID NO: 211430

SEQ ID NO: 476083 - RNA, 64 nt, Homo Sapiens; identical to SEQ ID NO: 211431

SEQ ID NO: 476084 - RNA, 64 nt, Homo Sapiens; identical to SEQ ID NO: 211432

SEQ ID NO: 476085 - RNA, 64 nt, Homo Sapiens; identical to SEQ ID NO: 211433

SEQ ID NO: 476086 - RNA, 64 nt, Homo Sapiens; identical to SEQ ID NO: 211434

SEQ ID NO: 476087 - RNA, 64 nt, Homo Sapiens; identical to SEQ ID NO: 211435

SEQ ID NO: 476088 - RNA, 64 nt, Homo Sapiens; identical to SEQ ID NO: 211436

SEQ ID NO: 476089 - RNA, 64 nt, Homo Sapiens; identical to SEQ ID NO: 211437

SEQ ID NO: 476090 - RNA, 64 nt, Homo Sapiens; identical to SEQ ID NO: 211438

SEQ ID NO: 476091 - RNA, 64 nt, Homo Sapiens; identical to SEQ ID NO: 211439

SEQ ID NO: 476092 - RNA, 64 nt, Homo Sapiens; identical to SEQ ID NO: 211440

SEQ ID NO: 476093 - RNA, 64 nt, Homo Sapiens; identical to SEQ ID NO: 211441

SEQ ID NO: 476094 - RNA, 64 nt, Homo Sapiens; identical to SEQ ID NO: 211442

SEQ ID NO: 476095 - RNA, 64 nt, Homo Sapiens; identical to SEQ ID NO: 211443

SEQ ID NO: 476096 - RNA, 64 nt, Homo Sapiens; identical to SEQ ID NO: 211444

SEQ ID NO: 476097 - RNA, 64 nt, Homo Sapiens; identical to SEQ ID NO: 211445

SEQ ID NO: 476098 - RNA, 64 nt, Homo Sapiens; identical to SEQ ID NO: 211446

SEQ ID NO: 476099 - RNA, 64 nt, Homo Sapiens; identical to SEQ ID NO: 211447

SEQ ID NO: 476100 - RNA, 64 nt, Homo Sapiens; identical to SEQ ID NO: 211448

SEQ ID NO: 476101 - RNA, 64 nt, Homo Sapiens; identical to SEQ ID NO: 211449

SEQ ID NO: 476102 - RNA, 64 nt, Homo Sapiens; identical to SEQ ID NO: 211450

SEQ ID NO: 476103 - RNA, 64 nt, Homo Sapiens; identical to SEQ ID NO: 211451

SEQ ID NO: 476104 - RNA, 64 nt, Homo Sapiens; identical to SEQ ID NO: 211452

SEQ ID NO: 476105 - RNA, 64 nt, Homo Sapiens; identical to SEQ ID NO: 211453

SEQ ID NO: 476106 - RNA, 64 nt, Homo Sapiens; identical to SEQ ID NO: 211454

SEQ ID NO: 476107 - RNA, 64 nt, Homo Sapiens; identical to SEQ ID NO: 211455

SEQ ID NO: 476108 - RNA, 64 nt, Homo Sapiens; identical to SEQ ID NO: 211456

SEQ ID NO: 476109 - RNA, 64 nt, Homo Sapiens; identical to SEQ ID NO: 211457

SEQ ID NO: 476110 - RNA, 64 nt, Homo Sapiens; identical to SEQ ID NO: 211458

SEQ ID NO: 476111 - RNA, 64 nt, Homo Sapiens; identical to SEQ ID NO: 211459

SEQ ID NO: 476112 - RNA, 64 nt, Homo Sapiens; identical to SEQ ID NO: 211460

SEQ ID NO: 476113 - RNA, 64 nt, Homo Sapiens; identical to SEQ ID NO: 211461

SEQ ID NO: 476114 - RNA, 64 nt, Homo Sapiens; identical to SEQ ID NO: 211462

SEQ ID NO: 476115 - RNA, 64 nt, Homo Sapiens; identical to SEQ ID NO: 211463

SEQ ID NO: 476116 - RNA, 64 nt, Homo Sapiens; identical to SEQ ID NO: 211464

SEQ ID NO: 476117 - RNA, 64 nt, Homo Sapiens; identical to SEQ ID NO: 211465

SEQ ID NO: 476118 - RNA, 64 nt, Homo Sapiens; identical to SEQ ID NO: 211466

SEQ ID NO: 476119 - RNA, 64 nt, Homo Sapiens; identical to SEQ ID NO: 211467

SEQ ID NO: 476120 - RNA, 64 nt, Homo Sapiens; identical to SEQ ID NO: 211468

SEQ ID NO: 476121 - RNA, 64 nt, Homo Sapiens; identical to SEQ ID NO: 211469

SEQ ID NO: 476122 - RNA, 64 nt, Homo Sapiens; identical to SEQ ID NO: 211470

SEQ ID NO: 476123 - RNA, 64 nt, Homo Sapiens; identical to SEQ ID NO: 211471

SEQ ID NO: 476124 - RNA, 64 nt, Homo Sapiens; identical to SEQ ID NO: 211472

SEQ ID NO: 476125 - RNA, 64 nt, Homo Sapiens; identical to SEQ ID NO: 211473

SEQ ID NO: 476126 - RNA, 64 nt, Homo Sapiens; identical to SEQ ID NO: 211474

SEQ ID NO: 476127 - RNA, 64 nt, Homo Sapiens; identical to SEQ ID NO: 211475

SEQ ID NO: 476128 - RNA, 64 nt, Homo Sapiens; identical to SEQ ID NO: 211476

SEQ ID NO: 476129 - RNA, 64 nt, Homo Sapiens; identical to SEQ ID NO: 211477

SEQ ID NO: 476130 - RNA, 64 nt, Homo Sapiens; identical to SEQ ID NO: 211478

SEQ ID NO: 476131 - RNA, 64 nt, Homo Sapiens; identical to SEQ ID NO: 211479

SEQ ID NO: 476132 - RNA, 64 nt, Homo Sapiens; identical to SEQ ID NO: 211480

SEQ ID NO: 476133 - RNA, 64 nt, Homo Sapiens; identical to SEQ ID NO: 211481

SEQ ID NO: 476134 - RNA, 64 nt, Homo Sapiens; identical to SEQ ID NO: 211482

SEQ ID NO: 476135 - RNA, 64 nt, Homo Sapiens; identical to SEQ ID NO: 211483

SEQ ID NO: 476136 - RNA, 64 nt, Homo Sapiens; identical to SEQ ID NO: 211484

SEQ ID NO: 476137 - RNA, 64 nt, Homo Sapiens; identical to SEQ ID NO: 211485

SEQ ID NO: 476138 - RNA, 64 nt, Homo Sapiens; identical to SEQ ID NO: 211486

SEQ ID NO: 476139 - RNA, 64 nt, Homo Sapiens; identical to SEQ ID NO: 211487

SEQ ID NO: 476140 - RNA, 64 nt, Homo Sapiens; identical to SEQ ID NO: 211488

SEQ ID NO: 476141 - RNA, 64 nt, Homo Sapiens; identical to SEQ ID NO: 211489

SEQ ID NO: 476142 - RNA, 64 nt, Homo Sapiens; identical to SEQ ID NO: 211490

SEQ ID NO: 476143 - RNA, 64 nt, Homo Sapiens; identical to SEQ ID NO: 211491

SEQ ID NO: 476144 - RNA, 64 nt, Homo Sapiens; identical to SEQ ID NO: 211492

SEQ ID NO: 476145 - RNA, 64 nt, Homo Sapiens; identical to SEQ ID NO: 211493

SEQ ID NO: 476146 - RNA, 64 nt, Homo Sapiens; identical to SEQ ID NO: 211494

SEQ ID NO: 476147 - RNA, 64 nt, Homo Sapiens; identical to SEQ ID NO: 211495

SEQ ID NO: 476148 - RNA, 64 nt, Homo Sapiens; identical to SEQ ID NO: 211496

SEQ ID NO: 476149 - RNA, 64 nt, Homo Sapiens; identical to SEQ ID NO: 211497

SEQ ID NO: 476150 - RNA, 64 nt, Homo Sapiens; identical to SEQ ID NO: 211498

SEQ ID NO: 476151 - RNA, 64 nt, Homo Sapiens; identical to SEQ ID NO: 211499

SEQ ID NO: 476152 - RNA, 64 nt, Homo Sapiens; identical to SEQ ID NO: 211500

SEQ ID NO: 476153 - RNA, 64 nt, Homo Sapiens; identical to SEQ ID NO: 211501

SEQ ID NO: 476154 - RNA, 64 nt, Homo Sapiens; identical to SEQ ID NO: 211502

SEQ ID NO: 476155 - RNA, 64 nt, Homo Sapiens; identical to SEQ ID NO: 211503

SEQ ID NO: 476156 - RNA, 64 nt, Homo Sapiens; identical to SEQ ID NO: 211504

SEQ ID NO: 476157 - RNA, 64 nt, Homo Sapiens; identical to SEQ ID NO: 211505

SEQ ID NO: 476158 - RNA, 64 nt, Homo Sapiens; identical to SEQ ID NO: 211506

SEQ ID NO: 476159 - RNA, 64 nt, Homo Sapiens; identical to SEQ ID NO: 211507

SEQ ID NO: 476160 - RNA, 64 nt, Homo Sapiens; identical to SEQ ID NO: 211508

SEQ ID NO: 476161 - RNA, 64 nt, Homo Sapiens; identical to SEQ ID NO: 211509

SEQ ID NO: 476162 - RNA, 64 nt, Homo Sapiens; identical to SEQ ID NO: 211510

SEQ ID NO: 476163 - RNA, 64 nt, Homo Sapiens; identical to SEQ ID NO: 211511

SEQ ID NO: 476164 - RNA, 64 nt, Homo Sapiens; identical to SEQ ID NO: 211512

SEQ ID NO: 476165 - RNA, 64 nt, Homo Sapiens; identical to SEQ ID NO: 211513

SEQ ID NO: 476166 - RNA, 64 nt, Homo Sapiens; identical to SEQ ID NO: 211514

SEQ ID NO: 476167 - RNA, 64 nt, Homo Sapiens; identical to SEQ ID NO: 211515

SEQ ID NO: 476168 - RNA, 64 nt, Homo Sapiens; identical to SEQ ID NO: 211516

SEQ ID NO: 476169 - RNA, 64 nt, Homo Sapiens; identical to SEQ ID NO: 211517

SEQ ID NO: 476170 - RNA, 64 nt, Homo Sapiens; identical to SEQ ID NO: 211518

SEQ ID NO: 476171 - RNA, 64 nt, Homo Sapiens; identical to SEQ ID NO: 211519

SEQ ID NO: 476172 - RNA, 64 nt, Homo Sapiens; identical to SEQ ID NO: 211520

SEQ ID NO: 476173 - RNA, 64 nt, Homo Sapiens; identical to SEQ ID NO: 211521

SEQ ID NO: 476174 - RNA, 64 nt, Homo Sapiens; identical to SEQ ID NO: 211522

SEQ ID NO: 476175 - RNA, 64 nt, Homo Sapiens; identical to SEQ ID NO: 211523

SEQ ID NO: 476176 - RNA, 64 nt, Homo Sapiens; identical to SEQ ID NO: 211524

SEQ ID NO: 476177 - RNA, 64 nt, Homo Sapiens; identical to SEQ ID NO: 211525

SEQ ID NO: 476178 - RNA, 64 nt, Homo Sapiens; identical to SEQ ID NO: 211526

SEQ ID NO: 476179 - RNA, 64 nt, Homo Sapiens; identical to SEQ ID NO: 211527

SEQ ID NO: 476180 - RNA, 64 nt, Homo Sapiens; identical to SEQ ID NO: 211528

SEQ ID NO: 476181 - RNA, 64 nt, Homo Sapiens; identical to SEQ ID NO: 211529

SEQ ID NO: 476182 - RNA, 64 nt, Homo Sapiens; identical to SEQ ID NO: 211530

SEQ ID NO: 476183 - RNA, 64 nt, Homo Sapiens; identical to SEQ ID NO: 211531

SEQ ID NO: 476184 - RNA, 64 nt, Homo Sapiens; identical to SEQ ID NO: 211532

SEQ ID NO: 476185 - RNA, 64 nt, Homo Sapiens; identical to SEQ ID NO: 211533

SEQ ID NO: 476186 - RNA, 64 nt, Homo Sapiens; identical to SEQ ID NO: 211534

SEQ ID NO: 476187 - RNA, 64 nt, Homo Sapiens; identical to SEQ ID NO: 211535

SEQ ID NO: 476188 - RNA, 64 nt, Homo Sapiens; identical to SEQ ID NO: 211536

SEQ ID NO: 476189 - RNA, 64 nt, Homo Sapiens; identical to SEQ ID NO: 211537

SEQ ID NO: 476190 - RNA, 64 nt, Homo Sapiens; identical to SEQ ID NO: 211538

SEQ ID NO: 476191 - RNA, 64 nt, Homo Sapiens; identical to SEQ ID NO: 211539

SEQ ID NO: 476192 - RNA, 64 nt, Homo Sapiens; identical to SEQ ID NO: 211540

SEQ ID NO: 476193 - RNA, 64 nt, Homo Sapiens; identical to SEQ ID NO: 211541

SEQ ID NO: 476194 - RNA, 64 nt, Homo Sapiens; identical to SEQ ID NO: 211542

SEQ ID NO: 476195 - RNA, 64 nt, Homo Sapiens; identical to SEQ ID NO: 211543

SEQ ID NO: 476196 - RNA, 64 nt, Homo Sapiens; identical to SEQ ID NO: 211544

SEQ ID NO: 476197 - RNA, 64 nt, Homo Sapiens; identical to SEQ ID NO: 211545

SEQ ID NO: 476198 - RNA, 64 nt, Homo Sapiens; identical to SEQ ID NO: 211546

SEQ ID NO: 476199 - RNA, 64 nt, Homo Sapiens; identical to SEQ ID NO: 211547

SEQ ID NO: 476200 - RNA, 64 nt, Homo Sapiens; identical to SEQ ID NO: 211548

SEQ ID NO: 476201 - RNA, 64 nt, Homo Sapiens; identical to SEQ ID NO: 211549

SEQ ID NO: 476202 - RNA, 64 nt, Homo Sapiens; identical to SEQ ID NO: 211550

SEQ ID NO: 476203 - RNA, 64 nt, Homo Sapiens; identical to SEQ ID NO: 211551

SEQ ID NO: 476204 - RNA, 64 nt, Homo Sapiens; identical to SEQ ID NO: 211552

SEQ ID NO: 476205 - RNA, 64 nt, Homo Sapiens; identical to SEQ ID NO: 211553

SEQ ID NO: 476206 - RNA, 64 nt, Homo Sapiens; identical to SEQ ID NO: 211554

SEQ ID NO: 476207 - RNA, 64 nt, Homo Sapiens; identical to SEQ ID NO: 211555

SEQ ID NO: 476208 - RNA, 64 nt, Homo Sapiens; identical to SEQ ID NO: 211556

SEQ ID NO: 476209 - RNA, 64 nt, Homo Sapiens; identical to SEQ ID NO: 211557

SEQ ID NO: 476210 - RNA, 64 nt, Homo Sapiens; identical to SEQ ID NO: 211558

SEQ ID NO: 476211 - RNA, 64 nt, Homo Sapiens; identical to SEQ ID NO: 211559

SEQ ID NO: 476212 - RNA, 64 nt, Homo Sapiens; identical to SEQ ID NO: 211560

SEQ ID NO: 476213 - RNA, 64 nt, Homo Sapiens; identical to SEQ ID NO: 126810

SEQ ID NO: 476214 - RNA, 64 nt, Homo Sapiens; identical to SEQ ID NO: 126811

SEQ ID NO: 476215 - RNA, 64 nt, Homo Sapiens; identical to SEQ ID NO: 126812

SEQ ID NO: 476216 - RNA, 64 nt, Homo Sapiens; identical to SEQ ID NO: 126813

SEQ ID NO: 476217 - RNA, 64 nt, Homo Sapiens; identical to SEQ ID NO: 126814

SEQ ID NO: 476218 - RNA, 64 nt, Homo Sapiens; identical to SEQ ID NO: 126815

SEQ ID NO: 476219 - RNA, 64 nt, Homo Sapiens; identical to SEQ ID NO: 126816

SEQ ID NO: 476220 - RNA, 64 nt, Homo Sapiens; identical to SEQ ID NO: 126817

SEQ ID NO: 476221 - RNA, 64 nt, Homo Sapiens; identical to SEQ ID NO: 126818

SEQ ID NO: 476222 - RNA, 64 nt, Homo Sapiens; identical to SEQ ID NO: 126819

SEQ ID NO: 476223 - RNA, 64 nt, Homo Sapiens; identical to SEQ ID NO: 126820

SEQ ID NO: 476224 - RNA, 64 nt, Homo Sapiens; identical to SEQ ID NO: 126821

SEQ ID NO: 476225 - RNA, 64 nt, Homo Sapiens; identical to SEQ ID NO: 126822

SEQ ID NO: 476226 - RNA, 64 nt, Homo Sapiens; identical to SEQ ID NO: 126823

SEQ ID NO: 476227 - RNA, 64 nt, Homo Sapiens; identical to SEQ ID NO: 126824

SEQ ID NO: 476228 - RNA, 64 nt, Homo Sapiens; identical to SEQ ID NO: 126825

SEQ ID NO: 476229 - RNA, 64 nt, Homo Sapiens; identical to SEQ ID NO: 126826

SEQ ID NO: 476230 - RNA, 64 nt, Homo Sapiens; identical to SEQ ID NO: 126827

SEQ ID NO: 476231 - RNA, 64 nt, Homo Sapiens; identical to SEQ ID NO: 126828

SEQ ID NO: 476232 - RNA, 64 nt, Homo Sapiens
aaaauauuuuacauuucaugcucauauaguaugaacaaacuauaaaagucauuuaaaauagaac

SEQ ID NO: 476233 - RNA, 64 nt, Homo Sapiens
auuuuaauauaaagaaauguucuaaaagaaauguacaaacuagacaaaguaacauguaauuguu

SEQ ID NO: 476234 - RNA, 63 nt, Homo Sapiens
auucaacaaccaggguauagccagauaagagaaacaaacuauuuuuuuugauggauugcagua

SEQ ID NO: 476235 - RNA, 64 nt, Homo Sapiens
auaguuuauaagauaaugcaaagaacuuucucugacaaacuaacugcaguaacagaaaccuuuc

SEQ ID NO: 476236 - RNA, 64 nt, Homo Sapiens
gauugcauuugaaagagauucauuuuaguuuaauacaaacuaauaccugagacuugccgucugg

SEQ ID NO: 476237 - RNA, 64 nt, Homo Sapiens
ugcuuguaaauaauuuauuaccacauaagguuaaacaaacuagguuuuccaacagugauggcuu

SEQ ID NO: 476238 - RNA, 64 nt, Homo Sapiens
gagccuaaaugugcaaauuaaaacuauuuuauaaacaaacuacaugcuaagagugguuugugua

SEQ ID NO: 476239 - RNA, 64 nt, Homo Sapiens
aaagauuccuccacugacuauggacauugaacaaacaaacuaccgaagaaagagucuuuguaaa

SEQ ID NO: 476240 - RNA, 64 nt, Homo Sapiens
uuaguaauagccuggguuaaaaucaucaaguaauacaaacuaauagguaauacaaacuauauau

SEQ ID NO: 476241 - RNA, 64 nt, Homo Sapiens
uauaaucaucaaguaauacauagauucagguaauacaaacuauaacaauucauuguguuaccug

SEQ ID NO: 476242 - RNA, 64 nt, Homo Sapiens
ugggcaacagagcaagaccuugucucaaaaauaaacaaacuaaaauuaaaaaaagaagacgaga

SEQ ID NO: 476243 - RNA, 64 nt, Homo Sapiens
ggcagaggcagagaugggagugaugcggacggacacaaacuaagggaugccacgaugccaagca

SEQ ID NO: 476244 - RNA, 64 nt, Homo Sapiens
uuacucuggauguuugguauuuuuuuacauuaaaacaaacuaaagcaaaauuuagaagaaagaa

SEQ ID NO: 476245 - RNA, 64 nt, Homo Sapiens
aucuaaucauuuuuaugacaaauugcagcaccaaacaaacuaauagcaacccauggcugugauu

SEQ ID NO: 476246 - RNA, 64 nt, Homo Sapiens; identical to SEQ ID NO: 155381

SEQ ID NO: 476247 - RNA, 64 nt, Homo Sapiens; identical to SEQ ID NO: 155382

SEQ ID NO: 476248 - RNA, 64 nt, Homo Sapiens; identical to SEQ ID NO: 104346

SEQ ID NO: 476249 - RNA, 64 nt, Homo Sapiens; identical to SEQ ID NO: 104347

SEQ ID NO: 476250 - RNA, 64 nt, Homo Sapiens; identical to SEQ ID NO: 104348

SEQ ID NO: 476251 - RNA, 64 nt, Homo Sapiens; identical to SEQ ID NO: 104349

SEQ ID NO: 476252 - RNA, 64 nt, Homo Sapiens; identical to SEQ ID NO: 104350

SEQ ID NO: 476253 - RNA, 64 nt, Homo Sapiens; identical to SEQ ID NO: 104351

SEQ ID NO: 476254 - RNA, 64 nt, Homo Sapiens; identical to SEQ ID NO: 104352

SEQ ID NO: 476255 - RNA, 64 nt, Homo Sapiens; identical to SEQ ID NO: 104353

SEQ ID NO: 476256 - RNA, 64 nt, Homo Sapiens; identical to SEQ ID NO: 104354

SEQ ID NO: 476257 - RNA, 64 nt, Homo Sapiens; identical to SEQ ID NO: 104355

SEQ ID NO: 476258 - RNA, 64 nt, Homo Sapiens; identical to SEQ ID NO: 104356

SEQ ID NO: 476259 - RNA, 64 nt, Homo Sapiens; identical to SEQ ID NO: 104357

SEQ ID NO: 476260 - RNA, 64 nt, Homo Sapiens; identical to SEQ ID NO: 104358

SEQ ID NO: 476261 - RNA, 64 nt, Homo Sapiens; identical to SEQ ID NO: 104359

SEQ ID NO: 476262 - RNA, 64 nt, Homo Sapiens; identical to SEQ ID NO: 104360

SEQ ID NO: 476263 - RNA, 64 nt, Homo Sapiens; identical to SEQ ID NO: 104361

SEQ ID NO: 476264 - RNA, 64 nt, Homo Sapiens; identical to SEQ ID NO: 104362

SEQ ID NO: 476265 - RNA, 64 nt, Homo Sapiens; identical to SEQ ID NO: 104363

SEQ ID NO: 476266 - RNA, 64 nt, Homo Sapiens; identical to SEQ ID NO: 104364

SEQ ID NO: 476267 - RNA, 64 nt, Homo Sapiens; identical to SEQ ID NO: 104365

SEQ ID NO: 476268 - RNA, 64 nt, Homo Sapiens; identical to SEQ ID NO: 104366

SEQ ID NO: 476269 - RNA, 64 nt, Homo Sapiens; identical to SEQ ID NO: 104367

SEQ ID NO: 476270 - RNA, 64 nt, Homo Sapiens; identical to SEQ ID NO: 104368

SEQ ID NO: 476271 - RNA, 64 nt, Homo Sapiens; identical to SEQ ID NO: 104369

SEQ ID NO: 476272 - RNA, 64 nt, Homo Sapiens; identical to SEQ ID NO: 104370

SEQ ID NO: 476273 - RNA, 64 nt, Homo Sapiens; identical to SEQ ID NO: 104371

SEQ ID NO: 476274 - RNA, 64 nt, Homo Sapiens; identical to SEQ ID NO: 104372

SEQ ID NO: 476275 - RNA, 64 nt, Homo Sapiens; identical to SEQ ID NO: 104373

SEQ ID NO: 476276 - RNA, 64 nt, Homo Sapiens; identical to SEQ ID NO: 104374

SEQ ID NO: 476277 - RNA, 64 nt, Homo Sapiens; identical to SEQ ID NO: 104375

SEQ ID NO: 476278 - RNA, 64 nt, Homo Sapiens; identical to SEQ ID NO: 104376

SEQ ID NO: 476279 - RNA, 64 nt, Homo Sapiens; identical to SEQ ID NO: 104377

SEQ ID NO: 476280 - RNA, 64 nt, Homo Sapiens; identical to SEQ ID NO: 104378

SEQ ID NO: 476281 - RNA, 64 nt, Homo Sapiens; identical to SEQ ID NO: 104379

SEQ ID NO: 476282 - RNA, 64 nt, Homo Sapiens; identical to SEQ ID NO: 104380

SEQ ID NO: 476283 - RNA, 64 nt, Homo Sapiens; identical to SEQ ID NO: 104381

SEQ ID NO: 476284 - RNA, 64 nt, Homo Sapiens; identical to SEQ ID NO: 104382

SEQ ID NO: 476285 - RNA, 64 nt, Homo Sapiens; identical to SEQ ID NO: 104383

SEQ ID NO: 476286 - RNA, 64 nt, Homo Sapiens; identical to SEQ ID NO: 104384

SEQ ID NO: 476287 - RNA, 64 nt, Homo Sapiens; identical to SEQ ID NO: 104385

SEQ ID NO: 476288 - RNA, 64 nt, Homo Sapiens; identical to SEQ ID NO: 104386

SEQ ID NO: 476289 - RNA, 64 nt, Homo Sapiens; identical to SEQ ID NO: 104387

SEQ ID NO: 476290 - RNA, 64 nt, Homo Sapiens; identical to SEQ ID NO: 104388

SEQ ID NO: 476291 - RNA, 64 nt, Homo Sapiens; identical to SEQ ID NO: 104389

SEQ ID NO: 476292 - RNA, 64 nt, Homo Sapiens; identical to SEQ ID NO: 104390

SEQ ID NO: 476293 - RNA, 64 nt, Homo Sapiens; identical to SEQ ID NO: 104391

SEQ ID NO: 476294 - RNA, 64 nt, Homo Sapiens; identical to SEQ ID NO: 104392

SEQ ID NO: 476295 - RNA, 64 nt, Homo Sapiens; identical to SEQ ID NO: 104393

SEQ ID NO: 476296 - RNA, 64 nt, Homo Sapiens; identical to SEQ ID NO: 104394

SEQ ID NO: 476297 - RNA, 64 nt, Homo Sapiens; identical to SEQ ID NO: 104395

SEQ ID NO: 476298 - RNA, 64 nt, Homo Sapiens; identical to SEQ ID NO: 104396

SEQ ID NO: 476299 - RNA, 64 nt, Homo Sapiens; identical to SEQ ID NO: 104397

SEQ ID NO: 476300 - RNA, 64 nt, Homo Sapiens; identical to SEQ ID NO: 104398

SEQ ID NO: 476301 - RNA, 64 nt, Homo Sapiens; identical to SEQ ID NO: 104399

SEQ ID NO: 476302 - RNA, 64 nt, Homo Sapiens; identical to SEQ ID NO: 104400

SEQ ID NO: 476303 - RNA, 64 nt, Homo Sapiens; identical to SEQ ID NO: 104401

SEQ ID NO: 476304 - RNA, 64 nt, Homo Sapiens; identical to SEQ ID NO: 104402

SEQ ID NO: 476305 - RNA, 64 nt, Homo Sapiens; identical to SEQ ID NO: 104403

SEQ ID NO: 476306 - RNA, 64 nt, Homo Sapiens; identical to SEQ ID NO: 104404

SEQ ID NO: 476307 - RNA, 64 nt, Homo Sapiens; identical to SEQ ID NO: 104405

SEQ ID NO: 476308 - RNA, 64 nt, Homo Sapiens; identical to SEQ ID NO: 104406

SEQ ID NO: 476309 - RNA, 64 nt, Homo Sapiens; identical to SEQ ID NO: 104407

SEQ ID NO: 476310 - RNA, 64 nt, Homo Sapiens; identical to SEQ ID NO: 104408

SEQ ID NO: 476311 - RNA, 64 nt, Homo Sapiens; identical to SEQ ID NO: 104409

SEQ ID NO: 476312 - RNA, 64 nt, Homo Sapiens; identical to SEQ ID NO: 104410

SEQ ID NO: 476313 - RNA, 64 nt, Homo Sapiens; identical to SEQ ID NO: 104411

SEQ ID NO: 476314 - RNA, 64 nt, Homo Sapiens; identical to SEQ ID NO: 104412

SEQ ID NO: 476315 - RNA, 64 nt, Homo Sapiens; identical to SEQ ID NO: 104413

SEQ ID NO: 476316 - RNA, 64 nt, Homo Sapiens; identical to SEQ ID NO: 104414

SEQ ID NO: 476317 - RNA, 64 nt, Homo Sapiens; identical to SEQ ID NO: 104415

SEQ ID NO: 476318 - RNA, 64 nt, Homo Sapiens; identical to SEQ ID NO: 104416

SEQ ID NO: 476319 - RNA, 64 nt, Homo Sapiens; identical to SEQ ID NO: 104417

SEQ ID NO: 476320 - RNA, 64 nt, Homo Sapiens; identical to SEQ ID NO: 104418

SEQ ID NO: 476321 - RNA, 64 nt, Homo Sapiens; identical to SEQ ID NO: 104419

SEQ ID NO: 476322 - RNA, 64 nt, Homo Sapiens; identical to SEQ ID NO: 104420

SEQ ID NO: 476323 - RNA, 64 nt, Homo Sapiens; identical to SEQ ID NO: 104421

SEQ ID NO: 476324 - RNA, 64 nt, Homo Sapiens; identical to SEQ ID NO: 104422

SEQ ID NO: 476325 - RNA, 64 nt, Homo Sapiens; identical to SEQ ID NO: 104423

SEQ ID NO: 476326 - RNA, 64 nt, Homo Sapiens; identical to SEQ ID NO: 104424

SEQ ID NO: 476327 - RNA, 64 nt, Homo Sapiens; identical to SEQ ID NO: 104425

SEQ ID NO: 476328 - RNA, 64 nt, Homo Sapiens
gccuugaaacaguuccauuuaugcugguuaagagaucccuuaagaaguuagaaggcuuaagaac

SEQ ID NO: 476329 - RNA, 64 nt, Homo Sapiens
aaguuagaaggcuuaagaacugcuucaugugaacaucccuuauuaguuacaaaguuauauucac

SEQ ID NO: 476330 - RNA, 64 nt, Homo Sapiens
ggcuuacaugauuuuauugcauuucuccuagaacaucccuuauugugcaacaguaguaggauau

SEQ ID NO: 476331 - RNA, 64 nt, Homo Sapiens
guagacauucauaaaaacuuuaugcauuaguuaaaucccuuaaaucuuauucuuuggucuuuca

SEQ ID NO: 476332 - RNA, 64 nt, Homo Sapiens
uuugaguccagcaugggcaacauaacaagaccccaucccuuauuaaaagaaaaaaaaauaauuc

SEQ ID NO: 476333 - RNA, 64 nt, Homo Sapiens
caccuuaccaauauaugacauuaagugagagugaaucccuuaggacuggaacacuucaagcuca

SEQ ID NO: 476334 - RNA, 64 nt, Homo Sapiens
guaucuguuuuguaagucuguaaugcaauuaauuaucccuuaauuaaaguaaagcacccuuuug

SEQ ID NO: 476335 - RNA, 64 nt, Homo Sapiens
gccuauaauggaauaugugaguuggaccuggaauaucccuuauuaagcaagguuguggccuuag

SEQ ID NO: 476336 - RNA, 64 nt, Homo Sapiens
gucaauaaaugugggaaagccuuugucaguauuaaucccuuaauugaccuaaguauacucacac

SEQ ID NO: 476337 - RNA, 64 nt, Homo Sapiens
uuagaaauugaaggaauuuuucaguuccaagugcaucccuuauucuauaggaaauaaacuggag

SEQ ID NO: 476338 - RNA, 64 nt, Homo Sapiens
aguauauaaaguuuugccccaugauaaaauaaguaacauauaaauuaauacauaaguuaauauu

SEQ ID NO: 476339 - RNA, 64 nt, Homo Sapiens
gaaggcaacaccuguggauaaaacauuagaagaaaacauauauuuuauuuucauacuuuugaua

SEQ ID NO: 476340 - RNA, 64 nt, Homo Sapiens
auauauuuaguguuuuauagaauuuuuuaaaguuaacauauaauguagauauuaauuuuuuccu

SEQ ID NO: 476341 - RNA, 64 nt, Homo Sapiens
gugguagcauuaucuuagacauuaaauuugaaguaacauauauccuguaguaacauagacccaa

SEQ ID NO: 476342 - RNA, 64 nt, Homo Sapiens
cgauuuagcagugucagcguuucuuuauugcaaaaacauauacccaguuguauauugaccagug

SEQ ID NO: 476343 - RNA, 64 nt, Homo Sapiens
guguuuaaaauagcauuucuaaaaacagcagaccaacauauagaaagaaugcauuauuccacaa

SEQ ID NO: 476344 - RNA, 64 nt, Homo Sapiens
uauauauacauauauauaaaagucuuuuguacauaacauauauaaauggugccugauaucucaa

SEQ ID NO: 476345 - RNA, 64 nt, Homo Sapiens
gauguggaaagcacauauauuagacuuuuauuaaaacauauauggaaacaaaagacauagaugg

SEQ ID NO: 476346 - RNA, 64 nt, Homo Sapiens
uuuuucuugagucucaagguuuuauacauucacaaacauauacacagaauuuguccuuuuuggu

SEQ ID NO: 476347 - RNA, 64 nt, Homo Sapiens
cuaaugaagaucauauacgugaaaauuauuugaaaacauauaaagcacuauacagauucgaaac

SEQ ID NO: 476348 - RNA, 64 nt, Homo Sapiens
acccaugaacuuaaaaugaaaguuaaaaauaaaaaacauauacaaauaaaaaaaucccgacuuu

SEQ ID NO: 476349 - RNA, 64 nt, Homo Sapiens
ugaugggacaagaagaauaguauuuauuuaauaaaacauauauuauauugaacuauguguuaau

SEQ ID NO: 476350 - RNA, 64 nt, Homo Sapiens
auuccuuuuauuuggaggguuuuacuuccuuguuaacauauaaaguuauaaaugaaggacaagg

SEQ ID NO: 476351 - RNA, 64 nt, Homo Sapiens
uuauuuccuagcuuuucugaauuaaugcacucuuaacauauaauuauauuaauccuauuugugc

SEQ ID NO: 476352 - RNA, 64 nt, Homo Sapiens
aaaauuauuuuuauuuuuaaaaaauuaugguaaaaacauauaaaauuuaccaucuuaaucacuu

SEQ ID NO: 476353 - RNA, 64 nt, Homo Sapiens
guaugcgaaagaguugauauuuuucccaccuggaaacauauacucuuuuucaaauaucccugcc

SEQ ID NO: 476354 - RNA, 64 nt, Homo Sapiens
ggccaaggaaaucugcauguuguagaaaauucauaacauauauauuuuucugaucggucguguu

SEQ ID NO: 476355 - RNA, 64 nt, Homo Sapiens
acccaccaugcugcuugaaagccacuugauccucaacauauacuauaauugcaaaggaaacaug

SEQ ID NO: 476356 - RNA, 64 nt, Homo Sapiens
uauuguguagucguuagcaagaucaucauaggcaaacauauauccguuccaaggcuaaaaguga

SEQ ID NO: 476357 - RNA, 64 nt, Homo Sapiens
ccugggcaacagagcgaggucccguuucuuaaaaaacauauauguguguggcguguguauauau

SEQ ID NO: 476358 - RNA, 64 nt, Homo Sapiens
auauuuuuucauuguauuauuacggagacuuucaaacauauauagaaagagcauaaugaagccu

SEQ ID NO: 476359 - RNA, 64 nt, Homo Sapiens
acuacaucguuggcuuuugaccuugcugaaaaggaacauauaauuguauggaugguaggauuaa

SEQ ID NO: 476360 - RNA, 64 nt, Homo Sapiens
ucuguuaccacuguuagagggaguuguaucauuuaacauauaguaggauaguuuaaguguaggg

SEQ ID NO: 476361 - RNA, 64 nt, Homo Sapiens
caaacauacacucacacacacaauuacuauguauaacauauaugaacauauauuauuauuaccu

SEQ ID NO: 476362 - RNA, 64 nt, Homo Sapiens
cucacacacacaauuacuauguauaacauauaugaacauauauuauuauuaccuaauauaugua

SEQ ID NO: 476363 - RNA, 64 nt, Homo Sapiens
uauaccuagcugucauaugaaggaaaugcaaagaaacauauauuuuauuaacuggugauuauau

SEQ ID NO: 476364 - RNA, 64 nt, Homo Sapiens
gccuuuuauuaacauguuuaugguacugcauagauacggguauuuauuuuacccuaagaagauu

SEQ ID NO: 476365 - RNA, 64 nt, Homo Sapiens
ucuucuuacuucacccggcugggcuccucauuuuuacggguaacagugaggcugggaaggggaa

SEQ ID NO: 476366 - RNA, 64 nt, Homo Sapiens
uuugcauuuggucacugauacaaagcacuguuaguacggguaugcaaaaggguaugucauggac

SEQ ID NO: 476367 - RNA, 64 nt, Homo Sapiens
acgaauguuugggguuuauguuuuuuaagguaaauacggguauuguuuuuaauuauuaccaugu

SEQ ID NO: 476368 - RNA, 64 nt, Homo Sapiens
ucuaaacuuguuugaugugacuuuuaauuuuaaauacggguaacaaucugaggcaauaucacua

SEQ ID NO: 476369 - RNA, 64 nt, Homo Sapiens
cccacuucccacccugccccucagagacugaaauuacggguaccugaagaugggagccuuuacc

SEQ ID NO: 476370 - RNA, 64 nt, Homo Sapiens
ucuauuuucagagcaugauauuauguccauaagcuacggguagggagguuucugcauagagucu

SEQ ID NO: 476371 - RNA, 64 nt, Homo Sapiens
guggcuguggucuacagaauuguuucauauaaaauacggguagagugguagaguuucaaaacuu

SEQ ID NO: 476372 - RNA, 64 nt, Homo Sapiens
cagauugagcauggcucucuugaauuucaguccuuacggguaaacuuaaauguguacauguagu

SEQ ID NO: 476373 - RNA, 64 nt, Homo Sapiens
aaacauaagaacuaucauaagaagaaauaaaaacuacggguagauaucacaaaucuuuuacgca

SEQ ID NO: 476374 - RNA, 64 nt, Homo Sapiens
cucgguggagggacgcgugcggcgggacggugccuacggguacuugcagcugugucccaugugg

SEQ ID NO: 476375 - RNA, 64 nt, Homo Sapiens
acucauccauuaucuuggcugugagcuccuuggguacggguaccuuguauguuuacuuuuauau

SEQ ID NO: 476376 - RNA, 64 nt, Homo Sapiens
cguguguuuucuggaugcugccguaucaggaacguacggguaaauggaguugugacugccgggg

SEQ ID NO: 476377 - RNA, 64 nt, Homo Sapiens
uuuaaagauucuccaaaaaguuaagaaaugaaaauacggguauuauuuuauuuuauuuuuauau

SEQ ID NO: 476378 - RNA, 64 nt, Homo Sapiens
ugcacuggggagguggcugccucccuucagagauuacggguacuuuuccugcucagcagagccc

SEQ ID NO: 476379 - RNA, 64 nt, Homo Sapiens
gcucccuguggacaaaagcacauaauucugcuguuacggguacuuugcucauacgagcuuucau

SEQ ID NO: 476380 - RNA, 64 nt, Homo Sapiens
aacaaagaaaagcacaacuugagauuuuuguuguuacggguauucagccuucagucaccgucug

SEQ ID NO: 476381 - RNA, 64 nt, Homo Sapiens
gccuaaaaggucaccccucgguauuaaaauagcuuacggguaaggaagaggggggugagcaggu

SEQ ID NO: 476382 - RNA, 64 nt, Homo Sapiens
cuuugaaagugcuuguuugggggagggaaggacauacggguaacuagaacuacccagcgagucg

SEQ ID NO: 476383 - RNA, 64 nt, Homo Sapiens
uuugugggaauagaaaaaaaggaaaguguuaacuuacggguauuaauaccuugaacgcuuaugu

SEQ ID NO: 476384 - RNA, 64 nt, Homo Sapiens; identical to SEQ ID NO: 95461

SEQ ID NO: 476385 - RNA, 64 nt, Homo Sapiens; identical to SEQ ID NO: 95462

SEQ ID NO: 476386 - RNA, 64 nt, Homo Sapiens; identical to SEQ ID NO: 95463

SEQ ID NO: 476387 - RNA, 64 nt, Homo Sapiens; identical to SEQ ID NO: 95464

SEQ ID NO: 476388 - RNA, 64 nt, Homo Sapiens; identical to SEQ ID NO: 119429

SEQ ID NO: 476389 - RNA, 64 nt, Homo Sapiens; identical to SEQ ID NO: 119430

SEQ ID NO: 476390 - RNA, 64 nt, Homo Sapiens; identical to SEQ ID NO: 119431

SEQ ID NO: 476391 - RNA, 64 nt, Homo Sapiens; identical to SEQ ID NO: 119432

SEQ ID NO: 476392 - RNA, 64 nt, Homo Sapiens; identical to SEQ ID NO: 119433

SEQ ID NO: 476393 - RNA, 64 nt, Homo Sapiens; identical to SEQ ID NO: 119434

SEQ ID NO: 476394 - RNA, 64 nt, Homo Sapiens; identical to SEQ ID NO: 119435

SEQ ID NO: 476395 - RNA, 64 nt, Homo Sapiens; identical to SEQ ID NO: 119436

SEQ ID NO: 476396 - RNA, 64 nt, Homo Sapiens; identical to SEQ ID NO: 155596

SEQ ID NO: 476397 - RNA, 64 nt, Homo Sapiens; identical to SEQ ID NO: 155597

SEQ ID NO: 476398 - RNA, 64 nt, Homo Sapiens; identical to SEQ ID NO: 155598

SEQ ID NO: 476399 - RNA, 64 nt, Homo Sapiens; identical to SEQ ID NO: 155599

SEQ ID NO: 476400 - RNA, 64 nt, Homo Sapiens; identical to SEQ ID NO: 155600

SEQ ID NO: 476401 - RNA, 64 nt, Homo Sapiens; identical to SEQ ID NO: 155601

SEQ ID NO: 476402 - RNA, 64 nt, Homo Sapiens; identical to SEQ ID NO: 155602

SEQ ID NO: 476403 - RNA, 64 nt, Homo Sapiens; identical to SEQ ID NO: 155603

SEQ ID NO: 476404 - RNA, 64 nt, Homo Sapiens; identical to SEQ ID NO: 155604

SEQ ID NO: 476405 - RNA, 64 nt, Homo Sapiens; identical to SEQ ID NO: 155605

SEQ ID NO: 476406 - RNA, 64 nt, Homo Sapiens; identical to SEQ ID NO: 155606

SEQ ID NO: 476407 - RNA, 64 nt, Homo Sapiens; identical to SEQ ID NO: 155607

SEQ ID NO: 476408 - RNA, 64 nt, Homo Sapiens; identical to SEQ ID NO: 155608

SEQ ID NO: 476409 - RNA, 64 nt, Homo Sapiens; identical to SEQ ID NO: 155609

SEQ ID NO: 476410 - RNA, 64 nt, Homo Sapiens; identical to SEQ ID NO: 155610

SEQ ID NO: 476411 - RNA, 64 nt, Homo Sapiens; identical to SEQ ID NO: 155611

SEQ ID NO: 476412 - RNA, 64 nt, Homo Sapiens; identical to SEQ ID NO: 155612

SEQ ID NO: 476413 - RNA, 64 nt, Homo Sapiens; identical to SEQ ID NO: 155613

SEQ ID NO: 476414 - RNA, 64 nt, Homo Sapiens; identical to SEQ ID NO: 155614

SEQ ID NO: 476415 - RNA, 64 nt, Homo Sapiens; identical to SEQ ID NO: 155615

SEQ ID NO: 476416 - RNA, 64 nt, Homo Sapiens; identical to SEQ ID NO: 155616

SEQ ID NO: 476417 - RNA, 64 nt, Homo Sapiens; identical to SEQ ID NO: 155617

SEQ ID NO: 476418 - RNA, 64 nt, Homo Sapiens; identical to SEQ ID NO: 155618

SEQ ID NO: 476419 - RNA, 64 nt, Homo Sapiens; identical to SEQ ID NO: 155619

SEQ ID NO: 476420 - RNA, 64 nt, Homo Sapiens; identical to SEQ ID NO: 155620

SEQ ID NO: 476421 - RNA, 64 nt, Homo Sapiens; identical to SEQ ID NO: 155621

SEQ ID NO: 476422 - RNA, 64 nt, Homo Sapiens; identical to SEQ ID NO: 155622

SEQ ID NO: 476423 - RNA, 64 nt, Homo Sapiens; identical to SEQ ID NO: 155623

SEQ ID NO: 476424 - RNA, 64 nt, Homo Sapiens; identical to SEQ ID NO: 155624

SEQ ID NO: 476425 - RNA, 64 nt, Homo Sapiens; identical to SEQ ID NO: 155625

SEQ ID NO: 476426 - RNA, 64 nt, Homo Sapiens; identical to SEQ ID NO: 155626

SEQ ID NO: 476427 - RNA, 64 nt, Homo Sapiens
aaugacagcuucacagccccuugaggagugaccaagccacaaaguaaauccuaaagccacaacc

SEQ ID NO: 476428 - RNA, 64 nt, Homo Sapiens
uugaggagugaccaagccacaaaguaaauccuaaagccacaaccccuucuaccacugagcugcu

SEQ ID NO: 476429 - RNA, 64 nt, Homo Sapiens
uagauuacauaauuagcagaauccaauauuuuaaagccacaaagaguagucuuaaaaucaaagu

SEQ ID NO: 476430 - RNA, 64 nt, Homo Sapiens
augccacauguuaguauaucgaaugugccuaugaagccacaaaguagauaaauguguguugaau

SEQ ID NO: 476431 - RNA, 64 nt, Homo Sapiens
cgguagucuguggaaaccaggaagauaaaacaacagccacaaaagagaaaaucaagaguguugc

SEQ ID NO: 476432 - RNA, 64 nt, Homo Sapiens
uugugucuuacagucaaguuuguagauuuucauaagccacaauuuuaaaagaugcaguaaucuu

SEQ ID NO: 476433 - RNA, 64 nt, Homo Sapiens
uaacaaaauggacaugguggcuuuguuuagguagagccacaaaagaaaagacuuguaauauuuu

SEQ ID NO: 476434 - RNA, 64 nt, Homo Sapiens
guacaggaacugcauugacuuucaguaaacauaaagccacaacuccuacaugauguuauguacc

SEQ ID NO: 476435 - RNA, 64 nt, Homo Sapiens
guagccuggcccagcuucuaaagaggaccuucguagccacaaggcaugcuaaaccucuaggguc

SEQ ID NO: 476436 - RNA, 64 nt, Homo Sapiens
guuuacauuggccuuugguuuuuuuuuuucuuucagccacaacuauaugcugauauaacucagc

SEQ ID NO: 476437 - RNA, 64 nt, Homo Sapiens
gggcccagacuauugcagccccuguacccgcagcagccacaaguagcuuuuaacuggugccuuc

SEQ ID NO: 476438 - RNA, 64 nt, Homo Sapiens
agaaaaaggacaaggacaugccugaacuuaagauagccacaaucagaaucaaucagaccuucuc

SEQ ID NO: 476439 - RNA, 64 nt, Homo Sapiens
accuuucucugacauaguucuuggcaugggagccagccacaaaugagauucugacguguccagg

SEQ ID NO: 476440 - RNA, 64 nt, Homo Sapiens
uauuuucccucuuccccuuuauaaauuaugcuaaagccacaaagcacauuuuuggggaucauag

SEQ ID NO: 476441 - RNA, 64 nt, Homo Sapiens
cacucuugacccuacacugaaggcugaaggcagaagccacaagaggccuugagugccaccccca

SEQ ID NO: 476442 - RNA, 64 nt, Homo Sapiens
caagccccugcccauggcccaauggggagccuccagccacaaguucccuguccuuaucagccac

SEQ ID NO: 476443 - RNA, 64 nt, Homo Sapiens
auauaaaucauuucaagacuucuauauggcaaauagccacaauuuuccucuuucuucauucaga

SEQ ID NO: 476444 - RNA, 64 nt, Homo Sapiens
ugaccccuucgugguuauaggcccccaucacccaagccacaagcgccacccuuugguuauuuca

SEQ ID NO: 476445 - RNA, 64 nt, Homo Sapiens
ugaaccaaaucaagaauggaaucccauucacaguagccacaaaaaguauaaaauaccuaggaau

SEQ ID NO: 476446 - RNA, 64 nt, Homo Sapiens
uuaauaucgcuaaucauuaaggaaaugcaaucaaagccacaaugagauaccaucucagaccugu

SEQ ID NO: 476447 - RNA, 64 nt, Homo Sapiens
aagaaaaacaguguuaaucuguaguugaaagaaagcuuaguagaugagagaguucuaggcuacu

SEQ ID NO: 476448 - RNA, 64 nt, Homo Sapiens
gcuuuaagcagugaaguuauccuaaugcaaaagagcuuaguagaaaaugagugguuuaccuuuu

SEQ ID NO: 476449 - RNA, 64 nt, Homo Sapiens
guugagggaagguucuucaugauccacacuuugggcuuaguauuucucaggaagagcuauggcc

SEQ ID NO: 476450 - RNA, 64 nt, Homo Sapiens
ucuuaaaugcaagugccuagauuagguagacuuugcuuaguauugacaacugcacaugaaaguu

SEQ ID NO: 476451 - RNA, 64 nt, Homo Sapiens
accaucuggguugcucaaguuaaaagucacagcugcuuaguacacuuucuuuguacaguggggg

SEQ ID NO: 476452 - RNA, 64 nt, Homo Sapiens
gcccucaauucauagagguuaagcaaaguugcuggcuuaguagauaucaccucuuuccagaacg

SEQ ID NO: 476453 - RNA, 64 nt, Homo Sapiens
agcacugccgcucaacagacaugacucagggauggcuuaguacugccccucagcagggaugacu

SEQ ID NO: 476454 - RNA, 64 nt, Homo Sapiens
agcacugccgcucaacagggaugacucagggauggcuuaguacugccccucaacagggaugacu

SEQ ID NO: 476455 - RNA, 64 nt, Homo Sapiens; identical to SEQ ID NO: 476453

SEQ ID NO: 476456 - RNA, 64 nt, Homo Sapiens; identical to SEQ ID NO: 476453

SEQ ID NO: 476457 - RNA, 64 nt, Homo Sapiens; identical to SEQ ID NO: 238476

SEQ ID NO: 476458 - RNA, 64 nt, Homo Sapiens; identical to SEQ ID NO: 238477

SEQ ID NO: 476459 - RNA, 53 nt, Homo Sapiens; identical to SEQ ID NO: 238478

SEQ ID NO: 476460 - RNA, 64 nt, Homo Sapiens; identical to SEQ ID NO: 238479

SEQ ID NO: 476461 - RNA, 64 nt, Homo Sapiens; identical to SEQ ID NO: 238480

SEQ ID NO: 476462 - RNA, 64 nt, Homo Sapiens; identical to SEQ ID NO: 238481

SEQ ID NO: 476463 - RNA, 64 nt, Homo Sapiens; identical to SEQ ID NO: 238482

SEQ ID NO: 476464 - RNA, 64 nt, Homo Sapiens; identical to SEQ ID NO: 238483

SEQ ID NO: 476465 - RNA, 64 nt, Homo Sapiens; identical to SEQ ID NO: 238484

SEQ ID NO: 476466 - RNA, 64 nt, Homo Sapiens; identical to SEQ ID NO: 238485

SEQ ID NO: 476467 - RNA, 64 nt, Homo Sapiens; identical to SEQ ID NO: 238486

SEQ ID NO: 476468 - RNA, 64 nt, Homo Sapiens; identical to SEQ ID NO: 238487

SEQ ID NO: 476469 - RNA, 64 nt, Homo Sapiens; identical to SEQ ID NO: 238488

SEQ ID NO: 476470 - RNA, 64 nt, Homo Sapiens; identical to SEQ ID NO: 238489

SEQ ID NO: 476471 - RNA, 64 nt, Homo Sapiens; identical to SEQ ID NO: 360046

SEQ ID NO: 476472 - RNA, 64 nt, Homo Sapiens; identical to SEQ ID NO: 360047

SEQ ID NO: 476473 - RNA, 64 nt, Homo Sapiens
ugcugaugaugcuaauggagaugaugguaaugauaaagacaacaacaaugauuaucaaguuccu

SEQ ID NO: 476474 - RNA, 64 nt, Homo Sapiens
ugagaauucaaaaacauccuugcagaaugauucaaaagacaaaagccaggcucaacuuauagaa

SEQ ID NO: 476475 - RNA, 64 nt, Homo Sapiens
uaaauaugaaagaacaaagguuauuuccuggagaaaagacaauuuauucaacaccaacgaggga

SEQ ID NO: 476476 - RNA, 63 nt, Homo Sapiens
auaggaacugaccccaacaauaaacuuugauaauaaagacaauaggcuauggugauuuuauuu

SEQ ID NO: 476477 - RNA, 64 nt, Homo Sapiens
gaaaaggcacauccuugucuuaaauguaaaauaaaaagacaaauuuagagcaauaaccacuuuu

SEQ ID NO: 476478 - RNA, 64 nt, Homo Sapiens
cauccaggcagggcuucucuguuugaaaaggcaaaaagacaagaugagugaggcugaaggcugg

SEQ ID NO: 476479 - RNA, 64 nt, Homo Sapiens
uauuuuuauuuauguuagaaaggugcaguuagaaaaagacaaccccuuaaacauguggacccau

SEQ ID NO: 476480 - RNA, 64 nt, Homo Sapiens
ugagaacaaguagacacacuuuuaguaaguuuaaaaagacaaauauccaaauaaacccugaaua

SEQ ID NO: 476481 - RNA, 64 nt, Homo Sapiens
ccacuuguugaaauccagcgguguugaacuuuaaaaagacaagaaggagcuaauuguucaagaa

SEQ ID NO: 476482 - RNA, 64 nt, Homo Sapiens
uauguagcucacaaacugguuuucugaagaugggaaagacaaauucauuguuaaugugagaaca

SEQ ID NO: 476483 - RNA, 64 nt, Homo Sapiens
aagcagaaauauuuuuaccgucccggaugauccgaaagacaagaggaucuuggguccuaucccu

SEQ ID NO: 476484 - RNA, 64 nt, Homo Sapiens
acuaccugcccuaccccaucccuucgauuuccucaaagacaacaugagcuucugggccuuagca

SEQ ID NO: 476485 - RNA, 64 nt, Homo Sapiens
uccucgagauucuuaugaguucuacacaauaagaaaagacaaaguggugaugcuuucuuaguau

SEQ ID NO: 476486 - RNA, 64 nt, Homo Sapiens
gagccaugaggagagggcuggcacauuuggagggaaagacaagaaggugggggccucucuggaa

SEQ ID NO: 476487 - RNA, 64 nt, Homo Sapiens
uuuugggcuggaugugguagguacauauuucacuaaagacaaguauauaaucaaagaauuuucu

SEQ ID NO: 476488 - RNA, 64 nt, Homo Sapiens
gccaagguguaugcucucaaauaaauaaaugaauaaagacaaaaggcacaaaaugaaugaauaa

SEQ ID NO: 476489 - RNA, 64 nt, Homo Sapiens
gcauacuuggggugagaggguuaauaagaauuacaaagacaaugugaauuuuugcuuuaguauu

SEQ ID NO: 476490 - RNA, 64 nt, Homo Sapiens
uuguuucuaauuuuuuuuuuguugucgugugagcaaagacaaacauaaauugaaaaacauccug

SEQ ID NO: 476491 - RNA, 64 nt, Homo Sapiens
guagagaauacaacaaagaguucuaagacuuagaaaagacaauuuuguggugucauuucaucca

SEQ ID NO: 476492 - RNA, 64 nt, Homo Sapiens
ugccauuaccacaugacucauucuuucuuuuuuuaaagacaaccggggcuucucuccuugaugc

SEQ ID NO: 476493 - RNA, 64 nt, Homo Sapiens
uugaagaagaaauguagccccaugccaugcugaaaaagacaaaagagucccagggaaagagaac

SEQ ID NO: 476494 - RNA, 64 nt, Homo Sapiens
ggacaucacucuuaucaaauagcaaauagaaauaaaagacaaaauauuuuaaagucaaguugug

SEQ ID NO: 476495 - RNA, 64 nt, Homo Sapiens
gggaaaguauuucucuugauagaugggggagaaaaaagacaagaucuuuuuuauaaaaaaagag

SEQ ID NO: 476496 - RNA, 64 nt, Homo Sapiens
gucugauucagauugcauggcuuuguaaccuaggaaagacaaagugaugguuggccauuugagu

SEQ ID NO: 476497 - RNA, 64 nt, Homo Sapiens
ccuuauugucugaauguaauugcccugcaaauaaaaagacaauucacagauaaagauuuuguuu

SEQ ID NO: 476498 - RNA, 64 nt, Homo Sapiens
ucuguuucuugagaagagaaggcuauuuaaagacaaagacaaauuuuauuacaucuuucacauu

SEQ ID NO: 476499 - RNA, 64 nt, Homo Sapiens
acaaauucuguuucuugagacacauuggcuauuuaaagacaaagguguauuuuauuacaucuuu

SEQ ID NO: 476500 - RNA, 64 nt, Homo Sapiens
guuuacaauuaauguuuucuacaugucugucuucaaagacaacaugcuuuggaaacauaugucc

SEQ ID NO: 476501 - RNA, 64 nt, Homo Sapiens
gguugagugcaacaucauguauuaauaucaaaugaaagacaagggugcuguaucuuugauuauu

SEQ ID NO: 476502 - RNA, 64 nt, Homo Sapiens
ccaaagagacucccacucagauucuaaagcauuuaaagacaauucuagcagaauuuaucaaaac

SEQ ID NO: 476503 - RNA, 64 nt, Homo Sapiens
uugaaagcaauguucauaaauauuuaagcaaauuaaagacaauguuaacaaauuuucuauuaaa

SEQ ID NO: 476504 - RNA, 64 nt, Homo Sapiens
ggacccuuaagaauuuaugcauuuuuaaguaaagaaagacaauucaucaaagacaccagggcag

SEQ ID NO: 476505 - RNA, 64 nt, Homo Sapiens
aaaucagcuuuggaaaguaaucaguaaaaaaagaaaagacaaaagcaucugagaguuucuuguu

SEQ ID NO: 476506 - RNA, 64 nt, Homo Sapiens
uaaaggaggggcuaggggagaacauaaggaaaaaaaagacaaaucaacccagaaagguuuaaaa

SEQ ID NO: 476507 - RNA, 64 nt, Homo Sapiens
aaguaaaaauaaaaacaaaacuuguuuagaaaaaaaagacaaaaggccucaaccaacuuaguga

SEQ ID NO: 476508 - RNA, 64 nt, Homo Sapiens
cuuucuguagcuuuacaauuaauuuaaguacuaaaaagacaaggauuucuuuuaagaaauuuau

SEQ ID NO: 476509 - RNA, 64 nt, Homo Sapiens
aguuuggacugaaucacaucuguaguacuuagccaaagacaauuuggaggagaauaucagccuu

SEQ ID NO: 476510 - RNA, 64 nt, Homo Sapiens
guguugcugguuacuaaacuuuauggugucacaaaaagacaaaugauuguaggauccauggaag

SEQ ID NO: 476511 - RNA, 64 nt, Homo Sapiens
cagccuaagcguacgagugaaaacaaugaugucaaaagacaauagcaaguauaggcuacuauuu

SEQ ID NO: 476512 - RNA, 64 nt, Homo Sapiens
agaugguugucuugugugcuucucugcauuuuuaaaagacaagacauucuuguacauauuauca

SEQ ID NO: 476513 - RNA, 64 nt, Homo Sapiens
auaccagaauugaauauaccauaugggauuggagaaagacaaauguggaagaaaucauagagcu

SEQ ID NO: 476514 - RNA, 64 nt, Homo Sapiens
ugugaccaaaaaaaagcaugagggauuacuagagaaagacaaaauuuuuuaagggauguugcaa

SEQ ID NO: 476515 - RNA, 64 nt, Homo Sapiens
gugcucuauguccuaguaacuggggguggggagaaaagacaaauaacagaagcaaaggagagcu

SEQ ID NO: 476516 - RNA, 64 nt, Homo Sapiens
gaauuugguuauaaaagaaauucugcauucuuuaaaagacaagacuucuuagcaaucaauauuu

SEQ ID NO: 476517 - RNA, 64 nt, Homo Sapiens
gacuggauagcuuuucuaauuauuaaaacuagcuaaagacaacaaccaucauuuugaaaagauu

SEQ ID NO: 476518 - RNA, 59 nt, Homo Sapiens
acucuucgaagagggauuaaaaggugcaaaaagacaacuaaaauacccauuuggaccaa

SEQ ID NO: 476519 - RNA, 64 nt, Homo Sapiens
acuucucgucuugugagcuaaggcuugugucaugaaagacaagaggccucucuuaacagcccag

SEQ ID NO: 476520 - RNA, 64 nt, Homo Sapiens
ucaugcccuugccuaucaaagaguauguuguaagaaagacaagacauuguguguauuagagacu

SEQ ID NO: 476521 - RNA, 64 nt, Homo Sapiens
ucgggaucccaaagaaugaggggaauuucuucagaaagacaaucucggcaugcauuauuucuuu

SEQ ID NO: 476522 - RNA, 64 nt, Homo Sapiens
gaaauggcaaacaaaagacucuguguuuugguucaaagacaaggcgcuccaagcuuggaaagag

SEQ ID NO: 476523 - RNA, 64 nt, Homo Sapiens
aaaguggcagaacugccucaauuagucagccacaaaagacaaucggaaggccaaaguauccauc

SEQ ID NO: 476524 - RNA, 64 nt, Homo Sapiens
gcugcagugaaaauuuuggagcaguucuuggcacaaagacaaaauucugaacuccccugugaau

SEQ ID NO: 476525 - RNA, 64 nt, Homo Sapiens
ucggauguaugaucucucuauauccuaaauaaaaaaagacaaaugaaaugugacccccaagucc

SEQ ID NO: 476526 - RNA, 64 nt, Homo Sapiens
uuuuucuuuucuugauuuuuauauaguagauuuuaaagacaaaagcaucuccuuacagucacua

SEQ ID NO: 476527 - RNA, 64 nt, Homo Sapiens
gguccuaaaagcaaaauaaaaacuauucgaaugaaaagacaagaaaaucagguauuaaucuugg

SEQ ID NO: 476528 - RNA, 64 nt, Homo Sapiens
uguuuagauagggcugggcaaggaaaaagaaaauaaagacaaccauauuuagcagugcaguuga

SEQ ID NO: 476529 - RNA, 64 nt, Homo Sapiens
guagauuguaugaguaagaaguauuaauuuuuuaaaagacaaaucaacuuugaagacacaaaag

SEQ ID NO: 476530 - RNA, 64 nt, Homo Sapiens
gaauuccagucaggcauuauaucaucuaaggaaaaaagacaaggcaaggcauguuacuacuuuu

SEQ ID NO: 476531 - RNA, 64 nt, Homo Sapiens
ucaugggggccuccagugucgcuacagaucuggaaaagacaagggagaccccaguugugccuuu

SEQ ID NO: 476532 - RNA, 64 nt, Homo Sapiens
aaugcacaaaagauauaaacaugccaaccuuagaaaagacaauaaaauugcaaaauaaagaaaa

SEQ ID NO: 476533 - RNA, 64 nt, Homo Sapiens
caguuauuaacauagaugaaguuguauacccaucaaagacaauaguaauuccaaaucuaucuga

SEQ ID NO: 476534 - RNA, 64 nt, Homo Sapiens
aaaagcugggaugcuugaggguauccaaguugaaaaagacaaaaucugaccaucagccagugac

SEQ ID NO: 476535 - RNA, 64 nt, Homo Sapiens
uuucuguugggaaggcccucuugguuuuggagagaaagacaaguuaugaguagcugcuacccug

SEQ ID NO: 476536 - RNA, 64 nt, Homo Sapiens
auccuuguugaaguuuuuuuauuauuacagccuuaaagacaaaacuagaaauaaauguuaccua

SEQ ID NO: 476537 - RNA, 64 nt, Homo Sapiens
uguguaauuauguaaauacaaagaaaaagaagucaaagacaaagugagcaaagaugguaaaaag

SEQ ID NO: 476538 - RNA, 64 nt, Homo Sapiens
cugcuguuauauagcaagacucuuaaaaguauugaaagacaauaaacaaguauacacuagaggc

SEQ ID NO: 476539 - RNA, 64 nt, Homo Sapiens
ccaaaccaauuuuuuuccugguguauauuacuacaaagacaaccuauuguauucaaaauucauu

SEQ ID NO: 476540 - RNA, 64 nt, Homo Sapiens
gacuuuuccugcacuggacaguaaaaaaauaauaaaagacaaaaacaaauuuaaaaaaaaauuu

SEQ ID NO: 476541 - RNA, 64 nt, Homo Sapiens
ugaaugucccuuccaacuuuuauauuaaaaauaaaaagacaagaaaauugaagaucauuuuuca

SEQ ID NO: 476542 - RNA, 64 nt, Homo Sapiens
cggguggcuagagggcuccuauuuuauaggcauuaaagacaaguuuuuuccuccucugaacugg

SEQ ID NO: 476543 - RNA, 64 nt, Homo Sapiens
caaagcccgcauaauuuuaaccgaccuaaacauaaaagacaaggugucagccccuuccuuuccc

SEQ ID NO: 476544 - RNA, 64 nt, Homo Sapiens
aaaaaaaaaaaacccaacaaaaaaagacaaaacaaaagacaaaacuguaaaaaaaaaaaaaaaa

SEQ ID NO: 476545 - RNA, 64 nt, Homo Sapiens
caaaagacaaaaaaaaaaaaaaaaaaaaaaaaaaaaagacaaaaggugauaaaaaacuguaaaa

SEQ ID NO: 476546 - RNA, 64 nt, Homo Sapiens
aaaaaaaaagaaaauauuuuaaaaaaacacaaaaaaagacaaaagggauucuugaacuugaaaa

SEQ ID NO: 476547 - RNA, 64 nt, Homo Sapiens
auggggguggguuuccuggcaccuacaugaaaaaaaagacaaguuauaugggugaugaagaaaa

SEQ ID NO: 476548 - RNA, 64 nt, Homo Sapiens
gaaaaaaaaagacguauuuuugcuuacucagauaaaagacaaccuguaaaaauauaauaauuaa

SEQ ID NO: 476549 - RNA, 64 nt, Homo Sapiens
aaaucacgucaguaaaauacuuuaacaaauauuuaaagacaaaacuuugaguauaacaucaagc

SEQ ID NO: 476550 - RNA, 64 nt, Homo Sapiens
uuuaugagaaauauuugaaguuagaaaaaaugaaaaagacaagaggggcagguguguauuuacu

SEQ ID NO: 476551 - RNA, 64 nt, Homo Sapiens
aucuguguuuuggaaugaguaaaccuguuacagaaaagacaagaggagaacauaagagaaaagg

SEQ ID NO: 476552 - RNA, 64 nt, Homo Sapiens
gcaucagacaaaggaaaagaauacagauuuagacaaagacaagaaaggaaaaagaguuaugaag

SEQ ID NO: 476553 - RNA, 64 nt, Homo Sapiens
gaaauuuggccagauggggaccccucccuccccaaaagacaagacuaaggcucagugccacuca

SEQ ID NO: 476554 - RNA, 64 nt, Homo Sapiens
acaucugcccaaugauccaggcuugaguaggaugaaagacaaacggcaaaucuuccagacuaug

SEQ ID NO: 476555 - RNA, 62 nt, Homo Sapiens
cugguggcagggcguuuucccaccgggauacgggaagccaccugugucagggcuaggcccug

SEQ ID NO: 476556 - RNA, 62 nt, Homo Sapiens
caguaauauuucagcaagaggagguggucaugggaagccagcacagcagaggcucccugacc

SEQ ID NO: 476557 - RNA, 62 nt, Homo Sapiens
aauacagguuuucuugaugaauguguauacaaggaagccaggcuuguuucucuagucacauc

SEQ ID NO: 476558 - RNA, 62 nt, Homo Sapiens
ugcagugcugguguguccuggcccugggagaaggaagccauucuucuuuucuaucccuuugg

SEQ ID NO: 476559 - RNA, 62 nt, Homo Sapiens
cacaaacacacaccugcugggaaauguugacuggaagccaccuuuuuaaggggcuguggggu

SEQ ID NO: 476560 - RNA, 62 nt, Homo Sapiens
guugggugcuuauuuaucugaccaagcacucuggaagccaggaugcccaucuccauagccag

SEQ ID NO: 476561 - RNA, 62 nt, Homo Sapiens
gagguagcagguagcucucucaaagacgugaaggaagccaggcugagaaggugaaaugugag

SEQ ID NO: 476562 - RNA, 62 nt, Homo Sapiens
gcugugguucagagaggguguggccuugggaaggaagccaugcguuguugggaagccagcag

SEQ ID NO: 476563 - RNA, 62 nt, Homo Sapiens
aguggccuugggaaggaagcucugcguuguugggaagccagcaucccacagucagaacugaa

SEQ ID NO: 476564 - RNA, 62 nt, Homo Sapiens
ccccuguugcucuccuuaguaccaaaggaaauggaagccauuucuugggcuuucgucauuaa

SEQ ID NO: 476565 - RNA, 62 nt, Homo Sapiens
cccaccccuccccacccaccaccgcucccgcgggaagccagcccgugcaacggaagccaggc

SEQ ID NO: 476566 - RNA, 62 nt, Homo Sapiens
caccgcucccgcgggaagccagcccgugcaacggaagccaggccaacugccccgcgucuuca

SEQ ID NO: 476567 - RNA, 62 nt, Homo Sapiens
ugugccucuccccaggaagcauccagggcagaggaagccacaucucccggugcccccaaccc

SEQ ID NO: 476568 - RNA, 62 nt, Homo Sapiens
ggggagcagggaguugcccuuccccucccucgggaagccaccuaagaauguuuacaugccaa

SEQ ID NO: 476569 - RNA, 62 nt, Homo Sapiens
uccugcaccuguccaccccaccccaacacccuggaagccacugucaaugauuagaucggguc

SEQ ID NO: 476570 - RNA, 62 nt, Homo Sapiens
agacacagcaggaggagagguuacauuuguggggaagccaacgacagcccuggcuaacuaac

SEQ ID NO: 476571 - RNA, 62 nt, Homo Sapiens
cugcugucgcucuguggggguggccgcggauuggaagccagccucgagcuccuaccaguggc

SEQ ID NO: 476572 - RNA, 62 nt, Homo Sapiens
aggaaaacaaacuagagguaggaccuucucauggaagccauuuguuauauaauuuauuguga

SEQ ID NO: 476573 - RNA, 62 nt, Homo Sapiens
cacauauucauaaaaaaaaucaacuucccuggggaagccaaauucguuuguuuaccagcaag

SEQ ID NO: 476574 - RNA, 62 nt, Homo Sapiens
cagccuccaggacguggcacgagcccagcugaggaagccacaagaccucugagugggcccca

SEQ ID NO: 476575 - RNA, 62 nt, Homo Sapiens
ccugagcgagccuguccucugcgucccaggaaggaagccaacgcgaccgugccucugugcca

SEQ ID NO: 476576 - RNA, 62 nt, Homo Sapiens
ugacaaguccaaggucacgaacugaggcucagggaagccaagccacuuuuucagacaaggaa

SEQ ID NO: 476577 - RNA, 62 nt, Homo Sapiens
acugaugccucccacugugacacagucgaaaaggaagccaccgaccagcuggcccaggauuu

SEQ ID NO: 476578 - RNA, 62 nt, Homo Sapiens
uucuacacacuugccucucgcacuuuuagaucggaagccaguaccucucugcgguucccucu

SEQ ID NO: 476579 - RNA, 62 nt, Homo Sapiens
cucuuugcuuggcuucucuuuugaccucggguggaagccaggacgccauccgaagacagcac

SEQ ID NO: 476580 - RNA, 62 nt, Homo Sapiens
ccugaggacccccgccuaccaccucgagaacuggaagccaaccucuaaccuccugaccucau

SEQ ID NO: 476581 - RNA, 62 nt, Homo Sapiens
cagugcccaagucucuauggagaaugagaacuggaagccacugcuaccgucuacccagcacc

SEQ ID NO: 476582 - RNA, 62 nt, Homo Sapiens
aggcgcgggggccacugaggcccagucucaaaggaagccacagacucuguuccugcccuagg

SEQ ID NO: 476583 - RNA, 62 nt, Homo Sapiens
gugcagagagcagccuggccgccuaggaggcaggaagccaagaaggccacaaggggaccccg

SEQ ID NO: 476584 - RNA, 62 nt, Homo Sapiens
ccuuugagaagauauuuucccacaaaggggugggaagccaggagugagaaggaauucaggga

SEQ ID NO: 476585 - RNA, 62 nt, Homo Sapiens
guggcugcguuuccuggggcccuggguuuuggggaagccaguuagcugcugcuuuggcacug

SEQ ID NO: 476586 - RNA, 62 nt, Homo Sapiens
ucagguguggacgggacagugaguggcugggaggaagccagaaucaacagcuccagcccucu

SEQ ID NO: 476587 - RNA, 62 nt, Homo Sapiens
ucaggcacuaagaggggcuggaccuggcggcaggaagccaaagagacugggccuaggccagg

SEQ ID NO: 476588 - RNA, 62 nt, Homo Sapiens
gucaagagggccaucccuaagaaaggccaggcggaagccaagcgccauuuugguagcuucca

SEQ ID NO: 476589 - RNA, 62 nt, Homo Sapiens
gagggcagcguccaggagagggcugagcacguggaagccauuccacuugguggccggacagu

SEQ ID NO: 476590 - RNA, 64 nt, Homo Sapiens; identical to SEQ ID NO: 147473

SEQ ID NO: 476591 - RNA, 64 nt, Homo Sapiens; identical to SEQ ID NO: 147474

SEQ ID NO: 476592 - RNA, 64 nt, Homo Sapiens; identical to SEQ ID NO: 147475

SEQ ID NO: 476593 - RNA, 64 nt, Homo Sapiens; identical to SEQ ID NO: 147476

SEQ ID NO: 476594 - RNA, 64 nt, Homo Sapiens; identical to SEQ ID NO: 147477

SEQ ID NO: 476595 - RNA, 64 nt, Homo Sapiens; identical to SEQ ID NO: 147478

SEQ ID NO: 476596 - RNA, 64 nt, Homo Sapiens; identical to SEQ ID NO: 147479

SEQ ID NO: 476597 - RNA, 64 nt, Homo Sapiens; identical to SEQ ID NO: 147480

SEQ ID NO: 476598 - RNA, 64 nt, Homo Sapiens; identical to SEQ ID NO: 147481

SEQ ID NO: 476599 - RNA, 64 nt, Homo Sapiens; identical to SEQ ID NO: 147482

SEQ ID NO: 476600 - RNA, 64 nt, Homo Sapiens; identical to SEQ ID NO: 366491

SEQ ID NO: 476601 - RNA, 64 nt, Homo Sapiens; identical to SEQ ID NO: 366492

SEQ ID NO: 476602 - RNA, 64 nt, Homo Sapiens; identical to SEQ ID NO: 366493

SEQ ID NO: 476603 - RNA, 64 nt, Homo Sapiens; identical to SEQ ID NO: 366494

SEQ ID NO: 476604 - RNA, 64 nt, Homo Sapiens; identical to SEQ ID NO: 366495

SEQ ID NO: 476605 - RNA, 64 nt, Homo Sapiens; identical to SEQ ID NO: 366496

SEQ ID NO: 476606 - RNA, 64 nt, Homo Sapiens; identical to SEQ ID NO: 366497

SEQ ID NO: 476607 - RNA, 64 nt, Homo Sapiens; identical to SEQ ID NO: 366498

SEQ ID NO: 476608 - RNA, 64 nt, Homo Sapiens; identical to SEQ ID NO: 366499

SEQ ID NO: 476609 - RNA, 64 nt, Homo Sapiens; identical to SEQ ID NO: 366500

SEQ ID NO: 476610 - RNA, 64 nt, Homo Sapiens; identical to SEQ ID NO: 366501

SEQ ID NO: 476611 - RNA, 64 nt, Homo Sapiens; identical to SEQ ID NO: 366502

SEQ ID NO: 476612 - RNA, 64 nt, Homo Sapiens; identical to SEQ ID NO: 366503

SEQ ID NO: 476613 - RNA, 64 nt, Homo Sapiens; identical to SEQ ID NO: 366504

SEQ ID NO: 476614 - RNA, 64 nt, Homo Sapiens; identical to SEQ ID NO: 366505

SEQ ID NO: 476615 - RNA, 64 nt, Homo Sapiens; identical to SEQ ID NO: 366506

SEQ ID NO: 476616 - RNA, 64 nt, Homo Sapiens; identical to SEQ ID NO: 366507

SEQ ID NO: 476617 - RNA, 64 nt, Homo Sapiens; identical to SEQ ID NO: 366508

SEQ ID NO: 476618 - RNA, 64 nt, Homo Sapiens; identical to SEQ ID NO: 366509

SEQ ID NO: 476619 - RNA, 64 nt, Homo Sapiens; identical to SEQ ID NO: 366510

SEQ ID NO: 476620 - RNA, 64 nt, Homo Sapiens; identical to SEQ ID NO: 366511

SEQ ID NO: 476621 - RNA, 64 nt, Homo Sapiens; identical to SEQ ID NO: 366512

SEQ ID NO: 476622 - RNA, 64 nt, Homo Sapiens; identical to SEQ ID NO: 366513

SEQ ID NO: 476623 - RNA, 64 nt, Homo Sapiens; identical to SEQ ID NO: 366514

SEQ ID NO: 476624 - RNA, 64 nt, Homo Sapiens; identical to SEQ ID NO: 366515

SEQ ID NO: 476625 - RNA, 64 nt, Homo Sapiens; identical to SEQ ID NO: 366516

SEQ ID NO: 476626 - RNA, 64 nt, Homo Sapiens; identical to SEQ ID NO: 366517

SEQ ID NO: 476627 - RNA, 64 nt, Homo Sapiens; identical to SEQ ID NO: 366518

SEQ ID NO: 476628 - RNA, 64 nt, Homo Sapiens; identical to SEQ ID NO: 366519

SEQ ID NO: 476629 - RNA, 64 nt, Homo Sapiens; identical to SEQ ID NO: 366520

SEQ ID NO: 476630 - RNA, 64 nt, Homo Sapiens; identical to SEQ ID NO: 366521

SEQ ID NO: 476631 - RNA, 64 nt, Homo Sapiens; identical to SEQ ID NO: 366522

SEQ ID NO: 476632 - RNA, 64 nt, Homo Sapiens; identical to SEQ ID NO: 366523

SEQ ID NO: 476633 - RNA, 64 nt, Homo Sapiens; identical to SEQ ID NO: 366524

SEQ ID NO: 476634 - RNA, 64 nt, Homo Sapiens; identical to SEQ ID NO: 366525

SEQ ID NO: 476635 - RNA, 64 nt, Homo Sapiens; identical to SEQ ID NO: 366526

SEQ ID NO: 476636 - RNA, 64 nt, Homo Sapiens; identical to SEQ ID NO: 366527

SEQ ID NO: 476637 - RNA, 64 nt, Homo Sapiens; identical to SEQ ID NO: 366528

SEQ ID NO: 476638 - RNA, 64 nt, Homo Sapiens; identical to SEQ ID NO: 366529

SEQ ID NO: 476639 - RNA, 64 nt, Homo Sapiens; identical to SEQ ID NO: 366530

SEQ ID NO: 476640 - RNA, 64 nt, Homo Sapiens; identical to SEQ ID NO: 366531

SEQ ID NO: 476641 - RNA, 64 nt, Homo Sapiens; identical to SEQ ID NO: 366532

SEQ ID NO: 476642 - RNA, 64 nt, Homo Sapiens; identical to SEQ ID NO: 366533

SEQ ID NO: 476643 - RNA, 64 nt, Homo Sapiens; identical to SEQ ID NO: 366534

SEQ ID NO: 476644 - RNA, 64 nt, Homo Sapiens; identical to SEQ ID NO: 225654

SEQ ID NO: 476645 - RNA, 64 nt, Homo Sapiens; identical to SEQ ID NO: 225655

SEQ ID NO: 476646 - RNA, 64 nt, Homo Sapiens; identical to SEQ ID NO: 225656

SEQ ID NO: 476647 - RNA, 64 nt, Homo Sapiens; identical to SEQ ID NO: 225657

SEQ ID NO: 476648 - RNA, 64 nt, Homo Sapiens; identical to SEQ ID NO: 225658

SEQ ID NO: 476649 - RNA, 64 nt, Homo Sapiens; identical to SEQ ID NO: 225659

SEQ ID NO: 476650 - RNA, 64 nt, Homo Sapiens
agaccuugggccggcacgcgugacacggcacuucaggcuccacgcacagaaucucgcagauagu

SEQ ID NO: 476651 - RNA, 64 nt, Homo Sapiens
cucggggaacacauuccgggagagaugccuggccaggcuccacggaucccgccagaaacaccaa

SEQ ID NO: 476652 - RNA, 64 nt, Homo Sapiens
agaccccugggcaucucccauucuccaucuauccaggcuccaggcuacgugguggccgguagaa

SEQ ID NO: 476653 - RNA, 64 nt, Homo Sapiens
gcacucggaggcugguggggggggcaagagcaccaggcuccaggauugaaccaccuucuuuccu

SEQ ID NO: 476654 - RNA, 64 nt, Homo Sapiens
cagcagguuggguucuagggcugaaccaggcgccaggcuccagaggacgaagggacucuguugc

SEQ ID NO: 476655 - RNA, 64 nt, Homo Sapiens
gcuggcccugggacccccaggaacgcuaagacacaggcuccaguaggggcuguugccuccaaua

SEQ ID NO: 476656 - RNA, 64 nt, Homo Sapiens
cagaaaaauaagaaacaccgauguucucauaaucaggcuccagcgcuggccccguggugaggcc

SEQ ID NO: 476657 - RNA, 64 nt, Homo Sapiens
agcaccccgacggggggccugcucccugggaggcaggcuccagaucccgccagcuccucagccu

SEQ ID NO: 476658 - RNA, 64 nt, Homo Sapiens
cugagcucuccugcagggugagggcauugagcugaggcuccaccucugagagcucuccagccug

SEQ ID NO: 476659 - RNA, 64 nt, Homo Sapiens
caaugccuuuccuuucuuuuagacaggacagcagaggcuccagacggggcuauucccauuuugc

SEQ ID NO: 476660 - RNA, 64 nt, Homo Sapiens
aggccuuggaugcccucuaggcucaggccugcacaggcuccaccaccugcugcuccacgaggaa

SEQ ID NO: 476661 - RNA, 64 nt, Homo Sapiens
ucccaccugcccuugagcgcgcugagcucugagaaggcuccaucugggagcccaagagccagug

SEQ ID NO: 476662 - RNA, 64 nt, Homo Sapiens
augagaaugugccaugcaugaagcaaaggauuccaggcuccagaaaaaaugaaugaacucaccu

SEQ ID NO: 476663 - RNA, 64 nt, Homo Sapiens
uccucucccacauuauuucuuaaucugaacaugaaggcuccauuagcaacacuaaaacuugauc

SEQ ID NO: 476664 - RNA, 64 nt, Homo Sapiens
aggguuggauuagagggguuaaacaacuugucuuaggcuccacagcugggaacaaguggggcug

SEQ ID NO: 476665 - RNA, 64 nt, Homo Sapiens
gcuuugcagaucacagugcuggaagcaggaacccaggcuccagaagguguugccaggggcccag

SEQ ID NO: 476666 - RNA, 64 nt, Homo Sapiens
guuccagaggaauccaugaagaauucccaugcccaggcuccaugugucauguggaaaccuccac

SEQ ID NO: 476667 - RNA, 64 nt, Homo Sapiens
cuuuccaauagcaaauucaaagcaagcaacuugcaggcuccauggaacuuuuaaugaaggacag

SEQ ID NO: 476668 - RNA, 64 nt, Homo Sapiens
gcuuugccaaaugcacggagugugcauucugccaaggcuccauagggggcagcccccagagucc

SEQ ID NO: 476669 - RNA, 64 nt, Homo Sapiens
ggaagaucucgcagccucagcauacccuagccugaggcuccacuuaucaccugguggucugauu

SEQ ID NO: 476670 - RNA, 50 nt, Homo Sapiens
uccuuggcuggagugucuagaggcuccagacucuccuguuaacccuccau

SEQ ID NO: 476671 - RNA, 64 nt, Homo Sapiens
ccacaugugaacccaucauuccuaaacccuggguaggcuccaugccaaguaacagcagagggag

SEQ ID NO: 476672 - RNA, 64 nt, Homo Sapiens; identical to SEQ ID NO: 233025

SEQ ID NO: 476673 - RNA, 64 nt, Homo Sapiens; identical to SEQ ID NO: 233026

SEQ ID NO: 476674 - RNA, 64 nt, Homo Sapiens; identical to SEQ ID NO: 233027

SEQ ID NO: 476675 - RNA, 64 nt, Homo Sapiens; identical to SEQ ID NO: 233028

SEQ ID NO: 476676 - RNA, 64 nt, Homo Sapiens; identical to SEQ ID NO: 233029

SEQ ID NO: 476677 - RNA, 64 nt, Homo Sapiens; identical to SEQ ID NO: 233030

SEQ ID NO: 476678 - RNA, 64 nt, Homo Sapiens; identical to SEQ ID NO: 233031

SEQ ID NO: 476679 - RNA, 64 nt, Homo Sapiens; identical to SEQ ID NO: 233032

SEQ ID NO: 476680 - RNA, 64 nt, Homo Sapiens; identical to SEQ ID NO: 233033

SEQ ID NO: 476681 - RNA, 64 nt, Homo Sapiens; identical to SEQ ID NO: 233034

SEQ ID NO: 476682 - RNA, 64 nt, Homo Sapiens; identical to SEQ ID NO: 233035

SEQ ID NO: 476683 - RNA, 64 nt, Homo Sapiens; identical to SEQ ID NO: 233036

SEQ ID NO: 476684 - RNA, 64 nt, Homo Sapiens; identical to SEQ ID NO: 233037

SEQ ID NO: 476685 - RNA, 64 nt, Homo Sapiens; identical to SEQ ID NO: 233038

SEQ ID NO: 476686 - RNA, 64 nt, Homo Sapiens; identical to SEQ ID NO: 233039

SEQ ID NO: 476687 - RNA, 64 nt, Homo Sapiens; identical to SEQ ID NO: 233040

SEQ ID NO: 476688 - RNA, 64 nt, Homo Sapiens; identical to SEQ ID NO: 233041

SEQ ID NO: 476689 - RNA, 64 nt, Homo Sapiens; identical to SEQ ID NO: 233042

SEQ ID NO: 476690 - RNA, 64 nt, Homo Sapiens; identical to SEQ ID NO: 233043

SEQ ID NO: 476691 - RNA, 64 nt, Homo Sapiens; identical to SEQ ID NO: 233044

SEQ ID NO: 476692 - RNA, 64 nt, Homo Sapiens; identical to SEQ ID NO: 233045

SEQ ID NO: 476693 - RNA, 64 nt, Homo Sapiens; identical to SEQ ID NO: 233046

SEQ ID NO: 476694 - RNA, 64 nt, Homo Sapiens; identical to SEQ ID NO: 233047

SEQ ID NO: 476695 - RNA, 64 nt, Homo Sapiens; identical to SEQ ID NO: 233048

SEQ ID NO: 476696 - RNA, 64 nt, Homo Sapiens; identical to SEQ ID NO: 233049

SEQ ID NO: 476697 - RNA, 64 nt, Homo Sapiens; identical to SEQ ID NO: 233050

SEQ ID NO: 476698 - RNA, 64 nt, Homo Sapiens; identical to SEQ ID NO: 434003

SEQ ID NO: 476699 - RNA, 64 nt, Homo Sapiens; identical to SEQ ID NO: 434004

SEQ ID NO: 476700 - RNA, 64 nt, Homo Sapiens; identical to SEQ ID NO: 434005

SEQ ID NO: 476701 - RNA, 64 nt, Homo Sapiens; identical to SEQ ID NO: 434006

SEQ ID NO: 476702 - RNA, 64 nt, Homo Sapiens; identical to SEQ ID NO: 434007

SEQ ID NO: 476703 - RNA, 64 nt, Homo Sapiens; identical to SEQ ID NO: 434008

SEQ ID NO: 476704 - RNA, 64 nt, Homo Sapiens; identical to SEQ ID NO: 434009

SEQ ID NO: 476705 - RNA, 64 nt, Homo Sapiens; identical to SEQ ID NO: 434010

SEQ ID NO: 476706 - RNA, 64 nt, Homo Sapiens; identical to SEQ ID NO: 434011

SEQ ID NO: 476707 - RNA, 64 nt, Homo Sapiens; identical to SEQ ID NO: 434012

SEQ ID NO: 476708 - RNA, 64 nt, Homo Sapiens; identical to SEQ ID NO: 434013

SEQ ID NO: 476709 - RNA, 64 nt, Homo Sapiens; identical to SEQ ID NO: 434014

SEQ ID NO: 476710 - RNA, 64 nt, Homo Sapiens; identical to SEQ ID NO: 434015

SEQ ID NO: 476711 - RNA, 64 nt, Homo Sapiens; identical to SEQ ID NO: 434016

SEQ ID NO: 476712 - RNA, 64 nt, Homo Sapiens; identical to SEQ ID NO: 434017

SEQ ID NO: 476713 - RNA, 64 nt, Homo Sapiens; identical to SEQ ID NO: 434018

SEQ ID NO: 476714 - RNA, 64 nt, Homo Sapiens; identical to SEQ ID NO: 434019

SEQ ID NO: 476715 - RNA, 64 nt, Homo Sapiens; identical to SEQ ID NO: 434020

SEQ ID NO: 476716 - RNA, 64 nt, Homo Sapiens; identical to SEQ ID NO: 434021

SEQ ID NO: 476717 - RNA, 64 nt, Homo Sapiens; identical to SEQ ID NO: 434022

SEQ ID NO: 476718 - RNA, 64 nt, Homo Sapiens; identical to SEQ ID NO: 434023

SEQ ID NO: 476719 - RNA, 64 nt, Homo Sapiens; identical to SEQ ID NO: 434024

SEQ ID NO: 476720 - RNA, 64 nt, Homo Sapiens; identical to SEQ ID NO: 434025

SEQ ID NO: 476721 - RNA, 64 nt, Homo Sapiens; identical to SEQ ID NO: 434026

SEQ ID NO: 476722 - RNA, 64 nt, Homo Sapiens; identical to SEQ ID NO: 434027

SEQ ID NO: 476723 - RNA, 64 nt, Homo Sapiens; identical to SEQ ID NO: 434028

SEQ ID NO: 476724 - RNA, 64 nt, Homo Sapiens; identical to SEQ ID NO: 434029

SEQ ID NO: 476725 - RNA, 64 nt, Homo Sapiens; identical to SEQ ID NO: 434030

SEQ ID NO: 476726 - RNA, 64 nt, Homo Sapiens; identical to SEQ ID NO: 434031

SEQ ID NO: 476727 - RNA, 64 nt, Homo Sapiens; identical to SEQ ID NO: 434032

SEQ ID NO: 476728 - RNA, 64 nt, Homo Sapiens; identical to SEQ ID NO: 434033

SEQ ID NO: 476729 - RNA, 64 nt, Homo Sapiens; identical to SEQ ID NO: 434034

SEQ ID NO: 476730 - RNA, 64 nt, Homo Sapiens; identical to SEQ ID NO: 434035

SEQ ID NO: 476731 - RNA, 64 nt, Homo Sapiens; identical to SEQ ID NO: 434036

SEQ ID NO: 476732 - RNA, 64 nt, Homo Sapiens; identical to SEQ ID NO: 434037

SEQ ID NO: 476733 - RNA, 64 nt, Homo Sapiens; identical to SEQ ID NO: 434038

SEQ ID NO: 476734 - RNA, 64 nt, Homo Sapiens; identical to SEQ ID NO: 434039

SEQ ID NO: 476735 - RNA, 64 nt, Homo Sapiens; identical to SEQ ID NO: 434040

SEQ ID NO: 476736 - RNA, 64 nt, Homo Sapiens; identical to SEQ ID NO: 434041

SEQ ID NO: 476737 - RNA, 64 nt, Homo Sapiens; identical to SEQ ID NO: 434042

SEQ ID NO: 476738 - RNA, 64 nt, Homo Sapiens; identical to SEQ ID NO: 434043

SEQ ID NO: 476739 - RNA, 64 nt, Homo Sapiens; identical to SEQ ID NO: 434044

SEQ ID NO: 476740 - RNA, 64 nt, Homo Sapiens
ccaccauccuauugcaaagguuccaacuguauauauucccaauagcaacguagcuucuaccaug

SEQ ID NO: 476741 - RNA, 64 nt, Homo Sapiens
aaauauugaaauguagcaauaaugucuuuugaauauucccaagcccaugaguccuugaaaauau

SEQ ID NO: 476742 - RNA, 64 nt, Homo Sapiens
gaacuuacgcauccaauguggguugucacuuguuauucccaaguacuauuauuccauacuacua

SEQ ID NO: 476743 - RNA, 64 nt, Homo Sapiens
uggagcaaggugcagugcuagaauauggugguugauucccaaacagagcaguuaacuuuacucu

SEQ ID NO: 476744 - RNA, 64 nt, Homo Sapiens
uucauuuguagauacugaacaucacugucauagaauucccaaauuuacauuuaaauaugcuaac

SEQ ID NO: 476745 - RNA, 64 nt, Homo Sapiens
aacuguacuuuauacaauucagcaguuguuucccauucccaacaguauucuguauaccccuuca

SEQ ID NO: 476746 - RNA, 64 nt, Homo Sapiens
uacuuaacacagauguuuuuaucucgcccugcauauucccaacaguucagugguacauaaauuu

SEQ ID NO: 476747 - RNA, 64 nt, Homo Sapiens
gaagguuauggucaaucccaaaagucaccacuccauucccaacuagacauuaccaaagugaccu

SEQ ID NO: 476748 - RNA, 64 nt, Homo Sapiens
gauugcuucucauccccagucccaaugcacauccauucccaagaaaugcuuugucuucagccuc

SEQ ID NO: 476749 - RNA, 64 nt, Homo Sapiens; identical to SEQ ID NO: 72494

SEQ ID NO: 476750 - RNA, 64 nt, Homo Sapiens; identical to SEQ ID NO: 72495

SEQ ID NO: 476751 - RNA, 64 nt, Homo Sapiens; identical to SEQ ID NO: 72496

SEQ ID NO: 476752 - RNA, 64 nt, Homo Sapiens; identical to SEQ ID NO: 72497

SEQ ID NO: 476753 - RNA, 64 nt, Homo Sapiens; identical to SEQ ID NO: 72498

SEQ ID NO: 476754 - RNA, 64 nt, Homo Sapiens; identical to SEQ ID NO: 72499

SEQ ID NO: 476755 - RNA, 64 nt, Homo Sapiens; identical to SEQ ID NO: 72500

SEQ ID NO: 476756 - RNA, 64 nt, Homo Sapiens; identical to SEQ ID NO: 72501

SEQ ID NO: 476757 - RNA, 64 nt, Homo Sapiens; identical to SEQ ID NO: 72502

SEQ ID NO: 476758 - RNA, 64 nt, Homo Sapiens; identical to SEQ ID NO: 72503

SEQ ID NO: 476759 - RNA, 64 nt, Homo Sapiens; identical to SEQ ID NO: 72504

SEQ ID NO: 476760 - RNA, 64 nt, Homo Sapiens; identical to SEQ ID NO: 72505

SEQ ID NO: 476761 - RNA, 64 nt, Homo Sapiens
auugauaguacaaaauccaacaacaauacugagaugaucuaagaagguuauaacaaaaugcucu

SEQ ID NO: 476762 - RNA, 64 nt, Homo Sapiens
auggaaguuuaaagaaaggacaucaucauagauaugaucuaacaguauuucuaacuauauuuga

SEQ ID NO: 476763 - RNA, 64 nt, Homo Sapiens; identical to SEQ ID NO: 301501

SEQ ID NO: 476764 - RNA, 64 nt, Homo Sapiens; identical to SEQ ID NO: 301502

SEQ ID NO: 476765 - RNA, 64 nt, Homo Sapiens; identical to SEQ ID NO: 24356

SEQ ID NO: 476766 - RNA, 64 nt, Homo Sapiens; identical to SEQ ID NO: 24357

SEQ ID NO: 476767 - RNA, 64 nt, Homo Sapiens; identical to SEQ ID NO: 24358

SEQ ID NO: 476768 - RNA, 64 nt, Homo Sapiens; identical to SEQ ID NO: 24359

SEQ ID NO: 476769 - RNA, 64 nt, Homo Sapiens; identical to SEQ ID NO: 24360

SEQ ID NO: 476770 - RNA, 64 nt, Homo Sapiens; identical to SEQ ID NO: 24361

SEQ ID NO: 476771 - RNA, 64 nt, Homo Sapiens; identical to SEQ ID NO: 24362

SEQ ID NO: 476772 - RNA, 64 nt, Homo Sapiens; identical to SEQ ID NO: 24363

SEQ ID NO: 476773 - RNA, 64 nt, Homo Sapiens; identical to SEQ ID NO: 24364

SEQ ID NO: 476774 - RNA, 64 nt, Homo Sapiens; identical to SEQ ID NO: 24365

SEQ ID NO: 476775 - RNA, 64 nt, Homo Sapiens; identical to SEQ ID NO: 24366

SEQ ID NO: 476776 - RNA, 64 nt, Homo Sapiens; identical to SEQ ID NO: 24367

SEQ ID NO: 476777 - RNA, 64 nt, Homo Sapiens; identical to SEQ ID NO: 24368

SEQ ID NO: 476778 - RNA, 64 nt, Homo Sapiens; identical to SEQ ID NO: 24369

SEQ ID NO: 476779 - RNA, 64 nt, Homo Sapiens; identical to SEQ ID NO: 24370

SEQ ID NO: 476780 - RNA, 64 nt, Homo Sapiens; identical to SEQ ID NO: 24371

SEQ ID NO: 476781 - RNA, 64 nt, Homo Sapiens
uuuguucagauggguggaaaggaagggugcauggcccgcucaccgcacaucccugugcacagcu

SEQ ID NO: 476782 - RNA, 64 nt, Homo Sapiens
cccagacacccagcaaucaauucgcagccaucuucccgcucagcaauugugcauacuccaaacu

SEQ ID NO: 476783 - RNA, 64 nt, Homo Sapiens
uauacucuauauuacuugguuuuuauuauuucaggagguuaaaacuuuaaaggagcuacaguca

SEQ ID NO: 476784 - RNA, 64 nt, Homo Sapiens
aguugggggccugggguucuuugccccaggaggugagguuaagggggcauaggggaguuggcuu

SEQ ID NO: 476785 - RNA, 64 nt, Homo Sapiens
cuaauucuaaagcugcuucagacugcuucaugaggagguuaaucuacaauuaaacaauauuucc

SEQ ID NO: 476786 - RNA, 64 nt, Homo Sapiens
augguucaucauuuccugggcuguuaaacaaagcgagguuaagguuagacucuugggaaucagc

SEQ ID NO: 476787 - RNA, 64 nt, Homo Sapiens
gaaaucugacagacaccagcucagccaggugauugagguuaacaucauccaugauaagcccuuu

SEQ ID NO: 476788 - RNA, 64 nt, Homo Sapiens
aauaugaaauacaaggaucuggcaagguuaggaagagguuaagaauaucagugacaguacucug

SEQ ID NO: 476789 - RNA, 64 nt, Homo Sapiens
ccaaguauucauuucaugauuucuugaaauuugggagguuaauaaucuguaguuauucuacauu

SEQ ID NO: 476790 - RNA, 64 nt, Homo Sapiens; identical to SEQ ID NO: 476789

SEQ ID NO: 476791 - RNA, 64 nt, Homo Sapiens; identical to SEQ ID NO: 388779

SEQ ID NO: 476792 - RNA, 64 nt, Homo Sapiens; identical to SEQ ID NO: 388780

SEQ ID NO: 476793 - RNA, 64 nt, Homo Sapiens; identical to SEQ ID NO: 388781

SEQ ID NO: 476794 - RNA, 64 nt, Homo Sapiens; identical to SEQ ID NO: 388782

SEQ ID NO: 476795 - RNA, 64 nt, Homo Sapiens; identical to SEQ ID NO: 388783

SEQ ID NO: 476796 - RNA, 64 nt, Homo Sapiens; identical to SEQ ID NO: 388784

SEQ ID NO: 476797 - RNA, 64 nt, Homo Sapiens; identical to SEQ ID NO: 388785

SEQ ID NO: 476798 - RNA, 64 nt, Homo Sapiens; identical to SEQ ID NO: 388786

SEQ ID NO: 476799 - RNA, 64 nt, Homo Sapiens; identical to SEQ ID NO: 388787

SEQ ID NO: 476800 - RNA, 64 nt, Homo Sapiens; identical to SEQ ID NO: 388788

SEQ ID NO: 476801 - RNA, 64 nt, Homo Sapiens
gauagguuugugaaagucuauugauagauaaauuagaauguauauuuuuacuuaagggauagug

SEQ ID NO: 476802 - RNA, 64 nt, Homo Sapiens
uuaagaaaucuauacaaauuuuaauuauuccuauagaauguauuuugauuggcaguuucuucgg

SEQ ID NO: 476803 - RNA, 64 nt, Homo Sapiens
ccaagcguacaggagaugggccauaccugaggagagaauguaugagaucaaaaaagaacaaaug

SEQ ID NO: 476804 - RNA, 64 nt, Homo Sapiens
agaaguuauagagcgacaacuuauauacacaccuagaauguaaguuaaacaaaauaccggcuuc

SEQ ID NO: 476805 - RNA, 64 nt, Homo Sapiens
gauagcuuucaggaaagauaaagagaacaugcuuagaauguaagcuaaacagauuuuuucuguu

SEQ ID NO: 476806 - RNA, 64 nt, Homo Sapiens
uggggcuaacuucgggaucccugcacuuuauguaagaauguaaaccuggagucucauuuaagaa

SEQ ID NO: 476807 - RNA, 64 nt, Homo Sapiens
aacugcuuucuucaacaucuuguuuacuacauccagaauguagauuggauuacacaggcaggcu

SEQ ID NO: 476808 - RNA, 64 nt, Homo Sapiens
aauuucacguaaauuagucaaacaggaaagauaaagaauguauacucaccaucaauaaaccaaa

SEQ ID NO: 476809 - RNA, 64 nt, Homo Sapiens
aaaacuguaagaauaauuuagcagaaauagaaccagaauguagaagaguagucauguaacagca

SEQ ID NO: 476810 - RNA, 64 nt, Homo Sapiens
aauaauauaaggaaaaagggaaaguaaacuauuuagaauguaguuuuguuauauucccagcauu

SEQ ID NO: 476811 - RNA, 64 nt, Homo Sapiens
uaucuuaccucggcauguacagugauauucucccagaauguacuauaaaaaugguuugagcguc

SEQ ID NO: 476812 - RNA, 64 nt, Homo Sapiens
acauaacugucacugaagugugguaguaauauauagaauguauucuuuuuuuuuuaauuauuag

SEQ ID NO: 476813 - RNA, 64 nt, Homo Sapiens
accgaggggccuuuguucuggggggacccagugcagaauguaagugggcccacccggugggacc

SEQ ID NO: 476814 - RNA, 64 nt, Homo Sapiens
gagaagguuuaucccgccgauagagggacggccaagaauguacguccagccugccccggagcug

SEQ ID NO: 476815 - RNA, 64 nt, Homo Sapiens
ucaagggacuauguauacaugauuaggguaagauagaauguauuauauauauauauauauacac

SEQ ID NO: 476816 - RNA, 64 nt, Homo Sapiens
augaauuguguggcagugauuggucuguuuguggagaauguaugaaagcuauuaauauucuaga

SEQ ID NO: 476817 - RNA, 64 nt, Homo Sapiens
auuuuagguaauccaaaauguguaaagccguuuuagaauguaaucuuauuguccauuuauaccc

SEQ ID NO: 476818 - RNA, 64 nt, Homo Sapiens
agaaaaaauauaaaggagaaggguaguaaauuauagaauguauauaaacuugagguuaaauaau

SEQ ID NO: 476819 - RNA, 64 nt, Homo Sapiens
gcuugucugaucguucaaagugaacaccauagguagaauguaaaucaauguuagccucaauuuc

SEQ ID NO: 476820 - RNA, 64 nt, Homo Sapiens
uuaagguguggcuuuaggaguaguacacagcaccagaauguauaacuugacaguggaacuacau

SEQ ID NO: 476821 - RNA, 64 nt, Homo Sapiens
gcuuuaaucggagcacugcuggaaaugauugcagagaauguagugcuucauauauccaugacca

SEQ ID NO: 476822 - RNA, 64 nt, Homo Sapiens
gcagagaccucauguggccaguuugauugauugaagaauguaucacucuuauucaagcaaagga

SEQ ID NO: 476823 - RNA, 64 nt, Homo Sapiens
ccugugugaaaauauaguuaacauugcaaacuuuagaauguauuaaaaauuuuaccuugccaua

SEQ ID NO: 476824 - RNA, 64 nt, Homo Sapiens
guauccuagucagggaaagaaccuguuuucuggaagaauguaaguugcuauauguggaggggca

SEQ ID NO: 476825 - RNA, 64 nt, Homo Sapiens
uuuaagaaauaaaacaacaaaaauauuccuuaguagaauguauaaaccagagcuguucacauga

SEQ ID NO: 476826 - RNA, 64 nt, Homo Sapiens
gauauaacauuuugcugauuaauaucuugagaauagaauguaaccauagagauuucuuggcgaa

SEQ ID NO: 476827 - RNA, 64 nt, Homo Sapiens
aguguauuuuaaaguaauaagagggaaguagauaagaauguauuuagcaaaauauuugucggug

SEQ ID NO: 476828 - RNA, 64 nt, Homo Sapiens
uuuuauaaccaccaucauuccaguucaccugaucagaauguauugcguaaagcugacaaguuac

SEQ ID NO: 476829 - RNA, 64 nt, Homo Sapiens
uuauagaugcguguauauguagagaacucuccauagaauguaaugccaaagauaggaggaagaa

SEQ ID NO: 476830 - RNA, 64 nt, Homo Sapiens
acucgcagcagauaucagugauggcaacgaaaguagaauguaaaucuccuaggauacagaaacc

SEQ ID NO: 476831 - RNA, 64 nt, Homo Sapiens
uuuccagugaaaacugaaagugcauuauuauggaagaauguauuugcagguaguaauagcauua

SEQ ID NO: 476832 - RNA, 64 nt, Homo Sapiens
uuaauauuuuugucuugaagcauuuucuagugauagaauguauuugucuuuuuuccugguggua

SEQ ID NO: 476833 - RNA, 64 nt, Homo Sapiens
guggcuuagguuauuugagguuuguucaucuugaagaauguauaaagugagacuugaacaaaau

SEQ ID NO: 476834 - RNA, 64 nt, Homo Sapiens
uuguaauuuaggaaauggcauuuauaugcuuuuaagaauguagaauguguaaaacaucuuuugu

SEQ ID NO: 476835 - RNA, 64 nt, Homo Sapiens
uuuaaguugauugacuaguuauuauguacauuucagaauguacacauaaauacugugaugaaaa

SEQ ID NO: 476836 - RNA, 64 nt, Homo Sapiens
uuaaaagcccugcuaauugcaugacacaccacauagaauguauacuagcagauacuauccagug

SEQ ID NO: 476837 - RNA, 64 nt, Homo Sapiens
gugggguggcaauagcauugugccauuuugucauagaauguaaaaauugguuaacuuuacaaau

SEQ ID NO: 476838 - RNA, 64 nt, Homo Sapiens
auuuuguacuacauuuauuuuuuuucuaaguuauagaauguauauuaaacauguauguacuuuu

SEQ ID NO: 476839 - RNA, 64 nt, Homo Sapiens
gacaagcugacauauuucccaaaucaaucauauaagaauguauacaaguaauaguuaucugaau

SEQ ID NO: 476840 - RNA, 64 nt, Homo Sapiens
uauuuccaaacuaaauuacuuaauauuuugacuaagaauguaaaaaaccuuuagacucugaaag

SEQ ID NO: 476841 - RNA, 64 nt, Homo Sapiens
gguccaaguaaaaugagguaagacuuaauauuaaagaauguaaaacacaaaacauuuaagugcc

SEQ ID NO: 476842 - RNA, 64 nt, Homo Sapiens
gguaucuauauacaaaaggcaaaagucagccuaaagaauguaaauugaaaaaagaugacaauuu

SEQ ID NO: 476843 - RNA, 64 nt, Homo Sapiens
acaaaaaggaacuaguuagauugacaaugguuugagaauguaaacucagagauauuuagaauau

SEQ ID NO: 476844 - RNA, 64 nt, Homo Sapiens
aaucuucuagaccgcuuaaauuuguauuucuggaagaauguagucauuucuggacaaaucuuau

SEQ ID NO: 476845 - RNA, 64 nt, Homo Sapiens
uuuuaaugaaguuccuuauuaaacuagugcugcaagaauguauucuguuuugcagcaguaagag

SEQ ID NO: 476846 - RNA, 64 nt, Homo Sapiens
guaagccuucuaugcauccacaccaaaauccugcagaauguaaguaagcucugcuuuauaagau

SEQ ID NO: 476847 - RNA, 64 nt, Homo Sapiens
aaaaacacacuguaauauuucaaguguaugcaguagaauguacuguaacugagcccuuucccac

SEQ ID NO: 476848 - RNA, 64 nt, Homo Sapiens
uuuguacauucaugucaacauagaaggaacacguagaauguauagcagucuuugauucguacaa

SEQ ID NO: 476849 - RNA, 64 nt, Homo Sapiens
ggacuuuguccucucuuauuacugagcaauuuggagaauguauugacucucagguauagaauga

SEQ ID NO: 476850 - RNA, 64 nt, Homo Sapiens
cggcagaaaagggacucaggcuucaagagagggcagaauguauuagauuugaacagagcaaagg

SEQ ID NO: 476851 - RNA, 64 nt, Homo Sapiens
cauacagauuuuuguuagucgaaaaaaaaaaaaaagaauguacuugagacucugucucaagaag

SEQ ID NO: 476852 - RNA, 64 nt, Homo Sapiens
uugaggaaauuugcagcuucauuggaguuggaguagaauguaguuuuaauguugaacaaaauaa

SEQ ID NO: 476853 - RNA, 64 nt, Homo Sapiens
guauaucauucuaaagauaguuuguugaacuguuagaauguaagaaccucuagaauuuuaagcc

SEQ ID NO: 476854 - RNA, 64 nt, Homo Sapiens; identical to SEQ ID NO: 160193

SEQ ID NO: 476855 - RNA, 64 nt, Homo Sapiens; identical to SEQ ID NO: 160194

SEQ ID NO: 476856 - RNA, 64 nt, Homo Sapiens; identical to SEQ ID NO: 160195

SEQ ID NO: 476857 - RNA, 64 nt, Homo Sapiens; identical to SEQ ID NO: 160196

SEQ ID NO: 476858 - RNA, 64 nt, Homo Sapiens; identical to SEQ ID NO: 160197

SEQ ID NO: 476859 - RNA, 64 nt, Homo Sapiens; identical to SEQ ID NO: 160198

SEQ ID NO: 476860 - RNA, 59 nt, Homo Sapiens; identical to SEQ ID NO: 160199

SEQ ID NO: 476861 - RNA, 64 nt, Homo Sapiens; identical to SEQ ID NO: 160200

SEQ ID NO: 476862 - RNA, 64 nt, Homo Sapiens; identical to SEQ ID NO: 160201

SEQ ID NO: 476863 - RNA, 64 nt, Homo Sapiens; identical to SEQ ID NO: 160202

SEQ ID NO: 476864 - RNA, 64 nt, Homo Sapiens; identical to SEQ ID NO: 160203

SEQ ID NO: 476865 - RNA, 64 nt, Homo Sapiens; identical to SEQ ID NO: 160204

SEQ ID NO: 476866 - RNA, 64 nt, Homo Sapiens; identical to SEQ ID NO: 160205

SEQ ID NO: 476867 - RNA, 64 nt, Homo Sapiens; identical to SEQ ID NO: 160206

SEQ ID NO: 476868 - RNA, 64 nt, Homo Sapiens; identical to SEQ ID NO: 160207

SEQ ID NO: 476869 - RNA, 64 nt, Homo Sapiens; identical to SEQ ID NO: 160208

SEQ ID NO: 476870 - RNA, 64 nt, Homo Sapiens; identical to SEQ ID NO: 160209

SEQ ID NO: 476871 - RNA, 64 nt, Homo Sapiens; identical to SEQ ID NO: 160210

SEQ ID NO: 476872 - RNA, 64 nt, Homo Sapiens; identical to SEQ ID NO: 160211

SEQ ID NO: 476873 - RNA, 64 nt, Homo Sapiens; identical to SEQ ID NO: 160212

SEQ ID NO: 476874 - RNA, 64 nt, Homo Sapiens; identical to SEQ ID NO: 160213

SEQ ID NO: 476875 - RNA, 64 nt, Homo Sapiens; identical to SEQ ID NO: 160214

SEQ ID NO: 476876 - RNA, 64 nt, Homo Sapiens; identical to SEQ ID NO: 160215

SEQ ID NO: 476877 - RNA, 64 nt, Homo Sapiens; identical to SEQ ID NO: 160216

SEQ ID NO: 476878 - RNA, 64 nt, Homo Sapiens; identical to SEQ ID NO: 160217

SEQ ID NO: 476879 - RNA, 64 nt, Homo Sapiens; identical to SEQ ID NO: 160218

SEQ ID NO: 476880 - RNA, 64 nt, Homo Sapiens; identical to SEQ ID NO: 160219

SEQ ID NO: 476881 - RNA, 64 nt, Homo Sapiens; identical to SEQ ID NO: 160220

SEQ ID NO: 476882 - RNA, 64 nt, Homo Sapiens; identical to SEQ ID NO: 160221

SEQ ID NO: 476883 - RNA, 64 nt, Homo Sapiens; identical to SEQ ID NO: 160222

SEQ ID NO: 476884 - RNA, 64 nt, Homo Sapiens; identical to SEQ ID NO: 160223

SEQ ID NO: 476885 - RNA, 64 nt, Homo Sapiens; identical to SEQ ID NO: 160224

SEQ ID NO: 476886 - RNA, 64 nt, Homo Sapiens; identical to SEQ ID NO: 160225

SEQ ID NO: 476887 - RNA, 64 nt, Homo Sapiens; identical to SEQ ID NO: 160226

SEQ ID NO: 476888 - RNA, 64 nt, Homo Sapiens; identical to SEQ ID NO: 160227

SEQ ID NO: 476889 - RNA, 64 nt, Homo Sapiens; identical to SEQ ID NO: 160228

SEQ ID NO: 476890 - RNA, 64 nt, Homo Sapiens; identical to SEQ ID NO: 160229

SEQ ID NO: 476891 - RNA, 64 nt, Homo Sapiens; identical to SEQ ID NO: 160230

SEQ ID NO: 476892 - RNA, 64 nt, Homo Sapiens; identical to SEQ ID NO: 160231

SEQ ID NO: 476893 - RNA, 64 nt, Homo Sapiens; identical to SEQ ID NO: 160232

SEQ ID NO: 476894 - RNA, 64 nt, Homo Sapiens; identical to SEQ ID NO: 160233

SEQ ID NO: 476895 - RNA, 64 nt, Homo Sapiens; identical to SEQ ID NO: 160234

SEQ ID NO: 476896 - RNA, 64 nt, Homo Sapiens; identical to SEQ ID NO: 160235

SEQ ID NO: 476897 - RNA, 64 nt, Homo Sapiens; identical to SEQ ID NO: 160236

SEQ ID NO: 476898 - RNA, 64 nt, Homo Sapiens
cugaggaagucuuuugccaggccaaggcugaaaccauccgcaacggaccccaagugaagacgag

SEQ ID NO: 476899 - RNA, 64 nt, Homo Sapiens
ucaaguaagugcuuugggaaagccagcaccaccccauccgcaucgcagggugaagaguccaaga

SEQ ID NO: 476900 - RNA, 64 nt, Homo Sapiens; identical to SEQ ID NO: 24913

SEQ ID NO: 476901 - RNA, 64 nt, Homo Sapiens; identical to SEQ ID NO: 24914

SEQ ID NO: 476902 - RNA, 64 nt, Homo Sapiens; identical to SEQ ID NO: 24915

SEQ ID NO: 476903 - RNA, 64 nt, Homo Sapiens; identical to SEQ ID NO: 24916

SEQ ID NO: 476904 - RNA, 64 nt, Homo Sapiens; identical to SEQ ID NO: 24917

SEQ ID NO: 476905 - RNA, 64 nt, Homo Sapiens; identical to SEQ ID NO: 24918

SEQ ID NO: 476906 - RNA, 64 nt, Homo Sapiens; identical to SEQ ID NO: 24919

SEQ ID NO: 476907 - RNA, 64 nt, Homo Sapiens; identical to SEQ ID NO: 24920

SEQ ID NO: 476908 - RNA, 64 nt, Homo Sapiens; identical to SEQ ID NO: 24921

SEQ ID NO: 476909 - RNA, 64 nt, Homo Sapiens; identical to SEQ ID NO: 24922

SEQ ID NO: 476910 - RNA, 64 nt, Homo Sapiens; identical to SEQ ID NO: 24923

SEQ ID NO: 476911 - RNA, 64 nt, Homo Sapiens; identical to SEQ ID NO: 24924

SEQ ID NO: 476912 - RNA, 64 nt, Homo Sapiens; identical to SEQ ID NO: 24925

SEQ ID NO: 476913 - RNA, 64 nt, Homo Sapiens; identical to SEQ ID NO: 24926

SEQ ID NO: 476914 - RNA, 64 nt, Homo Sapiens; identical to SEQ ID NO: 24927

SEQ ID NO: 476915 - RNA, 64 nt, Homo Sapiens; identical to SEQ ID NO: 24928

SEQ ID NO: 476916 - RNA, 64 nt, Homo Sapiens; identical to SEQ ID NO: 24929

SEQ ID NO: 476917 - RNA, 64 nt, Homo Sapiens; identical to SEQ ID NO: 24930

SEQ ID NO: 476918 - RNA, 64 nt, Homo Sapiens; identical to SEQ ID NO: 24931

SEQ ID NO: 476919 - RNA, 64 nt, Homo Sapiens; identical to SEQ ID NO: 24932

SEQ ID NO: 476920 - RNA, 64 nt, Homo Sapiens; identical to SEQ ID NO: 24933

SEQ ID NO: 476921 - RNA, 64 nt, Homo Sapiens; identical to SEQ ID NO: 24934

SEQ ID NO: 476922 - RNA, 64 nt, Homo Sapiens; identical to SEQ ID NO: 24935

SEQ ID NO: 476923 - RNA, 64 nt, Homo Sapiens; identical to SEQ ID NO: 24936

SEQ ID NO: 476924 - RNA, 64 nt, Homo Sapiens; identical to SEQ ID NO: 112962

SEQ ID NO: 476925 - RNA, 64 nt, Homo Sapiens; identical to SEQ ID NO: 112963

SEQ ID NO: 476926 - RNA, 64 nt, Homo Sapiens
cauuguuaucacugucauuuacaagaauacuguaaagcuuaagccuaagugguacuagggaacu

SEQ ID NO: 476927 - RNA, 64 nt, Homo Sapiens
cccaagcagauaaaaauaaaacuugaaugaaggaaagcuuaaagcgucaaaggcagaaucuguc

SEQ ID NO: 476928 - RNA, 64 nt, Homo Sapiens
caucucagugaagaauacuucucauuuuuuaaaaaagcuuaaaacuuugaaguuagcuuuaacu

SEQ ID NO: 476929 - RNA, 64 nt, Homo Sapiens
auuucccauuuaucgcagaccuuuuuuaggaagcaagcuuaauggcugauaauuuuaaauucuc

SEQ ID NO: 476930 - RNA, 64 nt, Homo Sapiens
uuucuguguuuuuuggaggugcaguuaaacuuuuaagcuuaagugugacaggacugauaaauag

SEQ ID NO: 476931 - RNA, 64 nt, Homo Sapiens
aaaaaaauugcuuauuacucuucauuuuacacuaaagcuuaaugucacuaaguuucaugucugu

SEQ ID NO: 476932 - RNA, 64 nt, Homo Sapiens
uuauagaaaaugcuaagguuuucaagcucacaauaagcuuaaauauauagaaguguuugaaaug

SEQ ID NO: 476933 - RNA, 64 nt, Homo Sapiens
ggcugacaugugccauuauaaaaagauuauuuuuaagcuuaaaauaaaucaaucccaguuuggg

SEQ ID NO: 476934 - RNA, 64 nt, Homo Sapiens; identical to SEQ ID NO: 217042

SEQ ID NO: 476935 - RNA, 64 nt, Homo Sapiens; identical to SEQ ID NO: 217043

SEQ ID NO: 476936 - RNA, 64 nt, Homo Sapiens; identical to SEQ ID NO: 217044

SEQ ID NO: 476937 - RNA, 64 nt, Homo Sapiens; identical to SEQ ID NO: 217045

SEQ ID NO: 476938 - RNA, 64 nt, Homo Sapiens; identical to SEQ ID NO: 217046

SEQ ID NO: 476939 - RNA, 64 nt, Homo Sapiens; identical to SEQ ID NO: 217047

SEQ ID NO: 476940 - RNA, 64 nt, Homo Sapiens; identical to SEQ ID NO: 217048

SEQ ID NO: 476941 - RNA, 64 nt, Homo Sapiens; identical to SEQ ID NO: 217049

SEQ ID NO: 476942 - RNA, 64 nt, Homo Sapiens; identical to SEQ ID NO: 217050

SEQ ID NO: 476943 - RNA, 64 nt, Homo Sapiens; identical to SEQ ID NO: 217051

SEQ ID NO: 476944 - RNA, 64 nt, Homo Sapiens; identical to SEQ ID NO: 217052

SEQ ID NO: 476945 - RNA, 64 nt, Homo Sapiens; identical to SEQ ID NO: 217053

SEQ ID NO: 476946 - RNA, 64 nt, Homo Sapiens; identical to SEQ ID NO: 217054

SEQ ID NO: 476947 - RNA, 64 nt, Homo Sapiens; identical to SEQ ID NO: 217055

SEQ ID NO: 476948 - RNA, 64 nt, Homo Sapiens; identical to SEQ ID NO: 217056

SEQ ID NO: 476949 - RNA, 64 nt, Homo Sapiens; identical to SEQ ID NO: 217057

SEQ ID NO: 476950 - RNA, 64 nt, Homo Sapiens; identical to SEQ ID NO: 217058

SEQ ID NO: 476951 - RNA, 64 nt, Homo Sapiens; identical to SEQ ID NO: 167179

SEQ ID NO: 476952 - RNA, 64 nt, Homo Sapiens; identical to SEQ ID NO: 167180

SEQ ID NO: 476953 - RNA, 64 nt, Homo Sapiens; identical to SEQ ID NO: 167181

SEQ ID NO: 476954 - RNA, 64 nt, Homo Sapiens; identical to SEQ ID NO: 167182

SEQ ID NO: 476955 - RNA, 51 nt, Homo Sapiens; identical to SEQ ID NO: 167183

SEQ ID NO: 476956 - RNA, 64 nt, Homo Sapiens; identical to SEQ ID NO: 167184

SEQ ID NO: 476957 - RNA, 64 nt, Homo Sapiens; identical to SEQ ID NO: 167185

SEQ ID NO: 476958 - RNA, 64 nt, Homo Sapiens; identical to SEQ ID NO: 167186

SEQ ID NO: 476959 - RNA, 58 nt, Homo Sapiens; identical to SEQ ID NO: 167187

SEQ ID NO: 476960 - RNA, 64 nt, Homo Sapiens; identical to SEQ ID NO: 167188

SEQ ID NO: 476961 - RNA, 64 nt, Homo Sapiens; identical to SEQ ID NO: 167189

SEQ ID NO: 476962 - RNA, 64 nt, Homo Sapiens; identical to SEQ ID NO: 167190

SEQ ID NO: 476963 - RNA, 64 nt, Homo Sapiens; identical to SEQ ID NO: 167191

SEQ ID NO: 476964 - RNA, 64 nt, Homo Sapiens; identical to SEQ ID NO: 167192

SEQ ID NO: 476965 - RNA, 64 nt, Homo Sapiens; identical to SEQ ID NO: 167193

SEQ ID NO: 476966 - RNA, 64 nt, Homo Sapiens; identical to SEQ ID NO: 167194

SEQ ID NO: 476967 - RNA, 64 nt, Homo Sapiens; identical to SEQ ID NO: 167195

SEQ ID NO: 476968 - RNA, 64 nt, Homo Sapiens; identical to SEQ ID NO: 167196

SEQ ID NO: 476969 - RNA, 64 nt, Homo Sapiens; identical to SEQ ID NO: 167197

SEQ ID NO: 476970 - RNA, 64 nt, Homo Sapiens; identical to SEQ ID NO: 167198

SEQ ID NO: 476971 - RNA, 64 nt, Homo Sapiens; identical to SEQ ID NO: 167199

SEQ ID NO: 476972 - RNA, 64 nt, Homo Sapiens; identical to SEQ ID NO: 167200

SEQ ID NO: 476973 - RNA, 64 nt, Homo Sapiens; identical to SEQ ID NO: 167201

SEQ ID NO: 476974 - RNA, 64 nt, Homo Sapiens; identical to SEQ ID NO: 167202

SEQ ID NO: 476975 - RNA, 64 nt, Homo Sapiens; identical to SEQ ID NO: 167203

SEQ ID NO: 476976 - RNA, 64 nt, Homo Sapiens; identical to SEQ ID NO: 167204

SEQ ID NO: 476977 - RNA, 64 nt, Homo Sapiens; identical to SEQ ID NO: 167205

SEQ ID NO: 476978 - RNA, 64 nt, Homo Sapiens; identical to SEQ ID NO: 167206

SEQ ID NO: 476979 - RNA, 64 nt, Homo Sapiens; identical to SEQ ID NO: 167207

SEQ ID NO: 476980 - RNA, 64 nt, Homo Sapiens; identical to SEQ ID NO: 167208

SEQ ID NO: 476981 - RNA, 64 nt, Homo Sapiens; identical to SEQ ID NO: 167209

SEQ ID NO: 476982 - RNA, 64 nt, Homo Sapiens; identical to SEQ ID NO: 167210

SEQ ID NO: 476983 - RNA, 64 nt, Homo Sapiens; identical to SEQ ID NO: 167211

SEQ ID NO: 476984 - RNA, 64 nt, Homo Sapiens; identical to SEQ ID NO: 167212

SEQ ID NO: 476985 - RNA, 64 nt, Homo Sapiens; identical to SEQ ID NO: 167213

SEQ ID NO: 476986 - RNA, 64 nt, Homo Sapiens; identical to SEQ ID NO: 167214

SEQ ID NO: 476987 - RNA, 64 nt, Homo Sapiens; identical to SEQ ID NO: 167215

SEQ ID NO: 476988 - RNA, 64 nt, Homo Sapiens; identical to SEQ ID NO: 167216

SEQ ID NO: 476989 - RNA, 64 nt, Homo Sapiens; identical to SEQ ID NO: 167217

SEQ ID NO: 476990 - RNA, 64 nt, Homo Sapiens; identical to SEQ ID NO: 167218

SEQ ID NO: 476991 - RNA, 64 nt, Homo Sapiens; identical to SEQ ID NO: 167219

SEQ ID NO: 476992 - RNA, 64 nt, Homo Sapiens; identical to SEQ ID NO: 167220

SEQ ID NO: 476993 - RNA, 64 nt, Homo Sapiens; identical to SEQ ID NO: 167221

SEQ ID NO: 476994 - RNA, 64 nt, Homo Sapiens; identical to SEQ ID NO: 167222

SEQ ID NO: 476995 - RNA, 64 nt, Homo Sapiens; identical to SEQ ID NO: 167223

SEQ ID NO: 476996 - RNA, 64 nt, Homo Sapiens; identical to SEQ ID NO: 167224

SEQ ID NO: 476997 - RNA, 64 nt, Homo Sapiens; identical to SEQ ID NO: 167225

SEQ ID NO: 476998 - RNA, 64 nt, Homo Sapiens; identical to SEQ ID NO: 167226

SEQ ID NO: 476999 - RNA, 64 nt, Homo Sapiens; identical to SEQ ID NO: 167227

SEQ ID NO: 477000 - RNA, 64 nt, Homo Sapiens; identical to SEQ ID NO: 167228

SEQ ID NO: 477001 - RNA, 64 nt, Homo Sapiens; identical to SEQ ID NO: 167229

SEQ ID NO: 477002 - RNA, 64 nt, Homo Sapiens; identical to SEQ ID NO: 167230

SEQ ID NO: 477003 - RNA, 64 nt, Homo Sapiens; identical to SEQ ID NO: 167231

SEQ ID NO: 477004 - RNA, 64 nt, Homo Sapiens; identical to SEQ ID NO: 167232

SEQ ID NO: 477005 - RNA, 64 nt, Homo Sapiens; identical to SEQ ID NO: 167233

SEQ ID NO: 477006 - RNA, 64 nt, Homo Sapiens; identical to SEQ ID NO: 167234

SEQ ID NO: 477007 - RNA, 64 nt, Homo Sapiens; identical to SEQ ID NO: 167235

SEQ ID NO: 477008 - RNA, 64 nt, Homo Sapiens; identical to SEQ ID NO: 167236

SEQ ID NO: 477009 - RNA, 64 nt, Homo Sapiens; identical to SEQ ID NO: 167237

SEQ ID NO: 477010 - RNA, 64 nt, Homo Sapiens; identical to SEQ ID NO: 167238

SEQ ID NO: 477011 - RNA, 64 nt, Homo Sapiens; identical to SEQ ID NO: 167239

SEQ ID NO: 477012 - RNA, 64 nt, Homo Sapiens; identical to SEQ ID NO: 167240

SEQ ID NO: 477013 - RNA, 64 nt, Homo Sapiens; identical to SEQ ID NO: 167241

SEQ ID NO: 477014 - RNA, 64 nt, Homo Sapiens; identical to SEQ ID NO: 167242

SEQ ID NO: 477015 - RNA, 64 nt, Homo Sapiens; identical to SEQ ID NO: 167243

SEQ ID NO: 477016 - RNA, 64 nt, Homo Sapiens; identical to SEQ ID NO: 167244

SEQ ID NO: 477017 - RNA, 64 nt, Homo Sapiens; identical to SEQ ID NO: 167245

SEQ ID NO: 477018 - RNA, 64 nt, Homo Sapiens; identical to SEQ ID NO: 167246

SEQ ID NO: 477019 - RNA, 64 nt, Homo Sapiens; identical to SEQ ID NO: 167247

SEQ ID NO: 477020 - RNA, 64 nt, Homo Sapiens; identical to SEQ ID NO: 167248

SEQ ID NO: 477021 - RNA, 64 nt, Homo Sapiens; identical to SEQ ID NO: 167249

SEQ ID NO: 477022 - RNA, 64 nt, Homo Sapiens; identical to SEQ ID NO: 167250

SEQ ID NO: 477023 - RNA, 64 nt, Homo Sapiens; identical to SEQ ID NO: 167251

SEQ ID NO: 477024 - RNA, 64 nt, Homo Sapiens; identical to SEQ ID NO: 167252

SEQ ID NO: 477025 - RNA, 64 nt, Homo Sapiens; identical to SEQ ID NO: 167253

SEQ ID NO: 477026 - RNA, 64 nt, Homo Sapiens; identical to SEQ ID NO: 167254

SEQ ID NO: 477027 - RNA, 64 nt, Homo Sapiens; identical to SEQ ID NO: 167255

SEQ ID NO: 477028 - RNA, 64 nt, Homo Sapiens; identical to SEQ ID NO: 167256

SEQ ID NO: 477029 - RNA, 64 nt, Homo Sapiens; identical to SEQ ID NO: 167257

SEQ ID NO: 477030 - RNA, 64 nt, Homo Sapiens; identical to SEQ ID NO: 167258

SEQ ID NO: 477031 - RNA, 64 nt, Homo Sapiens; identical to SEQ ID NO: 167259

SEQ ID NO: 477032 - RNA, 64 nt, Homo Sapiens; identical to SEQ ID NO: 167260

SEQ ID NO: 477033 - RNA, 64 nt, Homo Sapiens; identical to SEQ ID NO: 167261

SEQ ID NO: 477034 - RNA, 63 nt, Homo Sapiens; identical to SEQ ID NO: 167262

SEQ ID NO: 477035 - RNA, 64 nt, Homo Sapiens; identical to SEQ ID NO: 167263

SEQ ID NO: 477036 - RNA, 64 nt, Homo Sapiens; identical to SEQ ID NO: 167264

SEQ ID NO: 477037 - RNA, 64 nt, Homo Sapiens; identical to SEQ ID NO: 167265

SEQ ID NO: 477038 - RNA, 64 nt, Homo Sapiens; identical to SEQ ID NO: 167266

SEQ ID NO: 477039 - RNA, 64 nt, Homo Sapiens; identical to SEQ ID NO: 167267

SEQ ID NO: 477040 - RNA, 64 nt, Homo Sapiens; identical to SEQ ID NO: 167268

SEQ ID NO: 477041 - RNA, 64 nt, Homo Sapiens; identical to SEQ ID NO: 167269

SEQ ID NO: 477042 - RNA, 64 nt, Homo Sapiens; identical to SEQ ID NO: 167270

SEQ ID NO: 477043 - RNA, 64 nt, Homo Sapiens; identical to SEQ ID NO: 167271

SEQ ID NO: 477044 - RNA, 64 nt, Homo Sapiens; identical to SEQ ID NO: 167272

SEQ ID NO: 477045 - RNA, 64 nt, Homo Sapiens; identical to SEQ ID NO: 167273

SEQ ID NO: 477046 - RNA, 64 nt, Homo Sapiens; identical to SEQ ID NO: 167274

SEQ ID NO: 477047 - RNA, 64 nt, Homo Sapiens; identical to SEQ ID NO: 167275

SEQ ID NO: 477048 - RNA, 64 nt, Homo Sapiens; identical to SEQ ID NO: 167276

SEQ ID NO: 477049 - RNA, 64 nt, Homo Sapiens; identical to SEQ ID NO: 167277

SEQ ID NO: 477050 - RNA, 64 nt, Homo Sapiens; identical to SEQ ID NO: 167278

SEQ ID NO: 477051 - RNA, 64 nt, Homo Sapiens; identical to SEQ ID NO: 167279

SEQ ID NO: 477052 - RNA, 64 nt, Homo Sapiens; identical to SEQ ID NO: 167280

SEQ ID NO: 477053 - RNA, 64 nt, Homo Sapiens; identical to SEQ ID NO: 167281

SEQ ID NO: 477054 - RNA, 64 nt, Homo Sapiens; identical to SEQ ID NO: 167282

SEQ ID NO: 477055 - RNA, 64 nt, Homo Sapiens; identical to SEQ ID NO: 167283

SEQ ID NO: 477056 - RNA, 64 nt, Homo Sapiens; identical to SEQ ID NO: 167284

SEQ ID NO: 477057 - RNA, 64 nt, Homo Sapiens; identical to SEQ ID NO: 167285

SEQ ID NO: 477058 - RNA, 64 nt, Homo Sapiens; identical to SEQ ID NO: 167286

SEQ ID NO: 477059 - RNA, 64 nt, Homo Sapiens; identical to SEQ ID NO: 167287

SEQ ID NO: 477060 - RNA, 64 nt, Homo Sapiens; identical to SEQ ID NO: 167288

SEQ ID NO: 477061 - RNA, 64 nt, Homo Sapiens; identical to SEQ ID NO: 167289

SEQ ID NO: 477062 - RNA, 64 nt, Homo Sapiens; identical to SEQ ID NO: 167290

SEQ ID NO: 477063 - RNA, 64 nt, Homo Sapiens; identical to SEQ ID NO: 167291

SEQ ID NO: 477064 - RNA, 64 nt, Homo Sapiens; identical to SEQ ID NO: 167292

SEQ ID NO: 477065 - RNA, 64 nt, Homo Sapiens; identical to SEQ ID NO: 167293

SEQ ID NO: 477066 - RNA, 64 nt, Homo Sapiens; identical to SEQ ID NO: 167294

SEQ ID NO: 477067 - RNA, 64 nt, Homo Sapiens; identical to SEQ ID NO: 167295

SEQ ID NO: 477068 - RNA, 64 nt, Homo Sapiens; identical to SEQ ID NO: 167296

SEQ ID NO: 477069 - RNA, 64 nt, Homo Sapiens; identical to SEQ ID NO: 167297

SEQ ID NO: 477070 - RNA, 64 nt, Homo Sapiens; identical to SEQ ID NO: 167298

SEQ ID NO: 477071 - RNA, 64 nt, Homo Sapiens; identical to SEQ ID NO: 167299

SEQ ID NO: 477072 - RNA, 64 nt, Homo Sapiens; identical to SEQ ID NO: 167300

SEQ ID NO: 477073 - RNA, 64 nt, Homo Sapiens; identical to SEQ ID NO: 167301

SEQ ID NO: 477074 - RNA, 64 nt, Homo Sapiens; identical to SEQ ID NO: 167302

SEQ ID NO: 477075 - RNA, 64 nt, Homo Sapiens; identical to SEQ ID NO: 167303

SEQ ID NO: 477076 - RNA, 64 nt, Homo Sapiens; identical to SEQ ID NO: 167304

SEQ ID NO: 477077 - RNA, 64 nt, Homo Sapiens; identical to SEQ ID NO: 167305

SEQ ID NO: 477078 - RNA, 64 nt, Homo Sapiens; identical to SEQ ID NO: 167306

SEQ ID NO: 477079 - RNA, 64 nt, Homo Sapiens
ugcauugugaagaggaggaaaagugaaucacggagagagaaaggaaaggauagaaucacaggcu

SEQ ID NO: 477080 - RNA, 64 nt, Homo Sapiens
uuuauccagcuauacuuacuugcacaguggauuggagagaaaggauucuccagugugcacacuc

SEQ ID NO: 477081 - RNA, 64 nt, Homo Sapiens
aaugcccgagugacacaugagagcuguaugaauugagagaaaaggcaacaaguagcauucuuca

SEQ ID NO: 477082 - RNA, 64 nt, Homo Sapiens
uucugugcucuauuauacccugauagagaugggggagagaaaggaauguuuuugauggugguuu

SEQ ID NO: 477083 - RNA, 64 nt, Homo Sapiens
guguguguguguguguguguguguguggcagagagagagaaagagagagagagagagaaauucu

SEQ ID NO: 477084 - RNA, 64 nt, Homo Sapiens
guguguguggcagagagagagaaagagagagagagagagaaauucuguuaaaaucuauucugug

SEQ ID NO: 477085 - RNA, 64 nt, Homo Sapiens
agccccgcagaccuccccagccccuagcccaggagagagaaagccaggcagguagccaggggga

SEQ ID NO: 477086 - RNA, 64 nt, Homo Sapiens
aaggugcuggaggugggagcaggagauugagaaggagagaaagugggugagaugcuggagaaga

SEQ ID NO: 477087 - RNA, 64 nt, Homo Sapiens
ccacgcccuccccuccccugcugcaggggcucuggagagaaacaauaaagagauucacacacaa

SEQ ID NO: 477088 - RNA, 64 nt, Homo Sapiens
gcagcgccacagaagccccuaguaacuuaagugagagagaaaggcaggugucagcuuuucgucu

SEQ ID NO: 477089 - RNA, 64 nt, Homo Sapiens
acagggacuuugaaccuagggggagagggaagaggagagaaaaugcuuuaccggaguagggggu

SEQ ID NO: 477090 - RNA, 64 nt, Homo Sapiens
aaaaagugugacauuacagaaaaaaaaaaaaaaagagagaaacagcaaauuauuuguaugcuuc

SEQ ID NO: 477091 - RNA, 64 nt, Homo Sapiens
gaccaugcugcauacauucugaaaaagagagagagagagaaaaauuuccaguuccguucugaga

SEQ ID NO: 477092 - RNA, 64 nt, Homo Sapiens
gagagagagagagaaaaagauccaguuccguucugagagaaaaaugagcaaacauguugcuguu

SEQ ID NO: 477093 - RNA, 64 nt, Homo Sapiens
auaaaaacauagacuggaggagguaauccauggagagagaaaaagaagagggcucaggacaagg

SEQ ID NO: 477094 - RNA, 64 nt, Homo Sapiens
guguugggguuuugccagggaaguaaaaggaguugagagaaagaugggucaguucagaagacau

SEQ ID NO: 477095 - RNA, 64 nt, Homo Sapiens
gguugacuuuuugcacuucuguauauagucaaaagagagaaaccuguauaauaguaagaucuua

SEQ ID NO: 477096 - RNA, 64 nt, Homo Sapiens
aaacuacugcauguuuaaaacuucaacaaaaaaagagagaaagaacuauacuaagaacauauau

SEQ ID NO: 477097 - RNA, 64 nt, Homo Sapiens
uaauauuaacacaaaaaaauuauuaaaacgaggagagagaaaaaaagagcaagaaaagagaaaa

SEQ ID NO: 477098 - RNA, 64 nt, Homo Sapiens
gaggaagggaacuuauuucucgaaagacaaacgggagagaaaaaaaaugagcaaacaaaaaaau

SEQ ID NO: 477099 - RNA, 64 nt, Homo Sapiens
ucaaaccuugauaaacauaagagaauucauaccggagagaaacuguacaaaugugaagaauaug

SEQ ID NO: 477100 - RNA, 64 nt, Homo Sapiens
gguccucaaugcuuaauaaauauaauucaugcuggagagaaacuucacaugugaaccguguggc

SEQ ID NO: 477101 - RNA, 64 nt, Homo Sapiens
ucaaacuuuguuaaacauaagagaauuuauaccagagagaaacccuacacauguaaagaaugug

SEQ ID NO: 477102 - RNA, 64 nt, Homo Sapiens
acacaccacagccaggaggggccuuucccaccuggagagaaacuuccagaccagccccucauac

SEQ ID NO: 477103 - RNA, 64 nt, Homo Sapiens
ucauaccacagccaagaggggccuuucucaccuggagagaaauuuccagaccauccccucucac

SEQ ID NO: 477104 - RNA, 64 nt, Homo Sapiens
ucacaccacagccaagagaagccuuuccagccuggagagaaacuuccagaccagcccucucacu

SEQ ID NO: 477105 - RNA, 64 nt, Homo Sapiens
ucacaccacagccaggagaggccuuucccaccuggagagaaacuuccagaccagccccucauac

SEQ ID NO: 477106 - RNA, 64 nt, Homo Sapiens
ucauaccacagccaagaggggccuuucucaccuggagagaaacuuccagaccagccccucacac

SEQ ID NO: 477107 - RNA, 64 nt, Homo Sapiens
ucacaccaccgccaggagaggccuuucccaccgggagagaaacuuccagaccagccccucacac

SEQ ID NO: 477108 - RNA, 64 nt, Homo Sapiens
ucacaccacagccaggagaggccuuucccaccgggagagaaacuuccagaccagcccucucacu

SEQ ID NO: 477109 - RNA, 64 nt, Homo Sapiens
ucacaccacagccaggagagaccuuuucugccuggagagaaacuuucagaccagccccacacac

SEQ ID NO: 477110 - RNA, 64 nt, Homo Sapiens
ucacaccacagccaggagaggccuuucccaccuggagagaaacuuccagaccagccccucucac

SEQ ID NO: 477111 - RNA, 64 nt, Homo Sapiens
guuuuuuuaaugaugaaaaguuacacauuuuuuggagagaaaagucuuagcugaagguaaauca

SEQ ID NO: 477112 - RNA, 64 nt, Homo Sapiens
cuagaaaaugcauaagguuaguacaagaucaguagagagaaagucaaagauuacagaagugcug

SEQ ID NO: 477113 - RNA, 64 nt, Homo Sapiens
accaacaaagaagauguucauacauuaucaacaugagagaaaucugcauuuuaagccuucaaau

SEQ ID NO: 477114 - RNA, 64 nt, Homo Sapiens
aauuuauuuuacauugacauauuauggcaaagaggagagaaagagaaaaaaagcauacaucaug

SEQ ID NO: 477115 - RNA, 64 nt, Homo Sapiens
agagugagagcacaaagauaacgcaggagagagagagagaaagaaugagaaagaaaaggaaugc

SEQ ID NO: 477116 - RNA, 64 nt, Homo Sapiens
gauguaaugacagagaguucuggugagauacccagagagaaaaagagagagcagggugggguaa

SEQ ID NO: 477117 - RNA, 64 nt, Homo Sapiens
aaacuccuugaaaccagcucauguucuugcagcagagagaaauacucaccaggaaauucuguuu

SEQ ID NO: 477118 - RNA, 64 nt, Homo Sapiens
agggcaacuucuacucuucagaaaucuaaguuucgagagaaaggagagacacgaacaaaccaag

SEQ ID NO: 477119 - RNA, 64 nt, Homo Sapiens
auccccuucuccaaacgauuagucuaaauuuucagagagaaauagauaaaacacgccacagccu

SEQ ID NO: 477120 - RNA, 64 nt, Homo Sapiens
cuacaugcaucuagggcggagaggcugcacuugugagagaaaauacuauuucaagucauauucu

SEQ ID NO: 477121 - RNA, 64 nt, Homo Sapiens
uacaagcuuacuacacauaggaaaauucauacuggagagaaacuacaaaugugaagaauguguu

SEQ ID NO: 477122 - RNA, 64 nt, Homo Sapiens
auccucauaccuuacuauacagaaauucauacuggagagaaagccuacaauugugaagaaugug

SEQ ID NO: 477123 - RNA, 64 nt, Homo Sapiens
cacaccuugcuacauauaagacaguuuauacuuugagagaaacccugcaaaugugaauaaugug

SEQ ID NO: 477124 - RNA, 64 nt, Homo Sapiens
uaacaacuuacugaacauaagaaaauuuacacuagagagaaagccuacaaaugugaagaaugug

SEQ ID NO: 477125 - RNA, 64 nt, Homo Sapiens
ucaacccuuauuacacauaagauaauucauagcggagagaaaccccacaaaugugaagaaugug

SEQ ID NO: 477126 - RNA, 64 nt, Homo Sapiens
ucaacucuuacugcacauaagaucauucauacuggagagaaaccuuacaaaugugaggaaugug

SEQ ID NO: 477127 - RNA, 64 nt, Homo Sapiens
ucaaaccuuacuaaacacaagaagauucauacuagagagaaacccuacaaaugugaagaaugug

SEQ ID NO: 477128 - RNA, 64 nt, Homo Sapiens
ucgaacuuuacuaugcauaagaaaauucaaacuggagagaaacucuacaaaugugaagaaugug

SEQ ID NO: 477129 - RNA, 64 nt, Homo Sapiens
uccucaaaacuucuuacaccuaaaauucaugcaggagagaaacaccacaaaugugaaaaauuug

SEQ ID NO: 477130 - RNA, 64 nt, Homo Sapiens
ucaacccuuucugcacauaauauaauucauacuggagagaaaccccacaaauaugaagaaugug

SEQ ID NO: 477131 - RNA, 64 nt, Homo Sapiens
ucacaucuuauucagcaucaaagaauucacacaggagagaaagcacaugaauguaaugaaugug

SEQ ID NO: 477132 - RNA, 64 nt, Homo Sapiens
ucagccauugcucagcaucagauaauucacaccagagagaaacccucugaaugugacgaaugaa

SEQ ID NO: 477133 - RNA, 64 nt, Homo Sapiens
cacauuucaggcuuuacccaacaucgaaauaauggagagaaaauuguugauuauuuguuuauga

SEQ ID NO: 477134 - RNA, 64 nt, Homo Sapiens
uuacaagugugaagaauguggaaaauucauacuggagagaaaccucaaaacucauugaacacaa

SEQ ID NO: 477135 - RNA, 64 nt, Homo Sapiens
cuacaaaugugaagaauguggagaauucauacuggagagaaaccucaacccuuauuggacauaa

SEQ ID NO: 477136 - RNA, 64 nt, Homo Sapiens
augcucucuagcaacauugacuuucuuguagaaggagagaaacccaaauuuuccccauuuuucu

SEQ ID NO: 477137 - RNA, 64 nt, Homo Sapiens
aguuuccaaggauauguuucgaaagacgaagggagagagaaagcaaagaagagggagggagaga

SEQ ID NO: 477138 - RNA, 64 nt, Homo Sapiens
cgaagggagagagaaagcagagaagagggagggagagagaaagaguacugaagagaaaugggaa

SEQ ID NO: 477139 - RNA, 64 nt, Homo Sapiens
auaaaaauauagcauauaauucauagacuuugaggagagaaagcgcauaagugccauccuuuaa

SEQ ID NO: 477140 - RNA, 64 nt, Homo Sapiens
uaaaauuaaaauaguauuuuaacacaucauggaggagagaaacuuacuuguaacagcguaauua

SEQ ID NO: 477141 - RNA, 64 nt, Homo Sapiens
aaaggaaacacgaaagaaaagucaggaagguagagagagaaaaagggagggaaggagaaagaau

SEQ ID NO: 477142 - RNA, 64 nt, Homo Sapiens
ccccuggaggaaagucauuccugccuaauccaucgagagaaagaggcuuacgaaaaacuuugcc

SEQ ID NO: 477143 - RNA, 64 nt, Homo Sapiens
gagacacagagagaaggagaaagagggagggagagagagaaagagagagaaagagagagagaga

SEQ ID NO: 477144 - RNA, 64 nt, Homo Sapiens
gagaaggagaaagagggagggagagagagaaagagagagaaagagagagagagagagagagaga

SEQ ID NO: 477145 - RNA, 64 nt, Homo Sapiens
gagaaagagagagaaagagagagagagagagagagagagaaagcugaacgugcacucugacaag

SEQ ID NO: 477146 - RNA, 64 nt, Homo Sapiens
agucccucuaucccuucuccuguccaggggcccagagagaaacacaccuaccccuggccuugcc

SEQ ID NO: 477147 - RNA, 64 nt, Homo Sapiens
uccucuuuccguggcuggggguagacuuaauaaagagagaaauucaagaacugcuugcuuuauu

SEQ ID NO: 477148 - RNA, 64 nt, Homo Sapiens
aaauuuaacugccuaaaauguucuccuuagaugugagagaaagagaaaucagaaaaauuaauuc

SEQ ID NO: 477149 - RNA, 64 nt, Homo Sapiens
ucauguaaaauaagaaagcccuaaaauacuauuggagagaaaaaauuaacuagguugcuacuuu

SEQ ID NO: 477150 - RNA, 64 nt, Homo Sapiens
gagauggcccucugugacucggugguuggaaggggagagaaacugcuauagagagguuggaagg

SEQ ID NO: 477151 - RNA, 64 nt, Homo Sapiens
gcucccaccugccagucccuggcccuggggagaggagagaaagggccaugcucugggacgugug

SEQ ID NO: 477152 - RNA, 64 nt, Homo Sapiens
cuacaguugauccucaucugccacguuucagagggagagaaaugcugguggguaccuaucccag

SEQ ID NO: 477153 - RNA, 64 nt, Homo Sapiens
cacaucugucucugcaaugcagcagcaagaacuugagagaaaaaaccuauggcuggcuuuccuu

SEQ ID NO: 477154 - RNA, 64 nt, Homo Sapiens
guucggggauauauuaagauauuuuuguacauaagagagaaagagagagaaaaauuuauagaag

SEQ ID NO: 477155 - RNA, 64 nt, Homo Sapiens
auauuaagauauuuuuguacauaagagagaaagagagagaaaaauuuauagaaguuuuguacaa

SEQ ID NO: 477156 - RNA, 64 nt, Homo Sapiens
aagacuuagagaagaggaagcaaagugauauacagagagaaaaaagaguaagaauaaaaacuac

SEQ ID NO: 477157 - RNA, 64 nt, Homo Sapiens
cuauugaggcagugacuguugaggaugcaugugggagagaaaccucauacuuucugacacuuuu

SEQ ID NO: 477158 - RNA, 64 nt, Homo Sapiens
ccccaaaauagcugcccuuaaagaguuguuagcagagagaaaaauaacagugaaugugcuccug

SEQ ID NO: 477159 - RNA, 64 nt, Homo Sapiens
aaguauacacucagcaauaauuagaaaaaaaggagagagaaaagugauuuaaacaggguggauu

SEQ ID NO: 477160 - RNA, 64 nt, Homo Sapiens
uaacuuauuguguguuugauauucaacagcuauagagagaaagacgaaugugcuuuuuauugua

SEQ ID NO: 477161 - RNA, 64 nt, Homo Sapiens
ggaacugaaggacgcgguuagcaugugagaaagcgagagaaagaacgaguguggcagagagugu

SEQ ID NO: 477162 - RNA, 64 nt, Homo Sapiens
uacagaguaagugaaagggugccugcgcugacgugagagaaaggaaucuguaaacaguggaaac

SEQ ID NO: 477163 - RNA, 64 nt, Homo Sapiens
cuuauuuaccuaggagcauguaagagaaagaagggagagaaaagguugcaucugcaggaugccu

SEQ ID NO: 477164 - RNA, 64 nt, Homo Sapiens
cuuagaacauacacagaucccuuuuuuucuaaaggagagaaagaaaaauagaaucagauuaucu

SEQ ID NO: 477165 - RNA, 64 nt, Homo Sapiens
cuuagaauguacacagauccguuuuucucuaaaugagagaaagaucuucuauagacuugagaau

SEQ ID NO: 477166 - RNA, 64 nt, Homo Sapiens
uuuaaggcaaugaaucacaguauggaaauucuaagagagaaaguuuuacugguuuggcaugcgg

SEQ ID NO: 477167 - RNA, 64 nt, Homo Sapiens
aggggauguaaccagcaaugccccaggacuuacggagagaaauagucauugccuuaagccaccu

SEQ ID NO: 477168 - RNA, 64 nt, Homo Sapiens
ccccgacaucaccccaaggacaacggcagaaguagagagaaacuaccuaccucacuucaaauua

SEQ ID NO: 477169 - RNA, 64 nt, Homo Sapiens
agcagcucggcuacuuuuguaaacuucagauuuggagagaaacacgaaagucugaauccugacc

SEQ ID NO: 477170 - RNA, 64 nt, Homo Sapiens
gagagagagaugcuguugaagagagugagagagagagagaaagacagagagugagagagagaaa

SEQ ID NO: 477171 - RNA, 64 nt, Homo Sapiens
gagugagagagagagagaaagccagagagugagagagagaaagagaguaaccaguuuccagaga

SEQ ID NO: 477172 - RNA, 64 nt, Homo Sapiens
gaggagacagagagggagagaggaggcagagagggagagaaacaauaugaggagagagagacag

SEQ ID NO: 477173 - RNA, 64 nt, Homo Sapiens
gagguggggagaggggagaguggagaggaggggagagagaaagagaaaggaggagggagagaga

SEQ ID NO: 477174 - RNA, 64 nt, Homo Sapiens
aagucauuucaaauacaugaaaaaucuuacacuggagagaaacccuaugaguguaagcaaugug

SEQ ID NO: 477175 - RNA, 64 nt, Homo Sapiens
aaaaaucuucgauuucauaaaaggacacacacuggagagaaacccugugaauguaagaaaugua

SEQ ID NO: 477176 - RNA, 64 nt, Homo Sapiens
aagauccuuugaauacaugcaagaacacacaauggagagaaacccuaugaauguaaagaaugca

SEQ ID NO: 477177 - RNA, 64 nt, Homo Sapiens
acuucuuuucaauaucaugaaaggacucacaugggagagaaacccuaugaguguaugccaagug

SEQ ID NO: 477178 - RNA, 64 nt, Homo Sapiens
aaguuauuucaaacacaugaaaaaauucacacuggagagaaacccuauaaaugcaagcaaugug

SEQ ID NO: 477179 - RNA, 64 nt, Homo Sapiens
aagaaccuuucaauuuaugaaaggacacacacuggagagaaacccuaugaauguaagaaaugug

SEQ ID NO: 477180 - RNA, 64 nt, Homo Sapiens
caagaucguuugaauacaugcaaaacacacacuggagagaaaccuaugaauguaaggaaugcaa

SEQ ID NO: 477181 - RNA, 64 nt, Homo Sapiens
aagucauuucgaagacaugaaaaaacucacacuggagagaaacccuauaaaugcaugccaugug

SEQ ID NO: 477182 - RNA, 64 nt, Homo Sapiens
aguuccuuucaguaucaugaaaggacucacacuggagagaaacccuaugaguguaagcaaugug

SEQ ID NO: 477183 - RNA, 64 nt, Homo Sapiens
ccccacaccuucgaaggcaugguaggacucacuggagagaaacccuaugaguguaaggaaugug

SEQ ID NO: 477184 - RNA, 64 nt, Homo Sapiens
aguuccuuuugguaccaugaaaggacucacacuggagagaaacccuaugaguguaagcaaugug

SEQ ID NO: 477185 - RNA, 64 nt, Homo Sapiens
ccacaccuucgaauccaugguagaacucacacuggagagaaacccuaugaguguaaggaaugug

SEQ ID NO: 477186 - RNA, 64 nt, Homo Sapiens
aagucauuucaaauaccugaaaaaucuuacacuggagagaaacccuaugaguguaagcaaugug

SEQ ID NO: 477187 - RNA, 64 nt, Homo Sapiens
acuucuuuucgauaacaugaaaggacucacacuggagagaaacccuaugaguguaagcaaugug

SEQ ID NO: 477188 - RNA, 64 nt, Homo Sapiens
guaugaaaacacaaagcacaggucaggauccucugagagaaaaucaacauugcaccacguaggg

SEQ ID NO: 477189 - RNA, 64 nt, Homo Sapiens
aaugagggcaacaggagauguggggacguguuaggagagaaaaaaaaaaaaacaaaaauauaua

SEQ ID NO: 477190 - RNA, 64 nt, Homo Sapiens
aaucaaccaacacaagaucaaaaaggaaaaggacgagagaaaaauuauuuuuaagauaauuaaa

SEQ ID NO: 477191 - RNA, 64 nt, Homo Sapiens
ccacccugaccgugcugaacagacccccccacacgagagaaaauaaaggagcaauaaagucacg

SEQ ID NO: 477192 - RNA, 64 nt, Homo Sapiens
uuuacccuuaauacacauaagauaauuaaugcuggagagaaacccuacaaaugugaagaaugug

SEQ ID NO: 477193 - RNA, 64 nt, Homo Sapiens
ucauaccuuacuaaauauaagauaauucauauuggagagaaauucuacagaugugaagaaugug

SEQ ID NO: 477194 - RNA, 64 nt, Homo Sapiens
ucauccauuaguaaacauaagauaauucauacuggagagaaaaccuacaaaugugaggaaugug

SEQ ID NO: 477195 - RNA, 64 nt, Homo Sapiens
ucaacccuuacuacacauuagauaauucaugcuggagagaaacccuacaaaugugaaaaaugug

SEQ ID NO: 477196 - RNA, 64 nt, Homo Sapiens
aguccucaacuccuaguaaacauaauuaaugauggagagaaaccauacaacugugaagaaugug

SEQ ID NO: 477197 - RNA, 64 nt, Homo Sapiens
ccucaaacuuuauugaacaaaauaauucauacaggagagaaacccuacaaaugugaagaaugug

SEQ ID NO: 477198 - RNA, 64 nt, Homo Sapiens
ucaauuuuuacuaaacauaagaaaauucauacuggagagaaacccuaugauugugaaaaauaug

SEQ ID NO: 477199 - RNA, 64 nt, Homo Sapiens
ucgucccugcuucaacaucacaguauucauacuggagagaaaccuuacgaauguauuaaaugug

SEQ ID NO: 477200 - RNA, 64 nt, Homo Sapiens
ucgaaucuuacugcccaucaaagaguacauaauggagagaaacccaauagugugguaagugugg

SEQ ID NO: 477201 - RNA, 64 nt, Homo Sapiens
gaaaaucucauuacacaucagaaaauucacacuggagagaaaccuuaugaaugcagugaaugug

SEQ ID NO: 477202 - RNA, 64 nt, Homo Sapiens
ucaaaccucacugaacaugagaaaauucauacuggagagaaaccuuaucauuguaaucaaugug

SEQ ID NO: 477203 - RNA, 64 nt, Homo Sapiens
caaaaucuucuugagcaugaaaaaauucauacuggagagaaaccauucaaauguaaugaaugug

SEQ ID NO: 477204 - RNA, 64 nt, Homo Sapiens
cugcgggacagagugagacccugucugaaagaaagagagaaagaaagaaagaaagagagagaaa

SEQ ID NO: 477205 - RNA, 64 nt, Homo Sapiens
gucugaaagaaagagagaaagaaagaaagaaagagagagaaagaaagaaagaaagaaagggaaa

SEQ ID NO: 477206 - RNA, 64 nt, Homo Sapiens
aggaaggaaggaaaaagaaagagaaagagagagagagagaaagaaaaagaaagaaaaguaagaa

SEQ ID NO: 477207 - RNA, 61 nt, Homo Sapiens; identical to SEQ ID NO: 216570

SEQ ID NO: 477208 - RNA, 64 nt, Homo Sapiens
ucacgccuuaaaagacauaggagaauucauacuggagagaaaccuuacaaguguaaugagugug

SEQ ID NO: 477209 - RNA, 64 nt, Homo Sapiens
ucauaccuugcaguucaucagugaacucauacuggagagaaaccuuacaaaugucaugacugug

SEQ ID NO: 477210 - RNA, 64 nt, Homo Sapiens
ucauccuaugcaaaacauaggagaauucaugcaggagagaaaugucacaagugugaugaguguu

SEQ ID NO: 477211 - RNA, 64 nt, Homo Sapiens
ucacaccucauuagacaucagagaaucccuacuggagagaaaucuuacaaaugucaucagugug

SEQ ID NO: 477212 - RNA, 64 nt, Homo Sapiens
uuuccuuggagcacugagcaccauuuggaagcuugagagaaaccaaaauuaaagagagaaagag

SEQ ID NO: 477213 - RNA, 64 nt, Homo Sapiens
accauuuggaagcuugagagaaaccaaaauuaaagagagaaagagagagcgugcacgcuccugc

SEQ ID NO: 477214 - RNA, 64 nt, Homo Sapiens
caucugucguggcugagcggggcgagcuguucuggagagaaaacuucacaccccagugucacag

SEQ ID NO: 477215 - RNA, 64 nt, Homo Sapiens
ccacaaauuccaaugucacagggauggggggagagagagaaaaucccagggucuggugauggca

SEQ ID NO: 477216 - RNA, 64 nt, Homo Sapiens
aaaucacccaccacccccccgagagagacagagagagagaaaaagaaaacagaaacccgagaaa

SEQ ID NO: 477217 - RNA, 64 nt, Homo Sapiens
cugcaauuuaaaugguaugggugaacucacauuggagagaaaccacaaaccuuaauguguguau

SEQ ID NO: 477218 - RNA, 64 nt, Homo Sapiens
guaugaauguagagaaucugcagaaaucucacuggagagaaacuucaagccuuaccaaacacau

SEQ ID NO: 477219 - RNA, 64 nt, Homo Sapiens
uuaaagcuggguguccgggggacagaguacaaaagagagaaauugccaacuugagaaauaaagg

SEQ ID NO: 477220 - RNA, 64 nt, Homo Sapiens
uuuuguauguaaagaauuuggugaacuccuaccagagagaaacccuguauuccucaccccaccu

SEQ ID NO: 477221 - RNA, 64 nt, Homo Sapiens
uuauaaauguaaggauuguggagaaugcacacuggagagaaaccacaggcuuucgagugcacau

SEQ ID NO: 477222 - RNA, 64 nt, Homo Sapiens
cuaugaauguaaagaaugugacgaauucauacuggagagaaaccaguuauauucauauacauga

SEQ ID NO: 477223 - RNA, 64 nt, Homo Sapiens
uuaugaauguaaacagugugaagaacccacacuggagagaaaccgcagguuuccagauacauga

SEQ ID NO: 477224 - RNA, 64 nt, Homo Sapiens
cuacaaauguaaggaaugugaaggacucauacuggagagaaaccuacucagcucaaagacauga

SEQ ID NO: 477225 - RNA, 64 nt, Homo Sapiens
cuacaaaugcaaggaaugugaaagacucauacuggagagaaaccaacucugcucaaagacauga

SEQ ID NO: 477226 - RNA, 64 nt, Homo Sapiens
cuacaaauguaaggaaugugaaaggcucauacuggagagaaacccaaucugcucaaaaacauga

SEQ ID NO: 477227 - RNA, 64 nt, Homo Sapiens
uuaugaagguaaacaaugugaagaauucacacucgagagaaaccacuugccuucuacaacauga

SEQ ID NO: 477228 - RNA, 64 nt, Homo Sapiens
cuguacauguaaacaaugugaaaaacucacacuggagagaaacuaguucuugucuaagacauga

SEQ ID NO: 477229 - RNA, 64 nt, Homo Sapiens
auaugaauguaagcaguguuaagaacucacucuggagagaaacuaguuuauuucguaugcauga

SEQ ID NO: 477230 - RNA, 64 nt, Homo Sapiens
auaaagaaaauucuauauccgagaauauauacuggagagaaacuguaaucuuuuaaagacaccu

SEQ ID NO: 477231 - RNA, 64 nt, Homo Sapiens
caaggaauguaaacgguguggaguacuuacgcuggagagaaauuaguuccuuuuggauguauga

SEQ ID NO: 477232 - RNA, 64 nt, Homo Sapiens
acaaagcuggaagacaucacaaaaacuuaaacuggagagaaacucuaaaucuuacuaaacauaa

SEQ ID NO: 477233 - RNA, 64 nt, Homo Sapiens
cuacaaauguaaagaauguggauaauucauacuagagagaaaccuuaauccuuaugaaacaaaa

SEQ ID NO: 477234 - RNA, 64 nt, Homo Sapiens
cuacaaaugugauaaauguggauaauucauacuggagagaaauccaacuuuuauuaaaacacaa

SEQ ID NO: 477235 - RNA, 64 nt, Homo Sapiens
augcaugugugaagaauguggacaacucauacuggagagaaaccuuaaggcuuacuacauauaa

SEQ ID NO: 477236 - RNA, 64 nt, Homo Sapiens
cuacaaaugcgaagaauguggagaauucauacuggagagaaaccucaaaccuuguggaacauaa

SEQ ID NO: 477237 - RNA, 64 nt, Homo Sapiens
cuacaaacgugaagaauguggaaaauucaugcuggagagaaacaucaaucuuuauuacacauaa

SEQ ID NO: 477238 - RNA, 64 nt, Homo Sapiens
cuacaaaggugaagaauguggaaaauucauacuggagagaaaauucucagucuaguaaacauaa

SEQ ID NO: 477239 - RNA, 64 nt, Homo Sapiens
ucacaagugugaugauuguggagaauuuauacaggagagaaaccucauccuaugcaaaacauag

SEQ ID NO: 477240 - RNA, 64 nt, Homo Sapiens
uuacaaaugucaugacuguggugaacucauacuggagagaaaccucacauauugcaggucaucg

SEQ ID NO: 477241 - RNA, 64 nt, Homo Sapiens
uuacaaguguaaugaguguguggacuucacacuggagagaaaccucacaccuggaacaacauac

SEQ ID NO: 477242 - RNA, 64 nt, Homo Sapiens
uuacaaauguaagguuucuggagaauuuauacuggagagaaagcaucacaccuuaaagacauag

SEQ ID NO: 477243 - RNA, 64 nt, Homo Sapiens
ucacaugugugaugauuguggagaauucauacaggagagaaaccucauccuaugcaaaacauag

SEQ ID NO: 477244 - RNA, 64 nt, Homo Sapiens
uuacaaaugucaugacugugacacacucauacuggagagaaaccucauacauugcaguucauug

SEQ ID NO: 477245 - RNA, 64 nt, Homo Sapiens
cacaagugugaugauugugggaggauucauacaggagagaaacuucauccuaugcaaaacauag

SEQ ID NO: 477246 - RNA, 64 nt, Homo Sapiens
uuauaaaugucaugauugugucgaacucaugcuggagagaaaccucauauauugcuauucauca

SEQ ID NO: 477247 - RNA, 64 nt, Homo Sapiens
uuacaagugcaaugaguguguagaauucacacuggagagaaaccucacaccuggcacaccauac

SEQ ID NO: 477248 - RNA, 64 nt, Homo Sapiens
cuacaaguguaaugaaugugggcaauucguauuggagagaaaccucauaccuuguaauucaaaa

SEQ ID NO: 477249 - RNA, 64 nt, Homo Sapiens
uuacaaaugugaugaguguguagaauucaaacuggagagaaaccucauaccuggcaaaacauau

SEQ ID NO: 477250 - RNA, 64 nt, Homo Sapiens
uuacaaguguaaugaaugugagccauucauacuggagagaaacuucaacccuuguaagucacaa

SEQ ID NO: 477251 - RNA, 64 nt, Homo Sapiens
uuaaaaguguaaugaguguguagacuucauaguggagagaaaccucaaaccuuguauaccauca

SEQ ID NO: 477252 - RNA, 64 nt, Homo Sapiens
ucacaagugugaugauuguggaggauucauacaggagagaaaccucauccuaugcaaaacauag

SEQ ID NO: 477253 - RNA, 64 nt, Homo Sapiens
uuauaaaugucaugauugaggugaacucaugcuggagagaaaccucaugccuugcauuucacug

SEQ ID NO: 477254 - RNA, 64 nt, Homo Sapiens
uuacaagugcaaugaguguguagaauucacacuggagagaaaccucacacguggcaccccauac

SEQ ID NO: 477255 - RNA, 64 nt, Homo Sapiens
uuacaagcacaaugaauguguguaauucauaguggagagaaaccaaaggucaaaauucacaccu

SEQ ID NO: 477256 - RNA, 64 nt, Homo Sapiens
cauuauaaguguaaugaguguagaauucacacuggagagaaacugcauaucuggcaaaacauac

SEQ ID NO: 477257 - RNA, 64 nt, Homo Sapiens
uuacaaaugggaggaauguguagacuucauacuggagagaaaccgcaaccuuugcacaucacca

SEQ ID NO: 477258 - RNA, 64 nt, Homo Sapiens
uuacaagcauaaugaaugugggcaauucauacuggagagaaaccuucaacccuguaagucauaa

SEQ ID NO: 477259 - RNA, 64 nt, Homo Sapiens
uuuuguuuuuuaaacaaaugaugcugagaauaaggagagaaaugaauguagagagagguagaga

SEQ ID NO: 477260 - RNA, 64 nt, Homo Sapiens
aauaaggagagaaaugaauguagagagagguagagagagaaauaugaacucuaacaaaggacug

SEQ ID NO: 477261 - RNA, 64 nt, Homo Sapiens
cccaguuaguggugugcaaauuaaaaaaaagaaugagagaaaagagaagagaccugccagaaga

SEQ ID NO: 477262 - RNA, 64 nt, Homo Sapiens
ugggguuuuguuuccccaccugaaaaaaugaucagagagaaaagcucccucuuagaaucucuua

SEQ ID NO: 477263 - RNA, 64 nt, Homo Sapiens
guaauuugauuauuucauucgagggugagaauuugagagaaauaucacucugagcgagucucua

SEQ ID NO: 477264 - RNA, 64 nt, Homo Sapiens
auuucuauuaaugguuuaauaauauuacauauuugagagaaaaugaaacuuucuuuuacaaaag

SEQ ID NO: 477265 - RNA, 64 nt, Homo Sapiens
uaagagcugguucuaaaaucaucacauaugacacgagagaaaagaauugucaagugaggacuuc

SEQ ID NO: 477266 - RNA, 64 nt, Homo Sapiens
gagccgcugugcugguggggcagggcaaagaauagagagaaaggaagcaauccagaggugccuu

SEQ ID NO: 477267 - RNA, 64 nt, Homo Sapiens
ugcaugauuggcauuaguuaccacagccugcccagagagaaacuaucuucucccaacauuuacu

SEQ ID NO: 477268 - RNA, 64 nt, Homo Sapiens
aaaauguuacaaccgcuguaaaaugacggagagagagagaaagaaucccagacauuaacgguau

SEQ ID NO: 477269 - RNA, 64 nt, Homo Sapiens; identical to SEQ ID NO: 225847

SEQ ID NO: 477270 - RNA, 64 nt, Homo Sapiens; identical to SEQ ID NO: 225848

SEQ ID NO: 477271 - RNA, 64 nt, Homo Sapiens; identical to SEQ ID NO: 225849

SEQ ID NO: 477272 - RNA, 64 nt, Homo Sapiens; identical to SEQ ID NO: 225850

SEQ ID NO: 477273 - RNA, 64 nt, Homo Sapiens; identical to SEQ ID NO: 225851

SEQ ID NO: 477274 - RNA, 64 nt, Homo Sapiens; identical to SEQ ID NO: 225852

SEQ ID NO: 477275 - RNA, 64 nt, Homo Sapiens; identical to SEQ ID NO: 225853

SEQ ID NO: 477276 - RNA, 64 nt, Homo Sapiens; identical to SEQ ID NO: 225854

SEQ ID NO: 477277 - RNA, 64 nt, Homo Sapiens; identical to SEQ ID NO: 225855

SEQ ID NO: 477278 - RNA, 64 nt, Homo Sapiens; identical to SEQ ID NO: 225856

SEQ ID NO: 477279 - RNA, 64 nt, Homo Sapiens; identical to SEQ ID NO: 225857

SEQ ID NO: 477280 - RNA, 64 nt, Homo Sapiens; identical to SEQ ID NO: 225858

SEQ ID NO: 477281 - RNA, 64 nt, Homo Sapiens; identical to SEQ ID NO: 225859

SEQ ID NO: 477282 - RNA, 64 nt, Homo Sapiens; identical to SEQ ID NO: 225860

SEQ ID NO: 477283 - RNA, 64 nt, Homo Sapiens; identical to SEQ ID NO: 221951

SEQ ID NO: 477284 - RNA, 64 nt, Homo Sapiens; identical to SEQ ID NO: 221952

SEQ ID NO: 477285 - RNA, 64 nt, Homo Sapiens; identical to SEQ ID NO: 221953

SEQ ID NO: 477286 - RNA, 64 nt, Homo Sapiens; identical to SEQ ID NO: 221954

SEQ ID NO: 477287 - RNA, 64 nt, Homo Sapiens; identical to SEQ ID NO: 221955

SEQ ID NO: 477288 - RNA, 64 nt, Homo Sapiens; identical to SEQ ID NO: 221956

SEQ ID NO: 477289 - RNA, 64 nt, Homo Sapiens; identical to SEQ ID NO: 221957

SEQ ID NO: 477290 - RNA, 64 nt, Homo Sapiens; identical to SEQ ID NO: 221958

SEQ ID NO: 477291 - RNA, 64 nt, Homo Sapiens; identical to SEQ ID NO: 221959

SEQ ID NO: 477292 - RNA, 64 nt, Homo Sapiens; identical to SEQ ID NO: 221960

SEQ ID NO: 477293 - RNA, 64 nt, Homo Sapiens; identical to SEQ ID NO: 221961

SEQ ID NO: 477294 - RNA, 64 nt, Homo Sapiens; identical to SEQ ID NO: 221962

SEQ ID NO: 477295 - RNA, 64 nt, Homo Sapiens; identical to SEQ ID NO: 221963

SEQ ID NO: 477296 - RNA, 64 nt, Homo Sapiens; identical to SEQ ID NO: 221964

SEQ ID NO: 477297 - RNA, 64 nt, Homo Sapiens; identical to SEQ ID NO: 221965

SEQ ID NO: 477298 - RNA, 64 nt, Homo Sapiens; identical to SEQ ID NO: 221966

SEQ ID NO: 477299 - RNA, 64 nt, Homo Sapiens; identical to SEQ ID NO: 221967

SEQ ID NO: 477300 - RNA, 64 nt, Homo Sapiens; identical to SEQ ID NO: 221968

SEQ ID NO: 477301 - RNA, 64 nt, Homo Sapiens; identical to SEQ ID NO: 221969

SEQ ID NO: 477302 - RNA, 64 nt, Homo Sapiens; identical to SEQ ID NO: 221970

SEQ ID NO: 477303 - RNA, 64 nt, Homo Sapiens; identical to SEQ ID NO: 221971

SEQ ID NO: 477304 - RNA, 64 nt, Homo Sapiens; identical to SEQ ID NO: 221972

SEQ ID NO: 477305 - RNA, 64 nt, Homo Sapiens; identical to SEQ ID NO: 221973

SEQ ID NO: 477306 - RNA, 64 nt, Homo Sapiens; identical to SEQ ID NO: 221974

SEQ ID NO: 477307 - RNA, 64 nt, Homo Sapiens; identical to SEQ ID NO: 221975

SEQ ID NO: 477308 - RNA, 64 nt, Homo Sapiens; identical to SEQ ID NO: 221976

SEQ ID NO: 477309 - RNA, 64 nt, Homo Sapiens; identical to SEQ ID NO: 221977

SEQ ID NO: 477310 - RNA, 64 nt, Homo Sapiens; identical to SEQ ID NO: 221978

SEQ ID NO: 477311 - RNA, 64 nt, Homo Sapiens; identical to SEQ ID NO: 221979

SEQ ID NO: 477312 - RNA, 64 nt, Homo Sapiens; identical to SEQ ID NO: 221980

SEQ ID NO: 477313 - RNA, 64 nt, Homo Sapiens; identical to SEQ ID NO: 221981

SEQ ID NO: 477314 - RNA, 64 nt, Homo Sapiens; identical to SEQ ID NO: 221982

SEQ ID NO: 477315 - RNA, 64 nt, Homo Sapiens; identical to SEQ ID NO: 221983

SEQ ID NO: 477316 - RNA, 64 nt, Homo Sapiens; identical to SEQ ID NO: 221984

SEQ ID NO: 477317 - RNA, 64 nt, Homo Sapiens; identical to SEQ ID NO: 221985

SEQ ID NO: 477318 - RNA, 64 nt, Homo Sapiens; identical to SEQ ID NO: 221986

SEQ ID NO: 477319 - RNA, 64 nt, Homo Sapiens; identical to SEQ ID NO: 221987

SEQ ID NO: 477320 - RNA, 64 nt, Homo Sapiens; identical to SEQ ID NO: 221988

SEQ ID NO: 477321 - RNA, 64 nt, Homo Sapiens; identical to SEQ ID NO: 221989

SEQ ID NO: 477322 - RNA, 64 nt, Homo Sapiens; identical to SEQ ID NO: 221990

SEQ ID NO: 477323 - RNA, 64 nt, Homo Sapiens; identical to SEQ ID NO: 221991

SEQ ID NO: 477324 - RNA, 64 nt, Homo Sapiens; identical to SEQ ID NO: 221992

SEQ ID NO: 477325 - RNA, 64 nt, Homo Sapiens; identical to SEQ ID NO: 221993

SEQ ID NO: 477326 - RNA, 64 nt, Homo Sapiens; identical to SEQ ID NO: 221994

SEQ ID NO: 477327 - RNA, 64 nt, Homo Sapiens; identical to SEQ ID NO: 221995

SEQ ID NO: 477328 - RNA, 64 nt, Homo Sapiens; identical to SEQ ID NO: 221996

SEQ ID NO: 477329 - RNA, 64 nt, Homo Sapiens; identical to SEQ ID NO: 221997

SEQ ID NO: 477330 - RNA, 64 nt, Homo Sapiens; identical to SEQ ID NO: 221998

SEQ ID NO: 477331 - RNA, 64 nt, Homo Sapiens; identical to SEQ ID NO: 221999

SEQ ID NO: 477332 - RNA, 64 nt, Homo Sapiens; identical to SEQ ID NO: 222000

SEQ ID NO: 477333 - RNA, 64 nt, Homo Sapiens; identical to SEQ ID NO: 222001

SEQ ID NO: 477334 - RNA, 64 nt, Homo Sapiens; identical to SEQ ID NO: 222002

SEQ ID NO: 477335 - RNA, 64 nt, Homo Sapiens; identical to SEQ ID NO: 222003

SEQ ID NO: 477336 - RNA, 64 nt, Homo Sapiens; identical to SEQ ID NO: 222004

SEQ ID NO: 477337 - RNA, 64 nt, Homo Sapiens; identical to SEQ ID NO: 222005

SEQ ID NO: 477338 - RNA, 64 nt, Homo Sapiens; identical to SEQ ID NO: 222006

SEQ ID NO: 477339 - RNA, 64 nt, Homo Sapiens; identical to SEQ ID NO: 222007

SEQ ID NO: 477340 - RNA, 64 nt, Homo Sapiens
aguaacauuuggguuucacuaaaaaugucauaaagggcacuaaauuaaaaacucagguuagaac

SEQ ID NO: 477341 - RNA, 64 nt, Homo Sapiens
auguuuaucuuuuucuuuuugaggucucagccucgggcacuacagagacagaagugcuggcuag

SEQ ID NO: 477342 - RNA, 64 nt, Homo Sapiens
cguuucuccugagcccuggggucaccucagggacagcguccaggcuucagccaagggcucccug

SEQ ID NO: 477343 - RNA, 64 nt, Homo Sapiens
aacccugagugugauucuggcaucuguggacuugagcguccaaacccucgucugggcaccucag

SEQ ID NO: 477344 - RNA, 64 nt, Homo Sapiens
ucagacggaugggugacuagggaugagcuaugacagcguccaggggcagugaaucgaagcccaa

SEQ ID NO: 477345 - RNA, 64 nt, Homo Sapiens
ccccagcagcccccuccugccggggcagaaagccagcguccaugaccagaaaccaccaggcaca

SEQ ID NO: 477346 - RNA, 64 nt, Homo Sapiens
gucgguguggagauccaaaguggguuguggaaagagcguccauaggagaagugagaauacugug

SEQ ID NO: 477347 - RNA, 64 nt, Homo Sapiens
cuucaugccuugggccgagcagccugaggagcccagcguccacucuuucccaucuccccugggg

SEQ ID NO: 477348 - RNA, 64 nt, Homo Sapiens
cagccccuguccucaccucuccugccuuccacccagcguccaucaguacacuggagugccgagc

SEQ ID NO: 477349 - RNA, 64 nt, Homo Sapiens
auguuuaaaauauuucauagaugagcuuuuugguagcguccacauugaaaauuuuuauauacca

SEQ ID NO: 477350 - RNA, 64 nt, Homo Sapiens
uccccucaacgcuauauuuuagggugaagacccuagcguccagcuucggcuuuugcuuugcguu

SEQ ID NO: 477351 - RNA, 64 nt, Homo Sapiens
gcagauggcagaggaucugcucuucuccacagcaagcguccaggucuuugaagacacacucggc

SEQ ID NO: 477352 - RNA, 64 nt, Homo Sapiens
cccuuguccuccuucaaauaaaugcuuugugcgcagcguccaguuugcccaccuuguucaacuc

SEQ ID NO: 477353 - RNA, 64 nt, Homo Sapiens
gagaagagguuccaaauugggcuucugugcccagagcguccacagcaccauucccaguguagac

SEQ ID NO: 477354 - RNA, 64 nt, Homo Sapiens
auguacuguuuggauguagcauagucuugagucuagcguccacaaagaauuauucaaaugauau

SEQ ID NO: 477355 - RNA, 64 nt, Homo Sapiens
cugcagccugcugugcugagcccugcugcaguccagcguccagauggaugcacguucacuacug

SEQ ID NO: 477356 - RNA, 64 nt, Homo Sapiens
ucuuauuuaauuagaauggauauacacacucguuagcguccauuacggucuucugcaucacugg

SEQ ID NO: 477357 - RNA, 64 nt, Homo Sapiens
uuuacuugcuggaugauaccauaauguaucaaggagcguccauggauacaagauaagaugugua

SEQ ID NO: 477358 - RNA, 64 nt, Homo Sapiens
ccucuggagucucuccuugugauccuuccugaggagcguccauuggaucuguuucuuugccuga

SEQ ID NO: 477359 - RNA, 64 nt, Homo Sapiens
ucugcacucucugcucugcuuaaacucgcuucugagcguccacugauagaggaaaagacacaca

SEQ ID NO: 477360 - RNA, 64 nt, Homo Sapiens
gugauuuucauuguaaauauuugacuuuagugaaagcguccaauugacugcccucuuacuguuu

SEQ ID NO: 477361 - RNA, 64 nt, Homo Sapiens
cccuggggacaaagcagcgucuggcucgaguggaagcguccaaaccugcuuuucccaucucccc

SEQ ID NO: 477362 - RNA, 64 nt, Homo Sapiens
gugccuuucucucucggcuucguccccacucauuagcguccagacagaaaggcauuuccaccac

SEQ ID NO: 477363 - RNA, 64 nt, Homo Sapiens
ccauagucugucuccucacaucacagauagucacagcguccauuguauaaccccuuccacuauc

SEQ ID NO: 477364 - RNA, 64 nt, Homo Sapiens
uuuucauauuagagguggaaugcuaugugcaaacagcguccauuacaggagguaucaaacuagc

SEQ ID NO: 477365 - RNA, 64 nt, Homo Sapiens
acgauaaggcaguaaacauggagacacgggggacagcguccacacucagagggccugggccaca

SEQ ID NO: 477366 - RNA, 64 nt, Homo Sapiens
ggcaaaauggcuagaauuauucagacgauuuggcagcguccaggguaagcugguguuauaauac

SEQ ID NO: 477367 - RNA, 64 nt, Homo Sapiens
ggcuccaggcuccucacaacgccuccucccucccagcguccacucgguugccccccacucuaaa

SEQ ID NO: 477368 - RNA, 64 nt, Homo Sapiens
cuccucccagcuguaccggccacugcaacccaugagcguccaggugaucccccaaacagcaugu

SEQ ID NO: 477369 - RNA, 64 nt, Homo Sapiens
guacaucguuuuaaaugaaaauuuguuuuauuuuagcguccauucuucauuggcuauaaacuuu

SEQ ID NO: 477370 - RNA, 64 nt, Homo Sapiens
ccaaaggucagugacaguuucucagaagaggcccagcguccaccucucucccagggccagacag

SEQ ID NO: 477371 - RNA, 64 nt, Homo Sapiens
ggaaauucuuccuaaaacuaguucuuaaaaucagagcguccagaauaaaauccauuuaacuggu

SEQ ID NO: 477372 - RNA, 64 nt, Homo Sapiens
caguccugccuggggucaggcccggcuggagaacagcguccacggcagcggaggccaggucugu

SEQ ID NO: 477373 - RNA, 64 nt, Homo Sapiens
gcucagaacguuccaggccuuggugagacacagcagcguccaaugcucacaggcuguccccacu

SEQ ID NO: 477374 - RNA, 64 nt, Homo Sapiens
uccuacuaacucugagcugaugcguagacccaacagcguccagugaggaggaaguggaggccgc

SEQ ID NO: 477375 - RNA, 64 nt, Homo Sapiens
gcagcacaggaucagauggcgcguggcgaaagucagcguccacugugcugggccagagaggacg

SEQ ID NO: 477376 - RNA, 64 nt, Homo Sapiens
gugaagccuucuggaggagaaggugacguggcccagcguccaagggacagacucagcuccaggc

SEQ ID NO: 477377 - RNA, 64 nt, Homo Sapiens
cccccagggcugcuuccugcaaugaaucaauagcagcguccaguuauuuuucuuuucuuuuuuu

SEQ ID NO: 477378 - RNA, 64 nt, Homo Sapiens
agccaccauucuguggaaccuuuagugucuuaaaagcguccauaccuuuuaccauguggguuuc

SEQ ID NO: 477379 - RNA, 64 nt, Homo Sapiens
cuuuacaaccauggccucuaguauacuuaaaauaagcguccaguuauaaaaagccuauuugcac

SEQ ID NO: 477380 - RNA, 64 nt, Homo Sapiens
cuuccucaccaucccauuaaagaccgggcugguuagcguccagcucagggagaagggcgcuagu

SEQ ID NO: 477381 - RNA, 64 nt, Homo Sapiens
aggcacaucagucccaaaauucaucacuuaacccagcguccaggagggucaggccuguacccca

SEQ ID NO: 477382 - RNA, 64 nt, Homo Sapiens
uuaguuguaucucugugaaaaacuuguauacacaagcguccaugucucacacaaauauugaugu

SEQ ID NO: 477383 - RNA, 64 nt, Homo Sapiens
augugaauccuacaguuuccucacuuuagcagacagcguccacagaaaauggucuuaauggugc

SEQ ID NO: 477384 - RNA, 64 nt, Homo Sapiens
cccaguugacagucaguggaaugcucgucuccuuagcguccaggguggggauucugcuggaaua

SEQ ID NO: 477385 - RNA, 64 nt, Homo Sapiens
acaagucucuuacacuggacgcccacugcuccucagcguccaguccuccugggcggccccaggu

SEQ ID NO: 477386 - RNA, 64 nt, Homo Sapiens
aauggugcucaccaugcuuccccgacacggccugagcguccagaugugguggagaugacugaag

SEQ ID NO: 477387 - RNA, 64 nt, Homo Sapiens
ugggacugggauaauuguucuggaacuaaagaagagcguccagguguuaguuauuacguucacc

SEQ ID NO: 477388 - RNA, 64 nt, Homo Sapiens
ccccaggcccgggcgcaggaccgcuggaggacgcagcguccagggccagcgagcucccccggca

SEQ ID NO: 477389 - RNA, 64 nt, Homo Sapiens
cagcuucuucuucgagucggagagcuacaaggacagcguccaggguagggugagagggggacca

SEQ ID NO: 477390 - RNA, 64 nt, Homo Sapiens
cugaugccaacugcagauaauacacaccuccugcagcguccagccacggcuccagggcacugcu

SEQ ID NO: 477391 - RNA, 64 nt, Homo Sapiens
acacaaauaaaagacccuugcagucacucccaacagcguccagcccauagggcuggcucacauc

SEQ ID NO: 477392 - RNA, 64 nt, Homo Sapiens
gcagcccgggggcauccuggggugcuggggucuuagcguccagcgaagcugcugacugugauua

SEQ ID NO: 477393 - RNA, 64 nt, Homo Sapiens
gugcacccagcgcuccauaggauguucacgucuaagcguccaguucaggugaugagcugagaaa

SEQ ID NO: 477394 - RNA, 64 nt, Homo Sapiens
acuggggcccacccuucucacuuuagaggacuucagcguccaagaggcugugucucugccuugu

SEQ ID NO: 477395 - RNA, 64 nt, Homo Sapiens
caagaucuacauuucaacccugccuuacacccagagcguccagaucugccacauagaaggucag

SEQ ID NO: 477396 - RNA, 64 nt, Homo Sapiens
agagcucgggcccugugaccaagccauugagggcagcguccagggacaguggcugagcacgugg

SEQ ID NO: 477397 - RNA, 64 nt, Homo Sapiens
uuaaaagccgcugaccaaaggagaccagcacagcagcguccaggaacugggcccugagcuguga

SEQ ID NO: 477398 - RNA, 64 nt, Homo Sapiens
auguuaauuagcguaucauuccaaggucuuugggagcguccagccccacuugguccuaagaauc

SEQ ID NO: 477399 - RNA, 64 nt, Homo Sapiens
ggugccucucaagaaaccccacgugucccagcccagcguccagucugaacggagccaggaggcc

SEQ ID NO: 477400 - RNA, 64 nt, Homo Sapiens
aaggagagcuuagcaggagucuguuuuuagcaaaagcguccagaugacauuaaggaaaguucug

SEQ ID NO: 477401 - RNA, 64 nt, Homo Sapiens
aaccugauucaggguuagcagcaaugaguaucacagcguccaacucaguagcuccaguguauga

SEQ ID NO: 477402 - RNA, 64 nt, Homo Sapiens
cacagauuguucuguaaggaaguuugcuggagaaagcguccacuuuaguuauucuaaaauagaa

SEQ ID NO: 477403 - RNA, 64 nt, Homo Sapiens
cggguggagacuuugggauggacuggaggaggccagcguccagcuggcggugcucccgggaugu

SEQ ID NO: 477404 - RNA, 64 nt, Homo Sapiens
guggugugacggcucacugcagccugcgccucccagcguccagcaauucuuguuucucggccuc

SEQ ID NO: 477405 - RNA, 64 nt, Homo Sapiens
ugcggggccgggaaccacaccccaccccaccggcagcguccagguauccacccgcccacccgcc

SEQ ID NO: 477406 - RNA, 64 nt, Homo Sapiens
guuacucaucacugcauuguuagcccagugugucagcguccauugcuggacagaaagugauccu

SEQ ID NO: 477407 - RNA, 64 nt, Homo Sapiens
aauauuucacauccauccagagcucggaaucuacagcguccagccauuuccagcaagagcgcuu

SEQ ID NO: 477408 - RNA, 64 nt, Homo Sapiens
agcucacccgacgccgagccggacagaaagcauuagcguccacgcuggagcagcaccucagagu

SEQ ID NO: 477409 - RNA, 64 nt, Homo Sapiens
cacggacaaugccuggaucgagacgguggccgucagcguccacuuccaggaccagaaugacgug

SEQ ID NO: 477410 - RNA, 64 nt, Homo Sapiens
cccagguguccacacaccuguaggccucugagccagcguccaggguacaggugcgggugguggg

SEQ ID NO: 477411 - RNA, 64 nt, Homo Sapiens
agccacgggcucccaccccgagcacaacaggauaagcguccaggaucccaguccugagggacuc

SEQ ID NO: 477412 - RNA, 64 nt, Homo Sapiens
aguuauucuccccuaugccuuccuucucuuucuaagcguccacuaggucuggccuuggaaaccu

SEQ ID NO: 477413 - RNA, 64 nt, Homo Sapiens
ggauaucugaggaacauucacgacugccuucauaagcguccauacuuuuuuugcaaaugccacu

SEQ ID NO: 477414 - RNA, 64 nt, Homo Sapiens
aaaaaaaaaauagccgugcacucuugaccccgucagcguccaacguggaaaaggcguuaccucu

SEQ ID NO: 477415 - RNA, 64 nt, Homo Sapiens
gcccaguuauucuccccuaugccuucucuuccuaagcguccacuaggucuggccuuggaaaucu

SEQ ID NO: 477416 - RNA, 64 nt, Homo Sapiens
ccaagccugagcauccacacaagcgggccgcccgagcguccacuacacggccgcaccugcccca

SEQ ID NO: 477417 - RNA, 64 nt, Homo Sapiens; identical to SEQ ID NO: 477342

SEQ ID NO: 477418 - RNA, 64 nt, Homo Sapiens; identical to SEQ ID NO: 477343

SEQ ID NO: 477419 - RNA, 64 nt, Homo Sapiens; identical to SEQ ID NO: 477344

SEQ ID NO: 477420 - RNA, 64 nt, Homo Sapiens; identical to SEQ ID NO: 477345

SEQ ID NO: 477421 - RNA, 64 nt, Homo Sapiens; identical to SEQ ID NO: 477346

SEQ ID NO: 477422 - RNA, 64 nt, Homo Sapiens; identical to SEQ ID NO: 477347

SEQ ID NO: 477423 - RNA, 64 nt, Homo Sapiens; identical to SEQ ID NO: 477348

SEQ ID NO: 477424 - RNA, 64 nt, Homo Sapiens; identical to SEQ ID NO: 477349

SEQ ID NO: 477425 - RNA, 64 nt, Homo Sapiens; identical to SEQ ID NO: 477350

SEQ ID NO: 477426 - RNA, 64 nt, Homo Sapiens; identical to SEQ ID NO: 477351

SEQ ID NO: 477427 - RNA, 64 nt, Homo Sapiens; identical to SEQ ID NO: 477352

SEQ ID NO: 477428 - RNA, 64 nt, Homo Sapiens; identical to SEQ ID NO: 477353

SEQ ID NO: 477429 - RNA, 64 nt, Homo Sapiens; identical to SEQ ID NO: 477354

SEQ ID NO: 477430 - RNA, 64 nt, Homo Sapiens; identical to SEQ ID NO: 477355

SEQ ID NO: 477431 - RNA, 64 nt, Homo Sapiens; identical to SEQ ID NO: 477356

SEQ ID NO: 477432 - RNA, 64 nt, Homo Sapiens; identical to SEQ ID NO: 477357

SEQ ID NO: 477433 - RNA, 64 nt, Homo Sapiens; identical to SEQ ID NO: 477358

SEQ ID NO: 477434 - RNA, 64 nt, Homo Sapiens; identical to SEQ ID NO: 477359

SEQ ID NO: 477435 - RNA, 64 nt, Homo Sapiens; identical to SEQ ID NO: 477360

SEQ ID NO: 477436 - RNA, 64 nt, Homo Sapiens; identical to SEQ ID NO: 477361

SEQ ID NO: 477437 - RNA, 64 nt, Homo Sapiens; identical to SEQ ID NO: 477362

SEQ ID NO: 477438 - RNA, 64 nt, Homo Sapiens; identical to SEQ ID NO: 477363

SEQ ID NO: 477439 - RNA, 64 nt, Homo Sapiens; identical to SEQ ID NO: 477364

SEQ ID NO: 477440 - RNA, 64 nt, Homo Sapiens; identical to SEQ ID NO: 477365

SEQ ID NO: 477441 - RNA, 64 nt, Homo Sapiens; identical to SEQ ID NO: 477366

SEQ ID NO: 477442 - RNA, 64 nt, Homo Sapiens; identical to SEQ ID NO: 477367

SEQ ID NO: 477443 - RNA, 64 nt, Homo Sapiens; identical to SEQ ID NO: 477368

SEQ ID NO: 477444 - RNA, 64 nt, Homo Sapiens; identical to SEQ ID NO: 477369

SEQ ID NO: 477445 - RNA, 64 nt, Homo Sapiens; identical to SEQ ID NO: 477370

SEQ ID NO: 477446 - RNA, 64 nt, Homo Sapiens; identical to SEQ ID NO: 477371

SEQ ID NO: 477447 - RNA, 64 nt, Homo Sapiens; identical to SEQ ID NO: 477372

SEQ ID NO: 477448 - RNA, 64 nt, Homo Sapiens; identical to SEQ ID NO: 477373

SEQ ID NO: 477449 - RNA, 64 nt, Homo Sapiens; identical to SEQ ID NO: 477374

SEQ ID NO: 477450 - RNA, 64 nt, Homo Sapiens; identical to SEQ ID NO: 477375

SEQ ID NO: 477451 - RNA, 64 nt, Homo Sapiens; identical to SEQ ID NO: 477376

SEQ ID NO: 477452 - RNA, 64 nt, Homo Sapiens; identical to SEQ ID NO: 477377

SEQ ID NO: 477453 - RNA, 64 nt, Homo Sapiens; identical to SEQ ID NO: 477378

SEQ ID NO: 477454 - RNA, 64 nt, Homo Sapiens; identical to SEQ ID NO: 477379

SEQ ID NO: 477455 - RNA, 64 nt, Homo Sapiens; identical to SEQ ID NO: 477380

SEQ ID NO: 477456 - RNA, 64 nt, Homo Sapiens; identical to SEQ ID NO: 477381

SEQ ID NO: 477457 - RNA, 64 nt, Homo Sapiens; identical to SEQ ID NO: 477382

SEQ ID NO: 477458 - RNA, 64 nt, Homo Sapiens; identical to SEQ ID NO: 477383

SEQ ID NO: 477459 - RNA, 64 nt, Homo Sapiens; identical to SEQ ID NO: 477384

SEQ ID NO: 477460 - RNA, 64 nt, Homo Sapiens; identical to SEQ ID NO: 477385

SEQ ID NO: 477461 - RNA, 64 nt, Homo Sapiens; identical to SEQ ID NO: 477386

SEQ ID NO: 477462 - RNA, 64 nt, Homo Sapiens; identical to SEQ ID NO: 477387

SEQ ID NO: 477463 - RNA, 64 nt, Homo Sapiens; identical to SEQ ID NO: 477388

SEQ ID NO: 477464 - RNA, 64 nt, Homo Sapiens; identical to SEQ ID NO: 477389

SEQ ID NO: 477465 - RNA, 64 nt, Homo Sapiens; identical to SEQ ID NO: 477390

SEQ ID NO: 477466 - RNA, 64 nt, Homo Sapiens; identical to SEQ ID NO: 477391

SEQ ID NO: 477467 - RNA, 64 nt, Homo Sapiens; identical to SEQ ID NO: 477392

SEQ ID NO: 477468 - RNA, 64 nt, Homo Sapiens; identical to SEQ ID NO: 477393

SEQ ID NO: 477469 - RNA, 64 nt, Homo Sapiens; identical to SEQ ID NO: 477394

SEQ ID NO: 477470 - RNA, 64 nt, Homo Sapiens; identical to SEQ ID NO: 477395

SEQ ID NO: 477471 - RNA, 64 nt, Homo Sapiens; identical to SEQ ID NO: 477396

SEQ ID NO: 477472 - RNA, 64 nt, Homo Sapiens; identical to SEQ ID NO: 477397

SEQ ID NO: 477473 - RNA, 64 nt, Homo Sapiens; identical to SEQ ID NO: 477398

SEQ ID NO: 477474 - RNA, 64 nt, Homo Sapiens; identical to SEQ ID NO: 477399

SEQ ID NO: 477475 - RNA, 64 nt, Homo Sapiens; identical to SEQ ID NO: 477400

SEQ ID NO: 477476 - RNA, 64 nt, Homo Sapiens; identical to SEQ ID NO: 477401

SEQ ID NO: 477477 - RNA, 64 nt, Homo Sapiens; identical to SEQ ID NO: 477402

SEQ ID NO: 477478 - RNA, 64 nt, Homo Sapiens; identical to SEQ ID NO: 477403

SEQ ID NO: 477479 - RNA, 64 nt, Homo Sapiens; identical to SEQ ID NO: 477404

SEQ ID NO: 477480 - RNA, 64 nt, Homo Sapiens; identical to SEQ ID NO: 477405

SEQ ID NO: 477481 - RNA, 64 nt, Homo Sapiens; identical to SEQ ID NO: 477406

SEQ ID NO: 477482 - RNA, 64 nt, Homo Sapiens; identical to SEQ ID NO: 477407

SEQ ID NO: 477483 - RNA, 64 nt, Homo Sapiens; identical to SEQ ID NO: 477408

SEQ ID NO: 477484 - RNA, 64 nt, Homo Sapiens; identical to SEQ ID NO: 477409

SEQ ID NO: 477485 - RNA, 64 nt, Homo Sapiens; identical to SEQ ID NO: 477410

SEQ ID NO: 477486 - RNA, 64 nt, Homo Sapiens; identical to SEQ ID NO: 477411

SEQ ID NO: 477487 - RNA, 64 nt, Homo Sapiens; identical to SEQ ID NO: 477412

SEQ ID NO: 477488 - RNA, 64 nt, Homo Sapiens; identical to SEQ ID NO: 477413

SEQ ID NO: 477489 - RNA, 64 nt, Homo Sapiens; identical to SEQ ID NO: 477414

SEQ ID NO: 477490 - RNA, 64 nt, Homo Sapiens; identical to SEQ ID NO: 477415

SEQ ID NO: 477491 - RNA, 64 nt, Homo Sapiens; identical to SEQ ID NO: 477416

SEQ ID NO: 477492 - RNA, 64 nt, Homo Sapiens
aggcuuggccaucuagcauuccauacaaaauuguuuccuauaagcauuccuuuuauucucuauu

SEQ ID NO: 477493 - RNA, 64 nt, Homo Sapiens
acccuuucuuucucugggaucccugcccagcaccuuccuauagagaugacuuuaaaaggaaaaa

SEQ ID NO: 477494 - RNA, 64 nt, Homo Sapiens
acagaauaauuuggugugcauucuuucagacuuuuuccuauacauuuuauauguagaaauguag

SEQ ID NO: 477495 - RNA, 64 nt, Homo Sapiens
gaaauguagcaauguauuuguauagaugugaucauuccuauauuguuauugauuuuuuucacuu

SEQ ID NO: 477496 - RNA, 64 nt, Homo Sapiens
uggggcccaugugguaguccccauaccccuccaguuccuauauuuuugucuucuuccuuucccc

SEQ ID NO: 477497 - RNA, 64 nt, Homo Sapiens
ucacaaaugacuuguaaugucgugauuaaaaaaauuccuauauucuucugcaaaucaaacguuc

SEQ ID NO: 477498 - RNA, 64 nt, Homo Sapiens
gaacgcuguaagcuguguacuguuauaagugugcuuccuauauuguugcauuuccuugauaaua

SEQ ID NO: 477499 - RNA, 64 nt, Homo Sapiens
auuuugaucuagauauaaaauuaaaauuguccauuuccuauauaaauaccagcaagaucacucu

SEQ ID NO: 477500 - RNA, 64 nt, Homo Sapiens
cuguaauaguggagguauugaaguggauuguaauuuccuauaagaugaaccuuugaggccugua

SEQ ID NO: 477501 - RNA, 64 nt, Homo Sapiens
accccaguaauuugcaucaguaaugcuauaaaauuuccuauauuuaguuuuuuaauucauuuac

SEQ ID NO: 477502 - RNA, 64 nt, Homo Sapiens
uguguguauauguauguguuggguacuccccauuuuccuauauuacauuuggugguuuucuauu

SEQ ID NO: 477503 - RNA, 64 nt, Homo Sapiens
ugaauauuagaugggaaaaucuuguggaaucuguuuccuauauuggucucaucaauuaaagcac

SEQ ID NO: 477504 - RNA, 64 nt, Homo Sapiens
augauuugcuuaaauauccaaucuugaucucccuuuccuauauguuauacaguacacuucaguu

SEQ ID NO: 477505 - RNA, 64 nt, Homo Sapiens
uuugauagugggaccacauagccccauuaacugcuuccuauaaugggacuaugcuuuucucaaa

SEQ ID NO: 477506 - RNA, 60 nt, Homo Sapiens; identical to SEQ ID NO: 193746

SEQ ID NO: 477507 - RNA, 64 nt, Homo Sapiens; identical to SEQ ID NO: 193747

SEQ ID NO: 477508 - RNA, 64 nt, Homo Sapiens; identical to SEQ ID NO: 193748

SEQ ID NO: 477509 - RNA, 64 nt, Homo Sapiens; identical to SEQ ID NO: 193749

SEQ ID NO: 477510 - RNA, 64 nt, Homo Sapiens; identical to SEQ ID NO: 193750

SEQ ID NO: 477511 - RNA, 64 nt, Homo Sapiens; identical to SEQ ID NO: 193751

SEQ ID NO: 477512 - RNA, 64 nt, Homo Sapiens; identical to SEQ ID NO: 193752

SEQ ID NO: 477513 - RNA, 64 nt, Homo Sapiens; identical to SEQ ID NO: 193753

SEQ ID NO: 477514 - RNA, 64 nt, Homo Sapiens; identical to SEQ ID NO: 193754

SEQ ID NO: 477515 - RNA, 64 nt, Homo Sapiens; identical to SEQ ID NO: 193755

SEQ ID NO: 477516 - RNA, 64 nt, Homo Sapiens; identical to SEQ ID NO: 193756

SEQ ID NO: 477517 - RNA, 64 nt, Homo Sapiens; identical to SEQ ID NO: 193757

SEQ ID NO: 477518 - RNA, 64 nt, Homo Sapiens; identical to SEQ ID NO: 193758

SEQ ID NO: 477519 - RNA, 64 nt, Homo Sapiens; identical to SEQ ID NO: 193759

SEQ ID NO: 477520 - RNA, 64 nt, Homo Sapiens; identical to SEQ ID NO: 193760

SEQ ID NO: 477521 - RNA, 64 nt, Homo Sapiens; identical to SEQ ID NO: 193761

SEQ ID NO: 477522 - RNA, 64 nt, Homo Sapiens; identical to SEQ ID NO: 193762

SEQ ID NO: 477523 - RNA, 64 nt, Homo Sapiens; identical to SEQ ID NO: 193763

SEQ ID NO: 477524 - RNA, 64 nt, Homo Sapiens; identical to SEQ ID NO: 193764

SEQ ID NO: 477525 - RNA, 64 nt, Homo Sapiens; identical to SEQ ID NO: 193764

SEQ ID NO: 477526 - RNA, 64 nt, Homo Sapiens; identical to SEQ ID NO: 193766

SEQ ID NO: 477527 - RNA, 64 nt, Homo Sapiens; identical to SEQ ID NO: 193767

SEQ ID NO: 477528 - RNA, 64 nt, Homo Sapiens; identical to SEQ ID NO: 193768

SEQ ID NO: 477529 - RNA, 64 nt, Homo Sapiens; identical to SEQ ID NO: 193769

SEQ ID NO: 477530 - RNA, 64 nt, Homo Sapiens; identical to SEQ ID NO: 193770

SEQ ID NO: 477531 - RNA, 64 nt, Homo Sapiens; identical to SEQ ID NO: 193771

SEQ ID NO: 477532 - RNA, 64 nt, Homo Sapiens; identical to SEQ ID NO: 193772

SEQ ID NO: 477533 - RNA, 64 nt, Homo Sapiens; identical to SEQ ID NO: 193773

SEQ ID NO: 477534 - RNA, 64 nt, Homo Sapiens; identical to SEQ ID NO: 193774

SEQ ID NO: 477535 - RNA, 64 nt, Homo Sapiens; identical to SEQ ID NO: 193775

SEQ ID NO: 477536 - RNA, 64 nt, Homo Sapiens; identical to SEQ ID NO: 141798

SEQ ID NO: 477537 - RNA, 64 nt, Homo Sapiens; identical to SEQ ID NO: 141799

SEQ ID NO: 477538 - RNA, 64 nt, Homo Sapiens; identical to SEQ ID NO: 141800

SEQ ID NO: 477539 - RNA, 64 nt, Homo Sapiens; identical to SEQ ID NO: 141801

SEQ ID NO: 477540 - RNA, 64 nt, Homo Sapiens; identical to SEQ ID NO: 141802

SEQ ID NO: 477541 - RNA, 64 nt, Homo Sapiens; identical to SEQ ID NO: 141803

SEQ ID NO: 477542 - RNA, 64 nt, Homo Sapiens; identical to SEQ ID NO: 141804

SEQ ID NO: 477543 - RNA, 64 nt, Homo Sapiens; identical to SEQ ID NO: 141805

SEQ ID NO: 477544 - RNA, 64 nt, Homo Sapiens
guaacauucccaguuucagccacaauuuagccaagaauaagauaaaaacuugaauaagaaguaa

SEQ ID NO: 477545 - RNA, 64 nt, Homo Sapiens
agccacaauuuagccaagaauaagauaaaaacuugaauaagaaguaaguagcauaaaucaguau

SEQ ID NO: 477546 - RNA, 64 nt, Homo Sapiens
gcaccagcuaacaaugugauauaagagcgcaccagaauaagagcaagaauaagagugcaccaga

SEQ ID NO: 477547 - RNA, 64 nt, Homo Sapiens
gcaccagaauaagagcgcacauaagagugcaccagaauaagagcaucuucucuugaaaggaaga

SEQ ID NO: 477548 - RNA, 64 nt, Homo Sapiens
gcaccagaauaagagcgcacucucuugaaaggaagaauaagaguaucauugcauuuuaaaaucu

SEQ ID NO: 477549 - RNA, 64 nt, Homo Sapiens
ucagacacaaauuaagacaauaccuugugguagggaauaagaggcauuccuauugagaaccagc

SEQ ID NO: 477550 - RNA, 64 nt, Homo Sapiens
auaugugaugaauauaagaacaagacaauaaucugaauaagacacauggaguuuugcuaaggca

SEQ ID NO: 477551 - RNA, 64 nt, Homo Sapiens
cuuuggaaguacggcuaauagaagcccuagauccgaauaagauccgaauaagaauauguaaugg

SEQ ID NO: 477552 - RNA, 64 nt, Homo Sapiens
cggcuaauagaagcccuagauccgaauaagauccgaauaagaauauguaauggaccaggcgcag

SEQ ID NO: 477553 - RNA, 64 nt, Homo Sapiens
ccgauaagcagugaguguaaaauuguuguagcuugaauaagaaaccacuuuuguaguuuuaacc

SEQ ID NO: 477554 - RNA, 64 nt, Homo Sapiens
auuuuuugaaaauuuacuguagcuucuauuucgugaauaagaauguuuugauuuugaucauaca

SEQ ID NO: 477555 - RNA, 64 nt, Homo Sapiens
ucacaaacccuugcaacauugccugaaguuuauggaauaagauguauucucacucccuugaucu

SEQ ID NO: 477556 - RNA, 64 nt, Homo Sapiens
auuugacuuaucuggaaaagcaaaauguacuuaagaauaagaauaacaugguccauucaccuuu

SEQ ID NO: 477557 - RNA, 64 nt, Homo Sapiens
aagucucgauuucuucucucucugcauaugccuggaauaagagauccuuuuucaauguaacaau

SEQ ID NO: 477558 - RNA, 64 nt, Homo Sapiens
aaucugaagaugugaagggcacagaagugacuuugaauaagaagaauuuaguguaucuguaauu

SEQ ID NO: 477559 - RNA, 64 nt, Homo Sapiens
cagcaacaaucauugcuacuaacauaucuauuuggaauaagauauuuuauaaugauuuuuaaaa

SEQ ID NO: 477560 - RNA, 64 nt, Homo Sapiens
aaaauaucuuuaccuuauuaacacauaaauaagugaauaagauaucaacauacuuauccucuga

SEQ ID NO: 477561 - RNA, 64 nt, Homo Sapiens
cugugauuuuucucaccugccaaacagaaagagggaauaagaucgcucugcagggcuggaauuu

SEQ ID NO: 477562 - RNA, 64 nt, Homo Sapiens
acacguggugauugugaagagguuucccuuuacugaauaagauguuuucagguaucuuuguagc

SEQ ID NO: 477563 - RNA, 64 nt, Homo Sapiens
gaugcaaaaaaaaaaaaaaaaaaaaaaaaaaaaagaauaagaggugauauuacacccaugaaac

SEQ ID NO: 477564 - RNA, 64 nt, Homo Sapiens
aagaauaagaggugauauuacacccaugaaacaagaauaagaugcuauuuugagacaagaaaca

SEQ ID NO: 477565 - RNA, 64 nt, Homo Sapiens
uuuuuacuguuauuuaauugaaaccauagacuaagaauaagaagcaucauacuauaacugaaca

SEQ ID NO: 477566 - RNA, 64 nt, Homo Sapiens
gaauaguuguuuaaauauuuuuuaaaaaacacuugaauaagaaucaguaggguauaaacuagaa

SEQ ID NO: 477567 - RNA, 64 nt, Homo Sapiens
gagauuuuucuuuuaagcccugcucuuucucugagaaccaaaagaugccuugaauauuuauuca

SEQ ID NO: 477568 - RNA, 64 nt, Homo Sapiens
accuccuuuucuucuagcuuuguuguccucccaggaaccaaaaaaccccagcuauuuucugacc

SEQ ID NO: 477569 - RNA, 63 nt, Homo Sapiens
aaaaaaagaaaaaaaucccaaccugucacuaccagaaccaaaauucaacuugauuauaaauac

SEQ ID NO: 477570 - RNA, 64 nt, Homo Sapiens
uugcuuguugcaaugugguaaggacaagaaaauugaaccaaagccucaaaaucuuccuuugugu

SEQ ID NO: 477571 - RNA, 64 nt, Homo Sapiens
gcagaggccaaguuccaggugucuguguucccaggaaccaaauggggagucuggggcccguuuu

SEQ ID NO: 477572 - RNA, 64 nt, Homo Sapiens
cacccacccccauccaggaaccgugacguccaaggaaccaaacccagacgcagaacaauaaaau

SEQ ID NO: 477573 - RNA, 64 nt, Homo Sapiens
ccaaauauuaagcccuuaaaaaaauaaaaccucugaaccaaaaucuucccaggaauaguacuua

SEQ ID NO: 477574 - RNA, 64 nt, Homo Sapiens
gaagaaacaaacagaagucuuaagauuagaaugagaaccaaagagaauuuaacccugccauuuu

SEQ ID NO: 477575 - RNA, 64 nt, Homo Sapiens
cagcuuucucuggaaaaugaaugcuaauuagugugaaccaaaagaguaaguaagagucugaagu

SEQ ID NO: 477576 - RNA, 64 nt, Homo Sapiens
ccccuccgcacaggaaagguacccaguagauaaugaaccaaauuaaguucccucccuccagcca

SEQ ID NO: 477577 - RNA, 64 nt, Homo Sapiens
uguguucauguucccagccagcucugagacccaggaaccaaauauuccauuuuggcuucugcua

SEQ ID NO: 477578 - RNA, 64 nt, Homo Sapiens
guucccccaaaauaaacguguccccauuuuaccagaaccaaaccucaacacagcgaagcuguac

SEQ ID NO: 477579 - RNA, 64 nt, Homo Sapiens
guaguugacuccaagucucugugagcagugacuugaaccaaacacaccaggaauaauccauucu

SEQ ID NO: 477580 - RNA, 64 nt, Homo Sapiens
cacuguccuuagaagaaagggcauuuuuacuuuugaaccaaaaagagaaaaaaaaaucagaagu

SEQ ID NO: 477581 - RNA, 64 nt, Homo Sapiens
cgcaaaucaauaaauguaauccagcauauaaacagaaccaaagacagaaaccacaugauuaucu

SEQ ID NO: 477582 - RNA, 64 nt, Homo Sapiens
cagaauugaaaaacacuacuuuaaaguucauauggaaccaaaaaagagcccacauugccaaguc

SEQ ID NO: 477583 - RNA, 62 nt, Homo Sapiens
ccuugguggucauuucucuuaaauacauauucaagaaccaaaugaaugauuuuuucaguaaa

SEQ ID NO: 477584 - RNA, 64 nt, Homo Sapiens
ugaccuugugcauauauuggaaaaaaaaaaacaggaaccaaauguagugugaaauugucauguu

SEQ ID NO: 477585 - RNA, 64 nt, Homo Sapiens
auuuuacuguaaaucuuuaaagacagucuuuugggaaccaaaguuuuuuaaaaauuccuuuuag

SEQ ID NO: 477586 - RNA, 64 nt, Homo Sapiens
cauuuauaaugccguucuggucaaauaaaauuuugaaccaaaaauaagcaaggaauauaagauu

SEQ ID NO: 477587 - RNA, 64 nt, Homo Sapiens; identical to SEQ ID NO: 76027

SEQ ID NO: 477588 - RNA, 64 nt, Homo Sapiens; identical to SEQ ID NO: 76028

SEQ ID NO: 477589 - RNA, 64 nt, Homo Sapiens; identical to SEQ ID NO: 76029

SEQ ID NO: 477590 - RNA, 64 nt, Homo Sapiens; identical to SEQ ID NO: 76030

SEQ ID NO: 477591 - RNA, 64 nt, Homo Sapiens; identical to SEQ ID NO: 76031

SEQ ID NO: 477592 - RNA, 64 nt, Homo Sapiens; identical to SEQ ID NO: 76032

SEQ ID NO: 477593 - RNA, 64 nt, Homo Sapiens; identical to SEQ ID NO: 76033

SEQ ID NO: 477594 - RNA, 64 nt, Homo Sapiens; identical to SEQ ID NO: 76034

SEQ ID NO: 477595 - RNA, 64 nt, Homo Sapiens; identical to SEQ ID NO: 76035

SEQ ID NO: 477596 - RNA, 64 nt, Homo Sapiens; identical to SEQ ID NO: 76036

SEQ ID NO: 477597 - RNA, 64 nt, Homo Sapiens; identical to SEQ ID NO: 76037

SEQ ID NO: 477598 - RNA, 64 nt, Homo Sapiens; identical to SEQ ID NO: 76038

SEQ ID NO: 477599 - RNA, 64 nt, Homo Sapiens; identical to SEQ ID NO: 76039

SEQ ID NO: 477600 - RNA, 64 nt, Homo Sapiens; identical to SEQ ID NO: 76040

SEQ ID NO: 477601 - RNA, 64 nt, Homo Sapiens; identical to SEQ ID NO: 76041

SEQ ID NO: 477602 - RNA, 64 nt, Homo Sapiens; identical to SEQ ID NO: 76042

SEQ ID NO: 477603 - RNA, 64 nt, Homo Sapiens; identical to SEQ ID NO: 76043

SEQ ID NO: 477604 - RNA, 64 nt, Homo Sapiens; identical to SEQ ID NO: 76044

SEQ ID NO: 477605 - RNA, 64 nt, Homo Sapiens; identical to SEQ ID NO: 76045

SEQ ID NO: 477606 - RNA, 64 nt, Homo Sapiens; identical to SEQ ID NO: 76046

SEQ ID NO: 477607 - RNA, 64 nt, Homo Sapiens; identical to SEQ ID NO: 76047

SEQ ID NO: 477608 - RNA, 64 nt, Homo Sapiens; identical to SEQ ID NO: 76048

SEQ ID NO: 477609 - RNA, 64 nt, Homo Sapiens; identical to SEQ ID NO: 76049

SEQ ID NO: 477610 - RNA, 64 nt, Homo Sapiens; identical to SEQ ID NO: 76050

SEQ ID NO: 477611 - RNA, 64 nt, Homo Sapiens; identical to SEQ ID NO: 76051

SEQ ID NO: 477612 - RNA, 64 nt, Homo Sapiens; identical to SEQ ID NO: 76052

SEQ ID NO: 477613 - RNA, 64 nt, Homo Sapiens; identical to SEQ ID NO: 76053

SEQ ID NO: 477614 - RNA, 64 nt, Homo Sapiens; identical to SEQ ID NO: 76054

SEQ ID NO: 477615 - RNA, 64 nt, Homo Sapiens; identical to SEQ ID NO: 76055

SEQ ID NO: 477616 - RNA, 64 nt, Homo Sapiens; identical to SEQ ID NO: 76056

SEQ ID NO: 477617 - RNA, 64 nt, Homo Sapiens; identical to SEQ ID NO: 76057

SEQ ID NO: 477618 - RNA, 64 nt, Homo Sapiens; identical to SEQ ID NO: 76058

SEQ ID NO: 477619 - RNA, 52 nt, Homo Sapiens; identical to SEQ ID NO: 76059

SEQ ID NO: 477620 - RNA, 64 nt, Homo Sapiens; identical to SEQ ID NO: 76060

SEQ ID NO: 477621 - RNA, 64 nt, Homo Sapiens; identical to SEQ ID NO: 76061

SEQ ID NO: 477622 - RNA, 64 nt, Homo Sapiens; identical to SEQ ID NO: 76062

SEQ ID NO: 477623 - RNA, 64 nt, Homo Sapiens; identical to SEQ ID NO: 76062

SEQ ID NO: 477624 - RNA, 64 nt, Homo Sapiens; identical to SEQ ID NO: 76064

SEQ ID NO: 477625 - RNA, 64 nt, Homo Sapiens; identical to SEQ ID NO: 76065

SEQ ID NO: 477626 - RNA, 64 nt, Homo Sapiens; identical to SEQ ID NO: 76066

SEQ ID NO: 477627 - RNA, 64 nt, Homo Sapiens; identical to SEQ ID NO: 76067

SEQ ID NO: 477628 - RNA, 64 nt, Homo Sapiens; identical to SEQ ID NO: 76068

SEQ ID NO: 477629 - RNA, 64 nt, Homo Sapiens; identical to SEQ ID NO: 76069

SEQ ID NO: 477630 - RNA, 64 nt, Homo Sapiens; identical to SEQ ID NO: 76070

SEQ ID NO: 477631 - RNA, 64 nt, Homo Sapiens; identical to SEQ ID NO: 76071

SEQ ID NO: 477632 - RNA, 64 nt, Homo Sapiens; identical to SEQ ID NO: 76072

SEQ ID NO: 477633 - RNA, 64 nt, Homo Sapiens; identical to SEQ ID NO: 76073

SEQ ID NO: 477634 - RNA, 64 nt, Homo Sapiens; identical to SEQ ID NO: 76074

SEQ ID NO: 477635 - RNA, 64 nt, Homo Sapiens; identical to SEQ ID NO: 76075

SEQ ID NO: 477636 - RNA, 64 nt, Homo Sapiens; identical to SEQ ID NO: 76076

SEQ ID NO: 477637 - RNA, 64 nt, Homo Sapiens; identical to SEQ ID NO: 76077

SEQ ID NO: 477638 - RNA, 64 nt, Homo Sapiens; identical to SEQ ID NO: 76078

SEQ ID NO: 477639 - RNA, 64 nt, Homo Sapiens; identical to SEQ ID NO: 76079

SEQ ID NO: 477640 - RNA, 64 nt, Homo Sapiens; identical to SEQ ID NO: 76080

SEQ ID NO: 477641 - RNA, 64 nt, Homo Sapiens; identical to SEQ ID NO: 76081

SEQ ID NO: 477642 - RNA, 64 nt, Homo Sapiens; identical to SEQ ID NO: 76082

SEQ ID NO: 477643 - RNA, 64 nt, Homo Sapiens; identical to SEQ ID NO: 76083

SEQ ID NO: 477644 - RNA, 64 nt, Homo Sapiens; identical to SEQ ID NO: 76084

SEQ ID NO: 477645 - RNA, 64 nt, Homo Sapiens; identical to SEQ ID NO: 76085

SEQ ID NO: 477646 - RNA, 64 nt, Homo Sapiens; identical to SEQ ID NO: 76086

SEQ ID NO: 477647 - RNA, 64 nt, Homo Sapiens; identical to SEQ ID NO: 76087

SEQ ID NO: 477648 - RNA, 64 nt, Homo Sapiens; identical to SEQ ID NO: 76088

SEQ ID NO: 477649 - RNA, 64 nt, Homo Sapiens; identical to SEQ ID NO: 76089

SEQ ID NO: 477650 - RNA, 64 nt, Homo Sapiens; identical to SEQ ID NO: 76090

SEQ ID NO: 477651 - RNA, 64 nt, Homo Sapiens; identical to SEQ ID NO: 76090

SEQ ID NO: 477652 - RNA, 64 nt, Homo Sapiens; identical to SEQ ID NO: 50680

SEQ ID NO: 477653 - RNA, 64 nt, Homo Sapiens; identical to SEQ ID NO: 50681

SEQ ID NO: 477654 - RNA, 64 nt, Homo Sapiens; identical to SEQ ID NO: 50682

SEQ ID NO: 477655 - RNA, 64 nt, Homo Sapiens; identical to SEQ ID NO: 50683

SEQ ID NO: 477656 - RNA, 64 nt, Homo Sapiens; identical to SEQ ID NO: 50684

SEQ ID NO: 477657 - RNA, 64 nt, Homo Sapiens; identical to SEQ ID NO: 50685

SEQ ID NO: 477658 - RNA, 64 nt, Homo Sapiens; identical to SEQ ID NO: 50686

SEQ ID NO: 477659 - RNA, 64 nt, Homo Sapiens; identical to SEQ ID NO: 50687

SEQ ID NO: 477660 - RNA, 64 nt, Homo Sapiens; identical to SEQ ID NO: 50688

SEQ ID NO: 477661 - RNA, 64 nt, Homo Sapiens; identical to SEQ ID NO: 50689

SEQ ID NO: 477662 - RNA, 64 nt, Homo Sapiens; identical to SEQ ID NO: 50690

SEQ ID NO: 477663 - RNA, 64 nt, Homo Sapiens; identical to SEQ ID NO: 50691

SEQ ID NO: 477664 - RNA, 64 nt, Homo Sapiens; identical to SEQ ID NO: 50692

SEQ ID NO: 477665 - RNA, 64 nt, Homo Sapiens; identical to SEQ ID NO: 50693

SEQ ID NO: 477666 - RNA, 64 nt, Homo Sapiens; identical to SEQ ID NO: 153237

SEQ ID NO: 477667 - RNA, 64 nt, Homo Sapiens; identical to SEQ ID NO: 153238

SEQ ID NO: 477668 - RNA, 64 nt, Homo Sapiens; identical to SEQ ID NO: 153239

SEQ ID NO: 477669 - RNA, 64 nt, Homo Sapiens; identical to SEQ ID NO: 153240

SEQ ID NO: 477670 - RNA, 64 nt, Homo Sapiens; identical to SEQ ID NO: 153241

SEQ ID NO: 477671 - RNA, 64 nt, Homo Sapiens; identical to SEQ ID NO: 153242

SEQ ID NO: 477672 - RNA, 64 nt, Homo Sapiens; identical to SEQ ID NO: 153243

SEQ ID NO: 477673 - RNA, 64 nt, Homo Sapiens; identical to SEQ ID NO: 153244

SEQ ID NO: 477674 - RNA, 64 nt, Homo Sapiens; identical to SEQ ID NO: 153245

SEQ ID NO: 477675 - RNA, 64 nt, Homo Sapiens; identical to SEQ ID NO: 153246

SEQ ID NO: 477676 - RNA, 64 nt, Homo Sapiens; identical to SEQ ID NO: 50680

SEQ ID NO: 477677 - RNA, 64 nt, Homo Sapiens; identical to SEQ ID NO: 50681

SEQ ID NO: 477678 - RNA, 64 nt, Homo Sapiens; identical to SEQ ID NO: 50682

SEQ ID NO: 477679 - RNA, 64 nt, Homo Sapiens; identical to SEQ ID NO: 50683

SEQ ID NO: 477680 - RNA, 64 nt, Homo Sapiens; identical to SEQ ID NO: 50684

SEQ ID NO: 477681 - RNA, 64 nt, Homo Sapiens; identical to SEQ ID NO: 50685

SEQ ID NO: 477682 - RNA, 64 nt, Homo Sapiens; identical to SEQ ID NO: 50686

SEQ ID NO: 477683 - RNA, 64 nt, Homo Sapiens; identical to SEQ ID NO: 50687

SEQ ID NO: 477684 - RNA, 64 nt, Homo Sapiens; identical to SEQ ID NO: 50688

SEQ ID NO: 477685 - RNA, 64 nt, Homo Sapiens; identical to SEQ ID NO: 50689

SEQ ID NO: 477686 - RNA, 64 nt, Homo Sapiens; identical to SEQ ID NO: 50690

SEQ ID NO: 477687 - RNA, 64 nt, Homo Sapiens; identical to SEQ ID NO: 50691

SEQ ID NO: 477688 - RNA, 64 nt, Homo Sapiens; identical to SEQ ID NO: 50692

SEQ ID NO: 477689 - RNA, 64 nt, Homo Sapiens; identical to SEQ ID NO: 50693

SEQ ID NO: 477690 - RNA, 64 nt, Homo Sapiens; identical to SEQ ID NO: 153237

SEQ ID NO: 477691 - RNA, 64 nt, Homo Sapiens; identical to SEQ ID NO: 153238

SEQ ID NO: 477692 - RNA, 64 nt, Homo Sapiens; identical to SEQ ID NO: 153239

SEQ ID NO: 477693 - RNA, 64 nt, Homo Sapiens; identical to SEQ ID NO: 153240

SEQ ID NO: 477694 - RNA, 64 nt, Homo Sapiens; identical to SEQ ID NO: 153241

SEQ ID NO: 477695 - RNA, 64 nt, Homo Sapiens; identical to SEQ ID NO: 153242

SEQ ID NO: 477696 - RNA, 64 nt, Homo Sapiens; identical to SEQ ID NO: 153243

SEQ ID NO: 477697 - RNA, 64 nt, Homo Sapiens; identical to SEQ ID NO: 153244

SEQ ID NO: 477698 - RNA, 64 nt, Homo Sapiens; identical to SEQ ID NO: 153245

SEQ ID NO: 477699 - RNA, 64 nt, Homo Sapiens; identical to SEQ ID NO: 153246

SEQ ID NO: 477700 - RNA, 64 nt, Homo Sapiens; identical to SEQ ID NO: 50680

SEQ ID NO: 477701 - RNA, 64 nt, Homo Sapiens; identical to SEQ ID NO: 50681

SEQ ID NO: 477702 - RNA, 64 nt, Homo Sapiens; identical to SEQ ID NO: 50682

SEQ ID NO: 477703 - RNA, 64 nt, Homo Sapiens; identical to SEQ ID NO: 50683

SEQ ID NO: 477704 - RNA, 64 nt, Homo Sapiens; identical to SEQ ID NO: 50684

SEQ ID NO: 477705 - RNA, 64 nt, Homo Sapiens; identical to SEQ ID NO: 50685

SEQ ID NO: 477706 - RNA, 64 nt, Homo Sapiens; identical to SEQ ID NO: 50686

SEQ ID NO: 477707 - RNA, 64 nt, Homo Sapiens; identical to SEQ ID NO: 50687

SEQ ID NO: 477708 - RNA, 64 nt, Homo Sapiens; identical to SEQ ID NO: 50688

SEQ ID NO: 477709 - RNA, 64 nt, Homo Sapiens; identical to SEQ ID NO: 50689

SEQ ID NO: 477710 - RNA, 64 nt, Homo Sapiens; identical to SEQ ID NO: 50690

SEQ ID NO: 477711 - RNA, 64 nt, Homo Sapiens; identical to SEQ ID NO: 50691

SEQ ID NO: 477712 - RNA, 64 nt, Homo Sapiens; identical to SEQ ID NO: 50692

SEQ ID NO: 477713 - RNA, 64 nt, Homo Sapiens; identical to SEQ ID NO: 50693

SEQ ID NO: 477714 - RNA, 64 nt, Homo Sapiens; identical to SEQ ID NO: 153237

SEQ ID NO: 477715 - RNA, 64 nt, Homo Sapiens; identical to SEQ ID NO: 153238

SEQ ID NO: 477716 - RNA, 64 nt, Homo Sapiens; identical to SEQ ID NO: 153239

SEQ ID NO: 477717 - RNA, 64 nt, Homo Sapiens; identical to SEQ ID NO: 153240

SEQ ID NO: 477718 - RNA, 64 nt, Homo Sapiens; identical to SEQ ID NO: 153241

SEQ ID NO: 477719 - RNA, 64 nt, Homo Sapiens; identical to SEQ ID NO: 153242

SEQ ID NO: 477720 - RNA, 64 nt, Homo Sapiens; identical to SEQ ID NO: 153243

SEQ ID NO: 477721 - RNA, 64 nt, Homo Sapiens; identical to SEQ ID NO: 153244

SEQ ID NO: 477722 - RNA, 64 nt, Homo Sapiens; identical to SEQ ID NO: 153245

SEQ ID NO: 477723 - RNA, 64 nt, Homo Sapiens; identical to SEQ ID NO: 153246

SEQ ID NO: 477724 - RNA, 64 nt, Homo Sapiens; identical to SEQ ID NO: 50680

SEQ ID NO: 477725 - RNA, 64 nt, Homo Sapiens; identical to SEQ ID NO: 50681

SEQ ID NO: 477726 - RNA, 64 nt, Homo Sapiens; identical to SEQ ID NO: 50682

SEQ ID NO: 477727 - RNA, 64 nt, Homo Sapiens; identical to SEQ ID NO: 50683

SEQ ID NO: 477728 - RNA, 64 nt, Homo Sapiens; identical to SEQ ID NO: 50684

SEQ ID NO: 477729 - RNA, 64 nt, Homo Sapiens; identical to SEQ ID NO: 50685

SEQ ID NO: 477730 - RNA, 64 nt, Homo Sapiens; identical to SEQ ID NO: 50686

SEQ ID NO: 477731 - RNA, 64 nt, Homo Sapiens; identical to SEQ ID NO: 50687

SEQ ID NO: 477732 - RNA, 64 nt, Homo Sapiens; identical to SEQ ID NO: 50688

SEQ ID NO: 477733 - RNA, 64 nt, Homo Sapiens; identical to SEQ ID NO: 50689

SEQ ID NO: 477734 - RNA, 64 nt, Homo Sapiens; identical to SEQ ID NO: 50690

SEQ ID NO: 477735 - RNA, 64 nt, Homo Sapiens; identical to SEQ ID NO: 50691

SEQ ID NO: 477736 - RNA, 64 nt, Homo Sapiens; identical to SEQ ID NO: 50692

SEQ ID NO: 477737 - RNA, 64 nt, Homo Sapiens; identical to SEQ ID NO: 50693

SEQ ID NO: 477738 - RNA, 64 nt, Homo Sapiens; identical to SEQ ID NO: 153237

SEQ ID NO: 477739 - RNA, 64 nt, Homo Sapiens; identical to SEQ ID NO: 153238

SEQ ID NO: 477740 - RNA, 64 nt, Homo Sapiens; identical to SEQ ID NO: 153239

SEQ ID NO: 477741 - RNA, 64 nt, Homo Sapiens; identical to SEQ ID NO: 153240

SEQ ID NO: 477742 - RNA, 64 nt, Homo Sapiens; identical to SEQ ID NO: 153241

SEQ ID NO: 477743 - RNA, 64 nt, Homo Sapiens; identical to SEQ ID NO: 153242

SEQ ID NO: 477744 - RNA, 64 nt, Homo Sapiens; identical to SEQ ID NO: 153243

SEQ ID NO: 477745 - RNA, 64 nt, Homo Sapiens; identical to SEQ ID NO: 153244

SEQ ID NO: 477746 - RNA, 64 nt, Homo Sapiens; identical to SEQ ID NO: 153245

SEQ ID NO: 477747 - RNA, 64 nt, Homo Sapiens; identical to SEQ ID NO: 153246

SEQ ID NO: 477748 - RNA, 64 nt, Homo Sapiens; identical to SEQ ID NO: 50680

SEQ ID NO: 477749 - RNA, 64 nt, Homo Sapiens; identical to SEQ ID NO: 50681

SEQ ID NO: 477750 - RNA, 64 nt, Homo Sapiens; identical to SEQ ID NO: 50682

SEQ ID NO: 477751 - RNA, 64 nt, Homo Sapiens; identical to SEQ ID NO: 50683

SEQ ID NO: 477752 - RNA, 64 nt, Homo Sapiens; identical to SEQ ID NO: 50684

SEQ ID NO: 477753 - RNA, 64 nt, Homo Sapiens; identical to SEQ ID NO: 50685

SEQ ID NO: 477754 - RNA, 64 nt, Homo Sapiens; identical to SEQ ID NO: 50686

SEQ ID NO: 477755 - RNA, 64 nt, Homo Sapiens; identical to SEQ ID NO: 50687

SEQ ID NO: 477756 - RNA, 64 nt, Homo Sapiens; identical to SEQ ID NO: 50688

SEQ ID NO: 477757 - RNA, 64 nt, Homo Sapiens; identical to SEQ ID NO: 50689

SEQ ID NO: 477758 - RNA, 64 nt, Homo Sapiens; identical to SEQ ID NO: 50690

SEQ ID NO: 477759 - RNA, 64 nt, Homo Sapiens; identical to SEQ ID NO: 50691

SEQ ID NO: 477760 - RNA, 64 nt, Homo Sapiens; identical to SEQ ID NO: 50692

SEQ ID NO: 477761 - RNA, 64 nt, Homo Sapiens; identical to SEQ ID NO: 50693

SEQ ID NO: 477762 - RNA, 64 nt, Homo Sapiens; identical to SEQ ID NO: 153237

SEQ ID NO: 477763 - RNA, 64 nt, Homo Sapiens; identical to SEQ ID NO: 153238

SEQ ID NO: 477764 - RNA, 64 nt, Homo Sapiens; identical to SEQ ID NO: 153239

SEQ ID NO: 477765 - RNA, 64 nt, Homo Sapiens; identical to SEQ ID NO: 153240

SEQ ID NO: 477766 - RNA, 64 nt, Homo Sapiens; identical to SEQ ID NO: 153241

SEQ ID NO: 477767 - RNA, 64 nt, Homo Sapiens; identical to SEQ ID NO: 153242

SEQ ID NO: 477768 - RNA, 64 nt, Homo Sapiens; identical to SEQ ID NO: 153243

SEQ ID NO: 477769 - RNA, 64 nt, Homo Sapiens; identical to SEQ ID NO: 153244

SEQ ID NO: 477770 - RNA, 64 nt, Homo Sapiens; identical to SEQ ID NO: 153245

SEQ ID NO: 477771 - RNA, 64 nt, Homo Sapiens; identical to SEQ ID NO: 153246

SEQ ID NO: 477772 - RNA, 64 nt, Homo Sapiens; identical to SEQ ID NO: 50680

SEQ ID NO: 477773 - RNA, 64 nt, Homo Sapiens; identical to SEQ ID NO: 50681

SEQ ID NO: 477774 - RNA, 64 nt, Homo Sapiens; identical to SEQ ID NO: 50682

SEQ ID NO: 477775 - RNA, 64 nt, Homo Sapiens; identical to SEQ ID NO: 50683

SEQ ID NO: 477776 - RNA, 64 nt, Homo Sapiens; identical to SEQ ID NO: 50684

SEQ ID NO: 477777 - RNA, 64 nt, Homo Sapiens; identical to SEQ ID NO: 50685

SEQ ID NO: 477778 - RNA, 64 nt, Homo Sapiens; identical to SEQ ID NO: 50686

SEQ ID NO: 477779 - RNA, 64 nt, Homo Sapiens; identical to SEQ ID NO: 50687

SEQ ID NO: 477780 - RNA, 64 nt, Homo Sapiens; identical to SEQ ID NO: 50688

SEQ ID NO: 477781 - RNA, 64 nt, Homo Sapiens; identical to SEQ ID NO: 50689

SEQ ID NO: 477782 - RNA, 64 nt, Homo Sapiens; identical to SEQ ID NO: 50690

SEQ ID NO: 477783 - RNA, 64 nt, Homo Sapiens; identical to SEQ ID NO: 50691

SEQ ID NO: 477784 - RNA, 64 nt, Homo Sapiens; identical to SEQ ID NO: 50692

SEQ ID NO: 477785 - RNA, 64 nt, Homo Sapiens; identical to SEQ ID NO: 50693

SEQ ID NO: 477786 - RNA, 64 nt, Homo Sapiens; identical to SEQ ID NO: 153237

SEQ ID NO: 477787 - RNA, 64 nt, Homo Sapiens; identical to SEQ ID NO: 153238

SEQ ID NO: 477788 - RNA, 64 nt, Homo Sapiens; identical to SEQ ID NO: 153239

SEQ ID NO: 477789 - RNA, 64 nt, Homo Sapiens; identical to SEQ ID NO: 153240

SEQ ID NO: 477790 - RNA, 64 nt, Homo Sapiens; identical to SEQ ID NO: 153241

SEQ ID NO: 477791 - RNA, 64 nt, Homo Sapiens; identical to SEQ ID NO: 153242

SEQ ID NO: 477792 - RNA, 64 nt, Homo Sapiens; identical to SEQ ID NO: 153243

SEQ ID NO: 477793 - RNA, 64 nt, Homo Sapiens; identical to SEQ ID NO: 153244

SEQ ID NO: 477794 - RNA, 64 nt, Homo Sapiens; identical to SEQ ID NO: 153245

SEQ ID NO: 477795 - RNA, 64 nt, Homo Sapiens; identical to SEQ ID NO: 153246

SEQ ID NO: 477796 - RNA, 64 nt, Homo Sapiens; identical to SEQ ID NO: 50680

SEQ ID NO: 477797 - RNA, 64 nt, Homo Sapiens; identical to SEQ ID NO: 50681

SEQ ID NO: 477798 - RNA, 64 nt, Homo Sapiens; identical to SEQ ID NO: 50682

SEQ ID NO: 477799 - RNA, 64 nt, Homo Sapiens; identical to SEQ ID NO: 50683

SEQ ID NO: 477800 - RNA, 64 nt, Homo Sapiens; identical to SEQ ID NO: 50684

SEQ ID NO: 477801 - RNA, 64 nt, Homo Sapiens; identical to SEQ ID NO: 50685

SEQ ID NO: 477802 - RNA, 64 nt, Homo Sapiens; identical to SEQ ID NO: 50686

SEQ ID NO: 477803 - RNA, 64 nt, Homo Sapiens; identical to SEQ ID NO: 50687

SEQ ID NO: 477804 - RNA, 64 nt, Homo Sapiens; identical to SEQ ID NO: 50688

SEQ ID NO: 477805 - RNA, 64 nt, Homo Sapiens; identical to SEQ ID NO: 50689

SEQ ID NO: 477806 - RNA, 64 nt, Homo Sapiens; identical to SEQ ID NO: 50690

SEQ ID NO: 477807 - RNA, 64 nt, Homo Sapiens; identical to SEQ ID NO: 50691

SEQ ID NO: 477808 - RNA, 64 nt, Homo Sapiens; identical to SEQ ID NO: 50692

SEQ ID NO: 477809 - RNA, 64 nt, Homo Sapiens; identical to SEQ ID NO: 50693

SEQ ID NO: 477810 - RNA, 64 nt, Homo Sapiens; identical to SEQ ID NO: 153237

SEQ ID NO: 477811 - RNA, 64 nt, Homo Sapiens; identical to SEQ ID NO: 153238

SEQ ID NO: 477812 - RNA, 64 nt, Homo Sapiens; identical to SEQ ID NO: 153239

SEQ ID NO: 477813 - RNA, 64 nt, Homo Sapiens; identical to SEQ ID NO: 153240

SEQ ID NO: 477814 - RNA, 64 nt, Homo Sapiens; identical to SEQ ID NO: 153241

SEQ ID NO: 477815 - RNA, 64 nt, Homo Sapiens; identical to SEQ ID NO: 153242

SEQ ID NO: 477816 - RNA, 64 nt, Homo Sapiens; identical to SEQ ID NO: 153243

SEQ ID NO: 477817 - RNA, 64 nt, Homo Sapiens; identical to SEQ ID NO: 153244

SEQ ID NO: 477818 - RNA, 64 nt, Homo Sapiens; identical to SEQ ID NO: 153245

SEQ ID NO: 477819 - RNA, 64 nt, Homo Sapiens; identical to SEQ ID NO: 153246

SEQ ID NO: 477820 - RNA, 64 nt, Homo Sapiens; identical to SEQ ID NO: 102097

SEQ ID NO: 477821 - RNA, 64 nt, Homo Sapiens; identical to SEQ ID NO: 102098

SEQ ID NO: 477822 - RNA, 64 nt, Homo Sapiens; identical to SEQ ID NO: 102099

SEQ ID NO: 477823 - RNA, 64 nt, Homo Sapiens; identical to SEQ ID NO: 102100

SEQ ID NO: 477824 - RNA, 64 nt, Homo Sapiens; identical to SEQ ID NO: 102101

SEQ ID NO: 477825 - RNA, 64 nt, Homo Sapiens; identical to SEQ ID NO: 102102

SEQ ID NO: 477826 - RNA, 64 nt, Homo Sapiens; identical to SEQ ID NO: 102103

SEQ ID NO: 477827 - RNA, 64 nt, Homo Sapiens; identical to SEQ ID NO: 102104

SEQ ID NO: 477828 - RNA, 64 nt, Homo Sapiens; identical to SEQ ID NO: 102105

SEQ ID NO: 477829 - RNA, 64 nt, Homo Sapiens; identical to SEQ ID NO: 102106

SEQ ID NO: 477830 - RNA, 64 nt, Homo Sapiens; identical to SEQ ID NO: 102107

SEQ ID NO: 477831 - RNA, 64 nt, Homo Sapiens; identical to SEQ ID NO: 102108

SEQ ID NO: 477832 - RNA, 64 nt, Homo Sapiens; identical to SEQ ID NO: 102109

SEQ ID NO: 477833 - RNA, 64 nt, Homo Sapiens; identical to SEQ ID NO: 102110

SEQ ID NO: 477834 - RNA, 64 nt, Homo Sapiens; identical to SEQ ID NO: 102111

SEQ ID NO: 477835 - RNA, 64 nt, Homo Sapiens; identical to SEQ ID NO: 102112

SEQ ID NO: 477836 - RNA, 64 nt, Homo Sapiens; identical to SEQ ID NO: 102113

SEQ ID NO: 477837 - RNA, 64 nt, Homo Sapiens; identical to SEQ ID NO: 102114

SEQ ID NO: 477838 - RNA, 64 nt, Homo Sapiens; identical to SEQ ID NO: 102115

SEQ ID NO: 477839 - RNA, 64 nt, Homo Sapiens; identical to SEQ ID NO: 102116

SEQ ID NO: 477840 - RNA, 64 nt, Homo Sapiens
auaggagacaaaguuaggaaacauugauacaagcuuuguacagagauuuguacauuuguguaau

SEQ ID NO: 477841 - RNA, 64 nt, Homo Sapiens
guuaggaaacauugauacaagcuuuguacagagauuuguacauuuguguaauaggccuuuucau

SEQ ID NO: 477842 - RNA, 64 nt, Homo Sapiens
uggaaaaauauuuaagauaguuuugccagaacaguuuguacagacguaugcuuauuuuaaaauu

SEQ ID NO: 477843 - RNA, 64 nt, Homo Sapiens
uuuauugcuugauacuuuugacaacaaauuagguuuuguacaauugaacuuaaauaaaugucau

SEQ ID NO: 477844 - RNA, 64 nt, Homo Sapiens
accaaaaaagaaaaaaaaaauuuauuauacaaaguuuguacagucuuuuguacagagauauauu

SEQ ID NO: 477845 - RNA, 64 nt, Homo Sapiens
gauauauuuuuauuauacaagacaaaaaaaaucuuuuguacagaaaaaaaaaaaguaaaacaaa

SEQ ID NO: 477846 - RNA, 64 nt, Homo Sapiens
acuguaaagauuuguugacaucaaguuauucaaauuuguacagguaauuuuguugaaaaugguu

SEQ ID NO: 477847 - RNA, 64 nt, Homo Sapiens
guaauuguuuuuuaaagcaaugaaccuauuuucauuuguacaagcauuuauuuaugaaaaaaua

SEQ ID NO: 477848 - RNA, 64 nt, Homo Sapiens
cuuuuuuaaaaauuaauauauuuucaggcguauuuuuguacagugaaaagggaacauucuugcu

SEQ ID NO: 477849 - RNA, 64 nt, Homo Sapiens
gccuugugguuuaaaaaaaaaaagcaaacuuuuuuuuguacagcuauaguagagauuuguucaa

SEQ ID NO: 477850 - RNA, 64 nt, Homo Sapiens
gaguggcaaaguggcacuaaugaagcuuuugccuuuuguacauuugagauuuuuguauauagug

SEQ ID NO: 477851 - RNA, 64 nt, Homo Sapiens
uuaggauuuuuuuuuuuuguauugugaugcuuuauuuguacauuuuuuuccuuucuggauguaa

SEQ ID NO: 477852 - RNA, 64 nt, Homo Sapiens
uuuucguuguaggagcacuugauuucuaguguguuuuguacaguauauaacuacaagauaguac

SEQ ID NO: 477853 - RNA, 64 nt, Homo Sapiens
uuaauuacugagcagaaguaaauacuguuggcauuuuguacauaaucuaauuuuuauaugcaug

SEQ ID NO: 477854 - RNA, 64 nt, Homo Sapiens
ugaauuccuagucuuccuucauggcuuuccugucuuuguacaguugucauguuggagauuggua

SEQ ID NO: 477855 - RNA, 64 nt, Homo Sapiens
agaguacuguauuuuugaauaugugacuuuuuucuuuguacagauuuucaucuuauuaaaugug

SEQ ID NO: 477856 - RNA, 64 nt, Homo Sapiens
guaaaaauaaacuguuaugauugcauuuuuguauuuuguacaaacuggucuguacuccuuggau

SEQ ID NO: 477857 - RNA, 64 nt, Homo Sapiens
gcuucuuuuucaaaacuaguuucuguuaaauauuuuuguacauccuuuccugcaucuuucauag

SEQ ID NO: 477858 - RNA, 64 nt, Homo Sapiens
uuuugaagugagaaaaugaacauuaacaggcauguuuguacagcuagaauauauuaguaagaua

SEQ ID NO: 477859 - RNA, 64 nt, Homo Sapiens
aaauccaaauucucuuccugguuccagcacugauuuuguacauaaacauuaggcagguugcuua

SEQ ID NO: 477860 - RNA, 64 nt, Homo Sapiens
auaaaauaaaucuacuguuuagugagcaguaugauuuguacaugccauugaaaauuauuaauca

SEQ ID NO: 477861 - RNA, 64 nt, Homo Sapiens
aaaaugauuuaccccugguuaaguuucugaagacuuuguacauacagaaguauggcucuguucu

SEQ ID NO: 477862 - RNA, 64 nt, Homo Sapiens
uuagcaagucugugauguacuuucacuggcucuguuuguacauugagauuguuuguuuaacaau

SEQ ID NO: 477863 - RNA, 64 nt, Homo Sapiens
uuuauuuuuaaauuauguuuuacuguucauuugauuuguacagauucuuuauuaucauuguucu

SEQ ID NO: 477864 - RNA, 64 nt, Homo Sapiens
uauuuuuacaacucacuggugguuuuccgcauucuuuguacacccaugaaagaaaacuuuuaug

SEQ ID NO: 477865 - RNA, 64 nt, Homo Sapiens
agagagauccuggacuucuuuuugggggacuauuuuuguacagagaaaaccuggggaggguggg

SEQ ID NO: 477866 - RNA, 64 nt, Homo Sapiens
gacgaaaaaaauguuuuaauauuugcaagcaacuuuuguacaguauuuaucgagauaaacaugg

SEQ ID NO: 477867 - RNA, 64 nt, Homo Sapiens
aaugugccaacagcuugauguacaauuaaucuguuuuguacauagagugcuuuguagcaggcau

SEQ ID NO: 477868 - RNA, 64 nt, Homo Sapiens
gacuagucaugcaucaucagugagugaaacaaucuuuguacaaucauuucuaauaaaaauuuau

SEQ ID NO: 477869 - RNA, 64 nt, Homo Sapiens
cugcucuucuuaaaaucguuuagauuuuuuuugguuuguacagcuccaccuuuuagaggucuua

SEQ ID NO: 477870 - RNA, 64 nt, Homo Sapiens
ucacaguacagcuaauuuuuccuaguuaacauauuuuguacaauauuaaaaaaaugcacagaaa

SEQ ID NO: 477871 - RNA, 64 nt, Homo Sapiens
gaggucaccucugaagugaugauugaucuugccuuuuguacauguuguguccagugauaaaugu

SEQ ID NO: 477872 - RNA, 64 nt, Homo Sapiens
uaaguguaaauauuguauguaaacauuaaauuauuuuguacaguaaacauucuaauauuuuugu

SEQ ID NO: 477873 - RNA, 64 nt, Homo Sapiens
aggauuuauuuaagcuauuauuuuaauaaagaacuuuguacauuuuuauuuuuauauuuuuuuc

SEQ ID NO: 477874 - RNA, 64 nt, Homo Sapiens
cagaggcacucaugggaaaauugguuuugcuuucuuuguacacaccagagacccaucugagguc

SEQ ID NO: 477875 - RNA, 64 nt, Homo Sapiens
uuaaauuaaugucucaaagcaaugguuauauguauuuguacagugaguaauuuauccuaguggu

SEQ ID NO: 477876 - RNA, 64 nt, Homo Sapiens
aguugggccaaccuuugcugguuugucuuuuguuuuuguacagcugcugugguuggcuuaagag

SEQ ID NO: 477877 - RNA, 64 nt, Homo Sapiens
uuucggaaauaacaccucacagcagcuucgugcuuuuguacagaccuuuguaacaaguguacag

SEQ ID NO: 477878 - RNA, 64 nt, Homo Sapiens
uauaaaucugagcauugauaauguucuaucuaaauuuguacagugugauuuuuuuuuuuagaau

SEQ ID NO: 477879 - RNA, 64 nt, Homo Sapiens
auagucuauucaguucguucguuauaaauggcauuuuguacaaagacuuacuagucauuuuagu

SEQ ID NO: 477880 - RNA, 64 nt, Homo Sapiens
ugcacauguaaucaucauacguagaguuaaugauuuuguacauuuuuuggaaugauguaucuuu

SEQ ID NO: 477881 - RNA, 64 nt, Homo Sapiens
uuguuaauuaagggcauauaugacauuuuguagcuuuguacauguuguuuuuaaucuguauaga

SEQ ID NO: 477882 - RNA, 64 nt, Homo Sapiens
aaagauuuuuuccaaguaagauuugggcuuguuauuuguacauuuuaaauugcugcaguccaua

SEQ ID NO: 477883 - RNA, 64 nt, Homo Sapiens
uccuuuuugaggaagguuucgguaucuucaucauuuuguacauuaguauguugaaauaaacuau

SEQ ID NO: 477884 - RNA, 64 nt, Homo Sapiens
uaaauaaggucacaauauucgagaaugauugcuuuuuguacaguagugaagauggaaggcugga

SEQ ID NO: 477885 - RNA, 64 nt, Homo Sapiens
ugcuguaauuuauuaauguuuguagcuuuuuauauuuguacauuucuuaugagcuuuguuuaua

SEQ ID NO: 477886 - RNA, 62 nt, Homo Sapiens
aucaaaguuuuaaaaaaguaaaaauauuucagguuuuguacagaaccaugucugugucauuu

SEQ ID NO: 477887 - RNA, 64 nt, Homo Sapiens
caaauauuacguuuaucuaguuagaagcuaauguuuuguacauuuuuuguaugaggaagugaug

SEQ ID NO: 477888 - RNA, 64 nt, Homo Sapiens
acauuuauucaaugguugacguuguuuugugauauuuguacacaaauuuucuuuucucaguuuu

SEQ ID NO: 477889 - RNA, 64 nt, Homo Sapiens
cuugacacuuccauguuggcucuucucagcuuuuuuuguacauauuuuuuuuuucuaaagagaa

SEQ ID NO: 477890 - RNA, 64 nt, Homo Sapiens
uucuacuaccugacauuuauagacauuaccaagguuuguacaaauaaguucguaucuaaaccua

SEQ ID NO: 477891 - RNA, 64 nt, Homo Sapiens
agucuccguuggccggagguaucgccgauguagauuuguacaggggaucggggcuggaaccuag

SEQ ID NO: 477892 - RNA, 64 nt, Homo Sapiens
uguauauauguuguccaaaucugacaguagguauuuuguacauaugaaauuauaaaagaggauu

SEQ ID NO: 477893 - RNA, 64 nt, Homo Sapiens
auuagugaccuaaguuauuuuaaucaguuuuauuuuuguacaguuacugaucuuuacaacuguu

SEQ ID NO: 477894 - RNA, 64 nt, Homo Sapiens
ugugccuugugauugcugcuuuugcuugagguauuuuguacauauuugaauguucaguuucuau

SEQ ID NO: 477895 - RNA, 64 nt, Homo Sapiens
cuaaauauugaugucacaccugaaucuuagaacuuuuguacacauauaaacuuugcauuguauu

SEQ ID NO: 477896 - RNA, 64 nt, Homo Sapiens
gaugccucuaaccuuggauuggccuguguguguguuuguacauagaauauuuauuuuuauacag

SEQ ID NO: 477897 - RNA, 64 nt, Homo Sapiens
cagauuauuaaaaaagaaagaaaaaccugcauauuuuguacagaaaauaucaaccucuucccuu

SEQ ID NO: 477898 - RNA, 64 nt, Homo Sapiens
uuuuaaacaaaaacaaaaaaagcaaccagggcuauuuguacaguugaaggggugaacagaaugg

SEQ ID NO: 477899 - RNA, 64 nt, Homo Sapiens
gccugaaguaacucccacagaaaccaucaucgucuuuguacaucguauguacaaugcaaucauu

SEQ ID NO: 477900 - RNA, 64 nt, Homo Sapiens
aucaucauauuaauauuugauucaaaagaauuauuuuguacaaauugguugccaccgguccuac

SEQ ID NO: 477901 - RNA, 64 nt, Homo Sapiens
cagaguuugaugcauuucuauugaagcucucucuuuuguacauucagaggauuacuguuucaua

SEQ ID NO: 477902 - RNA, 64 nt, Homo Sapiens
uauccuaaccaguucggggauauauuaagauauuuuuguacauaagagagaaagagagagaaaa

SEQ ID NO: 477903 - RNA, 64 nt, Homo Sapiens
uaagagagaaagagagagaaaaauuuauagaaguuuuguacaaaugguuuaaaauguguauauc

SEQ ID NO: 477904 - RNA, 64 nt, Homo Sapiens
aaaucuauuggguuaauuucucccuauguuuauuuuuguacauuugagccaugucacacaaacu

SEQ ID NO: 477905 - RNA, 64 nt, Homo Sapiens
ucaaaaucugugaccugucagaauaaaaaugugguuuguacauaucaaauagauauuuuaaggg

SEQ ID NO: 477906 - RNA, 64 nt, Homo Sapiens
gacaggcaugaggagugccuauuuuguacaauauuuuguacaaacccucuuuuuuccugggaau

SEQ ID NO: 477907 - RNA, 64 nt, Homo Sapiens
auuuuguacaaagacaggcauuuccugggaauauuuuguacaauagcccuucuuuucccucuuu

SEQ ID NO: 477908 - RNA, 64 nt, Homo Sapiens
ucugguggaaaaaacucgucuacaucgaccuccguuuguacauuccaucacacccagcaauagc

SEQ ID NO: 477909 - RNA, 64 nt, Homo Sapiens
agcugagaaaaaaaaaaaaaaacacguuugauacuuuguacaucagaugcaucuuauuuaaaag

SEQ ID NO: 477910 - RNA, 64 nt, Homo Sapiens
cccggcucccgccccgccccggcgcggcguggcuuuuguacagacguucccacauucuugucaa

SEQ ID NO: 477911 - RNA, 64 nt, Homo Sapiens
uuuuagacugaacuucgguguuuucuugagacuuuuuguacaguauuuaucaccuacggaggaa

SEQ ID NO: 477912 - RNA, 64 nt, Homo Sapiens
uugggaugcuacuuagugauacaugcuuaacugguuuguacacuuggauuaguacuaauuuuau

SEQ ID NO: 477913 - RNA, 64 nt, Homo Sapiens
cauuuaaaugguucuaauuuuuguuauuugcaaauuuguacaaaucuauuuuuuuuuguuuauu

SEQ ID NO: 477914 - RNA, 64 nt, Homo Sapiens
ucuuuucuauuuuuuuuugugauuaaaugccagcuuuguacagguaaacuuuuggaaaaaaaaa

SEQ ID NO: 477915 - RNA, 64 nt, Homo Sapiens
guaugcuuuuuuuuuaguuuuguaaauaaauuuguuuguacauucaguuuguaauuguaauuuu

SEQ ID NO: 477916 - RNA, 64 nt, Homo Sapiens
uuguaauuguaauuuuuguaggaaauugucucaauuuguacaguuggcuucuguuggaggcaug

SEQ ID NO: 477917 - RNA, 64 nt, Homo Sapiens
gccauucuagaaauagaguuccaguuuugcuggauuuguacauacuuucuuacccuguucuguu

SEQ ID NO: 477918 - RNA, 64 nt, Homo Sapiens
uucugcauguuuuauaauuuuuuaaaaauuucuguuuguacauaauguauaugaagcaaauauu

SEQ ID NO: 477919 - RNA, 64 nt, Homo Sapiens
uuuaaguugugucagauucuucucccaggaaaucuuuguacagccucuguaugaagagaagauu

SEQ ID NO: 477920 - RNA, 64 nt, Homo Sapiens
gccuuucuuauuuauauagagaacacuucacuuuuuuguacauuuuuaaggggccuucagggaa

SEQ ID NO: 477921 - RNA, 64 nt, Homo Sapiens
cacuccgccauuccugguucucuccgaaccguucuuuguacaguaaauguaauucagcuguggu

SEQ ID NO: 477922 - RNA, 64 nt, Homo Sapiens
auuagaauguguaaaugaagcagagaauguaaauuuuguacaguaaaagugaauaaauaaguca

SEQ ID NO: 477923 - RNA, 64 nt, Homo Sapiens
aaccuuugcuuuccuuagacuccaaaagucacaauuuguacaagugucaacugucacuguuucu

SEQ ID NO: 477924 - RNA, 64 nt, Homo Sapiens
aaacaggugaaugcugacuugaucuaguguccuuuuuguacacuuuccugauauuuucuuaaaa

SEQ ID NO: 477925 - RNA, 64 nt, Homo Sapiens
agagaagcaaaaucuuuuuugacuugagucuauuuuuguacaaacuuuuagcuacugcuaauga

SEQ ID NO: 477926 - RNA, 64 nt, Homo Sapiens
uauuauguacacucagggaacauauuugguaaguuuuguacauaauugucaugcaauaauuauu

SEQ ID NO: 477927 - RNA, 64 nt, Homo Sapiens
aacacuggaugugauuaauaagcugggaccauaauuuguacagacuguaagacauaccaggccc

SEQ ID NO: 477928 - RNA, 64 nt, Homo Sapiens
ugaggagcagcagagucccuuguaaaagacugcuuuuguacagaaugcgcuauaaauuauaccu

SEQ ID NO: 477929 - RNA, 64 nt, Homo Sapiens
augaugcuucccccuucuccauggucuagucaauuuuguacaauuagguaucugacuuuacaag

SEQ ID NO: 477930 - RNA, 64 nt, Homo Sapiens
caugcaugcauguguguauaugucucaaauuggguuuguacacagaucuaaaguuggccuuugu

SEQ ID NO: 477931 - RNA, 64 nt, Homo Sapiens
auggauauuauauaugaaauaaauacugauugacuuuguacauuuugaaccagacauuuuuaua

SEQ ID NO: 477932 - RNA, 64 nt, Homo Sapiens; identical to SEQ ID NO: 180624

SEQ ID NO: 477933 - RNA, 64 nt, Homo Sapiens; identical to SEQ ID NO: 180625

SEQ ID NO: 477934 - RNA, 64 nt, Homo Sapiens; identical to SEQ ID NO: 180626

SEQ ID NO: 477935 - RNA, 64 nt, Homo Sapiens; identical to SEQ ID NO: 180627

SEQ ID NO: 477936 - RNA, 64 nt, Homo Sapiens; identical to SEQ ID NO: 180628

SEQ ID NO: 477937 - RNA, 64 nt, Homo Sapiens; identical to SEQ ID NO: 180629

SEQ ID NO: 477938 - RNA, 64 nt, Homo Sapiens; identical to SEQ ID NO: 180630

SEQ ID NO: 477939 - RNA, 64 nt, Homo Sapiens; identical to SEQ ID NO: 180631

SEQ ID NO: 477940 - RNA, 59 nt, Homo Sapiens
gaagagucuugagaggggcugucaucuguagcugccaucacagugaguuggcagaagug

SEQ ID NO: 477941 - RNA, 59 nt, Homo Sapiens
gccccugugccaggcuaagcugguacaagagcugccaaccucacagaguguuugcuagg

SEQ ID NO: 477942 - RNA, 59 nt, Homo Sapiens
cgagauagccaaggccaaaggguuucuaaagcugccagcuccuccucagaucuucugug

SEQ ID NO: 477943 - RNA, 59 nt, Homo Sapiens
ugccuguugggccaggagccggggaccagagcugccaccccuguccccgcacugggcuu

SEQ ID NO: 477944 - RNA, 59 nt, Homo Sapiens
gugcacuggggggaauguucggcuccagaagcugccagaguacacccaccugccucucu

SEQ ID NO: 477945 - RNA, 59 nt, Homo Sapiens
uaggacaugacuaggaguguaggggucccagcugccaagcgagcauugcagauugcagu

SEQ ID NO: 477946 - RNA, 59 nt, Homo Sapiens
uuuaaacaacauaaaggaauagaaagagcagcugccacucauugauuaaaauggaauaa

SEQ ID NO: 477947 - RNA, 59 nt, Homo Sapiens
auagacagcuacauuuuuaucugcaauauagcugccaaauaaaagauagucaagaaauu

SEQ ID NO: 477948 - RNA, 59 nt, Homo Sapiens
cacucccucccuggcuucagugcccaggcagcugccaagcaacuggacugaggggagug

SEQ ID NO: 477949 - RNA, 59 nt, Homo Sapiens
cacuguauaauuucgccuggucucuguggagcugccaucuuagaccucaaacuuuagca

SEQ ID NO: 477950 - RNA, 59 nt, Homo Sapiens
ccuggaggccagcucugccccaggggcugagcugccaccagagguccugggacccucac

SEQ ID NO: 477951 - RNA, 59 nt, Homo Sapiens
guggcugucggccagagggaauguucuggagcugccaaggagggaggagacucggguug

SEQ ID NO: 477952 - RNA, 59 nt, Homo Sapiens
gcucucucaggaccauccgaucaagcugcagcugccacccucaccuagaaacaugccuu

SEQ ID NO: 477953 - RNA, 59 nt, Homo Sapiens
uuggaauguccuggucacagggucaugucagcugccaguucucgucucccguccuggag

SEQ ID NO: 477954 - RNA, 59 nt, Homo Sapiens
ccccacgauuuaggguaacuguuaucaucagcugccauuucugauagggucuaccacau

SEQ ID NO: 477955 - RNA, 59 nt, Homo Sapiens
ccugugucaucacugcagcgguccucaggagcugccagggccaauugcuacagaguguc

SEQ ID NO: 477956 - RNA, 59 nt, Homo Sapiens
cccccgacacuccugcugucacccaggccagcugccacagggcagacacagcuccaggg

SEQ ID NO: 477957 - RNA, 59 nt, Homo Sapiens
ccagccccaucuggaaggagaaucgcuguagcugccagggauguucugggggaggaggc

SEQ ID NO: 477958 - RNA, 59 nt, Homo Sapiens
ggccuaaggcugagugagguccgccaggcagcugccacaccucucacucacuucuccac

SEQ ID NO: 477959 - RNA, 59 nt, Homo Sapiens
ccagccuguggccaggucacuauaaaacuagcugccaacugcgcuccugcgagaccaga

SEQ ID NO: 477960 - RNA, 59 nt, Homo Sapiens
caggagucgguaggacugugggcuccuccagcugccaggcuccuuugugcuggaaccug

SEQ ID NO: 477961 - RNA, 59 nt, Homo Sapiens
ugggaugguggcucaggcgcuacgccagcagcugccacaaugccagcccgaggcacugc

SEQ ID NO: 477962 - RNA, 59 nt, Homo Sapiens
ggcucccagaaagccuuauucaucccaccagcugccaguccuuuuccaccucccccuuc

SEQ ID NO: 477963 - RNA, 59 nt, Homo Sapiens
cuuggagcacauugauuuuugagcauuugagcugccacuccaagauggcuguaaacaca

SEQ ID NO: 477964 - RNA, 59 nt, Homo Sapiens
agagauggccccuccucaccugggacggaagcugccagcucgcuucccccaagcugccu

SEQ ID NO: 477965 - RNA, 59 nt, Homo Sapiens
ucugugucucagauggcgauuuugcugacagcugccaagaaaaugcuucacucaacagu

SEQ ID NO: 477966 - RNA, 59 nt, Homo Sapiens
aagaccccugggcaugauuuugcagagcaagcugccacguuuggugugguguuugccau

SEQ ID NO: 477967 - RNA, 59 nt, Homo Sapiens
augccuaugugcccaagagccccuggcauagcugccaccgaagaaggcaugggauggag

SEQ ID NO: 477968 - RNA, 59 nt, Homo Sapiens
aaacagcaaagucagcauuugcuguauagagcugccacccaacucuaagcaggagaaac

SEQ ID NO: 477969 - RNA, 59 nt, Homo Sapiens
aauuugaccucccagagccaguuuccauuagcugccaugcucugcugccucuaauucac

SEQ ID NO: 477970 - RNA, 59 nt, Homo Sapiens
cuggcccccucagccaucucagggugaggagcugccagucauguccagauggaaugacu

SEQ ID NO: 477971 - RNA, 59 nt, Homo Sapiens
gggaagaugugcauccguggucaaaagucagcugccagcccugcggaaccagagccuca

SEQ ID NO: 477972 - RNA, 59 nt, Homo Sapiens
gugugguauucgaggauuaugaugccaaaagcugccacucaguuaugucccauuuuuau

SEQ ID NO: 477973 - RNA, 59 nt, Homo Sapiens
acccaccuggcccuccuccugugcaggacagcugccagcuccacccgaccccagcagug

SEQ ID NO: 477974 - RNA, 59 nt, Homo Sapiens
aaggugugugaaagauguuauacaccaggagcugccacugcaugucccaaccagacugu

SEQ ID NO: 477975 - RNA, 59 nt, Homo Sapiens
ucuucaguucauuccacuuuaggaaacagagcugccaauugaaacagaagaagaaaaaa

SEQ ID NO: 477976 - RNA, 59 nt, Homo Sapiens
cacccugaaauugugacccccugggggacagcugccagacacagcuggcggcagcacca

SEQ ID NO: 477977 - RNA, 59 nt, Homo Sapiens
agaggucaugaagggaccucuguggcuccagcugccaacccuggagcccagaccgaggu

SEQ ID NO: 477978 - RNA, 59 nt, Homo Sapiens
aguuuccuuuuuuauucucucaagccaccagcugccagccaccagcagccagcugccag

SEQ ID NO: 477979 - RNA, 59 nt, Homo Sapiens
aagccaccagcugccagccaccagcagccagcugccagccuagcuuuuuuuuuuuuuuu

SEQ ID NO: 477980 - RNA, 64 nt, Homo Sapiens; identical to SEQ ID NO: 249371

SEQ ID NO: 477981 - RNA, 64 nt, Homo Sapiens; identical to SEQ ID NO: 249372

SEQ ID NO: 477982 - RNA, 64 nt, Homo Sapiens; identical to SEQ ID NO: 249373

SEQ ID NO: 477983 - RNA, 64 nt, Homo Sapiens; identical to SEQ ID NO: 249374

SEQ ID NO: 477984 - RNA, 64 nt, Homo Sapiens; identical to SEQ ID NO: 249375

SEQ ID NO: 477985 - RNA, 64 nt, Homo Sapiens; identical to SEQ ID NO: 249376

SEQ ID NO: 477986 - RNA, 64 nt, Homo Sapiens; identical to SEQ ID NO: 249377

SEQ ID NO: 477987 - RNA, 64 nt, Homo Sapiens; identical to SEQ ID NO: 249378

SEQ ID NO: 477988 - RNA, 64 nt, Homo Sapiens; identical to SEQ ID NO: 249379

SEQ ID NO: 477989 - RNA, 64 nt, Homo Sapiens; identical to SEQ ID NO: 249380

SEQ ID NO: 477990 - RNA, 64 nt, Homo Sapiens; identical to SEQ ID NO: 249381

SEQ ID NO: 477991 - RNA, 64 nt, Homo Sapiens; identical to SEQ ID NO: 249382

SEQ ID NO: 477992 - RNA, 64 nt, Homo Sapiens; identical to SEQ ID NO: 249383

SEQ ID NO: 477993 - RNA, 64 nt, Homo Sapiens; identical to SEQ ID NO: 249384

SEQ ID NO: 477994 - RNA, 64 nt, Homo Sapiens; identical to SEQ ID NO: 249385

SEQ ID NO: 477995 - RNA, 64 nt, Homo Sapiens; identical to SEQ ID NO: 249386

SEQ ID NO: 477996 - RNA, 64 nt, Homo Sapiens; identical to SEQ ID NO: 249387

SEQ ID NO: 477997 - RNA, 64 nt, Homo Sapiens; identical to SEQ ID NO: 249388

SEQ ID NO: 477998 - RNA, 64 nt, Homo Sapiens; identical to SEQ ID NO: 249389

SEQ ID NO: 477999 - RNA, 64 nt, Homo Sapiens; identical to SEQ ID NO: 249390

SEQ ID NO: 478000 - RNA, 63 nt, Homo Sapiens; identical to SEQ ID NO: 249391

SEQ ID NO: 478001 - RNA, 64 nt, Homo Sapiens; identical to SEQ ID NO: 249392

SEQ ID NO: 478002 - RNA, 64 nt, Homo Sapiens; identical to SEQ ID NO: 249393

SEQ ID NO: 478003 - RNA, 64 nt, Homo Sapiens; identical to SEQ ID NO: 249394

SEQ ID NO: 478004 - RNA, 64 nt, Homo Sapiens; identical to SEQ ID NO: 249395

SEQ ID NO: 478005 - RNA, 64 nt, Homo Sapiens; identical to SEQ ID NO: 249396

SEQ ID NO: 478006 - RNA, 64 nt, Homo Sapiens; identical to SEQ ID NO: 249397

SEQ ID NO: 478007 - RNA, 64 nt, Homo Sapiens; identical to SEQ ID NO: 249398

SEQ ID NO: 478008 - RNA, 64 nt, Homo Sapiens; identical to SEQ ID NO: 249399

SEQ ID NO: 478009 - RNA, 64 nt, Homo Sapiens; identical to SEQ ID NO: 249400

SEQ ID NO: 478010 - RNA, 64 nt, Homo Sapiens; identical to SEQ ID NO: 249401

SEQ ID NO: 478011 - RNA, 64 nt, Homo Sapiens; identical to SEQ ID NO: 249402

SEQ ID NO: 478012 - RNA, 64 nt, Homo Sapiens; identical to SEQ ID NO: 249403

SEQ ID NO: 478013 - RNA, 64 nt, Homo Sapiens; identical to SEQ ID NO: 249404

SEQ ID NO: 478014 - RNA, 64 nt, Homo Sapiens; identical to SEQ ID NO: 249405

SEQ ID NO: 478015 - RNA, 64 nt, Homo Sapiens; identical to SEQ ID NO: 249406

SEQ ID NO: 478016 - RNA, 64 nt, Homo Sapiens; identical to SEQ ID NO: 249407

SEQ ID NO: 478017 - RNA, 64 nt, Homo Sapiens; identical to SEQ ID NO: 249408

SEQ ID NO: 478018 - RNA, 64 nt, Homo Sapiens; identical to SEQ ID NO: 249409

SEQ ID NO: 478019 - RNA, 64 nt, Homo Sapiens; identical to SEQ ID NO: 249410

SEQ ID NO: 478020 - RNA, 64 nt, Homo Sapiens; identical to SEQ ID NO: 249411

SEQ ID NO: 478021 - RNA, 64 nt, Homo Sapiens; identical to SEQ ID NO: 249412

SEQ ID NO: 478022 - RNA, 64 nt, Homo Sapiens; identical to SEQ ID NO: 249413

SEQ ID NO: 478023 - RNA, 64 nt, Homo Sapiens; identical to SEQ ID NO: 249414

SEQ ID NO: 478024 - RNA, 64 nt, Homo Sapiens; identical to SEQ ID NO: 249415

SEQ ID NO: 478025 - RNA, 64 nt, Homo Sapiens; identical to SEQ ID NO: 249416

SEQ ID NO: 478026 - RNA, 64 nt, Homo Sapiens; identical to SEQ ID NO: 249417

SEQ ID NO: 478027 - RNA, 64 nt, Homo Sapiens; identical to SEQ ID NO: 249418

SEQ ID NO: 478028 - RNA, 64 nt, Homo Sapiens; identical to SEQ ID NO: 249419

SEQ ID NO: 478029 - RNA, 64 nt, Homo Sapiens; identical to SEQ ID NO: 249420

SEQ ID NO: 478030 - RNA, 64 nt, Homo Sapiens; identical to SEQ ID NO: 249421

SEQ ID NO: 478031 - RNA, 64 nt, Homo Sapiens; identical to SEQ ID NO: 249422

SEQ ID NO: 478032 - RNA, 64 nt, Homo Sapiens; identical to SEQ ID NO: 249423

SEQ ID NO: 478033 - RNA, 59 nt, Homo Sapiens; identical to SEQ ID NO: 249424

SEQ ID NO: 478034 - RNA, 62 nt, Homo Sapiens
cuagucuaggugugagagccccaagcccuuccaccagaaaaggcccugcugucugucugugc

SEQ ID NO: 478035 - RNA, 62 nt, Homo Sapiens
ucccaccccuugcccuuuccuucaagucagugaccagaaaaacaaaacucucaaaaauguau

SEQ ID NO: 478036 - RNA, 62 nt, Homo Sapiens
gcuggaauuugcauucgcaaaagaagaagcuaaccagaaaaagguaucucccugggauaaaa

SEQ ID NO: 478037 - RNA, 62 nt, Homo Sapiens
caaagagugccauuggaacaaaaacaacagcuaccagaaauacacuacaaucaccagcuuuu

SEQ ID NO: 478038 - RNA, 62 nt, Homo Sapiens
aauguguguguuugagcagcacaaucuguccaaccagaaaagccagguggugggaauaauuu

SEQ ID NO: 478039 - RNA, 62 nt, Homo Sapiens
cuaaagaagaggaauuauacuccguguuccuaaccagaaaucgcagggcacugagacacccg

SEQ ID NO: 478040 - RNA, 62 nt, Homo Sapiens
guuuaaauuuaccuacagccaaccaauugucaaccagaaaauccaggucuucagcuaagcuc

SEQ ID NO: 478041 - RNA, 62 nt, Homo Sapiens
acaggggcaggguucugacugaagcagagaugaccagaaagcgagaaaaaaaggaugugaca

SEQ ID NO: 478042 - RNA, 62 nt, Homo Sapiens
aauaaguacuccuaaagugaccauuauuagggaccagaaaauuauaucuuggcuaaguaaua

SEQ ID NO: 478043 - RNA, 62 nt, Homo Sapiens
accaugguaauauuugcaaaaggucuggccauaccagaaaaguacaguugagauaguuaaga

SEQ ID NO: 478044 - RNA, 62 nt, Homo Sapiens
aggaauaggaacuacaacuucauaaaugaggaaccagaaaagguaaaaaaaaaaaaaaaaac

SEQ ID NO: 478045 - RNA, 62 nt, Homo Sapiens
guggauaccuaguagucucugccauacccuugaccagaaauuuuucuucuaaagaauuuaau

SEQ ID NO: 478046 - RNA, 62 nt, Homo Sapiens
ccuuuaaauaugcuuuuugcuuucaaaaauaaaccagaaaaccuauauccuaugauacaacu

SEQ ID NO: 478047 - RNA, 62 nt, Homo Sapiens
gccuguacuaucauauaauuuaauguauauacaccagaaacuauuuuucaaacuuuuuuuac

SEQ ID NO: 478048 - RNA, 62 nt, Homo Sapiens
uaacgaauucuugaguuuguuuucuaaaggagaccagaaauccacuauuacaaauguauuug

SEQ ID NO: 478049 - RNA, 62 nt, Homo Sapiens
auuaucuuuguguauaugcuucauguuauuuaaccagaaaugucuuaucucuaaaaauuuuu

SEQ ID NO: 478050 - RNA, 62 nt, Homo Sapiens
caugcuggcuuaaauaaucuaggaagaguaaaaccagaaauuucaagccuacaaugcccuag

SEQ ID NO: 478051 - RNA, 62 nt, Homo Sapiens
cuucgcugcugcaagccagaggaggcaaccugaccagaaacauugcuucaaucagguuuggu

SEQ ID NO: 478052 - RNA, 62 nt, Homo Sapiens
auugauaaugugaauuuuuguaacagaauucaaccagaaauagucccuuuguaauuggcuuc

SEQ ID NO: 478053 - RNA, 62 nt, Homo Sapiens
ggcuuugacaccaagugcuaaaugaaugugugaccagaaaguauacugacuagcaaccaugg

SEQ ID NO: 478054 - RNA, 62 nt, Homo Sapiens
auauuuacacuaauuuuuuuaucuuuauugcuaccagaaaaaaaugcgaacgaaugcauugc

SEQ ID NO: 478055 - RNA, 62 nt, Homo Sapiens
uugcccagcaggaaaaucauguaaguuauaccaccagaaagcaaaaggagcaugguuuggug

SEQ ID NO: 478056 - RNA, 62 nt, Homo Sapiens
cgucucccaaucacccaggacccugguguucuaccagaaaaaucauccucagaaaagccuug

SEQ ID NO: 478057 - RNA, 62 nt, Homo Sapiens
cugguggcuuuggucccaaguguacuucagacaccagaaaguagacagagagcagaucaaug

SEQ ID NO: 478058 - RNA, 53 nt, Homo Sapiens
acgaagggaauuucugcugaagaaccagaaaaaagaaagcacaacaccuuucc

SEQ ID NO: 478059 - RNA, 62 nt, Homo Sapiens
guuugcauucacaugaaggaauugcuuuucacaccagaaauucagacuuagucaauguuggc

SEQ ID NO: 478060 - RNA, 62 nt, Homo Sapiens
auccuuuagccagcguuucaaccucauucaacaccagaaaguucacaguggaaaaaaucuug

SEQ ID NO: 478061 - RNA, 62 nt, Homo Sapiens
agguuucagccaaaggccuaacccuauucaacaccagaaaguuuacacuggagaaaggccuu

SEQ ID NO: 478062 - RNA, 62 nt, Homo Sapiens
uaucuaugucucgacuuuucugaugaaguuauaccagaaaaguuaauuauuugaugggccug

SEQ ID NO: 478063 - RNA, 62 nt, Homo Sapiens
aguuaauuauuugaugggccugccaugugaaaaccagaaaauaaccucguacucacaagcca

SEQ ID NO: 478064 - RNA, 64 nt, Homo Sapiens; identical to SEQ ID NO: 93499

SEQ ID NO: 478065 - RNA, 64 nt, Homo Sapiens; identical to SEQ ID NO: 93500

SEQ ID NO: 478066 - RNA, 64 nt, Homo Sapiens; identical to SEQ ID NO: 93501

SEQ ID NO: 478067 - RNA, 64 nt, Homo Sapiens; identical to SEQ ID NO: 93502

SEQ ID NO: 478068 - RNA, 64 nt, Homo Sapiens; identical to SEQ ID NO: 93503

SEQ ID NO: 478069 - RNA, 64 nt, Homo Sapiens; identical to SEQ ID NO: 93504

SEQ ID NO: 478070 - RNA, 64 nt, Homo Sapiens; identical to SEQ ID NO: 93505

SEQ ID NO: 478071 - RNA, 64 nt, Homo Sapiens; identical to SEQ ID NO: 93506

SEQ ID NO: 478072 - RNA, 64 nt, Homo Sapiens; identical to SEQ ID NO: 93507

SEQ ID NO: 478073 - RNA, 64 nt, Homo Sapiens; identical to SEQ ID NO: 93508

SEQ ID NO: 478074 - RNA, 64 nt, Homo Sapiens; identical to SEQ ID NO: 93509

SEQ ID NO: 478075 - RNA, 64 nt, Homo Sapiens; identical to SEQ ID NO: 93510

SEQ ID NO: 478076 - RNA, 64 nt, Homo Sapiens; identical to SEQ ID NO: 93511

SEQ ID NO: 478077 - RNA, 64 nt, Homo Sapiens; identical to SEQ ID NO: 93512

SEQ ID NO: 478078 - RNA, 64 nt, Homo Sapiens; identical to SEQ ID NO: 93513

SEQ ID NO: 478079 - RNA, 64 nt, Homo Sapiens; identical to SEQ ID NO: 93514

SEQ ID NO: 478080 - RNA, 64 nt, Homo Sapiens; identical to SEQ ID NO: 93515

SEQ ID NO: 478081 - RNA, 64 nt, Homo Sapiens; identical to SEQ ID NO: 93516

SEQ ID NO: 478082 - RNA, 64 nt, Homo Sapiens; identical to SEQ ID NO: 93517

SEQ ID NO: 478083 - RNA, 64 nt, Homo Sapiens; identical to SEQ ID NO: 93518

SEQ ID NO: 478084 - RNA, 64 nt, Homo Sapiens; identical to SEQ ID NO: 93519

SEQ ID NO: 478085 - RNA, 64 nt, Homo Sapiens; identical to SEQ ID NO: 93520

SEQ ID NO: 478086 - RNA, 64 nt, Homo Sapiens; identical to SEQ ID NO: 93521

SEQ ID NO: 478087 - RNA, 64 nt, Homo Sapiens; identical to SEQ ID NO: 93522

SEQ ID NO: 478088 - RNA, 64 nt, Homo Sapiens; identical to SEQ ID NO: 93523

SEQ ID NO: 478089 - RNA, 64 nt, Homo Sapiens; identical to SEQ ID NO: 93524

SEQ ID NO: 478090 - RNA, 64 nt, Homo Sapiens; identical to SEQ ID NO: 93525

SEQ ID NO: 478091 - RNA, 64 nt, Homo Sapiens; identical to SEQ ID NO: 93526

SEQ ID NO: 478092 - RNA, 64 nt, Homo Sapiens; identical to SEQ ID NO: 93527

SEQ ID NO: 478093 - RNA, 64 nt, Homo Sapiens; identical to SEQ ID NO: 93528

SEQ ID NO: 478094 - RNA, 64 nt, Homo Sapiens; identical to SEQ ID NO: 93529

SEQ ID NO: 478095 - RNA, 64 nt, Homo Sapiens; identical to SEQ ID NO: 93530

SEQ ID NO: 478096 - RNA, 64 nt, Homo Sapiens; identical to SEQ ID NO: 93531

SEQ ID NO: 478097 - RNA, 64 nt, Homo Sapiens; identical to SEQ ID NO: 93532

SEQ ID NO: 478098 - RNA, 64 nt, Homo Sapiens; identical to SEQ ID NO: 93533

SEQ ID NO: 478099 - RNA, 64 nt, Homo Sapiens; identical to SEQ ID NO: 93534

SEQ ID NO: 478100 - RNA, 64 nt, Homo Sapiens; identical to SEQ ID NO: 93535

SEQ ID NO: 478101 - RNA, 64 nt, Homo Sapiens; identical to SEQ ID NO: 93536

SEQ ID NO: 478102 - RNA, 64 nt, Homo Sapiens; identical to SEQ ID NO: 93537

SEQ ID NO: 478103 - RNA, 64 nt, Homo Sapiens; identical to SEQ ID NO: 93538

SEQ ID NO: 478104 - RNA, 64 nt, Homo Sapiens; identical to SEQ ID NO: 93539

SEQ ID NO: 478105 - RNA, 64 nt, Homo Sapiens; identical to SEQ ID NO: 93540

SEQ ID NO: 478106 - RNA, 64 nt, Homo Sapiens; identical to SEQ ID NO: 93541

SEQ ID NO: 478107 - RNA, 64 nt, Homo Sapiens; identical to SEQ ID NO: 93542

SEQ ID NO: 478108 - RNA, 64 nt, Homo Sapiens; identical to SEQ ID NO: 93543

SEQ ID NO: 478109 - RNA, 64 nt, Homo Sapiens; identical to SEQ ID NO: 93544

SEQ ID NO: 478110 - RNA, 64 nt, Homo Sapiens; identical to SEQ ID NO: 93545

SEQ ID NO: 478111 - RNA, 64 nt, Homo Sapiens; identical to SEQ ID NO: 93546

SEQ ID NO: 478112 - RNA, 64 nt, Homo Sapiens; identical to SEQ ID NO: 93547

SEQ ID NO: 478113 - RNA, 64 nt, Homo Sapiens; identical to SEQ ID NO: 93548

SEQ ID NO: 478114 - RNA, 64 nt, Homo Sapiens; identical to SEQ ID NO: 93549

SEQ ID NO: 478115 - RNA, 64 nt, Homo Sapiens; identical to SEQ ID NO: 93550

SEQ ID NO: 478116 - RNA, 64 nt, Homo Sapiens; identical to SEQ ID NO: 93551

SEQ ID NO: 478117 - RNA, 64 nt, Homo Sapiens; identical to SEQ ID NO: 93552

SEQ ID NO: 478118 - RNA, 64 nt, Homo Sapiens; identical to SEQ ID NO: 93553

SEQ ID NO: 478119 - RNA, 64 nt, Homo Sapiens; identical to SEQ ID NO: 93554

SEQ ID NO: 478120 - RNA, 64 nt, Homo Sapiens; identical to SEQ ID NO: 93555

SEQ ID NO: 478121 - RNA, 64 nt, Homo Sapiens; identical to SEQ ID NO: 93556

SEQ ID NO: 478122 - RNA, 64 nt, Homo Sapiens; identical to SEQ ID NO: 93557

SEQ ID NO: 478123 - RNA, 64 nt, Homo Sapiens; identical to SEQ ID NO: 93558

SEQ ID NO: 478124 - RNA, 64 nt, Homo Sapiens; identical to SEQ ID NO: 93559

SEQ ID NO: 478125 - RNA, 64 nt, Homo Sapiens; identical to SEQ ID NO: 93560

SEQ ID NO: 478126 - RNA, 64 nt, Homo Sapiens; identical to SEQ ID NO: 93561

SEQ ID NO: 478127 - RNA, 64 nt, Homo Sapiens; identical to SEQ ID NO: 93562

SEQ ID NO: 478128 - RNA, 64 nt, Homo Sapiens; identical to SEQ ID NO: 93563

SEQ ID NO: 478129 - RNA, 64 nt, Homo Sapiens; identical to SEQ ID NO: 93564

SEQ ID NO: 478130 - RNA, 64 nt, Homo Sapiens; identical to SEQ ID NO: 93565

SEQ ID NO: 478131 - RNA, 64 nt, Homo Sapiens; identical to SEQ ID NO: 93566

SEQ ID NO: 478132 - RNA, 64 nt, Homo Sapiens; identical to SEQ ID NO: 93567

SEQ ID NO: 478133 - RNA, 64 nt, Homo Sapiens; identical to SEQ ID NO: 93568

SEQ ID NO: 478134 - RNA, 64 nt, Homo Sapiens; identical to SEQ ID NO: 93569

SEQ ID NO: 478135 - RNA, 64 nt, Homo Sapiens; identical to SEQ ID NO: 93570

SEQ ID NO: 478136 - RNA, 64 nt, Homo Sapiens; identical to SEQ ID NO: 93571

SEQ ID NO: 478137 - RNA, 64 nt, Homo Sapiens; identical to SEQ ID NO: 93572

SEQ ID NO: 478138 - RNA, 64 nt, Homo Sapiens; identical to SEQ ID NO: 93573

SEQ ID NO: 478139 - RNA, 64 nt, Homo Sapiens; identical to SEQ ID NO: 93574

SEQ ID NO: 478140 - RNA, 64 nt, Homo Sapiens; identical to SEQ ID NO: 93575

SEQ ID NO: 478141 - RNA, 64 nt, Homo Sapiens; identical to SEQ ID NO: 93576

SEQ ID NO: 478142 - RNA, 64 nt, Homo Sapiens; identical to SEQ ID NO: 93577

SEQ ID NO: 478143 - RNA, 64 nt, Homo Sapiens; identical to SEQ ID NO: 93578

SEQ ID NO: 478144 - RNA, 64 nt, Homo Sapiens; identical to SEQ ID NO: 93579

SEQ ID NO: 478145 - RNA, 64 nt, Homo Sapiens; identical to SEQ ID NO: 93580

SEQ ID NO: 478146 - RNA, 64 nt, Homo Sapiens; identical to SEQ ID NO: 93581

SEQ ID NO: 478147 - RNA, 64 nt, Homo Sapiens; identical to SEQ ID NO: 93582

SEQ ID NO: 478148 - RNA, 64 nt, Homo Sapiens; identical to SEQ ID NO: 90702

SEQ ID NO: 478149 - RNA, 64 nt, Homo Sapiens; identical to SEQ ID NO: 90703

SEQ ID NO: 478150 - RNA, 64 nt, Homo Sapiens; identical to SEQ ID NO: 90704

SEQ ID NO: 478151 - RNA, 64 nt, Homo Sapiens; identical to SEQ ID NO: 90705

SEQ ID NO: 478152 - RNA, 64 nt, Homo Sapiens; identical to SEQ ID NO: 90706

SEQ ID NO: 478153 - RNA, 64 nt, Homo Sapiens; identical to SEQ ID NO: 90707

SEQ ID NO: 478154 - RNA, 64 nt, Homo Sapiens; identical to SEQ ID NO: 90708

SEQ ID NO: 478155 - RNA, 64 nt, Homo Sapiens; identical to SEQ ID NO: 90709

SEQ ID NO: 478156 - RNA, 64 nt, Homo Sapiens; identical to SEQ ID NO: 90710

SEQ ID NO: 478157 - RNA, 64 nt, Homo Sapiens; identical to SEQ ID NO: 90711

SEQ ID NO: 478158 - RNA, 64 nt, Homo Sapiens; identical to SEQ ID NO: 90712

SEQ ID NO: 478159 - RNA, 64 nt, Homo Sapiens; identical to SEQ ID NO: 90713

SEQ ID NO: 478160 - RNA, 64 nt, Homo Sapiens; identical to SEQ ID NO: 90714

SEQ ID NO: 478161 - RNA, 64 nt, Homo Sapiens; identical to SEQ ID NO: 90715

SEQ ID NO: 478162 - RNA, 64 nt, Homo Sapiens; identical to SEQ ID NO: 90716

SEQ ID NO: 478163 - RNA, 64 nt, Homo Sapiens; identical to SEQ ID NO: 90717

SEQ ID NO: 478164 - RNA, 64 nt, Homo Sapiens; identical to SEQ ID NO: 90718

SEQ ID NO: 478165 - RNA, 64 nt, Homo Sapiens; identical to SEQ ID NO: 90719

SEQ ID NO: 478166 - RNA, 64 nt, Homo Sapiens; identical to SEQ ID NO: 90720

SEQ ID NO: 478167 - RNA, 64 nt, Homo Sapiens; identical to SEQ ID NO: 90721

SEQ ID NO: 478168 - RNA, 64 nt, Homo Sapiens; identical to SEQ ID NO: 90722

SEQ ID NO: 478169 - RNA, 64 nt, Homo Sapiens; identical to SEQ ID NO: 90723

SEQ ID NO: 478170 - RNA, 64 nt, Homo Sapiens; identical to SEQ ID NO: 90724

SEQ ID NO: 478171 - RNA, 64 nt, Homo Sapiens; identical to SEQ ID NO: 90725

SEQ ID NO: 478172 - RNA, 64 nt, Homo Sapiens; identical to SEQ ID NO: 90726

SEQ ID NO: 478173 - RNA, 64 nt, Homo Sapiens; identical to SEQ ID NO: 90727

SEQ ID NO: 478174 - RNA, 64 nt, Homo Sapiens; identical to SEQ ID NO: 90728

SEQ ID NO: 478175 - RNA, 64 nt, Homo Sapiens; identical to SEQ ID NO: 90729

SEQ ID NO: 478176 - RNA, 64 nt, Homo Sapiens; identical to SEQ ID NO: 90730

SEQ ID NO: 478177 - RNA, 64 nt, Homo Sapiens; identical to SEQ ID NO: 90731

SEQ ID NO: 478178 - RNA, 64 nt, Homo Sapiens; identical to SEQ ID NO: 90732

SEQ ID NO: 478179 - RNA, 64 nt, Homo Sapiens; identical to SEQ ID NO: 90733

SEQ ID NO: 478180 - RNA, 64 nt, Homo Sapiens; identical to SEQ ID NO: 90734

SEQ ID NO: 478181 - RNA, 64 nt, Homo Sapiens; identical to SEQ ID NO: 50680

SEQ ID NO: 478182 - RNA, 64 nt, Homo Sapiens; identical to SEQ ID NO: 50681

SEQ ID NO: 478183 - RNA, 64 nt, Homo Sapiens; identical to SEQ ID NO: 50682

SEQ ID NO: 478184 - RNA, 64 nt, Homo Sapiens; identical to SEQ ID NO: 50683

SEQ ID NO: 478185 - RNA, 64 nt, Homo Sapiens; identical to SEQ ID NO: 50684

SEQ ID NO: 478186 - RNA, 64 nt, Homo Sapiens; identical to SEQ ID NO: 50685

SEQ ID NO: 478187 - RNA, 64 nt, Homo Sapiens; identical to SEQ ID NO: 50686

SEQ ID NO: 478188 - RNA, 64 nt, Homo Sapiens; identical to SEQ ID NO: 50687

SEQ ID NO: 478189 - RNA, 64 nt, Homo Sapiens; identical to SEQ ID NO: 50688

SEQ ID NO: 478190 - RNA, 64 nt, Homo Sapiens; identical to SEQ ID NO: 50689

SEQ ID NO: 478191 - RNA, 64 nt, Homo Sapiens; identical to SEQ ID NO: 50690

SEQ ID NO: 478192 - RNA, 64 nt, Homo Sapiens; identical to SEQ ID NO: 50691

SEQ ID NO: 478193 - RNA, 64 nt, Homo Sapiens; identical to SEQ ID NO: 50692

SEQ ID NO: 478194 - RNA, 64 nt, Homo Sapiens; identical to SEQ ID NO: 50693

SEQ ID NO: 478195 - RNA, 64 nt, Homo Sapiens; identical to SEQ ID NO: 153237

SEQ ID NO: 478196 - RNA, 64 nt, Homo Sapiens; identical to SEQ ID NO: 153238

SEQ ID NO: 478197 - RNA, 64 nt, Homo Sapiens; identical to SEQ ID NO: 153239

SEQ ID NO: 478198 - RNA, 64 nt, Homo Sapiens; identical to SEQ ID NO: 153240

SEQ ID NO: 478199 - RNA, 64 nt, Homo Sapiens; identical to SEQ ID NO: 153241

SEQ ID NO: 478200 - RNA, 64 nt, Homo Sapiens; identical to SEQ ID NO: 153242

SEQ ID NO: 478201 - RNA, 64 nt, Homo Sapiens; identical to SEQ ID NO: 153243

SEQ ID NO: 478202 - RNA, 64 nt, Homo Sapiens; identical to SEQ ID NO: 153244

SEQ ID NO: 478203 - RNA, 64 nt, Homo Sapiens; identical to SEQ ID NO: 153245

SEQ ID NO: 478204 - RNA, 64 nt, Homo Sapiens; identical to SEQ ID NO: 153246

SEQ ID NO: 478205 - RNA, 64 nt, Homo Sapiens; identical to SEQ ID NO: 50680

SEQ ID NO: 478206 - RNA, 64 nt, Homo Sapiens; identical to SEQ ID NO: 50681

SEQ ID NO: 478207 - RNA, 64 nt, Homo Sapiens; identical to SEQ ID NO: 50682

SEQ ID NO: 478208 - RNA, 64 nt, Homo Sapiens; identical to SEQ ID NO: 50683

SEQ ID NO: 478209 - RNA, 64 nt, Homo Sapiens; identical to SEQ ID NO: 50684

SEQ ID NO: 478210 - RNA, 64 nt, Homo Sapiens; identical to SEQ ID NO: 50685

SEQ ID NO: 478211 - RNA, 64 nt, Homo Sapiens; identical to SEQ ID NO: 50686

SEQ ID NO: 478212 - RNA, 64 nt, Homo Sapiens; identical to SEQ ID NO: 50687

SEQ ID NO: 478213 - RNA, 64 nt, Homo Sapiens; identical to SEQ ID NO: 50688

SEQ ID NO: 478214 - RNA, 64 nt, Homo Sapiens; identical to SEQ ID NO: 50689

SEQ ID NO: 478215 - RNA, 64 nt, Homo Sapiens; identical to SEQ ID NO: 50690

SEQ ID NO: 478216 - RNA, 64 nt, Homo Sapiens; identical to SEQ ID NO: 50691

SEQ ID NO: 478217 - RNA, 64 nt, Homo Sapiens; identical to SEQ ID NO: 50692

SEQ ID NO: 478218 - RNA, 64 nt, Homo Sapiens; identical to SEQ ID NO: 50693

SEQ ID NO: 478219 - RNA, 64 nt, Homo Sapiens; identical to SEQ ID NO: 153237

SEQ ID NO: 478220 - RNA, 64 nt, Homo Sapiens; identical to SEQ ID NO: 153238

SEQ ID NO: 478221 - RNA, 64 nt, Homo Sapiens; identical to SEQ ID NO: 153239

SEQ ID NO: 478222 - RNA, 64 nt, Homo Sapiens; identical to SEQ ID NO: 153240

SEQ ID NO: 478223 - RNA, 64 nt, Homo Sapiens; identical to SEQ ID NO: 153241

SEQ ID NO: 478224 - RNA, 64 nt, Homo Sapiens; identical to SEQ ID NO: 153242

SEQ ID NO: 478225 - RNA, 64 nt, Homo Sapiens; identical to SEQ ID NO: 153243

SEQ ID NO: 478226 - RNA, 64 nt, Homo Sapiens; identical to SEQ ID NO: 153244

SEQ ID NO: 478227 - RNA, 64 nt, Homo Sapiens; identical to SEQ ID NO: 153245

SEQ ID NO: 478228 - RNA, 64 nt, Homo Sapiens; identical to SEQ ID NO: 153246

SEQ ID NO: 478229 - RNA, 64 nt, Homo Sapiens
aaggcucccggcugccuccccgccaccgagcuuguagccugaaugccuggcugucgcauggagc

SEQ ID NO: 478230 - RNA, 64 nt, Homo Sapiens
gcuagcucuccuucgccuucugccaugcuggaaguagccugaggcccucaccagaagcagacgc

SEQ ID NO: 478231 - RNA, 64 nt, Homo Sapiens
caaccuagaccuggaccugggugggaggaaacuguagccugaguguccacagggacacacguga

SEQ ID NO: 478232 - RNA, 64 nt, Homo Sapiens
auuugaccucgaaugcuccuaaaagagaacuugauagccugacagcagagaaguauuauuuggu

SEQ ID NO: 478233 - RNA, 62 nt, Homo Sapiens
accagcagcugaucucuuccgaggaagugaagcuggcuuagugcaauagagcugcuugguug

SEQ ID NO: 478234 - RNA, 62 nt, Homo Sapiens
ggccagaaacuagcucacuccugcugcuucuccuggcuuacugcuauuuccaagaucucuua

SEQ ID NO: 478235 - RNA, 62 nt, Homo Sapiens
agucuccuggaagcagagcauugaccuggcuccuggcuuaccacuacccuuuagguugaagu

SEQ ID NO: 478236 - RNA, 62 nt, Homo Sapiens
ugaccucuagacacuaauuuuauccuuugaggcuggcuuaauuagggaugcugucauuaagg

SEQ ID NO: 478237 - RNA, 62 nt, Homo Sapiens
ugcaagcauauuggugcccuccaugaccaccucuggcuuaggacuuggcccuguuaugagcu

SEQ ID NO: 478238 - RNA, 62 nt, Homo Sapiens
ggacccaaaugggcacuuucuugucugagacucuggcuuauuccagguuggcugauguguug

SEQ ID NO: 478239 - RNA, 62 nt, Homo Sapiens
agugaugagauuauaggcgugagccaccgcgccuggcuuauacuuucuuaauaaaaaggaga

SEQ ID NO: 478240 - RNA, 62 nt, Homo Sapiens
ccucugagaucggugccacguguugcacuuggcuggcuuaugcaccagacugauuucuccga

SEQ ID NO: 478241 - RNA, 62 nt, Homo Sapiens
uugaagugugugugaugggggcucagaaacuccuggcuuagagcugcagauugacaggcgag

SEQ ID NO: 478242 - RNA, 62 nt, Homo Sapiens
gcacacaggaugcagccuucccccucccaggccuggcuuauuccaagaggcugagccaaugg

SEQ ID NO: 478243 - RNA, 62 nt, Homo Sapiens
auccugggggagccccuccccccccugaaucccuggcuuagcuaccuuccugccugugcacc

SEQ ID NO: 478244 - RNA, 62 nt, Homo Sapiens
uuuuuccuccaguuuuuaacaagaucacauaacuggcuuauuuuuaacagcuuugucaaacu

SEQ ID NO: 478245 - RNA, 62 nt, Homo Sapiens
uuuuauugaguuaaaugaguucuuaauaaucucuggcuuacaaguccuuaauuuaucaaaua

SEQ ID NO: 478246 - RNA, 62 nt, Homo Sapiens
gaaaaauaaaugaaguaucucuaggaaacagucuggcuuaacuauuuuugaaaauauaacug

SEQ ID NO: 478247 - RNA, 62 nt, Homo Sapiens
gcagugcugaaggaggagauccagguuuaaaucuggcuuauuaacucaagccaauuuuaagg

SEQ ID NO: 478248 - RNA, 62 nt, Homo Sapiens
ccuguuucuugcuccuguucucagccuguuaucuggcuuauccaucaguuucugaaccaaca

SEQ ID NO: 478249 - RNA, 62 nt, Homo Sapiens
auuucuuuuucaccguuuuuaccuuuuguccucuggcuuauugccucagaguugcaagaugg

SEQ ID NO: 478250 - RNA, 64 nt, Homo Sapiens; identical to SEQ ID NO: 275585

SEQ ID NO: 478251 - RNA, 64 nt, Homo Sapiens; identical to SEQ ID NO: 275586

SEQ ID NO: 478252 - RNA, 64 nt, Homo Sapiens; identical to SEQ ID NO: 275587

SEQ ID NO: 478253 - RNA, 64 nt, Homo Sapiens; identical to SEQ ID NO: 275588

SEQ ID NO: 478254 - RNA, 64 nt, Homo Sapiens; identical to SEQ ID NO: 275589

SEQ ID NO: 478255 - RNA, 64 nt, Homo Sapiens; identical to SEQ ID NO: 275590

SEQ ID NO: 478256 - RNA, 64 nt, Homo Sapiens; identical to SEQ ID NO: 275591

SEQ ID NO: 478257 - RNA, 64 nt, Homo Sapiens; identical to SEQ ID NO: 275592

SEQ ID NO: 478258 - RNA, 64 nt, Homo Sapiens; identical to SEQ ID NO: 275593

SEQ ID NO: 478259 - RNA, 64 nt, Homo Sapiens; identical to SEQ ID NO: 275594

SEQ ID NO: 478260 - RNA, 64 nt, Homo Sapiens; identical to SEQ ID NO: 287388

SEQ ID NO: 478261 - RNA, 64 nt, Homo Sapiens; identical to SEQ ID NO: 287389

SEQ ID NO: 478262 - RNA, 64 nt, Homo Sapiens; identical to SEQ ID NO: 287390

SEQ ID NO: 478263 - RNA, 64 nt, Homo Sapiens; identical to SEQ ID NO: 287391

SEQ ID NO: 478264 - RNA, 64 nt, Homo Sapiens; identical to SEQ ID NO: 287392

SEQ ID NO: 478265 - RNA, 64 nt, Homo Sapiens; identical to SEQ ID NO: 287393

SEQ ID NO: 478266 - RNA, 64 nt, Homo Sapiens; identical to SEQ ID NO: 287394

SEQ ID NO: 478267 - RNA, 64 nt, Homo Sapiens; identical to SEQ ID NO: 287395

SEQ ID NO: 478268 - RNA, 64 nt, Homo Sapiens; identical to SEQ ID NO: 287396

SEQ ID NO: 478269 - RNA, 64 nt, Homo Sapiens; identical to SEQ ID NO: 287397

SEQ ID NO: 478270 - RNA, 64 nt, Homo Sapiens; identical to SEQ ID NO: 287398

SEQ ID NO: 478271 - RNA, 64 nt, Homo Sapiens; identical to SEQ ID NO: 287399

SEQ ID NO: 478272 - RNA, 64 nt, Homo Sapiens
gcacuuguuaguggcuuccuccugccaaguguuguguaggcaaaaucacugagguuggccagcc

SEQ ID NO: 478273 - RNA, 64 nt, Homo Sapiens
cucuggcuaaaaacaaacucuaguguucaaaaccuguaggcacugaaugauauacuagaugaaa

SEQ ID NO: 478274 - RNA, 64 nt, Homo Sapiens
ugggggccauaccuguuccagcucuguucccaggguggggcagggagguggggguugggggagu

SEQ ID NO: 478275 - RNA, 64 nt, Homo Sapiens
aggguggggcagggagguggggguugggggaguaguggggcacggcuccuaagauccagccccc

SEQ ID NO: 478276 - RNA, 64 nt, Homo Sapiens
uccgccuuuccggggcugcuggccuggcccuugaguggggcagccuccuugccuggaacucacu

SEQ ID NO: 478277 - RNA, 64 nt, Homo Sapiens
cagguggaggugccaggaagcucccucccucacuguggggcauuucaccauucaaacaggucga

SEQ ID NO: 478278 - RNA, 64 nt, Homo Sapiens
gcggagacugcagaccagugcuucacuguguggaguggggcaggcaggggcuggaccccaggga

SEQ ID NO: 478279 - RNA, 64 nt, Homo Sapiens
ugggcagugcugguaggguuucaaggugcuauuaguggggcaggggcagggcggcugcucacag

SEQ ID NO: 478280 - RNA, 64 nt, Homo Sapiens
ucuccucaccaucuaaggcagaggaugggaugugguggggcagggaucugguacagacauaggc

SEQ ID NO: 478281 - RNA, 64 nt, Homo Sapiens
gaaggcugcacacaggcacauuccuucuuccacaguggggcaccaaggauucuguccucauugc

SEQ ID NO: 478282 - RNA, 64 nt, Homo Sapiens
uagguuaaaauuacacuaugagauaguuuuuacuguggggcaaauccaucauauuuuucaggac

SEQ ID NO: 478283 - RNA, 64 nt, Homo Sapiens
uugguuuaguguuauacuuucuucuugcugguggguggggcaguuuuaaguaauuauaucuucu

SEQ ID NO: 478284 - RNA, 64 nt, Homo Sapiens
gcuggccugggccuccaauccucccccuucccuuguggggcacaaacggucccacggugcggau

SEQ ID NO: 478285 - RNA, 64 nt, Homo Sapiens
uagcacccagaagggaccaaccucggcccucaggguggggcacugccgggcccgagugucugcc

SEQ ID NO: 478286 - RNA, 64 nt, Homo Sapiens
agaccucagccgccucggggaugagaggggacucguggggcaagcaagcugcccugugcucuga

SEQ ID NO: 478287 - RNA, 64 nt, Homo Sapiens
uguuuccugcagggcuggcccuggcucgggcaggguggggcaucaccaccucacuggccuugcu

SEQ ID NO: 478288 - RNA, 64 nt, Homo Sapiens
agagagaggggcucaggaacugggagccucguggguggggcagaugcuccgcggccuggagugg

SEQ ID NO: 478289 - RNA, 64 nt, Homo Sapiens
uggcagugcuggagaugaccccgagccccuccccguggggcacccaggagggcccugccggaau

SEQ ID NO: 478290 - RNA, 64 nt, Homo Sapiens
uuaaccuuuuucaugaaagucacccuccugccccguggggcaauccugggcugcgucccacauc

SEQ ID NO: 478291 - RNA, 64 nt, Homo Sapiens
gagauccucucuaaggccucggugguggcacaggguggggcaaggagagaggagaccaaaauga

SEQ ID NO: 478292 - RNA, 64 nt, Homo Sapiens
cacacacaccucccgccagccaccacagccaucuguggggcaggaaucuuggugcuuuguggcu

SEQ ID NO: 478293 - RNA, 64 nt, Homo Sapiens
ggcuguggggguguaagaauccaccaguggguguguggggcagucuauugacgggccuugguag

SEQ ID NO: 478294 - RNA, 64 nt, Homo Sapiens
caccccuuucuaccccagggcagggcagggcuggguggggcaagaucccccagcccgacuagac

SEQ ID NO: 478295 - RNA, 64 nt, Homo Sapiens
gagugccacaggaagucagacaaggaaggagaguguggggcaggugccguuuaaauggggggcg

SEQ ID NO: 478296 - RNA, 64 nt, Homo Sapiens
gggugauacucaguuucuugccuagccccguucuguggggcacugaaaagcuaagggcuugauu

SEQ ID NO: 478297 - RNA, 64 nt, Homo Sapiens
uggugggggcugggggaagacugguuuguucucuguggggcaguuuguucagguagucgcccuu

SEQ ID NO: 478298 - RNA, 64 nt, Homo Sapiens
uugccagcucuuucuuauucuacuacacaagccgccaacucaacugagagcuaaagagacuaga

SEQ ID NO: 478299 - RNA, 64 nt, Homo Sapiens
ugagagcuaaagagacuagaaaagagauaagcugccaacucaacugagaacaagaaacuagaag

SEQ ID NO: 478300 - RNA, 64 nt, Homo Sapiens
uuuauucuucaacaaugucuacuccauccccaacccaacucacagcccuaugacuacuaucuuu

SEQ ID NO: 478301 - RNA, 64 nt, Homo Sapiens
ucaaaacauugcuuugguuggugcauuuaaguauccaacucaaaaagcauaucaaauauuuugg

SEQ ID NO: 478302 - RNA, 64 nt, Homo Sapiens
cccaaacccccaucccuuccuccuccguccuaucccaacucaccguaugagcgcuuggcgcucc

SEQ ID NO: 478303 - RNA, 64 nt, Homo Sapiens
caccagguccgcaccucucccgccuucaaggcucccaacucagggaccuugaccccccuguccg

SEQ ID NO: 478304 - RNA, 64 nt, Homo Sapiens; identical to SEQ ID NO: 119503

SEQ ID NO: 478305 - RNA, 64 nt, Homo Sapiens; identical to SEQ ID NO: 119504

SEQ ID NO: 478306 - RNA, 64 nt, Homo Sapiens; identical to SEQ ID NO: 119505

SEQ ID NO: 478307 - RNA, 64 nt, Homo Sapiens; identical to SEQ ID NO: 119506

SEQ ID NO: 478308 - RNA, 64 nt, Homo Sapiens; identical to SEQ ID NO: 119507

SEQ ID NO: 478309 - RNA, 64 nt, Homo Sapiens; identical to SEQ ID NO: 119508

SEQ ID NO: 478310 - RNA, 64 nt, Homo Sapiens; identical to SEQ ID NO: 119509

SEQ ID NO: 478311 - RNA, 64 nt, Homo Sapiens; identical to SEQ ID NO: 119510

SEQ ID NO: 478312 - RNA, 64 nt, Homo Sapiens; identical to SEQ ID NO: 119511

SEQ ID NO: 478313 - RNA, 64 nt, Homo Sapiens; identical to SEQ ID NO: 119512

SEQ ID NO: 478314 - RNA, 64 nt, Homo Sapiens; identical to SEQ ID NO: 119513

SEQ ID NO: 478315 - RNA, 64 nt, Homo Sapiens; identical to SEQ ID NO: 119514

SEQ ID NO: 478316 - RNA, 64 nt, Homo Sapiens; identical to SEQ ID NO: 119515

SEQ ID NO: 478317 - RNA, 64 nt, Homo Sapiens; identical to SEQ ID NO: 119516

SEQ ID NO: 478318 - RNA, 64 nt, Homo Sapiens; identical to SEQ ID NO: 119517

SEQ ID NO: 478319 - RNA, 64 nt, Homo Sapiens; identical to SEQ ID NO: 119518

SEQ ID NO: 478320 - RNA, 64 nt, Homo Sapiens; identical to SEQ ID NO: 119519

SEQ ID NO: 478321 - RNA, 64 nt, Homo Sapiens; identical to SEQ ID NO: 119520

SEQ ID NO: 478322 - RNA, 64 nt, Homo Sapiens; identical to SEQ ID NO: 119521

SEQ ID NO: 478323 - RNA, 64 nt, Homo Sapiens; identical to SEQ ID NO: 119522

SEQ ID NO: 478324 - RNA, 64 nt, Homo Sapiens; identical to SEQ ID NO: 119523

SEQ ID NO: 478325 - RNA, 64 nt, Homo Sapiens; identical to SEQ ID NO: 119524

SEQ ID NO: 478326 - RNA, 64 nt, Homo Sapiens; identical to SEQ ID NO: 119525

SEQ ID NO: 478327 - RNA, 64 nt, Homo Sapiens; identical to SEQ ID NO: 119526

SEQ ID NO: 478328 - RNA, 64 nt, Homo Sapiens; identical to SEQ ID NO: 119527

SEQ ID NO: 478329 - RNA, 64 nt, Homo Sapiens; identical to SEQ ID NO: 119528

SEQ ID NO: 478330 - RNA, 64 nt, Homo Sapiens; identical to SEQ ID NO: 119529

SEQ ID NO: 478331 - RNA, 64 nt, Homo Sapiens; identical to SEQ ID NO: 119530

SEQ ID NO: 478332 - RNA, 64 nt, Homo Sapiens; identical to SEQ ID NO: 119531

SEQ ID NO: 478333 - RNA, 64 nt, Homo Sapiens; identical to SEQ ID NO: 119532

SEQ ID NO: 478334 - RNA, 64 nt, Homo Sapiens; identical to SEQ ID NO: 119533

SEQ ID NO: 478335 - RNA, 64 nt, Homo Sapiens; identical to SEQ ID NO: 119534

SEQ ID NO: 478336 - RNA, 64 nt, Homo Sapiens; identical to SEQ ID NO: 119535

SEQ ID NO: 478337 - RNA, 64 nt, Homo Sapiens; identical to SEQ ID NO: 119536

SEQ ID NO: 478338 - RNA, 64 nt, Homo Sapiens; identical to SEQ ID NO: 119537

SEQ ID NO: 478339 - RNA, 64 nt, Homo Sapiens; identical to SEQ ID NO: 119538

SEQ ID NO: 478340 - RNA, 64 nt, Homo Sapiens; identical to SEQ ID NO: 119539

SEQ ID NO: 478341 - RNA, 64 nt, Homo Sapiens; identical to SEQ ID NO: 119540

SEQ ID NO: 478342 - RNA, 64 nt, Homo Sapiens; identical to SEQ ID NO: 119541

SEQ ID NO: 478343 - RNA, 64 nt, Homo Sapiens; identical to SEQ ID NO: 119542

SEQ ID NO: 478344 - RNA, 64 nt, Homo Sapiens; identical to SEQ ID NO: 119543

SEQ ID NO: 478345 - RNA, 64 nt, Homo Sapiens; identical to SEQ ID NO: 119544

SEQ ID NO: 478346 - RNA, 64 nt, Homo Sapiens; identical to SEQ ID NO: 119545

SEQ ID NO: 478347 - RNA, 64 nt, Homo Sapiens; identical to SEQ ID NO: 119546

SEQ ID NO: 478348 - RNA, 64 nt, Homo Sapiens; identical to SEQ ID NO: 119547

SEQ ID NO: 478349 - RNA, 64 nt, Homo Sapiens; identical to SEQ ID NO: 119548

SEQ ID NO: 478350 - RNA, 64 nt, Homo Sapiens; identical to SEQ ID NO: 119549

SEQ ID NO: 478351 - RNA, 64 nt, Homo Sapiens; identical to SEQ ID NO: 119550

SEQ ID NO: 478352 - RNA, 64 nt, Homo Sapiens; identical to SEQ ID NO: 119551

SEQ ID NO: 478353 - RNA, 64 nt, Homo Sapiens; identical to SEQ ID NO: 119552

SEQ ID NO: 478354 - RNA, 64 nt, Homo Sapiens; identical to SEQ ID NO: 119553

SEQ ID NO: 478355 - RNA, 64 nt, Homo Sapiens; identical to SEQ ID NO: 119554

SEQ ID NO: 478356 - RNA, 64 nt, Homo Sapiens; identical to SEQ ID NO: 119555

SEQ ID NO: 478357 - RNA, 64 nt, Homo Sapiens; identical to SEQ ID NO: 119556

SEQ ID NO: 478358 - RNA, 64 nt, Homo Sapiens; identical to SEQ ID NO: 119557

SEQ ID NO: 478359 - RNA, 64 nt, Homo Sapiens; identical to SEQ ID NO: 119558

SEQ ID NO: 478360 - RNA, 64 nt, Homo Sapiens; identical to SEQ ID NO: 119559

SEQ ID NO: 478361 - RNA, 64 nt, Homo Sapiens; identical to SEQ ID NO: 119560

SEQ ID NO: 478362 - RNA, 64 nt, Homo Sapiens; identical to SEQ ID NO: 119561

SEQ ID NO: 478363 - RNA, 64 nt, Homo Sapiens; identical to SEQ ID NO: 119562

SEQ ID NO: 478364 - RNA, 64 nt, Homo Sapiens; identical to SEQ ID NO: 119563

SEQ ID NO: 478365 - RNA, 64 nt, Homo Sapiens; identical to SEQ ID NO: 119564

SEQ ID NO: 478366 - RNA, 64 nt, Homo Sapiens; identical to SEQ ID NO: 119565

SEQ ID NO: 478367 - RNA, 64 nt, Homo Sapiens; identical to SEQ ID NO: 119566

SEQ ID NO: 478368 - RNA, 64 nt, Homo Sapiens; identical to SEQ ID NO: 119567

SEQ ID NO: 478369 - RNA, 64 nt, Homo Sapiens; identical to SEQ ID NO: 119568

SEQ ID NO: 478370 - RNA, 64 nt, Homo Sapiens; identical to SEQ ID NO: 119569

SEQ ID NO: 478371 - RNA, 64 nt, Homo Sapiens; identical to SEQ ID NO: 119570

SEQ ID NO: 478372 - RNA, 64 nt, Homo Sapiens; identical to SEQ ID NO: 119571

SEQ ID NO: 478373 - RNA, 64 nt, Homo Sapiens; identical to SEQ ID NO: 119572

SEQ ID NO: 478374 - RNA, 64 nt, Homo Sapiens; identical to SEQ ID NO: 119573

SEQ ID NO: 478375 - RNA, 64 nt, Homo Sapiens; identical to SEQ ID NO: 119574

SEQ ID NO: 478376 - RNA, 64 nt, Homo Sapiens; identical to SEQ ID NO: 119575

SEQ ID NO: 478377 - RNA, 64 nt, Homo Sapiens; identical to SEQ ID NO: 119576

SEQ ID NO: 478378 - RNA, 64 nt, Homo Sapiens; identical to SEQ ID NO: 119577

SEQ ID NO: 478379 - RNA, 64 nt, Homo Sapiens; identical to SEQ ID NO: 119578

SEQ ID NO: 478380 - RNA, 64 nt, Homo Sapiens; identical to SEQ ID NO: 119579

SEQ ID NO: 478381 - RNA, 64 nt, Homo Sapiens; identical to SEQ ID NO: 119580

SEQ ID NO: 478382 - RNA, 64 nt, Homo Sapiens; identical to SEQ ID NO: 119581

SEQ ID NO: 478383 - RNA, 64 nt, Homo Sapiens; identical to SEQ ID NO: 119582

SEQ ID NO: 478384 - RNA, 64 nt, Homo Sapiens; identical to SEQ ID NO: 119583

SEQ ID NO: 478385 - RNA, 64 nt, Homo Sapiens; identical to SEQ ID NO: 119584

SEQ ID NO: 478386 - RNA, 64 nt, Homo Sapiens; identical to SEQ ID NO: 119585

SEQ ID NO: 478387 - RNA, 64 nt, Homo Sapiens; identical to SEQ ID NO: 119586

SEQ ID NO: 478388 - RNA, 64 nt, Homo Sapiens; identical to SEQ ID NO: 119587

SEQ ID NO: 478389 - RNA, 64 nt, Homo Sapiens; identical to SEQ ID NO: 119588

SEQ ID NO: 478390 - RNA, 64 nt, Homo Sapiens; identical to SEQ ID NO: 119589

SEQ ID NO: 478391 - RNA, 64 nt, Homo Sapiens; identical to SEQ ID NO: 119590

SEQ ID NO: 478392 - RNA, 64 nt, Homo Sapiens; identical to SEQ ID NO: 119591

SEQ ID NO: 478393 - RNA, 64 nt, Homo Sapiens; identical to SEQ ID NO: 119592

SEQ ID NO: 478394 - RNA, 64 nt, Homo Sapiens; identical to SEQ ID NO: 119593

SEQ ID NO: 478395 - RNA, 64 nt, Homo Sapiens; identical to SEQ ID NO: 119594

SEQ ID NO: 478396 - RNA, 64 nt, Homo Sapiens; identical to SEQ ID NO: 119595

SEQ ID NO: 478397 - RNA, 64 nt, Homo Sapiens; identical to SEQ ID NO: 119596

SEQ ID NO: 478398 - RNA, 64 nt, Homo Sapiens; identical to SEQ ID NO: 119597

SEQ ID NO: 478399 - RNA, 64 nt, Homo Sapiens
uaaacacacacacacacacacacacacacacacacauacacagacaaaaacacaaaaacucuga

SEQ ID NO: 478400 - RNA, 64 nt, Homo Sapiens
gaugguggugguacaguuggaauuagugccaugucauacacaaauguuccacaaggcgggagug

SEQ ID NO: 478401 - RNA, 64 nt, Homo Sapiens
cacacacacacacaccugagacaccacacacacacauacacacaauguacacacgcagacacag

SEQ ID NO: 478402 - RNA, 64 nt, Homo Sapiens
cacuccaauccauccaugcacgucgggggcaaagcauacacacacaagcuuuccugaacuggaa

SEQ ID NO: 478403 - RNA, 64 nt, Homo Sapiens
caaucauacaugcacacugaauucauacacaauucauacacaugacgugcacacacacauacau

SEQ ID NO: 478404 - RNA, 64 nt, Homo Sapiens
ucauacacaugcaaucauaccacacauacauauucauacacaauuaccuauacauacgugcaca

SEQ ID NO: 478405 - RNA, 64 nt, Homo Sapiens
cacauacagacagaccuacccaugaaaaguuacacauacacaccagaugcuaguguguggcagc

SEQ ID NO: 478406 - RNA, 64 nt, Homo Sapiens
uccuccauguucuucuaaaacauauacauauauacauacacacauacacauauucuucaggucu

SEQ ID NO: 478407 - RNA, 64 nt, Homo Sapiens
guucuucuaaaacauauacauauauacauacacacauacacauauucuucaggucucuaagccc

SEQ ID NO: 478408 - RNA, 64 nt, Homo Sapiens
gagagaccuagguucuuacacauaugcacacacgcauacacacaugcacgcacacacacauaca

SEQ ID NO: 478409 - RNA, 64 nt, Homo Sapiens
ugcacacacgcauacacacaugcacgcacacacacauacacacaugcacgcacgcacgcaugca

SEQ ID NO: 478410 - RNA, 64 nt, Homo Sapiens
cugcaaguuuaaauauuugagcuuuacaaauaaacauacacaugcucaguuuuuuaaguaaacc

SEQ ID NO: 478411 - RNA, 64 nt, Homo Sapiens
guaaggcuuauguguauuuuccauauauguaaaacauacacauguaaaauauauguggccauaa

SEQ ID NO: 478412 - RNA, 64 nt, Homo Sapiens
uuuaaagguauucauggugacucaggaauacacacauacacacacacacacacacacacacaca

SEQ ID NO: 478413 - RNA, 64 nt, Homo Sapiens
cauacacacacacacacacacacacacacacacacauacacacauauaauuugaaagaggugag

SEQ ID NO: 478414 - RNA, 64 nt, Homo Sapiens
ucuucacuuaaaguuguuuuauaaauuacaaacacauacacacaaauccauaauggacuagaau

SEQ ID NO: 478415 - RNA, 64 nt, Homo Sapiens
uuacacacacacacagaaugcaccuguaugugcacauacacacauaaaauguuugccauguaua

SEQ ID NO: 478416 - RNA, 64 nt, Homo Sapiens
ggaaagugaugaggaggaagaagagggcuguggucauacacacuguguacguggccaccgcaaa

SEQ ID NO: 478417 - RNA, 64 nt, Homo Sapiens
cugggauccgguuuucauuuuccgguccuuuugccauacacaguuacagagaucagucaaaucc

SEQ ID NO: 478418 - RNA, 64 nt, Homo Sapiens
uaggggccuucccucccaggucugugucugauagcauacacacacacauauauauacacacaca

SEQ ID NO: 478419 - RNA, 64 nt, Homo Sapiens
cacacacacacacacacacacacacacacacauacauacacacacacauauauauacacacaca

SEQ ID NO: 478420 - RNA, 64 nt, Homo Sapiens
agauagaaaaaucuagcaaauauuaaaaugggaucauacacagauagcaaucaaccccagaaaa

SEQ ID NO: 478421 - RNA, 64 nt, Homo Sapiens
caggaaacguggagcauuguuaacgccuuauacgcauacacagcuucgccagaagcuguccuua

SEQ ID NO: 478422 - RNA, 64 nt, Homo Sapiens
uaaaauaagauuagacagaaugauacuguggguccauacacaagugaacuuaucuaccugguua

SEQ ID NO: 478423 - RNA, 64 nt, Homo Sapiens
ggaggaaaaccuuauauacuugccauuuaaaacucauacacaugcaaaaaaaugcaaacuauga

SEQ ID NO: 478424 - RNA, 64 nt, Homo Sapiens
cacgagagacagaaggaaagauaugauacauacacauacacacaaaacguauacauauguguau

SEQ ID NO: 478425 - RNA, 64 nt, Homo Sapiens
cacacacacgagagacagaaguguauauaugauacauacacauaguauguaaacguauacauau

SEQ ID NO: 478426 - RNA, 64 nt, Homo Sapiens
ugcacacacaugcacacauacacgcacaugcacacauacacaugcaugcacacauacacaggca

SEQ ID NO: 478427 - RNA, 64 nt, Homo Sapiens
uacacgcacaugcacacauacacaugcaugcacacauacacaggcauacaugcaugcacacaca

SEQ ID NO: 478428 - RNA, 64 nt, Homo Sapiens
cacgcacacacacaugcacacauacacgugcacacauacacaggcacacaugcaugcacacaua

SEQ ID NO: 478429 - RNA, 64 nt, Homo Sapiens
cgugcacacauacacaggcacacaugcaugcacacauacacaugcacacacacaugcacacaua

SEQ ID NO: 478430 - RNA, 64 nt, Homo Sapiens
uauccaugcacacaaacacauauauacacaugcacauacacagauuuuucugcuggccaggugg

SEQ ID NO: 478431 - RNA, 64 nt, Homo Sapiens
auuagaaauaaguaguaaauuuugauauauuguacauacacacgugugugugugugugugugug

SEQ ID NO: 478432 - RNA, 64 nt, Homo Sapiens
uguauguaugugaaugugugugaguguguauucacauacacauauauacuggaaccuauaguag

SEQ ID NO: 478433 - RNA, 64 nt, Homo Sapiens
ggagugcagccuucuccauagucccgguaccuuccauacacagaaggcugugcuccgccauggu

SEQ ID NO: 478434 - RNA, 64 nt, Homo Sapiens
gcagugugaauagccuggccggacgaaaaagaggcauacacacaggaagccagagccccaagca

SEQ ID NO: 478435 - RNA, 64 nt, Homo Sapiens
cacacacagaaagacacacagagacacaccauuacauacacagacgcagccccuccccgccaca

SEQ ID NO: 478436 - RNA, 64 nt, Homo Sapiens
aagacacacacagacacacacaccauuacacacacauacacagacccuuccggccacagaaaca

SEQ ID NO: 478437 - RNA, 64 nt, Homo Sapiens
cacgcaaucgcagauacgccgagacacaccauuacauacacagacacacacccuccccgccaca

SEQ ID NO: 478438 - RNA, 64 nt, Homo Sapiens
cacacacagaaagacacagacagagacaccauuacauacacagacacacacacccuccccgcca

SEQ ID NO: 478439 - RNA, 64 nt, Homo Sapiens
cacacacagaaagacacacacagagacaccauuacauacacagacacacacccccuccccacca

SEQ ID NO: 478440 - RNA, 64 nt, Homo Sapiens
aucauauauauaauauauuuuuuguaacuaugaacauacacaguuuuccagaaauagauuuuac

SEQ ID NO: 478441 - RNA, 64 nt, Homo Sapiens
cagguaauaaacauccccaagguuuguggcuggccauacacauaggcaucaguuuaacaaccau

SEQ ID NO: 478442 - RNA, 64 nt, Homo Sapiens
ggccauauuuguggcccgugcagcuuccaaaucucauacacaacuguucccgauucacguuuuu

SEQ ID NO: 478443 - RNA, 64 nt, Homo Sapiens
gagccgccgugcccagccauugcauuuuuauucacauacacauuguuaauguggaacaauuuaa

SEQ ID NO: 478444 - RNA, 64 nt, Homo Sapiens
ucaucaagacaccuuuuuucuaaaauaggcauugcauacacauaugcacacguaugugcaugug

SEQ ID NO: 478445 - RNA, 64 nt, Homo Sapiens
ugugauuuuguguuuugaauuacugucagaauuacauacacaauuacaacaaacuuuuuuuaaa

SEQ ID NO: 478446 - RNA, 64 nt, Homo Sapiens
caucaggggaaaauguguguaaucuauggacagucauacacauaaagcaaaccaauaccuggug

SEQ ID NO: 478447 - RNA, 64 nt, Homo Sapiens
cacacacacacucugacugucacacucacacucacauacacacacuuuuaauguacaucacaca

SEQ ID NO: 478448 - RNA, 64 nt, Homo Sapiens
cacagagucuuuauugcagacacacauacacacacauacacacagauuacaggcgugagacaga

SEQ ID NO: 478449 - RNA, 64 nt, Homo Sapiens
cauacacacacacagagucugugagacagacacacauacacacaugagugcuaggauuacaggc

SEQ ID NO: 478450 - RNA, 64 nt, Homo Sapiens
uugcauaggguauuugauacaaucauuaauggaucauacacaauagguuuuuaaaaauuaauaa

SEQ ID NO: 478451 - RNA, 64 nt, Homo Sapiens
cguuuuacaugaucugauacaaccauuaaugaaucauacacaauagguuuuuuaaaauuaauau

SEQ ID NO: 478452 - RNA, 64 nt, Homo Sapiens
uacauacauacauacaaauaagaaauuauacguacauacacacacucucugaaugcugagcuga

SEQ ID NO: 478453 - RNA, 64 nt, Homo Sapiens
gccagaaaaagaagaaggagcggaaacauagaaacauacacaagugggucacauuuguuagcca

SEQ ID NO: 478454 - RNA, 64 nt, Homo Sapiens
cuuacccccauccacucuagcacacauacauacacauacacaccaguguccagauccccagagc

SEQ ID NO: 478455 - RNA, 64 nt, Homo Sapiens
cacacccuuacccccauccacagagccacacauacauacacauagagggcaguguccagauccc

SEQ ID NO: 478456 - RNA, 64 nt, Homo Sapiens
ccuuuguacaaagcuccucuuuucccuuuuuuuacauacacaagauccucuuggcagguggagc

SEQ ID NO: 478457 - RNA, 64 nt, Homo Sapiens
cucuggagaggagauugaaauauaauugcacccucauacacauuuaggaaaugguuaagaagug

SEQ ID NO: 478458 - RNA, 64 nt, Homo Sapiens
ugacucaugcugcuaagaugcacaaccgcacacccauacacaacuacaagggccacaaagcaac

SEQ ID NO: 478459 - RNA, 64 nt, Homo Sapiens
guggaaagcggccccugcugccccuccacacacacauacacacucacugaucuacagccccugu

SEQ ID NO: 478460 - RNA, 64 nt, Homo Sapiens
gccauagcucaucccuuucuagauuugacccaaucauacacaugagaaacguacauucauacac

SEQ ID NO: 478461 - RNA, 64 nt, Homo Sapiens
uuugacccaaucauacacaugagaaacguacauucauacacaagccuuuucacacagcacuccc

SEQ ID NO: 478462 - RNA, 64 nt, Homo Sapiens
cucuccuucuccaucucacccucccucucucacacauacacacacaaacacauacacacaacac

SEQ ID NO: 478463 - RNA, 64 nt, Homo Sapiens
cacccucccucucucacacauacacacacaaacacauacacacaacacuaagugccuagacuuu

SEQ ID NO: 478464 - RNA, 64 nt, Homo Sapiens
ugcacagaccacacacagcaacacacaguauacacauacacaagcaugcacacacguguagcuc

SEQ ID NO: 478465 - RNA, 64 nt, Homo Sapiens
cacgcuuacauguacacgugugccugcauacaggcauacacauguacacauacgugcauacaca

SEQ ID NO: 478466 - RNA, 64 nt, Homo Sapiens
ccugcauacaggcauacacaaguacacauacgugcauacacaugcaccuguauagaccaugcac

SEQ ID NO: 478467 - RNA, 64 nt, Homo Sapiens
gucuuugcuaugcaccauguaaaaucuggcuucacauacacagagacacuuguuaccauauuuu

SEQ ID NO: 478468 - RNA, 64 nt, Homo Sapiens
ucaaucuagaaagaacuugcuauacauagacacacauacacacccacacaggcacauacacuca

SEQ ID NO: 478469 - RNA, 64 nt, Homo Sapiens
cacagacacacacacacgaaaacacauacacacacauacacacaauucugcccacacacacaca

SEQ ID NO: 478470 - RNA, 64 nt, Homo Sapiens
cauacacacacacagacacacacacacacaaacacauacacacaauuaaaagaaauucugccca

SEQ ID NO: 478471 - RNA, 64 nt, Homo Sapiens
uaaaagaugagagaauucauagauaaguaaguaccauacacacccagucagugggcaagaggaa

SEQ ID NO: 478472 - RNA, 64 nt, Homo Sapiens
ugccaagaaaggaucucugguccuaucuagacaucauacacauuuggacauggggaggcgacag

SEQ ID NO: 478473 - RNA, 64 nt, Homo Sapiens
ugcacauaugucaaauauaauauacauacauacacauacacacauuugguguuuuuaaagugug

SEQ ID NO: 478474 - RNA, 64 nt, Homo Sapiens
cacacaugcacauaugucaaaguguguauacauacauacacauacaaggguuugguguuuuuaa

SEQ ID NO: 478475 - RNA, 64 nt, Homo Sapiens
caaaccuuuaguuuucugaugaucuacacacacacauacacacacacacacacacacgugcaca

SEQ ID NO: 478476 - RNA, 64 nt, Homo Sapiens
guauucaaauacuaaguaucuuauaugcuacgugcauacacauucuuuucuuaaacuuuaccug

SEQ ID NO: 478477 - RNA, 64 nt, Homo Sapiens
cauaaguuucaagaauaacauggcacacagaacaauggaaaaaaguuuguuuccauuggaaaau

SEQ ID NO: 478478 - RNA, 64 nt, Homo Sapiens
acuuaaagguauauauucaauuuuuuaccauuuuauggaaaauauuuaaaaucuguuuuuacag

SEQ ID NO: 478479 - RNA, 64 nt, Homo Sapiens
uggcuguuggaaaccugaaugcuuuuagacccaaauggaaaauuucugaaaugcuggauuaucu

SEQ ID NO: 478480 - RNA, 64 nt, Homo Sapiens
ucuugcacuuacaaauaaggucuaugggaguagcauggaaaacguuugcuguuuuucccuuuuu

SEQ ID NO: 478481 - RNA, 64 nt, Homo Sapiens
uaaacauagccuauuuuugugcuuaagauacugaauggaaaacuccauuguguguugcuggacu

SEQ ID NO: 478482 - RNA, 64 nt, Homo Sapiens
guccuucuugcucccccucacuguuuguccugagauggaaaaguaagcacuacaccuugccuug

SEQ ID NO: 478483 - RNA, 64 nt, Homo Sapiens
ugaggcuuagagauagacaacuccccauuaacagauggaaaaaccagggagggaagaaugaaca

SEQ ID NO: 478484 - RNA, 64 nt, Homo Sapiens
ccuuggaagagaaaaguagacauuuuguuaaccuauggaaaaaguuagccuaugaaaaaaaaaa

SEQ ID NO: 478485 - RNA, 64 nt, Homo Sapiens
gaauuuucuucagacaaaacugaaguucaaaacuauggaaaauuucuauaugugggaaccauuc

SEQ ID NO: 478486 - RNA, 64 nt, Homo Sapiens
auuauaguacaauucucaaguuauggaaaaccuuauggaaaauaaaauccuguaaauguaaaua

SEQ ID NO: 478487 - RNA, 64 nt, Homo Sapiens
uuauggaaaauaauuauaguuaaauguaaauauuauggaaaacccccacuggaaauaaauccug

SEQ ID NO: 478488 - RNA, 64 nt, Homo Sapiens
cacacgaauaacuuggauagcaaauccugagacaauggaaaaccauuaacuuuacuucauuggc

SEQ ID NO: 478489 - RNA, 64 nt, Homo Sapiens
aaauuucuuaucauuguuucaaaaaagcaaaaucauggaaaauuuuuguuguccaggcaaauaa

SEQ ID NO: 478490 - RNA, 64 nt, Homo Sapiens
uuuaucggcauuguccaaaauauuuuauucuuuaauggaaaaagccauuaauauucaaaugaag

SEQ ID NO: 478491 - RNA, 64 nt, Homo Sapiens
uccuacccugaccuucguaccuaugauuauacggauggaaaagcucagaacucaggugaaacau

SEQ ID NO: 478492 - RNA, 64 nt, Homo Sapiens
uuccccagugcuuccacacccgggcucugagcaaauggaaaagacuuuucauuuaguagacaau

SEQ ID NO: 478493 - RNA, 64 nt, Homo Sapiens
aaccaaucacuuuguaugcuaugcuccuacugugauggaaaacaaaaugaguauaacuuauuuu

SEQ ID NO: 478494 - RNA, 64 nt, Homo Sapiens
uauuccugaaauauauacaguauuaauuauaucuauggaaaaacuuuuucuuauuuuuaagugu

SEQ ID NO: 478495 - RNA, 64 nt, Homo Sapiens
uuuuucuuauuuuuaaguguagcuuauaguugguauggaaaacaaugcuucuguacuuuuuaaa

SEQ ID NO: 478496 - RNA, 64 nt, Homo Sapiens
caccaggacuccauucuuaagacucuaagccagaauggaaaauuacaccugaccaccauuuaag

SEQ ID NO: 478497 - RNA, 64 nt, Homo Sapiens
ucugucucccuaacucaacucauuuuuugggggaauggaaaagccaaaccuccuugggaaucca

SEQ ID NO: 478498 - RNA, 64 nt, Homo Sapiens
cagccaccacugugaugcgaauuaguaaugacugauggaaaaccccugacuuuuucucauugcc

SEQ ID NO: 478499 - RNA, 64 nt, Homo Sapiens
ucuguccauagugguucccuccauggggacuaauauggaaaaggggggcauuuguggaacuuac

SEQ ID NO: 478500 - RNA, 64 nt, Homo Sapiens
ucuuaagcuguucuugcauaggcucuuaagcagcauggaaaaaugguugauggaaaauaaacau

SEQ ID NO: 478501 - RNA, 64 nt, Homo Sapiens
gcauaggcucuuaagcagcauggaaaaaugguugauggaaaauaaacaucaguuucuaaaaguu

SEQ ID NO: 478502 - RNA, 64 nt, Homo Sapiens
uguguuuacaauuuuauaauuaguagauguaaacauggaaaaauuaauguguccaaaugaaagc

SEQ ID NO: 478503 - RNA, 64 nt, Homo Sapiens
augguuuaauguguccaaaugaauuaacuacauaauggaaaagucaggcaggcacucaagaaau

SEQ ID NO: 478504 - RNA, 64 nt, Homo Sapiens
ucuuccaacccuccauuagcucaauuuugagauaauggaaaauugacuggaaauucaaaacuca

SEQ ID NO: 478505 - RNA, 64 nt, Homo Sapiens
caguauuuugagaauugccauauuaauuuuuauaauggaaaacuuaauaaauugcuacuguuuu

SEQ ID NO: 478506 - RNA, 64 nt, Homo Sapiens
uauucagcaaggccaaagacuuuugagaauguguauggaaaauucuuuuugugcauuugagggc

SEQ ID NO: 478507 - RNA, 64 nt, Homo Sapiens
ucuaugaauguuaaauucagaauaucucuaaaacauggaaaauugauguuucaauaaaaaggga

SEQ ID NO: 478508 - RNA, 64 nt, Homo Sapiens
aucacacagaagagggcuguggugaaggaccagcauggaaaacgcauugacuuggagcaccugg

SEQ ID NO: 478509 - RNA, 64 nt, Homo Sapiens
aauugaauauaucuaugagggcauguauuaguuaauggaaaaaaaaauacaacacuaacaauac

SEQ ID NO: 478510 - RNA, 55 nt, Homo Sapiens
auaaauccguggauuccugaacaguauggaaaagcaaacugugcaacuacuacau

SEQ ID NO: 478511 - RNA, 64 nt, Homo Sapiens
ccauggauuuugugcuugggacagaccauaaaugauggaaaaugucaacacaaaaauagcugaa

SEQ ID NO: 478512 - RNA, 64 nt, Homo Sapiens
uuacucagagauaacauagauuauccaggcugagauggaaaacaagcccuuuauugaauuuuca

SEQ ID NO: 478513 - RNA, 64 nt, Homo Sapiens
cauuuauuuucuucagccugugcaaaacaaagcaauggaaaaggaaacuaaaaaauauacauac

SEQ ID NO: 478514 - RNA, 64 nt, Homo Sapiens
auucccauaauuucacuuuacuuucuguuuaggcauggaaaaauuuaucagucagaauugcugu

SEQ ID NO: 478515 - RNA, 64 nt, Homo Sapiens
acaaaagauuccaaagaaagucaaaaaguguaaaauggaaaauaagagaucaaaaugaauauag

SEQ ID NO: 478516 - RNA, 64 nt, Homo Sapiens
cuuuucuguugguagagcucucccauuuggugacauggaaaauaccuuuccauuaucacaacaa

SEQ ID NO: 478517 - RNA, 64 nt, Homo Sapiens
aacuugguugcuaauuacaagaaugaaaauuauaauggaaaaggacaaaauaauauaccagcug

SEQ ID NO: 478518 - RNA, 64 nt, Homo Sapiens
uucagcgguugaggagaauugcggcgagacaagcauggaaaaucagugacaucugauuggcaga

SEQ ID NO: 478519 - RNA, 64 nt, Homo Sapiens
agauuugaggacuuguuaaagagcacugggucauauggaaaaaauguaugugucucccaggugc

SEQ ID NO: 478520 - RNA, 57 nt, Homo Sapiens
auaccaauaagucagccugaugcucuaauggaaaaauggcccucuucaagccuggug

SEQ ID NO: 478521 - RNA, 64 nt, Homo Sapiens
gaugaggcuccaccuuguuaaauaaauuggauguauggaaaaauagacugcagaaaaggggaac

SEQ ID NO: 478522 - RNA, 64 nt, Homo Sapiens
uuuucauuaccaaaauguacagcuauuauuugccauggaaaagguuagucucauuuagaaaaau

SEQ ID NO: 478523 - RNA, 64 nt, Homo Sapiens
uuuacaccaucugcaaccauaugcuauuaauaaaauggaaaaaaacaaaauggucauuuugcau

SEQ ID NO: 478524 - RNA, 64 nt, Homo Sapiens
aauaguaaaucuauuuuuacugaauaaaguaauuauggaaaauauuuuaaacucuagaagcuuc

SEQ ID NO: 478525 - RNA, 64 nt, Homo Sapiens
gcuuuccagucacacaucaaggcgcuugaucacaauggaaaaggugaagaaauuugagguaaau

SEQ ID NO: 478526 - RNA, 64 nt, Homo Sapiens
uuuggaaaguacuuaaaaguuaccagaauuuucaauggaaaaugagggguuucuccccacugau

SEQ ID NO: 478527 - RNA, 64 nt, Homo Sapiens
caaagagaaaaagcacagguuagcuccccauuagauggaaaaguguagggacugagaagggcug

SEQ ID NO: 478528 - RNA, 64 nt, Homo Sapiens
agcauuuauacuugagaaaaauuguauaaagaauauggaaaagccauuuauaucugcucacaug

SEQ ID NO: 478529 - RNA, 64 nt, Homo Sapiens
uguauuggagaaaaacccugcaaauguaauaaauauggaaaaacauuuuuucaaaaacuacagc

SEQ ID NO: 478530 - RNA, 64 nt, Homo Sapiens
auaauguuccaguugaaugcaaaacaaaaaaaauauggaaaacauuuugauaaaauuuuuuccu

SEQ ID NO: 478531 - RNA, 64 nt, Homo Sapiens
cccauauaaauuaucucuaacgucuuuguuguuuauggaaaagcccagauacuggauauaucac

SEQ ID NO: 478532 - RNA, 64 nt, Homo Sapiens
aagucaaguuauuauugcuguuacucuggaugauauggaaaacacugccauauuuuaaaucaac

SEQ ID NO: 478533 - RNA, 64 nt, Homo Sapiens
ccuaacuuauuggagcacaucaguuucuuggguaauggaaaacauuaccuagaguugccagugg

SEQ ID NO: 478534 - RNA, 64 nt, Homo Sapiens
gguuuuaaucauucuucuauaaaauacauuuaaaauggaaaaauacuuaauaucacuaaauauc

SEQ ID NO: 478535 - RNA, 64 nt, Homo Sapiens
aacuuucagauucagcccagucucauagagacauauggaaaaauagaaauaaacguaauaaaua

SEQ ID NO: 478536 - RNA, 64 nt, Homo Sapiens
gcgguguuaauuuuuaugguaacucugaaaucagauggaaaagaggccucagguaaggaugagg

SEQ ID NO: 478537 - RNA, 64 nt, Homo Sapiens
gcccagcaucacugaucauuuggccaacaauccuauggaaaaaauuuucaaaagaagacaucug

SEQ ID NO: 478538 - RNA, 64 nt, Homo Sapiens
uugaaaauggacgccuuccuaacuggccagccauauggaaaagaucaauaaaucgugcugggau

SEQ ID NO: 478539 - RNA, 64 nt, Homo Sapiens
gucuuuggaagauaaucuuccucuuuggaaaugaauggaaaagcaaaaggcccuauuacuuuua

SEQ ID NO: 478540 - RNA, 64 nt, Homo Sapiens
uuuguguugaacugaaggcuaagucucaguggacauggaaaagacuuuugggugauuuauuuuu

SEQ ID NO: 478541 - RNA, 64 nt, Homo Sapiens
auggacaaccucuugacuagauaguaaccaugcaauggaaaaaauguuaguuucuggggaaaga

SEQ ID NO: 478542 - RNA, 64 nt, Homo Sapiens
aaauauacaaauaugaaaugucaggauguucacuauggaaaaaccauguugauguugaugggag

SEQ ID NO: 478543 - RNA, 64 nt, Homo Sapiens
caaccucugcuuguccggaaaacgacaacacgaaauggaaaaggcuacagcccucugcauaaac

SEQ ID NO: 478544 - RNA, 64 nt, Homo Sapiens
guuucucaacucuugcuuugguguuugccgcagcauggaaaacagggcgccuaaggcugggagc

SEQ ID NO: 478545 - RNA, 64 nt, Homo Sapiens
uagcuagaaauaauuauguggaaaaaaaugaauaauggaaaauagugagucucaaauuguucuc

SEQ ID NO: 478546 - RNA, 64 nt, Homo Sapiens
cagccauugggaaauugggagaaaugauaaacaaauggaaaaagaagaugucccuaaccuacac

SEQ ID NO: 478547 - RNA, 64 nt, Homo Sapiens
ugauuaucuucagcccaggcuuuugcuagauggaauggaaaagcaacuucauuugacacaaagc

SEQ ID NO: 478548 - RNA, 64 nt, Homo Sapiens
uuuuuuggguuaaaagaugguuguagcauuuaaaauggaaaauuuucuccuugguuugcuagua

SEQ ID NO: 478549 - RNA, 64 nt, Homo Sapiens
gugaacggaaaacacagaguucaaaaugcagagaauggaaaacacuguaggguacuguaauuug

SEQ ID NO: 478550 - RNA, 64 nt, Homo Sapiens
agucugagaucuguacuguuaauuaguuuacagaauggaaaaggauuugaguaaccaucaacac

SEQ ID NO: 478551 - RNA, 64 nt, Homo Sapiens
auuuauucuuuuaaauaauauuauaagauuggcaauggaaaaacacagccuggauugagaauuu

SEQ ID NO: 478552 - RNA, 64 nt, Homo Sapiens
gcaauaagaaauuaauaccccaugggauaugggaauggaaaaggcuaugcaugcucuaagucug

SEQ ID NO: 478553 - RNA, 64 nt, Homo Sapiens
uaaacaucaaagaaaacauuuuuauuaguuacuuauggaaaaucaucuauuacaaugauaaccu

SEQ ID NO: 478554 - RNA, 64 nt, Homo Sapiens
uugucauugccucuggucauuugucuaaauaggaauggaaaauuaaaagaaaagcaacaaucca

SEQ ID NO: 478555 - RNA, 64 nt, Homo Sapiens
uugcuguuauuuuuggugaauuaucuagaaaaauauggaaaauauacaaaauaaguguuguggu

SEQ ID NO: 478556 - RNA, 64 nt, Homo Sapiens
cugcuguuguuccacaucucaugacaaaguuugaauggaaaagcucuugaacuuaaagaaacaa

SEQ ID NO: 478557 - RNA, 64 nt, Homo Sapiens
gaggauaccaacuguaugcuaaauagaggauacaauggaaaauaauugugcuauccugaaugga

SEQ ID NO: 478558 - RNA, 50 nt, Homo Sapiens
gaggauacaauggaaaauagauggaaaauaggacaauugugcuauccuga

SEQ ID NO: 478559 - RNA, 64 nt, Homo Sapiens
uacaaaugccuaguuguguuguguucuccacauaauggaaaaugaaaagguagagaaacuugua

SEQ ID NO: 478560 - RNA, 64 nt, Homo Sapiens
gugguuaauucugaauuucacuugaacaagaugaauggaaaauuaucccaaaaggaagaacugu

SEQ ID NO: 478561 - RNA, 64 nt, Homo Sapiens
uuacucaaaaaguaccucuucaggucuugagaacauggaaaagaauugagugcuuuuaaauacu

SEQ ID NO: 478562 - RNA, 64 nt, Homo Sapiens
cauaaacuauguagcaaaaguaucuguaaaauccauggaaaauaaaaguuguaucauucuuuuu

SEQ ID NO: 478563 - RNA, 64 nt, Homo Sapiens
acaguaucuaacauuaccauaguuguauuuuaccauggaaaaauuuugcuuucucuucaagaua

SEQ ID NO: 478564 - RNA, 64 nt, Homo Sapiens
aacuaaaauguugggugaaucuugagaggaaaaaauggaaaagagaaguuaauuacugggccaa

SEQ ID NO: 478565 - RNA, 64 nt, Homo Sapiens
auggguaggggugcauugcuuuuuccacaguauaauggaaaauauuguaaauagcaguucacau

SEQ ID NO: 478566 - RNA, 64 nt, Homo Sapiens
guuauccaucaaaagugauauaagugagagaguaauggaaaacuaaucacuuaauuaguaccau

SEQ ID NO: 478567 - RNA, 64 nt, Homo Sapiens
aauguauccccugccuauuuuccuuguguaacaaauggaaaacauucuccccugugagaaauaa

SEQ ID NO: 478568 - RNA, 64 nt, Homo Sapiens
gcaugggaaagcaaagcagaaaacagugccccaaauggaaaaaagauacucacacagaacaaaa

SEQ ID NO: 478569 - RNA, 64 nt, Homo Sapiens
aaauaaaaaucugacuuaguaaaugauguggucuauggaaaaaauuuuuauuuuuuuuauuauu

SEQ ID NO: 478570 - RNA, 64 nt, Homo Sapiens
ggccauccuuuuccccccaauacauacauaccaaauggaaaaguucuuucacaucaccuauccc

SEQ ID NO: 478571 - RNA, 64 nt, Homo Sapiens
agggcaagagaccuguuuuagugcugcauucgacauggaaaaguccuuuuaaccugugcuugca

SEQ ID NO: 478572 - RNA, 64 nt, Homo Sapiens
aucuucucagccuccuagccaaguccuauguaauauggaaaacaaacacugcagacuugagauu

SEQ ID NO: 478573 - RNA, 64 nt, Homo Sapiens
aauaauuugguuuguggacugggcaugguggcuuauggaaaagaggugagccuuugugaagaac

SEQ ID NO: 478574 - RNA, 64 nt, Homo Sapiens
uauggaaaagaggugagccuuugugaagaacauaauggaaaagugcauguacgggaaauaacag

SEQ ID NO: 478575 - RNA, 64 nt, Homo Sapiens
uuacauuagcugugguuguagcugacugggaacaauggaaaaaauugcacacaauggguuugga

SEQ ID NO: 478576 - RNA, 64 nt, Homo Sapiens
augggcuuugcacacaaugguaucauuuagaugcauggaaaaaaagaauuucauagccuguauc

SEQ ID NO: 478577 - RNA, 64 nt, Homo Sapiens
uaugugauuuuuuaaauguccccuuuaguauuuaauggaaaauugguuccugcaaaagacaaag

SEQ ID NO: 478578 - RNA, 64 nt, Homo Sapiens
uuagcucuucugacuggauuuuucuacaaaaacuauggaaaauaucuuuguucuuguuugcugc

SEQ ID NO: 478579 - RNA, 64 nt, Homo Sapiens
uucaauguguuccuguugggcguuacuagaaacuauggaaaacuggaaaauaacuuugaaaaaa

SEQ ID NO: 478580 - RNA, 64 nt, Homo Sapiens
uaaaaugucuuaauguagguuguagucacuuuagauggaaaauuaccucacaucuguuuucuuc

SEQ ID NO: 478581 - RNA, 64 nt, Homo Sapiens
aucuuggcauaagcucaaaaaagccaggaucuuuauggaaaaauuuuaauacuuuguuaaaagg

SEQ ID NO: 478582 - RNA, 64 nt, Homo Sapiens
cuggaauaaauggaaagaaauaccauauacauagauggaaaaacccaguauuauaaaaaccuca

SEQ ID NO: 478583 - RNA, 64 nt, Homo Sapiens
uauuuuaaguugggacaagaucaccaguuuguaaauggaaaacugggacgauucccaaaauaaa

SEQ ID NO: 478584 - RNA, 64 nt, Homo Sapiens
acauauuaugagaaaauuguucuucaggaaguucauggaaaaaucaguucgcuaguacaagggg

SEQ ID NO: 478585 - RNA, 64 nt, Homo Sapiens
uaacccaguugagauuuuuagaccugaaagauccauggaaaaguaaaaaauguauauggguaag

SEQ ID NO: 478586 - RNA, 64 nt, Homo Sapiens
cuacaauaacauuuugugcaagcuggaguacuggauggaaaacuaaauacacuguuuugcauca

SEQ ID NO: 478587 - RNA, 64 nt, Homo Sapiens
gagggcagcaaaugcugacaaggaugaaaagcacauggaaaaaaauggaugaggagggaaaacu

SEQ ID NO: 478588 - RNA, 64 nt, Homo Sapiens
gaaaaaaauggaugaggagggaaaacucugccaaauggaaaaugaccaaauuuaagaggguggg

SEQ ID NO: 478589 - RNA, 64 nt, Homo Sapiens
aguuguugggaaaggaguacauguauauauaccuauggaaaacugaaauucucucacucugugu

SEQ ID NO: 478590 - RNA, 64 nt, Homo Sapiens
agucuccaauuucacaucuuuaggagcugaagaaauggaaaagcaauugcuucuuagugcuuau

SEQ ID NO: 478591 - RNA, 64 nt, Homo Sapiens
agucauuaauguucuuuauaaaaagugaaauaagauggaaaaauaaggauccuacagccaguaa

SEQ ID NO: 478592 - RNA, 64 nt, Homo Sapiens
gauuccacaguggcaagaaacaucauucuacauaauggaaaacauuuacaucaaaucccacuua

SEQ ID NO: 478593 - RNA, 64 nt, Homo Sapiens; identical to SEQ ID NO: 297911

SEQ ID NO: 478594 - RNA, 64 nt, Homo Sapiens; identical to SEQ ID NO: 297912

SEQ ID NO: 478595 - RNA, 64 nt, Homo Sapiens; identical to SEQ ID NO: 297913

SEQ ID NO: 478596 - RNA, 64 nt, Homo Sapiens; identical to SEQ ID NO: 297914

SEQ ID NO: 478597 - RNA, 64 nt, Homo Sapiens; identical to SEQ ID NO: 297915

SEQ ID NO: 478598 - RNA, 64 nt, Homo Sapiens; identical to SEQ ID NO: 297916

SEQ ID NO: 478599 - RNA, 64 nt, Homo Sapiens; identical to SEQ ID NO: 297917

SEQ ID NO: 478600 - RNA, 64 nt, Homo Sapiens; identical to SEQ ID NO: 297918

SEQ ID NO: 478601 - RNA, 64 nt, Homo Sapiens; identical to SEQ ID NO: 297919

SEQ ID NO: 478602 - RNA, 64 nt, Homo Sapiens; identical to SEQ ID NO: 297920

SEQ ID NO: 478603 - RNA, 64 nt, Homo Sapiens; identical to SEQ ID NO: 297921

SEQ ID NO: 478604 - RNA, 64 nt, Homo Sapiens; identical to SEQ ID NO: 297922

SEQ ID NO: 478605 - RNA, 64 nt, Homo Sapiens; identical to SEQ ID NO: 297923

SEQ ID NO: 478606 - RNA, 64 nt, Homo Sapiens; identical to SEQ ID NO: 297924

SEQ ID NO: 478607 - RNA, 64 nt, Homo Sapiens; identical to SEQ ID NO: 297925

SEQ ID NO: 478608 - RNA, 64 nt, Homo Sapiens; identical to SEQ ID NO: 297926

SEQ ID NO: 478609 - RNA, 64 nt, Homo Sapiens; identical to SEQ ID NO: 297927

SEQ ID NO: 478610 - RNA, 64 nt, Homo Sapiens; identical to SEQ ID NO: 297928

SEQ ID NO: 478611 - RNA, 64 nt, Homo Sapiens; identical to SEQ ID NO: 297929

SEQ ID NO: 478612 - RNA, 64 nt, Homo Sapiens; identical to SEQ ID NO: 297930

SEQ ID NO: 478613 - RNA, 64 nt, Homo Sapiens; identical to SEQ ID NO: 297931

SEQ ID NO: 478614 - RNA, 64 nt, Homo Sapiens; identical to SEQ ID NO: 297932

SEQ ID NO: 478615 - RNA, 64 nt, Homo Sapiens; identical to SEQ ID NO: 297933

SEQ ID NO: 478616 - RNA, 64 nt, Homo Sapiens; identical to SEQ ID NO: 297934

SEQ ID NO: 478617 - RNA, 64 nt, Homo Sapiens; identical to SEQ ID NO: 297935

SEQ ID NO: 478618 - RNA, 64 nt, Homo Sapiens; identical to SEQ ID NO: 297936

SEQ ID NO: 478619 - RNA, 64 nt, Homo Sapiens; identical to SEQ ID NO: 297937

SEQ ID NO: 478620 - RNA, 64 nt, Homo Sapiens; identical to SEQ ID NO: 297938

SEQ ID NO: 478621 - RNA, 64 nt, Homo Sapiens; identical to SEQ ID NO: 297939

SEQ ID NO: 478622 - RNA, 64 nt, Homo Sapiens; identical to SEQ ID NO: 297940

SEQ ID NO: 478623 - RNA, 64 nt, Homo Sapiens; identical to SEQ ID NO: 297941

SEQ ID NO: 478624 - RNA, 64 nt, Homo Sapiens; identical to SEQ ID NO: 297942

SEQ ID NO: 478625 - RNA, 64 nt, Homo Sapiens; identical to SEQ ID NO: 297943

SEQ ID NO: 478626 - RNA, 64 nt, Homo Sapiens; identical to SEQ ID NO: 297944

SEQ ID NO: 478627 - RNA, 64 nt, Homo Sapiens
uuauuucaagggauggcauaacuguaagaggucagugcuagaauaaaguccuguagguuuauuu

SEQ ID NO: 478628 - RNA, 64 nt, Homo Sapiens
uggaagggacuguggccaggguaguucucagguugugcuagagcagcacuuuguuauguggaag

SEQ ID NO: 478629 - RNA, 64 nt, Homo Sapiens
acuaggagcccagcugggauucuugagugcaaaggugcuagacaagagaaaaacaauauaacuu

SEQ ID NO: 478630 - RNA, 64 nt, Homo Sapiens
cuaagaggcacucacaaggccuuuaaccaguuaggugcuagaucagcuagucauggauaacaga

SEQ ID NO: 478631 - RNA, 64 nt, Homo Sapiens
aggacgucaaaaacucaccauggaccccaaggcagaaaccaagaacugucugcaggcaaauaag

SEQ ID NO: 478632 - RNA, 64 nt, Homo Sapiens
gaugcuuaauggugcuagaggcucaaguguguuugaaaccaagagccaguugucccccaugcag

SEQ ID NO: 478633 - RNA, 64 nt, Homo Sapiens
cucagccucugcaacugcaagaaaggggacccaagaaaccaaagucugccgcccaccucgcucc

SEQ ID NO: 478634 - RNA, 64 nt, Homo Sapiens
uauuaaguguucucaacugaguaacuuuuaaguggaaaccaaguuuagauuuggggagugguaa

SEQ ID NO: 478635 - RNA, 64 nt, Homo Sapiens
gacuuugucuaagccucauuauacugaaguugaagaaaccaaaugagcuccacccucacuuugc

SEQ ID NO: 478636 - RNA, 64 nt, Homo Sapiens
aaaaauuuauuaaauauaaauauccccagggacagaaaccaaggccccgagcucagggcagcug

SEQ ID NO: 478637 - RNA, 64 nt, Homo Sapiens
aagucaauugaguaaggacaccuccagccauacagaaaccaacacugugugggggccaaggucu

SEQ ID NO: 478638 - RNA, 64 nt, Homo Sapiens
gggagagcgaugcuuggauuuuuguuuccuauuagaaaccaacaguuuuguucuaauuucauuu

SEQ ID NO: 478639 - RNA, 64 nt, Homo Sapiens
ugaagcucccagugaccuggagggaggauuccuggaaaccaaacaaucaguuuaggugcaggug

SEQ ID NO: 478640 - RNA, 64 nt, Homo Sapiens
uucaucagguaucuuucuguggcauuugagaacagaaaccaagaaacaugguaauuacuaaauu

SEQ ID NO: 478641 - RNA, 64 nt, Homo Sapiens
ucccuuuucuauaaaaaauaaguuaaugugucaagaaaccaacucuauuaaggugggguuuaau

SEQ ID NO: 478642 - RNA, 64 nt, Homo Sapiens
cauugcugauugguguuaaguugcuagacacugcgaaaccaagcugacucacaagaagaccucu

SEQ ID NO: 478643 - RNA, 64 nt, Homo Sapiens
guuuucgcacuucuuggcugguccagggacugcagaaaccaaagcugcuauuguugaggaauaa

SEQ ID NO: 478644 - RNA, 64 nt, Homo Sapiens
aauuauguuaauaauuuauuuaaugagugguauggaaaccaauugauuuuuuuagauaaaagaa

SEQ ID NO: 478645 - RNA, 64 nt, Homo Sapiens
ccccacucccacuuccaggauugugguuuggauugaaaccaaguuuacaaguagacaccccugg

SEQ ID NO: 478646 - RNA, 64 nt, Homo Sapiens
ucaaaugauugccaucagaaagagacaacuugaagaaaccaacaaugacuaugaaacagcugac

SEQ ID NO: 478647 - RNA, 64 nt, Homo Sapiens
uuuucacccauucugugguucauuguaguuuaaggaaaccaagcauauagaugcauuagugauu

SEQ ID NO: 478648 - RNA, 64 nt, Homo Sapiens
uuucaccuuuguauaagauauagccaagacugaagaaaccaaauauauguguuuacuguagcau

SEQ ID NO: 478649 - RNA, 64 nt, Homo Sapiens
auauauauuauuuuuuuuuaagaaaggaggaaaagaaaccaaaaguuuuuuuuaagaaaaaaaa

SEQ ID NO: 478650 - RNA, 64 nt, Homo Sapiens
ugcugccuucauccuccccaccuaaugcauuuuugaaaccaaagguaccuagccucagagacag

SEQ ID NO: 478651 - RNA, 64 nt, Homo Sapiens
gaaaauauuuccugauucaagauucuauaaaaaggaaaccaagcauaagacucugucaucauac

SEQ ID NO: 478652 - RNA, 64 nt, Homo Sapiens
gcacaauucccauugagagacuucacuuauugcugaaaccaagaaaagggcaagaucuuuuuuc

SEQ ID NO: 478653 - RNA, 64 nt, Homo Sapiens
aaggccagcaccuccgucggacacggggcagagagaaaccaaccucccccaggacuugaugacc

SEQ ID NO: 478654 - RNA, 64 nt, Homo Sapiens
cucaaaaaacagucuccuaauugcuuaaaaugaugaaaccaaccauguuuaaaacaucaacaca

SEQ ID NO: 478655 - RNA, 64 nt, Homo Sapiens
gcgcuuugcaauauuuauuagacuugaaaagaaagaaaccaaguggacauuagucguuauauuu

SEQ ID NO: 478656 - RNA, 64 nt, Homo Sapiens
ccuucuagauucaggugacuccuuccaguuaugagaaaccaauguccuuagaagucccauucuc

SEQ ID NO: 478657 - RNA, 64 nt, Homo Sapiens
guauguguuuuaaaauuacauaauauaggauuuagaaaccaagguuuacaauuaggcuauuuuu

SEQ ID NO: 478658 - RNA, 64 nt, Homo Sapiens
acaggcacccaagcacuaccugguuccagugagagaaaccaaccaggcgaguggggcccaggac

SEQ ID NO: 478659 - RNA, 64 nt, Homo Sapiens
cagaugagaugacugccauggagggaaagugacggaaaccaaguuccuucgagcuugacucuga

SEQ ID NO: 478660 - RNA, 64 nt, Homo Sapiens
cuguguaucuaauacuaaccgguauuucagcuuugaaaccaaauagaagauuuauuccaccagg

SEQ ID NO: 478661 - RNA, 64 nt, Homo Sapiens
aaauacaaaauccuucuccagaacaccugauggugaaaccaaacgaaacugacuugcucaccug

SEQ ID NO: 478662 - RNA, 64 nt, Homo Sapiens
gggagucucccaugaugggguucaugaugagauggaaaccaaaacgccgcguggacugaagcuc

SEQ ID NO: 478663 - RNA, 64 nt, Homo Sapiens
aguugaguuuccaauggaacauaucacaauuuacgaaaccaaaauacaguauacauauauauuu

SEQ ID NO: 478664 - RNA, 64 nt, Homo Sapiens
cugagcuuuuaacuuucuccccuaacuugggccagaaaccaaagaggcuaaccuuucuaagcuc

SEQ ID NO: 478665 - RNA, 64 nt, Homo Sapiens
cccugcugagcagagccauucuacagagauccaggaaaccaaagggaaacuuacauguugagau

SEQ ID NO: 478666 - RNA, 64 nt, Homo Sapiens
aaucugugugacuugcuuuacuuauaugcacugggaaaccaaaacgacuugaguguaaacauaa

SEQ ID NO: 478667 - RNA, 64 nt, Homo Sapiens
agaauuagggaugggaauacuuuuuuuucuucuggaaaccaagugagauagucuuauucugauu

SEQ ID NO: 478668 - RNA, 64 nt, Homo Sapiens
uaaccuuuugcaccugcucuuucucuacuuugaggaaaccaaagguuucuucccuguauuuucu

SEQ ID NO: 478669 - RNA, 64 nt, Homo Sapiens
ucaauuuagagguauggauggucggugaauaaaugaaaccaaucuucauuauguguucuacagu

SEQ ID NO: 478670 - RNA, 64 nt, Homo Sapiens
acugcauccuucaacucucacuagaaaaucuuuugaaaccaaauggauuaauuuauggcuauuu

SEQ ID NO: 478671 - RNA, 64 nt, Homo Sapiens
acugaagaugauguaugaaggaguuggaguuguugaaaccaagguguccaugaucccuccccac

SEQ ID NO: 478672 - RNA, 64 nt, Homo Sapiens; identical to SEQ ID NO: 82031

SEQ ID NO: 478673 - RNA, 64 nt, Homo Sapiens; identical to SEQ ID NO: 82032

SEQ ID NO: 478674 - RNA, 64 nt, Homo Sapiens; identical to SEQ ID NO: 82033

SEQ ID NO: 478675 - RNA, 64 nt, Homo Sapiens; identical to SEQ ID NO: 82034

SEQ ID NO: 478676 - RNA, 64 nt, Homo Sapiens
ccucugaaggccgggacccagucauacauccuuagaaaccaaaguaugguuuuuguuuucucuu

SEQ ID NO: 478677 - RNA, 64 nt, Homo Sapiens
gaagaaaaauagguguauaaaauguuuuccaugagaaaccaagaaacuuacacugguuugacag

SEQ ID NO: 478678 - RNA, 64 nt, Homo Sapiens
cucauuaaguguuauuuauuuuacucaagaacuggaaaccaacuaaaugccuucuauagaagua

SEQ ID NO: 478679 - RNA, 64 nt, Homo Sapiens
acucuuucucaccugaugcucuuaaaagaucuuagaaaccaaccauacagacgagccgaugcgg

SEQ ID NO: 478680 - RNA, 64 nt, Homo Sapiens
ccauuugcacauaguuaccagucacucuguuucugaaaccaauccagaaauucauguuagaaca

SEQ ID NO: 478681 - RNA, 53 nt, Homo Sapiens
ucagggaaaguaaaaaguaaaaagaaaccaagaauuuuccauuuugugaucaa

SEQ ID NO: 478682 - RNA, 64 nt, Homo Sapiens
caguaauguauuugaaggaaaaauacccugauuugaaaccaacagcagauguugcaaacuuuca

SEQ ID NO: 478683 - RNA, 50 nt, Homo Sapiens
uuauccucuccuacacauaagaaaccaaaaggcugggcguaguggcucac

SEQ ID NO: 478684 - RNA, 64 nt, Homo Sapiens
augccucuacuaucauuaccucuauugggacccagaaaccaauaccccaaaauauggugcaugg

SEQ ID NO: 478685 - RNA, 64 nt, Homo Sapiens
ccacgcuuguuccccauguaccucuagagaagcagaaaccaaagucccccugugcccugggagg

SEQ ID NO: 478686 - RNA, 64 nt, Homo Sapiens
uuagcaccuuuucaagggguuuuugauguuaacagaaaccaauccucugagggcuguuuuuuuu

SEQ ID NO: 478687 - RNA, 64 nt, Homo Sapiens
cccauaguacagugccuuguaccuuucccauaaagaaaccaaacagcuagcaaucuaugcaaac

SEQ ID NO: 478688 - RNA, 64 nt, Homo Sapiens
aaaaugugccuuuggugggcgguuugaacuuuuggaaaccaauuaaaacucuguguugcugcag

SEQ ID NO: 478689 - RNA, 64 nt, Homo Sapiens
gggucggcaguggacgcguaaaagguugguuucagaaaccaagauuaaagaggagagcaggaag

SEQ ID NO: 478690 - RNA, 58 nt, Homo Sapiens
cauuuuuuccugugaauuugucaucugagaaaccaacauuaaaaaagccaccaacuga

SEQ ID NO: 478691 - RNA, 64 nt, Homo Sapiens
cucagaggggcaaagucaccguuuuauagaugaggaaaccaagggucuacaauggggagaacuu

SEQ ID NO: 478692 - RNA, 64 nt, Homo Sapiens
gauaaaacuguucauggauguuccacgcaaauaagaaaccaagguacuucguuaugaaaaugcc

SEQ ID NO: 478693 - RNA, 64 nt, Homo Sapiens; identical to SEQ ID NO: 82035

SEQ ID NO: 478694 - RNA, 64 nt, Homo Sapiens; identical to SEQ ID NO: 82036

SEQ ID NO: 478695 - RNA, 64 nt, Homo Sapiens
caaagaaaauucugaaaaauggagaugcuaccaagaaaccaaccauguuauucauguauuacug

SEQ ID NO: 478696 - RNA, 64 nt, Homo Sapiens
cuucagauaaacuugcaagaugacugaaaugcuugaaaccaaagcuccucaauugggaguguug

SEQ ID NO: 478697 - RNA, 64 nt, Homo Sapiens
caauaugagguaccuuuacaacaugagugaaaaugaaaccaaguuagguuuccgcuuucauggg

SEQ ID NO: 478698 - RNA, 64 nt, Homo Sapiens
aaacuuguuuuuagaauauuaaugugaguaaauugaaaccaagagauuuacuuuuaagaggcaa

SEQ ID NO: 478699 - RNA, 64 nt, Homo Sapiens
gcagugaguuaaaauuuaguaagaugaagauguggaaaccaaugaaaaguacauuuagaaaugc

SEQ ID NO: 478700 - RNA, 64 nt, Homo Sapiens
guagagcugaguuaccaaaauuucuauuucaaaggaaaccaaaccuuaaaaaaaaaaaacaaaa

SEQ ID NO: 478701 - RNA, 64 nt, Homo Sapiens
aaauggugcuuuguuccugcugguuccaagcucagaaaccaagacuagcuuuguaggagagaau

SEQ ID NO: 478702 - RNA, 64 nt, Homo Sapiens
caucuauuccuuuucucuugugucccuacucauugaaaccaaacucuggaaaggacccaaugua

SEQ ID NO: 478703 - RNA, 64 nt, Homo Sapiens; identical to SEQ ID NO: 82037

SEQ ID NO: 478704 - RNA, 64 nt, Homo Sapiens; identical to SEQ ID NO: 82038

SEQ ID NO: 478705 - RNA, 64 nt, Homo Sapiens
uaaggacuuuccuuccuccaucuccaagaaugcugaaaccaagggggaugacaugugacuccua

SEQ ID NO: 478706 - RNA, 64 nt, Homo Sapiens
cuuuuauuuauagaaugcaugucuuuuguguuaagaaaccaaagagaaauaaagagaacacucc

SEQ ID NO: 478707 - RNA, 64 nt, Homo Sapiens
gauggcucacugggcucuuggaggggaaugugaagaaaccaaggagucacuuuuucaucuagau

SEQ ID NO: 478708 - RNA, 64 nt, Homo Sapiens
ugguaggcagugucccuucugcuugaaaccuauugaaaccaauuuaaaacuguguacuuuuuaa

SEQ ID NO: 478709 - RNA, 64 nt, Homo Sapiens
ucaccuuaguggaaagguuaaaaaccagagccuggaaaccaagaugauugauuugacaagguau

SEQ ID NO: 478710 - RNA, 64 nt, Homo Sapiens
ucucagugacagaagcauguuugagaugccgugggaaaccaaauauauaauaauaaaaauauaa

SEQ ID NO: 478711 - RNA, 64 nt, Homo Sapiens
gcaaauauuccauuguaaacaaaucaaaggaaaagaaaccaagaacugaauuacugucugccca

SEQ ID NO: 478712 - RNA, 64 nt, Homo Sapiens
cagucaaagggcaccauucuuuuuuuuuuuuuuugaaaccaaagcugucucagaaauggccaau

SEQ ID NO: 478713 - RNA, 64 nt, Homo Sapiens
aaauugcacuuuuggaagcccggugucaugaaaugaaaccaaaccucggugccaucgcagagua

SEQ ID NO: 478714 - RNA, 64 nt, Homo Sapiens
ugcagauggauguuuccaugaagaaaucucugaagaaaccaaaagagcugaaacugaaaaaaga

SEQ ID NO: 478715 - RNA, 64 nt, Homo Sapiens
gugugcaaaccucuugacuuuaccccacauuacugaaaccaaaauauauuugcuucaucugccc

SEQ ID NO: 478716 - RNA, 64 nt, Homo Sapiens
acuggagagaaaaccaacguacgagcaacaaucggaaaccaaaucccaacucacccaagcagca

SEQ ID NO: 478717 - RNA, 64 nt, Homo Sapiens; identical to SEQ ID NO: 82039

SEQ ID NO: 478718 - RNA, 64 nt, Homo Sapiens; identical to SEQ ID NO: 82040

SEQ ID NO: 478719 - RNA, 64 nt, Homo Sapiens
uggaagaugucuuuuucaguucuugaaaugagaagaaaccaacccguucauggagcuggucauu

SEQ ID NO: 478720 - RNA, 64 nt, Homo Sapiens
ggugucaguaaaauucuguguuuugccaauuagagaaaccaaccuuuuaaauugcaaauguaau

SEQ ID NO: 478721 - RNA, 63 nt, Homo Sapiens
gugaauagccacaucuuaccucgcucuggaguagaaaccaaauuuuguuuagcccaaaaguaa

SEQ ID NO: 478722 - RNA, 64 nt, Homo Sapiens
cauggcaacgcuggugcuugauaaaggguuauuugaaaccaaucauauaaauauaaaauuauau

SEQ ID NO: 478723 - RNA, 64 nt, Homo Sapiens
auuuaaauuauauugauguuuuuuuuaaaaaaaagaaaccaacagaagcuuuacuuuuccacuu

SEQ ID NO: 478724 - RNA, 64 nt, Homo Sapiens
agauuugucuacaaaugcuaugcuuaauucuguugaaaccaaaaauuuuuacaccccuuaaggg

SEQ ID NO: 478725 - RNA, 64 nt, Homo Sapiens
cuugcucucacuaguugucagggaaaugccagaugaaaccaacuaaugccaccagagauagugg

SEQ ID NO: 478726 - RNA, 64 nt, Homo Sapiens
cucuucucuguccccugcccggagaacugagcaggaaaccaagggggugaggcuuagcccagaa

SEQ ID NO: 478727 - RNA, 64 nt, Homo Sapiens
gccuccauuuuccugagaucaaaaagacuguuucgaaaccaacaucugauauguaaacugcucu

SEQ ID NO: 478728 - RNA, 64 nt, Homo Sapiens
ccuucugagcguuucugacagcucccagcugggagaaaccaacaugacgaaaagacaaagaaua

SEQ ID NO: 478729 - RNA, 64 nt, Homo Sapiens
ggaaugaugguugcacaacuuugugaauauacuagaaaccaaugaauuaaaaacuuuggaagau

SEQ ID NO: 478730 - RNA, 64 nt, Homo Sapiens
ucugcaguuccuuauaggcgaagggaaccggguggaaaccaagcugggagaggcugaggauggc

SEQ ID NO: 478731 - RNA, 64 nt, Homo Sapiens
auuguaccauacaauuucauuaucuuaucagaaugaaaccaauucacagggaaacuagagacua

SEQ ID NO: 478732 - RNA, 64 nt, Homo Sapiens
aggaaauaucaaagaacacaacgcaggacuugcugaaaccaaauuacuacuucacacucuccuu

SEQ ID NO: 478733 - RNA, 64 nt, Homo Sapiens
gcaacauuuuggaagcagagggcaacucucacuggaaaccaaaucuccuggcaccuugaucuug

SEQ ID NO: 478734 - RNA, 64 nt, Homo Sapiens
uauauaagucaagaauguuuuauugucauuaugugaaaccaauauuggcaaauaguacuuuaau

SEQ ID NO: 478735 - RNA, 64 nt, Homo Sapiens
caguaauagauaugugauuuuacaucauuuuuaagaaaccaaggggaaguaauaaguugaaaaa

SEQ ID NO: 478736 - RNA, 64 nt, Homo Sapiens
uaaucucauguauaaaaacuuuucuuuaaauaaggaaaccaauaccauucuuaauuguaauuuu

SEQ ID NO: 478737 - RNA, 64 nt, Homo Sapiens
ggcagcuuucccugacaagcuuggcaucaguauagaaaccaacuuugguugacaaaauuggcug

SEQ ID NO: 478738 - RNA, 64 nt, Homo Sapiens
aacaucugguacagcugccaugaaccuuuuguaugaaaccaagagcuccaugcucgcuacgucu

SEQ ID NO: 478739 - RNA, 64 nt, Homo Sapiens
cagagagcuuaacucacuucaacuuagagaggaagaaaccaagacuucugguaccaugauccuc

SEQ ID NO: 478740 - RNA, 64 nt, Homo Sapiens; identical to SEQ ID NO: 82041

SEQ ID NO: 478741 - RNA, 64 nt, Homo Sapiens; identical to SEQ ID NO: 82042

SEQ ID NO: 478742 - RNA, 64 nt, Homo Sapiens
aaaagaagccaagcaaaaaucaugguauaaagaggaaaccaagacaauggaggggucuggggac

SEQ ID NO: 478743 - RNA, 64 nt, Homo Sapiens
gaacugccaacaaaauaaaagcucaauaaauguugaaaccaacugugccugguauauaguaggu

SEQ ID NO: 478744 - RNA, 64 nt, Homo Sapiens
auacaaaugaaucaguaucaguuuucuucuuugggaaaccaaacaaucccaguucucuaauuug

SEQ ID NO: 478745 - RNA, 64 nt, Homo Sapiens
ccagcuuccuuuuccuuuaaucugacuucagacagaaaccaauauugucuucguaaaaguuaga

SEQ ID NO: 478746 - RNA, 64 nt, Homo Sapiens
uaaauauuucugcauuucagcaaaaacaaugaaggaaaccaaaaauaaaccaaaacaaaauuuc

SEQ ID NO: 478747 - RNA, 64 nt, Homo Sapiens
ugccugugcuuuuguuugacugucucuagauuuugaaaccaaaaaacugaacugaaaucaucua

SEQ ID NO: 478748 - RNA, 64 nt, Homo Sapiens
gcugugccggcgcuacgggacccgagccgucccagaaaccaaagggcaggcacggcagcaaacg

SEQ ID NO: 478749 - RNA, 64 nt, Homo Sapiens
guaaaguaaaaggaaacaguacacuuggagcuaggaaaccaaagcaagcuuugugaaacuggca

SEQ ID NO: 478750 - RNA, 64 nt, Homo Sapiens
augaucaguccaacugaacgaccuuacaaaugaggaaaccaagauaaaugagcugccagaauca

SEQ ID NO: 478751 - RNA, 64 nt, Homo Sapiens
gauaccuccagguuccaguaaaauucuucugaccgaaaccaauguggguguuagaaaaauuacc

SEQ ID NO: 478752 - RNA, 64 nt, Homo Sapiens
caccccagcacugcuguugggaaggugacugcaggaaaccaauucuuacaagauccaggcccag

SEQ ID NO: 478753 - RNA, 64 nt, Homo Sapiens
auacaaccagcauagaaagacccaaaacuauacagaaaccaaaaccagaaugccauguggugga

SEQ ID NO: 478754 - RNA, 64 nt, Homo Sapiens
agauauuaagcguguguaaaugggcuuuagucuggaaaccaaaaaaaaaaaaaaaauuuaguca

SEQ ID NO: 478755 - RNA, 64 nt, Homo Sapiens
cccaccaugcccuucugccaucuucugggagaaggaaaccaaaggaucuaaaacugggguuugg

SEQ ID NO: 478756 - RNA, 64 nt, Homo Sapiens
gacccuagagcagaggugggcaaacuaugaccuggaaaccaaaucugacuuaccaccuuuuccu

SEQ ID NO: 478757 - RNA, 64 nt, Homo Sapiens
aucugauuugguauugugauuuacuucagacccugaaaccaaauaucugaucuuccauuagacu

SEQ ID NO: 478758 - RNA, 64 nt, Homo Sapiens; identical to SEQ ID NO: 82043

SEQ ID NO: 478759 - RNA, 64 nt, Homo Sapiens; identical to SEQ ID NO: 82044

SEQ ID NO: 478760 - RNA, 64 nt, Homo Sapiens
gguugcauggaaguuuuauucucuuguuuugcuggaaaccaagaggauccaaacuuccugcaac

SEQ ID NO: 478761 - RNA, 64 nt, Homo Sapiens
gggugggaggcaccaaaacuuggcagcugugccagaaaccaaagccaggcccagauguaggggg

SEQ ID NO: 478762 - RNA, 64 nt, Homo Sapiens
ccagagcagccuguggccugggucacuggugucugaaaccaaauacgcaaaacuggcuucuucu

SEQ ID NO: 478763 - RNA, 64 nt, Homo Sapiens
cugaagagucagguugaagcugacaguacugggagaaaccaagguuaaaguuccuaagacccag

SEQ ID NO: 478764 - RNA, 64 nt, Homo Sapiens
gaaguuuuguuuuuguuuuuacucauaauagggagaaaccaagauaauguaauaauagaaaaau

SEQ ID NO: 478765 - RNA, 64 nt, Homo Sapiens
uuagaaacauuagaaauuugguuagaucuuguaggaaaccaagacaggauaacacaagcuuagu

SEQ ID NO: 478766 - RNA, 64 nt, Homo Sapiens
aagcagacacaacaugcauuugggaaaauagguagaaaccaagguaaaaauuguuagaaauugg

SEQ ID NO: 478767 - RNA, 64 nt, Homo Sapiens
agaaaacuauuguuggaucaugagugauacuagugaaaccaaauuuagccugugucaaguucuu

SEQ ID NO: 478768 - RNA, 64 nt, Homo Sapiens; identical to SEQ ID NO: 82045

SEQ ID NO: 478769 - RNA, 64 nt, Homo Sapiens; identical to SEQ ID NO: 82046

SEQ ID NO: 478770 - RNA, 64 nt, Homo Sapiens
aguuugcucuaggggaagagcagcgauggucucagaaaccaaacuguacaugcauucauacagg

SEQ ID NO: 478771 - RNA, 64 nt, Homo Sapiens
cauggagcaguucccagaguccugcacagaugaggaaaccaaggaucagagcuggaaccucauc

SEQ ID NO: 478772 - RNA, 64 nt, Homo Sapiens
guaucugcucuaaaaugacuaggccagacaccaagaaaccaagccucuuccucaaggcaaccug

SEQ ID NO: 478773 - RNA, 64 nt, Homo Sapiens
cucagaaaauguuuacuguuauaagcagguacuagaaaccaaaagugauuauuauuaacucuag

SEQ ID NO: 478774 - RNA, 64 nt, Homo Sapiens
uagucaucucauccuacucaauuuuucaaaggcagaaaccaacccuggagcaauugagaggacu

SEQ ID NO: 478775 - RNA, 64 nt, Homo Sapiens
cauuuuauauggcugaucaauuuucauacauugagaaaccaagucaaucaagcaggaaucauuu

SEQ ID NO: 478776 - RNA, 64 nt, Homo Sapiens
uacuagucaaauccgucagugaucccgagucccagaaaccaaaggcucuuuucagagccaccca

SEQ ID NO: 478777 - RNA, 64 nt, Homo Sapiens
uagcuuuaggggaccaugaagagacucucuuagggaaaccaauaguccccaucagcaccaugga

SEQ ID NO: 478778 - RNA, 64 nt, Homo Sapiens
cauuuaguaauguaccuugaguuaaaaagccugagaaaccaaacacagcuaaugcuauggggug

SEQ ID NO: 478779 - RNA, 64 nt, Homo Sapiens
agagggaacgagcuguagguuugcagaaaugugugaaaccaaaaugaucacugccuacuuguga

SEQ ID NO: 478780 - RNA, 64 nt, Homo Sapiens
ugguuuaaucagucuaauuguuuugacuguuauagaaaccaaauauuuuacuguuucuuuuaag

SEQ ID NO: 478781 - RNA, 64 nt, Homo Sapiens
gugagguagauugcugucccguuaacauagugcugaaaccaaaggcaguggggguccaaacucg

SEQ ID NO: 478782 - RNA, 64 nt, Homo Sapiens
cacuuucuagaacauauucuuuacuaauguuauugaaaccaauuucuacuucauacugauguuu

SEQ ID NO: 478783 - RNA, 64 nt, Homo Sapiens
auuuuaauaccaugccagagaagaguauucugcugaaaccaacagguuuuacuggucaaaauga

SEQ ID NO: 478784 - RNA, 64 nt, Homo Sapiens
uugggaauuaaacaggucacacgugacagaugaagaaaccaagggggcugcugaggagaccugg

SEQ ID NO: 478785 - RNA, 64 nt, Homo Sapiens
caauuacuauaauccugagccauggugugcuacugaaaccaauuuuuauccaccaucuaguccu

SEQ ID NO: 478786 - RNA, 64 nt, Homo Sapiens
auccugccuucuuuguggggacaauuaccuaaaagaaaccaaaaaucaucacaaauccuuuaaa

SEQ ID NO: 478787 - RNA, 64 nt, Homo Sapiens
aacaagaaccucucuuucuaaauacuauuaauaagaaaccaacacagggcgaaaagaaaaaaau

SEQ ID NO: 478788 - RNA, 64 nt, Homo Sapiens
cuuggauuuagauucaaaagcugacaucacaguagaaaccaaacuuggaauacuggucaucuuu

SEQ ID NO: 478789 - RNA, 64 nt, Homo Sapiens
uuaauuauacuaugccauuaugcagaucucagaugaaaccaagccugacacccuuuaauguggu

SEQ ID NO: 478790 - RNA, 64 nt, Homo Sapiens
ugauucuuaauuaguauacaaauuuggcugacaagaaaccaaagaauaaaauuguaauauaaua

SEQ ID NO: 478791 - RNA, 64 nt, Homo Sapiens
cugccaacaccuugaucuugagagggccucagaagaaaccaaccacucuuuacaagcuaagaag

SEQ ID NO: 478792 - RNA, 64 nt, Homo Sapiens
aaagugaaacuuuggauaaguacaauguguaauggaaaccaagggucaagaguugaggagacau

SEQ ID NO: 478793 - RNA, 64 nt, Homo Sapiens
uuguauauugaauuacauuagauuauaauucugugaaaccaaguuaucuuugugcuauauagug

SEQ ID NO: 478794 - RNA, 64 nt, Homo Sapiens
aguuugacugggagcgugugacauagcccacuaggaaaccaagacuugugaaguugcuguuggc

SEQ ID NO: 478795 - RNA, 64 nt, Homo Sapiens
aacagccaagucagcaagcaagcuucaaagucaugaaaccaaucaagaauugucauaggaggga

SEQ ID NO: 478796 - RNA, 64 nt, Homo Sapiens
gcgccccuucaccucgcgugcuuuucucccaagcgaaaccaaauccagccuccccgcccgcucu

SEQ ID NO: 478797 - RNA, 64 nt, Homo Sapiens
uaauuuacuucuuauaaauugaagucuuaaaugugaaaccaagaaauguaaucaagcaguaaaa

SEQ ID NO: 478798 - RNA, 64 nt, Homo Sapiens
cuccaccacugugcacuuagccaugauggcaacagaaaccaagagacacaauuacgcagguauu

SEQ ID NO: 478799 - RNA, 64 nt, Homo Sapiens; identical to SEQ ID NO: 82047

SEQ ID NO: 478800 - RNA, 64 nt, Homo Sapiens; identical to SEQ ID NO: 82048

SEQ ID NO: 478801 - RNA, 64 nt, Homo Sapiens
guuaaaagccuauuauuguuaaaggccuuuuauggaaaccaacuuggaaaacaaccuuaaaugu

SEQ ID NO: 478802 - RNA, 64 nt, Homo Sapiens
aaaaaaauaaaacgcaaaaaaagaaacuguaaaggaaaccaagagauuuuguuuaauuuuuuug

SEQ ID NO: 478803 - RNA, 64 nt, Homo Sapiens
ccaaaggcauaagacccuaagccuccuuuugcuugaaaccaaagauauauacacaggauccuau

SEQ ID NO: 478804 - RNA, 64 nt, Homo Sapiens
ccuucaagaggguuacaauguggccaucagacaggaaaccaaacgguggauaaaguauuaagua

SEQ ID NO: 478805 - RNA, 64 nt, Homo Sapiens
augucuucagugauugaaacggaugggaauagcagaaaccaaccgcauggaggagggaggcgug

SEQ ID NO: 478806 - RNA, 64 nt, Homo Sapiens
uagaaacacauuccuugggaaaccagugugcuuugaaaccaaauaugaaagugguaaaaguggg

SEQ ID NO: 478807 - RNA, 64 nt, Homo Sapiens
aaauuacuuaagaaauggaaauuauugacuuuuggaaaccaaccgcucaaaacacuacauccac

SEQ ID NO: 478808 - RNA, 64 nt, Homo Sapiens
acaacaagauacaaauaccucucuauuucacacagaaaccaaggauauucucauuauuaacuuc

SEQ ID NO: 478809 - RNA, 64 nt, Homo Sapiens
guugacauacaaaccaugauuuucucuguuuuaugaaaccaacuucuucuaucuucuuuccacc

SEQ ID NO: 478810 - RNA, 64 nt, Homo Sapiens
guuauauaugaacacucaaaucuuuuacuguaacgaaaccaagaaacuuguuuagaaugugaua

SEQ ID NO: 478811 - RNA, 64 nt, Homo Sapiens; identical to SEQ ID NO: 82049

SEQ ID NO: 478812 - RNA, 64 nt, Homo Sapiens; identical to SEQ ID NO: 82050

SEQ ID NO: 478813 - RNA, 64 nt, Homo Sapiens; identical to SEQ ID NO: 82051

SEQ ID NO: 478814 - RNA, 64 nt, Homo Sapiens
aaucacuuuuuaaaauauaaggaccgaaugcaaggaaaccaaaguuuauuaauaauuuuuauau

SEQ ID NO: 478815 - RNA, 64 nt, Homo Sapiens
ccgagggaacccugggucuugggaagaacaacaggaaaccaaggucugaccuaggguucccucc

SEQ ID NO: 478816 - RNA, 64 nt, Homo Sapiens
caauagaaauuuuucucauaauauauaccuaugugaaaccaacuuaucugcauaauuaaaucua

SEQ ID NO: 478817 - RNA, 64 nt, Homo Sapiens
acuuuuagcuuugaucacaaguggacaaauuucugaaaccaaaggcaacuaaguugcuguguua

SEQ ID NO: 478818 - RNA, 62 nt, Homo Sapiens
cagugcaagauucaguucaagcuuccuagauagaaaccaaagacagacucugcugucgcuga

SEQ ID NO: 478819 - RNA, 64 nt, Homo Sapiens
ggucaggaguuguuucugacacgcggcucaaaaggaaaccaaguuuacagauugccuccuuaug

SEQ ID NO: 478820 - RNA, 64 nt, Homo Sapiens
guguuuaaacuuaaaacugcacggacuaugagaagaaaccaaacacgcauuggcauccaaggcc

SEQ ID NO: 478821 - RNA, 64 nt, Homo Sapiens
guccaccuggguguguucaugaaccccugcaaaugaaaccaaacgaaccccugcaacccucccu

SEQ ID NO: 478822 - RNA, 64 nt, Homo Sapiens
acuguagaagaugaggaauccuuuguacacguuugaaaccaacuuucucauaguauagaguuua

SEQ ID NO: 478823 - RNA, 64 nt, Homo Sapiens
gaauggcugaugucucuuucaguuagucugguuggaaaccaagauuaggggaucauaucaagaa

SEQ ID NO: 478824 - RNA, 64 nt, Homo Sapiens
uguauaauguacaguuuucauauuuauaauucuugaaaccaaaaucccuaccugugaguuccuu

SEQ ID NO: 478825 - RNA, 64 nt, Homo Sapiens
ggcaaaacgugggugcaaaaccugacaguguggagaaaccaacacagugaguuggucaaaugcu

SEQ ID NO: 478826 - RNA, 64 nt, Homo Sapiens
ccucauccucagaugcucaaaacacaaccaacgcgaaaccaauuagaacugucggaggaaagac

SEQ ID NO: 478827 - RNA, 64 nt, Homo Sapiens
guuucuuuucccaugcucuuagaauccaggugcugaaaccaaguacaguuucccuacuguaugu

SEQ ID NO: 478828 - RNA, 64 nt, Homo Sapiens
ugggcuuuauuuggacaaaccaaacuuuuagccugaaaccaacuuuaugccacuaagucauagc

SEQ ID NO: 478829 - RNA, 64 nt, Homo Sapiens
uguccacagauguacuggccauuacaugaaacaagaaaccaagcaucuuugcuguuguuaauua

SEQ ID NO: 478830 - RNA, 64 nt, Homo Sapiens
uggcauuuccauguauauauguauauaaaugcaggaaaccaacaugucauugacaccucucuuc

SEQ ID NO: 478831 - RNA, 64 nt, Homo Sapiens
uaagucuguacaaccuagcauagaauaaaaaacugaaaccaagauucccaacguuuuucauagc

SEQ ID NO: 478832 - RNA, 64 nt, Homo Sapiens
cacaauuaagagcucaugucuuagcaagaucugggaaaccaacauugcgagaguagcuauuuug

SEQ ID NO: 478833 - RNA, 64 nt, Homo Sapiens
acccaggaagcgucuuuggugcuugggagaccaagaaaccaagaaauuaacaacugaaagcauu

SEQ ID NO: 478834 - RNA, 64 nt, Homo Sapiens
ggguucugaacccguucccuacacagaaaucuuggaaaccaaaugcugcugaguaaggaugaag

SEQ ID NO: 478835 - RNA, 64 nt, Homo Sapiens
ccaucaaaacacauacacccagaaagaaacaacagaaaccaaaacucacaaggcgcaugauuac

SEQ ID NO: 478836 - RNA, 64 nt, Homo Sapiens
ugggcacuaagcuaugggagagaccauagcugcagaaaccaacccugcccuaggcauaaaaugc

SEQ ID NO: 478837 - RNA, 64 nt, Homo Sapiens
ggcagcaggcucaggcccacaccuugugauuuuugaaaccaaagcccagaagaugauguuuacu

SEQ ID NO: 478838 - RNA, 64 nt, Homo Sapiens
aauugagagugagaaagaggaugaaagcaagccugaaaccaagcacacgauuugucagagagaa

SEQ ID NO: 478839 - RNA, 64 nt, Homo Sapiens
cugggucucucuccacccgguucauggagcuggagaaaccaaaaaggacguguaccucugugug

SEQ ID NO: 478840 - RNA, 64 nt, Homo Sapiens
aagaaaccuagaaucuaaugguagacccaguuuugaaaccaaaauaaugucauuuuuauggauu

SEQ ID NO: 478841 - RNA, 64 nt, Homo Sapiens
gugccgagugaauaaaggaugaagaaaaugcaaagaaaccaaaucacaccugcaauguaaaaug

SEQ ID NO: 478842 - RNA, 64 nt, Homo Sapiens
uugggagggggaagaggaccgccucaucuggagggaaaccaaaaggaaccaacauucaaauucu

SEQ ID NO: 478843 - RNA, 64 nt, Homo Sapiens
aagcagcuugguauucauaagcagagucuaccuugaaaccaauuuaguacaauaagcguuaagg

SEQ ID NO: 478844 - RNA, 64 nt, Homo Sapiens
uauauauuuuuaaaucacauuaauuuuaccaagugaaaccaagccauacuguuuuugagccaau

SEQ ID NO: 478845 - RNA, 64 nt, Homo Sapiens
gacaguccuguaagaucgagcaaccagucaugaugaaaccaagugguggccggaucaguaugac

SEQ ID NO: 478846 - RNA, 64 nt, Homo Sapiens
uuauaugcauuaauuuaagagcaucuacuuagaagaaaccaaauagucuaucgcccucauauca

SEQ ID NO: 478847 - RNA, 64 nt, Homo Sapiens
uaaagaaugagaauggauucuguacaauacacuagaaaccaacauaauguauuucuuuaaaacc

SEQ ID NO: 478848 - RNA, 64 nt, Homo Sapiens
cucugaaaaccaaaaguauuuucauaacccauuugaaaccaaaccugaccugaacuuacacuga

SEQ ID NO: 478849 - RNA, 64 nt, Homo Sapiens
ugggaguagacagaguuguauggccuggacaguggaaaccaagagcaggaucgcaaaguaacag

SEQ ID NO: 478850 - RNA, 64 nt, Homo Sapiens
agaauccucuauuauuuucaaccccagccccagagaaaccaauaugaagagaaaagccaugccc

SEQ ID NO: 478851 - RNA, 64 nt, Homo Sapiens
cuacuucacuaaugacgauguuuuaucuguagcagaaaccaagucccguucgcccccaugugac

SEQ ID NO: 478852 - RNA, 64 nt, Homo Sapiens
gaaaagcacauugcgauccauuucguuuuuaugggaaaccaagguuuugcacaagguguuucau

SEQ ID NO: 478853 - RNA, 64 nt, Homo Sapiens
agauacaucugcuggagagcugucucucuuuggagaaaccaacccuguggugccaaauugcugg

SEQ ID NO: 478854 - RNA, 64 nt, Homo Sapiens
gguaaucugauccaccacuuaaaaacaaaaaacagaaaccaaucggccugaagaggaagagaaa

SEQ ID NO: 478855 - RNA, 64 nt, Homo Sapiens
ucgguuuccgcccucuagcgguggggccugcugggaaaccaaggccuccagagaccgagcagcu

SEQ ID NO: 478856 - RNA, 64 nt, Homo Sapiens; identical to SEQ ID NO: 82052

SEQ ID NO: 478857 - RNA, 64 nt, Homo Sapiens; identical to SEQ ID NO: 82053

SEQ ID NO: 478858 - RNA, 64 nt, Homo Sapiens
aagagcaaagggaacccagcccugguuuugcuuugaaaccaagaucauuccuggggcacugugg

SEQ ID NO: 478859 - RNA, 64 nt, Homo Sapiens
uugcaccuggaaacuuacaaaaugguguugcugggaaaccaaguguucaucaguguuuuauaga

SEQ ID NO: 478860 - RNA, 64 nt, Homo Sapiens
uagagcuacaaacucagcugguucauaaucaacagaaaccaagauauauauaacuaugcuaauu

SEQ ID NO: 478861 - RNA, 64 nt, Homo Sapiens
ucucacucaggccuccagggauccaugggggagugaaaccaauucucagagaacaacccaccag

SEQ ID NO: 478862 - RNA, 64 nt, Homo Sapiens
cagacauacgaaacacaaaccacaacugacacaggaaaccaacacccaaagcauggacuaaccc

SEQ ID NO: 478863 - RNA, 64 nt, Homo Sapiens
gccucauccucauugcuucugccuccacguaaaugaaaccaaaggccucagcauauccugggag

SEQ ID NO: 478864 - RNA, 64 nt, Homo Sapiens
aaacuuaaucuucaucuuuaaaaaaaagaaaaaagaaaccaaaaugagaaucaacacuucauag

SEQ ID NO: 478865 - RNA, 64 nt, Homo Sapiens
uuauuuuuuaaaugaaaccuuuuuuuuucuuuuugaaaccaaauguuaaacuauagccuuaaga

SEQ ID NO: 478866 - RNA, 64 nt, Homo Sapiens
gagaaaaaaaaaaagagaacccacaugaagcucugaaaccaaacagcauccugccaugagcuuc

SEQ ID NO: 478867 - RNA, 64 nt, Homo Sapiens
ccauacacagaaacauaauaaacaaucuucacacgaaaccaaaaauagcauacaccuaauguug

SEQ ID NO: 478868 - RNA, 64 nt, Homo Sapiens
gaccuuuggcucacagaacugcaggguauggugagaaaccaacuacggauugcugcaaaccaca

SEQ ID NO: 478869 - RNA, 64 nt, Homo Sapiens
ucagauggcucccacauuuuaagauuuuaaaaaugaaaccaaaaaauaaauugaagaaaacugu

SEQ ID NO: 478870 - RNA, 64 nt, Homo Sapiens
auuaaauacuuaaugcugauuugaagagauagcugaaaccaaggcugaagacuguuuuacuuuc

SEQ ID NO: 478871 - RNA, 64 nt, Homo Sapiens
ccccagaucaugcuuuaauucuuucuuuucuguagaaaccaacaguuuccauuuaugucaaugc

SEQ ID NO: 478872 - RNA, 64 nt, Homo Sapiens
agcaaguguguagcuuaaggccacuacugguaaggaaaccaaguguccucugugccuuuuuucu

SEQ ID NO: 478873 - RNA, 64 nt, Homo Sapiens
gcuagcugugcagaacccaauugcccuuugcacagaaaccaaccccugacccagcgguaccggc

SEQ ID NO: 478874 - RNA, 64 nt, Homo Sapiens
ccauggugauagccugaaagagcuuuccucacuagaaaccaaaugguguaaauauuuuauuuga

SEQ ID NO: 478875 - RNA, 64 nt, Homo Sapiens
ggaugggagccacagugcccuucacucucuccuggaaaccaacuguaagcuggugggcucaacc

SEQ ID NO: 478876 - RNA, 64 nt, Homo Sapiens
guguuuaguaucugaauuugaaacucaucugguggaaaccaaguuucaggggacaugaguuuuc

SEQ ID NO: 478877 - RNA, 64 nt, Homo Sapiens
cccagccccuccccccucccgggacucucucggggaaaccaaggggcuggucccaugugugaaa

SEQ ID NO: 478878 - RNA, 64 nt, Homo Sapiens
ugaaaaauagcauaugccuuaaagauacaugauugaaaccaaguauaacauuaagaaaaacaau

SEQ ID NO: 478879 - RNA, 64 nt, Homo Sapiens
gggaucgggccaggcucccacgucuuaccccacugaaaccaacagagcuucagccucucuucgu

SEQ ID NO: 478880 - RNA, 64 nt, Homo Sapiens
uacuguggucucuugggacuauuccccugaagaagaaaccaaugauggagcucuggacuccuaa

SEQ ID NO: 478881 - RNA, 64 nt, Homo Sapiens
aggcuuuagaagagauuaucaucuaacucuucuggaaaccaaaucuguccacucuuguucaagu

SEQ ID NO: 478882 - RNA, 64 nt, Homo Sapiens
ugguuugggguaugggguggaccagaggagucaagaaaccaagacguuuguagguucuuacugg

SEQ ID NO: 478883 - RNA, 64 nt, Homo Sapiens
agacccugaagaauauuugaacauguuuaaucuggaaaccaaagggcaagaugaccgucacauu

SEQ ID NO: 478884 - RNA, 64 nt, Homo Sapiens
uaagaguguguuucuguguuaccaaaauagagcagaaaccaagccaaaguucaaaaguagaaau

SEQ ID NO: 478885 - RNA, 64 nt, Homo Sapiens
ucuucucugcuggcuggggcucucuucauuguuagaaaccaaaguuauuuguguuaucuuuauu

SEQ ID NO: 478886 - RNA, 64 nt, Homo Sapiens
augaaugaaccccuggcuccaagaugccugaucagaaaccaaccugccuccauuauccauuccc

SEQ ID NO: 478887 - RNA, 64 nt, Homo Sapiens
aaaccgugcgcugugacccaucuguguucccgcggaaaccaaccagaucccgccccuccugucc

SEQ ID NO: 478888 - RNA, 64 nt, Homo Sapiens
gucagaaggauguaugaugaccccuuccugggaggaaaccaauuagaaguaagcucugcauguu

SEQ ID NO: 478889 - RNA, 64 nt, Homo Sapiens
ccuuggaagcaagugggguguggaugucacuuuggaaaccaagcuuccccaaccucuuacaccc

SEQ ID NO: 478890 - RNA, 64 nt, Homo Sapiens
accaccuuucauguuuuugauugcccuacaaagagaaaccaaaugagcugauuacugacuauaa

SEQ ID NO: 478891 - RNA, 64 nt, Homo Sapiens
uauaguggucacugugauauaauaaaucauaaaggaaaccaaaucacaaaggagaugguguggc

SEQ ID NO: 478892 - RNA, 64 nt, Homo Sapiens; identical to SEQ ID NO: 82054

SEQ ID NO: 478893 - RNA, 64 nt, Homo Sapiens; identical to SEQ ID NO: 82055

SEQ ID NO: 478894 - RNA, 64 nt, Homo Sapiens
uuuuuaaaaagaaacuauuuuuguguuugaaagugaaaccaacauccagaucuauagcagaguc

SEQ ID NO: 478895 - RNA, 64 nt, Homo Sapiens
aauugaaagcaacacuaauauagagccacuuccugaaaccaagaaucuguaguuuugauccaaa

SEQ ID NO: 478896 - RNA, 64 nt, Homo Sapiens
uguuccaucauuucuagcuaaaacuccauuuggugaaaccaacauauccauuucuuuuccuagu

SEQ ID NO: 478897 - RNA, 64 nt, Homo Sapiens
acaaccgugggggaacacaccacuuuuuacuguugaaaccaacacaacguugaaauccaggcuu

SEQ ID NO: 478898 - RNA, 64 nt, Homo Sapiens
ggcccuucugaaacuuauggucaucucucccacugaaaccaaggucuuuucaaauguggcuaaa

SEQ ID NO: 478899 - RNA, 64 nt, Homo Sapiens
acccuucagugcuacauuuuguggcuuuuuaauggaaaccaagccaauguuauagacguuugga

SEQ ID NO: 478900 - RNA, 64 nt, Homo Sapiens
accuggcaccacuuucaagagcuggauggaacaggaaaccaaucggccccuggcuccggagaau

SEQ ID NO: 478901 - RNA, 64 nt, Homo Sapiens
aagaaggcuuaguagcucagaaauaggaaauguagaaaccaagcugugugugugugugcacaau

SEQ ID NO: 478902 - RNA, 64 nt, Homo Sapiens
uuuuaaaaugaagugucaagaaaacacaucaguagaaaccaagacgagcuugucagcuuuuuug

SEQ ID NO: 478903 - RNA, 64 nt, Homo Sapiens
cuauuuaacugugaacuauguauuuagaaagacugaaaccaagagcauccuuauauaauaaugc

SEQ ID NO: 478904 - RNA, 64 nt, Homo Sapiens
ccugcucucuccuaaggcucucuguuacacaugugaaaccaaagcagacugccagcagcacccg

SEQ ID NO: 478905 - RNA, 64 nt, Homo Sapiens
guacaaacuguguugucuuuaacugaaaaaauaugaaaccaaaaauuauguuuuuacugaaauu

SEQ ID NO: 478906 - RNA, 64 nt, Homo Sapiens
aacacucuguacugugugcgucuagugaaugugugaaaccaagauauuuaacaauagcaauagu

SEQ ID NO: 478907 - RNA, 64 nt, Homo Sapiens
cuuaccaggucuuggacuguuuuccaaauaaaaagaaaccaacuaugaaaguugaccauaguua

SEQ ID NO: 478908 - RNA, 64 nt, Homo Sapiens
ccacuuuuguuuauaagacccguuaguuacaaaggaaaccaaugggauuccaaaugaaccccug

SEQ ID NO: 478909 - RNA, 64 nt, Homo Sapiens
ugauacacacuuucaugaugauuccuuuuauagagaaaccaaccccagcucuaguucagcuaua

SEQ ID NO: 478910 - RNA, 64 nt, Homo Sapiens
aacaucagacaucauugcguccuguuacacuauggaaaccaagauuaauugaaaugucaaguuu

SEQ ID NO: 478911 - RNA, 64 nt, Homo Sapiens
agcaagcccuugaugaccaaguuguuuuacagcugaaaccaaccuguuuuuuguuguuguuguu

SEQ ID NO: 478912 - RNA, 64 nt, Homo Sapiens
cgcccgacgcagacgcggugcgaagcagccuccugaaaccaaaaggcccccgggggccccgccc

SEQ ID NO: 478913 - RNA, 64 nt, Homo Sapiens
gggaugcuaacuacaacauguuaguucaucaaaggaaaccaacccuagcucuagccuguaccag

SEQ ID NO: 478914 - RNA, 64 nt, Homo Sapiens
caggccaggugggcggacaacaacgagauugcuggaaaccaaguuccccacagacugccccagc

SEQ ID NO: 478915 - RNA, 64 nt, Homo Sapiens
aaaaccauuuucagggagcucagggaacggggaggaaaccaaagccaaaccugugaccccaggc

SEQ ID NO: 478916 - RNA, 64 nt, Homo Sapiens
ucaccuaggauuggcuauucugagggauugcauagaaaccaagcuccacuugcuguccuuggga

SEQ ID NO: 478917 - RNA, 64 nt, Homo Sapiens
uuugcuaaauauguacaugaacaggcacauguaagaaaccaaaacauaaugaauuacagucaug

SEQ ID NO: 478918 - RNA, 64 nt, Homo Sapiens
ucuuacccuugcccuagauuacuauauauacacggaaaccaauuacaucuguucccaccaacuu

SEQ ID NO: 478919 - RNA, 64 nt, Homo Sapiens
cccccguccggcuuccuugguggaggccgucuaggaaaccaaaaacucccaggaugccccggug

SEQ ID NO: 478920 - RNA, 64 nt, Homo Sapiens
aaaggagaaguggggcagcugcaggacauguagagaaaccaaacugggaaaucuuacaaggagu

SEQ ID NO: 478921 - RNA, 64 nt, Homo Sapiens
cuccaguuuaaaaaguguuauuuuuaaaacauuugaaaccaaguacuguuuaauuucaaucaga

SEQ ID NO: 478922 - RNA, 64 nt, Homo Sapiens
ugcuucagccccagguguggugacuuagaccuaggaaaccaauuaugaguggaaagugacccuc

SEQ ID NO: 478923 - RNA, 64 nt, Homo Sapiens
aacaaaaugccaguauuuucuuaagccaugaugugaaaccaaugacccugugaccacauggcac

SEQ ID NO: 478924 - RNA, 64 nt, Homo Sapiens
aacguccugaccugugaucacacaugacagugaggaaaccaagugcaacuccuggguuuuuuua

SEQ ID NO: 478925 - RNA, 64 nt, Homo Sapiens
gauauugcucuauauuuuuuuccauuuaucuguggaaaccaacaaaauuucauuuuuuccuuuu

SEQ ID NO: 478926 - RNA, 64 nt, Homo Sapiens; identical to SEQ ID NO: 82056

SEQ ID NO: 478927 - RNA, 64 nt, Homo Sapiens; identical to SEQ ID NO: 82057

SEQ ID NO: 478928 - RNA, 64 nt, Homo Sapiens
cauguaggaaaauauugguauuauuaguuaaaaggaaaccaaggcaacuaaauuuacccuuuac

SEQ ID NO: 478929 - RNA, 64 nt, Homo Sapiens
aaaaaucgcauuucaacccugggacaggucccuggaaaccaaagaaccuuggagugagagccca

SEQ ID NO: 478930 - RNA, 64 nt, Homo Sapiens
gugaacacaucaacaccacguuaaagaugcuuuggaaaccaaccacggggaacuauagcaauau

SEQ ID NO: 478931 - RNA, 64 nt, Homo Sapiens
gugaacuuccugucucccaccccacuuuggcccagaaaccaaaucuccccaccaccccuccugc

SEQ ID NO: 478932 - RNA, 64 nt, Homo Sapiens
uacaaacacaauauuuaaucccaugaucuccaaagaaaccaaaaggcaauuuaacgagccacuu

SEQ ID NO: 478933 - RNA, 64 nt, Homo Sapiens
ucaugugggcuugccuucucugccaaacgacugggaaaccaaaaugagcccaccuuguguucuu

SEQ ID NO: 478934 - RNA, 64 nt, Homo Sapiens
gagagaaagucaaauaaagucaaagaccaguuuggaaaccaaaguuggaaaagaagaauuguag

SEQ ID NO: 478935 - RNA, 64 nt, Homo Sapiens
agaaacacccuaaucuagauaaaggucuguuucagaaaccaacagugauggcauucuaaagagu

SEQ ID NO: 478936 - RNA, 64 nt, Homo Sapiens
gguuggagacuucaaccgggcaaaggagcacaaggaaaccaagcagcagaggccccaucagcac

SEQ ID NO: 478937 - RNA, 64 nt, Homo Sapiens
aaauauaguuuauaaaucggcaguacgguauuaugaaaccaagaaaggguuucuugaaaagcuu

SEQ ID NO: 478938 - RNA, 64 nt, Homo Sapiens
gaaaacggcacaccaaucaauaaagaacugagcagaaaccaacagugugcuuuuaauaaaggau

SEQ ID NO: 478939 - RNA, 64 nt, Homo Sapiens
cuaucugggucucuuauuucaccuaauaaagcaagaaaccaagcaucacugcuccuuauaauaa

SEQ ID NO: 478940 - RNA, 64 nt, Homo Sapiens
aagaauaaaugagagauauuuauucuuacauauagaaaccaaguauaaacuauuuaaaucaaaa

SEQ ID NO: 478941 - RNA, 64 nt, Homo Sapiens
uacaaguauucaguuccaauauguacacaacuuagaaaccaaauauuuauaaaugcacuguaau

SEQ ID NO: 478942 - RNA, 64 nt, Homo Sapiens
auacugcacucuaauauuuugauagaaaucauuagaaaccaagcuuuaaauaaaacuucuuuug

SEQ ID NO: 478943 - RNA, 64 nt, Homo Sapiens
acuuagcucaccugcauucuauuuauaguccaaagaaaccaaaguuugaagaaaaaaaagcguu

SEQ ID NO: 478944 - RNA, 64 nt, Homo Sapiens
agauucaugaaaccuuggccgguuugcaugguaugaaaccaaauuguagcagcacacuuguuca

SEQ ID NO: 478945 - RNA, 64 nt, Homo Sapiens
cugcugacaccucaaucuuaagggggccucagaggaaaccaaccgaauagccaucgacaaacua

SEQ ID NO: 478946 - RNA, 64 nt, Homo Sapiens
uuaugaagaucuucucccagggccugccuuaucagaaaccaagcugagcuguagcauuugggcu

SEQ ID NO: 478947 - RNA, 64 nt, Homo Sapiens
acuuuacauuuuuauuuuuacagaggaaagaauggaaaccaaucauuggcaccaaguuaggucu

SEQ ID NO: 478948 - RNA, 64 nt, Homo Sapiens
caucaacgcacaccugcuaucguggaacagccuagaaaccaagggacuccaccaccaagucacu

SEQ ID NO: 478949 - RNA, 64 nt, Homo Sapiens
cgccagcugauuggaugucuaggaaugacugaaagaaaccaaaacagccuguccacugcugcug

SEQ ID NO: 478950 - RNA, 64 nt, Homo Sapiens
cuugcccuggggccgguucuuacccagguccagagaaaccaacgcgggaugucagacuucacca

SEQ ID NO: 478951 - RNA, 64 nt, Homo Sapiens
gucaguaccccugguaaaccaagccucccacacugaaaccaaaacauaaaaaccaaacccagac

SEQ ID NO: 478952 - RNA, 64 nt, Homo Sapiens
uggccgucugcaagccgaggagggggccucaggagaaaccaacccugcaaucaccuugaucuug

SEQ ID NO: 478953 - RNA, 64 nt, Homo Sapiens; identical to SEQ ID NO: 82058

SEQ ID NO: 478954 - RNA, 64 nt, Homo Sapiens; identical to SEQ ID NO: 82059

SEQ ID NO: 478955 - RNA, 64 nt, Homo Sapiens
uuaguggauuuaccuguagaguuuauuggauccugaaaccaaucaauuacuuagaacuaggcaa

SEQ ID NO: 478956 - RNA, 64 nt, Homo Sapiens
ugugacagucacugcauuugccugcuucuuuccagaaaccaaacuaggagaugaaacugguucc

SEQ ID NO: 478957 - RNA, 64 nt, Homo Sapiens
caccaagucucgucuucuuuccuuccugugaguugaaaccaaacaggccucucgcucacuccuc

SEQ ID NO: 478958 - RNA, 57 nt, Homo Sapiens
ccgaagucaacaacaagcaaggaguccgaaaccaaguuagucugcagaugccucuaa

SEQ ID NO: 478959 - RNA, 64 nt, Homo Sapiens
agcugcaaaguggagucuggauuccucaccccgggaaaccaaggcaaccacaaagguguuugug

SEQ ID NO: 478960 - RNA, 64 nt, Homo Sapiens
ugucuccugggggggagaaauaugggagggguuggaaaccaaguuuuaacuuaaucaaaugugg

SEQ ID NO: 478961 - RNA, 64 nt, Homo Sapiens
ccuucccauuuccuccucccgccaaaagcacucugaaaccaagaguuuggccacccucuggcca

SEQ ID NO: 478962 - RNA, 63 nt, Homo Sapiens
aaaaaugaguuguucaucaguaaaacacugaaaagaaaccaacaaauuguauauuuugaaaaa

SEQ ID NO: 478963 - RNA, 64 nt, Homo Sapiens
aaccagacccgaaaccaggcuaggaaccagaccugaaaccaaggaaggcagguagccuggcgcc

SEQ ID NO: 478964 - RNA, 64 nt, Homo Sapiens
cagaaucagaaaaaaaaagcauuaaaauuuauuugaaaccaaaaaagagcccaaaaagccaaag

SEQ ID NO: 478965 - RNA, 64 nt, Homo Sapiens
uuuccaguuuuauggaauugggagucugacaagugaaaccaauuuaauguaaaguauuuggcuu

SEQ ID NO: 478966 - RNA, 64 nt, Homo Sapiens
agaaccccuuuuaucccuggaagaggcuguguaugaaaccaaugcccaggguuugaaggguguu

SEQ ID NO: 478967 - RNA, 64 nt, Homo Sapiens
ucuuuuucagcuuuauuuuuaagaguacagucaggaaaccaacaaggggccuaagaguggcugc

SEQ ID NO: 478968 - RNA, 64 nt, Homo Sapiens
uccaacuccaaagccauaaauaaucaccauuuuugaaaccaaaccagagccugaguguugccua

SEQ ID NO: 478969 - RNA, 64 nt, Homo Sapiens
gguuaaaauuuauagucauucuaacugcacuuuggaaaccaagcaaggggagaagacaaaugaa

SEQ ID NO: 478970 - RNA, 64 nt, Homo Sapiens
ggucaagcaauaggcgccuggcagugucaagccugaaaccaagcaauaccgucauguuucagcc

SEQ ID NO: 478971 - RNA, 64 nt, Homo Sapiens
uauccagaggccugcugcagauggggaagagcuggaaaccaagaaguuugucaacagaggaccc

SEQ ID NO: 478972 - RNA, 64 nt, Homo Sapiens
aaaaaaagucauuaggcuuucccuuugugucagugaaaccaaaagugcuucuuacaacguucgc

SEQ ID NO: 478973 - RNA, 64 nt, Homo Sapiens
gauuugguugccauagucauaagcaaugauacaugaaaccaaugaaagacaguacauguaauaa

SEQ ID NO: 478974 - RNA, 64 nt, Homo Sapiens
agaacauauuugcauaagauagcuauuuacucuggaaaccaacaacuuuugagauuucccuugc

SEQ ID NO: 478975 - RNA, 64 nt, Homo Sapiens
aauuagugcaaauacaagcugcguuucuuuaauagaaaccaaaggcaucuggagcccgagaggc

SEQ ID NO: 478976 - RNA, 64 nt, Homo Sapiens
uuuccuagccagcugggggacacuggaaauucgggaaaccaagagagaggaagaaggagacgcc

SEQ ID NO: 478977 - RNA, 64 nt, Homo Sapiens
gcaggcugagcaagucuguaaacugauucugggagaaaccaagcugcuggccauaggguguccu

SEQ ID NO: 478978 - RNA, 64 nt, Homo Sapiens
cagagcugaggggacagggaccuuugucaguggggaaaccaaggcacaggacagcagaagaucc

SEQ ID NO: 478979 - RNA, 64 nt, Homo Sapiens
ucacccuggcugggagcaucguauguuucugguggaaaccaaguccuucccuuauuucuaacgu

SEQ ID NO: 478980 - RNA, 64 nt, Homo Sapiens
ggcucauggagaaaacaaaugacuuagggaacuugaaaccaacucugccgcaagaccacuacau

SEQ ID NO: 478981 - RNA, 64 nt, Homo Sapiens
ucuaagaggacuggauugcaaucucccaaagagagaaaccaauucuggcugccucugagucuga

SEQ ID NO: 478982 - RNA, 64 nt, Homo Sapiens
aacacuacuauuaaacugcacuaugguugaaucagaaaccaagacgacgguagaguucuuucau

SEQ ID NO: 478983 - RNA, 64 nt, Homo Sapiens
augggaaguggcuccuagggcauccagccuguaggaaaccaaagacaaggcuuccaggggaugc

SEQ ID NO: 478984 - RNA, 64 nt, Homo Sapiens
aaaacccccuaagugagggauaagauuugagggugaaaccaaagcugcacuucuagcccucauu

SEQ ID NO: 478985 - RNA, 64 nt, Homo Sapiens
gcuagggaaacagauacucucuguacauaaaguagaaaccaaaacuuagcaagauauuuuaucu

SEQ ID NO: 478986 - RNA, 64 nt, Homo Sapiens
uucuuuuuuauacucaaucacacccucauacacagaaaccaauuagauaaagaccuuuuccaug

SEQ ID NO: 478987 - RNA, 64 nt, Homo Sapiens
caacuuuucaccuccugaguaacaaaaacaccaagaaaccaaguccucucacugccugccagaa

SEQ ID NO: 478988 - RNA, 64 nt, Homo Sapiens
gggcugguauucucucuaugauaauaaaaaacaagaaaccaaguuauaguccuagcugacgcca

SEQ ID NO: 478989 - RNA, 64 nt, Homo Sapiens
cuuauauuaaaaggcaaagacacucagaaaugaugaaaccaaauuuuuuagaagaaauauguua

SEQ ID NO: 478990 - RNA, 64 nt, Homo Sapiens
ugauuccuuccaacgugcacuucagcuggagaaagaaaccaagaagggaagcggccgcugggcc

SEQ ID NO: 478991 - RNA, 64 nt, Homo Sapiens
guuuggucagacaucaucuccuuggcugcccuuugaaaccaaaucacuugccuuggggauaaag

SEQ ID NO: 478992 - RNA, 64 nt, Homo Sapiens
auaugacguacgaaauggacaaaaagcuuuuucugaaaccaacuuuuuacuuccaucauccuuu

SEQ ID NO: 478993 - RNA, 64 nt, Homo Sapiens
uuuuuaguuauuguucaaggauuuucacagaguggaaaccaauugugauaggcuuaaagauugu

SEQ ID NO: 478994 - RNA, 64 nt, Homo Sapiens
acaaacauuuuuaaaauuaauaacauggaacaaugaaaccaacagaggccgauuuuuuuuuuuu

SEQ ID NO: 478995 - RNA, 64 nt, Homo Sapiens
agucccagugaucuguuaccgcuugccucuuugagaaaccaaggagccgggcaggguggaagga

SEQ ID NO: 478996 - RNA, 64 nt, Homo Sapiens
uugccaggggugaggccgugccccaggccuccccgaaaccaaaggggaaggcagggguggggcc

SEQ ID NO: 478997 - RNA, 64 nt, Homo Sapiens
gcuaggggcccgccccgcggacugacagcaccaggaaaccaaaugaugucccugcccgccgccc

SEQ ID NO: 478998 - RNA, 64 nt, Homo Sapiens
accuucgaaaacaugguaggacucacacuggauagaaaccaaagcaggugaaucaccugagguc

SEQ ID NO: 478999 - RNA, 64 nt, Homo Sapiens
cucccacugccgcucaggggcugacccuauuuaggaaaccaaagaggguggguugaaccuacuc

SEQ ID NO: 479000 - RNA, 64 nt, Homo Sapiens
cucugggucccccuucucuguccacccacagagugaaaccaauuaaaauguuggaucucauuua

SEQ ID NO: 479001 - RNA, 64 nt, Homo Sapiens
cuuggagcacugagcaccauuuggaagcuugagagaaaccaaaauuaaagagagaaagagagag

SEQ ID NO: 479002 - RNA, 64 nt, Homo Sapiens
cuugccucaagcaaaagcauucguaagaucuuaagaaaccaaucgcccagcauucagggaggag

SEQ ID NO: 479003 - RNA, 64 nt, Homo Sapiens
cugucuccaccuugauauuguauggccuccagaggaaaccaaccccuggaacagaugcuuucau

SEQ ID NO: 479004 - RNA, 64 nt, Homo Sapiens
gggggaugucagccucaccccccugcuccaggaugaaaccaagaugcagagggagccuccugcu

SEQ ID NO: 479005 - RNA, 64 nt, Homo Sapiens
cuaauaaaguuuucccaucccguggccgaagcuggaaaccaaaccucggggcgggcggagcccg

SEQ ID NO: 479006 - RNA, 64 nt, Homo Sapiens
agagacugaucauccaggccuuuuaaaugaucaugaaaccaaaaaaauguuugucuuuucuguu

SEQ ID NO: 479007 - RNA, 64 nt, Homo Sapiens
aaaaaaaucaaucagaauaagggugguuuauccagaaaccaagauuuauuauccuguccccaga

SEQ ID NO: 479008 - RNA, 64 nt, Homo Sapiens
ugcuccaugccggguuauuucgugcaauaggguggaaaccaaacuucauaaccaggccggacca

SEQ ID NO: 479009 - RNA, 64 nt, Homo Sapiens
uggaagcccccucugccuccgaagggggugcccugaaaccaaacgcaggcggguggggggaugg

SEQ ID NO: 479010 - RNA, 64 nt, Homo Sapiens
cagcugcuguuaauauggauaauaaauguauugugaaaccaaaauacuguauguugcuuuucua

SEQ ID NO: 479011 - RNA, 64 nt, Homo Sapiens
ugcagccucaacaccauggaucuguaaaaugugugaaaccaaacacugauugcugucucgugug

SEQ ID NO: 479012 - RNA, 64 nt, Homo Sapiens
cagucuucuauaaucugggguugauuuuacuucagaaaccaaauaaggcaggaaggauccugcc

SEQ ID NO: 479013 - RNA, 64 nt, Homo Sapiens
auuaaaacuuaacagcaucaaauuauugggaccagaaaccaaguaauguauaauguggcuuuug

SEQ ID NO: 479014 - RNA, 64 nt, Homo Sapiens
gcccuuccaacucuggagugucuguaguucuugugaaaccaaaacguugacuaccugccucuuu

SEQ ID NO: 479015 - RNA, 64 nt, Homo Sapiens
cugaagccuggauuccagcagugaaugcuagacagaaaccaagccauuaaugagauguuauuac

SEQ ID NO: 479016 - RNA, 64 nt, Homo Sapiens
acuuuauuacgaguaaaguguaaugaguacuguggaaaccaaauuugaauacugcaaauuugua

SEQ ID NO: 479017 - RNA, 64 nt, Homo Sapiens
uacaaacagggcagaaccacagaagaacguuuuagaaaccaagagaugugcagaaagaaauguu

SEQ ID NO: 479018 - RNA, 64 nt, Homo Sapiens; identical to SEQ ID NO: 82060

SEQ ID NO: 479019 - RNA, 64 nt, Homo Sapiens; identical to SEQ ID NO: 82061

SEQ ID NO: 479020 - RNA, 64 nt, Homo Sapiens
uccucgaguggccacugugagccucgucacagcagaaaccaacuuuucuaacgacugaguucgc

SEQ ID NO: 479021 - RNA, 64 nt, Homo Sapiens
acaacaaaauggcuuguugcuaguccagacuuuagaaaccaaacuuuuacuggcaguucuauag

SEQ ID NO: 479022 - RNA, 64 nt, Homo Sapiens
cugcacaccuagaaccccaagagaggccaaaagggaaaccaagggaugaugccuaggcccaaag

SEQ ID NO: 479023 - RNA, 64 nt, Homo Sapiens
ucauguucuucuaaagugucgaggucuugcuuuugaaaccaaaagccccuucugccuuccagga

SEQ ID NO: 479024 - RNA, 64 nt, Homo Sapiens
cuaagagaugagcgaugccuacuucacagaugaggaaaccaaggggagaaagagaauuaucccc

SEQ ID NO: 479025 - RNA, 64 nt, Homo Sapiens
augauaaugauaccaaaggaaagauaauuaucaugaaaccaacuuuuggaucauucccuuuuua

SEQ ID NO: 479026 - RNA, 64 nt, Homo Sapiens
ccacacaacaucaagaaggccgacaaccagguuggaaaccaagacggagcucagacccaccaca

SEQ ID NO: 479027 - RNA, 64 nt, Homo Sapiens
cuuggggcagccauuggccucugucucguuuugggaaaccaaggucaggaggccguugcagaca

SEQ ID NO: 479028 - RNA, 64 nt, Homo Sapiens
guaauaauuguggaaauguuacuucugauuuagugaaaccaauuaguagagauaauguguaguc

SEQ ID NO: 479029 - RNA, 64 nt, Homo Sapiens
gaacgggaccugcuggccuccauuggagccuagugaaaccaaauaagaacucaaauuccuuucu

SEQ ID NO: 479030 - RNA, 64 nt, Homo Sapiens
aagaaacuucgccuuaucagucaccggguguuccgaaaccaaaguuccagaggaugcaucuggc

SEQ ID NO: 479031 - RNA, 64 nt, Homo Sapiens
agucugcuguccugaaacccagaagugauggagagaaaccaacaagagaucucgaacccugucu

SEQ ID NO: 479032 - RNA, 64 nt, Homo Sapiens
gcaccuacugggugcuggguucacuguguccuaggaaaccaagaggguccccaguccuggccuc

SEQ ID NO: 479033 - RNA, 64 nt, Homo Sapiens
gcugguaccugcuggcccauggcccggguguagagaaaccaagcggcagccaccaccaguguug

SEQ ID NO: 479034 - RNA, 64 nt, Homo Sapiens
caucugcauguuuauuuccucaaguuaugcgaaggaaaccaagcuuaugcuaccuaccccugua

SEQ ID NO: 479035 - RNA, 64 nt, Homo Sapiens
auuuaagacgggcugcucuucuccugguuggaaagaaaccaaaggcucuuucuaccaauguuug

SEQ ID NO: 479036 - RNA, 64 nt, Homo Sapiens
cuguaggaacuugacuugcguuagaguguacucugaaaccaacucgucucuggccgcaggaguc

SEQ ID NO: 479037 - RNA, 64 nt, Homo Sapiens
gaaagaagguuuaucauuacaaauaccuuccaaugaaaccaagaauuucucaaaauauuuaaug

SEQ ID NO: 479038 - RNA, 64 nt, Homo Sapiens
caaaaucaguuuuuauauuccccaaaagaagaaggaaaccaaggaguagcuauauauuucuacu

SEQ ID NO: 479039 - RNA, 64 nt, Homo Sapiens
caacuauagguuuaaaccaagacaaaugaagacugaaaccaagaauauuguucuuaugcuggaa

SEQ ID NO: 479040 - RNA, 64 nt, Homo Sapiens
gaaugggagggcgggccuggagcugcgugagagugaaaccaagaagcggauggggaagggagag

SEQ ID NO: 479041 - RNA, 64 nt, Homo Sapiens
uauaaagugccucggacaguccgcaguuguagcagaaaccaacaagaaccacuccuucauguuu

SEQ ID NO: 479042 - RNA, 64 nt, Homo Sapiens
agucauaugccuccagccauuauaugagaacugugaaaccaauaugguuuucuuuaugucuugg

SEQ ID NO: 479043 - RNA, 64 nt, Homo Sapiens
auuauuucuuaucuuucuucuuuuauauuuuuuggaaaccaaauuuauaguuaguuuagguaaa

SEQ ID NO: 479044 - RNA, 64 nt, Homo Sapiens
caccaaaaaaaguauauagugacauuuuuaguaugaaaccaaauuacacuaaggucuuuuguug

SEQ ID NO: 479045 - RNA, 64 nt, Homo Sapiens
ugcauagaaggaggagagggaaaauguuuuguaagaaaccaaucaagauaaaggacagugaagu

SEQ ID NO: 479046 - RNA, 64 nt, Homo Sapiens
aauaaaauuuccccuaaucuuuucugaaucuucugaaaccaaauguaacuauguuuuaucgucc

SEQ ID NO: 479047 - RNA, 64 nt, Homo Sapiens
uuaaauuucuuaaccuaggcuucagggagcauaugaaaccaaaauuauauggaacauuuucugu

SEQ ID NO: 479048 - RNA, 64 nt, Homo Sapiens
uguagaacuguaauaagugaauuacaggucacaugaaaccaaaacgggcccugcuccauaagag

SEQ ID NO: 479049 - RNA, 64 nt, Homo Sapiens
acuagugcagcauuucagcaaaaccugguuuuaugaaaccaaagaacucuuaaauuauaaugug

SEQ ID NO: 479050 - RNA, 64 nt, Homo Sapiens
cauuacaccaugguuuuuaguauuauuacaagaagaaaccaagaagcuaauuaagggcgaugau

SEQ ID NO: 479051 - RNA, 64 nt, Homo Sapiens
uggacaaauccucaccaccauaauuaaacauggagaaaccaaaucagaggagggugaggaagac

SEQ ID NO: 479052 - RNA, 64 nt, Homo Sapiens
ccacuucuuucuaggagauuaaaugucccccugagaaaccaaucauuucaacauagagucacau

SEQ ID NO: 479053 - RNA, 64 nt, Homo Sapiens
cacagagaggcucuccucucgaaugcacaaaugggaaaccaagggugaggccugcagaggcccu

SEQ ID NO: 479054 - RNA, 61 nt, Homo Sapiens
uggacaaaucaucaccacugucacacauggagaaaccaaauaggacaguggggaggauuag

SEQ ID NO: 479055 - RNA, 61 nt, Homo Sapiens
uggacaaauccucacuaccaucaaacauggagaaaccaaauaggaggguggggaggacuag

SEQ ID NO: 479056 - RNA, 64 nt, Homo Sapiens
cccaugagcagcaguggaaguggugagggcucuagaaaccaagcaacugaggaaggugcuuaga

SEQ ID NO: 479057 - RNA, 64 nt, Homo Sapiens
caugaaaauuauggaagacuuuagccagaauaaagaaaccaaauugaaacuuugggaauuugcu

SEQ ID NO: 479058 - RNA, 64 nt, Homo Sapiens
aauuauuauuucuuaucuucuuuuauauuuuuuggaaaccaaauuuauaguuaguuuagguaaa

SEQ ID NO: 479059 - RNA, 64 nt, Homo Sapiens
augugugaacuugacuuguguuagaguauauucugaaaccaacuugucccaggccacaggagug

SEQ ID NO: 479060 - RNA, 65 nt, Homo Sapiens
caggacgucaaaaacucaccauggaccccaaggcagaaaccaagaacugucugcaggcaaauaag

SEQ ID NO: 479061 - RNA, 65 nt, Homo Sapiens
ggaugcuuaauggugcuagaggcucaaguguguuugaaaccaagagccaguugucccccaugcag

SEQ ID NO: 479062 - RNA, 65 nt, Homo Sapiens
ccucagccucugcaacugcaagaaaggggacccaagaaaccaaagucugccgcccaccucgcucc

SEQ ID NO: 479063 - RNA, 65 nt, Homo Sapiens
auauuaaguguucucaacugaguaacuuuuaaguggaaaccaaguuuagauuuggggagugguaa

SEQ ID NO: 479064 - RNA, 65 nt, Homo Sapiens
agacuuugucuaagccucauuauacugaaguugaagaaaccaaaugagcuccacccucacuuugc

SEQ ID NO: 479065 - RNA, 65 nt, Homo Sapiens
uaaaaauuuauuaaauauaaauauccccagggacagaaaccaaggccccgagcucagggcagcug

SEQ ID NO: 479066 - RNA, 65 nt, Homo Sapiens
gaagucaauugaguaaggacaccuccagccauacagaaaccaacacugugugggggccaaggucu

SEQ ID NO: 479067 - RNA, 65 nt, Homo Sapiens
cgggagagcgaugcuuggauuuuuguuuccuauuagaaaccaacaguuuuguucuaauuucauuu

SEQ ID NO: 479068 - RNA, 65 nt, Homo Sapiens
uugaagcucccagugaccuggagggaggauuccuggaaaccaaacaaucaguuuaggugcaggug

SEQ ID NO: 479069 - RNA, 65 nt, Homo Sapiens
uuucaucagguaucuuucuguggcauuugagaacagaaaccaagaaacaugguaauuacuaaauu

SEQ ID NO: 479070 - RNA, 65 nt, Homo Sapiens
aucccuuuucuauaaaaaauaaguuaaugugucaagaaaccaacucuauuaaggugggguuuaau

SEQ ID NO: 479071 - RNA, 65 nt, Homo Sapiens
acauugcugauugguguuaaguugcuagacacugcgaaaccaagcugacucacaagaagaccucu

SEQ ID NO: 479072 - RNA, 65 nt, Homo Sapiens
gguuuucgcacuucuuggcugguccagggacugcagaaaccaaagcugcuauuguugaggaauaa

SEQ ID NO: 479073 - RNA, 65 nt, Homo Sapiens
caauuauguuaauaauuuauuuaaugagugguauggaaaccaauugauuuuuuuagauaaaagaa

SEQ ID NO: 479074 - RNA, 65 nt, Homo Sapiens
cccccacucccacuuccaggauugugguuuggauugaaaccaaguuuacaaguagacaccccugg

SEQ ID NO: 479075 - RNA, 65 nt, Homo Sapiens
gucaaaugauugccaucagaaagagacaacuugaagaaaccaacaaugacuaugaaacagcugac

SEQ ID NO: 479076 - RNA, 65 nt, Homo Sapiens
auuuucacccauucugugguucauuguaguuuaaggaaaccaagcauauagaugcauuagugauu

SEQ ID NO: 479077 - RNA, 65 nt, Homo Sapiens
guuucaccuuuguauaagauauagccaagacugaagaaaccaaauauauguguuuacuguagcau

SEQ ID NO: 479078 - RNA, 65 nt, Homo Sapiens
uauauauauuauuuuuuuuuaagaaaggaggaaaagaaaccaaaaguuuuuuuuaagaaaaaaaa

SEQ ID NO: 479079 - RNA, 65 nt, Homo Sapiens
gugcugccuucauccuccccaccuaaugcauuuuugaaaccaaagguaccuagccucagagacag

SEQ ID NO: 479080 - RNA, 65 nt, Homo Sapiens
cgaaaauauuuccugauucaagauucuauaaaaaggaaaccaagcauaagacucugucaucauac

SEQ ID NO: 479081 - RNA, 65 nt, Homo Sapiens
gcacaauucccauugagagaccuucacuuauugcugaaaccaagaaaaagggcaagaucuuuuuu

SEQ ID NO: 479082 - RNA, 65 nt, Homo Sapiens
aaggccagcaccuccgucggcacacggggcagagagaaaccaaccaucccccaggacuugaugac

SEQ ID NO: 479083 - RNA, 65 nt, Homo Sapiens
cucaaaaaacagucuccuaaauugcuuaaaaugaugaaaccaaccgauguuuaaaacaucaacac

SEQ ID NO: 479084 - RNA, 65 nt, Homo Sapiens
gcgcuuugcaauauuuauuaugacuugaaaagaaagaaaccaagugggacauuagucguuauauu

SEQ ID NO: 479085 - RNA, 65 nt, Homo Sapiens
ccuucuagauucaggugacucccuuccaguuaugagaaaccaaugguccuuagaagucccauucu

SEQ ID NO: 479086 - RNA, 65 nt, Homo Sapiens
guauguguuuuaaaauuacauuaauauaggauuuagaaaccaaggguuuacaauuaggcuauuuu

SEQ ID NO: 479087 - RNA, 65 nt, Homo Sapiens
acaggcacccaagcacuacccugguuccagugagagaaaccaacccaggcgaguggggcccagga

SEQ ID NO: 479088 - RNA, 65 nt, Homo Sapiens
cagaugagaugacugccaugagagggaaagugacggaaaccaagucuccuucgagcuugacucug

SEQ ID NO: 479089 - RNA, 65 nt, Homo Sapiens
cuguguaucuaauacuaaccggguauuucagcuuugaaaccaaaugagaagauuuauuccaccag

SEQ ID NO: 479090 - RNA, 65 nt, Homo Sapiens
aaauacaaaauccuucuccaggaacaccugauggugaaaccaaaccgaaacugacuugcucaccu

SEQ ID NO: 479091 - RNA, 65 nt, Homo Sapiens
gggagucucccaugauggggcuucaugaugagauggaaaccaaaaacgccgcguggacugaagcu

SEQ ID NO: 479092 - RNA, 65 nt, Homo Sapiens
aguugaguuuccaauggaacuauaucacaauuuacgaaaccaaaauuacaguauacauauauauu

SEQ ID NO: 479093 - RNA, 65 nt, Homo Sapiens
cugagcuuuuaacuuucucccccuaacuugggccagaaaccaaagaaggcuaaccuuucuaagcu

SEQ ID NO: 479094 - RNA, 65 nt, Homo Sapiens
cccugcugagcagagccauuucuacagagauccaggaaaccaaaggggaaacuuacauguugaga

SEQ ID NO: 479095 - RNA, 65 nt, Homo Sapiens
aaucugugugacuugcuuuaacuuauaugcacugggaaaccaaaaucgacuugaguguaaacaua

SEQ ID NO: 479096 - RNA, 65 nt, Homo Sapiens
agaauuagggaugggaauacuuuuuuuuucuucuggaaaccaaguugagauagucuuauucugau

SEQ ID NO: 479097 - RNA, 65 nt, Homo Sapiens
uaaccuuuugcaccugcucuuuucucuacuuugaggaaaccaaagcguuucuucccuguauuuuc

SEQ ID NO: 479098 - RNA, 65 nt, Homo Sapiens
ucaauuuagagguauggaugugucggugaauaaaugaaaccaaucuuucauuauguguucuacag

SEQ ID NO: 479099 - RNA, 65 nt, Homo Sapiens
uacugcauccuucaacucucacuagaaaaucuuuugaaaccaaauggauuaauuuauggcuauuu

SEQ ID NO: 479100 - RNA, 65 nt, Homo Sapiens
aacugaagaugauguaugaaggaguuggaguuguugaaaccaagguguccaugaucccuccccac

SEQ ID NO: 479101 - RNA, 65 nt, Homo Sapiens
gcagugucuuaaggagacugguaggaggaggcauggaaaccaaaaggccguguguuuagaagccu

SEQ ID NO: 479102 - RNA, 65 nt, Homo Sapiens
uaaacaaaugcuuguugauagccuuuuucuaucaagaaaccaaggagcuaauuauuaauaacaau

SEQ ID NO: 479103 - RNA, 65 nt, Homo Sapiens
auuccuggaaucaaggaauccugagucugggcaaugaaaccaaagccaggaguugacgcauccug

SEQ ID NO: 479104 - RNA, 65 nt, Homo Sapiens
uuucuuggcaguauuccaugggauguuaagcaaaggaaaccaaaggaaucguuucaaauggacuc

SEQ ID NO: 479105 - RNA, 65 nt, Homo Sapiens
uccucugaaggccgggacccagucauacauccuuagaaaccaaaguaugguuuuuguuuucucuu

SEQ ID NO: 479106 - RNA, 65 nt, Homo Sapiens
ggaagaaaaauagguguauaaaauguuuuccaugagaaaccaagaaacuuacacugguuugacag

SEQ ID NO: 479107 - RNA, 65 nt, Homo Sapiens
acucauuaaguguuauuuauuuuacucaagaacuggaaaccaacuaaaugccuucuauagaagua

SEQ ID NO: 479108 - RNA, 65 nt, Homo Sapiens
uacucuuucucaccugaugcucuuaaaagaucuuagaaaccaaccauacagacgagccgaugcgg

SEQ ID NO: 479109 - RNA, 65 nt, Homo Sapiens
gccauuugcacauaguuaccagucacucuguuucugaaaccaauccagaaauucauguuagaaca

SEQ ID NO: 479110 - RNA, 53 nt, Homo Sapiens; identical to SEQ ID NO: 478681

SEQ ID NO: 479111 - RNA, 65 nt, Homo Sapiens
ucaguaauguauuugaaggaaaaauacccugauuugaaaccaacagcagauguugcaaacuuuca

SEQ ID NO: 479112 - RNA, 50 nt, Homo Sapiens; identical to SEQ ID NO: 478683

SEQ ID NO: 479113 - RNA, 65 nt, Homo Sapiens
gaugccucuacuaucauuaccucuauugggacccagaaaccaauaccccaaaauauggugcaugg

SEQ ID NO: 479114 - RNA, 65 nt, Homo Sapiens
gccacgcuuguuccccauguaccucuagagaagcagaaaccaaagucccccugugcccugggagg

SEQ ID NO: 479115 - RNA, 65 nt, Homo Sapiens
uuagcaccuuuucaagggguuuuuugauguuaacagaaaccaaucgcucugagggcuguuuuuuu

SEQ ID NO: 479116 - RNA, 65 nt, Homo Sapiens
cccauaguacagugccuugucaccuuucccauaaagaaaccaaacuagcuagcaaucuaugcaaa

SEQ ID NO: 479117 - RNA, 65 nt, Homo Sapiens
aaaaugugccuuuggugggcggguuugaacuuuuggaaaccaauucaaaacucuguguugcugca

SEQ ID NO: 479118 - RNA, 65 nt, Homo Sapiens
gggucggcaguggacgcguagaaagguugguuucagaaaccaagacuuaaagaggagagcaggaa

SEQ ID NO: 479119 - RNA, 58 nt, Homo Sapiens; identical to SEQ ID NO: 478690

SEQ ID NO: 479120 - RNA, 65 nt, Homo Sapiens
cucagaggggcaaagucaccuguuuuauagaugaggaaaccaaggggucuacaauggggagaacu

SEQ ID NO: 479121 - RNA, 65 nt, Homo Sapiens
gauaaaacuguucauggaugcuuccacgcaaauaagaaaccaaggguacuucguuaugaaaaugc

SEQ ID NO: 479122 - RNA, 65 nt, Homo Sapiens
uuuuucaggaugcuguauuucugccucguaggguagaaaccaauaaaaaugugaacguuuucuaa

SEQ ID NO: 479123 - RNA, 65 nt, Homo Sapiens
uaagaacugaaugacagugaggcaguuaaucugcugaaaccaaagggauacauucuucagcauuu

SEQ ID NO: 479124 - RNA, 65 nt, Homo Sapiens
caaagaaaauucugaaaaaugggagaugcuaccaagaaaccaaccuauguuauucauguauuacu

SEQ ID NO: 479125 - RNA, 65 nt, Homo Sapiens
cuucagauaaacuugcaagagugacugaaaugcuugaaaccaaagacuccucaauugggaguguu

SEQ ID NO: 479126 - RNA, 65 nt, Homo Sapiens
caauaugagguaccuuuacagacaugagugaaaaugaaaccaaguauagguuuccgcuuucaugg

SEQ ID NO: 479127 - RNA, 65 nt, Homo Sapiens
aaacuuguuuuuagaauauuaaaugugaguaaauugaaaccaagaggauuuacuuuuaagaggca

SEQ ID NO: 479128 - RNA, 65 nt, Homo Sapiens
cgcagugaguuaaaauuuaguaagaugaagauguggaaaccaaugaaaaguacauuuagaaaugc

SEQ ID NO: 479129 - RNA, 65 nt, Homo Sapiens
uguagagcugaguuaccaaaauuucuauuucaaaggaaaccaaaccuuaaaaaaaaaaaacaaaa

SEQ ID NO: 479130 - RNA, 65 nt, Homo Sapiens
uaaauggugcuuuguuccugcugguuccaagcucagaaaccaagacuagcuuuguaggagagaau

SEQ ID NO: 479131 - RNA, 65 nt, Homo Sapiens
ucaucuauuccuuuucucuugugucccuacucauugaaaccaaacucuggaaaggacccaaugua

SEQ ID NO: 479132 - RNA, 65 nt, Homo Sapiens
uaauguuucuuaaaaguuuuugagaaaaaaaggaagaaaccaacucauucagaaggcucggauuc

SEQ ID NO: 479133 - RNA, 65 nt, Homo Sapiens
aguccaggaguccaaguagaucucgaaguaaaucugaaaccaaaucaagacacagaacaaggucu

SEQ ID NO: 479134 - RNA, 65 nt, Homo Sapiens
uuaaggacuuuccuuccuccaucuccaagaaugcugaaaccaagggggaugacaugugacuccua

SEQ ID NO: 479135 - RNA, 65 nt, Homo Sapiens
ccuuuuauuuauagaaugcaugucuuuuguguuaagaaaccaaagagaaauaaagagaacacucc

SEQ ID NO: 479136 - RNA, 65 nt, Homo Sapiens
ugauggcucacugggcucuuggaggggaaugugaagaaaccaaggagucacuuuuucaucuagau

SEQ ID NO: 479137 - RNA, 65 nt, Homo Sapiens
gugguaggcagugucccuucugcuugaaaccuauugaaaccaauuuaaaacuguguacuuuuuaa

SEQ ID NO: 479138 - RNA, 65 nt, Homo Sapiens
gucaccuuaguggaaagguuaaaaaccagagccuggaaaccaagaugauugauuugacaagguau

SEQ ID NO: 479139 - RNA, 65 nt, Homo Sapiens
uucucagugacagaagcauguuugagaugccgugggaaaccaaauauauaauaauaaaaauauaa

SEQ ID NO: 479140 - RNA, 65 nt, Homo Sapiens
ugcaaauauuccauuguaaacaaaucaaaggaaaagaaaccaagaacugaauuacugucugccca

SEQ ID NO: 479141 - RNA, 65 nt, Homo Sapiens
ucagucaaagggcaccauucuuuuuuuuuuuuuuugaaaccaaagcugucucagaaauggccaau

SEQ ID NO: 479142 - RNA, 65 nt, Homo Sapiens
caaauugcacuuuuggaagcccggugucaugaaaugaaaccaaaccucggugccaucgcagagua

SEQ ID NO: 479143 - RNA, 65 nt, Homo Sapiens
cugcagauggauguuuccaugaagaaaucucugaagaaaccaaaagagcugaaacugaaaaaaga

SEQ ID NO: 479144 - RNA, 65 nt, Homo Sapiens
cgugugcaaaccucuugacuuuaccccacauuacugaaaccaaaauauauuugcuucaucugccc

SEQ ID NO: 479145 - RNA, 65 nt, Homo Sapiens
acuggagagaaaaccaacguaacgagcaacaaucggaaaccaaauacccaacucacccaagcagc

SEQ ID NO: 479146 - RNA, 65 nt, Homo Sapiens
auggaugcuguuuuuauugguaauugggagauaaugaaaccaaucgugguggugucaccacuacu

SEQ ID NO: 479147 - RNA, 65 nt, Homo Sapiens
uuuaaaauguuggucuagguauuuaacauauuuaagaaaccaauaauuauguucuguuaauggga

SEQ ID NO: 479148 - RNA, 65 nt, Homo Sapiens
uggaagaugucuuuuucaguuucuugaaaugagaagaaaccaaccccguucauggagcuggucau

SEQ ID NO: 479149 - RNA, 65 nt, Homo Sapiens
ggugucaguaaaauucuguguuuuugccaauuagagaaaccaaccuuuuuaaauugcaaauguaa

SEQ ID NO: 479150 - RNA, 63 nt, Homo Sapiens; identical to SEQ ID NO: 478721

SEQ ID NO: 479151 - RNA, 65 nt, Homo Sapiens
cauggcaacgcuggugcuuguauaaaggguuauuugaaaccaaucuauauaaauauaaaauuaua

SEQ ID NO: 479152 - RNA, 65 nt, Homo Sapiens
auuuaaauuauauugauguuuuuuuuuaaaaaaaagaaaccaacaagaagcuuuacuuuuccacu

SEQ ID NO: 479153 - RNA, 65 nt, Homo Sapiens
agauuugucuacaaaugcuagugcuuaauucuguugaaaccaaaacauuuuuacaccccuuaagg

SEQ ID NO: 479154 - RNA, 65 nt, Homo Sapiens
cuugcucucacuaguugucaggggaaaugccagaugaaaccaacucaaugccaccagagauagug

SEQ ID NO: 479155 - RNA, 65 nt, Homo Sapiens
cucuucucuguccccugcccaggagaacugagcaggaaaccaaggggggugaggcuuagcccaga

SEQ ID NO: 479156 - RNA, 65 nt, Homo Sapiens
ugccuccauuuuccugagaucaaaaagacuguuucgaaaccaacaucugauauguaaacugcucu

SEQ ID NO: 479157 - RNA, 65 nt, Homo Sapiens
cccuucugagcguuucugacagcucccagcugggagaaaccaacaugacgaaaagacaaagaaua

SEQ ID NO: 479158 - RNA, 65 nt, Homo Sapiens
uggaaugaugguugcacaacuuugugaauauacuagaaaccaaugaauuaaaaacuuuggaagau

SEQ ID NO: 479159 - RNA, 65 nt, Homo Sapiens
uucugcaguuccuuauaggcgaagggaaccggguggaaaccaagcugggagaggcugaggauggc

SEQ ID NO: 479160 - RNA, 65 nt, Homo Sapiens
cauuguaccauacaauuucauuaucuuaucagaaugaaaccaauucacagggaaacuagagacua

SEQ ID NO: 479161 - RNA, 65 nt, Homo Sapiens
aaggaaauaucaaagaacacaacgcaggacuugcugaaaccaaauuacuacuucacacucuccuu

SEQ ID NO: 479162 - RNA, 65 nt, Homo Sapiens
ggcaacauuuuggaagcagagggcaacucucacuggaaaccaaaucuccuggcaccuugaucuug

SEQ ID NO: 479163 - RNA, 65 nt, Homo Sapiens
guauauaagucaagaauguuuuauugucauuaugugaaaccaauauuggcaaauaguacuuuaau

SEQ ID NO: 479164 - RNA, 65 nt, Homo Sapiens
gcaguaauagauaugugauuuuacaucauuuuuaagaaaccaaggggaaguaauaaguugaaaaa

SEQ ID NO: 479165 - RNA, 65 nt, Homo Sapiens
uaaucucauguauaaaaacuuuuucuuuaaauaaggaaaccaauauccauucuuaauuguaauuu

SEQ ID NO: 479166 - RNA, 65 nt, Homo Sapiens
ggcagcuuucccugacaagcguuggcaucaguauagaaaccaacuguugguugacaaaauuggcu

SEQ ID NO: 479167 - RNA, 65 nt, Homo Sapiens
aacaucugguacagcugccauugaaccuuuuguaugaaaccaagaagcuccaugcucgcuacguc

SEQ ID NO: 479168 - RNA, 65 nt, Homo Sapiens
cagagagcuuaacucacuuccaacuuagagaggaagaaaccaagagcuucugguaccaugauccu

SEQ ID NO: 479169 - RNA, 65 nt, Homo Sapiens
ucuguuucuuggugguuauguuauacuauauugcagaaaccaauaacuggauugauuguggacuu

SEQ ID NO: 479170 - RNA, 65 nt, Homo Sapiens
cccucaugguaguauuuccucauaacuagaagguggaaaccaaaauaacuuucuaacagaacuuc

SEQ ID NO: 479171 - RNA, 65 nt, Homo Sapiens
aaaagaagccaagcaaaaauccaugguauaaagaggaaaccaagaucaauggaggggucugggga

SEQ ID NO: 479172 - RNA, 65 nt, Homo Sapiens
gaacugccaacaaaauaaaaugcucaauaaauguugaaaccaacuagugccugguauauaguagg

SEQ ID NO: 479173 - RNA, 65 nt, Homo Sapiens
auacaaaugaaucaguaucagguuuucuucuuugggaaaccaaacaaaucccaguucucuaauuu

SEQ ID NO: 479174 - RNA, 65 nt, Homo Sapiens
ccagcuuccuuuuccuuuaaaucugacuucagacagaaaccaauaauugucuucguaaaaguuag

SEQ ID NO: 479175 - RNA, 65 nt, Homo Sapiens
uaaauauuucugcauuucagccaaaaacaaugaaggaaaccaaaauauaaaccaaaacaaaauuu

SEQ ID NO: 479176 - RNA, 65 nt, Homo Sapiens
cugccugugcuuuuguuugacugucucuagauuuugaaaccaaaaaacugaacugaaaucaucua

SEQ ID NO: 479177 - RNA, 65 nt, Homo Sapiens
agcugugccggcgcuacgggacccgagccgucccagaaaccaaagggcaggcacggcagcaaacg

SEQ ID NO: 479178 - RNA, 65 nt, Homo Sapiens
gguaaaguaaaaggaaacaguacacuuggagcuaggaaaccaaagcaagcuuugugaaacuggca

SEQ ID NO: 479179 - RNA, 65 nt, Homo Sapiens
gaugaucaguccaacugaacgaccuuacaaaugaggaaaccaagauaaaugagcugccagaauca

SEQ ID NO: 479180 - RNA, 65 nt, Homo Sapiens
ggauaccuccagguuccaguaaaauucuucugaccgaaaccaauguggguguuagaaaaauuacc

SEQ ID NO: 479181 - RNA, 65 nt, Homo Sapiens
ucaccccagcacugcuguugggaaggugacugcaggaaaccaauucuuacaagauccaggcccag

SEQ ID NO: 479182 - RNA, 65 nt, Homo Sapiens
aauacaaccagcauagaaagacccaaaacuauacagaaaccaaaaccagaaugccauguggugga

SEQ ID NO: 479183 - RNA, 65 nt, Homo Sapiens
aagauauuaagcguguguaaaugggcuuuagucuggaaaccaaaaaaaaaaaaaaaauuuaguca

SEQ ID NO: 479184 - RNA, 65 nt, Homo Sapiens
ucccaccaugcccuucugccaucuucugggagaaggaaaccaaaggaucuaaaacugggguuugg

SEQ ID NO: 479185 - RNA, 65 nt, Homo Sapiens
ugacccuagagcagaggugggcaaacuaugaccuggaaaccaaaucugacuuaccaccuuuuccu

SEQ ID NO: 479186 - RNA, 65 nt, Homo Sapiens
caucugauuugguauugugauuuacuucagacccugaaaccaaauaucugaucuuccauuagacu

SEQ ID NO: 479187 - RNA, 65 nt, Homo Sapiens
cucuaaacucguccccagaggaggacuugaaugaggaaaccaacacuuugagaaaccaaaguccu

SEQ ID NO: 479188 - RNA, 65 nt, Homo Sapiens
agaggaggacuugaaugaggaaaccaacacuuugagaaaccaaaguccuuuuucccaaagguucu

SEQ ID NO: 479189 - RNA, 65 nt, Homo Sapiens
ggguugcauggaaguuuuauucucuuguuuugcuggaaaccaagaggauccaaacuuccugcaac

SEQ ID NO: 479190 - RNA, 65 nt, Homo Sapiens
ugggugggaggcaccaaaacuuggcagcugugccagaaaccaaagccaggcccagauguaggggg

SEQ ID NO: 479191 - RNA, 65 nt, Homo Sapiens
ccagagcagccuguggccuguggucacuggugucugaaaccaaaucacgcaaaacuggcuucuuc

SEQ ID NO: 479192 - RNA, 65 nt, Homo Sapiens
cugaagagucagguugaagcgugacaguacugggagaaaccaaggauuaaaguuccuaagaccca

SEQ ID NO: 479193 - RNA, 65 nt, Homo Sapiens
gaaguuuuguuuuuguuuuuuacucauaauagggagaaaccaagacuaauguaauaauagaaaaa

SEQ ID NO: 479194 - RNA, 65 nt, Homo Sapiens
uuagaaacauuagaaauuuguguuagaucuuguaggaaaccaagaucaggauaacacaagcuuag

SEQ ID NO: 479195 - RNA, 65 nt, Homo Sapiens
aagcagacacaacaugcauugugggaaaauagguagaaaccaaggcuaaaaauuguuagaaauug

SEQ ID NO: 479196 - RNA, 65 nt, Homo Sapiens
agaaaacuauuguuggaucauugagugauacuagugaaaccaaauauuagccugugucaaguucu

SEQ ID NO: 479197 - RNA, 65 nt, Homo Sapiens
acuaguuugaaaucguuuauuaccauacccaucuagaaaccaagaaaagcuaaagaagacuauga

SEQ ID NO: 479198 - RNA, 65 nt, Homo Sapiens
cuaaauaauuacaccaacuuaggucucauuacaaugaaaccaaucgaauccaagugacugugaaa

SEQ ID NO: 479199 - RNA, 65 nt, Homo Sapiens
aguuugcucuaggggaagaggcagcgauggucucagaaaccaaacuuguacaugcauucauacag

SEQ ID NO: 479200 - RNA, 65 nt, Homo Sapiens
cauggagcaguucccagagucccugcacagaugaggaaaccaagguaucagagcuggaaccucau

SEQ ID NO: 479201 - RNA, 65 nt, Homo Sapiens
guaucugcucuaaaaugacugaggccagacaccaagaaaccaagcgcucuuccucaaggcaaccu

SEQ ID NO: 479202 - RNA, 65 nt, Homo Sapiens
cucagaaaauguuuacuguugauaagcagguacuagaaaccaaaaggugauuauuauuaacucua

SEQ ID NO: 479203 - RNA, 65 nt, Homo Sapiens
auagucaucucauccuacucaauuuuucaaaggcagaaaccaacccuggagcaauugagaggacu

SEQ ID NO: 479204 - RNA, 65 nt, Homo Sapiens
acauuuuauauggcugaucaauuuucauacauugagaaaccaagucaaucaagcaggaaucauuu

SEQ ID NO: 479205 - RNA, 65 nt, Homo Sapiens
uuacuagucaaauccgucagugaucccgagucccagaaaccaaaggcucuuuucagagccaccca

SEQ ID NO: 479206 - RNA, 65 nt, Homo Sapiens
cuagcuuuaggggaccaugaagagacucucuuagggaaaccaauaguccccaucagcaccaugga

SEQ ID NO: 479207 - RNA, 65 nt, Homo Sapiens
ucauuuaguaauguaccuugaguuaaaaagccugagaaaccaaacacagcuaaugcuauggggug

SEQ ID NO: 479208 - RNA, 65 nt, Homo Sapiens
cagagggaacgagcuguagguuugcagaaaugugugaaaccaaaaugaucacugccuacuuguga

SEQ ID NO: 479209 - RNA, 65 nt, Homo Sapiens
augguuuaaucagucuaauuguuuugacuguuauagaaaccaaauauuuuacuguuucuuuuaag

SEQ ID NO: 479210 - RNA, 65 nt, Homo Sapiens
agugagguagauugcugucccguuaacauagugcugaaaccaaaggcaguggggguccaaacucg

SEQ ID NO: 479211 - RNA, 65 nt, Homo Sapiens
ccacuuucuagaacauauucuuuacuaauguuauugaaaccaauuucuacuucauacugauguuu

SEQ ID NO: 479212 - RNA, 65 nt, Homo Sapiens
cauuuuaauaccaugccagagaagaguauucugcugaaaccaacagguuuuacuggucaaaauga

SEQ ID NO: 479213 - RNA, 65 nt, Homo Sapiens
uuugggaauuaaacaggucacacgugacagaugaagaaaccaagggggcugcugaggagaccugg

SEQ ID NO: 479214 - RNA, 65 nt, Homo Sapiens
ucaauuacuauaauccugagccauggugugcuacugaaaccaauuuuuauccaccaucuaguccu

SEQ ID NO: 479215 - RNA, 65 nt, Homo Sapiens
auccugccuucuuuguggggaacaauuaccuaaaagaaaccaaaagaucaucacaaauccuuuaa

SEQ ID NO: 479216 - RNA, 65 nt, Homo Sapiens
aacaagaaccucucuuucuauaauacuauuaauaagaaaccaacaucagggcgaaaagaaaaaaa

SEQ ID NO: 479217 - RNA, 65 nt, Homo Sapiens
cuuggauuuagauucaaaagucugacaucacaguagaaaccaaacuuuggaauacuggucaucuu

SEQ ID NO: 479218 - RNA, 65 nt, Homo Sapiens
uuaauuauacuaugccauuauugcagaucucagaugaaaccaagcucugacacccuuuaaugugg

SEQ ID NO: 479219 - RNA, 65 nt, Homo Sapiens
ugauucuuaauuaguauacaaaauuuggcugacaagaaaccaaagcaauaaaauuguaauauaau

SEQ ID NO: 479220 - RNA, 65 nt, Homo Sapiens
cugccaacaccuugaucuuggagagggccucagaagaaaccaaccaacucuuuacaagcuaagaa

SEQ ID NO: 479221 - RNA, 65 nt, Homo Sapiens
aaagugaaacuuuggauaaguuacaauguguaauggaaaccaaggagucaagaguugaggagaca

SEQ ID NO: 479222 - RNA, 65 nt, Homo Sapiens
uuguauauugaauuacauuaggauuauaauucugugaaaccaaguuuaucuuugugcuauauagu

SEQ ID NO: 479223 - RNA, 65 nt, Homo Sapiens
aguuugacugggagcgugugcacauagcccacuaggaaaccaagaccuugugaaguugcuguugg

SEQ ID NO: 479224 - RNA, 65 nt, Homo Sapiens
aacagccaagucagcaagcaaagcuucaaagucaugaaaccaaucgaagaauugucauaggaggg

SEQ ID NO: 479225 - RNA, 65 nt, Homo Sapiens
gcgccccuucaccucgcgugucuuuucucccaagcgaaaccaaaugccagccuccccgcccgcuc

SEQ ID NO: 479226 - RNA, 65 nt, Homo Sapiens
auaauuuacuucuuauaaauugaagucuuaaaugugaaaccaagaaauguaaucaagcaguaaaa

SEQ ID NO: 479227 - RNA, 65 nt, Homo Sapiens
gcuccaccacugugcacuuagccaugauggcaacagaaaccaagagacacaauuacgcagguauu

SEQ ID NO: 479228 - RNA, 65 nt, Homo Sapiens
uucuuuuugaaucucucaaacggcaacauuccucagaaaccaaagcuuuauuucaaaucucuucc

SEQ ID NO: 479229 - RNA, 65 nt, Homo Sapiens
caucucuguugcuaacacacagagcucaccuguuugaaaccaagcuuucaaacauguugaagcuc

SEQ ID NO: 479230 - RNA, 65 nt, Homo Sapiens
uguuaaaagccuauuauuguuaaaggccuuuuauggaaaccaacuuggaaaacaaccuuaaaugu

SEQ ID NO: 479231 - RNA, 65 nt, Homo Sapiens
gaaaaaaauaaaacgcaaaaaaagaaacuguaaaggaaaccaagagauuuuguuuaauuuuuuug

SEQ ID NO: 479232 - RNA, 65 nt, Homo Sapiens
uccaaaggcauaagacccuaagccuccuuuugcuugaaaccaaagauauauacacaggauccuau

SEQ ID NO: 479233 - RNA, 65 nt, Homo Sapiens
uccuucaagaggguuacaauguggccaucagacaggaaaccaaacgguggauaaaguauuaagua

SEQ ID NO: 479234 - RNA, 65 nt, Homo Sapiens
augucuucagugauugaaacgggaugggaauagcagaaaccaaccggcauggaggagggaggcgu

SEQ ID NO: 479235 - RNA, 65 nt, Homo Sapiens
uagaaacacauuccuugggagaaccagugugcuuugaaaccaaaucaugaaagugguaaaagugg

SEQ ID NO: 479236 - RNA, 65 nt, Homo Sapiens
aaauuacuuaagaaauggaacauuauugacuuuuggaaaccaaccagcucaaaacacuacaucca

SEQ ID NO: 479237 - RNA, 65 nt, Homo Sapiens
acaacaagauacaaauaccuccucuauuucacacagaaaccaaggaauauucucauuauuaacuu

SEQ ID NO: 479238 - RNA, 65 nt, Homo Sapiens
guugacauacaaaccaugaucuuucucuguuuuaugaaaccaacuaucuucuaucuucuuuccac

SEQ ID NO: 479239 - RNA, 65 nt, Homo Sapiens
uguuauauaugaacacucaaaucuuuuacuguaacgaaaccaagaaacuuguuuagaaugugaua

SEQ ID NO: 479240 - RNA, 65 nt, Homo Sapiens
cuuuggggaauuuuggccaggagacccugaaacaugaaaccaaacaggcuuugauauuuuuuuuu

SEQ ID NO: 479241 - RNA, 65 nt, Homo Sapiens
gcuguggcuuugagaaguuaacuuuuguggaauaugaaaccaaaggaagaauuuccauguagaua

SEQ ID NO: 479242 - RNA, 65 nt, Homo Sapiens
ucaugggaauuacauaaggauaaugaggcccaacugaaaccaaguuucagucugccuuaccuuua

SEQ ID NO: 479243 - RNA, 65 nt, Homo Sapiens
uaaucacuuuuuaaaauauaaggaccgaaugcaaggaaaccaaaguuuauuaauaauuuuuauau

SEQ ID NO: 479244 - RNA, 65 nt, Homo Sapiens
accgagggaacccugggucuugggaagaacaacaggaaaccaaggucugaccuaggguucccucc

SEQ ID NO: 479245 - RNA, 65 nt, Homo Sapiens
acaauagaaauuuuucucauaauauauaccuaugugaaaccaacuuaucugcauaauuaaaucua

SEQ ID NO: 479246 - RNA, 65 nt, Homo Sapiens
aacuuuuagcuuugaucacaaguggacaaauuucugaaaccaaaggcaacuaaguugcuguguua

SEQ ID NO: 479247 - RNA, 62 nt, Homo Sapiens; identical to SEQ ID NO: 478818

SEQ ID NO: 479248 - RNA, 65 nt, Homo Sapiens
ggucaggaguuguuucugacgacgcggcucaaaaggaaaccaaguuuuacagauugccuccuuau

SEQ ID NO: 479249 - RNA, 65 nt, Homo Sapiens
guguuuaaacuuaaaacugccacggacuaugagaagaaaccaaaccacgcauuggcauccaaggc

SEQ ID NO: 479250 - RNA, 65 nt, Homo Sapiens
guccaccuggguguguucauugaaccccugcaaaugaaaccaaacugaaccccugcaacccuccc

SEQ ID NO: 479251 - RNA, 65 nt, Homo Sapiens
acuguagaagaugaggaaucacuuuguacacguuugaaaccaacucuucucauaguauagaguuu

SEQ ID NO: 479252 - RNA, 65 nt, Homo Sapiens
gaauggcugaugucucuuucaaguuagucugguuggaaaccaagauuuaggggaucauaucaaga

SEQ ID NO: 479253 - RNA, 65 nt, Homo Sapiens
uguauaauguacaguuuucauuauuuauaauucuugaaaccaaaacucccuaccugugaguuccu

SEQ ID NO: 479254 - RNA, 65 nt, Homo Sapiens
ggcaaaacgugggugcaaaauccugacaguguggagaaaccaacaacagugaguuggucaaaugc

SEQ ID NO: 479255 - RNA, 65 nt, Homo Sapiens
ccucauccucagaugcucaacaacacaaccaacgcgaaaccaauucagaacugucggaggaaaga

SEQ ID NO: 479256 - RNA, 65 nt, Homo Sapiens
guuucuuuucccaugcucuuuagaauccaggugcugaaaccaagucacaguuucccuacuguaug

SEQ ID NO: 479257 - RNA, 65 nt, Homo Sapiens
uugggcuuuauuuggacaaaccaaacuuuuagccugaaaccaacuuuaugccacuaagucauagc

SEQ ID NO: 479258 - RNA, 65 nt, Homo Sapiens
uuguccacagauguacuggccauuacaugaaacaagaaaccaagcaucuuugcuguuguuaauua

SEQ ID NO: 479259 - RNA, 65 nt, Homo Sapiens
cuggcauuuccauguauauauguauauaaaugcaggaaaccaacaugucauugacaccucucuuc

SEQ ID NO: 479260 - RNA, 65 nt, Homo Sapiens
auaagucuguacaaccuagcauagaauaaaaaacugaaaccaagauucccaacguuuuucauagc

SEQ ID NO: 479261 - RNA, 65 nt, Homo Sapiens
acacaauuaagagcucaugucuuagcaagaucugggaaaccaacauugcgagaguagcuauuuug

SEQ ID NO: 479262 - RNA, 65 nt, Homo Sapiens
aacccaggaagcgucuuuggugcuugggagaccaagaaaccaagaaauuaacaacugaaagcauu

SEQ ID NO: 479263 - RNA, 65 nt, Homo Sapiens
aggguucugaacccguucccuacacagaaaucuuggaaaccaaaugcugcugaguaaggaugaag

SEQ ID NO: 479264 - RNA, 65 nt, Homo Sapiens
gccaucaaaacacauacacccagaaagaaacaacagaaaccaaaacucacaaggcgcaugauuac

SEQ ID NO: 479265 - RNA, 65 nt, Homo Sapiens
gugggcacuaagcuaugggagagaccauagcugcagaaaccaacccugcccuaggcauaaaaugc

SEQ ID NO: 479266 - RNA, 65 nt, Homo Sapiens
aggcagcaggcucaggcccacaccuugugauuuuugaaaccaaagcccagaagaugauguuuacu

SEQ ID NO: 479267 - RNA, 65 nt, Homo Sapiens
aauugagagugagaaagaggaaugaaagcaagccugaaaccaagccacacgauuugucagagaga

SEQ ID NO: 479268 - RNA, 65 nt, Homo Sapiens
cugggucucucuccacccggguucauggagcuggagaaaccaaaauaggacguguaccucugugu

SEQ ID NO: 479269 - RNA, 65 nt, Homo Sapiens
aagaaaccuagaaucuaauguguagacccaguuuugaaaccaaaauuaaugucauuuuuauggau

SEQ ID NO: 479270 - RNA, 65 nt, Homo Sapiens
gugccgagugaauaaaggauggaagaaaaugcaaagaaaccaaauccacaccugcaauguaaaau

SEQ ID NO: 479271 - RNA, 65 nt, Homo Sapiens
uugggagggggaagaggaccugccucaucuggagggaaaccaaaauggaaccaacauucaaauuc

SEQ ID NO: 479272 - RNA, 65 nt, Homo Sapiens
aagcagcuugguauucauaaggcagagucuaccuugaaaccaauuuuaguacaauaagcguuaag

SEQ ID NO: 479273 - RNA, 65 nt, Homo Sapiens
auauauauuuuuaaaucacauuaauuuuaccaagugaaaccaagccauacuguuuuugagccaau

SEQ ID NO: 479274 - RNA, 65 nt, Homo Sapiens
agacaguccuguaagaucgagcaaccagucaugaugaaaccaagugguggccggaucaguaugac

SEQ ID NO: 479275 - RNA, 65 nt, Homo Sapiens
uuuauaugcauuaauuuaagagcaucuacuuagaagaaaccaaauagucuaucgcccucauauca

SEQ ID NO: 479276 - RNA, 65 nt, Homo Sapiens
guaaagaaugagaauggauucuguacaauacacuagaaaccaacauaauguauuucuuuaaaacc

SEQ ID NO: 479277 - RNA, 65 nt, Homo Sapiens
gcucugaaaaccaaaaguauuuucauaacccauuugaaaccaaaccugaccugaacuuacacuga

SEQ ID NO: 479278 - RNA, 65 nt, Homo Sapiens
augggaguagacagaguuguauggccuggacaguggaaaccaagagcaggaucgcaaaguaacag

SEQ ID NO: 479279 - RNA, 65 nt, Homo Sapiens
agaauccucuauuauuuucacaccccagccccagagaaaccaauaaugaagagaaaagccaugcc

SEQ ID NO: 479280 - RNA, 65 nt, Homo Sapiens
cuacuucacuaaugacgaugcuuuuaucuguagcagaaaccaaguacccguucgcccccauguga

SEQ ID NO: 479281 - RNA, 65 nt, Homo Sapiens
gaaaagcacauugcgauccauuuucguuuuuaugggaaaccaagguuuuugcacaagguguuuca

SEQ ID NO: 479282 - RNA, 65 nt, Homo Sapiens
agauacaucugcuggagagcgugucucucuuuggagaaaccaaccacuguggugccaaauugcug

SEQ ID NO: 479283 - RNA, 65 nt, Homo Sapiens
gguaaucugauccaccacuuaaaaaacaaaaaacagaaaccaaucuggccugaagaggaagagaa

SEQ ID NO: 479284 - RNA, 65 nt, Homo Sapiens
ucgguuuccgcccucuagcguguggggccugcugggaaaccaagggccuccagagaccgagcagc

SEQ ID NO: 479285 - RNA, 65 nt, Homo Sapiens
aagucagcauguaagcgucaaaccaagcaucuauagaaaccaagauauuuuaguuuuauuuuuga

SEQ ID NO: 479286 - RNA, 65 nt, Homo Sapiens
aucuauagaaaccaagaaaguuuaguuuuauuuuugaaaccaagcggauuuggaauuuuuguuau

SEQ ID NO: 479287 - RNA, 65 nt, Homo Sapiens
aagagcaaagggaacccagcgccugguuuugcuuugaaaccaagauucauuccuggggcacugug

SEQ ID NO: 479288 - RNA, 65 nt, Homo Sapiens
uugcaccuggaaacuuacaaaaaugguguugcugggaaaccaaguuguucaucaguguuuuauag

SEQ ID NO: 479289 - RNA, 65 nt, Homo Sapiens
uagagcuacaaacucagcuguguucauaaucaacagaaaccaagauuauauauaacuaugcuaau

SEQ ID NO: 479290 - RNA, 65 nt, Homo Sapiens
aucucacucaggccuccagggauccaugggggagugaaaccaauucucagagaacaacccaccag

SEQ ID NO: 479291 - RNA, 65 nt, Homo Sapiens
ccagacauacgaaacacaaaccacaacugacacaggaaaccaacacccaaagcauggacuaaccc

SEQ ID NO: 479292 - RNA, 65 nt, Homo Sapiens
cgccucauccucauugcuucugccuccacguaaaugaaaccaaaggccucagcauauccugggag

SEQ ID NO: 479293 - RNA, 65 nt, Homo Sapiens
caaacuuaaucuucaucuuuaaaaaaaagaaaaaagaaaccaaaaugagaaucaacacuucauag

SEQ ID NO: 479294 - RNA, 65 nt, Homo Sapiens
auuauuuuuuaaaugaaaccuuuuuuuuucuuuuugaaaccaaauguuaaacuauagccuuaaga

SEQ ID NO: 479295 - RNA, 65 nt, Homo Sapiens
agagaaaaaaaaaaagagaacccacaugaagcucugaaaccaaacagcauccugccaugagcuuc

SEQ ID NO: 479296 - RNA, 65 nt, Homo Sapiens
uccauacacagaaacauaauaaacaaucuucacacgaaaccaaaaauagcauacaccuaauguug

SEQ ID NO: 479297 - RNA, 65 nt, Homo Sapiens
agaccuuuggcucacagaacugcaggguauggugagaaaccaacuacggauugcugcaaaccaca

SEQ ID NO: 479298 - RNA, 65 nt, Homo Sapiens
cucagauggcucccacauuuuaagauuuuaaaaaugaaaccaaaaaauaaauugaagaaaacugu

SEQ ID NO: 479299 - RNA, 65 nt, Homo Sapiens
uauuaaauacuuaaugcugauuugaagagauagcugaaaccaaggcugaagacuguuuuacuuuc

SEQ ID NO: 479300 - RNA, 65 nt, Homo Sapiens
cccccagaucaugcuuuaauucuuucuuuucuguagaaaccaacaguuuccauuuaugucaaugc

SEQ ID NO: 479301 - RNA, 65 nt, Homo Sapiens
aagcaaguguguagcuuaaggccacuacugguaaggaaaccaaguguccucugugccuuuuuucu

SEQ ID NO: 479302 - RNA, 65 nt, Homo Sapiens
ugcuagcugugcagaacccaauugcccuuugcacagaaaccaaccccugacccagcgguaccggc

SEQ ID NO: 479303 - RNA, 65 nt, Homo Sapiens
cccauggugauagccugaaagagcuuuccucacuagaaaccaaaugguguaaauauuuuauuuga

SEQ ID NO: 479304 - RNA, 65 nt, Homo Sapiens
gggaugggagccacagugcccuucacucucuccuggaaaccaacuguaagcuggugggcucaacc

SEQ ID NO: 479305 - RNA, 65 nt, Homo Sapiens
uguguuuaguaucugaauuugaaacucaucugguggaaaccaaguuucaggggacaugaguuuuc

SEQ ID NO: 479306 - RNA, 65 nt, Homo Sapiens
cccagccccuccccccucccagggacucucucggggaaaccaagguggcuggucccaugugugaa

SEQ ID NO: 479307 - RNA, 65 nt, Homo Sapiens
ugaaaaauagcauaugccuuuaaagauacaugauugaaaccaaguuauaacauuaagaaaaacaa

SEQ ID NO: 479308 - RNA, 65 nt, Homo Sapiens
gggaucgggccaggcucccaucgucuuaccccacugaaaccaacaagagcuucagccucucuucg

SEQ ID NO: 479309 - RNA, 65 nt, Homo Sapiens
uacuguggucucuugggacuaauuccccugaagaagaaaccaauguauggagcucuggacuccua

SEQ ID NO: 479310 - RNA, 65 nt, Homo Sapiens
aggcuuuagaagagauuaucuaucuaacucuucuggaaaccaaauucuguccacucuuguucaag

SEQ ID NO: 479311 - RNA, 65 nt, Homo Sapiens
ugguuugggguauggggugggaccagaggagucaagaaaccaagaacguuuguagguucuuacug

SEQ ID NO: 479312 - RNA, 65 nt, Homo Sapiens
agacccugaagaauauuugauacauguuuaaucuggaaaccaaaguggcaagaugaccgucacau

SEQ ID NO: 479313 - RNA, 65 nt, Homo Sapiens
uaagaguguguuucuguguuuaccaaaauagagcagaaaccaagcacaaaguucaaaaguagaaa

SEQ ID NO: 479314 - RNA, 65 nt, Homo Sapiens
ucuucucugcuggcuggggcuucucuucauuguuagaaaccaaagauuauuuguguuaucuuuau

SEQ ID NO: 479315 - RNA, 65 nt, Homo Sapiens
augaaugaaccccuggcucccaagaugccugaucagaaaccaacccugccuccauuauccauucc

SEQ ID NO: 479316 - RNA, 65 nt, Homo Sapiens
aaaccgugcgcugugacccacucuguguucccgcggaaaccaacccagaucccgccccuccuguc

SEQ ID NO: 479317 - RNA, 65 nt, Homo Sapiens
gucagaaggauguaugaugauccccuuccugggaggaaaccaauucagaaguaagcucugcaugu

SEQ ID NO: 479318 - RNA, 65 nt, Homo Sapiens
ccuuggaagcaaguggggugcuggaugucacuuuggaaaccaagcuuuccccaaccucuuacacc

SEQ ID NO: 479319 - RNA, 65 nt, Homo Sapiens
caccaccuuucauguuuuugauugcccuacaaagagaaaccaaaugagcugauuacugacuauaa

SEQ ID NO: 479320 - RNA, 65 nt, Homo Sapiens
auauaguggucacugugauauaauaaaucauaaaggaaaccaaaucacaaaggagaugguguggc

SEQ ID NO: 479321 - RNA, 65 nt, Homo Sapiens
cacuuggccucacuaccagaagaaggguggagucagaaaccaaagugaccuccagagcuguccuc

SEQ ID NO: 479322 - RNA, 65 nt, Homo Sapiens
agagcaaauauuguucuucccauuuuacagauucagaaaccaaggcuaagggacuggucuaaagu

SEQ ID NO: 479323 - RNA, 65 nt, Homo Sapiens
uuuuuuaaaaagaaacuauuuuuguguuugaaagugaaaccaacauccagaucuauagcagaguc

SEQ ID NO: 479324 - RNA, 65 nt, Homo Sapiens
uaauugaaagcaacacuaauauagagccacuuccugaaaccaagaaucuguaguuuugauccaaa

SEQ ID NO: 479325 - RNA, 65 nt, Homo Sapiens
auguuccaucauuucuagcuaaaacuccauuuggugaaaccaacauauccauuucuuuuccuagu

SEQ ID NO: 479326 - RNA, 65 nt, Homo Sapiens
gacaaccgugggggaacacaccacuuuuuacuguugaaaccaacacaacguugaaauccaggcuu

SEQ ID NO: 479327 - RNA, 65 nt, Homo Sapiens
uggcccuucugaaacuuauggucaucucucccacugaaaccaaggucuuuucaaauguggcuaaa

SEQ ID NO: 479328 - RNA, 65 nt, Homo Sapiens
aacccuucagugcuacauuuuguggcuuuuuaauggaaaccaagccaauguuauagacguuugga

SEQ ID NO: 479329 - RNA, 65 nt, Homo Sapiens
accuggcaccacuuucaagaugcuggauggaacaggaaaccaaucuggccccuggcuccggagaa

SEQ ID NO: 479330 - RNA, 65 nt, Homo Sapiens
aagaaggcuuaguagcucaguaaauaggaaauguagaaaccaagcgugugugugugugugcacaa

SEQ ID NO: 479331 - RNA, 65 nt, Homo Sapiens
uuuuaaaaugaagugucaaggaaaacacaucaguagaaaccaagaccgagcuugucagcuuuuuu

SEQ ID NO: 479332 - RNA, 65 nt, Homo Sapiens
cuauuuaacugugaacuaugcuauuuagaaagacugaaaccaagaagcauccuuauauaauaaug

SEQ ID NO: 479333 - RNA, 65 nt, Homo Sapiens
ccugcucucuccuaaggcucgucuguuacacaugugaaaccaaagccagacugccagcagcaccc

SEQ ID NO: 479334 - RNA, 65 nt, Homo Sapiens
guacaaacuguguugucuuuuaacugaaaaaauaugaaaccaaaauauuauguuuuuacugaaau

SEQ ID NO: 479335 - RNA, 65 nt, Homo Sapiens
aacacucuguacugugugcguucuagugaaugugugaaaccaagauuauuuaacaauagcaauag

SEQ ID NO: 479336 - RNA, 65 nt, Homo Sapiens
cuuaccaggucuuggacuguauuuccaaauaaaaagaaaccaacuaaugaaaguugaccauaguu

SEQ ID NO: 479337 - RNA, 65 nt, Homo Sapiens
ccacuuuuguuuauaagaccgcguuaguuacaaaggaaaccaauguggauuccaaaugaaccccu

SEQ ID NO: 479338 - RNA, 65 nt, Homo Sapiens
ugauacacacuuucaugaugaauuccuuuuauagagaaaccaaccuccagcucuaguucagcuau

SEQ ID NO: 479339 - RNA, 65 nt, Homo Sapiens
aacaucagacaucauugcguuccuguuacacuauggaaaccaagauuuaauugaaaugucaaguu

SEQ ID NO: 479340 - RNA, 65 nt, Homo Sapiens
agcaagcccuugaugaccaauguuguuuuacagcugaaaccaaccuuguuuuuuguuguuguugu

SEQ ID NO: 479341 - RNA, 65 nt, Homo Sapiens
cgcccgacgcagacgcggugccgaagcagccuccugaaaccaaaacggcccccgggggccccgcc

SEQ ID NO: 479342 - RNA, 65 nt, Homo Sapiens
gggaugcuaacuacaacaugguuaguucaucaaaggaaaccaaccccuagcucuagccuguacca

SEQ ID NO: 479343 - RNA, 65 nt, Homo Sapiens
caggccaggugggcggacaaccaacgagauugcuggaaaccaaguguccccacagacugccccag

SEQ ID NO: 479344 - RNA, 65 nt, Homo Sapiens
aaaaccauuuucagggagcuccagggaacggggaggaaaccaaaguccaaaccugugaccccagg

SEQ ID NO: 479345 - RNA, 65 nt, Homo Sapiens
cucaccuaggauuggcuauucugagggauugcauagaaaccaagcuccacuugcuguccuuggga

SEQ ID NO: 479346 - RNA, 65 nt, Homo Sapiens
uuugcuaaauauguacaugagacaggcacauguaagaaaccaaaaucauaaugaauuacagucau

SEQ ID NO: 479347 - RNA, 65 nt, Homo Sapiens
ucuuacccuugcccuagauuuacuauauauacacggaaaccaauuaacaucuguucccaccaacu

SEQ ID NO: 479348 - RNA, 65 nt, Homo Sapiens
gcccccguccggcuuccuugguggaggccgucuaggaaaccaaaaacucccaggaugccccggug

SEQ ID NO: 479349 - RNA, 65 nt, Homo Sapiens
uaaaggagaaguggggcagcugcaggacauguagagaaaccaaacugggaaaucuuacaaggagu

SEQ ID NO: 479350 - RNA, 65 nt, Homo Sapiens
acuccaguuuaaaaaguguuauuuuuaaaacauuugaaaccaaguacuguuuaauuucaaucaga

SEQ ID NO: 479351 - RNA, 65 nt, Homo Sapiens
uugcuucagccccagguguggugacuuagaccuaggaaaccaauuaugaguggaaagugacccuc

SEQ ID NO: 479352 - RNA, 65 nt, Homo Sapiens
aaacaaaaugccaguauuuucuuaagccaugaugugaaaccaaugacccugugaccacauggcac

SEQ ID NO: 479353 - RNA, 65 nt, Homo Sapiens
aaacguccugaccugugaucacacaugacagugaggaaaccaagugcaacuccuggguuuuuuua

SEQ ID NO: 479354 - RNA, 65 nt, Homo Sapiens
gauauugcucuauauuuuuuuuccauuuaucuguggaaaccaacacaaauuucauuuuuuccuuu

SEQ ID NO: 479355 - RNA, 65 nt, Homo Sapiens
gccuucaaugaaacaagccuuuauaaauugccauggaaaccaaguagaaaccaaaccaccaucuu

SEQ ID NO: 479356 - RNA, 65 nt, Homo Sapiens
caccaucuuuuauaaauugcaucuguuccaaugaagaaaccaaacuugaacacccaaacuacguc

SEQ ID NO: 479357 - RNA, 65 nt, Homo Sapiens
cauguaggaaaauauugguacuuauuaguuaaaaggaaaccaagggcaacuaaauuuacccuuua

SEQ ID NO: 479358 - RNA, 65 nt, Homo Sapiens
aaaaaucgcauuucaacccuagggacaggucccuggaaaccaaaguaaccuuggagugagagccc

SEQ ID NO: 479359 - RNA, 65 nt, Homo Sapiens
gugaacacaucaacaccacguuuaaagaugcuuuggaaaccaaccaacggggaacuauagcaaua

SEQ ID NO: 479360 - RNA, 65 nt, Homo Sapiens
gugaacuuccugucucccacccccacuuuggcccagaaaccaaauucuccccaccaccccuccug

SEQ ID NO: 479361 - RNA, 65 nt, Homo Sapiens
uacaaacacaauauuuaaucuccaugaucuccaaagaaaccaaaauggcaauuuaacgagccacu

SEQ ID NO: 479362 - RNA, 65 nt, Homo Sapiens
gucaugugggcuugccuucucugccaaacgacugggaaaccaaaaugagcccaccuuguguucuu

SEQ ID NO: 479363 - RNA, 65 nt, Homo Sapiens
agagagaaagucaaauaaagucaaagaccaguuuggaaaccaaaguuggaaaagaagaauuguag

SEQ ID NO: 479364 - RNA, 65 nt, Homo Sapiens
aagaaacacccuaaucuagauaaaggucuguuucagaaaccaacagugauggcauucuaaagagu

SEQ ID NO: 479365 - RNA, 65 nt, Homo Sapiens
agguuggagacuucaaccgggcaaaggagcacaaggaaaccaagcagcagaggccccaucagcac

SEQ ID NO: 479366 - RNA, 65 nt, Homo Sapiens
aaaauauaguuuauaaaucggcaguacgguauuaugaaaccaagaaaggguuucuugaaaagcuu

SEQ ID NO: 479367 - RNA, 65 nt, Homo Sapiens
agaaaacggcacaccaaucaauaaagaacugagcagaaaccaacagugugcuuuuaauaaaggau

SEQ ID NO: 479368 - RNA, 65 nt, Homo Sapiens
cuaucugggucucuuauuucaaccuaauaaagcaagaaaccaagccaucacugcuccuuauaaua

SEQ ID NO: 479369 - RNA, 65 nt, Homo Sapiens
aagaauaaaugagagauauuauauucuuacauauagaaaccaaguuauaaacuauuuaaaucaaa

SEQ ID NO: 479370 - RNA, 65 nt, Homo Sapiens
uacaaguauucaguuccaauuauguacacaacuuagaaaccaaaugauuuauaaaugcacuguaa

SEQ ID NO: 479371 - RNA, 65 nt, Homo Sapiens
auacugcacucuaauauuuuggauagaaaucauuagaaaccaagcuuuuaaauaaaacuucuuuu

SEQ ID NO: 479372 - RNA, 65 nt, Homo Sapiens
acuuagcucaccugcauucuuauuuauaguccaaagaaaccaaagauuugaagaaaaaaaagcgu

SEQ ID NO: 479373 - RNA, 65 nt, Homo Sapiens
agauucaugaaaccuuggccagguuugcaugguaugaaaccaaauguguagcagcacacuuguuc

SEQ ID NO: 479374 - RNA, 65 nt, Homo Sapiens
cugcugacaccucaaucuuaaagggggccucagaggaaaccaaccggaauagccaucgacaaacu

SEQ ID NO: 479375 - RNA, 65 nt, Homo Sapiens
uuaugaagaucuucucccaguggccugccuuaucagaaaccaagccugagcuguagcauuugggc

SEQ ID NO: 479376 - RNA, 65 nt, Homo Sapiens
acuuuacauuuuuauuuuuaucagaggaaagaauggaaaccaaucuauuggcaccaaguuagguc

SEQ ID NO: 479377 - RNA, 65 nt, Homo Sapiens
ccaucaacgcacaccugcuaucguggaacagccuagaaaccaagggacuccaccaccaagucacu

SEQ ID NO: 479378 - RNA, 65 nt, Homo Sapiens
ccgccagcugauuggaugucuaggaaugacugaaagaaaccaaaacagccuguccacugcugcug

SEQ ID NO: 479379 - RNA, 65 nt, Homo Sapiens
ccuugcccuggggccgguucuuacccagguccagagaaaccaacgcgggaugucagacuucacca

SEQ ID NO: 479380 - RNA, 65 nt, Homo Sapiens
agucaguaccccugguaaaccaagccucccacacugaaaccaaaacauaaaaaccaaacccagac

SEQ ID NO: 479381 - RNA, 65 nt, Homo Sapiens
guggccgucugcaagccgaggagggggccucaggagaaaccaacccugcaaucaccuugaucuug

SEQ ID NO: 479382 - RNA, 65 nt, Homo Sapiens
ugguccuugugaugguauuacuuuuuacaaagaaugaaaccaaauggacucagcccucucccaca

SEQ ID NO: 479383 - RNA, 65 nt, Homo Sapiens
aguuguccccauugucuacccacacaaauccucaggaaaccaaccaccgcccagguggcccugag

SEQ ID NO: 479384 - RNA, 65 nt, Homo Sapiens
cuuaguggauuuaccuguagaguuuauuggauccugaaaccaaucaauuacuuagaacuaggcaa

SEQ ID NO: 479385 - RNA, 65 nt, Homo Sapiens
uugugacagucacugcauuugccugcuucuuuccagaaaccaaacuaggagaugaaacugguucc

SEQ ID NO: 479386 - RNA, 65 nt, Homo Sapiens
ucaccaagucucgucuucuuuccuuccugugaguugaaaccaaacaggccucucgcucacuccuc

SEQ ID NO: 479387 - RNA, 57 nt, Homo Sapiens; identical to SEQ ID NO: 478958

SEQ ID NO: 479388 - RNA, 65 nt, Homo Sapiens
agcugcaaaguggagucugggauuccucaccccgggaaaccaaggccaaccacaaagguguuugu

SEQ ID NO: 479389 - RNA, 65 nt, Homo Sapiens
ugucuccugggggggagaaaguaugggagggguuggaaaccaaguauuuaacuuaaucaaaugug

SEQ ID NO: 479390 - RNA, 65 nt, Homo Sapiens
ccuucccauuuccuccucccagccaaaagcacucugaaaccaagauguuuggccacccucuggcc

SEQ ID NO: 479391 - RNA, 64 nt, Homo Sapiens
aaaaaugaguuguucaucagauaaaacacugaaaagaaaccaacuaaauuguauauuuugaaaa

SEQ ID NO: 479392 - RNA, 65 nt, Homo Sapiens
aaccagacccgaaaccaggccuaggaaccagaccugaaaccaaggaaaggcagguagccuggcgc

SEQ ID NO: 479393 - RNA, 65 nt, Homo Sapiens
acagaaucagaaaaaaaaagcauuaaaauuuauuugaaaccaaaaaagagcccaaaaagccaaag

SEQ ID NO: 479394 - RNA, 65 nt, Homo Sapiens
uuuuccaguuuuauggaauugggagucugacaagugaaaccaauuuaauguaaaguauuuggcuu

SEQ ID NO: 479395 - RNA, 65 nt, Homo Sapiens
aagaaccccuuuuaucccuggaagaggcuguguaugaaaccaaugcccaggguuugaaggguguu

SEQ ID NO: 479396 - RNA, 65 nt, Homo Sapiens
cucuuuuucagcuuuauuuuuaagaguacagucaggaaaccaacaaggggccuaagaguggcugc

SEQ ID NO: 479397 - RNA, 65 nt, Homo Sapiens
cuccaacuccaaagccauaaauaaucaccauuuuugaaaccaaaccagagccugaguguugccua

SEQ ID NO: 479398 - RNA, 65 nt, Homo Sapiens
agguuaaaauuuauagucauucuaacugcacuuuggaaaccaagcaaggggagaagacaaaugaa

SEQ ID NO: 479399 - RNA, 65 nt, Homo Sapiens
aggucaagcaauaggcgccuggcagugucaagccugaaaccaagcaauaccgucauguuucagcc

SEQ ID NO: 479400 - RNA, 65 nt, Homo Sapiens
uuauccagaggccugcugcagauggggaagagcuggaaaccaagaaguuugucaacagaggaccc

SEQ ID NO: 479401 - RNA, 65 nt, Homo Sapiens
gaaaaaaagucauuaggcuuucccuuugugucagugaaaccaaaagugcuucuuacaacguucgc

SEQ ID NO: 479402 - RNA, 65 nt, Homo Sapiens
agauuugguugccauagucauaagcaaugauacaugaaaccaaugaaagacaguacauguaauaa

SEQ ID NO: 479403 - RNA, 65 nt, Homo Sapiens
uagaacauauuugcauaagauagcuauuuacucuggaaaccaacaacuuuugagauuucccuugc

SEQ ID NO: 479404 - RNA, 65 nt, Homo Sapiens
uaauuagugcaaauacaagcugcguuucuuuaauagaaaccaaaggcaucuggagcccgagaggc

SEQ ID NO: 479405 - RNA, 65 nt, Homo Sapiens
auuuccuagccagcugggggacacuggaaauucgggaaaccaagagagaggaagaaggagacgcc

SEQ ID NO: 479406 - RNA, 65 nt, Homo Sapiens
cgcaggcugagcaagucuguaaacugauucugggagaaaccaagcugcuggccauaggguguccu

SEQ ID NO: 479407 - RNA, 65 nt, Homo Sapiens
cagagcugaggggacagggacccuuugucaguggggaaaccaaggacacaggacagcagaagauc

SEQ ID NO: 479408 - RNA, 65 nt, Homo Sapiens
ucacccuggcugggagcaucuguauguuucugguggaaaccaaguuccuucccuuauuucuaacg

SEQ ID NO: 479409 - RNA, 65 nt, Homo Sapiens
ggcucauggagaaaacaaauugacuuagggaacuugaaaccaacuacugccgcaagaccacuaca

SEQ ID NO: 479410 - RNA, 65 nt, Homo Sapiens
ucuaagaggacuggauugcaaaucucccaaagagagaaaccaauuucuggcugccucugagucug

SEQ ID NO: 479411 - RNA, 65 nt, Homo Sapiens
aacacuacuauuaaacugcaucuaugguugaaucagaaaccaagaccgacgguagaguucuuuca

SEQ ID NO: 479412 - RNA, 65 nt, Homo Sapiens
augggaaguggcuccuagggccauccagccuguaggaaaccaaaguacaaggcuuccaggggaug

SEQ ID NO: 479413 - RNA, 65 nt, Homo Sapiens
aaaacccccuaagugagggauuaagauuugagggugaaaccaaagccugcacuucuagcccucau

SEQ ID NO: 479414 - RNA, 65 nt, Homo Sapiens
gcuagggaaacagauacucuucuguacauaaaguagaaaccaaaaucuuagcaagauauuuuauc

SEQ ID NO: 479415 - RNA, 65 nt, Homo Sapiens
uucuuuuuuauacucaaucagcacccucauacacagaaaccaauugagauaaagaccuuuuccau

SEQ ID NO: 479416 - RNA, 65 nt, Homo Sapiens
caacuuuucaccuccugaguaaacaaaaacaccaagaaaccaaguuccucucacugccugccaga

SEQ ID NO: 479417 - RNA, 65 nt, Homo Sapiens
gggcugguauucucucuaugaauaauaaaaaacaagaaaccaaguguauaguccuagcugacgcc

SEQ ID NO: 479418 - RNA, 65 nt, Homo Sapiens
cuuauauuaaaaggcaaagaacacucagaaaugaugaaaccaaauauuuuuagaagaaauauguu

SEQ ID NO: 479419 - RNA, 65 nt, Homo Sapiens
cugauuccuuccaacgugcacuucagcuggagaaagaaaccaagaagggaagcggccgcugggcc

SEQ ID NO: 479420 - RNA, 65 nt, Homo Sapiens
cguuuggucagacaucaucuccuuggcugcccuuugaaaccaaaucacuugccuuggggauaaag

SEQ ID NO: 479421 - RNA, 65 nt, Homo Sapiens
aauaugacguacgaaauggacaaaaagcuuuuucugaaaccaacuuuuuacuuccaucauccuuu

SEQ ID NO: 479422 - RNA, 65 nt, Homo Sapiens
uuuuuaguuauuguucaagguauuuucacagaguggaaaccaauuagugauaggcuuaaagauug

SEQ ID NO: 479423 - RNA, 65 nt, Homo Sapiens
acaaacauuuuuaaaauuaauuaacauggaacaaugaaaccaacacgaggccgauuuuuuuuuuu

SEQ ID NO: 479424 - RNA, 65 nt, Homo Sapiens
agucccagugaucuguuaccagcuugccucuuugagaaaccaaggcagccgggcaggguggaagg

SEQ ID NO: 479425 - RNA, 65 nt, Homo Sapiens
guugccaggggugaggccgugccccaggccuccccgaaaccaaaggggaaggcagggguggggcc

SEQ ID NO: 479426 - RNA, 65 nt, Homo Sapiens
agcuaggggcccgccccgcggacugacagcaccaggaaaccaaaugaugucccugcccgccgccc

SEQ ID NO: 479427 - RNA, 65 nt, Homo Sapiens
caccuucgaaaacaugguaggacucacacuggauagaaaccaaagcaggugaaucaccugagguc

SEQ ID NO: 479428 - RNA, 65 nt, Homo Sapiens
ccucccacugccgcucaggggcugacccuauuuaggaaaccaaagaggguggguugaaccuacuc

SEQ ID NO: 479429 - RNA, 65 nt, Homo Sapiens
ccucugggucccccuucucuguccacccacagagugaaaccaauuaaaauguuggaucucauuua

SEQ ID NO: 479430 - RNA, 65 nt, Homo Sapiens
ccuuggagcacugagcaccauuuggaagcuugagagaaaccaaaauuaaagagagaaagagagag

SEQ ID NO: 479431 - RNA, 65 nt, Homo Sapiens
cuugccucaagcaaaagcaugucguaagaucuuaagaaaccaaucggcccagcauucagggagga

SEQ ID NO: 479432 - RNA, 65 nt, Homo Sapiens
cugucuccaccuugauauuguuauggccuccagaggaaaccaaccaccuggaacagaugcuuuca

SEQ ID NO: 479433 - RNA, 65 nt, Homo Sapiens
gggggaugucagccucacccucccugcuccaggaugaaaccaagacugcagagggagccuccugc

SEQ ID NO: 479434 - RNA, 65 nt, Homo Sapiens
cuaauaaaguuuucccauccgcguggccgaagcuggaaaccaaacgcucggggcgggcggagccc

SEQ ID NO: 479435 - RNA, 65 nt, Homo Sapiens
agagacugaucauccaggccuuuuuaaaugaucaugaaaccaaaagaaauguuugucuuuucugu

SEQ ID NO: 479436 - RNA, 65 nt, Homo Sapiens
aaaaaaaucaaucagaauaaagggugguuuauccagaaaccaagauuuuauuauccuguccccag

SEQ ID NO: 479437 - RNA, 65 nt, Homo Sapiens
ugcuccaugccggguuauuuacgugcaauaggguggaaaccaaacuuucauaaccaggccggacc

SEQ ID NO: 479438 - RNA, 65 nt, Homo Sapiens
uggaagcccccucugccuccggaagggggugcccugaaaccaaacggcaggcggguggggggaug

SEQ ID NO: 479439 - RNA, 65 nt, Homo Sapiens
cagcugcuguuaauauggauaaauaaauguauugugaaaccaaaauuacuguauguugcuuuucu

SEQ ID NO: 479440 - RNA, 65 nt, Homo Sapiens
ugcagccucaacaccauggagucuguaaaaugugugaaaccaaacuacugauugcugucucgugu

SEQ ID NO: 479441 - RNA, 65 nt, Homo Sapiens
cagucuucuauaaucuggggcuugauuuuacuucagaaaccaaauaaaggcaggaaggauccugc

SEQ ID NO: 479442 - RNA, 65 nt, Homo Sapiens
aauuaaaacuuaacagcaucaaauuauugggaccagaaaccaaguaauguauaauguggcuuuug

SEQ ID NO: 479443 - RNA, 65 nt, Homo Sapiens
ggcccuuccaacucuggagugucuguaguucuugugaaaccaaaacguugacuaccugccucuuu

SEQ ID NO: 479444 - RNA, 65 nt, Homo Sapiens
ccugaagccuggauuccagcagugaaugcuagacagaaaccaagccauuaaugagauguuauuac

SEQ ID NO: 479445 - RNA, 65 nt, Homo Sapiens
uacuuuauuacgaguaaaguguaaugaguacuguggaaaccaaauuugaauacugcaaauuugua

SEQ ID NO: 479446 - RNA, 65 nt, Homo Sapiens
auacaaacagggcagaaccacagaagaacguuuuagaaaccaagagaugugcagaaagaaauguu

SEQ ID NO: 479447 - RNA, 65 nt, Homo Sapiens
aauugaaauaagcucuuugcaggcguccaauccuagaaaccaauggucuccagaacucucacaca

SEQ ID NO: 479448 - RNA, 65 nt, Homo Sapiens
caauuccucuuauucuuaaauaucuaaagggaaaggaaaccaacuuuaauuucagaacuucucuu

SEQ ID NO: 479449 - RNA, 65 nt, Homo Sapiens
uuccucgaguggccacugugagccucgucacagcagaaaccaacuuuucuaacgacugaguucgc

SEQ ID NO: 479450 - RNA, 65 nt, Homo Sapiens
acaacaaaauggcuuguugcguaguccagacuuuagaaaccaaacguuuuacuggcaguucuaua

SEQ ID NO: 479451 - RNA, 65 nt, Homo Sapiens
cugcacaccuagaaccccaaggagaggccaaaagggaaaccaaggggaugaugccuaggcccaaa

SEQ ID NO: 479452 - RNA, 65 nt, Homo Sapiens
ucauguucuucuaaagugucagaggucuugcuuuugaaaccaaaaggccccuucugccuuccagg

SEQ ID NO: 479453 - RNA, 65 nt, Homo Sapiens
cuaagagaugagcgaugccucacuucacagaugaggaaaccaagguggagaaagagaauuauccc

SEQ ID NO: 479454 - RNA, 65 nt, Homo Sapiens
uaugauaaugauaccaaaggaaagauaauuaucaugaaaccaacuuuuggaucauucccuuuuua

SEQ ID NO: 479455 - RNA, 65 nt, Homo Sapiens
gccacacaacaucaagaaggccgacaaccagguuggaaaccaagacggagcucagacccaccaca

SEQ ID NO: 479456 - RNA, 65 nt, Homo Sapiens
gcuuggggcagccauuggccucugucucguuuugggaaaccaaggucaggaggccguugcagaca

SEQ ID NO: 479457 - RNA, 65 nt, Homo Sapiens
guaauaauuguggaaauguucacuucugauuuagugaaaccaauuaaguagagauaauguguagu

SEQ ID NO: 479458 - RNA, 65 nt, Homo Sapiens
gaacgggaccugcuggccucucauuggagccuagugaaaccaaaucaagaacucaaauuccuuuc

SEQ ID NO: 479459 - RNA, 65 nt, Homo Sapiens
aagaaacuucgccuuaucagcucaccggguguuccgaaaccaaagguuccagaggaugcaucugg

SEQ ID NO: 479460 - RNA, 65 nt, Homo Sapiens
cagucugcuguccugaaacccagaagugauggagagaaaccaacaagagaucucgaacccugucu

SEQ ID NO: 479461 - RNA, 65 nt, Homo Sapiens
agcaccuacugggugcuggguucacuguguccuaggaaaccaagaggguccccaguccuggccuc

SEQ ID NO: 479462 - RNA, 65 nt, Homo Sapiens
cgcugguaccugcuggcccauggcccggguguagagaaaccaagcggcagccaccaccaguguug

SEQ ID NO: 479463 - RNA, 65 nt, Homo Sapiens
caucugcauguuuauuuccuacaaguuaugcgaaggaaaccaagcuuuaugcuaccuaccccugu

SEQ ID NO: 479464 - RNA, 65 nt, Homo Sapiens
auuuaagacgggcugcucuugcuccugguuggaaagaaaccaaagggcucuuucuaccaauguuu

SEQ ID NO: 479465 - RNA, 65 nt, Homo Sapiens
acuguaggaacuugacuugcguuagaguguacucugaaaccaacucgucucuggccgcaggaguc

SEQ ID NO: 479466 - RNA, 65 nt, Homo Sapiens
ugaaagaagguuuaucauuacaaauaccuuccaaugaaaccaagaauuucucaaaauauuuaaug

SEQ ID NO: 479467 - RNA, 65 nt, Homo Sapiens
ucaaaaucaguuuuuauauuccccaaaagaagaaggaaaccaaggaguagcuauauauuucuacu

SEQ ID NO: 479468 - RNA, 65 nt, Homo Sapiens
gcaacuauagguuuaaaccaagacaaaugaagacugaaaccaagaauauuguucuuaugcuggaa

SEQ ID NO: 479469 - RNA, 65 nt, Homo Sapiens
ugaaugggagggcgggccuggagcugcgugagagugaaaccaagaagcggauggggaagggagag

SEQ ID NO: 479470 - RNA, 65 nt, Homo Sapiens
cuauaaagugccucggacaguccgcaguuguagcagaaaccaacaagaaccacuccuucauguuu

SEQ ID NO: 479471 - RNA, 65 nt, Homo Sapiens
aagucauaugccuccagccauuauaugagaacugugaaaccaauaugguuuucuuuaugucuugg

SEQ ID NO: 479472 - RNA, 65 nt, Homo Sapiens
uauuauuucuuaucuuucuucuuuuauauuuuuuggaaaccaaauuuauaguuaguuuagguaaa

SEQ ID NO: 479473 - RNA, 65 nt, Homo Sapiens
ucaccaaaaaaaguauauagugacauuuuuaguaugaaaccaaauuacacuaaggucuuuuguug

SEQ ID NO: 479474 - RNA, 65 nt, Homo Sapiens
cugcauagaaggaggagagggaaaauguuuuguaagaaaccaaucaagauaaaggacagugaagu

SEQ ID NO: 479475 - RNA, 65 nt, Homo Sapiens
uaauaaaauuuccccuaaucuuuucugaaucuucugaaaccaaauguaacuauguuuuaucgucc

SEQ ID NO: 479476 - RNA, 65 nt, Homo Sapiens
cuuaaauuucuuaaccuaggcuucagggagcauaugaaaccaaaauuauauggaacauuuucugu

SEQ ID NO: 479477 - RNA, 65 nt, Homo Sapiens
auguagaacuguaauaagugaauuacaggucacaugaaaccaaaacgggcccugcuccauaagag

SEQ ID NO: 479478 - RNA, 65 nt, Homo Sapiens
acuagugcagcauuucagcagaaaccugguuuuaugaaaccaaagaaacucuuaaauuauaaugu

SEQ ID NO: 479479 - RNA, 65 nt, Homo Sapiens
cauuacaccaugguuuuuaguuauuauuacaagaagaaaccaagaaagcuaauuaagggcgauga

SEQ ID NO: 479480 - RNA, 65 nt, Homo Sapiens
uggacaaauccucaccaccacuaauuaaacauggagaaaccaaauucagaggagggugaggaaga

SEQ ID NO: 479481 - RNA, 65 nt, Homo Sapiens
ccacuucuuucuaggagauuuaaaugucccccugagaaaccaauccauuucaacauagagucaca

SEQ ID NO: 479482 - RNA, 65 nt, Homo Sapiens
cacagagaggcucuccucucugaaugcacaaaugggaaaccaaggugugaggccugcagaggccc

SEQ ID NO: 479483 - RNA, 61 nt, Homo Sapiens; identical to SEQ ID NO: 479054

SEQ ID NO: 479484 - RNA, 61 nt, Homo Sapiens; identical to SEQ ID NO: 479055

SEQ ID NO: 479485 - RNA, 65 nt, Homo Sapiens
cccaugagcagcaguggaagauggugagggcucuagaaaccaagcgaacugaggaaggugcuuag

SEQ ID NO: 479486 - RNA, 65 nt, Homo Sapiens
caugaaaauuauggaagacuuuuagccagaauaaagaaaccaaaucugaaacuuugggaauuugc

SEQ ID NO: 479487 - RNA, 65 nt, Homo Sapiens
uaauuauuauuucuuaucuucuuuuauauuuuuuggaaaccaaauuuauaguuaguuuagguaaa

SEQ ID NO: 479488 - RNA, 65 nt, Homo Sapiens
aaugugugaacuugacuuguguuagaguauauucugaaaccaacuugucccaggccacaggagug

SEQ ID NO: 479489 - RNA, 66 nt, Homo Sapiens
ucaggacgucaaaaacucaccauggaccccaaggcagaaaccaagaacugucugcaggcaaauaag

SEQ ID NO: 479490 - RNA, 66 nt, Homo Sapiens
uggaugcuuaauggugcuagaggcucaaguguguuugaaaccaagagccaguugucccccaugcag

SEQ ID NO: 479491 - RNA, 66 nt, Homo Sapiens
uccucagccucugcaacugcaagaaaggggacccaagaaaccaaagucugccgcccaccucgcucc

SEQ ID NO: 479492 - RNA, 66 nt, Homo Sapiens
gauauuaaguguucucaacugaguaacuuuuaaguggaaaccaaguuuagauuuggggagugguaa

SEQ ID NO: 479493 - RNA, 66 nt, Homo Sapiens
aagacuuugucuaagccucauuauacugaaguugaagaaaccaaaugagcuccacccucacuuugc

SEQ ID NO: 479494 - RNA, 66 nt, Homo Sapiens
auaaaaauuuauuaaauauaaauauccccagggacagaaaccaaggccccgagcucagggcagcug

SEQ ID NO: 479495 - RNA, 66 nt, Homo Sapiens
ugaagucaauugaguaaggacaccuccagccauacagaaaccaacacugugugggggccaaggucu

SEQ ID NO: 479496 - RNA, 66 nt, Homo Sapiens
gcgggagagcgaugcuuggauuuuuguuuccuauuagaaaccaacaguuuuguucuaauuucauuu

SEQ ID NO: 479497 - RNA, 66 nt, Homo Sapiens
auugaagcucccagugaccuggagggaggauuccuggaaaccaaacaaucaguuuaggugcaggug

SEQ ID NO: 479498 - RNA, 66 nt, Homo Sapiens
cuuucaucagguaucuuucuguggcauuugagaacagaaaccaagaaacaugguaauuacuaaauu

SEQ ID NO: 479499 - RNA, 66 nt, Homo Sapiens
uaucccuuuucuauaaaaaauaaguuaaugugucaagaaaccaacucuauuaaggugggguuuaau

SEQ ID NO: 479500 - RNA, 65 nt, Homo Sapiens; identical to SEQ ID NO: 479071

SEQ ID NO: 479501 - RNA, 66 nt, Homo Sapiens
agguuuucgcacuucuuggcugguccagggacugcagaaaccaaagcugcuauuguugaggaauaa

SEQ ID NO: 479502 - RNA, 66 nt, Homo Sapiens
ccaauuauguuaauaauuuauuuaaugagugguauggaaaccaauugauuuuuuuagauaaaagaa

SEQ ID NO: 479503 - RNA, 66 nt, Homo Sapiens
ucccccacucccacuuccaggauugugguuuggauugaaaccaaguuuacaaguagacaccccugg

SEQ ID NO: 479504 - RNA, 66 nt, Homo Sapiens
cgucaaaugauugccaucagaaagagacaacuugaagaaaccaacaaugacuaugaaacagcugac

SEQ ID NO: 479505 - RNA, 66 nt, Homo Sapiens
cauuuucacccauucugugguucauuguaguuuaaggaaaccaagcauauagaugcauuagugauu

SEQ ID NO: 479506 - RNA, 66 nt, Homo Sapiens
gguuucaccuuuguauaagauauagccaagacugaagaaaccaaauauauguguuuacuguagcau

SEQ ID NO: 479507 - RNA, 66 nt, Homo Sapiens
uuauauauauuauuuuuuuuuaagaaaggaggaaaagaaaccaaaaguuuuuuuuaagaaaaaaaa

SEQ ID NO: 479508 - RNA, 66 nt, Homo Sapiens
ggugcugccuucauccuccccaccuaaugcauuuuugaaaccaaagguaccuagccucagagacag

SEQ ID NO: 479509 - RNA, 66 nt, Homo Sapiens
acgaaaauauuuccugauucaagauucuauaaaaaggaaaccaagcauaagacucugucaucauac

SEQ ID NO: 479510 - RNA, 66 nt, Homo Sapiens
gcacaauucccauugagagauccuucacuuauugcugaaaccaagacaaaagggcaagaucuuuuu

SEQ ID NO: 479511 - RNA, 66 nt, Homo Sapiens
aaggccagcaccuccgucggccacacggggcagagagaaaccaacccaucccccaggacuugauga

SEQ ID NO: 479512 - RNA, 66 nt, Homo Sapiens
cucaaaaaacagucuccuaacauugcuuaaaaugaugaaaccaaccggauguuuaaaacaucaaca

SEQ ID NO: 479513 - RNA, 66 nt, Homo Sapiens
gcgcuuugcaauauuuauuauugacuugaaaagaaagaaaccaaguugggacauuagucguuauau

SEQ ID NO: 479514 - RNA, 66 nt, Homo Sapiens
ccuucuagauucaggugacuucccuuccaguuaugagaaaccaauggguccuuagaagucccauuc

SEQ ID NO: 479515 - RNA, 66 nt, Homo Sapiens
guauguguuuuaaaauuacauuuaauauaggauuuagaaaccaagguguuuacaauuaggcuauuu

SEQ ID NO: 479516 - RNA, 66 nt, Homo Sapiens
acaggcacccaagcacuaccacugguuccagugagagaaaccaaccccaggcgaguggggcccagg

SEQ ID NO: 479517 - RNA, 66 nt, Homo Sapiens
cagaugagaugacugccauggagagggaaagugacggaaaccaaguucuccuucgagcuugacucu

SEQ ID NO: 479518 - RNA, 66 nt, Homo Sapiens
cuguguaucuaauacuaaccgggguauuucagcuuugaaaccaaauugagaagauuuauuccacca

SEQ ID NO: 479519 - RNA, 66 nt, Homo Sapiens
aaauacaaaauccuucuccauggaacaccugauggugaaaccaaacccgaaacugacuugcucacc

SEQ ID NO: 479520 - RNA, 66 nt, Homo Sapiens
gggagucucccaugauggggucuucaugaugagauggaaaccaaaaaacgccgcguggacugaagc

SEQ ID NO: 479521 - RNA, 66 nt, Homo Sapiens
aguugaguuuccaauggaacuuauaucacaauuuacgaaaccaaaacuuacaguauacauauauau

SEQ ID NO: 479522 - RNA, 66 nt, Homo Sapiens
cugagcuuuuaacuuucuccucccuaacuugggccagaaaccaaagcaaggcuaaccuuucuaagc

SEQ ID NO: 479523 - RNA, 66 nt, Homo Sapiens
cccugcugagcagagccauuaucuacagagauccaggaaaccaaagugggaaacuuacauguugag

SEQ ID NO: 479524 - RNA, 66 nt, Homo Sapiens
aaucugugugacuugcuuuaaacuuauaugcacugggaaaccaaaaaucgacuugaguguaaacau

SEQ ID NO: 479525 - RNA, 66 nt, Homo Sapiens
agaauuagggaugggaauacuuuuuuuuuucuucuggaaaccaaguuugagauagucuuauucuga

SEQ ID NO: 479526 - RNA, 66 nt, Homo Sapiens
uaaccuuuugcaccugcucucuuucucuacuuugaggaaaccaaagccguuucuucccuguauuuu

SEQ ID NO: 479527 - RNA, 66 nt, Homo Sapiens
ucaauuuagagguauggauggugucggugaauaaaugaaaccaaucauuucauuauguguucuaca

SEQ ID NO: 479528 - RNA, 66 nt, Homo Sapiens
cuacugcauccuucaacucucacuagaaaaucuuuugaaaccaaauggauuaauuuauggcuauuu

SEQ ID NO: 479529 - RNA, 66 nt, Homo Sapiens
uaacugaagaugauguaugaaggaguuggaguuguugaaaccaagguguccaugaucccuccccac

SEQ ID NO: 479530 - RNA, 66 nt, Homo Sapiens
ggcagugucuuaaggagacugguaggaggaggcauggaaaccaaaaggccguguguuuagaagccu

SEQ ID NO: 479531 - RNA, 66 nt, Homo Sapiens
auaaacaaaugcuuguugauagccuuuuucuaucaagaaaccaaggagcuaauuauuaauaacaau

SEQ ID NO: 479532 - RNA, 66 nt, Homo Sapiens
cauuccuggaaucaaggaauccugagucugggcaaugaaaccaaagccaggaguugacgcauccug

SEQ ID NO: 479533 - RNA, 66 nt, Homo Sapiens
uuuucuuggcaguauuccaugggauguuaagcaaaggaaaccaaaggaaucguuucaaauggacuc

SEQ ID NO: 479534 - RNA, 66 nt, Homo Sapiens
auccucugaaggccgggacccagucauacauccuuagaaaccaaaguaugguuuuuguuuucucuu

SEQ ID NO: 479535 - RNA, 66 nt, Homo Sapiens
aggaagaaaaauagguguauaaaauguuuuccaugagaaaccaagaaacuuacacugguuugacag

SEQ ID NO: 479536 - RNA, 66 nt, Homo Sapiens
uacucauuaaguguuauuuauuuuacucaagaacuggaaaccaacuaaaugccuucuauagaagua

SEQ ID NO: 479537 - RNA, 66 nt, Homo Sapiens
uuacucuuucucaccugaugcucuuaaaagaucuuagaaaccaaccauacagacgagccgaugcgg

SEQ ID NO: 479538 - RNA, 66 nt, Homo Sapiens
agccauuugcacauaguuaccagucacucuguuucugaaaccaauccagaaauucauguuagaaca

SEQ ID NO: 479539 - RNA, 53 nt, Homo Sapiens; identical to SEQ ID NO: 478681

SEQ ID NO: 479540 - RNA, 66 nt, Homo Sapiens
cucaguaauguauuugaaggaaaaauacccugauuugaaaccaacagcagauguugcaaacuuuca

SEQ ID NO: 479541 - RNA, 50 nt, Homo Sapiens; identical to SEQ ID NO: 478683

SEQ ID NO: 479542 - RNA, 66 nt, Homo Sapiens
ugaugccucuacuaucauuaccucuauugggacccagaaaccaauaccccaaaauauggugcaugg

SEQ ID NO: 479543 - RNA, 66 nt, Homo Sapiens
agccacgcuuguuccccauguaccucuagagaagcagaaaccaaagucccccugugcccugggagg

SEQ ID NO: 479544 - RNA, 66 nt, Homo Sapiens
uuagcaccuuuucaagggguuuuuuugauguuaacagaaaccaaucggcucugagggcuguuuuuu

SEQ ID NO: 479545 - RNA, 66 nt, Homo Sapiens
cccauaguacagugccuuguacaccuuucccauaaagaaaccaaacauagcuagcaaucuaugcaa

SEQ ID NO: 479546 - RNA, 66 nt, Homo Sapiens
aaaaugugccuuuggugggcaggguuugaacuuuuggaaaccaauuccaaaacucuguguugcugc

SEQ ID NO: 479547 - RNA, 66 nt, Homo Sapiens
gggucggcaguggacgcguaagaaagguugguuucagaaaccaagaucuuaaagaggagagcagga

SEQ ID NO: 479548 - RNA, 58 nt, Homo Sapiens; identical to SEQ ID NO: 478690

SEQ ID NO: 479549 - RNA, 66 nt, Homo Sapiens
cucagaggggcaaagucaccuuguuuuauagaugaggaaaccaagggggucuacaauggggagaac

SEQ ID NO: 479550 - RNA, 66 nt, Homo Sapiens
gauaaaacuguucauggaugccuuccacgcaaauaagaaaccaaggaguacuucguuaugaaaaug

SEQ ID NO: 479551 - RNA, 66 nt, Homo Sapiens
uuuuucaggaugcuguauuuacugccucguaggguagaaaccaauauaaaaugugaacguuuucua

SEQ ID NO: 479552 - RNA, 66 nt, Homo Sapiens
uaagaacugaaugacagugauggcaguuaaucugcugaaaccaaaguggauacauucuucagcauu

SEQ ID NO: 479553 - RNA, 66 nt, Homo Sapiens
caaagaaaauucugaaaaauugggagaugcuaccaagaaaccaaccguauguuauucauguauuac

SEQ ID NO: 479554 - RNA, 66 nt, Homo Sapiens
cuucagauaaacuugcaagaugugacugaaaugcuugaaaccaaagcacuccucaauugggagugu

SEQ ID NO: 479555 - RNA, 66 nt, Homo Sapiens
caauaugagguaccuuuacaggacaugagugaaaaugaaaccaagucauagguuuccgcuuucaug

SEQ ID NO: 479556 - RNA, 66 nt, Homo Sapiens
aaacuuguuuuuagaauauuaaaaugugaguaaauugaaaccaagagggauuuacuuuuaagaggc

SEQ ID NO: 479557 - RNA, 66 nt, Homo Sapiens
ccgcagugaguuaaaauuuaguaagaugaagauguggaaaccaaugaaaaguacauuuagaaaugc

SEQ ID NO: 479558 - RNA, 66 nt, Homo Sapiens
cuguagagcugaguuaccaaaauuucuauuucaaaggaaaccaaaccuuaaaaaaaaaaaacaaaa

SEQ ID NO: 479559 - RNA, 66 nt, Homo Sapiens
guaaauggugcuuuguuccugcugguuccaagcucagaaaccaagacuagcuuuguaggagagaau

SEQ ID NO: 479560 - RNA, 66 nt, Homo Sapiens
cucaucuauuccuuuucucuugugucccuacucauugaaaccaaacucuggaaaggacccaaugua

SEQ ID NO: 479561 - RNA, 66 nt, Homo Sapiens
uuaauguuucuuaaaaguuuuugagaaaaaaaggaagaaaccaacucauucagaaggcucggauuc

SEQ ID NO: 479562 - RNA, 66 nt, Homo Sapiens
caguccaggaguccaaguagaucucgaaguaaaucugaaaccaaaucaagacacagaacaaggucu

SEQ ID NO: 479563 - RNA, 66 nt, Homo Sapiens
uuuaaggacuuuccuuccuccaucuccaagaaugcugaaaccaagggggaugacaugugacuccua

SEQ ID NO: 479564 - RNA, 66 nt, Homo Sapiens
uccuuuuauuuauagaaugcaugucuuuuguguuaagaaaccaaagagaaauaaagagaacacucc

SEQ ID NO: 479565 - RNA, 66 nt, Homo Sapiens
cugauggcucacugggcucuuggaggggaaugugaagaaaccaaggagucacuuuuucaucuagau

SEQ ID NO: 479566 - RNA, 66 nt, Homo Sapiens
agugguaggcagugucccuucugcuugaaaccuauugaaaccaauuuaaaacuguguacuuuuuaa

SEQ ID NO: 479567 - RNA, 66 nt, Homo Sapiens
agucaccuuaguggaaagguuaaaaaccagagccuggaaaccaagaugauugauuugacaagguau

SEQ ID NO: 479568 - RNA, 66 nt, Homo Sapiens
uuucucagugacagaagcauguuugagaugccgugggaaaccaaauauauaauaauaaaaauauaa

SEQ ID NO: 479569 - RNA, 66 nt, Homo Sapiens
augcaaauauuccauuguaaacaaaucaaaggaaaagaaaccaagaacugaauuacugucugccca

SEQ ID NO: 479570 - RNA, 66 nt, Homo Sapiens
aucagucaaagggcaccauucuuuuuuuuuuuuuuugaaaccaaagcugucucagaaauggccaau

SEQ ID NO: 479571 - RNA, 66 nt, Homo Sapiens
ucaaauugcacuuuuggaagcccggugucaugaaaugaaaccaaaccucggugccaucgcagagua

SEQ ID NO: 479572 - RNA, 66 nt, Homo Sapiens
gcugcagauggauguuuccaugaagaaaucucugaagaaaccaaaagagcugaaacugaaaaaaga

SEQ ID NO: 479573 - RNA, 66 nt, Homo Sapiens
acgugugcaaaccucuugacuuuaccccacauuacugaaaccaaaauauauuugcuucaucugccc

SEQ ID NO: 479574 - RNA, 66 nt, Homo Sapiens
acuggagagaaaaccaacgucaacgagcaacaaucggaaaccaaaucacccaacucacccaagcag

SEQ ID NO: 479575 - RNA, 66 nt, Homo Sapiens
auggaugcuguuuuuauugguuaauugggagauaaugaaaccaaucagugguggugucaccacuac

SEQ ID NO: 479576 - RNA, 66 nt, Homo Sapiens
uuuaaaauguuggucuagguaauuuaacauauuuaagaaaccaauagauuauguucuguuaauggg

SEQ ID NO: 479577 - RNA, 66 nt, Homo Sapiens
uggaagaugucuuuuucaguuuucuugaaaugagaagaaaccaacccccguucauggagcugguca

SEQ ID NO: 479578 - RNA, 66 nt, Homo Sapiens
ggugucaguaaaauucugugauuuuugccaauuagagaaaccaaccuuuuuuaaauugcaaaugua

SEQ ID NO: 479579 - RNA, 63 nt, Homo Sapiens; identical to SEQ ID NO: 478721

SEQ ID NO: 479580 - RNA, 66 nt, Homo Sapiens
cauggcaacgcuggugcuugauauaaaggguuauuugaaaccaaucauauauaaauauaaaauuau

SEQ ID NO: 479581 - RNA, 66 nt, Homo Sapiens
auuuaaauuauauugauguuuuuuuuuuaaaaaaaagaaaccaacacagaagcuuuacuuuuccac

SEQ ID NO: 479582 - RNA, 66 nt, Homo Sapiens
agauuugucuacaaaugcuaggugcuuaauucuguugaaaccaaaagcauuuuuacaccccuuaag

SEQ ID NO: 479583 - RNA, 66 nt, Homo Sapiens
cuugcucucacuaguugucagggggaaaugccagaugaaaccaacuacaaugccaccagagauagu

SEQ ID NO: 479584 - RNA, 66 nt, Homo Sapiens
cucuucucuguccccugcccaaggagaacugagcaggaaaccaagggggggugaggcuuagcccag

SEQ ID NO: 479585 - RNA, 66 nt, Homo Sapiens
cugccuccauuuuccugagaucaaaaagacuguuucgaaaccaacaucugauauguaaacugcucu

SEQ ID NO: 479586 - RNA, 66 nt, Homo Sapiens
ccccuucugagcguuucugacagcucccagcugggagaaaccaacaugacgaaaagacaaagaaua

SEQ ID NO: 479587 - RNA, 66 nt, Homo Sapiens
guggaaugaugguugcacaacuuugugaauauacuagaaaccaaugaauuaaaaacuuuggaagau

SEQ ID NO: 479588 - RNA, 66 nt, Homo Sapiens
uuucugcaguuccuuauaggcgaagggaaccggguggaaaccaagcugggagaggcugaggauggc

SEQ ID NO: 479589 - RNA, 66 nt, Homo Sapiens
acauuguaccauacaauuucauuaucuuaucagaaugaaaccaauucacagggaaacuagagacua

SEQ ID NO: 479590 - RNA, 66 nt, Homo Sapiens
caaggaaauaucaaagaacacaacgcaggacuugcugaaaccaaauuacuacuucacacucuccuu

SEQ ID NO: 479591 - RNA, 66 nt, Homo Sapiens
aggcaacauuuuggaagcagagggcaacucucacuggaaaccaaaucuccuggcaccuugaucuug

SEQ ID NO: 479592 - RNA, 66 nt, Homo Sapiens
aguauauaagucaagaauguuuuauugucauuaugugaaaccaauauuggcaaauaguacuuuaau

SEQ ID NO: 479593 - RNA, 66 nt, Homo Sapiens
ugcaguaauagauaugugauuuuacaucauuuuuaagaaaccaaggggaaguaauaaguugaaaaa

SEQ ID NO: 479594 - RNA, 66 nt, Homo Sapiens
uaaucucauguauaaaaacuuuuuucuuuaaauaaggaaaccaauauuccauucuuaauuguaauu

SEQ ID NO: 479595 - RNA, 66 nt, Homo Sapiens
ggcagcuuucccugacaagcuguuggcaucaguauagaaaccaacuuguugguugacaaaauuggc

SEQ ID NO: 479596 - RNA, 66 nt, Homo Sapiens
aacaucugguacagcugccacuugaaccuuuuguaugaaaccaagacagcuccaugcucgcuacgu

SEQ ID NO: 479597 - RNA, 66 nt, Homo Sapiens
cagagagcuuaacucacuucucaacuuagagaggaagaaaccaagaagcuucugguaccaugaucc

SEQ ID NO: 479598 - RNA, 66 nt, Homo Sapiens
ucuguuucuuggugguuauguuuauacuauauugcagaaaccaauagacuggauugauuguggacu

SEQ ID NO: 479599 - RNA, 66 nt, Homo Sapiens
cccucaugguaguauuuccuccauaacuagaagguggaaaccaaaacuaacuuucuaacagaacuu

SEQ ID NO: 479600 - RNA, 66 nt, Homo Sapiens
aaaagaagccaagcaaaaauaccaugguauaaagaggaaaccaagacucaauggaggggucugggg

SEQ ID NO: 479601 - RNA, 66 nt, Homo Sapiens
gaacugccaacaaaauaaaagugcucaauaaauguugaaaccaacucagugccugguauauaguag

SEQ ID NO: 479602 - RNA, 66 nt, Homo Sapiens
auacaaaugaaucaguaucaugguuuucuucuuugggaaaccaaacgaaaucccaguucucuaauu

SEQ ID NO: 479603 - RNA, 66 nt, Homo Sapiens
ccagcuuccuuuuccuuuaagaucugacuucagacagaaaccaauauauugucuucguaaaaguua

SEQ ID NO: 479604 - RNA, 66 nt, Homo Sapiens
uaaauauuucugcauuucaguccaaaaacaaugaaggaaaccaaaauuauaaaccaaaacaaaauu

SEQ ID NO: 479605 - RNA, 66 nt, Homo Sapiens
ucugccugugcuuuuguuugacugucucuagauuuugaaaccaaaaaacugaacugaaaucaucua

SEQ ID NO: 479606 - RNA, 66 nt, Homo Sapiens
cagcugugccggcgcuacgggacccgagccgucccagaaaccaaagggcaggcacggcagcaaacg

SEQ ID NO: 479607 - RNA, 66 nt, Homo Sapiens
ugguaaaguaaaaggaaacaguacacuuggagcuaggaaaccaaagcaagcuuugugaaacuggca

SEQ ID NO: 479608 - RNA, 66 nt, Homo Sapiens
agaugaucaguccaacugaacgaccuuacaaaugaggaaaccaagauaaaugagcugccagaauca

SEQ ID NO: 479609 - RNA, 66 nt, Homo Sapiens
gggauaccuccagguuccaguaaaauucuucugaccgaaaccaauguggguguuagaaaaauuacc

SEQ ID NO: 479610 - RNA, 66 nt, Homo Sapiens
cucaccccagcacugcuguugggaaggugacugcaggaaaccaauucuuacaagauccaggcccag

SEQ ID NO: 479611 - RNA, 66 nt, Homo Sapiens
aaauacaaccagcauagaaagacccaaaacuauacagaaaccaaaaccagaaugccauguggugga

SEQ ID NO: 479612 - RNA, 66 nt, Homo Sapiens
caagauauuaagcguguguaaaugggcuuuagucuggaaaccaaaaaaaaaaaaaaaauuuaguca

SEQ ID NO: 479613 - RNA, 66 nt, Homo Sapiens
uucccaccaugcccuucugccaucuucugggagaaggaaaccaaaggaucuaaaacugggguuugg

SEQ ID NO: 479614 - RNA, 66 nt, Homo Sapiens
uugacccuagagcagaggugggcaaacuaugaccuggaaaccaaaucugacuuaccaccuuuuccu

SEQ ID NO: 479615 - RNA, 66 nt, Homo Sapiens
gcaucugauuugguauugugauuuacuucagacccugaaaccaaauaucugaucuuccauuagacu

SEQ ID NO: 479616 - RNA, 66 nt, Homo Sapiens
acucuaaacucguccccagaggaggacuugaaugaggaaaccaacacuuugagaaaccaaaguccu

SEQ ID NO: 479617 - RNA, 66 nt, Homo Sapiens
cagaggaggacuugaaugaggaaaccaacacuuugagaaaccaaaguccuuuuucccaaagguucu

SEQ ID NO: 479618 - RNA, 66 nt, Homo Sapiens
cggguugcauggaaguuuuauucucuuguuuugcuggaaaccaagaggauccaaacuuccugcaac

SEQ ID NO: 479619 - RNA, 66 nt, Homo Sapiens
gugggugggaggcaccaaaacuuggcagcugugccagaaaccaaagccaggcccagauguaggggg

SEQ ID NO: 479620 - RNA, 66 nt, Homo Sapiens
ccagagcagccuguggccugcuggucacuggugucugaaaccaaauacacgcaaaacuggcuucuu

SEQ ID NO: 479621 - RNA, 66 nt, Homo Sapiens
cugaagagucagguugaagcagugacaguacugggagaaaccaaggcauuaaaguuccuaagaccc

SEQ ID NO: 479622 - RNA, 66 nt, Homo Sapiens
gaaguuuuguuuuuguuuuuauacucauaauagggagaaaccaagaccuaauguaauaauagaaaa

SEQ ID NO: 479623 - RNA, 66 nt, Homo Sapiens
uuagaaacauuagaaauuugguguuagaucuuguaggaaaccaagaaucaggauaacacaagcuua

SEQ ID NO: 479624 - RNA, 66 nt, Homo Sapiens
aagcagacacaacaugcauuggugggaaaauagguagaaaccaaggccuaaaaauuguuagaaauu

SEQ ID NO: 479625 - RNA, 66 nt, Homo Sapiens
agaaaacuauuguuggaucauuugagugauacuagugaaaccaaaucauuagccugugucaaguuc

SEQ ID NO: 479626 - RNA, 66 nt, Homo Sapiens
acuaguuugaaaucguuuauauaccauacccaucuagaaaccaagagaaagcuaaagaagacuaug

SEQ ID NO: 479627 - RNA, 66 nt, Homo Sapiens
cuaaauaauuacaccaacuuaaggucucauuacaaugaaaccaaucugaauccaagugacugugaa

SEQ ID NO: 479628 - RNA, 66 nt, Homo Sapiens
aguuugcucuaggggaagagggcagcgauggucucagaaaccaaacuuuguacaugcauucauaca

SEQ ID NO: 479629 - RNA, 66 nt, Homo Sapiens
cauggagcaguucccagaguucccugcacagaugaggaaaccaaggcuaucagagcuggaaccuca

SEQ ID NO: 479630 - RNA, 66 nt, Homo Sapiens
guaucugcucuaaaaugacuugaggccagacaccaagaaaccaagcagcucuuccucaaggcaacc

SEQ ID NO: 479631 - RNA, 66 nt, Homo Sapiens
cucagaaaauguuuacuguuagauaagcagguacuagaaaccaaaagggugauuauuauuaacucu

SEQ ID NO: 479632 - RNA, 66 nt, Homo Sapiens
gauagucaucucauccuacucaauuuuucaaaggcagaaaccaacccuggagcaauugagaggacu

SEQ ID NO: 479633 - RNA, 66 nt, Homo Sapiens
cacauuuuauauggcugaucaauuuucauacauugagaaaccaagucaaucaagcaggaaucauuu

SEQ ID NO: 479634 - RNA, 66 nt, Homo Sapiens
auuacuagucaaauccgucagugaucccgagucccagaaaccaaaggcucuuuucagagccaccca

SEQ ID NO: 479635 - RNA, 66 nt, Homo Sapiens
ucuagcuuuaggggaccaugaagagacucucuuagggaaaccaauaguccccaucagcaccaugga

SEQ ID NO: 479636 - RNA, 66 nt, Homo Sapiens
cucauuuaguaauguaccuugaguuaaaaagccugagaaaccaaacacagcuaaugcuauggggug

SEQ ID NO: 479637 - RNA, 66 nt, Homo Sapiens
ucagagggaacgagcuguagguuugcagaaaugugugaaaccaaaaugaucacugccuacuuguga

SEQ ID NO: 479638 - RNA, 66 nt, Homo Sapiens
uaugguuuaaucagucuaauuguuuugacuguuauagaaaccaaauauuuuacuguuucuuuuaag

SEQ ID NO: 479639 - RNA, 66 nt, Homo Sapiens
gagugagguagauugcugucccguuaacauagugcugaaaccaaaggcaguggggguccaaacucg

SEQ ID NO: 479640 - RNA, 66 nt, Homo Sapiens
uccacuuucuagaacauauucuuuacuaauguuauugaaaccaauuucuacuucauacugauguuu

SEQ ID NO: 479641 - RNA, 66 nt, Homo Sapiens
acauuuuaauaccaugccagagaagaguauucugcugaaaccaacagguuuuacuggucaaaauga

SEQ ID NO: 479642 - RNA, 66 nt, Homo Sapiens
auuugggaauuaaacaggucacacgugacagaugaagaaaccaagggggcugcugaggagaccugg

SEQ ID NO: 479643 - RNA, 66 nt, Homo Sapiens
aucaauuacuauaauccugagccauggugugcuacugaaaccaauuuuuauccaccaucuaguccu

SEQ ID NO: 479644 - RNA, 66 nt, Homo Sapiens
auccugccuucuuuguggggaaacaauuaccuaaaagaaaccaaaaugaucaucacaaauccuuua

SEQ ID NO: 479645 - RNA, 66 nt, Homo Sapiens
aacaagaaccucucuuucuaauaauacuauuaauaagaaaccaacagucagggcgaaaagaaaaaa

SEQ ID NO: 479646 - RNA, 66 nt, Homo Sapiens
cuuggauuuagauucaaaaguucugacaucacaguagaaaccaaacauuuggaauacuggucaucu

SEQ ID NO: 479647 - RNA, 66 nt, Homo Sapiens
uuaauuauacuaugccauuaguugcagaucucagaugaaaccaagcuucugacacccuuuaaugug

SEQ ID NO: 479648 - RNA, 66 nt, Homo Sapiens
ugauucuuaauuaguauacauaaauuuggcugacaagaaaccaaagacaauaaaauuguaauauaa

SEQ ID NO: 479649 - RNA, 66 nt, Homo Sapiens
cugccaacaccuugaucuugagagagggccucagaagaaaccaacccaacucuuuacaagcuaaga

SEQ ID NO: 479650 - RNA, 66 nt, Homo Sapiens
aaagugaaacuuuggauaagauuacaauguguaauggaaaccaagggagucaagaguugaggagac

SEQ ID NO: 479651 - RNA, 66 nt, Homo Sapiens
uuguauauugaauuacauuauggauuauaauucugugaaaccaaguguuaucuuugugcuauauag

SEQ ID NO: 479652 - RNA, 66 nt, Homo Sapiens
aguuugacugggagcguguggcacauagcccacuaggaaaccaagaaccuugugaaguugcuguug

SEQ ID NO: 479653 - RNA, 66 nt, Homo Sapiens
aacagccaagucagcaagcagaagcuucaaagucaugaaaccaaucggaagaauugucauaggagg

SEQ ID NO: 479654 - RNA, 66 nt, Homo Sapiens
gcgccccuucaccucgcgugcucuuuucucccaagcgaaaccaaaucgccagccuccccgcccgcu

SEQ ID NO: 479655 - RNA, 66 nt, Homo Sapiens
uauaauuuacuucuuauaaauugaagucuuaaaugugaaaccaagaaauguaaucaagcaguaaaa

SEQ ID NO: 479656 - RNA, 66 nt, Homo Sapiens
agcuccaccacugugcacuuagccaugauggcaacagaaaccaagagacacaauuacgcagguauu

SEQ ID NO: 479657 - RNA, 66 nt, Homo Sapiens
uuucuuuuugaaucucucaaacggcaacauuccucagaaaccaaagcuuuauuucaaaucucuucc

SEQ ID NO: 479658 - RNA, 66 nt, Homo Sapiens
gcaucucuguugcuaacacacagagcucaccuguuugaaaccaagcuuucaaacauguugaagcuc

SEQ ID NO: 479659 - RNA, 66 nt, Homo Sapiens
uuguuaaaagccuauuauuguuaaaggccuuuuauggaaaccaacuuggaaaacaaccuuaaaugu

SEQ ID NO: 479660 - RNA, 66 nt, Homo Sapiens
ugaaaaaaauaaaacgcaaaaaaagaaacuguaaaggaaaccaagagauuuuguuuaauuuuuuug

SEQ ID NO: 479661 - RNA, 66 nt, Homo Sapiens
uuccaaaggcauaagacccuaagccuccuuuugcuugaaaccaaagauauauacacaggauccuau

SEQ ID NO: 479662 - RNA, 66 nt, Homo Sapiens
uuccuucaagaggguuacaauguggccaucagacaggaaaccaaacgguggauaaaguauuaagua

SEQ ID NO: 479663 - RNA, 66 nt, Homo Sapiens
augucuucagugauugaaacugggaugggaauagcagaaaccaaccaggcauggaggagggaggcg

SEQ ID NO: 479664 - RNA, 66 nt, Homo Sapiens
uagaaacacauuccuugggaggaaccagugugcuuugaaaccaaauucaugaaagugguaaaagug

SEQ ID NO: 479665 - RNA, 66 nt, Homo Sapiens
aaauuacuuaagaaauggaaacauuauugacuuuuggaaaccaaccgagcucaaaacacuacaucc

SEQ ID NO: 479666 - RNA, 66 nt, Homo Sapiens
acaacaagauacaaauaccuuccucuauuucacacagaaaccaaggcaauauucucauuauuaacu

SEQ ID NO: 479667 - RNA, 66 nt, Homo Sapiens
guugacauacaaaccaugauccuuucucuguuuuaugaaaccaacucaucuucuaucuucuuucca

SEQ ID NO: 479668 - RNA, 66 nt, Homo Sapiens
uuguuauauaugaacacucaaaucuuuuacuguaacgaaaccaagaaacuuguuuagaaugugaua

SEQ ID NO: 479669 - RNA, 66 nt, Homo Sapiens
gcuuuggggaauuuuggccaggagacccugaaacaugaaaccaaacaggcuuugauauuuuuuuuu

SEQ ID NO: 479670 - RNA, 66 nt, Homo Sapiens
ugcuguggcuuugagaaguuaacuuuuguggaauaugaaaccaaaggaagaauuuccauguagaua

SEQ ID NO: 479671 - RNA, 66 nt, Homo Sapiens
aucaugggaauuacauaaggauaaugaggcccaacugaaaccaaguuucagucugccuuaccuuua

SEQ ID NO: 479672 - RNA, 66 nt, Homo Sapiens
uuaaucacuuuuuaaaauauaaggaccgaaugcaaggaaaccaaaguuuauuaauaauuuuuauau

SEQ ID NO: 479673 - RNA, 66 nt, Homo Sapiens
aaccgagggaacccugggucuugggaagaacaacaggaaaccaaggucugaccuaggguucccucc

SEQ ID NO: 479674 - RNA, 66 nt, Homo Sapiens
aacaauagaaauuuuucucauaauauauaccuaugugaaaccaacuuaucugcauaauuaaaucua

SEQ ID NO: 479675 - RNA, 66 nt, Homo Sapiens
aaacuuuuagcuuugaucacaaguggacaaauuucugaaaccaaaggcaacuaaguugcuguguua

SEQ ID NO: 479676 - RNA, 62 nt, Homo Sapiens; identical to SEQ ID NO: 478818

SEQ ID NO: 479677 - RNA, 66 nt, Homo Sapiens
ggucaggaguuguuucugacugacgcggcucaaaaggaaaccaaguuuuuacagauugccuccuua

SEQ ID NO: 479678 - RNA, 66 nt, Homo Sapiens
guguuuaaacuuaaaacugcccacggacuaugagaagaaaccaaacccacgcauuggcauccaagg

SEQ ID NO: 479679 - RNA, 66 nt, Homo Sapiens
guccaccuggguguguucaucugaaccccugcaaaugaaaccaaaccugaaccccugcaacccucc

SEQ ID NO: 479680 - RNA, 66 nt, Homo Sapiens
acuguagaagaugaggaaucuacuuuguacacguuugaaaccaacuucuucucauaguauagaguu

SEQ ID NO: 479681 - RNA, 66 nt, Homo Sapiens
gaauggcugaugucucuuucaaaguuagucugguuggaaaccaagauuuuaggggaucauaucaag

SEQ ID NO: 479682 - RNA, 66 nt, Homo Sapiens
uguauaauguacaguuuucauuuauuuauaauucuugaaaccaaaaacucccuaccugugaguucc

SEQ ID NO: 479683 - RNA, 66 nt, Homo Sapiens
ggcaaaacgugggugcaaaacuccugacaguguggagaaaccaacacacagugaguuggucaaaug

SEQ ID NO: 479684 - RNA, 66 nt, Homo Sapiens
ccucauccucagaugcucaaacaacacaaccaacgcgaaaccaauuucagaacugucggaggaaag

SEQ ID NO: 479685 - RNA, 66 nt, Homo Sapiens
guuucuuuucccaugcucuuguagaauccaggugcugaaaccaaguacacaguuucccuacuguau

SEQ ID NO: 479686 - RNA, 66 nt, Homo Sapiens
auugggcuuuauuuggacaaaccaaacuuuuagccugaaaccaacuuuaugccacuaagucauagc

SEQ ID NO: 479687 - RNA, 66 nt, Homo Sapiens
auuguccacagauguacuggccauuacaugaaacaagaaaccaagcaucuuugcuguuguuaauua

SEQ ID NO: 479688 - RNA, 66 nt, Homo Sapiens
acuggcauuuccauguauauauguauauaaaugcaggaaaccaacaugucauugacaccucucuuc

SEQ ID NO: 479689 - RNA, 66 nt, Homo Sapiens
aauaagucuguacaaccuagcauagaauaaaaaacugaaaccaagauucccaacguuuuucauagc

SEQ ID NO: 479690 - RNA, 66 nt, Homo Sapiens
cacacaauuaagagcucaugucuuagcaagaucugggaaaccaacauugcgagaguagcuauuuug

SEQ ID NO: 479691 - RNA, 66 nt, Homo Sapiens
caacccaggaagcgucuuuggugcuugggagaccaagaaaccaagaaauuaacaacugaaagcauu

SEQ ID NO: 479692 - RNA, 66 nt, Homo Sapiens
gaggguucugaacccguucccuacacagaaaucuuggaaaccaaaugcugcugaguaaggaugaag

SEQ ID NO: 479693 - RNA, 66 nt, Homo Sapiens
ugccaucaaaacacauacacccagaaagaaacaacagaaaccaaaacucacaaggcgcaugauuac

SEQ ID NO: 479694 - RNA, 66 nt, Homo Sapiens
ggugggcacuaagcuaugggagagaccauagcugcagaaaccaacccugcccuaggcauaaaaugc

SEQ ID NO: 479695 - RNA, 66 nt, Homo Sapiens
caggcagcaggcucaggcccacaccuugugauuuuugaaaccaaagcccagaagaugauguuuacu

SEQ ID NO: 479696 - RNA, 66 nt, Homo Sapiens
aauugagagugagaaagaggaaaugaaagcaagccugaaaccaagcccacacgauuugucagagag

SEQ ID NO: 479697 - RNA, 66 nt, Homo Sapiens
cugggucucucuccacccgguguucauggagcuggagaaaccaaaaguaggacguguaccucugug

SEQ ID NO: 479698 - RNA, 66 nt, Homo Sapiens
aagaaaccuagaaucuaauguuguagacccaguuuugaaaccaaaaauuaaugucauuuuuaugga

SEQ ID NO: 479699 - RNA, 66 nt, Homo Sapiens
gugccgagugaauaaaggauuggaagaaaaugcaaagaaaccaaaugccacaccugcaauguaaaa

SEQ ID NO: 479700 - RNA, 66 nt, Homo Sapiens
uugggagggggaagaggacccugccucaucuggagggaaaccaaaauuggaaccaacauucaaauu

SEQ ID NO: 479701 - RNA, 66 nt, Homo Sapiens
aagcagcuugguauucauaagggcagagucuaccuugaaaccaauuauuaguacaauaagcguuaa

SEQ ID NO: 479702 - RNA, 66 nt, Homo Sapiens
uauauauauuuuuaaaucacauuaauuuuaccaagugaaaccaagccauacuguuuuugagccaau

SEQ ID NO: 479703 - RNA, 66 nt, Homo Sapiens
aagacaguccuguaagaucgagcaaccagucaugaugaaaccaagugguggccggaucaguaugac

SEQ ID NO: 479704 - RNA, 66 nt, Homo Sapiens
auuuauaugcauuaauuuaagagcaucuacuuagaagaaaccaaauagucuaucgcccucauauca

SEQ ID NO: 479705 - RNA, 66 nt, Homo Sapiens
aguaaagaaugagaauggauucuguacaauacacuagaaaccaacauaauguauuucuuuaaaacc

SEQ ID NO: 479706 - RNA, 66 nt, Homo Sapiens
ugcucugaaaaccaaaaguauuuucauaacccauuugaaaccaaaccugaccugaacuuacacuga

SEQ ID NO: 479707 - RNA, 66 nt, Homo Sapiens
aaugggaguagacagaguuguauggccuggacaguggaaaccaagagcaggaucgcaaaguaacag

SEQ ID NO: 479708 - RNA, 66 nt, Homo Sapiens
agaauccucuauuauuuucaccaccccagccccagagaaaccaauaaaugaagagaaaagccaugc

SEQ ID NO: 479709 - RNA, 66 nt, Homo Sapiens
cuacuucacuaaugacgaugacuuuuaucuguagcagaaaccaagugacccguucgcccccaugug

SEQ ID NO: 479710 - RNA, 66 nt, Homo Sapiens
gaaaagcacauugcgauccaauuuucguuuuuaugggaaaccaagguuuuuugcacaagguguuuc

SEQ ID NO: 479711 - RNA, 66 nt, Homo Sapiens
agauacaucugcuggagagcggugucucucuuuggagaaaccaaccaacuguggugccaaauugcu

SEQ ID NO: 479712 - RNA, 66 nt, Homo Sapiens
gguaaucugauccaccacuuaaaaaaacaaaaaacagaaaccaaucguggccugaagaggaagaga

SEQ ID NO: 479713 - RNA, 66 nt, Homo Sapiens
ucgguuuccgcccucuagcgcuguggggccugcugggaaaccaaggagccuccagagaccgagcag

SEQ ID NO: 479714 - RNA, 66 nt, Homo Sapiens
aagucagcauguaagcgucaaaaccaagcaucuauagaaaccaagauuauuuuaguuuuauuuuug

SEQ ID NO: 479715 - RNA, 66 nt, Homo Sapiens
aucuauagaaaccaagaaaguuuuaguuuuauuuuugaaaccaagcgggauuuggaauuuuuguua

SEQ ID NO: 479716 - RNA, 66 nt, Homo Sapiens
aagagcaaagggaacccagcggccugguuuugcuuugaaaccaagaguucauuccuggggcacugu

SEQ ID NO: 479717 - RNA, 66 nt, Homo Sapiens
uugcaccuggaaacuuacaagaaaugguguugcugggaaaccaaguauguucaucaguguuuuaua

SEQ ID NO: 479718 - RNA, 66 nt, Homo Sapiens
uagagcuacaaacucagcuguuguucauaaucaacagaaaccaagaauuauauauaacuaugcuaa

SEQ ID NO: 479719 - RNA, 66 nt, Homo Sapiens
aaucucacucaggccuccagggauccaugggggagugaaaccaauucucagagaacaacccaccag

SEQ ID NO: 479720 - RNA, 66 nt, Homo Sapiens
uccagacauacgaaacacaaaccacaacugacacaggaaaccaacacccaaagcauggacuaaccc

SEQ ID NO: 479721 - RNA, 66 nt, Homo Sapiens
gcgccucauccucauugcuucugccuccacguaaaugaaaccaaaggccucagcauauccugggag

SEQ ID NO: 479722 - RNA, 66 nt, Homo Sapiens
acaaacuuaaucuucaucuuuaaaaaaaagaaaaaagaaaccaaaaugagaaucaacacuucauag

SEQ ID NO: 479723 - RNA, 66 nt, Homo Sapiens
aauuauuuuuuaaaugaaaccuuuuuuuuucuuuuugaaaccaaauguuaaacuauagccuuaaga

SEQ ID NO: 479724 - RNA, 66 nt, Homo Sapiens
gagagaaaaaaaaaaagagaacccacaugaagcucugaaaccaaacagcauccugccaugagcuuc

SEQ ID NO: 479725 - RNA, 66 nt, Homo Sapiens
guccauacacagaaacauaauaaacaaucuucacacgaaaccaaaaauagcauacaccuaauguug

SEQ ID NO: 479726 - RNA, 66 nt, Homo Sapiens
aagaccuuuggcucacagaacugcaggguauggugagaaaccaacuacggauugcugcaaaccaca

SEQ ID NO: 479727 - RNA, 66 nt, Homo Sapiens
ucucagauggcucccacauuuuaagauuuuaaaaaugaaaccaaaaaauaaauugaagaaaacugu

SEQ ID NO: 479728 - RNA, 66 nt, Homo Sapiens
auauuaaauacuuaaugcugauuugaagagauagcugaaaccaaggcugaagacuguuuuacuuuc

SEQ ID NO: 479729 - RNA, 66 nt, Homo Sapiens
ucccccagaucaugcuuuaauucuuucuuuucuguagaaaccaacaguuuccauuuaugucaaugc

SEQ ID NO: 479730 - RNA, 66 nt, Homo Sapiens
caagcaaguguguagcuuaaggccacuacugguaaggaaaccaaguguccucugugccuuuuuucu

SEQ ID NO: 479731 - RNA, 66 nt, Homo Sapiens
cugcuagcugugcagaacccaauugcccuuugcacagaaaccaaccccugacccagcgguaccggc

SEQ ID NO: 479732 - RNA, 66 nt, Homo Sapiens
ccccauggugauagccugaaagagcuuuccucacuagaaaccaaaugguguaaauauuuuauuuga

SEQ ID NO: 479733 - RNA, 66 nt, Homo Sapiens
agggaugggagccacagugcccuucacucucuccuggaaaccaacuguaagcuggugggcucaacc

SEQ ID NO: 479734 - RNA, 66 nt, Homo Sapiens
guguguuuaguaucugaauuugaaacucaucugguggaaaccaaguuucaggggacaugaguuuuc

SEQ ID NO: 479735 - RNA, 66 nt, Homo Sapiens
cccagccccuccccccucccaagggacucucucggggaaaccaagguuggcuggucccauguguga

SEQ ID NO: 479736 - RNA, 66 nt, Homo Sapiens
ugaaaaauagcauaugccuuauaaagauacaugauugaaaccaaguuuauaacauuaagaaaaaca

SEQ ID NO: 479737 - RNA, 66 nt, Homo Sapiens
gggaucgggccaggcucccagucgucuuaccccacugaaaccaacacagagcuucagccucucuuc

SEQ ID NO: 479738 - RNA, 66 nt, Homo Sapiens
uacuguggucucuugggacuaaauuccccugaagaagaaaccaaugguauggagcucuggacuccu

SEQ ID NO: 479739 - RNA, 66 nt, Homo Sapiens
aggcuuuagaagagauuaucguaucuaacucuucuggaaaccaaaucucuguccacucuuguucaa

SEQ ID NO: 479740 - RNA, 66 nt, Homo Sapiens
ugguuugggguaugggguggggaccagaggagucaagaaaccaagacacguuuguagguucuuacu

SEQ ID NO: 479741 - RNA, 66 nt, Homo Sapiens
agacccugaagaauauuugauuacauguuuaaucuggaaaccaaagguggcaagaugaccgucaca

SEQ ID NO: 479742 - RNA, 66 nt, Homo Sapiens
uaagaguguguuucuguguuauaccaaaauagagcagaaaccaagcaacaaaguucaaaaguagaa

SEQ ID NO: 479743 - RNA, 66 nt, Homo Sapiens
ucuucucugcuggcuggggcuuucucuucauuguuagaaaccaaaguauuauuuguguuaucuuua

SEQ ID NO: 479744 - RNA, 66 nt, Homo Sapiens
augaaugaaccccuggcuccccaagaugccugaucagaaaccaaccgcugccuccauuauccauuc

SEQ ID NO: 479745 - RNA, 66 nt, Homo Sapiens
aaaccgugcgcugugacccaccucuguguucccgcggaaaccaaccccagaucccgccccuccugu

SEQ ID NO: 479746 - RNA, 66 nt, Homo Sapiens
gucagaaggauguaugaugauuccccuuccugggaggaaaccaauuccagaaguaagcucugcaug

SEQ ID NO: 479747 - RNA, 66 nt, Homo Sapiens
ccuuggaagcaaguggggugccuggaugucacuuuggaaaccaagcuuuuccccaaccucuuacac

SEQ ID NO: 479748 - RNA, 66 nt, Homo Sapiens
ucaccaccuuucauguuuuugauugcccuacaaagagaaaccaaaugagcugauuacugacuauaa

SEQ ID NO: 479749 - RNA, 66 nt, Homo Sapiens
uauauaguggucacugugauauaauaaaucauaaaggaaaccaaaucacaaaggagaugguguggc

SEQ ID NO: 479750 - RNA, 66 nt, Homo Sapiens
ccacuuggccucacuaccagaagaaggguggagucagaaaccaaagugaccuccagagcuguccuc

SEQ ID NO: 479751 - RNA, 66 nt, Homo Sapiens
uagagcaaauauuguucuucccauuuuacagauucagaaaccaaggcuaagggacuggucuaaagu

SEQ ID NO: 479752 - RNA, 66 nt, Homo Sapiens
cuuuuuuaaaaagaaacuauuuuuguguuugaaagugaaaccaacauccagaucuauagcagaguc

SEQ ID NO: 479753 - RNA, 66 nt, Homo Sapiens
uuaauugaaagcaacacuaauauagagccacuuccugaaaccaagaaucuguaguuuugauccaaa

SEQ ID NO: 479754 - RNA, 66 nt, Homo Sapiens
aauguuccaucauuucuagcuaaaacuccauuuggugaaaccaacauauccauuucuuuuccuagu

SEQ ID NO: 479755 - RNA, 66 nt, Homo Sapiens
agacaaccgugggggaacacaccacuuuuuacuguugaaaccaacacaacguugaaauccaggcuu

SEQ ID NO: 479756 - RNA, 66 nt, Homo Sapiens
guggcccuucugaaacuuauggucaucucucccacugaaaccaaggucuuuucaaauguggcuaaa

SEQ ID NO: 479757 - RNA, 66 nt, Homo Sapiens
aaacccuucagugcuacauuuuguggcuuuuuaauggaaaccaagccaauguuauagacguuugga

SEQ ID NO: 479758 - RNA, 66 nt, Homo Sapiens
accuggcaccacuuucaagaaugcuggauggaacaggaaaccaaucguggccccuggcuccggaga

SEQ ID NO: 479759 - RNA, 66 nt, Homo Sapiens
aagaaggcuuaguagcucagauaaauaggaaauguagaaaccaagcugugugugugugugugcaca

SEQ ID NO: 479760 - RNA, 66 nt, Homo Sapiens
uuuuaaaaugaagugucaagugaaaacacaucaguagaaaccaagaaccgagcuugucagcuuuuu

SEQ ID NO: 479761 - RNA, 66 nt, Homo Sapiens
cuauuuaacugugaacuauggcuauuuagaaagacugaaaccaagauagcauccuuauauaauaau

SEQ ID NO: 479762 - RNA, 66 nt, Homo Sapiens
ccugcucucuccuaaggcuccgucuguuacacaugugaaaccaaagcccagacugccagcagcacc

SEQ ID NO: 479763 - RNA, 66 nt, Homo Sapiens
guacaaacuguguugucuuuuuaacugaaaaaauaugaaaccaaaaauauuauguuuuuacugaaa

SEQ ID NO: 479764 - RNA, 66 nt, Homo Sapiens
aacacucuguacugugugcgguucuagugaaugugugaaaccaagaguuauuuaacaauagcaaua

SEQ ID NO: 479765 - RNA, 66 nt, Homo Sapiens
cuuaccaggucuuggacuguuauuuccaaauaaaaagaaaccaacuuaaugaaaguugaccauagu

SEQ ID NO: 479766 - RNA, 66 nt, Homo Sapiens
ccacuuuuguuuauaagaccugcguuaguuacaaaggaaaccaaugguggauuccaaaugaacccc

SEQ ID NO: 479767 - RNA, 66 nt, Homo Sapiens
ugauacacacuuucaugauguaauuccuuuuauagagaaaccaacccuccagcucuaguucagcua

SEQ ID NO: 479768 - RNA, 66 nt, Homo Sapiens
aacaucagacaucauugcguuuccuguuacacuauggaaaccaagauuuuaauugaaaugucaagu

SEQ ID NO: 479769 - RNA, 66 nt, Homo Sapiens
agcaagcccuugaugaccaauuguuguuuuacagcugaaaccaaccguuguuuuuuguuguuguug

SEQ ID NO: 479770 - RNA, 66 nt, Homo Sapiens
cgcccgacgcagacgcggugcccgaagcagccuccugaaaccaaaaucggcccccgggggccccgc

SEQ ID NO: 479771 - RNA, 66 nt, Homo Sapiens
gggaugcuaacuacaacaugaguuaguucaucaaaggaaaccaaccaccuagcucuagccuguacc

SEQ ID NO: 479772 - RNA, 66 nt, Homo Sapiens
caggccaggugggcggacaagccaacgagauugcuggaaaccaagugguccccacagacugcccca

SEQ ID NO: 479773 - RNA, 66 nt, Homo Sapiens
aaaaccauuuucagggagcugccagggaacggggaggaaaccaaagguccaaaccugugaccccag

SEQ ID NO: 479774 - RNA, 66 nt, Homo Sapiens
gcucaccuaggauuggcuauucugagggauugcauagaaaccaagcuccacuugcuguccuuggga

SEQ ID NO: 479775 - RNA, 66 nt, Homo Sapiens
uuugcuaaauauguacaugaugacaggcacauguaagaaaccaaaagucauaaugaauuacaguca

SEQ ID NO: 479776 - RNA, 66 nt, Homo Sapiens
ucuuacccuugcccuagauuuuacuauauauacacggaaaccaauugaacaucuguucccaccaac

SEQ ID NO: 479777 - RNA, 66 nt, Homo Sapiens
cgcccccguccggcuuccuugguggaggccgucuaggaaaccaaaaacucccaggaugccccggug

SEQ ID NO: 479778 - RNA, 66 nt, Homo Sapiens
guaaaggagaaguggggcagcugcaggacauguagagaaaccaaacugggaaaucuuacaaggagu

SEQ ID NO: 479779 - RNA, 66 nt, Homo Sapiens
aacuccaguuuaaaaaguguuauuuuuaaaacauuugaaaccaaguacuguuuaauuucaaucaga

SEQ ID NO: 479780 - RNA, 66 nt, Homo Sapiens
cuugcuucagccccagguguggugacuuagaccuaggaaaccaauuaugaguggaaagugacccuc

SEQ ID NO: 479781 - RNA, 66 nt, Homo Sapiens
gaaacaaaaugccaguauuuucuuaagccaugaugugaaaccaaugacccugugaccacauggcac

SEQ ID NO: 479782 - RNA, 66 nt, Homo Sapiens
gaaacguccugaccugugaucacacaugacagugaggaaaccaagugcaacuccuggguuuuuuua

SEQ ID NO: 479783 - RNA, 66 nt, Homo Sapiens
gauauugcucuauauuuuuuuuuccauuuaucuguggaaaccaacaucaaauuucauuuuuuccuu

SEQ ID NO: 479784 - RNA, 66 nt, Homo Sapiens
gccuucaaugaaacaagccuuuuauaaauugccauggaaaccaaguaagaaaccaaaccaccaucu

SEQ ID NO: 479785 - RNA, 66 nt, Homo Sapiens
caccaucuuuuauaaauugccaucuguuccaaugaagaaaccaaaccuugaacacccaaacuacgu

SEQ ID NO: 479786 - RNA, 66 nt, Homo Sapiens
cauguaggaaaauauugguaacuuauuaguuaaaaggaaaccaaggagcaacuaaauuuacccuuu

SEQ ID NO: 479787 - RNA, 66 nt, Homo Sapiens
aaaaaucgcauuucaacccucagggacaggucccuggaaaccaaaguuaaccuuggagugagagcc

SEQ ID NO: 479788 - RNA, 66 nt, Homo Sapiens
gugaacacaucaacaccacgauuuaaagaugcuuuggaaaccaaccaaacggggaacuauagcaau

SEQ ID NO: 479789 - RNA, 66 nt, Homo Sapiens
gugaacuuccugucucccacgccccacuuuggcccagaaaccaaauuucuccccaccaccccuccu

SEQ ID NO: 479790 - RNA, 66 nt, Homo Sapiens
uacaaacacaauauuuaaucuuccaugaucuccaaagaaaccaaaauuggcaauuuaacgagccac

SEQ ID NO: 479791 - RNA, 66 nt, Homo Sapiens
agucaugugggcuugccuucucugccaaacgacugggaaaccaaaaugagcccaccuuguguucuu

SEQ ID NO: 479792 - RNA, 66 nt, Homo Sapiens
gagagagaaagucaaauaaagucaaagaccaguuuggaaaccaaaguuggaaaagaagaauuguag

SEQ ID NO: 479793 - RNA, 66 nt, Homo Sapiens
aaagaaacacccuaaucuagauaaaggucuguuucagaaaccaacagugauggcauucuaaagagu

SEQ ID NO: 479794 - RNA, 66 nt, Homo Sapiens
gagguuggagacuucaaccgggcaaaggagcacaaggaaaccaagcagcagaggccccaucagcac

SEQ ID NO: 479795 - RNA, 66 nt, Homo Sapiens
uaaaauauaguuuauaaaucggcaguacgguauuaugaaaccaagaaaggguuucuugaaaagcuu

SEQ ID NO: 479796 - RNA, 66 nt, Homo Sapiens
gagaaaacggcacaccaaucaauaaagaacugagcagaaaccaacagugugcuuuuaauaaaggau

SEQ ID NO: 479797 - RNA, 66 nt, Homo Sapiens
cuaucugggucucuuauuucaaaccuaauaaagcaagaaaccaagcucaucacugcuccuuauaau

SEQ ID NO: 479798 - RNA, 66 nt, Homo Sapiens
aagaauaaaugagagauauuaauauucuuacauauagaaaccaaguauauaaacuauuuaaaucaa

SEQ ID NO: 479799 - RNA, 66 nt, Homo Sapiens
uacaaguauucaguuccaauauauguacacaacuuagaaaccaaauagauuuauaaaugcacugua

SEQ ID NO: 479800 - RNA, 66 nt, Homo Sapiens
auacugcacucuaauauuuuuggauagaaaucauuagaaaccaagcguuuuaaauaaaacuucuuu

SEQ ID NO: 479801 - RNA, 66 nt, Homo Sapiens
acuuagcucaccugcauucuuuauuuauaguccaaagaaaccaaaguauuugaagaaaaaaaagcg

SEQ ID NO: 479802 - RNA, 66 nt, Homo Sapiens
agauucaugaaaccuuggcccagguuugcaugguaugaaaccaaauaguguagcagcacacuuguu

SEQ ID NO: 479803 - RNA, 66 nt, Homo Sapiens
cugcugacaccucaaucuuauaagggggccucagaggaaaccaaccgggaauagccaucgacaaac

SEQ ID NO: 479804 - RNA, 66 nt, Homo Sapiens
uuaugaagaucuucucccagcuggccugccuuaucagaaaccaagcgcugagcuguagcauuuggg

SEQ ID NO: 479805 - RNA, 66 nt, Homo Sapiens
acuuuacauuuuuauuuuuacucagaggaaagaauggaaaccaaucguauuggcaccaaguuaggu

SEQ ID NO: 479806 - RNA, 66 nt, Homo Sapiens
uccaucaacgcacaccugcuaucguggaacagccuagaaaccaagggacuccaccaccaagucacu

SEQ ID NO: 479807 - RNA, 66 nt, Homo Sapiens
cccgccagcugauuggaugucuaggaaugacugaaagaaaccaaaacagccuguccacugcugcug

SEQ ID NO: 479808 - RNA, 66 nt, Homo Sapiens
uccuugcccuggggccgguucuuacccagguccagagaaaccaacgcgggaugucagacuucacca

SEQ ID NO: 479809 - RNA, 66 nt, Homo Sapiens
gagucaguaccccugguaaaccaagccucccacacugaaaccaaaacauaaaaaccaaacccagac

SEQ ID NO: 479810 - RNA, 66 nt, Homo Sapiens
gguggccgucugcaagccgaggagggggccucaggagaaaccaacccugcaaucaccuugaucuug

SEQ ID NO: 479811 - RNA, 66 nt, Homo Sapiens
augguccuugugaugguauuacuuuuuacaaagaaugaaaccaaauggacucagcccucucccaca

SEQ ID NO: 479812 - RNA, 66 nt, Homo Sapiens
uaguuguccccauugucuacccacacaaauccucaggaaaccaaccaccgcccagguggcccugag

SEQ ID NO: 479813 - RNA, 66 nt, Homo Sapiens
ccuuaguggauuuaccuguagaguuuauuggauccugaaaccaaucaauuacuuagaacuaggcaa

SEQ ID NO: 479814 - RNA, 66 nt, Homo Sapiens
guugugacagucacugcauuugccugcuucuuuccagaaaccaaacuaggagaugaaacugguucc

SEQ ID NO: 479815 - RNA, 66 nt, Homo Sapiens
aucaccaagucucgucuucuuuccuuccugugaguugaaaccaaacaggccucucgcucacuccuc

SEQ ID NO: 479816 - RNA, 57 nt, Homo Sapiens; identical to SEQ ID NO: 478958

SEQ ID NO: 479817 - RNA, 66 nt, Homo Sapiens
agcugcaaaguggagucuggugauuccucaccccgggaaaccaaggcccaaccacaaagguguuug

SEQ ID NO: 479818 - RNA, 66 nt, Homo Sapiens
ugucuccugggggggagaaagguaugggagggguuggaaaccaaguuauuuaacuuaaucaaaugu

SEQ ID NO: 479819 - RNA, 66 nt, Homo Sapiens
ccuucccauuuccuccuccccagccaaaagcacucugaaaccaagacuguuuggccacccucuggc

SEQ ID NO: 479820 - RNA, 65 nt, Homo Sapiens
aaaaaugaguuguucaucagaauaaaacacugaaaagaaaccaacuuaaauuguauauuuugaaa

SEQ ID NO: 479821 - RNA, 66 nt, Homo Sapiens
aaccagacccgaaaccaggcccuaggaaccagaccugaaaccaagguaaaggcagguagccuggcg

SEQ ID NO: 479822 - RNA, 66 nt, Homo Sapiens
cacagaaucagaaaaaaaaagcauuaaaauuuauuugaaaccaaaaaagagcccaaaaagccaaag

SEQ ID NO: 479823 - RNA, 66 nt, Homo Sapiens
auuuuccaguuuuauggaauugggagucugacaagugaaaccaauuuaauguaaaguauuuggcuu

SEQ ID NO: 479824 - RNA, 66 nt, Homo Sapiens
caagaaccccuuuuaucccuggaagaggcuguguaugaaaccaaugcccaggguuugaaggguguu

SEQ ID NO: 479825 - RNA, 66 nt, Homo Sapiens
gcucuuuuucagcuuuauuuuuaagaguacagucaggaaaccaacaaggggccuaagaguggcugc

SEQ ID NO: 479826 - RNA, 65 nt, Homo Sapiens; identical to SEQ ID NO: 479397

SEQ ID NO: 479827 - RNA, 66 nt, Homo Sapiens
gagguuaaaauuuauagucauucuaacugcacuuuggaaaccaagcaaggggagaagacaaaugaa

SEQ ID NO: 479828 - RNA, 66 nt, Homo Sapiens
gaggucaagcaauaggcgccuggcagugucaagccugaaaccaagcaauaccgucauguuucagcc

SEQ ID NO: 479829 - RNA, 66 nt, Homo Sapiens
uuuauccagaggccugcugcagauggggaagagcuggaaaccaagaaguuugucaacagaggaccc

SEQ ID NO: 479830 - RNA, 66 nt, Homo Sapiens
ggaaaaaaagucauuaggcuuucccuuugugucagugaaaccaaaagugcuucuuacaacguucgc

SEQ ID NO: 479831 - RNA, 66 nt, Homo Sapiens
aagauuugguugccauagucauaagcaaugauacaugaaaccaaugaaagacaguacauguaauaa

SEQ ID NO: 479832 - RNA, 66 nt, Homo Sapiens
uuagaacauauuugcauaagauagcuauuuacucuggaaaccaacaacuuuugagauuucccuugc

SEQ ID NO: 479833 - RNA, 66 nt, Homo Sapiens
uuaauuagugcaaauacaagcugcguuucuuuaauagaaaccaaaggcaucuggagcccgagaggc

SEQ ID NO: 479834 - RNA, 66 nt, Homo Sapiens
cauuuccuagccagcugggggacacuggaaauucgggaaaccaagagagaggaagaaggagacgcc

SEQ ID NO: 479835 - RNA, 66 nt, Homo Sapiens
ccgcaggcugagcaagucuguaaacugauucugggagaaaccaagcugcuggccauaggguguccu

SEQ ID NO: 479836 - RNA, 66 nt, Homo Sapiens
cagagcugaggggacagggaccccuuugucaguggggaaaccaaggcacacaggacagcagaagau

SEQ ID NO: 479837 - RNA, 66 nt, Homo Sapiens
ucacccuggcugggagcaucguguauguuucugguggaaaccaaguuuccuucccuuauuucuaac

SEQ ID NO: 479838 - RNA, 66 nt, Homo Sapiens
ggcucauggagaaaacaaauaugacuuagggaacuugaaaccaacuaacugccgcaagaccacuac

SEQ ID NO: 479839 - RNA, 66 nt, Homo Sapiens
ucuaagaggacuggauugcagaaucucccaaagagagaaaccaauucucuggcugccucugagucu

SEQ ID NO: 479840 - RNA, 66 nt, Homo Sapiens
aacacuacuauuaaacugcaaucuaugguugaaucagaaaccaagacccgacgguagaguucuuuc

SEQ ID NO: 479841 - RNA, 66 nt, Homo Sapiens
augggaaguggcuccuaggggccauccagccuguaggaaaccaaagcuacaaggcuuccaggggau

SEQ ID NO: 479842 - RNA, 66 nt, Homo Sapiens
aaaacccccuaagugagggauuuaagauuugagggugaaaccaaagcccugcacuucuagcccuca

SEQ ID NO: 479843 - RNA, 66 nt, Homo Sapiens
gcuagggaaacagauacucucucuguacauaaaguagaaaccaaaauucuuagcaagauauuuuau

SEQ ID NO: 479844 - RNA, 66 nt, Homo Sapiens
uucuuuuuuauacucaaucaugcacccucauacacagaaaccaauuagagauaaagaccuuuucca

SEQ ID NO: 479845 - RNA, 66 nt, Homo Sapiens
caacuuuucaccuccugaguaaaacaaaaacaccaagaaaccaagucuccucucacugccugccag

SEQ ID NO: 479846 - RNA, 66 nt, Homo Sapiens
gggcugguauucucucuaugcaauaauaaaaaacaagaaaccaagucguauaguccuagcugacgc

SEQ ID NO: 479847 - RNA, 66 nt, Homo Sapiens
cuuauauuaaaaggcaaagauacacucagaaaugaugaaaccaaauuauuuuuagaagaaauaugu

SEQ ID NO: 479848 - RNA, 66 nt, Homo Sapiens
ucugauuccuuccaacgugcacuucagcuggagaaagaaaccaagaagggaagcggccgcugggcc

SEQ ID NO: 479849 - RNA, 66 nt, Homo Sapiens
gcguuuggucagacaucaucuccuuggcugcccuuugaaaccaaaucacuugccuuggggauaaag

SEQ ID NO: 479850 - RNA, 66 nt, Homo Sapiens
aaauaugacguacgaaauggacaaaaagcuuuuucugaaaccaacuuuuuacuuccaucauccuuu

SEQ ID NO: 479851 - RNA, 66 nt, Homo Sapiens
uuuuuaguuauuguucaaggguauuuucacagaguggaaaccaauucagugauaggcuuaaagauu

SEQ ID NO: 479852 - RNA, 66 nt, Homo Sapiens
acaaacauuuuuaaaauuaauuuaacauggaacaaugaaaccaacaacgaggccgauuuuuuuuuu

SEQ ID NO: 479853 - RNA, 66 nt, Homo Sapiens
agucccagugaucuguuaccgagcuugccucuuugagaaaccaaggccagccgggcaggguggaag

SEQ ID NO: 479854 - RNA, 66 nt, Homo Sapiens
uguugccaggggugaggccgugccccaggccuccccgaaaccaaaggggaaggcagggguggggcc

SEQ ID NO: 479855 - RNA, 66 nt, Homo Sapiens
gagcuaggggcccgccccgcggacugacagcaccaggaaaccaaaugaugucccugcccgccgccc

SEQ ID NO: 479856 - RNA, 66 nt, Homo Sapiens
acaccuucgaaaacaugguaggacucacacuggauagaaaccaaagcaggugaaucaccugagguc

SEQ ID NO: 479857 - RNA, 66 nt, Homo Sapiens
accucccacugccgcucaggggcugacccuauuuaggaaaccaaagaggguggguugaaccuacuc

SEQ ID NO: 479858 - RNA, 66 nt, Homo Sapiens
gccucugggucccccuucucuguccacccacagagugaaaccaauuaaaauguuggaucucauuua

SEQ ID NO: 479859 - RNA, 66 nt, Homo Sapiens
uccuuggagcacugagcaccauuuggaagcuugagagaaaccaaaauuaaagagagaaagagagag

SEQ ID NO: 479860 - RNA, 66 nt, Homo Sapiens
cuugccucaagcaaaagcauagucguaagaucuuaagaaaccaaucuggcccagcauucagggagg

SEQ ID NO: 479861 - RNA, 66 nt, Homo Sapiens
cugucuccaccuugauauugauuauggccuccagaggaaaccaaccgaccuggaacagaugcuuuc

SEQ ID NO: 479862 - RNA, 66 nt, Homo Sapiens
gggggaugucagccucaccccucccugcuccaggaugaaaccaagagcugcagagggagccuccug

SEQ ID NO: 479863 - RNA, 66 nt, Homo Sapiens
cuaauaaaguuuucccaucccgcguggccgaagcuggaaaccaaacagcucggggcgggcggagcc

SEQ ID NO: 479864 - RNA, 66 nt, Homo Sapiens
agagacugaucauccaggccuuuuuuaaaugaucaugaaaccaaaaugaaauguuugucuuuucug

SEQ ID NO: 479865 - RNA, 66 nt, Homo Sapiens
aaaaaaaucaaucagaauaagagggugguuuauccagaaaccaagaguuuuauuauccugucccca

SEQ ID NO: 479866 - RNA, 66 nt, Homo Sapiens
ugcuccaugccggguuauuucacgugcaauaggguggaaaccaaacauuucauaaccaggccggac

SEQ ID NO: 479867 - RNA, 66 nt, Homo Sapiens
uggaagcccccucugccuccgggaagggggugcccugaaaccaaacgggcaggcggguggggggau

SEQ ID NO: 479868 - RNA, 66 nt, Homo Sapiens
cagcugcuguuaauauggauuaaauaaauguauugugaaaccaaaaauuacuguauguugcuuuuc

SEQ ID NO: 479869 - RNA, 66 nt, Homo Sapiens
ugcagccucaacaccauggaugucuguaaaaugugugaaaccaaacguacugauugcugucucgug

SEQ ID NO: 479870 - RNA, 66 nt, Homo Sapiens
cagucuucuauaaucuggggccuugauuuuacuucagaaaccaaaucaaaggcaggaaggauccug

SEQ ID NO: 479871 - RNA, 66 nt, Homo Sapiens
aaauuaaaacuuaacagcaucaaauuauugggaccagaaaccaaguaauguauaauguggcuuuug

SEQ ID NO: 479872 - RNA, 66 nt, Homo Sapiens
gggcccuuccaacucuggagugucuguaguucuugugaaaccaaaacguugacuaccugccucuuu

SEQ ID NO: 479873 - RNA, 66 nt, Homo Sapiens
gccugaagccuggauuccagcagugaaugcuagacagaaaccaagccauuaaugagauguuauuac

SEQ ID NO: 479874 - RNA, 66 nt, Homo Sapiens
guacuuuauuacgaguaaaguguaaugaguacuguggaaaccaaauuugaauacugcaaauuugua

SEQ ID NO: 479875 - RNA, 66 nt, Homo Sapiens
uauacaaacagggcagaaccacagaagaacguuuuagaaaccaagagaugugcagaaagaaauguu

SEQ ID NO: 479876 - RNA, 66 nt, Homo Sapiens
aaauugaaauaagcucuuugcaggcguccaauccuagaaaccaauggucuccagaacucucacaca

SEQ ID NO: 479877 - RNA, 66 nt, Homo Sapiens
ucaauuccucuuauucuuaaauaucuaaagggaaaggaaaccaacuuuaauuucagaacuucucuu

SEQ ID NO: 479878 - RNA, 66 nt, Homo Sapiens
cuuccucgaguggccacugugagccucgucacagcagaaaccaacuuuucuaacgacugaguucgc

SEQ ID NO: 479879 - RNA, 66 nt, Homo Sapiens
acaacaaaauggcuuguugcaguaguccagacuuuagaaaccaaacuguuuuacuggcaguucuau

SEQ ID NO: 479880 - RNA, 66 nt, Homo Sapiens
cugcacaccuagaaccccaaaggagaggccaaaagggaaaccaagguggaugaugccuaggcccaa

SEQ ID NO: 479881 - RNA, 66 nt, Homo Sapiens
ucauguucuucuaaagugucgagaggucuugcuuuugaaaccaaaauggccccuucugccuuccag

SEQ ID NO: 479882 - RNA, 66 nt, Homo Sapiens
cuaagagaugagcgaugccuccacuucacagaugaggaaaccaagguuggagaaagagaauuaucc

SEQ ID NO: 479883 - RNA, 66 nt, Homo Sapiens
auaugauaaugauaccaaaggaaagauaauuaucaugaaaccaacuuuuggaucauucccuuuuua

SEQ ID NO: 479884 - RNA, 66 nt, Homo Sapiens
cgccacacaacaucaagaaggccgacaaccagguuggaaaccaagacggagcucagacccaccaca

SEQ ID NO: 479885 - RNA, 66 nt, Homo Sapiens
agcuuggggcagccauuggccucugucucguuuugggaaaccaaggucaggaggccguugcagaca

SEQ ID NO: 479886 - RNA, 66 nt, Homo Sapiens
guaauaauuguggaaauguuucacuucugauuuagugaaaccaauuaaaguagagauaauguguag

SEQ ID NO: 479887 - RNA, 66 nt, Homo Sapiens
gaacgggaccugcuggccuccucauuggagccuagugaaaccaaauccaagaacucaaauuccuuu

SEQ ID NO: 479888 - RNA, 66 nt, Homo Sapiens
aagaaacuucgccuuaucaggcucaccggguguuccgaaaccaaaggguuccagaggaugcaucug

SEQ ID NO: 479889 - RNA, 66 nt, Homo Sapiens
ccagucugcuguccugaaacccagaagugauggagagaaaccaacaagagaucucgaacccugucu

SEQ ID NO: 479890 - RNA, 66 nt, Homo Sapiens
aagcaccuacugggugcuggguucacuguguccuaggaaaccaagaggguccccaguccuggccuc

SEQ ID NO: 479891 - RNA, 66 nt, Homo Sapiens
gcgcugguaccugcuggcccauggcccggguguagagaaaccaagcggcagccaccaccaguguug

SEQ ID NO: 479892 - RNA, 66 nt, Homo Sapiens
caucugcauguuuauuuccuuacaaguuaugcgaaggaaaccaagcuuuuaugcuaccuaccccug

SEQ ID NO: 479893 - RNA, 66 nt, Homo Sapiens
auuuaagacgggcugcucuuugcuccugguuggaaagaaaccaaaguggcucuuucuaccaauguu

SEQ ID NO: 479894 - RNA, 66 nt, Homo Sapiens
aacuguaggaacuugacuugcguuagaguguacucugaaaccaacucgucucuggccgcaggaguc

SEQ ID NO: 479895 - RNA, 66 nt, Homo Sapiens
cugaaagaagguuuaucauuacaaauaccuuccaaugaaaccaagaauuucucaaaauauuuaaug

SEQ ID NO: 479896 - RNA, 66 nt, Homo Sapiens
cucaaaaucaguuuuuauauuccccaaaagaagaaggaaaccaaggaguagcuauauauuucuacu

SEQ ID NO: 479897 - RNA, 66 nt, Homo Sapiens
ggcaacuauagguuuaaaccaagacaaaugaagacugaaaccaagaauauuguucuuaugcuggaa

SEQ ID NO: 479898 - RNA, 66 nt, Homo Sapiens
gugaaugggagggcgggccuggagcugcgugagagugaaaccaagaagcggauggggaagggagag

SEQ ID NO: 479899 - RNA, 66 nt, Homo Sapiens
ccuauaaagugccucggacaguccgcaguuguagcagaaaccaacaagaaccacuccuucauguuu

SEQ ID NO: 479900 - RNA, 66 nt, Homo Sapiens
uaagucauaugccuccagccauuauaugagaacugugaaaccaauaugguuuucuuuaugucuugg

SEQ ID NO: 479901 - RNA, 66 nt, Homo Sapiens
uuauuauuucuuaucuuucuucuuuuauauuuuuuggaaaccaaauuuauaguuaguuuagguaaa

SEQ ID NO: 479902 - RNA, 66 nt, Homo Sapiens
aucaccaaaaaaaguauauagugacauuuuuaguaugaaaccaaauuacacuaaggucuuuuguug

SEQ ID NO: 479903 - RNA, 66 nt, Homo Sapiens
gcugcauagaaggaggagagggaaaauguuuuguaagaaaccaaucaagauaaaggacagugaagu

SEQ ID NO: 479904 - RNA, 66 nt, Homo Sapiens
auaauaaaauuuccccuaaucuuuucugaaucuucugaaaccaaauguaacuauguuuuaucgucc

SEQ ID NO: 479905 - RNA, 66 nt, Homo Sapiens
ucuuaaauuucuuaaccuaggcuucagggagcauaugaaaccaaaauuauauggaacauuuucugu

SEQ ID NO: 479906 - RNA, 66 nt, Homo Sapiens
cauguagaacuguaauaagugaauuacaggucacaugaaaccaaaacgggcccugcuccauaagag

SEQ ID NO: 479907 - RNA, 66 nt, Homo Sapiens
acuagugcagcauuucagcaugaaaccugguuuuaugaaaccaaaggaaacucuuaaauuauaaug

SEQ ID NO: 479908 - RNA, 66 nt, Homo Sapiens
cauuacaccaugguuuuuagauuauuauuacaagaagaaaccaagauaagcuaauuaagggcgaug

SEQ ID NO: 479909 - RNA, 66 nt, Homo Sapiens
uggacaaauccucaccaccaacuaauuaaacauggagaaaccaaaugucagaggagggugaggaag

SEQ ID NO: 479910 - RNA, 66 nt, Homo Sapiens
ccacuucuuucuaggagauuauaaaugucccccugagaaaccaaucgcauuucaacauagagucac

SEQ ID NO: 479911 - RNA, 66 nt, Homo Sapiens
cacagagaggcucuccucuccugaaugcacaaaugggaaaccaagggugugaggccugcagaggcc

SEQ ID NO: 479912 - RNA, 61 nt, Homo Sapiens; identical to SEQ ID NO: 479054

SEQ ID NO: 479913 - RNA, 61 nt, Homo Sapiens; identical to SEQ ID NO: 479055

SEQ ID NO: 479914 - RNA, 66 nt, Homo Sapiens
cccaugagcagcaguggaaggauggugagggcucuagaaaccaagcugaacugaggaaggugcuua

SEQ ID NO: 479915 - RNA, 66 nt, Homo Sapiens
caugaaaauuauggaagacucuuuagccagaauaaagaaaccaaauucugaaacuuugggaauuug

SEQ ID NO: 479916 - RNA, 66 nt, Homo Sapiens
auaauuauuauuucuuaucuucuuuuauauuuuuuggaaaccaaauuuauaguuaguuuagguaaa

SEQ ID NO: 479917 - RNA, 66 nt, Homo Sapiens
aaaugugugaacuugacuuguguuagaguauauucugaaaccaacuugucccaggccacaggagug

SEQ ID NO: 479918 - RNA, 64 nt, Homo Sapiens
aauuugaaugaacuaaagauauaucucuaccuucucauuugaauaucuuuaguucauucagauu

SEQ ID NO: 479919 - RNA, 64 nt, Homo Sapiens
aaucugaaugaacuaaagauguaucuguaccuucucauuugauguauuaaucauaaaauuucac

SEQ ID NO: 479920 - RNA, 64 nt, Homo Sapiens
uagguuuauauuuucagaucucucaaaaaucacaucauuugaccaaagaauaauuuaagacaca

SEQ ID NO: 479921 - RNA, 64 nt, Homo Sapiens
gaaaaccuuagauagagggacaugugaaacaaaaucauuugaaauuuugauucagacauccauu

SEQ ID NO: 479922 - RNA, 64 nt, Homo Sapiens
gguuugacaguaucuuuucucuaagacccaggggucauuugagaaauucauuguuuugugggau

SEQ ID NO: 479923 - RNA, 64 nt, Homo Sapiens
aauagaguccagcugccucuccaucagucaacacucauuugacagcccccaucaugccccacac

SEQ ID NO: 479924 - RNA, 64 nt, Homo Sapiens
gcuucagucucggaacaugauauuggaacuagggucauuugaaauaaacugaagaaagugucua

SEQ ID NO: 479925 - RNA, 64 nt, Homo Sapiens
uccuuccauuugaccuaauuugauugggcaauacucauuugagugacuuacaaauaaugggcuc

SEQ ID NO: 479926 - RNA, 64 nt, Homo Sapiens
uuggaagccuuuugcagcucuguggcuuggaauuucauuugagcaauuucuauaggauauguau

SEQ ID NO: 479927 - RNA, 64 nt, Homo Sapiens
gagccacacauuuaaauacagacagcuuuccugaucauuugauuuauugugcaccugauuuuug

SEQ ID NO: 479928 - RNA, 64 nt, Homo Sapiens
auuaauggcuuuuuccauuauuaaugugaucccuucauuugaauuucuuauguauggguuuuuu

SEQ ID NO: 479929 - RNA, 64 nt, Homo Sapiens
acacugcaacagugaacuuuuaguacuugauuggucauuugaaaguggccuuuuaaccaagaag

SEQ ID NO: 479930 - RNA, 64 nt, Homo Sapiens
aucuugaaaggcuuuuggugaaaaugaagggauuucauuugaaauuacagcaugaugaauuuug

SEQ ID NO: 479931 - RNA, 64 nt, Homo Sapiens
cguuaugacuuuggcaacuugcuucauuucuuuuucauuugacuuacaacacacuucucuaaca

SEQ ID NO: 479932 - RNA, 64 nt, Homo Sapiens
auucucuuagaaauucaaguauuuucaaggggagucauuugagauauauuuauuuuacuaggag

SEQ ID NO: 479933 - RNA, 64 nt, Homo Sapiens
ucuaugagguucuuagaaaaauuugguuuuaaaaucauuugaggacaggaaugucuauagcaag

SEQ ID NO: 479934 - RNA, 64 nt, Homo Sapiens
ucucugguugccuccugccaccagcauccauggcucauuugacaccuuuuuaaauaucaggaca

SEQ ID NO: 479935 - RNA, 64 nt, Homo Sapiens
uucagguuugcugucacauaugcaucaucugaaaucauuugaaauuuuuguacaauaaaauauc

SEQ ID NO: 479936 - RNA, 64 nt, Homo Sapiens
acuuggcccuugguaaaauuuugacaaucauaagucauuugaaaagaacagacuuacuaaaauc

SEQ ID NO: 479937 - RNA, 64 nt, Homo Sapiens
cucccacaacaaauaccaagcaucaaaagcacuuucauuugaaaauuauuauguuguaauuuuu

SEQ ID NO: 479938 - RNA, 64 nt, Homo Sapiens
ucguacugguuuuaaaccuuaauucacuguguuuucauuugauggagugacuuucuaacauagg

SEQ ID NO: 479939 - RNA, 64 nt, Homo Sapiens
ucguacugguuuuaaaccuuaauucacuguguuuucauuugaugacaaugcuguguaacauagg

SEQ ID NO: 479940 - RNA, 64 nt, Homo Sapiens
gguauaaaguauacuuuuucgcacuacauuaauaucauuugauauaguaagaguauucuaaaca

SEQ ID NO: 479941 - RNA, 64 nt, Homo Sapiens
uuaaaaugagaaguuauuauucauacuguguugcucauuugacaaaauaagguaaggauuucau

SEQ ID NO: 479942 - RNA, 64 nt, Homo Sapiens
aaucccagcacuuugggaggccgaggcggguggaucauuugaggucaggaguuugaaaccagcc

SEQ ID NO: 479943 - RNA, 64 nt, Homo Sapiens
gaauuuuuccauauaaaucucaaugaauucccuuucauuugaauaggcaaacccaaauccaugc

SEQ ID NO: 479944 - RNA, 64 nt, Homo Sapiens
auuuuguauaaaaaagaacaacagaaauuaucugucauuugagaaguggcuugacaaucauuug

SEQ ID NO: 479945 - RNA, 64 nt, Homo Sapiens
gaaauuaucugucauuugagaaguggcuugacaaucauuugagcuuugaaagcagucacugugg

SEQ ID NO: 479946 - RNA, 64 nt, Homo Sapiens
augaagacccaaggcauaagguugggaaaacaccucauuugaccuugccagcugaccuucaaac

SEQ ID NO: 479947 - RNA, 64 nt, Homo Sapiens
aacuugaauggaauaacgacauuccagaaguuaaucauuugaauucugaacacuggagaaaaac

SEQ ID NO: 479948 - RNA, 64 nt, Homo Sapiens
uaacaaaaugcuauuaaucugacugcuguacucuucauuugauggugacugaaggauuuauuca

SEQ ID NO: 479949 - RNA, 64 nt, Homo Sapiens
uuucaccucugucuguuggauuugcuguggccccucauuugacccuguggcugcuagugaccuc

SEQ ID NO: 479950 - RNA, 64 nt, Homo Sapiens
cuucacacaaauaauaaccucuuuaaccuacaggucauuugaguuuuuguaucuuccauucaua

SEQ ID NO: 479951 - RNA, 64 nt, Homo Sapiens
ccauucauuaagugccuucuacccacuuaucccuucauuugacaaggacuuuucaccauccauc

SEQ ID NO: 479952 - RNA, 64 nt, Homo Sapiens
ucaagaauucgagaucagccgcaccuauuugggaucauuugaggauuaaagcccuuuuuaaaaa

SEQ ID NO: 479953 - RNA, 64 nt, Homo Sapiens
uguuugcuuuucuacuuuuaauacuggagucuuaucauuugaagcuaaguuuuuaguaugggug

SEQ ID NO: 479954 - RNA, 64 nt, Homo Sapiens
auuucuucucugguuguaauucuaaauuacagagucauuugagcuuucuccccucccgcuagua

SEQ ID NO: 479955 - RNA, 64 nt, Homo Sapiens
uguagcauucuguuuuagcaucuuugaauuaugaucauuugauuuggcuaauuacaaaaaguac

SEQ ID NO: 479956 - RNA, 64 nt, Homo Sapiens
gugugaauucaauacaggcuuuacugguaaagccucauuugaaucucuguauuaauccccauca

SEQ ID NO: 479957 - RNA, 64 nt, Homo Sapiens
uaaagucaaaugccaaacacauugagcaguuagcucauuugagaguaugagucuucuguaauuc

SEQ ID NO: 479958 - RNA, 64 nt, Homo Sapiens
aguguuggacuugugugaaaagagagaaugucuuucauuugaaggaauguggcagguuagaaag

SEQ ID NO: 479959 - RNA, 64 nt, Homo Sapiens
uuauuuuuuucuaauaugugaaugguaauuagaaucauuugaaugauggagacauuaacaagcu

SEQ ID NO: 479960 - RNA, 64 nt, Homo Sapiens
agcacuccuagucucuggcccagagccuaaaaccucauuugauaaccuucucauuccuuccuuu

SEQ ID NO: 479961 - RNA, 64 nt, Homo Sapiens
uauuuuuauauguauaucuacaauccgagaugaaucauuugaaguuuuaauuuuuaagaguguu

SEQ ID NO: 479962 - RNA, 64 nt, Homo Sapiens
acuacaaggaagguuuuccauuauacuuuuaaagucauuugagggcucuggcucuguggcuuug

SEQ ID NO: 479963 - RNA, 64 nt, Homo Sapiens
auagcaagaccucaucucagaaaaaaaaaaaaagucauuugaaaacuucuaauacagcaaaauc

SEQ ID NO: 479964 - RNA, 64 nt, Homo Sapiens
cagaagggccacacuccaggaggaguguugagagucauuugagguagucuugccaccuguuuuc

SEQ ID NO: 479965 - RNA, 64 nt, Homo Sapiens
ggucccagcuacucaggaggcugaggugggaggaucauuugagccuaggaggucaaggcugcag

SEQ ID NO: 479966 - RNA, 64 nt, Homo Sapiens; identical to SEQ ID NO: 113393

SEQ ID NO: 479967 - RNA, 64 nt, Homo Sapiens; identical to SEQ ID NO: 113394

SEQ ID NO: 479968 - RNA, 64 nt, Homo Sapiens; identical to SEQ ID NO: 113395

SEQ ID NO: 479969 - RNA, 64 nt, Homo Sapiens; identical to SEQ ID NO: 113396

SEQ ID NO: 479970 - RNA, 64 nt, Homo Sapiens; identical to SEQ ID NO: 113397

SEQ ID NO: 479971 - RNA, 64 nt, Homo Sapiens; identical to SEQ ID NO: 113398

SEQ ID NO: 479972 - RNA, 64 nt, Homo Sapiens; identical to SEQ ID NO: 113399

SEQ ID NO: 479973 - RNA, 64 nt, Homo Sapiens; identical to SEQ ID NO: 113400

SEQ ID NO: 479974 - RNA, 64 nt, Homo Sapiens; identical to SEQ ID NO: 113401

SEQ ID NO: 479975 - RNA, 64 nt, Homo Sapiens; identical to SEQ ID NO: 113402

SEQ ID NO: 479976 - RNA, 64 nt, Homo Sapiens; identical to SEQ ID NO: 113403

SEQ ID NO: 479977 - RNA, 64 nt, Homo Sapiens; identical to SEQ ID NO: 113404

SEQ ID NO: 479978 - RNA, 64 nt, Homo Sapiens; identical to SEQ ID NO: 113405

SEQ ID NO: 479979 - RNA, 64 nt, Homo Sapiens; identical to SEQ ID NO: 113406

SEQ ID NO: 479980 - RNA, 64 nt, Homo Sapiens; identical to SEQ ID NO: 113407

SEQ ID NO: 479981 - RNA, 64 nt, Homo Sapiens; identical to SEQ ID NO: 113408

SEQ ID NO: 479982 - RNA, 64 nt, Homo Sapiens; identical to SEQ ID NO: 113409

SEQ ID NO: 479983 - RNA, 64 nt, Homo Sapiens; identical to SEQ ID NO: 113410

SEQ ID NO: 479984 - RNA, 64 nt, Homo Sapiens; identical to SEQ ID NO: 113411

SEQ ID NO: 479985 - RNA, 64 nt, Homo Sapiens; identical to SEQ ID NO: 113412

SEQ ID NO: 479986 - RNA, 64 nt, Homo Sapiens; identical to SEQ ID NO: 113413

SEQ ID NO: 479987 - RNA, 64 nt, Homo Sapiens; identical to SEQ ID NO: 113414

SEQ ID NO: 479988 - RNA, 64 nt, Homo Sapiens; identical to SEQ ID NO: 113415

SEQ ID NO: 479989 - RNA, 64 nt, Homo Sapiens; identical to SEQ ID NO: 113416

SEQ ID NO: 479990 - RNA, 64 nt, Homo Sapiens; identical to SEQ ID NO: 113417

SEQ ID NO: 479991 - RNA, 64 nt, Homo Sapiens; identical to SEQ ID NO: 113418

SEQ ID NO: 479992 - RNA, 64 nt, Homo Sapiens; identical to SEQ ID NO: 113419

SEQ ID NO: 479993 - RNA, 64 nt, Homo Sapiens; identical to SEQ ID NO: 113420

SEQ ID NO: 479994 - RNA, 64 nt, Homo Sapiens; identical to SEQ ID NO: 113421

SEQ ID NO: 479995 - RNA, 58 nt, Homo Sapiens; identical to SEQ ID NO: 113422

SEQ ID NO: 479996 - RNA, 64 nt, Homo Sapiens; identical to SEQ ID NO: 113423

SEQ ID NO: 479997 - RNA, 64 nt, Homo Sapiens; identical to SEQ ID NO: 113424

SEQ ID NO: 479998 - RNA, 64 nt, Homo Sapiens; identical to SEQ ID NO: 113425

SEQ ID NO: 479999 - RNA, 64 nt, Homo Sapiens; identical to SEQ ID NO: 113426

SEQ ID NO: 480000 - RNA, 64 nt, Homo Sapiens; identical to SEQ ID NO: 113427

SEQ ID NO: 480001 - RNA, 64 nt, Homo Sapiens; identical to SEQ ID NO: 113428

SEQ ID NO: 480002 - RNA, 64 nt, Homo Sapiens; identical to SEQ ID NO: 113429

SEQ ID NO: 480003 - RNA, 64 nt, Homo Sapiens; identical to SEQ ID NO: 113430

SEQ ID NO: 480004 - RNA, 64 nt, Homo Sapiens; identical to SEQ ID NO: 113431

SEQ ID NO: 480005 - RNA, 64 nt, Homo Sapiens; identical to SEQ ID NO: 113432

SEQ ID NO: 480006 - RNA, 64 nt, Homo Sapiens; identical to SEQ ID NO: 113433

SEQ ID NO: 480007 - RNA, 64 nt, Homo Sapiens; identical to SEQ ID NO: 113434

SEQ ID NO: 480008 - RNA, 64 nt, Homo Sapiens; identical to SEQ ID NO: 113435

SEQ ID NO: 480009 - RNA, 64 nt, Homo Sapiens; identical to SEQ ID NO: 113436

SEQ ID NO: 480010 - RNA, 64 nt, Homo Sapiens; identical to SEQ ID NO: 113437

SEQ ID NO: 480011 - RNA, 64 nt, Homo Sapiens; identical to SEQ ID NO: 113438

SEQ ID NO: 480012 - RNA, 64 nt, Homo Sapiens; identical to SEQ ID NO: 113439

SEQ ID NO: 480013 - RNA, 64 nt, Homo Sapiens; identical to SEQ ID NO: 113440

SEQ ID NO: 480014 - RNA, 64 nt, Homo Sapiens; identical to SEQ ID NO: 113441

SEQ ID NO: 480015 - RNA, 64 nt, Homo Sapiens; identical to SEQ ID NO: 113442

SEQ ID NO: 480016 - RNA, 64 nt, Homo Sapiens; identical to SEQ ID NO: 113443

SEQ ID NO: 480017 - RNA, 64 nt, Homo Sapiens; identical to SEQ ID NO: 113444

SEQ ID NO: 480018 - RNA, 64 nt, Homo Sapiens; identical to SEQ ID NO: 113445

SEQ ID NO: 480019 - RNA, 64 nt, Homo Sapiens; identical to SEQ ID NO: 113446

SEQ ID NO: 480020 - RNA, 64 nt, Homo Sapiens; identical to SEQ ID NO: 113447

SEQ ID NO: 480021 - RNA, 64 nt, Homo Sapiens; identical to SEQ ID NO: 113448

SEQ ID NO: 480022 - RNA, 64 nt, Homo Sapiens; identical to SEQ ID NO: 113449

SEQ ID NO: 480023 - RNA, 64 nt, Homo Sapiens; identical to SEQ ID NO: 113450

SEQ ID NO: 480024 - RNA, 64 nt, Homo Sapiens; identical to SEQ ID NO: 113451

SEQ ID NO: 480025 - RNA, 64 nt, Homo Sapiens; identical to SEQ ID NO: 113452

SEQ ID NO: 480026 - RNA, 64 nt, Homo Sapiens; identical to SEQ ID NO: 113453

SEQ ID NO: 480027 - RNA, 64 nt, Homo Sapiens; identical to SEQ ID NO: 113454

SEQ ID NO: 480028 - RNA, 64 nt, Homo Sapiens; identical to SEQ ID NO: 113455

SEQ ID NO: 480029 - RNA, 64 nt, Homo Sapiens; identical to SEQ ID NO: 113456

SEQ ID NO: 480030 - RNA, 64 nt, Homo Sapiens; identical to SEQ ID NO: 113457

SEQ ID NO: 480031 - RNA, 64 nt, Homo Sapiens; identical to SEQ ID NO: 113458

SEQ ID NO: 480032 - RNA, 64 nt, Homo Sapiens; identical to SEQ ID NO: 113459

SEQ ID NO: 480033 - RNA, 64 nt, Homo Sapiens; identical to SEQ ID NO: 113460

SEQ ID NO: 480034 - RNA, 64 nt, Homo Sapiens; identical to SEQ ID NO: 113461

SEQ ID NO: 480035 - RNA, 64 nt, Homo Sapiens; identical to SEQ ID NO: 113462

SEQ ID NO: 480036 - RNA, 64 nt, Homo Sapiens; identical to SEQ ID NO: 113463

SEQ ID NO: 480037 - RNA, 64 nt, Homo Sapiens; identical to SEQ ID NO: 113464

SEQ ID NO: 480038 - RNA, 64 nt, Homo Sapiens; identical to SEQ ID NO: 113465

SEQ ID NO: 480039 - RNA, 64 nt, Homo Sapiens; identical to SEQ ID NO: 113466

SEQ ID NO: 480040 - RNA, 64 nt, Homo Sapiens; identical to SEQ ID NO: 113467

SEQ ID NO: 480041 - RNA, 64 nt, Homo Sapiens; identical to SEQ ID NO: 113468

SEQ ID NO: 480042 - RNA, 64 nt, Homo Sapiens; identical to SEQ ID NO: 113469

SEQ ID NO: 480043 - RNA, 64 nt, Homo Sapiens; identical to SEQ ID NO: 113470

SEQ ID NO: 480044 - RNA, 64 nt, Homo Sapiens; identical to SEQ ID NO: 113471

SEQ ID NO: 480045 - RNA, 64 nt, Homo Sapiens; identical to SEQ ID NO: 113472

SEQ ID NO: 480046 - RNA, 64 nt, Homo Sapiens; identical to SEQ ID NO: 113473

SEQ ID NO: 480047 - RNA, 64 nt, Homo Sapiens; identical to SEQ ID NO: 113474

SEQ ID NO: 480048 - RNA, 64 nt, Homo Sapiens; identical to SEQ ID NO: 113475

SEQ ID NO: 480049 - RNA, 64 nt, Homo Sapiens; identical to SEQ ID NO: 113476

SEQ ID NO: 480050 - RNA, 64 nt, Homo Sapiens; identical to SEQ ID NO: 113477

SEQ ID NO: 480051 - RNA, 64 nt, Homo Sapiens; identical to SEQ ID NO: 113478

SEQ ID NO: 480052 - RNA, 64 nt, Homo Sapiens; identical to SEQ ID NO: 113479

SEQ ID NO: 480053 - RNA, 64 nt, Homo Sapiens; identical to SEQ ID NO: 113480

SEQ ID NO: 480054 - RNA, 64 nt, Homo Sapiens; identical to SEQ ID NO: 113481

SEQ ID NO: 480055 - RNA, 64 nt, Homo Sapiens
uuuccccaccagcuccacaaccccaacuuuccccuacccccaaccugcccaaaauuuccccuac

SEQ ID NO: 480056 - RNA, 64 nt, Homo Sapiens
uuuccccuacccccaacuuucccaaaauuuccccuacccccaaccugggcugaugaaggcacug

SEQ ID NO: 480057 - RNA, 64 nt, Homo Sapiens
caucuucugggcccuucucuccuuuaggccagcuuacccccaaaccuggcuccuggggacggau

SEQ ID NO: 480058 - RNA, 64 nt, Homo Sapiens
ucagcugugacaucgugccugggaaggcgaaauauacccccagccccuuccaacacacacacuc

SEQ ID NO: 480059 - RNA, 64 nt, Homo Sapiens
guacagaaaauguaucucuuggggagggccuguguacccccauucucugauuauaaacagauaa

SEQ ID NO: 480060 - RNA, 64 nt, Homo Sapiens
aacagauaaacccaaauguggaucauccuuggaauacccccauucuccuugccucuuagcaugu

SEQ ID NO: 480061 - RNA, 64 nt, Homo Sapiens
uuaaaacguuuuuuuuuauuguacuuauuuuguuuacccccaauccaaccuguauggcgggucu

SEQ ID NO: 480062 - RNA, 64 nt, Homo Sapiens
uuuucccaggccaggcacugagcauggcagucccuacccccaaugacucccccaucuugcugac

SEQ ID NO: 480063 - RNA, 64 nt, Homo Sapiens; identical to SEQ ID NO: 134055

SEQ ID NO: 480064 - RNA, 64 nt, Homo Sapiens; identical to SEQ ID NO: 134056

SEQ ID NO: 480065 - RNA, 64 nt, Homo Sapiens; identical to SEQ ID NO: 134057

SEQ ID NO: 480066 - RNA, 64 nt, Homo Sapiens; identical to SEQ ID NO: 134058

SEQ ID NO: 480067 - RNA, 64 nt, Homo Sapiens; identical to SEQ ID NO: 134059

SEQ ID NO: 480068 - RNA, 64 nt, Homo Sapiens; identical to SEQ ID NO: 134060

SEQ ID NO: 480069 - RNA, 64 nt, Homo Sapiens; identical to SEQ ID NO: 134061

SEQ ID NO: 480070 - RNA, 64 nt, Homo Sapiens; identical to SEQ ID NO: 134062

SEQ ID NO: 480071 - RNA, 64 nt, Homo Sapiens; identical to SEQ ID NO: 134063

SEQ ID NO: 480072 - RNA, 64 nt, Homo Sapiens; identical to SEQ ID NO: 134064

SEQ ID NO: 480073 - RNA, 64 nt, Homo Sapiens; identical to SEQ ID NO: 134065

SEQ ID NO: 480074 - RNA, 64 nt, Homo Sapiens; identical to SEQ ID NO: 134066

SEQ ID NO: 480075 - RNA, 64 nt, Homo Sapiens; identical to SEQ ID NO: 134067

SEQ ID NO: 480076 - RNA, 64 nt, Homo Sapiens; identical to SEQ ID NO: 134068

SEQ ID NO: 480077 - RNA, 64 nt, Homo Sapiens; identical to SEQ ID NO: 134069

SEQ ID NO: 480078 - RNA, 64 nt, Homo Sapiens; identical to SEQ ID NO: 134070

SEQ ID NO: 480079 - RNA, 64 nt, Homo Sapiens; identical to SEQ ID NO: 134071

SEQ ID NO: 480080 - RNA, 64 nt, Homo Sapiens; identical to SEQ ID NO: 134072

SEQ ID NO: 480081 - RNA, 64 nt, Homo Sapiens; identical to SEQ ID NO: 134073

SEQ ID NO: 480082 - RNA, 64 nt, Homo Sapiens; identical to SEQ ID NO: 134074

SEQ ID NO: 480083 - RNA, 64 nt, Homo Sapiens; identical to SEQ ID NO: 134075

SEQ ID NO: 480084 - RNA, 64 nt, Homo Sapiens; identical to SEQ ID NO: 134076

SEQ ID NO: 480085 - RNA, 64 nt, Homo Sapiens; identical to SEQ ID NO: 134077

SEQ ID NO: 480086 - RNA, 64 nt, Homo Sapiens; identical to SEQ ID NO: 134078

SEQ ID NO: 480087 - RNA, 64 nt, Homo Sapiens; identical to SEQ ID NO: 134079

SEQ ID NO: 480088 - RNA, 64 nt, Homo Sapiens; identical to SEQ ID NO: 134080

SEQ ID NO: 480089 - RNA, 64 nt, Homo Sapiens; identical to SEQ ID NO: 134081

SEQ ID NO: 480090 - RNA, 64 nt, Homo Sapiens; identical to SEQ ID NO: 134082

SEQ ID NO: 480091 - RNA, 64 nt, Homo Sapiens; identical to SEQ ID NO: 134083

SEQ ID NO: 480092 - RNA, 64 nt, Homo Sapiens; identical to SEQ ID NO: 134084

SEQ ID NO: 480093 - RNA, 64 nt, Homo Sapiens; identical to SEQ ID NO: 134085

SEQ ID NO: 480094 - RNA, 64 nt, Homo Sapiens; identical to SEQ ID NO: 134086

SEQ ID NO: 480095 - RNA, 64 nt, Homo Sapiens; identical to SEQ ID NO: 134087

SEQ ID NO: 480096 - RNA, 64 nt, Homo Sapiens; identical to SEQ ID NO: 134088

SEQ ID NO: 480097 - RNA, 64 nt, Homo Sapiens; identical to SEQ ID NO: 134089

SEQ ID NO: 480098 - RNA, 64 nt, Homo Sapiens; identical to SEQ ID NO: 134090

SEQ ID NO: 480099 - RNA, 64 nt, Homo Sapiens; identical to SEQ ID NO: 134091

SEQ ID NO: 480100 - RNA, 64 nt, Homo Sapiens; identical to SEQ ID NO: 134092

SEQ ID NO: 480101 - RNA, 64 nt, Homo Sapiens; identical to SEQ ID NO: 134093

SEQ ID NO: 480102 - RNA, 64 nt, Homo Sapiens; identical to SEQ ID NO: 134094

SEQ ID NO: 480103 - RNA, 64 nt, Homo Sapiens; identical to SEQ ID NO: 134095

SEQ ID NO: 480104 - RNA, 64 nt, Homo Sapiens; identical to SEQ ID NO: 134096

SEQ ID NO: 480105 - RNA, 64 nt, Homo Sapiens; identical to SEQ ID NO: 134097

SEQ ID NO: 480106 - RNA, 64 nt, Homo Sapiens; identical to SEQ ID NO: 134098

SEQ ID NO: 480107 - RNA, 64 nt, Homo Sapiens; identical to SEQ ID NO: 134099

SEQ ID NO: 480108 - RNA, 64 nt, Homo Sapiens; identical to SEQ ID NO: 134100

SEQ ID NO: 480109 - RNA, 64 nt, Homo Sapiens; identical to SEQ ID NO: 134101

SEQ ID NO: 480110 - RNA, 64 nt, Homo Sapiens; identical to SEQ ID NO: 134102

SEQ ID NO: 480111 - RNA, 64 nt, Homo Sapiens; identical to SEQ ID NO: 134103

SEQ ID NO: 480112 - RNA, 64 nt, Homo Sapiens; identical to SEQ ID NO: 134104

SEQ ID NO: 480113 - RNA, 64 nt, Homo Sapiens; identical to SEQ ID NO: 134105

SEQ ID NO: 480114 - RNA, 64 nt, Homo Sapiens; identical to SEQ ID NO: 134106

SEQ ID NO: 480115 - RNA, 64 nt, Homo Sapiens; identical to SEQ ID NO: 134107

SEQ ID NO: 480116 - RNA, 64 nt, Homo Sapiens; identical to SEQ ID NO: 134108

SEQ ID NO: 480117 - RNA, 64 nt, Homo Sapiens; identical to SEQ ID NO: 134109

SEQ ID NO: 480118 - RNA, 64 nt, Homo Sapiens; identical to SEQ ID NO: 134110

SEQ ID NO: 480119 - RNA, 64 nt, Homo Sapiens; identical to SEQ ID NO: 134111

SEQ ID NO: 480120 - RNA, 64 nt, Homo Sapiens; identical to SEQ ID NO: 134112

SEQ ID NO: 480121 - RNA, 64 nt, Homo Sapiens; identical to SEQ ID NO: 134113

SEQ ID NO: 480122 - RNA, 64 nt, Homo Sapiens; identical to SEQ ID NO: 134114

SEQ ID NO: 480123 - RNA, 64 nt, Homo Sapiens; identical to SEQ ID NO: 134115

SEQ ID NO: 480124 - RNA, 64 nt, Homo Sapiens; identical to SEQ ID NO: 134116

SEQ ID NO: 480125 - RNA, 64 nt, Homo Sapiens; identical to SEQ ID NO: 134117

SEQ ID NO: 480126 - RNA, 64 nt, Homo Sapiens; identical to SEQ ID NO: 134118

SEQ ID NO: 480127 - RNA, 64 nt, Homo Sapiens; identical to SEQ ID NO: 134119

SEQ ID NO: 480128 - RNA, 64 nt, Homo Sapiens; identical to SEQ ID NO: 134120

SEQ ID NO: 480129 - RNA, 64 nt, Homo Sapiens; identical to SEQ ID NO: 134121

SEQ ID NO: 480130 - RNA, 64 nt, Homo Sapiens; identical to SEQ ID NO: 134122

SEQ ID NO: 480131 - RNA, 64 nt, Homo Sapiens; identical to SEQ ID NO: 134123

SEQ ID NO: 480132 - RNA, 64 nt, Homo Sapiens; identical to SEQ ID NO: 134124

SEQ ID NO: 480133 - RNA, 64 nt, Homo Sapiens; identical to SEQ ID NO: 134125

SEQ ID NO: 480134 - RNA, 64 nt, Homo Sapiens; identical to SEQ ID NO: 221220

SEQ ID NO: 480135 - RNA, 64 nt, Homo Sapiens; identical to SEQ ID NO: 221221

SEQ ID NO: 480136 - RNA, 64 nt, Homo Sapiens; identical to SEQ ID NO: 221222

SEQ ID NO: 480137 - RNA, 64 nt, Homo Sapiens; identical to SEQ ID NO: 221223

SEQ ID NO: 480138 - RNA, 64 nt, Homo Sapiens; identical to SEQ ID NO: 221224

SEQ ID NO: 480139 - RNA, 64 nt, Homo Sapiens; identical to SEQ ID NO: 221225

SEQ ID NO: 480140 - RNA, 64 nt, Homo Sapiens; identical to SEQ ID NO: 221226

SEQ ID NO: 480141 - RNA, 64 nt, Homo Sapiens; identical to SEQ ID NO: 221227

SEQ ID NO: 480142 - RNA, 64 nt, Homo Sapiens; identical to SEQ ID NO: 221228

SEQ ID NO: 480143 - RNA, 64 nt, Homo Sapiens; identical to SEQ ID NO: 221229

SEQ ID NO: 480144 - RNA, 64 nt, Homo Sapiens; identical to SEQ ID NO: 221230

SEQ ID NO: 480145 - RNA, 64 nt, Homo Sapiens; identical to SEQ ID NO: 221231

SEQ ID NO: 480146 - RNA, 64 nt, Homo Sapiens; identical to SEQ ID NO: 221232

SEQ ID NO: 480147 - RNA, 64 nt, Homo Sapiens; identical to SEQ ID NO: 221233

SEQ ID NO: 480148 - RNA, 64 nt, Homo Sapiens; identical to SEQ ID NO: 221234

SEQ ID NO: 480149 - RNA, 64 nt, Homo Sapiens; identical to SEQ ID NO: 221235

SEQ ID NO: 480150 - RNA, 64 nt, Homo Sapiens; identical to SEQ ID NO: 221236

SEQ ID NO: 480151 - RNA, 64 nt, Homo Sapiens; identical to SEQ ID NO: 221237

SEQ ID NO: 480152 - RNA, 64 nt, Homo Sapiens; identical to SEQ ID NO: 221238

SEQ ID NO: 480153 - RNA, 64 nt, Homo Sapiens; identical to SEQ ID NO: 221239

SEQ ID NO: 480154 - RNA, 64 nt, Homo Sapiens; identical to SEQ ID NO: 221240

SEQ ID NO: 480155 - RNA, 64 nt, Homo Sapiens; identical to SEQ ID NO: 221241

SEQ ID NO: 480156 - RNA, 64 nt, Homo Sapiens; identical to SEQ ID NO: 221242

SEQ ID NO: 480157 - RNA, 64 nt, Homo Sapiens; identical to SEQ ID NO: 221243

SEQ ID NO: 480158 - RNA, 64 nt, Homo Sapiens; identical to SEQ ID NO: 221244

SEQ ID NO: 480159 - RNA, 64 nt, Homo Sapiens; identical to SEQ ID NO: 221245

SEQ ID NO: 480160 - RNA, 64 nt, Homo Sapiens; identical to SEQ ID NO: 221246

SEQ ID NO: 480161 - RNA, 64 nt, Homo Sapiens; identical to SEQ ID NO: 221247

SEQ ID NO: 480162 - RNA, 64 nt, Homo Sapiens; identical to SEQ ID NO: 221248

SEQ ID NO: 480163 - RNA, 64 nt, Homo Sapiens; identical to SEQ ID NO: 221249

SEQ ID NO: 480164 - RNA, 64 nt, Homo Sapiens; identical to SEQ ID NO: 221250

SEQ ID NO: 480165 - RNA, 64 nt, Homo Sapiens; identical to SEQ ID NO: 221251

SEQ ID NO: 480166 - RNA, 64 nt, Homo Sapiens; identical to SEQ ID NO: 221252

SEQ ID NO: 480167 - RNA, 64 nt, Homo Sapiens; identical to SEQ ID NO: 221253

SEQ ID NO: 480168 - RNA, 64 nt, Homo Sapiens; identical to SEQ ID NO: 221254

SEQ ID NO: 480169 - RNA, 64 nt, Homo Sapiens; identical to SEQ ID NO: 221255

SEQ ID NO: 480170 - RNA, 64 nt, Homo Sapiens; identical to SEQ ID NO: 221256

SEQ ID NO: 480171 - RNA, 64 nt, Homo Sapiens; identical to SEQ ID NO: 221257

SEQ ID NO: 480172 - RNA, 64 nt, Homo Sapiens; identical to SEQ ID NO: 221258

SEQ ID NO: 480173 - RNA, 64 nt, Homo Sapiens; identical to SEQ ID NO: 221259

SEQ ID NO: 480174 - RNA, 64 nt, Homo Sapiens; identical to SEQ ID NO: 221260

SEQ ID NO: 480175 - RNA, 64 nt, Homo Sapiens; identical to SEQ ID NO: 221261

SEQ ID NO: 480176 - RNA, 64 nt, Homo Sapiens; identical to SEQ ID NO: 221262

SEQ ID NO: 480177 - RNA, 64 nt, Homo Sapiens; identical to SEQ ID NO: 221263

SEQ ID NO: 480178 - RNA, 64 nt, Homo Sapiens; identical to SEQ ID NO: 221264

SEQ ID NO: 480179 - RNA, 64 nt, Homo Sapiens; identical to SEQ ID NO: 221265

SEQ ID NO: 480180 - RNA, 64 nt, Homo Sapiens; identical to SEQ ID NO: 221266

SEQ ID NO: 480181 - RNA, 54 nt, Homo Sapiens; identical to SEQ ID NO: 221267

SEQ ID NO: 480182 - RNA, 64 nt, Homo Sapiens; identical to SEQ ID NO: 221268

SEQ ID NO: 480183 - RNA, 64 nt, Homo Sapiens; identical to SEQ ID NO: 221269

SEQ ID NO: 480184 - RNA, 64 nt, Homo Sapiens; identical to SEQ ID NO: 221270

SEQ ID NO: 480185 - RNA, 64 nt, Homo Sapiens; identical to SEQ ID NO: 221271

SEQ ID NO: 480186 - RNA, 64 nt, Homo Sapiens; identical to SEQ ID NO: 221272

SEQ ID NO: 480187 - RNA, 64 nt, Homo Sapiens; identical to SEQ ID NO: 221273

SEQ ID NO: 480188 - RNA, 64 nt, Homo Sapiens; identical to SEQ ID NO: 55178

SEQ ID NO: 480189 - RNA, 64 nt, Homo Sapiens; identical to SEQ ID NO: 55179

SEQ ID NO: 480190 - RNA, 64 nt, Homo Sapiens; identical to SEQ ID NO: 55180

SEQ ID NO: 480191 - RNA, 64 nt, Homo Sapiens; identical to SEQ ID NO: 55181

SEQ ID NO: 480192 - RNA, 64 nt, Homo Sapiens; identical to SEQ ID NO: 55182

SEQ ID NO: 480193 - RNA, 64 nt, Homo Sapiens; identical to SEQ ID NO: 55183

SEQ ID NO: 480194 - RNA, 64 nt, Homo Sapiens; identical to SEQ ID NO: 55184

SEQ ID NO: 480195 - RNA, 64 nt, Homo Sapiens; identical to SEQ ID NO: 55185

SEQ ID NO: 480196 - RNA, 64 nt, Homo Sapiens; identical to SEQ ID NO: 55186

SEQ ID NO: 480197 - RNA, 64 nt, Homo Sapiens; identical to SEQ ID NO: 55187

SEQ ID NO: 480198 - RNA, 64 nt, Homo Sapiens; identical to SEQ ID NO: 55188

SEQ ID NO: 480199 - RNA, 64 nt, Homo Sapiens; identical to SEQ ID NO: 55189

SEQ ID NO: 480200 - RNA, 64 nt, Homo Sapiens; identical to SEQ ID NO: 173467

SEQ ID NO: 480201 - RNA, 64 nt, Homo Sapiens; identical to SEQ ID NO: 173468

SEQ ID NO: 480202 - RNA, 64 nt, Homo Sapiens; identical to SEQ ID NO: 173469

SEQ ID NO: 480203 - RNA, 64 nt, Homo Sapiens; identical to SEQ ID NO: 173470

SEQ ID NO: 480204 - RNA, 64 nt, Homo Sapiens; identical to SEQ ID NO: 173471

SEQ ID NO: 480205 - RNA, 64 nt, Homo Sapiens; identical to SEQ ID NO: 173472

SEQ ID NO: 480206 - RNA, 64 nt, Homo Sapiens; identical to SEQ ID NO: 173473

SEQ ID NO: 480207 - RNA, 64 nt, Homo Sapiens; identical to SEQ ID NO: 173474

SEQ ID NO: 480208 - RNA, 64 nt, Homo Sapiens; identical to SEQ ID NO: 173475

SEQ ID NO: 480209 - RNA, 64 nt, Homo Sapiens; identical to SEQ ID NO: 173476

SEQ ID NO: 480210 - RNA, 64 nt, Homo Sapiens; identical to SEQ ID NO: 173477

SEQ ID NO: 480211 - RNA, 64 nt, Homo Sapiens; identical to SEQ ID NO: 173478

SEQ ID NO: 480212 - RNA, 64 nt, Homo Sapiens; identical to SEQ ID NO: 173479

SEQ ID NO: 480213 - RNA, 64 nt, Homo Sapiens; identical to SEQ ID NO: 173480

SEQ ID NO: 480214 - RNA, 64 nt, Homo Sapiens; identical to SEQ ID NO: 173481

SEQ ID NO: 480215 - RNA, 64 nt, Homo Sapiens; identical to SEQ ID NO: 173482

SEQ ID NO: 480216 - RNA, 64 nt, Homo Sapiens; identical to SEQ ID NO: 173483

SEQ ID NO: 480217 - RNA, 64 nt, Homo Sapiens; identical to SEQ ID NO: 173484

SEQ ID NO: 480218 - RNA, 64 nt, Homo Sapiens; identical to SEQ ID NO: 173485

SEQ ID NO: 480219 - RNA, 64 nt, Homo Sapiens; identical to SEQ ID NO: 173486

SEQ ID NO: 480220 - RNA, 64 nt, Homo Sapiens; identical to SEQ ID NO: 173487

SEQ ID NO: 480221 - RNA, 64 nt, Homo Sapiens; identical to SEQ ID NO: 173488

SEQ ID NO: 480222 - RNA, 64 nt, Homo Sapiens; identical to SEQ ID NO: 232496

SEQ ID NO: 480223 - RNA, 64 nt, Homo Sapiens; identical to SEQ ID NO: 232497

SEQ ID NO: 480224 - RNA, 64 nt, Homo Sapiens; identical to SEQ ID NO: 232498

SEQ ID NO: 480225 - RNA, 64 nt, Homo Sapiens; identical to SEQ ID NO: 232499

SEQ ID NO: 480226 - RNA, 64 nt, Homo Sapiens; identical to SEQ ID NO: 232500

SEQ ID NO: 480227 - RNA, 64 nt, Homo Sapiens; identical to SEQ ID NO: 232501

SEQ ID NO: 480228 - RNA, 64 nt, Homo Sapiens; identical to SEQ ID NO: 232502

SEQ ID NO: 480229 - RNA, 64 nt, Homo Sapiens; identical to SEQ ID NO: 232503

SEQ ID NO: 480230 - RNA, 64 nt, Homo Sapiens; identical to SEQ ID NO: 232504

SEQ ID NO: 480231 - RNA, 64 nt, Homo Sapiens; identical to SEQ ID NO: 232505

SEQ ID NO: 480232 - RNA, 64 nt, Homo Sapiens; identical to SEQ ID NO: 232506

SEQ ID NO: 480233 - RNA, 64 nt, Homo Sapiens; identical to SEQ ID NO: 232507

SEQ ID NO: 480234 - RNA, 64 nt, Homo Sapiens; identical to SEQ ID NO: 232508

SEQ ID NO: 480235 - RNA, 64 nt, Homo Sapiens; identical to SEQ ID NO: 232509

SEQ ID NO: 480236 - RNA, 64 nt, Homo Sapiens; identical to SEQ ID NO: 232510

SEQ ID NO: 480237 - RNA, 64 nt, Homo Sapiens; identical to SEQ ID NO: 232511

SEQ ID NO: 480238 - RNA, 64 nt, Homo Sapiens; identical to SEQ ID NO: 232512

SEQ ID NO: 480239 - RNA, 64 nt, Homo Sapiens; identical to SEQ ID NO: 232513

SEQ ID NO: 480240 - RNA, 64 nt, Homo Sapiens
ucaucacugaccuggugguggggcugugaccugggcagcucaagacuggugccccuugcugauc

SEQ ID NO: 480241 - RNA, 64 nt, Homo Sapiens
ggcuaauuagaccccuccccuugugucaacuccggcagcucaagacccccgagcaacauuugua

SEQ ID NO: 480242 - RNA, 64 nt, Homo Sapiens
gcaggugaccccauccccagccccaugcucuccugcagcucaggccucaccugguguucagaca

SEQ ID NO: 480243 - RNA, 64 nt, Homo Sapiens
gagacccuaaguuaaggggcucaggucuuucugugcagcucaggcugccuggucccaguaggua

SEQ ID NO: 480244 - RNA, 64 nt, Homo Sapiens
aggauucuauccuuuccaauuuaccgggacuggggcagcucacuggauaugcaggcacucaugc

SEQ ID NO: 480245 - RNA, 64 nt, Homo Sapiens
ggcugggggugaggagucccccccuuaaucugcagcagcucacacacuagcccaucuucaauga

SEQ ID NO: 480246 - RNA, 64 nt, Homo Sapiens
ugcauagccucuguccucaggacggaacuugggugcagcucagugggucggaagagaaggcggu

SEQ ID NO: 480247 - RNA, 64 nt, Homo Sapiens
gggucugucuuugagaugcccaggccagcagaaagcagcucagaaguauuguugcucauggugu

SEQ ID NO: 480248 - RNA, 64 nt, Homo Sapiens
uugggcaaacccuggcucggagcccagggcagaggcagcucagaguggaggcucuaggcagguu

SEQ ID NO: 480249 - RNA, 64 nt, Homo Sapiens
ggcaucagcacaggggucccugccccacccuccggcagcucagggaguguuuuccugugaggcc

SEQ ID NO: 480250 - RNA, 64 nt, Homo Sapiens
gagacccaagugaagaucugaucgcugcaucccugcagcucaaccgcgcgcccgcaggguggag

SEQ ID NO: 480251 - RNA, 64 nt, Homo Sapiens
gaacuggagaaggaguuccaaacuucacuaccaagcagcucacgaacccaacgcggugcgcacc

SEQ ID NO: 480252 - RNA, 64 nt, Homo Sapiens
ugaaagagaaaagaggcucagaaaaguuuagagagcagcucagugucacacugggagcugggca

SEQ ID NO: 480253 - RNA, 64 nt, Homo Sapiens
cauugaggagaagagacuuacccaggcucacacagcagcucagccuguuccaggcgcuggucag

SEQ ID NO: 480254 - RNA, 64 nt, Homo Sapiens
cagccgucauggaaaugaugagucagaagauucagcagcucacagcccugggggcagcucaggc

SEQ ID NO: 480255 - RNA, 64 nt, Homo Sapiens
gagucagaagauucagcagcucacagcccugggggcagcucaggcuacugcuaaggccugagag

SEQ ID NO: 480256 - RNA, 64 nt, Homo Sapiens
gggccccacggacagucagccugccggccucccugcagcucacggggcagaaccagcacaucug

SEQ ID NO: 480257 - RNA, 64 nt, Homo Sapiens
cacacuuuauuccuaaaacgugucuuauuuuuaugcagcucauuuuuucuuuaaaggagaaaac

SEQ ID NO: 480258 - RNA, 64 nt, Homo Sapiens
caccggcuggccuggccccucagggucccugguggcagcucaccucucccuuggauuguccccg

SEQ ID NO: 480259 - RNA, 64 nt, Homo Sapiens
aagcucagggccuggcucagguggggucacucuggcagcucagagagggugggagugggcccaa

SEQ ID NO: 480260 - RNA, 64 nt, Homo Sapiens
caugcaagaaguacugccaauacugccaaccagagcagcucacucgagaucuuuguguccagag

SEQ ID NO: 480261 - RNA, 64 nt, Homo Sapiens
acuucugccuuggccucccaaagugcugaauuaagcagcucaccauccacacggcugaccucau

SEQ ID NO: 480262 - RNA, 64 nt, Homo Sapiens
gagacuuacaugagugaaaggguugccucaucaagcagcucaguguaaauggggaggcuaggcu

SEQ ID NO: 480263 - RNA, 64 nt, Homo Sapiens
guuucaucaaauggagugguuuaaaacugaucaagcagcucauaauaaugaauuccugcucugu

SEQ ID NO: 480264 - RNA, 64 nt, Homo Sapiens
gggugguccugaagacuccggccaagaggcacaagcagcucaagaacaagcuggagaagaacga

SEQ ID NO: 480265 - RNA, 64 nt, Homo Sapiens
agaguccacucccuuccuggcugugucaccccgagcagcucauccaccauggaggucauuggcc

SEQ ID NO: 480266 - RNA, 64 nt, Homo Sapiens
uggaauacauggaaaagagcaagcaucugcaggagcagcucaaugaacucaagacagaaaucga

SEQ ID NO: 480267 - RNA, 64 nt, Homo Sapiens
ucucuggcaauuccaucugguuuugagaaacuuagcagcucacagagcacagagauccugccuu

SEQ ID NO: 480268 - RNA, 64 nt, Homo Sapiens
auccacacugccggacccuaggcuguucagggaggcagcucauuuccaccccggccccaggaca

SEQ ID NO: 480269 - RNA, 64 nt, Homo Sapiens
accucccccugccucccugccuguguccgcuuuugcagcucaaugcagccaugacaaggaaaga

SEQ ID NO: 480270 - RNA, 64 nt, Homo Sapiens; identical to SEQ ID NO: 219214

SEQ ID NO: 480271 - RNA, 64 nt, Homo Sapiens; identical to SEQ ID NO: 219215

SEQ ID NO: 480272 - RNA, 64 nt, Homo Sapiens; identical to SEQ ID NO: 219216

SEQ ID NO: 480273 - RNA, 64 nt, Homo Sapiens; identical to SEQ ID NO: 219217

SEQ ID NO: 480274 - RNA, 64 nt, Homo Sapiens; identical to SEQ ID NO: 219218

SEQ ID NO: 480275 - RNA, 64 nt, Homo Sapiens; identical to SEQ ID NO: 219219

SEQ ID NO: 480276 - RNA, 64 nt, Homo Sapiens; identical to SEQ ID NO: 219220

SEQ ID NO: 480277 - RNA, 64 nt, Homo Sapiens; identical to SEQ ID NO: 219221

SEQ ID NO: 480278 - RNA, 64 nt, Homo Sapiens; identical to SEQ ID NO: 219222

SEQ ID NO: 480279 - RNA, 64 nt, Homo Sapiens; identical to SEQ ID NO: 219223

SEQ ID NO: 480280 - RNA, 64 nt, Homo Sapiens; identical to SEQ ID NO: 219224

SEQ ID NO: 480281 - RNA, 64 nt, Homo Sapiens; identical to SEQ ID NO: 219225

SEQ ID NO: 480282 - RNA, 64 nt, Homo Sapiens; identical to SEQ ID NO: 219226

SEQ ID NO: 480283 - RNA, 64 nt, Homo Sapiens; identical to SEQ ID NO: 219227

SEQ ID NO: 480284 - RNA, 64 nt, Homo Sapiens
auuaaacuccuggaucuucaagucccauuaccagaaagaccaaaucaaacuaugaagaaacaga

SEQ ID NO: 480285 - RNA, 64 nt, Homo Sapiens
uucccuuugauggcugugugguuuuucucuuuuuaaagaccaacuuguguccuuguuuuuccuu

SEQ ID NO: 480286 - RNA, 64 nt, Homo Sapiens
augaaguugucauucagggccccucauguagccaaaagaccaagaaaaaucuggcccacagaua

SEQ ID NO: 480287 - RNA, 64 nt, Homo Sapiens
uauuuuauucagguugaucuguugaauauuugcuaaagaccaguucuuuaagcuaagacaugua

SEQ ID NO: 480288 - RNA, 64 nt, Homo Sapiens
uacccagcacccaugaaauaaauuuuugucuuaaaaagaccacauuaguaaaaccaugcuguag

SEQ ID NO: 480289 - RNA, 64 nt, Homo Sapiens
guaauuuuucugaacuucugaauauugacauguaaaagaccaaagagaaagaaccucuuuccug

SEQ ID NO: 480290 - RNA, 64 nt, Homo Sapiens
cuuauguaaccauuuuaaacgugguuucuauaggaaagaccaacauuuguuuagcuugcuuggc

SEQ ID NO: 480291 - RNA, 64 nt, Homo Sapiens
acauggaaaccccaguggaaucagauuuucccucaaagaccaugaugguaucggacuaguuuuc

SEQ ID NO: 480292 - RNA, 64 nt, Homo Sapiens
aucuggaguuugagguguguaugaguacaaacugaaagaccacuggucaaagccaaggacgucg

SEQ ID NO: 480293 - RNA, 64 nt, Homo Sapiens
agucguauuggaaguacuacaacggaacacauccaaagaccaucaaaguacugaggagaaagcu

SEQ ID NO: 480294 - RNA, 64 nt, Homo Sapiens
ucccaugccuucaagucagcaucaggcuuagggcaaagaccaggccucugaagcugccucuugu

SEQ ID NO: 480295 - RNA, 64 nt, Homo Sapiens
ucagcuucuugggacuucaaccaucuucuuucugaaagaccaaaucuaauguaaccaguaacgu

SEQ ID NO: 480296 - RNA, 64 nt, Homo Sapiens
gaauuuuuuaucuagagaccagcauguucuccccaaagaccaagauauucugccaaaauaucag

SEQ ID NO: 480297 - RNA, 64 nt, Homo Sapiens
gaauuuuuugucuagagaccagcauguucuccccaaagaccagaauauucuaccuaaauaucaa

SEQ ID NO: 480298 - RNA, 64 nt, Homo Sapiens
ucuaccuaaauaucaaggccaggauuuucuaccuaaagaccaggacuuuuuaucuagagaccag

SEQ ID NO: 480299 - RNA, 64 nt, Homo Sapiens
ggauuuucuacccagagaccaagguguucuucccaaagaccaaaauauucuacccauaugucag

SEQ ID NO: 480300 - RNA, 64 nt, Homo Sapiens
ggauuuucuacccagagaccaagguuaucuuccuaaagaccaaaauauucuacccauaugucag

SEQ ID NO: 480301 - RNA, 64 nt, Homo Sapiens
gaaaccauguauauucaccacuaggacagguuaaaaagaccauuguauguuuuucuauuucuga

SEQ ID NO: 480302 - RNA, 64 nt, Homo Sapiens
auauggcuauuagaaauccacauucuuacacaagaaagaccauauuagaaucuaaggaaaacau

SEQ ID NO: 480303 - RNA, 64 nt, Homo Sapiens
aaacaaagucuccaagaaauaugggacuaugugaaaagaccaaaucuaccucugauugguguac

SEQ ID NO: 480304 - RNA, 64 nt, Homo Sapiens
ugauaccagccgcugcaaaaucaugccaaaauguaaagaccaucgagacuaggaagaaacugca

SEQ ID NO: 480305 - RNA, 64 nt, Homo Sapiens
cuuggucauuucugcccucuagccacaucccucuguuccucacuguggggauuacuacagaaag

SEQ ID NO: 480306 - RNA, 64 nt, Homo Sapiens
guggggauuacuacagaaaggugcucugugccaaguuccucacucauucgcgcuccuguaggcc

SEQ ID NO: 480307 - RNA, 64 nt, Homo Sapiens
aaucuccuuaaaaacuuugaauauauuguguuaaguuccucaagcucuuuguauggcaguaugu

SEQ ID NO: 480308 - RNA, 64 nt, Homo Sapiens
agucggaacaauugccuguugaagcaguguuaguguuccucaaagaaaagcaggggugcuuuug

SEQ ID NO: 480309 - RNA, 64 nt, Homo Sapiens
aagugugcuugaggaaagaauggucuuuuggaggguuccucaugaaaggugggaggcggguggg

SEQ ID NO: 480310 - RNA, 64 nt, Homo Sapiens
gugccaguguguuuacauuuaaacagagcuaucuguuccucauaagucccagugagggagcuag

SEQ ID NO: 480311 - RNA, 64 nt, Homo Sapiens
uuuccuuuuuaaacauuugcguuuuauuuccaugguuccucaaguuuuagguuugguauguguu

SEQ ID NO: 480312 - RNA, 64 nt, Homo Sapiens
gccuucuugggauacuaagaucaucugcucuucaguuccucacuaaguuugguuccagccaacg

SEQ ID NO: 480313 - RNA, 64 nt, Homo Sapiens
gcuauacuguguacacauaaucaaaauaagaucuguuccucauaaaauguaacaauaaaguucc

SEQ ID NO: 480314 - RNA, 64 nt, Homo Sapiens
auaagaucuguuccucauagaauguaacaauaaaguuccucaaaugugccucaauuauugcaaa

SEQ ID NO: 480315 - RNA, 64 nt, Homo Sapiens
ucagauauauuggcaguuuuccuuaagcuauuuaguuccucaucuguugcuuuuucauuuugua

SEQ ID NO: 480316 - RNA, 64 nt, Homo Sapiens
uaccaguuugugauguuuucucuaaaaacuugaaguuccucaggccuguaacuucuggaaaaga

SEQ ID NO: 480317 - RNA, 64 nt, Homo Sapiens
aagaaaaaaaauguguuuuuaguacccaauuaaaguuccucaguaguagaacauaaaauugaau

SEQ ID NO: 480318 - RNA, 64 nt, Homo Sapiens
uaaccucucauuaugugucucagagcauccuagaguuccucagccuccuuguuguuugcaaugg

SEQ ID NO: 480319 - RNA, 64 nt, Homo Sapiens
uguaugaagaucugagguauaagcucuugcuggaguuccucaaugacuacccaccuuuacgaug

SEQ ID NO: 480320 - RNA, 64 nt, Homo Sapiens
ugacuacccaccuuuacgaugcacccacagugaaguuccucacacccugcuaccacccuaacgu

SEQ ID NO: 480321 - RNA, 64 nt, Homo Sapiens
agcuuguccucaagcgaggcugggaguagcuagaguuccucaugccugaucaacgucugucucu

SEQ ID NO: 480322 - RNA, 64 nt, Homo Sapiens
gguugucagaccgaagguguguaagccagguucaguuccucauugccucuaagcucaugugguu

SEQ ID NO: 480323 - RNA, 64 nt, Homo Sapiens
ccuuacuaaacauucauguacaagccuuuuagcuguuccucaauuacaaaugugaagaaugugg

SEQ ID NO: 480324 - RNA, 64 nt, Homo Sapiens
ccuuacuacucauaaaagaauaaagacuucaacuguuccucacauacaaaugcgaagaauguga

SEQ ID NO: 480325 - RNA, 64 nt, Homo Sapiens
cccaccacuuagaccacgcccaccuccugaccgcguuccucagccuccucuccuaggucccucc

SEQ ID NO: 480326 - RNA, 64 nt, Homo Sapiens
uccaccuagaaccaggcugcccucuacugugcucguuccucaagcauuuauuaagcaccuacug

SEQ ID NO: 480327 - RNA, 64 nt, Homo Sapiens
gcuuuucccuggagaguggggagaugagaccaguguuccucacacuggagggugauagacccca

SEQ ID NO: 480328 - RNA, 64 nt, Homo Sapiens
ggagcucaguuuccucucuucucacccuccaccuguuccucauuugccauuauucaccuugucc

SEQ ID NO: 480329 - RNA, 64 nt, Homo Sapiens; identical to SEQ ID NO: 132195

SEQ ID NO: 480330 - RNA, 64 nt, Homo Sapiens; identical to SEQ ID NO: 132196

SEQ ID NO: 480331 - RNA, 64 nt, Homo Sapiens; identical to SEQ ID NO: 132197

SEQ ID NO: 480332 - RNA, 64 nt, Homo Sapiens; identical to SEQ ID NO: 132198

SEQ ID NO: 480333 - RNA, 64 nt, Homo Sapiens; identical to SEQ ID NO: 132199

SEQ ID NO: 480334 - RNA, 64 nt, Homo Sapiens; identical to SEQ ID NO: 132200

SEQ ID NO: 480335 - RNA, 64 nt, Homo Sapiens; identical to SEQ ID NO: 132201

SEQ ID NO: 480336 - RNA, 64 nt, Homo Sapiens; identical to SEQ ID NO: 132202

SEQ ID NO: 480337 - RNA, 64 nt, Homo Sapiens; identical to SEQ ID NO: 132203

SEQ ID NO: 480338 - RNA, 64 nt, Homo Sapiens; identical to SEQ ID NO: 132204

SEQ ID NO: 480339 - RNA, 64 nt, Homo Sapiens; identical to SEQ ID NO: 132205

SEQ ID NO: 480340 - RNA, 64 nt, Homo Sapiens; identical to SEQ ID NO: 132206

SEQ ID NO: 480341 - RNA, 64 nt, Homo Sapiens; identical to SEQ ID NO: 132207

SEQ ID NO: 480342 - RNA, 64 nt, Homo Sapiens; identical to SEQ ID NO: 132208

SEQ ID NO: 480343 - RNA, 64 nt, Homo Sapiens; identical to SEQ ID NO: 132209

SEQ ID NO: 480344 - RNA, 64 nt, Homo Sapiens; identical to SEQ ID NO: 132210

SEQ ID NO: 480345 - RNA, 64 nt, Homo Sapiens; identical to SEQ ID NO: 132211

SEQ ID NO: 480346 - RNA, 64 nt, Homo Sapiens; identical to SEQ ID NO: 132212

SEQ ID NO: 480347 - RNA, 64 nt, Homo Sapiens; identical to SEQ ID NO: 132213

SEQ ID NO: 480348 - RNA, 64 nt, Homo Sapiens; identical to SEQ ID NO: 132214

SEQ ID NO: 480349 - RNA, 64 nt, Homo Sapiens; identical to SEQ ID NO: 72787

SEQ ID NO: 480350 - RNA, 64 nt, Homo Sapiens; identical to SEQ ID NO: 72788

SEQ ID NO: 480351 - RNA, 64 nt, Homo Sapiens; identical to SEQ ID NO: 72789

SEQ ID NO: 480352 - RNA, 64 nt, Homo Sapiens; identical to SEQ ID NO: 72790

SEQ ID NO: 480353 - RNA, 64 nt, Homo Sapiens; identical to SEQ ID NO: 72791

SEQ ID NO: 480354 - RNA, 64 nt, Homo Sapiens; identical to SEQ ID NO: 72792

SEQ ID NO: 480355 - RNA, 64 nt, Homo Sapiens; identical to SEQ ID NO: 72793

SEQ ID NO: 480356 - RNA, 64 nt, Homo Sapiens; identical to SEQ ID NO: 72794

SEQ ID NO: 480357 - RNA, 64 nt, Homo Sapiens; identical to SEQ ID NO: 72795

SEQ ID NO: 480358 - RNA, 64 nt, Homo Sapiens; identical to SEQ ID NO: 72796

SEQ ID NO: 480359 - RNA, 64 nt, Homo Sapiens; identical to SEQ ID NO: 72797

SEQ ID NO: 480360 - RNA, 64 nt, Homo Sapiens; identical to SEQ ID NO: 72798

SEQ ID NO: 480361 - RNA, 64 nt, Homo Sapiens; identical to SEQ ID NO: 72799

SEQ ID NO: 480362 - RNA, 64 nt, Homo Sapiens; identical to SEQ ID NO: 72800

SEQ ID NO: 480363 - RNA, 64 nt, Homo Sapiens; identical to SEQ ID NO: 72801

SEQ ID NO: 480364 - RNA, 64 nt, Homo Sapiens; identical to SEQ ID NO: 72802

SEQ ID NO: 480365 - RNA, 64 nt, Homo Sapiens; identical to SEQ ID NO: 72803

SEQ ID NO: 480366 - RNA, 64 nt, Homo Sapiens; identical to SEQ ID NO: 72804

SEQ ID NO: 480367 - RNA, 64 nt, Homo Sapiens; identical to SEQ ID NO: 72805

SEQ ID NO: 480368 - RNA, 64 nt, Homo Sapiens; identical to SEQ ID NO: 72806

SEQ ID NO: 480369 - RNA, 64 nt, Homo Sapiens; identical to SEQ ID NO: 72807

SEQ ID NO: 480370 - RNA, 64 nt, Homo Sapiens; identical to SEQ ID NO: 72808

SEQ ID NO: 480371 - RNA, 64 nt, Homo Sapiens; identical to SEQ ID NO: 72809

SEQ ID NO: 480372 - RNA, 64 nt, Homo Sapiens; identical to SEQ ID NO: 72810

SEQ ID NO: 480373 - RNA, 64 nt, Homo Sapiens; identical to SEQ ID NO: 72811

SEQ ID NO: 480374 - RNA, 64 nt, Homo Sapiens; identical to SEQ ID NO: 72812

SEQ ID NO: 480375 - RNA, 64 nt, Homo Sapiens; identical to SEQ ID NO: 72813

SEQ ID NO: 480376 - RNA, 64 nt, Homo Sapiens; identical to SEQ ID NO: 72814

SEQ ID NO: 480377 - RNA, 64 nt, Homo Sapiens; identical to SEQ ID NO: 72815

SEQ ID NO: 480378 - RNA, 64 nt, Homo Sapiens; identical to SEQ ID NO: 72816

SEQ ID NO: 480379 - RNA, 64 nt, Homo Sapiens; identical to SEQ ID NO: 72817

SEQ ID NO: 480380 - RNA, 64 nt, Homo Sapiens; identical to SEQ ID NO: 72818

SEQ ID NO: 480381 - RNA, 64 nt, Homo Sapiens; identical to SEQ ID NO: 72819

SEQ ID NO: 480382 - RNA, 64 nt, Homo Sapiens; identical to SEQ ID NO: 72820

SEQ ID NO: 480383 - RNA, 64 nt, Homo Sapiens; identical to SEQ ID NO: 72821

SEQ ID NO: 480384 - RNA, 64 nt, Homo Sapiens; identical to SEQ ID NO: 72822

SEQ ID NO: 480385 - RNA, 64 nt, Homo Sapiens; identical to SEQ ID NO: 72823

SEQ ID NO: 480386 - RNA, 64 nt, Homo Sapiens; identical to SEQ ID NO: 72824

SEQ ID NO: 480387 - RNA, 64 nt, Homo Sapiens; identical to SEQ ID NO: 72825

SEQ ID NO: 480388 - RNA, 64 nt, Homo Sapiens; identical to SEQ ID NO: 72826

SEQ ID NO: 480389 - RNA, 64 nt, Homo Sapiens; identical to SEQ ID NO: 72827

SEQ ID NO: 480390 - RNA, 64 nt, Homo Sapiens; identical to SEQ ID NO: 72828

SEQ ID NO: 480391 - RNA, 64 nt, Homo Sapiens; identical to SEQ ID NO: 72829

SEQ ID NO: 480392 - RNA, 64 nt, Homo Sapiens; identical to SEQ ID NO: 72830

SEQ ID NO: 480393 - RNA, 64 nt, Homo Sapiens; identical to SEQ ID NO: 72831

SEQ ID NO: 480394 - RNA, 64 nt, Homo Sapiens; identical to SEQ ID NO: 72832

SEQ ID NO: 480395 - RNA, 64 nt, Homo Sapiens; identical to SEQ ID NO: 72833

SEQ ID NO: 480396 - RNA, 64 nt, Homo Sapiens; identical to SEQ ID NO: 72834

SEQ ID NO: 480397 - RNA, 64 nt, Homo Sapiens; identical to SEQ ID NO: 72835

SEQ ID NO: 480398 - RNA, 64 nt, Homo Sapiens; identical to SEQ ID NO: 72836

SEQ ID NO: 480399 - RNA, 64 nt, Homo Sapiens; identical to SEQ ID NO: 72837

SEQ ID NO: 480400 - RNA, 64 nt, Homo Sapiens; identical to SEQ ID NO: 72838

SEQ ID NO: 480401 - RNA, 64 nt, Homo Sapiens; identical to SEQ ID NO: 72839

SEQ ID NO: 480402 - RNA, 64 nt, Homo Sapiens; identical to SEQ ID NO: 72840

SEQ ID NO: 480403 - RNA, 64 nt, Homo Sapiens; identical to SEQ ID NO: 72841

SEQ ID NO: 480404 - RNA, 64 nt, Homo Sapiens
aaaggcagcauauuuccaauuccaacauuacuguuucuaccaagucccauuagaagagcuguuc

SEQ ID NO: 480405 - RNA, 64 nt, Homo Sapiens
agaagagcuguucuuugaagaaucauauucaaccuucuaccaaaaugcuuuaaguucuauggaa

SEQ ID NO: 480406 - RNA, 64 nt, Homo Sapiens
uaugguugccucaauauaacaaaccuagaucauuuucuaccaacgauacauuggucaaacacuc

SEQ ID NO: 480407 - RNA, 64 nt, Homo Sapiens
ccaauaggagauacauugguuguuauaauauauuuucuaccauuauggguuuuauggauuucuu

SEQ ID NO: 480408 - RNA, 64 nt, Homo Sapiens
ccauaugcaccucuagaaccuaaccagggcuuccuucuaccagcugugggcgggcuuggucugg

SEQ ID NO: 480409 - RNA, 64 nt, Homo Sapiens
gcccagauuuugccacuggguauggcagaucauuuucuaccauggccugcugcucuuguagugg

SEQ ID NO: 480410 - RNA, 64 nt, Homo Sapiens
aaauuaguuuaucauuauauucuaaucuugaauauucuaccauauuuaaaaauaucucaagguu

SEQ ID NO: 480411 - RNA, 64 nt, Homo Sapiens
aagguuucuguucauuaugaaacaucaauauguuuucuaccauuugugaagaaaugaauuuucc

SEQ ID NO: 480412 - RNA, 64 nt, Homo Sapiens; identical to SEQ ID NO: 357461

SEQ ID NO: 480413 - RNA, 64 nt, Homo Sapiens; identical to SEQ ID NO: 357462

SEQ ID NO: 480414 - RNA, 64 nt, Homo Sapiens; identical to SEQ ID NO: 357463

SEQ ID NO: 480415 - RNA, 64 nt, Homo Sapiens; identical to SEQ ID NO: 357464

SEQ ID NO: 480416 - RNA, 64 nt, Homo Sapiens; identical to SEQ ID NO: 357465

SEQ ID NO: 480417 - RNA, 64 nt, Homo Sapiens; identical to SEQ ID NO: 357466

SEQ ID NO: 480418 - RNA, 64 nt, Homo Sapiens; identical to SEQ ID NO: 357467

SEQ ID NO: 480419 - RNA, 64 nt, Homo Sapiens; identical to SEQ ID NO: 357468

SEQ ID NO: 480420 - RNA, 64 nt, Homo Sapiens; identical to SEQ ID NO: 357469

SEQ ID NO: 480421 - RNA, 64 nt, Homo Sapiens; identical to SEQ ID NO: 357470

SEQ ID NO: 480422 - RNA, 64 nt, Homo Sapiens; identical to SEQ ID NO: 357471

SEQ ID NO: 480423 - RNA, 64 nt, Homo Sapiens; identical to SEQ ID NO: 357472

SEQ ID NO: 480424 - RNA, 64 nt, Homo Sapiens; identical to SEQ ID NO: 357473

SEQ ID NO: 480425 - RNA, 64 nt, Homo Sapiens; identical to SEQ ID NO: 357474

SEQ ID NO: 480426 - RNA, 64 nt, Homo Sapiens; identical to SEQ ID NO: 357475

SEQ ID NO: 480427 - RNA, 64 nt, Homo Sapiens; identical to SEQ ID NO: 357476

SEQ ID NO: 480428 - RNA, 64 nt, Homo Sapiens; identical to SEQ ID NO: 357477

SEQ ID NO: 480429 - RNA, 64 nt, Homo Sapiens; identical to SEQ ID NO: 357478

SEQ ID NO: 480430 - RNA, 64 nt, Homo Sapiens; identical to SEQ ID NO: 357479

SEQ ID NO: 480431 - RNA, 64 nt, Homo Sapiens; identical to SEQ ID NO: 357480

SEQ ID NO: 480432 - RNA, 64 nt, Homo Sapiens; identical to SEQ ID NO: 357481

SEQ ID NO: 480433 - RNA, 64 nt, Homo Sapiens; identical to SEQ ID NO: 357482

SEQ ID NO: 480434 - RNA, 64 nt, Homo Sapiens; identical to SEQ ID NO: 357483

SEQ ID NO: 480435 - RNA, 64 nt, Homo Sapiens; identical to SEQ ID NO: 357484

SEQ ID NO: 480436 - RNA, 64 nt, Homo Sapiens; identical to SEQ ID NO: 357485

SEQ ID NO: 480437 - RNA, 64 nt, Homo Sapiens; identical to SEQ ID NO: 357486

SEQ ID NO: 480438 - RNA, 64 nt, Homo Sapiens; identical to SEQ ID NO: 357487

SEQ ID NO: 480439 - RNA, 64 nt, Homo Sapiens; identical to SEQ ID NO: 357488

SEQ ID NO: 480440 - RNA, 64 nt, Homo Sapiens; identical to SEQ ID NO: 357489

SEQ ID NO: 480441 - RNA, 64 nt, Homo Sapiens; identical to SEQ ID NO: 357490

SEQ ID NO: 480442 - RNA, 64 nt, Homo Sapiens; identical to SEQ ID NO: 357491

SEQ ID NO: 480443 - RNA, 64 nt, Homo Sapiens; identical to SEQ ID NO: 357492

SEQ ID NO: 480444 - RNA, 64 nt, Homo Sapiens; identical to SEQ ID NO: 357493

SEQ ID NO: 480445 - RNA, 64 nt, Homo Sapiens; identical to SEQ ID NO: 357494

SEQ ID NO: 480446 - RNA, 64 nt, Homo Sapiens; identical to SEQ ID NO: 357495

SEQ ID NO: 480447 - RNA, 64 nt, Homo Sapiens; identical to SEQ ID NO: 357496

SEQ ID NO: 480448 - RNA, 64 nt, Homo Sapiens; identical to SEQ ID NO: 357497

SEQ ID NO: 480449 - RNA, 64 nt, Homo Sapiens; identical to SEQ ID NO: 357498

SEQ ID NO: 480450 - RNA, 64 nt, Homo Sapiens; identical to SEQ ID NO: 357499

SEQ ID NO: 480451 - RNA, 64 nt, Homo Sapiens; identical to SEQ ID NO: 357500

SEQ ID NO: 480452 - RNA, 64 nt, Homo Sapiens; identical to SEQ ID NO: 357501

SEQ ID NO: 480453 - RNA, 64 nt, Homo Sapiens; identical to SEQ ID NO: 357502

SEQ ID NO: 480454 - RNA, 64 nt, Homo Sapiens; identical to SEQ ID NO: 357503

SEQ ID NO: 480455 - RNA, 64 nt, Homo Sapiens; identical to SEQ ID NO: 357504

SEQ ID NO: 480456 - RNA, 64 nt, Homo Sapiens; identical to SEQ ID NO: 357505

SEQ ID NO: 480457 - RNA, 64 nt, Homo Sapiens; identical to SEQ ID NO: 357506

SEQ ID NO: 480458 - RNA, 64 nt, Homo Sapiens; identical to SEQ ID NO: 357507

SEQ ID NO: 480459 - RNA, 64 nt, Homo Sapiens; identical to SEQ ID NO: 357508

SEQ ID NO: 480460 - RNA, 64 nt, Homo Sapiens; identical to SEQ ID NO: 357509

SEQ ID NO: 480461 - RNA, 64 nt, Homo Sapiens; identical to SEQ ID NO: 357510

SEQ ID NO: 480462 - RNA, 64 nt, Homo Sapiens; identical to SEQ ID NO: 357511

SEQ ID NO: 480463 - RNA, 64 nt, Homo Sapiens; identical to SEQ ID NO: 357512

SEQ ID NO: 480464 - RNA, 64 nt, Homo Sapiens; identical to SEQ ID NO: 357513

SEQ ID NO: 480465 - RNA, 64 nt, Homo Sapiens; identical to SEQ ID NO: 357514

SEQ ID NO: 480466 - RNA, 64 nt, Homo Sapiens; identical to SEQ ID NO: 357515

SEQ ID NO: 480467 - RNA, 64 nt, Homo Sapiens; identical to SEQ ID NO: 357516

SEQ ID NO: 480468 - RNA, 64 nt, Homo Sapiens; identical to SEQ ID NO: 357517

SEQ ID NO: 480469 - RNA, 64 nt, Homo Sapiens; identical to SEQ ID NO: 357518

SEQ ID NO: 480470 - RNA, 64 nt, Homo Sapiens; identical to SEQ ID NO: 357519

SEQ ID NO: 480471 - RNA, 64 nt, Homo Sapiens; identical to SEQ ID NO: 357520

SEQ ID NO: 480472 - RNA, 64 nt, Homo Sapiens; identical to SEQ ID NO: 357521

SEQ ID NO: 480473 - RNA, 64 nt, Homo Sapiens; identical to SEQ ID NO: 357522

SEQ ID NO: 480474 - RNA, 64 nt, Homo Sapiens; identical to SEQ ID NO: 357523

SEQ ID NO: 480475 - RNA, 64 nt, Homo Sapiens; identical to SEQ ID NO: 357524

SEQ ID NO: 480476 - RNA, 64 nt, Homo Sapiens; identical to SEQ ID NO: 357525

SEQ ID NO: 480477 - RNA, 64 nt, Homo Sapiens; identical to SEQ ID NO: 357526

SEQ ID NO: 480478 - RNA, 64 nt, Homo Sapiens; identical to SEQ ID NO: 357527

SEQ ID NO: 480479 - RNA, 64 nt, Homo Sapiens; identical to SEQ ID NO: 357528

SEQ ID NO: 480480 - RNA, 64 nt, Homo Sapiens; identical to SEQ ID NO: 357529

SEQ ID NO: 480481 - RNA, 64 nt, Homo Sapiens; identical to SEQ ID NO: 357530

SEQ ID NO: 480482 - RNA, 64 nt, Homo Sapiens; identical to SEQ ID NO: 357531

SEQ ID NO: 480483 - RNA, 64 nt, Homo Sapiens; identical to SEQ ID NO: 357532

SEQ ID NO: 480484 - RNA, 64 nt, Homo Sapiens; identical to SEQ ID NO: 357533

SEQ ID NO: 480485 - RNA, 64 nt, Homo Sapiens; identical to SEQ ID NO: 357534

SEQ ID NO: 480486 - RNA, 64 nt, Homo Sapiens; identical to SEQ ID NO: 357535

SEQ ID NO: 480487 - RNA, 64 nt, Homo Sapiens; identical to SEQ ID NO: 357536

SEQ ID NO: 480488 - RNA, 64 nt, Homo Sapiens; identical to SEQ ID NO: 357537

SEQ ID NO: 480489 - RNA, 64 nt, Homo Sapiens; identical to SEQ ID NO: 357538

SEQ ID NO: 480490 - RNA, 64 nt, Homo Sapiens; identical to SEQ ID NO: 357539

SEQ ID NO: 480491 - RNA, 64 nt, Homo Sapiens; identical to SEQ ID NO: 357540

SEQ ID NO: 480492 - RNA, 64 nt, Homo Sapiens; identical to SEQ ID NO: 357541

SEQ ID NO: 480493 - RNA, 64 nt, Homo Sapiens; identical to SEQ ID NO: 357542

SEQ ID NO: 480494 - RNA, 64 nt, Homo Sapiens; identical to SEQ ID NO: 357543

SEQ ID NO: 480495 - RNA, 64 nt, Homo Sapiens; identical to SEQ ID NO: 357544

SEQ ID NO: 480496 - RNA, 64 nt, Homo Sapiens; identical to SEQ ID NO: 357545

SEQ ID NO: 480497 - RNA, 64 nt, Homo Sapiens; identical to SEQ ID NO: 357546

SEQ ID NO: 480498 - RNA, 64 nt, Homo Sapiens; identical to SEQ ID NO: 357547

SEQ ID NO: 480499 - RNA, 64 nt, Homo Sapiens; identical to SEQ ID NO: 357548

SEQ ID NO: 480500 - RNA, 64 nt, Homo Sapiens; identical to SEQ ID NO: 357549

SEQ ID NO: 480501 - RNA, 64 nt, Homo Sapiens; identical to SEQ ID NO: 357550

SEQ ID NO: 480502 - RNA, 64 nt, Homo Sapiens; identical to SEQ ID NO: 357551

SEQ ID NO: 480503 - RNA, 64 nt, Homo Sapiens; identical to SEQ ID NO: 357552

SEQ ID NO: 480504 - RNA, 64 nt, Homo Sapiens; identical to SEQ ID NO: 357553

SEQ ID NO: 480505 - RNA, 64 nt, Homo Sapiens; identical to SEQ ID NO: 357554

SEQ ID NO: 480506 - RNA, 64 nt, Homo Sapiens; identical to SEQ ID NO: 357555

SEQ ID NO: 480507 - RNA, 64 nt, Homo Sapiens; identical to SEQ ID NO: 357556

SEQ ID NO: 480508 - RNA, 64 nt, Homo Sapiens; identical to SEQ ID NO: 357557

SEQ ID NO: 480509 - RNA, 64 nt, Homo Sapiens; identical to SEQ ID NO: 357558

SEQ ID NO: 480510 - RNA, 64 nt, Homo Sapiens; identical to SEQ ID NO: 357559

SEQ ID NO: 480511 - RNA, 64 nt, Homo Sapiens; identical to SEQ ID NO: 357560

SEQ ID NO: 480512 - RNA, 64 nt, Homo Sapiens; identical to SEQ ID NO: 357561

SEQ ID NO: 480513 - RNA, 64 nt, Homo Sapiens; identical to SEQ ID NO: 357562

SEQ ID NO: 480514 - RNA, 64 nt, Homo Sapiens; identical to SEQ ID NO: 357563

SEQ ID NO: 480515 - RNA, 64 nt, Homo Sapiens; identical to SEQ ID NO: 357564

SEQ ID NO: 480516 - RNA, 64 nt, Homo Sapiens; identical to SEQ ID NO: 357565

SEQ ID NO: 480517 - RNA, 64 nt, Homo Sapiens; identical to SEQ ID NO: 357566

SEQ ID NO: 480518 - RNA, 64 nt, Homo Sapiens; identical to SEQ ID NO: 357567

SEQ ID NO: 480519 - RNA, 64 nt, Homo Sapiens; identical to SEQ ID NO: 357568

SEQ ID NO: 480520 - RNA, 64 nt, Homo Sapiens; identical to SEQ ID NO: 357569

SEQ ID NO: 480521 - RNA, 64 nt, Homo Sapiens; identical to SEQ ID NO: 357570

SEQ ID NO: 480522 - RNA, 64 nt, Homo Sapiens; identical to SEQ ID NO: 357571

SEQ ID NO: 480523 - RNA, 64 nt, Homo Sapiens; identical to SEQ ID NO: 357572

SEQ ID NO: 480524 - RNA, 64 nt, Homo Sapiens; identical to SEQ ID NO: 357573

SEQ ID NO: 480525 - RNA, 64 nt, Homo Sapiens; identical to SEQ ID NO: 357574

SEQ ID NO: 480526 - RNA, 64 nt, Homo Sapiens; identical to SEQ ID NO: 357575

SEQ ID NO: 480527 - RNA, 64 nt, Homo Sapiens; identical to SEQ ID NO: 357576

SEQ ID NO: 480528 - RNA, 64 nt, Homo Sapiens; identical to SEQ ID NO: 357577

SEQ ID NO: 480529 - RNA, 64 nt, Homo Sapiens; identical to SEQ ID NO: 357578

SEQ ID NO: 480530 - RNA, 64 nt, Homo Sapiens; identical to SEQ ID NO: 357579

SEQ ID NO: 480531 - RNA, 64 nt, Homo Sapiens; identical to SEQ ID NO: 357580

SEQ ID NO: 480532 - RNA, 64 nt, Homo Sapiens; identical to SEQ ID NO: 357581

SEQ ID NO: 480533 - RNA, 64 nt, Homo Sapiens; identical to SEQ ID NO: 357582

SEQ ID NO: 480534 - RNA, 64 nt, Homo Sapiens; identical to SEQ ID NO: 357583

SEQ ID NO: 480535 - RNA, 64 nt, Homo Sapiens; identical to SEQ ID NO: 357584

SEQ ID NO: 480536 - RNA, 64 nt, Homo Sapiens; identical to SEQ ID NO: 357585

SEQ ID NO: 480537 - RNA, 64 nt, Homo Sapiens; identical to SEQ ID NO: 357586

SEQ ID NO: 480538 - RNA, 64 nt, Homo Sapiens; identical to SEQ ID NO: 357587

SEQ ID NO: 480539 - RNA, 64 nt, Homo Sapiens; identical to SEQ ID NO: 357588

SEQ ID NO: 480540 - RNA, 64 nt, Homo Sapiens; identical to SEQ ID NO: 357589

SEQ ID NO: 480541 - RNA, 64 nt, Homo Sapiens; identical to SEQ ID NO: 357590

SEQ ID NO: 480542 - RNA, 64 nt, Homo Sapiens; identical to SEQ ID NO: 357591

SEQ ID NO: 480543 - RNA, 64 nt, Homo Sapiens; identical to SEQ ID NO: 357592

SEQ ID NO: 480544 - RNA, 64 nt, Homo Sapiens; identical to SEQ ID NO: 357593

SEQ ID NO: 480545 - RNA, 64 nt, Homo Sapiens; identical to SEQ ID NO: 357594

SEQ ID NO: 480546 - RNA, 64 nt, Homo Sapiens; identical to SEQ ID NO: 357595

SEQ ID NO: 480547 - RNA, 64 nt, Homo Sapiens; identical to SEQ ID NO: 357596

SEQ ID NO: 480548 - RNA, 64 nt, Homo Sapiens; identical to SEQ ID NO: 357597

SEQ ID NO: 480549 - RNA, 64 nt, Homo Sapiens; identical to SEQ ID NO: 357598

SEQ ID NO: 480550 - RNA, 64 nt, Homo Sapiens; identical to SEQ ID NO: 357599

SEQ ID NO: 480551 - RNA, 64 nt, Homo Sapiens; identical to SEQ ID NO: 357600

SEQ ID NO: 480552 - RNA, 64 nt, Homo Sapiens; identical to SEQ ID NO: 357601

SEQ ID NO: 480553 - RNA, 64 nt, Homo Sapiens; identical to SEQ ID NO: 357602

SEQ ID NO: 480554 - RNA, 64 nt, Homo Sapiens; identical to SEQ ID NO: 357603

SEQ ID NO: 480555 - RNA, 64 nt, Homo Sapiens; identical to SEQ ID NO: 357604

SEQ ID NO: 480556 - RNA, 64 nt, Homo Sapiens; identical to SEQ ID NO: 357605

SEQ ID NO: 480557 - RNA, 64 nt, Homo Sapiens; identical to SEQ ID NO: 357606

SEQ ID NO: 480558 - RNA, 64 nt, Homo Sapiens; identical to SEQ ID NO: 357607

SEQ ID NO: 480559 - RNA, 64 nt, Homo Sapiens; identical to SEQ ID NO: 357608

SEQ ID NO: 480560 - RNA, 64 nt, Homo Sapiens; identical to SEQ ID NO: 357609

SEQ ID NO: 480561 - RNA, 64 nt, Homo Sapiens; identical to SEQ ID NO: 357610

SEQ ID NO: 480562 - RNA, 64 nt, Homo Sapiens; identical to SEQ ID NO: 357611

SEQ ID NO: 480563 - RNA, 64 nt, Homo Sapiens; identical to SEQ ID NO: 357612

SEQ ID NO: 480564 - RNA, 64 nt, Homo Sapiens; identical to SEQ ID NO: 357613

SEQ ID NO: 480565 - RNA, 64 nt, Homo Sapiens; identical to SEQ ID NO: 357614

SEQ ID NO: 480566 - RNA, 64 nt, Homo Sapiens; identical to SEQ ID NO: 357615

SEQ ID NO: 480567 - RNA, 64 nt, Homo Sapiens; identical to SEQ ID NO: 357616

SEQ ID NO: 480568 - RNA, 64 nt, Homo Sapiens; identical to SEQ ID NO: 357617

SEQ ID NO: 480569 - RNA, 64 nt, Homo Sapiens; identical to SEQ ID NO: 357618

SEQ ID NO: 480570 - RNA, 64 nt, Homo Sapiens; identical to SEQ ID NO: 357619

SEQ ID NO: 480571 - RNA, 64 nt, Homo Sapiens
cuaaggacccaaauuucccugggggcauccugcuuccugaaagcuguuggauuucagugauuuu

SEQ ID NO: 480572 - RNA, 64 nt, Homo Sapiens
uuccuccccuuuugcccccguggggcucccggcauccugaaagccagcaaagccuccagcaucu

SEQ ID NO: 480573 - RNA, 64 nt, Homo Sapiens
uguuuuuagaguccugaagucuggaggcuagacuuccugaaagcaagucaagaauauagagcac

SEQ ID NO: 480574 - RNA, 64 nt, Homo Sapiens
aauuaguauaacauuuacucugaauuugaagauuuccugaaacaaaguuuguacaagaagccca

SEQ ID NO: 480575 - RNA, 64 nt, Homo Sapiens
ccuagaaauuucuaucugaaacuggcaauaguauuccugaaauagggagaauauucccuaagca

SEQ ID NO: 480576 - RNA, 64 nt, Homo Sapiens
aaaaugaggggagaauauucaguauuuauauuauuccugaaaaucuugcuauauaguaguaugc

SEQ ID NO: 480577 - RNA, 64 nt, Homo Sapiens
agaugaccaagccagaauauggaauguucauguauccugaaauggguuccugcaugugguuucc

SEQ ID NO: 480578 - RNA, 64 nt, Homo Sapiens
gaggcauacagaaaauggaaauaguauuucgcuguccugaaacuuucagugaaagagaucaccc

SEQ ID NO: 480579 - RNA, 64 nt, Homo Sapiens
aacucauaaucuauaaacaaaaucuuuguuaagguccugaaaguaaggaagucuaaauauucag

SEQ ID NO: 480580 - RNA, 64 nt, Homo Sapiens
aagucaucuauaguugauauuugaaaugugguuuuccugaaaucaaaauaauguaauuguaauu

SEQ ID NO: 480581 - RNA, 64 nt, Homo Sapiens
caaaauugcacuguguuugacacaacugucauaauccugaaauccccagguagccuguuucuaa

SEQ ID NO: 480582 - RNA, 64 nt, Homo Sapiens
aaaucagaauuaacauuuuuuuauucccuuauauuccugaaaagaugucacccacgaaagaacu

SEQ ID NO: 480583 - RNA, 64 nt, Homo Sapiens
uuuaaagaaagcaggagcugcuaucccuuccccuuccugaaaguaucccgagaaguugugacau

SEQ ID NO: 480584 - RNA, 64 nt, Homo Sapiens
ucuauuccaaaggaaaaucacuccaacucucugauccugaaauaaaggaaaagaacaccuaucu

SEQ ID NO: 480585 - RNA, 64 nt, Homo Sapiens
caggauuuuccaaucucuacgauuuuccugaaaauccugaaaacccaaaaagagauugcucuca

SEQ ID NO: 480586 - RNA, 64 nt, Homo Sapiens
ccugaaaaccaggauuuuccuugcucucagauuuuccugaaaauggagagcuuccaaaaagaga

SEQ ID NO: 480587 - RNA, 64 nt, Homo Sapiens
ccucguuuugaaggugaaucuuaugcuuuggggcuccugaaacaguuucuuaggaaauagaaug

SEQ ID NO: 480588 - RNA, 64 nt, Homo Sapiens
guugaucuacguguugugucaauucuaacugaucuccugaaaaugucuuauauauacucuacug

SEQ ID NO: 480589 - RNA, 64 nt, Homo Sapiens
cacauguguuuauucauuggguuguuaacggcauuccugaaagcaggcuuuuuccccgccuuug

SEQ ID NO: 480590 - RNA, 64 nt, Homo Sapiens
aagaaaacuacaagcuggaggguucugugucuaauccugaaacauugccaguccuugaagaaug

SEQ ID NO: 480591 - RNA, 64 nt, Homo Sapiens
gguuuuaagugcuuuccuucaucccaucagugaauccugaaacuaaacuuagaaagggaaggaa

SEQ ID NO: 480592 - RNA, 64 nt, Homo Sapiens
aacgcuagaagccuaagaacaacucaacaagugcuccugaaagauggcaguggcagagaaucca

SEQ ID NO: 480593 - RNA, 64 nt, Homo Sapiens
auaagagccugcccaagacuaugucuuauguguguccugaaaaauguccuugcaguuagccccc

SEQ ID NO: 480594 - RNA, 64 nt, Homo Sapiens
ugcuaaucuauuugccaaacgagcucaugguauuuccugaaagaaccugaugaguagauaagug

SEQ ID NO: 480595 - RNA, 64 nt, Homo Sapiens
ccaggagaggcgucagaagucaggcagugaggaauccugaaacauaugcguuccaucuccaauc

SEQ ID NO: 480596 - RNA, 64 nt, Homo Sapiens
ccucgccagauuuugcacuccggccucccgucuuuccugaaaccuucuuguccucagugccacc

SEQ ID NO: 480597 - RNA, 64 nt, Homo Sapiens
ggauuuagugcaaaaaguuuguuauuuauuuuguuccugaaaugucaguugugaauccuauggu

SEQ ID NO: 480598 - RNA, 64 nt, Homo Sapiens
aauuaauugugcauuuaauaucaaucaucugauuuccugaaagucuguuaacuucccaccacca

SEQ ID NO: 480599 - RNA, 61 nt, Homo Sapiens
gcaaagugaaccgccccugagguggggcuucuccugaaaucuacaggccucagggugggag

SEQ ID NO: 480600 - RNA, 64 nt, Homo Sapiens
uacaaggaucagauucuugcugugacccaagaacuccugaaaucauauagaaaggcuggggugg

SEQ ID NO: 480601 - RNA, 64 nt, Homo Sapiens
uguugguucaacgugguuuccuuguacuugauccuccugaaaugagagauuuuccugagaugac

SEQ ID NO: 480602 - RNA, 64 nt, Homo Sapiens
accauuauucauuuauuggcuuaaguaugcuuucuccugaaaacuuuagcauugggugcaaaua

SEQ ID NO: 480603 - RNA, 64 nt, Homo Sapiens
cuuccauuuccaucguccuuucugaaggaacagcuccugaaaccagucucccugggcugagaca

SEQ ID NO: 480604 - RNA, 64 nt, Homo Sapiens
gacagaaccugcagcucuguggaaagaggcaaaguccugaaaaggcaaaggguugucacuuagg

SEQ ID NO: 480605 - RNA, 64 nt, Homo Sapiens
cagggccagagacaaggacauaccaagaaugaguuccugaaaccccucaguggggaggcuuccu

SEQ ID NO: 480606 - RNA, 64 nt, Homo Sapiens
ccaccaggcgcccaguguagccccguggaaccguuccugaaagggagccacacuggggcccccc

SEQ ID NO: 480607 - RNA, 64 nt, Homo Sapiens
aaaaagcaagaauaugaagaaguaauuguaagcauccugaaauaauaaacaaagucuuccugga

SEQ ID NO: 480608 - RNA, 64 nt, Homo Sapiens
auaaaucagggaacuaaccagcaguucaaaagacuccugaaauguuaucaagaaagcagauuug

SEQ ID NO: 480609 - RNA, 64 nt, Homo Sapiens
caugggcuuccucgggggccauccugcgugaauauccugaaauugaguccccuccccggccacc

SEQ ID NO: 480610 - RNA, 64 nt, Homo Sapiens
caaucucuguuccaucaagguuaacaacugucacuccugaaaagagcuuguggaaggauuuagc

SEQ ID NO: 480611 - RNA, 64 nt, Homo Sapiens
cucagccucucagacuugaugaugaaguaggugguccugaaaguuaacaggagggcuggggucc

SEQ ID NO: 480612 - RNA, 64 nt, Homo Sapiens
uugaauuucaaacuaaauuguauuuucagagcuauccugaaacugaacagcugaaacuuuaaaa

SEQ ID NO: 480613 - RNA, 64 nt, Homo Sapiens
cuuacuuaaugucuucuuuucccuacucuaaugcauuucuaacucacuuuggagcuuugguuuu

SEQ ID NO: 480614 - RNA, 64 nt, Homo Sapiens
cuuagaaaugucaauggggcaggaagaaaacacaauuucuaacugccuguuuuuguauaauuua

SEQ ID NO: 480615 - RNA, 64 nt, Homo Sapiens
guugaaaucuaaagcaaauuugcaauuucuuaagauuucuaaaauuuaccagaacaguuuagcc

SEQ ID NO: 480616 - RNA, 64 nt, Homo Sapiens
gaauguagcuuaaugauuuucuguuucccauaccauuucuaaucuuuuguguaauuuucucuua

SEQ ID NO: 480617 - RNA, 64 nt, Homo Sapiens
uugaaauaguauugauuuagaaaaaguauauugcauuucuaaaaaacaucuaccaagguuacuc

SEQ ID NO: 480618 - RNA, 64 nt, Homo Sapiens
uaaaguuaugcuaaauugagaauuucacuauuccauuucuaaaucugcuucauaugcuuuuuuu

SEQ ID NO: 480619 - RNA, 64 nt, Homo Sapiens
acauacuguuuaucugcuucuaaaaaucuuuaauauuucuaaagagcaaaacuuguaaacagag

SEQ ID NO: 480620 - RNA, 64 nt, Homo Sapiens
ggauaugguguuggugaaauuuauguuuuauuacauuucuaauauaguugcuguaaaugauauc

SEQ ID NO: 480621 - RNA, 64 nt, Homo Sapiens
uauucuaugugugauuucugugauguauguggagauuucuaaaaaugaaugugguucuguacag

SEQ ID NO: 480622 - RNA, 64 nt, Homo Sapiens
uaaauuaugugugccuaucuuaaagcccauuuucauuucuaaucaaaacaauauuuauagggcu

SEQ ID NO: 480623 - RNA, 64 nt, Homo Sapiens
cucccuuuuuugauuuaguugaugaacuagugugauuucuaaucagccagcccugauaaugaag

SEQ ID NO: 480624 - RNA, 64 nt, Homo Sapiens
aauaacuuccugauuggaguguguaagcugagcgauuucuaauaaaauuuuaguuguacacuuu

SEQ ID NO: 480625 - RNA, 64 nt, Homo Sapiens
aaauuggauuuuacauguacauuugaaugccagaauuucuaaauaaauccccugguuaggaaau

SEQ ID NO: 480626 - RNA, 64 nt, Homo Sapiens
agaaaggacaucaucauagauaugaucuaacaguauuucuaacuauauuugaucauuaaaagcc

SEQ ID NO: 480627 - RNA, 64 nt, Homo Sapiens
auuuuaaaaggaauauuuauuagccauaugcagaauuucuaaugaugauauuguacagcuucua

SEQ ID NO: 480628 - RNA, 64 nt, Homo Sapiens
acuuuacaccuuugacaaaaaagggagagcuauuauuucuaaauuucuuucacugguuauauua

SEQ ID NO: 480629 - RNA, 64 nt, Homo Sapiens
uacgaacuauagugccuggaaaaauaugagacauauuucuaacaauuauuuaaaaacacaugga

SEQ ID NO: 480630 - RNA, 64 nt, Homo Sapiens
gggcuggucccaucaucugacagcauauccacugauuucuaaaugauuucaguuuacauaucga

SEQ ID NO: 480631 - RNA, 64 nt, Homo Sapiens
ugguucauuguggccuaucuggugacauguucagauuucuaauuuauuccuuuaugcugcaagu

SEQ ID NO: 480632 - RNA, 64 nt, Homo Sapiens
aggauucuaauagcuacaucuacuuaauaucuucauuucuaaauugacugcuuuuaccuuuuuc

SEQ ID NO: 480633 - RNA, 64 nt, Homo Sapiens
uccaucagugcaacucgagcuccauccuccuccgauuucuaagguuccaguuuucuggagggac

SEQ ID NO: 480634 - RNA, 64 nt, Homo Sapiens
ccuaaauaagauccacccacaccuaagucacagaauuucuaaguuccccaacuacucucacacc

SEQ ID NO: 480635 - RNA, 64 nt, Homo Sapiens
aucauuguauuuuuuauuaaaaguuuuguaauaaauuucuaaauuaucuucuggugugggacuu

SEQ ID NO: 480636 - RNA, 64 nt, Homo Sapiens
uuauuacaauuauucauaauaauauucuuuucuuauuucuaagccuuucugggaaaucauuuca

SEQ ID NO: 480637 - RNA, 64 nt, Homo Sapiens
uuagaaaugguauagucaaagacauuuuauccacauuucuaauaguggacuugauuaaguagau

SEQ ID NO: 480638 - RNA, 64 nt, Homo Sapiens
uuuccaauauuaauaccuuauguuguccuuaaauauuucuaaaagcgccuuuauuucagcauua

SEQ ID NO: 480639 - RNA, 64 nt, Homo Sapiens
agguaucaguauuucagaauccugcgacgauuuuauuucuaaauucauguacuguauguccaua

SEQ ID NO: 480640 - RNA, 64 nt, Homo Sapiens
agucaaucauuucucacuguguacauaaugcuuaauuucuaaagauaauauuacuguuuauuuc

SEQ ID NO: 480641 - RNA, 64 nt, Homo Sapiens
agaaaacaaugcaaaaccuuugagguagaccaggauuucuaaucaaaagggaaaagaagauguu

SEQ ID NO: 480642 - RNA, 64 nt, Homo Sapiens
auggugguuugagccuugauuauauauauauuggauuucuaagggaaagaaagccuuuuucaua

SEQ ID NO: 480643 - RNA, 64 nt, Homo Sapiens
ccuuaaaaccaacuaugccaauaaauucaaaaauauuucuaaaauacguuccuauuguuuaaua

SEQ ID NO: 480644 - RNA, 64 nt, Homo Sapiens
ugacuaauuuuuuuuuuuuuuaaggaauaaaggaauuucuaacauuacuguuaguuuguuuuga

SEQ ID NO: 480645 - RNA, 64 nt, Homo Sapiens
caacagcagguauuuuuguacauaacggaaaacgauuucuaaaguacugcaagaccugacuauu

SEQ ID NO: 480646 - RNA, 64 nt, Homo Sapiens
cacaagaaauagugagguaggaaauacaaaggaaauuucuaaagagaagcaagauacuuuaaga

SEQ ID NO: 480647 - RNA, 64 nt, Homo Sapiens
agauuuuuugacauuaaugugccccuuuccaaccauuucuaaguggcaugagccaccacaccca

SEQ ID NO: 480648 - RNA, 64 nt, Homo Sapiens
cguuaucugugcagaauauauuuccuuauucagaauuucuaaaaauuuaaguucuguaagggcu

SEQ ID NO: 480649 - RNA, 64 nt, Homo Sapiens
guacuuguauugucauuuggagaaacaauaaaagauuucuaaaccacugauguuguuucuccuu

SEQ ID NO: 480650 - RNA, 64 nt, Homo Sapiens
uucacucauauuguuucuccauaaacauuaaaagauuucuaaacgucuuuauuuuguccuuuga

SEQ ID NO: 480651 - RNA, 64 nt, Homo Sapiens
guuuaaguucuaugagggcuuuuccuuauucagaauuucuaaaaccuuaucuauguagaauaua

SEQ ID NO: 480652 - RNA, 64 nt, Homo Sapiens
uugaguuuccaugacugaacuauucccacaugucauuucuaaugagucuagagagaaggugauc

SEQ ID NO: 480653 - RNA, 64 nt, Homo Sapiens
gacaugguaauccagcauucaauuuggauagaaaauuucuaaggugaucugaguuucuaucacu

SEQ ID NO: 480654 - RNA, 64 nt, Homo Sapiens
cugucuuuucaacuuauguaaacaguuugugauaauuucuaaaaguauuucaguuccgugucuu

SEQ ID NO: 480655 - RNA, 64 nt, Homo Sapiens
aaaauuuauugagugaaacacucaguguaacugcauuucuaauaugaccauugugaaauccuuu

SEQ ID NO: 480656 - RNA, 64 nt, Homo Sapiens
cuacaagaaugcuguaaagucucuucuuuucauuauuucuaauguguuuguuuucaccuugacg

SEQ ID NO: 480657 - RNA, 64 nt, Homo Sapiens
uuguaagaguagguuuaaaacaaucuaaggugcaauuucuaaaugcccugguucauguuuucau

SEQ ID NO: 480658 - RNA, 64 nt, Homo Sapiens
gggaaauuauuugaagugauauauuugguuaaacauuucuaaaaauaaacuaccaauacuaaau

SEQ ID NO: 480659 - RNA, 64 nt, Homo Sapiens
ugcuaaucuuuacuaaauagugagcuaaauuagaauuucuaacucuuauauugugcucuuuuaa

SEQ ID NO: 480660 - RNA, 64 nt, Homo Sapiens
ccaauauauagucauauugcugccauuguacuuaauuucuaaauauauaaaauccacauuuaaa

SEQ ID NO: 480661 - RNA, 64 nt, Homo Sapiens
ucuugcccauccauuaagguaccuucucacaaacauuucuaaucuacuggcuggagugcagugg

SEQ ID NO: 480662 - RNA, 64 nt, Homo Sapiens
cauguaagguacuguguuguaccuuuauuucuguauuucuaaaagaagaaaguucuuuccuagc

SEQ ID NO: 480663 - RNA, 64 nt, Homo Sapiens
ugucuuugcauucagaccaauauuucagguggauauuucuaaguauuacuagaaaauacguuug

SEQ ID NO: 480664 - RNA, 64 nt, Homo Sapiens
auuagacugguaaaauaaagaccaaaauaugcagauuucuaauuggcauucauaaggugaauaa

SEQ ID NO: 480665 - RNA, 64 nt, Homo Sapiens
uugaccacuuggagaacucagaaaauuauuuuaaauuucuaaguuauaauaaauuugcacacag

SEQ ID NO: 480666 - RNA, 64 nt, Homo Sapiens
uggaauugugagccucuauguuguuguugaucccauuucuaacuuugggaugauuugauuucug

SEQ ID NO: 480667 - RNA, 64 nt, Homo Sapiens
auauaaaaugacuguuccuucucucuuucuagggauuucuaaauagaaaccaacaaacaagaac

SEQ ID NO: 480668 - RNA, 64 nt, Homo Sapiens
cgcacucuggagccauguagaaggaggcagauucauuucuaagagaauguggaguguggagagg

SEQ ID NO: 480669 - RNA, 64 nt, Homo Sapiens
cuuuaaaaauuauucauaaagauaaagauguaugauuucuaagggcauguuucacauugugaca

SEQ ID NO: 480670 - RNA, 64 nt, Homo Sapiens
acuuguaagaacccagugggaucuuaaaaauacaauuucuaagcaggguaauaaaaaggaccua

SEQ ID NO: 480671 - RNA, 64 nt, Homo Sapiens
uucuugaaucugggaugagaugacggauguaaauauuucuaaauuuuaaaugcuacauuacuug

SEQ ID NO: 480672 - RNA, 64 nt, Homo Sapiens
uucuuuucaugcuaccuucaaucuucaacuaaagauuucuaaaagggguaagaaaugaggcagu

SEQ ID NO: 480673 - RNA, 64 nt, Homo Sapiens
cauguauauguacguuuauagguauaaauucauaauuucuaaacuguggaaauggaauagaauu

SEQ ID NO: 480674 - RNA, 64 nt, Homo Sapiens
uucggcugcuaugaauaaagaagacaauugagcuauuucuaauuaguuuauccauucuacuauu

SEQ ID NO: 480675 - RNA, 64 nt, Homo Sapiens
auuaggaggaaugugcuuuuauauuucuaagcuuauuucuaacuccauagaacugucccacaaa

SEQ ID NO: 480676 - RNA, 64 nt, Homo Sapiens
uuauuucuaacuauuaggagcugucccacaaaauauuucuaagcuauuuuagacaaccauagaa

SEQ ID NO: 480677 - RNA, 64 nt, Homo Sapiens
uuuuguuucuguuuccuaaauacuccuaaauaauauuucuaaucagccauuaugcuggggcauc

SEQ ID NO: 480678 - RNA, 64 nt, Homo Sapiens
cacguacguggaaacacaagagcccaccacuugaauuucuaagaccauuucauucugaaacuuc

SEQ ID NO: 480679 - RNA, 64 nt, Homo Sapiens
uauuuucaccucaaugugauuuaagcagaccaaaauuucuaauucugcuaauucugaaggggaa

SEQ ID NO: 480680 - RNA, 64 nt, Homo Sapiens
agaugcaguguuguuucuguucaucaggguuaauauuucuaacuauauugcuuguaggugaccc

SEQ ID NO: 480681 - RNA, 64 nt, Homo Sapiens
ccugugcaccuaccccuuggaaaugucugcugguauuucuaauuccacaggucaucagaugccu

SEQ ID NO: 480682 - RNA, 64 nt, Homo Sapiens
uuaaugauaaacucagaucugaucaagaguccggauuucuaacaguccuugcuuuggggggugu

SEQ ID NO: 480683 - RNA, 64 nt, Homo Sapiens
auauaaauuucagccuacaucuuuaaugacauugauuucuaauguaagguaacucccauaucuc

SEQ ID NO: 480684 - RNA, 64 nt, Homo Sapiens
uaacucccauaucuccuuuagagaaggaguuaauauuucuaaggcuucuggccuuuccuagcua

SEQ ID NO: 480685 - RNA, 64 nt, Homo Sapiens
uuaacauuucggcauguaaugcuuaugaacuaaaauuucuaacagcaccucaaccauuuuuuuu

SEQ ID NO: 480686 - RNA, 64 nt, Homo Sapiens
uacuauaggucauuuaauauauacuaaauuuuauauuucuaaaugaaauuauucugcaucacaa

SEQ ID NO: 480687 - RNA, 64 nt, Homo Sapiens
auggugcucucagguccaagcuaaauauacuuagauuucuaagucccaguguuagaugagugac

SEQ ID NO: 480688 - RNA, 64 nt, Homo Sapiens
guauacuugcucacuguucuuuuuauuaauguaaauuucuaaucuguguaucaaaaaaaucaca

SEQ ID NO: 480689 - RNA, 64 nt, Homo Sapiens
ggucaccaagaagguuuacuuaauuaaauaccgcauuucuaagagaagauacuuuguguaagaa

SEQ ID NO: 480690 - RNA, 64 nt, Homo Sapiens
cauacugaacaaaugucauucuaguuuagauagcauuucuaagauaacugauacuaauacuugu

SEQ ID NO: 480691 - RNA, 64 nt, Homo Sapiens
cgguauuuagaaaaaauaaauuauagcaaguaugauuucuaagaauguuuuucuauaaauuacu

SEQ ID NO: 480692 - RNA, 64 nt, Homo Sapiens
aaaggaaaucaugcaaaacauuugaaugcaaagcauuucuaacaaaaagugacuggagcacuug

SEQ ID NO: 480693 - RNA, 64 nt, Homo Sapiens
gcaauauaaagucacaauagauaauauauaucaaauuucuaaaagguaaagaauguuguggguu

SEQ ID NO: 480694 - RNA, 64 nt, Homo Sapiens
uauuuuuaugccccuucugaucuuuuccauauguauuucuaaauggauaaauuauucuaggcuu

SEQ ID NO: 480695 - RNA, 64 nt, Homo Sapiens
auguagugaaagaacaaauccuagagucuuugaaauuucuaagggcauucuagaccucuguugg

SEQ ID NO: 480696 - RNA, 64 nt, Homo Sapiens
auuggacugugcccuguuuuuaguuuucaaaucaauuucuaauucuggugauugugugauguaa

SEQ ID NO: 480697 - RNA, 64 nt, Homo Sapiens
aauuccauacuaaaacuaggaaugaaagugagagauuucuaaacuuuugcgaaagugggucauu

SEQ ID NO: 480698 - RNA, 64 nt, Homo Sapiens
ugguauaaaaaagaggucuucauuuagacaugugauuucuaaaauuccagaaagcaaaauugau

SEQ ID NO: 480699 - RNA, 64 nt, Homo Sapiens
aguuuucugaaaaaaugcaguaaauauaagccacauuucuaaaguuuauuuuuaugaaagcuuc

SEQ ID NO: 480700 - RNA, 64 nt, Homo Sapiens
ucaaaacauacuuaaucugauacauuauuaaacgauuucuaaaauuaauuaugaaaacuagcau

SEQ ID NO: 480701 - RNA, 64 nt, Homo Sapiens
auuucugcuaaauaucaccugugcuuucaccagaauuucuaagacucuggacguugugagaauu

SEQ ID NO: 480702 - RNA, 64 nt, Homo Sapiens
caguugugacuaacuagacaccaaaguucuaauaauuucuaauguuggacaccuuuagguucuu

SEQ ID NO: 480703 - RNA, 64 nt, Homo Sapiens
cucuaggaccaugguuaagaguccaagaauccacauuucuaaaaucuuauaguucuaggcacug

SEQ ID NO: 480704 - RNA, 64 nt, Homo Sapiens
ugaugggguagcaucacugcuaagcaaugaaugaauuucuaaauacaguaugugcuggguaaac

SEQ ID NO: 480705 - RNA, 64 nt, Homo Sapiens
uggucuaagaagauacugucuuucaauagaaaugauuucuaaacugcuacagauuaagaauaga

SEQ ID NO: 480706 - RNA, 64 nt, Homo Sapiens
cuagaaaacuuuauucauuuuagaauagaacauaauuucuaacuguaaaauugucauuuuguac

SEQ ID NO: 480707 - RNA, 64 nt, Homo Sapiens
uguucaauauugccguuacauuuauuagccuguaauuucuaaauuggagauucucuacauuuca

SEQ ID NO: 480708 - RNA, 64 nt, Homo Sapiens
uaauugguuaucaugggaaagugucaugcagaguauuucuaaagagcaucuaauuucaauuaua

SEQ ID NO: 480709 - RNA, 64 nt, Homo Sapiens
ccuguuuguugaagggaaguucugaggaauggacauuucuaauuuugguguaauggggcagaaa

SEQ ID NO: 480710 - RNA, 64 nt, Homo Sapiens
gaugccaagacacccggguucugaaaaugugcuguguuccuaccucggcaagaucaccagcacu

SEQ ID NO: 480711 - RNA, 64 nt, Homo Sapiens
caaacuucuuauuugucuaaauugccccuuuuucuguuccuaaaaggaaggauaagagagaaca

SEQ ID NO: 480712 - RNA, 64 nt, Homo Sapiens
gguuugguaggccucacugcucuccagaggcuaguguuccuaucccaggauggcuguugggauu

SEQ ID NO: 480713 - RNA, 64 nt, Homo Sapiens
uuucucugucagaucaauuuguuuuucuuaauguuguuccuaucaaaaaaaaaaaaaaggaaga

SEQ ID NO: 480714 - RNA, 64 nt, Homo Sapiens
cacuuguuuuuuacauuuuaagaguuguagaaguuguuccuaacuuggggacuggaccuacccu

SEQ ID NO: 480715 - RNA, 64 nt, Homo Sapiens
gguuguucaccuuguaccagugguuauuugaguuuguuccuauuacaccaauccuuacuugagg

SEQ ID NO: 480716 - RNA, 64 nt, Homo Sapiens
aagcucaaacagaagggaaugcuauuacuggugguguuccuacgguaagacuuaagcaaagccu

SEQ ID NO: 480717 - RNA, 64 nt, Homo Sapiens
ccuuuuucauauuugaaaauguggaaagaaaagauguuccuaaaagguuagauauuuugagcua

SEQ ID NO: 480718 - RNA, 64 nt, Homo Sapiens
ggaauugaggugggucaggugaaggaagaguguauguuccuauuuuuauuccagccuuuuaaau

SEQ ID NO: 480719 - RNA, 64 nt, Homo Sapiens
uggagcaagcucucgagggcagcacugacaaauguguuccuaagaagacauucagacccaggug

SEQ ID NO: 480720 - RNA, 64 nt, Homo Sapiens
gucccagcacuuugggaggcuggaugcaguggcuuguuccuauauucaaaaauuucaucugagc

SEQ ID NO: 480721 - RNA, 64 nt, Homo Sapiens
gugaugucuugguuuuugucauccuuuaguguuguguuccuacuuugguuguagauuuuaucuu

SEQ ID NO: 480722 - RNA, 64 nt, Homo Sapiens
ucaacuugauuauagagaaggggacuaccagacauguuccuagcgagccagauuccacauucau

SEQ ID NO: 480723 - RNA, 64 nt, Homo Sapiens
ccacaacagcagcaggggccuucucucuggacucuguuccuauacuggcagccuugcccaguug

SEQ ID NO: 480724 - RNA, 62 nt, Homo Sapiens
gaugaauggauaaagaaaaugcaaccuagguguccaacaacaacaauagccaagauauagga

SEQ ID NO: 480725 - RNA, 62 nt, Homo Sapiens
caugagcaacaguauauacauaacuauuauacuccaacaauuaagacuuaguuaaggauagu

SEQ ID NO: 480726 - RNA, 62 nt, Homo Sapiens
gcugcaguucuagugauaaaaagcaauuucccuccaacaaggccaggucucaaaaauucauc

SEQ ID NO: 480727 - RNA, 62 nt, Homo Sapiens
accuuugcaauauauuuuaaauauaaaaggucuccaacaaaguagaauuuuuuauagcuuag

SEQ ID NO: 480728 - RNA, 62 nt, Homo Sapiens
gagauggggagguuuuuaguuucaaauacccauccaacaagagauaucaagaguuuguuauu

SEQ ID NO: 480729 - RNA, 62 nt, Homo Sapiens
uuuuacuuuuuguaggauuuaacauagucguuuccaacaaaguauuguuugaacaggaagug

SEQ ID NO: 480730 - RNA, 62 nt, Homo Sapiens
caacaaaucaaauaacuuacaaaguaauaaauuccaacaaagcacaaggaauaaguuccaac

SEQ ID NO: 480731 - RNA, 52 nt, Homo Sapiens
uaauaaauuccaacaaagcaguuccaacaaagagaaaucccacaaggaauaa

SEQ ID NO: 480732 - RNA, 62 nt, Homo Sapiens
acaagugggaguuaagagaggucuggaaaguguccaacaaggaauucacaccucugccuccu

SEQ ID NO: 480733 - RNA, 62 nt, Homo Sapiens
ucuaauucauuuucucuuuaguguuaguagacuccaacaacagaaguggcaucuguguauuc

SEQ ID NO: 480734 - RNA, 64 nt, Homo Sapiens; identical to SEQ ID NO: 80857

SEQ ID NO: 480735 - RNA, 64 nt, Homo Sapiens; identical to SEQ ID NO: 80858

SEQ ID NO: 480736 - RNA, 64 nt, Homo Sapiens; identical to SEQ ID NO: 80859

SEQ ID NO: 480737 - RNA, 64 nt, Homo Sapiens; identical to SEQ ID NO: 80860

SEQ ID NO: 480738 - RNA, 64 nt, Homo Sapiens; identical to SEQ ID NO: 80861

SEQ ID NO: 480739 - RNA, 64 nt, Homo Sapiens; identical to SEQ ID NO: 80862

SEQ ID NO: 480740 - RNA, 64 nt, Homo Sapiens; identical to SEQ ID NO: 80863

SEQ ID NO: 480741 - RNA, 64 nt, Homo Sapiens; identical to SEQ ID NO: 80864

SEQ ID NO: 480742 - RNA, 64 nt, Homo Sapiens; identical to SEQ ID NO: 80865

SEQ ID NO: 480743 - RNA, 64 nt, Homo Sapiens; identical to SEQ ID NO: 80866

SEQ ID NO: 480744 - RNA, 64 nt, Homo Sapiens; identical to SEQ ID NO: 80867

SEQ ID NO: 480745 - RNA, 64 nt, Homo Sapiens; identical to SEQ ID NO: 80868

SEQ ID NO: 480746 - RNA, 64 nt, Homo Sapiens; identical to SEQ ID NO: 80869

SEQ ID NO: 480747 - RNA, 64 nt, Homo Sapiens; identical to SEQ ID NO: 80870

SEQ ID NO: 480748 - RNA, 64 nt, Homo Sapiens; identical to SEQ ID NO: 80871

SEQ ID NO: 480749 - RNA, 64 nt, Homo Sapiens; identical to SEQ ID NO: 80872

SEQ ID NO: 480750 - RNA, 64 nt, Homo Sapiens; identical to SEQ ID NO: 80873

SEQ ID NO: 480751 - RNA, 64 nt, Homo Sapiens; identical to SEQ ID NO: 80874

SEQ ID NO: 480752 - RNA, 64 nt, Homo Sapiens; identical to SEQ ID NO: 80875

SEQ ID NO: 480753 - RNA, 64 nt, Homo Sapiens; identical to SEQ ID NO: 80876

SEQ ID NO: 480754 - RNA, 64 nt, Homo Sapiens; identical to SEQ ID NO: 80877

SEQ ID NO: 480755 - RNA, 64 nt, Homo Sapiens; identical to SEQ ID NO: 80878

SEQ ID NO: 480756 - RNA, 64 nt, Homo Sapiens; identical to SEQ ID NO: 80879

SEQ ID NO: 480757 - RNA, 64 nt, Homo Sapiens; identical to SEQ ID NO: 80880

SEQ ID NO: 480758 - RNA, 64 nt, Homo Sapiens; identical to SEQ ID NO: 80881

SEQ ID NO: 480759 - RNA, 64 nt, Homo Sapiens; identical to SEQ ID NO: 80882

SEQ ID NO: 480760 - RNA, 59 nt, Homo Sapiens; identical to SEQ ID NO: 80883

SEQ ID NO: 480761 - RNA, 64 nt, Homo Sapiens; identical to SEQ ID NO: 80884

SEQ ID NO: 480762 - RNA, 64 nt, Homo Sapiens; identical to SEQ ID NO: 80885

SEQ ID NO: 480763 - RNA, 64 nt, Homo Sapiens; identical to SEQ ID NO: 80886

SEQ ID NO: 480764 - RNA, 64 nt, Homo Sapiens; identical to SEQ ID NO: 80887

SEQ ID NO: 480765 - RNA, 64 nt, Homo Sapiens; identical to SEQ ID NO: 80888

SEQ ID NO: 480766 - RNA, 64 nt, Homo Sapiens; identical to SEQ ID NO: 80889

SEQ ID NO: 480767 - RNA, 64 nt, Homo Sapiens; identical to SEQ ID NO: 80890

SEQ ID NO: 480768 - RNA, 64 nt, Homo Sapiens; identical to SEQ ID NO: 80891

SEQ ID NO: 480769 - RNA, 64 nt, Homo Sapiens; identical to SEQ ID NO: 80892

SEQ ID NO: 480770 - RNA, 64 nt, Homo Sapiens; identical to SEQ ID NO: 80893

SEQ ID NO: 480771 - RNA, 64 nt, Homo Sapiens; identical to SEQ ID NO: 80894

SEQ ID NO: 480772 - RNA, 64 nt, Homo Sapiens; identical to SEQ ID NO: 80895

SEQ ID NO: 480773 - RNA, 64 nt, Homo Sapiens; identical to SEQ ID NO: 80896

SEQ ID NO: 480774 - RNA, 64 nt, Homo Sapiens; identical to SEQ ID NO: 80897

SEQ ID NO: 480775 - RNA, 64 nt, Homo Sapiens; identical to SEQ ID NO: 80898

SEQ ID NO: 480776 - RNA, 64 nt, Homo Sapiens; identical to SEQ ID NO: 80899

SEQ ID NO: 480777 - RNA, 64 nt, Homo Sapiens; identical to SEQ ID NO: 80900

SEQ ID NO: 480778 - RNA, 64 nt, Homo Sapiens; identical to SEQ ID NO: 80901

SEQ ID NO: 480779 - RNA, 64 nt, Homo Sapiens; identical to SEQ ID NO: 80902

SEQ ID NO: 480780 - RNA, 64 nt, Homo Sapiens; identical to SEQ ID NO: 80903

SEQ ID NO: 480781 - RNA, 64 nt, Homo Sapiens; identical to SEQ ID NO: 80904

SEQ ID NO: 480782 - RNA, 64 nt, Homo Sapiens; identical to SEQ ID NO: 80905

SEQ ID NO: 480783 - RNA, 59 nt, Homo Sapiens
cuuauuuuaaaagccagucaaagauuccacugauugacauuugauaaauaaacaucagg

SEQ ID NO: 480784 - RNA, 59 nt, Homo Sapiens
auuuuuguacacauauauuuauauaaucacugauugagauuuaggaaaaagcauuucua

SEQ ID NO: 480785 - RNA, 59 nt, Homo Sapiens
uuuaugcuuguuaguguauuuuggaaaugcugauugauuauuuugugagcaaaacauac

SEQ ID NO: 480786 - RNA, 59 nt, Homo Sapiens
uuucacauuguaugaaauacggagggaugcugauugauauaauguguguuuugggagag

SEQ ID NO: 480787 - RNA, 59 nt, Homo Sapiens
aaugagguuaggccucuccuccuaauauacugauugacaaugcauauuagccagguaau

SEQ ID NO: 480788 - RNA, 59 nt, Homo Sapiens
cucugucucccugucuucuuuagaucggucugauugauuuuaaaaguggacccaaacuu

SEQ ID NO: 480789 - RNA, 59 nt, Homo Sapiens
ucuuuuagaaaguuaaaaauguauaguaacugauugagggggaaaagaaugaucuuuau

SEQ ID NO: 480790 - RNA, 59 nt, Homo Sapiens
acucgucauaagugagaggcguguguugacugauugacccagcgcuuuggaaauaaaug

SEQ ID NO: 480791 - RNA, 64 nt, Homo Sapiens
augguuuuugugcucuuguaguuccuuggaaccacauuauuaugauuuaccuuaucaaaaccac

SEQ ID NO: 480792 - RNA, 64 nt, Homo Sapiens
gauuucaguaauuaaaauggcaugacaguugugucauuauuagauauauacauuugcuaucaua

SEQ ID NO: 480793 - RNA, 64 nt, Homo Sapiens
auaauaaacaguuaaugguucaaaagcuuauuuucauuauuauuauauaguauccuuuuagaua

SEQ ID NO: 480794 - RNA, 64 nt, Homo Sapiens
aauugauagaauuuuagcucgauuuugacuacuucauuauuaaaaaggaaugaaacuugguuaa

SEQ ID NO: 480795 - RNA, 64 nt, Homo Sapiens
cucuaaaaagaaaugaaguauccacgcaauggaacauuauuagagggaaauaaaauguggucug

SEQ ID NO: 480796 - RNA, 64 nt, Homo Sapiens
cauuagggaaaugcaagucagaaaaaauacucaacauuauuauucaaauggcuacuaagcacau

SEQ ID NO: 480797 - RNA, 64 nt, Homo Sapiens
aacuguuagggucuuucccauugucaguaggauacauuauuagaagaaccgccaccucaaugca

SEQ ID NO: 480798 - RNA, 64 nt, Homo Sapiens
aacuguuaaggucuuucccguugucaguagaauacauuauuagaagaaccgccaccucaaugca

SEQ ID NO: 480799 - RNA, 64 nt, Homo Sapiens
auauaaaaaauguuauuacuauuaguagaaaauacauuauuagacagugauagaacaaaagagg

SEQ ID NO: 480800 - RNA, 64 nt, Homo Sapiens
cuccuaauaaguuccucugagugggugucagugucauuauuaguuaguaccuuuuuaacagcau

SEQ ID NO: 480801 - RNA, 64 nt, Homo Sapiens
cagccugugcuguaguuaauggaaacauuuucaucauuauuauuuguugacaugaauagaccau

SEQ ID NO: 480802 - RNA, 64 nt, Homo Sapiens
agaguauuguuuucaaaacauagugcagaaauaacauuauuaauuauauuacuguuaaauuucu

SEQ ID NO: 480803 - RNA, 64 nt, Homo Sapiens
gacuauauguuuugaaguuucagaauaauagugucauuauuauauauuuauuuuuucuaaguuc

SEQ ID NO: 480804 - RNA, 64 nt, Homo Sapiens
uugcauuauuuauuuuuucuucuuaauauuuuuacauuauuauauuguuuaauauuuauuuuaa

SEQ ID NO: 480805 - RNA, 64 nt, Homo Sapiens
agucauaaggcauuuaucuguuauauguuaguuacauuauuaaauccuugcacuuagauuuaau

SEQ ID NO: 480806 - RNA, 64 nt, Homo Sapiens
augcuuuccagcugcaaggaucaguuugucuuagcauuauuagcccccagcgcucucaguccaa

SEQ ID NO: 480807 - RNA, 64 nt, Homo Sapiens
cucugaaauucaggacacaucaaguuccauaauucauuauuaagcugccugauccaaucauuau

SEQ ID NO: 480808 - RNA, 64 nt, Homo Sapiens
gaguucaggcaaguuugugguuucaugacacugacauuauuaaagugugugugugugguguguc

SEQ ID NO: 480809 - RNA, 64 nt, Homo Sapiens
gaugcaucaugucuucugcuuuagauugugcuuucauuauuauaucacggugugauaauacucu

SEQ ID NO: 480810 - RNA, 64 nt, Homo Sapiens
ucuuguuuguaaauauauugucuauucuugugagcauuauuaaauuuuccauuugggggcaaac

SEQ ID NO: 480811 - RNA, 64 nt, Homo Sapiens
guaauuuuauuauaggacuuugaaaagauguggccauuauuacaaaacuuccauauucuguuuu

SEQ ID NO: 480812 - RNA, 64 nt, Homo Sapiens
uaauucugagucauucauggaaguuugauauaggcauuauuauaugcccuuuagcuaacuaaua

SEQ ID NO: 480813 - RNA, 64 nt, Homo Sapiens
cauucugaauuggaugcauaggauucaggauaaacauuauuauggcccuguuuuuagccggaaa

SEQ ID NO: 480814 - RNA, 64 nt, Homo Sapiens
gcagcacuguauauaccuguuuucaccuuuguuucauuauuacauugugcaacuuuacaguaga

SEQ ID NO: 480815 - RNA, 64 nt, Homo Sapiens
uuguagggagauauguagguuccaaaacacaucacauuauuaggugaaguucuaaugucugugu

SEQ ID NO: 480816 - RNA, 64 nt, Homo Sapiens
aacuaauauaugugagaguaaaaguaauaacaaacauuauuauauugaguggaaaacacuuuag

SEQ ID NO: 480817 - RNA, 64 nt, Homo Sapiens; identical to SEQ ID NO: 351843

SEQ ID NO: 480818 - RNA, 64 nt, Homo Sapiens; identical to SEQ ID NO: 351844

SEQ ID NO: 480819 - RNA, 64 nt, Homo Sapiens; identical to SEQ ID NO: 247175

SEQ ID NO: 480820 - RNA, 64 nt, Homo Sapiens; identical to SEQ ID NO: 247176

SEQ ID NO: 480821 - RNA, 64 nt, Homo Sapiens; identical to SEQ ID NO: 247177

SEQ ID NO: 480822 - RNA, 64 nt, Homo Sapiens; identical to SEQ ID NO: 247178

SEQ ID NO: 480823 - RNA, 64 nt, Homo Sapiens; identical to SEQ ID NO: 247179

SEQ ID NO: 480824 - RNA, 64 nt, Homo Sapiens; identical to SEQ ID NO: 247180

SEQ ID NO: 480825 - RNA, 64 nt, Homo Sapiens; identical to SEQ ID NO: 247181

SEQ ID NO: 480826 - RNA, 64 nt, Homo Sapiens; identical to SEQ ID NO: 247182

SEQ ID NO: 480827 - RNA, 64 nt, Homo Sapiens; identical to SEQ ID NO: 247183

SEQ ID NO: 480828 - RNA, 64 nt, Homo Sapiens; identical to SEQ ID NO: 247184

SEQ ID NO: 480829 - RNA, 64 nt, Homo Sapiens; identical to SEQ ID NO: 247185

SEQ ID NO: 480830 - RNA, 64 nt, Homo Sapiens; identical to SEQ ID NO: 247186

SEQ ID NO: 480831 - RNA, 64 nt, Homo Sapiens; identical to SEQ ID NO: 247187

SEQ ID NO: 480832 - RNA, 64 nt, Homo Sapiens; identical to SEQ ID NO: 247188

SEQ ID NO: 480833 - RNA, 64 nt, Homo Sapiens; identical to SEQ ID NO: 247189

SEQ ID NO: 480834 - RNA, 64 nt, Homo Sapiens; identical to SEQ ID NO: 247190

SEQ ID NO: 480835 - RNA, 64 nt, Homo Sapiens; identical to SEQ ID NO: 247191

SEQ ID NO: 480836 - RNA, 64 nt, Homo Sapiens; identical to SEQ ID NO: 247192

SEQ ID NO: 480837 - RNA, 64 nt, Homo Sapiens; identical to SEQ ID NO: 247193

SEQ ID NO: 480838 - RNA, 64 nt, Homo Sapiens; identical to SEQ ID NO: 247194

SEQ ID NO: 480839 - RNA, 64 nt, Homo Sapiens; identical to SEQ ID NO: 247195

SEQ ID NO: 480840 - RNA, 64 nt, Homo Sapiens; identical to SEQ ID NO: 247196

SEQ ID NO: 480841 - RNA, 64 nt, Homo Sapiens; identical to SEQ ID NO: 247197

SEQ ID NO: 480842 - RNA, 64 nt, Homo Sapiens; identical to SEQ ID NO: 247198

SEQ ID NO: 480843 - RNA, 64 nt, Homo Sapiens; identical to SEQ ID NO: 247199

SEQ ID NO: 480844 - RNA, 64 nt, Homo Sapiens; identical to SEQ ID NO: 247200

SEQ ID NO: 480845 - RNA, 64 nt, Homo Sapiens; identical to SEQ ID NO: 247201

SEQ ID NO: 480846 - RNA, 61 nt, Homo Sapiens; identical to SEQ ID NO: 247202

SEQ ID NO: 480847 - RNA, 64 nt, Homo Sapiens; identical to SEQ ID NO: 247203

SEQ ID NO: 480848 - RNA, 64 nt, Homo Sapiens; identical to SEQ ID NO: 247204

SEQ ID NO: 480849 - RNA, 64 nt, Homo Sapiens; identical to SEQ ID NO: 247205

SEQ ID NO: 480850 - RNA, 64 nt, Homo Sapiens; identical to SEQ ID NO: 247206

SEQ ID NO: 480851 - RNA, 64 nt, Homo Sapiens; identical to SEQ ID NO: 247207

SEQ ID NO: 480852 - RNA, 64 nt, Homo Sapiens; identical to SEQ ID NO: 247208

SEQ ID NO: 480853 - RNA, 64 nt, Homo Sapiens; identical to SEQ ID NO: 247209

SEQ ID NO: 480854 - RNA, 64 nt, Homo Sapiens; identical to SEQ ID NO: 247210

SEQ ID NO: 480855 - RNA, 64 nt, Homo Sapiens; identical to SEQ ID NO: 247211

SEQ ID NO: 480856 - RNA, 64 nt, Homo Sapiens; identical to SEQ ID NO: 247212

SEQ ID NO: 480857 - RNA, 64 nt, Homo Sapiens; identical to SEQ ID NO: 247213

SEQ ID NO: 480858 - RNA, 64 nt, Homo Sapiens; identical to SEQ ID NO: 247214

SEQ ID NO: 480859 - RNA, 64 nt, Homo Sapiens; identical to SEQ ID NO: 247215

SEQ ID NO: 480860 - RNA, 64 nt, Homo Sapiens; identical to SEQ ID NO: 247216

SEQ ID NO: 480861 - RNA, 64 nt, Homo Sapiens; identical to SEQ ID NO: 247217

SEQ ID NO: 480862 - RNA, 64 nt, Homo Sapiens; identical to SEQ ID NO: 247218

SEQ ID NO: 480863 - RNA, 64 nt, Homo Sapiens; identical to SEQ ID NO: 247219

SEQ ID NO: 480864 - RNA, 64 nt, Homo Sapiens; identical to SEQ ID NO: 247220

SEQ ID NO: 480865 - RNA, 64 nt, Homo Sapiens; identical to SEQ ID NO: 247221

SEQ ID NO: 480866 - RNA, 64 nt, Homo Sapiens; identical to SEQ ID NO: 247222

SEQ ID NO: 480867 - RNA, 64 nt, Homo Sapiens; identical to SEQ ID NO: 247223

SEQ ID NO: 480868 - RNA, 64 nt, Homo Sapiens; identical to SEQ ID NO: 247224

SEQ ID NO: 480869 - RNA, 64 nt, Homo Sapiens; identical to SEQ ID NO: 247225

SEQ ID NO: 480870 - RNA, 64 nt, Homo Sapiens; identical to SEQ ID NO: 247226

SEQ ID NO: 480871 - RNA, 64 nt, Homo Sapiens; identical to SEQ ID NO: 247227

SEQ ID NO: 480872 - RNA, 64 nt, Homo Sapiens; identical to SEQ ID NO: 247228

SEQ ID NO: 480873 - RNA, 64 nt, Homo Sapiens; identical to SEQ ID NO: 247229

SEQ ID NO: 480874 - RNA, 64 nt, Homo Sapiens; identical to SEQ ID NO: 247230

SEQ ID NO: 480875 - RNA, 64 nt, Homo Sapiens; identical to SEQ ID NO: 247231

SEQ ID NO: 480876 - RNA, 64 nt, Homo Sapiens; identical to SEQ ID NO: 247232

SEQ ID NO: 480877 - RNA, 64 nt, Homo Sapiens; identical to SEQ ID NO: 247233

SEQ ID NO: 480878 - RNA, 64 nt, Homo Sapiens; identical to SEQ ID NO: 247234

SEQ ID NO: 480879 - RNA, 64 nt, Homo Sapiens; identical to SEQ ID NO: 247235

SEQ ID NO: 480880 - RNA, 64 nt, Homo Sapiens; identical to SEQ ID NO: 247236

SEQ ID NO: 480881 - RNA, 64 nt, Homo Sapiens; identical to SEQ ID NO: 247237

SEQ ID NO: 480882 - RNA, 64 nt, Homo Sapiens; identical to SEQ ID NO: 247238

SEQ ID NO: 480883 - RNA, 64 nt, Homo Sapiens; identical to SEQ ID NO: 247239

SEQ ID NO: 480884 - RNA, 64 nt, Homo Sapiens; identical to SEQ ID NO: 247240

SEQ ID NO: 480885 - RNA, 64 nt, Homo Sapiens; identical to SEQ ID NO: 247241

SEQ ID NO: 480886 - RNA, 64 nt, Homo Sapiens; identical to SEQ ID NO: 247242

SEQ ID NO: 480887 - RNA, 64 nt, Homo Sapiens; identical to SEQ ID NO: 247243

SEQ ID NO: 480888 - RNA, 64 nt, Homo Sapiens; identical to SEQ ID NO: 247244

SEQ ID NO: 480889 - RNA, 64 nt, Homo Sapiens; identical to SEQ ID NO: 247245

SEQ ID NO: 480890 - RNA, 64 nt, Homo Sapiens; identical to SEQ ID NO: 247246

SEQ ID NO: 480891 - RNA, 64 nt, Homo Sapiens; identical to SEQ ID NO: 247247

SEQ ID NO: 480892 - RNA, 64 nt, Homo Sapiens; identical to SEQ ID NO: 247248

SEQ ID NO: 480893 - RNA, 64 nt, Homo Sapiens; identical to SEQ ID NO: 247249

SEQ ID NO: 480894 - RNA, 64 nt, Homo Sapiens; identical to SEQ ID NO: 247250

SEQ ID NO: 480895 - RNA, 64 nt, Homo Sapiens; identical to SEQ ID NO: 247251

SEQ ID NO: 480896 - RNA, 64 nt, Homo Sapiens; identical to SEQ ID NO: 247252

SEQ ID NO: 480897 - RNA, 64 nt, Homo Sapiens
uauuuuggaaacaguauuuguuuaccagaccuugguaaaagaacguuugaccugguuguguuau

SEQ ID NO: 480898 - RNA, 64 nt, Homo Sapiens
uaauugcuagaaacauuugauuuaagucguguuuguaaaagaagaaccugcauaacuuuuuguc

SEQ ID NO: 480899 - RNA, 64 nt, Homo Sapiens
aaaacuuuugcugaggucuuccacucuaacaaaaguaaaagaacaaccuuuuuuuuuuucuucu

SEQ ID NO: 480900 - RNA, 64 nt, Homo Sapiens
aaguuucaggaaauaaaacuagauacaguauuuaguaaaagagacugauaucaaaacaucucua

SEQ ID NO: 480901 - RNA, 64 nt, Homo Sapiens
aaaaaagaaauucaugcauaguaagaagggaacuguaaaagagaucaggauuuuuuuuuuuuaa

SEQ ID NO: 480902 - RNA, 64 nt, Homo Sapiens
auucauguucaugugauuaacucuuagaaguguuguaaaagaugcagaguaaguauuaugcccc

SEQ ID NO: 480903 - RNA, 64 nt, Homo Sapiens
gccauuuguguuucagcucacaguucuuugcuggguaaaagaaauacuuucugacagucaccug

SEQ ID NO: 480904 - RNA, 64 nt, Homo Sapiens
aaucagcagacuggaagcugaggaagaucuagaaguaaaagaaaaaauuagaugcguuaaaaug

SEQ ID NO: 480905 - RNA, 64 nt, Homo Sapiens
agguaccagugcauagcagcugaaugccagcccuguaaaagaccaccauaaagagagcuccaug

SEQ ID NO: 480906 - RNA, 64 nt, Homo Sapiens
auuacugaagaaugagguuuuucauaccugaagaguaaaagaaaaacuaagagaucaaacugag

SEQ ID NO: 480907 - RNA, 64 nt, Homo Sapiens
gguuauauguaaugugauaaauuagcuaugaaugguaaaagaacaaaacugaucagaguaaauu

SEQ ID NO: 480908 - RNA, 64 nt, Homo Sapiens
gaauuacaguaaacccaucugcaaguaauuuuuuguaaaagauuaauucuguuaucaauaacuu

SEQ ID NO: 480909 - RNA, 64 nt, Homo Sapiens
aauucuguuaucaauaacuuagagaauuaagaaaguaaaagagaaaacauugguuuaauuuuca

SEQ ID NO: 480910 - RNA, 64 nt, Homo Sapiens
guauguguuccaggaauguuaaugagaugguauuguaaaagaguugcauggauaaaacuuggcc

SEQ ID NO: 480911 - RNA, 64 nt, Homo Sapiens
uuucugcuuuuaugacuguauuuauuccuuuacuguaaaagaauaugaagaacucauacauguu

SEQ ID NO: 480912 - RNA, 64 nt, Homo Sapiens
gaaucaugcaucuauuuauaauucuaauuauuuuguaaaagaagacaaaauuaugaaucuuaag

SEQ ID NO: 480913 - RNA, 64 nt, Homo Sapiens
aucuuugcaccuuaauauuaauggacuguuucagguaaaagagaaugaauguaugauugugaac

SEQ ID NO: 480914 - RNA, 64 nt, Homo Sapiens
ccuaguguuguugggaacuaauugaacagcuacaguaaaagaaguuccuaucucauugccuuug

SEQ ID NO: 480915 - RNA, 64 nt, Homo Sapiens
ucucauugccuuuguggaaaggcuucccuaugugguaaaagaaaggcauuccuccguaaccuag

SEQ ID NO: 480916 - RNA, 64 nt, Homo Sapiens
ucuugcuucacuguucaccucaaucucaaagccaguaaaagaaaugcauguaaaagauguauua

SEQ ID NO: 480917 - RNA, 64 nt, Homo Sapiens
uauuacaaucucaaagccagagaacacacugcauguaaaagaugucaacgauuaagucuaccaa

SEQ ID NO: 480918 - RNA, 64 nt, Homo Sapiens
aguaaacauugguaagaaugauuucaagauauuuguaaaagaacuauaauucuugaaugaggca

SEQ ID NO: 480919 - RNA, 64 nt, Homo Sapiens
cuauacaucauuuuugcccucacuauggacagauguaaaagaaaaugcuuagcaauguucuaau

SEQ ID NO: 480920 - RNA, 64 nt, Homo Sapiens
ggauuuuacuacuaaaauuggacauuuaagcgaaguaaaagaggccgggugcgguggcucacgc

SEQ ID NO: 480921 - RNA, 64 nt, Homo Sapiens
ggagacugcaucucaaaaaagaaaaauaaacgaaguaaaagauauuuaucagagcuguuacagg

SEQ ID NO: 480922 - RNA, 64 nt, Homo Sapiens
uuucaaucuuacaaagcaacucgaacaguuaucaguaaaagacaacaauagcugccuuccccua

SEQ ID NO: 480923 - RNA, 64 nt, Homo Sapiens
gcuaguuggccuccucauuucuggucgggauuaaguaaaagacguuuaagcaagcagucauaga

SEQ ID NO: 480924 - RNA, 64 nt, Homo Sapiens
gcaauuacuacugcuaaauguguuuaaagaaugaguaaaagaaaugcccgacucucacuucaua

SEQ ID NO: 480925 - RNA, 64 nt, Homo Sapiens
agauacuuaacaauaauuggaguugaacaaacauguaaaagaagugguuuuuacuuagaucaug

SEQ ID NO: 480926 - RNA, 64 nt, Homo Sapiens
aaauaguucugugacuaggagaacaaauaaaguaguaaaagaagcuuugauucuguaauaacua

SEQ ID NO: 480927 - RNA, 64 nt, Homo Sapiens
caagugaccaucauuucacccuaagaaaccaggaguaaaagagucagucucaaaggccagguug

SEQ ID NO: 480928 - RNA, 64 nt, Homo Sapiens; identical to SEQ ID NO: 411269

SEQ ID NO: 480929 - RNA, 64 nt, Homo Sapiens; identical to SEQ ID NO: 411270

SEQ ID NO: 480930 - RNA, 64 nt, Homo Sapiens; identical to SEQ ID NO: 411271

SEQ ID NO: 480931 - RNA, 64 nt, Homo Sapiens; identical to SEQ ID NO: 411272

SEQ ID NO: 480932 - RNA, 64 nt, Homo Sapiens; identical to SEQ ID NO: 411273

SEQ ID NO: 480933 - RNA, 64 nt, Homo Sapiens; identical to SEQ ID NO: 411274

SEQ ID NO: 480934 - RNA, 64 nt, Homo Sapiens; identical to SEQ ID NO: 411275

SEQ ID NO: 480935 - RNA, 64 nt, Homo Sapiens; identical to SEQ ID NO: 411276

SEQ ID NO: 480936 - RNA, 64 nt, Homo Sapiens; identical to SEQ ID NO: 411277

SEQ ID NO: 480937 - RNA, 64 nt, Homo Sapiens; identical to SEQ ID NO: 411278

SEQ ID NO: 480938 - RNA, 64 nt, Homo Sapiens; identical to SEQ ID NO: 411279

SEQ ID NO: 480939 - RNA, 64 nt, Homo Sapiens; identical to SEQ ID NO: 411280

SEQ ID NO: 480940 - RNA, 64 nt, Homo Sapiens; identical to SEQ ID NO: 411281

SEQ ID NO: 480941 - RNA, 64 nt, Homo Sapiens; identical to SEQ ID NO: 411282

SEQ ID NO: 480942 - RNA, 64 nt, Homo Sapiens; identical to SEQ ID NO: 411283

SEQ ID NO: 480943 - RNA, 64 nt, Homo Sapiens; identical to SEQ ID NO: 411284

SEQ ID NO: 480944 - RNA, 64 nt, Homo Sapiens; identical to SEQ ID NO: 411285

SEQ ID NO: 480945 - RNA, 64 nt, Homo Sapiens; identical to SEQ ID NO: 411286

SEQ ID NO: 480946 - RNA, 64 nt, Homo Sapiens; identical to SEQ ID NO: 411287

SEQ ID NO: 480947 - RNA, 64 nt, Homo Sapiens; identical to SEQ ID NO: 411288

SEQ ID NO: 480948 - RNA, 64 nt, Homo Sapiens; identical to SEQ ID NO: 411289

SEQ ID NO: 480949 - RNA, 64 nt, Homo Sapiens; identical to SEQ ID NO: 411290

SEQ ID NO: 480950 - RNA, 64 nt, Homo Sapiens; identical to SEQ ID NO: 411291

SEQ ID NO: 480951 - RNA, 64 nt, Homo Sapiens; identical to SEQ ID NO: 411292

SEQ ID NO: 480952 - RNA, 64 nt, Homo Sapiens; identical to SEQ ID NO: 411293

SEQ ID NO: 480953 - RNA, 64 nt, Homo Sapiens; identical to SEQ ID NO: 411294

SEQ ID NO: 480954 - RNA, 64 nt, Homo Sapiens; identical to SEQ ID NO: 411295

SEQ ID NO: 480955 - RNA, 64 nt, Homo Sapiens; identical to SEQ ID NO: 411296

SEQ ID NO: 480956 - RNA, 64 nt, Homo Sapiens; identical to SEQ ID NO: 411297

SEQ ID NO: 480957 - RNA, 64 nt, Homo Sapiens; identical to SEQ ID NO: 411298

SEQ ID NO: 480958 - RNA, 64 nt, Homo Sapiens; identical to SEQ ID NO: 411299

SEQ ID NO: 480959 - RNA, 64 nt, Homo Sapiens; identical to SEQ ID NO: 411300

SEQ ID NO: 480960 - RNA, 64 nt, Homo Sapiens; identical to SEQ ID NO: 411301

SEQ ID NO: 480961 - RNA, 64 nt, Homo Sapiens; identical to SEQ ID NO: 411302

SEQ ID NO: 480962 - RNA, 64 nt, Homo Sapiens; identical to SEQ ID NO: 411303

SEQ ID NO: 480963 - RNA, 64 nt, Homo Sapiens; identical to SEQ ID NO: 411304

SEQ ID NO: 480964 - RNA, 64 nt, Homo Sapiens; identical to SEQ ID NO: 411305

SEQ ID NO: 480965 - RNA, 64 nt, Homo Sapiens; identical to SEQ ID NO: 411306

SEQ ID NO: 480966 - RNA, 64 nt, Homo Sapiens; identical to SEQ ID NO: 411307

SEQ ID NO: 480967 - RNA, 64 nt, Homo Sapiens; identical to SEQ ID NO: 411308

SEQ ID NO: 480968 - RNA, 64 nt, Homo Sapiens; identical to SEQ ID NO: 411309

SEQ ID NO: 480969 - RNA, 64 nt, Homo Sapiens; identical to SEQ ID NO: 411310

SEQ ID NO: 480970 - RNA, 64 nt, Homo Sapiens; identical to SEQ ID NO: 411311

SEQ ID NO: 480971 - RNA, 64 nt, Homo Sapiens; identical to SEQ ID NO: 411312

SEQ ID NO: 480972 - RNA, 64 nt, Homo Sapiens; identical to SEQ ID NO: 411313

SEQ ID NO: 480973 - RNA, 64 nt, Homo Sapiens; identical to SEQ ID NO: 411314

SEQ ID NO: 480974 - RNA, 64 nt, Homo Sapiens; identical to SEQ ID NO: 411315

SEQ ID NO: 480975 - RNA, 64 nt, Homo Sapiens; identical to SEQ ID NO: 411316

SEQ ID NO: 480976 - RNA, 64 nt, Homo Sapiens; identical to SEQ ID NO: 411317

SEQ ID NO: 480977 - RNA, 64 nt, Homo Sapiens; identical to SEQ ID NO: 411318

SEQ ID NO: 480978 - RNA, 64 nt, Homo Sapiens; identical to SEQ ID NO: 411319

SEQ ID NO: 480979 - RNA, 64 nt, Homo Sapiens; identical to SEQ ID NO: 411320

SEQ ID NO: 480980 - RNA, 64 nt, Homo Sapiens; identical to SEQ ID NO: 411321

SEQ ID NO: 480981 - RNA, 64 nt, Homo Sapiens; identical to SEQ ID NO: 411322

SEQ ID NO: 480982 - RNA, 64 nt, Homo Sapiens; identical to SEQ ID NO: 411323

SEQ ID NO: 480983 - RNA, 64 nt, Homo Sapiens; identical to SEQ ID NO: 411324

SEQ ID NO: 480984 - RNA, 64 nt, Homo Sapiens; identical to SEQ ID NO: 411325

SEQ ID NO: 480985 - RNA, 64 nt, Homo Sapiens; identical to SEQ ID NO: 411326

SEQ ID NO: 480986 - RNA, 64 nt, Homo Sapiens; identical to SEQ ID NO: 411327

SEQ ID NO: 480987 - RNA, 64 nt, Homo Sapiens; identical to SEQ ID NO: 411328

SEQ ID NO: 480988 - RNA, 64 nt, Homo Sapiens; identical to SEQ ID NO: 411329

SEQ ID NO: 480989 - RNA, 64 nt, Homo Sapiens; identical to SEQ ID NO: 411330

SEQ ID NO: 480990 - RNA, 64 nt, Homo Sapiens; identical to SEQ ID NO: 411331

SEQ ID NO: 480991 - RNA, 52 nt, Homo Sapiens; identical to SEQ ID NO: 264778

SEQ ID NO: 480992 - RNA, 64 nt, Homo Sapiens; identical to SEQ ID NO: 411333

SEQ ID NO: 480993 - RNA, 64 nt, Homo Sapiens; identical to SEQ ID NO: 411334

SEQ ID NO: 480994 - RNA, 64 nt, Homo Sapiens; identical to SEQ ID NO: 411335

SEQ ID NO: 480995 - RNA, 64 nt, Homo Sapiens; identical to SEQ ID NO: 411336

SEQ ID NO: 480996 - RNA, 64 nt, Homo Sapiens; identical to SEQ ID NO: 411337

SEQ ID NO: 480997 - RNA, 64 nt, Homo Sapiens; identical to SEQ ID NO: 411338

SEQ ID NO: 480998 - RNA, 64 nt, Homo Sapiens; identical to SEQ ID NO: 411339

SEQ ID NO: 480999 - RNA, 64 nt, Homo Sapiens; identical to SEQ ID NO: 411340

SEQ ID NO: 481000 - RNA, 64 nt, Homo Sapiens; identical to SEQ ID NO: 411341

SEQ ID NO: 481001 - RNA, 64 nt, Homo Sapiens; identical to SEQ ID NO: 411342

SEQ ID NO: 481002 - RNA, 64 nt, Homo Sapiens; identical to SEQ ID NO: 411343

SEQ ID NO: 481003 - RNA, 64 nt, Homo Sapiens; identical to SEQ ID NO: 411344

SEQ ID NO: 481004 - RNA, 64 nt, Homo Sapiens; identical to SEQ ID NO: 411345

SEQ ID NO: 481005 - RNA, 64 nt, Homo Sapiens; identical to SEQ ID NO: 411346

SEQ ID NO: 481006 - RNA, 64 nt, Homo Sapiens; identical to SEQ ID NO: 411347

SEQ ID NO: 481007 - RNA, 64 nt, Homo Sapiens; identical to SEQ ID NO: 411348

SEQ ID NO: 481008 - RNA, 64 nt, Homo Sapiens; identical to SEQ ID NO: 411349

SEQ ID NO: 481009 - RNA, 63 nt, Homo Sapiens
uaguaguaaggaagucaaauuuguuuuuuuaucauugauuauaagugguauauuuguuuuuug

SEQ ID NO: 481010 - RNA, 63 nt, Homo Sapiens
cauugauuauaagugguauauuuguuuuuugucauugauuaaaagugauuuuagcccuaggcc

SEQ ID NO: 481011 - RNA, 63 nt, Homo Sapiens
guuaccccaauucuaaauagguaccaaaagaguauugauuaugaccuggagccugagcuuugg

SEQ ID NO: 481012 - RNA, 63 nt, Homo Sapiens
uaggaagcuuaaguaaauuucugauuuuccuuuauugauuauguaacccacgugauuugcaua

SEQ ID NO: 481013 - RNA, 63 nt, Homo Sapiens
aguuaaagugucaugccuugaccaaucuaaugaauugauuaauuaacugggccuuuauacuua

SEQ ID NO: 481014 - RNA, 63 nt, Homo Sapiens
cuaggaaguuagucuaauaauucacugcagaaaauugauuaaguggcuguccuuuuaauuaag

SEQ ID NO: 481015 - RNA, 63 nt, Homo Sapiens
cuuuccuaaagaaaagccauggucauuaaaauaauugauuauauuugaguccaugaaugcuau

SEQ ID NO: 481016 - RNA, 63 nt, Homo Sapiens
uauaaaauucaguuuaaaaacaagacugaagacauugauuagacaacaaugcaaauucuucuu

SEQ ID NO: 481017 - RNA, 63 nt, Homo Sapiens
auuaauaaucuuuugggaggguagaauaaaauaauugauuacuauugcugcauacccggggug

SEQ ID NO: 481018 - RNA, 63 nt, Homo Sapiens
ggaacauuguguggguuuuguuuuguuuaauuuauugauuagucuuuaaaguaggcuuuuuuu

SEQ ID NO: 481019 - RNA, 63 nt, Homo Sapiens
aaguauuuuauauauaaccaucuaaauuugauaauugauuaggaaguauguuucauuauucuu

SEQ ID NO: 481020 - RNA, 63 nt, Homo Sapiens
agcaaauaccugucuuagggagcuugcacauggauugauuaaaccccuuaaaaugucuaguaa

SEQ ID NO: 481021 - RNA, 63 nt, Homo Sapiens
uggacaaaaagucuggaaacuuucauaucaauaauugauuauguauuaacugaaacaaaagac

SEQ ID NO: 481022 - RNA, 63 nt, Homo Sapiens
ugaaacaaaagacuagagaaagacacagugggaauugauuauguauuaacugaggaauaaaag

SEQ ID NO: 481023 - RNA, 63 nt, Homo Sapiens
ugacugugagauuccaagugauuuaguaaaaugauugauuauggugaaugaaaauaugcuugu

SEQ ID NO: 481024 - RNA, 63 nt, Homo Sapiens
acucagcuauaauccugaggauauguuuuccuuauugauuacaaauguucucuacauguuagg

SEQ ID NO: 481025 - RNA, 64 nt, Homo Sapiens; identical to SEQ ID NO: 394591

SEQ ID NO: 481026 - RNA, 64 nt, Homo Sapiens; identical to SEQ ID NO: 394592

SEQ ID NO: 481027 - RNA, 64 nt, Homo Sapiens; identical to SEQ ID NO: 394593

SEQ ID NO: 481028 - RNA, 64 nt, Homo Sapiens; identical to SEQ ID NO: 394594

SEQ ID NO: 481029 - RNA, 64 nt, Homo Sapiens; identical to SEQ ID NO: 394595

SEQ ID NO: 481030 - RNA, 64 nt, Homo Sapiens; identical to SEQ ID NO: 394596

SEQ ID NO: 481031 - RNA, 64 nt, Homo Sapiens; identical to SEQ ID NO: 394597

SEQ ID NO: 481032 - RNA, 64 nt, Homo Sapiens; identical to SEQ ID NO: 394598

SEQ ID NO: 481033 - RNA, 64 nt, Homo Sapiens; identical to SEQ ID NO: 394599

SEQ ID NO: 481034 - RNA, 64 nt, Homo Sapiens; identical to SEQ ID NO: 394600

SEQ ID NO: 481035 - RNA, 64 nt, Homo Sapiens; identical to SEQ ID NO: 394601

SEQ ID NO: 481036 - RNA, 64 nt, Homo Sapiens; identical to SEQ ID NO: 394602

SEQ ID NO: 481037 - RNA, 64 nt, Homo Sapiens; identical to SEQ ID NO: 394603

SEQ ID NO: 481038 - RNA, 64 nt, Homo Sapiens; identical to SEQ ID NO: 394604

SEQ ID NO: 481039 - RNA, 64 nt, Homo Sapiens; identical to SEQ ID NO: 394605

SEQ ID NO: 481040 - RNA, 64 nt, Homo Sapiens; identical to SEQ ID NO: 394606

SEQ ID NO: 481041 - RNA, 64 nt, Homo Sapiens; identical to SEQ ID NO: 394607

SEQ ID NO: 481042 - RNA, 64 nt, Homo Sapiens; identical to SEQ ID NO: 394608

SEQ ID NO: 481043 - RNA, 64 nt, Homo Sapiens; identical to SEQ ID NO: 394609

SEQ ID NO: 481044 - RNA, 64 nt, Homo Sapiens; identical to SEQ ID NO: 394610

SEQ ID NO: 481045 - RNA, 64 nt, Homo Sapiens; identical to SEQ ID NO: 455473

SEQ ID NO: 481046 - RNA, 64 nt, Homo Sapiens; identical to SEQ ID NO: 455474

SEQ ID NO: 481047 - RNA, 64 nt, Homo Sapiens; identical to SEQ ID NO: 455475

SEQ ID NO: 481048 - RNA, 64 nt, Homo Sapiens; identical to SEQ ID NO: 455476

SEQ ID NO: 481049 - RNA, 64 nt, Homo Sapiens; identical to SEQ ID NO: 455477

SEQ ID NO: 481050 - RNA, 64 nt, Homo Sapiens; identical to SEQ ID NO: 455478

SEQ ID NO: 481051 - RNA, 64 nt, Homo Sapiens; identical to SEQ ID NO: 455479

SEQ ID NO: 481052 - RNA, 64 nt, Homo Sapiens; identical to SEQ ID NO: 455480

SEQ ID NO: 481053 - RNA, 64 nt, Homo Sapiens; identical to SEQ ID NO: 455481

SEQ ID NO: 481054 - RNA, 64 nt, Homo Sapiens; identical to SEQ ID NO: 455482

SEQ ID NO: 481055 - RNA, 64 nt, Homo Sapiens
auguugcuguaauuuuuuaauuuguacauauguugucuuugauaauguucuuuuuuguaaaaug

SEQ ID NO: 481056 - RNA, 64 nt, Homo Sapiens
acagacauugcccggaaacuaacgcaguuuggaugucuuugaggaagccuguuucagcugccug

SEQ ID NO: 481057 - RNA, 64 nt, Homo Sapiens
uacucauaguuuuaaacugcaaccaagacagaaagucuuugaauuuuuauuaguuggccuguuu

SEQ ID NO: 481058 - RNA, 64 nt, Homo Sapiens
uuuaaccuuugacuggaaguacuuugaucauucagucuuugaacguccuacugagaaaaugagc

SEQ ID NO: 481059 - RNA, 64 nt, Homo Sapiens
aggaauuauuguuauugguuuuacuaaguuagcugucuuugauggaggugguugucaauugacc

SEQ ID NO: 481060 - RNA, 64 nt, Homo Sapiens
uuucucuuuuaacaaaaaugcacuccccuuaacugucuuugaacccccagucagcauuauuuaa

SEQ ID NO: 481061 - RNA, 64 nt, Homo Sapiens
gugucugaacuuuaaaaaguugguacuuuuaucugucuuugaaauuuaaagguagauuucuucc

SEQ ID NO: 481062 - RNA, 64 nt, Homo Sapiens
guguggauguugguguuuugugugaucucacauugucuuugaaauuuugauuuguaacaaauau

SEQ ID NO: 481063 - RNA, 64 nt, Homo Sapiens
ucugaaugugugcgcugguucucuuuaggugaucgucuuugaaguucagcaaagcugcuuguuc

SEQ ID NO: 481064 - RNA, 64 nt, Homo Sapiens
uggcccaggauguagugaaagaacaaauccuagagucuuugaaauuucuaagggcauucuagac

SEQ ID NO: 481065 - RNA, 64 nt, Homo Sapiens
caauagaauaaagaaugugucauucucacaaacugucuuugaagcagcugugcuuguuaucuuc

SEQ ID NO: 481066 - RNA, 64 nt, Homo Sapiens
guggugagggugggugauggcucacugcaccagugucuuugauggguuuuugcagacucgaagu

SEQ ID NO: 481067 - RNA, 64 nt, Homo Sapiens
cacacacaaaaaaggcaguaggaaaaaugcuggcccugaugaccuguccuuauucagaaugaga

SEQ ID NO: 481068 - RNA, 64 nt, Homo Sapiens
auccucacguguucgguacugagcagccacuaccccugaugagaacaguaugaagaaagggggc

SEQ ID NO: 481069 - RNA, 64 nt, Homo Sapiens
guaaaguuacacuguucacauauaguuugucaucccugaugaauuucuucuaggcaucaugucc

SEQ ID NO: 481070 - RNA, 64 nt, Homo Sapiens
auucuucuaggcaucaugucaaauuuaugggcuuccugaugaugcugaaacauugagggaacac

SEQ ID NO: 481071 - RNA, 64 nt, Homo Sapiens
gcccgcagugagcuauacuucugacugaggucacccugaugaauucagagaacuggaccccauc

SEQ ID NO: 481072 - RNA, 64 nt, Homo Sapiens
aauucuacaacagaaaaaaucauguucagaacaaccugaugagagugguauguugcaguuccgg

SEQ ID NO: 481073 - RNA, 64 nt, Homo Sapiens
ucaucccagcccuugaucgccagcacaacuuugaccugaugaccccugaugacaacucuuaugc

SEQ ID NO: 481074 - RNA, 64 nt, Homo Sapiens
acucuuaugccagcacaacucugacuccuuaaccccugaugacaugagguugcuuguuucgucc

SEQ ID NO: 481075 - RNA, 64 nt, Homo Sapiens; identical to SEQ ID NO: 236085

SEQ ID NO: 481076 - RNA, 64 nt, Homo Sapiens; identical to SEQ ID NO: 236086

SEQ ID NO: 481077 - RNA, 64 nt, Homo Sapiens; identical to SEQ ID NO: 236087

SEQ ID NO: 481078 - RNA, 64 nt, Homo Sapiens; identical to SEQ ID NO: 236088

SEQ ID NO: 481079 - RNA, 64 nt, Homo Sapiens; identical to SEQ ID NO: 236089

SEQ ID NO: 481080 - RNA, 64 nt, Homo Sapiens; identical to SEQ ID NO: 236090

SEQ ID NO: 481081 - RNA, 64 nt, Homo Sapiens; identical to SEQ ID NO: 236091

SEQ ID NO: 481082 - RNA, 64 nt, Homo Sapiens; identical to SEQ ID NO: 236092

SEQ ID NO: 481083 - RNA, 64 nt, Homo Sapiens; identical to SEQ ID NO: 236093

SEQ ID NO: 481084 - RNA, 64 nt, Homo Sapiens; identical to SEQ ID NO: 236094

SEQ ID NO: 481085 - RNA, 64 nt, Homo Sapiens; identical to SEQ ID NO: 236095

SEQ ID NO: 481086 - RNA, 64 nt, Homo Sapiens; identical to SEQ ID NO: 236096

SEQ ID NO: 481087 - RNA, 64 nt, Homo Sapiens; identical to SEQ ID NO: 236097

SEQ ID NO: 481088 - RNA, 64 nt, Homo Sapiens; identical to SEQ ID NO: 236098

SEQ ID NO: 481089 - RNA, 64 nt, Homo Sapiens; identical to SEQ ID NO: 236099

SEQ ID NO: 481090 - RNA, 64 nt, Homo Sapiens; identical to SEQ ID NO: 236100

SEQ ID NO: 481091 - RNA, 64 nt, Homo Sapiens; identical to SEQ ID NO: 236101

SEQ ID NO: 481092 - RNA, 64 nt, Homo Sapiens; identical to SEQ ID NO: 236102

SEQ ID NO: 481093 - RNA, 64 nt, Homo Sapiens; identical to SEQ ID NO: 236103

SEQ ID NO: 481094 - RNA, 64 nt, Homo Sapiens; identical to SEQ ID NO: 236104

SEQ ID NO: 481095 - RNA, 64 nt, Homo Sapiens; identical to SEQ ID NO: 236105

SEQ ID NO: 481096 - RNA, 64 nt, Homo Sapiens; identical to SEQ ID NO: 236106

SEQ ID NO: 481097 - RNA, 64 nt, Homo Sapiens; identical to SEQ ID NO: 236107

SEQ ID NO: 481098 - RNA, 64 nt, Homo Sapiens; identical to SEQ ID NO: 236108

SEQ ID NO: 481099 - RNA, 64 nt, Homo Sapiens; identical to SEQ ID NO: 236109

SEQ ID NO: 481100 - RNA, 64 nt, Homo Sapiens; identical to SEQ ID NO: 236110

SEQ ID NO: 481101 - RNA, 64 nt, Homo Sapiens; identical to SEQ ID NO: 236111

SEQ ID NO: 481102 - RNA, 64 nt, Homo Sapiens; identical to SEQ ID NO: 236112

SEQ ID NO: 481103 - RNA, 64 nt, Homo Sapiens; identical to SEQ ID NO: 236113

SEQ ID NO: 481104 - RNA, 64 nt, Homo Sapiens; identical to SEQ ID NO: 236114

SEQ ID NO: 481105 - RNA, 64 nt, Homo Sapiens; identical to SEQ ID NO: 236115

SEQ ID NO: 481106 - RNA, 64 nt, Homo Sapiens; identical to SEQ ID NO: 236116

SEQ ID NO: 481107 - RNA, 64 nt, Homo Sapiens; identical to SEQ ID NO: 236117

SEQ ID NO: 481108 - RNA, 64 nt, Homo Sapiens; identical to SEQ ID NO: 236118

SEQ ID NO: 481109 - RNA, 64 nt, Homo Sapiens; identical to SEQ ID NO: 236119

SEQ ID NO: 481110 - RNA, 64 nt, Homo Sapiens; identical to SEQ ID NO: 236120

SEQ ID NO: 481111 - RNA, 64 nt, Homo Sapiens; identical to SEQ ID NO: 236121

SEQ ID NO: 481112 - RNA, 64 nt, Homo Sapiens; identical to SEQ ID NO: 236122

SEQ ID NO: 481113 - RNA, 64 nt, Homo Sapiens; identical to SEQ ID NO: 236123

SEQ ID NO: 481114 - RNA, 64 nt, Homo Sapiens; identical to SEQ ID NO: 236124

SEQ ID NO: 481115 - RNA, 64 nt, Homo Sapiens; identical to SEQ ID NO: 236125

SEQ ID NO: 481116 - RNA, 64 nt, Homo Sapiens; identical to SEQ ID NO: 236126

SEQ ID NO: 481117 - RNA, 64 nt, Homo Sapiens; identical to SEQ ID NO: 236127

SEQ ID NO: 481118 - RNA, 64 nt, Homo Sapiens; identical to SEQ ID NO: 236128

SEQ ID NO: 481119 - RNA, 64 nt, Homo Sapiens; identical to SEQ ID NO: 236129

SEQ ID NO: 481120 - RNA, 64 nt, Homo Sapiens; identical to SEQ ID NO: 236130

SEQ ID NO: 481121 - RNA, 64 nt, Homo Sapiens; identical to SEQ ID NO: 236131

SEQ ID NO: 481122 - RNA, 64 nt, Homo Sapiens; identical to SEQ ID NO: 236132

SEQ ID NO: 481123 - RNA, 64 nt, Homo Sapiens; identical to SEQ ID NO: 236133

SEQ ID NO: 481124 - RNA, 64 nt, Homo Sapiens; identical to SEQ ID NO: 236134

SEQ ID NO: 481125 - RNA, 64 nt, Homo Sapiens; identical to SEQ ID NO: 236135

SEQ ID NO: 481126 - RNA, 64 nt, Homo Sapiens; identical to SEQ ID NO: 236136

SEQ ID NO: 481127 - RNA, 64 nt, Homo Sapiens; identical to SEQ ID NO: 236137

SEQ ID NO: 481128 - RNA, 64 nt, Homo Sapiens; identical to SEQ ID NO: 236138

SEQ ID NO: 481129 - RNA, 64 nt, Homo Sapiens; identical to SEQ ID NO: 236139

SEQ ID NO: 481130 - RNA, 64 nt, Homo Sapiens; identical to SEQ ID NO: 236140

SEQ ID NO: 481131 - RNA, 64 nt, Homo Sapiens; identical to SEQ ID NO: 236141

SEQ ID NO: 481132 - RNA, 64 nt, Homo Sapiens; identical to SEQ ID NO: 53373

SEQ ID NO: 481133 - RNA, 64 nt, Homo Sapiens; identical to SEQ ID NO: 53374

SEQ ID NO: 481134 - RNA, 64 nt, Homo Sapiens; identical to SEQ ID NO: 53375

SEQ ID NO: 481135 - RNA, 64 nt, Homo Sapiens; identical to SEQ ID NO: 53376

SEQ ID NO: 481136 - RNA, 64 nt, Homo Sapiens; identical to SEQ ID NO: 53377

SEQ ID NO: 481137 - RNA, 64 nt, Homo Sapiens; identical to SEQ ID NO: 53378

SEQ ID NO: 481138 - RNA, 64 nt, Homo Sapiens; identical to SEQ ID NO: 53379

SEQ ID NO: 481139 - RNA, 64 nt, Homo Sapiens; identical to SEQ ID NO: 53380

SEQ ID NO: 481140 - RNA, 64 nt, Homo Sapiens; identical to SEQ ID NO: 53381

SEQ ID NO: 481141 - RNA, 64 nt, Homo Sapiens; identical to SEQ ID NO: 53382

SEQ ID NO: 481142 - RNA, 64 nt, Homo Sapiens; identical to SEQ ID NO: 53383

SEQ ID NO: 481143 - RNA, 64 nt, Homo Sapiens; identical to SEQ ID NO: 53384

SEQ ID NO: 481144 - RNA, 64 nt, Homo Sapiens; identical to SEQ ID NO: 53385

SEQ ID NO: 481145 - RNA, 64 nt, Homo Sapiens; identical to SEQ ID NO: 53386

SEQ ID NO: 481146 - RNA, 64 nt, Homo Sapiens; identical to SEQ ID NO: 53387

SEQ ID NO: 481147 - RNA, 64 nt, Homo Sapiens; identical to SEQ ID NO: 53388

SEQ ID NO: 481148 - RNA, 64 nt, Homo Sapiens; identical to SEQ ID NO: 53389

SEQ ID NO: 481149 - RNA, 64 nt, Homo Sapiens; identical to SEQ ID NO: 53390

SEQ ID NO: 481150 - RNA, 64 nt, Homo Sapiens; identical to SEQ ID NO: 53391

SEQ ID NO: 481151 - RNA, 64 nt, Homo Sapiens; identical to SEQ ID NO: 53392

SEQ ID NO: 481152 - RNA, 64 nt, Homo Sapiens; identical to SEQ ID NO: 53393

SEQ ID NO: 481153 - RNA, 64 nt, Homo Sapiens; identical to SEQ ID NO: 53394

SEQ ID NO: 481154 - RNA, 64 nt, Homo Sapiens; identical to SEQ ID NO: 53395

SEQ ID NO: 481155 - RNA, 64 nt, Homo Sapiens; identical to SEQ ID NO: 53396

SEQ ID NO: 481156 - RNA, 64 nt, Homo Sapiens; identical to SEQ ID NO: 53397

SEQ ID NO: 481157 - RNA, 64 nt, Homo Sapiens; identical to SEQ ID NO: 53398

SEQ ID NO: 481158 - RNA, 64 nt, Homo Sapiens; identical to SEQ ID NO: 53399

SEQ ID NO: 481159 - RNA, 64 nt, Homo Sapiens; identical to SEQ ID NO: 53400

SEQ ID NO: 481160 - RNA, 64 nt, Homo Sapiens; identical to SEQ ID NO: 53401

SEQ ID NO: 481161 - RNA, 64 nt, Homo Sapiens; identical to SEQ ID NO: 53402

SEQ ID NO: 481162 - RNA, 64 nt, Homo Sapiens; identical to SEQ ID NO: 53403

SEQ ID NO: 481163 - RNA, 64 nt, Homo Sapiens; identical to SEQ ID NO: 53404

SEQ ID NO: 481164 - RNA, 64 nt, Homo Sapiens; identical to SEQ ID NO: 53405

SEQ ID NO: 481165 - RNA, 64 nt, Homo Sapiens; identical to SEQ ID NO: 53406

SEQ ID NO: 481166 - RNA, 64 nt, Homo Sapiens; identical to SEQ ID NO: 53407

SEQ ID NO: 481167 - RNA, 64 nt, Homo Sapiens; identical to SEQ ID NO: 53408

SEQ ID NO: 481168 - RNA, 64 nt, Homo Sapiens; identical to SEQ ID NO: 53409

SEQ ID NO: 481169 - RNA, 64 nt, Homo Sapiens; identical to SEQ ID NO: 53410

SEQ ID NO: 481170 - RNA, 64 nt, Homo Sapiens; identical to SEQ ID NO: 53411

SEQ ID NO: 481171 - RNA, 64 nt, Homo Sapiens; identical to SEQ ID NO: 53412

SEQ ID NO: 481172 - RNA, 64 nt, Homo Sapiens; identical to SEQ ID NO: 53413

SEQ ID NO: 481173 - RNA, 64 nt, Homo Sapiens; identical to SEQ ID NO: 53414

SEQ ID NO: 481174 - RNA, 64 nt, Homo Sapiens; identical to SEQ ID NO: 53415

SEQ ID NO: 481175 - RNA, 64 nt, Homo Sapiens; identical to SEQ ID NO: 53416

SEQ ID NO: 481176 - RNA, 64 nt, Homo Sapiens; identical to SEQ ID NO: 53417

SEQ ID NO: 481177 - RNA, 64 nt, Homo Sapiens; identical to SEQ ID NO: 53418

SEQ ID NO: 481178 - RNA, 64 nt, Homo Sapiens; identical to SEQ ID NO: 53419

SEQ ID NO: 481179 - RNA, 64 nt, Homo Sapiens; identical to SEQ ID NO: 53420

SEQ ID NO: 481180 - RNA, 64 nt, Homo Sapiens; identical to SEQ ID NO: 53421

SEQ ID NO: 481181 - RNA, 64 nt, Homo Sapiens; identical to SEQ ID NO: 53422

SEQ ID NO: 481182 - RNA, 64 nt, Homo Sapiens; identical to SEQ ID NO: 53423

SEQ ID NO: 481183 - RNA, 64 nt, Homo Sapiens; identical to SEQ ID NO: 53424

SEQ ID NO: 481184 - RNA, 64 nt, Homo Sapiens; identical to SEQ ID NO: 53425

SEQ ID NO: 481185 - RNA, 64 nt, Homo Sapiens; identical to SEQ ID NO: 53426

SEQ ID NO: 481186 - RNA, 64 nt, Homo Sapiens; identical to SEQ ID NO: 236085

SEQ ID NO: 481187 - RNA, 64 nt, Homo Sapiens; identical to SEQ ID NO: 236086

SEQ ID NO: 481188 - RNA, 64 nt, Homo Sapiens; identical to SEQ ID NO: 236087

SEQ ID NO: 481189 - RNA, 64 nt, Homo Sapiens; identical to SEQ ID NO: 236088

SEQ ID NO: 481190 - RNA, 64 nt, Homo Sapiens; identical to SEQ ID NO: 236089

SEQ ID NO: 481191 - RNA, 64 nt, Homo Sapiens; identical to SEQ ID NO: 236090

SEQ ID NO: 481192 - RNA, 64 nt, Homo Sapiens; identical to SEQ ID NO: 236091

SEQ ID NO: 481193 - RNA, 64 nt, Homo Sapiens; identical to SEQ ID NO: 236092

SEQ ID NO: 481194 - RNA, 64 nt, Homo Sapiens; identical to SEQ ID NO: 236093

SEQ ID NO: 481195 - RNA, 64 nt, Homo Sapiens; identical to SEQ ID NO: 236094

SEQ ID NO: 481196 - RNA, 64 nt, Homo Sapiens; identical to SEQ ID NO: 236095

SEQ ID NO: 481197 - RNA, 64 nt, Homo Sapiens; identical to SEQ ID NO: 236096

SEQ ID NO: 481198 - RNA, 64 nt, Homo Sapiens; identical to SEQ ID NO: 236097

SEQ ID NO: 481199 - RNA, 64 nt, Homo Sapiens; identical to SEQ ID NO: 236098

SEQ ID NO: 481200 - RNA, 64 nt, Homo Sapiens; identical to SEQ ID NO: 236099

SEQ ID NO: 481201 - RNA, 64 nt, Homo Sapiens; identical to SEQ ID NO: 236100

SEQ ID NO: 481202 - RNA, 64 nt, Homo Sapiens; identical to SEQ ID NO: 236101

SEQ ID NO: 481203 - RNA, 64 nt, Homo Sapiens; identical to SEQ ID NO: 236102

SEQ ID NO: 481204 - RNA, 64 nt, Homo Sapiens; identical to SEQ ID NO: 236103

SEQ ID NO: 481205 - RNA, 64 nt, Homo Sapiens; identical to SEQ ID NO: 236104

SEQ ID NO: 481206 - RNA, 64 nt, Homo Sapiens; identical to SEQ ID NO: 236105

SEQ ID NO: 481207 - RNA, 64 nt, Homo Sapiens; identical to SEQ ID NO: 236106

SEQ ID NO: 481208 - RNA, 64 nt, Homo Sapiens; identical to SEQ ID NO: 236107

SEQ ID NO: 481209 - RNA, 64 nt, Homo Sapiens; identical to SEQ ID NO: 236108

SEQ ID NO: 481210 - RNA, 64 nt, Homo Sapiens; identical to SEQ ID NO: 236109

SEQ ID NO: 481211 - RNA, 64 nt, Homo Sapiens; identical to SEQ ID NO: 236110

SEQ ID NO: 481212 - RNA, 64 nt, Homo Sapiens; identical to SEQ ID NO: 236111

SEQ ID NO: 481213 - RNA, 64 nt, Homo Sapiens; identical to SEQ ID NO: 236112

SEQ ID NO: 481214 - RNA, 64 nt, Homo Sapiens; identical to SEQ ID NO: 236113

SEQ ID NO: 481215 - RNA, 64 nt, Homo Sapiens; identical to SEQ ID NO: 236114

SEQ ID NO: 481216 - RNA, 64 nt, Homo Sapiens; identical to SEQ ID NO: 236115

SEQ ID NO: 481217 - RNA, 64 nt, Homo Sapiens; identical to SEQ ID NO: 236116

SEQ ID NO: 481218 - RNA, 64 nt, Homo Sapiens; identical to SEQ ID NO: 236117

SEQ ID NO: 481219 - RNA, 64 nt, Homo Sapiens; identical to SEQ ID NO: 236118

SEQ ID NO: 481220 - RNA, 64 nt, Homo Sapiens; identical to SEQ ID NO: 236119

SEQ ID NO: 481221 - RNA, 64 nt, Homo Sapiens; identical to SEQ ID NO: 236120

SEQ ID NO: 481222 - RNA, 64 nt, Homo Sapiens; identical to SEQ ID NO: 236121

SEQ ID NO: 481223 - RNA, 64 nt, Homo Sapiens; identical to SEQ ID NO: 236122

SEQ ID NO: 481224 - RNA, 64 nt, Homo Sapiens; identical to SEQ ID NO: 236123

SEQ ID NO: 481225 - RNA, 64 nt, Homo Sapiens; identical to SEQ ID NO: 236124

SEQ ID NO: 481226 - RNA, 64 nt, Homo Sapiens; identical to SEQ ID NO: 236125

SEQ ID NO: 481227 - RNA, 64 nt, Homo Sapiens; identical to SEQ ID NO: 236126

SEQ ID NO: 481228 - RNA, 64 nt, Homo Sapiens; identical to SEQ ID NO: 236127

SEQ ID NO: 481229 - RNA, 64 nt, Homo Sapiens; identical to SEQ ID NO: 236128

SEQ ID NO: 481230 - RNA, 64 nt, Homo Sapiens; identical to SEQ ID NO: 236129

SEQ ID NO: 481231 - RNA, 64 nt, Homo Sapiens; identical to SEQ ID NO: 236130

SEQ ID NO: 481232 - RNA, 64 nt, Homo Sapiens; identical to SEQ ID NO: 236131

SEQ ID NO: 481233 - RNA, 64 nt, Homo Sapiens; identical to SEQ ID NO: 236132

SEQ ID NO: 481234 - RNA, 64 nt, Homo Sapiens; identical to SEQ ID NO: 236133

SEQ ID NO: 481235 - RNA, 64 nt, Homo Sapiens; identical to SEQ ID NO: 236134

SEQ ID NO: 481236 - RNA, 64 nt, Homo Sapiens; identical to SEQ ID NO: 236135

SEQ ID NO: 481237 - RNA, 64 nt, Homo Sapiens; identical to SEQ ID NO: 236136

SEQ ID NO: 481238 - RNA, 64 nt, Homo Sapiens; identical to SEQ ID NO: 236137

SEQ ID NO: 481239 - RNA, 64 nt, Homo Sapiens; identical to SEQ ID NO: 236138

SEQ ID NO: 481240 - RNA, 64 nt, Homo Sapiens; identical to SEQ ID NO: 236139

SEQ ID NO: 481241 - RNA, 64 nt, Homo Sapiens; identical to SEQ ID NO: 236140

SEQ ID NO: 481242 - RNA, 64 nt, Homo Sapiens; identical to SEQ ID NO: 236141

SEQ ID NO: 481243 - RNA, 64 nt, Homo Sapiens; identical to SEQ ID NO: 53373

SEQ ID NO: 481244 - RNA, 64 nt, Homo Sapiens; identical to SEQ ID NO: 53374

SEQ ID NO: 481245 - RNA, 64 nt, Homo Sapiens; identical to SEQ ID NO: 53375

SEQ ID NO: 481246 - RNA, 64 nt, Homo Sapiens; identical to SEQ ID NO: 53376

SEQ ID NO: 481247 - RNA, 64 nt, Homo Sapiens; identical to SEQ ID NO: 53377

SEQ ID NO: 481248 - RNA, 64 nt, Homo Sapiens; identical to SEQ ID NO: 53378

SEQ ID NO: 481249 - RNA, 64 nt, Homo Sapiens; identical to SEQ ID NO: 53379

SEQ ID NO: 481250 - RNA, 64 nt, Homo Sapiens; identical to SEQ ID NO: 53380

SEQ ID NO: 481251 - RNA, 64 nt, Homo Sapiens; identical to SEQ ID NO: 53381

SEQ ID NO: 481252 - RNA, 64 nt, Homo Sapiens; identical to SEQ ID NO: 53382

SEQ ID NO: 481253 - RNA, 64 nt, Homo Sapiens; identical to SEQ ID NO: 53383

SEQ ID NO: 481254 - RNA, 64 nt, Homo Sapiens; identical to SEQ ID NO: 53384

SEQ ID NO: 481255 - RNA, 64 nt, Homo Sapiens; identical to SEQ ID NO: 53385

SEQ ID NO: 481256 - RNA, 64 nt, Homo Sapiens; identical to SEQ ID NO: 53386

SEQ ID NO: 481257 - RNA, 64 nt, Homo Sapiens; identical to SEQ ID NO: 53387

SEQ ID NO: 481258 - RNA, 64 nt, Homo Sapiens; identical to SEQ ID NO: 53388

SEQ ID NO: 481259 - RNA, 64 nt, Homo Sapiens; identical to SEQ ID NO: 53389

SEQ ID NO: 481260 - RNA, 64 nt, Homo Sapiens; identical to SEQ ID NO: 53390

SEQ ID NO: 481261 - RNA, 64 nt, Homo Sapiens; identical to SEQ ID NO: 53391

SEQ ID NO: 481262 - RNA, 64 nt, Homo Sapiens; identical to SEQ ID NO: 53392

SEQ ID NO: 481263 - RNA, 64 nt, Homo Sapiens; identical to SEQ ID NO: 53393

SEQ ID NO: 481264 - RNA, 64 nt, Homo Sapiens; identical to SEQ ID NO: 53394

SEQ ID NO: 481265 - RNA, 64 nt, Homo Sapiens; identical to SEQ ID NO: 53395

SEQ ID NO: 481266 - RNA, 64 nt, Homo Sapiens; identical to SEQ ID NO: 53396

SEQ ID NO: 481267 - RNA, 64 nt, Homo Sapiens; identical to SEQ ID NO: 53397

SEQ ID NO: 481268 - RNA, 64 nt, Homo Sapiens; identical to SEQ ID NO: 53398

SEQ ID NO: 481269 - RNA, 64 nt, Homo Sapiens; identical to SEQ ID NO: 53399

SEQ ID NO: 481270 - RNA, 64 nt, Homo Sapiens; identical to SEQ ID NO: 53400

SEQ ID NO: 481271 - RNA, 64 nt, Homo Sapiens; identical to SEQ ID NO: 53401

SEQ ID NO: 481272 - RNA, 64 nt, Homo Sapiens; identical to SEQ ID NO: 53402

SEQ ID NO: 481273 - RNA, 64 nt, Homo Sapiens; identical to SEQ ID NO: 53403

SEQ ID NO: 481274 - RNA, 64 nt, Homo Sapiens; identical to SEQ ID NO: 53404

SEQ ID NO: 481275 - RNA, 64 nt, Homo Sapiens; identical to SEQ ID NO: 53405

SEQ ID NO: 481276 - RNA, 64 nt, Homo Sapiens; identical to SEQ ID NO: 53406

SEQ ID NO: 481277 - RNA, 64 nt, Homo Sapiens; identical to SEQ ID NO: 53407

SEQ ID NO: 481278 - RNA, 64 nt, Homo Sapiens; identical to SEQ ID NO: 53408

SEQ ID NO: 481279 - RNA, 64 nt, Homo Sapiens; identical to SEQ ID NO: 53409

SEQ ID NO: 481280 - RNA, 64 nt, Homo Sapiens; identical to SEQ ID NO: 53410

SEQ ID NO: 481281 - RNA, 64 nt, Homo Sapiens; identical to SEQ ID NO: 53411

SEQ ID NO: 481282 - RNA, 64 nt, Homo Sapiens; identical to SEQ ID NO: 53412

SEQ ID NO: 481283 - RNA, 64 nt, Homo Sapiens; identical to SEQ ID NO: 53413

SEQ ID NO: 481284 - RNA, 64 nt, Homo Sapiens; identical to SEQ ID NO: 53414

SEQ ID NO: 481285 - RNA, 64 nt, Homo Sapiens; identical to SEQ ID NO: 53415

SEQ ID NO: 481286 - RNA, 64 nt, Homo Sapiens; identical to SEQ ID NO: 53416

SEQ ID NO: 481287 - RNA, 64 nt, Homo Sapiens; identical to SEQ ID NO: 53417

SEQ ID NO: 481288 - RNA, 64 nt, Homo Sapiens; identical to SEQ ID NO: 53418

SEQ ID NO: 481289 - RNA, 64 nt, Homo Sapiens; identical to SEQ ID NO: 53419

SEQ ID NO: 481290 - RNA, 64 nt, Homo Sapiens; identical to SEQ ID NO: 53420

SEQ ID NO: 481291 - RNA, 64 nt, Homo Sapiens; identical to SEQ ID NO: 53421

SEQ ID NO: 481292 - RNA, 64 nt, Homo Sapiens; identical to SEQ ID NO: 53422

SEQ ID NO: 481293 - RNA, 64 nt, Homo Sapiens; identical to SEQ ID NO: 53423

SEQ ID NO: 481294 - RNA, 64 nt, Homo Sapiens; identical to SEQ ID NO: 53424

SEQ ID NO: 481295 - RNA, 64 nt, Homo Sapiens; identical to SEQ ID NO: 53425

SEQ ID NO: 481296 - RNA, 64 nt, Homo Sapiens; identical to SEQ ID NO: 53426

SEQ ID NO: 481297 - RNA, 64 nt, Homo Sapiens; identical to SEQ ID NO: 179118

SEQ ID NO: 481298 - RNA, 64 nt, Homo Sapiens; identical to SEQ ID NO: 179119

SEQ ID NO: 481299 - RNA, 64 nt, Homo Sapiens; identical to SEQ ID NO: 179120

SEQ ID NO: 481300 - RNA, 64 nt, Homo Sapiens; identical to SEQ ID NO: 179121

SEQ ID NO: 481301 - RNA, 64 nt, Homo Sapiens; identical to SEQ ID NO: 179122

SEQ ID NO: 481302 - RNA, 64 nt, Homo Sapiens; identical to SEQ ID NO: 179123

SEQ ID NO: 481303 - RNA, 64 nt, Homo Sapiens; identical to SEQ ID NO: 179124

SEQ ID NO: 481304 - RNA, 64 nt, Homo Sapiens; identical to SEQ ID NO: 179125

SEQ ID NO: 481305 - RNA, 64 nt, Homo Sapiens; identical to SEQ ID NO: 179126

SEQ ID NO: 481306 - RNA, 64 nt, Homo Sapiens; identical to SEQ ID NO: 179127

SEQ ID NO: 481307 - RNA, 64 nt, Homo Sapiens; identical to SEQ ID NO: 179128

SEQ ID NO: 481308 - RNA, 64 nt, Homo Sapiens; identical to SEQ ID NO: 179129

SEQ ID NO: 481309 - RNA, 64 nt, Homo Sapiens; identical to SEQ ID NO: 179130

SEQ ID NO: 481310 - RNA, 64 nt, Homo Sapiens; identical to SEQ ID NO: 179131

SEQ ID NO: 481311 - RNA, 64 nt, Homo Sapiens; identical to SEQ ID NO: 179132

SEQ ID NO: 481312 - RNA, 64 nt, Homo Sapiens; identical to SEQ ID NO: 179133

SEQ ID NO: 481313 - RNA, 64 nt, Homo Sapiens; identical to SEQ ID NO: 179134

SEQ ID NO: 481314 - RNA, 64 nt, Homo Sapiens; identical to SEQ ID NO: 179135

SEQ ID NO: 481315 - RNA, 64 nt, Homo Sapiens; identical to SEQ ID NO: 179136

SEQ ID NO: 481316 - RNA, 64 nt, Homo Sapiens; identical to SEQ ID NO: 179137

SEQ ID NO: 481317 - RNA, 64 nt, Homo Sapiens; identical to SEQ ID NO: 179138

SEQ ID NO: 481318 - RNA, 64 nt, Homo Sapiens; identical to SEQ ID NO: 179139

SEQ ID NO: 481319 - RNA, 64 nt, Homo Sapiens; identical to SEQ ID NO: 179140

SEQ ID NO: 481320 - RNA, 64 nt, Homo Sapiens; identical to SEQ ID NO: 179141

SEQ ID NO: 481321 - RNA, 64 nt, Homo Sapiens
cuggcuaacacagugaaacgcgaggucaggagaucgagaccaucaggccgaggcggguggauca

SEQ ID NO: 481322 - RNA, 64 nt, Homo Sapiens
cuggcuaacauggugaaaccugaagucaggagaucgagaccaucaggccgaggggggcggaucg

SEQ ID NO: 481323 - RNA, 64 nt, Homo Sapiens
cuggcgaacacggugaaacccaaggucaggagaucgagaccaucaggccaaggugggcggauca

SEQ ID NO: 481324 - RNA, 64 nt, Homo Sapiens
cugaccaacauggcgaaaccugaggucaggaguucgagaccagcgccgaggcagguggaucacc

SEQ ID NO: 481325 - RNA, 64 nt, Homo Sapiens
cuggccaacauggugaaacccaagguccagagaucgagaccaucaggccgaggcaggcggauca

SEQ ID NO: 481326 - RNA, 64 nt, Homo Sapiens
cugaccaacguggugaaaccugaggucaggagaucgagaccaucaggccaaggugggcggauca

SEQ ID NO: 481327 - RNA, 64 nt, Homo Sapiens
cuggccaacauggcaaaaccugaggucaggaguucgagaccagcaggcgggugaaucacuugau

SEQ ID NO: 481328 - RNA, 64 nt, Homo Sapiens
cugaccaacauggcgaaaccugaggucaggaguucgagaccagcgccgaggaggguggaucacu

SEQ ID NO: 481329 - RNA, 64 nt, Homo Sapiens
ccaaggcaggcuggaucaccugaggacaggaguucgagaccagucuggccaacauggggaaacc

SEQ ID NO: 481330 - RNA, 64 nt, Homo Sapiens
gccaaggugggaggauggcuuguguccagaaguucgagaccagccuggacaacauagugagauc

SEQ ID NO: 481331 - RNA, 64 nt, Homo Sapiens
gccaaggcugguggaucaccugaggucaggaguucgagaccagccuggccaacacggugaaacc

SEQ ID NO: 481332 - RNA, 64 nt, Homo Sapiens
gcugagauggguggaucaccugagguugggaguucgagaccagccugacaaaacauagugaaac

SEQ ID NO: 481333 - RNA, 64 nt, Homo Sapiens
cugaccaauauggugaaaccuggggucaggaguucgagaccagcgccaaggcaggugggucacc

SEQ ID NO: 481334 - RNA, 64 nt, Homo Sapiens
aauggccaguauggugaaacugaagucaagaguucgagaccagcaggccuaggcgggcggauca

SEQ ID NO: 481335 - RNA, 64 nt, Homo Sapiens
gucggaaaugaucuggcugaauccgugguggcaccgagaccaaacucauucaccaaaugaugcc

SEQ ID NO: 481336 - RNA, 64 nt, Homo Sapiens
aggccgaggcggguggaucaugaggucaggagaucgagaccauccuggcuaacacgugaaaccc

SEQ ID NO: 481337 - RNA, 64 nt, Homo Sapiens
aggccgaggcgggcagaucacgaggucaggagaucgagaccauccuggcuaacacggugaaacc

SEQ ID NO: 481338 - RNA, 64 nt, Homo Sapiens
acugaggcaggaggaucacuuaaggccaggaguucgagaccagccugggcaacagcaagaccuc

SEQ ID NO: 481339 - RNA, 64 nt, Homo Sapiens
cuggccaacauggugaaaccugaggucaggaguucgagaccagcgcugagaugggcagaucacu

SEQ ID NO: 481340 - RNA, 64 nt, Homo Sapiens
cugggcuacauagugagaccugaacucaggaauucgagaccagcgccaaggagggaggaucacu

SEQ ID NO: 481341 - RNA, 64 nt, Homo Sapiens
aggccgaggcggguggaucacaaggucagcagaucgagaccauccuggccaacauggugaaacc

SEQ ID NO: 481342 - RNA, 64 nt, Homo Sapiens
gccgaggugggaggaucacuugagcccaggaguucgagaccagccuaggcaacauagcaagacc

SEQ ID NO: 481343 - RNA, 64 nt, Homo Sapiens
cuggccaaccaacauggugaugaggucaggaguucgagaccagcccgggcgugguggcucacgc

SEQ ID NO: 481344 - RNA, 64 nt, Homo Sapiens
cuggccaacauggcgaaaccugaggucaggagaucgagaccagcgccgaggugggcagaucagc

SEQ ID NO: 481345 - RNA, 64 nt, Homo Sapiens
ugauggaaagacuuaaagaugaauuugagaaaaauugaaagaaauuagauuaucagguucuguu

SEQ ID NO: 481346 - RNA, 64 nt, Homo Sapiens
auuacaagucuuucacagaaguuuggugguaauauugaaagaacuagcauugggcagaaugugu

SEQ ID NO: 481347 - RNA, 64 nt, Homo Sapiens
ugguaauaaacaugaaaacugguuuguagcaguuuugaaagaauagaaugcauucaaauguaag

SEQ ID NO: 481348 - RNA, 64 nt, Homo Sapiens
uaaacauucuauauauucuaugccugcucuagaauugaaagacuucagcaguauuaaagcauuu

SEQ ID NO: 481349 - RNA, 64 nt, Homo Sapiens
cuggugccuuguggugcccuugcugugagugacuuugaaagacuugggaaaaaaaugcaauugu

SEQ ID NO: 481350 - RNA, 64 nt, Homo Sapiens
ggacacgaaggaggagugacagcucuggagguucuugaaagaggugggggccccugaugccaag

SEQ ID NO: 481351 - RNA, 64 nt, Homo Sapiens
gagagacuuggcuuccuuaggccccgugaggguuuugaaagagagaccauuauaauaaagcaug

SEQ ID NO: 481352 - RNA, 63 nt, Homo Sapiens
augaaaaaugguuuuguauggauucuucucaguuugaaagacaaggagaagcgugcugaauag

SEQ ID NO: 481353 - RNA, 64 nt, Homo Sapiens
aucauaacuguuaauucucagccaucuuugaagcuugaaagaagagucuuugguauuuuguaaa

SEQ ID NO: 481354 - RNA, 64 nt, Homo Sapiens
ucauuuuaaaacuuuuuuuuaacuaauaauagcuuugaaagaagaggcuuaauuuggggguggu

SEQ ID NO: 481355 - RNA, 64 nt, Homo Sapiens
uuacucacugcugcaaauacuguauauucaggacuugaaagaaauggugaaugccuauggugga

SEQ ID NO: 481356 - RNA, 64 nt, Homo Sapiens
uuguuuuggauauaguauaagcagugucuguguuuugaaagaauagaacacaguuuguagugcc

SEQ ID NO: 481357 - RNA, 64 nt, Homo Sapiens
aaugggucuuggaguauagauuuuuauuaguagcuugaaagagcuuaaucauaugcaguaagua

SEQ ID NO: 481358 - RNA, 64 nt, Homo Sapiens
ggcaucuaucuugaaaguaaucuuguauuggagauugaaagaugcuguaauuuagaaauuaaca

SEQ ID NO: 481359 - RNA, 64 nt, Homo Sapiens
ucuguccaggagaacagaagggaaaaaaagauacuugaaagaaacugaaggaaauuuaaacaaa

SEQ ID NO: 481360 - RNA, 64 nt, Homo Sapiens
aaagaaacugaaggaaauuuaaacaaagaaacacuugaaagaaacuggaaagaaaaauaauuuu

SEQ ID NO: 481361 - RNA, 64 nt, Homo Sapiens
ugugacuuccuuggaaaucaaauguaaaguuuaauugaaagaauguaaagcaaccaaaaagaaa

SEQ ID NO: 481362 - RNA, 64 nt, Homo Sapiens
ggaccaugguuaagcaaccauauagaaagcuuuguugaaagaaaguauggcaucuuguaccacu

SEQ ID NO: 481363 - RNA, 64 nt, Homo Sapiens
cuauuaucuauuacucuugagagcuggcuguccuuugaaagaaagaaguaauguucuuugaaag

SEQ ID NO: 481364 - RNA, 64 nt, Homo Sapiens
cuggcuguccuuugaaagaaagaaguaauguucuuugaaagaaagaaaaaucucuugcuguguc

SEQ ID NO: 481365 - RNA, 64 nt, Homo Sapiens
ugugauuuauuaauuuuaaaacauucagaacuuguugaaagaaaaauuauaucugaaucaagau

SEQ ID NO: 481366 - RNA, 64 nt, Homo Sapiens
gaguucgaaagaagaagcaagcgcuggccuggccuugaaagaaccgaagucuuucccauucacu

SEQ ID NO: 481367 - RNA, 64 nt, Homo Sapiens
cauguucuuagagccucagcgcagaaccaccaccuugaaagaucgggggggggggguguugucu

SEQ ID NO: 481368 - RNA, 64 nt, Homo Sapiens
ugcuuuuuguuuuuguauauguagucauuuuuauuugaaagaugauuuuuugccagauaaaaau

SEQ ID NO: 481369 - RNA, 64 nt, Homo Sapiens
accaguuucagguguuuaguucuuccaaagcacauugaaagagaaguucuuuguuauuuuuguu

SEQ ID NO: 481370 - RNA, 64 nt, Homo Sapiens
uucuccaaaugagaucuaaguaggagauaccagguugaaagacccaacuucauuugaugcuaaa

SEQ ID NO: 481371 - RNA, 64 nt, Homo Sapiens
aauuuugucuuuaccugcauuaaggcuguugcuauugaaagaucuugcagacuaaauuauuuua

SEQ ID NO: 481372 - RNA, 64 nt, Homo Sapiens
guaguaauuuuaggaagaaguuuaaauuaguuacuugaaagaaucucuauuugcagcuuuuaug

SEQ ID NO: 481373 - RNA, 64 nt, Homo Sapiens
auuuuagcagaugguacuuugauggaagaagugcuugaaagagaauaucucaccucuaggauau

SEQ ID NO: 481374 - RNA, 64 nt, Homo Sapiens
acauuuuauuaugauggugcuuuuagagagcacuuugaaagauaauuuagauaauguaacagga

SEQ ID NO: 481375 - RNA, 64 nt, Homo Sapiens
gcugaguugcuguggguauaauugaacaaugaccuugaaagacagugaagauagucuguugaag

SEQ ID NO: 481376 - RNA, 64 nt, Homo Sapiens
augauguuuaaauuaccuuuauguuugaguaaauuugaaagaguggcauagguggguauuuuag

SEQ ID NO: 481377 - RNA, 64 nt, Homo Sapiens
aucaguaacuuugcuugccacggaaaagguguuuuugaaagauguggcuauaaugagaauugca

SEQ ID NO: 481378 - RNA, 64 nt, Homo Sapiens
aaggggcaaguuucacccaaaugccugagacugcuugaaagauauauuuuaaguggugcacuaa

SEQ ID NO: 481379 - RNA, 64 nt, Homo Sapiens
ucauuauaauucugagcaggaaauuuauaagaaauugaaagagcagaagaauuacagcccuguc

SEQ ID NO: 481380 - RNA, 64 nt, Homo Sapiens
uuauuuuugccaguguacuauaccucaguccuauuugaaagaccuaauugaaagaaaaaucaua

SEQ ID NO: 481381 - RNA, 64 nt, Homo Sapiens
uguacuauaccucaguccuauuugaaagaccuaauugaaagaaaaaucauagaaauaaguaaaa

SEQ ID NO: 481382 - RNA, 64 nt, Homo Sapiens
ucagcauuuuaucauuccauggaaggagaaucuuuugaaagaaagcauugccuccuaccagaac

SEQ ID NO: 481383 - RNA, 64 nt, Homo Sapiens
gaucugggaaaccaacauugcgagaguagcuauuuugaaagaauaauucuccagaaguuaacau

SEQ ID NO: 481384 - RNA, 64 nt, Homo Sapiens
aaauuucuucacucucauuugcauaaugaguauuuugaaagaaguacuuacauugaaccuggug

SEQ ID NO: 481385 - RNA, 64 nt, Homo Sapiens
acccuuugguuucauuguguccuuuuuuagauuuuugaaagaaagguuucaaaucuugcaucuu

SEQ ID NO: 481386 - RNA, 64 nt, Homo Sapiens
uaugucuuggaccuaucaaacaaacacuuauuguuugaaagacuucauaacaucugggucuacu

SEQ ID NO: 481387 - RNA, 64 nt, Homo Sapiens
aaaaaauacuuaaauauuugggagaaaggggugauugaaagaaauugucauaugcuccuagaga

SEQ ID NO: 481388 - RNA, 64 nt, Homo Sapiens
uuauuuaacagaucccuaaucaucaaauuguugauugaaagacugaucauaaaccaaugcuggu

SEQ ID NO: 481389 - RNA, 64 nt, Homo Sapiens
guuacauguucgguacuaagucauuuucaggggauugaaagacuauugcuggauuucaugaugc

SEQ ID NO: 481390 - RNA, 64 nt, Homo Sapiens
ggguuggguaaaguagauuaggaacuacgccaaguugaaagaugccaguguuuuaucucagcag

SEQ ID NO: 481391 - RNA, 64 nt, Homo Sapiens
uucuaacaaaaagccaauaagcaauaugcaguuuuugaaagauuuaggcuagcuucuacaaauu

SEQ ID NO: 481392 - RNA, 64 nt, Homo Sapiens
uggucauaugagaagcaggugcgcagagaauuccuugaaagaucugagguuuuuaacaugaagu

SEQ ID NO: 481393 - RNA, 64 nt, Homo Sapiens
caaauuuggcuuauuuuuucugauuuaugaggguuugaaagaaagaauucaccuaaaagauucc

SEQ ID NO: 481394 - RNA, 64 nt, Homo Sapiens
guuuaauaauuugacuuuuuucuaauauuuuaguuugaaagaaaauuucuucccaagcaaugcu

SEQ ID NO: 481395 - RNA, 64 nt, Homo Sapiens
auaaucuuuugcuuuaauugcuacuguacuugcuuugaaagauuaccuacuauuuuaugauaaa

SEQ ID NO: 481396 - RNA, 64 nt, Homo Sapiens
gggggagaggggcaaaugccuccgggacugacacuccaggcagcuuugccuucucuccccuguc

SEQ ID NO: 481397 - RNA, 64 nt, Homo Sapiens
ucuguccccucuccuggggcuuaaguggguugcuuccaggcagaagcagccaaggaccgauucc

SEQ ID NO: 481398 - RNA, 64 nt, Homo Sapiens
gguugcuuccaggcagaagcagccaaggaccgauuccaggcacuuucuguagcaaaugacugug

SEQ ID NO: 481399 - RNA, 64 nt, Homo Sapiens
ggcucagggugaauuacaaguacuuucuccugccuccaggcauuccaggcaccagagccuugag

SEQ ID NO: 481400 - RNA, 64 nt, Homo Sapiens
agagccuugaguacuuucucccaggucuuguggcuccaggcaccgugaagccuagacaaagccg

SEQ ID NO: 481401 - RNA, 64 nt, Homo Sapiens
auccccaggugcugaaauggucuuuccaccucucuccaggcauuuggagguguguggaaggcac

SEQ ID NO: 481402 - RNA, 64 nt, Homo Sapiens
caccugccucugcuugcuuugcagagccaucugcuccaggcaccgugccccacugcugcccucu

SEQ ID NO: 481403 - RNA, 64 nt, Homo Sapiens
caaaucuuuaagugcacgauauaguauuguuaauuccaggcaccauguuguacaacagaucuuu

SEQ ID NO: 481404 - RNA, 64 nt, Homo Sapiens
ggcugaggugggagaaucuccugagccuggaagguccaggcagugagccaagauugugccacca

SEQ ID NO: 481405 - RNA, 64 nt, Homo Sapiens
uaaacucaaaucuuugucacacaaacccaaguuguccaggcaaaaaaaagaaaacaaaagccag

SEQ ID NO: 481406 - RNA, 64 nt, Homo Sapiens
acaaaacuccuuuauucaaacagaaauucauauauccaggcaacuaaccaacagaaguuauuua

SEQ ID NO: 481407 - RNA, 64 nt, Homo Sapiens
aucuggaaguuauuacagggccagcuugccauauuccaggcacacguuaucaaguuugggccua

SEQ ID NO: 481408 - RNA, 64 nt, Homo Sapiens
cucccuuccauaauuccccucauccaccgcccacuccaggcacucacucaaacuugcucuucaa

SEQ ID NO: 481409 - RNA, 64 nt, Homo Sapiens
uuuuuacaaaacgaaugcucuaaauucugaggauuccaggcaggccauccauagagaaauaacu

SEQ ID NO: 481410 - RNA, 64 nt, Homo Sapiens
ggcaggaaguuccaagggauguauguuuauagcauccaggcaaugaucuuuuuuuuuccacgaa

SEQ ID NO: 481411 - RNA, 64 nt, Homo Sapiens
uugccgggcucggggccccaccaugccgugaagauccaggcauccuggagcuggacagcacacg

SEQ ID NO: 481412 - RNA, 64 nt, Homo Sapiens
caaggugaccagccagcugaccagcuggcuggaguccaggcagcggagaugcccuagugguggc

SEQ ID NO: 481413 - RNA, 64 nt, Homo Sapiens
auguugaggagagaugaaaacuggacauugagccuccaggcaccucugauuuucacaucucuac

SEQ ID NO: 481414 - RNA, 64 nt, Homo Sapiens
cucgcccgccggcugcgcuccagcagcuccacguuccaggcagcccaggucagccggacagcuc

SEQ ID NO: 481415 - RNA, 64 nt, Homo Sapiens
acggcaggggugagcagcuucuagcauuucugccuccaggcagggggccuguuuucagguguuc

SEQ ID NO: 481416 - RNA, 64 nt, Homo Sapiens
ccugccccugaagacccucuuuccuaggcugagguccaggcagcuggggcaggaaagugagcca

SEQ ID NO: 481417 - RNA, 64 nt, Homo Sapiens
ggaaccaucuauuguuuuguauacaacucagagcuccaggcagcugcuucccucaugcccugga

SEQ ID NO: 481418 - RNA, 64 nt, Homo Sapiens
cucucuuacuugaacacaaaaugcauauccuauuuccaggcagguugguauuuuuuaauuauga

SEQ ID NO: 481419 - RNA, 64 nt, Homo Sapiens
ccaccaagcucccugucacccagccauggugugguccaggcagggacaucucgguacccuuucu

SEQ ID NO: 481420 - RNA, 64 nt, Homo Sapiens
guccacaaacacuccguggcugagaggcagcggauccaggcagcgaugcugagccaccuccucc

SEQ ID NO: 481421 - RNA, 64 nt, Homo Sapiens
gcugcucucaggaccagagaagggaaaugacuucuccaggcagaggcagaucugagucuagaac

SEQ ID NO: 481422 - RNA, 64 nt, Homo Sapiens
ccaaagcaaaggagaguccugggagcccacaagauccaggcagaaggagauggguuuggggcug

SEQ ID NO: 481423 - RNA, 64 nt, Homo Sapiens
ccccuccagaccucacacuguccuaaaaaugggguccaggcagauuuuauuggggaggggagca

SEQ ID NO: 481424 - RNA, 64 nt, Homo Sapiens
caugggaggcggccucccugcacugugccugccauccaggcagcgguucagagcauuacucucc

SEQ ID NO: 481425 - RNA, 64 nt, Homo Sapiens
acaagggccccuuugccuucucauccucaggaguuccaggcacaugagucaccguccauccaca

SEQ ID NO: 481426 - RNA, 64 nt, Homo Sapiens
caccacugggaggacguggagaggacagugaacuuccaggcaagagcuuccuucuuuugucuca

SEQ ID NO: 481427 - RNA, 64 nt, Homo Sapiens
cagagggaagguuaagguuggcucuggccaggauuccaggcagcagguuggagugacugguggg

SEQ ID NO: 481428 - RNA, 64 nt, Homo Sapiens
gcagaggaaugauggagaaucuaguguagcagccuccaggcaggauucagcacaacacugggga

SEQ ID NO: 481429 - RNA, 64 nt, Homo Sapiens
auggcccuggagagugggccugggugguaccugcuccaggcagggaaacugggggcucgcccuu

SEQ ID NO: 481430 - RNA, 64 nt, Homo Sapiens
ugccacccacccaguuuuauaaucccgcucccucuccaggcaaccccacccaccagccuaggcc

SEQ ID NO: 481431 - RNA, 64 nt, Homo Sapiens
aggcuggaauaaacgcugcuugaugauucugaaauccaggcagcccugucuccuuugcuacaug

SEQ ID NO: 481432 - RNA, 64 nt, Homo Sapiens
uguggacucaaggaguccaggccaggggcugggguccaggcaucagugcaucaguggccugguu

SEQ ID NO: 481433 - RNA, 64 nt, Homo Sapiens
cggagcugugagugccugcaguagucagguuguguccaggcauggagucugagggcugcuuggu

SEQ ID NO: 481434 - RNA, 64 nt, Homo Sapiens
caccugcaaaugaguuaaagaagaggcgugggaauccaggcagugguuuuuccuuucggagccu

SEQ ID NO: 481435 - RNA, 64 nt, Homo Sapiens
uaguccaggggcaccuggcuucagguagguuugauccaggcaucaggccauugcaucuauuuuu

SEQ ID NO: 481436 - RNA, 64 nt, Homo Sapiens
ccugaagauguguugcuacuagucagaucuaagcuccaggcacggaaacuccaguauauuccag

SEQ ID NO: 481437 - RNA, 64 nt, Homo Sapiens
ucccguugccaccuccugcucaggaaguuccuuuuccaggcagggcgauguaugcuuugguuga

SEQ ID NO: 481438 - RNA, 64 nt, Homo Sapiens
augccccgaggagccaaguuugggacauuuacccuccaggcaucuguguccccucuugaagaga

SEQ ID NO: 481439 - RNA, 64 nt, Homo Sapiens
ccccucuugaagagaaaacacacagcuucacacauccaggcauagggggcaagcucuuggggca

SEQ ID NO: 481440 - RNA, 64 nt, Homo Sapiens
cauguccaccauagaauuugucugugguccauccuccaggcaucgcaucccauuucuucugggg

SEQ ID NO: 481441 - RNA, 64 nt, Homo Sapiens
uggaucagaagucgcagcucugugcuccagagccuccaggcaauaauagaccaacgcuaaagcc

SEQ ID NO: 481442 - RNA, 64 nt, Homo Sapiens; identical to SEQ ID NO: 219832

SEQ ID NO: 481443 - RNA, 64 nt, Homo Sapiens; identical to SEQ ID NO: 219833

SEQ ID NO: 481444 - RNA, 64 nt, Homo Sapiens; identical to SEQ ID NO: 219834

SEQ ID NO: 481445 - RNA, 64 nt, Homo Sapiens; identical to SEQ ID NO: 219835

SEQ ID NO: 481446 - RNA, 64 nt, Homo Sapiens; identical to SEQ ID NO: 219836

SEQ ID NO: 481447 - RNA, 64 nt, Homo Sapiens; identical to SEQ ID NO: 219837

SEQ ID NO: 481448 - RNA, 64 nt, Homo Sapiens; identical to SEQ ID NO: 219838

SEQ ID NO: 481449 - RNA, 64 nt, Homo Sapiens; identical to SEQ ID NO: 219839

SEQ ID NO: 481450 - RNA, 61 nt, Homo Sapiens
augaagacacuuguaacauauucaacguccuguacuccaguuuugacuacgagaucagauu

SEQ ID NO: 481451 - RNA, 61 nt, Homo Sapiens
cuacuucaaagaaauugagccagcacuaucuguacuccaacauuaccggaucuggauuggg

SEQ ID NO: 481452 - RNA, 61 nt, Homo Sapiens
cugggugaagaagugagacuauugcgccauuguacuccagcagagguugcagugagccggg

SEQ ID NO: 481453 - RNA, 61 nt, Homo Sapiens
uugggcaacagaguaagacuauagugccauuguacuccagcggaguuugcagugagccgag

SEQ ID NO: 481454 - RNA, 64 nt, Homo Sapiens
cuguuugccuggcaccuagacaccccuguggugaggucagcagggggccgccugugcuuucuua

SEQ ID NO: 481455 - RNA, 64 nt, Homo Sapiens
cuacacgaggcgcugcggcuccaccugaccagugggucagcaggcacggcuggcagccuucucu

SEQ ID NO: 481456 - RNA, 64 nt, Homo Sapiens
cucagccaccaccugugcggcgcuugcuccgaggggucagcaagagcaacugauggcugccacu

SEQ ID NO: 481457 - RNA, 64 nt, Homo Sapiens
agacccagccaagaacuacagggcggcgggcugcggucagcacgugugcucgggacacagcgga

SEQ ID NO: 481458 - RNA, 64 nt, Homo Sapiens
uuucaaauagggucuaacucagcaacucgcuuuaggucagcagccucccugaagaccaaaauua

SEQ ID NO: 481459 - RNA, 64 nt, Homo Sapiens
agccagcuuucccugccucucaucaacugaaugaggucagcaugucuauucagcuucguuuauu

SEQ ID NO: 481460 - RNA, 64 nt, Homo Sapiens
guucuucugccagccugcagguggccacucauguggucagcaggucggcggagagacugggaug

SEQ ID NO: 481461 - RNA, 64 nt, Homo Sapiens
aagauauugauuucauuuagauuucccuccacgaggucagcaaacuaucauguucuuauguaaa

SEQ ID NO: 481462 - RNA, 64 nt, Homo Sapiens
ugugcugcaggccuccccucgaaagacacugggaggucagcauguuccacagguguucagaggg

SEQ ID NO: 481463 - RNA, 64 nt, Homo Sapiens
agaaaaugccagggauccaccacaagauggagauggucagcacaaaccgauucuguuccucuuu

SEQ ID NO: 481464 - RNA, 64 nt, Homo Sapiens
cuuggcauugauacauaggcucaggggucuuaccggucagcaacaagcccgugaucgcucguuu

SEQ ID NO: 481465 - RNA, 64 nt, Homo Sapiens
aaggccuucaccuacgugaaauugcaaccaaaaaggucagcacauuuucucuuguucuugaaac

SEQ ID NO: 481466 - RNA, 64 nt, Homo Sapiens
uggcccccuaucuccugaccugccggggauuuggggucagcaucgaccuauuugcuaggggugc

SEQ ID NO: 481467 - RNA, 64 nt, Homo Sapiens
caggggcgccagaggcccagcagguggcaccgggggucagcauggugccgcgggccacaguggg

SEQ ID NO: 481468 - RNA, 64 nt, Homo Sapiens
gacccacugccccaucuccccugcagggcucaggggucagcaggccacgggaggauccugaccc

SEQ ID NO: 481469 - RNA, 64 nt, Homo Sapiens
ugcaggucagggcagguccuacgcugggcugucuggucagcacggcgugggaucacggguccuu

SEQ ID NO: 481470 - RNA, 64 nt, Homo Sapiens
uccacuaguggcugcucugugcugcagaugagagggucagcauccccuuugcccuaagcagaca

SEQ ID NO: 481471 - RNA, 64 nt, Homo Sapiens
ugugaaaggaagauuaaaaagauuggccucauugggucagcaccagaaggucccaaucacacau

SEQ ID NO: 481472 - RNA, 64 nt, Homo Sapiens
gugggcucggguacaugggaaggcccaaggagguggaguggagacugucaucccaggacacuug

SEQ ID NO: 481473 - RNA, 64 nt, Homo Sapiens
ugauugucagcgggcucacaguggggagcacccuggaguggagaugacacugcacgugggcgua

SEQ ID NO: 481474 - RNA, 64 nt, Homo Sapiens
ugagaaugaguuuauuccuaguucuggacucuugggaguggaaaaccuugguccuuuuguuuuu

SEQ ID NO: 481475 - RNA, 64 nt, Homo Sapiens
uucgucaaccgguacuuuuaguuacaguagccagggaguggaauaaguccccaaacuaccucuu

SEQ ID NO: 481476 - RNA, 64 nt, Homo Sapiens
gcaaauaauugagggauuuaaauuugcaaaaugaggaguggauuaauggcuaagauugcucuaa

SEQ ID NO: 481477 - RNA, 64 nt, Homo Sapiens
aaaaauauacauagaaagagacacugccacccagggaguggaucaggaccuagguguuuggggu

SEQ ID NO: 481478 - RNA, 64 nt, Homo Sapiens
cauacgcgaaggguguguggcccgugaacccugaggaguggaguagagagucucuguacacagc

SEQ ID NO: 481479 - RNA, 64 nt, Homo Sapiens
cauacacgaagggcguguggcccgugaacccugaggaguggaguagagagucucuguacacagc

SEQ ID NO: 481480 - RNA, 64 nt, Homo Sapiens
cauacgcgaaggccauauggcccacgaacccugaggaguggaguugucagcagagucuccaagc

SEQ ID NO: 481481 - RNA, 64 nt, Homo Sapiens
cgcuuguaggguuucaccaguucagagcgcguauggaguggaaaaagacaucacaaucccauua

SEQ ID NO: 481482 - RNA, 64 nt, Homo Sapiens; identical to SEQ ID NO: 481481

SEQ ID NO: 481483 - RNA, 64 nt, Homo Sapiens
cagaauuccuaaacuuuaaaaugguacugucugcggaguggaguauggaugguuaugucaaagu

SEQ ID NO: 481484 - RNA, 64 nt, Homo Sapiens
uagaggcacauacaaaaccuacauucucuaguugggaguggauuuuuaaaguuuuccuuuuauc

SEQ ID NO: 481485 - RNA, 64 nt, Homo Sapiens
cgagccaggaauaacgaaugcuaaggaggaccucggaguggaccuccccugugaugacuggcag

SEQ ID NO: 481486 - RNA, 64 nt, Homo Sapiens
cgagucccuggagcaggcaggcaaggcucuccguggaguggacucacaggcuggccacagcugg

SEQ ID NO: 481487 - RNA, 64 nt, Homo Sapiens
ggagggcguggagggcgugggagcgugggaggcgggaguggaguggaagaagagggagaggugg

SEQ ID NO: 481488 - RNA, 64 nt, Homo Sapiens
gcguggagggcgugggagcgugggaggcgggaguggaguggaagaagagggagagguggagcaa

SEQ ID NO: 481489 - RNA, 64 nt, Homo Sapiens
ugaccagaauauaagggugcugagcuaaggcugaggaguggagacagggcauggggggcagugg

SEQ ID NO: 481490 - RNA, 64 nt, Homo Sapiens
cuugcugcugguaugagacucauguugggagaggggaguggauugagcccuuccucucagcccc

SEQ ID NO: 481491 - RNA, 64 nt, Homo Sapiens
caagauuucagccuggaagagggcaaaguggacgggaguggacaggaguggaugcgauaagaug

SEQ ID NO: 481492 - RNA, 64 nt, Homo Sapiens
gccuggaagagggcaaaguggacgggaguggacaggaguggaugcgauaagaugugguuugaag

SEQ ID NO: 481493 - RNA, 64 nt, Homo Sapiens; identical to SEQ ID NO: 481491

SEQ ID NO: 481494 - RNA, 64 nt, Homo Sapiens; identical to SEQ ID NO: 481492

SEQ ID NO: 481495 - RNA, 64 nt, Homo Sapiens
ucaucaggcuugccaagagggugcccgucagcggggaguggaacucagugccuggaaggcaggu

SEQ ID NO: 481496 - RNA, 64 nt, Homo Sapiens
ggcacuguggugaaauggcuccuggcacuggcugggaguggagaugcagcagcugagggggugc

SEQ ID NO: 481497 - RNA, 64 nt, Homo Sapiens
uuccuccagagccaaaaaggcaauaaacggcuguggaguggaaaaugggaugcgguggguugcc

SEQ ID NO: 481498 - RNA, 64 nt, Homo Sapiens
ggugccucccacugcagccucgccacguggucccggaguggaacggcagacauuuauggacacc

SEQ ID NO: 481499 - RNA, 64 nt, Homo Sapiens
aguguuccaugagccuaggauggugcaguaguguggaguggaugaugcuggggaaauggaacca

SEQ ID NO: 481500 - RNA, 64 nt, Homo Sapiens
agauguguguucugcuccucccuccuucuccuuaggaguggaggggagugggaggcuccccugc

SEQ ID NO: 481501 - RNA, 64 nt, Homo Sapiens
aaauuuuuuuucccuuucuuucaucuuugauuccuggaccuaauguauucauaauucuaucaag

SEQ ID NO: 481502 - RNA, 64 nt, Homo Sapiens
uagauugauuucauuucuaaucagaaccuuaggcuggaccuaaauugugucuacugauuggcua

SEQ ID NO: 481503 - RNA, 64 nt, Homo Sapiens
uauguccauuucucaauuuuucucuuuaaaaauacuaaaucauuauaaaauaaugauuuuucac

SEQ ID NO: 481504 - RNA, 64 nt, Homo Sapiens
agucucggcucuucugaaauucucugccaucucgcuaaaucaucuuuaaucauuucaaaguuaa

SEQ ID NO: 481505 - RNA, 60 nt, Homo Sapiens
gguccucugaugaauucugaagauaaucuccuaaaucacugacguugagaugucaucauc

SEQ ID NO: 481506 - RNA, 64 nt, Homo Sapiens
uaaaaggaauuuaaauuuuguuuauauacauuaacuaaaucaguacaaguuuggggugaaaagg

SEQ ID NO: 481507 - RNA, 64 nt, Homo Sapiens
aaaacaggaaaacacagcuuagcuucuccauugucuaaaucagguuccuauuauuucucuucuu

SEQ ID NO: 481508 - RNA, 64 nt, Homo Sapiens
uaauuauucaauuagguaaguccuaggaugaaaacuaaaucaauuugaaaugauuuguuucucu

SEQ ID NO: 481509 - RNA, 64 nt, Homo Sapiens
ggcggcuugcuguccagccugugugggggccgucccgucccacacuccccugggcauucuugga

SEQ ID NO: 481510 - RNA, 64 nt, Homo Sapiens
ggucguaacccucuguggcuccccugcaucagcaccgucccaccaccaaguucaccagguucac

SEQ ID NO: 481511 - RNA, 64 nt, Homo Sapiens
ccuucccuucccuggcgccccucaggggcuuaguccgucccaccaggagggcuggucuccgcuc

SEQ ID NO: 481512 - RNA, 64 nt, Homo Sapiens
agagcccggggcuacuuccagcucccucccuuggccgucccaauccuggugccucuggcuggag

SEQ ID NO: 481513 - RNA, 64 nt, Homo Sapiens; identical to SEQ ID NO: 169421

SEQ ID NO: 481514 - RNA, 64 nt, Homo Sapiens; identical to SEQ ID NO: 169422

SEQ ID NO: 481515 - RNA, 64 nt, Homo Sapiens; identical to SEQ ID NO: 169423

SEQ ID NO: 481516 - RNA, 64 nt, Homo Sapiens; identical to SEQ ID NO: 169424

SEQ ID NO: 481517 - RNA, 64 nt, Homo Sapiens; identical to SEQ ID NO: 169425

SEQ ID NO: 481518 - RNA, 64 nt, Homo Sapiens; identical to SEQ ID NO: 169426

SEQ ID NO: 481519 - RNA, 64 nt, Homo Sapiens; identical to SEQ ID NO: 169427

SEQ ID NO: 481520 - RNA, 64 nt, Homo Sapiens; identical to SEQ ID NO: 169428

SEQ ID NO: 481521 - RNA, 64 nt, Homo Sapiens; identical to SEQ ID NO: 169429

SEQ ID NO: 481522 - RNA, 64 nt, Homo Sapiens; identical to SEQ ID NO: 169430

SEQ ID NO: 481523 - RNA, 64 nt, Homo Sapiens; identical to SEQ ID NO: 169431

SEQ ID NO: 481524 - RNA, 64 nt, Homo Sapiens; identical to SEQ ID NO: 169432

SEQ ID NO: 481525 - RNA, 64 nt, Homo Sapiens; identical to SEQ ID NO: 169433

SEQ ID NO: 481526 - RNA, 64 nt, Homo Sapiens; identical to SEQ ID NO: 169434

SEQ ID NO: 481527 - RNA, 64 nt, Homo Sapiens; identical to SEQ ID NO: 169435

SEQ ID NO: 481528 - RNA, 64 nt, Homo Sapiens; identical to SEQ ID NO: 169436

SEQ ID NO: 481529 - RNA, 64 nt, Homo Sapiens; identical to SEQ ID NO: 169437

SEQ ID NO: 481530 - RNA, 64 nt, Homo Sapiens; identical to SEQ ID NO: 169438

SEQ ID NO: 481531 - RNA, 64 nt, Homo Sapiens; identical to SEQ ID NO: 169439

SEQ ID NO: 481532 - RNA, 64 nt, Homo Sapiens; identical to SEQ ID NO: 169440

SEQ ID NO: 481533 - RNA, 64 nt, Homo Sapiens; identical to SEQ ID NO: 169441

SEQ ID NO: 481534 - RNA, 64 nt, Homo Sapiens; identical to SEQ ID NO: 169442

SEQ ID NO: 481535 - RNA, 64 nt, Homo Sapiens; identical to SEQ ID NO: 169443

SEQ ID NO: 481536 - RNA, 64 nt, Homo Sapiens; identical to SEQ ID NO: 169442

SEQ ID NO: 481537 - RNA, 64 nt, Homo Sapiens; identical to SEQ ID NO: 169443

SEQ ID NO: 481538 - RNA, 64 nt, Homo Sapiens; identical to SEQ ID NO: 56858

SEQ ID NO: 481539 - RNA, 64 nt, Homo Sapiens; identical to SEQ ID NO: 56859

SEQ ID NO: 481540 - RNA, 64 nt, Homo Sapiens; identical to SEQ ID NO: 56860

SEQ ID NO: 481541 - RNA, 64 nt, Homo Sapiens; identical to SEQ ID NO: 56861

SEQ ID NO: 481542 - RNA, 64 nt, Homo Sapiens; identical to SEQ ID NO: 56862

SEQ ID NO: 481543 - RNA, 64 nt, Homo Sapiens; identical to SEQ ID NO: 56863

SEQ ID NO: 481544 - RNA, 64 nt, Homo Sapiens; identical to SEQ ID NO: 56864

SEQ ID NO: 481545 - RNA, 64 nt, Homo Sapiens; identical to SEQ ID NO: 56865

SEQ ID NO: 481546 - RNA, 64 nt, Homo Sapiens; identical to SEQ ID NO: 56866

SEQ ID NO: 481547 - RNA, 64 nt, Homo Sapiens; identical to SEQ ID NO: 56867

SEQ ID NO: 481548 - RNA, 64 nt, Homo Sapiens; identical to SEQ ID NO: 56868

SEQ ID NO: 481549 - RNA, 64 nt, Homo Sapiens; identical to SEQ ID NO: 56869

SEQ ID NO: 481550 - RNA, 64 nt, Homo Sapiens; identical to SEQ ID NO: 56870

SEQ ID NO: 481551 - RNA, 64 nt, Homo Sapiens; identical to SEQ ID NO: 56871

SEQ ID NO: 481552 - RNA, 64 nt, Homo Sapiens; identical to SEQ ID NO: 56872

SEQ ID NO: 481553 - RNA, 64 nt, Homo Sapiens; identical to SEQ ID NO: 56873

SEQ ID NO: 481554 - RNA, 64 nt, Homo Sapiens; identical to SEQ ID NO: 56874

SEQ ID NO: 481555 - RNA, 64 nt, Homo Sapiens; identical to SEQ ID NO: 56875

SEQ ID NO: 481556 - RNA, 64 nt, Homo Sapiens; identical to SEQ ID NO: 56876

SEQ ID NO: 481557 - RNA, 64 nt, Homo Sapiens; identical to SEQ ID NO: 56877

SEQ ID NO: 481558 - RNA, 64 nt, Homo Sapiens; identical to SEQ ID NO: 56878

SEQ ID NO: 481559 - RNA, 64 nt, Homo Sapiens; identical to SEQ ID NO: 56879

SEQ ID NO: 481560 - RNA, 64 nt, Homo Sapiens; identical to SEQ ID NO: 56880

SEQ ID NO: 481561 - RNA, 64 nt, Homo Sapiens; identical to SEQ ID NO: 56881

SEQ ID NO: 481562 - RNA, 64 nt, Homo Sapiens; identical to SEQ ID NO: 478274

SEQ ID NO: 481563 - RNA, 64 nt, Homo Sapiens; identical to SEQ ID NO: 478275

SEQ ID NO: 481564 - RNA, 64 nt, Homo Sapiens; identical to SEQ ID NO: 478276

SEQ ID NO: 481565 - RNA, 64 nt, Homo Sapiens; identical to SEQ ID NO: 478277

SEQ ID NO: 481566 - RNA, 64 nt, Homo Sapiens; identical to SEQ ID NO: 478278

SEQ ID NO: 481567 - RNA, 64 nt, Homo Sapiens; identical to SEQ ID NO: 478279

SEQ ID NO: 481568 - RNA, 64 nt, Homo Sapiens; identical to SEQ ID NO: 478280

SEQ ID NO: 481569 - RNA, 64 nt, Homo Sapiens; identical to SEQ ID NO: 478281

SEQ ID NO: 481570 - RNA, 64 nt, Homo Sapiens; identical to SEQ ID NO: 478282

SEQ ID NO: 481571 - RNA, 64 nt, Homo Sapiens; identical to SEQ ID NO: 478283

SEQ ID NO: 481572 - RNA, 64 nt, Homo Sapiens; identical to SEQ ID NO: 478284

SEQ ID NO: 481573 - RNA, 64 nt, Homo Sapiens; identical to SEQ ID NO: 478285

SEQ ID NO: 481574 - RNA, 64 nt, Homo Sapiens; identical to SEQ ID NO: 478286

SEQ ID NO: 481575 - RNA, 64 nt, Homo Sapiens; identical to SEQ ID NO: 478287

SEQ ID NO: 481576 - RNA, 64 nt, Homo Sapiens; identical to SEQ ID NO: 478288

SEQ ID NO: 481577 - RNA, 64 nt, Homo Sapiens; identical to SEQ ID NO: 478289

SEQ ID NO: 481578 - RNA, 64 nt, Homo Sapiens; identical to SEQ ID NO: 478290

SEQ ID NO: 481579 - RNA, 64 nt, Homo Sapiens; identical to SEQ ID NO: 478291

SEQ ID NO: 481580 - RNA, 64 nt, Homo Sapiens; identical to SEQ ID NO: 478292

SEQ ID NO: 481581 - RNA, 64 nt, Homo Sapiens; identical to SEQ ID NO: 478293

SEQ ID NO: 481582 - RNA, 64 nt, Homo Sapiens; identical to SEQ ID NO: 478294

SEQ ID NO: 481583 - RNA, 64 nt, Homo Sapiens; identical to SEQ ID NO: 478295

SEQ ID NO: 481584 - RNA, 64 nt, Homo Sapiens; identical to SEQ ID NO: 478296

SEQ ID NO: 481585 - RNA, 64 nt, Homo Sapiens; identical to SEQ ID NO: 478297

SEQ ID NO: 481586 - RNA, 64 nt, Homo Sapiens
agcacuuugggaagccgaggugggcagaucauaaggucgggagauuaagaccauccuggcuaac

SEQ ID NO: 481587 - RNA, 64 nt, Homo Sapiens
ucaugcuguucucuuugcugacacugugacccugggucgggacagaccagcagcaaucugucuu

SEQ ID NO: 481588 - RNA, 64 nt, Homo Sapiens
gggagcaagcaagguuagcaacugugaacagagaggucgggauuugcccugggggaggaagaga

SEQ ID NO: 481589 - RNA, 64 nt, Homo Sapiens
accugggaaguuuguuaaaaucccaaaucuggcuggucgggaauaaguguccuaagucaguggu

SEQ ID NO: 481590 - RNA, 64 nt, Homo Sapiens
cacuuugggaggcugaggcagguggaucucuugaggucgggaguuugagaccagccuggccaac

SEQ ID NO: 481591 - RNA, 64 nt, Homo Sapiens
gcuuuccugagggacucgaaauucuccggcggguggucgggagcuggggcucugaggggcucua

SEQ ID NO: 481592 - RNA, 64 nt, Homo Sapiens
cacuuugggaggcugaggcgggcggaucaccugaggucgggaguucgaggccagccugaccaac

SEQ ID NO: 481593 - RNA, 64 nt, Homo Sapiens
cagcaucaggguuaagaagacuucccuaaucuauggucgggagauucgguauccccccaucuug

SEQ ID NO: 481594 - RNA, 64 nt, Homo Sapiens
gguuugugcuauuccccacuuguaucuggaauagggucgggaaguuuucugucuguuuuaauca

SEQ ID NO: 481595 - RNA, 64 nt, Homo Sapiens
caagggugugucugcucuuuuggcccucauucggggucgggaacuucugcugggggacugaggc

SEQ ID NO: 481596 - RNA, 64 nt, Homo Sapiens
ggugggcgcuagaagaugcacagcccuggccuggggucgggagaaggggcccaacuuucacguc

SEQ ID NO: 481597 - RNA, 64 nt, Homo Sapiens
accugccagugugcagacucccaggagggagcggggucgggaucugaucuguccugggcgggga

SEQ ID NO: 481598 - RNA, 64 nt, Homo Sapiens
cacuuugggaggcugagacagguggaucacuugaggucgggaguucgagaccagccuggccaac

SEQ ID NO: 481599 - RNA, 64 nt, Homo Sapiens
uucgugguccugcgcuucugcucuugcugcugggggucgggacgucuuuggggcccugggcggc

SEQ ID NO: 481600 - RNA, 64 nt, Homo Sapiens
ucgagaccagccugaccaacggcggaucaccugaggucgggagucacuuugggaguccaaggug

SEQ ID NO: 481601 - RNA, 64 nt, Homo Sapiens
ucuagaccagccugaccaacgguggaucaccugaggucgggagugcacuuugggaggcugaggg

SEQ ID NO: 481602 - RNA, 64 nt, Homo Sapiens
cagcagcuuuggagacacaaccccuccugccccaggucgggagacccaagagagguauccucag

SEQ ID NO: 481603 - RNA, 64 nt, Homo Sapiens
caccuugggaggcccaggcaggcagaucaccugaggucgggaguucgagaccagcgugaccaac

SEQ ID NO: 481604 - RNA, 64 nt, Homo Sapiens
aauacgcugagccugugaccagaggaugauggauggucgggauugaggcuguugaccugggcag

SEQ ID NO: 481605 - RNA, 64 nt, Homo Sapiens
ucgagaccagccugaccagcgguggaucaccugaggucgggaguucccagcacuuugggaggug

SEQ ID NO: 481606 - RNA, 64 nt, Homo Sapiens
gugugagugccuagcacaguagaucgguuucucgggucgggauagguaaguuccucugggucgc

SEQ ID NO: 481607 - RNA, 64 nt, Homo Sapiens
uugaguccccgucucuacuaggcggaugaguugaggucgggagucacuuugggaggccgaggcg

SEQ ID NO: 481608 - RNA, 64 nt, Homo Sapiens
cuucaguggagaggccuaacugccacgugcugacggucgggaagaaugaugggcgcauccuguc

SEQ ID NO: 481609 - RNA, 64 nt, Homo Sapiens
ccagugaaacuugaaccgggagggcagggggacgggucgggacagggggggggggggggggcag

SEQ ID NO: 481610 - RNA, 64 nt, Homo Sapiens
gcugugccgggaggcagccaggcgcgaugucaaaggucgggacagcaucacagaccccagcugg

SEQ ID NO: 481611 - RNA, 64 nt, Homo Sapiens
uagcuguagaacacaacuaauaugugaagcauugggucgggaacgccuuuuacuuucgugugga

SEQ ID NO: 481612 - RNA, 64 nt, Homo Sapiens
cugguccuucaugaagagcagacacuuagaggcuggucgggaauggggaggucgccccugggag

SEQ ID NO: 481613 - RNA, 64 nt, Homo Sapiens
aacuuuguguuuuuucggaggggguugguggggaggucgggaugccugggaucccuuccuggag

SEQ ID NO: 481614 - RNA, 64 nt, Homo Sapiens
agaacaagaguguggcaaagaacacccgugcuggggucgggaugagguugaagggucuugguca

SEQ ID NO: 481615 - RNA, 64 nt, Homo Sapiens
uuuuuuuuuuuuuuuuucuggcggugagccagagggucgggagaaacgcugcucgccccacacc

SEQ ID NO: 481616 - RNA, 64 nt, Homo Sapiens
aaguuaauucucacuguacugucugcacuagagaggucgggaggggaauauggaaucuauuucu

SEQ ID NO: 481617 - RNA, 64 nt, Homo Sapiens
uugaaaccagucucaccaggggcggauugcuugaggucgggagucacucugggaggcugaggug

SEQ ID NO: 481618 - RNA, 64 nt, Homo Sapiens
uugagaccagccugaccaacggcggaucaccugaggucgggagucacuuugggaggccgaggug

SEQ ID NO: 481619 - RNA, 64 nt, Homo Sapiens
cacuuugggaggcugagguaggaggaucacgugaggucgggaguucaagaccagccuggccauc

SEQ ID NO: 481620 - RNA, 64 nt, Homo Sapiens
ucgagaccagccuuaccaacggcggaucaccugaggucgggagucacuuugggaggccgagaca

SEQ ID NO: 481621 - RNA, 64 nt, Homo Sapiens
ugagauauuguaaucaaauaacaauauuaguuuaggucgggaacuaagagcuaugugaaaacag

SEQ ID NO: 481622 - RNA, 64 nt, Homo Sapiens
guggagguuugucgggcaccagccagcguagcagggucgggaaaggccaccugucccacuccua

SEQ ID NO: 481623 - RNA, 64 nt, Homo Sapiens
ggacaugccaggccaggccuggaguggggggcagggucgggaagcuuccuacuguacauauugg

SEQ ID NO: 481624 - RNA, 64 nt, Homo Sapiens
ugaguuucuuugcagugagcggacucugcaguggggucgggaaggaggcacagggcagugcagg

SEQ ID NO: 481625 - RNA, 64 nt, Homo Sapiens
guaggagaagcuauaaggaaagacgcaauuggaaggucgggagguuuuccaaagcuucaggaga

SEQ ID NO: 481626 - RNA, 51 nt, Homo Sapiens
cuugguccugccauaccuagaggucgggacagacgacgcuaccugcccaga

SEQ ID NO: 481627 - RNA, 64 nt, Homo Sapiens
cgcuuugggaggccgaggcaggcagaucaccugaggucgggaguuggagacccgccuggcuaac

SEQ ID NO: 481628 - RNA, 64 nt, Homo Sapiens
ucgagaccaaccugaccaacgguggaucaccugaggucgggagucaguuugggaggucgaggua

SEQ ID NO: 481629 - RNA, 64 nt, Homo Sapiens
uugagaccagccuggccaacgguggaucaccugaggucgggagucacuuugggaggcugaggcg

SEQ ID NO: 481630 - RNA, 64 nt, Homo Sapiens
ugaaggcggccggugagcggggcggguucugcugggucgggaagaaaaauaauucugcaaggua

SEQ ID NO: 481631 - RNA, 64 nt, Homo Sapiens
uagauuuuaugauagaauuaucacucauuuuuaaggucgggagucuagaaacuauguucaucag

SEQ ID NO: 481632 - RNA, 64 nt, Homo Sapiens
ucgagaccagccugaccaacgguggaucaccugaggucgggagucgcuuugggaggcagaggca

SEQ ID NO: 481633 - RNA, 64 nt, Homo Sapiens
aaguaaaagacggcuaguugagcagucauagacuggucgggauucuaagaugauccuuuaagca

SEQ ID NO: 481634 - RNA, 64 nt, Homo Sapiens
cccgaggccucacuguauggugcccucuccaaagggucgggaggguagcucuccaggccagagc

SEQ ID NO: 481635 - RNA, 63 nt, Homo Sapiens
uccuccagagcuugagcuagaagucuccaaggaggucgggauggggcuuguagcagaaggcaa

SEQ ID NO: 481636 - RNA, 64 nt, Homo Sapiens
cacugugggaggccgaggcggauggaucaccugaggucgggaauucgagaccagccugaccaac

SEQ ID NO: 481637 - RNA, 64 nt, Homo Sapiens
ucugccuauuaucagugcuggggacaccccugggggucgggacguguacccugggaggccuggc

SEQ ID NO: 481638 - RNA, 64 nt, Homo Sapiens
cacuuugggaggccaaggcgggcggaucaccugaggucgggaguuugagaccagcccgaccaac

SEQ ID NO: 481639 - RNA, 64 nt, Homo Sapiens
guuuuguccaguggccaauagcaagauaugaaccggucgggacauguauggacuuggucugaug

SEQ ID NO: 481640 - RNA, 64 nt, Homo Sapiens
gagacccagcucuccuuucugccgaugacuggguggucgggaggauucucuccccagcuggaag

SEQ ID NO: 481641 - RNA, 64 nt, Homo Sapiens
ggggggaauguuuuggcugggaagaggagaggggggucgggaauccggggaagggcaugggcua

SEQ ID NO: 481642 - RNA, 64 nt, Homo Sapiens
ggggacgcaggccccucuccgcgcaaagggcaugggucgggagacccgcuuuaagggguaaagg

SEQ ID NO: 481643 - RNA, 64 nt, Homo Sapiens
guagaguacauaaucagugccuggccuuggagcaggucgggagauuugccuuccuguuggcugu

SEQ ID NO: 481644 - RNA, 64 nt, Homo Sapiens
acgccccugaguucagagucggggacccaggccaggucgggagcacagccgcuccccaaaccca

SEQ ID NO: 481645 - RNA, 64 nt, Homo Sapiens
cacuuugggaggccaagacgggcggaucuuuugaggucgggaguuggaggccagccuggccaaa

SEQ ID NO: 481646 - RNA, 64 nt, Homo Sapiens
uccgggugccucccucugcuuguacagagcccauggucgggacagugcccuggccuuugccggg

SEQ ID NO: 481647 - RNA, 64 nt, Homo Sapiens
cuuccuccuguuuaguuuuugcuucuaaauccgcggucgggauucagcuggggcagccccucug

SEQ ID NO: 481648 - RNA, 64 nt, Homo Sapiens
cccauguucugggcggcuugggugccagggcuggggucgggacaccgcagggaagacgaagcca

SEQ ID NO: 481649 - RNA, 64 nt, Homo Sapiens
ggagguggccucccgccaacaggcccuggcuccuggucgggaagccacaaggcuugucccccag

SEQ ID NO: 481650 - RNA, 64 nt, Homo Sapiens
uugagaccagccugaccaacgguggaucaccugaggucgggauucacuuugggaggccauggca

SEQ ID NO: 481651 - RNA, 64 nt, Homo Sapiens
ucgagaccagccuggccaacggcagaucgccugaggucgggagucacuuugggagguugaggug

SEQ ID NO: 481652 - RNA, 64 nt, Homo Sapiens
ucgagaccagccugaccaacgguggaucaccugaggucgggagucacuuugggaggcugaggca

SEQ ID NO: 481653 - RNA, 64 nt, Homo Sapiens
cacuuugggaggccgaagcgggcggaucaccugaggucgggaguucgagaccagccugaccaac

SEQ ID NO: 481654 - RNA, 64 nt, Homo Sapiens
ucaagaccagccuggccaacggcggaucacuugaggucgggagucacuuugggaggccgaggug

SEQ ID NO: 481655 - RNA, 64 nt, Homo Sapiens
ugaaaugguauggcugaaguucauuuguuuacagggucgggaaugucuucaguucuugagaguc

SEQ ID NO: 481656 - RNA, 64 nt, Homo Sapiens
uuuuuaaacccaggcagcuucagacauuucaggaggucgggaaagagcccacccucgugguccc

SEQ ID NO: 481657 - RNA, 64 nt, Homo Sapiens
uauauuuacauagaucccagaguguaacaaauaaggucgggacacuaauuuugauuuuaacauu

SEQ ID NO: 481658 - RNA, 64 nt, Homo Sapiens
agcagcucagggcucagggggccacaaggaggcaggucgggaggaagaagagguggaggugugg

SEQ ID NO: 481659 - RNA, 64 nt, Homo Sapiens
ggagcacguggcucagacacagacacgggaaaggggucgggacaccgaggggcggacaccggag

SEQ ID NO: 481660 - RNA, 64 nt, Homo Sapiens
gcagauuagcugcuacuacuuuuaaaagacuuaaggucgggaugccuuuuuuuccauguaagga

SEQ ID NO: 481661 - RNA, 63 nt, Homo Sapiens
cuuuuccacccugggccccaaugccguccuuuccccgcagagacuggucuuggaaacccucag

SEQ ID NO: 481662 - RNA, 63 nt, Homo Sapiens
cccuuaccgguggcucuuccugccugggacccucccgcagagucccacuagccagcggccuca

SEQ ID NO: 481663 - RNA, 63 nt, Homo Sapiens
cagagcagccaggcuggggccccucugucucaacccgcagacccuugacugaaugagagaggc

SEQ ID NO: 481664 - RNA, 63 nt, Homo Sapiens
cacaagcccuacccgugcugcuaguggcccagccccgcagaccgcuggcauggucagguaaca

SEQ ID NO: 481665 - RNA, 63 nt, Homo Sapiens
gggacaugaggggcagcuagacuucacccccuucccgcagaccugccuccagagcaaggagaa

SEQ ID NO: 481666 - RNA, 63 nt, Homo Sapiens
gcaucaccugucaaaaauggaguuccacuucuccccgcagaccuaggucagacuuuuccuuuc

SEQ ID NO: 481667 - RNA, 63 nt, Homo Sapiens
gagaggcaguacgcauccuuacccaggggaggacccgcagauccuguagacuaucugccagca

SEQ ID NO: 481668 - RNA, 63 nt, Homo Sapiens
ggguguugggauacugcagggccaggacugagccccgcagaccuccccagccccuagcccagg

SEQ ID NO: 481669 - RNA, 63 nt, Homo Sapiens
gagaggcccgcccgcccaccgugggcagugccacccgcagaugacacgcgcucuccaccaccc

SEQ ID NO: 481670 - RNA, 63 nt, Homo Sapiens
ccuuggacauccuccucccaagccgaggccuaccccgcagacauggucacagcggaggugugg

SEQ ID NO: 481671 - RNA, 63 nt, Homo Sapiens
ucucagaaucaugcugagagcaggccagagcuacccgcagagucgguagggcguggaaagggg

SEQ ID NO: 481672 - RNA, 63 nt, Homo Sapiens
gucugugugcuguuugaaaaagccuggcucugccccgcagacguggggcccagacaccagccu

SEQ ID NO: 481673 - RNA, 63 nt, Homo Sapiens
cagagcuggcugcuggacgcaccgugcucgcugcccgcagaagcggcacugugcuggcgggcu

SEQ ID NO: 481674 - RNA, 63 nt, Homo Sapiens
ugagacucuguuuaucacuagccuucugucccucccgcagaagacuguuggauugaacaaaau

SEQ ID NO: 481675 - RNA, 63 nt, Homo Sapiens
cccagagaugaugugggcagggggcagagggcacccgcagagugagucccuggcaguagccuu

SEQ ID NO: 481676 - RNA, 63 nt, Homo Sapiens
gacccguucagacacugcguugcgggcuccuuccccgcagaggccggggccucccugacuuug

SEQ ID NO: 481677 - RNA, 63 nt, Homo Sapiens
ugccaguagccuaggugucucaggccccugggccccgcagauggccauuuccggugccugccc

SEQ ID NO: 481678 - RNA, 63 nt, Homo Sapiens
acuuucacacucugccauguagaguccuggcuucccgcagacgcagugugaaguuucuggcau

SEQ ID NO: 481679 - RNA, 63 nt, Homo Sapiens
ccguccacagcccugccucaggaagagcuggagcccgcagaagagcgcugagcugagggacga

SEQ ID NO: 481680 - RNA, 63 nt, Homo Sapiens
augcaccauguccugaaagauggcacccucccacccgcagagugcuuccugcaagcuggcguu

SEQ ID NO: 481681 - RNA, 63 nt, Homo Sapiens
uaaggagguagcucccagcacucaaccaaccuccccgcagagcucccuuccugacccuccgcu

SEQ ID NO: 481682 - RNA, 63 nt, Homo Sapiens
cuccggugcagacgcgcugcuccggcuacaauccccgcagaguccucggagcccggcccgccc

SEQ ID NO: 481683 - RNA, 63 nt, Homo Sapiens
gcuggaauauuaaaauucuuugcagggcugcaucccgcagaugacggaauaguguggggugug

SEQ ID NO: 481684 - RNA, 63 nt, Homo Sapiens
uggggugcuggggcugcauggggagguggccagcccgcagaggauccuggccugagaauugag

SEQ ID NO: 481685 - RNA, 63 nt, Homo Sapiens
gccgcgcgucccucuugugcggccucgucauuccccgcagaccccugggucgcagacgagguc

SEQ ID NO: 481686 - RNA, 63 nt, Homo Sapiens
gguucugcccuguggaguauuuuaacaggaguccccgcagauguuuaucuuccgaggccaccg

SEQ ID NO: 481687 - RNA, 63 nt, Homo Sapiens
uuguuuagcuuaccuuucugcuaggauuggcuucccgcagagggcagggcccauccuaagcag

SEQ ID NO: 481688 - RNA, 63 nt, Homo Sapiens
ugcgcuuguuggcgcgacuguggcucgagcuggcccgcagacacguggguuucaucacucuga

SEQ ID NO: 481689 - RNA, 63 nt, Homo Sapiens
cacugccacagcugugaggggcugggaccauggcccgcagaggagcauugcucaggguggggg

SEQ ID NO: 481690 - RNA, 63 nt, Homo Sapiens
cuaagagggccuauugucaggcaagaaucaaggcccgcagaugccuggcaccaugcacggcca

SEQ ID NO: 481691 - RNA, 63 nt, Homo Sapiens
uuggcacaaaguggagucaaugaaauaugccuacccgcagagcuuacaagccuuuuuaagaua

SEQ ID NO: 481692 - RNA, 63 nt, Homo Sapiens
gcacaggaagaggcaggggcagccugcaggcuccccgcagagacggcguggaccgaggguccc

SEQ ID NO: 481693 - RNA, 63 nt, Homo Sapiens
aaagagagugugacucccuuugaugggugcguucccgcagacccccaggugccccccucaccu

SEQ ID NO: 481694 - RNA, 63 nt, Homo Sapiens
gcacccaaggccgggaaggguagugugggucggcccgcagaugaggccccaggaguggcaccu

SEQ ID NO: 481695 - RNA, 63 nt, Homo Sapiens
ggugcucuccuuugcccuccccuuccugcccuacccgcagaauacccaggguggggaggccac

SEQ ID NO: 481696 - RNA, 63 nt, Homo Sapiens
cugucccaugggcucuggccccauccucuguuacccgcagaucucagcagaaugacucuggaa

SEQ ID NO: 481697 - RNA, 63 nt, Homo Sapiens
agcagguggugguggaaauuccagcaggugggucccgcagaggcccugaggccucacuuuucg

SEQ ID NO: 481698 - RNA, 63 nt, Homo Sapiens
gagacuccccgcccgcccuccucugcccccucccccgcagacagacagacagacggacgggac

SEQ ID NO: 481699 - RNA, 63 nt, Homo Sapiens
uccucuuugagugucugucuacauccccacaugcccgcagagagaagucacgccuuggcccug

SEQ ID NO: 481700 - RNA, 63 nt, Homo Sapiens
ccagcgaugccaggaaacaaguugcuucugcagcccgcagaugccugcccauauauuauacca

SEQ ID NO: 481701 - RNA, 63 nt, Homo Sapiens
ggcuuccccaagcucuguuuucccuagggcugccccgcagaggcuucuggccccucugaggau

SEQ ID NO: 481702 - RNA, 63 nt, Homo Sapiens
gaucaugucccauccaguccagugaauccacgacccgcagaccuguccccccgcaacagcuua

SEQ ID NO: 481703 - RNA, 63 nt, Homo Sapiens
ggcaugccccccagcuacuguaugcccccgacccccgcagaggcagaaugaacccauagggag

SEQ ID NO: 481704 - RNA, 63 nt, Homo Sapiens
ccgcaccccccggcccugccggaggcaccgaugcccgcagagcacgcacgaccccaagcccgc

SEQ ID NO: 481705 - RNA, 63 nt, Homo Sapiens
cucccggcgccuugagacccgggaccuucagggcccgcagacccgacuuguggcucggaccca

SEQ ID NO: 481706 - RNA, 63 nt, Homo Sapiens
aggaaauccguaggcaggagagcucugcagggccccgcagaugccucauuucauccuugcaac

SEQ ID NO: 481707 - RNA, 63 nt, Homo Sapiens
guccuccggauaaacagcaugaaucgucacgaccccgcagacugaaaaacuucaagaagaaaa

SEQ ID NO: 481708 - RNA, 63 nt, Homo Sapiens
agcaaagaggcucuuuagaggcagcgggggaggcccgcagagcgcgccccuagccgguuccug

SEQ ID NO: 481709 - RNA, 63 nt, Homo Sapiens
cacugcauucccucccagccauaccaccccucacccgcagagucugucuugcugccggccuug

SEQ ID NO: 481710 - RNA, 63 nt, Homo Sapiens
cuuccaugcugagugaugcucagggaagugaugcccgcagaaggcgucugggccuaaggaucc

SEQ ID NO: 481711 - RNA, 61 nt, Homo Sapiens
uggcugcugcgugugaacugcugccuaugcccccgcagaacgcucaggaccaaccgcauag

SEQ ID NO: 481712 - RNA, 63 nt, Homo Sapiens
cccugaccucugcccccaggaggauggacugggcccgcagauggaaggucaggaggcaagugg

SEQ ID NO: 481713 - RNA, 63 nt, Homo Sapiens
ggggcacacagacuguggcagagcugcgcccaucccgcagaggccccuguccaccuggagacc

SEQ ID NO: 481714 - RNA, 63 nt, Homo Sapiens
cccuggcaucucaagagggaaccgccgccagcgcccgcagacaugggccucggcccuucccgc

SEQ ID NO: 481715 - RNA, 63 nt, Homo Sapiens
uccaggguggccaaguggauuguccagcgcagccccgcagagccccuccuaccccugggcagg

SEQ ID NO: 481716 - RNA, 63 nt, Homo Sapiens
gccagggaccgccugcugccuguccaccauggccccgcagaacggggugcagaucuccuggcg

SEQ ID NO: 481717 - RNA, 63 nt, Homo Sapiens
ucucugagccgcggacaugcccucgcauugcuucccgcagagugcagagacaggaagcuggag

SEQ ID NO: 481718 - RNA, 63 nt, Homo Sapiens
cugaggauggagccgcccccagccgacuccaagcccgcagagggcagacgccacccuggacug

SEQ ID NO: 481719 - RNA, 63 nt, Homo Sapiens
ggaggauuccagaacagcagcacugagcucccacccgcagagccucuggacggccuuggcaac

SEQ ID NO: 481720 - RNA, 63 nt, Homo Sapiens
caaggacgccuaccccgaaaccggccccgacgccccgcagaggcccgccugaagccagcccgg

SEQ ID NO: 481721 - RNA, 61 nt, Homo Sapiens
ucacuguggcaaagccucaccacagucgguccccgcagaggucacccaguggcucugcuga

SEQ ID NO: 481722 - RNA, 63 nt, Homo Sapiens
caaaccacucaggacaguacccguggcacugggcccgcagaagcaagggaugacuugguucuu

SEQ ID NO: 481723 - RNA, 63 nt, Homo Sapiens
agaggcccccgagguguguguaggaggcggaggcccgcagagcacagagcaggagaagggcuu

SEQ ID NO: 481724 - RNA, 63 nt, Homo Sapiens
cgaguuggggggaggggguguggcaacgugccccccgcagaggccacgcauguuugaccaaag

SEQ ID NO: 481725 - RNA, 63 nt, Homo Sapiens
cugagucuuuuggaggcuccaagccucaaagugcccgcagagcccaccuugaggguuuugcua

SEQ ID NO: 481726 - RNA, 63 nt, Homo Sapiens
auaguguagauggacauuugccacaacacacugcccgcagaaauggacuuaccgugaagccaa

SEQ ID NO: 481727 - RNA, 63 nt, Homo Sapiens
gcccacggacaguguccacuugucccagccagccccgcagagcgguggcgcuucucagccggc

SEQ ID NO: 481728 - RNA, 63 nt, Homo Sapiens
aaagguggaaacacgugccuggaggaggcgaagcccgcagagcuuuccaggagccccaggccc

SEQ ID NO: 481729 - RNA, 63 nt, Homo Sapiens
guggccauguggcacgcugcgggcagcaggcagcccgcagaugagggccaaggacaauuggga

SEQ ID NO: 481730 - RNA, 63 nt, Homo Sapiens
cuccuucccauccucugaaagccaagccccacacccgcagaccgccccuccuucugcugccug

SEQ ID NO: 481731 - RNA, 63 nt, Homo Sapiens
ggggugcagaucaggcgccggcaaugcaucacucccgcagaggcgguacccggccgccguucu

SEQ ID NO: 481732 - RNA, 63 nt, Homo Sapiens
acugaacagaacgucgcugauggagaaagggcucccgcagaaggaacggccuguaccgugcgc

SEQ ID NO: 481733 - RNA, 63 nt, Homo Sapiens
guguaugcgagcgcccgccucccagccccggugcccgcagaagacgcuuuuccccagcagguc

SEQ ID NO: 481734 - RNA, 63 nt, Homo Sapiens
ggcccucgggaagccuuggacagaacccuccaccccgcagaccaggcgucguguguguguggg

SEQ ID NO: 481735 - RNA, 63 nt, Homo Sapiens
uacgggggcgcggcagggguccccggccccucccccgcagaggucaaugccaacgaacaaacg

SEQ ID NO: 481736 - RNA, 63 nt, Homo Sapiens
cgcccccuccgccgccccuuccccagcccugcccccgcagacucccccugccgccaagacuuc

SEQ ID NO: 481737 - RNA, 63 nt, Homo Sapiens
cgguuucggggcucccccuuccucucccucccucccgcagaaggggguuuuaggggccugggc

SEQ ID NO: 481738 - RNA, 63 nt, Homo Sapiens
ggcugggccccuccaggagucacagaugaggcccccgcagagacuggugaguggugacccugu

SEQ ID NO: 481739 - RNA, 63 nt, Homo Sapiens
cuuaaaaaaaucacccacaagacccccaagggacccgcagaccgguccggaagggugaucauc

SEQ ID NO: 481740 - RNA, 56 nt, Homo Sapiens
ucuggauuaggucucuguugcuccugcccgcagaccacucccuguccuuuucauag

SEQ ID NO: 481741 - RNA, 63 nt, Homo Sapiens
aaaacauggcugccaaagugggugugagagggucccgcagaaguggaggucagaguggaagca

SEQ ID NO: 481742 - RNA, 63 nt, Homo Sapiens
cuggcuccuccgacuacaccucucccggcuccgcccgcagacuccgggagcugauggccccuc

SEQ ID NO: 481743 - RNA, 63 nt, Homo Sapiens
cccauccccccucagauccagacaugccccucccccgcagacacaccccaaggcagcccaacc

SEQ ID NO: 481744 - RNA, 63 nt, Homo Sapiens
cuccacuccaccuccacccacuguccgccucugcccgcagagcccacgcccgacuagcaggca

SEQ ID NO: 481745 - RNA, 63 nt, Homo Sapiens
gugugaggggcuuggccugcgccccgccagcugcccgcagaggugcagccucgaggaaucuga

SEQ ID NO: 481746 - RNA, 63 nt, Homo Sapiens
acuaggcguggaccugcccauggugccugucagcccgcagagcccaucuacgcccaacacaga

SEQ ID NO: 481747 - RNA, 63 nt, Homo Sapiens
guuaaugaauggucugcccuauucuuuguucaccccgcagauaugggacaucugaggauuggg

SEQ ID NO: 481748 - RNA, 63 nt, Homo Sapiens
gauuaacggugcuaaccccgucugcuccucccucccgcagagacuggggccuggacuggacau

SEQ ID NO: 481749 - RNA, 63 nt, Homo Sapiens
gagcugcgcuuggggguccucucugggucgugccccgcagacuccccguccucugcugcuggc

SEQ ID NO: 481750 - RNA, 60 nt, Homo Sapiens
gcagagaucggcccuacuagaugcagagaccccgcagagcugcauugacuaccagauuua

SEQ ID NO: 481751 - RNA, 63 nt, Homo Sapiens
cccacgccucggggcccccgccgccccuccggacccgcagagcuggggacauggcaugcccug

SEQ ID NO: 481752 - RNA, 63 nt, Homo Sapiens
ugcccuuacugaggugacagggcugucccggggcccgcagagggugagcuagcccuuagagaa

SEQ ID NO: 481753 - RNA, 63 nt, Homo Sapiens
cuacagcugccaggucaugcgagcaguggaggucccgcagaaggcuaccugagccugacgccc

SEQ ID NO: 481754 - RNA, 63 nt, Homo Sapiens
cgggcacuucucagcauggcgccccuaccagaccccgcagaccgccccucuccaauaggugug

SEQ ID NO: 481755 - RNA, 63 nt, Homo Sapiens
gccuaaguauguggagcucugcuuuggcacugccccgcagaggccacgccuauuuauucuguu

SEQ ID NO: 481756 - RNA, 63 nt, Homo Sapiens
uggacagcgacacgcaggggguggcaggggagccccgcagagccuguccccaaauuggccucg

SEQ ID NO: 481757 - RNA, 63 nt, Homo Sapiens
ugagggauguggucagcagucucaugccauuuucccgcagagcuuccugaccauccucagaau

SEQ ID NO: 481758 - RNA, 64 nt, Homo Sapiens
aauuuuuaaaguugaaaagcaucccaguuaaacuagaugugauaguuaaaccagaugaaagcau

SEQ ID NO: 481759 - RNA, 64 nt, Homo Sapiens
cauaucuauaaugcccuucuauaugugcuaccauagaugugacauuuuugaccuuaauaucguc

SEQ ID NO: 481760 - RNA, 64 nt, Homo Sapiens
cugagcgacauggcgcccaaccuggcaggagagcagaugugauuagagaauccucgaggugcuu

SEQ ID NO: 481761 - RNA, 64 nt, Homo Sapiens
cauggugcccggcuacucuuagugcugggauuacagaugugagcugcccaccucggccucccaa

SEQ ID NO: 481762 - RNA, 50 nt, Homo Sapiens
agaauuccuucauggugugaagaugugaauaauugcacaugguuuugaga

SEQ ID NO: 481763 - RNA, 64 nt, Homo Sapiens
guugugggaggggaaagaggaaacagagcuagucagaugugaauuguaucuguuguaauaaaca

SEQ ID NO: 481764 - RNA, 64 nt, Homo Sapiens
gaagcucuuaacggcuuggacagucagaacugcaagaugugaaucccuuagggcauacuacugu

SEQ ID NO: 481765 - RNA, 64 nt, Homo Sapiens
ucgauuucacuuuauaacuagccaucugagucacagaugugaagagagcuacuucgugacacug

SEQ ID NO: 481766 - RNA, 64 nt, Homo Sapiens
acugauuuccagccccaccaugugugcuguuuucagaugugauugagggguguucugcccugcc

SEQ ID NO: 481767 - RNA, 64 nt, Homo Sapiens
ucugcccugccuccacugucacagccuuuaauaaagaugugaaucuugaaagccugaugcucca

SEQ ID NO: 481768 - RNA, 64 nt, Homo Sapiens
aucuacacacugggagaugcugucuucagaacuuagaugugaaagcucuuccacgcuuagauca

SEQ ID NO: 481769 - RNA, 64 nt, Homo Sapiens
ugcacucagaagaucaguggccuacaggauuuccagaugugacucaauuuugcccaugacauug

SEQ ID NO: 481770 - RNA, 64 nt, Homo Sapiens
auauaagauaauucauauuggagagaaauucuacagaugugaagaauguggcaaaggcuuuaau

SEQ ID NO: 481771 - RNA, 64 nt, Homo Sapiens
aauucuuacugcagagaaacucuacaaaccaguaagaugugacagugcuucugacaacaucuca

SEQ ID NO: 481772 - RNA, 64 nt, Homo Sapiens
guaaggggaaagccaaagcuaaauguggccaaagagaugugagguuaacaugccaagagaugug

SEQ ID NO: 481773 - RNA, 64 nt, Homo Sapiens
uguggccaaagagaugugaguuuaacaugccaagagaugugaaaugaaaagaaugaauugagag

SEQ ID NO: 481774 - RNA, 63 nt, Homo Sapiens
uuuauaauauaagcaacauuuagcuaguuguuuugaagacacccaguacuaaguaauauuguu

SEQ ID NO: 481775 - RNA, 63 nt, Homo Sapiens
gucugaaguuucuuuggaaacucugcaaugcacugaagacaucuguaauaugauguuaccaaa

SEQ ID NO: 481776 - RNA, 63 nt, Homo Sapiens
aacacucaccugggacguuggcacagauaucuuugaagacacagaguuucuguggauauauuu

SEQ ID NO: 481777 - RNA, 63 nt, Homo Sapiens
ccauaucuaugauaucgcauagcaucuuguaacugaagacacaaauguauauaauucaaacag

SEQ ID NO: 481778 - RNA, 63 nt, Homo Sapiens
uaguggaggagggagaaccauauuuauuuauaaugaagacaucuaagaucccuaugaugaaug

SEQ ID NO: 481779 - RNA, 63 nt, Homo Sapiens
uguucuguuggcaagccacagugcucccuugacugaagacauuuccagguagauuucucagcc

SEQ ID NO: 481780 - RNA, 63 nt, Homo Sapiens
guguuuuaaagaaaugcagggaggcaauguuucugaagacauuuucuguuuauaagagaguag

SEQ ID NO: 481781 - RNA, 63 nt, Homo Sapiens
uucuauuaaauaucaauuaguaaguauagcuaaugaagacauauaaugaaaguaauuuuaugc

SEQ ID NO: 481782 - RNA, 63 nt, Homo Sapiens
ugagauccuauccaagauuucugaguuagccaaugaagacaucagucucuaagauugagaggu

SEQ ID NO: 481783 - RNA, 63 nt, Homo Sapiens
agaugaugagaaaagcucacgacagaucugaagugaagacaggggaauccccucacagugggc

SEQ ID NO: 481784 - RNA, 63 nt, Homo Sapiens
ugccugcacucccuggccuugcccgucgugugcugaagacauguuucaagaaccgcauuucgg

SEQ ID NO: 481785 - RNA, 63 nt, Homo Sapiens
ccggagggaggcacuagucaccgacagcggccuugaagacagagcaaagcgcccacccagguc

SEQ ID NO: 481786 - RNA, 63 nt, Homo Sapiens
uaaaaaaagauauaguauuaaugccuguauuuaugaagacagggccauugcacugcugcuaug

SEQ ID NO: 481787 - RNA, 63 nt, Homo Sapiens
ucagaggccaaaucuguaaaaucaaaaugagguugaagacaauuagugaaaguaauguuauag

SEQ ID NO: 481788 - RNA, 63 nt, Homo Sapiens
uaucaaccacguggagaaaaacuuagcagcaacugaagacaauuaaaugaaauuugcaaaauc

SEQ ID NO: 481789 - RNA, 63 nt, Homo Sapiens
gauauugacacugucccucugccguccuucuaaugaagacaauuguucucacaguguggggca

SEQ ID NO: 481790 - RNA, 63 nt, Homo Sapiens
aaggaauuguggauggaagacaagcagaaaagcugaagacaauaguuccucagacagaccuca

SEQ ID NO: 481791 - RNA, 63 nt, Homo Sapiens
gauggcucugcacgaaggagaaccacgcauuuaugaagacauccaggacuacgaggcggccaa

SEQ ID NO: 481792 - RNA, 63 nt, Homo Sapiens
gcucuaucagccccuguaccccacacugcccucugaagacaacacaggcuccugcuuccaccu

SEQ ID NO: 481793 - RNA, 63 nt, Homo Sapiens
uaccucacugggaauguguuuugaaaaugaauuugaagacaagccaacaaacccugcacucca

SEQ ID NO: 481794 - RNA, 63 nt, Homo Sapiens
caguaugggguuucccucuggaaaaagaaaaucugaagacauuacaguugccuauugccucuu

SEQ ID NO: 481795 - RNA, 63 nt, Homo Sapiens
caguugcacaaauggguaacuaucaggaauaucugaagacauuggcuucuccacugcgagaga

SEQ ID NO: 481796 - RNA, 64 nt, Homo Sapiens
ugaauaaaacuuuaccaaggcuaacuguuacaccaaaucuuaaguccuggaaggaacugggcau

SEQ ID NO: 481797 - RNA, 64 nt, Homo Sapiens
uauauuuuaaaucauaaauaccacaauguaaagcaaaucuuagcuucuaaaauguaaauauuug

SEQ ID NO: 481798 - RNA, 64 nt, Homo Sapiens
gcuggugcugaaaucucuuccaaacugaauguacaaaucuuagugcucacaagucaauugcaaa

SEQ ID NO: 481799 - RNA, 64 nt, Homo Sapiens
agaaacuggguuuaugcacuuaaaauaaaaugcuaaaucuuaaauccaaacuaagauaagagac

SEQ ID NO: 481800 - RNA, 64 nt, Homo Sapiens
uagaguauauucugaaaauuuaggaaugaggaagaaaucuuaauacuuccuuccuuaacauaca

SEQ ID NO: 481801 - RNA, 64 nt, Homo Sapiens
gaaaacuaugucaguaacauguugcuuuguauaaaaaucuuauuuauaaaugugaagcuuuuug

SEQ ID NO: 481802 - RNA, 64 nt, Homo Sapiens
uuuuugcaauaacaaacauugacaaaauuguaggaaaucuuacagggcuagauugggauuugaa

SEQ ID NO: 481803 - RNA, 64 nt, Homo Sapiens
uaaucaugcuuuugggcuuccagugcauuauaagaaaucuuaguauguuaugcugugaauuauu

SEQ ID NO: 481804 - RNA, 64 nt, Homo Sapiens
auuucuaaaaauaagaauaaaaagaauggcguacaaaucuuauuuuauuuaaaugugugaucag

SEQ ID NO: 481805 - RNA, 64 nt, Homo Sapiens
uaugugcuauuagcauuguuucauauugaggacaaaaucuuaaacuggcaaacugaguugccgg

SEQ ID NO: 481806 - RNA, 64 nt, Homo Sapiens
aguugaauuguuguaaggacugaaguuaaaucuuaaaucuuauuaauguucugauacauuagga

SEQ ID NO: 481807 - RNA, 64 nt, Homo Sapiens
ucuuauuaguugaauuguugauuaggaugaaguuaaaucuuaaauuuuuuuaauguucugauac

SEQ ID NO: 481808 - RNA, 64 nt, Homo Sapiens
uauuuuuccuuuaaauuuuaaucuuauaauauagaaaucuuauguaaaugaaauuuugucaugu

SEQ ID NO: 481809 - RNA, 64 nt, Homo Sapiens
ucaaaugaauuauuuucuucuuguuaaauaaauuaaaucuuacuuucuuuuaaugaccaaccuu

SEQ ID NO: 481810 - RNA, 64 nt, Homo Sapiens
cauaauucagcauaagaaaauucacaccagagccaaaucuuacaaauguagcaguugugaaaga

SEQ ID NO: 481811 - RNA, 64 nt, Homo Sapiens
ucuuaaucgacuccugcaaaucuauaccagugagaaaucuuacaaauguauugaauguggcaaa

SEQ ID NO: 481812 - RNA, 64 nt, Homo Sapiens
uguagugcaaacuuuaagcaccuuaaaacauuuaaaaucuuauuacaggugauagagauagaua

SEQ ID NO: 481813 - RNA, 64 nt, Homo Sapiens
guucaagauauauucuuuuugguuuuaaaaugcaaaaucuuauuggcuguucuguugaauguca

SEQ ID NO: 481814 - RNA, 64 nt, Homo Sapiens
agauuucaaagaauuacugguuuuaccaugacucaaaucuuaagaucuguuucuacuauucagu

SEQ ID NO: 481815 - RNA, 64 nt, Homo Sapiens
cagaauuuucucauauacaguauucagugcacagaaaucuuaugauuggcucaaguacaguaag

SEQ ID NO: 481816 - RNA, 64 nt, Homo Sapiens
uuaaaauuuuuaguuuuggauuguauacuaaugaaaaucuuaaugauguuuuugauuuuuauau

SEQ ID NO: 481817 - RNA, 64 nt, Homo Sapiens
gauguuuuugauuuuuauauacuuauuuuaaagaaaaucuuauauaguacauuuuacaaaaauu

SEQ ID NO: 481818 - RNA, 64 nt, Homo Sapiens
uugaaaagaagauauugcauuuuuaagaguuuaaaaaucuuaugagugagaaauauuaaaaaaa

SEQ ID NO: 481819 - RNA, 64 nt, Homo Sapiens
aguuuaaaaaucuuaugagugagaaauauuaaaaaaaucuuauuuucaccucuuuagaagaaau

SEQ ID NO: 481820 - RNA, 64 nt, Homo Sapiens
gauuguacagggagaaauuacuuguuaaaaaucaaaaucuuacucauguaauuggacauguaaa

SEQ ID NO: 481821 - RNA, 64 nt, Homo Sapiens
uauauugaucuaguugaucgacaguugucaaaaaaaaucuuacagugucauuuuauaguacuuu

SEQ ID NO: 481822 - RNA, 64 nt, Homo Sapiens
caguuaacaaauuauuuguaauguauuuuuuuagaaaucuuaaaauugccuuugcacugaagua

SEQ ID NO: 481823 - RNA, 64 nt, Homo Sapiens
aaugucaacuuugagcacuuuguugaguuuugaaaaaucuuauuuguugcugcacagguuaaua

SEQ ID NO: 481824 - RNA, 64 nt, Homo Sapiens
acauauauugauucaugucauauguagcuuuaagaaaucuuaacgcauuuuuguuuguuuuuua

SEQ ID NO: 481825 - RNA, 64 nt, Homo Sapiens
aaaauauuccagaguucuugaguuuagauucacaaaaucuuaccuaaguuuuuauuuugaaaua

SEQ ID NO: 481826 - RNA, 64 nt, Homo Sapiens
aaugucaucagugugguaaguccaugcuggacagaaaucuuacaccucaauagacaucagagaa

SEQ ID NO: 481827 - RNA, 64 nt, Homo Sapiens
aaugugaagacugugacaaauucauacugcagagaaaucuuacaccuugcaagucaucauaguc

SEQ ID NO: 481828 - RNA, 64 nt, Homo Sapiens
aaugucaucaguguggaagguccaugcuggacagaaaucuuacaccucauuagacaucagagaa

SEQ ID NO: 481829 - RNA, 64 nt, Homo Sapiens
aacgugaacaaugugacaaauucauacugcauagaaaucuuacaccuugcaagucaucauagac

SEQ ID NO: 481830 - RNA, 64 nt, Homo Sapiens
gaaaguuaauuucacauucuuugggguauaaugaaaaucuuacuacuguggcuuaggauacuua

SEQ ID NO: 481831 - RNA, 64 nt, Homo Sapiens
gugcauccuuacacaccuuccaaugugaacuuugaaaucuuauugaaagccuacuauugcguuu

SEQ ID NO: 481832 - RNA, 64 nt, Homo Sapiens
aaauaaauccacccauguuauuaaguuugcacucaaaucuuaagagcuuuguuuguucuuguuu

SEQ ID NO: 481833 - RNA, 64 nt, Homo Sapiens
acuguuauucuuugcacuuucuguaaaaugcaaaaaaucuuaauucacacuugaaccauaguua

SEQ ID NO: 481834 - RNA, 64 nt, Homo Sapiens; identical to SEQ ID NO: 216241

SEQ ID NO: 481835 - RNA, 64 nt, Homo Sapiens; identical to SEQ ID NO: 216242

SEQ ID NO: 481836 - RNA, 64 nt, Homo Sapiens; identical to SEQ ID NO: 216243

SEQ ID NO: 481837 - RNA, 64 nt, Homo Sapiens; identical to SEQ ID NO: 216244

SEQ ID NO: 481838 - RNA, 64 nt, Homo Sapiens
agcaccacccgccuccccgagccccucccucacuggcacgcaugcaguacaggaggguggcgag

SEQ ID NO: 481839 - RNA, 64 nt, Homo Sapiens
cagccacagccacacgugugugccacugucccuuggcacgcacaccgcugucacaauggcacac

SEQ ID NO: 481840 - RNA, 64 nt, Homo Sapiens
ugccuguuggcugcugcggcggcggccucucgacggcacgcacuccucaaggauacagggagcc

SEQ ID NO: 481841 - RNA, 64 nt, Homo Sapiens
acugcuucccacuggggccgaagugcucccuggaggcacgcacccacggccccggguccaggag

SEQ ID NO: 481842 - RNA, 64 nt, Homo Sapiens; identical to SEQ ID NO: 361028

SEQ ID NO: 481843 - RNA, 64 nt, Homo Sapiens; identical to SEQ ID NO: 361029

SEQ ID NO: 481844 - RNA, 64 nt, Homo Sapiens
gucguagagucucaccaucuccaaggauuggucuugagaacacuguucagugacggccaugcag

SEQ ID NO: 481845 - RNA, 64 nt, Homo Sapiens
cgcucuuccugcggguucuuggcgagacacagcuugagaacagaagggcgucgggggaaccugc

SEQ ID NO: 481846 - RNA, 64 nt, Homo Sapiens
gaguagcugcccuuucucagggcagaugaugcuuugagaacauacuuuggccauuacccccagc

SEQ ID NO: 481847 - RNA, 64 nt, Homo Sapiens
gaaguauauauaucauagcaaauaagucaucugaugagaacaagcuauuugggcacaacacauc

SEQ ID NO: 481848 - RNA, 64 nt, Homo Sapiens
gcaucugcauucauagccacgaacaguuauucuaugagaacacuauuugucuguaaaagugcag

SEQ ID NO: 481849 - RNA, 64 nt, Homo Sapiens
uuucuauaugggugauuuugguaggaaaaaucguugagaacacuuucaggccccuauauuuucu

SEQ ID NO: 481850 - RNA, 64 nt, Homo Sapiens
uuggacaucaugacgaaaccugagaacaggauuuugagaacagcguuguuugagcccaggaauu

SEQ ID NO: 481851 - RNA, 64 nt, Homo Sapiens
auuuugagaacagcuuggacugagcccaggaauuugagaacagggcugaggcaagcagguuguu

SEQ ID NO: 481852 - RNA, 64 nt, Homo Sapiens
cacaccaccaaaugucacacauuauuuuauaaauugagaacaacuuucuccuuugaagucauuu

SEQ ID NO: 481853 - RNA, 64 nt, Homo Sapiens
gcacacagcucccuuuucaauugaacuuuggcaaugagaacacaaacagugguguugcauugaa

SEQ ID NO: 481854 - RNA, 64 nt, Homo Sapiens
ucuccaucuagagcccaaugaaggaagcuucaaaugagaacaugauggaaucaguaaccauuca

SEQ ID NO: 481855 - RNA, 64 nt, Homo Sapiens
aaaauaucagacauguuuuggaaaagucuuaauuugagaacaccaaaggaaacuaccccagaau

SEQ ID NO: 481856 - RNA, 64 nt, Homo Sapiens
ugauguuugguuuucuguuccucucccuuauacgugagaacaugcauggguacucaauguuuag

SEQ ID NO: 481857 - RNA, 64 nt, Homo Sapiens
ggaaugguggaaagguagaaagccauauuggaacugagaacacagaagacauauggauguuagc

SEQ ID NO: 481858 - RNA, 64 nt, Homo Sapiens
gauuccacuucuccuacauuuaauuauuuuuaauugagaacaacucaugaucacaauucauaaa

SEQ ID NO: 481859 - RNA, 64 nt, Homo Sapiens
ugucugcuuauaauauucacugaucugcaguuuaugagaacacauuuucacaguuauguuucuu

SEQ ID NO: 481860 - RNA, 64 nt, Homo Sapiens
agauauuuuaccaugaagagauugcacuuauccuugagaacagucuaaauauaaaugaagauau

SEQ ID NO: 481861 - RNA, 64 nt, Homo Sapiens
agauauuuuaccaugaagagauugcacuuauccuugagaacagucuaaugauacuuuuuuuacu

SEQ ID NO: 481862 - RNA, 64 nt, Homo Sapiens
aagcaauaaucuuuguuacuuaaccuaucagcccugagaacacaaauugucugugugaggugcu

SEQ ID NO: 481863 - RNA, 64 nt, Homo Sapiens
gugucuaucugggugugggcugccccccaccagcugagaacaaagcagggggcaaggggccagg

SEQ ID NO: 481864 - RNA, 64 nt, Homo Sapiens
cuugcucuugccauguucuuuaugguuuccuuccugagaacaauuuuuacauaaaugccauauu

SEQ ID NO: 481865 - RNA, 64 nt, Homo Sapiens
caagacuuuaaauucccauaugacuggggugcacugagaacagggaggcugacaugucaguaac

SEQ ID NO: 481866 - RNA, 64 nt, Homo Sapiens
agcauuaaauugguuuuucuaugcugugaaaugcugagaacagauguauccauuugaguccugc

SEQ ID NO: 481867 - RNA, 64 nt, Homo Sapiens
acuuacccugggcuucaggagcuggguuggcuucugagaacagggagcauggcccagacaagca

SEQ ID NO: 481868 - RNA, 64 nt, Homo Sapiens
ccaaguacagugagcacaauagagaaaugggaaaugagaacauuaacauucaaugucaccugaa

SEQ ID NO: 481869 - RNA, 64 nt, Homo Sapiens
aguuuauuacucacuaaagaagcucauuacagcaugagaacagcguggcacaaauacucaugcc

SEQ ID NO: 481870 - RNA, 64 nt, Homo Sapiens
aaguaacugacaugucuauuuccuugggagcaugugagaacauagcaguagggaccaaaagucu

SEQ ID NO: 481871 - RNA, 64 nt, Homo Sapiens
gauacgacuucuacuauauacauuucucugucccugagaacagagaaacguaacccuguagggg

SEQ ID NO: 481872 - RNA, 64 nt, Homo Sapiens
agggguugccccagaaggcaggggaaggaccugaugagaacagaauagcugggaggcugcagag

SEQ ID NO: 481873 - RNA, 64 nt, Homo Sapiens
cgcuuccucaaaaagaucacagagggaggagcucugagaacagucuccuucaacaguucggcca

SEQ ID NO: 481874 - RNA, 64 nt, Homo Sapiens
cccaaugugaugcacaccuaccaaaccagaugggugagaacaaguucccaccaaggaggaaugg

SEQ ID NO: 481875 - RNA, 64 nt, Homo Sapiens
aacccagauuggugagauagagaaggaaaguuacugagaacaaaaaugaagauguuguaugaca

SEQ ID NO: 481876 - RNA, 64 nt, Homo Sapiens
uuuaucuagaauggauucaaucacacgagcuagcuucugcaaugcgucccgugucuccagggga

SEQ ID NO: 481877 - RNA, 64 nt, Homo Sapiens
cgguuuaccaguuuauuaacuguugcggacaucauucugcaaccgaucauugcuggcaugaagc

SEQ ID NO: 481878 - RNA, 64 nt, Homo Sapiens
uaaguuguuccauucuuuggccauuauaacuuuuuucugcaaauauucuggugacuuaucuuug

SEQ ID NO: 481879 - RNA, 64 nt, Homo Sapiens
auaaacuguugauaauagaucaucuuguauauacuucugcaauuauaagauguuuuuugaugau

SEQ ID NO: 481880 - RNA, 64 nt, Homo Sapiens
agcuacuucuuuguuagaggauugagaaugaaauuucugcaaaagggcccaugguucauuuggu

SEQ ID NO: 481881 - RNA, 64 nt, Homo Sapiens
guggaacucccugauucuauacccucuuccuucuuucugcaaggcagaggaauaauauuuuuaa

SEQ ID NO: 481882 - RNA, 64 nt, Homo Sapiens
gagaauuauauuucaucauucccagaucaucauuuucugcaacuggaaugcauuugcauaauga

SEQ ID NO: 481883 - RNA, 64 nt, Homo Sapiens
cugagaacucuccaaggaauuaauuuuucugaacuucugcaauuugacauguaaaagaccaaag

SEQ ID NO: 481884 - RNA, 64 nt, Homo Sapiens
gaaaagaaagcauacaugcuuaugcaugaaacaauucugcaaaaaaaggaugaauuuccuccau

SEQ ID NO: 481885 - RNA, 64 nt, Homo Sapiens
ucugcgucaauuaagucaagcugaagcuacugacuucugcaaaguauuagugguacaguaaaaa

SEQ ID NO: 481886 - RNA, 64 nt, Homo Sapiens
augagauguacagauuucggcugccugccuacuuuucugcaaaaacuuuuauguauaauucuuu

SEQ ID NO: 481887 - RNA, 64 nt, Homo Sapiens
acuuggauucacaaauguccaagcaggcuccagcuucugcaaaaagaaaaugaaggccaaacag

SEQ ID NO: 481888 - RNA, 64 nt, Homo Sapiens
ucaaggcacuaguaucagauugcaagccaagugguucugcaaggucccacacaccuuggccuuc

SEQ ID NO: 481889 - RNA, 64 nt, Homo Sapiens
caagugguucugcaaggucacacacaccuuggccuucugcaagcccucccuaccucauccaucc

SEQ ID NO: 481890 - RNA, 64 nt, Homo Sapiens
agcucucagaccaucagcaucaccugcagacacuuucugcaauaagccugacacauacuaaggg

SEQ ID NO: 481891 - RNA, 64 nt, Homo Sapiens
cacucucagaccaucagcaucacaugcacacauuuucugcaauuagccucacccaugcuaaggg

SEQ ID NO: 481892 - RNA, 64 nt, Homo Sapiens
ggcuacuccucuuauauuaauuaaacaauguuucuucugcaacuuaauacauuuaagaucuugu

SEQ ID NO: 481893 - RNA, 64 nt, Homo Sapiens
ggcaaguucauugugcuacccugguugucauaguuucugcaaagauugcucuucuucuuuuaga

SEQ ID NO: 481894 - RNA, 64 nt, Homo Sapiens
uuuuccaggaaaaucugcuuaaaauagacccagcuucugcaaggcuuggcaauuaauagcggca

SEQ ID NO: 481895 - RNA, 64 nt, Homo Sapiens
uuccucugacaucaaaaaauuuucgucugaucuuuucugcaauguugccuccauugucagacua

SEQ ID NO: 481896 - RNA, 64 nt, Homo Sapiens
gcagggaccaucaagaaccuacagacuccaucucuucugcaagccucaugccaacccugggcua

SEQ ID NO: 481897 - RNA, 64 nt, Homo Sapiens
aagaauuaaugacuuacuuuaauuacuggaauucuucugcaacauuugacaaaacuaaccuuga

SEQ ID NO: 481898 - RNA, 64 nt, Homo Sapiens
aguggaugaauguucuuuaaauuuguguaaauacuucugcaaagguacugaugcuguaaaguca

SEQ ID NO: 481899 - RNA, 64 nt, Homo Sapiens
guguaauggaauuaaagugcuuuugcacaauaaguucugcaaaacccucucauucaugaaaagg

SEQ ID NO: 481900 - RNA, 64 nt, Homo Sapiens
aauauuuugaauauuuuagcuauauuuaguggcuuucugcaagcaacuagaacagagaaguaau

SEQ ID NO: 481901 - RNA, 64 nt, Homo Sapiens
ugaaaaagaaauauaaaaaggacccuaaaaagaauucugcaaaauaagagaagaaauaauuugu

SEQ ID NO: 481902 - RNA, 64 nt, Homo Sapiens
acgguuuuucuaccugauuguaucuauuaaaccauucugcaaauuccaccauguuccugacacc

SEQ ID NO: 481903 - RNA, 64 nt, Homo Sapiens
ugcacugaauugcugaaaguuuaauuuagauccuuucugcaaaguaaacaacagaacuuuaugc

SEQ ID NO: 481904 - RNA, 64 nt, Homo Sapiens
uuccagguuuuguugaagagauaccugccagcacuucugcaagcugaaauuuacagaagcaaau

SEQ ID NO: 481905 - RNA, 64 nt, Homo Sapiens
ccucauguaaacuggauugagaaauucucagugauucugcaauggauuuuuuuuuaaugcagaa

SEQ ID NO: 481906 - RNA, 64 nt, Homo Sapiens
cuacccugucaaggagaucaccagccugccugacuucugcaaacucuuacuaaggauguuuuua

SEQ ID NO: 481907 - RNA, 64 nt, Homo Sapiens
caacuuuuuauuuuuauuuuaaaccucuuagcuuuucugcaauuaaacaaaaaacaaaaacuaa

SEQ ID NO: 481908 - RNA, 64 nt, Homo Sapiens
guaugugucauagaauacuuaguucugcuagauauucugcaaauauauuugggaauuacuuccu

SEQ ID NO: 481909 - RNA, 64 nt, Homo Sapiens
uucauauacccaauaauaagcuacagaacuaauauucugcaaaugucucuuggaacacacugcc

SEQ ID NO: 481910 - RNA, 64 nt, Homo Sapiens; identical to SEQ ID NO: 87706

SEQ ID NO: 481911 - RNA, 64 nt, Homo Sapiens; identical to SEQ ID NO: 87707

SEQ ID NO: 481912 - RNA, 64 nt, Homo Sapiens; identical to SEQ ID NO: 87708

SEQ ID NO: 481913 - RNA, 64 nt, Homo Sapiens; identical to SEQ ID NO: 87709

SEQ ID NO: 481914 - RNA, 64 nt, Homo Sapiens; identical to SEQ ID NO: 87710

SEQ ID NO: 481915 - RNA, 64 nt, Homo Sapiens; identical to SEQ ID NO: 87711

SEQ ID NO: 481916 - RNA, 64 nt, Homo Sapiens; identical to SEQ ID NO: 87712

SEQ ID NO: 481917 - RNA, 64 nt, Homo Sapiens; identical to SEQ ID NO: 87713

SEQ ID NO: 481918 - RNA, 64 nt, Homo Sapiens; identical to SEQ ID NO: 87714

SEQ ID NO: 481919 - RNA, 64 nt, Homo Sapiens; identical to SEQ ID NO: 87715

SEQ ID NO: 481920 - RNA, 64 nt, Homo Sapiens; identical to SEQ ID NO: 87716

SEQ ID NO: 481921 - RNA, 64 nt, Homo Sapiens; identical to SEQ ID NO: 87717

SEQ ID NO: 481922 - RNA, 64 nt, Homo Sapiens; identical to SEQ ID NO: 87718

SEQ ID NO: 481923 - RNA, 64 nt, Homo Sapiens; identical to SEQ ID NO: 87719

SEQ ID NO: 481924 - RNA, 64 nt, Homo Sapiens; identical to SEQ ID NO: 87720

SEQ ID NO: 481925 - RNA, 64 nt, Homo Sapiens; identical to SEQ ID NO: 87721

SEQ ID NO: 481926 - RNA, 64 nt, Homo Sapiens; identical to SEQ ID NO: 87722

SEQ ID NO: 481927 - RNA, 64 nt, Homo Sapiens; identical to SEQ ID NO: 87723

SEQ ID NO: 481928 - RNA, 64 nt, Homo Sapiens; identical to SEQ ID NO: 87724

SEQ ID NO: 481929 - RNA, 64 nt, Homo Sapiens; identical to SEQ ID NO: 87725

SEQ ID NO: 481930 - RNA, 64 nt, Homo Sapiens; identical to SEQ ID NO: 87726

SEQ ID NO: 481931 - RNA, 64 nt, Homo Sapiens; identical to SEQ ID NO: 87727

SEQ ID NO: 481932 - RNA, 64 nt, Homo Sapiens; identical to SEQ ID NO: 87728

SEQ ID NO: 481933 - RNA, 64 nt, Homo Sapiens; identical to SEQ ID NO: 87729

SEQ ID NO: 481934 - RNA, 64 nt, Homo Sapiens; identical to SEQ ID NO: 87730

SEQ ID NO: 481935 - RNA, 64 nt, Homo Sapiens; identical to SEQ ID NO: 87731

SEQ ID NO: 481936 - RNA, 64 nt, Homo Sapiens; identical to SEQ ID NO: 87732

SEQ ID NO: 481937 - RNA, 64 nt, Homo Sapiens; identical to SEQ ID NO: 87733

SEQ ID NO: 481938 - RNA, 64 nt, Homo Sapiens; identical to SEQ ID NO: 87734

SEQ ID NO: 481939 - RNA, 64 nt, Homo Sapiens; identical to SEQ ID NO: 87735

SEQ ID NO: 481940 - RNA, 64 nt, Homo Sapiens; identical to SEQ ID NO: 87736

SEQ ID NO: 481941 - RNA, 64 nt, Homo Sapiens; identical to SEQ ID NO: 87737

SEQ ID NO: 481942 - RNA, 64 nt, Homo Sapiens; identical to SEQ ID NO: 87738

SEQ ID NO: 481943 - RNA, 64 nt, Homo Sapiens; identical to SEQ ID NO: 87739

SEQ ID NO: 481944 - RNA, 64 nt, Homo Sapiens; identical to SEQ ID NO: 87740

SEQ ID NO: 481945 - RNA, 64 nt, Homo Sapiens; identical to SEQ ID NO: 87741

SEQ ID NO: 481946 - RNA, 64 nt, Homo Sapiens; identical to SEQ ID NO: 87742

SEQ ID NO: 481947 - RNA, 64 nt, Homo Sapiens; identical to SEQ ID NO: 87743

SEQ ID NO: 481948 - RNA, 64 nt, Homo Sapiens; identical to SEQ ID NO: 87744

SEQ ID NO: 481949 - RNA, 64 nt, Homo Sapiens; identical to SEQ ID NO: 87745

SEQ ID NO: 481950 - RNA, 64 nt, Homo Sapiens; identical to SEQ ID NO: 87746

SEQ ID NO: 481951 - RNA, 64 nt, Homo Sapiens; identical to SEQ ID NO: 87747

SEQ ID NO: 481952 - RNA, 64 nt, Homo Sapiens; identical to SEQ ID NO: 87748

SEQ ID NO: 481953 - RNA, 64 nt, Homo Sapiens; identical to SEQ ID NO: 87749

SEQ ID NO: 481954 - RNA, 64 nt, Homo Sapiens; identical to SEQ ID NO: 87750

SEQ ID NO: 481955 - RNA, 64 nt, Homo Sapiens; identical to SEQ ID NO: 87751

SEQ ID NO: 481956 - RNA, 64 nt, Homo Sapiens; identical to SEQ ID NO: 87752

SEQ ID NO: 481957 - RNA, 64 nt, Homo Sapiens; identical to SEQ ID NO: 87753

SEQ ID NO: 481958 - RNA, 64 nt, Homo Sapiens; identical to SEQ ID NO: 87754

SEQ ID NO: 481959 - RNA, 64 nt, Homo Sapiens; identical to SEQ ID NO: 87755

SEQ ID NO: 481960 - RNA, 64 nt, Homo Sapiens; identical to SEQ ID NO: 87756

SEQ ID NO: 481961 - RNA, 63 nt, Homo Sapiens; identical to SEQ ID NO: 87757

SEQ ID NO: 481962 - RNA, 64 nt, Homo Sapiens; identical to SEQ ID NO: 87758

SEQ ID NO: 481963 - RNA, 62 nt, Homo Sapiens
uauguucuuaucucagacuucuuuccaaacagugccaucaaauuuuuuuaauaaggacaccu

SEQ ID NO: 481964 - RNA, 62 nt, Homo Sapiens
ugggauggguagguuccaguuuuucucaaauaugccaucauagguaaagaaauacauuuucu

SEQ ID NO: 481965 - RNA, 62 nt, Homo Sapiens
ggaggcugcagggaccaagaaggggcccaggcugccaucacuaccucccacugcucccuguc

SEQ ID NO: 481966 - RNA, 62 nt, Homo Sapiens
aggugggugagggguugcccgcugccccucccugccaucagcgccacccggggugcuguuca

SEQ ID NO: 481967 - RNA, 62 nt, Homo Sapiens
agucacuugccuuccacgguggccagcccugcugccaucauuggcugaagcaccaccaggau

SEQ ID NO: 481968 - RNA, 62 nt, Homo Sapiens
caaccucccaaguagcugggacuacaggcauaugccaucacacccagcuaauuuuuguuuuu

SEQ ID NO: 481969 - RNA, 62 nt, Homo Sapiens
auccuugccuucauauaacauaacaugcuucgugccaucaugucauggucauugccuucaua

SEQ ID NO: 481970 - RNA, 62 nt, Homo Sapiens
gucauugccuucauauaacauuugguggcagcugccaucaugagggugugcugguaaaguau

SEQ ID NO: 481971 - RNA, 62 nt, Homo Sapiens
cccagcuaauauuuuuuuauacuacaggcucaugccaucaugcagccuccugaguagcuggg

SEQ ID NO: 481972 - RNA, 62 nt, Homo Sapiens
acggcucacugcagccucagggagugcaguggugccaucacccucacuuugacacccaggcu

SEQ ID NO: 481973 - RNA, 64 nt, Homo Sapiens; identical to SEQ ID NO: 276706

SEQ ID NO: 481974 - RNA, 64 nt, Homo Sapiens; identical to SEQ ID NO: 276707

SEQ ID NO: 481975 - RNA, 64 nt, Homo Sapiens; identical to SEQ ID NO: 276708

SEQ ID NO: 481976 - RNA, 64 nt, Homo Sapiens; identical to SEQ ID NO: 276709

SEQ ID NO: 481977 - RNA, 64 nt, Homo Sapiens; identical to SEQ ID NO: 276710

SEQ ID NO: 481978 - RNA, 64 nt, Homo Sapiens; identical to SEQ ID NO: 276711

SEQ ID NO: 481979 - RNA, 64 nt, Homo Sapiens; identical to SEQ ID NO: 276712

SEQ ID NO: 481980 - RNA, 62 nt, Homo Sapiens; identical to SEQ ID NO: 276713

SEQ ID NO: 481981 - RNA, 64 nt, Homo Sapiens; identical to SEQ ID NO: 276714

SEQ ID NO: 481982 - RNA, 64 nt, Homo Sapiens; identical to SEQ ID NO: 276715

SEQ ID NO: 481983 - RNA, 64 nt, Homo Sapiens; identical to SEQ ID NO: 276716

SEQ ID NO: 481984 - RNA, 64 nt, Homo Sapiens; identical to SEQ ID NO: 276717

SEQ ID NO: 481985 - RNA, 64 nt, Homo Sapiens; identical to SEQ ID NO: 276718

SEQ ID NO: 481986 - RNA, 64 nt, Homo Sapiens; identical to SEQ ID NO: 276719

SEQ ID NO: 481987 - RNA, 64 nt, Homo Sapiens; identical to SEQ ID NO: 276720

SEQ ID NO: 481988 - RNA, 64 nt, Homo Sapiens; identical to SEQ ID NO: 276721

SEQ ID NO: 481989 - RNA, 64 nt, Homo Sapiens; identical to SEQ ID NO: 276722

SEQ ID NO: 481990 - RNA, 64 nt, Homo Sapiens; identical to SEQ ID NO: 276723

SEQ ID NO: 481991 - RNA, 64 nt, Homo Sapiens; identical to SEQ ID NO: 276724

SEQ ID NO: 481992 - RNA, 64 nt, Homo Sapiens; identical to SEQ ID NO: 276725

SEQ ID NO: 481993 - RNA, 64 nt, Homo Sapiens; identical to SEQ ID NO: 276726

SEQ ID NO: 481994 - RNA, 64 nt, Homo Sapiens; identical to SEQ ID NO: 276727

SEQ ID NO: 481995 - RNA, 64 nt, Homo Sapiens; identical to SEQ ID NO: 276728

SEQ ID NO: 481996 - RNA, 64 nt, Homo Sapiens; identical to SEQ ID NO: 276729

SEQ ID NO: 481997 - RNA, 64 nt, Homo Sapiens; identical to SEQ ID NO: 276730

SEQ ID NO: 481998 - RNA, 64 nt, Homo Sapiens; identical to SEQ ID NO: 276731

SEQ ID NO: 481999 - RNA, 64 nt, Homo Sapiens; identical to SEQ ID NO: 276732

SEQ ID NO: 482000 - RNA, 64 nt, Homo Sapiens; identical to SEQ ID NO: 276733

SEQ ID NO: 482001 - RNA, 64 nt, Homo Sapiens; identical to SEQ ID NO: 276734

SEQ ID NO: 482002 - RNA, 64 nt, Homo Sapiens; identical to SEQ ID NO: 276735

SEQ ID NO: 482003 - RNA, 64 nt, Homo Sapiens; identical to SEQ ID NO: 276736

SEQ ID NO: 482004 - RNA, 64 nt, Homo Sapiens; identical to SEQ ID NO: 276737

SEQ ID NO: 482005 - RNA, 64 nt, Homo Sapiens; identical to SEQ ID NO: 276738

SEQ ID NO: 482006 - RNA, 64 nt, Homo Sapiens; identical to SEQ ID NO: 276739

SEQ ID NO: 482007 - RNA, 64 nt, Homo Sapiens; identical to SEQ ID NO: 276740

SEQ ID NO: 482008 - RNA, 64 nt, Homo Sapiens; identical to SEQ ID NO: 276741

SEQ ID NO: 482009 - RNA, 64 nt, Homo Sapiens; identical to SEQ ID NO: 276742

SEQ ID NO: 482010 - RNA, 64 nt, Homo Sapiens; identical to SEQ ID NO: 276743

SEQ ID NO: 482011 - RNA, 64 nt, Homo Sapiens; identical to SEQ ID NO: 276744

SEQ ID NO: 482012 - RNA, 64 nt, Homo Sapiens; identical to SEQ ID NO: 276745

SEQ ID NO: 482013 - RNA, 64 nt, Homo Sapiens; identical to SEQ ID NO: 276746

SEQ ID NO: 482014 - RNA, 64 nt, Homo Sapiens; identical to SEQ ID NO: 276747

SEQ ID NO: 482015 - RNA, 64 nt, Homo Sapiens; identical to SEQ ID NO: 276748

SEQ ID NO: 482016 - RNA, 64 nt, Homo Sapiens; identical to SEQ ID NO: 276749

SEQ ID NO: 482017 - RNA, 64 nt, Homo Sapiens; identical to SEQ ID NO: 276750

SEQ ID NO: 482018 - RNA, 64 nt, Homo Sapiens; identical to SEQ ID NO: 276751

SEQ ID NO: 482019 - RNA, 64 nt, Homo Sapiens; identical to SEQ ID NO: 276752

SEQ ID NO: 482020 - RNA, 64 nt, Homo Sapiens; identical to SEQ ID NO: 276753

SEQ ID NO: 482021 - RNA, 64 nt, Homo Sapiens; identical to SEQ ID NO: 276754

SEQ ID NO: 482022 - RNA, 64 nt, Homo Sapiens; identical to SEQ ID NO: 276755

SEQ ID NO: 482023 - RNA, 64 nt, Homo Sapiens; identical to SEQ ID NO: 276756

SEQ ID NO: 482024 - RNA, 64 nt, Homo Sapiens; identical to SEQ ID NO: 276757

SEQ ID NO: 482025 - RNA, 64 nt, Homo Sapiens; identical to SEQ ID NO: 276758

SEQ ID NO: 482026 - RNA, 64 nt, Homo Sapiens; identical to SEQ ID NO: 276759

SEQ ID NO: 482027 - RNA, 64 nt, Homo Sapiens; identical to SEQ ID NO: 276760

SEQ ID NO: 482028 - RNA, 64 nt, Homo Sapiens; identical to SEQ ID NO: 276759

SEQ ID NO: 482029 - RNA, 64 nt, Homo Sapiens; identical to SEQ ID NO: 105601

SEQ ID NO: 482030 - RNA, 64 nt, Homo Sapiens; identical to SEQ ID NO: 105602

SEQ ID NO: 482031 - RNA, 64 nt, Homo Sapiens; identical to SEQ ID NO: 105603

SEQ ID NO: 482032 - RNA, 64 nt, Homo Sapiens; identical to SEQ ID NO: 105604

SEQ ID NO: 482033 - RNA, 64 nt, Homo Sapiens; identical to SEQ ID NO: 105605

SEQ ID NO: 482034 - RNA, 64 nt, Homo Sapiens; identical to SEQ ID NO: 105606

SEQ ID NO: 482035 - RNA, 64 nt, Homo Sapiens; identical to SEQ ID NO: 105607

SEQ ID NO: 482036 - RNA, 64 nt, Homo Sapiens; identical to SEQ ID NO: 105608

SEQ ID NO: 482037 - RNA, 64 nt, Homo Sapiens; identical to SEQ ID NO: 105609

SEQ ID NO: 482038 - RNA, 64 nt, Homo Sapiens; identical to SEQ ID NO: 105610

SEQ ID NO: 482039 - RNA, 64 nt, Homo Sapiens; identical to SEQ ID NO: 105611

SEQ ID NO: 482040 - RNA, 64 nt, Homo Sapiens; identical to SEQ ID NO: 105612

SEQ ID NO: 482041 - RNA, 64 nt, Homo Sapiens; identical to SEQ ID NO: 105613

SEQ ID NO: 482042 - RNA, 64 nt, Homo Sapiens; identical to SEQ ID NO: 105614

SEQ ID NO: 482043 - RNA, 64 nt, Homo Sapiens; identical to SEQ ID NO: 88792

SEQ ID NO: 482044 - RNA, 64 nt, Homo Sapiens; identical to SEQ ID NO: 88793

SEQ ID NO: 482045 - RNA, 64 nt, Homo Sapiens; identical to SEQ ID NO: 88794

SEQ ID NO: 482046 - RNA, 64 nt, Homo Sapiens; identical to SEQ ID NO: 88795

SEQ ID NO: 482047 - RNA, 64 nt, Homo Sapiens; identical to SEQ ID NO: 88796

SEQ ID NO: 482048 - RNA, 64 nt, Homo Sapiens; identical to SEQ ID NO: 88797

SEQ ID NO: 482049 - RNA, 64 nt, Homo Sapiens; identical to SEQ ID NO: 88798

SEQ ID NO: 482050 - RNA, 64 nt, Homo Sapiens; identical to SEQ ID NO: 88799

SEQ ID NO: 482051 - RNA, 64 nt, Homo Sapiens; identical to SEQ ID NO: 88800

SEQ ID NO: 482052 - RNA, 64 nt, Homo Sapiens; identical to SEQ ID NO: 88801

SEQ ID NO: 482053 - RNA, 64 nt, Homo Sapiens; identical to SEQ ID NO: 88802

SEQ ID NO: 482054 - RNA, 64 nt, Homo Sapiens
gaggauggcuugaagccaguaguucaagaccagccugggcaacauaguaagaccccaucucuau

SEQ ID NO: 482055 - RNA, 64 nt, Homo Sapiens
gcagugagcugugauugugccacuguuuuccagccugggcaauacagugagacccugucucaaa

SEQ ID NO: 482056 - RNA, 64 nt, Homo Sapiens
gagaauugcuugaguccaggaguuugagaugcgccugggcaacauagaaaccugugucuacaaa

SEQ ID NO: 482057 - RNA, 64 nt, Homo Sapiens
gcagugagcugagaucgcaccauuacacuccagccugggcaacagagccagacucugucucaaa

SEQ ID NO: 482058 - RNA, 64 nt, Homo Sapiens
ucccucucccaucuucucauauccuggcucuucucugggcaagaugagccaagcagaacauucc

SEQ ID NO: 482059 - RNA, 64 nt, Homo Sapiens
ccuguccaaggaccuucccucuucuccccaguuccugggcaaucacuucaccuuggacaaagga

SEQ ID NO: 482060 - RNA, 64 nt, Homo Sapiens
ugaugagacuccgucucuacaguucgagacuagccugggcaacggaagauggcuugaacucagg

SEQ ID NO: 482061 - RNA, 64 nt, Homo Sapiens
gaaugagauccugucucuuacacugcacuccacucugggcaacaguaguaagcuacgaucaugc

SEQ ID NO: 482062 - RNA, 64 nt, Homo Sapiens
cccacagaagacuucccagcguuacuucucucaucugggcaaaauaguaccccaagaagaaaau

SEQ ID NO: 482063 - RNA, 64 nt, Homo Sapiens
uagugagaccccugucucccaguuuaagaccagccugggcaacagaggaucaguugaggccagg

SEQ ID NO: 482064 - RNA, 64 nt, Homo Sapiens
gaacaagaacccaucucaaacacaucacuccaaccugggcaacagcagugagccaagaucaugc

SEQ ID NO: 482065 - RNA, 64 nt, Homo Sapiens
cgaugaaacuccgucucuacaguucaagaucagucugggcaacagcggauugccugagcucagg

SEQ ID NO: 482066 - RNA, 64 nt, Homo Sapiens
gagugagacccugucucaaaacuggcacuccagccugggcaacacaguaagccaagaucacacc

SEQ ID NO: 482067 - RNA, 64 nt, Homo Sapiens
uagugagaccccaucucuauaguuugagacuagccugggcaacagcuaagcauuuuuuaaauug

SEQ ID NO: 482068 - RNA, 64 nt, Homo Sapiens
guguuauuaaaaaauuacaaaggccuagaccagccugggcaacauggugaaaccccaucucuac

SEQ ID NO: 482069 - RNA, 64 nt, Homo Sapiens
gcagugaaucaugaucaugccacuguacuccagccugggcaacagagaccaucuuaaaaaaaaa

SEQ ID NO: 482070 - RNA, 64 nt, Homo Sapiens
gcagugagcagagaucgcaccacugcacuccagccugggcaagagugagacugugucucaaaag

SEQ ID NO: 482071 - RNA, 64 nt, Homo Sapiens
gaggaucacuuagguccaggaguucgagacuagccugggcaacauagugagacaccggaucuac

SEQ ID NO: 482072 - RNA, 64 nt, Homo Sapiens
gcagugagccgugauugcaccacugcacuccagccugggcaacagagcaagacccugucuugga

SEQ ID NO: 482073 - RNA, 64 nt, Homo Sapiens
uucugccucuuaagccugcucccucacccaggcacugggcaagugaagaguuugccuguacucu

SEQ ID NO: 482074 - RNA, 64 nt, Homo Sapiens
gcagugagccaagauugcgccguuguacuccagccugggcaacagagcaagacccaucucaaaa

SEQ ID NO: 482075 - RNA, 64 nt, Homo Sapiens
ugacagaauacuagauaggaauuaaaaguacaagcugggcaaacagauuaccauuagaagcaaa

SEQ ID NO: 482076 - RNA, 64 nt, Homo Sapiens
aaaauaaauggcauaagagcgguggaauugaugucugggcaauuaggcuaugacuaagaauuua

SEQ ID NO: 482077 - RNA, 64 nt, Homo Sapiens
gcaguucgcuugggcccaagaguucgagaccagccugggcaacauggugaaacccuaucuccgu

SEQ ID NO: 482078 - RNA, 64 nt, Homo Sapiens
gagccgaggucaugccacugcacuccagccuggccugggcaacagagcaagacccugucucaaa

SEQ ID NO: 482079 - RNA, 64 nt, Homo Sapiens
gcauugagcugagaucaugcuagugcgcuccagccugggcaacagagcgagacuucaucucaga

SEQ ID NO: 482080 - RNA, 64 nt, Homo Sapiens
ggagugagcugagaucgcgccaccgcacuccagccugggcaacagagcgagacuccaucucaaa

SEQ ID NO: 482081 - RNA, 64 nt, Homo Sapiens
gagugagauccugacucaaacacugcauucuagccugggcaacagcaaugagcuaugauuucac

SEQ ID NO: 482082 - RNA, 64 nt, Homo Sapiens
uagcgagacugcaucucuacgguucaagacuagccugggcaacagaggauugcuugaggccgag

SEQ ID NO: 482083 - RNA, 64 nt, Homo Sapiens
gagugagacccuauuucaaacacugcacuccagccugggcaacagcagugagcacagaucacac

SEQ ID NO: 482084 - RNA, 64 nt, Homo Sapiens
uggcuaaaccccaucucuacaguucaagaccagccugggcaacaguggauugcuuaagcccagg

SEQ ID NO: 482085 - RNA, 64 nt, Homo Sapiens
gaguaagacaaaaaaauauacacugcacucuagccugggcaacagcagugagccaaggucacgu

SEQ ID NO: 482086 - RNA, 64 nt, Homo Sapiens
uggugaaacccuguuucuauaauucaagaccagccugggcaacaguagauuacuugagcccagg

SEQ ID NO: 482087 - RNA, 64 nt, Homo Sapiens
gaggauugcuugaagcuaggaguuugagaccagccugggcaacaggguaagguccugucucuac

SEQ ID NO: 482088 - RNA, 64 nt, Homo Sapiens
ugcagugagcugugaugugcccuuaugcuauagccugggcaagagcgugagacccugucucaaa

SEQ ID NO: 482089 - RNA, 64 nt, Homo Sapiens
gcggaucacuugaggccaggaauuugaaaccagccugggcaaaacccugucucuacuaaaaaua

SEQ ID NO: 482090 - RNA, 64 nt, Homo Sapiens
gggcagaugggcacaggugcuggugaugccucuccugggcaaaacgccccauuuguggcacuuu

SEQ ID NO: 482091 - RNA, 64 nt, Homo Sapiens
gagaaagacccugucucaaacagugcacucuagccugggcaacacuagagugagccgugaucac

SEQ ID NO: 482092 - RNA, 64 nt, Homo Sapiens
gagcgagaucccaucacuacaguucgagaccacccugggcaacagaggaucgcuugaggccagg

SEQ ID NO: 482093 - RNA, 64 nt, Homo Sapiens
uggcgaaauccccgucuuuaaguucgagaccagccugggcaacggagaaucgcuugagcucagg

SEQ ID NO: 482094 - RNA, 64 nt, Homo Sapiens
uagcaaaaccuagucccuaaaguuuaaggccagccugggcaacaaggaucaccuugaggccagg

SEQ ID NO: 482095 - RNA, 64 nt, Homo Sapiens
gcagugagccgagaucgcaccauugcacuccugccugggcaacaagagugaaacuccaucucca

SEQ ID NO: 482096 - RNA, 64 nt, Homo Sapiens
gcagauuauuugagcucaggaguuugagaccauccugggcaacauggcgaaacccuaucucuac

SEQ ID NO: 482097 - RNA, 64 nt, Homo Sapiens
ggcgagacucugucucaaaacauugcacuccagccugggcaacggcagugagcugagaucacau

SEQ ID NO: 482098 - RNA, 64 nt, Homo Sapiens
uuuuuaagacucugucuuaacuuaaaaaaagagccugggcaauugcaagaguuuuuuuaagacu

SEQ ID NO: 482099 - RNA, 64 nt, Homo Sapiens
guuuuuuuaagacucuuaaacacugcacuccagccugggcaagagcagcgagccaagaucgugc

SEQ ID NO: 482100 - RNA, 64 nt, Homo Sapiens
gagugagacccugucucugacacugcacuccagccugggcaacagcagugggcugugaucacac

SEQ ID NO: 482101 - RNA, 64 nt, Homo Sapiens
uagugagacuccugucucuaaguucaagaccagccugggcaacagaggaucacuugagcccagg

SEQ ID NO: 482102 - RNA, 64 nt, Homo Sapiens
uaaccagugagcacugguuaguacugguccccuucugggcaacauggcccuaccagacacugcu

SEQ ID NO: 482103 - RNA, 64 nt, Homo Sapiens
gugagccaucaucauggcaucauugcauuccagccugggcaacagagcaagaccucgucucaaa

SEQ ID NO: 482104 - RNA, 64 nt, Homo Sapiens
aagcaagaccuugucucaaacacuacacuccagccugggcaacaguagugagccaagaucgugc

SEQ ID NO: 482105 - RNA, 64 nt, Homo Sapiens
ugacgaaaccccgucucuacaguucgagagcagccugggcaacagcagaucacuugagcccagg

SEQ ID NO: 482106 - RNA, 64 nt, Homo Sapiens
acagauggcuugagcucaggaguucgugaccagccugggcaacccugucucuacaaaaaauaca

SEQ ID NO: 482107 - RNA, 64 nt, Homo Sapiens
gaggacugcuugagcccaggaguuugagaccagccugggcaauguagcaagaccccaucucuau

SEQ ID NO: 482108 - RNA, 64 nt, Homo Sapiens
acuucccccugaggacugacucuuccuagcagagcugggcaacuugucccaaaucuagcuuugc

SEQ ID NO: 482109 - RNA, 64 nt, Homo Sapiens
gcagugagccgagaucacgccacugcacuccagccugggcaacaagagugaaacuccgucucaa

SEQ ID NO: 482110 - RNA, 64 nt, Homo Sapiens
gggaggaucacuugaguccagguucaagacuagccugggcaacauggcaagacccugucccuau

SEQ ID NO: 482111 - RNA, 64 nt, Homo Sapiens
gcagugaacugagaucacgacacugcacuccagccugggcaacaguaaaaccuggucuccaaaa

SEQ ID NO: 482112 - RNA, 64 nt, Homo Sapiens
aaagcgaaacucugucucaacacugcauuccagccugggcaacauacaguagccgagaucgcgc

SEQ ID NO: 482113 - RNA, 64 nt, Homo Sapiens
agagcgaaacucugucucaacauugcacuccagccugggcaacagcagugagcugagaucgcac

SEQ ID NO: 482114 - RNA, 64 nt, Homo Sapiens
gcagugagccaagaucgcgccacugcacuccagucugggcaacagagugagacccugucucaau

SEQ ID NO: 482115 - RNA, 64 nt, Homo Sapiens
agguuagacguucccugcccugggacgcucaccccugggcaagaggcuggaaguucacaccauc

SEQ ID NO: 482116 - RNA, 64 nt, Homo Sapiens
gugagacccugucucaaaaacacugugcucccaccugggcaacagcagugagccaagauugcac

SEQ ID NO: 482117 - RNA, 64 nt, Homo Sapiens
uggcgaaacuccauuucuauaguucaagaccagccugggcaacagcagaucacugaagcucagg

SEQ ID NO: 482118 - RNA, 64 nt, Homo Sapiens
aaggaucgcugcagcccaggaguucgagacuagccugggcaacauagcgagaccucgucucuac

SEQ ID NO: 482119 - RNA, 64 nt, Homo Sapiens
gaggauugcuugagcccaggaguuugagaccagccugggcaacacagcgagaccuugucucuua

SEQ ID NO: 482120 - RNA, 64 nt, Homo Sapiens
agcucacccuucgucauggaccgagguucccacucugggcaaagccccucacacugcaagggau

SEQ ID NO: 482121 - RNA, 63 nt, Homo Sapiens
uuuuuuuauaccuaaauaaagaaaaaucuuuagccugggcaacauagggagacccuaucucua

SEQ ID NO: 482122 - RNA, 64 nt, Homo Sapiens
gagacccugucucaaccacccauugcacuccagccugggcaacagcaaugagcuauaauugcau

SEQ ID NO: 482123 - RNA, 64 nt, Homo Sapiens
uaguaaaaccucaucuauaccaccacccuccagccugggcaacgcacacaaggaauauaaaaac

SEQ ID NO: 482124 - RNA, 64 nt, Homo Sapiens
ugggugauuccucccaggagagggggugggggaucugggcaaggagccguaggguggcacuggg

SEQ ID NO: 482125 - RNA, 64 nt, Homo Sapiens
agagcuacugagacuuggaacaagggcccagacccugggcaaacagccuuccuuucuccugccc

SEQ ID NO: 482126 - RNA, 64 nt, Homo Sapiens
gcagugagucaagaucacgccauugcacuccagccugggcaacaagagcgaaacuccaucucaa

SEQ ID NO: 482127 - RNA, 64 nt, Homo Sapiens
gaggauuacuugaaacccacaguuugagaccagccugggcaacauagugagacccugucucuaa

SEQ ID NO: 482128 - RNA, 64 nt, Homo Sapiens
ggcggggaggauccauugagcccagcaguccaaccugggcaaaauagugagagacccuguaucu

SEQ ID NO: 482129 - RNA, 64 nt, Homo Sapiens
gcagugagcugagauugugccacugcacuccagccugggcaacaaagcaagacucugucucaaa

SEQ ID NO: 482130 - RNA, 64 nt, Homo Sapiens
gcagugagccaagaucaugucacugcauuccagccugggcaacagaggaagacuccgucucaaa

SEQ ID NO: 482131 - RNA, 64 nt, Homo Sapiens
uuuuggguuugcugcucccuuccauaagguggagcugggcaagaggcccccaggguuguccagc

SEQ ID NO: 482132 - RNA, 64 nt, Homo Sapiens
agaagguccucagccaugccucuucagggucacucugggcaaagagugauugugaugcuauuua

SEQ ID NO: 482133 - RNA, 64 nt, Homo Sapiens
gcgacuccaucucuacaaauaaauaaaaaauuagcugggcaauuggcgggcauggaggugggug

SEQ ID NO: 482134 - RNA, 64 nt, Homo Sapiens
gcagugaguugugauugcaccacugcccuccagccugggcaacagagugaaaccuugucucucu

SEQ ID NO: 482135 - RNA, 64 nt, Homo Sapiens
gucgugagcuaugauuaugccacugcuuuccagccugggcaacauaguaagaccccaucucuua

SEQ ID NO: 482136 - RNA, 64 nt, Homo Sapiens
gcagugagccaugaucgagccacugcacuccagccugggcaacagaugaagacccuauuucaga

SEQ ID NO: 482137 - RNA, 64 nt, Homo Sapiens
gaggauugcuugaagccaggaguuugggaccagccugggcaacauagggggaucccaucucuac

SEQ ID NO: 482138 - RNA, 64 nt, Homo Sapiens
gcagugagcuaugauuguaccacugcacuccagccugggcaacagagcaagaccuugucucaaa

SEQ ID NO: 482139 - RNA, 64 nt, Homo Sapiens
gaggaucacuuaaggccaggaguucgagaccagccugggcaacagcaagaccucaucucuacaa

SEQ ID NO: 482140 - RNA, 64 nt, Homo Sapiens
gcaggaggaucacucgagcucaagaauucaagaccugggcaagagagagagacuuugucucuau

SEQ ID NO: 482141 - RNA, 64 nt, Homo Sapiens
gcagugagcuguguucacaccacugcacuccagucugggcaacagugcaagacccugucacuua

SEQ ID NO: 482142 - RNA, 64 nt, Homo Sapiens
cagcaagauccugucuaaaacacugcacuccagccugggcaacagaagagagcuaugacugcau

SEQ ID NO: 482143 - RNA, 64 nt, Homo Sapiens
uagcaagacccccaccaucuaguuugagaccagccugggcaacagaggacugcuuaagcucagg

SEQ ID NO: 482144 - RNA, 64 nt, Homo Sapiens
cauaguggcuuaugccuguagcagaaaagaagggcugggcaagggguagggggcaggaagagga

SEQ ID NO: 482145 - RNA, 64 nt, Homo Sapiens
uaguaagacccccaucgcuaaguucaagaccagccugggcaauggaggaucaguugagccccag

SEQ ID NO: 482146 - RNA, 64 nt, Homo Sapiens
cagcgagacuccgucucaaacacugcacuccagccugggcaacagcagugaaccaagaucaugc

SEQ ID NO: 482147 - RNA, 64 nt, Homo Sapiens
gagggagcccccgucucaaccacugcacuccagccugggcaacagcauugagccaugauugcac

SEQ ID NO: 482148 - RNA, 64 nt, Homo Sapiens
uggugagaccccaucucuacaguucaagaccagccugggcaacaggggauugauugaggccagg

SEQ ID NO: 482149 - RNA, 64 nt, Homo Sapiens
gagugagacucuguuucuaacacugcacuccagccugggcaacagcagugagccgagaucgucc

SEQ ID NO: 482150 - RNA, 64 nt, Homo Sapiens
uggugaaaccccaucucuacaguucaagaccagccugggcaagauggguggaucacaagucagg

SEQ ID NO: 482151 - RNA, 64 nt, Homo Sapiens
uagggagauccugucucuauguugugaggucaaccugggcaauaaggaucacuugagaccagga

SEQ ID NO: 482152 - RNA, 64 nt, Homo Sapiens
ugaugagaccccaucucuacaguuccagaucaaccugggcaacaaaggauugcuugaggccagg

SEQ ID NO: 482153 - RNA, 64 nt, Homo Sapiens
gaggaucccuuuagcccaggaguuaaagaccagccugggcaacauagggagacccugucuuuuu

SEQ ID NO: 482154 - RNA, 64 nt, Homo Sapiens
ugaggugggaggaucccaggaguucaaauccugccugggcaacauagcaagacccugucucuua

SEQ ID NO: 482155 - RNA, 64 nt, Homo Sapiens
gagugagacucugucucaaacacugcacuccagccugggcaacagcagugagcugagaucacgc

SEQ ID NO: 482156 - RNA, 64 nt, Homo Sapiens
gagcgagacucagucucaaacacugcacuccagccugggcaacagcagugagcugaagucccgc

SEQ ID NO: 482157 - RNA, 64 nt, Homo Sapiens
cagccaaaacccucccagacgucuccucuccugccugggcaaaguccagcuuggcaccccgucu

SEQ ID NO: 482158 - RNA, 64 nt, Homo Sapiens
gcagugagcugagauugcgccauugcacuccagccugggcaacaagagcaaaauucugccucaa

SEQ ID NO: 482159 - RNA, 64 nt, Homo Sapiens
cuccaugaccccucugauucgaguugaccguauucugggcaagaccccaccaugggcuguggga

SEQ ID NO: 482160 - RNA, 64 nt, Homo Sapiens
ccaccccugggagggaugagauccccaguccagccugggcaaccuccuccaccucucccauucc

SEQ ID NO: 482161 - RNA, 64 nt, Homo Sapiens
gagccagacuccgucucuaacacugcacuccagccugggcaacaguagugagcugagaucgugc

SEQ ID NO: 482162 - RNA, 64 nt, Homo Sapiens
uggugaaacccugucucuacaguucgggaccagccugggcaacagcagaucaccugagaucagg

SEQ ID NO: 482163 - RNA, 64 nt, Homo Sapiens
agagugaaauucugucucaacauugcacuccagccugggcaacagcagugagccaagaucuugc

SEQ ID NO: 482164 - RNA, 64 nt, Homo Sapiens
gugaaacuccaucucaaaaacacugcacuccagccugggcaacagcaaugagccgagaucacac

SEQ ID NO: 482165 - RNA, 64 nt, Homo Sapiens; identical to SEQ ID NO: 293686

SEQ ID NO: 482166 - RNA, 64 nt, Homo Sapiens; identical to SEQ ID NO: 293687

SEQ ID NO: 482167 - RNA, 64 nt, Homo Sapiens; identical to SEQ ID NO: 293688

SEQ ID NO: 482168 - RNA, 64 nt, Homo Sapiens; identical to SEQ ID NO: 293689

SEQ ID NO: 482169 - RNA, 64 nt, Homo Sapiens; identical to SEQ ID NO: 293690

SEQ ID NO: 482170 - RNA, 64 nt, Homo Sapiens; identical to SEQ ID NO: 293691

SEQ ID NO: 482171 - RNA, 64 nt, Homo Sapiens; identical to SEQ ID NO: 293692

SEQ ID NO: 482172 - RNA, 64 nt, Homo Sapiens; identical to SEQ ID NO: 293693

SEQ ID NO: 482173 - RNA, 64 nt, Homo Sapiens; identical to SEQ ID NO: 293694

SEQ ID NO: 482174 - RNA, 64 nt, Homo Sapiens; identical to SEQ ID NO: 293695

SEQ ID NO: 482175 - RNA, 64 nt, Homo Sapiens; identical to SEQ ID NO: 293696

SEQ ID NO: 482176 - RNA, 64 nt, Homo Sapiens; identical to SEQ ID NO: 293697

SEQ ID NO: 482177 - RNA, 64 nt, Homo Sapiens; identical to SEQ ID NO: 293698

SEQ ID NO: 482178 - RNA, 64 nt, Homo Sapiens; identical to SEQ ID NO: 293699

SEQ ID NO: 482179 - RNA, 64 nt, Homo Sapiens; identical to SEQ ID NO: 293700

SEQ ID NO: 482180 - RNA, 64 nt, Homo Sapiens; identical to SEQ ID NO: 293701

SEQ ID NO: 482181 - RNA, 64 nt, Homo Sapiens; identical to SEQ ID NO: 44368

SEQ ID NO: 482182 - RNA, 64 nt, Homo Sapiens; identical to SEQ ID NO: 44369

SEQ ID NO: 482183 - RNA, 64 nt, Homo Sapiens; identical to SEQ ID NO: 44370

SEQ ID NO: 482184 - RNA, 64 nt, Homo Sapiens; identical to SEQ ID NO: 44371

SEQ ID NO: 482185 - RNA, 64 nt, Homo Sapiens; identical to SEQ ID NO: 44372

SEQ ID NO: 482186 - RNA, 64 nt, Homo Sapiens; identical to SEQ ID NO: 44373

SEQ ID NO: 482187 - RNA, 64 nt, Homo Sapiens; identical to SEQ ID NO: 128910

SEQ ID NO: 482188 - RNA, 64 nt, Homo Sapiens; identical to SEQ ID NO: 128911

SEQ ID NO: 482189 - RNA, 64 nt, Homo Sapiens; identical to SEQ ID NO: 128912

SEQ ID NO: 482190 - RNA, 64 nt, Homo Sapiens; identical to SEQ ID NO: 128913

SEQ ID NO: 482191 - RNA, 64 nt, Homo Sapiens; identical to SEQ ID NO: 128914

SEQ ID NO: 482192 - RNA, 64 nt, Homo Sapiens; identical to SEQ ID NO: 128915

SEQ ID NO: 482193 - RNA, 64 nt, Homo Sapiens; identical to SEQ ID NO: 128916

SEQ ID NO: 482194 - RNA, 64 nt, Homo Sapiens; identical to SEQ ID NO: 128917

SEQ ID NO: 482195 - RNA, 64 nt, Homo Sapiens; identical to SEQ ID NO: 128918

SEQ ID NO: 482196 - RNA, 64 nt, Homo Sapiens; identical to SEQ ID NO: 128919

SEQ ID NO: 482197 - RNA, 64 nt, Homo Sapiens; identical to SEQ ID NO: 128920

SEQ ID NO: 482198 - RNA, 64 nt, Homo Sapiens; identical to SEQ ID NO: 128921

SEQ ID NO: 482199 - RNA, 64 nt, Homo Sapiens; identical to SEQ ID NO: 128922

SEQ ID NO: 482200 - RNA, 64 nt, Homo Sapiens; identical to SEQ ID NO: 128923

SEQ ID NO: 482201 - RNA, 64 nt, Homo Sapiens; identical to SEQ ID NO: 128924

SEQ ID NO: 482202 - RNA, 64 nt, Homo Sapiens; identical to SEQ ID NO: 128925

SEQ ID NO: 482203 - RNA, 64 nt, Homo Sapiens; identical to SEQ ID NO: 128926

SEQ ID NO: 482204 - RNA, 64 nt, Homo Sapiens; identical to SEQ ID NO: 128927

SEQ ID NO: 482205 - RNA, 64 nt, Homo Sapiens; identical to SEQ ID NO: 128928

SEQ ID NO: 482206 - RNA, 64 nt, Homo Sapiens; identical to SEQ ID NO: 128929

SEQ ID NO: 482207 - RNA, 64 nt, Homo Sapiens; identical to SEQ ID NO: 128930

SEQ ID NO: 482208 - RNA, 64 nt, Homo Sapiens; identical to SEQ ID NO: 128931

SEQ ID NO: 482209 - RNA, 64 nt, Homo Sapiens; identical to SEQ ID NO: 128932

SEQ ID NO: 482210 - RNA, 64 nt, Homo Sapiens; identical to SEQ ID NO: 128933

SEQ ID NO: 482211 - RNA, 64 nt, Homo Sapiens; identical to SEQ ID NO: 128934

SEQ ID NO: 482212 - RNA, 64 nt, Homo Sapiens; identical to SEQ ID NO: 128935

SEQ ID NO: 482213 - RNA, 64 nt, Homo Sapiens; identical to SEQ ID NO: 128936

SEQ ID NO: 482214 - RNA, 64 nt, Homo Sapiens; identical to SEQ ID NO: 128937

SEQ ID NO: 482215 - RNA, 64 nt, Homo Sapiens; identical to SEQ ID NO: 128938

SEQ ID NO: 482216 - RNA, 64 nt, Homo Sapiens; identical to SEQ ID NO: 128939

SEQ ID NO: 482217 - RNA, 64 nt, Homo Sapiens; identical to SEQ ID NO: 128940

SEQ ID NO: 482218 - RNA, 64 nt, Homo Sapiens; identical to SEQ ID NO: 128941

SEQ ID NO: 482219 - RNA, 64 nt, Homo Sapiens; identical to SEQ ID NO: 128942

SEQ ID NO: 482220 - RNA, 64 nt, Homo Sapiens; identical to SEQ ID NO: 128943

SEQ ID NO: 482221 - RNA, 64 nt, Homo Sapiens
uguuuuuggucuguugaagaaauaaagcagggacugugaacauuagcgugugugaacaaaugga

SEQ ID NO: 482222 - RNA, 64 nt, Homo Sapiens
uggaaauaaagcagggacuguuuuuuaaagcgugugugaacaaagugcauguguuuuuuuuuuu

SEQ ID NO: 482223 - RNA, 64 nt, Homo Sapiens
auuuugauuaauuaauaagguaaaauuaaguugaugugaacauauaugagcuauaauaaacuug

SEQ ID NO: 482224 - RNA, 64 nt, Homo Sapiens
guuaaauagcaucaguuuguucaaauuaaauggcugugaacaauuagaaucuaaaauuuguuau

SEQ ID NO: 482225 - RNA, 64 nt, Homo Sapiens
guuuguaguucucuacauuucucuggauggagacugugaacaucugauuguucagcaaccuuca

SEQ ID NO: 482226 - RNA, 64 nt, Homo Sapiens
caagcucucaucauaugcaaauucucagaagggcugugaacaccuuaguaauaaauuuaucuuu

SEQ ID NO: 482227 - RNA, 64 nt, Homo Sapiens
cuguuugagaaugaugcuacucugaucuaaugaaugugaacauguagauguuuuguguguauuu

SEQ ID NO: 482228 - RNA, 64 nt, Homo Sapiens
agaaaaauuuuguuaggccacaaaaacacugcacugugaacauuuuagaaaagguaugucagac

SEQ ID NO: 482229 - RNA, 64 nt, Homo Sapiens
uaaauauguguguuuacacauaugucugcaugcaugugaacacacacacacacacacacacacc

SEQ ID NO: 482230 - RNA, 64 nt, Homo Sapiens
gaauguuucuauuuacaacugugcuuaucaaaauugugaacacccccacccccgcauuuuugug

SEQ ID NO: 482231 - RNA, 64 nt, Homo Sapiens
cgugucuggguugccuggggcucacagccucacaugugaacacccuccuuugugcuauguggag

SEQ ID NO: 482232 - RNA, 64 nt, Homo Sapiens
uacuuuccuuuuuuacauguuaacucaaaaguuuugugaacaaguucuuacacacucacacaca

SEQ ID NO: 482233 - RNA, 64 nt, Homo Sapiens
cauuuucauuuucugggauauguacagguuuuuaugugaacauaaaagcugcugugaacauuca

SEQ ID NO: 482234 - RNA, 64 nt, Homo Sapiens
cauguacagguuuuuaugugccuaauaaagcugcugugaacauuaguuguuuucaguuuuuugc

SEQ ID NO: 482235 - RNA, 64 nt, Homo Sapiens
guauaaagagcugauaacaguacucagaagaaucugugaacaaauacuugaaaauggguucaau

SEQ ID NO: 482236 - RNA, 64 nt, Homo Sapiens
guagacugccauuauguguggucuucccauuaaaugugaacauuuuaauauguaugcauucacc

SEQ ID NO: 482237 - RNA, 64 nt, Homo Sapiens
guggccacggcugcuugugaaagccucuuacugccccacuuaggugcuggucacgugguagaug

SEQ ID NO: 482238 - RNA, 64 nt, Homo Sapiens
uacuuuaacuacugugacuuguucucuggccacacccacuuaugaauaaccagugagaggggca

SEQ ID NO: 482239 - RNA, 64 nt, Homo Sapiens
gauggguagggauuuauccaaucuaagcccuaaccccacuuagugaccucaguguuuucuucca

SEQ ID NO: 482240 - RNA, 64 nt, Homo Sapiens
cuuuaaaaaccuuccugagacuuaagcauucugccccacuuacuaacugccaguucuccagcac

SEQ ID NO: 482241 - RNA, 64 nt, Homo Sapiens
gguguagccaguguuucccauaugccccuggagccccacuuauugaggccagcagaauaggugc

SEQ ID NO: 482242 - RNA, 64 nt, Homo Sapiens
gaaaagacugggggauaugaaaucuucccccuaccccacuuaaugcguuggauaugauuuuuca

SEQ ID NO: 482243 - RNA, 64 nt, Homo Sapiens
ggagaacuagguguccagauuaucagccaaggagcccacuuaggcaaugugcuacgauccaaga

SEQ ID NO: 482244 - RNA, 64 nt, Homo Sapiens
cauaaaauguaacccauuuaguccauuucuugaacccacuuauaauaagcuaagaucacuauag

SEQ ID NO: 482245 - RNA, 64 nt, Homo Sapiens; identical to SEQ ID NO: 112922

SEQ ID NO: 482246 - RNA, 64 nt, Homo Sapiens; identical to SEQ ID NO: 112923

SEQ ID NO: 482247 - RNA, 64 nt, Homo Sapiens; identical to SEQ ID NO: 112924

SEQ ID NO: 482248 - RNA, 64 nt, Homo Sapiens; identical to SEQ ID NO: 112925

SEQ ID NO: 482249 - RNA, 64 nt, Homo Sapiens; identical to SEQ ID NO: 112926

SEQ ID NO: 482250 - RNA, 64 nt, Homo Sapiens; identical to SEQ ID NO: 112927

SEQ ID NO: 482251 - RNA, 64 nt, Homo Sapiens; identical to SEQ ID NO: 112928

SEQ ID NO: 482252 - RNA, 64 nt, Homo Sapiens; identical to SEQ ID NO: 112929

SEQ ID NO: 482253 - RNA, 64 nt, Homo Sapiens; identical to SEQ ID NO: 112930

SEQ ID NO: 482254 - RNA, 64 nt, Homo Sapiens; identical to SEQ ID NO: 112931

SEQ ID NO: 482255 - RNA, 64 nt, Homo Sapiens; identical to SEQ ID NO: 112932

SEQ ID NO: 482256 - RNA, 64 nt, Homo Sapiens; identical to SEQ ID NO: 112933

SEQ ID NO: 482257 - RNA, 64 nt, Homo Sapiens; identical to SEQ ID NO: 112934

SEQ ID NO: 482258 - RNA, 64 nt, Homo Sapiens; identical to SEQ ID NO: 112935

SEQ ID NO: 482259 - RNA, 64 nt, Homo Sapiens; identical to SEQ ID NO: 112936

SEQ ID NO: 482260 - RNA, 64 nt, Homo Sapiens; identical to SEQ ID NO: 112937

SEQ ID NO: 482261 - RNA, 64 nt, Homo Sapiens; identical to SEQ ID NO: 112938

SEQ ID NO: 482262 - RNA, 64 nt, Homo Sapiens; identical to SEQ ID NO: 112939

SEQ ID NO: 482263 - RNA, 64 nt, Homo Sapiens; identical to SEQ ID NO: 112940

SEQ ID NO: 482264 - RNA, 64 nt, Homo Sapiens; identical to SEQ ID NO: 112941

SEQ ID NO: 482265 - RNA, 64 nt, Homo Sapiens; identical to SEQ ID NO: 112942

SEQ ID NO: 482266 - RNA, 64 nt, Homo Sapiens; identical to SEQ ID NO: 112943

SEQ ID NO: 482267 - RNA, 64 nt, Homo Sapiens; identical to SEQ ID NO: 112944

SEQ ID NO: 482268 - RNA, 64 nt, Homo Sapiens; identical to SEQ ID NO: 112945

SEQ ID NO: 482269 - RNA, 64 nt, Homo Sapiens; identical to SEQ ID NO: 112946

SEQ ID NO: 482270 - RNA, 64 nt, Homo Sapiens; identical to SEQ ID NO: 112947

SEQ ID NO: 482271 - RNA, 64 nt, Homo Sapiens; identical to SEQ ID NO: 112948

SEQ ID NO: 482272 - RNA, 64 nt, Homo Sapiens; identical to SEQ ID NO: 112949

SEQ ID NO: 482273 - RNA, 64 nt, Homo Sapiens; identical to SEQ ID NO: 112950

SEQ ID NO: 482274 - RNA, 64 nt, Homo Sapiens; identical to SEQ ID NO: 112951

SEQ ID NO: 482275 - RNA, 64 nt, Homo Sapiens; identical to SEQ ID NO: 112952

SEQ ID NO: 482276 - RNA, 64 nt, Homo Sapiens; identical to SEQ ID NO: 112953

SEQ ID NO: 482277 - RNA, 64 nt, Homo Sapiens; identical to SEQ ID NO: 112954

SEQ ID NO: 482278 - RNA, 50 nt, Homo Sapiens; identical to SEQ ID NO: 112955

SEQ ID NO: 482279 - RNA, 64 nt, Homo Sapiens; identical to SEQ ID NO: 112956

SEQ ID NO: 482280 - RNA, 64 nt, Homo Sapiens; identical to SEQ ID NO: 112957

SEQ ID NO: 482281 - RNA, 64 nt, Homo Sapiens; identical to SEQ ID NO: 112958

SEQ ID NO: 482282 - RNA, 64 nt, Homo Sapiens; identical to SEQ ID NO: 112959

SEQ ID NO: 482283 - RNA, 64 nt, Homo Sapiens; identical to SEQ ID NO: 112960

SEQ ID NO: 482284 - RNA, 64 nt, Homo Sapiens; identical to SEQ ID NO: 112961

SEQ ID NO: 482285 - RNA, 64 nt, Homo Sapiens
gaaacuccuguucaugcccagcuagaacagucucuugaggcacaucccuggggcuuuaacuccu

SEQ ID NO: 482286 - RNA, 64 nt, Homo Sapiens
cacugccaaaacaucaaccugucugcuggagacauugaggcaggcaucucagguguguugcagu

SEQ ID NO: 482287 - RNA, 64 nt, Homo Sapiens
ggggaguaguucuugguaggcuccgaacucuguuuugaggcaaacaaaagucccaauuaagaac

SEQ ID NO: 482288 - RNA, 64 nt, Homo Sapiens
gcagccacugcucguuguaacugcauguaccaucuugaggcacacgagauauaugauuccaguu

SEQ ID NO: 482289 - RNA, 64 nt, Homo Sapiens
aggaucgcuugagcccaggagcuacuuugggagguugaggcaggggugcaugcuugugguccca

SEQ ID NO: 482290 - RNA, 64 nt, Homo Sapiens
uugaaggauucacaggguaaucuguuggcucaaguugaggcagguuucaggaggugccagcagc

SEQ ID NO: 482291 - RNA, 64 nt, Homo Sapiens
uggugcacgccugcagucccagcuacucaggagguugaggcagaagaaucgcuugaacccagga

SEQ ID NO: 482292 - RNA, 64 nt, Homo Sapiens
acugaggcucagagaaggugugaccucuuguugcuugaggcacagaguuauaaaguaacauauc

SEQ ID NO: 482293 - RNA, 64 nt, Homo Sapiens; identical to SEQ ID NO: 163189

SEQ ID NO: 482294 - RNA, 64 nt, Homo Sapiens; identical to SEQ ID NO: 163190

SEQ ID NO: 482295 - RNA, 64 nt, Homo Sapiens; identical to SEQ ID NO: 163191

SEQ ID NO: 482296 - RNA, 64 nt, Homo Sapiens; identical to SEQ ID NO: 163192

SEQ ID NO: 482297 - RNA, 64 nt, Homo Sapiens; identical to SEQ ID NO: 163193

SEQ ID NO: 482298 - RNA, 64 nt, Homo Sapiens; identical to SEQ ID NO: 163194

SEQ ID NO: 482299 - RNA, 64 nt, Homo Sapiens; identical to SEQ ID NO: 163195

SEQ ID NO: 482300 - RNA, 64 nt, Homo Sapiens; identical to SEQ ID NO: 163196

SEQ ID NO: 482301 - RNA, 64 nt, Homo Sapiens; identical to SEQ ID NO: 163197

SEQ ID NO: 482302 - RNA, 64 nt, Homo Sapiens; identical to SEQ ID NO: 163198

SEQ ID NO: 482303 - RNA, 64 nt, Homo Sapiens; identical to SEQ ID NO: 163199

SEQ ID NO: 482304 - RNA, 64 nt, Homo Sapiens; identical to SEQ ID NO: 163200

SEQ ID NO: 482305 - RNA, 64 nt, Homo Sapiens; identical to SEQ ID NO: 163201

SEQ ID NO: 482306 - RNA, 64 nt, Homo Sapiens; identical to SEQ ID NO: 163202

SEQ ID NO: 482307 - RNA, 64 nt, Homo Sapiens; identical to SEQ ID NO: 163203

SEQ ID NO: 482308 - RNA, 64 nt, Homo Sapiens; identical to SEQ ID NO: 163204

SEQ ID NO: 482309 - RNA, 64 nt, Homo Sapiens; identical to SEQ ID NO: 163205

SEQ ID NO: 482310 - RNA, 64 nt, Homo Sapiens; identical to SEQ ID NO: 163206

SEQ ID NO: 482311 - RNA, 64 nt, Homo Sapiens; identical to SEQ ID NO: 163207

SEQ ID NO: 482312 - RNA, 64 nt, Homo Sapiens; identical to SEQ ID NO: 163208

SEQ ID NO: 482313 - RNA, 64 nt, Homo Sapiens; identical to SEQ ID NO: 163209

SEQ ID NO: 482314 - RNA, 64 nt, Homo Sapiens; identical to SEQ ID NO: 163210

SEQ ID NO: 482315 - RNA, 64 nt, Homo Sapiens; identical to SEQ ID NO: 163211

SEQ ID NO: 482316 - RNA, 64 nt, Homo Sapiens; identical to SEQ ID NO: 163212

SEQ ID NO: 482317 - RNA, 64 nt, Homo Sapiens; identical to SEQ ID NO: 163213

SEQ ID NO: 482318 - RNA, 64 nt, Homo Sapiens; identical to SEQ ID NO: 163214

SEQ ID NO: 482319 - RNA, 64 nt, Homo Sapiens; identical to SEQ ID NO: 163215

SEQ ID NO: 482320 - RNA, 64 nt, Homo Sapiens; identical to SEQ ID NO: 163216

SEQ ID NO: 482321 - RNA, 64 nt, Homo Sapiens; identical to SEQ ID NO: 163217

SEQ ID NO: 482322 - RNA, 64 nt, Homo Sapiens; identical to SEQ ID NO: 163218

SEQ ID NO: 482323 - RNA, 64 nt, Homo Sapiens; identical to SEQ ID NO: 163219

SEQ ID NO: 482324 - RNA, 64 nt, Homo Sapiens; identical to SEQ ID NO: 163220

SEQ ID NO: 482325 - RNA, 64 nt, Homo Sapiens; identical to SEQ ID NO: 163221

SEQ ID NO: 482326 - RNA, 64 nt, Homo Sapiens; identical to SEQ ID NO: 163222

SEQ ID NO: 482327 - RNA, 64 nt, Homo Sapiens; identical to SEQ ID NO: 163223

SEQ ID NO: 482328 - RNA, 64 nt, Homo Sapiens; identical to SEQ ID NO: 163224

SEQ ID NO: 482329 - RNA, 64 nt, Homo Sapiens; identical to SEQ ID NO: 163225

SEQ ID NO: 482330 - RNA, 64 nt, Homo Sapiens; identical to SEQ ID NO: 163226

SEQ ID NO: 482331 - RNA, 64 nt, Homo Sapiens; identical to SEQ ID NO: 163227

SEQ ID NO: 482332 - RNA, 64 nt, Homo Sapiens; identical to SEQ ID NO: 163228

SEQ ID NO: 482333 - RNA, 64 nt, Homo Sapiens; identical to SEQ ID NO: 163229

SEQ ID NO: 482334 - RNA, 64 nt, Homo Sapiens; identical to SEQ ID NO: 163230

SEQ ID NO: 482335 - RNA, 64 nt, Homo Sapiens
gcuggcuaaugaaagccuccucaccucuucccaacccuuacaagcaagggugcuaggggcucag

SEQ ID NO: 482336 - RNA, 64 nt, Homo Sapiens
acaaguguccucucuucugcauacauuugggcuccccuuacagagcccuuugcccuggcucucu

SEQ ID NO: 482337 - RNA, 64 nt, Homo Sapiens
ccugguaguuuggggaaaggcuggagaggcugcucccuuacagaacucaauggggaccaccuuc

SEQ ID NO: 482338 - RNA, 64 nt, Homo Sapiens
cuuuggucuuacacauccuuugacaucuuuaaaccccuuacacucccucuacgucucucuagaa

SEQ ID NO: 482339 - RNA, 64 nt, Homo Sapiens
uggacuauugugccaacugccaggcugccuccugcccuuacagcccuaaguggcugccuucuuu

SEQ ID NO: 482340 - RNA, 64 nt, Homo Sapiens
aaaggacuugauguacauaacuccugucccuuuucccuuacaagguggggauugccccuggcuu

SEQ ID NO: 482341 - RNA, 64 nt, Homo Sapiens
cgaguggccagcuucacucucugggggagugcaggguggacaucaccuuggaggcccugcacug

SEQ ID NO: 482342 - RNA, 64 nt, Homo Sapiens
aucagaagcucccagcugaccagacacugccugggguggacauucagcagagugcgaguggaga

SEQ ID NO: 482343 - RNA, 64 nt, Homo Sapiens
uucacugguggaccaguuggguuagcucagggccgguggacaugcaggaauaauaaaccaauga

SEQ ID NO: 482344 - RNA, 64 nt, Homo Sapiens
uuuucaaccuuuauuaaaaaauuuuuuaauccaggguggacauuacguuccccuugguuaacug

SEQ ID NO: 482345 - RNA, 64 nt, Homo Sapiens
ggucaccuaucuguagccagcucggugagggacagguggacaacgcgggccggcaaggccauac

SEQ ID NO: 482346 - RNA, 64 nt, Homo Sapiens
gaaaggcuucucagccucugcccacacccagccugguggacauggguccucuugguaagugugg

SEQ ID NO: 482347 - RNA, 64 nt, Homo Sapiens
acuucaacgcaugauauuuaaccacguggcaagugguggacaaacugaaccacguaaagcucga

SEQ ID NO: 482348 - RNA, 64 nt, Homo Sapiens
caacccagcaucccccgaccgaagaauggaggaagguggacaagcugggggcucuuccaaguca

SEQ ID NO: 482349 - RNA, 64 nt, Homo Sapiens
agcuaacccugagcuuguccgacaugggaaagcagguggacaugacaccuugguggcacuggug

SEQ ID NO: 482350 - RNA, 64 nt, Homo Sapiens
ggaaagcagguggacaugagaccuugguggcacugguggacauggacccgcuggccagagggac

SEQ ID NO: 482351 - RNA, 64 nt, Homo Sapiens
cuuucagcgaaguaggagaaugacauucaaccaagguggacagcuauccgcuuacgguacaagc

SEQ ID NO: 482352 - RNA, 64 nt, Homo Sapiens
ggaccugcgcagauggggaccugauugacuuggagguggacaaugcugcaugaagaccugcccc

SEQ ID NO: 482353 - RNA, 64 nt, Homo Sapiens
gaacucaugccaacagucuuuaugaugggauuaagguggacaagaucuccuaagaucugugaau

SEQ ID NO: 482354 - RNA, 64 nt, Homo Sapiens
gacaagaucuccuaagaucugugaaugggauuaagguggacaagaucuccuaagaucugaaaag

SEQ ID NO: 482355 - RNA, 64 nt, Homo Sapiens
gccccgugcacucgggggccggaggaccggagucccugcagaagcuccuaugcugguggaaggc

SEQ ID NO: 482356 - RNA, 64 nt, Homo Sapiens
cuuuucucugaauuccuuaugggggccuuggguaccugcagagcccccucggugcugcaggcug

SEQ ID NO: 482357 - RNA, 64 nt, Homo Sapiens
guuuugccagcuuugcuucuccuuccucucuguuccugcagacacuuuuuucucuaauuuucua

SEQ ID NO: 482358 - RNA, 64 nt, Homo Sapiens
cugggagcugcaggaacugugguugguucuagccccugcagagcugccuuggucuuguuucugu

SEQ ID NO: 482359 - RNA, 64 nt, Homo Sapiens
accauggcauucccuauucccauagugugggggaccugcagagauacuugcugacuuaaccccc

SEQ ID NO: 482360 - RNA, 64 nt, Homo Sapiens
aacucggucccuuccugucucuaguucaucagcaccugcagaugccugacucuuguuagccuua

SEQ ID NO: 482361 - RNA, 64 nt, Homo Sapiens
caauggcccuuucacaagcucuugccucacaaccccugcagaaguccuucaacaaaacuaauaa

SEQ ID NO: 482362 - RNA, 64 nt, Homo Sapiens
ucaccguuggcuacccggucacggaggccggccaccugcagagccucuacacagguagugcccc

SEQ ID NO: 482363 - RNA, 64 nt, Homo Sapiens
gggucucagaaccgagugagguguacauugccguccugcagagauccaggcugcacgcggcgga

SEQ ID NO: 482364 - RNA, 64 nt, Homo Sapiens
gcuuccuagcucaugcccaucugucuggguucucccugcagacagaggaugaccuucggucggu

SEQ ID NO: 482365 - RNA, 64 nt, Homo Sapiens
uaucacaguuagcuggggcuguucaaauccuuacccugcagaaauguccacugccacuccccca

SEQ ID NO: 482366 - RNA, 64 nt, Homo Sapiens
aaagccucuauagaaaguccucugugaucugacuccugcagacucuuccagauuuuucugccca

SEQ ID NO: 482367 - RNA, 64 nt, Homo Sapiens
aaaauacgcauguucucacccagagugacaaaauccugcagauagguuuaagaccuaguggcuc

SEQ ID NO: 482368 - RNA, 64 nt, Homo Sapiens
cgcccgcauuucuccagggcgacaaucaaaaaugccugcagacaccaccccgcccccaaaucgu

SEQ ID NO: 482369 - RNA, 64 nt, Homo Sapiens
cgagcagagcccgcagcccagcugcucuaaggcgccugcagagguccgcacgggggaccucgga

SEQ ID NO: 482370 - RNA, 64 nt, Homo Sapiens
ucuggggcugaggacacacagauacauaaugacaccugcagaaauguauucucugaggacacuu

SEQ ID NO: 482371 - RNA, 64 nt, Homo Sapiens
agaagcagacgcuggcaccgugcugcuuguacagccugcagagccgugagccaaguaaaccucu

SEQ ID NO: 482372 - RNA, 64 nt, Homo Sapiens
gaggggcgcauuccuccagcgccaagcgucagagccugcagacaacggagggcagcgccccccc

SEQ ID NO: 482373 - RNA, 64 nt, Homo Sapiens
gaagcuucuccuccccaaggcggccauggggcagccugcagaggacaguggacguggagcugcg

SEQ ID NO: 482374 - RNA, 64 nt, Homo Sapiens
aaagcugggacaucccaccacacgcugagccagaccugcagagugggaagcuggaccagggcag

SEQ ID NO: 482375 - RNA, 64 nt, Homo Sapiens
aucuguucccagcagaggagagcugcugcgcugaccugcagagguugguggucccagcacagag

SEQ ID NO: 482376 - RNA, 64 nt, Homo Sapiens
cagacucaccaacuuugcaauagaaauacuggugccugcagagcagcacuaacaguggcaggug

SEQ ID NO: 482377 - RNA, 64 nt, Homo Sapiens
ugguccaaguccuuauucugcuugccccaacuuaccugcagacacuccuuuugcuaccacucaa

SEQ ID NO: 482378 - RNA, 64 nt, Homo Sapiens
guggccuuagugcaggaaacucagcccugguggcccugcagaacaaugcaucugacaugugcga

SEQ ID NO: 482379 - RNA, 64 nt, Homo Sapiens
ccaggaccgagcucuuccugcuguuugccggccuccugcagagguaccgccugcugcccccgcc

SEQ ID NO: 482380 - RNA, 64 nt, Homo Sapiens
cgugcgagcccugcaccccccagguccugggacuccugcagaccccacuccauucccgcuccug

SEQ ID NO: 482381 - RNA, 64 nt, Homo Sapiens
acuuuucguuggggaagagaguaauuuacuccugccugcagaaugaguuuagccaacagaacag

SEQ ID NO: 482382 - RNA, 64 nt, Homo Sapiens
gccuuucucccagcuuugccccagcauuuuggaaccugcagagauuccuagagcccaucccgca

SEQ ID NO: 482383 - RNA, 64 nt, Homo Sapiens
ccgguuucuauuuugcacacaggccggagcugagccugcagaccagcaccugcagaggagcagg

SEQ ID NO: 482384 - RNA, 64 nt, Homo Sapiens
agcaggaggccggagcugagggacaugcagagcaccugcagaggcagagcccggcaccccauga

SEQ ID NO: 482385 - RNA, 64 nt, Homo Sapiens
ccccauggcauggagcuuacucaagccugccuguccugcagaguuguccaggcacaguggcucc

SEQ ID NO: 482386 - RNA, 64 nt, Homo Sapiens
cuguccaggcacaguggcucaccaagugggggagccugcagaacgcuuccccuccagcacaggg

SEQ ID NO: 482387 - RNA, 64 nt, Homo Sapiens
auaagcacagaaaauuauaauguguauuuccuccccugcagaaaccaguguggcguugaauaga

SEQ ID NO: 482388 - RNA, 64 nt, Homo Sapiens
acacuuggggggaccucagccaucaacacagcagccugcagauacugugaucuucccagcucug

SEQ ID NO: 482389 - RNA, 64 nt, Homo Sapiens
gggagcagcccaaacuggcuggguuucagcaauuccugcagagccugcagcccaggacgacuga

SEQ ID NO: 482390 - RNA, 64 nt, Homo Sapiens
ccugcagcccaggacgacugaagcucuugcagccccugcagacgagagucaggccagcacccug

SEQ ID NO: 482391 - RNA, 64 nt, Homo Sapiens
uugcagaaaagaaacauguuaaaaucauggcacaccugcagaauuucagaugacagugugguca

SEQ ID NO: 482392 - RNA, 64 nt, Homo Sapiens
agauguaccaugaacuaacaauucuuugaaaggaccugcagaagcauuuuuaauaccucauucu

SEQ ID NO: 482393 - RNA, 64 nt, Homo Sapiens
agauagcuugcuguauucuguauagcuuacucuaccugcagacagaaaaugaaagaaaaaaaug

SEQ ID NO: 482394 - RNA, 64 nt, Homo Sapiens
gguucagcuuuuagcaaaaagggcuacaguucacccugcagaguauuaagguuucuggauuuuu

SEQ ID NO: 482395 - RNA, 64 nt, Homo Sapiens
gauagcgauagcuuuuaguagacagcgguaggugccugcagaacuuguguuuuucucaucuuua

SEQ ID NO: 482396 - RNA, 64 nt, Homo Sapiens
ggguggaggcucugccuugccucaagaaccauccccugcagagcauccagggagguuucucgcc

SEQ ID NO: 482397 - RNA, 64 nt, Homo Sapiens
gguccuuccccaaucaggugugggacauccagaaccugcagaaggugaacaccauccgggccca

SEQ ID NO: 482398 - RNA, 64 nt, Homo Sapiens
ucugggacauccgaacccuugacugcauccacguccugcagacgucugguggcagcgucuacuc

SEQ ID NO: 482399 - RNA, 64 nt, Homo Sapiens
cucacagaggcacaaacccacauaguuguggacgccugcagagacucaaauauugagaggacuu

SEQ ID NO: 482400 - RNA, 64 nt, Homo Sapiens
ucauggcaacagaacgugggaugcuggaggcaugccugcagaaggacuguugaugcgacccaaa

SEQ ID NO: 482401 - RNA, 64 nt, Homo Sapiens
ccggugaggugggaugauuucgcccgcaggcagcccugcagacaucagcuggaccuugcugugu

SEQ ID NO: 482402 - RNA, 64 nt, Homo Sapiens
ucuggcccuggcggguggcucuuucagggcagccccugcagacgaucugagccagcaccgccgg

SEQ ID NO: 482403 - RNA, 64 nt, Homo Sapiens
aaucaguacagguuaucccguucuuugaaaagguccugcagagauguuucucucuugaagagga

SEQ ID NO: 482404 - RNA, 64 nt, Homo Sapiens
ggaugcuucugccuagugacgaggggccacugucccugcagagucaggagcggcgggcuuuccc

SEQ ID NO: 482405 - RNA, 64 nt, Homo Sapiens
uggaugcucaaggcccugccgugcaccaguugguccugcagaacugcugcugcagaacgcacag

SEQ ID NO: 482406 - RNA, 64 nt, Homo Sapiens
gcucugaagagaaggagggacggccggacgaugcccugcagacuucccuccaggaaaugaggac

SEQ ID NO: 482407 - RNA, 64 nt, Homo Sapiens
uggcuaucuuucuuggcuaacauuaaauauucuuguaccagagcauggaaaaucguuuauaauu

SEQ ID NO: 482408 - RNA, 64 nt, Homo Sapiens
gcucauucacucaguaauacugagcacuuaccauguaccagaauuuuacuaggcacaaccauga

SEQ ID NO: 482409 - RNA, 64 nt, Homo Sapiens; identical to SEQ ID NO: 123292

SEQ ID NO: 482410 - RNA, 64 nt, Homo Sapiens; identical to SEQ ID NO: 123293

SEQ ID NO: 482411 - RNA, 64 nt, Homo Sapiens; identical to SEQ ID NO: 123294

SEQ ID NO: 482412 - RNA, 64 nt, Homo Sapiens; identical to SEQ ID NO: 123295

SEQ ID NO: 482413 - RNA, 64 nt, Homo Sapiens; identical to SEQ ID NO: 123296

SEQ ID NO: 482414 - RNA, 64 nt, Homo Sapiens; identical to SEQ ID NO: 123297

SEQ ID NO: 482415 - RNA, 64 nt, Homo Sapiens; identical to SEQ ID NO: 123298

SEQ ID NO: 482416 - RNA, 64 nt, Homo Sapiens; identical to SEQ ID NO: 123299

SEQ ID NO: 482417 - RNA, 64 nt, Homo Sapiens; identical to SEQ ID NO: 123300

SEQ ID NO: 482418 - RNA, 64 nt, Homo Sapiens; identical to SEQ ID NO: 123301

SEQ ID NO: 482419 - RNA, 64 nt, Homo Sapiens; identical to SEQ ID NO: 123302

SEQ ID NO: 482420 - RNA, 64 nt, Homo Sapiens; identical to SEQ ID NO: 123303

SEQ ID NO: 482421 - RNA, 64 nt, Homo Sapiens; identical to SEQ ID NO: 123304

SEQ ID NO: 482422 - RNA, 64 nt, Homo Sapiens; identical to SEQ ID NO: 123305

SEQ ID NO: 482423 - RNA, 64 nt, Homo Sapiens; identical to SEQ ID NO: 123306

SEQ ID NO: 482424 - RNA, 64 nt, Homo Sapiens; identical to SEQ ID NO: 123307

SEQ ID NO: 482425 - RNA, 64 nt, Homo Sapiens; identical to SEQ ID NO: 234336

SEQ ID NO: 482426 - RNA, 64 nt, Homo Sapiens; identical to SEQ ID NO: 234337

SEQ ID NO: 482427 - RNA, 64 nt, Homo Sapiens; identical to SEQ ID NO: 234338

SEQ ID NO: 482428 - RNA, 64 nt, Homo Sapiens; identical to SEQ ID NO: 234339

SEQ ID NO: 482429 - RNA, 64 nt, Homo Sapiens; identical to SEQ ID NO: 234340

SEQ ID NO: 482430 - RNA, 64 nt, Homo Sapiens; identical to SEQ ID NO: 234341

SEQ ID NO: 482431 - RNA, 64 nt, Homo Sapiens; identical to SEQ ID NO: 234342

SEQ ID NO: 482432 - RNA, 64 nt, Homo Sapiens; identical to SEQ ID NO: 234343

SEQ ID NO: 482433 - RNA, 64 nt, Homo Sapiens; identical to SEQ ID NO: 234344

SEQ ID NO: 482434 - RNA, 64 nt, Homo Sapiens; identical to SEQ ID NO: 234345

SEQ ID NO: 482435 - RNA, 64 nt, Homo Sapiens
cuuagagaugcuaauggaauccaggcccgagcuggcagaagagagcucuuuuaggcagaagaau

SEQ ID NO: 482436 - RNA, 64 nt, Homo Sapiens
ccaggcccgagcuggcagaacauagcucuuuuaggcagaagaaucaguggggagcagaagcacu

SEQ ID NO: 482437 - RNA, 64 nt, Homo Sapiens
caaccagaggguuccuggaggcccucuaggaggggcagaagagcucaacacaccuaagccagug

SEQ ID NO: 482438 - RNA, 64 nt, Homo Sapiens
caugggaggaggaggugggggcaaacacgugggugcagaagaccugcucugggccugacucaaa

SEQ ID NO: 482439 - RNA, 64 nt, Homo Sapiens
uuuuauuucuuuggucugugagcaacucaaagaggcagaagaggagaaugacuuuuccagaaua

SEQ ID NO: 482440 - RNA, 64 nt, Homo Sapiens
gcugguaaguccuagggauuuccagaaguagccugcagaagaagguaaguuugaaagccacucc

SEQ ID NO: 482441 - RNA, 64 nt, Homo Sapiens
auucugagcaggaaauuuauaagaaauugaaagagcagaagaauuacagcccugucacaugugc

SEQ ID NO: 482442 - RNA, 64 nt, Homo Sapiens
ccacaggcugguggccauguucucugaauugggugcagaagacaagggcagaguggcugcggcc

SEQ ID NO: 482443 - RNA, 64 nt, Homo Sapiens
gccccuauuaccuuuguagcagccacaucagaaagcagaagaaaacaguauuucugaaggcauu

SEQ ID NO: 482444 - RNA, 64 nt, Homo Sapiens
aaguacaaccacuaucuuuucuuacccacacuacgcagaagagacaugcggcaaaccgcaugcu

SEQ ID NO: 482445 - RNA, 64 nt, Homo Sapiens
cuccuggaucccuuucacuaacuacagccaaauugcagaagaaacaaguuuuuuucaaagucca

SEQ ID NO: 482446 - RNA, 64 nt, Homo Sapiens
gaggggaaaccugccucugggggcagaugcagaagcagaagaggccgguaaacgcaagcccuug

SEQ ID NO: 482447 - RNA, 64 nt, Homo Sapiens
aaacacucucggaugccgcucuaugacugugcuugcagaagagucucaucgaggccccucgcuu

SEQ ID NO: 482448 - RNA, 64 nt, Homo Sapiens
acgaaaugccuuugggugggcacccgugcagagggcagaagagggggaagugaugcagagagcc

SEQ ID NO: 482449 - RNA, 64 nt, Homo Sapiens
acaaaguguggaagccaggguccagcuuagcaacgcagaagaguuuggaccuuuggguggcaau

SEQ ID NO: 482450 - RNA, 64 nt, Homo Sapiens
guguguugccuuacccagaaugacugucuuuauugcagaagacaacacacacacacacacacuc

SEQ ID NO: 482451 - RNA, 64 nt, Homo Sapiens
guguguugccuuaccagaauacacagucuuuauugcagaagacaacacacacacacacacacac

SEQ ID NO: 482452 - RNA, 64 nt, Homo Sapiens
guguguugccuuauaggcguacagagucuuuauugcagaagacaauacacacacauacacacac

SEQ ID NO: 482453 - RNA, 64 nt, Homo Sapiens
uguucauucagcgaauagcacccaguccugccuggcagaagaucaugcaguuuggaaguuuuca

SEQ ID NO: 482454 - RNA, 64 nt, Homo Sapiens
uguucauuccaguguugagaugcuuugcaucucugcagaagaaauuuauuuuaaauuguuuaaa

SEQ ID NO: 482455 - RNA, 64 nt, Homo Sapiens
ccacccccacccccgcacccccauucuacacaaggcagaagaggcacggguuuuucugggagcg

SEQ ID NO: 482456 - RNA, 64 nt, Homo Sapiens
acgaccccaccucgaggagcuuccugagcagguggcagaagaugcgguaagaugggccuuguga

SEQ ID NO: 482457 - RNA, 64 nt, Homo Sapiens
uugcauaccagcucucaugcgcaagcuggaagcugcagaagacaggacggccagagcgagcugu

SEQ ID NO: 482458 - RNA, 64 nt, Homo Sapiens
acauggcugccaaaguguuuugugagagggucccgcagaagaaagaggucagaguggaagcagg

SEQ ID NO: 482459 - RNA, 64 nt, Homo Sapiens
gccaggacuaggucuucugcccauggauucaggugcagaagaggcaucuggugaugccaaagcc

SEQ ID NO: 482460 - RNA, 64 nt, Homo Sapiens
ccaauuaccugccccucccuuccuggaugccccugcagaagacccccuccccacagaaagcugc

SEQ ID NO: 482461 - RNA, 64 nt, Homo Sapiens; identical to SEQ ID NO: 267144

SEQ ID NO: 482462 - RNA, 64 nt, Homo Sapiens; identical to SEQ ID NO: 267145

SEQ ID NO: 482463 - RNA, 64 nt, Homo Sapiens; identical to SEQ ID NO: 267146

SEQ ID NO: 482464 - RNA, 64 nt, Homo Sapiens; identical to SEQ ID NO: 267147

SEQ ID NO: 482465 - RNA, 64 nt, Homo Sapiens; identical to SEQ ID NO: 267148

SEQ ID NO: 482466 - RNA, 64 nt, Homo Sapiens; identical to SEQ ID NO: 267149

SEQ ID NO: 482467 - RNA, 64 nt, Homo Sapiens; identical to SEQ ID NO: 267150

SEQ ID NO: 482468 - RNA, 64 nt, Homo Sapiens; identical to SEQ ID NO: 267151

SEQ ID NO: 482469 - RNA, 64 nt, Homo Sapiens; identical to SEQ ID NO: 267152

SEQ ID NO: 482470 - RNA, 64 nt, Homo Sapiens; identical to SEQ ID NO: 267153

SEQ ID NO: 482471 - RNA, 64 nt, Homo Sapiens; identical to SEQ ID NO: 267154

SEQ ID NO: 482472 - RNA, 64 nt, Homo Sapiens; identical to SEQ ID NO: 267155

SEQ ID NO: 482473 - RNA, 64 nt, Homo Sapiens; identical to SEQ ID NO: 267156

SEQ ID NO: 482474 - RNA, 64 nt, Homo Sapiens; identical to SEQ ID NO: 267157

SEQ ID NO: 482475 - RNA, 64 nt, Homo Sapiens; identical to SEQ ID NO: 267157

SEQ ID NO: 482476 - RNA, 64 nt, Homo Sapiens; identical to SEQ ID NO: 267159

SEQ ID NO: 482477 - RNA, 64 nt, Homo Sapiens; identical to SEQ ID NO: 267160

SEQ ID NO: 482478 - RNA, 64 nt, Homo Sapiens; identical to SEQ ID NO: 267161

SEQ ID NO: 482479 - RNA, 64 nt, Homo Sapiens; identical to SEQ ID NO: 267162

SEQ ID NO: 482480 - RNA, 64 nt, Homo Sapiens; identical to SEQ ID NO: 267163

SEQ ID NO: 482481 - RNA, 64 nt, Homo Sapiens; identical to SEQ ID NO: 267164

SEQ ID NO: 482482 - RNA, 64 nt, Homo Sapiens; identical to SEQ ID NO: 267165

SEQ ID NO: 482483 - RNA, 64 nt, Homo Sapiens; identical to SEQ ID NO: 482435

SEQ ID NO: 482484 - RNA, 64 nt, Homo Sapiens; identical to SEQ ID NO: 482436

SEQ ID NO: 482485 - RNA, 64 nt, Homo Sapiens; identical to SEQ ID NO: 482437

SEQ ID NO: 482486 - RNA, 64 nt, Homo Sapiens; identical to SEQ ID NO: 482438

SEQ ID NO: 482487 - RNA, 64 nt, Homo Sapiens; identical to SEQ ID NO: 482439

SEQ ID NO: 482488 - RNA, 64 nt, Homo Sapiens; identical to SEQ ID NO: 482440

SEQ ID NO: 482489 - RNA, 64 nt, Homo Sapiens; identical to SEQ ID NO: 482441

SEQ ID NO: 482490 - RNA, 64 nt, Homo Sapiens; identical to SEQ ID NO: 482442

SEQ ID NO: 482491 - RNA, 64 nt, Homo Sapiens; identical to SEQ ID NO: 482443

SEQ ID NO: 482492 - RNA, 64 nt, Homo Sapiens; identical to SEQ ID NO: 482444

SEQ ID NO: 482493 - RNA, 64 nt, Homo Sapiens; identical to SEQ ID NO: 482445

SEQ ID NO: 482494 - RNA, 64 nt, Homo Sapiens; identical to SEQ ID NO: 482446

SEQ ID NO: 482495 - RNA, 64 nt, Homo Sapiens; identical to SEQ ID NO: 482447

SEQ ID NO: 482496 - RNA, 64 nt, Homo Sapiens; identical to SEQ ID NO: 482448

SEQ ID NO: 482497 - RNA, 64 nt, Homo Sapiens; identical to SEQ ID NO: 482449

SEQ ID NO: 482498 - RNA, 64 nt, Homo Sapiens; identical to SEQ ID NO: 482450

SEQ ID NO: 482499 - RNA, 64 nt, Homo Sapiens; identical to SEQ ID NO: 482451

SEQ ID NO: 482500 - RNA, 64 nt, Homo Sapiens; identical to SEQ ID NO: 482452

SEQ ID NO: 482501 - RNA, 64 nt, Homo Sapiens; identical to SEQ ID NO: 482453

SEQ ID NO: 482502 - RNA, 64 nt, Homo Sapiens; identical to SEQ ID NO: 482454

SEQ ID NO: 482503 - RNA, 64 nt, Homo Sapiens; identical to SEQ ID NO: 482455

SEQ ID NO: 482504 - RNA, 64 nt, Homo Sapiens; identical to SEQ ID NO: 482456

SEQ ID NO: 482505 - RNA, 64 nt, Homo Sapiens; identical to SEQ ID NO: 482457

SEQ ID NO: 482506 - RNA, 64 nt, Homo Sapiens; identical to SEQ ID NO: 482458

SEQ ID NO: 482507 - RNA, 64 nt, Homo Sapiens; identical to SEQ ID NO: 482459

SEQ ID NO: 482508 - RNA, 64 nt, Homo Sapiens; identical to SEQ ID NO: 482460

SEQ ID NO: 482509 - RNA, 64 nt, Homo Sapiens; identical to SEQ ID NO: 267144

SEQ ID NO: 482510 - RNA, 64 nt, Homo Sapiens; identical to SEQ ID NO: 267145

SEQ ID NO: 482511 - RNA, 64 nt, Homo Sapiens; identical to SEQ ID NO: 267146

SEQ ID NO: 482512 - RNA, 64 nt, Homo Sapiens; identical to SEQ ID NO: 267147

SEQ ID NO: 482513 - RNA, 64 nt, Homo Sapiens; identical to SEQ ID NO: 267148

SEQ ID NO: 482514 - RNA, 64 nt, Homo Sapiens; identical to SEQ ID NO: 267149

SEQ ID NO: 482515 - RNA, 64 nt, Homo Sapiens; identical to SEQ ID NO: 267150

SEQ ID NO: 482516 - RNA, 64 nt, Homo Sapiens; identical to SEQ ID NO: 267151

SEQ ID NO: 482517 - RNA, 64 nt, Homo Sapiens; identical to SEQ ID NO: 267152

SEQ ID NO: 482518 - RNA, 64 nt, Homo Sapiens; identical to SEQ ID NO: 267153

SEQ ID NO: 482519 - RNA, 64 nt, Homo Sapiens; identical to SEQ ID NO: 267154

SEQ ID NO: 482520 - RNA, 64 nt, Homo Sapiens; identical to SEQ ID NO: 267155

SEQ ID NO: 482521 - RNA, 64 nt, Homo Sapiens; identical to SEQ ID NO: 267156

SEQ ID NO: 482522 - RNA, 64 nt, Homo Sapiens; identical to SEQ ID NO: 267157

SEQ ID NO: 482523 - RNA, 64 nt, Homo Sapiens; identical to SEQ ID NO: 267157

SEQ ID NO: 482524 - RNA, 64 nt, Homo Sapiens; identical to SEQ ID NO: 267159

SEQ ID NO: 482525 - RNA, 64 nt, Homo Sapiens; identical to SEQ ID NO: 267160

SEQ ID NO: 482526 - RNA, 64 nt, Homo Sapiens; identical to SEQ ID NO: 267161

SEQ ID NO: 482527 - RNA, 64 nt, Homo Sapiens; identical to SEQ ID NO: 267162

SEQ ID NO: 482528 - RNA, 64 nt, Homo Sapiens; identical to SEQ ID NO: 267163

SEQ ID NO: 482529 - RNA, 64 nt, Homo Sapiens; identical to SEQ ID NO: 267164

SEQ ID NO: 482530 - RNA, 64 nt, Homo Sapiens; identical to SEQ ID NO: 267165

SEQ ID NO: 482531 - RNA, 64 nt, Homo Sapiens
aggcgggaguguuucacuuucuggugauaaacuugauggucauuguuaugauuaagauaaugcc

SEQ ID NO: 482532 - RNA, 64 nt, Homo Sapiens
acauaaaggauuaaaaucacacuaauaaccccuggauggucaaucugauaauaggaucagauuu

SEQ ID NO: 482533 - RNA, 64 nt, Homo Sapiens
aaauaggccccuuugaggcuccugagugcccucagauggucaaaacccaguuuucccucuggga

SEQ ID NO: 482534 - RNA, 64 nt, Homo Sapiens
uagcauuuuucacucuuggcuucuuuucucccuugauggucaagucucuuauguuucaauauuu

SEQ ID NO: 482535 - RNA, 64 nt, Homo Sapiens
uguuuuaaauuuugugaugugggaaucaauuuuagauggucacaaucuagauuauaaucaauag

SEQ ID NO: 482536 - RNA, 64 nt, Homo Sapiens
aauuuauccagaauggcaguagcuuuagcaagcagauggucacaaucuguuuucuaaaucauuu

SEQ ID NO: 482537 - RNA, 64 nt, Homo Sapiens
aguguuauagugaaaauuuuccaguuugauaauugauggucagagccagcacuggaauuuugaa

SEQ ID NO: 482538 - RNA, 64 nt, Homo Sapiens
gucucuguuucccagugggguggacaguauaucagauggucagaacaaauaaaguucaguguca

SEQ ID NO: 482539 - RNA, 64 nt, Homo Sapiens
guucccacccagaacuaauuuauuuuuuauuaaagauggucaugacaaaugagaaaugagcucu

SEQ ID NO: 482540 - RNA, 64 nt, Homo Sapiens
gccgacaccucccucaucucucuuauaguggaaggauggucagcauuaggcugauggggacuga

SEQ ID NO: 482541 - RNA, 64 nt, Homo Sapiens
aaguauuccacaaaucuuaccucuuuaggucacugauggucacuccgauucugagugccacauu

SEQ ID NO: 482542 - RNA, 64 nt, Homo Sapiens
auaguuuaugucaucucuucauuauuuagggcuggauggucaacucagucagugauuuuuugau

SEQ ID NO: 482543 - RNA, 64 nt, Homo Sapiens
guggagaggggugcacccacgaggugaaaugggagauggucagugagggguuuggguuaaguau

SEQ ID NO: 482544 - RNA, 64 nt, Homo Sapiens
ccuacccaccugcccuguuugacugcaaggagaggauggucagcccuguuccagagagaggugg

SEQ ID NO: 482545 - RNA, 64 nt, Homo Sapiens
gggcccaaauggcagggauaaggaucucucuagugauggucagaccccuauggaccagaagcca

SEQ ID NO: 482546 - RNA, 64 nt, Homo Sapiens
caccagcacuuuauacacuugaccuuccccaaaggauggucacacuggggaucuugcccccuuu

SEQ ID NO: 482547 - RNA, 64 nt, Homo Sapiens
cauaucacuaugaacuuggaaacuuauuucaagugauggucauuauauucucauggcuuuguua

SEQ ID NO: 482548 - RNA, 64 nt, Homo Sapiens
ucgcuagagacauaucagggcccaaggaacaagagauggucaaggacaagaggcuggccccagu

SEQ ID NO: 482549 - RNA, 64 nt, Homo Sapiens
uuguggucugugcuuucagagcaagacucucucugauggucacucaucuagcaaguucccaaag

SEQ ID NO: 482550 - RNA, 64 nt, Homo Sapiens
gagauggagcuacgaaaggaaaaggcccaaaggugauggucaucgguuagggguggaguccgcc

SEQ ID NO: 482551 - RNA, 64 nt, Homo Sapiens
gucaucaggaguacagccuaacaagugugauuaggauggucaagaccuggggcccuggcaucac

SEQ ID NO: 482552 - RNA, 64 nt, Homo Sapiens
aacuugaaauuuauagcuguuagcaauucauucagauggucaaugauucuagauaaaucaucau

SEQ ID NO: 482553 - RNA, 64 nt, Homo Sapiens
aaauguaauuuuuuguuguuuaaggccuugccuugauggucacaguuaucccaauggacacuaa

SEQ ID NO: 482554 - RNA, 64 nt, Homo Sapiens
ucaucagacacuggaaugcagugauucuucuaaugauggucaacugcaaggagaaacuguuuac

SEQ ID NO: 482555 - RNA, 64 nt, Homo Sapiens
gaaauuuguaacacuuuggucacaucugucucuagauggucauugaauuuguuuaaagauggau

SEQ ID NO: 482556 - RNA, 64 nt, Homo Sapiens
cuuuuugugaaguuagguucuuaaaagugcccaugauggucacuuaaaaugugcaguaauagca

SEQ ID NO: 482557 - RNA, 64 nt, Homo Sapiens
ggacacuucacuaccagaugugugcagugcaacagauggucauauacacugugaggcacugaaa

SEQ ID NO: 482558 - RNA, 64 nt, Homo Sapiens
acacugcuuuauaaugaaaaugaggacacuuucugauggucaguaaaaucuuaaaugauuuuug

SEQ ID NO: 482559 - RNA, 64 nt, Homo Sapiens
uuacugcugccauuuuccucaccaguauuccagagauggucauagcucauuacucuaccaccaa

SEQ ID NO: 482560 - RNA, 64 nt, Homo Sapiens
acgagggaaauaugagaaggcauaacaggcaccagauggucaagugcugcagaauguuaaacug

SEQ ID NO: 482561 - RNA, 64 nt, Homo Sapiens
gacuacugaaauaaaauauguccuuuauuugauugauggucauuuucaagaaauuaguuuucuu

SEQ ID NO: 482562 - RNA, 64 nt, Homo Sapiens
cauuucuucccacagccaaauauuaucccccaaggauggucagccugguugcuagcacauacuu

SEQ ID NO: 482563 - RNA, 64 nt, Homo Sapiens
uccaguaucuccccuaaguuuaauaggaggucaggauggucagcuggcagcagcucauuuucuu

SEQ ID NO: 482564 - RNA, 64 nt, Homo Sapiens
gagggaugcucagggagggagggauggugggguggauggucagguucgcugacaaauggcugug

SEQ ID NO: 482565 - RNA, 64 nt, Homo Sapiens
ucugagacagugguuugagagucacugggcugcugauggucagccagauucuuggauucacuug

SEQ ID NO: 482566 - RNA, 64 nt, Homo Sapiens
augaaacugguaacagguuguguugauaaaaaaugauggucaguucaucuuucaugcagugaca

SEQ ID NO: 482567 - RNA, 64 nt, Homo Sapiens
caacuaguauuuguugagcuccuauuugcccagagauggucauauuuaaacagaaguauacguu

SEQ ID NO: 482568 - RNA, 64 nt, Homo Sapiens
uccccuagucacucauccauccccuggcuccagagauggucacaugacccaggccuggccaguc

SEQ ID NO: 482569 - RNA, 64 nt, Homo Sapiens
accaguaacuucauggaggcccuuaacguuuccugauggucauacuacaauuuuuggaguccac

SEQ ID NO: 482570 - RNA, 64 nt, Homo Sapiens
uuuuuuucuuuuauuugcucgaguucacauuaaugauggucacaaggcugccuuguugggcagg

SEQ ID NO: 482571 - RNA, 64 nt, Homo Sapiens
ggcccugcaaggcccacacucacgcccugugggugauggucacggugggugggugggggcugac

SEQ ID NO: 482572 - RNA, 64 nt, Homo Sapiens
aacagcagaagggcagggcaaggcugagcucugagauggucaguuuagaguaggaugcugggca

SEQ ID NO: 482573 - RNA, 64 nt, Homo Sapiens
ugcacuuaguauuaaguugaaacuugaacaaauagauggucacauugcugaacauaauucuaaa

SEQ ID NO: 482574 - RNA, 64 nt, Homo Sapiens
aaugucaacaaagggaaaauaaacuaucagcuuggauggucacuugaauagaagaugguuauac

SEQ ID NO: 482575 - RNA, 64 nt, Homo Sapiens
ugauucuuuuuuugugacuagaaauucuuaagccgauggucacuauagcucauccuuaauguau

SEQ ID NO: 482576 - RNA, 64 nt, Homo Sapiens
uaugauuucugcaaacccauacuagcagaggccagauggucagagcugggauggggccauaucu

SEQ ID NO: 482577 - RNA, 64 nt, Homo Sapiens
ggcaugaggguguggaggacgugccuacuguggagauggucaccuguccccucaggcugucacc

SEQ ID NO: 482578 - RNA, 64 nt, Homo Sapiens
cccaguucucgugcccuuagugugcagggaaagggauggucaggcggagcuuggcccugcgccc

SEQ ID NO: 482579 - RNA, 64 nt, Homo Sapiens
uacacaaagaccaucgagacugcuuagaaccaaggauggucaugcagagagaagccauucguga

SEQ ID NO: 482580 - RNA, 64 nt, Homo Sapiens
ucggaguuccaguaccgccccccauccaacacuggauggucauccagcaccggccucgggaagc

SEQ ID NO: 482581 - RNA, 64 nt, Homo Sapiens
ucaguugguugcaccguuagccccucuccucccggauggucauguuuuugucacauuagagaau

SEQ ID NO: 482582 - RNA, 64 nt, Homo Sapiens
uauguuccuaauaagugaagggaaagauaauaaugauggucaacaauaagccacgucaaugcau

SEQ ID NO: 482583 - RNA, 64 nt, Homo Sapiens
gagggagagauugggggaauggggagaugaugaugauggucaaagggugcaaaaucucacacaa

SEQ ID NO: 482584 - RNA, 64 nt, Homo Sapiens
aaaacuuggcuucucucuaccucucagcacuaaugauggucaaaugccuuacaucuuuucugau

SEQ ID NO: 482585 - RNA, 64 nt, Homo Sapiens
caaacaguuuccauaaagaucaggggaagauaaagauggucacagugugcauacaucucaucca

SEQ ID NO: 482586 - RNA, 64 nt, Homo Sapiens
aaaucagcugcuacuacuccaaaaggugaccaaugauggucaccucuuaguuugcaguuacacu

SEQ ID NO: 482587 - RNA, 64 nt, Homo Sapiens
agauuuuccauuuuuuuuacuauuuauuugaauugauggucaagugcugcaaauaguuaaauua

SEQ ID NO: 482588 - RNA, 64 nt, Homo Sapiens
agaugagcaaaggauugguauuuguggacuuccagauggucaggaguuuaacagaaagagcaca

SEQ ID NO: 482589 - RNA, 64 nt, Homo Sapiens
aaauuuuggaagaugcuuuacuauguaaaguauagauggucauuuuaaucauucagccacauac

SEQ ID NO: 482590 - RNA, 64 nt, Homo Sapiens
cugcucucucaugaaacaagagcuagaaacucaggauggucaucuuggagggaccaaggggugg

SEQ ID NO: 482591 - RNA, 64 nt, Homo Sapiens
acccaccaccuucuucuccuacauaucccuuccagauggucauccagacucagagcucucucua

SEQ ID NO: 482592 - RNA, 64 nt, Homo Sapiens
ucuauuuaagaaauaugaagaaaaaauacaccaagauggucaaauuacuacacaaaucagcacc

SEQ ID NO: 482593 - RNA, 64 nt, Homo Sapiens
ucaugucuguuguauuuucaguaaugugauuucagauggucaucuggauucucccacuucucua

SEQ ID NO: 482594 - RNA, 64 nt, Homo Sapiens
cugcuugucucuuugugucuguuauccugggcaggauggucauucucaaaaacccugggguccu

SEQ ID NO: 482595 - RNA, 64 nt, Homo Sapiens
gaaacucacuucuuuucagguguuuuuaggugaugauggucauuuaaauauacaaacuuauuca

SEQ ID NO: 482596 - RNA, 64 nt, Homo Sapiens
caagguaguaggucucuuucgggcauuucucuaugauggucauuuuauauuaacagaauaucau

SEQ ID NO: 482597 - RNA, 64 nt, Homo Sapiens
auaguacacccauugcuccucagucaucauaaaagauggucaugugugauuuguauuaaugcac

SEQ ID NO: 482598 - RNA, 64 nt, Homo Sapiens
gcucuccccagagggagggcgagaaggguguggugauggucaaucuggcugucggaacagauuc

SEQ ID NO: 482599 - RNA, 64 nt, Homo Sapiens
agaguauccacuguuuauucaacaacuacuacuugauggucagacacaaacaaacaagcuaggu

SEQ ID NO: 482600 - RNA, 64 nt, Homo Sapiens
gagacacccaggggccuggcccgccagcccaaaagauggucaucgggaagagaaaaagaaaaaa

SEQ ID NO: 482601 - RNA, 64 nt, Homo Sapiens
guuucaucguuugucaaaguuccguaggaucagugauggucauucagcaugacugguucuggga

SEQ ID NO: 482602 - RNA, 64 nt, Homo Sapiens
cagugagauaggaaaucaagaguaacagcucuaagauggucaugaaaaccccagacuuugaauu

SEQ ID NO: 482603 - RNA, 64 nt, Homo Sapiens
ggagccuucauauguuaaauauuccugcacuagugauggucacuuagaauguuuauagaaaugu

SEQ ID NO: 482604 - RNA, 64 nt, Homo Sapiens
agcccaggaaagggggauguuuuccugguguuuggauggucagcugggaguguccaucaucagg

SEQ ID NO: 482605 - RNA, 64 nt, Homo Sapiens
accuccucgagugcccugggaccacugggccacagauggucaucaggggaagccaccagggagu

SEQ ID NO: 482606 - RNA, 64 nt, Homo Sapiens
cugucagacauccaaguuuacucaaguuccacaggauggucaagccugggagguccugcugcaa

SEQ ID NO: 482607 - RNA, 64 nt, Homo Sapiens
uugggagcaucggcagccgacucgucgcgguagagauggucaagcgcugcugggcguucugcac

SEQ ID NO: 482608 - RNA, 64 nt, Homo Sapiens
cacugauagaauuucugaaagagaaagagaaguagauggucaaccagucacuaguugguuggca

SEQ ID NO: 482609 - RNA, 64 nt, Homo Sapiens
uuuacuauuuaaagagcguaaauagugaaaguaagauggucauacuuacugacuuuaucuauuu

SEQ ID NO: 482610 - RNA, 64 nt, Homo Sapiens
aaugaaagcacuaaguuugguuuugcuuuugugagauggucagcuuuggugcucuccacaacau

SEQ ID NO: 482611 - RNA, 64 nt, Homo Sapiens
gggucaguuguagcugcugcaaaguucuguagcugauggucauuuaauugcauggggguuauuu

SEQ ID NO: 482612 - RNA, 64 nt, Homo Sapiens
uaacaaucaaaaagaggagauuuggaggaauagagauggucaauuuugcaauccaaauccagcc

SEQ ID NO: 482613 - RNA, 64 nt, Homo Sapiens
guaacagcacuuugcugagauccaagucuccaaagauggucacuuucuguguaaugaggcuauu

SEQ ID NO: 482614 - RNA, 64 nt, Homo Sapiens
aauauccuguacauauuuaccuagaguauggagagauggucagauuauuuucuauaggcaaugu

SEQ ID NO: 482615 - RNA, 64 nt, Homo Sapiens
cuaccucccuccccgucucauuccguugucuguggauggucauugcaguuuaagagcagaacag

SEQ ID NO: 482616 - RNA, 64 nt, Homo Sapiens
gcagcugagggaggggcgcuggccacaugucacugauggucagauuccaaaguccuuucuuuau

SEQ ID NO: 482617 - RNA, 64 nt, Homo Sapiens
uguggggucauacaucaucguguuuguaagagaagauggucauuuuauucucuguauaaaacuu

SEQ ID NO: 482618 - RNA, 64 nt, Homo Sapiens
agaguuuucaagaaacugcguucuacuuccagaagauggucacuuuaaccuuguaaauauuuau

SEQ ID NO: 482619 - RNA, 64 nt, Homo Sapiens
agcuccuggaccugugucuaguacauacugaagcgauggucagaguguguagagugaaguugcu

SEQ ID NO: 482620 - RNA, 64 nt, Homo Sapiens
gccacggccaagggccacggaucuaaggggccgcgauggucaggcaaugcaugcccaccuguug

SEQ ID NO: 482621 - RNA, 64 nt, Homo Sapiens
aucucaugacauuauauuugcuagaaagcaaugugauggucaggauaucagucaugacuagugc

SEQ ID NO: 482622 - RNA, 64 nt, Homo Sapiens
acucaggggcagauuccacuagccccagcccagggauggucagaccaggucccaggcuguggaa

SEQ ID NO: 482623 - RNA, 55 nt, Homo Sapiens
caguguuaacuugcauauugggaaugauggucaaucucaucaugaacacagcuaa

SEQ ID NO: 482624 - RNA, 64 nt, Homo Sapiens
guggggagcagggacggccauguguuugggcccggauggucaggaccuggucuuacuguccaug

SEQ ID NO: 482625 - RNA, 59 nt, Homo Sapiens
ucacccccucuucagguugauacugccuggauggucaccucuggugcgcagcaagugca

SEQ ID NO: 482626 - RNA, 64 nt, Homo Sapiens
uuugccaagaccgugaucaagguagcuuaagagagauggucaggagaaaacacuguuuuuguuu

SEQ ID NO: 482627 - RNA, 64 nt, Homo Sapiens
gaggcaaaccaagccuccuuagugcccuggggcugauggucacccagagccauagagcacccuu

SEQ ID NO: 482628 - RNA, 64 nt, Homo Sapiens
ugauauuccuucauuuucagaaauaacucugaaagauggucauaaucuuauaugaauaauuuug

SEQ ID NO: 482629 - RNA, 64 nt, Homo Sapiens
accacaauuaauuguaauuaucuuugaggagaaugauggucaccuucucuucuuucucucuuuu

SEQ ID NO: 482630 - RNA, 64 nt, Homo Sapiens
uuccaggugcuaguacaucaagugagugcuccaugauggucauguuggccagugauggggaauc

SEQ ID NO: 482631 - RNA, 64 nt, Homo Sapiens
gcuggggucauuuuuaggggaaaaaggaggauaugauggucacauggggaaccuccccucaucg

SEQ ID NO: 482632 - RNA, 64 nt, Homo Sapiens
acucccuccacccccccuccacuguaggccacuggauggucauuugcaucuccguaaaugugcu

SEQ ID NO: 482633 - RNA, 64 nt, Homo Sapiens
uccccucccccaccugguugggguagagcaaaaggauggucacucuuccgaggucucccugaaa

SEQ ID NO: 482634 - RNA, 64 nt, Homo Sapiens
gugucaugggaagcccaccccucccacccuccgagauggucaguuaggccuaguccucucauuc

SEQ ID NO: 482635 - RNA, 64 nt, Homo Sapiens
uuagucucucuacaugggaaugauuacacugugugauggucauacuaaucacaucaaucucucu

SEQ ID NO: 482636 - RNA, 64 nt, Homo Sapiens
uaugaaguaauagaguuugcggaauuuucuggaagauggucagcucuaaguauucaauuaagug

SEQ ID NO: 482637 - RNA, 64 nt, Homo Sapiens
uauaugaaacaugucuuuaguugccaaaauaagggauggucaaaaguuagacucuuaaaauccu

SEQ ID NO: 482638 - RNA, 64 nt, Homo Sapiens
aucauuccugugcucagagggccuugugaccucagauggucaccuccauucagacuccuuuccu

SEQ ID NO: 482639 - RNA, 64 nt, Homo Sapiens
agaaggagaccuuuucacaauggaaaaccugggggauggucagagcccagucgagaccucacac

SEQ ID NO: 482640 - RNA, 64 nt, Homo Sapiens
ccucccuugcuuccagauuguuuuagugggcccugauggucauuuuucuaaacagaggcccugc

SEQ ID NO: 482641 - RNA, 64 nt, Homo Sapiens
aucuacccuugauuaucuagaaagacuugguaaugauggucaguuccuuuuagauuucagaaaa

SEQ ID NO: 482642 - RNA, 64 nt, Homo Sapiens
cugaugcaaaaaacagaaaaggggugauguaggagauggucagguugguaggagaagcuauaag

SEQ ID NO: 482643 - RNA, 64 nt, Homo Sapiens
uacagcuuuggaaggaucuuuuuuucuuuaacuagauggucaccuucuucccuaccacacaugg

SEQ ID NO: 482644 - RNA, 64 nt, Homo Sapiens
aguaccugugaaaucuauaacucagaaauggucagauggucaggagccagcuaugcagcaguau

SEQ ID NO: 482645 - RNA, 64 nt, Homo Sapiens
uuguggaucuugguguuauuuaaaaaauugaggugauggucauugcaagcucaucuauuaagua

SEQ ID NO: 482646 - RNA, 64 nt, Homo Sapiens
aagcuaagcaagagagccaaauuuuuagaaaucugauggucaaaauagcugaaagcaguaaaca

SEQ ID NO: 482647 - RNA, 64 nt, Homo Sapiens
aaggaaccucaggcaccaacagugagcccacgaggauggucacaugccaugugcagaauuugac

SEQ ID NO: 482648 - RNA, 64 nt, Homo Sapiens
ggacuuuggaccauaggggaaagcagcugacugagauggucaaauccacugccaacagaaaaca

SEQ ID NO: 482649 - RNA, 64 nt, Homo Sapiens
uugcaguuuuuuccuugaagaaaugaaaacaaaugauggucauggacugcaaagcuuacucagg

SEQ ID NO: 482650 - RNA, 64 nt, Homo Sapiens
caggcaaaaugaagcuggccacugaaaacuguaagauggucaaaagcugacagccuguguaugu

SEQ ID NO: 482651 - RNA, 64 nt, Homo Sapiens
cacagagauaugcacacacacggaugcacacacagauggucacacagagauacgcaaacacacc

SEQ ID NO: 482652 - RNA, 64 nt, Homo Sapiens
guguaaggaguuuuuuugucaaaauaaccuuuuagauggucaaaauauuuauauaauuuuauag

SEQ ID NO: 482653 - RNA, 64 nt, Homo Sapiens
gagggcagcagggacaggacuguuucuuagcagagauggucacagcugcaggacgaacugucga

SEQ ID NO: 482654 - RNA, 64 nt, Homo Sapiens
cucacacucagaaccucauaccccagagcaaaccgauggucagggagagggcuagagcucacac

SEQ ID NO: 482655 - RNA, 64 nt, Homo Sapiens
gcuucucuguauuaaauagucuagaaguuaaggggauggucacauuuaccauguauuguguuau

SEQ ID NO: 482656 - RNA, 64 nt, Homo Sapiens
uugguuaaauuaacaucuauacgauggaauacuagauggucauuaaaauuaugugucagaagaa

SEQ ID NO: 482657 - RNA, 64 nt, Homo Sapiens
agugagacugucucaaaaaaaaaaaaaaauuaaugauggucaaaggguauaaaaucucagacag

SEQ ID NO: 482658 - RNA, 64 nt, Homo Sapiens
caccuugcccuuccuuccaccaccgaagaaaaaagauggucauacuaacaggugaaauguacaa

SEQ ID NO: 482659 - RNA, 64 nt, Homo Sapiens
uuaagguaaagguuuuggcuccaguaaauccccugauggucacaaagggcauaggaaaauuuuc

SEQ ID NO: 482660 - RNA, 64 nt, Homo Sapiens
uuuuuucaguauuauuuauauuauccacuggucagauggucaacaauugaaugccuugaaagua

SEQ ID NO: 482661 - RNA, 64 nt, Homo Sapiens
uuuguaaaauauuuguuuguaaacaaaaaaggaagauggucaaguuguggaggguuauuuaaaa

SEQ ID NO: 482662 - RNA, 64 nt, Homo Sapiens
uagccucuggggugaaauacgugccucguggacagauggucauucccuaguguuggaaagggca

SEQ ID NO: 482663 - RNA, 64 nt, Homo Sapiens
caccuggguguuacaaaguuuccccccuuuuauagauggucacgaaagggauagagguuggguu

SEQ ID NO: 482664 - RNA, 64 nt, Homo Sapiens
cuggucucgaacuccugaccugagauuucaccaugauggucagguuuuguauuuuuaauagagu

SEQ ID NO: 482665 - RNA, 64 nt, Homo Sapiens
acccaggacccaggccuagccacugcccacagcugauggucacuguuuuggcuggcuccagagu

SEQ ID NO: 482666 - RNA, 64 nt, Homo Sapiens
uagauggcugcugggugugcagcaggagaaggaggauggucagccuuggagcaucucucaauua

SEQ ID NO: 482667 - RNA, 64 nt, Homo Sapiens
ugucaauguuacuuucuugucacuuuccuacccugauggucacacuagcccaccccaagcuccg

SEQ ID NO: 482668 - RNA, 64 nt, Homo Sapiens
aacacauggggauccggccuggagcuuuguguuggauggucagcuccagagggucagcccaugg

SEQ ID NO: 482669 - RNA, 64 nt, Homo Sapiens
uugcuuuaacccagcagggcggggccgugauccugauggucacaugagccuuccacuguggaug

SEQ ID NO: 482670 - RNA, 64 nt, Homo Sapiens
uucaugacaggcggcaucucugggaaguaggacugauggucaucucaccgguucucacuguguc

SEQ ID NO: 482671 - RNA, 64 nt, Homo Sapiens
ugggcgaugccaacauuaauucuuuguauaugaggauggucaggccaugucugcacaagauucu

SEQ ID NO: 482672 - RNA, 64 nt, Homo Sapiens
ucuccugcuuuguccaguucuccccaauauaccugauggucaacaggugccuccaucucucccu

SEQ ID NO: 482673 - RNA, 64 nt, Homo Sapiens
ucaggggcuccuucuggcugcaguaagcucccuggauggucacagugccgccccauccccaggc

SEQ ID NO: 482674 - RNA, 64 nt, Homo Sapiens
auucuggugauugugugauguaaagaggugcuaugauggucaugcaauuaauacuaaauauuga

SEQ ID NO: 482675 - RNA, 64 nt, Homo Sapiens
ucauguauugaaugagugaaccagaaaauuagaagauggucaaaaaaaguccaaguuaccaauu

SEQ ID NO: 482676 - RNA, 64 nt, Homo Sapiens
uguagaaaaugccagggauccaccacaagauggagauggucagcacaaaccgauucuguuccuc

SEQ ID NO: 482677 - RNA, 64 nt, Homo Sapiens
ccucucccuggccugagguucaaaggccucaucggauggucaguacaguggggucaccuguugu

SEQ ID NO: 482678 - RNA, 64 nt, Homo Sapiens
cucuugcccucaaacacuaccagcuuucugcauggauggucaguaggcagcgagcagcccaggc

SEQ ID NO: 482679 - RNA, 64 nt, Homo Sapiens
cuucagcugggaaucuucaagaugcggcggagacgauggucagcguuccuacaaaacccucuuu

SEQ ID NO: 482680 - RNA, 64 nt, Homo Sapiens
ugugucugccugccucaugcucucuauagaggaggauggucaucgugacagcagcagcucaagu

SEQ ID NO: 482681 - RNA, 64 nt, Homo Sapiens
cugcagcuagcauaguuucaugcucagugaggaugauggucaccguguuuguuguguacuuacu

SEQ ID NO: 482682 - RNA, 64 nt, Homo Sapiens
guuuuggaaaagugagcucuggguucugcucugagauggucagagaagaugcgggccaggagac

SEQ ID NO: 482683 - RNA, 64 nt, Homo Sapiens
cucuacugggacauguuagguacuaaacaguuuggauggucaguuuucagguuuuuacucacuu

SEQ ID NO: 482684 - RNA, 64 nt, Homo Sapiens
gggccugcagagggagaugugcagaagccaucaagauggucaaaagcugaggggacagggagga

SEQ ID NO: 482685 - RNA, 64 nt, Homo Sapiens
ggcagcuggaggguaggcucagcccagaugcagagauggucaugaugggccaccucuuccucca

SEQ ID NO: 482686 - RNA, 64 nt, Homo Sapiens
ugcccuggccccuccucuggcgaccagaacuccagauggucaccgugugaggagaccaucaccu

SEQ ID NO: 482687 - RNA, 64 nt, Homo Sapiens
aacugacuacaaaacaggaaggcuugcagcuggugauggucaagcggugacccacggggcuccu

SEQ ID NO: 482688 - RNA, 64 nt, Homo Sapiens
gguuggagcugugacaguggucagucugaguucugauggucagacccaggucccucuccuguag

SEQ ID NO: 482689 - RNA, 64 nt, Homo Sapiens
accugggccauugcaaccaagaaguacagagugggauggucaggggguggggagauggagcagg

SEQ ID NO: 482690 - RNA, 64 nt, Homo Sapiens
cccuccaggcuucggggaaaauuguuuucaaagugauggucagaggcuggggugggagucugga

SEQ ID NO: 482691 - RNA, 64 nt, Homo Sapiens
ucccauguugucccugcugcgccugcuuugggacgauggucaggcacggcccugagcggcugca

SEQ ID NO: 482692 - RNA, 64 nt, Homo Sapiens
aauuaguuuaaaagccaaggucauaacaugaauugauggucaauuucccuucagcagaaggaaa

SEQ ID NO: 482693 - RNA, 64 nt, Homo Sapiens
gggcagacgaaugugucguggagggacauugaaugauggucagaagaagacuugaaugaaguug

SEQ ID NO: 482694 - RNA, 64 nt, Homo Sapiens
ccaggcgggcauuuuaauaaugaguguugugacugauggucaacuuggagucuugcacuggcca

SEQ ID NO: 482695 - RNA, 64 nt, Homo Sapiens
ucucccggguccagcgccuggggcugccccucaagauggucauguacucagcugugaguccuug

SEQ ID NO: 482696 - RNA, 64 nt, Homo Sapiens
gcauuuuaucaaaugcauuuucuacauguauuaagauggucauauuauucuucuucuuuuaugu

SEQ ID NO: 482697 - RNA, 64 nt, Homo Sapiens
cccucccucaggaugacgcuaguuagcugacacagauggucaccuccauuaccaaguagaguca

SEQ ID NO: 482698 - RNA, 64 nt, Homo Sapiens
guccgguggccgugggggugccugaaucucguaugauggucacaugccuggcccugcugccccu

SEQ ID NO: 482699 - RNA, 64 nt, Homo Sapiens
gaagagaagcacgcuguccccucugggcgccugggauggucaccccacacagaagucuggucac

SEQ ID NO: 482700 - RNA, 64 nt, Homo Sapiens
guaagaugagcaauugcaacaaaagaaugauuaugauggucagaccaugguccuggacccagca

SEQ ID NO: 482701 - RNA, 64 nt, Homo Sapiens
aauuaaugauggugagaagaguugaaugagggcugauggucagaaacuuguuaauuagaauguu

SEQ ID NO: 482702 - RNA, 64 nt, Homo Sapiens
ugcaggagcucagcauagacccagcucucugggggauggucaccuggugauuucaaugauggca

SEQ ID NO: 482703 - RNA, 64 nt, Homo Sapiens
cagagauuacucuggcuuugacccuuguuuagcugauggucauuucugggauuggaauauuuaa

SEQ ID NO: 482704 - RNA, 64 nt, Homo Sapiens
gucacuagaaguuaccugaguccugggggucaccgauggucagaccuggggcacuggaacacau

SEQ ID NO: 482705 - RNA, 64 nt, Homo Sapiens
uagccugucugucacacgacgguauuggagaagggauggucaguacaacaaaaaagaauguuuu

SEQ ID NO: 482706 - RNA, 64 nt, Homo Sapiens
uguucccagauaagaucacuccuucuggggacaagauggucacuaguagauccagguuuacuuu

SEQ ID NO: 482707 - RNA, 64 nt, Homo Sapiens
uaguuggaagccggcguucgguaucagaagcgcugauggucauauccaaucucaauaucugggu

SEQ ID NO: 482708 - RNA, 64 nt, Homo Sapiens
aaguuugcagauacucgccacugcaagcgcacuugauggucaggccaguugacauccaggaugg

SEQ ID NO: 482709 - RNA, 64 nt, Homo Sapiens
ggggcauaucucagucaggcagcggcuuccugaugauggucauuggggugguugucaugugaug

SEQ ID NO: 482710 - RNA, 64 nt, Homo Sapiens
guggagcgcaagugcuggacuggagcgccugugagauggucagcggggggccucaacccucucc

SEQ ID NO: 482711 - RNA, 64 nt, Homo Sapiens
ugggcgcuuggaaaguguuugaugggcucaggcugauggucagccccgcacccggagccucagg

SEQ ID NO: 482712 - RNA, 64 nt, Homo Sapiens
aucuuguagccaaauuugacacuauuuauuucuggauggucauuaaacucugaauguauuuaua

SEQ ID NO: 482713 - RNA, 64 nt, Homo Sapiens
aggcucguaggauauuucaggugagucaggguuggauggucaucggcuuucagaaggagaccac

SEQ ID NO: 482714 - RNA, 64 nt, Homo Sapiens
uuggcuacaucuuucccacaaccguauaacgaccgauggucauuucuccaagagcaggcuuggc

SEQ ID NO: 482715 - RNA, 64 nt, Homo Sapiens
ccaugacuuuguaauuuugagaauuccucccagugauggucaguauucuuuuggaauguaaacc

SEQ ID NO: 482716 - RNA, 64 nt, Homo Sapiens
auguauggcauuaagaaauagagaaagaguguaagauggucaauauuugguuuccuaaaugcuu

SEQ ID NO: 482717 - RNA, 64 nt, Homo Sapiens
ucacgacccaucacucuaccucuaccagcgcacugauggucacugguggaacuccacucacugg

SEQ ID NO: 482718 - RNA, 64 nt, Homo Sapiens
cccuucauguccauguuagcuuucacacacuguagauggucacuguugaugacuucuuguggca

SEQ ID NO: 482719 - RNA, 64 nt, Homo Sapiens
acaggucaaaaccaagagagacuaaaaacacacugauggucaacuuuuuuuuuuuuuuuugucc

SEQ ID NO: 482720 - RNA, 52 nt, Homo Sapiens
gucaagaaucauggaaguaaacaucugagaaaccuguugaagauuauuucau

SEQ ID NO: 482721 - RNA, 64 nt, Homo Sapiens
caaacucuucaguuaauucuuagauacacuaaaaaucugagaaacucuacauguaacuauuucu

SEQ ID NO: 482722 - RNA, 64 nt, Homo Sapiens
ggucugaaauccagcaucuaguugcaaacuaugcaucugagaaauuacagaaugggagaaaauu

SEQ ID NO: 482723 - RNA, 64 nt, Homo Sapiens
uaagaaguaauaaugaguaaaucucagaaaguaaaucugagaggaaaggaacuuuuaaaagauu

SEQ ID NO: 482724 - RNA, 64 nt, Homo Sapiens
ggacacauuugggaguauuuaaucagguguggcuaucugagaaaucaacuuugggggaaaugua

SEQ ID NO: 482725 - RNA, 64 nt, Homo Sapiens
cacuaauuuuacuuaccuauuagauuuugaaaguaucugagauauacaaaucucccuguaggaa

SEQ ID NO: 482726 - RNA, 64 nt, Homo Sapiens
uaagaacacaauuauuauucuuuuucauuaaagcaucugagaucaaguugaccucaagauaaca

SEQ ID NO: 482727 - RNA, 64 nt, Homo Sapiens
aauaauuuaugaugacucaggaauuaaaucuucuaucugagaguacugacauggcuaacugcaa

SEQ ID NO: 482728 - RNA, 64 nt, Homo Sapiens
ucaaauuuacaucaaagauaccugaaguguugguaucugagaauaucugucacuccucuuaucu

SEQ ID NO: 482729 - RNA, 64 nt, Homo Sapiens
guguugguaucugagaauaucugucacuccucuuaucugagaagugaccuuuuauuuuuaagau

SEQ ID NO: 482730 - RNA, 64 nt, Homo Sapiens
ccagcaccacgauggccccaggacguuguuuaagaucugagaucccuugguuucucucuuguug

SEQ ID NO: 482731 - RNA, 64 nt, Homo Sapiens
uaagaucugagaucccuugguuucucucuuguugaucugagaugcuacaucagggcccuugcug

SEQ ID NO: 482732 - RNA, 64 nt, Homo Sapiens
gcagcuucuaagagcgaacuucacauaggaagggaucugagaacacguugccaggggcuugaga

SEQ ID NO: 482733 - RNA, 64 nt, Homo Sapiens
ucuauuaauaucaacucugaagcuaauuguacuaaucugagauuguguuuguucauaauaaaag

SEQ ID NO: 482734 - RNA, 64 nt, Homo Sapiens
agcauuaacccaaaaguccgcaguccaaaguuucaucugagacaaggcaagucccuuccacuua

SEQ ID NO: 482735 - RNA, 64 nt, Homo Sapiens
cuuuacuccaguucccaaaaaguuuuucaucuccaucugagaccaccucagccugaauuuuauu

SEQ ID NO: 482736 - RNA, 64 nt, Homo Sapiens
uggguuggacaaccucauuuuaacucagucuuuaaucugagaggccacagugcaauuuuauuuu

SEQ ID NO: 482737 - RNA, 64 nt, Homo Sapiens
ggauauugauacuguuuguguuuuuaguugggagaucugagagaccuggcuuuggcaagagcag

SEQ ID NO: 482738 - RNA, 64 nt, Homo Sapiens
acugaguucccaggcuaaauuuuuguauuucuuuaucugagagaagacucaguauagcuuaaaa

SEQ ID NO: 482739 - RNA, 64 nt, Homo Sapiens
gucuccagaccagguuacugcagagacuagauguaucugagaggguacaacucaaaaggugcuu

SEQ ID NO: 482740 - RNA, 64 nt, Homo Sapiens
gcugcucagacccuccagaugagguccagcccagaucugagaggaacccuggaaaugugaaguc

SEQ ID NO: 482741 - RNA, 64 nt, Homo Sapiens
ugcaagaaugaccucugucuguugaagccuugguaucugagaggucaggaaggggaccucuuug

SEQ ID NO: 482742 - RNA, 64 nt, Homo Sapiens
uaucuaauuagagaaauaauuguuguauuuuaagaucugagaguguguacaaguuuuaguauac

SEQ ID NO: 482743 - RNA, 64 nt, Homo Sapiens
gcauggugggucauugaggagacccaggaaucucaucugagaacccacucucugccggagaacc

SEQ ID NO: 482744 - RNA, 64 nt, Homo Sapiens
gaucacugucaaguugcacugcagccucuuuagaaucugagagauuagaucuuaaaugaguuug

SEQ ID NO: 482745 - RNA, 64 nt, Homo Sapiens
cauugguuugucuugcauuccauugguuuugagcaucugagagguguuucucacaugcauacua

SEQ ID NO: 482746 - RNA, 64 nt, Homo Sapiens
aggcaaaagaauggcuacuuaaaaauggaucccaaucugagaaaaggagauccuaauaugaaag

SEQ ID NO: 482747 - RNA, 64 nt, Homo Sapiens
ggagauacaaacuuuguaaugaaaauccaugguuaucugagauauauuucuguggaaauaugag

SEQ ID NO: 482748 - RNA, 64 nt, Homo Sapiens; identical to SEQ ID NO: 284001

SEQ ID NO: 482749 - RNA, 64 nt, Homo Sapiens; identical to SEQ ID NO: 284002

SEQ ID NO: 482750 - RNA, 64 nt, Homo Sapiens; identical to SEQ ID NO: 284003

SEQ ID NO: 482751 - RNA, 64 nt, Homo Sapiens; identical to SEQ ID NO: 284004

SEQ ID NO: 482752 - RNA, 64 nt, Homo Sapiens; identical to SEQ ID NO: 284005

SEQ ID NO: 482753 - RNA, 64 nt, Homo Sapiens; identical to SEQ ID NO: 284006

SEQ ID NO: 482754 - RNA, 64 nt, Homo Sapiens; identical to SEQ ID NO: 284007

SEQ ID NO: 482755 - RNA, 64 nt, Homo Sapiens; identical to SEQ ID NO: 284008

SEQ ID NO: 482756 - RNA, 64 nt, Homo Sapiens; identical to SEQ ID NO: 284009

SEQ ID NO: 482757 - RNA, 64 nt, Homo Sapiens; identical to SEQ ID NO: 284010

SEQ ID NO: 482758 - RNA, 64 nt, Homo Sapiens; identical to SEQ ID NO: 284011

SEQ ID NO: 482759 - RNA, 64 nt, Homo Sapiens; identical to SEQ ID NO: 284012

SEQ ID NO: 482760 - RNA, 64 nt, Homo Sapiens; identical to SEQ ID NO: 284013

SEQ ID NO: 482761 - RNA, 64 nt, Homo Sapiens; identical to SEQ ID NO: 284014

SEQ ID NO: 482762 - RNA, 64 nt, Homo Sapiens; identical to SEQ ID NO: 284015

SEQ ID NO: 482763 - RNA, 64 nt, Homo Sapiens; identical to SEQ ID NO: 284016

SEQ ID NO: 482764 - RNA, 64 nt, Homo Sapiens; identical to SEQ ID NO: 284017

SEQ ID NO: 482765 - RNA, 64 nt, Homo Sapiens; identical to SEQ ID NO: 284018

SEQ ID NO: 482766 - RNA, 64 nt, Homo Sapiens; identical to SEQ ID NO: 284019

SEQ ID NO: 482767 - RNA, 64 nt, Homo Sapiens; identical to SEQ ID NO: 284020

SEQ ID NO: 482768 - RNA, 64 nt, Homo Sapiens; identical to SEQ ID NO: 284021

SEQ ID NO: 482769 - RNA, 64 nt, Homo Sapiens; identical to SEQ ID NO: 284022

SEQ ID NO: 482770 - RNA, 64 nt, Homo Sapiens; identical to SEQ ID NO: 284023

SEQ ID NO: 482771 - RNA, 64 nt, Homo Sapiens; identical to SEQ ID NO: 284024

SEQ ID NO: 482772 - RNA, 64 nt, Homo Sapiens; identical to SEQ ID NO: 284025

SEQ ID NO: 482773 - RNA, 64 nt, Homo Sapiens; identical to SEQ ID NO: 284026

SEQ ID NO: 482774 - RNA, 64 nt, Homo Sapiens; identical to SEQ ID NO: 284027

SEQ ID NO: 482775 - RNA, 64 nt, Homo Sapiens; identical to SEQ ID NO: 284028

SEQ ID NO: 482776 - RNA, 64 nt, Homo Sapiens; identical to SEQ ID NO: 284029

SEQ ID NO: 482777 - RNA, 54 nt, Homo Sapiens; identical to SEQ ID NO: 284030

SEQ ID NO: 482778 - RNA, 64 nt, Homo Sapiens; identical to SEQ ID NO: 284031

SEQ ID NO: 482779 - RNA, 64 nt, Homo Sapiens; identical to SEQ ID NO: 284032

SEQ ID NO: 482780 - RNA, 64 nt, Homo Sapiens; identical to SEQ ID NO: 284033

SEQ ID NO: 482781 - RNA, 64 nt, Homo Sapiens; identical to SEQ ID NO: 284034

SEQ ID NO: 482782 - RNA, 64 nt, Homo Sapiens; identical to SEQ ID NO: 284035

SEQ ID NO: 482783 - RNA, 64 nt, Homo Sapiens; identical to SEQ ID NO: 284036

SEQ ID NO: 482784 - RNA, 64 nt, Homo Sapiens; identical to SEQ ID NO: 284037

SEQ ID NO: 482785 - RNA, 64 nt, Homo Sapiens; identical to SEQ ID NO: 284038

SEQ ID NO: 482786 - RNA, 64 nt, Homo Sapiens; identical to SEQ ID NO: 286991

SEQ ID NO: 482787 - RNA, 64 nt, Homo Sapiens; identical to SEQ ID NO: 286992

SEQ ID NO: 482788 - RNA, 64 nt, Homo Sapiens; identical to SEQ ID NO: 286993

SEQ ID NO: 482789 - RNA, 64 nt, Homo Sapiens; identical to SEQ ID NO: 286994

SEQ ID NO: 482790 - RNA, 64 nt, Homo Sapiens; identical to SEQ ID NO: 286995

SEQ ID NO: 482791 - RNA, 64 nt, Homo Sapiens; identical to SEQ ID NO: 286996

SEQ ID NO: 482792 - RNA, 64 nt, Homo Sapiens; identical to SEQ ID NO: 286997

SEQ ID NO: 482793 - RNA, 64 nt, Homo Sapiens; identical to SEQ ID NO: 286998

SEQ ID NO: 482794 - RNA, 64 nt, Homo Sapiens; identical to SEQ ID NO: 286999

SEQ ID NO: 482795 - RNA, 64 nt, Homo Sapiens; identical to SEQ ID NO: 287000

SEQ ID NO: 482796 - RNA, 64 nt, Homo Sapiens; identical to SEQ ID NO: 287001

SEQ ID NO: 482797 - RNA, 64 nt, Homo Sapiens; identical to SEQ ID NO: 287002

SEQ ID NO: 482798 - RNA, 64 nt, Homo Sapiens; identical to SEQ ID NO: 287003

SEQ ID NO: 482799 - RNA, 64 nt, Homo Sapiens; identical to SEQ ID NO: 287004

SEQ ID NO: 482800 - RNA, 64 nt, Homo Sapiens; identical to SEQ ID NO: 287005

SEQ ID NO: 482801 - RNA, 64 nt, Homo Sapiens; identical to SEQ ID NO: 287006

SEQ ID NO: 482802 - RNA, 64 nt, Homo Sapiens; identical to SEQ ID NO: 287007

SEQ ID NO: 482803 - RNA, 64 nt, Homo Sapiens; identical to SEQ ID NO: 287008

SEQ ID NO: 482804 - RNA, 64 nt, Homo Sapiens; identical to SEQ ID NO: 287009

SEQ ID NO: 482805 - RNA, 64 nt, Homo Sapiens; identical to SEQ ID NO: 287010

SEQ ID NO: 482806 - RNA, 64 nt, Homo Sapiens; identical to SEQ ID NO: 287011

SEQ ID NO: 482807 - RNA, 64 nt, Homo Sapiens; identical to SEQ ID NO: 287012

SEQ ID NO: 482808 - RNA, 64 nt, Homo Sapiens; identical to SEQ ID NO: 287013

SEQ ID NO: 482809 - RNA, 64 nt, Homo Sapiens; identical to SEQ ID NO: 287014

SEQ ID NO: 482810 - RNA, 64 nt, Homo Sapiens; identical to SEQ ID NO: 287015

SEQ ID NO: 482811 - RNA, 64 nt, Homo Sapiens; identical to SEQ ID NO: 287016

SEQ ID NO: 482812 - RNA, 64 nt, Homo Sapiens; identical to SEQ ID NO: 287017

SEQ ID NO: 482813 - RNA, 64 nt, Homo Sapiens; identical to SEQ ID NO: 287018

SEQ ID NO: 482814 - RNA, 64 nt, Homo Sapiens; identical to SEQ ID NO: 287019

SEQ ID NO: 482815 - RNA, 64 nt, Homo Sapiens; identical to SEQ ID NO: 287020

SEQ ID NO: 482816 - RNA, 64 nt, Homo Sapiens; identical to SEQ ID NO: 287021

SEQ ID NO: 482817 - RNA, 64 nt, Homo Sapiens; identical to SEQ ID NO: 287022

SEQ ID NO: 482818 - RNA, 64 nt, Homo Sapiens; identical to SEQ ID NO: 287023

SEQ ID NO: 482819 - RNA, 64 nt, Homo Sapiens; identical to SEQ ID NO: 287024

SEQ ID NO: 482820 - RNA, 64 nt, Homo Sapiens; identical to SEQ ID NO: 287025

SEQ ID NO: 482821 - RNA, 64 nt, Homo Sapiens; identical to SEQ ID NO: 287026

SEQ ID NO: 482822 - RNA, 64 nt, Homo Sapiens; identical to SEQ ID NO: 287027

SEQ ID NO: 482823 - RNA, 64 nt, Homo Sapiens; identical to SEQ ID NO: 287028

SEQ ID NO: 482824 - RNA, 64 nt, Homo Sapiens; identical to SEQ ID NO: 287029

SEQ ID NO: 482825 - RNA, 64 nt, Homo Sapiens; identical to SEQ ID NO: 287030

SEQ ID NO: 482826 - RNA, 64 nt, Homo Sapiens; identical to SEQ ID NO: 287031

SEQ ID NO: 482827 - RNA, 64 nt, Homo Sapiens; identical to SEQ ID NO: 287032

SEQ ID NO: 482828 - RNA, 64 nt, Homo Sapiens; identical to SEQ ID NO: 287033

SEQ ID NO: 482829 - RNA, 64 nt, Homo Sapiens; identical to SEQ ID NO: 287034

SEQ ID NO: 482830 - RNA, 64 nt, Homo Sapiens; identical to SEQ ID NO: 287035

SEQ ID NO: 482831 - RNA, 64 nt, Homo Sapiens; identical to SEQ ID NO: 287036

SEQ ID NO: 482832 - RNA, 64 nt, Homo Sapiens; identical to SEQ ID NO: 287037

SEQ ID NO: 482833 - RNA, 64 nt, Homo Sapiens; identical to SEQ ID NO: 287038

SEQ ID NO: 482834 - RNA, 64 nt, Homo Sapiens; identical to SEQ ID NO: 287039

SEQ ID NO: 482835 - RNA, 64 nt, Homo Sapiens; identical to SEQ ID NO: 287040

SEQ ID NO: 482836 - RNA, 64 nt, Homo Sapiens; identical to SEQ ID NO: 287041

SEQ ID NO: 482837 - RNA, 64 nt, Homo Sapiens; identical to SEQ ID NO: 287042

SEQ ID NO: 482838 - RNA, 64 nt, Homo Sapiens; identical to SEQ ID NO: 287043

SEQ ID NO: 482839 - RNA, 64 nt, Homo Sapiens; identical to SEQ ID NO: 287044

SEQ ID NO: 482840 - RNA, 64 nt, Homo Sapiens; identical to SEQ ID NO: 287045

SEQ ID NO: 482841 - RNA, 64 nt, Homo Sapiens; identical to SEQ ID NO: 287046

SEQ ID NO: 482842 - RNA, 64 nt, Homo Sapiens; identical to SEQ ID NO: 287047

SEQ ID NO: 482843 - RNA, 64 nt, Homo Sapiens; identical to SEQ ID NO: 287048

SEQ ID NO: 482844 - RNA, 64 nt, Homo Sapiens; identical to SEQ ID NO: 287049

SEQ ID NO: 482845 - RNA, 64 nt, Homo Sapiens; identical to SEQ ID NO: 287050

SEQ ID NO: 482846 - RNA, 64 nt, Homo Sapiens; identical to SEQ ID NO: 287051

SEQ ID NO: 482847 - RNA, 64 nt, Homo Sapiens; identical to SEQ ID NO: 287052

SEQ ID NO: 482848 - RNA, 64 nt, Homo Sapiens; identical to SEQ ID NO: 287053

SEQ ID NO: 482849 - RNA, 64 nt, Homo Sapiens; identical to SEQ ID NO: 287054

SEQ ID NO: 482850 - RNA, 64 nt, Homo Sapiens; identical to SEQ ID NO: 287055

SEQ ID NO: 482851 - RNA, 64 nt, Homo Sapiens; identical to SEQ ID NO: 287056

SEQ ID NO: 482852 - RNA, 64 nt, Homo Sapiens; identical to SEQ ID NO: 287057

SEQ ID NO: 482853 - RNA, 64 nt, Homo Sapiens; identical to SEQ ID NO: 287058

SEQ ID NO: 482854 - RNA, 64 nt, Homo Sapiens; identical to SEQ ID NO: 287059

SEQ ID NO: 482855 - RNA, 64 nt, Homo Sapiens; identical to SEQ ID NO: 287060

SEQ ID NO: 482856 - RNA, 64 nt, Homo Sapiens; identical to SEQ ID NO: 287061

SEQ ID NO: 482857 - RNA, 64 nt, Homo Sapiens; identical to SEQ ID NO: 287062

SEQ ID NO: 482858 - RNA, 64 nt, Homo Sapiens; identical to SEQ ID NO: 287063

SEQ ID NO: 482859 - RNA, 64 nt, Homo Sapiens; identical to SEQ ID NO: 287064

SEQ ID NO: 482860 - RNA, 64 nt, Homo Sapiens; identical to SEQ ID NO: 287065

SEQ ID NO: 482861 - RNA, 64 nt, Homo Sapiens; identical to SEQ ID NO: 287066

SEQ ID NO: 482862 - RNA, 64 nt, Homo Sapiens; identical to SEQ ID NO: 287067

SEQ ID NO: 482863 - RNA, 64 nt, Homo Sapiens; identical to SEQ ID NO: 287068

SEQ ID NO: 482864 - RNA, 64 nt, Homo Sapiens; identical to SEQ ID NO: 287069

SEQ ID NO: 482865 - RNA, 64 nt, Homo Sapiens; identical to SEQ ID NO: 287070

SEQ ID NO: 482866 - RNA, 64 nt, Homo Sapiens; identical to SEQ ID NO: 287071

SEQ ID NO: 482867 - RNA, 64 nt, Homo Sapiens; identical to SEQ ID NO: 287072

SEQ ID NO: 482868 - RNA, 64 nt, Homo Sapiens; identical to SEQ ID NO: 287073

SEQ ID NO: 482869 - RNA, 64 nt, Homo Sapiens; identical to SEQ ID NO: 287074

SEQ ID NO: 482870 - RNA, 64 nt, Homo Sapiens; identical to SEQ ID NO: 287075

SEQ ID NO: 482871 - RNA, 55 nt, Homo Sapiens; identical to SEQ ID NO: 287076

SEQ ID NO: 482872 - RNA, 64 nt, Homo Sapiens; identical to SEQ ID NO: 287077

SEQ ID NO: 482873 - RNA, 64 nt, Homo Sapiens; identical to SEQ ID NO: 287078

SEQ ID NO: 482874 - RNA, 64 nt, Homo Sapiens; identical to SEQ ID NO: 287079

SEQ ID NO: 482875 - RNA, 64 nt, Homo Sapiens; identical to SEQ ID NO: 287080

SEQ ID NO: 482876 - RNA, 64 nt, Homo Sapiens; identical to SEQ ID NO: 287081

SEQ ID NO: 482877 - RNA, 64 nt, Homo Sapiens; identical to SEQ ID NO: 287082

SEQ ID NO: 482878 - RNA, 64 nt, Homo Sapiens; identical to SEQ ID NO: 287083

SEQ ID NO: 482879 - RNA, 64 nt, Homo Sapiens; identical to SEQ ID NO: 287084

SEQ ID NO: 482880 - RNA, 64 nt, Homo Sapiens; identical to SEQ ID NO: 287085

SEQ ID NO: 482881 - RNA, 64 nt, Homo Sapiens; identical to SEQ ID NO: 287086

SEQ ID NO: 482882 - RNA, 64 nt, Homo Sapiens; identical to SEQ ID NO: 287087

SEQ ID NO: 482883 - RNA, 64 nt, Homo Sapiens; identical to SEQ ID NO: 287088

SEQ ID NO: 482884 - RNA, 64 nt, Homo Sapiens; identical to SEQ ID NO: 287089

SEQ ID NO: 482885 - RNA, 64 nt, Homo Sapiens; identical to SEQ ID NO: 287090

SEQ ID NO: 482886 - RNA, 64 nt, Homo Sapiens; identical to SEQ ID NO: 287091

SEQ ID NO: 482887 - RNA, 64 nt, Homo Sapiens; identical to SEQ ID NO: 287092

SEQ ID NO: 482888 - RNA, 64 nt, Homo Sapiens; identical to SEQ ID NO: 287093

SEQ ID NO: 482889 - RNA, 64 nt, Homo Sapiens; identical to SEQ ID NO: 287094

SEQ ID NO: 482890 - RNA, 64 nt, Homo Sapiens; identical to SEQ ID NO: 287095

SEQ ID NO: 482891 - RNA, 64 nt, Homo Sapiens; identical to SEQ ID NO: 287096

SEQ ID NO: 482892 - RNA, 64 nt, Homo Sapiens; identical to SEQ ID NO: 287097

SEQ ID NO: 482893 - RNA, 64 nt, Homo Sapiens; identical to SEQ ID NO: 287098

SEQ ID NO: 482894 - RNA, 64 nt, Homo Sapiens; identical to SEQ ID NO: 287099

SEQ ID NO: 482895 - RNA, 64 nt, Homo Sapiens; identical to SEQ ID NO: 287100

SEQ ID NO: 482896 - RNA, 64 nt, Homo Sapiens; identical to SEQ ID NO: 287101

SEQ ID NO: 482897 - RNA, 64 nt, Homo Sapiens; identical to SEQ ID NO: 287102

SEQ ID NO: 482898 - RNA, 64 nt, Homo Sapiens; identical to SEQ ID NO: 287103

SEQ ID NO: 482899 - RNA, 64 nt, Homo Sapiens; identical to SEQ ID NO: 287104

SEQ ID NO: 482900 - RNA, 64 nt, Homo Sapiens; identical to SEQ ID NO: 287105

SEQ ID NO: 482901 - RNA, 64 nt, Homo Sapiens; identical to SEQ ID NO: 287106

SEQ ID NO: 482902 - RNA, 64 nt, Homo Sapiens; identical to SEQ ID NO: 287107

SEQ ID NO: 482903 - RNA, 64 nt, Homo Sapiens; identical to SEQ ID NO: 287108

SEQ ID NO: 482904 - RNA, 64 nt, Homo Sapiens; identical to SEQ ID NO: 287109

SEQ ID NO: 482905 - RNA, 64 nt, Homo Sapiens; identical to SEQ ID NO: 287110

SEQ ID NO: 482906 - RNA, 64 nt, Homo Sapiens; identical to SEQ ID NO: 287111

SEQ ID NO: 482907 - RNA, 64 nt, Homo Sapiens; identical to SEQ ID NO: 287112

SEQ ID NO: 482908 - RNA, 64 nt, Homo Sapiens; identical to SEQ ID NO: 287113

SEQ ID NO: 482909 - RNA, 64 nt, Homo Sapiens; identical to SEQ ID NO: 287114

SEQ ID NO: 482910 - RNA, 64 nt, Homo Sapiens; identical to SEQ ID NO: 287115

SEQ ID NO: 482911 - RNA, 64 nt, Homo Sapiens; identical to SEQ ID NO: 287116

SEQ ID NO: 482912 - RNA, 64 nt, Homo Sapiens; identical to SEQ ID NO: 287117

SEQ ID NO: 482913 - RNA, 64 nt, Homo Sapiens; identical to SEQ ID NO: 287118

SEQ ID NO: 482914 - RNA, 52 nt, Homo Sapiens; identical to SEQ ID NO: 287119

SEQ ID NO: 482915 - RNA, 64 nt, Homo Sapiens; identical to SEQ ID NO: 287120

SEQ ID NO: 482916 - RNA, 64 nt, Homo Sapiens; identical to SEQ ID NO: 287121

SEQ ID NO: 482917 - RNA, 64 nt, Homo Sapiens; identical to SEQ ID NO: 287122

SEQ ID NO: 482918 - RNA, 55 nt, Homo Sapiens; identical to SEQ ID NO: 287123

SEQ ID NO: 482919 - RNA, 64 nt, Homo Sapiens; identical to SEQ ID NO: 287124

SEQ ID NO: 482920 - RNA, 64 nt, Homo Sapiens; identical to SEQ ID NO: 287125

SEQ ID NO: 482921 - RNA, 64 nt, Homo Sapiens; identical to SEQ ID NO: 287126

SEQ ID NO: 482922 - RNA, 64 nt, Homo Sapiens; identical to SEQ ID NO: 287127

SEQ ID NO: 482923 - RNA, 64 nt, Homo Sapiens; identical to SEQ ID NO: 287128

SEQ ID NO: 482924 - RNA, 64 nt, Homo Sapiens; identical to SEQ ID NO: 287129

SEQ ID NO: 482925 - RNA, 64 nt, Homo Sapiens; identical to SEQ ID NO: 287130

SEQ ID NO: 482926 - RNA, 64 nt, Homo Sapiens; identical to SEQ ID NO: 287131

SEQ ID NO: 482927 - RNA, 64 nt, Homo Sapiens; identical to SEQ ID NO: 287132

SEQ ID NO: 482928 - RNA, 64 nt, Homo Sapiens; identical to SEQ ID NO: 287133

SEQ ID NO: 482929 - RNA, 64 nt, Homo Sapiens; identical to SEQ ID NO: 287134

SEQ ID NO: 482930 - RNA, 64 nt, Homo Sapiens; identical to SEQ ID NO: 287135

SEQ ID NO: 482931 - RNA, 64 nt, Homo Sapiens; identical to SEQ ID NO: 287136

SEQ ID NO: 482932 - RNA, 64 nt, Homo Sapiens; identical to SEQ ID NO: 287137

SEQ ID NO: 482933 - RNA, 64 nt, Homo Sapiens; identical to SEQ ID NO: 287138

SEQ ID NO: 482934 - RNA, 64 nt, Homo Sapiens; identical to SEQ ID NO: 287139

SEQ ID NO: 482935 - RNA, 64 nt, Homo Sapiens; identical to SEQ ID NO: 287140

SEQ ID NO: 482936 - RNA, 64 nt, Homo Sapiens; identical to SEQ ID NO: 287141

SEQ ID NO: 482937 - RNA, 64 nt, Homo Sapiens; identical to SEQ ID NO: 287142

SEQ ID NO: 482938 - RNA, 64 nt, Homo Sapiens; identical to SEQ ID NO: 287143

SEQ ID NO: 482939 - RNA, 64 nt, Homo Sapiens; identical to SEQ ID NO: 287144

SEQ ID NO: 482940 - RNA, 64 nt, Homo Sapiens; identical to SEQ ID NO: 287145

SEQ ID NO: 482941 - RNA, 64 nt, Homo Sapiens; identical to SEQ ID NO: 287146

SEQ ID NO: 482942 - RNA, 64 nt, Homo Sapiens; identical to SEQ ID NO: 287147

SEQ ID NO: 482943 - RNA, 64 nt, Homo Sapiens; identical to SEQ ID NO: 287148

SEQ ID NO: 482944 - RNA, 64 nt, Homo Sapiens; identical to SEQ ID NO: 287149

SEQ ID NO: 482945 - RNA, 64 nt, Homo Sapiens; identical to SEQ ID NO: 287150

SEQ ID NO: 482946 - RNA, 64 nt, Homo Sapiens; identical to SEQ ID NO: 287151

SEQ ID NO: 482947 - RNA, 64 nt, Homo Sapiens; identical to SEQ ID NO: 287152

SEQ ID NO: 482948 - RNA, 64 nt, Homo Sapiens; identical to SEQ ID NO: 287153

SEQ ID NO: 482949 - RNA, 64 nt, Homo Sapiens; identical to SEQ ID NO: 287154

SEQ ID NO: 482950 - RNA, 64 nt, Homo Sapiens; identical to SEQ ID NO: 287155

SEQ ID NO: 482951 - RNA, 64 nt, Homo Sapiens; identical to SEQ ID NO: 287156

SEQ ID NO: 482952 - RNA, 64 nt, Homo Sapiens; identical to SEQ ID NO: 287157

SEQ ID NO: 482953 - RNA, 64 nt, Homo Sapiens; identical to SEQ ID NO: 287158

SEQ ID NO: 482954 - RNA, 64 nt, Homo Sapiens; identical to SEQ ID NO: 287159

SEQ ID NO: 482955 - RNA, 64 nt, Homo Sapiens; identical to SEQ ID NO: 287160

SEQ ID NO: 482956 - RNA, 64 nt, Homo Sapiens; identical to SEQ ID NO: 287161

SEQ ID NO: 482957 - RNA, 64 nt, Homo Sapiens; identical to SEQ ID NO: 287162

SEQ ID NO: 482958 - RNA, 64 nt, Homo Sapiens; identical to SEQ ID NO: 287163

SEQ ID NO: 482959 - RNA, 64 nt, Homo Sapiens; identical to SEQ ID NO: 287164

SEQ ID NO: 482960 - RNA, 64 nt, Homo Sapiens; identical to SEQ ID NO: 287165

SEQ ID NO: 482961 - RNA, 64 nt, Homo Sapiens; identical to SEQ ID NO: 287166

SEQ ID NO: 482962 - RNA, 64 nt, Homo Sapiens; identical to SEQ ID NO: 287167

SEQ ID NO: 482963 - RNA, 64 nt, Homo Sapiens; identical to SEQ ID NO: 287168

SEQ ID NO: 482964 - RNA, 64 nt, Homo Sapiens; identical to SEQ ID NO: 287169

SEQ ID NO: 482965 - RNA, 64 nt, Homo Sapiens; identical to SEQ ID NO: 287170

SEQ ID NO: 482966 - RNA, 64 nt, Homo Sapiens; identical to SEQ ID NO: 287171

SEQ ID NO: 482967 - RNA, 64 nt, Homo Sapiens; identical to SEQ ID NO: 287172

SEQ ID NO: 482968 - RNA, 64 nt, Homo Sapiens; identical to SEQ ID NO: 287173

SEQ ID NO: 482969 - RNA, 64 nt, Homo Sapiens; identical to SEQ ID NO: 287174

SEQ ID NO: 482970 - RNA, 64 nt, Homo Sapiens; identical to SEQ ID NO: 287175

SEQ ID NO: 482971 - RNA, 64 nt, Homo Sapiens; identical to SEQ ID NO: 287176

SEQ ID NO: 482972 - RNA, 64 nt, Homo Sapiens; identical to SEQ ID NO: 194853

SEQ ID NO: 482973 - RNA, 64 nt, Homo Sapiens; identical to SEQ ID NO: 194854

SEQ ID NO: 482974 - RNA, 64 nt, Homo Sapiens; identical to SEQ ID NO: 194855

SEQ ID NO: 482975 - RNA, 64 nt, Homo Sapiens; identical to SEQ ID NO: 194856

SEQ ID NO: 482976 - RNA, 64 nt, Homo Sapiens; identical to SEQ ID NO: 194857

SEQ ID NO: 482977 - RNA, 64 nt, Homo Sapiens; identical to SEQ ID NO: 194858

SEQ ID NO: 482978 - RNA, 64 nt, Homo Sapiens; identical to SEQ ID NO: 194859

SEQ ID NO: 482979 - RNA, 64 nt, Homo Sapiens; identical to SEQ ID NO: 194860

SEQ ID NO: 482980 - RNA, 64 nt, Homo Sapiens; identical to SEQ ID NO: 194861

SEQ ID NO: 482981 - RNA, 64 nt, Homo Sapiens; identical to SEQ ID NO: 194862

SEQ ID NO: 482982 - RNA, 64 nt, Homo Sapiens; identical to SEQ ID NO: 194863

SEQ ID NO: 482983 - RNA, 64 nt, Homo Sapiens; identical to SEQ ID NO: 194864

SEQ ID NO: 482984 - RNA, 64 nt, Homo Sapiens; identical to SEQ ID NO: 194865

SEQ ID NO: 482985 - RNA, 64 nt, Homo Sapiens; identical to SEQ ID NO: 194866

SEQ ID NO: 482986 - RNA, 64 nt, Homo Sapiens; identical to SEQ ID NO: 194867

SEQ ID NO: 482987 - RNA, 64 nt, Homo Sapiens; identical to SEQ ID NO: 194868

SEQ ID NO: 482988 - RNA, 64 nt, Homo Sapiens; identical to SEQ ID NO: 194869

SEQ ID NO: 482989 - RNA, 64 nt, Homo Sapiens; identical to SEQ ID NO: 194870

SEQ ID NO: 482990 - RNA, 64 nt, Homo Sapiens; identical to SEQ ID NO: 194871

SEQ ID NO: 482991 - RNA, 64 nt, Homo Sapiens; identical to SEQ ID NO: 194872

SEQ ID NO: 482992 - RNA, 64 nt, Homo Sapiens; identical to SEQ ID NO: 194873

SEQ ID NO: 482993 - RNA, 64 nt, Homo Sapiens; identical to SEQ ID NO: 194874

SEQ ID NO: 482994 - RNA, 64 nt, Homo Sapiens; identical to SEQ ID NO: 194875

SEQ ID NO: 482995 - RNA, 64 nt, Homo Sapiens; identical to SEQ ID NO: 194876

SEQ ID NO: 482996 - RNA, 64 nt, Homo Sapiens; identical to SEQ ID NO: 194877

SEQ ID NO: 482997 - RNA, 64 nt, Homo Sapiens; identical to SEQ ID NO: 194878

SEQ ID NO: 482998 - RNA, 64 nt, Homo Sapiens; identical to SEQ ID NO: 194879

SEQ ID NO: 482999 - RNA, 64 nt, Homo Sapiens; identical to SEQ ID NO: 194880

SEQ ID NO: 483000 - RNA, 64 nt, Homo Sapiens; identical to SEQ ID NO: 194881

SEQ ID NO: 483001 - RNA, 64 nt, Homo Sapiens; identical to SEQ ID NO: 194882

SEQ ID NO: 483002 - RNA, 64 nt, Homo Sapiens; identical to SEQ ID NO: 194883

SEQ ID NO: 483003 - RNA, 64 nt, Homo Sapiens; identical to SEQ ID NO: 194884

SEQ ID NO: 483004 - RNA, 64 nt, Homo Sapiens; identical to SEQ ID NO: 194885

SEQ ID NO: 483005 - RNA, 64 nt, Homo Sapiens; identical to SEQ ID NO: 194886

SEQ ID NO: 483006 - RNA, 64 nt, Homo Sapiens; identical to SEQ ID NO: 194887

SEQ ID NO: 483007 - RNA, 64 nt, Homo Sapiens; identical to SEQ ID NO: 194888

SEQ ID NO: 483008 - RNA, 64 nt, Homo Sapiens; identical to SEQ ID NO: 194889

SEQ ID NO: 483009 - RNA, 64 nt, Homo Sapiens; identical to SEQ ID NO: 194890

SEQ ID NO: 483010 - RNA, 64 nt, Homo Sapiens; identical to SEQ ID NO: 194891

SEQ ID NO: 483011 - RNA, 64 nt, Homo Sapiens; identical to SEQ ID NO: 194892

SEQ ID NO: 483012 - RNA, 64 nt, Homo Sapiens; identical to SEQ ID NO: 194893

SEQ ID NO: 483013 - RNA, 64 nt, Homo Sapiens; identical to SEQ ID NO: 194894

SEQ ID NO: 483014 - RNA, 64 nt, Homo Sapiens; identical to SEQ ID NO: 194895

SEQ ID NO: 483015 - RNA, 64 nt, Homo Sapiens; identical to SEQ ID NO: 194896

SEQ ID NO: 483016 - RNA, 64 nt, Homo Sapiens; identical to SEQ ID NO: 194897

SEQ ID NO: 483017 - RNA, 64 nt, Homo Sapiens; identical to SEQ ID NO: 194898

SEQ ID NO: 483018 - RNA, 64 nt, Homo Sapiens; identical to SEQ ID NO: 194899

SEQ ID NO: 483019 - RNA, 64 nt, Homo Sapiens; identical to SEQ ID NO: 194900

SEQ ID NO: 483020 - RNA, 64 nt, Homo Sapiens; identical to SEQ ID NO: 194901

SEQ ID NO: 483021 - RNA, 64 nt, Homo Sapiens; identical to SEQ ID NO: 194902

SEQ ID NO: 483022 - RNA, 64 nt, Homo Sapiens; identical to SEQ ID NO: 194903

SEQ ID NO: 483023 - RNA, 64 nt, Homo Sapiens; identical to SEQ ID NO: 194904

SEQ ID NO: 483024 - RNA, 64 nt, Homo Sapiens; identical to SEQ ID NO: 194905

SEQ ID NO: 483025 - RNA, 64 nt, Homo Sapiens; identical to SEQ ID NO: 194906

SEQ ID NO: 483026 - RNA, 64 nt, Homo Sapiens; identical to SEQ ID NO: 194907

SEQ ID NO: 483027 - RNA, 64 nt, Homo Sapiens; identical to SEQ ID NO: 194908

SEQ ID NO: 483028 - RNA, 64 nt, Homo Sapiens; identical to SEQ ID NO: 194909

SEQ ID NO: 483029 - RNA, 64 nt, Homo Sapiens; identical to SEQ ID NO: 194910

SEQ ID NO: 483030 - RNA, 64 nt, Homo Sapiens; identical to SEQ ID NO: 194911

SEQ ID NO: 483031 - RNA, 64 nt, Homo Sapiens; identical to SEQ ID NO: 194912

SEQ ID NO: 483032 - RNA, 64 nt, Homo Sapiens; identical to SEQ ID NO: 194913

SEQ ID NO: 483033 - RNA, 64 nt, Homo Sapiens; identical to SEQ ID NO: 194914

SEQ ID NO: 483034 - RNA, 64 nt, Homo Sapiens; identical to SEQ ID NO: 194915

SEQ ID NO: 483035 - RNA, 64 nt, Homo Sapiens; identical to SEQ ID NO: 194916

SEQ ID NO: 483036 - RNA, 64 nt, Homo Sapiens; identical to SEQ ID NO: 194917

SEQ ID NO: 483037 - RNA, 64 nt, Homo Sapiens; identical to SEQ ID NO: 194918

SEQ ID NO: 483038 - RNA, 64 nt, Homo Sapiens; identical to SEQ ID NO: 194919

SEQ ID NO: 483039 - RNA, 64 nt, Homo Sapiens; identical to SEQ ID NO: 194920

SEQ ID NO: 483040 - RNA, 64 nt, Homo Sapiens; identical to SEQ ID NO: 194921

SEQ ID NO: 483041 - RNA, 64 nt, Homo Sapiens; identical to SEQ ID NO: 194922

SEQ ID NO: 483042 - RNA, 64 nt, Homo Sapiens; identical to SEQ ID NO: 194923

SEQ ID NO: 483043 - RNA, 64 nt, Homo Sapiens; identical to SEQ ID NO: 194924

SEQ ID NO: 483044 - RNA, 64 nt, Homo Sapiens; identical to SEQ ID NO: 194925

SEQ ID NO: 483045 - RNA, 64 nt, Homo Sapiens; identical to SEQ ID NO: 194926

SEQ ID NO: 483046 - RNA, 64 nt, Homo Sapiens; identical to SEQ ID NO: 194927

SEQ ID NO: 483047 - RNA, 64 nt, Homo Sapiens; identical to SEQ ID NO: 194928

SEQ ID NO: 483048 - RNA, 64 nt, Homo Sapiens; identical to SEQ ID NO: 194929

SEQ ID NO: 483049 - RNA, 64 nt, Homo Sapiens; identical to SEQ ID NO: 194930

SEQ ID NO: 483050 - RNA, 64 nt, Homo Sapiens; identical to SEQ ID NO: 194931

SEQ ID NO: 483051 - RNA, 64 nt, Homo Sapiens; identical to SEQ ID NO: 194932

SEQ ID NO: 483052 - RNA, 64 nt, Homo Sapiens; identical to SEQ ID NO: 194933

SEQ ID NO: 483053 - RNA, 64 nt, Homo Sapiens; identical to SEQ ID NO: 194934

SEQ ID NO: 483054 - RNA, 64 nt, Homo Sapiens; identical to SEQ ID NO: 194935

SEQ ID NO: 483055 - RNA, 64 nt, Homo Sapiens; identical to SEQ ID NO: 194936

SEQ ID NO: 483056 - RNA, 64 nt, Homo Sapiens; identical to SEQ ID NO: 194937

SEQ ID NO: 483057 - RNA, 64 nt, Homo Sapiens; identical to SEQ ID NO: 194938

SEQ ID NO: 483058 - RNA, 64 nt, Homo Sapiens; identical to SEQ ID NO: 194939

SEQ ID NO: 483059 - RNA, 64 nt, Homo Sapiens; identical to SEQ ID NO: 194940

SEQ ID NO: 483060 - RNA, 64 nt, Homo Sapiens; identical to SEQ ID NO: 194941

SEQ ID NO: 483061 - RNA, 64 nt, Homo Sapiens; identical to SEQ ID NO: 194942

SEQ ID NO: 483062 - RNA, 64 nt, Homo Sapiens; identical to SEQ ID NO: 194943

SEQ ID NO: 483063 - RNA, 64 nt, Homo Sapiens; identical to SEQ ID NO: 194944

SEQ ID NO: 483064 - RNA, 64 nt, Homo Sapiens; identical to SEQ ID NO: 194945

SEQ ID NO: 483065 - RNA, 51 nt, Homo Sapiens; identical to SEQ ID NO: 194946

SEQ ID NO: 483066 - RNA, 64 nt, Homo Sapiens; identical to SEQ ID NO: 194947

SEQ ID NO: 483067 - RNA, 64 nt, Homo Sapiens; identical to SEQ ID NO: 194948

SEQ ID NO: 483068 - RNA, 64 nt, Homo Sapiens; identical to SEQ ID NO: 194949

SEQ ID NO: 483069 - RNA, 64 nt, Homo Sapiens; identical to SEQ ID NO: 194950

SEQ ID NO: 483070 - RNA, 64 nt, Homo Sapiens
guaggugugggguuccagaggacagcaggacacucucgcauacuuugccaaaugaggccugcuc

SEQ ID NO: 483071 - RNA, 64 nt, Homo Sapiens
uccccaccccuuucuccccgucucccuucucuuucucgcauaacagcucaguauuuaaacauca

SEQ ID NO: 483072 - RNA, 64 nt, Homo Sapiens
aaguaaaaaggaauacugugagcauaaucaauaacucgcauaugcuguaauaguuaaauccuac

SEQ ID NO: 483073 - RNA, 64 nt, Homo Sapiens
accuuuccaccacagccagcggcaccagggguuucucgcauaggacuucugccuggagacuuag

SEQ ID NO: 483074 - RNA, 64 nt, Homo Sapiens
gcacaaugcugucuucaucauugagguuuucauucucgcauaaagaagcuuuauggugauuauu

SEQ ID NO: 483075 - RNA, 64 nt, Homo Sapiens
auauuauagcaggccaagaucuuugguauauagucucgcauauuaacugaaacuguuugucuuc

SEQ ID NO: 483076 - RNA, 64 nt, Homo Sapiens
aacuagguuugacuguauuauuagcaacgacuuucucgcauacuucacauccucucaccaugcg

SEQ ID NO: 483077 - RNA, 64 nt, Homo Sapiens
acagagguggggcuucgggcccugcuugcagucacucgcauagccugccuuccugggccagcuu

SEQ ID NO: 483078 - RNA, 64 nt, Homo Sapiens
ccagcuggagguuucagggcuucuggaggaugcucucgcauagcucgagguccucugcccaccu

SEQ ID NO: 483079 - RNA, 64 nt, Homo Sapiens
gacuugugacaauuuagacugaacuacauucuuucucgcauaguuacaagaguuccuauggaca

SEQ ID NO: 483080 - RNA, 64 nt, Homo Sapiens
cugccuaugaugaaggaccguuccuaagaugcaucucgcauaggucugagcagcgaaagcuccc

SEQ ID NO: 483081 - RNA, 64 nt, Homo Sapiens
cucugucagaaucaaagacuaagcuuaagaguuccucgcauauaucguugugcacaggaucaac

SEQ ID NO: 483082 - RNA, 64 nt, Homo Sapiens
acaggaaacuggauugccaaaucaacuuggauggcucgcauaugcugggcaaaucuuacuuggc

SEQ ID NO: 483083 - RNA, 64 nt, Homo Sapiens
agccuauauaaauauaaacaaggaaggaaacugucucgcauaggugcaguauucucuugcuaag

SEQ ID NO: 483084 - RNA, 64 nt, Homo Sapiens
ucaucuuauguaaguguuaauuaauauuaagggaaaugacuacaaacuuucaaagcaaaugcuc

SEQ ID NO: 483085 - RNA, 64 nt, Homo Sapiens
aaauaugggaggacaaagaaucgcaaauucuucaaaugacuauuaucaguauuauuaacaugcg

SEQ ID NO: 483086 - RNA, 64 nt, Homo Sapiens
aaguggcaacauuuuuauucuucagagucagguaaaugacuauaauaguuugguuucuaaugaa

SEQ ID NO: 483087 - RNA, 64 nt, Homo Sapiens
cacaaagaacucacagucugauuaggaugaacuuaaugacuauuuacaccucaaaauauauuca

SEQ ID NO: 483088 - RNA, 64 nt, Homo Sapiens
uucuuauaaagucaguuagaaggacuuccuuaacaaugacuauuauaaugucuuacuuaaaaua

SEQ ID NO: 483089 - RNA, 64 nt, Homo Sapiens
aagcugcuuugcucccuauauauuaaguagauguaaugacuagacaauagguaagaauaaacug

SEQ ID NO: 483090 - RNA, 64 nt, Homo Sapiens
gccugaagggccauuuucagagcugcagcugcaaaaugacuacaaggaacuaaaccuccagguc

SEQ ID NO: 483091 - RNA, 64 nt, Homo Sapiens
cuguuuggaaguguaaugauuuuaucacauggugaaugacuacuaagaguaaugauuauaucac

SEQ ID NO: 483092 - RNA, 64 nt, Homo Sapiens
ugacuacuaagaguaaugauuauaucacauugugaaugacuacuugccacaguaaaaauacaug

SEQ ID NO: 483093 - RNA, 64 nt, Homo Sapiens
aguaaaggugaccaagucucuuucuuaaagucacaaugacuaaaguauuaguugaauuuuuuuu

SEQ ID NO: 483094 - RNA, 64 nt, Homo Sapiens
accucuguaucuaaauguauaccauccacuuguaaaugacuauaaacuauuaugugauugcuuu

SEQ ID NO: 483095 - RNA, 64 nt, Homo Sapiens
aacagugagagcccuucaugacuauuuauugcugaaugacuaccaaauaacuaggcguggacuu

SEQ ID NO: 483096 - RNA, 64 nt, Homo Sapiens
caaccuuuggaugcacuuuaccaagaaugagaagaaugacuaugagguugaccaauaaccaugc

SEQ ID NO: 483097 - RNA, 64 nt, Homo Sapiens
guuuuuauuaaaacauaagagugcuuuuuaaaauaaugacuacuaaauaugcaccuaggagaau

SEQ ID NO: 483098 - RNA, 64 nt, Homo Sapiens
cagaagggcacaagggggaagcuugaguuuuuaaaaugacuaccaccccuuuugaugaccccag

SEQ ID NO: 483099 - RNA, 64 nt, Homo Sapiens
caaucaaauugucauuaauguugguaugcuuacaaaugacuaacgugggcuauacuguauuauu

SEQ ID NO: 483100 - RNA, 64 nt, Homo Sapiens; identical to SEQ ID NO: 50174

SEQ ID NO: 483101 - RNA, 64 nt, Homo Sapiens; identical to SEQ ID NO: 50175

SEQ ID NO: 483102 - RNA, 64 nt, Homo Sapiens; identical to SEQ ID NO: 50176

SEQ ID NO: 483103 - RNA, 64 nt, Homo Sapiens; identical to SEQ ID NO: 50177

SEQ ID NO: 483104 - RNA, 64 nt, Homo Sapiens; identical to SEQ ID NO: 50178

SEQ ID NO: 483105 - RNA, 64 nt, Homo Sapiens; identical to SEQ ID NO: 50179

SEQ ID NO: 483106 - RNA, 64 nt, Homo Sapiens; identical to SEQ ID NO: 50180

SEQ ID NO: 483107 - RNA, 64 nt, Homo Sapiens; identical to SEQ ID NO: 50181

SEQ ID NO: 483108 - RNA, 64 nt, Homo Sapiens; identical to SEQ ID NO: 50182

SEQ ID NO: 483109 - RNA, 64 nt, Homo Sapiens; identical to SEQ ID NO: 50183

SEQ ID NO: 483110 - RNA, 64 nt, Homo Sapiens; identical to SEQ ID NO: 50184

SEQ ID NO: 483111 - RNA, 64 nt, Homo Sapiens; identical to SEQ ID NO: 50185

SEQ ID NO: 483112 - RNA, 64 nt, Homo Sapiens; identical to SEQ ID NO: 50186

SEQ ID NO: 483113 - RNA, 64 nt, Homo Sapiens; identical to SEQ ID NO: 50187

SEQ ID NO: 483114 - RNA, 64 nt, Homo Sapiens; identical to SEQ ID NO: 50188

SEQ ID NO: 483115 - RNA, 64 nt, Homo Sapiens; identical to SEQ ID NO: 50189

SEQ ID NO: 483116 - RNA, 64 nt, Homo Sapiens; identical to SEQ ID NO: 50190

SEQ ID NO: 483117 - RNA, 64 nt, Homo Sapiens; identical to SEQ ID NO: 50191

SEQ ID NO: 483118 - RNA, 64 nt, Homo Sapiens; identical to SEQ ID NO: 50192

SEQ ID NO: 483119 - RNA, 64 nt, Homo Sapiens; identical to SEQ ID NO: 50193

SEQ ID NO: 483120 - RNA, 64 nt, Homo Sapiens; identical to SEQ ID NO: 50194

SEQ ID NO: 483121 - RNA, 64 nt, Homo Sapiens; identical to SEQ ID NO: 50195

SEQ ID NO: 483122 - RNA, 64 nt, Homo Sapiens; identical to SEQ ID NO: 50196

SEQ ID NO: 483123 - RNA, 64 nt, Homo Sapiens; identical to SEQ ID NO: 50197

SEQ ID NO: 483124 - RNA, 64 nt, Homo Sapiens; identical to SEQ ID NO: 50198

SEQ ID NO: 483125 - RNA, 64 nt, Homo Sapiens; identical to SEQ ID NO: 50199

SEQ ID NO: 483126 - RNA, 64 nt, Homo Sapiens; identical to SEQ ID NO: 50200

SEQ ID NO: 483127 - RNA, 64 nt, Homo Sapiens; identical to SEQ ID NO: 50201

SEQ ID NO: 483128 - RNA, 64 nt, Homo Sapiens; identical to SEQ ID NO: 50202

SEQ ID NO: 483129 - RNA, 64 nt, Homo Sapiens; identical to SEQ ID NO: 50203

SEQ ID NO: 483130 - RNA, 64 nt, Homo Sapiens; identical to SEQ ID NO: 50204

SEQ ID NO: 483131 - RNA, 64 nt, Homo Sapiens; identical to SEQ ID NO: 50205

SEQ ID NO: 483132 - RNA, 64 nt, Homo Sapiens; identical to SEQ ID NO: 50206

SEQ ID NO: 483133 - RNA, 64 nt, Homo Sapiens; identical to SEQ ID NO: 50207

SEQ ID NO: 483134 - RNA, 64 nt, Homo Sapiens; identical to SEQ ID NO: 50208

SEQ ID NO: 483135 - RNA, 64 nt, Homo Sapiens; identical to SEQ ID NO: 50209

SEQ ID NO: 483136 - RNA, 64 nt, Homo Sapiens; identical to SEQ ID NO: 50210

SEQ ID NO: 483137 - RNA, 64 nt, Homo Sapiens; identical to SEQ ID NO: 50211

SEQ ID NO: 483138 - RNA, 64 nt, Homo Sapiens; identical to SEQ ID NO: 50212

SEQ ID NO: 483139 - RNA, 64 nt, Homo Sapiens; identical to SEQ ID NO: 50213

SEQ ID NO: 483140 - RNA, 64 nt, Homo Sapiens; identical to SEQ ID NO: 50214

SEQ ID NO: 483141 - RNA, 64 nt, Homo Sapiens; identical to SEQ ID NO: 50215

SEQ ID NO: 483142 - RNA, 64 nt, Homo Sapiens; identical to SEQ ID NO: 50216

SEQ ID NO: 483143 - RNA, 64 nt, Homo Sapiens; identical to SEQ ID NO: 50217

SEQ ID NO: 483144 - RNA, 64 nt, Homo Sapiens; identical to SEQ ID NO: 50218

SEQ ID NO: 483145 - RNA, 64 nt, Homo Sapiens; identical to SEQ ID NO: 50219

SEQ ID NO: 483146 - RNA, 64 nt, Homo Sapiens; identical to SEQ ID NO: 50220

SEQ ID NO: 483147 - RNA, 64 nt, Homo Sapiens; identical to SEQ ID NO: 50221

SEQ ID NO: 483148 - RNA, 64 nt, Homo Sapiens; identical to SEQ ID NO: 50222

SEQ ID NO: 483149 - RNA, 64 nt, Homo Sapiens; identical to SEQ ID NO: 50223

SEQ ID NO: 483150 - RNA, 64 nt, Homo Sapiens; identical to SEQ ID NO: 50224

SEQ ID NO: 483151 - RNA, 64 nt, Homo Sapiens; identical to SEQ ID NO: 50225

SEQ ID NO: 483152 - RNA, 64 nt, Homo Sapiens; identical to SEQ ID NO: 50226

SEQ ID NO: 483153 - RNA, 64 nt, Homo Sapiens; identical to SEQ ID NO: 50227

SEQ ID NO: 483154 - RNA, 64 nt, Homo Sapiens; identical to SEQ ID NO: 50228

SEQ ID NO: 483155 - RNA, 64 nt, Homo Sapiens; identical to SEQ ID NO: 50229

SEQ ID NO: 483156 - RNA, 64 nt, Homo Sapiens; identical to SEQ ID NO: 50230

SEQ ID NO: 483157 - RNA, 64 nt, Homo Sapiens; identical to SEQ ID NO: 50231

SEQ ID NO: 483158 - RNA, 64 nt, Homo Sapiens; identical to SEQ ID NO: 50232

SEQ ID NO: 483159 - RNA, 64 nt, Homo Sapiens; identical to SEQ ID NO: 50233

SEQ ID NO: 483160 - RNA, 64 nt, Homo Sapiens; identical to SEQ ID NO: 50234

SEQ ID NO: 483161 - RNA, 64 nt, Homo Sapiens; identical to SEQ ID NO: 50235

SEQ ID NO: 483162 - RNA, 64 nt, Homo Sapiens; identical to SEQ ID NO: 50236

SEQ ID NO: 483163 - RNA, 64 nt, Homo Sapiens; identical to SEQ ID NO: 50237

SEQ ID NO: 483164 - RNA, 64 nt, Homo Sapiens; identical to SEQ ID NO: 50238

SEQ ID NO: 483165 - RNA, 64 nt, Homo Sapiens; identical to SEQ ID NO: 50239

SEQ ID NO: 483166 - RNA, 64 nt, Homo Sapiens; identical to SEQ ID NO: 50240

SEQ ID NO: 483167 - RNA, 64 nt, Homo Sapiens; identical to SEQ ID NO: 50241

SEQ ID NO: 483168 - RNA, 64 nt, Homo Sapiens; identical to SEQ ID NO: 50242

SEQ ID NO: 483169 - RNA, 64 nt, Homo Sapiens; identical to SEQ ID NO: 50243

SEQ ID NO: 483170 - RNA, 64 nt, Homo Sapiens
aaauguaaucuccaacauccaugugccagaaagcagagaauagaccuguccauaucuggcuugc

SEQ ID NO: 483171 - RNA, 64 nt, Homo Sapiens
caugaaaagaaagggaagaauuagcaaguuuaggagagaauaguuuucccuuuuuccugggagu

SEQ ID NO: 483172 - RNA, 64 nt, Homo Sapiens
gacaucuucaaccuagcacaauucacugaauaucagagaauacuuuucucauaaaauucuguca

SEQ ID NO: 483173 - RNA, 64 nt, Homo Sapiens
cauaugaaaauacuugauuuucaucuuaaaugagagagaauauuucuaagaaaugauauuuuuc

SEQ ID NO: 483174 - RNA, 64 nt, Homo Sapiens
uggacaugagaccagugugaagacucacccuggaagagaauauucuccccaaacugcccuaccu

SEQ ID NO: 483175 - RNA, 64 nt, Homo Sapiens
aggcuuuucucugucuuccaugucuugagaucucagagaauaauaauaaaaauguuacuuuaua

SEQ ID NO: 483176 - RNA, 64 nt, Homo Sapiens
caggcauucugucauguugaacaauuuuaaauaaagagaauaucugguguuaggagcuuguuuu

SEQ ID NO: 483177 - RNA, 64 nt, Homo Sapiens
gcucuuuccuaaaacauggcaaaugaauagauguagagaauaacaauauuacuuacaagaugaa

SEQ ID NO: 483178 - RNA, 64 nt, Homo Sapiens
aaauguaugcuacucugaaaacaaagcuuauguuagagaauaucuuacuguaagaaacaaggaa

SEQ ID NO: 483179 - RNA, 64 nt, Homo Sapiens
uuggaugcagugaaaagggcagaaauaccacagcagagaauaaaauugauaauguuggcaacac

SEQ ID NO: 483180 - RNA, 64 nt, Homo Sapiens
uacacuuaauuucacaauacuuugcuauugguaaagagaauaaauuuacuaagguaggguagca

SEQ ID NO: 483181 - RNA, 64 nt, Homo Sapiens
caucaaauuuauaucucgaauaugucauuucugaagagaauagucaugauuaacauaauccagg

SEQ ID NO: 483182 - RNA, 64 nt, Homo Sapiens
gccucugggugucauguggaccagacuucugaauagagaauauuuauaacuuuuguaugagaga

SEQ ID NO: 483183 - RNA, 64 nt, Homo Sapiens
cucuccucccggauggucauguuuuugucacauuagagaauaaacagccacacacacauuuuuu

SEQ ID NO: 483184 - RNA, 64 nt, Homo Sapiens
aauuuuggccucucauaguuuucucucucuuuaaagagaauaaauagagggccagguguggugg

SEQ ID NO: 483185 - RNA, 64 nt, Homo Sapiens
uuaaaaaaaaaaaaaaaaaaaaaaaaagagagagagagaauaaauagaaaagaauguggcuggg

SEQ ID NO: 483186 - RNA, 64 nt, Homo Sapiens
uauucugcaguucucagcuuggugaggcuccaaaagagaauaugucagauguauuccuacuucc

SEQ ID NO: 483187 - RNA, 64 nt, Homo Sapiens
cugacgguaaaguuaagauuaaauuaagacagagagagaauacauaucacugccaggccugaua

SEQ ID NO: 483188 - RNA, 64 nt, Homo Sapiens
aauacuugaagcaagaagggcccugcaaacccaaagagaauauuccccuaacucacagcacaaa

SEQ ID NO: 483189 - RNA, 64 nt, Homo Sapiens
guucccuguagguccucuguugaagacagaagcgagagaauaaacccgagggucagugccccag

SEQ ID NO: 483190 - RNA, 64 nt, Homo Sapiens
cuuuugcauauacaggugaagcuguugaccugcaagagaauauaagcuuagcuuguuuucuggu

SEQ ID NO: 483191 - RNA, 64 nt, Homo Sapiens
uauaugaagagagacugguuaaacauguuuggaaagagaauaaaugagauauagcaggagacca

SEQ ID NO: 483192 - RNA, 64 nt, Homo Sapiens
uugggucaagaagugaucuuuagcuaauaaagaaagagaauagaaaacacgcaugagauauuca

SEQ ID NO: 483193 - RNA, 64 nt, Homo Sapiens
uauaagccaaagcuauauguuguaacuuuuuuuuagagaauagcuuuaucuugguuuaacucuu

SEQ ID NO: 483194 - RNA, 64 nt, Homo Sapiens
auggugccgcuggggacuuuuuagagaaauguaaagagaauagcuauucagugucuacuagcag

SEQ ID NO: 483195 - RNA, 64 nt, Homo Sapiens
cugcuacuguaaacaugaauauugaauacugacaagagaauacccauacaaaucgucccaccgc

SEQ ID NO: 483196 - RNA, 64 nt, Homo Sapiens
auaagggaaaaauaugagaaaaauaaaaauaaaaagagaauaauaggccaggcacuguggcuca

SEQ ID NO: 483197 - RNA, 64 nt, Homo Sapiens
aacaagagcgagacuccguuuccaaaaaaauaagagagaauagaagaagcuacugcaugauguu

SEQ ID NO: 483198 - RNA, 64 nt, Homo Sapiens
cauuuacuucaacucuaccuuaguagauacaaguagagaauauggagaggaucauuacauugaa

SEQ ID NO: 483199 - RNA, 64 nt, Homo Sapiens
uuuaauuuagguguuuuggguuuuuuuccuuuaaagagaauaguguucacaaaauuugagcugc

SEQ ID NO: 483200 - RNA, 64 nt, Homo Sapiens
cauguugacuuugugaauguagagaauagcauauagagaauaauuaaaauuuuauuugacuuau

SEQ ID NO: 483201 - RNA, 64 nt, Homo Sapiens
auauagagaauaaucauguuuuuauuugacuuauagagaauagcaaaaacauuaccacuaaaau

SEQ ID NO: 483202 - RNA, 64 nt, Homo Sapiens
uacaugaagggacaaaucuuggugaaaaagcaccagagaauacagccucuucuugucuuucaua

SEQ ID NO: 483203 - RNA, 64 nt, Homo Sapiens; identical to SEQ ID NO: 218133

SEQ ID NO: 483204 - RNA, 64 nt, Homo Sapiens; identical to SEQ ID NO: 218134

SEQ ID NO: 483205 - RNA, 64 nt, Homo Sapiens; identical to SEQ ID NO: 218135

SEQ ID NO: 483206 - RNA, 64 nt, Homo Sapiens; identical to SEQ ID NO: 218136

SEQ ID NO: 483207 - RNA, 64 nt, Homo Sapiens; identical to SEQ ID NO: 218137

SEQ ID NO: 483208 - RNA, 64 nt, Homo Sapiens; identical to SEQ ID NO: 218138

SEQ ID NO: 483209 - RNA, 64 nt, Homo Sapiens; identical to SEQ ID NO: 218139

SEQ ID NO: 483210 - RNA, 64 nt, Homo Sapiens; identical to SEQ ID NO: 218140

SEQ ID NO: 483211 - RNA, 64 nt, Homo Sapiens; identical to SEQ ID NO: 218141

SEQ ID NO: 483212 - RNA, 64 nt, Homo Sapiens; identical to SEQ ID NO: 218142

SEQ ID NO: 483213 - RNA, 64 nt, Homo Sapiens; identical to SEQ ID NO: 218143

SEQ ID NO: 483214 - RNA, 64 nt, Homo Sapiens; identical to SEQ ID NO: 218144

SEQ ID NO: 483215 - RNA, 64 nt, Homo Sapiens; identical to SEQ ID NO: 218145

SEQ ID NO: 483216 - RNA, 64 nt, Homo Sapiens; identical to SEQ ID NO: 218146

SEQ ID NO: 483217 - RNA, 64 nt, Homo Sapiens; identical to SEQ ID NO: 218147

SEQ ID NO: 483218 - RNA, 64 nt, Homo Sapiens; identical to SEQ ID NO: 218148

SEQ ID NO: 483219 - RNA, 64 nt, Homo Sapiens; identical to SEQ ID NO: 218149

SEQ ID NO: 483220 - RNA, 64 nt, Homo Sapiens; identical to SEQ ID NO: 218150

SEQ ID NO: 483221 - RNA, 64 nt, Homo Sapiens; identical to SEQ ID NO: 218151

SEQ ID NO: 483222 - RNA, 64 nt, Homo Sapiens; identical to SEQ ID NO: 218152

SEQ ID NO: 483223 - RNA, 64 nt, Homo Sapiens; identical to SEQ ID NO: 218153

SEQ ID NO: 483224 - RNA, 64 nt, Homo Sapiens; identical to SEQ ID NO: 218154

SEQ ID NO: 483225 - RNA, 64 nt, Homo Sapiens; identical to SEQ ID NO: 218155

SEQ ID NO: 483226 - RNA, 64 nt, Homo Sapiens; identical to SEQ ID NO: 218156

SEQ ID NO: 483227 - RNA, 64 nt, Homo Sapiens; identical to SEQ ID NO: 218157

SEQ ID NO: 483228 - RNA, 64 nt, Homo Sapiens; identical to SEQ ID NO: 218158

SEQ ID NO: 483229 - RNA, 64 nt, Homo Sapiens; identical to SEQ ID NO: 218159

SEQ ID NO: 483230 - RNA, 64 nt, Homo Sapiens; identical to SEQ ID NO: 218160

SEQ ID NO: 483231 - RNA, 64 nt, Homo Sapiens; identical to SEQ ID NO: 218161

SEQ ID NO: 483232 - RNA, 64 nt, Homo Sapiens; identical to SEQ ID NO: 218162

SEQ ID NO: 483233 - RNA, 64 nt, Homo Sapiens; identical to SEQ ID NO: 218163

SEQ ID NO: 483234 - RNA, 64 nt, Homo Sapiens; identical to SEQ ID NO: 218164

SEQ ID NO: 483235 - RNA, 64 nt, Homo Sapiens; identical to SEQ ID NO: 218165

SEQ ID NO: 483236 - RNA, 64 nt, Homo Sapiens; identical to SEQ ID NO: 218166

SEQ ID NO: 483237 - RNA, 64 nt, Homo Sapiens; identical to SEQ ID NO: 218167

SEQ ID NO: 483238 - RNA, 64 nt, Homo Sapiens; identical to SEQ ID NO: 218168

SEQ ID NO: 483239 - RNA, 64 nt, Homo Sapiens; identical to SEQ ID NO: 360611

SEQ ID NO: 483240 - RNA, 64 nt, Homo Sapiens; identical to SEQ ID NO: 360612

SEQ ID NO: 483241 - RNA, 64 nt, Homo Sapiens; identical to SEQ ID NO: 360613

SEQ ID NO: 483242 - RNA, 64 nt, Homo Sapiens; identical to SEQ ID NO: 360614

SEQ ID NO: 483243 - RNA, 64 nt, Homo Sapiens; identical to SEQ ID NO: 360615

SEQ ID NO: 483244 - RNA, 64 nt, Homo Sapiens; identical to SEQ ID NO: 360616

SEQ ID NO: 483245 - RNA, 64 nt, Homo Sapiens; identical to SEQ ID NO: 360617

SEQ ID NO: 483246 - RNA, 64 nt, Homo Sapiens; identical to SEQ ID NO: 360618

SEQ ID NO: 483247 - RNA, 64 nt, Homo Sapiens; identical to SEQ ID NO: 360619

SEQ ID NO: 483248 - RNA, 64 nt, Homo Sapiens; identical to SEQ ID NO: 360620

SEQ ID NO: 483249 - RNA, 64 nt, Homo Sapiens; identical to SEQ ID NO: 360621

SEQ ID NO: 483250 - RNA, 64 nt, Homo Sapiens; identical to SEQ ID NO: 360622

SEQ ID NO: 483251 - RNA, 64 nt, Homo Sapiens; identical to SEQ ID NO: 360623

SEQ ID NO: 483252 - RNA, 64 nt, Homo Sapiens; identical to SEQ ID NO: 360624

SEQ ID NO: 483253 - RNA, 64 nt, Homo Sapiens; identical to SEQ ID NO: 360625

SEQ ID NO: 483254 - RNA, 64 nt, Homo Sapiens; identical to SEQ ID NO: 360626

SEQ ID NO: 483255 - RNA, 64 nt, Homo Sapiens; identical to SEQ ID NO: 360627

SEQ ID NO: 483256 - RNA, 64 nt, Homo Sapiens; identical to SEQ ID NO: 360628

SEQ ID NO: 483257 - RNA, 64 nt, Homo Sapiens; identical to SEQ ID NO: 360629

SEQ ID NO: 483258 - RNA, 64 nt, Homo Sapiens; identical to SEQ ID NO: 360630

SEQ ID NO: 483259 - RNA, 64 nt, Homo Sapiens; identical to SEQ ID NO: 360631

SEQ ID NO: 483260 - RNA, 64 nt, Homo Sapiens; identical to SEQ ID NO: 360632

SEQ ID NO: 483261 - RNA, 64 nt, Homo Sapiens; identical to SEQ ID NO: 360633

SEQ ID NO: 483262 - RNA, 64 nt, Homo Sapiens; identical to SEQ ID NO: 360634

SEQ ID NO: 483263 - RNA, 64 nt, Homo Sapiens; identical to SEQ ID NO: 360635

SEQ ID NO: 483264 - RNA, 64 nt, Homo Sapiens; identical to SEQ ID NO: 360636

SEQ ID NO: 483265 - RNA, 64 nt, Homo Sapiens; identical to SEQ ID NO: 360637

SEQ ID NO: 483266 - RNA, 64 nt, Homo Sapiens; identical to SEQ ID NO: 360638

SEQ ID NO: 483267 - RNA, 64 nt, Homo Sapiens
uuuuugguuaaacagcagcacuuuuuaguucccuaaacuuuagaagaaaugcuaucagaaauag

SEQ ID NO: 483268 - RNA, 64 nt, Homo Sapiens
ggauuauugcuuagauaacucuuguuuucugguaaaacuuuaguuguauugccauccacuccuu

SEQ ID NO: 483269 - RNA, 64 nt, Homo Sapiens
ugaauaguuguuucguuacauuuagaugaaaguuaaacuuuacugaauuucaguacauuaguuu

SEQ ID NO: 483270 - RNA, 64 nt, Homo Sapiens
uuuacugaauuucaguacauuaguuuuuacacuaaaacuuuacaagauaaaauuggacuucauu

SEQ ID NO: 483271 - RNA, 64 nt, Homo Sapiens
uaauaauaaagaaucccaucauuaugagaacaguaaacuuuaagccucuaaguuguagccugua

SEQ ID NO: 483272 - RNA, 64 nt, Homo Sapiens
ccacuaucuugcacugcuaacuacaguuuaaaacaaacuuuaaauccauuacacaauuagacuc

SEQ ID NO: 483273 - RNA, 64 nt, Homo Sapiens
aggaaaugugcugugauggcauuaaacuuuaauaaaacuuuaaaaagagauaaaauauuguacc

SEQ ID NO: 483274 - RNA, 64 nt, Homo Sapiens
aaaacuuuaaaaggaaauguaauauuguaccauuaaacuuuaauauuaacaaaaaaagagauaa

SEQ ID NO: 483275 - RNA, 64 nt, Homo Sapiens
ggacucagggagcaaccacaggcucuccacuuugaaacuuuaguuugaauuuuaaaagauagga

SEQ ID NO: 483276 - RNA, 64 nt, Homo Sapiens
uuucaucauagaaaacauguuuaagauaaaauacaaacuuuaccuaccccaaauucauaaagua

SEQ ID NO: 483277 - RNA, 64 nt, Homo Sapiens
ucuaguuucuuuugauaguacauauucacaauggaaacuuuaggaaauguuuauauuagauaac

SEQ ID NO: 483278 - RNA, 64 nt, Homo Sapiens
gucucuaaguuaugacuguguacuuauuaagagcaaacuuuagucaaggaaauacauaugcaga

SEQ ID NO: 483279 - RNA, 64 nt, Homo Sapiens
aacaggguagcuccugagccuuucccuuuauuggaaacuuuaacugcaguguuaauauauacac

SEQ ID NO: 483280 - RNA, 64 nt, Homo Sapiens
agucagaaugguuggaauuuuggcuuucuaagaaaaacuuuauuuugcauaagcauguggucag

SEQ ID NO: 483281 - RNA, 64 nt, Homo Sapiens
gaauugcuugaagaguucaucacggaaauucaagaaacuuuacuucaaaauauucacaaggcua

SEQ ID NO: 483282 - RNA, 64 nt, Homo Sapiens
uauuguauagagcuauucaugccauuuuuugggaaaacuuuaaaaauugccccaaauacugaca

SEQ ID NO: 483283 - RNA, 64 nt, Homo Sapiens
uguaaaccauuguaacuauuaaagcacaaucacuaaacuuuauuuuuuuuuuuuuuugguuuua

SEQ ID NO: 483284 - RNA, 64 nt, Homo Sapiens
ggguuuuuauuguuguuguuggauaucauuuuaaaaacuuuauucguuuuuauuccucuuauug

SEQ ID NO: 483285 - RNA, 64 nt, Homo Sapiens
auccaauuauagauaaauuuuuuaaaauauauaaaaacuuuaugacucuuucuaaauaagaggu

SEQ ID NO: 483286 - RNA, 64 nt, Homo Sapiens
ggaaaaaucaauuuauaaaauuaugccuucaucaaaacuuuaaaguuacuugaaugucacaaaa

SEQ ID NO: 483287 - RNA, 64 nt, Homo Sapiens
auauuuaaaaaucugaauuuuuuagaagaaugcaaaacuuuaguaaacccuaaguaaagucaaa

SEQ ID NO: 483288 - RNA, 64 nt, Homo Sapiens
uuaauuauuuagauauuuaauuucgcagauuuuuaaacuuuauuuucauaauuucugcuuaaug

SEQ ID NO: 483289 - RNA, 64 nt, Homo Sapiens
ugcacucugcuggaugaaauggcaguggauuuuuaaacuuuaauuucccaaaugucucucucag

SEQ ID NO: 483290 - RNA, 64 nt, Homo Sapiens
uaauugcuaagauuuaaggacguucuuuauuaugaaacuuuaucacauucgaaauguuuguuua

SEQ ID NO: 483291 - RNA, 64 nt, Homo Sapiens
gccauuuuuuuuaaugguacuuaguauuuugaucaaacuuuagucuccagaacuaaacaagucc

SEQ ID NO: 483292 - RNA, 64 nt, Homo Sapiens
auacuguugguuucuguaaauguugcaggguuuuaaacuuuauaauuacuuuaauauuuuugau

SEQ ID NO: 483293 - RNA, 64 nt, Homo Sapiens
ugacaauagcugcuuaguuuccuguuaagagaagaaacuuuaucuuuuaauuaugugcucuuaa

SEQ ID NO: 483294 - RNA, 64 nt, Homo Sapiens
ccuuacuuuguuuuacuugccauuuauuguaaggaaacuuuaaagcauuuuuuaggaaauacuc

SEQ ID NO: 483295 - RNA, 64 nt, Homo Sapiens
uuacaacugcuauauagacauuuuguuucaaaugaaacuuuaaaagacugaaaaauuuuguaaa

SEQ ID NO: 483296 - RNA, 64 nt, Homo Sapiens
cagaaguauauuuuagaaucccugccuguuaaggaaacuuuauuugugguagguacaguucugg

SEQ ID NO: 483297 - RNA, 64 nt, Homo Sapiens
aguuucagaagcauagauuguaguguaccuuuuuaaacuuuauuuuuuuaaaaaaaguuguuuu

SEQ ID NO: 483298 - RNA, 64 nt, Homo Sapiens
uauucauacuacuguucaaucuuuauuuagaaauaaacuuuaucuaugauuucauuuucuuaua

SEQ ID NO: 483299 - RNA, 64 nt, Homo Sapiens
aaauaaaguuuuauuuucccacuuuaaauguauaaaacuuuaucggaucacaaaaugugauaaa

SEQ ID NO: 483300 - RNA, 64 nt, Homo Sapiens
uguauaaaacuuuaucaaaucacaaaaugugauaaaacuuuaaaucugauaauuggcacuggau

SEQ ID NO: 483301 - RNA, 64 nt, Homo Sapiens
augaaaaaacgcacugacauacaaagcuuugaaaaaacuuuaacucagcacaacaaggaacaaa

SEQ ID NO: 483302 - RNA, 64 nt, Homo Sapiens
acuuagaauuuuggccuucuucucugugguuuugaaacuuuaguggauuauguauauuuuuaua

SEQ ID NO: 483303 - RNA, 64 nt, Homo Sapiens
uuugugguccccaaaugaugagcuuuuugagggcaaacuuuaccaccucuaaggagaccuuuga

SEQ ID NO: 483304 - RNA, 64 nt, Homo Sapiens
auuucacauuauucugggcaccacaaaauauacaaaacuuuaucagggaaacuaagauucuuuu

SEQ ID NO: 483305 - RNA, 64 nt, Homo Sapiens
aauaaaaagacaaccacauaguucguuuaccuucaaacuuuagguuuuuuuaaugauauacuga

SEQ ID NO: 483306 - RNA, 64 nt, Homo Sapiens
caaaauaucucugaguucuguguauuuucagucaaaacuuuaaaccuguagaaucaauuuaagu

SEQ ID NO: 483307 - RNA, 64 nt, Homo Sapiens
ucaauacaccaaggaaacuggauccagaauuccuaaacuuuaaaaugguacugucugcggagug

SEQ ID NO: 483308 - RNA, 64 nt, Homo Sapiens
uaaauuaggauuucuuaaagaaaacauagggagaaaacuuuacaugcaauuaaaaauggacuuu

SEQ ID NO: 483309 - RNA, 64 nt, Homo Sapiens
cuuauuuuuaaucaaauaacuagacauauaucagaaacuuuaaaauguaaaaguuguacacuuu

SEQ ID NO: 483310 - RNA, 64 nt, Homo Sapiens
aggagaaaagcaauccuccugauuguauuguuuuaaacuuuaagaauuuaucaaaaugccggua

SEQ ID NO: 483311 - RNA, 64 nt, Homo Sapiens
auuauuaccaagaaaauauugaguuuaccugauuaaacuuuaaaaguuaauuguagauuuaaau

SEQ ID NO: 483312 - RNA, 64 nt, Homo Sapiens
ucuuuccucuuuaggcgugguugagaaaaagcagaaacuuuacauaaagcuguauuucuuaauc

SEQ ID NO: 483313 - RNA, 64 nt, Homo Sapiens
aaccugaaagaugugacaauaaaauuaauacuggaaacuuuacacaaacuuuacuaaacauaag

SEQ ID NO: 483314 - RNA, 64 nt, Homo Sapiens
aaacauaagaaaauuaauacuguaacuaaaucucaaacuuuacugugaagaauguggcaaugcu

SEQ ID NO: 483315 - RNA, 64 nt, Homo Sapiens
aaaugcuacauuacuugguguccuuuuuucucccaaacuuuauuuagaaauggaaggaguucaa

SEQ ID NO: 483316 - RNA, 64 nt, Homo Sapiens
guauuuuuaccacaauaaacaaaaaacccuaaaaaaacuuuaaugaaagguggaaaauaauuua

SEQ ID NO: 483317 - RNA, 64 nt, Homo Sapiens
auuuacaucaauauuuugaagaaaggauuaauuuaaacuuuacagaucaauauuuugaauaugu

SEQ ID NO: 483318 - RNA, 64 nt, Homo Sapiens
auuuagaucaauauuuugaaaauguaaaaggauuaaacuuuacaaauauauuaguacauucuag

SEQ ID NO: 483319 - RNA, 64 nt, Homo Sapiens
uuuuuauauuugugaucuaccugcucuauuauauaaacuuuauaaccccaagauuucagauauu

SEQ ID NO: 483320 - RNA, 64 nt, Homo Sapiens
gacaagugauuuucaagucugaaugucuuuuuucaaacuuuauugggagaugguaagaaacaau

SEQ ID NO: 483321 - RNA, 64 nt, Homo Sapiens
uuuguugaagguuguauguuccagugaguuguauaaacuuuauuuuccacaugcauuuuauuuc

SEQ ID NO: 483322 - RNA, 64 nt, Homo Sapiens
uuuauauaacguaugcuauguauuuuuggaagcaaaacuuuaauaccacgaccacauggaaaca

SEQ ID NO: 483323 - RNA, 64 nt, Homo Sapiens
uaaauguuaucagccagucuuccaaaauggucauaaacuuuauaaacugcuuuggguaaacuga

SEQ ID NO: 483324 - RNA, 64 nt, Homo Sapiens
auugcuuaaauauuacauauuagggauuguaagaaaacuuuaauuaaaaauuaaagacuauaua

SEQ ID NO: 483325 - RNA, 64 nt, Homo Sapiens
augaacaugaggaugggaucaaugugggaugaauaaacuuuaguucagaaacaggacuuacuaa

SEQ ID NO: 483326 - RNA, 64 nt, Homo Sapiens
ucugcuguguuaacuuugugaaacuggauggaacaaacuuuaacuuaccaagcaccaaguguga

SEQ ID NO: 483327 - RNA, 64 nt, Homo Sapiens
cugcauaaaucacuuaucgguaauuucuugaucuaaacuuuaugcuguggggauccaggauuug

SEQ ID NO: 483328 - RNA, 64 nt, Homo Sapiens
gguaccagauauuuucuauaaucagcucacucugaaacuuuaaguaauagcauuaaaauugcag

SEQ ID NO: 483329 - RNA, 64 nt, Homo Sapiens
agcuuugcuucagaauuagaaaugucacaacccaaaacuuuacaucauagaaaggagcaaccaa

SEQ ID NO: 483330 - RNA, 64 nt, Homo Sapiens
ggcagucuucugcagacuuaauucccucucaacaaaacuuuauaaguguguaccuuuuaaaauu

SEQ ID NO: 483331 - RNA, 64 nt, Homo Sapiens
cuuauucuuagcuguauauauuaucuucuuuaacaaacuuuacuucuaauaaaaagucacaaag

SEQ ID NO: 483332 - RNA, 64 nt, Homo Sapiens
uuauugacauuguacauagcaugcuuggaaaauuaaacuuuaauuguaaauagguggaauauga

SEQ ID NO: 483333 - RNA, 64 nt, Homo Sapiens
gggacuugcauuaucgguucuuugugcagauuaaaaacuuuauaaacacauuaacaugauucug

SEQ ID NO: 483334 - RNA, 64 nt, Homo Sapiens
ucuggauaccuuuuucuuauacuuucuccuaggaaaacuuuaaaacuuuaaaaaggcaaaccua

SEQ ID NO: 483335 - RNA, 64 nt, Homo Sapiens
ccuuuuucuuauacuuucuccuaggaaaacuuuaaaacuuuaaaaaggcaaaccuaccaauagg

SEQ ID NO: 483336 - RNA, 64 nt, Homo Sapiens
auagcauucuucaaaauauuuuagaucuuguuucaaacuuuacaaaauguaaacuuaaaaaugu

SEQ ID NO: 483337 - RNA, 64 nt, Homo Sapiens
gaacagucaacauuuuagaucaugcucaagaucaaaacuuuauagccaaauaggacuuuccacu

SEQ ID NO: 483338 - RNA, 64 nt, Homo Sapiens
uuaaaaccaaauuuagguguagaaugguuguuauaaacuuuauuuugaaguuugagaucugaug

SEQ ID NO: 483339 - RNA, 64 nt, Homo Sapiens
uuuuuuauacauaaacaagaaaauuaacuuuuauaaacuuuacccacuuuuguucuugguuugu

SEQ ID NO: 483340 - RNA, 64 nt, Homo Sapiens
auggcccuggccuagcauacaaguacacuguuucaaacuuuacuuuugaggucuguucuuucca

SEQ ID NO: 483341 - RNA, 64 nt, Homo Sapiens
uuuuacuaguguuacuuaauaaggccuggucauaaaacuuuaaacaucaucauucauguuuuuu

SEQ ID NO: 483342 - RNA, 64 nt, Homo Sapiens
aaauacucaaaaauauguaagagauaaacuauuaaaacuuuaaaccuuucuccauccuugauca

SEQ ID NO: 483343 - RNA, 64 nt, Homo Sapiens
uacuaauucaacugucucucaaaacuuuaaauaaaaacuuuaugugaagcuugcuuggaagggg

SEQ ID NO: 483344 - RNA, 64 nt, Homo Sapiens
uaaaaacuuuauguacuaauugcuuggaaggggaaaacuuuaaauagaauguguaaaugaagcu

SEQ ID NO: 483345 - RNA, 64 nt, Homo Sapiens
gacacugagcuugaacuucagcuauguuuuaauaaaacuuuaugaucauaaaugaaugaucaug

SEQ ID NO: 483346 - RNA, 64 nt, Homo Sapiens
gacacugaacuugaacuuccgcuauguuuuaauaaaacuuuacaaucauaaaugaaugaucaug

SEQ ID NO: 483347 - RNA, 64 nt, Homo Sapiens
aauaggaagaaugugacaaauucauacugcagagaaacuuuacaccuugcacgucaucauagaa

SEQ ID NO: 483348 - RNA, 64 nt, Homo Sapiens
aguguaaugaauguggcaaguucauacuggagagaaacuuuacaccuuguaagucacaaagcca

SEQ ID NO: 483349 - RNA, 64 nt, Homo Sapiens
uguguuuuaauuauuuucacauuuucucucugcaaaacuuuaguuuucugaugaucuacacaca

SEQ ID NO: 483350 - RNA, 64 nt, Homo Sapiens
ucuuauaugcuacgugcauacacauucuuuucuuaaacuuuaccuguguuuuaacuaauauugu

SEQ ID NO: 483351 - RNA, 64 nt, Homo Sapiens
uugaagcuguauuuuaauauuguaaaacugugauaaacuuuauaggucugucauuuuugaauac

SEQ ID NO: 483352 - RNA, 64 nt, Homo Sapiens
agcuaaauauucuaaacuggaggacuuuuuuuuuaaacuuuaagcuucaguuuaaaaaaggaaa

SEQ ID NO: 483353 - RNA, 64 nt, Homo Sapiens
ugggccuaauuuuuuaaagaauccaagacaaacuaaacuuuacuggguauauaaccuucucaau

SEQ ID NO: 483354 - RNA, 64 nt, Homo Sapiens
aauuuucauucggaauccgaaggauacagucuuuaaacuuuagaauucccaagaaggcuuuauu

SEQ ID NO: 483355 - RNA, 64 nt, Homo Sapiens; identical to SEQ ID NO: 483353

SEQ ID NO: 483356 - RNA, 64 nt, Homo Sapiens; identical to SEQ ID NO: 483354

SEQ ID NO: 483357 - RNA, 64 nt, Homo Sapiens
aaagcuugaaaguaaguugcuuccaugagcauggauuacccaguagcuacuuuuuaauagagac

SEQ ID NO: 483358 - RNA, 64 nt, Homo Sapiens
ggguaauuuuucacagccaccuauguacauacuaauuacccauuggauacuuauaucuaaaagu

SEQ ID NO: 483359 - RNA, 64 nt, Homo Sapiens
agacagaaccccuacuuccaagugcucuauuuguauuacccagaugacugaagcuuaagagaag

SEQ ID NO: 483360 - RNA, 64 nt, Homo Sapiens
gucauggaucuuagagcuaaaaaggacuguaaaaauuacccagaacagcguccucagacuuaac

SEQ ID NO: 483361 - RNA, 64 nt, Homo Sapiens
caccucucuugaaccccaaaugcucucucuucuuauuacccaaacccauggcucuauuucuucu

SEQ ID NO: 483362 - RNA, 64 nt, Homo Sapiens
auggugacaccccgucucuacuaaaaauacaaaaauuacccaggcauaguggcacacgccugua

SEQ ID NO: 483363 - RNA, 64 nt, Homo Sapiens
caagugaacuaaacuauaagcuggaucuaaagaaauuacccagugagcagugaggagaaacaag

SEQ ID NO: 483364 - RNA, 64 nt, Homo Sapiens
agugguaacagauggguagaggcagcucaggugaauuacccagcuugccucucaauucauuccu

SEQ ID NO: 483365 - RNA, 64 nt, Homo Sapiens
gaagguaacugauaaaccaaaauugagcauaguaauuacccacagaaggaggaaguggaaggga

SEQ ID NO: 483366 - RNA, 64 nt, Homo Sapiens
uaaacugugcauaugaaaugcuggugacgguagcauuacccaaauuuuacuuacagguguucug

SEQ ID NO: 483367 - RNA, 64 nt, Homo Sapiens
uuucuuuuuaauacaaauguucuccuauuuuuguauuacccagcauugccugcuccucagaguc

SEQ ID NO: 483368 - RNA, 64 nt, Homo Sapiens
acuuuuuuguaaaugcggcauuuuaacagguucuauuacccagauaauugcaacaccagucugu

SEQ ID NO: 483369 - RNA, 64 nt, Homo Sapiens
cucggguauuucuucauagcaaaccucuuuuauaauuacccaguggaacugugagucgaaaauu

SEQ ID NO: 483370 - RNA, 64 nt, Homo Sapiens
ggucuuaagaugcaaaucaacccacuccagaagcauuacccauagcaguugcuaaauaaaucuc

SEQ ID NO: 483371 - RNA, 64 nt, Homo Sapiens
cuuugcuuuaaguugcacuugaaucuccuccauuauuacccagguuuucugacuuacccuuuug

SEQ ID NO: 483372 - RNA, 64 nt, Homo Sapiens
uuagaggggaaaaaaaaacaugcucguguuauaaauuacccaguuccuuuaaacauacaaaaau

SEQ ID NO: 483373 - RNA, 64 nt, Homo Sapiens
uacaugauuucagaagaugaaagacacuaauauuauuacccauagaaucacaucuucagaagag

SEQ ID NO: 483374 - RNA, 64 nt, Homo Sapiens
cucaggguuaacagcuagccgacucugcagguggauuacccagguccaugcacuggaaugcggg

SEQ ID NO: 483375 - RNA, 64 nt, Homo Sapiens
cccccuucaacccaguugauaaggaauuucugggauuacccagucauccccacagaccagaaac

SEQ ID NO: 483376 - RNA, 64 nt, Homo Sapiens
guuuuucagugagaaugaaacccucuauaaauagauuacccaaggauuacagauacuuauaaaa

SEQ ID NO: 483377 - RNA, 64 nt, Homo Sapiens
accuguauuguagccccaaugucauuauguaauuauuacccagaauugcucuuccauaaagcuu

SEQ ID NO: 483378 - RNA, 64 nt, Homo Sapiens
acagaagacuucagacucaccauaauugcugauaauuacccacucuuaaauuugucgagugauu

SEQ ID NO: 483379 - RNA, 64 nt, Homo Sapiens
aguagcauuucauuuaagauaaggcucauauaguauuacccaacuaguugguaaugugauuaug

SEQ ID NO: 483380 - RNA, 64 nt, Homo Sapiens
aaauuccauccuucacuuauguaacauguugcaaauuacccaaagaugagucuuucuucuuucu

SEQ ID NO: 483381 - RNA, 64 nt, Homo Sapiens
uaguaaggaagaaaaacugaaaauguuuuaguuuauuacccaguauauuuggguaauaaugaaa

SEQ ID NO: 483382 - RNA, 64 nt, Homo Sapiens
auguguacaaaguuaugcuaccuaauuacagaccauuacccaaauauccuaccaggcuuuccau

SEQ ID NO: 483383 - RNA, 64 nt, Homo Sapiens
ccucuucuccugagggcugcuccagacaacauuuauuacccagaagaccuuuugucugaaaacc

SEQ ID NO: 483384 - RNA, 64 nt, Homo Sapiens
guuuuuauguagcagggaaagucuauuucuaguuauuacccagaacauugucucuaaauugugg

SEQ ID NO: 483385 - RNA, 64 nt, Homo Sapiens
augaucauggcauccaagacucagacuagaaauaauuacccaguucugacaaagucacaaaguc

SEQ ID NO: 483386 - RNA, 54 nt, Homo Sapiens
acaugacaugugggccaaguuucuauuacccacugggagcaacaaagcuccuaa

SEQ ID NO: 483387 - RNA, 64 nt, Homo Sapiens
gucaggccucugagcccaagcaaagagaguggaaauuacccacuagaaauucagaaacuacaga

SEQ ID NO: 483388 - RNA, 64 nt, Homo Sapiens
uggugauaugaucuuaagcuaaauuuuuuauacaauuacccaauaauaguuuuauagaacuuaa

SEQ ID NO: 483389 - RNA, 64 nt, Homo Sapiens
ugacaccaccgaauauauuagaacguauuuagccauuacccacguuuuuuucaguucauaugca

SEQ ID NO: 483390 - RNA, 64 nt, Homo Sapiens
acuccacagucucuguguaaggugcuuaaaguuuauuacccacaaaacaaacuugauuaaaacu

SEQ ID NO: 483391 - RNA, 64 nt, Homo Sapiens
ccaagcauuaaagguguggccaugaguuuacagaauuacccacauuccaguugccacugggaug

SEQ ID NO: 483392 - RNA, 64 nt, Homo Sapiens
ggugauccagccugccuauaaggacaagauaaacauuacccagcugggacuccaaaacucaacc

SEQ ID NO: 483393 - RNA, 64 nt, Homo Sapiens
uugagguuugggcgggaacaaauagucaaauuauauuacccaucuacaugguuuucuuuuucuu

SEQ ID NO: 483394 - RNA, 64 nt, Homo Sapiens
ugucaggaugccauagugcuguggggagcacaguauuacccaguggguagggcuucugucuucc

SEQ ID NO: 483395 - RNA, 64 nt, Homo Sapiens
cuuuaagaguuuugguggcucucccauguuuccuauuacccauggauuuacccugagccuuccu

SEQ ID NO: 483396 - RNA, 64 nt, Homo Sapiens
acuuagcuugccaguugagacaaucaccacaguuauuacccaaauacuaugaacauauuuuugu

SEQ ID NO: 483397 - RNA, 64 nt, Homo Sapiens
auaaaacauuuugagaagggguaagcagugaguuauuacccacaauuuaaagcaaauuuugaau

SEQ ID NO: 483398 - RNA, 64 nt, Homo Sapiens
uuacucaaaaacagcuggaagaagaaauugcuagauuacccaaagaaauagaucaguuggagaa

SEQ ID NO: 483399 - RNA, 64 nt, Homo Sapiens
uaucagucucggaaacuucugaaaaaugcuaauaauuacccaaggauuaugucaaauuuuaaaa

SEQ ID NO: 483400 - RNA, 64 nt, Homo Sapiens
aacguuucuugugagugagcagcaacuaaaaaccauuacccaagauaaugugcugaauaagcuc

SEQ ID NO: 483401 - RNA, 64 nt, Homo Sapiens
gugcuuauuauuguuuaugagcaauugauagaguauuacccacgaaaagaguuagacucuauug

SEQ ID NO: 483402 - RNA, 64 nt, Homo Sapiens
gcaaggggcaggacaggcccccagccugucccucauuacccaagaagagcugagcagggcacug

SEQ ID NO: 483403 - RNA, 64 nt, Homo Sapiens
cgaccuggcugccccucaccgucuaauccuucucauuacccaccgcugucuaacccccagcugg

SEQ ID NO: 483404 - RNA, 64 nt, Homo Sapiens
aagguugagcugcugagauuaccagaguaucuggauuacccaggccaguguaaccagcuuagua

SEQ ID NO: 483405 - RNA, 64 nt, Homo Sapiens
gauaucuaugaaaaccaguggcacugcccuggugauuacccagauucagggugauaacuacuua

SEQ ID NO: 483406 - RNA, 64 nt, Homo Sapiens
ggaauguuggugaaugucaaagaggagcauguaaauuacccaagucccuuuuugcagugacaga

SEQ ID NO: 483407 - RNA, 64 nt, Homo Sapiens
aaauugaucugcagcugacuuuuuuuuccccugaauuacccaucagcaugacccaggucaacuu

SEQ ID NO: 483408 - RNA, 64 nt, Homo Sapiens
ucugacugaccaccagucaggcagaauuggcaccauuacccaggacuugauuugcuagcuggug

SEQ ID NO: 483409 - RNA, 64 nt, Homo Sapiens
gccugcagagccgugagccaaguaaaccucuuuaauuacccagccucagguaauccuuuauagc

SEQ ID NO: 483410 - RNA, 64 nt, Homo Sapiens
cauaaaccugugcugaacauaacuucucauguauauuacccaauggaaaauauaaugaucagca

SEQ ID NO: 483411 - RNA, 64 nt, Homo Sapiens
gaaugcccaaaauagugaauuauuuaaacagauuauuacccauauuaugaagaaauacucugca

SEQ ID NO: 483412 - RNA, 64 nt, Homo Sapiens
uggccagaugaguuuaucaugucagugaaaaauaauuacccacaaaugccaccagaacuuacga

SEQ ID NO: 483413 - RNA, 64 nt, Homo Sapiens
uguugaauaaaacuauaaauuuggugucucacaaauuacccaauuaggugcauucuuuuuuucu

SEQ ID NO: 483414 - RNA, 64 nt, Homo Sapiens
uuucuucaugaguugacauguuggaguauaaaauauuacccaagauaaaaacuuacauuguuua

SEQ ID NO: 483415 - RNA, 64 nt, Homo Sapiens
acuagcaagaaguucuuguuuacucuguauuuauauuacccauacauacaguccuccuucaccu

SEQ ID NO: 483416 - RNA, 64 nt, Homo Sapiens
agagguauccucagccccucagccgagagggacuauuacccaagggcccagcaggagcugcuuc

SEQ ID NO: 483417 - RNA, 64 nt, Homo Sapiens
cacacuguuguuuaguuaaguuuuaaauagguguauuacccaagaaguaaagauggaaacguua

SEQ ID NO: 483418 - RNA, 57 nt, Homo Sapiens
aggcagaagaagaauuuuaaugaaaaaauuacccagauuggcuccauggaaaaggag

SEQ ID NO: 483419 - RNA, 64 nt, Homo Sapiens
augguucagccacugguacuacgagaauguuuguauuacccacauuugaaaugauuugcuauga

SEQ ID NO: 483420 - RNA, 64 nt, Homo Sapiens
gcaagaaggcccaguugccacagauuauacaaccauuacccaaaccacucugacagucuccucc

SEQ ID NO: 483421 - RNA, 64 nt, Homo Sapiens
uauaaccauuuaaagaaagauccauuuuauuaggauuacccaaacauaaccuuuacacuccucg

SEQ ID NO: 483422 - RNA, 64 nt, Homo Sapiens
caguaaaacauuuagguguuuuuauuuaccccacauuacccaauaaauuugaaaugaauguuuu

SEQ ID NO: 483423 - RNA, 64 nt, Homo Sapiens
cuggugguuauuacagcaugaaagacccuuuuugauuacccacaccccaacccucuuaaauguc

SEQ ID NO: 483424 - RNA, 64 nt, Homo Sapiens
cccguuccccugaggugcucgcaguguggacaccauuacccaccgcagacugguguuguucauc

SEQ ID NO: 483425 - RNA, 64 nt, Homo Sapiens
augagacuuugaaacuaucucaugccagugccuuauuacccaggaagauuuuaaaggaccucau

SEQ ID NO: 483426 - RNA, 64 nt, Homo Sapiens
ugggaguucuggaucacaauaugucugggcucucauuacccaaacaucugagauuccauuuuug

SEQ ID NO: 483427 - RNA, 64 nt, Homo Sapiens
agaaagugagacauggacaagacucuagucauaaauuacccaucuuuuugaaaacaguguagcg

SEQ ID NO: 483428 - RNA, 64 nt, Homo Sapiens
ggacaauggcauucucuacaaugcaauaaaaacaauuacccaugauuuugcugcggccgcuucc

SEQ ID NO: 483429 - RNA, 64 nt, Homo Sapiens
agcauuguacauaacuuggggguaugugugcaggauuacccaagaauaacuuaaguagaagaaa

SEQ ID NO: 483430 - RNA, 64 nt, Homo Sapiens
aacauccugcaacaccauccugggagacaagagcauuacccagcuuggcuuucacgggggaggg

SEQ ID NO: 483431 - RNA, 64 nt, Homo Sapiens
uccucuuuugccucugagaaaaagaauugucuacauuacccaucauaaucauuuacuguuccuc

SEQ ID NO: 483432 - RNA, 64 nt, Homo Sapiens
aaaaggcaggcuggaaggccgaauuccaaaaaugauuacccauugaagaauacaugguagggag

SEQ ID NO: 483433 - RNA, 64 nt, Homo Sapiens
ccucagaaaaacacacaagaggggaaguacuuucauuacccaagaacgcagauuacaauggagu

SEQ ID NO: 483434 - RNA, 64 nt, Homo Sapiens
auucacauguagugauuauuaaagaaaggagauuauuacccagaguuuaaacacaacucuauag

SEQ ID NO: 483435 - RNA, 64 nt, Homo Sapiens
acuuucauuuguuuuuauauucauuuuaucaaaaauuacccauauaaaugaugcuuuguauaau

SEQ ID NO: 483436 - RNA, 64 nt, Homo Sapiens
aacauugaauguagauggcuaauuugagaaaaauauuacccaguaaaucaguguugggaauuau

SEQ ID NO: 483437 - RNA, 64 nt, Homo Sapiens
uaaccauuuuaacucuccagaaauuuuuucuuaaauuacccaugcccuuucccuuuuucccacu

SEQ ID NO: 483438 - RNA, 64 nt, Homo Sapiens
cagauuucagaugaggcaacauuuucuugagauaauuacccaaguuucauccauguugaauggu

SEQ ID NO: 483439 - RNA, 64 nt, Homo Sapiens
uuggaaagcucuuuauagccauuugguauuuccuauuacccaccuccuauuuuaaauauuuauc

SEQ ID NO: 483440 - RNA, 64 nt, Homo Sapiens
aagacaggcaaaguuguggacuguuugaucuuguauuacccacaggaaugagggcagcuaaacc

SEQ ID NO: 483441 - RNA, 64 nt, Homo Sapiens
auacaaagugagaguaggaagacucaaacacgauauuacccaaguuccugagacuagagaagug

SEQ ID NO: 483442 - RNA, 64 nt, Homo Sapiens
gggaaacacaauggcuacuuacccgcuuuaugucauuacccauucaaaggccauggauaacccu

SEQ ID NO: 483443 - RNA, 64 nt, Homo Sapiens
ucugaggguucagguucacggagaggccuuuacaauuacccagucuucauggaauccuugagaa

SEQ ID NO: 483444 - RNA, 64 nt, Homo Sapiens
gccgaggacaugcaugacacgccacaccacugccauuacccaguuccuuggagucccaggggca

SEQ ID NO: 483445 - RNA, 64 nt, Homo Sapiens
uaauaagcauaguacccaauguacauauuauuucauuacccaggacaugucacagggguuuggu

SEQ ID NO: 483446 - RNA, 64 nt, Homo Sapiens
cuuuuuacucugcucaaaaagcaucucuccucccauuacccaaccuuggucauaagugugccug

SEQ ID NO: 483447 - RNA, 64 nt, Homo Sapiens
uaucauagcagagacaucuguaugcauuccugucauuacccauuguaacagagccacaaacuaa

SEQ ID NO: 483448 - RNA, 64 nt, Homo Sapiens
aaauaauuuuuuuaaaaaagaaaaagacaauaguauuacccaugggacaaaauuuguacuauua

SEQ ID NO: 483449 - RNA, 64 nt, Homo Sapiens
gugcuguuuguucuuaaaaugcauuuaaagaaaaauuacccauauugacuuucacaccucauau

SEQ ID NO: 483450 - RNA, 64 nt, Homo Sapiens
uguaggaagccauacacugaugcuggcaauguuaauuacccaggaugaaaggaccgccuuauca

SEQ ID NO: 483451 - RNA, 64 nt, Homo Sapiens
aacugugaguuaauuaaaccucuuuccuuuauaaauuacccagucaugggcaguccuuuacagc

SEQ ID NO: 483452 - RNA, 64 nt, Homo Sapiens
agcugcauggcgcuccuaggcggucccagcuggaauuacccaaccccaugacggacccuuucau

SEQ ID NO: 483453 - RNA, 64 nt, Homo Sapiens
gcgguaaaaaagacauguucauuaaaugugacaaauuacccaaguugucgaaucauaccagauu

SEQ ID NO: 483454 - RNA, 64 nt, Homo Sapiens
gccaggaguucaagaccagcgccaaagcagguggauuacccaaguaaucccagcacuuugggag

SEQ ID NO: 483455 - RNA, 64 nt, Homo Sapiens
cuuuauugacucauuuuauugcaaaacaaaaaggauuacccaaacaacauguuucgaacaagga

SEQ ID NO: 483456 - RNA, 64 nt, Homo Sapiens
gaacugaaauuaaaacuauucaugcuacccagccauuacccagcuaaauaaucuuacucuagau

SEQ ID NO: 483457 - RNA, 64 nt, Homo Sapiens
acugaugacugauagaaagcccucuuucacucugauuacccacucacuacaugaaguccugaaa

SEQ ID NO: 483458 - RNA, 64 nt, Homo Sapiens
guagcucuggacuggagggguagauggggagucaauuacccaucacauaaauaugaaacauuua

SEQ ID NO: 483459 - RNA, 64 nt, Homo Sapiens
gugagguaauugagggcuuugagagaagcugacaauuacccauaugccucugccccaugggccc

SEQ ID NO: 483460 - RNA, 64 nt, Homo Sapiens
gugguaggugcucaauaaauaggguggugugaggauuacccaguagcgauggcaccuccguccc

SEQ ID NO: 483461 - RNA, 64 nt, Homo Sapiens
auuauaguauuuauuguauuuuuauguucugaaaauuacccauggaacaauaugcuuaggauua

SEQ ID NO: 483462 - RNA, 64 nt, Homo Sapiens
ccccuuccaucucugacuuaagcaaaagaaaaagauuacccaaaaacugucuuuaaaagagaga

SEQ ID NO: 483463 - RNA, 64 nt, Homo Sapiens
auuuaauguugcguaccuuaauaacaaugcauguauuacccagaugagguauucccacauagaa

SEQ ID NO: 483464 - RNA, 64 nt, Homo Sapiens
acaacugugaaacucuguauuacaaaacuuaugaauuacccagcacccuaauaucccaggcaca

SEQ ID NO: 483465 - RNA, 64 nt, Homo Sapiens
auaccauuauagucucuucuaggaaugcugaaagauuacccaacuucuagagaaaaagggaucu

SEQ ID NO: 483466 - RNA, 64 nt, Homo Sapiens
gaaaaauauucuauuuuuuauucagugcugcguaauuacccaugguagccaacccuacaaaaga

SEQ ID NO: 483467 - RNA, 64 nt, Homo Sapiens
uacuguugugaccugaaguucaccauuaaaagggauuacccaagcaaaaucauggaaugguuau

SEQ ID NO: 483468 - RNA, 64 nt, Homo Sapiens
aucaaaccacuucugacaaaauuagcuguuuugaauuacccauaucacugccaguuuuauuuua

SEQ ID NO: 483469 - RNA, 64 nt, Homo Sapiens
cuuacuuuccaucuauaaaaggaaaugagcuuaaauuacccaaguuugaauccuguuguagaau

SEQ ID NO: 483470 - RNA, 64 nt, Homo Sapiens
caaggcuucuagaaggagcugggugauuaaucaaauuacccaccgucagaccaucaaucucuug

SEQ ID NO: 483471 - RNA, 64 nt, Homo Sapiens
ccaccacagaaucagcuaauaaggagcuuuucaaauuacccaguuuaaaaacaauucauguuca

SEQ ID NO: 483472 - RNA, 64 nt, Homo Sapiens
ugaaauggaguacucaguuagccaaccagcagacauuacccacuguuuuccaaacuggauagcu

SEQ ID NO: 483473 - RNA, 64 nt, Homo Sapiens
ucaucuuagauuuuuugagaacucaccagcuuuuauuacccacugaauuuucagacuaucuuag

SEQ ID NO: 483474 - RNA, 64 nt, Homo Sapiens
agaaagaaacuaaagacccugaaugaauuugcagauuacccaugugcacaguggggaccuggcc

SEQ ID NO: 483475 - RNA, 64 nt, Homo Sapiens
uuaaucaacagaaugguuuauucauugauacuaaauuacccagcucuuuaaggauuauuagugu

SEQ ID NO: 483476 - RNA, 64 nt, Homo Sapiens
ugcagaacuaaggaaagcaacuuaucucaaacagauuacccaucaagguugaaacaugacagug

SEQ ID NO: 483477 - RNA, 64 nt, Homo Sapiens
uagacaagcaagugcacaugauaaacaucaaaauauuacccagcugaauaguuacugcugcacu

SEQ ID NO: 483478 - RNA, 64 nt, Homo Sapiens
ggacaguggcgacugcccggcugcaugcacuccgauuacccacgugcugccguccuggucucau

SEQ ID NO: 483479 - RNA, 64 nt, Homo Sapiens
gcagauauuaugagaaacuguuuaauaaugcacuauuacccaggagaucuugcaggucuaguau

SEQ ID NO: 483480 - RNA, 64 nt, Homo Sapiens
uauuguugaauuuuacauacaaaauauucugcacauuacccauagauuaacuuuuuuuaacgca

SEQ ID NO: 483481 - RNA, 64 nt, Homo Sapiens
caaagagaucugaaguaugucauuucugugcuuaauuacccaacacacagagcaugucccagaa

SEQ ID NO: 483482 - RNA, 64 nt, Homo Sapiens
aucaaguauuucuuuauagccucuuuucuuauaaauuacccagugaacugugagccaauuauac

SEQ ID NO: 483483 - RNA, 64 nt, Homo Sapiens
gcuggguccuccuuuggccuggacccaggacuuaauuacccagugcccaguugugccacauucc

SEQ ID NO: 483484 - RNA, 64 nt, Homo Sapiens
uauacccaaucccugaugaauuacucaacugaguauuacccaguugcacucacaguaaacuaca

SEQ ID NO: 483485 - RNA, 64 nt, Homo Sapiens
uauagaagagaggcuaacuaaguggcaagacaacauuacccaacuugggagagauggcaaacac

SEQ ID NO: 483486 - RNA, 64 nt, Homo Sapiens
guguacacaaaaacauaauguaucuuaugaaagcauuacccaaccuguuugaguugagaaugca

SEQ ID NO: 483487 - RNA, 64 nt, Homo Sapiens
uguaucucuucucccccagccccuauugggaaaaauuacccaguauaguucagguuaugaggag

SEQ ID NO: 483488 - RNA, 64 nt, Homo Sapiens
cugcccccagcaucuggacaagcuaauagcaaauauuacccauugcuaucaagggaggaggggg

SEQ ID NO: 483489 - RNA, 64 nt, Homo Sapiens
uccuaagcaaaaagaacaaagcuggaggcaucgcauuacccaacuucaaacuauacuacagggc

SEQ ID NO: 483490 - RNA, 64 nt, Homo Sapiens
agugaucacuugacaguuuuuuuuuuuuuuaaauauuacccaaaaugcuccccaaauaagaaau

SEQ ID NO: 483491 - RNA, 64 nt, Homo Sapiens
ugggcacacacccagcggccugcagaguaagcuuauuacccacaacugugcccgcuuugugcuu

SEQ ID NO: 483492 - RNA, 64 nt, Homo Sapiens
aucucauacaagugaaaggauacuggagagagaaauuacccauuucuaaaaaaaaaccacacuc

SEQ ID NO: 483493 - RNA, 64 nt, Homo Sapiens
auuuccaagacacaaacaugaccuauccaagcgcauuacccacuuguggccaaucaguggccag

SEQ ID NO: 483494 - RNA, 64 nt, Homo Sapiens
acaguuuuuuuuccccugaaaucuacauauacuuauuacccaguaauuuaagaacucugaaaca

SEQ ID NO: 483495 - RNA, 64 nt, Homo Sapiens
agcacaguauuugcuuuuuaaggggagucaauugauuacccagcacccuauugacuuccgggua

SEQ ID NO: 483496 - RNA, 64 nt, Homo Sapiens
uucacagcaaggaaauucaccuucaaaagcacugauuacccaaugcaccucccuccccagcucg

SEQ ID NO: 483497 - RNA, 64 nt, Homo Sapiens
gaggugaauuuuccgggaacuuugcagcauaccaauuacccauaaacagcacaccuguguccaa

SEQ ID NO: 483498 - RNA, 64 nt, Homo Sapiens
gacuugggaacuaaaauguuuuuuaccauccgucauuacccaaaaaaaauugacagcuaguguu

SEQ ID NO: 483499 - RNA, 64 nt, Homo Sapiens
aaaaaggaugucagaaauuggcauaaaaacagaaauuacccaguaaaugagcgauauaugaacg

SEQ ID NO: 483500 - RNA, 64 nt, Homo Sapiens
acuauauggacugguaaugguuacagguucagagauuacccagugaggccuuauuccucccuuc

SEQ ID NO: 483501 - RNA, 64 nt, Homo Sapiens
gcagucaacguagaaugcuugggaaauagucauaauuacccacauauaguaauuaauagauggu

SEQ ID NO: 483502 - RNA, 64 nt, Homo Sapiens
auucaaauagaacauuuaaaaugauuucauuauuauuacccauacuguugccacucauauugua

SEQ ID NO: 483503 - RNA, 64 nt, Homo Sapiens
aucagagacauuuaugaacaaugacagaagaaaaauuacccaaauaaauguggaagcaagcaaa

SEQ ID NO: 483504 - RNA, 64 nt, Homo Sapiens
uuugcccaggcugguuuggaacuccugacuucaaauuacccaccugccucagccucccaaagug

SEQ ID NO: 483505 - RNA, 64 nt, Homo Sapiens
ugugauugccauagugggauauucccucucccacauuacccaagagggaaaugggcugucuuac

SEQ ID NO: 483506 - RNA, 64 nt, Homo Sapiens
aaccccucccuuccccacauagaaaaagagacaaauuacccagaacccugucucaagaaagaaa

SEQ ID NO: 483507 - RNA, 64 nt, Homo Sapiens
caucagaaaaaaaaaaaaaacugcuuauuuuaggauuacccacuggcugagccacaggcauuuc

SEQ ID NO: 483508 - RNA, 64 nt, Homo Sapiens
gaccgaugguaagugaggauugcauccugaggccauuacccagugaaacgaaacaaauguaaua

SEQ ID NO: 483509 - RNA, 64 nt, Homo Sapiens
uuuccaguuuuuacuuuagaagacaauauuuagaauuacccagcuuucuguaucacuguguccc

SEQ ID NO: 483510 - RNA, 64 nt, Homo Sapiens
cauaguggugggugccuguacuaaaaauacaaaaauuacccaagauggugaaacccugucucua

SEQ ID NO: 483511 - RNA, 64 nt, Homo Sapiens
uugcaucuucuuccacugggcucuggauuaaucaauuacccaaaggcugcaccugccguguugu

SEQ ID NO: 483512 - RNA, 64 nt, Homo Sapiens
uaugaaauuucaacuuuuccuuucauacgucuuuauuacccaagucuucucccguccauuccag

SEQ ID NO: 483513 - RNA, 64 nt, Homo Sapiens
ugguccagggccugggaaauuucuacuuauccucauuacccaggucccuccuuuggacccugua

SEQ ID NO: 483514 - RNA, 64 nt, Homo Sapiens
uagcuuugaggguaaaugaaaauauaacccauagauuacccagccacuugggaacagcagguaa

SEQ ID NO: 483515 - RNA, 64 nt, Homo Sapiens
auuguagccaccugugcgccccucccaacugggcauuacccaccgaccccgucuaacacugcau

SEQ ID NO: 483516 - RNA, 64 nt, Homo Sapiens
aaugaauagugagucagaucuauugcuucucuguauuacccacaugacaacugucuauaaugag

SEQ ID NO: 483517 - RNA, 64 nt, Homo Sapiens
cuacaacuuaguuuuaaauuacuugcuacuggggauuacccauggauauccuuaauaggcagga

SEQ ID NO: 483518 - RNA, 64 nt, Homo Sapiens
aaugaaaucaaauuuaucaguuuuuuucccccuaauuacccaaaagaucuuuugcaaacuaugu

SEQ ID NO: 483519 - RNA, 64 nt, Homo Sapiens
guuagcaagaauccucuaaaucaguuuauggagaauuacccacccucgauaucugaucccauuc

SEQ ID NO: 483520 - RNA, 64 nt, Homo Sapiens
gcuccccaaggcuggugggagcugcugguccuccauuacccacuuguguucuggguguucaggu

SEQ ID NO: 483521 - RNA, 64 nt, Homo Sapiens
uaaaccacauguuagauaaauacuaggucuucucauuacccauggcauacacaagcaccaaacc

SEQ ID NO: 483522 - RNA, 64 nt, Homo Sapiens
ccuccaugauccgagagugggaaaaggcccgauuauuacccauaaggcacacucucuaaggccu

SEQ ID NO: 483523 - RNA, 64 nt, Homo Sapiens
ucugauggguucgagaaaacuuauguuuuugcagauuacccagcuuuguucuuguuauaaagau

SEQ ID NO: 483524 - RNA, 64 nt, Homo Sapiens
agggagaguggucgugagcuggucuuggggcacaauuacccagagauauauuuauuaacagcca

SEQ ID NO: 483525 - RNA, 64 nt, Homo Sapiens
cuaacuguaagaaauuaauucuuuuucuuuauaaauuacccagguucuguuuuaagccucagaa

SEQ ID NO: 483526 - RNA, 64 nt, Homo Sapiens
gaacaauaaaaaagguacaaaaagugaaguacaaauuacccaaaucucuccacccuuauauaau

SEQ ID NO: 483527 - RNA, 64 nt, Homo Sapiens
cugccaaaaccaaauugagcucagcuuccuaggcauuacccaaaagcaagguguuuaaguaauu

SEQ ID NO: 483528 - RNA, 64 nt, Homo Sapiens
ccaacuuucucauauugcauauaaauccuuauaaauuacccaauuuagaacuagaaguaaacac

SEQ ID NO: 483529 - RNA, 64 nt, Homo Sapiens
uaugcaugaauucauucuccuuaaguccauucuaauuacccaaauguauauugcuuuuuaaaag

SEQ ID NO: 483530 - RNA, 64 nt, Homo Sapiens
ccauauugcacuuuuaguucagcuaaccaacugcauuacccaaaaguugggaggauggggagac

SEQ ID NO: 483531 - RNA, 64 nt, Homo Sapiens
auauuggaagcagccugaggcuggucguuuugugauuacccauaggugagaggaggaguuagag

SEQ ID NO: 483532 - RNA, 64 nt, Homo Sapiens
gcccaagcugcaugucaccugagggcuggcaggaaggggcgagaaaucccagggcauuguacca

SEQ ID NO: 483533 - RNA, 64 nt, Homo Sapiens
gcugccccggacgacugcgcgcuggccuugucccaggggcgacguugucuuccggcuccuccca

SEQ ID NO: 483534 - RNA, 64 nt, Homo Sapiens
agcacacaaguaaguagugggcuccaagccugugaggggcgaacagucugacugaugagaugcu

SEQ ID NO: 483535 - RNA, 64 nt, Homo Sapiens
guacgcccuuagccuuuggagcaguggaaggaggaggggcgaaaggcauggacauguccucugu

SEQ ID NO: 483536 - RNA, 64 nt, Homo Sapiens
guguucacuaagaggccuuuaauccuggggaguaaggggcgaaggcccuuagacaaccauggcu

SEQ ID NO: 483537 - RNA, 64 nt, Homo Sapiens
ggacagaaagaaggagggacaggcaggcagcaggaggggcgagcugggaggcaggaggcagcgg

SEQ ID NO: 483538 - RNA, 64 nt, Homo Sapiens
cacacgcuguauggaagggugugggugugugugaaggggcgaguggagacacuguguguaucuc

SEQ ID NO: 483539 - RNA, 64 nt, Homo Sapiens
uccacaagaagcaaugaggacugcccaguggaggaggggcgauguggcuggggagcuagggaga

SEQ ID NO: 483540 - RNA, 64 nt, Homo Sapiens
cccaaacaaaaucacaaaaccuggacaucccucaaggggcgaagaggcggccgggagacugcag

SEQ ID NO: 483541 - RNA, 64 nt, Homo Sapiens
aauaccuuugauuguaacgucugcccuggaggggaggggcgauaacucuucuccugcucccccc

SEQ ID NO: 483542 - RNA, 64 nt, Homo Sapiens
uaaaacuguggagaguggggacauaguuuucugaaggggcgacuuuguuuuagaaaaaaaaaca

SEQ ID NO: 483543 - RNA, 64 nt, Homo Sapiens
uaggaaaugcuacaugcggaaugugcacguuuccaggggcgaguauugucaaucaaaagguuug

SEQ ID NO: 483544 - RNA, 64 nt, Homo Sapiens
ugccugugaaugcugagugagcgaguaagggaggaggggcgauugaggguucaccucugccuug

SEQ ID NO: 483545 - RNA, 64 nt, Homo Sapiens
caaccccaccucuaugcccuuugggguuggugucaggggcgagcuauuuauuuauuuauucucc

SEQ ID NO: 483546 - RNA, 64 nt, Homo Sapiens
gaggggggugggauuuuugguggacaugaaggaaaggggcgaggcaccuuguaaaugcucuaac

SEQ ID NO: 483547 - RNA, 64 nt, Homo Sapiens
agccggagggacgcggaggaggaagaggguagacaggggcgaccugugauuguuguuauugaug

SEQ ID NO: 483548 - RNA, 64 nt, Homo Sapiens
agggccugagcuggggcaggccucccucagggccaggggcgauggcaccccggggacaggcaga

SEQ ID NO: 483549 - RNA, 64 nt, Homo Sapiens
ggguguacgucaacaucaguuggugcagcuccggaggggcgagagagcgugggguucggcggcc

SEQ ID NO: 483550 - RNA, 64 nt, Homo Sapiens
gggguuguucuccuacgccugccggaggagguguaggggcgagacugagcgcccagcgggcagg

SEQ ID NO: 483551 - RNA, 64 nt, Homo Sapiens
cuuuggugacagacggagagagcccagcuggcggaggggcgaagggcugggguugggcuggugc

SEQ ID NO: 483552 - RNA, 64 nt, Homo Sapiens
ggaagugcagaguggauggacggguuuagaggggaggggcgaaggugcuguaaacagguuuggg

SEQ ID NO: 483553 - RNA, 64 nt, Homo Sapiens
accaugaugauuuguuccaguucucccagggcagaggggcgagggagaggcuuuugcugugaga

SEQ ID NO: 483554 - RNA, 64 nt, Homo Sapiens
agguccaucucaaaggucacgucuaaaaaguaaaaggggcgaucuccaccucccugcacuugua

SEQ ID NO: 483555 - RNA, 64 nt, Homo Sapiens
uagggacaguugucugguuugugccaaaccuucgaggggcgaguagggagugggggaggugggu

SEQ ID NO: 483556 - RNA, 64 nt, Homo Sapiens
cuguacagagcagcgucccuuugguuuggcccagaggggcgaacaauugcaagggagagggccu

SEQ ID NO: 483557 - RNA, 64 nt, Homo Sapiens
aggacauguggauauccagcggggagcagggcugaggggcgaagggcugugguugaccugccuu

SEQ ID NO: 483558 - RNA, 64 nt, Homo Sapiens
uugaucauagaugccaccugcuuuguuaaauaagaggggcgacgagaacaccuccuucagagcc

SEQ ID NO: 483559 - RNA, 64 nt, Homo Sapiens
guauuuuuuucuucguguaagggcagggugggggaggggcgagagggcugggcaggcauucugg

SEQ ID NO: 483560 - RNA, 64 nt, Homo Sapiens
gcugaaaugggguugccaggacaacaagcauggcaggggcgaauggggacaucaggugacugac

SEQ ID NO: 483561 - RNA, 64 nt, Homo Sapiens
ggagggaacgagcgggcgcccaaagacucggcaaaggggcgagacccgcggggcuggggccaga

SEQ ID NO: 483562 - RNA, 64 nt, Homo Sapiens
caggccgcgggaaagccaggcaagggaggaagccaggggcgaggcugaacacugagggcaggag

SEQ ID NO: 483563 - RNA, 64 nt, Homo Sapiens
ucgcagcucacucgaggccuggggaaggggacucaggggcgaggaggaugacuggguccggucg

SEQ ID NO: 483564 - RNA, 64 nt, Homo Sapiens
gcuuucaaugcucgaaacuacaaauggcagaauuaggggcgaguuuauucaugugggacaugag

SEQ ID NO: 483565 - RNA, 64 nt, Homo Sapiens
agauaaggagccccucucuguuucugagggcaggaggggcgaccagcccccccauuccugggcc

SEQ ID NO: 483566 - RNA, 64 nt, Homo Sapiens
ugcugcugaggggugagugcuuauaugucagaaaaggggcgauaggguccugggucucuugcau

SEQ ID NO: 483567 - RNA, 64 nt, Homo Sapiens
ccagugcuugggcucugcuggccccagggcacugaggggcgaagcucaacccugcccugaacau

SEQ ID NO: 483568 - RNA, 64 nt, Homo Sapiens
ugaguguccccuugggcccauggcccagucacucaggggcgaguuucuuuucuaacauagcccu

SEQ ID NO: 483569 - RNA, 64 nt, Homo Sapiens
agcuuugcagcauuaaaaaaugcacugucccuagaggggcgaugggggacccagacauauccuu

SEQ ID NO: 483570 - RNA, 64 nt, Homo Sapiens
gcgacaaugucuugcugcucggauuaggugggggaggggcgacaguagugagcgccugagccga

SEQ ID NO: 483571 - RNA, 64 nt, Homo Sapiens
acggaacaauggggccuucaaacuguccuaaggcaggggcgagcgacaagcacauagcaagcug

SEQ ID NO: 483572 - RNA, 64 nt, Homo Sapiens
aggggaaaaaugggaaauaguuaggaugggggagaggggcgagauaagccaucagaaguuacuu

SEQ ID NO: 483573 - RNA, 59 nt, Homo Sapiens
agcuuagugagcuuaccccgugggcccucaggggcgauuugggggggcaagaacgguag

SEQ ID NO: 483574 - RNA, 64 nt, Homo Sapiens
augagaaaccuuccagggaaccucuagcucucggaggggcgaucuuguucccagacacacaacc

SEQ ID NO: 483575 - RNA, 64 nt, Homo Sapiens
auaaaguuuuccucuuuuuuaaccucugugggggaggggcgaguaagcuacaacagguuuggaa

SEQ ID NO: 483576 - RNA, 64 nt, Homo Sapiens
aaauuauaaacuuuuauacuuggguaagucccccaggggcgaguuccucgcucugggaugcagg

SEQ ID NO: 483577 - RNA, 64 nt, Homo Sapiens
aagaguggguggcuggcuggcuggcuggaaggggaggggcgagagggcugucucggugaugagc

SEQ ID NO: 483578 - RNA, 64 nt, Homo Sapiens
acuaguggacaaagccagcaccgcaucagcagccaggggcgagcggcugcggccacgugaggcu

SEQ ID NO: 483579 - RNA, 64 nt, Homo Sapiens
cgccucccgcccucggcugggagcggauggguguaggggcgagguccccggccuggguuggagg

SEQ ID NO: 483580 - RNA, 64 nt, Homo Sapiens
uguccccagguuucuggcagcgucugcucuagccaggggcgacggggugagucacagcccucuc

SEQ ID NO: 483581 - RNA, 64 nt, Homo Sapiens
gugccaccgcaggcagcgcuagccagccccuggcaggggcgacuaggggaggggaccaugaggc

SEQ ID NO: 483582 - RNA, 64 nt, Homo Sapiens
gagacugggccuaggccaggaguucccaaaugugaggggcgagaaacaagacaagcuccucccu

SEQ ID NO: 483583 - RNA, 64 nt, Homo Sapiens
gcugcuuccucgcggcagccuucuuuccaccgacaggggcgagggugguagagaacucucuucc

SEQ ID NO: 483584 - RNA, 64 nt, Homo Sapiens
ugagggagaaggggagaaaguuuggggaggaggaaggggcgauuccccuuugccauagccugau

SEQ ID NO: 483585 - RNA, 64 nt, Homo Sapiens
gcgggccugccagcugggggccuuugcggcgcgcaggggcgaagccuguaaucacugcagccgc

SEQ ID NO: 483586 - RNA, 64 nt, Homo Sapiens
cugaggccacagggagcggccaucgccauugggaaggggcgacuccacggaaagcccagacggg

SEQ ID NO: 483587 - RNA, 64 nt, Homo Sapiens
gguccccagccucugggcuccuguuuccauaggaaggggcgacaccuuccucccaggaagcuga

SEQ ID NO: 483588 - RNA, 64 nt, Homo Sapiens
cccccuccaguuguaaaugccacuucaugaggggaggggcgaggggaagcccaccccugcaugc

SEQ ID NO: 483589 - RNA, 64 nt, Homo Sapiens
ucaugaccuucugucccggccgcgacugagagccaggggcgacacacccucauuuucugguccu

SEQ ID NO: 483590 - RNA, 64 nt, Homo Sapiens
ucggcaaagcaacauggcagccgguccccuucccaggggcgaggcccucuggaaguggccuugc

SEQ ID NO: 483591 - RNA, 64 nt, Homo Sapiens
gcuguugguccucucucuguggggcugaauugccaggggcgaggcccuuccucuuugguggcau

SEQ ID NO: 483592 - RNA, 64 nt, Homo Sapiens
ccauuucugaccugaaugaaauauucagggacuuaggggcgaugauuguagaacagguacguga

SEQ ID NO: 483593 - RNA, 64 nt, Homo Sapiens
ucaggguggggccuugagaaggggaaugugggacaggggcgauggugccuggucucugaguaag

SEQ ID NO: 483594 - RNA, 64 nt, Homo Sapiens
caacuuuaugucaguggaaaggagauaagcugcaaggggcgaagaggaaacaggucaugaaggu

SEQ ID NO: 483595 - RNA, 64 nt, Homo Sapiens
uaaagaccuguccaccuguaaguagcugguaaagaggggcgaacccaagaccgguugcucugag

SEQ ID NO: 483596 - RNA, 64 nt, Homo Sapiens
accaggccagccugggacugagccuggucacacaaggggcgagcacuuuugccccucccuucag

SEQ ID NO: 483597 - RNA, 64 nt, Homo Sapiens
ggggaggggggugauggugcgcuccccaugagggaggggcgacgugucuuuccagggggaaggg

SEQ ID NO: 483598 - RNA, 64 nt, Homo Sapiens
gcggacagguggucggcgucggggugcgguggguaggggcgaggacaacgcagggugcgcuggg

SEQ ID NO: 483599 - RNA, 64 nt, Homo Sapiens
ugcuccaaaaccaaaaagcuggguccucuggaggaggggcgagcuguggagcagccacccacug

SEQ ID NO: 483600 - RNA, 64 nt, Homo Sapiens
cuaguggccugaggagaugugccgcgggaccuccaggggcgacuggccucccacugccccacac

SEQ ID NO: 483601 - RNA, 64 nt, Homo Sapiens
cuuuaagcgaggcagaauggggcaggguucuagaaggggcgagggggcuuggaagggcgcugag

SEQ ID NO: 483602 - RNA, 64 nt, Homo Sapiens
acccacgugagagaaucugcacaagggggaggaaaggggcgagcggccagggugggagggaggg

SEQ ID NO: 483603 - RNA, 64 nt, Homo Sapiens
aaaagaaagauggaagaaggagaagccacucaguaggauagaagccauggaugauguuaaggau

SEQ ID NO: 483604 - RNA, 64 nt, Homo Sapiens
ccacucaguaggauagaagacauggaugauguuaaggauagaagguccagcagugaacuugggc

SEQ ID NO: 483605 - RNA, 64 nt, Homo Sapiens
guucucagcaucaggccaccuccaccccaaugccaggauagauguauucuagaguaggggugga

SEQ ID NO: 483606 - RNA, 64 nt, Homo Sapiens
aauaaacucuaggcccagggcuacuaaagacuucaggauagaauucuccaucaaauauacagca

SEQ ID NO: 483607 - RNA, 64 nt, Homo Sapiens; identical to SEQ ID NO: 334332

SEQ ID NO: 483608 - RNA, 64 nt, Homo Sapiens; identical to SEQ ID NO: 334333

SEQ ID NO: 483609 - RNA, 64 nt, Homo Sapiens; identical to SEQ ID NO: 334334

SEQ ID NO: 483610 - RNA, 64 nt, Homo Sapiens; identical to SEQ ID NO: 334335

SEQ ID NO: 483611 - RNA, 64 nt, Homo Sapiens; identical to SEQ ID NO: 334336

SEQ ID NO: 483612 - RNA, 64 nt, Homo Sapiens; identical to SEQ ID NO: 334337

SEQ ID NO: 483613 - RNA, 64 nt, Homo Sapiens; identical to SEQ ID NO: 334338

SEQ ID NO: 483614 - RNA, 64 nt, Homo Sapiens; identical to SEQ ID NO: 334339

SEQ ID NO: 483615 - RNA, 64 nt, Homo Sapiens; identical to SEQ ID NO: 334340

SEQ ID NO: 483616 - RNA, 64 nt, Homo Sapiens; identical to SEQ ID NO: 334341

SEQ ID NO: 483617 - RNA, 64 nt, Homo Sapiens; identical to SEQ ID NO: 334342

SEQ ID NO: 483618 - RNA, 64 nt, Homo Sapiens; identical to SEQ ID NO: 334343

SEQ ID NO: 483619 - RNA, 64 nt, Homo Sapiens; identical to SEQ ID NO: 334344

SEQ ID NO: 483620 - RNA, 64 nt, Homo Sapiens; identical to SEQ ID NO: 334345

SEQ ID NO: 483621 - RNA, 64 nt, Homo Sapiens; identical to SEQ ID NO: 334346

SEQ ID NO: 483622 - RNA, 64 nt, Homo Sapiens; identical to SEQ ID NO: 334347

SEQ ID NO: 483623 - RNA, 64 nt, Homo Sapiens; identical to SEQ ID NO: 334348

SEQ ID NO: 483624 - RNA, 64 nt, Homo Sapiens; identical to SEQ ID NO: 334349

SEQ ID NO: 483625 - RNA, 64 nt, Homo Sapiens; identical to SEQ ID NO: 334350

SEQ ID NO: 483626 - RNA, 64 nt, Homo Sapiens; identical to SEQ ID NO: 334351

SEQ ID NO: 483627 - RNA, 64 nt, Homo Sapiens; identical to SEQ ID NO: 334352

SEQ ID NO: 483628 - RNA, 64 nt, Homo Sapiens; identical to SEQ ID NO: 334353

SEQ ID NO: 483629 - RNA, 64 nt, Homo Sapiens; identical to SEQ ID NO: 334354

SEQ ID NO: 483630 - RNA, 64 nt, Homo Sapiens; identical to SEQ ID NO: 334355

SEQ ID NO: 483631 - RNA, 64 nt, Homo Sapiens; identical to SEQ ID NO: 334356

SEQ ID NO: 483632 - RNA, 64 nt, Homo Sapiens; identical to SEQ ID NO: 334357

SEQ ID NO: 483633 - RNA, 64 nt, Homo Sapiens; identical to SEQ ID NO: 277107

SEQ ID NO: 483634 - RNA, 64 nt, Homo Sapiens; identical to SEQ ID NO: 277108

SEQ ID NO: 483635 - RNA, 63 nt, Homo Sapiens
uggaaccucaggacccgcccauuucucggcaguacugugaauuuugaaguuaaacuaaauuuu

SEQ ID NO: 483636 - RNA, 63 nt, Homo Sapiens
ugacaugaagaguuuaguuuuuuuacuuuauaaacugugaauaugaguaugccagcugcauac

SEQ ID NO: 483637 - RNA, 63 nt, Homo Sapiens
aacaacaacaacaaaccacaaaauuauuugaguacugugaaggauuauuugucuaacaguuca

SEQ ID NO: 483638 - RNA, 63 nt, Homo Sapiens
uguggaaagagcguccauaggagaagugagaauacugugaaaaagggauguuagcauucauua

SEQ ID NO: 483639 - RNA, 63 nt, Homo Sapiens
ugaguaugccagcugcauuauuuuacuuuauaaacugugaauacgacaugaagaguuuaguuu

SEQ ID NO: 483640 - RNA, 63 nt, Homo Sapiens
uugaaguuaaacuaaauuuuauuucucggcaguacugugaauuuggaaccucaggacccgccc

SEQ ID NO: 483641 - RNA, 63 nt, Homo Sapiens
ugguuuaacacuguauccuacaacucaagcugaacugugaaaggccucauucuccaagagcca

SEQ ID NO: 483642 - RNA, 63 nt, Homo Sapiens
guuuuuguacaguuaucauggcuuaaaaaaauuacugugaauucauuuuucuggaguggaaaa

SEQ ID NO: 483643 - RNA, 63 nt, Homo Sapiens
auggccauauauaauuuuuuuuuuggcugcguaacugugaacuaaggcuguaauuggagcagc

SEQ ID NO: 483644 - RNA, 63 nt, Homo Sapiens
uacuuccugaaggggagggaagaggacuuuggaacugugaauacuguugagagcauuucagcc

SEQ ID NO: 483645 - RNA, 63 nt, Homo Sapiens
uauuaugggauugcuaccuguauaaacaauggcacugugaaaauacuguuaguuuuaauacaa

SEQ ID NO: 483646 - RNA, 63 nt, Homo Sapiens
uuaacacuagcuuuguauuuuuuuuucuguaaaacugugaacugauauauuuuccuuuaucac

SEQ ID NO: 483647 - RNA, 63 nt, Homo Sapiens
ucagaaucgccucagcauuuggaaccuccuagcacugugaaagacuccuugaaguguugcaag

SEQ ID NO: 483648 - RNA, 63 nt, Homo Sapiens
uagcaauauaguacuggacauaaaguccguuuuacugugaauauagacugaucacucagaaau

SEQ ID NO: 483649 - RNA, 63 nt, Homo Sapiens
ugagaaauacagaagaaaauaaacuuauuaacaacugugaauacaucuuugggacaccucaga

SEQ ID NO: 483650 - RNA, 63 nt, Homo Sapiens
auuuugaagaaaacacaacaaaaaucaaaaggcacugugaacuauuucaaggccauauuuuaa

SEQ ID NO: 483651 - RNA, 63 nt, Homo Sapiens
agaugcccuggucuugcuuucuggucacaggugacugugaaacuaguaaucauguuggcuggu

SEQ ID NO: 483652 - RNA, 61 nt, Homo Sapiens; identical to SEQ ID NO: 379771

SEQ ID NO: 483653 - RNA, 63 nt, Homo Sapiens
aaaguucauucuguagugcagcaucccucauuuacugugaacuaauuuauuucuuaagaaaaa

SEQ ID NO: 483654 - RNA, 63 nt, Homo Sapiens
ucacccaggcaaaauggcuagucuccugagccaacugugaaccgugguuaaugaucagaagau

SEQ ID NO: 483655 - RNA, 63 nt, Homo Sapiens
uugggauuuauguccuugcccuuccccacaaggacugugaauaggagauacaauaucacaccc

SEQ ID NO: 483656 - RNA, 63 nt, Homo Sapiens
aucugguuccucauucacugcauaugagguacuacugugaagggccuccccccaugguguuuu

SEQ ID NO: 483657 - RNA, 63 nt, Homo Sapiens
cucagccuuuuccuccucaguuuucucuuuaaaacugugaaguacuaacuuuccaaggccugc

SEQ ID NO: 483658 - RNA, 63 nt, Homo Sapiens
cagggcccacaucaucuaggcuccccagcccccacugugaaggggcuggccaggggcccgagc

SEQ ID NO: 483659 - RNA, 63 nt, Homo Sapiens
ccaucagaugugccaaauggaauauugaguucaacugugaaaugugcauuaggcuguaguucu

SEQ ID NO: 483660 - RNA, 63 nt, Homo Sapiens
aaguugaauggugguuuuuaggggggauuucagacugugaagaucuucacuggaaaacaggga

SEQ ID NO: 483661 - RNA, 63 nt, Homo Sapiens
uaaacauaauuaaugauggagagaaaccauacaacugugaagaauguggcaaagcuuuuaacc

SEQ ID NO: 483662 - RNA, 63 nt, Homo Sapiens
cauuuauauuugagaaaaauuguagaaauauagacugugaaaaagacgucaauaucugcucac

SEQ ID NO: 483663 - RNA, 63 nt, Homo Sapiens
auaugagccuuugaaaguuccaggugagaagaaacugugaagucaauuauucugaugcuggga

SEQ ID NO: 483664 - RNA, 63 nt, Homo Sapiens
ugaugacgggcuuguagcacgucuuaagcuucaacugugaaaaagcauucaacagagaacucu

SEQ ID NO: 483665 - RNA, 63 nt, Homo Sapiens
agccauuaauacaugcucacuacaaauauaaagacugugaaaauuuauacuugagaaauauug

SEQ ID NO: 483666 - RNA, 63 nt, Homo Sapiens
auauggcaaagccuuuaauagggaacuccugugacugugaagaauaaaaaaauucauacugga

SEQ ID NO: 483667 - RNA, 63 nt, Homo Sapiens
uuuguuuuccaagcuguuuugggcuguauugauacugugaaugaggguagcaccgugagaaau

SEQ ID NO: 483668 - RNA, 63 nt, Homo Sapiens
gaaaggaugggucaccucucccccugugcugucacugugaaugugucacaaaaaggaggugcc

SEQ ID NO: 483669 - RNA, 63 nt, Homo Sapiens
ggcugaaagacaccuucccgcaauugucuugagacugugaagagcaaugccuguggcuucagu

SEQ ID NO: 483670 - RNA, 63 nt, Homo Sapiens
uaauggaaacguaggagcauuuuugugaaagaaacugugaaugcccuucuccuuugaaugcug

SEQ ID NO: 483671 - RNA, 63 nt, Homo Sapiens
agucagacaaauaaagcaagagcagggggcugaacugugaacagcuggcccguugguuuucug

SEQ ID NO: 483672 - RNA, 63 nt, Homo Sapiens
acagacccugggucccacacccuuccaccuccuacugugaagaugauaaagaacuuagucauc

SEQ ID NO: 483673 - RNA, 64 nt, Homo Sapiens; identical to SEQ ID NO: 110800

SEQ ID NO: 483674 - RNA, 64 nt, Homo Sapiens; identical to SEQ ID NO: 110801

SEQ ID NO: 483675 - RNA, 64 nt, Homo Sapiens; identical to SEQ ID NO: 110802

SEQ ID NO: 483676 - RNA, 64 nt, Homo Sapiens; identical to SEQ ID NO: 110803

SEQ ID NO: 483677 - RNA, 64 nt, Homo Sapiens; identical to SEQ ID NO: 110804

SEQ ID NO: 483678 - RNA, 64 nt, Homo Sapiens; identical to SEQ ID NO: 110805

SEQ ID NO: 483679 - RNA, 64 nt, Homo Sapiens; identical to SEQ ID NO: 110806

SEQ ID NO: 483680 - RNA, 64 nt, Homo Sapiens; identical to SEQ ID NO: 110807

SEQ ID NO: 483681 - RNA, 64 nt, Homo Sapiens; identical to SEQ ID NO: 110808

SEQ ID NO: 483682 - RNA, 64 nt, Homo Sapiens; identical to SEQ ID NO: 110809

SEQ ID NO: 483683 - RNA, 64 nt, Homo Sapiens; identical to SEQ ID NO: 110810

SEQ ID NO: 483684 - RNA, 64 nt, Homo Sapiens; identical to SEQ ID NO: 110811

SEQ ID NO: 483685 - RNA, 64 nt, Homo Sapiens
auauauuugaaauugcuuuggacaaguuuucuaggcuaucuaccagguagcucauuaaacguaa

SEQ ID NO: 483686 - RNA, 64 nt, Homo Sapiens
uucugaguaaauuugcugaaaauauaagagagaagcuaucuaauaccuuggagguaggucaucc

SEQ ID NO: 483687 - RNA, 64 nt, Homo Sapiens
uggaauugcuuaccaaaggacuccuccucccccagcuaucuauagaugcuauggucagguuaua

SEQ ID NO: 483688 - RNA, 64 nt, Homo Sapiens
uggaguugaaagaguuaagaaucuguagauacuagcuaucuaggccuaaccucuuuucugcauc

SEQ ID NO: 483689 - RNA, 64 nt, Homo Sapiens
ccaaggaacuaggaagcagccaugggagaggggaaggguucaagcccgggaugggcccgcguga

SEQ ID NO: 483690 - RNA, 64 nt, Homo Sapiens
gcggcccccuugcccaaccucggguuuagggaggaggguucacaguguuuuugugggggcgggg

SEQ ID NO: 483691 - RNA, 64 nt, Homo Sapiens
aaugacuauuuacaccucaaaauauauucagcaaaggguucacuuaguugccccucaugcuuca

SEQ ID NO: 483692 - RNA, 64 nt, Homo Sapiens
augugacuacagaacucuaggugaaaaaucagguaggguucaaauuaaguagaacugcccuugc

SEQ ID NO: 483693 - RNA, 64 nt, Homo Sapiens
augcaggcaacauuaccuugcaacacuuuucuccaggguucaccgaagcagcaauuaauuagau

SEQ ID NO: 483694 - RNA, 64 nt, Homo Sapiens
gacuaacgaacguuuuaaagucgcuuguuuuaaaaggguucaagcguguaguuucugguaucgu

SEQ ID NO: 483695 - RNA, 64 nt, Homo Sapiens
aaggaaguugcacuaauucucaacucugguugagaggguucauaaauuucaugaaaauaucucc

SEQ ID NO: 483696 - RNA, 64 nt, Homo Sapiens
aaauguaaauuccaagagggcuuucacaguccacaggguucaaaugacuuggguaacagaaguu

SEQ ID NO: 483697 - RNA, 64 nt, Homo Sapiens
gaucauaggaauauuaggagaggaggguuuaaauaggguucagacaaaaugauauuuuuauuuu

SEQ ID NO: 483698 - RNA, 64 nt, Homo Sapiens
augauggaaggccgaagagcaaucuaugagguuuaggguucaaauuauacaguguuucguucua

SEQ ID NO: 483699 - RNA, 64 nt, Homo Sapiens
gcccagggaugcaaagguugggguucagagaaccaggguucaaacaaaaagaaagaagugacua

SEQ ID NO: 483700 - RNA, 64 nt, Homo Sapiens
gaaccaggguucaaagcccaagaaagaagugacuaggguucagaagagcgagaccgucucaaaa

SEQ ID NO: 483701 - RNA, 64 nt, Homo Sapiens
uuaaguuacaagagaccacauccacccagggauuaggguucaaguagcagcugcuaacccuugc

SEQ ID NO: 483702 - RNA, 64 nt, Homo Sapiens
uuuuuagggggaaugggaaacggacaccucauaaaggguucaaagaucaucaauuuuucugacu

SEQ ID NO: 483703 - RNA, 64 nt, Homo Sapiens
agaagcaauuccaccaaacucauguuuucacaggaggguucaguguggagagcaaaaaagcuga

SEQ ID NO: 483704 - RNA, 64 nt, Homo Sapiens
guuucuucuucgaggaaagccaagcuccucaaacaggguucaguccacguuguguuuucacacc

SEQ ID NO: 483705 - RNA, 64 nt, Homo Sapiens; identical to SEQ ID NO: 86065

SEQ ID NO: 483706 - RNA, 64 nt, Homo Sapiens; identical to SEQ ID NO: 86066

SEQ ID NO: 483707 - RNA, 64 nt, Homo Sapiens; identical to SEQ ID NO: 86067

SEQ ID NO: 483708 - RNA, 64 nt, Homo Sapiens; identical to SEQ ID NO: 86068

SEQ ID NO: 483709 - RNA, 64 nt, Homo Sapiens; identical to SEQ ID NO: 86069

SEQ ID NO: 483710 - RNA, 64 nt, Homo Sapiens; identical to SEQ ID NO: 86070

SEQ ID NO: 483711 - RNA, 64 nt, Homo Sapiens; identical to SEQ ID NO: 86071

SEQ ID NO: 483712 - RNA, 64 nt, Homo Sapiens; identical to SEQ ID NO: 86072

SEQ ID NO: 483713 - RNA, 64 nt, Homo Sapiens; identical to SEQ ID NO: 86073

SEQ ID NO: 483714 - RNA, 64 nt, Homo Sapiens; identical to SEQ ID NO: 86074

SEQ ID NO: 483715 - RNA, 64 nt, Homo Sapiens; identical to SEQ ID NO: 86075

SEQ ID NO: 483716 - RNA, 64 nt, Homo Sapiens; identical to SEQ ID NO: 86076

SEQ ID NO: 483717 - RNA, 64 nt, Homo Sapiens; identical to SEQ ID NO: 86077

SEQ ID NO: 483718 - RNA, 64 nt, Homo Sapiens; identical to SEQ ID NO: 86078

SEQ ID NO: 483719 - RNA, 64 nt, Homo Sapiens; identical to SEQ ID NO: 86079

SEQ ID NO: 483720 - RNA, 64 nt, Homo Sapiens; identical to SEQ ID NO: 86080

SEQ ID NO: 483721 - RNA, 64 nt, Homo Sapiens; identical to SEQ ID NO: 86081

SEQ ID NO: 483722 - RNA, 64 nt, Homo Sapiens; identical to SEQ ID NO: 86082

SEQ ID NO: 483723 - RNA, 64 nt, Homo Sapiens; identical to SEQ ID NO: 86083

SEQ ID NO: 483724 - RNA, 64 nt, Homo Sapiens; identical to SEQ ID NO: 86084

SEQ ID NO: 483725 - RNA, 64 nt, Homo Sapiens; identical to SEQ ID NO: 86085

SEQ ID NO: 483726 - RNA, 64 nt, Homo Sapiens; identical to SEQ ID NO: 86086

SEQ ID NO: 483727 - RNA, 64 nt, Homo Sapiens; identical to SEQ ID NO: 86087

SEQ ID NO: 483728 - RNA, 64 nt, Homo Sapiens; identical to SEQ ID NO: 86088

SEQ ID NO: 483729 - RNA, 64 nt, Homo Sapiens; identical to SEQ ID NO: 86089

SEQ ID NO: 483730 - RNA, 64 nt, Homo Sapiens; identical to SEQ ID NO: 86090

SEQ ID NO: 483731 - RNA, 64 nt, Homo Sapiens; identical to SEQ ID NO: 86091

SEQ ID NO: 483732 - RNA, 64 nt, Homo Sapiens; identical to SEQ ID NO: 86092

SEQ ID NO: 483733 - RNA, 64 nt, Homo Sapiens; identical to SEQ ID NO: 86093

SEQ ID NO: 483734 - RNA, 64 nt, Homo Sapiens; identical to SEQ ID NO: 86094

SEQ ID NO: 483735 - RNA, 64 nt, Homo Sapiens; identical to SEQ ID NO: 86095

SEQ ID NO: 483736 - RNA, 64 nt, Homo Sapiens; identical to SEQ ID NO: 86096

SEQ ID NO: 483737 - RNA, 64 nt, Homo Sapiens; identical to SEQ ID NO: 86097

SEQ ID NO: 483738 - RNA, 64 nt, Homo Sapiens; identical to SEQ ID NO: 86098

SEQ ID NO: 483739 - RNA, 64 nt, Homo Sapiens; identical to SEQ ID NO: 86099

SEQ ID NO: 483740 - RNA, 64 nt, Homo Sapiens; identical to SEQ ID NO: 86100

SEQ ID NO: 483741 - RNA, 64 nt, Homo Sapiens; identical to SEQ ID NO: 86101

SEQ ID NO: 483742 - RNA, 64 nt, Homo Sapiens; identical to SEQ ID NO: 86102

SEQ ID NO: 483743 - RNA, 64 nt, Homo Sapiens; identical to SEQ ID NO: 86103

SEQ ID NO: 483744 - RNA, 64 nt, Homo Sapiens; identical to SEQ ID NO: 86104

SEQ ID NO: 483745 - RNA, 64 nt, Homo Sapiens; identical to SEQ ID NO: 86105

SEQ ID NO: 483746 - RNA, 64 nt, Homo Sapiens; identical to SEQ ID NO: 86106

SEQ ID NO: 483747 - RNA, 64 nt, Homo Sapiens; identical to SEQ ID NO: 86107

SEQ ID NO: 483748 - RNA, 64 nt, Homo Sapiens; identical to SEQ ID NO: 86108

SEQ ID NO: 483749 - RNA, 64 nt, Homo Sapiens; identical to SEQ ID NO: 86109

SEQ ID NO: 483750 - RNA, 64 nt, Homo Sapiens; identical to SEQ ID NO: 86110

SEQ ID NO: 483751 - RNA, 64 nt, Homo Sapiens; identical to SEQ ID NO: 86111

SEQ ID NO: 483752 - RNA, 64 nt, Homo Sapiens; identical to SEQ ID NO: 86112

SEQ ID NO: 483753 - RNA, 64 nt, Homo Sapiens; identical to SEQ ID NO: 86113

SEQ ID NO: 483754 - RNA, 64 nt, Homo Sapiens; identical to SEQ ID NO: 86114

SEQ ID NO: 483755 - RNA, 64 nt, Homo Sapiens; identical to SEQ ID NO: 86115

SEQ ID NO: 483756 - RNA, 64 nt, Homo Sapiens; identical to SEQ ID NO: 86116

SEQ ID NO: 483757 - RNA, 64 nt, Homo Sapiens; identical to SEQ ID NO: 86117

SEQ ID NO: 483758 - RNA, 64 nt, Homo Sapiens; identical to SEQ ID NO: 86118

SEQ ID NO: 483759 - RNA, 64 nt, Homo Sapiens; identical to SEQ ID NO: 86119

SEQ ID NO: 483760 - RNA, 64 nt, Homo Sapiens; identical to SEQ ID NO: 86120

SEQ ID NO: 483761 - RNA, 64 nt, Homo Sapiens; identical to SEQ ID NO: 86121

SEQ ID NO: 483762 - RNA, 64 nt, Homo Sapiens; identical to SEQ ID NO: 86122

SEQ ID NO: 483763 - RNA, 64 nt, Homo Sapiens; identical to SEQ ID NO: 86123

SEQ ID NO: 483764 - RNA, 64 nt, Homo Sapiens; identical to SEQ ID NO: 86124

SEQ ID NO: 483765 - RNA, 64 nt, Homo Sapiens; identical to SEQ ID NO: 120972

SEQ ID NO: 483766 - RNA, 64 nt, Homo Sapiens; identical to SEQ ID NO: 120973

SEQ ID NO: 483767 - RNA, 64 nt, Homo Sapiens; identical to SEQ ID NO: 120974

SEQ ID NO: 483768 - RNA, 64 nt, Homo Sapiens; identical to SEQ ID NO: 120975

SEQ ID NO: 483769 - RNA, 64 nt, Homo Sapiens; identical to SEQ ID NO: 120976

SEQ ID NO: 483770 - RNA, 64 nt, Homo Sapiens; identical to SEQ ID NO: 120977

SEQ ID NO: 483771 - RNA, 64 nt, Homo Sapiens; identical to SEQ ID NO: 120978

SEQ ID NO: 483772 - RNA, 64 nt, Homo Sapiens; identical to SEQ ID NO: 120979

SEQ ID NO: 483773 - RNA, 64 nt, Homo Sapiens; identical to SEQ ID NO: 120980

SEQ ID NO: 483774 - RNA, 64 nt, Homo Sapiens; identical to SEQ ID NO: 120981

SEQ ID NO: 483775 - RNA, 64 nt, Homo Sapiens; identical to SEQ ID NO: 120982

SEQ ID NO: 483776 - RNA, 64 nt, Homo Sapiens; identical to SEQ ID NO: 120983

SEQ ID NO: 483777 - RNA, 64 nt, Homo Sapiens; identical to SEQ ID NO: 120984

SEQ ID NO: 483778 - RNA, 64 nt, Homo Sapiens; identical to SEQ ID NO: 120985

SEQ ID NO: 483779 - RNA, 64 nt, Homo Sapiens; identical to SEQ ID NO: 120986

SEQ ID NO: 483780 - RNA, 64 nt, Homo Sapiens; identical to SEQ ID NO: 120987

SEQ ID NO: 483781 - RNA, 64 nt, Homo Sapiens; identical to SEQ ID NO: 120988

SEQ ID NO: 483782 - RNA, 64 nt, Homo Sapiens; identical to SEQ ID NO: 120989

SEQ ID NO: 483783 - RNA, 64 nt, Homo Sapiens; identical to SEQ ID NO: 120990

SEQ ID NO: 483784 - RNA, 64 nt, Homo Sapiens; identical to SEQ ID NO: 120991

SEQ ID NO: 483785 - RNA, 64 nt, Homo Sapiens
acuuauuacauggcuuacuuaauguaucucuaaugcauuugaaguuucauuucaaauauguuuu

SEQ ID NO: 483786 - RNA, 64 nt, Homo Sapiens
caauauuguaauaauccaugcugcaauuuuuuuugcauuugacaagcugguuuagauacauuag

SEQ ID NO: 483787 - RNA, 64 nt, Homo Sapiens
auuuccuuuuuuuuuuuuuuuacuucagcuacuugcauuugauugccaucuguugaucaggaac

SEQ ID NO: 483788 - RNA, 64 nt, Homo Sapiens
gguaacaguggagcuagggcucuucuguuuugcugcauuugaaacuuaacuuuaaccaauauuu

SEQ ID NO: 483789 - RNA, 64 nt, Homo Sapiens
gaaggacccuuuagcucugugauuaguuucaccagcauuugagaaacaaagaaugcuugcauuu

SEQ ID NO: 483790 - RNA, 64 nt, Homo Sapiens
aguuucaccagcauuugagaaacaaagaaugcuugcauuugauuuugaaaaauuauuagcaugu

SEQ ID NO: 483791 - RNA, 64 nt, Homo Sapiens
gcaaagagauuguucugaagaccgugcucuaagggcauuugaaagacugccagguagugcgagc

SEQ ID NO: 483792 - RNA, 64 nt, Homo Sapiens
uucaggggugggagaaacuccuuuccuucagcuggcauuugaauguuuccaaaucuauuuuauc

SEQ ID NO: 483793 - RNA, 64 nt, Homo Sapiens
aaaauauuugguucccuuuuaaaggcucuaaaaagcauuugaggauauauuuguaucucuacag

SEQ ID NO: 483794 - RNA, 64 nt, Homo Sapiens
ggaggauuauugcuaugaaucauuuuuuuaaagggcauuugaggugcuauuguacgguuucaug

SEQ ID NO: 483795 - RNA, 64 nt, Homo Sapiens
ugccacucuuggagcacauugcuguaaacacagagcauuugagcgaaaaggauaagccaagaug

SEQ ID NO: 483796 - RNA, 64 nt, Homo Sapiens
gggaguagggggcuagauguuggaggugguugcugcauuugagaacuccggcggucugaggcca

SEQ ID NO: 483797 - RNA, 64 nt, Homo Sapiens
auuuugauguuuuaaggauguucuuucuggcuaugcauuugaaaggggcaguggugguuuucug

SEQ ID NO: 483798 - RNA, 64 nt, Homo Sapiens
ucuguucuuuccaaaguacacaguaaaugggggugcauuugaggauuuccguuaaaauaccagc

SEQ ID NO: 483799 - RNA, 64 nt, Homo Sapiens
ucuuuaaauuaggauugcaaaccaaggaaagaacgcauuugagauuuuaagaugucacuuauaa

SEQ ID NO: 483800 - RNA, 64 nt, Homo Sapiens
aacagauuuugaagaaauccuguaagaugauaaagcauuugaaugguacaguagauguaaaaaa

SEQ ID NO: 483801 - RNA, 64 nt, Homo Sapiens
gauuugcaagaggaauugaucaguaucacuuuaaguccugcauuuaauuggcagcacaagaucc

SEQ ID NO: 483802 - RNA, 64 nt, Homo Sapiens
gaaugggucaggagaccgcugcuucugggcauaaguccugcaaggaaagcaacauggaaaacag

SEQ ID NO: 483803 - RNA, 64 nt, Homo Sapiens; identical to SEQ ID NO: 154299

SEQ ID NO: 483804 - RNA, 64 nt, Homo Sapiens; identical to SEQ ID NO: 154300

SEQ ID NO: 483805 - RNA, 64 nt, Homo Sapiens; identical to SEQ ID NO: 154301

SEQ ID NO: 483806 - RNA, 64 nt, Homo Sapiens; identical to SEQ ID NO: 154302

SEQ ID NO: 483807 - RNA, 64 nt, Homo Sapiens; identical to SEQ ID NO: 154303

SEQ ID NO: 483808 - RNA, 64 nt, Homo Sapiens; identical to SEQ ID NO: 154304

SEQ ID NO: 483809 - RNA, 64 nt, Homo Sapiens; identical to SEQ ID NO: 154305

SEQ ID NO: 483810 - RNA, 64 nt, Homo Sapiens; identical to SEQ ID NO: 154306

SEQ ID NO: 483811 - RNA, 64 nt, Homo Sapiens; identical to SEQ ID NO: 154307

SEQ ID NO: 483812 - RNA, 64 nt, Homo Sapiens; identical to SEQ ID NO: 154308

SEQ ID NO: 483813 - RNA, 64 nt, Homo Sapiens; identical to SEQ ID NO: 154309

SEQ ID NO: 483814 - RNA, 64 nt, Homo Sapiens; identical to SEQ ID NO: 154310

SEQ ID NO: 483815 - RNA, 64 nt, Homo Sapiens; identical to SEQ ID NO: 154311

SEQ ID NO: 483816 - RNA, 64 nt, Homo Sapiens; identical to SEQ ID NO: 154312

SEQ ID NO: 483817 - RNA, 64 nt, Homo Sapiens; identical to SEQ ID NO: 154313

SEQ ID NO: 483818 - RNA, 54 nt, Homo Sapiens; identical to SEQ ID NO: 154314

SEQ ID NO: 483819 - RNA, 64 nt, Homo Sapiens; identical to SEQ ID NO: 154315

SEQ ID NO: 483820 - RNA, 64 nt, Homo Sapiens; identical to SEQ ID NO: 154316

SEQ ID NO: 483821 - RNA, 64 nt, Homo Sapiens; identical to SEQ ID NO: 154317

SEQ ID NO: 483822 - RNA, 64 nt, Homo Sapiens; identical to SEQ ID NO: 154318

SEQ ID NO: 483823 - RNA, 64 nt, Homo Sapiens; identical to SEQ ID NO: 154319

SEQ ID NO: 483824 - RNA, 64 nt, Homo Sapiens; identical to SEQ ID NO: 154320

SEQ ID NO: 483825 - RNA, 64 nt, Homo Sapiens; identical to SEQ ID NO: 154321

SEQ ID NO: 483826 - RNA, 64 nt, Homo Sapiens; identical to SEQ ID NO: 154322

SEQ ID NO: 483827 - RNA, 64 nt, Homo Sapiens; identical to SEQ ID NO: 154323

SEQ ID NO: 483828 - RNA, 64 nt, Homo Sapiens; identical to SEQ ID NO: 154324

SEQ ID NO: 483829 - RNA, 64 nt, Homo Sapiens; identical to SEQ ID NO: 154325

SEQ ID NO: 483830 - RNA, 64 nt, Homo Sapiens; identical to SEQ ID NO: 154326

SEQ ID NO: 483831 - RNA, 64 nt, Homo Sapiens; identical to SEQ ID NO: 154327

SEQ ID NO: 483832 - RNA, 64 nt, Homo Sapiens; identical to SEQ ID NO: 154328

SEQ ID NO: 483833 - RNA, 64 nt, Homo Sapiens; identical to SEQ ID NO: 154329

SEQ ID NO: 483834 - RNA, 64 nt, Homo Sapiens; identical to SEQ ID NO: 154330

SEQ ID NO: 483835 - RNA, 64 nt, Homo Sapiens; identical to SEQ ID NO: 154331

SEQ ID NO: 483836 - RNA, 64 nt, Homo Sapiens; identical to SEQ ID NO: 154332

SEQ ID NO: 483837 - RNA, 64 nt, Homo Sapiens; identical to SEQ ID NO: 154333

SEQ ID NO: 483838 - RNA, 64 nt, Homo Sapiens; identical to SEQ ID NO: 154334

SEQ ID NO: 483839 - RNA, 64 nt, Homo Sapiens; identical to SEQ ID NO: 154335

SEQ ID NO: 483840 - RNA, 64 nt, Homo Sapiens; identical to SEQ ID NO: 154336

SEQ ID NO: 483841 - RNA, 64 nt, Homo Sapiens; identical to SEQ ID NO: 154337

SEQ ID NO: 483842 - RNA, 64 nt, Homo Sapiens; identical to SEQ ID NO: 154338

SEQ ID NO: 483843 - RNA, 64 nt, Homo Sapiens; identical to SEQ ID NO: 154339

SEQ ID NO: 483844 - RNA, 64 nt, Homo Sapiens; identical to SEQ ID NO: 154340

SEQ ID NO: 483845 - RNA, 64 nt, Homo Sapiens; identical to SEQ ID NO: 154341

SEQ ID NO: 483846 - RNA, 64 nt, Homo Sapiens; identical to SEQ ID NO: 154342

SEQ ID NO: 483847 - RNA, 64 nt, Homo Sapiens; identical to SEQ ID NO: 154343

SEQ ID NO: 483848 - RNA, 64 nt, Homo Sapiens; identical to SEQ ID NO: 154344

SEQ ID NO: 483849 - RNA, 64 nt, Homo Sapiens; identical to SEQ ID NO: 154345

SEQ ID NO: 483850 - RNA, 55 nt, Homo Sapiens; identical to SEQ ID NO: 154346

SEQ ID NO: 483851 - RNA, 64 nt, Homo Sapiens; identical to SEQ ID NO: 154347

SEQ ID NO: 483852 - RNA, 64 nt, Homo Sapiens; identical to SEQ ID NO: 154348

SEQ ID NO: 483853 - RNA, 64 nt, Homo Sapiens; identical to SEQ ID NO: 154349

SEQ ID NO: 483854 - RNA, 64 nt, Homo Sapiens; identical to SEQ ID NO: 154350

SEQ ID NO: 483855 - RNA, 64 nt, Homo Sapiens; identical to SEQ ID NO: 154351

SEQ ID NO: 483856 - RNA, 64 nt, Homo Sapiens; identical to SEQ ID NO: 154352

SEQ ID NO: 483857 - RNA, 64 nt, Homo Sapiens; identical to SEQ ID NO: 154353

SEQ ID NO: 483858 - RNA, 64 nt, Homo Sapiens; identical to SEQ ID NO: 154354

SEQ ID NO: 483859 - RNA, 64 nt, Homo Sapiens; identical to SEQ ID NO: 154355

SEQ ID NO: 483860 - RNA, 64 nt, Homo Sapiens; identical to SEQ ID NO: 154356

SEQ ID NO: 483861 - RNA, 64 nt, Homo Sapiens
auuucagggaaaugaagauggaauuugaaggucacuuuuaaaauuaagucauugaugcugcugu

SEQ ID NO: 483862 - RNA, 64 nt, Homo Sapiens
uugacuuaggucuuucaguuuuccuuucgguucccuuuuaaaaaugugauuguuaaccugccuc

SEQ ID NO: 483863 - RNA, 64 nt, Homo Sapiens
aucuucaaagguucaugcucaauauugugaaaagcuuuuaaaaguuguuuugaaaagacaauca

SEQ ID NO: 483864 - RNA, 64 nt, Homo Sapiens
cuuaauauaugcagaccaacaggucuuugcauuccuuuuaaauaacugguugugacaaagcuug

SEQ ID NO: 483865 - RNA, 64 nt, Homo Sapiens
gauuuuccucaucucuuuauagcuuucccaaaaucuuuuaaaaaagaauuuaauuaaaugacag

SEQ ID NO: 483866 - RNA, 64 nt, Homo Sapiens
caaaugggguaacgauauuuucugcauagauuuucuuuuaaauugguucuuuguuucugaagaa

SEQ ID NO: 483867 - RNA, 64 nt, Homo Sapiens
ugaaagaguucaguucuguaguaucugaauuugucuuuuaaaaugaguacauauauaggcaaua

SEQ ID NO: 483868 - RNA, 64 nt, Homo Sapiens
uuaaguaauuaaauuccuaugucaguugccaaaucuuuuaaacuuauguauucaccaagcccaa

SEQ ID NO: 483869 - RNA, 64 nt, Homo Sapiens
auauuuugucucucugacuugauuucuauaaaugcuuuuaaaaacaagugaagccccucuuuau

SEQ ID NO: 483870 - RNA, 64 nt, Homo Sapiens
gugagaggagucaagccaauauuaaauaugcauucuuuuaaaguaugugcaaucacuuuuagaa

SEQ ID NO: 483871 - RNA, 64 nt, Homo Sapiens
guaggggagccuccuucuagauguaggcauuuggcuuuuaaaggggaacucagcucugauucug

SEQ ID NO: 483872 - RNA, 64 nt, Homo Sapiens
aucaggguuaaaagcugcacugaccaaagcuguacuuuuaaaacacaaccccugggcuagugau

SEQ ID NO: 483873 - RNA, 64 nt, Homo Sapiens
uagcacaguaucaguaccauuuauuugucugccgcuuuuaaaaaauacccauuggcuaugccac

SEQ ID NO: 483874 - RNA, 64 nt, Homo Sapiens
ucccauuuucugaauuuuuuuuuaaauuuccccccuuuuaaaauuguucgaaagcccacaguua

SEQ ID NO: 483875 - RNA, 64 nt, Homo Sapiens
uguuuccuuuuauuuuauagagcagaacccuagucuuuuaaacaguuuagagugaaauauaugc

SEQ ID NO: 483876 - RNA, 64 nt, Homo Sapiens
ucagaauauacuaaauuaacuuuuuaaaacacaacuuuuaaaaaauguaucaaaauaauaaacg

SEQ ID NO: 483877 - RNA, 64 nt, Homo Sapiens
agaaaagaaaaauuuaaacggaguaagaccuuaucuuuuaaaaacuacuccagccugagcgaca

SEQ ID NO: 483878 - RNA, 64 nt, Homo Sapiens
ugcaugagcuagaauuuguuagucuuaaguuucucuuuuaaagcauucgugaaugucauauagu

SEQ ID NO: 483879 - RNA, 64 nt, Homo Sapiens
gguuucauuggauauaggcccacuccucauagagcuuuuaaaauguaauagacaucuaaaauuc

SEQ ID NO: 483880 - RNA, 58 nt, Homo Sapiens
acaaguguaauagacaucuagcauuuuucuuuuaaaaguugcucauucugaaauuuaa

SEQ ID NO: 483881 - RNA, 64 nt, Homo Sapiens
aaagaccugacuugcuuuuuagugccauacuuaacuuuuaaagguuuaccuuauuaaaaugaaa

SEQ ID NO: 483882 - RNA, 64 nt, Homo Sapiens
cuaaugucugggcuuugaguuggaaagcaaaccccuuuuaaaauaaauuuuguacaaucugucc

SEQ ID NO: 483883 - RNA, 64 nt, Homo Sapiens
uugguacuacuacuaaaucuucuguaucaguggacuuuuaaaacaguuuuauuaugcaguuaaa

SEQ ID NO: 483884 - RNA, 64 nt, Homo Sapiens
caacaccugaaaaucaugaguuucauugguaaaacuuuuaaauuauacuaauucauuuuaucac

SEQ ID NO: 483885 - RNA, 64 nt, Homo Sapiens
guauguuuguaugguagagacucaauaguguuggcuuuuaaaaccccugaagggcauaccuaac

SEQ ID NO: 483886 - RNA, 64 nt, Homo Sapiens
gaaauuaaaucagacaccacacugaaaaugaucucuuuuaaaaaaaaggguugaguaacuuaga

SEQ ID NO: 483887 - RNA, 64 nt, Homo Sapiens
uaacacacacaugaacugcauuuuaaagaaggcacuuuuaaaauuuuuuuaaaauuaaguaauu

SEQ ID NO: 483888 - RNA, 64 nt, Homo Sapiens
uucuaaucuauccccucuaacucaccccacccugcuuuuaaaaauauucuuuguaaaauucucc

SEQ ID NO: 483889 - RNA, 64 nt, Homo Sapiens
guuuugagggaucuguggaugccauaagacugaccuuuuaaaauugucucauuagccugaaugu

SEQ ID NO: 483890 - RNA, 64 nt, Homo Sapiens
uaguauacacuuauuuuaaggaaaaaaaaaggcccuuuuaaaaacucuuaagaagauuaaaaga

SEQ ID NO: 483891 - RNA, 64 nt, Homo Sapiens
aaaaugccaaauuuauuaagacuguuaaaacuuccuuuuaaaucguauaaaccuuuuuagugug

SEQ ID NO: 483892 - RNA, 64 nt, Homo Sapiens
uacauaucuuuaugauuuucgucuuucaaauugacuuuuaaaaagagguacuguuagucuguua

SEQ ID NO: 483893 - RNA, 64 nt, Homo Sapiens
uguggggcugcuauuuucuugguagagaugauagcuuuuaaauuuuggaugguuauaugcuaau

SEQ ID NO: 483894 - RNA, 64 nt, Homo Sapiens
caggcugaaacauuuuauuuaacauacaggcauucuuuuaaaaccuugaaaaaagccuuuugac

SEQ ID NO: 483895 - RNA, 64 nt, Homo Sapiens
cugucaggaucccacuguaaccucagcacugucacuuuuaaaaccaguguuaaugaauaucaug

SEQ ID NO: 483896 - RNA, 64 nt, Homo Sapiens
uccuuugccugcaugagguguuuaguuggaugugcuuuuaaaugucuaauccucccuuuuuuga

SEQ ID NO: 483897 - RNA, 64 nt, Homo Sapiens
caaaucuuggcagcuguccuuaccugagaggugucuuuuaaaaaagcuagcauacacuaccucu

SEQ ID NO: 483898 - RNA, 64 nt, Homo Sapiens
uaccuagcuacaacuuuuauaguaacaugauaaucuuuuaaauuugucauucaaaaaugaguua

SEQ ID NO: 483899 - RNA, 64 nt, Homo Sapiens
ccaagacuuuacuacuuaaagaugugaaaaacaccuuuuaaaguuuuuaaaguaaguuauauug

SEQ ID NO: 483900 - RNA, 64 nt, Homo Sapiens
aaguuauauaacuacauagauaauauauaugagacuuuuaaagauaaaaaguguguuugguuau

SEQ ID NO: 483901 - RNA, 64 nt, Homo Sapiens
uauaguaaaagucauauuuaauggauuguauugacuuuuaaaaauuacuuaaaguagcaaaguc

SEQ ID NO: 483902 - RNA, 64 nt, Homo Sapiens
caucagauaucgugagacuuugaaaagggaaacccuuuuaaaacaagagagaaugagaacuaag

SEQ ID NO: 483903 - RNA, 64 nt, Homo Sapiens
uuaaaaacuaaggaugauggauugcaaaacaguucuuuuaaauuaguuuauaugcuuuaggugu

SEQ ID NO: 483904 - RNA, 64 nt, Homo Sapiens
uuaacuagucauuugacuggaaaaaaauaaaauacuuuuaaauggacaugguuuuauuuuuaau

SEQ ID NO: 483905 - RNA, 64 nt, Homo Sapiens
gauauuuaucacaaucauccucauuauggaagaccuuuuaaagcauuguuuuagaaugucugag

SEQ ID NO: 483906 - RNA, 64 nt, Homo Sapiens
auaaugccuacuacuccgacuuuuauagaagcuacuuuuaaaucagaauauuuaauuuuugaua

SEQ ID NO: 483907 - RNA, 64 nt, Homo Sapiens
cccuucuuuugaaaauaaacugagucaauuuagccuuuuaaaaauauagucaucucuuuuaaau

SEQ ID NO: 483908 - RNA, 64 nt, Homo Sapiens
gagucaauuuagccuuuuaaaaauauagucaucucuuuuaaauagaauccucuuccaccaucaa

SEQ ID NO: 483909 - RNA, 64 nt, Homo Sapiens
gaaaaaagucucuccccaagggcagccuuuguuacuuuuaaauauuuucuguuauuacaagugc

SEQ ID NO: 483910 - RNA, 64 nt, Homo Sapiens
uauuuucuguuauuacaagugcucuaauugugaacuuuuaaauaaaauacuauuaagagguaau

SEQ ID NO: 483911 - RNA, 64 nt, Homo Sapiens
ugauuuugcagacucuggcauaaaaccucucuuacuuuuaaacuagugauggaaagucugguau

SEQ ID NO: 483912 - RNA, 64 nt, Homo Sapiens
uucacuaauauagcauugugucuugggcauuuaucuuuuaaaacucaaaaagcuuuaaauaaau

SEQ ID NO: 483913 - RNA, 64 nt, Homo Sapiens
uuuugaacucaguagaaaaagugguagccuccaucuuuuaaacuugaaguuuuuuuauauauuu

SEQ ID NO: 483914 - RNA, 64 nt, Homo Sapiens
ugcauuuuugcaaaacaagagugacuuuggaaaccuuuuaaaaaugagcacuaugauuaucaag

SEQ ID NO: 483915 - RNA, 64 nt, Homo Sapiens
auacaaugauauccaauauuauggcucucauguacuuuuaaauugcaagaacagaaguguucac

SEQ ID NO: 483916 - RNA, 64 nt, Homo Sapiens
gauuacguuuacauucuucuaucagauaauuaugcuuuuaaacucuccuuugauuagagaccag

SEQ ID NO: 483917 - RNA, 64 nt, Homo Sapiens
uucuccauucauauuuuuaugaguagaaucugggcuuuuaaauuucucuucuuauucuuugaag

SEQ ID NO: 483918 - RNA, 64 nt, Homo Sapiens
auggggucugugggcuaguuaaaauagaaauaaacuuuuaaaauauccacagaauugauauugu

SEQ ID NO: 483919 - RNA, 64 nt, Homo Sapiens
ucauugaauuguagguuuccuuuuuuuuucuuuacuuuuaaauuuuaacuuuuaaaaucuauuu

SEQ ID NO: 483920 - RNA, 64 nt, Homo Sapiens
guuuccuuuuuuuuucuuuacuuuuaaauuuuaacuuuuaaaaucuauuucauuucuuaguuau

SEQ ID NO: 483921 - RNA, 64 nt, Homo Sapiens
auuaacaaaaauugacaaaucuuccaagggacaucuuuuaaaacaagugcuucagauccagaaa

SEQ ID NO: 483922 - RNA, 64 nt, Homo Sapiens
uacagaaggguuugacguuuuauugggcuuuugucuuuuaaagaauaugucuacuauggguauu

SEQ ID NO: 483923 - RNA, 64 nt, Homo Sapiens
ugcacaagcugauuuuaagugauauucagauggccuuuuaaauuuaauuauuauguauuuaaaa

SEQ ID NO: 483924 - RNA, 64 nt, Homo Sapiens
aagugauaugaacugugauaaugcagaagguuuccuuuuaaaauaaaguucagucaaaaaagug

SEQ ID NO: 483925 - RNA, 64 nt, Homo Sapiens
uuuuugguuggcaguaaccgauuuuaaugacuagcuuuuaaaaauacaguacaaagacuuugua

SEQ ID NO: 483926 - RNA, 64 nt, Homo Sapiens
gaaaggagucuuuaucuuggggagcaaaagcugacuuuuaaacuugaccccugcuguuuuuaaa

SEQ ID NO: 483927 - RNA, 64 nt, Homo Sapiens
augaaaugugcguguugauagcaauaauuuguuucuuuuaaagauucuaaaaggucugagaccu

SEQ ID NO: 483928 - RNA, 64 nt, Homo Sapiens
cuuaaagaauuugcauccauuuuugagucuaaaucuuuuaaaauauacugagauccacaucuag

SEQ ID NO: 483929 - RNA, 64 nt, Homo Sapiens
auuuauuuuuuuuaaaguaucacuguaagcuauacuuuuaaaauggucuaaaauacuacauugu

SEQ ID NO: 483930 - RNA, 64 nt, Homo Sapiens
aaacuauuuaauguaaaauauuuaacaauccuagcuuuuaaaaguguuuaugaagagaguugag

SEQ ID NO: 483931 - RNA, 64 nt, Homo Sapiens
caacuguggcaccaauucuaugguuauuaaaaugcuuuuaaaguugcaaaaucuaagaguuggg

SEQ ID NO: 483932 - RNA, 64 nt, Homo Sapiens
cuucagacugucaagacgaccaauguaaaaccaucuuuuaaagcaucuguaauuuauuagcuaa

SEQ ID NO: 483933 - RNA, 64 nt, Homo Sapiens
ugacuauuguuuuguacaucuguguugggggguacuuuuaaagguauuucauucccaauuugug

SEQ ID NO: 483934 - RNA, 64 nt, Homo Sapiens
gcagcuuauuauucucaauugauaaaaauucgcucuuuuaaaguauucauaauguuaggaagau

SEQ ID NO: 483935 - RNA, 64 nt, Homo Sapiens
uuuuucuuuuuuguuguuguaaaauuggaagauucuuuuaaaaauuuuaaaaaaugcuaauaag

SEQ ID NO: 483936 - RNA, 64 nt, Homo Sapiens
augcuaauaagaaaauuggaagagaugguauuaccuuuuaaaaaagacuucggaaaauuaaguc

SEQ ID NO: 483937 - RNA, 64 nt, Homo Sapiens
acauaaaggaauaucuuuuuaagagcagcugccacuuuuaaacaugauuaaaauggaauaaaga

SEQ ID NO: 483938 - RNA, 64 nt, Homo Sapiens
aaaaauucuuuaaaauauuuuauauuuuuuucaccuuuuaaacagagugaaucaguuucuuguu

SEQ ID NO: 483939 - RNA, 64 nt, Homo Sapiens
auaucguguauauagcuuuaacacaguguacauucuuuuaaauucaucuauuuuguguacuugu

SEQ ID NO: 483940 - RNA, 64 nt, Homo Sapiens
uaguuuugcuguugcuccuaauuugaaauuuguccuuuuaaagaaucauguaggccauuuuuau

SEQ ID NO: 483941 - RNA, 64 nt, Homo Sapiens
accagcucagugcugguuuacggaacaacucuuacuuuuaaaaauuacuuguucccccaaauug

SEQ ID NO: 483942 - RNA, 64 nt, Homo Sapiens
auuaauuccaucugagugauugucaguguaaggccuuuuaaaacaaaagcaaguucuuuguuag

SEQ ID NO: 483943 - RNA, 64 nt, Homo Sapiens
uuugacuuacaacacacuucucuaacaucuagcccuuuuaaauuuuuaauuaauuucaaagcuu

SEQ ID NO: 483944 - RNA, 64 nt, Homo Sapiens
cuuuugccuuagugugaaaauguaacauuuuaugcuuuuaaaaucaauagauucaucaccuuag

SEQ ID NO: 483945 - RNA, 64 nt, Homo Sapiens
gaaugcauucauuuuuuggacauugcuuacuuaucuuuuaaauguuucuuuuauuacaaagccu

SEQ ID NO: 483946 - RNA, 64 nt, Homo Sapiens
auguuucuuuuauuacaaagccuauuuugaguagcuuuuaaaacugaauuuccuuuaauugguu

SEQ ID NO: 483947 - RNA, 64 nt, Homo Sapiens
auguauuuuaaaauaaggggaagagucauuuucacuuuuaaacuacuauuuuucuuuccaaguc

SEQ ID NO: 483948 - RNA, 64 nt, Homo Sapiens
uguaauaaucauuuuagaauuaaaauuuauucuacuuuuaaauaaauuaugaauauuaaaggug

SEQ ID NO: 483949 - RNA, 64 nt, Homo Sapiens
gugauuuuuaguaaccuuuaaaaauguauaaugacuuuuaaaauuuguagaauugaaaagacgc

SEQ ID NO: 483950 - RNA, 64 nt, Homo Sapiens
accaacauuuauaccugaccagauggcuaaagugcuuuuaaaguuuuguuuaaguagagcugga

SEQ ID NO: 483951 - RNA, 64 nt, Homo Sapiens
cagauucuuuauuuucccaaacacuacaaaaaaacuuuuaaaacuuugccauuucaucuguuua

SEQ ID NO: 483952 - RNA, 64 nt, Homo Sapiens
auuucuauuuuuuuauugucuaaguggguugggacuuuuaaauacugagccugguugauguguu

SEQ ID NO: 483953 - RNA, 64 nt, Homo Sapiens
aagaauuuaugggagccuauauaaacauaucuugcuuuuaaaaaguucuugagggaauagcaac

SEQ ID NO: 483954 - RNA, 64 nt, Homo Sapiens
gcaacuuucccauggcugugccuauuuccuagaccuuuuaaaagaugugcagagcagcuuagca

SEQ ID NO: 483955 - RNA, 64 nt, Homo Sapiens
gguauuuuuaaauuguuuuuaaucuuuuuuggugcuuuuaaacauguuuagcaaaaaccaauuc

SEQ ID NO: 483956 - RNA, 64 nt, Homo Sapiens
cuagaaaguaugguuuaacuggacccuauuaugccuuuuaaaaauaauuucaguaacccauaaa

SEQ ID NO: 483957 - RNA, 64 nt, Homo Sapiens
guaaauauuaauaaauggauacacauucaaaauacuuuuaaaaaaaagaaaauguuaccaguuu

SEQ ID NO: 483958 - RNA, 64 nt, Homo Sapiens
ugguugaauuuuuggauauauuauguugauuuaacuuuuaaaauguuguuuaaaagugugaagc

SEQ ID NO: 483959 - RNA, 64 nt, Homo Sapiens
uuuaauuguguaguuuccauuucuuagcuuuugccuuuuaaauuuauacuucagccaggcauag

SEQ ID NO: 483960 - RNA, 64 nt, Homo Sapiens
cuguacuccagacuggauaacagcaagagcccaucuuuuaaaaaaaguaaaaauuaaaaauaua

SEQ ID NO: 483961 - RNA, 64 nt, Homo Sapiens
uaauaaaaggaagaugaguauaaaacuugcgugucuuuuaaaaaacugaaguuggcauguuucg

SEQ ID NO: 483962 - RNA, 64 nt, Homo Sapiens
aauaauucagaugagacugaaauucaaaccaacacuuuuaaaaaacuuaguuuuuucauuuaau

SEQ ID NO: 483963 - RNA, 64 nt, Homo Sapiens
uaauacagacuuaucuccucauuaccuuuucucacuuuuaaaacuggcuuuuccauguuguuuu

SEQ ID NO: 483964 - RNA, 64 nt, Homo Sapiens
acccaucuugcuuucuuuuuuuuccccacauuggcuuuuaaaauaugggcauuaucauuggaug

SEQ ID NO: 483965 - RNA, 64 nt, Homo Sapiens
uuuugaccauuuuguuaugaugccuauuguguaucuuuuaaagggcauugcugagcuuuuuaga

SEQ ID NO: 483966 - RNA, 64 nt, Homo Sapiens
gaaaaugugacacuugugaauuggaaauccuucccuuuuaaagauuaagcuauuucaccuuugu

SEQ ID NO: 483967 - RNA, 64 nt, Homo Sapiens
uugauuuuauaugcuauuuaacugccaucauuuacuuuuaaacuuuaucuuuuuaguauggcaa

SEQ ID NO: 483968 - RNA, 64 nt, Homo Sapiens
uuccgacacaacuuccauuaauaugggaugaacacuuuuaaacuccucuuuguaauaggaaacu

SEQ ID NO: 483969 - RNA, 64 nt, Homo Sapiens
uguauguggacugcuguuugcauaaacagggccccuuuuaaacuccaccucaguguuguuccua

SEQ ID NO: 483970 - RNA, 64 nt, Homo Sapiens
uguuaauacuucauaauaugugaaaaacucggaucuuuuaaaaagcaucauagaucauuuuucc

SEQ ID NO: 483971 - RNA, 64 nt, Homo Sapiens
uagccuaaccuucaacauaaaauaaugaagagaacuuuuaaacuuuuuuaugaauuccuaaaca

SEQ ID NO: 483972 - RNA, 64 nt, Homo Sapiens
caaagggauuaaagaccuaaauaugaagacaaaacuuuuaaaugagaaucuauaagguuauuuu

SEQ ID NO: 483973 - RNA, 64 nt, Homo Sapiens
auauuugagagcugacuacaaacauuaaaucgcacuuuuaaagugagucauugaaauaaauagu

SEQ ID NO: 483974 - RNA, 64 nt, Homo Sapiens
aauuuauuuuuauauggaauugcauaaugugugccuuuuaaaacaauaacaaaaaccagagaug

SEQ ID NO: 483975 - RNA, 64 nt, Homo Sapiens
gcuaaauuagaauuucuaacucuuauauugugcucuuuuaaaugccaauuacagucccuuacug

SEQ ID NO: 483976 - RNA, 64 nt, Homo Sapiens
ccuauuuaauuggguuccacugaaccucaugggacuuuuaaaagaagggcuauuuaaggaauuc

SEQ ID NO: 483977 - RNA, 64 nt, Homo Sapiens
uuuaaggaauucacuugguaguacuuugcuuuagcuuuuaaauggcuugauuuuaaaggagaaa

SEQ ID NO: 483978 - RNA, 64 nt, Homo Sapiens
aaacaacuuuauaagagaaacaguggucuucaaucuuuuaaagacaugaaauccuauauggcau

SEQ ID NO: 483979 - RNA, 64 nt, Homo Sapiens
ccuuuuuggugagaagaaauaagacauuuucucccuuuuaaagaucaucucuucagagcugcau

SEQ ID NO: 483980 - RNA, 64 nt, Homo Sapiens
cuucaaaaaauuauuuuaggcaaaguccauacuccuuuuaaaacaauauuuauguccuauguuu

SEQ ID NO: 483981 - RNA, 64 nt, Homo Sapiens
guagcauucugugcgaaaaaguauugaagauuagcuuuuaaaaacugaaaaaaaaaaaugaaug

SEQ ID NO: 483982 - RNA, 64 nt, Homo Sapiens
ugcugucuaauauucaaacauagaaagggagcugcuuuuaaagaauucccugcaaauacugaaa

SEQ ID NO: 483983 - RNA, 64 nt, Homo Sapiens
uucuaauuggaauguucauuugccucuuuuuacucuuuuaaaugcuuguagguggcuuggggug

SEQ ID NO: 483984 - RNA, 64 nt, Homo Sapiens
uugauguuaaguguuugauucagagaugucugcucuuuuaaauuauauauaaggaaaaaaaaua

SEQ ID NO: 483985 - RNA, 64 nt, Homo Sapiens
uuguuaauuuuguaaacuuucaauuaaauaggaccuuuuaaaaagggggaagaaaaggaggaac

SEQ ID NO: 483986 - RNA, 64 nt, Homo Sapiens
gauucagugcauagaaaacuauuugauuauguaucuuuuaaauuauaugcacacauugcuacuu

SEQ ID NO: 483987 - RNA, 64 nt, Homo Sapiens
ucuguaguguaugguaagucgccuccauaucccccuuuuaaaauggcgugagccaccgcacccg

SEQ ID NO: 483988 - RNA, 64 nt, Homo Sapiens
ccuuaggauauucuauaugagaaugaggaggcaucuuuuaaaagcacaauaauguaaaugcaga

SEQ ID NO: 483989 - RNA, 64 nt, Homo Sapiens
gauuaggauuauugaaauguaauguauaugaauccuuuuaaaauacaccugcucuuuaugugaa

SEQ ID NO: 483990 - RNA, 64 nt, Homo Sapiens
gugucagccauauguaugggaaaauaaaauuaaucuuuuaaaauuccccccagauuugggggac

SEQ ID NO: 483991 - RNA, 64 nt, Homo Sapiens
aaagaaauguguuuuuaucgcaccaugacuguggcuuuuaaaauggucaacagcaaaaugccug

SEQ ID NO: 483992 - RNA, 64 nt, Homo Sapiens
gaaaaacugaugauuagauuuaagcgcuugccuucuuuuaaaaaaauucaucauggauaaaaac

SEQ ID NO: 483993 - RNA, 64 nt, Homo Sapiens
ucgugauugguuaguccauacuuaaauguucauucuuuuaaauccaaagaacuagagaagaaau

SEQ ID NO: 483994 - RNA, 64 nt, Homo Sapiens
aaucugugaaauuaacaugcaaaauauuaagaaucuuuuaaaaaauguguauuucuaauuauau

SEQ ID NO: 483995 - RNA, 64 nt, Homo Sapiens
gccucagugauacaguauaaguuuuguaaaaguacuuuuaaauuaaaaaaaagucagguacucu

SEQ ID NO: 483996 - RNA, 64 nt, Homo Sapiens
auuaagcuuuaaagugcuagagccucaaaacauacuuuuaaagcgauccauaaacuuuuaaaga

SEQ ID NO: 483997 - RNA, 64 nt, Homo Sapiens
agccucaaaacauacuuuuagcaagauccauaaacuuuuaaagaggcuccgacuccagcucugg

SEQ ID NO: 483998 - RNA, 64 nt, Homo Sapiens
gggaauaauuuguauguaucuauuuuuauucuggcuuuuaaaauguacuucugugguuaaugua

SEQ ID NO: 483999 - RNA, 64 nt, Homo Sapiens
uuuuaauauucucugaucuuuaccagauauuauacuuuuaaauauaguuuuugaguuauuuaug

SEQ ID NO: 484000 - RNA, 64 nt, Homo Sapiens
agcaagaagaaaaacucagagaauauaaaaucaacuuuuaaaauugugugcucucuucuucacg

SEQ ID NO: 484001 - RNA, 64 nt, Homo Sapiens
acuaaccgugacuacaacaaaaauucuugauugacuuuuaaaguuauuuccuggcauucuggua

SEQ ID NO: 484002 - RNA, 64 nt, Homo Sapiens
uggugggguuaauauagcauguuauccugucuaucuuuuaaagauuucuguauaagacuguuga

SEQ ID NO: 484003 - RNA, 64 nt, Homo Sapiens
uuaauuuuuuauauuuaaauguagacuuuugacacuuuuaaaaaacaaaaaaagacaagagaga

SEQ ID NO: 484004 - RNA, 64 nt, Homo Sapiens
gagcugaucugcaucuguuuauccauuuuaguagcuuuuaaauaugauuuuaugugaagugcca

SEQ ID NO: 484005 - RNA, 64 nt, Homo Sapiens
ggaaugagugugguaagaaauuuauaaaguuuugcuuuuaaaacguggacauaacucauuuuuc

SEQ ID NO: 484006 - RNA, 64 nt, Homo Sapiens
uugauacaauagaagcugacuuuuaaggcauuggcuuuuaaauuaauacauauauccaaggaua

SEQ ID NO: 484007 - RNA, 64 nt, Homo Sapiens
guuuuuaacuacucagacuuuugaggaauuaauccuuuuaaaacauuuuuguuaaaguuagugu

SEQ ID NO: 484008 - RNA, 64 nt, Homo Sapiens
ucuccccagaggaacuuagggauuucaccccuggcuuuuaaaaaaaacgaaauaccgacaagcc

SEQ ID NO: 484009 - RNA, 64 nt, Homo Sapiens
gcuucagagucaucucuguccugcccgggaugcacuuuuaaaugaagaguuagaauauuuuauu

SEQ ID NO: 484010 - RNA, 64 nt, Homo Sapiens
uauauagaaaagcuacaaaguaaauugagcaaugcuuuuaaaguuaucuuuguuuuauagacuu

SEQ ID NO: 484011 - RNA, 64 nt, Homo Sapiens
acaauuaaucuacaaagggaauuaauauuguugacuuuuaaaacaucugcuggauauauuauau

SEQ ID NO: 484012 - RNA, 64 nt, Homo Sapiens
aguggguucuuuuuaauguuuauacuuagauuuucuuuuaaaaaaauuaaaauaaaacaaaaaa

SEQ ID NO: 484013 - RNA, 64 nt, Homo Sapiens
ucuauucuuuuuuuugcauccaauugugccugaacuuuuaaaauauguaaaugcugccauguuc

SEQ ID NO: 484014 - RNA, 64 nt, Homo Sapiens
guuuaaaaccacaaucuguaggcuuuaagaauugcuuuuaaaccuuuuuaagugauaaacucuu

SEQ ID NO: 484015 - RNA, 64 nt, Homo Sapiens
guuauuuucauuaauaacuuuugcuaaaauuuaccuuuuaaaaguucugaaauuugggguuggu

SEQ ID NO: 484016 - RNA, 64 nt, Homo Sapiens
ggaaauccaaauugaauuuucacuuaccucagaucuuuuaaaguagggauacagagauggaugc

SEQ ID NO: 484017 - RNA, 64 nt, Homo Sapiens
accuugcgauuugcacauaucuuuuuaagaugaacuuuuaaagacauuuuuguccaguguuuuu

SEQ ID NO: 484018 - RNA, 64 nt, Homo Sapiens
uaaaaucugaggaguguacagaaaaugaaaacuccuuuuaaaaaaaauccugaguuuccauaag

SEQ ID NO: 484019 - RNA, 64 nt, Homo Sapiens
aucuggauguuuuuuauuuaauguuucagcugugcuuuuaaaaacucuuuguauauuuguacaa

SEQ ID NO: 484020 - RNA, 64 nt, Homo Sapiens
aagaacacuuucugcucauaugaccucuccucuucuuuuaaaaaucuauuguugccuuuccaag

SEQ ID NO: 484021 - RNA, 64 nt, Homo Sapiens
cugccucuggguuuuuguuuuuuaaacaguuccacuuuuaaaacaaaaaaaaaaggcuuuucuu

SEQ ID NO: 484022 - RNA, 64 nt, Homo Sapiens
agugccagaugccccagugcaggcagagacaucucuuuuaaaaaguuccagauuguucaucuag

SEQ ID NO: 484023 - RNA, 64 nt, Homo Sapiens
aauuguuuuacugagccuucuuuuuauuagucagcuuuuaaaguaagaguucuuucacuuaccc

SEQ ID NO: 484024 - RNA, 64 nt, Homo Sapiens
aaagagcaguguucuccauuugaaaauuaaucugcuuuuaaaauagguuacucaaguagaagcc

SEQ ID NO: 484025 - RNA, 64 nt, Homo Sapiens
acuacguuuucacagacaauagguaaaaaugcaccuuuuaaagcaugaacugauuuagcaacac

SEQ ID NO: 484026 - RNA, 64 nt, Homo Sapiens
cuuuuuucaaucucauaaaaaagggauagugcaucuuuuaaaauacauuuuauuuggggaggaa

SEQ ID NO: 484027 - RNA, 64 nt, Homo Sapiens
cuuaaauaaucuuagaauuaauugauaaaugucucuuuuaaaaucuacuguauuuauuauaauu

SEQ ID NO: 484028 - RNA, 64 nt, Homo Sapiens
cacaugcaucuaaacugcugggcaauccaguugacuuuuaaauguaagaauggaauuccaaaca

SEQ ID NO: 484029 - RNA, 64 nt, Homo Sapiens
aguaaaucuauggauaugguauuuugugaaugaucuuuuaaauaaaagaaaaccuuacguaaua

SEQ ID NO: 484030 - RNA, 64 nt, Homo Sapiens
cuaagugcuagaauuuauaguuacaggcgguguccuuuuaaauguggaaaggcuuuuaaaauau

SEQ ID NO: 484031 - RNA, 64 nt, Homo Sapiens
aguuacaggcgguguccuuuuaaauguggaaaggcuuuuaaaauauuuuaaaacuggaccugua

SEQ ID NO: 484032 - RNA, 64 nt, Homo Sapiens
ugaucauugacaugugauuucaaaacacaguguucuuuuaaaaaucuauaauaugucaaaauac

SEQ ID NO: 484033 - RNA, 64 nt, Homo Sapiens
aguagcaaguuaaacuucacuauaaggucacaugcuuuuaaaauccucucacaucuuacagauc

SEQ ID NO: 484034 - RNA, 64 nt, Homo Sapiens
uaugauuagacuucguuaguaucacuguuuaccccuuuuaaagaacuccaauucaguaaauggu

SEQ ID NO: 484035 - RNA, 64 nt, Homo Sapiens
uugaaauuuuaaaauauggauauauauuauguaucuuuuaaaaauguuuauaauuauuaggaau

SEQ ID NO: 484036 - RNA, 64 nt, Homo Sapiens
uauuuaauuuguuugaacaauucuuuuuaauuuucuuuuaaacuuuucuacuggaaagauuuuu

SEQ ID NO: 484037 - RNA, 64 nt, Homo Sapiens
uuucuccguugcaaagaauguuuuuaaagcuuuucuuuuaaauuguagaauuuuuaaacagauu

SEQ ID NO: 484038 - RNA, 64 nt, Homo Sapiens
uuuuaagaacuugauccauucagcaucauuuauucuuuuaaaaugauccucagguccagaauuc

SEQ ID NO: 484039 - RNA, 64 nt, Homo Sapiens
aagggggugauucugaggcagcugccuccauucucuuuuaaaaagaggugcuuggccuccagua

SEQ ID NO: 484040 - RNA, 64 nt, Homo Sapiens
uugugagguagauuggagugagguacacguuguccuuuuaaaggcccagccuauaaaaaaagga

SEQ ID NO: 484041 - RNA, 64 nt, Homo Sapiens
uccaauuuauaaucaagaaggggcucuggauccccuuuuaaauuacacacacucucacacacau

SEQ ID NO: 484042 - RNA, 64 nt, Homo Sapiens
gugcaaucuuuagccccagggaggucaauaaugucuuuuaaagccagaagucacauuuuaccaa

SEQ ID NO: 484043 - RNA, 64 nt, Homo Sapiens
gauuauuuguaagaccuucaccaaguucugauaucuuuuaaagacauaguucaaaauugcuuuu

SEQ ID NO: 484044 - RNA, 64 nt, Homo Sapiens
aaauuauguuuucuuuaaguguuuaugguaaacucuuuuaaagaaaauuuaauauguuauagcu

SEQ ID NO: 484045 - RNA, 64 nt, Homo Sapiens
aagcauuuagugcucaguccugcucuuuacauuucuuuuaaaauggguagccugaauugcuuuc

SEQ ID NO: 484046 - RNA, 64 nt, Homo Sapiens
uuuguguuccuuuuugcagcuucuuccuucccuccuuuuaaaauuauccugaaaggcaacauaa

SEQ ID NO: 484047 - RNA, 64 nt, Homo Sapiens
gguaugccaacuuaaguauuauuccuuuuuauuccuuuuaaaauugaaaauaucagcuuuucuu

SEQ ID NO: 484048 - RNA, 64 nt, Homo Sapiens
uuuaguauucgucauuagcaacauuggaggagaucuuuuaaaugagccuacugagauccaugug

SEQ ID NO: 484049 - RNA, 64 nt, Homo Sapiens
gagcuuuggaaccauuugugaaaauagaaacuagcuuuuaaacuaauuuucauuaagccaguau

SEQ ID NO: 484050 - RNA, 64 nt, Homo Sapiens
aacauauucucaguugauccaauauuuaaaauugcuuuuaaauauguuaauuucuacuuuuuuu

SEQ ID NO: 484051 - RNA, 64 nt, Homo Sapiens
auuauucaagaugaauuuaauggacaaauuuaaacuuuuaaaaguauuuucuuaguuuuguucu

SEQ ID NO: 484052 - RNA, 64 nt, Homo Sapiens
uguacuuaaaaugcauagcauuauuaaaaacaaucuuuuaaaauauaauuuauaacauagauug

SEQ ID NO: 484053 - RNA, 64 nt, Homo Sapiens
ugcuuacucuacaguuauucaaaugagagucacgcuuuuaaauuuacagcucaucacagaaauc

SEQ ID NO: 484054 - RNA, 64 nt, Homo Sapiens
guuucccuucauaaaauguaauguacauuguaaucuuuuaaaagaaaaaucaggguugcacuug

SEQ ID NO: 484055 - RNA, 64 nt, Homo Sapiens
ucuuuuaaaagaaaaaucaggguugcacuugcaacuuuuaaaaaaccgaguguggaaacauugg

SEQ ID NO: 484056 - RNA, 64 nt, Homo Sapiens
ugcugcaacguuuuuaaaaauaaaauaaccuuuccuuuuaaauguuucuuuuucaaauccaauu

SEQ ID NO: 484057 - RNA, 64 nt, Homo Sapiens
guaaccaaaucuaaauuuaaauuuaaaauuuucacuuuuaaacaaugguaaauuucagauguuu

SEQ ID NO: 484058 - RNA, 64 nt, Homo Sapiens
accauaauuccauuuuuuccgagacuauggacugcuuuuaaacuucagcauguuugugauggau

SEQ ID NO: 484059 - RNA, 64 nt, Homo Sapiens
auuuugugugguuuggugcacuacacuaacuagacuuuuaaaagcucuggaguguccauuuaga

SEQ ID NO: 484060 - RNA, 64 nt, Homo Sapiens
uaucuucaaucagcuguuggucaagacuaacuuucuuuuaaagguucauuuguaugauaaauuc

SEQ ID NO: 484061 - RNA, 64 nt, Homo Sapiens
aacaauauguggggagagcacucgguugucuuuacuuuuaaaaguaauacuuggugcuaagaau

SEQ ID NO: 484062 - RNA, 64 nt, Homo Sapiens
ccuugaagaauaucuaagcuuuuucugagaugggcuuuuaaaauuauaauaagggaaguuuauu

SEQ ID NO: 484063 - RNA, 64 nt, Homo Sapiens
agaccugaagauuguaauauucaugucugugaagcuuuuaaacauuacacuugagaucagucau

SEQ ID NO: 484064 - RNA, 64 nt, Homo Sapiens
ugaauauauuuuuuucuuuaaauaggaacaaccucuuuuaaaagagaaaaauuauuucagugau

SEQ ID NO: 484065 - RNA, 64 nt, Homo Sapiens
ucucaaaugcuggguugaaaaauguuuugaaagccuuuuaaaauauauaucuuuauaaaguaau

SEQ ID NO: 484066 - RNA, 64 nt, Homo Sapiens
auaaggcaucuuuuuauccuuaaguguaauauuccuuuuaaauugguuguuaauauuuguauug

SEQ ID NO: 484067 - RNA, 64 nt, Homo Sapiens
gcacaaguuaucaggcaacacuacauauaugaagcuuuuaaaaaaaaaggaaaccugcaaaugu

SEQ ID NO: 484068 - RNA, 64 nt, Homo Sapiens
gaugugaauauauguggaaagugcccccugacuucuuuuaaaugauccuccuuaacugucugca

SEQ ID NO: 484069 - RNA, 64 nt, Homo Sapiens
ccugggauaaauuuuagaauuuuauaggccugaccuuuuaaauuucuauuguuuaacucacuag

SEQ ID NO: 484070 - RNA, 64 nt, Homo Sapiens
cauauugguaaaugauacccagcuuagcaaaauacuuuuaaaaauugcccugaguauuaaagcu

SEQ ID NO: 484071 - RNA, 64 nt, Homo Sapiens
ccuuucagguaguuacaucacuuuuucauuaauacuuuuaaauaaauacaggcuuucuagagau

SEQ ID NO: 484072 - RNA, 64 nt, Homo Sapiens
cuuaaacuuuucaauaaaauauacuacuuuguaacuuuuaaagugguuaauauaggcagggcga

SEQ ID NO: 484073 - RNA, 64 nt, Homo Sapiens
ucacugauguguaaaaagguuugucucuuuaagucuuuuaaauaccagugucucaaccauagua

SEQ ID NO: 484074 - RNA, 64 nt, Homo Sapiens
cagugauuuggaugaaggcacuuauucaacuuuacuuuuaaaaugauauuucauagggcccugu

SEQ ID NO: 484075 - RNA, 64 nt, Homo Sapiens
ugcuuuucauguugaaaaucacccuaaauguucccuuuuaaaucagaaugcauuaagugugguu

SEQ ID NO: 484076 - RNA, 64 nt, Homo Sapiens
uucuucaagaaaauccaggcuaggaaaaucaguucuuuuaaaauaaaaggggccucaaugauga

SEQ ID NO: 484077 - RNA, 64 nt, Homo Sapiens
caguucugcauccaacuugaugcuuuccuuguaucuuuuaaacuagcucccacuaaugaaaccc

SEQ ID NO: 484078 - RNA, 64 nt, Homo Sapiens
ucugcaacuccaaaguagacagacauguuuuucucuuuuaaaucuucaauaauaggcuaaggaa

SEQ ID NO: 484079 - RNA, 64 nt, Homo Sapiens
ugaugcauaucauuuuucuauaaguaaucaguugcuuuuaaaaucagaaggcuauauuauucua

SEQ ID NO: 484080 - RNA, 64 nt, Homo Sapiens
uguucuccucccuuuauaaauuuuauucauaggacuuuuaaaaggcuugugcuaucuuuccagu

SEQ ID NO: 484081 - RNA, 64 nt, Homo Sapiens
cuuccauguugaagccagauuuucuguaguaaaacuuuuaaauauuauuuuaaaagaaauaugu

SEQ ID NO: 484082 - RNA, 64 nt, Homo Sapiens
uugugguaauacccagaaugaugcuaugcuucuacuuuuaaaauuuuuuuaaaauaacuggcaa

SEQ ID NO: 484083 - RNA, 64 nt, Homo Sapiens
cuauucauuuuuauuuaaauaucuuuugugauuucuuuuaaauagcaaaacagguucagauuuc

SEQ ID NO: 484084 - RNA, 64 nt, Homo Sapiens
uuugaauugacaguuacauguuacacaagcaaaacuuuuaaauauacuagcccuuuuuauauau

SEQ ID NO: 484085 - RNA, 64 nt, Homo Sapiens
uuguucuuguccaaaguugcgaaauuccaacugacuuuuaaacuccuuggucuuuuaauuaaaa

SEQ ID NO: 484086 - RNA, 64 nt, Homo Sapiens
uggugacacucuuaucguaauuaaauuccucugacuuuuaaaaaucuguccucuugccuuuuac

SEQ ID NO: 484087 - RNA, 64 nt, Homo Sapiens
gcccuugugucucccagugaguuuuggggacagacuuuuaaaaucucugguuggaaaugccauu

SEQ ID NO: 484088 - RNA, 64 nt, Homo Sapiens
uaacaaguccuguucuguuuuuuguucacaaccucuuuuaaaucuugguuuuugaauuguugau

SEQ ID NO: 484089 - RNA, 64 nt, Homo Sapiens
uaaaacaucagauuaaauaauuacacuguucaggcuuuuaaaaaaauaccacugugagaauaaa

SEQ ID NO: 484090 - RNA, 64 nt, Homo Sapiens
aagguauguaaguuauuaaaugguuaaucauggccuuuuaaaaauaaaauaaagugauaccuuu

SEQ ID NO: 484091 - RNA, 64 nt, Homo Sapiens
gaucucagaagucuguagaugguuucaaaauuaccuuuuaaaaucugacaguuccaucuuggaa

SEQ ID NO: 484092 - RNA, 64 nt, Homo Sapiens
agaacuuguaagacauuaugagauggacauugugcuuuuaaacugaauuuggcaggaauuccca

SEQ ID NO: 484093 - RNA, 64 nt, Homo Sapiens
cagaguaaguauguucuuacagauacuuguaagacuuuuaaaauaagguucuaaacuguguuac

SEQ ID NO: 484094 - RNA, 64 nt, Homo Sapiens
aagauacuuaauauuuuuaaaaaauauuucucuacuuuuaaaacgaaauagaaauaguucuuua

SEQ ID NO: 484095 - RNA, 64 nt, Homo Sapiens
uuuucuaaauaagauaauucucauuuguguuugucuuuuaaaaggccaauaaaauaucuuucag

SEQ ID NO: 484096 - RNA, 64 nt, Homo Sapiens
uugaauaccaacauuuaaaaugaugguauuuuaucuuuuaaacuuaaaaauuauuuaauacagc

SEQ ID NO: 484097 - RNA, 64 nt, Homo Sapiens
auacugcagaauauaguguaucaaaaacuuuuuucuuuuaaauuauuaaagugucuuuuauacu

SEQ ID NO: 484098 - RNA, 64 nt, Homo Sapiens
uuuuuuuuucuuuugauguugcaacuuuuggguucuuuuaaacugugauagugaugguaacuga

SEQ ID NO: 484099 - RNA, 64 nt, Homo Sapiens
uuuuucuuuuugauacuccagguuuauaaacuaucuuuuaaaauuuuaagccaggacuucaaaa

SEQ ID NO: 484100 - RNA, 64 nt, Homo Sapiens
gcaaacauuuacauuuguuuuuuacaauaaauuucuuuuaaaauauacuuucuauuuuucugua

SEQ ID NO: 484101 - RNA, 64 nt, Homo Sapiens
aaagaaauaaguaguuucauuuuccuuuuauuaacuuuuaaaauucuuccuaaaaauugagagg

SEQ ID NO: 484102 - RNA, 64 nt, Homo Sapiens
uuuguauuugauaacauccucuuuaauggucaagcuuuuaaaaagucucauuaggcaauuuaug

SEQ ID NO: 484103 - RNA, 64 nt, Homo Sapiens
gaaaauuauuacauccuuuauuuaaaauauaauacuuuuaaaaauggcacaugugccagcugaa

SEQ ID NO: 484104 - RNA, 64 nt, Homo Sapiens
aagcuuaaauuacucaauuuacuguaaaacagaacuuuuaaaugauauaaaggaagaauaaguc

SEQ ID NO: 484105 - RNA, 64 nt, Homo Sapiens
ugacauaguuagauuauuuaauaaguugcuuugacuuuuaaaaauauuguaacuuucauuagaa

SEQ ID NO: 484106 - RNA, 64 nt, Homo Sapiens
caugaaaaagcauuaaccuuaauacauuuagaaacuuuuaaaguuuuuacuuagauacuaauaa

SEQ ID NO: 484107 - RNA, 64 nt, Homo Sapiens
auauauauacaugcacacacaccgauacauuuaccuuuuaaaaaaaugauuuauaagugaacug

SEQ ID NO: 484108 - RNA, 64 nt, Homo Sapiens
cauguuuuauuggaaaugcacgugguuucuuaggcuuuuaaacaaauacauggaaugguugaaa

SEQ ID NO: 484109 - RNA, 64 nt, Homo Sapiens
ggcccacaaugcuccaauuuccuacuccucuuuucuuuuaaaaggaagcaccugggugugccua

SEQ ID NO: 484110 - RNA, 64 nt, Homo Sapiens
ggacaaugaaggugacugugcauacuguuccagacuuuuaaaggguaauuuauuuguuuugcua

SEQ ID NO: 484111 - RNA, 64 nt, Homo Sapiens
cauuaaauguaaacuuaaaaagcuuuuaaaagaccuuuuaaagacaauuuauaauagaacuuau

SEQ ID NO: 484112 - RNA, 64 nt, Homo Sapiens
accuuuuaaagacauuaaauaauagaacuuauagcuuuuaaaaguaauuuaguuggcaauuuau

SEQ ID NO: 484113 - RNA, 64 nt, Homo Sapiens
ugaaauuucuaucauguaccccuccaucuuuaaacuuuuaaauggcgugagccaccacacccag

SEQ ID NO: 484114 - RNA, 64 nt, Homo Sapiens
uguuuuauauauuuaggggguucuuccuuuuuuucuuuuaaaaauuguugcauguaugaauagu

SEQ ID NO: 484115 - RNA, 64 nt, Homo Sapiens
gauuuaauguaccuuuuuguacuguaagcuuguccuuuuaaaggcuggagcucguaauuuuuua

SEQ ID NO: 484116 - RNA, 64 nt, Homo Sapiens
uguuuacuuuuucauuccuucaacacucaaaugacuuuuaaaguguaauuucuugugaagaagc

SEQ ID NO: 484117 - RNA, 64 nt, Homo Sapiens
auaauuuggggggagggguggaggggaagcauaucuuuuaaauuaugacucgcaagcaauguua

SEQ ID NO: 484118 - RNA, 64 nt, Homo Sapiens
aagcuagcuaauucuuguuuucugauuuaaagcacuuuuaaaucuuauccugcccccuaaaaac

SEQ ID NO: 484119 - RNA, 64 nt, Homo Sapiens
cccugaauuaaguguuaauuugauggaaacucugcuuuuaaaaucaucauuuacuggguucuaa

SEQ ID NO: 484120 - RNA, 64 nt, Homo Sapiens
uuuucauuagauugguuguaccaugucaccuuagcuuuuaaaaauacucuuuucagauucacgu

SEQ ID NO: 484121 - RNA, 64 nt, Homo Sapiens
uucaagaucaauaugucuaauaagugcugguguccuuuuaaaguauuuaaauauauauguugcu

SEQ ID NO: 484122 - RNA, 64 nt, Homo Sapiens
cauccuuaucuuuguuccucuuuacauaauguuccuuuuaaaaaaaaucacugauuaugaugug

SEQ ID NO: 484123 - RNA, 64 nt, Homo Sapiens
gaaguugucucacagcucacuuguauucuguugacuuuuaaaaaauuaugcuuucuguuucacu

SEQ ID NO: 484124 - RNA, 64 nt, Homo Sapiens
uuuugggucuuuuuauauauguucugugucuaaccuuuuaaaaccuggaacacagauauaacaa

SEQ ID NO: 484125 - RNA, 64 nt, Homo Sapiens
gcuccuguuuuuggaaaguauguuaugugguuuucuuuuaaaaaucccagcgccuuuuaaaagu

SEQ ID NO: 484126 - RNA, 64 nt, Homo Sapiens
uuguuaugugguuuucuuuuaggaaucccagcgccuuuuaaaagcagcauugaucuagaagcag

SEQ ID NO: 484127 - RNA, 64 nt, Homo Sapiens
acuguuuacuaugaagacaaacuauuucuuaugccuuuuaaaauuaauuuguauuaaauuuauu

SEQ ID NO: 484128 - RNA, 64 nt, Homo Sapiens
auguguugcauuuacacagucuuauuuuuaaucacuuuuaaauauugaagaaauaguacgacaa

SEQ ID NO: 484129 - RNA, 64 nt, Homo Sapiens
ccucaucuguuguacugaacuugacguuggagaccuuuuaaaugcagagaugaguuaguguuuc

SEQ ID NO: 484130 - RNA, 64 nt, Homo Sapiens
ucaacuuaauuuuuucuaaguaaaaaucaaaauucuuuuaaauaaaaucguuguggaaggugau

SEQ ID NO: 484131 - RNA, 64 nt, Homo Sapiens
aaacuguuuucuuuuggaaccuuuuaaauguagacuuuuaaaaugaaaccagacaaagcauuga

SEQ ID NO: 484132 - RNA, 64 nt, Homo Sapiens
uagacuuuuaaaauaaacugagacaaagcauugacuuuuaaaugcaacagcccuaugggaaacc

SEQ ID NO: 484133 - RNA, 64 nt, Homo Sapiens
acuucaugauuuugcauccaauucgugucugugccuuuuaaagggugaggucugugucacuuug

SEQ ID NO: 484134 - RNA, 64 nt, Homo Sapiens
agccaccgugcccagccaagaauuuuuauuuuugcuuuuaaauagcaaaagaagaagauucugu

SEQ ID NO: 484135 - RNA, 64 nt, Homo Sapiens
aaguaauaauaauugguguuuuuuuuuaaaggagcuuuuaaacagugaaaugcaaaugugcaau

SEQ ID NO: 484136 - RNA, 64 nt, Homo Sapiens
aagccagugacucccaguucuuuguuccccaaaucuuuuaaauggauuuuuacaagucagauuu

SEQ ID NO: 484137 - RNA, 64 nt, Homo Sapiens
uguccaacacuaaugguuuauauaugaaaauagacuuuuaaaaccuccuuguuugucccauuca

SEQ ID NO: 484138 - RNA, 64 nt, Homo Sapiens
acgaaucucaugaauauucaugagaaauuggucucuuuuaaaagggaauagccuuuccucaguc

SEQ ID NO: 484139 - RNA, 64 nt, Homo Sapiens
ugcagugccagaggggccucuggagcaggccuggcuuuuaaauggggggcugaauuccagcuca

SEQ ID NO: 484140 - RNA, 64 nt, Homo Sapiens
auacauuucuuguaaaaccuggcuuguugcuuggcuuuuaaagaugguguauguuuguaaaaau

SEQ ID NO: 484141 - RNA, 64 nt, Homo Sapiens
agcaucauacucaccgagucuagucaguguagugcuuuuaaaaauuuuguccuuucauguaacu

SEQ ID NO: 484142 - RNA, 64 nt, Homo Sapiens
agauucccuguuggauuuacuucggauuuauucccuuuuaaagaauuuuugcccauaucuggaa

SEQ ID NO: 484143 - RNA, 64 nt, Homo Sapiens
ugggucucaaccccuccccaccugcugucccccacuuuuaaagaccaguuucccauccuuuguc

SEQ ID NO: 484144 - RNA, 64 nt, Homo Sapiens
gucuauagauugggguagagcacuuuaaccauuucuuuuaaaagggcauucaugcagagcaaag

SEQ ID NO: 484145 - RNA, 64 nt, Homo Sapiens
gccccccguauguuuuaagaguaaugguagugggcuuuuaaacucccuaccucugccaaggcaa

SEQ ID NO: 484146 - RNA, 64 nt, Homo Sapiens
agcacuaaauaacuugggggauuguggccccagacuuuuaaaacuugugaggggaagagacugc

SEQ ID NO: 484147 - RNA, 64 nt, Homo Sapiens
auggaguguaguaguaguguguacagguagaaaacuuuuaaauacagcaugcagguguuucagu

SEQ ID NO: 484148 - RNA, 64 nt, Homo Sapiens
auugcuuaauguuuuaagcuuaauagccuuugcacuuuuaaaauaaaaaccaaguaugcaaauc

SEQ ID NO: 484149 - RNA, 64 nt, Homo Sapiens
guaaguuaaguuguaaagacuuuggaauaaguuucuuuuaaaaauaugacauagccagugaugu

SEQ ID NO: 484150 - RNA, 64 nt, Homo Sapiens
aaauaacucuaaugaauauucaagauauuuuagccuuuuaaaaaguugagauuuagcucaugga

SEQ ID NO: 484151 - RNA, 64 nt, Homo Sapiens
cuuucuuauaauauguuguaguuacuagugaauucuuuuaaaagcaauaccuagaguuagaaca

SEQ ID NO: 484152 - RNA, 64 nt, Homo Sapiens
ccgugguauacagcuccugugacauuugaaguuucuuuuaaagggguuuuucuuaaucaaaguu

SEQ ID NO: 484153 - RNA, 64 nt, Homo Sapiens
guuuauauguugaaaaacugcauagugcccucuacuuuuaaagguuugauacuugucuauccuu

SEQ ID NO: 484154 - RNA, 64 nt, Homo Sapiens
aaauggcaacuuggcacaccucauucugguuucacuuuuaaaaucuccuagauucauuauucuu

SEQ ID NO: 484155 - RNA, 64 nt, Homo Sapiens
aaggaggcuguaguagaagcaccauuugcauacucuuuuaaauccaugcuggcugggguuagug

SEQ ID NO: 484156 - RNA, 64 nt, Homo Sapiens
aaauuuuagaggaaaauuaaaaugauauauuucacuuuuaaagguuuuuuuuccucuauuuauc

SEQ ID NO: 484157 - RNA, 64 nt, Homo Sapiens
augcaccguguuugccuguuaaaaauauauuuggcuuuuaaaguuauuauaagcaugaucuuuu

SEQ ID NO: 484158 - RNA, 64 nt, Homo Sapiens
uauauuuggcuuuuaaaguaauuauaagcaugaucuuuuaaaaaccuuaauguguaauuuacuu

SEQ ID NO: 484159 - RNA, 64 nt, Homo Sapiens
caauauaauguuaauauuacaaauauauuaauuucuuuuaaacuuaaaaccuuagacugauuuu

SEQ ID NO: 484160 - RNA, 64 nt, Homo Sapiens
gagaaaacugugucacucuuuuagaaauuagccacuuuuaaaaucugcauaaccaguauuagca

SEQ ID NO: 484161 - RNA, 64 nt, Homo Sapiens
cuuugucagauaauuucacuuuuuuauaaugucucuuuuaaaguugccuggccucauuugagua

SEQ ID NO: 484162 - RNA, 64 nt, Homo Sapiens
uuggucacuguauguaucagagugcauucaccaccuuuuaaauuuuaucugugucgucccacug

SEQ ID NO: 484163 - RNA, 64 nt, Homo Sapiens
gaaaccucuuacaugugauuugaauaguggaauucuuuuaaaugagaauagaugaaaauuuuga

SEQ ID NO: 484164 - RNA, 64 nt, Homo Sapiens
uuuuccaaccauugcuugauagguaguaauauuccuuuuaaauuuccucaagaaugucugaaga

SEQ ID NO: 484165 - RNA, 64 nt, Homo Sapiens
uagacauucgucaucaguuguucuugaacauggucuuuuaaaaacuagucagaugaauuguuuu

SEQ ID NO: 484166 - RNA, 64 nt, Homo Sapiens
uguuuugaaauggagaggaaaauuggcaccucaucuuuuaaaggcaguaauggaauugauuuuc

SEQ ID NO: 484167 - RNA, 64 nt, Homo Sapiens
aguacucaguuuucagguucuuccuagcucggggcuuuuaaauuuugaaaucuaaacauucuuu

SEQ ID NO: 484168 - RNA, 64 nt, Homo Sapiens
uccccgguuauugauguacuagauuuguguaugucuuuuaaacaguucuaguuucaccuuacac

SEQ ID NO: 484169 - RNA, 64 nt, Homo Sapiens
cucccaauagcuuucaauuguucuuucuggaagacuuuuaaaaaaauauaaauaugcauauaua

SEQ ID NO: 484170 - RNA, 64 nt, Homo Sapiens
gccagaaauuuauaccauuuaaaacucaguaagucuuuuaaauaucaggaaggagagaagcgac

SEQ ID NO: 484171 - RNA, 64 nt, Homo Sapiens
cccaggaauucauuaauaaucauccuuggcuuuccuuuuaaaggcuauuuugaaauggucuuuu

SEQ ID NO: 484172 - RNA, 64 nt, Homo Sapiens
aaugaaauagauguaaggaaggagggauuuaaaccuuuuaaaaaacuuuugcugacuuauauua

SEQ ID NO: 484173 - RNA, 64 nt, Homo Sapiens
ucuuuauaaugcaguggcaaaagguucugaaagccuuuuaaacucgaaccagugggggaaagau

SEQ ID NO: 484174 - RNA, 64 nt, Homo Sapiens
uauuuuuuaacaaucuucaauaauguaaagauuacuuuuaaaauauuuaaguuaaaacuacuug

SEQ ID NO: 484175 - RNA, 64 nt, Homo Sapiens
guacagaauaauugugcuugauugcugaauaaaacuuuuaaaaaauaugaaaaauuauggucuu

SEQ ID NO: 484176 - RNA, 64 nt, Homo Sapiens
uccacaaauuuuucauacuccuacauguauucagcuuuuaaaacguaugugccuugauccaacg

SEQ ID NO: 484177 - RNA, 64 nt, Homo Sapiens
cauaaaugcauuauaggauccuugugucucugugcuuuuaaaugaacaacuucauauaugagga

SEQ ID NO: 484178 - RNA, 64 nt, Homo Sapiens
gugagccugaauuuuguugcgguauuuaucuuuacuuuuaaacaauagaaauuacacccaaaga

SEQ ID NO: 484179 - RNA, 64 nt, Homo Sapiens
aaguauuuccuauuaaacuaacaaaggggucagucuuuuaaaauuccuacaaaucagcguaguu

SEQ ID NO: 484180 - RNA, 64 nt, Homo Sapiens
ugaauaaaauuucuguauacaaaguccucauuuucuuuuaaaauuauaggguaaagcuuugucu

SEQ ID NO: 484181 - RNA, 64 nt, Homo Sapiens
uaaaugucuccuucuguguuaacuuuuuagcucucuuuuaaaaagaaauaaggagaaaccccau

SEQ ID NO: 484182 - RNA, 64 nt, Homo Sapiens
uacuaauaguccggccaggcaauauuuuaagugccuuuuaaaaauuugaguuggauuggaaagg

SEQ ID NO: 484183 - RNA, 64 nt, Homo Sapiens
auaccaacauuaugaaauuuugaaccucccgugccuuuuaaaaaguuauauauuuaauauuaag

SEQ ID NO: 484184 - RNA, 64 nt, Homo Sapiens
guuuugaacuguauuuacaugacaaauauuuauacuuuuaaauugcacuggaggaaaaauaauu

SEQ ID NO: 484185 - RNA, 64 nt, Homo Sapiens
agcaaaacaguuauuucucuggaaaagcuucagacuuuuaaacucauuaacagcuggggaggag

SEQ ID NO: 484186 - RNA, 64 nt, Homo Sapiens
uaaagaauucacacaacuacuuaaucgucaaccacuuuuaaacaaagggucuuaaagaauuuuu

SEQ ID NO: 484187 - RNA, 64 nt, Homo Sapiens
agucauuuuucuugaucguuacuauauaaauaagcuuuuaaacaaugacaaucuuauugucaac

SEQ ID NO: 484188 - RNA, 64 nt, Homo Sapiens
ugaaauaaccagcuccauuccuuuuugcuuugcccuuuuaaagcuuaaauggcuagaaaauggu

SEQ ID NO: 484189 - RNA, 64 nt, Homo Sapiens
gcuagaaaauggucuuuuugaauuuuuugaguaacuuuuaaaugccuuuccacuccauuguauc

SEQ ID NO: 484190 - RNA, 64 nt, Homo Sapiens
gugcacuaacaaaaugcuauagucagagcauuuucuuuuaaauuaaccucuaggaccagagcau

SEQ ID NO: 484191 - RNA, 64 nt, Homo Sapiens
ucuuuagggagagagggauggagguuuuguuuuccuuuuaaaaucaucuguaagaucuauacuc

SEQ ID NO: 484192 - RNA, 64 nt, Homo Sapiens
uuucuuaaguuggaacaggucauuuucuuuugugcuuuuaaaugcaaagagggauugcccugca

SEQ ID NO: 484193 - RNA, 64 nt, Homo Sapiens
gcuuaaaauggcauucucuagcaaagagauuagacuuuuaaauaacucuuauaaaacagguugg

SEQ ID NO: 484194 - RNA, 64 nt, Homo Sapiens
agcaaaaaguagaaguaucaaauaaaaagggcaacuuuuaaaauauuaagccugaagacuucua

SEQ ID NO: 484195 - RNA, 64 nt, Homo Sapiens
ugcacaaaaagauaccuuaaaauuugaaacauugcuuuuaaaacuacuuagcacuucagggcag

SEQ ID NO: 484196 - RNA, 64 nt, Homo Sapiens
caaacugcacaugauuucacaaauauuaaaaagucuuuuaaaaaguauugccaaacauuaaugu

SEQ ID NO: 484197 - RNA, 64 nt, Homo Sapiens
aaauugauguugaugcaauccuuacaaaugauugcuuuuaaaauuuuaagcuaggaaaagaaau

SEQ ID NO: 484198 - RNA, 64 nt, Homo Sapiens
uucaggcccugaacaggaaauuuaugacauccaucuuuuaaauuagaaauacugugcugaaagu

SEQ ID NO: 484199 - RNA, 64 nt, Homo Sapiens
uugguguuuucuuuuucuuagugauggcaaaaggcuuuuaaaagugcaaauugcuaugugugug

SEQ ID NO: 484200 - RNA, 64 nt, Homo Sapiens
uaacuuuucuaguuuuuaagcuucuggaacuuggcuuuuaaauuuuauuuucuaccuggauaaa

SEQ ID NO: 484201 - RNA, 64 nt, Homo Sapiens
aacuuuuuaucuucugucuuuaacuuaaaaacagcuuuuaaaacaugucuuuauaagguucacu

SEQ ID NO: 484202 - RNA, 64 nt, Homo Sapiens
cauguaucuugauuguugauguagcuugagcuuucuuuuaaaaugucuuuuuuugaaauaaaaa

SEQ ID NO: 484203 - RNA, 64 nt, Homo Sapiens
guuuucccuuuucugaucugcucuccuucagugccuuuuaaaagcuacugaauuucugucuugc

SEQ ID NO: 484204 - RNA, 64 nt, Homo Sapiens
auuaaagcuucuaugaguaugggucaaauuggagcuuuuaaagaguguucauuacauuccccaa

SEQ ID NO: 484205 - RNA, 64 nt, Homo Sapiens
guauuauuugaagaguauuuugaaacuuaaucaucuuuuaaaauauuuaugcuauuuaauuuug

SEQ ID NO: 484206 - RNA, 64 nt, Homo Sapiens
agggcauguucaguuuucuguuguaaauagucugcuuuuaaagguucaugcuauucagaaucac

SEQ ID NO: 484207 - RNA, 64 nt, Homo Sapiens
acaaagcaugguuuguggcucugaccagguucaccuuuuaaacgcagugucuucuagaaggugc

SEQ ID NO: 484208 - RNA, 64 nt, Homo Sapiens
cuaagcuuccauagaaauacacuuuguaucuggaccucaaaauuaugggaacauuuacuuaaac

SEQ ID NO: 484209 - RNA, 64 nt, Homo Sapiens
aauuaugauaaaggacaaaauaagcuguuugccaccucaaaacuuuaugaacuucaccaccacu

SEQ ID NO: 484210 - RNA, 64 nt, Homo Sapiens
uaacgguugcaccuccaaguaaccccugacugcuccucaaaagcggaagagagacugaagucac

SEQ ID NO: 484211 - RNA, 64 nt, Homo Sapiens
ugauucagaaacugacuugggaaucauuucuccuccucaaaaacgcugccuauaaaucuuggag

SEQ ID NO: 484212 - RNA, 64 nt, Homo Sapiens
acccuugacgucaagucuccuggcccgucauguuccucaaaagccaaaguuggggcaggcuggc

SEQ ID NO: 484213 - RNA, 64 nt, Homo Sapiens
aaaugagaucccgccucuucaggaacacccgacuccucaaaagcgacaacaugcgaccgugacc

SEQ ID NO: 484214 - RNA, 64 nt, Homo Sapiens
uauaauacuugucuuucucuccucucccuccaucccucaaaagaucuuuaugcauuucccacua

SEQ ID NO: 484215 - RNA, 64 nt, Homo Sapiens
gagugaggggcauagugaaaaaggaacagccaugccucaaaaucaaaucauuugcauucccaca

SEQ ID NO: 484216 - RNA, 64 nt, Homo Sapiens
gguuguggcuccuguugaauaguuguugguuguuccucaaaacaugaacuuccaguaggcccac

SEQ ID NO: 484217 - RNA, 64 nt, Homo Sapiens
caugcccauugucuucagguugguccuuuucacuccucaaaaugguuugccauggagcacuaga

SEQ ID NO: 484218 - RNA, 64 nt, Homo Sapiens
aaaaaaaaaagaguuaaucuagagugaaacuccaccucaaaaaagcacuccagccugggcgaca

SEQ ID NO: 484219 - RNA, 64 nt, Homo Sapiens
cagaacguggccgggcgugguuuuguuucuggauccucaaaacuagaagugucgcuuuccagcc

SEQ ID NO: 484220 - RNA, 64 nt, Homo Sapiens
cuguggcacaugccuguauuacugaaagcuaaauccucaaaaccuaguaaggggacuaaugauu

SEQ ID NO: 484221 - RNA, 64 nt, Homo Sapiens
aaaugagcauguaauaauacaagaacuguuucccccucaaaaccugaaccugaauuauuuguaa

SEQ ID NO: 484222 - RNA, 64 nt, Homo Sapiens
aagaaauauauccuaugcagcaaauuugacucugccucaaaaaauuguguacaauuuggggccu

SEQ ID NO: 484223 - RNA, 64 nt, Homo Sapiens
uucagcuccgugugugagauagacacacacaaguccucaaaaguucagccucucacccacuccc

SEQ ID NO: 484224 - RNA, 64 nt, Homo Sapiens
ucucugaguguuuagggaaauagcuucuuuaaaaccucaaaaccaugaccauccugucaaagac

SEQ ID NO: 484225 - RNA, 64 nt, Homo Sapiens
ugcauuccagccugggugacagagugagacucccccucaaaaaaaaaaaaaaaaaaaaaaaaaa

SEQ ID NO: 484226 - RNA, 64 nt, Homo Sapiens
auacauacacacacacacauacaguauauucuuuccucaaaaggguuaagaugucuaaaauagg

SEQ ID NO: 484227 - RNA, 64 nt, Homo Sapiens
aucucuagaugcaaauacauugaguuuaaaagugccucaaaauaauugagaucacauuucagga

SEQ ID NO: 484228 - RNA, 64 nt, Homo Sapiens
uguacgaaucacggcuguuggacaucucgguaucaccguugaugaacucauugguuucacaagu

SEQ ID NO: 484229 - RNA, 64 nt, Homo Sapiens
cgcuguggcagaccuguggguaaaaguaccccauaccguugacgcaccgaagucaacuugacug

SEQ ID NO: 484230 - RNA, 64 nt, Homo Sapiens
uugauaaaaagaaaguuuauuaaguguuguauguaccguugaugcguccaacauuccuuguuug

SEQ ID NO: 484231 - RNA, 64 nt, Homo Sapiens
cccugcagaaggugcaaugugucagggcuuugccaccguugaaguuagugcaaauaugacccug

SEQ ID NO: 484232 - RNA, 64 nt, Homo Sapiens
uguccuuuguuuuuguguguggaccucaguaggcaccguugaggaaacugaaacccucuuucca

SEQ ID NO: 484233 - RNA, 64 nt, Homo Sapiens
ugugaagucuacuuuaguauuccuguaauacuaaaccguugaguuucuaaauauuuauuuauuc

SEQ ID NO: 484234 - RNA, 64 nt, Homo Sapiens
agaucaauuucagcuacaauuggauuuaugacguaccguugagaccuucaaugcuugacuugaa

SEQ ID NO: 484235 - RNA, 64 nt, Homo Sapiens
agaaggcugaguuuacauaaugcaauuugagaacaccguugacaauuuuugagguuugcacuca

SEQ ID NO: 484236 - RNA, 64 nt, Homo Sapiens
aagaccuaaggagcuguccaggcugagucaguugaccguugagggagagagaaagcacggcuga

SEQ ID NO: 484237 - RNA, 64 nt, Homo Sapiens
agggaagaaaggcugagucuaaaggauaagugcuaccguugagaaguucucugacuguguuggg

SEQ ID NO: 484238 - RNA, 64 nt, Homo Sapiens
caucuugauuugguugguuuugggaggaagaaucaccguugacgguuuaaaaagggaaacaaug

SEQ ID NO: 484239 - RNA, 64 nt, Homo Sapiens
ggcauagaauugacucuguuaguggucuccagcaaccguugaaacugcuggcuuugcaaauaga

SEQ ID NO: 484240 - RNA, 64 nt, Homo Sapiens
auauauaaagaaugagucucuaacgauucaaauuaccguugaguugaguguuucucaggauucc

SEQ ID NO: 484241 - RNA, 64 nt, Homo Sapiens
acaggccgcagcuccauuuucuuauugcgcugcuaccguugacuuccaggcacgguuuggaaau

SEQ ID NO: 484242 - RNA, 64 nt, Homo Sapiens
auucuacauagacaaucauguaacuuuuuguaagaccguugagucacucacuuauuaauucuag

SEQ ID NO: 484243 - RNA, 64 nt, Homo Sapiens
uugcagugagccgagaucacgaucagaaaaaagcaccguugaggcagcauuugagcucagcuau

SEQ ID NO: 484244 - RNA, 64 nt, Homo Sapiens
cucguagcacucaauuuaguaacuucuagaugcuaccguugaccugaguuaaauucauuuaguc

SEQ ID NO: 484245 - RNA, 64 nt, Homo Sapiens
gccaauguuaugccagcuccauguucucccaaauaccguugaugugaauuauuuuaaaggcaaa

SEQ ID NO: 484246 - RNA, 64 nt, Homo Sapiens
caggaugacgugcagaaaaaugggugaaggauaaaccguugagacguggccccacugguaggau

SEQ ID NO: 484247 - RNA, 64 nt, Homo Sapiens
agaaucauuaaagaaaaagaaaaaagauuuuaagaccguugaaaucaauuaucaagaacguccu

SEQ ID NO: 484248 - RNA, 64 nt, Homo Sapiens
uuauuugggggaguuuucccgccggguuucucggaccguugacucccguucuggcagcgcaccg

SEQ ID NO: 484249 - RNA, 64 nt, Homo Sapiens
uacauuuuuuacuuuagauugccuucccuaggaaaccguugauuccccuuuacauucccuccuu

SEQ ID NO: 484250 - RNA, 64 nt, Homo Sapiens
ucacuaccaccuggaguuuguuguggaaugagggaccguugagcgaugaauuugcugucauguu

SEQ ID NO: 484251 - RNA, 64 nt, Homo Sapiens
caguauaguuuaaaaaucugggugguuuaccugcaccguugacuacucuaggacugggcccgag

SEQ ID NO: 484252 - RNA, 64 nt, Homo Sapiens
ggcagaaagagccaggagaaagcagggugguggcaccguugaaaaaguguucagagcagacaga

SEQ ID NO: 484253 - RNA, 60 nt, Homo Sapiens
ucuucuccuggauccaguaagaguuucggcaccguugacgaacugcagcgaucuuacugg

SEQ ID NO: 484254 - RNA, 64 nt, Homo Sapiens; identical to SEQ ID NO: 183939

SEQ ID NO: 484255 - RNA, 64 nt, Homo Sapiens; identical to SEQ ID NO: 183940

SEQ ID NO: 484256 - RNA, 64 nt, Homo Sapiens; identical to SEQ ID NO: 183941

SEQ ID NO: 484257 - RNA, 64 nt, Homo Sapiens; identical to SEQ ID NO: 183942

SEQ ID NO: 484258 - RNA, 64 nt, Homo Sapiens; identical to SEQ ID NO: 183943

SEQ ID NO: 484259 - RNA, 64 nt, Homo Sapiens; identical to SEQ ID NO: 183944

SEQ ID NO: 484260 - RNA, 64 nt, Homo Sapiens; identical to SEQ ID NO: 183945

SEQ ID NO: 484261 - RNA, 64 nt, Homo Sapiens; identical to SEQ ID NO: 183946

SEQ ID NO: 484262 - RNA, 64 nt, Homo Sapiens; identical to SEQ ID NO: 183947

SEQ ID NO: 484263 - RNA, 64 nt, Homo Sapiens; identical to SEQ ID NO: 183948

SEQ ID NO: 484264 - RNA, 64 nt, Homo Sapiens; identical to SEQ ID NO: 183949

SEQ ID NO: 484265 - RNA, 64 nt, Homo Sapiens; identical to SEQ ID NO: 183950

SEQ ID NO: 484266 - RNA, 64 nt, Homo Sapiens; identical to SEQ ID NO: 183951

SEQ ID NO: 484267 - RNA, 64 nt, Homo Sapiens; identical to SEQ ID NO: 183952

SEQ ID NO: 484268 - RNA, 64 nt, Homo Sapiens; identical to SEQ ID NO: 183953

SEQ ID NO: 484269 - RNA, 64 nt, Homo Sapiens; identical to SEQ ID NO: 183954

SEQ ID NO: 484270 - RNA, 64 nt, Homo Sapiens; identical to SEQ ID NO: 183955

SEQ ID NO: 484271 - RNA, 64 nt, Homo Sapiens; identical to SEQ ID NO: 183956

SEQ ID NO: 484272 - RNA, 64 nt, Homo Sapiens; identical to SEQ ID NO: 183957

SEQ ID NO: 484273 - RNA, 64 nt, Homo Sapiens; identical to SEQ ID NO: 183958

SEQ ID NO: 484274 - RNA, 64 nt, Homo Sapiens; identical to SEQ ID NO: 183959

SEQ ID NO: 484275 - RNA, 64 nt, Homo Sapiens; identical to SEQ ID NO: 183960

SEQ ID NO: 484276 - RNA, 64 nt, Homo Sapiens; identical to SEQ ID NO: 183961

SEQ ID NO: 484277 - RNA, 64 nt, Homo Sapiens; identical to SEQ ID NO: 183962

SEQ ID NO: 484278 - RNA, 64 nt, Homo Sapiens; identical to SEQ ID NO: 183963

SEQ ID NO: 484279 - RNA, 64 nt, Homo Sapiens; identical to SEQ ID NO: 183964

SEQ ID NO: 484280 - RNA, 64 nt, Homo Sapiens; identical to SEQ ID NO: 183965

SEQ ID NO: 484281 - RNA, 64 nt, Homo Sapiens; identical to SEQ ID NO: 183966

SEQ ID NO: 484282 - RNA, 64 nt, Homo Sapiens; identical to SEQ ID NO: 293061

SEQ ID NO: 484283 - RNA, 64 nt, Homo Sapiens; identical to SEQ ID NO: 293062

SEQ ID NO: 484284 - RNA, 64 nt, Homo Sapiens; identical to SEQ ID NO: 293063

SEQ ID NO: 484285 - RNA, 64 nt, Homo Sapiens; identical to SEQ ID NO: 293064

SEQ ID NO: 484286 - RNA, 64 nt, Homo Sapiens; identical to SEQ ID NO: 293065

SEQ ID NO: 484287 - RNA, 64 nt, Homo Sapiens; identical to SEQ ID NO: 293066

SEQ ID NO: 484288 - RNA, 64 nt, Homo Sapiens; identical to SEQ ID NO: 293067

SEQ ID NO: 484289 - RNA, 64 nt, Homo Sapiens; identical to SEQ ID NO: 293068

SEQ ID NO: 484290 - RNA, 64 nt, Homo Sapiens; identical to SEQ ID NO: 293069

SEQ ID NO: 484291 - RNA, 64 nt, Homo Sapiens; identical to SEQ ID NO: 293070

SEQ ID NO: 484292 - RNA, 64 nt, Homo Sapiens
ugaaauugagcacaccugccagguugaaucaaggugaaucaaucuaaaaucaguggaaaagggc

SEQ ID NO: 484293 - RNA, 64 nt, Homo Sapiens
ugaaucaaucugaaauugagggaaaagggcagguugaaucaaggaaacugguuuuaaaaucagu

SEQ ID NO: 484294 - RNA, 64 nt, Homo Sapiens
ugacaucuaaccaagacugugucaacaauauugcugaaucaaugguuuuguccaguuuauuggc

SEQ ID NO: 484295 - RNA, 64 nt, Homo Sapiens
cacauuuguuccuuuauaucuguuuacaaaacugugaaucaaaaagacaaaacuuucuuccuag

SEQ ID NO: 484296 - RNA, 64 nt, Homo Sapiens
ugucuagacauauuugcauaaugucagggcugagugaaucaaagucuccuacuuugaaaacuga

SEQ ID NO: 484297 - RNA, 64 nt, Homo Sapiens
acacuguauguucaguagguacaaaauaacauucugaaucaagcagguuaaaauuuuaauuucu

SEQ ID NO: 484298 - RNA, 64 nt, Homo Sapiens
gucuuuaaauaaaauuuuaaguccaaggcaggccugaaucaacuaaguuaaagacuucuuucca

SEQ ID NO: 484299 - RNA, 64 nt, Homo Sapiens
aagcagggcccugucuuaugacuuugguggaagaugaaucaaggagugaaaaccuccuguuuag

SEQ ID NO: 484300 - RNA, 64 nt, Homo Sapiens
ccgaaaaaacaugaaauuuuucauuaaaaugccaugaaucaagccagggccguuggcuuaugcc

SEQ ID NO: 484301 - RNA, 64 nt, Homo Sapiens
agacccagccucaaaaaaaaaaaaaaaaaagugaugaaucaaaauuagaaauuaagaguuuuaa

SEQ ID NO: 484302 - RNA, 64 nt, Homo Sapiens
uuuuuuaaguguaaucagaagacacugccuggccugaaucaaccuguugggauuacaggcauga

SEQ ID NO: 484303 - RNA, 64 nt, Homo Sapiens
uuuuuuuuuuuuucggacagacguaagcaaacacugaaucaacuguagggaguuuccaccuugu

SEQ ID NO: 484304 - RNA, 64 nt, Homo Sapiens
uggcagugauggggaaagcuuuuucugaagcugccuucaccacugccuaccuguucacuucaga

SEQ ID NO: 484305 - RNA, 64 nt, Homo Sapiens
aagccacugagucugcccugggcucugauaaaaccuucaccauuaacuugcugugugaccuugg

SEQ ID NO: 484306 - RNA, 64 nt, Homo Sapiens
gucacaggaagaaccugccauaucgaggcacauacuucaccacuaccacgguaauggacagagu

SEQ ID NO: 484307 - RNA, 64 nt, Homo Sapiens
gucacaggaagcacuugccauaucgaggcacauacuucaccaccaccauggaaauggacagagu

SEQ ID NO: 484308 - RNA, 64 nt, Homo Sapiens
uuuaagugcacaguucaguaauaaaacauacugucuucaccauuuaaauugucguaaaauacuc

SEQ ID NO: 484309 - RNA, 64 nt, Homo Sapiens
ugcugaagaaaagugucuucuagaaacuaaacaucuucaccaggagguggaucuuggaaagcac

SEQ ID NO: 484310 - RNA, 64 nt, Homo Sapiens
cucuugcuuccuaaugcucucugagaaaugucagcuucaccacguauuuuaaaugucaaugugc

SEQ ID NO: 484311 - RNA, 64 nt, Homo Sapiens
uuugcauuugucugcaucaguucuccgucacccucuucaccaucugucggccggcacacuggcc

SEQ ID NO: 484312 - RNA, 64 nt, Homo Sapiens
accugccucugagaccucgcgucucccagagaugcuucaccagccguagagucacucccugccc

SEQ ID NO: 484313 - RNA, 64 nt, Homo Sapiens
ggaaucacucuuguggauguuucagcuucuucaucuucaccagagaccccgcgaccucuccauc

SEQ ID NO: 484314 - RNA, 64 nt, Homo Sapiens
uauaugccuuacuauuguaucacaacauaucagacuucaccaaacuucaguuuuacugcauuuu

SEQ ID NO: 484315 - RNA, 64 nt, Homo Sapiens
uguccauugcguuauuuucuaccugaguucacagcuucaccacuuguuccugauaauugugcac

SEQ ID NO: 484316 - RNA, 64 nt, Homo Sapiens; identical to SEQ ID NO: 72506

SEQ ID NO: 484317 - RNA, 64 nt, Homo Sapiens; identical to SEQ ID NO: 72507

SEQ ID NO: 484318 - RNA, 64 nt, Homo Sapiens; identical to SEQ ID NO: 72508

SEQ ID NO: 484319 - RNA, 64 nt, Homo Sapiens; identical to SEQ ID NO: 72509

SEQ ID NO: 484320 - RNA, 64 nt, Homo Sapiens; identical to SEQ ID NO: 72510

SEQ ID NO: 484321 - RNA, 64 nt, Homo Sapiens; identical to SEQ ID NO: 72511

SEQ ID NO: 484322 - RNA, 64 nt, Homo Sapiens; identical to SEQ ID NO: 72512

SEQ ID NO: 484323 - RNA, 64 nt, Homo Sapiens; identical to SEQ ID NO: 72513

SEQ ID NO: 484324 - RNA, 64 nt, Homo Sapiens; identical to SEQ ID NO: 72514

SEQ ID NO: 484325 - RNA, 64 nt, Homo Sapiens; identical to SEQ ID NO: 72515

SEQ ID NO: 484326 - RNA, 64 nt, Homo Sapiens; identical to SEQ ID NO: 72516

SEQ ID NO: 484327 - RNA, 64 nt, Homo Sapiens; identical to SEQ ID NO: 72517

SEQ ID NO: 484328 - RNA, 64 nt, Homo Sapiens; identical to SEQ ID NO: 72518

SEQ ID NO: 484329 - RNA, 64 nt, Homo Sapiens; identical to SEQ ID NO: 72519

SEQ ID NO: 484330 - RNA, 64 nt, Homo Sapiens; identical to SEQ ID NO: 72520

SEQ ID NO: 484331 - RNA, 64 nt, Homo Sapiens; identical to SEQ ID NO: 72521

SEQ ID NO: 484332 - RNA, 64 nt, Homo Sapiens; identical to SEQ ID NO: 72522

SEQ ID NO: 484333 - RNA, 64 nt, Homo Sapiens; identical to SEQ ID NO: 72523

SEQ ID NO: 484334 - RNA, 64 nt, Homo Sapiens; identical to SEQ ID NO: 72524

SEQ ID NO: 484335 - RNA, 64 nt, Homo Sapiens; identical to SEQ ID NO: 72525

SEQ ID NO: 484336 - RNA, 64 nt, Homo Sapiens; identical to SEQ ID NO: 72526

SEQ ID NO: 484337 - RNA, 64 nt, Homo Sapiens; identical to SEQ ID NO: 72527

SEQ ID NO: 484338 - RNA, 64 nt, Homo Sapiens; identical to SEQ ID NO: 72528

SEQ ID NO: 484339 - RNA, 64 nt, Homo Sapiens; identical to SEQ ID NO: 72529

SEQ ID NO: 484340 - RNA, 64 nt, Homo Sapiens; identical to SEQ ID NO: 72530

SEQ ID NO: 484341 - RNA, 64 nt, Homo Sapiens; identical to SEQ ID NO: 72531

SEQ ID NO: 484342 - RNA, 64 nt, Homo Sapiens; identical to SEQ ID NO: 72532

SEQ ID NO: 484343 - RNA, 64 nt, Homo Sapiens; identical to SEQ ID NO: 72533

SEQ ID NO: 484344 - RNA, 64 nt, Homo Sapiens; identical to SEQ ID NO: 72534

SEQ ID NO: 484345 - RNA, 64 nt, Homo Sapiens; identical to SEQ ID NO: 72535

SEQ ID NO: 484346 - RNA, 64 nt, Homo Sapiens; identical to SEQ ID NO: 72536

SEQ ID NO: 484347 - RNA, 64 nt, Homo Sapiens; identical to SEQ ID NO: 72537

SEQ ID NO: 484348 - RNA, 64 nt, Homo Sapiens; identical to SEQ ID NO: 72538

SEQ ID NO: 484349 - RNA, 64 nt, Homo Sapiens; identical to SEQ ID NO: 72539

SEQ ID NO: 484350 - RNA, 64 nt, Homo Sapiens; identical to SEQ ID NO: 72540

SEQ ID NO: 484351 - RNA, 64 nt, Homo Sapiens; identical to SEQ ID NO: 72541

SEQ ID NO: 484352 - RNA, 64 nt, Homo Sapiens; identical to SEQ ID NO: 72542

SEQ ID NO: 484353 - RNA, 64 nt, Homo Sapiens; identical to SEQ ID NO: 72543

SEQ ID NO: 484354 - RNA, 64 nt, Homo Sapiens; identical to SEQ ID NO: 72544

SEQ ID NO: 484355 - RNA, 64 nt, Homo Sapiens; identical to SEQ ID NO: 72545

SEQ ID NO: 484356 - RNA, 64 nt, Homo Sapiens; identical to SEQ ID NO: 72546

SEQ ID NO: 484357 - RNA, 64 nt, Homo Sapiens; identical to SEQ ID NO: 72547

SEQ ID NO: 484358 - RNA, 64 nt, Homo Sapiens; identical to SEQ ID NO: 72548

SEQ ID NO: 484359 - RNA, 64 nt, Homo Sapiens; identical to SEQ ID NO: 72549

SEQ ID NO: 484360 - RNA, 64 nt, Homo Sapiens; identical to SEQ ID NO: 72550

SEQ ID NO: 484361 - RNA, 64 nt, Homo Sapiens; identical to SEQ ID NO: 72551

SEQ ID NO: 484362 - RNA, 64 nt, Homo Sapiens; identical to SEQ ID NO: 72552

SEQ ID NO: 484363 - RNA, 64 nt, Homo Sapiens; identical to SEQ ID NO: 72553

SEQ ID NO: 484364 - RNA, 64 nt, Homo Sapiens; identical to SEQ ID NO: 72554

SEQ ID NO: 484365 - RNA, 64 nt, Homo Sapiens; identical to SEQ ID NO: 72555

SEQ ID NO: 484366 - RNA, 64 nt, Homo Sapiens; identical to SEQ ID NO: 72556

SEQ ID NO: 484367 - RNA, 64 nt, Homo Sapiens; identical to SEQ ID NO: 72557

SEQ ID NO: 484368 - RNA, 64 nt, Homo Sapiens; identical to SEQ ID NO: 72558

SEQ ID NO: 484369 - RNA, 64 nt, Homo Sapiens; identical to SEQ ID NO: 72559

SEQ ID NO: 484370 - RNA, 64 nt, Homo Sapiens; identical to SEQ ID NO: 72560

SEQ ID NO: 484371 - RNA, 64 nt, Homo Sapiens; identical to SEQ ID NO: 72561

SEQ ID NO: 484372 - RNA, 64 nt, Homo Sapiens; identical to SEQ ID NO: 72562

SEQ ID NO: 484373 - RNA, 64 nt, Homo Sapiens; identical to SEQ ID NO: 72563

SEQ ID NO: 484374 - RNA, 64 nt, Homo Sapiens; identical to SEQ ID NO: 72564

SEQ ID NO: 484375 - RNA, 64 nt, Homo Sapiens; identical to SEQ ID NO: 72565

SEQ ID NO: 484376 - RNA, 64 nt, Homo Sapiens; identical to SEQ ID NO: 72566

SEQ ID NO: 484377 - RNA, 64 nt, Homo Sapiens; identical to SEQ ID NO: 72567

SEQ ID NO: 484378 - RNA, 64 nt, Homo Sapiens; identical to SEQ ID NO: 72568

SEQ ID NO: 484379 - RNA, 64 nt, Homo Sapiens; identical to SEQ ID NO: 72569

SEQ ID NO: 484380 - RNA, 64 nt, Homo Sapiens; identical to SEQ ID NO: 72570

SEQ ID NO: 484381 - RNA, 64 nt, Homo Sapiens; identical to SEQ ID NO: 72571

SEQ ID NO: 484382 - RNA, 64 nt, Homo Sapiens; identical to SEQ ID NO: 72572

SEQ ID NO: 484383 - RNA, 64 nt, Homo Sapiens; identical to SEQ ID NO: 72573

SEQ ID NO: 484384 - RNA, 64 nt, Homo Sapiens; identical to SEQ ID NO: 72574

SEQ ID NO: 484385 - RNA, 64 nt, Homo Sapiens; identical to SEQ ID NO: 72575

SEQ ID NO: 484386 - RNA, 64 nt, Homo Sapiens; identical to SEQ ID NO: 72576

SEQ ID NO: 484387 - RNA, 64 nt, Homo Sapiens; identical to SEQ ID NO: 72577

SEQ ID NO: 484388 - RNA, 64 nt, Homo Sapiens; identical to SEQ ID NO: 72578

SEQ ID NO: 484389 - RNA, 64 nt, Homo Sapiens; identical to SEQ ID NO: 72579

SEQ ID NO: 484390 - RNA, 64 nt, Homo Sapiens; identical to SEQ ID NO: 72580

SEQ ID NO: 484391 - RNA, 64 nt, Homo Sapiens; identical to SEQ ID NO: 72581

SEQ ID NO: 484392 - RNA, 64 nt, Homo Sapiens; identical to SEQ ID NO: 72582

SEQ ID NO: 484393 - RNA, 64 nt, Homo Sapiens; identical to SEQ ID NO: 72583

SEQ ID NO: 484394 - RNA, 64 nt, Homo Sapiens; identical to SEQ ID NO: 72584

SEQ ID NO: 484395 - RNA, 64 nt, Homo Sapiens; identical to SEQ ID NO: 72585

SEQ ID NO: 484396 - RNA, 64 nt, Homo Sapiens; identical to SEQ ID NO: 72586

SEQ ID NO: 484397 - RNA, 64 nt, Homo Sapiens; identical to SEQ ID NO: 72587

SEQ ID NO: 484398 - RNA, 64 nt, Homo Sapiens; identical to SEQ ID NO: 72588

SEQ ID NO: 484399 - RNA, 64 nt, Homo Sapiens; identical to SEQ ID NO: 72589

SEQ ID NO: 484400 - RNA, 64 nt, Homo Sapiens; identical to SEQ ID NO: 72590

SEQ ID NO: 484401 - RNA, 64 nt, Homo Sapiens; identical to SEQ ID NO: 72591

SEQ ID NO: 484402 - RNA, 64 nt, Homo Sapiens; identical to SEQ ID NO: 72592

SEQ ID NO: 484403 - RNA, 64 nt, Homo Sapiens; identical to SEQ ID NO: 72593

SEQ ID NO: 484404 - RNA, 64 nt, Homo Sapiens; identical to SEQ ID NO: 72594

SEQ ID NO: 484405 - RNA, 64 nt, Homo Sapiens; identical to SEQ ID NO: 72595

SEQ ID NO: 484406 - RNA, 64 nt, Homo Sapiens; identical to SEQ ID NO: 72596

SEQ ID NO: 484407 - RNA, 64 nt, Homo Sapiens; identical to SEQ ID NO: 72597

SEQ ID NO: 484408 - RNA, 64 nt, Homo Sapiens; identical to SEQ ID NO: 72598

SEQ ID NO: 484409 - RNA, 64 nt, Homo Sapiens; identical to SEQ ID NO: 72599

SEQ ID NO: 484410 - RNA, 64 nt, Homo Sapiens; identical to SEQ ID NO: 72600

SEQ ID NO: 484411 - RNA, 64 nt, Homo Sapiens; identical to SEQ ID NO: 72601

SEQ ID NO: 484412 - RNA, 64 nt, Homo Sapiens; identical to SEQ ID NO: 130638

SEQ ID NO: 484413 - RNA, 64 nt, Homo Sapiens; identical to SEQ ID NO: 130639

SEQ ID NO: 484414 - RNA, 64 nt, Homo Sapiens; identical to SEQ ID NO: 130640

SEQ ID NO: 484415 - RNA, 64 nt, Homo Sapiens; identical to SEQ ID NO: 130641

SEQ ID NO: 484416 - RNA, 64 nt, Homo Sapiens; identical to SEQ ID NO: 130642

SEQ ID NO: 484417 - RNA, 64 nt, Homo Sapiens; identical to SEQ ID NO: 130643

SEQ ID NO: 484418 - RNA, 64 nt, Homo Sapiens; identical to SEQ ID NO: 130644

SEQ ID NO: 484419 - RNA, 64 nt, Homo Sapiens; identical to SEQ ID NO: 130645

SEQ ID NO: 484420 - RNA, 64 nt, Homo Sapiens; identical to SEQ ID NO: 130646

SEQ ID NO: 484421 - RNA, 64 nt, Homo Sapiens; identical to SEQ ID NO: 130647

SEQ ID NO: 484422 - RNA, 64 nt, Homo Sapiens; identical to SEQ ID NO: 130648

SEQ ID NO: 484423 - RNA, 64 nt, Homo Sapiens; identical to SEQ ID NO: 130649

SEQ ID NO: 484424 - RNA, 64 nt, Homo Sapiens; identical to SEQ ID NO: 130650

SEQ ID NO: 484425 - RNA, 64 nt, Homo Sapiens; identical to SEQ ID NO: 130651

SEQ ID NO: 484426 - RNA, 64 nt, Homo Sapiens; identical to SEQ ID NO: 130652

SEQ ID NO: 484427 - RNA, 64 nt, Homo Sapiens; identical to SEQ ID NO: 130653

SEQ ID NO: 484428 - RNA, 64 nt, Homo Sapiens; identical to SEQ ID NO: 130654

SEQ ID NO: 484429 - RNA, 64 nt, Homo Sapiens; identical to SEQ ID NO: 130655

SEQ ID NO: 484430 - RNA, 64 nt, Homo Sapiens; identical to SEQ ID NO: 130656

SEQ ID NO: 484431 - RNA, 64 nt, Homo Sapiens; identical to SEQ ID NO: 130657

SEQ ID NO: 484432 - RNA, 64 nt, Homo Sapiens; identical to SEQ ID NO: 130658

SEQ ID NO: 484433 - RNA, 64 nt, Homo Sapiens; identical to SEQ ID NO: 130659

SEQ ID NO: 484434 - RNA, 64 nt, Homo Sapiens
uguuuuuguuuuuuugauuugggcuuuauuuuuuucuguguacuguacuauauuguaaaaggga

SEQ ID NO: 484435 - RNA, 64 nt, Homo Sapiens
cuucccuuuccucccccucccaugcguaagacguucuguguaaccuccauuaaauuugguacaa

SEQ ID NO: 484436 - RNA, 64 nt, Homo Sapiens
accuaauaccaguaugugauaaauguugauguuuucuguguacaaacacauuuucuaugcaugu

SEQ ID NO: 484437 - RNA, 64 nt, Homo Sapiens
uucuguguacaaacacauuuucuaugcaugugucucuguguauauggcauauaccuaguaagua

SEQ ID NO: 484438 - RNA, 64 nt, Homo Sapiens
uaaguccaagccccggcuggccugcucucacgugucuguguaagaucaugcaagagaaaucaca

SEQ ID NO: 484439 - RNA, 64 nt, Homo Sapiens
uagaaacaaauaaaacucucuauauauguguaugucuguguacaaaaaaaugacagagcugaug

SEQ ID NO: 484440 - RNA, 64 nt, Homo Sapiens
ugauuuuguacuuuaaauguuucacauaucuggaucuguguauuguauagauauguauauaugg

SEQ ID NO: 484441 - RNA, 64 nt, Homo Sapiens
aaacaaaauaaagccccucuugacuuggaagugcucuguguacucuauaacuccacaggaaaua

SEQ ID NO: 484442 - RNA, 64 nt, Homo Sapiens
ugaaaauaaugagacaucuuuuaaaccuagcaccucuguguauuaacguuguguuuccuguuuc

SEQ ID NO: 484443 - RNA, 64 nt, Homo Sapiens
uuauuguaguucccaguuuaucuuugaagaggguucuguguacgaacaucuaauauauuuaauu

SEQ ID NO: 484444 - RNA, 64 nt, Homo Sapiens
cacauaggauuucucuuaaucugaggucauuguaucuguguaucgaaaguggugcuagacagag

SEQ ID NO: 484445 - RNA, 64 nt, Homo Sapiens
uuugcucauacacgcacaucuggguguggcgguuucuguguacgcugucaugguaugugaggug

SEQ ID NO: 484446 - RNA, 64 nt, Homo Sapiens
cugcuaagcuaaagaaacugcuuacaguuuauuuucuguguaaaaugaguaggaugucucuugg

SEQ ID NO: 484447 - RNA, 64 nt, Homo Sapiens
ugacacagcuugugaauguuuagugugcugcuguucuguguacauaaagucaucaaaguggggu

SEQ ID NO: 484448 - RNA, 64 nt, Homo Sapiens
ucugauguguucuuccuuuagucaucauguuaggucuguguacccuaaaucagcauauuacuca

SEQ ID NO: 484449 - RNA, 64 nt, Homo Sapiens
cagaaagguuuuacaauccaaacauuauauguucucuguguaacugaauuucacuuaucuuuua

SEQ ID NO: 484450 - RNA, 64 nt, Homo Sapiens
cuuuuucuccuacuuuuuaccaauucuguuuuaaucuguguauuucaaaagugaauguauaaua

SEQ ID NO: 484451 - RNA, 64 nt, Homo Sapiens
uguccucgaggaucccggauaacccaagcauugaucuguguacguucuccaggauaaaauuaaa

SEQ ID NO: 484452 - RNA, 64 nt, Homo Sapiens
cgcuggucuuguuuggaggaacugcagcauggugucuguguaccuagucgaguauucauccgag

SEQ ID NO: 484453 - RNA, 64 nt, Homo Sapiens
gaggggaguuaggaguugcucgaggccuuuucucucuguguacagucaucugaggugagaccac

SEQ ID NO: 484454 - RNA, 64 nt, Homo Sapiens
uuggaguuuuggugacuuuucugcagccuuugcuucuguguauuaugccuuugggacauuagga

SEQ ID NO: 484455 - RNA, 64 nt, Homo Sapiens
gggaugguauuagagagagagcaugaggaacucaucuguguauuuagacggccuuguaaauagg

SEQ ID NO: 484456 - RNA, 64 nt, Homo Sapiens
cuggaaucuguggcaacuauuaacugccaaucugucuguguaaguaccuuugucccuaguacug

SEQ ID NO: 484457 - RNA, 64 nt, Homo Sapiens
ccucauacuguuuacugauagcaggaugcuggcaucuguguaguugccccaugucuccuuggca

SEQ ID NO: 484458 - RNA, 64 nt, Homo Sapiens
ugcugauuugaguagugauuuuaauuaccuaacgucuguguaacuuauuuaccucugugcuguu

SEQ ID NO: 484459 - RNA, 64 nt, Homo Sapiens
acaucaccaucagcaggcuccaguugaacacuagucuguguaacuuuaaacaucuagcaguaaa

SEQ ID NO: 484460 - RNA, 64 nt, Homo Sapiens
gaaaaauacuuugauuuuuauccauuucuuuuacucuguguaaagacuugagaagucuaauuca

SEQ ID NO: 484461 - RNA, 64 nt, Homo Sapiens
uagcauguguacuauaaucaucaagugaugcgugucuguguauuuauaagauuaagauuauacu

SEQ ID NO: 484462 - RNA, 64 nt, Homo Sapiens
cuagaauuuccucuauacacagucuugaugaacaucuguguacccaaggucaacacaucaguuc

SEQ ID NO: 484463 - RNA, 64 nt, Homo Sapiens
ccauagaucggcgggugcugcagccucacuguguucuguguacgugacaacagacuaacucgga

SEQ ID NO: 484464 - RNA, 64 nt, Homo Sapiens
cgaggucaaucaugccauugaccgagugaccacuucuguguagaguuucaccuccaaguuuuac

SEQ ID NO: 484465 - RNA, 64 nt, Homo Sapiens
gggugaugcacccauugugauugugauucaaacuucuguguacuuuuauugugguaauuauguu

SEQ ID NO: 484466 - RNA, 64 nt, Homo Sapiens
uaauuuaauuugcaguuuguuguauaguuuuuagucuguguagucacaacuguugaugguaggc

SEQ ID NO: 484467 - RNA, 64 nt, Homo Sapiens
auggaaacuugugugaccauugucaaucuuuuuuucuguguaaccuugagacccuucaccagaa

SEQ ID NO: 484468 - RNA, 64 nt, Homo Sapiens
auagacccuuuggacuuuagucuucauguuggccucuguguacuauauuuggcucucugccuuc

SEQ ID NO: 484469 - RNA, 64 nt, Homo Sapiens
uucaaauuguuuauguauauuauaguaugcuauuucuguguaugucuguguauguuguguaugg

SEQ ID NO: 484470 - RNA, 64 nt, Homo Sapiens
uuguguaugguauaguaugcuauaauaugcuacuucuguguaugagcugggagcuaaauaaggg

SEQ ID NO: 484471 - RNA, 64 nt, Homo Sapiens
guuuguguauuuguauguuguaagcguuuccuaaucuguguauaucuagauguuuuuaauaaga

SEQ ID NO: 484472 - RNA, 64 nt, Homo Sapiens
uacuagucauuccauaagagucuuaaaggacugcucuguguaacacugugacugccgugugugc

SEQ ID NO: 484473 - RNA, 64 nt, Homo Sapiens
acccccaggccuccccggccuuguacaguguaccucuguguaucuguacagccucgcuccugcc

SEQ ID NO: 484474 - RNA, 64 nt, Homo Sapiens
guguguaugauuuuugccucagaaacuauacucuucuguguaacagaccaauaaacaacauuug

SEQ ID NO: 484475 - RNA, 64 nt, Homo Sapiens
ggaauguauuuuucaaauacuuguuucuuuggagucuguguaaugaccacggcgcuuaucagca

SEQ ID NO: 484476 - RNA, 64 nt, Homo Sapiens
uugcccugccccaugaagggcuguuggucccaguucuguguagccccuagugaugcugcgagug

SEQ ID NO: 484477 - RNA, 64 nt, Homo Sapiens
gguggaggaucucgguuugcaaauuagauaauacucuguguauaaugcuacauaucaauaacua

SEQ ID NO: 484478 - RNA, 64 nt, Homo Sapiens
accaucaugguuaggcacgauaacuaaucuuuguucuguguaaaaaaauauggagagugaaaca

SEQ ID NO: 484479 - RNA, 64 nt, Homo Sapiens
agaaaauauuaccuaaauuguuauuuugggaccuucuguguaaauguauucuguguauuauucu

SEQ ID NO: 484480 - RNA, 64 nt, Homo Sapiens
auucuuuauuuugggaccuuccuauugacuguauucuguguauuugugaaguaaauugauauaa

SEQ ID NO: 484481 - RNA, 64 nt, Homo Sapiens
uauauguauauuuccuuuuuugugauauggggugucuguguacaauuaugggaaguuucuuguc

SEQ ID NO: 484482 - RNA, 64 nt, Homo Sapiens
uuuaaauaauuucuuuaaaaaguugauauuuuuuucuguguagagcucuuaauaguuuuuaaua

SEQ ID NO: 484483 - RNA, 64 nt, Homo Sapiens
agaaaugaguaccaacaggaccuaaauguuuauuaaaaguuagaacuuacuguaauguauuaua

SEQ ID NO: 484484 - RNA, 64 nt, Homo Sapiens
uuuuaucugcagggcuaggugggcugguauuaauaaaaguuagcuggauuagugccauuauuca

SEQ ID NO: 484485 - RNA, 64 nt, Homo Sapiens
gucuuuccuguaaguuaacaagguauauaaaguaaaaaguuaaaaugaauuaauaaacauuugg

SEQ ID NO: 484486 - RNA, 64 nt, Homo Sapiens
gugacuccacuuaauuuuagaacaaaguuacauaaaaaguuauuuguuaccaaauuagaacuaa

SEQ ID NO: 484487 - RNA, 64 nt, Homo Sapiens
gccucagcuuacugaguaaggauauguauuucuuaaaaguuaguuuauccacuucagauuucau

SEQ ID NO: 484488 - RNA, 64 nt, Homo Sapiens
ggggagaaaguaaucucaguuguuuuagaaacgaaaaaguuaagcauuguuuacuugaaguggg

SEQ ID NO: 484489 - RNA, 64 nt, Homo Sapiens
cuuuuuguauaggcuaagaaacagguuaucagugaaaaguuaauuauggcuuuggcacuagaau

SEQ ID NO: 484490 - RNA, 64 nt, Homo Sapiens
aucuauuuuuucuugacuucuuuuauauaguaauaaaaguuauuuuggaagcucuuuguguguu

SEQ ID NO: 484491 - RNA, 64 nt, Homo Sapiens
cuaccuguccugaaccugguccugugggccauugaaaaguuagaucugugaucucugggguuuu

SEQ ID NO: 484492 - RNA, 64 nt, Homo Sapiens
gaauuuaccauauaucuuuguuuuucuucaacgaaaaaguuaauugaggcaaugucaucugcuc

SEQ ID NO: 484493 - RNA, 64 nt, Homo Sapiens
auuauauauauauauauauaaauuauccauucucaaaaguuaaaauguuuaucucaaaaguuaa

SEQ ID NO: 484494 - RNA, 64 nt, Homo Sapiens
auuauccauucucaaaaguuugaauguuuaucucaaaaguuaaagauuuauguuuuaugcaggc

SEQ ID NO: 484495 - RNA, 64 nt, Homo Sapiens
gaccagaaauuuuucuucuaaagaauuuaauucuaaaaguuauagacauucccaaagauauacc

SEQ ID NO: 484496 - RNA, 64 nt, Homo Sapiens
aaaaaaucaaaauaauuaaaauaaauuguuagagaaaaguuacuuuaaaaauagcuauaacgcu

SEQ ID NO: 484497 - RNA, 64 nt, Homo Sapiens
aaaauuaucuuugaaacaccaacugauucauaagaaaaguuauuuuggucucuaauauauuugg

SEQ ID NO: 484498 - RNA, 64 nt, Homo Sapiens
uucguaccuuucuaccaaaauuuuguggacaaugaaaaguuauucaaagucaagaggaggaagu

SEQ ID NO: 484499 - RNA, 64 nt, Homo Sapiens
gagcuuccuuauguuucacaaaguuaccccacacaaaaguuacuaauuuauuauucuaauccaa

SEQ ID NO: 484500 - RNA, 64 nt, Homo Sapiens
ccacacaaaaguuacugagcuauuauucuaauccaaaaguuaccuaugggcuuauauugaaauu

SEQ ID NO: 484501 - RNA, 64 nt, Homo Sapiens
guuuugaggcugaacauaauuucauuaucccucaaaaaguuaccaccacaucagaaaaaauaaa

SEQ ID NO: 484502 - RNA, 64 nt, Homo Sapiens
uuuuuuccaguguauugcucauauuaucagaaggaaaaguuauuuaaguaugucaguuaauugu

SEQ ID NO: 484503 - RNA, 64 nt, Homo Sapiens
ccauauuuuagaagcuaugaaaguccuuuuaugaaaaaguuacugauugcuucucaguuauuag

SEQ ID NO: 484504 - RNA, 64 nt, Homo Sapiens
agaguaagauaaagcagauucugucuucauugcaaaaaguuauucucaauggaagaauggcauc

SEQ ID NO: 484505 - RNA, 64 nt, Homo Sapiens
auauugcagauuacuuaaauauggccaucaaaacaaaaguuacaacacguaucucuuuucaucu

SEQ ID NO: 484506 - RNA, 64 nt, Homo Sapiens
cagaauuguguugacugggggaggugaaucacaaaaaaguuacgaggaguuuaagaguuaaaua

SEQ ID NO: 484507 - RNA, 64 nt, Homo Sapiens
auccucauuuuacacaugagggaccgaaggauagaaaaguuauuuuucaaaggucuugcaguua

SEQ ID NO: 484508 - RNA, 64 nt, Homo Sapiens
uaugcuuaaccacuuaaugugaugaaauauuccuaaaaguuaaaugacuauuaaagcauauauu

SEQ ID NO: 484509 - RNA, 64 nt, Homo Sapiens
uuugguaaaugguaaggaauuaguaagcuuuauaaaaaguuauucuguauaauauuagacaaaa

SEQ ID NO: 484510 - RNA, 64 nt, Homo Sapiens
gauugauagucuguauaauauugagagaaacacaaaaaguuauacucauaagcuauucuaauuu

SEQ ID NO: 484511 - RNA, 64 nt, Homo Sapiens
agaaggaagaaaugguuuucuuaaauaccuacaaaaaaguuacugugguaucuaugaguuauca

SEQ ID NO: 484512 - RNA, 64 nt, Homo Sapiens
cuuccuacucaacuauuuauaaucucauuaauuaaaaaguuauaauuuuagauaaaaauucuag

SEQ ID NO: 484513 - RNA, 64 nt, Homo Sapiens
cacagcccuaugacuacuaucuuugcauuaguuaaaaaguuaguauauaggcaucaaacaaccu

SEQ ID NO: 484514 - RNA, 64 nt, Homo Sapiens
uaaaacuuugguuguuuuccuguaauauaaaagaaaaaguuaauuuaucaauugauugaauaca

SEQ ID NO: 484515 - RNA, 64 nt, Homo Sapiens
cauucauuucauacucucaaaacaccaaacuucaaaaaguuaauuauugucauaaugcauuauu

SEQ ID NO: 484516 - RNA, 64 nt, Homo Sapiens
guaccuauuauuguucccuggugaaacugaggagaaaaguuaaucaaccagguuacucccacag

SEQ ID NO: 484517 - RNA, 64 nt, Homo Sapiens
auggacccaugagaguauauuuuuaugagggagcaaaaguuagacugagaacaaacguuagaaa

SEQ ID NO: 484518 - RNA, 64 nt, Homo Sapiens
uugauuauguauacaugacaccuaaagagggaacaaaaguuaguuuuauuuuuuuaauaaacaa

SEQ ID NO: 484519 - RNA, 64 nt, Homo Sapiens
ugucauuuggagaaaauacgcuggaaaaguuaaaaaaaguuacagauaaaguuuccauauuuuu

SEQ ID NO: 484520 - RNA, 64 nt, Homo Sapiens
aaaaguuacaugucauuuggccauauuuuucuggaaaaguuaaaauaagugguugauaaaguuu

SEQ ID NO: 484521 - RNA, 64 nt, Homo Sapiens
ggauuaaagaaagucaggauaaaaaaauuaugaaaaaaguuauggagacucugucucaaaaaaa

SEQ ID NO: 484522 - RNA, 64 nt, Homo Sapiens
aaaaaaggccaggugcagugguaacuuaugguauaaaaguuaugugggauaaaaaagguuaugg

SEQ ID NO: 484523 - RNA, 64 nt, Homo Sapiens
ggauaaaaaagguuauggguguuaugggauuaaaaaaaguuaugaaauuaaaaaaaaauuaaaa

SEQ ID NO: 484524 - RNA, 64 nt, Homo Sapiens
ggauuaaaaaaaguuaugggauuaaaaaaaaauuaaaaguuaugaucuaaaagcuggccacuaa

SEQ ID NO: 484525 - RNA, 64 nt, Homo Sapiens
aauccaugauuuauacucagaaucgacauucuuaaaaaguuauuucaagggauggcauaacugu

SEQ ID NO: 484526 - RNA, 64 nt, Homo Sapiens
uuuggggguaaagcauuuuggaggaauaaccuuaaaaaguuaaaaagucauuguaauaacugau

SEQ ID NO: 484527 - RNA, 64 nt, Homo Sapiens
cgggcgugguggcaugcguguggcuaaaaauacaaaaaguuagcccuuccaagaccaggcgcgg

SEQ ID NO: 484528 - RNA, 64 nt, Homo Sapiens
aaucaaaauaacagauuaucauguuuauccauuuaaaaguuauaaauagagacccacagagcua

SEQ ID NO: 484529 - RNA, 64 nt, Homo Sapiens
gaaguguucuucucucaagugucaucuuaaggugaaaaguuauuuaauauaaugcaacauuuaa

SEQ ID NO: 484530 - RNA, 64 nt, Homo Sapiens
acacuaaaaguauuauaguauucauaauucaaacaaaaguuauuagggaaaugauucaaauuuu

SEQ ID NO: 484531 - RNA, 64 nt, Homo Sapiens
gagaaagcaagauccaaauugauuuugggauauuaaaaguuaacagaacacugaacaaggaaag

SEQ ID NO: 484532 - RNA, 64 nt, Homo Sapiens
aggauaagucucuggagcagaauuuaucacacacaaaaguuacaccaacagaauaccaagcaga

SEQ ID NO: 484533 - RNA, 64 nt, Homo Sapiens
cgaaguguagaaaauaaaaugcuauaauagcaauaaaaguuagauauccuuuaaaucaaacugg

SEQ ID NO: 484534 - RNA, 64 nt, Homo Sapiens
uauuagauaaaggcucaaaguuuugacauauuuuaaaaguuaauagaugagacaucuuaauuug

SEQ ID NO: 484535 - RNA, 64 nt, Homo Sapiens
gcaaacuuaguucuguaacugcauuuuucaccuuaaaaguuaaaugaaaugcaugaugguauuu

SEQ ID NO: 484536 - RNA, 64 nt, Homo Sapiens
aggcaagauaucauuuauuggacuucuugaaaauaaaaguuacaaaauccaacaacaacaacaa

SEQ ID NO: 484537 - RNA, 64 nt, Homo Sapiens
aagugcacuaggggacaguugauuucaaucuaagaaaaguuaacacuugggaauuacaagaagu

SEQ ID NO: 484538 - RNA, 64 nt, Homo Sapiens
agcaaguuguuuucuuucagaguuuccuccuucaaaaaguuauauugcauuuacaaauguuuua

SEQ ID NO: 484539 - RNA, 64 nt, Homo Sapiens
gcugaucaagaaauuuaaaacaacaacaacaacaaaaaguuacgggguucaucuccuacacaau

SEQ ID NO: 484540 - RNA, 64 nt, Homo Sapiens
uguguuucuaauuuaccguuuaaauuuauuuguaaaaaguuaagggagaguuggucuuucccug

SEQ ID NO: 484541 - RNA, 64 nt, Homo Sapiens
auuaucgcccacauuuguaauauagucgccauugaaaaguuaauuauccuuuuuuuagggauuu

SEQ ID NO: 484542 - RNA, 64 nt, Homo Sapiens
auauagaacgaauuuggguuuuuaaagaaauauuaaaaguuagguacuguaaguguucuuaaaa

SEQ ID NO: 484543 - RNA, 64 nt, Homo Sapiens
aagcucaguuaguuuuuuuauuauuauuauuauuaaaaguuaauucaggacugaugugaccuac

SEQ ID NO: 484544 - RNA, 64 nt, Homo Sapiens
caaaccaaagcaacuuaguaaaauaauagguauaaaaaguuauucuguaagucuguugguugua

SEQ ID NO: 484545 - RNA, 64 nt, Homo Sapiens
gaaaguaaauauuccagaaguugauagccugguuaaaaguuagauccucuauuaccauucuaag

SEQ ID NO: 484546 - RNA, 64 nt, Homo Sapiens
ccaguugagauuuuuaaaaaugaaagauccauggaaaaguuaacaauguauauggguaaggacc

SEQ ID NO: 484547 - RNA, 64 nt, Homo Sapiens
gccuaggagugugagacugaaugacuaacgguagaaaaguuauuagagaaaauuaaugaaugag

SEQ ID NO: 484548 - RNA, 64 nt, Homo Sapiens
caccaguuagaaguuuguuugcgauaauccaagcaaaaguuaaugguggcuucaacuagguagu

SEQ ID NO: 484549 - RNA, 64 nt, Homo Sapiens
cuaugucucgacuuuucugaugaaguuauaccagaaaaguuaauuauuugaugggccugccaug

SEQ ID NO: 484550 - RNA, 64 nt, Homo Sapiens
agcaauaucaacguuuuaacaugcucaccucagcaaaaguuaagacagcuguaaauggacugau

SEQ ID NO: 484551 - RNA, 64 nt, Homo Sapiens
auaccaauaaaugcuuuagcugcaacuaaaauaaaaaaguuaaagguaagaaaaugacugccuc

SEQ ID NO: 484552 - RNA, 64 nt, Homo Sapiens
ucucaccauuccugugguacucaccaucucuuguaaaaguuaauggcuuuucuuuggacaguuu

SEQ ID NO: 484553 - RNA, 64 nt, Homo Sapiens
auuuaucuuuaggugguuucuuuuacagaauuagaaaaguuaacuacuaaauuaauacuccucc

SEQ ID NO: 484554 - RNA, 64 nt, Homo Sapiens
cauuuaguguucucacagcuuggauauuuuucugaaaaguuauuugccaaaacugaaauccuuc

SEQ ID NO: 484555 - RNA, 64 nt, Homo Sapiens
uuuggauccuauugaggggauaagaggaugucaaaaaaguuaaauaccuaaguagaaaaaaaua

SEQ ID NO: 484556 - RNA, 64 nt, Homo Sapiens
agguucuacauuuuucuuaaauaaauuagggaguaaaaguuauacuuaacuugucugucuauua

SEQ ID NO: 484557 - RNA, 64 nt, Homo Sapiens
caaauuccucuuccucugagaaccagugaaacagaaaaguuaaucugcuuucaaauuacaaugg

SEQ ID NO: 484558 - RNA, 64 nt, Homo Sapiens
aggcaaacauuuucucuuaggagcaaggaagguaaaaaguuaacaacugaaaagcugagaccaa

SEQ ID NO: 484559 - RNA, 64 nt, Homo Sapiens
ucccuuuagcuguguuauuaugcagcugaaauugaaaaguuauuuuaguuuugcauaguucuag

SEQ ID NO: 484560 - RNA, 64 nt, Homo Sapiens
aaaauuguuguccgguuuacaagaaaacaaaaccaaaaguuauucauucuaaagauagaguaaa

SEQ ID NO: 484561 - RNA, 64 nt, Homo Sapiens; identical to SEQ ID NO: 237905

SEQ ID NO: 484562 - RNA, 64 nt, Homo Sapiens; identical to SEQ ID NO: 237906

SEQ ID NO: 484563 - RNA, 64 nt, Homo Sapiens
aagaguggggaacagggccagcaagacagaccaccagccagaaaucucugauaucaaccucaug

SEQ ID NO: 484564 - RNA, 64 nt, Homo Sapiens
auggggaagaaauaccccagacccaacaaaccuccagccagaaagccagcuauuuugcauuuga

SEQ ID NO: 484565 - RNA, 64 nt, Homo Sapiens
ccaagacuggaugcuggaucucauagaaaauucacagccagacaaucuucuaaucuggagucuu

SEQ ID NO: 484566 - RNA, 64 nt, Homo Sapiens
cuucauggaccaacagugauugaggauuugugggcagccagagggagucugacugaaguuuacu

SEQ ID NO: 484567 - RNA, 64 nt, Homo Sapiens
cuuuccaucugcuuguauuuuccauacacauccccagccagaaguuaguguccgaagaccgaau

SEQ ID NO: 484568 - RNA, 64 nt, Homo Sapiens
gacagggccuagcuuucauuugacacacagacuacagccagaagcccauggagcagggauguca

SEQ ID NO: 484569 - RNA, 64 nt, Homo Sapiens
agagauacaguccacagguggacaaagggauccccagccagagagagagagaccagccaacagc

SEQ ID NO: 484570 - RNA, 64 nt, Homo Sapiens
gagagagaccagccaacagcuugauagaccagugcagccagagagaccaccaaacagagccccc

SEQ ID NO: 484571 - RNA, 64 nt, Homo Sapiens
cccccagcaaaucaggaccuaucuaggcagaccccagccagacccccgccagacagacucccaa

SEQ ID NO: 484572 - RNA, 64 nt, Homo Sapiens
gagagugugucuccuuccuguaugcuggugugagcagccagagggagggaugcucagggaggga

SEQ ID NO: 484573 - RNA, 64 nt, Homo Sapiens
aggaggaggcacgggugagccuguguucugcaggcagccagaaaugguuuuguuucuccugggg

SEQ ID NO: 484574 - RNA, 64 nt, Homo Sapiens
ggcaccacgcaagggcagagcugggcggcauccacagccagagaggcagaggcaagagcagagc

SEQ ID NO: 484575 - RNA, 64 nt, Homo Sapiens
uugcauggaugcaguugugacucuggggacaaugcagccagaagcugagggaccagcacuuggu

SEQ ID NO: 484576 - RNA, 64 nt, Homo Sapiens
ugagagaugugcccacugcccgugcagccuccuucagccagagcccagagcauagacaggagug

SEQ ID NO: 484577 - RNA, 64 nt, Homo Sapiens
agguuuccuggagcucuuggcuucagccagcccccagccagaguccuggcuaggacagugaccu

SEQ ID NO: 484578 - RNA, 64 nt, Homo Sapiens
gaagcguccuugggaucccaauuacacuagaaaucagccagaaggguagcccuggcuagacuga

SEQ ID NO: 484579 - RNA, 64 nt, Homo Sapiens
ucuccacagcucaaagcauuuaaagcccuucacucagccagaccugggugauucuguccucaaa

SEQ ID NO: 484580 - RNA, 64 nt, Homo Sapiens
ugccugcaucuauucuuuguaccaucugucuugccagccagaagccucugccucccuagcuuuu

SEQ ID NO: 484581 - RNA, 64 nt, Homo Sapiens
ggcagcuugagagggcaaacccaaaaccucaugacagccagagccugucuuucagcauucaguc

SEQ ID NO: 484582 - RNA, 64 nt, Homo Sapiens
guggcucuuucagaagacccaggaagggcagcuccagccagaggaccuuccuggcuaugcaggu

SEQ ID NO: 484583 - RNA, 64 nt, Homo Sapiens
uucacuucagccgcccaauuccaucucuccucugcagccagauucacuggcugaugcucacugc

SEQ ID NO: 484584 - RNA, 64 nt, Homo Sapiens
gaacaauggucaucugagaaaaccccacaucccacagccagaaacgagucucggggguggucac

SEQ ID NO: 484585 - RNA, 64 nt, Homo Sapiens
uugcccugacggaguggccccuuacugccagacccagccagacuccuucacauagucauugucc

SEQ ID NO: 484586 - RNA, 64 nt, Homo Sapiens
aguucacuaauguuagccuuauuuaggacaaagucagccagacaccuuguacugggcacgcguc

SEQ ID NO: 484587 - RNA, 64 nt, Homo Sapiens
gccuuuucuacacaggauccaaggucacgagaagcagccagagugccccgccuccgccggcucu

SEQ ID NO: 484588 - RNA, 64 nt, Homo Sapiens
cagcgcgguggcugggucugcacacuggccucugcagccagauuucuauauugggaguuuuuua

SEQ ID NO: 484589 - RNA, 64 nt, Homo Sapiens
aauaagaaacaccgcaacagucauaaucaggcuccagccagaaacccguggugaggccauguuc

SEQ ID NO: 484590 - RNA, 64 nt, Homo Sapiens
gccgauuccgggagcuugggcuagaccaggccugcagccagaacuucucacagaagcugcgacu

SEQ ID NO: 484591 - RNA, 64 nt, Homo Sapiens
agacucggagggagcugcucagggccggugagcgcagccagaagcccuggccagugaggagcuc

SEQ ID NO: 484592 - RNA, 64 nt, Homo Sapiens
ggcauuggccccagccuucugaaagccggcgcugcagccagaggccgcacgcugcacugucgcg

SEQ ID NO: 484593 - RNA, 64 nt, Homo Sapiens
caaaggaacaccaggcccagcgcccucuuugguccagccagacccugggcccucucuccucacu

SEQ ID NO: 484594 - RNA, 64 nt, Homo Sapiens
ucccuggccugugcgucugcccccuucugagaugcagccagaagcucugugccugcugcaaaga

SEQ ID NO: 484595 - RNA, 64 nt, Homo Sapiens
ucuggcuguuguccaaagcaugggauucuggaggcagccagagcccugcugaguuccugcuuuc

SEQ ID NO: 484596 - RNA, 64 nt, Homo Sapiens
acaggcuucuuccugagauauccucagguuuucucagccagagagcugccuuuagaguccaacu

SEQ ID NO: 484597 - RNA, 64 nt, Homo Sapiens
aucccaccucccuuucuuagcagaaucuaaauuacagccagaccucuggcugcagaggagucug

SEQ ID NO: 484598 - RNA, 64 nt, Homo Sapiens
ccuccuuggugguaaaagaggguugcauuucuugcagccagaaggcagagaaagugaagaccaa

SEQ ID NO: 484599 - RNA, 64 nt, Homo Sapiens
cucaggcagcuggggcugaggcccaaaggcagaacagccagagggggcaggaggggaccaaaaa

SEQ ID NO: 484600 - RNA, 64 nt, Homo Sapiens
ugcugcccaggcagcguggaggggaaggguagggcagccagagaaaggagcagagaaggcacac

SEQ ID NO: 484601 - RNA, 58 nt, Homo Sapiens; identical to SEQ ID NO: 165744

SEQ ID NO: 484602 - RNA, 64 nt, Homo Sapiens
uggauaggggcagggcacucauuaaagugcaucacagccagagccuguugugucucaguugggu

SEQ ID NO: 484603 - RNA, 64 nt, Homo Sapiens
ggggggugacugggacccagccuuugggccuccccagccagagcagcccagcaacagugugucc

SEQ ID NO: 484604 - RNA, 64 nt, Homo Sapiens
gaggucacagaugugggagacccccaaagcucuccagccagacucauguguccucugacguaug

SEQ ID NO: 484605 - RNA, 64 nt, Homo Sapiens
cuucagccaaaugccccaacgaggggaaguuccucagccagacucccuccucccguccacccca

SEQ ID NO: 484606 - RNA, 64 nt, Homo Sapiens
cagcagaugaguugaguggggcagagggacagggcagccagaccaaggccaagccuucucaccc

SEQ ID NO: 484607 - RNA, 64 nt, Homo Sapiens
gacaggagacccuaaggccccgggagcccagugccagccagagguugugcaggcaaggagacca

SEQ ID NO: 484608 - RNA, 64 nt, Homo Sapiens
uauaauuguuuuuuaaaugugguacacucuggcccagccagagccauuguugauuguuaugacu

SEQ ID NO: 484609 - RNA, 64 nt, Homo Sapiens
gagaaaauguaagcagacagagaaauaaugaucccagccagacucagaaaccucagugaaauca

SEQ ID NO: 484610 - RNA, 60 nt, Homo Sapiens
cagcccccagaucccacagucuauaaaccacucaaagauuagauguauccuagcuuuuag

SEQ ID NO: 484611 - RNA, 60 nt, Homo Sapiens
acuucaaaccauuuaacugggaguucucuccucaaagaagucugcuccugaaggcagggu

SEQ ID NO: 484612 - RNA, 60 nt, Homo Sapiens
cuacggaauuuagcauuuugagucacuggucucaaagaauaaauggauugaaagagugaa

SEQ ID NO: 484613 - RNA, 60 nt, Homo Sapiens
agcuguggaaagaagucacauuugaacaaacucaaagaaccauuugacuuggaagcaaug

SEQ ID NO: 484614 - RNA, 60 nt, Homo Sapiens
uguaccuuauugaucuuugcccauggaagucucaaagaucuuucguugguuguuucucug

SEQ ID NO: 484615 - RNA, 60 nt, Homo Sapiens
agaauccugcuuuacaggaucauguaaaugcucaaagauguaauguaguucuuuguuccu

SEQ ID NO: 484616 - RNA, 60 nt, Homo Sapiens
uagaguuaaugaguuguuguucuccaaaaccucaaagagaacuucacauaaacuuccugu

SEQ ID NO: 484617 - RNA, 60 nt, Homo Sapiens
aagagugaggcuaaacugcggugugugugacucaaagaucucuaaagacauugucaccga

SEQ ID NO: 484618 - RNA, 60 nt, Homo Sapiens
accaccaaccccacagaaauacgaaaaacccucaaagauuacuauaaacaccuguaugca

SEQ ID NO: 484619 - RNA, 60 nt, Homo Sapiens
cagccauuguggaaagcacugcagcgauuucucaaagacauaaaagaacauagcauucaa

SEQ ID NO: 484620 - RNA, 60 nt, Homo Sapiens
agugggagcuaaacauugauuacacauggacucaaagaagggaacaguagacacgggcuu

SEQ ID NO: 484621 - RNA, 60 nt, Homo Sapiens
ugaaaggacucauacuggaguacuacucagcucaaagacaguggaaaagcauuuagauac

SEQ ID NO: 484622 - RNA, 60 nt, Homo Sapiens
ugaaaagacucauacuggagcacaacucugcucaaagacagugggaaaguguucguauau

SEQ ID NO: 484623 - RNA, 64 nt, Homo Sapiens
uccauuuccucucauuccauucauggguggacagcgaccacaaagacucauggggcuucccugg

SEQ ID NO: 484624 - RNA, 64 nt, Homo Sapiens
cggucaaguucugacuuuucauuacaggugugagcgaccacauccggccucccaaaguucuggg

SEQ ID NO: 484625 - RNA, 64 nt, Homo Sapiens
auggaacaaagacagauaccuucagaggguuuugcgaccacaagcuucaugaugucuuaauugc

SEQ ID NO: 484626 - RNA, 64 nt, Homo Sapiens
gacaaaaucagcuuuacaacaaucccuagaggcucgaccacagaauaaugccagucaccacccu

SEQ ID NO: 484627 - RNA, 64 nt, Homo Sapiens
agagcgugggagacgguggggcggcagggacacccgaccacaccggcacggugguacugggggu

SEQ ID NO: 484628 - RNA, 64 nt, Homo Sapiens
gagggaaaaagaaaacaauucuuaagaaugaaaccgaccacaugucuuacugcaucagaccuuc

SEQ ID NO: 484629 - RNA, 64 nt, Homo Sapiens
aagugcugggauuccaggugugagccgcugcggccgaccacauuugauguuugaaguuguaauc

SEQ ID NO: 484630 - RNA, 64 nt, Homo Sapiens
caacaaaaugaaacgcaaccaccaccaaccacugcgaccacaagaaggaugauucaacagguuu

SEQ ID NO: 484631 - RNA, 64 nt, Homo Sapiens
gucccccagccggcuggguggcucuggggccaaccgaccacaggugucacugaucacagguguc

SEQ ID NO: 484632 - RNA, 64 nt, Homo Sapiens
ggaugcugcaaaaacguugauccaaguacaaggccgaccacaauugcugugauuaacgaguaac

SEQ ID NO: 484633 - RNA, 64 nt, Homo Sapiens
ugucagcaauagugaccucauuaccaagggguggcgaccacauuaccaagcgcaauuccccauu

SEQ ID NO: 484634 - RNA, 64 nt, Homo Sapiens
gaguucagugccuggguguuccugccccuccugccgaccacacgcugucuugcccgccugcccg

SEQ ID NO: 484635 - RNA, 64 nt, Homo Sapiens
gccccggacuccuacgugcccucaauaaagaaaccgaccacaugccugcgcuaccgucuguggu

SEQ ID NO: 484636 - RNA, 64 nt, Homo Sapiens
gguguugccaacucuuggcagcacugggccaaaccgaccacauaccaugagcucccaaauggcg

SEQ ID NO: 484637 - RNA, 64 nt, Homo Sapiens
caaaaucugaaagcuaacaccccacuuugacccucgaccacaccugaaaaugucucaaaucucc

SEQ ID NO: 484638 - RNA, 64 nt, Homo Sapiens
agaaagaaggaaucauauucuuguauaucaucuucgaccacaucuguagugauugauccuuacc

SEQ ID NO: 484639 - RNA, 64 nt, Homo Sapiens
gaaacauauuuuuggaagcaacuggacaacaccacgaccacaugggugcuuuggcccuaauagc

SEQ ID NO: 484640 - RNA, 64 nt, Homo Sapiens
agccucgaaacaccaggcaggaggcggcugucugcgaccacagcuguugacagggagccaaggc

SEQ ID NO: 484641 - RNA, 64 nt, Homo Sapiens
cuuuaacagggauccaagaucuuugcaguucaaucgaccacauaggaauuuccaggcaccaaaa

SEQ ID NO: 484642 - RNA, 64 nt, Homo Sapiens
gucugcacucuaacccuaggaguuucagggcuaacgaccacaggggagguuaagugacuugccc

SEQ ID NO: 484643 - RNA, 64 nt, Homo Sapiens
ccagcauuagcagaacauaucaggccaagggccucgaccacaggccugagcuuacaaagcaugg

SEQ ID NO: 484644 - RNA, 64 nt, Homo Sapiens
ggacacccagccagggaauucccugggcucagcacgaccacacaggcccucccuggcucccugu

SEQ ID NO: 484645 - RNA, 64 nt, Homo Sapiens
gggcggaccgcuggacagacacgcgggccgggcacgaccacaccggagagacacccccaucccc

SEQ ID NO: 484646 - RNA, 64 nt, Homo Sapiens
aucaggucuuugccaccgagagucauuuuuagcucgaccacaucagcgacguauuuccuguugu

SEQ ID NO: 484647 - RNA, 64 nt, Homo Sapiens
uacuugcaccgugugguaugcccaucagcgccuacgaccacaaggggugcugcuggacggcaag

SEQ ID NO: 484648 - RNA, 64 nt, Homo Sapiens
ccuaccucaguucaagguaagcuuacacucaaaacgaccacaguguaaaaucugguauuuacug

SEQ ID NO: 484649 - RNA, 51 nt, Homo Sapiens
cugaugaucauguuuuaugaccgaccacacguguccuaagcagauugcuua

SEQ ID NO: 484650 - RNA, 64 nt, Homo Sapiens
agcauggccgcugccagccccuuguagagcagcccgaccacaggggugaagaaaagugaacgcc

SEQ ID NO: 484651 - RNA, 64 nt, Homo Sapiens
caggacagagccaggcuguuucugcagcuuggcccgaccacaaaugggucucccuccgagucac

SEQ ID NO: 484652 - RNA, 64 nt, Homo Sapiens
cuccagcuuuccugguuagcgcaacgcggcuccacgaccacacgcacuucaggguggaagcugg

SEQ ID NO: 484653 - RNA, 64 nt, Homo Sapiens
gcggcuucucugccauuagcagcccugggcgggccgaccacacucgaggcugcggugcuacggg

SEQ ID NO: 484654 - RNA, 64 nt, Homo Sapiens
gccuguguccaggccuacucccuggucucaccuccgaccacagucggcggcaccuucucagagu

SEQ ID NO: 484655 - RNA, 64 nt, Homo Sapiens
ccaaugccuucccagcuuggcugggugccuuccccgaccacaccccucuaccaucuguaaacaa

SEQ ID NO: 484656 - RNA, 64 nt, Homo Sapiens
guucugaaaggagacauugcucuaugucugccuucgaccacagcaagccaucauccuccauugc

SEQ ID NO: 484657 - RNA, 64 nt, Homo Sapiens
aguggacuuuuugcgggguguggcggccgggucucgaccacagcguggaucaccggcuguuuag

SEQ ID NO: 484658 - RNA, 64 nt, Homo Sapiens
caccucgagcaacacuugugcuguagcccauguucgaccacaugcgauuuuuccccaggcuuuc

SEQ ID NO: 484659 - RNA, 64 nt, Homo Sapiens
agccaagccuuuuccacuguagucucgugugugccgaccacaggcacccagcaggcgcaaccag

SEQ ID NO: 484660 - RNA, 64 nt, Homo Sapiens
cccugauggcucucaccaccauggcgucacuccgcgaccacagcacaccagaaacacucagcau

SEQ ID NO: 484661 - RNA, 64 nt, Homo Sapiens
uucagagagagagagggagucaaggugugaccgucgaccacagccagugucaggccucugccuc

SEQ ID NO: 484662 - RNA, 64 nt, Homo Sapiens
ugcuacacucugacacaaacauuuacugcuggaucgaccacaaagcagauguggcuucuuaggu

SEQ ID NO: 484663 - RNA, 64 nt, Homo Sapiens
aaccccaucaccaagaggagacucaccucuaccucgaccacaucuugcuugaggcuccagacau

SEQ ID NO: 484664 - RNA, 64 nt, Homo Sapiens
gccuuccucccuggguuugucuggacaccgagagcgaccacauccuggagaagccaggagaaaa

SEQ ID NO: 484665 - RNA, 64 nt, Homo Sapiens
cuaagcauuuucacagccguuucuucauauaauccgaccacagugggaggugugauuuacccau

SEQ ID NO: 484666 - RNA, 64 nt, Homo Sapiens
ggugucugcggaaacucgaggcacgugaccaugccgaccacaaagcauugcuguugaaugguga

SEQ ID NO: 484667 - RNA, 64 nt, Homo Sapiens
cacgcaugcacacacgcagaaucgcacgcggccacgaccacagacacugaacacgcgugugugc

SEQ ID NO: 484668 - RNA, 64 nt, Homo Sapiens
uguuccucugccuggccauccugcuggagcaccgcgaccacaucaugcgcaaugggcuggauua

SEQ ID NO: 484669 - RNA, 64 nt, Homo Sapiens
uuggccacgucuuccuucugccugagcuuccccccgaccacaggcccuuuccucaggcaagguc

SEQ ID NO: 484670 - RNA, 64 nt, Homo Sapiens
caaaaucuugguuauuacauauaagugggccacuuaggaagauuuuuuauccaauacucauuaa

SEQ ID NO: 484671 - RNA, 64 nt, Homo Sapiens
uuuccuaaaaugaaagaacacaggaauaacuauauaggaagauuagaccuguuugggggcgcug

SEQ ID NO: 484672 - RNA, 64 nt, Homo Sapiens
cuccccuacucccuuauguguuguguauuccacuuaggaagaaaugcccaaaagagguccuggc

SEQ ID NO: 484673 - RNA, 64 nt, Homo Sapiens
aaaguccacuuuacucaaauuggugaacaguguauaggaagaagccagcaggagcucugacuaa

SEQ ID NO: 484674 - RNA, 64 nt, Homo Sapiens
accugcaugagugaaggauuuccacguagacaccuaggaagagcccgcaugcccuagacucacu

SEQ ID NO: 484675 - RNA, 64 nt, Homo Sapiens
ugcgucuauuucuucuauugugcuucuuuggggauaggaagagaaacauaacuacuguuccagg

SEQ ID NO: 484676 - RNA, 64 nt, Homo Sapiens
agcugauagaaauucaagauuuuucaguuguucuuaggaagaacauauuuuuacugugaaggug

SEQ ID NO: 484677 - RNA, 64 nt, Homo Sapiens
uccuuugaccucaccaggccaugugugggggaacuaggaagaagcuccauagcucucugcccug

SEQ ID NO: 484678 - RNA, 64 nt, Homo Sapiens
aaauacuuaguuguuccaggcaccuaaaaucaauuaggaagacauaguucccuucuuuuuuggg

SEQ ID NO: 484679 - RNA, 64 nt, Homo Sapiens
caugggguuauugagacauuggaugugaaauaccuaggaagacauguauggagaaugcuuaaca

SEQ ID NO: 484680 - RNA, 64 nt, Homo Sapiens
uaacaaaugcucuucuccuuuuucugucuucccuuaggaagaacguuaucucucuucugauuag

SEQ ID NO: 484681 - RNA, 64 nt, Homo Sapiens
caguguggaguucaccuuggaagggcguucuagguaggaagagcccgcagggccaugcagaccu

SEQ ID NO: 484682 - RNA, 64 nt, Homo Sapiens
gccuagaggagucaggagcagggacuuugacucuuaggaagagcacacaugagggcaaggcugc

SEQ ID NO: 484683 - RNA, 64 nt, Homo Sapiens
gcaguggcuguaggcuggguaggaggcugcuaguuaggaagaugucccaguuuuagugcagcuu

SEQ ID NO: 484684 - RNA, 64 nt, Homo Sapiens
ggucaaaaauguuaucuucaagcccuuugacuucuaggaagaaacugaccuuuccuaccugaag

SEQ ID NO: 484685 - RNA, 64 nt, Homo Sapiens
aguuucuccaagcaggacauggacaaggaugaucuaggaagacuuuggaaagaguaggaagacu

SEQ ID NO: 484686 - RNA, 64 nt, Homo Sapiens
ggacaaggaugaucuaggaagacuuuggaaagaguaggaagacuuuggaaagacuuuuccaacc

SEQ ID NO: 484687 - RNA, 64 nt, Homo Sapiens
caaaaucaugccaaaauguaaagaccaucgagacuaggaagaaacugcaugaacuaacgagcaa

SEQ ID NO: 484688 - RNA, 64 nt, Homo Sapiens
gcaaagaaauggaagagcauuccaugcucauggguaggaagaaucaauaucaugaaaauggccc

SEQ ID NO: 484689 - RNA, 64 nt, Homo Sapiens
caggcaagauaaagauaugaaaggcauauauaaauaggaagaggggaagucaguuucucuugca

SEQ ID NO: 484690 - RNA, 64 nt, Homo Sapiens
caauaaaaauugaaaaauaucucaugcucauggauaggaagaaucaguauuguuaaaauacugc

SEQ ID NO: 484691 - RNA, 64 nt, Homo Sapiens
uggaugcuccuccuguuuacgcgacuggguaaauuaggaagagggauuggguguucauccagag

SEQ ID NO: 484692 - RNA, 64 nt, Homo Sapiens
uagguuaagucguaacgagugaggggauuggguuuaggaagagcguggagggcaaggcuggggg

SEQ ID NO: 484693 - RNA, 64 nt, Homo Sapiens; identical to SEQ ID NO: 236580

SEQ ID NO: 484694 - RNA, 64 nt, Homo Sapiens; identical to SEQ ID NO: 236581

SEQ ID NO: 484695 - RNA, 64 nt, Homo Sapiens; identical to SEQ ID NO: 236582

SEQ ID NO: 484696 - RNA, 64 nt, Homo Sapiens; identical to SEQ ID NO: 236583

SEQ ID NO: 484697 - RNA, 64 nt, Homo Sapiens; identical to SEQ ID NO: 236584

SEQ ID NO: 484698 - RNA, 64 nt, Homo Sapiens; identical to SEQ ID NO: 236585

SEQ ID NO: 484699 - RNA, 64 nt, Homo Sapiens; identical to SEQ ID NO: 236586

SEQ ID NO: 484700 - RNA, 64 nt, Homo Sapiens; identical to SEQ ID NO: 236587

SEQ ID NO: 484701 - RNA, 64 nt, Homo Sapiens; identical to SEQ ID NO: 236588

SEQ ID NO: 484702 - RNA, 64 nt, Homo Sapiens; identical to SEQ ID NO: 236589

SEQ ID NO: 484703 - RNA, 64 nt, Homo Sapiens; identical to SEQ ID NO: 236590

SEQ ID NO: 484704 - RNA, 64 nt, Homo Sapiens; identical to SEQ ID NO: 236591

SEQ ID NO: 484705 - RNA, 64 nt, Homo Sapiens; identical to SEQ ID NO: 236592

SEQ ID NO: 484706 - RNA, 64 nt, Homo Sapiens; identical to SEQ ID NO: 236593

SEQ ID NO: 484707 - RNA, 64 nt, Homo Sapiens; identical to SEQ ID NO: 236594

SEQ ID NO: 484708 - RNA, 64 nt, Homo Sapiens; identical to SEQ ID NO: 236595

SEQ ID NO: 484709 - RNA, 64 nt, Homo Sapiens; identical to SEQ ID NO: 236596

SEQ ID NO: 484710 - RNA, 64 nt, Homo Sapiens; identical to SEQ ID NO: 236597

SEQ ID NO: 484711 - RNA, 64 nt, Homo Sapiens; identical to SEQ ID NO: 236598

SEQ ID NO: 484712 - RNA, 64 nt, Homo Sapiens; identical to SEQ ID NO: 236599

SEQ ID NO: 484713 - RNA, 64 nt, Homo Sapiens; identical to SEQ ID NO: 236600

SEQ ID NO: 484714 - RNA, 64 nt, Homo Sapiens; identical to SEQ ID NO: 236601

SEQ ID NO: 484715 - RNA, 64 nt, Homo Sapiens; identical to SEQ ID NO: 236602

SEQ ID NO: 484716 - RNA, 64 nt, Homo Sapiens; identical to SEQ ID NO: 236603

SEQ ID NO: 484717 - RNA, 64 nt, Homo Sapiens; identical to SEQ ID NO: 236604

SEQ ID NO: 484718 - RNA, 64 nt, Homo Sapiens; identical to SEQ ID NO: 236605

SEQ ID NO: 484719 - RNA, 64 nt, Homo Sapiens; identical to SEQ ID NO: 236606

SEQ ID NO: 484720 - RNA, 64 nt, Homo Sapiens; identical to SEQ ID NO: 236607

SEQ ID NO: 484721 - RNA, 64 nt, Homo Sapiens; identical to SEQ ID NO: 236608

SEQ ID NO: 484722 - RNA, 64 nt, Homo Sapiens; identical to SEQ ID NO: 236609

SEQ ID NO: 484723 - RNA, 64 nt, Homo Sapiens; identical to SEQ ID NO: 236610

SEQ ID NO: 484724 - RNA, 64 nt, Homo Sapiens; identical to SEQ ID NO: 236611

SEQ ID NO: 484725 - RNA, 64 nt, Homo Sapiens; identical to SEQ ID NO: 236612

SEQ ID NO: 484726 - RNA, 64 nt, Homo Sapiens; identical to SEQ ID NO: 236613

SEQ ID NO: 484727 - RNA, 64 nt, Homo Sapiens; identical to SEQ ID NO: 236614

SEQ ID NO: 484728 - RNA, 64 nt, Homo Sapiens; identical to SEQ ID NO: 236615

SEQ ID NO: 484729 - RNA, 64 nt, Homo Sapiens; identical to SEQ ID NO: 236616

SEQ ID NO: 484730 - RNA, 64 nt, Homo Sapiens; identical to SEQ ID NO: 236617

SEQ ID NO: 484731 - RNA, 64 nt, Homo Sapiens; identical to SEQ ID NO: 236618

SEQ ID NO: 484732 - RNA, 64 nt, Homo Sapiens; identical to SEQ ID NO: 236619

SEQ ID NO: 484733 - RNA, 64 nt, Homo Sapiens
uacugccuuacuguacauacaccacagcaggaugcuaauggaauaagacuaacuugaaaagaaa

SEQ ID NO: 484734 - RNA, 58 nt, Homo Sapiens
gauugguuaaaaugugauuuuagcuugacuaauggaauuuacacacuccuuucacuga

SEQ ID NO: 484735 - RNA, 64 nt, Homo Sapiens
uucgugcuguauguuuuuuuuuucccccuucacucuaauggacuguuccagggaagggaugggg

SEQ ID NO: 484736 - RNA, 64 nt, Homo Sapiens
aacagcccauaaugcuccccgggagcagaggccacuaauggagagugggaagagccuggaaaga

SEQ ID NO: 484737 - RNA, 64 nt, Homo Sapiens
ccucaaauggaacaggauuuuuugaugcuuugcucuaauggaacuguuuaaaaaauuuuuuuuu

SEQ ID NO: 484738 - RNA, 64 nt, Homo Sapiens
agaaaaugauggguugaauuuacugauuauugaccuaauggauggcuuuuuaaaauguuuuaau

SEQ ID NO: 484739 - RNA, 64 nt, Homo Sapiens; identical to SEQ ID NO: 236580

SEQ ID NO: 484740 - RNA, 64 nt, Homo Sapiens; identical to SEQ ID NO: 236581

SEQ ID NO: 484741 - RNA, 64 nt, Homo Sapiens; identical to SEQ ID NO: 236582

SEQ ID NO: 484742 - RNA, 64 nt, Homo Sapiens; identical to SEQ ID NO: 236583

SEQ ID NO: 484743 - RNA, 64 nt, Homo Sapiens; identical to SEQ ID NO: 236584

SEQ ID NO: 484744 - RNA, 64 nt, Homo Sapiens; identical to SEQ ID NO: 236585

SEQ ID NO: 484745 - RNA, 64 nt, Homo Sapiens; identical to SEQ ID NO: 236586

SEQ ID NO: 484746 - RNA, 64 nt, Homo Sapiens; identical to SEQ ID NO: 236587

SEQ ID NO: 484747 - RNA, 64 nt, Homo Sapiens; identical to SEQ ID NO: 236588

SEQ ID NO: 484748 - RNA, 64 nt, Homo Sapiens; identical to SEQ ID NO: 236589

SEQ ID NO: 484749 - RNA, 64 nt, Homo Sapiens; identical to SEQ ID NO: 236590

SEQ ID NO: 484750 - RNA, 64 nt, Homo Sapiens; identical to SEQ ID NO: 236591

SEQ ID NO: 484751 - RNA, 64 nt, Homo Sapiens; identical to SEQ ID NO: 236592

SEQ ID NO: 484752 - RNA, 64 nt, Homo Sapiens; identical to SEQ ID NO: 236593

SEQ ID NO: 484753 - RNA, 64 nt, Homo Sapiens; identical to SEQ ID NO: 236594

SEQ ID NO: 484754 - RNA, 64 nt, Homo Sapiens; identical to SEQ ID NO: 236595

SEQ ID NO: 484755 - RNA, 64 nt, Homo Sapiens; identical to SEQ ID NO: 236596

SEQ ID NO: 484756 - RNA, 64 nt, Homo Sapiens; identical to SEQ ID NO: 236597

SEQ ID NO: 484757 - RNA, 64 nt, Homo Sapiens; identical to SEQ ID NO: 236598

SEQ ID NO: 484758 - RNA, 64 nt, Homo Sapiens; identical to SEQ ID NO: 236599

SEQ ID NO: 484759 - RNA, 64 nt, Homo Sapiens; identical to SEQ ID NO: 236600

SEQ ID NO: 484760 - RNA, 64 nt, Homo Sapiens; identical to SEQ ID NO: 236601

SEQ ID NO: 484761 - RNA, 64 nt, Homo Sapiens; identical to SEQ ID NO: 236602

SEQ ID NO: 484762 - RNA, 64 nt, Homo Sapiens; identical to SEQ ID NO: 236603

SEQ ID NO: 484763 - RNA, 64 nt, Homo Sapiens; identical to SEQ ID NO: 236604

SEQ ID NO: 484764 - RNA, 64 nt, Homo Sapiens; identical to SEQ ID NO: 236605

SEQ ID NO: 484765 - RNA, 64 nt, Homo Sapiens; identical to SEQ ID NO: 236606

SEQ ID NO: 484766 - RNA, 64 nt, Homo Sapiens; identical to SEQ ID NO: 236607

SEQ ID NO: 484767 - RNA, 64 nt, Homo Sapiens; identical to SEQ ID NO: 236608

SEQ ID NO: 484768 - RNA, 64 nt, Homo Sapiens; identical to SEQ ID NO: 236609

SEQ ID NO: 484769 - RNA, 64 nt, Homo Sapiens; identical to SEQ ID NO: 236610

SEQ ID NO: 484770 - RNA, 64 nt, Homo Sapiens; identical to SEQ ID NO: 236611

SEQ ID NO: 484771 - RNA, 64 nt, Homo Sapiens; identical to SEQ ID NO: 236612

SEQ ID NO: 484772 - RNA, 64 nt, Homo Sapiens; identical to SEQ ID NO: 236613

SEQ ID NO: 484773 - RNA, 64 nt, Homo Sapiens; identical to SEQ ID NO: 236614

SEQ ID NO: 484774 - RNA, 64 nt, Homo Sapiens; identical to SEQ ID NO: 236615

SEQ ID NO: 484775 - RNA, 64 nt, Homo Sapiens; identical to SEQ ID NO: 236616

SEQ ID NO: 484776 - RNA, 64 nt, Homo Sapiens; identical to SEQ ID NO: 236617

SEQ ID NO: 484777 - RNA, 64 nt, Homo Sapiens; identical to SEQ ID NO: 236618

SEQ ID NO: 484778 - RNA, 64 nt, Homo Sapiens; identical to SEQ ID NO: 236619

SEQ ID NO: 484779 - RNA, 64 nt, Homo Sapiens; identical to SEQ ID NO: 484733

SEQ ID NO: 484780 - RNA, 58 nt, Homo Sapiens; identical to SEQ ID NO: 484734

SEQ ID NO: 484781 - RNA, 64 nt, Homo Sapiens; identical to SEQ ID NO: 484735

SEQ ID NO: 484782 - RNA, 64 nt, Homo Sapiens; identical to SEQ ID NO: 484736

SEQ ID NO: 484783 - RNA, 64 nt, Homo Sapiens; identical to SEQ ID NO: 484737

SEQ ID NO: 484784 - RNA, 64 nt, Homo Sapiens; identical to SEQ ID NO: 484738

SEQ ID NO: 484785 - RNA, 64 nt, Homo Sapiens; identical to SEQ ID NO: 114148

SEQ ID NO: 484786 - RNA, 64 nt, Homo Sapiens; identical to SEQ ID NO: 114149

SEQ ID NO: 484787 - RNA, 64 nt, Homo Sapiens; identical to SEQ ID NO: 114150

SEQ ID NO: 484788 - RNA, 64 nt, Homo Sapiens; identical to SEQ ID NO: 114151

SEQ ID NO: 484789 - RNA, 64 nt, Homo Sapiens; identical to SEQ ID NO: 114152

SEQ ID NO: 484790 - RNA, 64 nt, Homo Sapiens; identical to SEQ ID NO: 114153

SEQ ID NO: 484791 - RNA, 64 nt, Homo Sapiens; identical to SEQ ID NO: 114154

SEQ ID NO: 484792 - RNA, 64 nt, Homo Sapiens; identical to SEQ ID NO: 114155

SEQ ID NO: 484793 - RNA, 64 nt, Homo Sapiens; identical to SEQ ID NO: 114156

SEQ ID NO: 484794 - RNA, 64 nt, Homo Sapiens; identical to SEQ ID NO: 114157

SEQ ID NO: 484795 - RNA, 64 nt, Homo Sapiens; identical to SEQ ID NO: 114158

SEQ ID NO: 484796 - RNA, 64 nt, Homo Sapiens; identical to SEQ ID NO: 114159

SEQ ID NO: 484797 - RNA, 64 nt, Homo Sapiens
aggaggcauuccacacaggcacugccccaggacaacacaacaaggacagucacaacaaggacaa

SEQ ID NO: 484798 - RNA, 64 nt, Homo Sapiens
cacaacaaggacagucacaacaaggacaacaaggacacaacacaacacacaacaaggacaguca

SEQ ID NO: 484799 - RNA, 64 nt, Homo Sapiens
caaggacagucacaacaaggacaacaaggacacaacacaacacacaacaaggacagucacaaca

SEQ ID NO: 484800 - RNA, 64 nt, Homo Sapiens
agucacaacaaggacaacaaggacacaacacaacacacaacaaggacagucacaacaagccuag

SEQ ID NO: 484801 - RNA, 64 nt, Homo Sapiens
cagagauucugcaacacgaauucgaagcaaacaaacacaacacaacagaauuccuggaaagaag

SEQ ID NO: 484802 - RNA, 64 nt, Homo Sapiens
auucugcaacacgaauucgaagcaaacaaacacaacacaacagaauuccuggaaagaagacgac

SEQ ID NO: 484803 - RNA, 64 nt, Homo Sapiens
auuucccuagauugugaaagugaucacgacaaucacacaacaaauaauuaagugacuugguaug

SEQ ID NO: 484804 - RNA, 64 nt, Homo Sapiens
uuuauauuuucaucauugacuacauauuucuuauacacaacacacaauuuaugaauuuuuucuc

SEQ ID NO: 484805 - RNA, 64 nt, Homo Sapiens
cuguuauagacauuuauggauacauuuccucuaaacacaacagggcacagcaaauacgacuuca

SEQ ID NO: 484806 - RNA, 64 nt, Homo Sapiens
cuucauuuggcuucgaguuccccaggcgcuguagacacaacaugaaucgggcucucugcucucu

SEQ ID NO: 484807 - RNA, 64 nt, Homo Sapiens
gcaaacagaagggagaaagucaagcacuugauuaacacaacacuugagcaacugacuuaauuuu

SEQ ID NO: 484808 - RNA, 64 nt, Homo Sapiens
acguaaguuucauuugggcaacauccucugccacacacaacaaaccucaucaucauucccaaca

SEQ ID NO: 484809 - RNA, 64 nt, Homo Sapiens
ccaggagagaacccacgcacaugcacaccacaacacacaacacaccucaccucacaccacagca

SEQ ID NO: 484810 - RNA, 64 nt, Homo Sapiens
caccacaucucaccacaccacagcacaccucaccacacaacacaccacaccccacaccgcacug

SEQ ID NO: 484811 - RNA, 64 nt, Homo Sapiens
gaguuaggucuuuaucaaguaaaccuaagaauaaacacaacaauuuagaaaauguguugauaga

SEQ ID NO: 484812 - RNA, 64 nt, Homo Sapiens
ugagcuccuagccaauguauccaucagcauaacaacacaacacuaaucugaaacaagguaucuu

SEQ ID NO: 484813 - RNA, 64 nt, Homo Sapiens
acacguagacaggcuguaauauucaaaccaccucugggccaaugcauuuccaaaggaugccuuu

SEQ ID NO: 484814 - RNA, 64 nt, Homo Sapiens
gguuguuugaaccugagaguguguaauggucauuugggccaagccucagcuagggcugcugccu

SEQ ID NO: 484815 - RNA, 64 nt, Homo Sapiens
ggccuaagguccacuggacaagaaggcuugcacuugggccaaagcugcccaugcagcagagggc

SEQ ID NO: 484816 - RNA, 64 nt, Homo Sapiens
ucggaggagagaagaaagugcagaaggaggacuuugggccaauuauccugaccacucuugaacc

SEQ ID NO: 484817 - RNA, 64 nt, Homo Sapiens
aggguccuaccucuggguuuccuggaaguggauuugggccaagaaggagagggagaaaggcccg

SEQ ID NO: 484818 - RNA, 64 nt, Homo Sapiens
cccauuuccucuggcaacaaaagccagaguguugugggccaaguccccccacagggccucugca

SEQ ID NO: 484819 - RNA, 64 nt, Homo Sapiens
gaggcuggacucggggcauguguggaagcugcagugggccaagcaguccugguaccugagcgcc

SEQ ID NO: 484820 - RNA, 64 nt, Homo Sapiens
aggccccaugaagagcgcccuggacugcugagggugggccaacagcccagagcucaggacacuu

SEQ ID NO: 484821 - RNA, 64 nt, Homo Sapiens
agcuggcccaguuguccaugacaaaagaggcuuuugggccaaaaugugagggugguggguggga

SEQ ID NO: 484822 - RNA, 64 nt, Homo Sapiens
uuccuugcauuaaaggagaucuuccccuaaccuuugggccaauuuacuggccacuaauuucguu

SEQ ID NO: 484823 - RNA, 64 nt, Homo Sapiens
acucuuauugguaagcuauaggagacucaggaucugggccaaccucaaggugggggcuucagag

SEQ ID NO: 484824 - RNA, 64 nt, Homo Sapiens
uucagcacagaaccugaaugccaggaaaaauuccugggccaagaagcuaaagcuaaagaaaccu

SEQ ID NO: 484825 - RNA, 64 nt, Homo Sapiens
agggguccuugggccucuaguggggugaagaaucugggccaacccuccaacauugcauccuuuc

SEQ ID NO: 484826 - RNA, 64 nt, Homo Sapiens
gggcugccucuuuuccuuucgccaagacuccuucugggccaaugaugcacucagcuucguguug

SEQ ID NO: 484827 - RNA, 64 nt, Homo Sapiens; identical to SEQ ID NO: 393047

SEQ ID NO: 484828 - RNA, 64 nt, Homo Sapiens; identical to SEQ ID NO: 393048

SEQ ID NO: 484829 - RNA, 64 nt, Homo Sapiens; identical to SEQ ID NO: 393049

SEQ ID NO: 484830 - RNA, 64 nt, Homo Sapiens; identical to SEQ ID NO: 393050

SEQ ID NO: 484831 - RNA, 64 nt, Homo Sapiens; identical to SEQ ID NO: 393051

SEQ ID NO: 484832 - RNA, 64 nt, Homo Sapiens; identical to SEQ ID NO: 393052

SEQ ID NO: 484833 - RNA, 64 nt, Homo Sapiens; identical to SEQ ID NO: 393053

SEQ ID NO: 484834 - RNA, 64 nt, Homo Sapiens; identical to SEQ ID NO: 393054

SEQ ID NO: 484835 - RNA, 64 nt, Homo Sapiens; identical to SEQ ID NO: 393055

SEQ ID NO: 484836 - RNA, 64 nt, Homo Sapiens; identical to SEQ ID NO: 393056

SEQ ID NO: 484837 - RNA, 64 nt, Homo Sapiens; identical to SEQ ID NO: 393057

SEQ ID NO: 484838 - RNA, 64 nt, Homo Sapiens; identical to SEQ ID NO: 393058

SEQ ID NO: 484839 - RNA, 64 nt, Homo Sapiens; identical to SEQ ID NO: 393059

SEQ ID NO: 484840 - RNA, 64 nt, Homo Sapiens; identical to SEQ ID NO: 393060

SEQ ID NO: 484841 - RNA, 64 nt, Homo Sapiens; identical to SEQ ID NO: 393061

SEQ ID NO: 484842 - RNA, 64 nt, Homo Sapiens; identical to SEQ ID NO: 393062

SEQ ID NO: 484843 - RNA, 64 nt, Homo Sapiens; identical to SEQ ID NO: 393063

SEQ ID NO: 484844 - RNA, 64 nt, Homo Sapiens; identical to SEQ ID NO: 393064

SEQ ID NO: 484845 - RNA, 64 nt, Homo Sapiens; identical to SEQ ID NO: 393065

SEQ ID NO: 484846 - RNA, 64 nt, Homo Sapiens; identical to SEQ ID NO: 393066

SEQ ID NO: 484847 - RNA, 64 nt, Homo Sapiens; identical to SEQ ID NO: 393067

SEQ ID NO: 484848 - RNA, 64 nt, Homo Sapiens; identical to SEQ ID NO: 393068

SEQ ID NO: 484849 - RNA, 64 nt, Homo Sapiens; identical to SEQ ID NO: 393069

SEQ ID NO: 484850 - RNA, 64 nt, Homo Sapiens; identical to SEQ ID NO: 393070

SEQ ID NO: 484851 - RNA, 64 nt, Homo Sapiens; identical to SEQ ID NO: 393071

SEQ ID NO: 484852 - RNA, 64 nt, Homo Sapiens; identical to SEQ ID NO: 393072

SEQ ID NO: 484853 - RNA, 64 nt, Homo Sapiens; identical to SEQ ID NO: 393073

SEQ ID NO: 484854 - RNA, 64 nt, Homo Sapiens; identical to SEQ ID NO: 393074

SEQ ID NO: 484855 - RNA, 64 nt, Homo Sapiens; identical to SEQ ID NO: 393075

SEQ ID NO: 484856 - RNA, 64 nt, Homo Sapiens; identical to SEQ ID NO: 393076

SEQ ID NO: 484857 - RNA, 64 nt, Homo Sapiens; identical to SEQ ID NO: 393077

SEQ ID NO: 484858 - RNA, 64 nt, Homo Sapiens; identical to SEQ ID NO: 393078

SEQ ID NO: 484859 - RNA, 64 nt, Homo Sapiens; identical to SEQ ID NO: 393079

SEQ ID NO: 484860 - RNA, 64 nt, Homo Sapiens; identical to SEQ ID NO: 393080

SEQ ID NO: 484861 - RNA, 64 nt, Homo Sapiens; identical to SEQ ID NO: 393081

SEQ ID NO: 484862 - RNA, 64 nt, Homo Sapiens; identical to SEQ ID NO: 393082

SEQ ID NO: 484863 - RNA, 64 nt, Homo Sapiens; identical to SEQ ID NO: 393083

SEQ ID NO: 484864 - RNA, 64 nt, Homo Sapiens; identical to SEQ ID NO: 393084

SEQ ID NO: 484865 - RNA, 64 nt, Homo Sapiens; identical to SEQ ID NO: 393085

SEQ ID NO: 484866 - RNA, 64 nt, Homo Sapiens; identical to SEQ ID NO: 393086

SEQ ID NO: 484867 - RNA, 64 nt, Homo Sapiens; identical to SEQ ID NO: 393087

SEQ ID NO: 484868 - RNA, 64 nt, Homo Sapiens; identical to SEQ ID NO: 393088

SEQ ID NO: 484869 - RNA, 64 nt, Homo Sapiens; identical to SEQ ID NO: 393089

SEQ ID NO: 484870 - RNA, 64 nt, Homo Sapiens; identical to SEQ ID NO: 393090

SEQ ID NO: 484871 - RNA, 64 nt, Homo Sapiens; identical to SEQ ID NO: 393091

SEQ ID NO: 484872 - RNA, 64 nt, Homo Sapiens; identical to SEQ ID NO: 393092

SEQ ID NO: 484873 - RNA, 64 nt, Homo Sapiens; identical to SEQ ID NO: 393093

SEQ ID NO: 484874 - RNA, 64 nt, Homo Sapiens; identical to SEQ ID NO: 393094

SEQ ID NO: 484875 - RNA, 64 nt, Homo Sapiens; identical to SEQ ID NO: 393095

SEQ ID NO: 484876 - RNA, 64 nt, Homo Sapiens; identical to SEQ ID NO: 393096

SEQ ID NO: 484877 - RNA, 64 nt, Homo Sapiens; identical to SEQ ID NO: 393097

SEQ ID NO: 484878 - RNA, 64 nt, Homo Sapiens; identical to SEQ ID NO: 393098

SEQ ID NO: 484879 - RNA, 64 nt, Homo Sapiens; identical to SEQ ID NO: 393099

SEQ ID NO: 484880 - RNA, 64 nt, Homo Sapiens; identical to SEQ ID NO: 393100

SEQ ID NO: 484881 - RNA, 64 nt, Homo Sapiens; identical to SEQ ID NO: 393101

SEQ ID NO: 484882 - RNA, 64 nt, Homo Sapiens; identical to SEQ ID NO: 393102

SEQ ID NO: 484883 - RNA, 64 nt, Homo Sapiens; identical to SEQ ID NO: 393103

SEQ ID NO: 484884 - RNA, 64 nt, Homo Sapiens; identical to SEQ ID NO: 393104

SEQ ID NO: 484885 - RNA, 64 nt, Homo Sapiens; identical to SEQ ID NO: 393105

SEQ ID NO: 484886 - RNA, 64 nt, Homo Sapiens; identical to SEQ ID NO: 393106

SEQ ID NO: 484887 - RNA, 64 nt, Homo Sapiens; identical to SEQ ID NO: 393107

SEQ ID NO: 484888 - RNA, 64 nt, Homo Sapiens; identical to SEQ ID NO: 393108

SEQ ID NO: 484889 - RNA, 64 nt, Homo Sapiens; identical to SEQ ID NO: 393109

SEQ ID NO: 484890 - RNA, 64 nt, Homo Sapiens; identical to SEQ ID NO: 393110

SEQ ID NO: 484891 - RNA, 64 nt, Homo Sapiens; identical to SEQ ID NO: 393111

SEQ ID NO: 484892 - RNA, 64 nt, Homo Sapiens; identical to SEQ ID NO: 393112

SEQ ID NO: 484893 - RNA, 64 nt, Homo Sapiens; identical to SEQ ID NO: 393113

SEQ ID NO: 484894 - RNA, 64 nt, Homo Sapiens; identical to SEQ ID NO: 393114

SEQ ID NO: 484895 - RNA, 64 nt, Homo Sapiens; identical to SEQ ID NO: 393115

SEQ ID NO: 484896 - RNA, 64 nt, Homo Sapiens; identical to SEQ ID NO: 393116

SEQ ID NO: 484897 - RNA, 64 nt, Homo Sapiens; identical to SEQ ID NO: 393117

SEQ ID NO: 484898 - RNA, 64 nt, Homo Sapiens; identical to SEQ ID NO: 393118

SEQ ID NO: 484899 - RNA, 64 nt, Homo Sapiens; identical to SEQ ID NO: 393119

SEQ ID NO: 484900 - RNA, 64 nt, Homo Sapiens; identical to SEQ ID NO: 393120

SEQ ID NO: 484901 - RNA, 64 nt, Homo Sapiens; identical to SEQ ID NO: 393121

SEQ ID NO: 484902 - RNA, 64 nt, Homo Sapiens; identical to SEQ ID NO: 393122

SEQ ID NO: 484903 - RNA, 64 nt, Homo Sapiens; identical to SEQ ID NO: 393123

SEQ ID NO: 484904 - RNA, 64 nt, Homo Sapiens; identical to SEQ ID NO: 393124

SEQ ID NO: 484905 - RNA, 64 nt, Homo Sapiens; identical to SEQ ID NO: 393125

SEQ ID NO: 484906 - RNA, 64 nt, Homo Sapiens; identical to SEQ ID NO: 393126

SEQ ID NO: 484907 - RNA, 64 nt, Homo Sapiens; identical to SEQ ID NO: 393127

SEQ ID NO: 484908 - RNA, 64 nt, Homo Sapiens; identical to SEQ ID NO: 393128

SEQ ID NO: 484909 - RNA, 64 nt, Homo Sapiens; identical to SEQ ID NO: 393129

SEQ ID NO: 484910 - RNA, 64 nt, Homo Sapiens; identical to SEQ ID NO: 393130

SEQ ID NO: 484911 - RNA, 64 nt, Homo Sapiens; identical to SEQ ID NO: 393131

SEQ ID NO: 484912 - RNA, 64 nt, Homo Sapiens; identical to SEQ ID NO: 393132

SEQ ID NO: 484913 - RNA, 64 nt, Homo Sapiens; identical to SEQ ID NO: 393133

SEQ ID NO: 484914 - RNA, 64 nt, Homo Sapiens; identical to SEQ ID NO: 393134

SEQ ID NO: 484915 - RNA, 64 nt, Homo Sapiens; identical to SEQ ID NO: 393135

SEQ ID NO: 484916 - RNA, 64 nt, Homo Sapiens; identical to SEQ ID NO: 393136

SEQ ID NO: 484917 - RNA, 64 nt, Homo Sapiens; identical to SEQ ID NO: 393137

SEQ ID NO: 484918 - RNA, 64 nt, Homo Sapiens; identical to SEQ ID NO: 393138

SEQ ID NO: 484919 - RNA, 64 nt, Homo Sapiens; identical to SEQ ID NO: 393139

SEQ ID NO: 484920 - RNA, 64 nt, Homo Sapiens; identical to SEQ ID NO: 393140

SEQ ID NO: 484921 - RNA, 64 nt, Homo Sapiens; identical to SEQ ID NO: 393141

SEQ ID NO: 484922 - RNA, 64 nt, Homo Sapiens; identical to SEQ ID NO: 393142

SEQ ID NO: 484923 - RNA, 64 nt, Homo Sapiens; identical to SEQ ID NO: 393143

SEQ ID NO: 484924 - RNA, 64 nt, Homo Sapiens; identical to SEQ ID NO: 393144

SEQ ID NO: 484925 - RNA, 64 nt, Homo Sapiens; identical to SEQ ID NO: 393145

SEQ ID NO: 484926 - RNA, 64 nt, Homo Sapiens; identical to SEQ ID NO: 393146

SEQ ID NO: 484927 - RNA, 64 nt, Homo Sapiens; identical to SEQ ID NO: 393147

SEQ ID NO: 484928 - RNA, 64 nt, Homo Sapiens; identical to SEQ ID NO: 393148

SEQ ID NO: 484929 - RNA, 64 nt, Homo Sapiens; identical to SEQ ID NO: 393149

SEQ ID NO: 484930 - RNA, 64 nt, Homo Sapiens; identical to SEQ ID NO: 393150

SEQ ID NO: 484931 - RNA, 64 nt, Homo Sapiens; identical to SEQ ID NO: 393151

SEQ ID NO: 484932 - RNA, 64 nt, Homo Sapiens; identical to SEQ ID NO: 393152

SEQ ID NO: 484933 - RNA, 64 nt, Homo Sapiens; identical to SEQ ID NO: 393153

SEQ ID NO: 484934 - RNA, 64 nt, Homo Sapiens; identical to SEQ ID NO: 393154

SEQ ID NO: 484935 - RNA, 64 nt, Homo Sapiens; identical to SEQ ID NO: 393155

SEQ ID NO: 484936 - RNA, 64 nt, Homo Sapiens; identical to SEQ ID NO: 393156

SEQ ID NO: 484937 - RNA, 64 nt, Homo Sapiens; identical to SEQ ID NO: 393157

SEQ ID NO: 484938 - RNA, 64 nt, Homo Sapiens; identical to SEQ ID NO: 393158

SEQ ID NO: 484939 - RNA, 64 nt, Homo Sapiens; identical to SEQ ID NO: 393159

SEQ ID NO: 484940 - RNA, 64 nt, Homo Sapiens; identical to SEQ ID NO: 393160

SEQ ID NO: 484941 - RNA, 64 nt, Homo Sapiens; identical to SEQ ID NO: 393161

SEQ ID NO: 484942 - RNA, 64 nt, Homo Sapiens; identical to SEQ ID NO: 393162

SEQ ID NO: 484943 - RNA, 64 nt, Homo Sapiens; identical to SEQ ID NO: 393163

SEQ ID NO: 484944 - RNA, 64 nt, Homo Sapiens; identical to SEQ ID NO: 393164

SEQ ID NO: 484945 - RNA, 64 nt, Homo Sapiens; identical to SEQ ID NO: 393165

SEQ ID NO: 484946 - RNA, 64 nt, Homo Sapiens; identical to SEQ ID NO: 393166

SEQ ID NO: 484947 - RNA, 64 nt, Homo Sapiens; identical to SEQ ID NO: 393167

SEQ ID NO: 484948 - RNA, 64 nt, Homo Sapiens; identical to SEQ ID NO: 393168

SEQ ID NO: 484949 - RNA, 64 nt, Homo Sapiens; identical to SEQ ID NO: 393169

SEQ ID NO: 484950 - RNA, 64 nt, Homo Sapiens; identical to SEQ ID NO: 393170

SEQ ID NO: 484951 - RNA, 64 nt, Homo Sapiens; identical to SEQ ID NO: 393171

SEQ ID NO: 484952 - RNA, 64 nt, Homo Sapiens; identical to SEQ ID NO: 393172

SEQ ID NO: 484953 - RNA, 64 nt, Homo Sapiens; identical to SEQ ID NO: 393173

SEQ ID NO: 484954 - RNA, 64 nt, Homo Sapiens; identical to SEQ ID NO: 393174

SEQ ID NO: 484955 - RNA, 64 nt, Homo Sapiens; identical to SEQ ID NO: 393175

SEQ ID NO: 484956 - RNA, 64 nt, Homo Sapiens; identical to SEQ ID NO: 393176

SEQ ID NO: 484957 - RNA, 64 nt, Homo Sapiens
ugagcaaagcauugagcaaaggggucccauagaggugagggaagccugaaaaacuaagaugcug

SEQ ID NO: 484958 - RNA, 64 nt, Homo Sapiens
gggggauggcuaaaaccaucauaguacagguaaggugagggaauaguaaguggugagaacuacu

SEQ ID NO: 484959 - RNA, 64 nt, Homo Sapiens
auaaggguaagggaguauucuagucccaagaagggugagggagaggaguuugugagcuuggcuc

SEQ ID NO: 484960 - RNA, 64 nt, Homo Sapiens
caaguuucacagaggcuaagcuucuaguuuacaggugagggaaccuggugacuggcucuuauca

SEQ ID NO: 484961 - RNA, 64 nt, Homo Sapiens
guggggcuguuugagagccucccaagagggccgggugagggaugaggacaggcauccuaucccc

SEQ ID NO: 484962 - RNA, 64 nt, Homo Sapiens
gagaaccugauugcugaugauggccuuaaagguggugagggagauacugggggcagagcagacu

SEQ ID NO: 484963 - RNA, 64 nt, Homo Sapiens
accugguagugaauguguagcugggggguggggggugagggaaacgugugugcaaugccuuuuu

SEQ ID NO: 484964 - RNA, 64 nt, Homo Sapiens
caugaaccucagacuucuggcauccuuuaauaaggugagggaagauaaaaauggaauuuugcaa

SEQ ID NO: 484965 - RNA, 64 nt, Homo Sapiens
ugaucggccauagggcuuccauggguggaaacuugugagggaguuuguauuaggucuggucaug

SEQ ID NO: 484966 - RNA, 64 nt, Homo Sapiens
agcagauugccccagaggggccgguaauaaucacgugagggauaaucagauuccugcguauuca

SEQ ID NO: 484967 - RNA, 64 nt, Homo Sapiens
uugggcacccuaaguuuggguugcuaacuucaaggugagggacagaagcaaaguugugguucuc

SEQ ID NO: 484968 - RNA, 64 nt, Homo Sapiens
gaggcaucuggaugaaaaucgucuguucugacgggugagggacauuagaaggugguaccugaug

SEQ ID NO: 484969 - RNA, 64 nt, Homo Sapiens
ccuugagcagcagucagcacaggugcgugggggcgugagggaggcagggucuucaccacaggcg

SEQ ID NO: 484970 - RNA, 64 nt, Homo Sapiens
cuaagggcuggcauccacaucauuucacccugcagugagggaagaggccaccagguggcagcac

SEQ ID NO: 484971 - RNA, 64 nt, Homo Sapiens; identical to SEQ ID NO: 21897

SEQ ID NO: 484972 - RNA, 64 nt, Homo Sapiens; identical to SEQ ID NO: 21898

SEQ ID NO: 484973 - RNA, 64 nt, Homo Sapiens; identical to SEQ ID NO: 21899

SEQ ID NO: 484974 - RNA, 64 nt, Homo Sapiens; identical to SEQ ID NO: 21900

SEQ ID NO: 484975 - RNA, 64 nt, Homo Sapiens; identical to SEQ ID NO: 21901

SEQ ID NO: 484976 - RNA, 64 nt, Homo Sapiens; identical to SEQ ID NO: 21902

SEQ ID NO: 484977 - RNA, 64 nt, Homo Sapiens
ccagaaccagcagucuccuguggccaagggugagguggccaaaauggcuuagccggaggggacg

SEQ ID NO: 484978 - RNA, 64 nt, Homo Sapiens
gugagguggccaaaaccagauagccggaggggacguggccaaggcucugcuuugugcuguggcu

SEQ ID NO: 484979 - RNA, 64 nt, Homo Sapiens
auccuauggaaaaaagcccaaaaagaagacaucuguggccaacagacaugaacagacacuuuuc

SEQ ID NO: 484980 - RNA, 64 nt, Homo Sapiens
guuuucuuuuuuuuuuuuuugugagccacugcucguggccaaaaagagugcagggauuacaggc

SEQ ID NO: 484981 - RNA, 64 nt, Homo Sapiens
ucucucacaacuaggcgguccugggauggggcauguggccaagggcuccagggccaggguguga

SEQ ID NO: 484982 - RNA, 64 nt, Homo Sapiens
uggaagucucaaggucacgggaccccuaaucagaguggccaaucccugugugucguucccuugu

SEQ ID NO: 484983 - RNA, 64 nt, Homo Sapiens; identical to SEQ ID NO: 47705

SEQ ID NO: 484984 - RNA, 64 nt, Homo Sapiens; identical to SEQ ID NO: 47706

SEQ ID NO: 484985 - RNA, 64 nt, Homo Sapiens; identical to SEQ ID NO: 47707

SEQ ID NO: 484986 - RNA, 64 nt, Homo Sapiens; identical to SEQ ID NO: 47708

SEQ ID NO: 484987 - RNA, 64 nt, Homo Sapiens; identical to SEQ ID NO: 47709

SEQ ID NO: 484988 - RNA, 53 nt, Homo Sapiens; identical to SEQ ID NO: 47710

SEQ ID NO: 484989 - RNA, 64 nt, Homo Sapiens; identical to SEQ ID NO: 58517

SEQ ID NO: 484990 - RNA, 64 nt, Homo Sapiens; identical to SEQ ID NO: 58518

SEQ ID NO: 484991 - RNA, 64 nt, Homo Sapiens; identical to SEQ ID NO: 58519

SEQ ID NO: 484992 - RNA, 64 nt, Homo Sapiens; identical to SEQ ID NO: 58520

SEQ ID NO: 484993 - RNA, 64 nt, Homo Sapiens; identical to SEQ ID NO: 58521

SEQ ID NO: 484994 - RNA, 64 nt, Homo Sapiens; identical to SEQ ID NO: 58522

SEQ ID NO: 484995 - RNA, 64 nt, Homo Sapiens; identical to SEQ ID NO: 58523

SEQ ID NO: 484996 - RNA, 64 nt, Homo Sapiens; identical to SEQ ID NO: 58524

SEQ ID NO: 484997 - RNA, 64 nt, Homo Sapiens; identical to SEQ ID NO: 58525

SEQ ID NO: 484998 - RNA, 64 nt, Homo Sapiens; identical to SEQ ID NO: 58526

SEQ ID NO: 484999 - RNA, 64 nt, Homo Sapiens; identical to SEQ ID NO: 58527

SEQ ID NO: 485000 - RNA, 64 nt, Homo Sapiens; identical to SEQ ID NO: 58528

SEQ ID NO: 485001 - RNA, 64 nt, Homo Sapiens; identical to SEQ ID NO: 58529

SEQ ID NO: 485002 - RNA, 64 nt, Homo Sapiens; identical to SEQ ID NO: 58530

SEQ ID NO: 485003 - RNA, 64 nt, Homo Sapiens; identical to SEQ ID NO: 58531

SEQ ID NO: 485004 - RNA, 64 nt, Homo Sapiens; identical to SEQ ID NO: 58532

SEQ ID NO: 485005 - RNA, 64 nt, Homo Sapiens
gccccccagggccuaucgugcaagaggauggggugggggccaggcuggaaugacuagagggagc

SEQ ID NO: 485006 - RNA, 64 nt, Homo Sapiens
aauugagcaugacaucuuccucuuggugaugggugggggccaagcugacacauggauguaccua

SEQ ID NO: 485007 - RNA, 55 nt, Homo Sapiens
gucuguacacaggcgagugagcucagggggccaccugugcuccccccgcuacccu

SEQ ID NO: 485008 - RNA, 64 nt, Homo Sapiens
ggaguuaaccaaguuuggugcaggagcaggggcagggggccacuguagugagcguggagaaauu

SEQ ID NO: 485009 - RNA, 64 nt, Homo Sapiens
uccuuuucucugcccuuuuugggcugggggacuggggggccauuaccuggcugccccucaccuu

SEQ ID NO: 485010 - RNA, 64 nt, Homo Sapiens
ggggaacugagggcaaggggaggcaucccagccugggggccaguauucuggucauuucccccaa

SEQ ID NO: 485011 - RNA, 64 nt, Homo Sapiens
ggcugguuagcggaugugggaggcugugaccccagggggccauagggugcgguggaacugcagg

SEQ ID NO: 485012 - RNA, 64 nt, Homo Sapiens
gguuagggcucuggaggugcuuucacucaaccaagggggccacagcacuggggagugaaacugc

SEQ ID NO: 485013 - RNA, 64 nt, Homo Sapiens
cuccugcaacugacccaguccgcaaauauuuauugggggccagcccagggcugggacugggcau

SEQ ID NO: 485014 - RNA, 64 nt, Homo Sapiens
cuggcucgacccaggacuuggguugaggaugcacgggggccaccuugcccggggccacuggugg

SEQ ID NO: 485015 - RNA, 64 nt, Homo Sapiens
guaagugucaagugggaggauacugcccccuugugggggccagacgggucggacacggcugugc

SEQ ID NO: 485016 - RNA, 64 nt, Homo Sapiens
ucuguaacaucccacaucugccagggaagggucugggggccaguggaggccugaggugucccuc

SEQ ID NO: 485017 - RNA, 64 nt, Homo Sapiens
uccuuuugguuuuguggggagaggggaaggaucagggggccaggccagcagcucgggggccaca

SEQ ID NO: 485018 - RNA, 64 nt, Homo Sapiens
gaggggaaggaucagggggccaggccagcagcucgggggccacaaggagauggauaaugugccu

SEQ ID NO: 485019 - RNA, 64 nt, Homo Sapiens
uagggggcacugcuugaagcacagcacuugguuagggggccacagaggccuaaguuugcuggcc

SEQ ID NO: 485020 - RNA, 64 nt, Homo Sapiens
ucuguagccucccccuugcccucaaagggggagugggggccagcuuuaccucacccacugugac

SEQ ID NO: 485021 - RNA, 64 nt, Homo Sapiens
gcagcagucaccacuagggggugauggagaggaagggggccaccccagggccauuaacaaccag

SEQ ID NO: 485022 - RNA, 64 nt, Homo Sapiens
cuccuugaggggcucuucuggucagccccacccugggggccauuuccccauuaacuacccccag

SEQ ID NO: 485023 - RNA, 54 nt, Homo Sapiens
gugcugaggaggggcugugagccugggggccacuguggacagacgugggcuuca

SEQ ID NO: 485024 - RNA, 64 nt, Homo Sapiens
gguggggaagggaagccagauccagcacccccuggggggccaucgggaguguggcuggggguga

SEQ ID NO: 485025 - RNA, 64 nt, Homo Sapiens
gaggaaggaaauguucauuuaagccacaaggcgcgggggccacuccuaggcccagucucaaagg

SEQ ID NO: 485026 - RNA, 64 nt, Homo Sapiens
cagccagccagaugccuggcaagagggaccaagagggggccacgcuugucacccauugagcugc

SEQ ID NO: 485027 - RNA, 64 nt, Homo Sapiens
agccggccagcaguggagacagcaucagggaagagggggccaugggcuggggcagcuccugggg

SEQ ID NO: 485028 - RNA, 64 nt, Homo Sapiens
ggcuaccccuacugcgcggcaacccugaggccaagggggccacuccaccaagcuccucccccag

SEQ ID NO: 485029 - RNA, 64 nt, Homo Sapiens
gaggggguggaggacucuccccugccucuggggagggggccaucugcugcgcccggccccacug

SEQ ID NO: 485030 - RNA, 64 nt, Homo Sapiens
aguaugcaccuuguguugagagagaggcaacccugggggccaguucaggugguccccaaccaua

SEQ ID NO: 485031 - RNA, 64 nt, Homo Sapiens
ccagccccucccaccacagcaggugucauauauggggggccaacaccagggaugguacuagggg

SEQ ID NO: 485032 - RNA, 64 nt, Homo Sapiens
gcaaaggacuguuuuuuccugagcuuggccagaagggggccaugaggccucaguggacuuucca

SEQ ID NO: 485033 - RNA, 64 nt, Homo Sapiens
ugagcugagauggaacccuuuuggcccccgagcugggggccaugagcuccagacccccagcaac

SEQ ID NO: 485034 - RNA, 64 nt, Homo Sapiens
ccgcuauuaucugcguucucugccaaagacucgugggggccaucacaccugcccugugcagcgg

SEQ ID NO: 485035 - RNA, 64 nt, Homo Sapiens
guuugcuuccccugugcccacugcuguaugaucugggggccaccacccugugccgguggccucu

SEQ ID NO: 485036 - RNA, 64 nt, Homo Sapiens
augaccccuucucucuccagcuggaggguaacuggggggccaccccaaagaaggcagggaaugc

SEQ ID NO: 485037 - RNA, 64 nt, Homo Sapiens
gaaggcagggaaugccuggaagguugguuccuuggggggccaaacuuaccucggggagaggggg

SEQ ID NO: 485038 - RNA, 64 nt, Homo Sapiens
uccccaggccguggcugcccgggcagcacagagagggggccaccagcuguuagaguccaacgug

SEQ ID NO: 485039 - RNA, 64 nt, Homo Sapiens
ugcacagacgucccuccacgcacgugggucuucagggggccaggccgcaaugugcccccagacg

SEQ ID NO: 485040 - RNA, 64 nt, Homo Sapiens
uucagguagcugcuuggcggcggccagccccacagggggccaggggcauggccacaggcccccc

SEQ ID NO: 485041 - RNA, 64 nt, Homo Sapiens
ggagcugggcuggggcugcugcucuggggucuccgggggccacagcuuggggugaguugaagac

SEQ ID NO: 485042 - RNA, 64 nt, Homo Sapiens
ucuccaggggcagggggauuuuaggagauggggugggggccagccccuacuggacccuuguaau

SEQ ID NO: 485043 - RNA, 64 nt, Homo Sapiens
gugcucccccacuuccaggccuuaguuggggugggggggccagcuccugggccuggggucuucu

SEQ ID NO: 485044 - RNA, 64 nt, Homo Sapiens
ccggggcucccaggcgagggagccccuccccgcagggggccaggaggcccccucccuggaggcc

SEQ ID NO: 485045 - RNA, 64 nt, Homo Sapiens
cuccagagagggggcaccucucccccacccuggggggggccaggagcaauaagggcuggguuug

SEQ ID NO: 485046 - RNA, 64 nt, Homo Sapiens
caagugugggugugugagugcccccaaagcaucggggggccacgugcugugccuagucuagugu

SEQ ID NO: 485047 - RNA, 64 nt, Homo Sapiens
guguuucugugcuccaaguuggcccucagcugucgggggccacuaggccugcccugcuauuuca

SEQ ID NO: 485048 - RNA, 64 nt, Homo Sapiens
guccugcucaacucuaccccaccuacuaggagaggggggccaaggcaugugucccaggagcagg

SEQ ID NO: 485049 - RNA, 64 nt, Homo Sapiens
caggcugcagaggcaccucagagggccccugugugggggccaguaagugugcacuccagcuucg

SEQ ID NO: 485050 - RNA, 64 nt, Homo Sapiens
uagugguuaauagaguuuacagugagcuugccuuaggauggaccagcaagcccccguggacccu

SEQ ID NO: 485051 - RNA, 64 nt, Homo Sapiens
uucuguguagauagagauggugucaaggaggugcaggauggagaugggagauuucauggagccu

SEQ ID NO: 485052 - RNA, 64 nt, Homo Sapiens
gcccccugcguguguauauuggugggaggcauagaggauggauguucuagaaaugaguaagaca

SEQ ID NO: 485053 - RNA, 64 nt, Homo Sapiens
ucggucacaugccagguccccagcuacgcauucaaggauggauaauauacauagcagcacaucc

SEQ ID NO: 485054 - RNA, 64 nt, Homo Sapiens
acagauucugcuuugaauauagcuacagaaauaaaggauggacuacagugugggacagguaauu

SEQ ID NO: 485055 - RNA, 64 nt, Homo Sapiens
gaagacucuguuucgaauauagccacagaaauaaaggauggagaaaaaucugggacagguaauu

SEQ ID NO: 485056 - RNA, 64 nt, Homo Sapiens
aaagauucuguuucgaacauagccacagaaauaaaggauggagaaaaaucugggacagguaauu

SEQ ID NO: 485057 - RNA, 64 nt, Homo Sapiens
gaagguucuguuuugaguauagccagagaaaacaaggauggagaaaaaucuaggacagguaauu

SEQ ID NO: 485058 - RNA, 64 nt, Homo Sapiens
aaggauucuuuuucgaauauaaccagaggaaaaaaggauggagaaauaucuaggaaagguaauu

SEQ ID NO: 485059 - RNA, 64 nt, Homo Sapiens
aaggauucuuuuucgaauauaaccagagaaaaaaaggauggagaaauaucuaggaaagguaauu

SEQ ID NO: 485060 - RNA, 64 nt, Homo Sapiens
gaagauucuguuuuggguauagccagagaaaacaaggauggagaaaaaucuaggacagguaauu

SEQ ID NO: 485061 - RNA, 64 nt, Homo Sapiens
aagggagacagcuugcagauaaaggguuucaccaaggauggagauuccacguugccuucugcgc

SEQ ID NO: 485062 - RNA, 64 nt, Homo Sapiens
gaaguaucagcacccagaagacaccaagaacaugaggauggagaaaaacacaaaacauaauaaa

SEQ ID NO: 485063 - RNA, 64 nt, Homo Sapiens
gaaagcugggacaagcagggccucccugggguggaggauggaagauucuggccagucccugcau

SEQ ID NO: 485064 - RNA, 64 nt, Homo Sapiens
ggucagggggagaaaggaaauauugggguuucccaggauggauugauguggcaaucaaugacac

SEQ ID NO: 485065 - RNA, 64 nt, Homo Sapiens
uacuuugcugcccuugccauuaaauuguaggagcaggauggaaaacacuaaaaaagaagguuuc

SEQ ID NO: 485066 - RNA, 64 nt, Homo Sapiens
ccaccgcugcccugccauccgguuccuguggcccaggauggaggguauagacaaggcugagcag

SEQ ID NO: 485067 - RNA, 64 nt, Homo Sapiens
uguggcucuucucaucuuuggauaggauggagauaggauggagaguuggggagagaaggaugga

SEQ ID NO: 485068 - RNA, 64 nt, Homo Sapiens
uaggauggagauguggcucuagaaggauggagauaggauggagaaaccacacgcuguuggggag

SEQ ID NO: 485069 - RNA, 64 nt, Homo Sapiens
uaggauggagauaggauggacuguuggggagagaaggauggagacugaaacagacaaccacacg

SEQ ID NO: 485070 - RNA, 64 nt, Homo Sapiens
aaaacagacugugggaaggagaggugaggauggaaggauggagagagaaaguuaucaagagaaa

SEQ ID NO: 485071 - RNA, 64 nt, Homo Sapiens
gauggagaaaaacagacuguaagagaaagaggugaggauggaaguuugggaagagaaaguuauc

SEQ ID NO: 485072 - RNA, 64 nt, Homo Sapiens
ccauggucaguugugagcauuuugguuuccgcaaaggauggauggugagcaucaugggaaagcu

SEQ ID NO: 485073 - RNA, 64 nt, Homo Sapiens
auauuggcccagcaaggcaaagaacugaaguuccaggauggaagaaccuguguucuccucauaa

SEQ ID NO: 485074 - RNA, 64 nt, Homo Sapiens
cuuuuagaugacauucuacaagggggaccauaaaaggauggaaauucgaguuuuucaaauugug

SEQ ID NO: 485075 - RNA, 64 nt, Homo Sapiens
uuucuagagguugggccuuagugaauaagaaaguaggauggagcuuaauguauuguaucaaauu

SEQ ID NO: 485076 - RNA, 64 nt, Homo Sapiens
cccuauuugcuuaaaaguacaggcucccuaagagaggauggagagggagagacugaauuguuag

SEQ ID NO: 485077 - RNA, 64 nt, Homo Sapiens
acauauuccaaaacccuucuuuuuaaaaggaaaaaggauggagagaaggauggaaagccuggac

SEQ ID NO: 485078 - RNA, 64 nt, Homo Sapiens
acccuucuuuuuaaaaggaaaaaggauggagagaaggauggaaagccuggacuuaaaccuuuag

SEQ ID NO: 485079 - RNA, 64 nt, Homo Sapiens
cgggcgcuguccuugccggguacaguauuaggugaggauggaugcuccuuagcccgucacucca

SEQ ID NO: 485080 - RNA, 64 nt, Homo Sapiens
ugugugcacaagaacugugggaggcaggggugagaggauggaauuguuccugggccuggcgggg

SEQ ID NO: 485081 - RNA, 64 nt, Homo Sapiens
cucacuauggcaugcuucccuccuggugggcccuaggauggaugacacucaagauacuacagau

SEQ ID NO: 485082 - RNA, 64 nt, Homo Sapiens
uaucucuacuuggaucaauucuggucauuucaagaggauggaggccucaagugugggaacuucc

SEQ ID NO: 485083 - RNA, 64 nt, Homo Sapiens
gcuuuguacugcucucugggagccucccugcuugaggauggaaggaugaaauuugacgaauaua

SEQ ID NO: 485084 - RNA, 64 nt, Homo Sapiens
caaagccggggaccaucuguauugcuuuguuuuuaggauggagaaugucagaucaaguuagaaa

SEQ ID NO: 485085 - RNA, 64 nt, Homo Sapiens
gaugagaaggcccgucugcagcaccaggucacugaggauggagaguucuggugaguccagaacc

SEQ ID NO: 485086 - RNA, 64 nt, Homo Sapiens
cauucuuucacaggagcuuuucaugcauuugacaaggauggagaugguaucaucaagcucaacg

SEQ ID NO: 485087 - RNA, 64 nt, Homo Sapiens
uauggagagcucugauuccuacauaauaugaauaaggauggauaggccgggcgugguggcucau

SEQ ID NO: 485088 - RNA, 64 nt, Homo Sapiens
uaacagagcgagaccccgacucaauaaauaaauaaggauggauaaauuguagcguaugcaccau

SEQ ID NO: 485089 - RNA, 64 nt, Homo Sapiens
ggggacacuugcuuaggggcuuccaguguuggacaggauggaggaguuucuguugacccccacc

SEQ ID NO: 485090 - RNA, 64 nt, Homo Sapiens
ucagggacggacccagccuggcccagguugcaacaggauggaauuacagaaccaacauugugac

SEQ ID NO: 485091 - RNA, 64 nt, Homo Sapiens
ccuuuuagaggcuugcuauauuucugauucuguuucucaguagucccuaacuagaguucuagag

SEQ ID NO: 485092 - RNA, 64 nt, Homo Sapiens
ucauuaacucauugaaagauuccacgaggcucauucucaguaucaaaggguaggcauggaaaau

SEQ ID NO: 485093 - RNA, 64 nt, Homo Sapiens
uguuuaagaucacacagcuagugcaguuacccccucucaguaauuauguuuggcaaauaugaaa

SEQ ID NO: 485094 - RNA, 64 nt, Homo Sapiens
aauuagggacauggaugaaauuggaaaucuucauucucaguaaacuaucgcaaggacaaaaaac

SEQ ID NO: 485095 - RNA, 64 nt, Homo Sapiens
ucccaaucaugaaaaucccuaucuucagcuugucucucaguauuagaagcauagcccuuaacaa

SEQ ID NO: 485096 - RNA, 64 nt, Homo Sapiens
uaugauugaagcaaauucuacgugcauauuucagucucaguauuuuucaguucauugauuuaua

SEQ ID NO: 485097 - RNA, 64 nt, Homo Sapiens
acaugaaaauuguugcuucuuucauuacuaacaaucucaguacaucacuaauauuuggaaguau

SEQ ID NO: 485098 - RNA, 64 nt, Homo Sapiens
ggaguagaauucaucugguuuaaauaucuaaaugucucaguagaggaauagcgauagauuuaua

SEQ ID NO: 485099 - RNA, 64 nt, Homo Sapiens
acuggauggaaagacaaacugcacaggcagauguuugccucauaauagucguaaguggaguccu

SEQ ID NO: 485100 - RNA, 64 nt, Homo Sapiens
gcaacccagucacacuguggccaguaaaauacuauugccucauauuguccucugcaagcuucuu

SEQ ID NO: 485101 - RNA, 64 nt, Homo Sapiens
cacaugggagaaaaagucauccaguuuuucauguuugccucaaguaaucuuuacaguguuacaa

SEQ ID NO: 485102 - RNA, 64 nt, Homo Sapiens
gagaaguugcuuugcucagugcuuugccccaggauugccucaaaucugaguggacuucauccuu

SEQ ID NO: 485103 - RNA, 64 nt, Homo Sapiens
cauuacuccugugugacaguccagcauugagaauuugccucacuucaccucagcuguacaaacu

SEQ ID NO: 485104 - RNA, 64 nt, Homo Sapiens
aacucucucuuuguuuuuaaaauguguauaauuauugccucauaugaggcucaaguaaauccuc

SEQ ID NO: 485105 - RNA, 64 nt, Homo Sapiens
uaaaaagugcuuuugugagcagcaagacuucucuuugccucaaacuuggaacuggaauccuuuc

SEQ ID NO: 485106 - RNA, 64 nt, Homo Sapiens
uuuuuccuugcaaauguaguuauaccuguguuucuugccucauucugcucguccccaagugacc

SEQ ID NO: 485107 - RNA, 64 nt, Homo Sapiens
cucccaagcaguugggacuauucaagcgauucucuugccucaacugcaaccuccaccuccuggg

SEQ ID NO: 485108 - RNA, 64 nt, Homo Sapiens
ucagguauaccucacuuuacgcucaacucucuuauugccucacuucucuccaggcaggucugaa

SEQ ID NO: 485109 - RNA, 64 nt, Homo Sapiens
uccagccuccaagucaccuggccugggaaaguacuugccucauguugcucugguuugugauaau

SEQ ID NO: 485110 - RNA, 64 nt, Homo Sapiens
aacugaagacagccuuugugcggugccuccaacuuugccucaaaugggacaguggguugaggga

SEQ ID NO: 485111 - RNA, 64 nt, Homo Sapiens
uuucaccccccaccccccacguucaccuuugaccuugccucaccaccccucccuccgagcugca

SEQ ID NO: 485112 - RNA, 64 nt, Homo Sapiens
uuuaaccccccaccugagcccuucaccgcugaccuugccucaccaccccucccucugagcugca

SEQ ID NO: 485113 - RNA, 64 nt, Homo Sapiens
caucauaaagcagagacuuacaugagugaaaggguugccucaucaagcagcucaguguaaaugg

SEQ ID NO: 485114 - RNA, 64 nt, Homo Sapiens
ggagucaaaugcuuuuauaaaguuccuucagugguugccucacuugcguuuuccuacaagaugu

SEQ ID NO: 485115 - RNA, 64 nt, Homo Sapiens
aaacuucaugagggucucuuaugagccugcggguuugccucaagugccgagagaagaggagugg

SEQ ID NO: 485116 - RNA, 64 nt, Homo Sapiens
aagaacucuugggccagccaagcugccacuucuuuugccucaugugcucucuaccuaggacacc

SEQ ID NO: 485117 - RNA, 64 nt, Homo Sapiens
gagaaagagaaauaaccugucucucauuccuaaguugccucauuaauuuucaugaacaagaaua

SEQ ID NO: 485118 - RNA, 64 nt, Homo Sapiens
acacagcuaugauggaaugauauauccaaguuccuugccucagugaaauaugcauauguauauc

SEQ ID NO: 485119 - RNA, 64 nt, Homo Sapiens; identical to SEQ ID NO: 72083

SEQ ID NO: 485120 - RNA, 64 nt, Homo Sapiens; identical to SEQ ID NO: 72084

SEQ ID NO: 485121 - RNA, 64 nt, Homo Sapiens; identical to SEQ ID NO: 72085

SEQ ID NO: 485122 - RNA, 64 nt, Homo Sapiens; identical to SEQ ID NO: 72086

SEQ ID NO: 485123 - RNA, 64 nt, Homo Sapiens; identical to SEQ ID NO: 72087

SEQ ID NO: 485124 - RNA, 64 nt, Homo Sapiens; identical to SEQ ID NO: 72088

SEQ ID NO: 485125 - RNA, 64 nt, Homo Sapiens; identical to SEQ ID NO: 72089

SEQ ID NO: 485126 - RNA, 64 nt, Homo Sapiens; identical to SEQ ID NO: 72090

SEQ ID NO: 485127 - RNA, 64 nt, Homo Sapiens; identical to SEQ ID NO: 72091

SEQ ID NO: 485128 - RNA, 64 nt, Homo Sapiens; identical to SEQ ID NO: 72092

SEQ ID NO: 485129 - RNA, 64 nt, Homo Sapiens; identical to SEQ ID NO: 72093

SEQ ID NO: 485130 - RNA, 64 nt, Homo Sapiens; identical to SEQ ID NO: 72094

SEQ ID NO: 485131 - RNA, 64 nt, Homo Sapiens; identical to SEQ ID NO: 72095

SEQ ID NO: 485132 - RNA, 64 nt, Homo Sapiens; identical to SEQ ID NO: 72096

SEQ ID NO: 485133 - RNA, 64 nt, Homo Sapiens; identical to SEQ ID NO: 72097

SEQ ID NO: 485134 - RNA, 64 nt, Homo Sapiens; identical to SEQ ID NO: 72098

SEQ ID NO: 485135 - RNA, 64 nt, Homo Sapiens; identical to SEQ ID NO: 72099

SEQ ID NO: 485136 - RNA, 64 nt, Homo Sapiens; identical to SEQ ID NO: 72100

SEQ ID NO: 485137 - RNA, 64 nt, Homo Sapiens; identical to SEQ ID NO: 72101

SEQ ID NO: 485138 - RNA, 64 nt, Homo Sapiens; identical to SEQ ID NO: 72102

SEQ ID NO: 485139 - RNA, 64 nt, Homo Sapiens; identical to SEQ ID NO: 72103

SEQ ID NO: 485140 - RNA, 64 nt, Homo Sapiens; identical to SEQ ID NO: 72104

SEQ ID NO: 485141 - RNA, 64 nt, Homo Sapiens; identical to SEQ ID NO: 72105

SEQ ID NO: 485142 - RNA, 64 nt, Homo Sapiens; identical to SEQ ID NO: 72106

SEQ ID NO: 485143 - RNA, 64 nt, Homo Sapiens; identical to SEQ ID NO: 72107

SEQ ID NO: 485144 - RNA, 64 nt, Homo Sapiens; identical to SEQ ID NO: 72108

SEQ ID NO: 485145 - RNA, 64 nt, Homo Sapiens; identical to SEQ ID NO: 72109

SEQ ID NO: 485146 - RNA, 64 nt, Homo Sapiens
ugcuacaacauagaucauaugugaagacuuuguuauaccuuauuuagaacauuuuauuuauacu

SEQ ID NO: 485147 - RNA, 64 nt, Homo Sapiens
ucucuaagacuggcucuuagucacuaucucagaaauaccuuaaugagcaaaacauagaacaaaa

SEQ ID NO: 485148 - RNA, 64 nt, Homo Sapiens
gugaagaauguggcaaagauuucuauugauucucauaccuuacuaaauauaagauaauucauau

SEQ ID NO: 485149 - RNA, 64 nt, Homo Sapiens
augaggaaugucucaaagcuuuuuacugauucuuauaccuuacuaaacauaaaauaauucauaa

SEQ ID NO: 485150 - RNA, 64 nt, Homo Sapiens; identical to SEQ ID NO: 380673

SEQ ID NO: 485151 - RNA, 64 nt, Homo Sapiens; identical to SEQ ID NO: 380674

SEQ ID NO: 485152 - RNA, 64 nt, Homo Sapiens; identical to SEQ ID NO: 380675

SEQ ID NO: 485153 - RNA, 64 nt, Homo Sapiens; identical to SEQ ID NO: 380676

SEQ ID NO: 485154 - RNA, 63 nt, Homo Sapiens; identical to SEQ ID NO: 380677

SEQ ID NO: 485155 - RNA, 64 nt, Homo Sapiens; identical to SEQ ID NO: 380678

SEQ ID NO: 485156 - RNA, 64 nt, Homo Sapiens; identical to SEQ ID NO: 380679

SEQ ID NO: 485157 - RNA, 64 nt, Homo Sapiens; identical to SEQ ID NO: 380680

SEQ ID NO: 485158 - RNA, 64 nt, Homo Sapiens; identical to SEQ ID NO: 380681

SEQ ID NO: 485159 - RNA, 64 nt, Homo Sapiens; identical to SEQ ID NO: 380682

SEQ ID NO: 485160 - RNA, 64 nt, Homo Sapiens; identical to SEQ ID NO: 380683

SEQ ID NO: 485161 - RNA, 64 nt, Homo Sapiens; identical to SEQ ID NO: 380684

SEQ ID NO: 485162 - RNA, 64 nt, Homo Sapiens; identical to SEQ ID NO: 380685

SEQ ID NO: 485163 - RNA, 64 nt, Homo Sapiens; identical to SEQ ID NO: 380686

SEQ ID NO: 485164 - RNA, 58 nt, Homo Sapiens; identical to SEQ ID NO: 380687

SEQ ID NO: 485165 - RNA, 64 nt, Homo Sapiens; identical to SEQ ID NO: 380688

SEQ ID NO: 485166 - RNA, 64 nt, Homo Sapiens; identical to SEQ ID NO: 380689

SEQ ID NO: 485167 - RNA, 64 nt, Homo Sapiens; identical to SEQ ID NO: 380690

SEQ ID NO: 485168 - RNA, 64 nt, Homo Sapiens; identical to SEQ ID NO: 380691

SEQ ID NO: 485169 - RNA, 64 nt, Homo Sapiens; identical to SEQ ID NO: 380692

SEQ ID NO: 485170 - RNA, 64 nt, Homo Sapiens; identical to SEQ ID NO: 380693

SEQ ID NO: 485171 - RNA, 64 nt, Homo Sapiens; identical to SEQ ID NO: 380694

SEQ ID NO: 485172 - RNA, 64 nt, Homo Sapiens; identical to SEQ ID NO: 380695

SEQ ID NO: 485173 - RNA, 64 nt, Homo Sapiens; identical to SEQ ID NO: 380696

SEQ ID NO: 485174 - RNA, 64 nt, Homo Sapiens; identical to SEQ ID NO: 380697

SEQ ID NO: 485175 - RNA, 64 nt, Homo Sapiens; identical to SEQ ID NO: 380698

SEQ ID NO: 485176 - RNA, 64 nt, Homo Sapiens; identical to SEQ ID NO: 380699

SEQ ID NO: 485177 - RNA, 64 nt, Homo Sapiens; identical to SEQ ID NO: 380700

SEQ ID NO: 485178 - RNA, 64 nt, Homo Sapiens; identical to SEQ ID NO: 380701

SEQ ID NO: 485179 - RNA, 64 nt, Homo Sapiens
uccucugcugagaauccccacuugguguagggggagaggggaaaggggucuggcccaucgaggg

SEQ ID NO: 485180 - RNA, 64 nt, Homo Sapiens
ccucccacugccugacaccugggacaggcugggcagaggggagagagggcaggacaggccagag

SEQ ID NO: 485181 - RNA, 64 nt, Homo Sapiens
ugucacggagaaucuaucuaaucccacuguauuaagaggggaaaccgggccaagcgcaguggcu

SEQ ID NO: 485182 - RNA, 64 nt, Homo Sapiens
agcgaaacuccgucucaaaaaaaaauaaaaaugaagaggggaaaccagaauaaauuaucuuuug

SEQ ID NO: 485183 - RNA, 64 nt, Homo Sapiens
agaauggcccaaggaacuaggaagcagccaugggagaggggaaggguucaagcccgggaugggc

SEQ ID NO: 485184 - RNA, 64 nt, Homo Sapiens
gucugcucuccuuugcucucugcagcuguaagccagaggggauucaagguaaauaggcuuuaca

SEQ ID NO: 485185 - RNA, 64 nt, Homo Sapiens
uucuggguaaggcucaucuuuaaaaacuggcuucagaggggagaggggagaacaaugaauuggc

SEQ ID NO: 485186 - RNA, 64 nt, Homo Sapiens
uaaggcucaucuuuaaaaacuggcuucagaggggagaggggagaacaaugaauuggcucuauuu

SEQ ID NO: 485187 - RNA, 64 nt, Homo Sapiens
agagagugcagagcuccaggacagaggggauuaaagaggggaggaagagcagaagggaggggag

SEQ ID NO: 485188 - RNA, 64 nt, Homo Sapiens
aaagaggggaggagagagugaagggaggggagacagaggggauuggaugggggcugaagagcag

SEQ ID NO: 485189 - RNA, 64 nt, Homo Sapiens
aggaggacuaaaugaaaaguaggcuggggagcacagaggggagguuugccaucaccaguuucuc

SEQ ID NO: 485190 - RNA, 64 nt, Homo Sapiens
ucccuguccccagagggaggagcaggcaggagagagaggggaaggagguaugaaucccaguccc

SEQ ID NO: 485191 - RNA, 64 nt, Homo Sapiens
caggaaacacccccaggaggccaagccugaaaacagaggggagggaggaaggaaggagucccag

SEQ ID NO: 485192 - RNA, 64 nt, Homo Sapiens
uuuuuuuuuuucagauacugugcuugauuuuuggagaggggagagguggaaauuccuaaauggc

SEQ ID NO: 485193 - RNA, 64 nt, Homo Sapiens
uuugcagagucaacagcccaucagcccauguuuuagaggggacacuuugguccucgguucccac

SEQ ID NO: 485194 - RNA, 64 nt, Homo Sapiens
uccagagucaaugaacgucaaaaagguuaagaugagaggggacuacaaaccugaugccuuaagg

SEQ ID NO: 485195 - RNA, 64 nt, Homo Sapiens
gaagggucauagcuaaaugccugcccacauccacagaggggagaucuuccugccucuccccacc

SEQ ID NO: 485196 - RNA, 64 nt, Homo Sapiens
ucuuacucuucccauuccucagaccagcaggaaaagaggggagacgucagucuuuuuccugugg

SEQ ID NO: 485197 - RNA, 64 nt, Homo Sapiens
uuaccccucagcccaccucacuauggugcuggguagaggggauaccuggguucuaaccucuaaa

SEQ ID NO: 485198 - RNA, 64 nt, Homo Sapiens
gaugcuuuauggaauguaagcacccagggacaagagaggggaaaccaagugugacauccuucag

SEQ ID NO: 485199 - RNA, 64 nt, Homo Sapiens
gauggguaggugcuuuccaaaaaugagcagugugagaggggagggucugagauggaucauaagu

SEQ ID NO: 485200 - RNA, 64 nt, Homo Sapiens
uguguccugcuuauuaaaugucugacaugguaggagaggggagaaaauucagcaaguuauuaaa

SEQ ID NO: 485201 - RNA, 64 nt, Homo Sapiens
cuccaaaagagucaucgcagaauuaugccuuggcagaggggagaaugcaagggagccaguacug

SEQ ID NO: 485202 - RNA, 64 nt, Homo Sapiens
gggauagaggaaagggauggucugugacgcagacagaggggaugucuucagaacacacagacuu

SEQ ID NO: 485203 - RNA, 64 nt, Homo Sapiens
gagaaccaccacugccugaccacgugcgacagagagaggggagauguaaauguagcugagaccc

SEQ ID NO: 485204 - RNA, 64 nt, Homo Sapiens
ccuaggcugccucaauggagauagagauggcugaagaggggaagauuuggaaauaaagaaugug

SEQ ID NO: 485205 - RNA, 64 nt, Homo Sapiens
gugggcaugggaggggucugauauuugcuuuccuagaggggaguucugcagagaugccugugag

SEQ ID NO: 485206 - RNA, 64 nt, Homo Sapiens
ggauucuugcugcugguauggcccccauguugggagaggggaguugcuagagcccuuccucuca

SEQ ID NO: 485207 - RNA, 64 nt, Homo Sapiens
cacagagagguaaaauggaggccagugccauuucagaggggaggcucaggaaggcuucuugcuu

SEQ ID NO: 485208 - RNA, 64 nt, Homo Sapiens
cucucuggcccacucaugauggagaaguguggucagaggggagcaaugggcuuugcugcuuaug

SEQ ID NO: 485209 - RNA, 64 nt, Homo Sapiens
acgccagcugcggggacgcacuugggacuccucgagaggggacucgcggccgcgauggcaaggc

SEQ ID NO: 485210 - RNA, 64 nt, Homo Sapiens
ugguccuguggucagagcccaagcagcacucaggagaggggagaaaggaggugcaccuggcagc

SEQ ID NO: 485211 - RNA, 64 nt, Homo Sapiens
uguggagagcuccuggugucgaggacugagacugagaggggagcccccuccaucuggcccccuu

SEQ ID NO: 485212 - RNA, 64 nt, Homo Sapiens
ggauaggcgcaguggucagaugaagcagcgccagagaggggaccucccagcucuuauuugcacc

SEQ ID NO: 485213 - RNA, 64 nt, Homo Sapiens
ggagguagaggagcuauguggagcaaaggccgacagaggggaaggaauggaccugugagaggaa

SEQ ID NO: 485214 - RNA, 64 nt, Homo Sapiens
uuuauuuuuaauuuaucucugugaccugccagggagaggggagagagagagagaugcuguugag

SEQ ID NO: 485215 - RNA, 64 nt, Homo Sapiens
agaggcagagagggaaagagagggagagagagacagaggggaagagagagggagagagagacag

SEQ ID NO: 485216 - RNA, 64 nt, Homo Sapiens
gagauaugaggagagagagaaaagagagguggggagaggggagaauggagaggaggggagagag

SEQ ID NO: 485217 - RNA, 64 nt, Homo Sapiens
accugugacacccugaguccgggagccuguccucagaggggacauucucugcauuccuuccggg

SEQ ID NO: 485218 - RNA, 64 nt, Homo Sapiens
uugggagccugggcuugaagcuaaggaggagugcagaggggaccgggcugcuggguuggagggg

SEQ ID NO: 485219 - RNA, 64 nt, Homo Sapiens
gaagcugauaugaggaagggaagcugagccaggcagaggggaaaggaggggagaagcccagcag

SEQ ID NO: 485220 - RNA, 64 nt, Homo Sapiens
gugcguauuuauucagggagggguggcuugaggaagaggggaagcccaggucugacguccuugg

SEQ ID NO: 485221 - RNA, 64 nt, Homo Sapiens
gaagcccaugacuucagacaauggcuuuggugggagaggggauauuuaacccuuuagcccuagg

SEQ ID NO: 485222 - RNA, 64 nt, Homo Sapiens
gacuggccccugggaagcuccaagguuccccaggagaggggaggaaguauguugguggugaaag

SEQ ID NO: 485223 - RNA, 64 nt, Homo Sapiens
uuuuaaggaaagaagccgugcggcagugcagaccagaggggacccaccccucuccuuuggccuc

SEQ ID NO: 485224 - RNA, 64 nt, Homo Sapiens
gcugaggacacuggcccuuacucucccguggaggagaggggauguccugggaugguacccugug

SEQ ID NO: 485225 - RNA, 64 nt, Homo Sapiens
gcaggggcauggcacccuuuccugucgggaagggagaggggaacuacccccccagccugcccuc

SEQ ID NO: 485226 - RNA, 64 nt, Homo Sapiens
ucucagugccccugcccuaggggugucugucuccagaggggagggacaaauccccuacuggggc

SEQ ID NO: 485227 - RNA, 64 nt, Homo Sapiens
cucacuaccgccagacaccccgguggaagcauuuagaggggaccacgggagggacaaggcuucu

SEQ ID NO: 485228 - RNA, 64 nt, Homo Sapiens
ucacauccucaggucucgggaccauggggggcucagaggggagacacaccuacugcuuccucag

SEQ ID NO: 485229 - RNA, 64 nt, Homo Sapiens
ggcauguugcuccacauuccuuacacacagggguagaggggauugcuuuugugacccacguuca

SEQ ID NO: 485230 - RNA, 64 nt, Homo Sapiens
cucuuguacggaugaucgcaaaacugagguguagagaggggaauggccaaaaucacaaagcaag

SEQ ID NO: 485231 - RNA, 64 nt, Homo Sapiens
gaaacagaaccaauaggauauauaagcccaaauaagaggggauuuauuaugggaauuggcucuc

SEQ ID NO: 485232 - RNA, 64 nt, Homo Sapiens
aaaucaaaacaaagaaccugcucugaugacacuuagaggggagagaugaaagccaaacaaauga

SEQ ID NO: 485233 - RNA, 64 nt, Homo Sapiens
ugugcaggaaccagcaaugauuggggggaggaauagaggggaggccuuuagacuaacgaauaua

SEQ ID NO: 485234 - RNA, 64 nt, Homo Sapiens
ggagaguguggggaauaggauggaauaagggaggagaggggacuaaggcaggaaugcuggagcc

SEQ ID NO: 485235 - RNA, 64 nt, Homo Sapiens
agaaggaagggaagggcagauuugggggaggcggagaggggagacuuccuuccagggcuuuucc

SEQ ID NO: 485236 - RNA, 64 nt, Homo Sapiens
gaccugcucagagucauugcaaacagaagccuggagaggggaguuucuuaggcaaacgccugca

SEQ ID NO: 485237 - RNA, 64 nt, Homo Sapiens
cucugggacaggggcuggggcuggggugggacccagaggggagggaaggaggugugcguggcuu

SEQ ID NO: 485238 - RNA, 64 nt, Homo Sapiens
cacaguggacugaaaggacugccugucccaagcgagaggggagagguugcacuggccagcaugg

SEQ ID NO: 485239 - RNA, 64 nt, Homo Sapiens
gagacauucgcuugguuuagggcggcgggggaggagaggggaaaugcuuaaaaauguaauuggg

SEQ ID NO: 485240 - RNA, 62 nt, Homo Sapiens
aacuaggaaaggggaucagaaacauccucuccccgcucuagguuucuucucccaaaggggac

SEQ ID NO: 485241 - RNA, 62 nt, Homo Sapiens
guuugauauauaaauaaguucauguuuacacuccgcucuaaucuaaaagggugauugacauc

SEQ ID NO: 485242 - RNA, 62 nt, Homo Sapiens
guggcuguguccaucucugcucccccaaaggcccgcucuaggccuuauccucccucuagguc

SEQ ID NO: 485243 - RNA, 62 nt, Homo Sapiens
cauuuauaauuccaacauuguucuagucugggccgcucuaaaaauggugguuugggcuuguc

SEQ ID NO: 485244 - RNA, 62 nt, Homo Sapiens
ggcaucauuauccggugcuugaacaaggagcuccgcucuacaacugguuuuuuuaggacuug

SEQ ID NO: 485245 - RNA, 62 nt, Homo Sapiens
gcacaagccccacagagggggaacagccagcaccgcucuagcugguuguugccaugccggaa

SEQ ID NO: 485246 - RNA, 62 nt, Homo Sapiens
ugcaguccuggaagcgcgagggccucaaaggcccgcucuacaucuucugccuuagucucagu

SEQ ID NO: 485247 - RNA, 62 nt, Homo Sapiens
uaauuaugcuuaagcuuuuaacagcauuuuaaccgcucuaaaaauuaccagaguaagaaaaa

SEQ ID NO: 485248 - RNA, 62 nt, Homo Sapiens
cacuugccggcccccaccaguucuuggguuccccgcucuaguuugaccugugcagcacauuc

SEQ ID NO: 485249 - RNA, 62 nt, Homo Sapiens
ccuggccucccuggccacagcagccuuacccaccgcucuacgugucccgggcacuucccgca

SEQ ID NO: 485250 - RNA, 62 nt, Homo Sapiens
cuaaaaauaacgaaagguuggucagagggaggccgcucuaaauucaucuuugacuccaaaau

SEQ ID NO: 485251 - RNA, 62 nt, Homo Sapiens
cucucaggaauuugcuuguucuugcacuccagccgcucuaguccuccccgcacaggcugugg

SEQ ID NO: 485252 - RNA, 62 nt, Homo Sapiens
gggccucauuucucccagagggagcugcuggcccgcucuaaggggugcaagaggaaggagug

SEQ ID NO: 485253 - RNA, 62 nt, Homo Sapiens
ccagucagcuccugggguugcgccaggcgcccccgcucuagcucacuguugccucgcugucu

SEQ ID NO: 485254 - RNA, 62 nt, Homo Sapiens
acugcagucaguguugaguggugccaugugggccgcucuauuccaaaggaaucauggauuag

SEQ ID NO: 485255 - RNA, 62 nt, Homo Sapiens
cacuucacuauacuucucuuagaccagagcuuccgcucuaccuucaaaccuggguggcccug

SEQ ID NO: 485256 - RNA, 62 nt, Homo Sapiens
cauuccuuccaccaucugcaucuguagccccuccgcucuacuuauagaugauugugccaucu

SEQ ID NO: 485257 - RNA, 62 nt, Homo Sapiens
uggaaugccgcugucucugaggggugggggugccgcucuaaauuggcuccauaucauuugag

SEQ ID NO: 485258 - RNA, 62 nt, Homo Sapiens
uccucuccaacgugcugcucuccacgccggccccgcucuacggaggccuggcacugcugacc

SEQ ID NO: 485259 - RNA, 62 nt, Homo Sapiens
auccauagaaaaugacuuauuuccagaagauaccgcucuaaaaaugaaauuguuaggugaaa

SEQ ID NO: 485260 - RNA, 62 nt, Homo Sapiens
cuuuuagcagaucugcagccuuccuuguugccccgcucuagaccucagccuuggggcuguuu

SEQ ID NO: 485261 - RNA, 62 nt, Homo Sapiens
gggauagugacuacuuuuuuuggguguuaaguccgcucuauaacauaauugacacaguuuau

SEQ ID NO: 485262 - RNA, 62 nt, Homo Sapiens
cauguugugggagcccucguccccccuccugcccgcucuacccugaccugggcuugucaucu

SEQ ID NO: 485263 - RNA, 62 nt, Homo Sapiens
uccuacuugaacaaacacauugggagcuucuuccgcucuaagaaguacccaugcccugaaug

SEQ ID NO: 485264 - RNA, 62 nt, Homo Sapiens
uacccuuuaaacugucacugcauaugcaaguaccgcucuaauuuuuggaucauuaaagggag

SEQ ID NO: 485265 - RNA, 64 nt, Homo Sapiens; identical to SEQ ID NO: 53771

SEQ ID NO: 485266 - RNA, 64 nt, Homo Sapiens; identical to SEQ ID NO: 53772

SEQ ID NO: 485267 - RNA, 64 nt, Homo Sapiens; identical to SEQ ID NO: 53773

SEQ ID NO: 485268 - RNA, 64 nt, Homo Sapiens; identical to SEQ ID NO: 53774

SEQ ID NO: 485269 - RNA, 64 nt, Homo Sapiens; identical to SEQ ID NO: 53775

SEQ ID NO: 485270 - RNA, 64 nt, Homo Sapiens; identical to SEQ ID NO: 53776

SEQ ID NO: 485271 - RNA, 64 nt, Homo Sapiens; identical to SEQ ID NO: 53777

SEQ ID NO: 485272 - RNA, 64 nt, Homo Sapiens; identical to SEQ ID NO: 53778

SEQ ID NO: 485273 - RNA, 64 nt, Homo Sapiens; identical to SEQ ID NO: 53779

SEQ ID NO: 485274 - RNA, 64 nt, Homo Sapiens; identical to SEQ ID NO: 53780

SEQ ID NO: 485275 - RNA, 64 nt, Homo Sapiens; identical to SEQ ID NO: 53781

SEQ ID NO: 485276 - RNA, 64 nt, Homo Sapiens; identical to SEQ ID NO: 53782

SEQ ID NO: 485277 - RNA, 64 nt, Homo Sapiens; identical to SEQ ID NO: 53783

SEQ ID NO: 485278 - RNA, 64 nt, Homo Sapiens; identical to SEQ ID NO: 53784

SEQ ID NO: 485279 - RNA, 64 nt, Homo Sapiens; identical to SEQ ID NO: 53785

SEQ ID NO: 485280 - RNA, 64 nt, Homo Sapiens; identical to SEQ ID NO: 53786

SEQ ID NO: 485281 - RNA, 64 nt, Homo Sapiens; identical to SEQ ID NO: 53787

SEQ ID NO: 485282 - RNA, 64 nt, Homo Sapiens; identical to SEQ ID NO: 53788

SEQ ID NO: 485283 - RNA, 64 nt, Homo Sapiens; identical to SEQ ID NO: 53789

SEQ ID NO: 485284 - RNA, 64 nt, Homo Sapiens; identical to SEQ ID NO: 53790

SEQ ID NO: 485285 - RNA, 64 nt, Homo Sapiens; identical to SEQ ID NO: 53791

SEQ ID NO: 485286 - RNA, 64 nt, Homo Sapiens; identical to SEQ ID NO: 53792

SEQ ID NO: 485287 - RNA, 64 nt, Homo Sapiens; identical to SEQ ID NO: 53793

SEQ ID NO: 485288 - RNA, 64 nt, Homo Sapiens; identical to SEQ ID NO: 53794

SEQ ID NO: 485289 - RNA, 64 nt, Homo Sapiens; identical to SEQ ID NO: 53795

SEQ ID NO: 485290 - RNA, 64 nt, Homo Sapiens; identical to SEQ ID NO: 53796

SEQ ID NO: 485291 - RNA, 64 nt, Homo Sapiens; identical to SEQ ID NO: 53797

SEQ ID NO: 485292 - RNA, 64 nt, Homo Sapiens; identical to SEQ ID NO: 53798

SEQ ID NO: 485293 - RNA, 64 nt, Homo Sapiens; identical to SEQ ID NO: 53799

SEQ ID NO: 485294 - RNA, 64 nt, Homo Sapiens; identical to SEQ ID NO: 53800

SEQ ID NO: 485295 - RNA, 64 nt, Homo Sapiens; identical to SEQ ID NO: 53801

SEQ ID NO: 485296 - RNA, 64 nt, Homo Sapiens; identical to SEQ ID NO: 53802

SEQ ID NO: 485297 - RNA, 64 nt, Homo Sapiens; identical to SEQ ID NO: 53803

SEQ ID NO: 485298 - RNA, 64 nt, Homo Sapiens; identical to SEQ ID NO: 53804

SEQ ID NO: 485299 - RNA, 64 nt, Homo Sapiens; identical to SEQ ID NO: 53805

SEQ ID NO: 485300 - RNA, 64 nt, Homo Sapiens; identical to SEQ ID NO: 53806

SEQ ID NO: 485301 - RNA, 64 nt, Homo Sapiens; identical to SEQ ID NO: 53807

SEQ ID NO: 485302 - RNA, 64 nt, Homo Sapiens; identical to SEQ ID NO: 53808

SEQ ID NO: 485303 - RNA, 64 nt, Homo Sapiens; identical to SEQ ID NO: 53809

SEQ ID NO: 485304 - RNA, 64 nt, Homo Sapiens; identical to SEQ ID NO: 53810

SEQ ID NO: 485305 - RNA, 64 nt, Homo Sapiens; identical to SEQ ID NO: 53811

SEQ ID NO: 485306 - RNA, 64 nt, Homo Sapiens; identical to SEQ ID NO: 53812

SEQ ID NO: 485307 - RNA, 64 nt, Homo Sapiens; identical to SEQ ID NO: 53813

SEQ ID NO: 485308 - RNA, 64 nt, Homo Sapiens; identical to SEQ ID NO: 53814

SEQ ID NO: 485309 - RNA, 64 nt, Homo Sapiens; identical to SEQ ID NO: 53815

SEQ ID NO: 485310 - RNA, 64 nt, Homo Sapiens
gcucauacccagcccuaccaaucaugaacuggaacuccauaaggaggggccaaauugggaggcc

SEQ ID NO: 485311 - RNA, 64 nt, Homo Sapiens
gcuuagguaccucagguggcccaggagguccccccuccauaaggacgucaaacuuccaggaggg

SEQ ID NO: 485312 - RNA, 64 nt, Homo Sapiens; identical to SEQ ID NO: 299632

SEQ ID NO: 485313 - RNA, 64 nt, Homo Sapiens; identical to SEQ ID NO: 299633

SEQ ID NO: 485314 - RNA, 51 nt, Homo Sapiens; identical to SEQ ID NO: 299634

SEQ ID NO: 485315 - RNA, 64 nt, Homo Sapiens; identical to SEQ ID NO: 299635

SEQ ID NO: 485316 - RNA, 64 nt, Homo Sapiens; identical to SEQ ID NO: 299636

SEQ ID NO: 485317 - RNA, 64 nt, Homo Sapiens; identical to SEQ ID NO: 299637

SEQ ID NO: 485318 - RNA, 64 nt, Homo Sapiens; identical to SEQ ID NO: 299638

SEQ ID NO: 485319 - RNA, 64 nt, Homo Sapiens; identical to SEQ ID NO: 299639

SEQ ID NO: 485320 - RNA, 64 nt, Homo Sapiens; identical to SEQ ID NO: 299640

SEQ ID NO: 485321 - RNA, 64 nt, Homo Sapiens; identical to SEQ ID NO: 299641

SEQ ID NO: 485322 - RNA, 64 nt, Homo Sapiens; identical to SEQ ID NO: 299642

SEQ ID NO: 485323 - RNA, 64 nt, Homo Sapiens; identical to SEQ ID NO: 299643

SEQ ID NO: 485324 - RNA, 64 nt, Homo Sapiens; identical to SEQ ID NO: 299644

SEQ ID NO: 485325 - RNA, 64 nt, Homo Sapiens; identical to SEQ ID NO: 299645

SEQ ID NO: 485326 - RNA, 64 nt, Homo Sapiens; identical to SEQ ID NO: 299646

SEQ ID NO: 485327 - RNA, 64 nt, Homo Sapiens; identical to SEQ ID NO: 299647

SEQ ID NO: 485328 - RNA, 64 nt, Homo Sapiens; identical to SEQ ID NO: 299648

SEQ ID NO: 485329 - RNA, 64 nt, Homo Sapiens
ugagccaagaucgcgcuauugcacuccagccugggugacagagcaagacucugccucagaaaaa

SEQ ID NO: 485330 - RNA, 64 nt, Homo Sapiens
uaaaauuaagucauugaugcugcuguuacagagugugacagaggauccaugucugugacacagg

SEQ ID NO: 485331 - RNA, 64 nt, Homo Sapiens
gacacucugucucaaaaaaaguacuccagccugggugacagaguugagccgagauuaugccacu

SEQ ID NO: 485332 - RNA, 64 nt, Homo Sapiens
gagacuccgucucaaaaaacgcacuccagccugggugacagagcggagccgagauagugucacu

SEQ ID NO: 485333 - RNA, 64 nt, Homo Sapiens
gagaccuggucucuaaaaaaauccuccaguaugggugacagaguugagcugucauugugccacu

SEQ ID NO: 485334 - RNA, 64 nt, Homo Sapiens
aaagguuguuuuaauaucuauuaagugaaguuuugugacagaaauguaugccaaaauuaguugu

SEQ ID NO: 485335 - RNA, 64 nt, Homo Sapiens
uaauuuacuacauauauugauucauugagagacagugacagauaaaaaauaaucaaagauagca

SEQ ID NO: 485336 - RNA, 64 nt, Homo Sapiens
aguaaaauugcaggugauuuucuagguauccauugugacagacauaaaucuuaaaaccuucaua

SEQ ID NO: 485337 - RNA, 64 nt, Homo Sapiens
gagacccugucucaaaagcagcccuccagccugggugacagaguugugcugugauugugacacu

SEQ ID NO: 485338 - RNA, 64 nt, Homo Sapiens
cagacucugucucaaaaaaagcacuccagccugggugacagagcugagccgagaucaugcgacu

SEQ ID NO: 485339 - RNA, 64 nt, Homo Sapiens
uaaaaacaacacauuauuuggaauaggucuaauugugacagacuaaaccaaacaggcuagggga

SEQ ID NO: 485340 - RNA, 64 nt, Homo Sapiens
gauacuccaucucaaaaaaaguacuccagccugggugacagaguugagacaagaucacgucacu

SEQ ID NO: 485341 - RNA, 64 nt, Homo Sapiens
ugagccaagaucguaccacugcacuccagccugggugacagagugagacucugucuccaaaaaa

SEQ ID NO: 485342 - RNA, 64 nt, Homo Sapiens
gugagcugagaucacaccacugcacuccagccuggugacagagcaagacuccggcucuuaaaaa

SEQ ID NO: 485343 - RNA, 64 nt, Homo Sapiens
gucauggccguggugaggguccagguugggagcagugacagagauggggauggguuuaggagcu

SEQ ID NO: 485344 - RNA, 64 nt, Homo Sapiens
gagacucugucucaaaaaaaguacuccagccugggugacagagcugagcugugauugugccacu

SEQ ID NO: 485345 - RNA, 64 nt, Homo Sapiens
aagaccugucacccugccacgcaguccagccugggugacagagcugagccaugaucacaucacu

SEQ ID NO: 485346 - RNA, 64 nt, Homo Sapiens
ucuaacuucaagugacugaauuuaacagauauaugugacagaaaauauuaauauuaaucaagaa

SEQ ID NO: 485347 - RNA, 64 nt, Homo Sapiens
gagacuccaucucuuuaaaagcacuccagccugagugacagagcaugagccaugauuucccacu

SEQ ID NO: 485348 - RNA, 64 nt, Homo Sapiens
gagacccugucucaaaaaaagcacuccggccugggugacagaguucagcccugauugugccagu

SEQ ID NO: 485349 - RNA, 64 nt, Homo Sapiens
aagauguaugauuucuaagggcauguuucacauugugacagauauuuauauaauucaaaagaau

SEQ ID NO: 485350 - RNA, 64 nt, Homo Sapiens
ugaaaucauguuugaauuuccaaguuaaaauauugugacagauuuacacugaagcagcucauag

SEQ ID NO: 485351 - RNA, 64 nt, Homo Sapiens
acaaauagaaaaccuauuuuaaggaaaaaaauuggugacagagcuugcuuuaaucaccauauaa

SEQ ID NO: 485352 - RNA, 64 nt, Homo Sapiens
ucuaagcaggaagauagacgcucagccucugugggugacagacuuuuaucccacaguggauuga

SEQ ID NO: 485353 - RNA, 64 nt, Homo Sapiens
ugagccaggaucacaccauugcuguccagccugggugacagagcaagacugcguuucaaaaaaa

SEQ ID NO: 485354 - RNA, 64 nt, Homo Sapiens
ugagcugagauccugccacugcacuccagucugggugacagagcaagacuccaucucaaaaaau

SEQ ID NO: 485355 - RNA, 64 nt, Homo Sapiens
gagaaacugagccaaggccacauagcuaccuacagugacagaaucaaaauucaaacucagguuu

SEQ ID NO: 485356 - RNA, 64 nt, Homo Sapiens
ugaucaggaauugugccacugcacuccaaccugagugacagagcaacacucugucuuaaaagaa

SEQ ID NO: 485357 - RNA, 64 nt, Homo Sapiens
ccauccucuugucagggcccuuuccuguguacacgugacagagugccuuuucgagacuggcagg

SEQ ID NO: 485358 - RNA, 64 nt, Homo Sapiens
aaagacccacaugcuacaagacgggcaaaauaaagugacagaugaccacccugcagcucuccag

SEQ ID NO: 485359 - RNA, 64 nt, Homo Sapiens
uagagaagagaauggaaagcguaucuucuccccagugacagaaguucucagaccugugauccgu

SEQ ID NO: 485360 - RNA, 64 nt, Homo Sapiens
guuccauagucugagagaauugaaggaaaaaaaugugacagaaucucuucuuagggaaaucucc

SEQ ID NO: 485361 - RNA, 64 nt, Homo Sapiens
agggauuugaauacagguuagcccagaucaaguagugacagagucacagagccauaccauauca

SEQ ID NO: 485362 - RNA, 64 nt, Homo Sapiens
aagacugucucaaaaaaaaagcacuccagccugggugacagaacugagccaagaucgcgccacu

SEQ ID NO: 485363 - RNA, 64 nt, Homo Sapiens
gacauugcggacagccacggccaggccagagggagugacagaggcagccccauucugccugccc

SEQ ID NO: 485364 - RNA, 64 nt, Homo Sapiens
ugagccgagaucacgccacugcacuauagccuaggugacagagugagacucugucucaaaaaaa

SEQ ID NO: 485365 - RNA, 64 nt, Homo Sapiens
ugagccgagauugcaccaccgcacuccagccugggugacagagcgagacuuaucucauaaauaa

SEQ ID NO: 485366 - RNA, 64 nt, Homo Sapiens
ucucauaaauaaauagauagauacuccagccugggugacagagcgagacuuauagauagauaga

SEQ ID NO: 485367 - RNA, 64 nt, Homo Sapiens
cgcagugagauugcgccauugcauuccagccugggugacagagcgagacuccguaucagaaaga

SEQ ID NO: 485368 - RNA, 64 nt, Homo Sapiens
gugaccccucauugcaccacuuuacuuagccugggugacagagugagacccuaucucaaaaaaa

SEQ ID NO: 485369 - RNA, 64 nt, Homo Sapiens
aagacccugucucaacaaaagcacuccagccugggugacagaguugagccaagaucgcacuacu

SEQ ID NO: 485370 - RNA, 64 nt, Homo Sapiens
cagacuccaucucaaagaaagcacuccagccugggugacagagcugagccgagaucgcgccacu

SEQ ID NO: 485371 - RNA, 64 nt, Homo Sapiens
gagacccugucuccgaaaaaguacuccagccugggugacagaguggggucauaaucaugccacu

SEQ ID NO: 485372 - RNA, 64 nt, Homo Sapiens
gagacuccgucucaaaaaaagcacuccagccugggugacagagcugagcucagauagugccacu

SEQ ID NO: 485373 - RNA, 64 nt, Homo Sapiens
uuagagcaaaaauuaguaauaagaaauagcuacagugacagauuaaauguuuguuaauaaaaau

SEQ ID NO: 485374 - RNA, 64 nt, Homo Sapiens
gagaccgucucaaaaagaaagcacuccagccugggugacagagcugagccaagaucgcgccacu

SEQ ID NO: 485375 - RNA, 64 nt, Homo Sapiens
gagacuccaucucaaaaaaagcacuccagccugggugacagagcugagcagagaucaugcuacu

SEQ ID NO: 485376 - RNA, 64 nt, Homo Sapiens
cagauaguguaucgaaaaauguacuccagcaugggugacagagaggagccaugaucaugccauu

SEQ ID NO: 485377 - RNA, 64 nt, Homo Sapiens
gugagcuaagacugcaccacugcacuccagccuggugacagaacgagacucugucuuaaaaaca

SEQ ID NO: 485378 - RNA, 64 nt, Homo Sapiens
ugagcugugaucucaccacugcauuccagccugggugacagaguuagauuccacccucucccac

SEQ ID NO: 485379 - RNA, 64 nt, Homo Sapiens; identical to SEQ ID NO: 155381

SEQ ID NO: 485380 - RNA, 64 nt, Homo Sapiens; identical to SEQ ID NO: 155382

SEQ ID NO: 485381 - RNA, 64 nt, Homo Sapiens; identical to SEQ ID NO: 458775

SEQ ID NO: 485382 - RNA, 64 nt, Homo Sapiens; identical to SEQ ID NO: 458776

SEQ ID NO: 485383 - RNA, 64 nt, Homo Sapiens; identical to SEQ ID NO: 458777

SEQ ID NO: 485384 - RNA, 64 nt, Homo Sapiens; identical to SEQ ID NO: 458778

SEQ ID NO: 485385 - RNA, 64 nt, Homo Sapiens; identical to SEQ ID NO: 458779

SEQ ID NO: 485386 - RNA, 64 nt, Homo Sapiens; identical to SEQ ID NO: 458780

SEQ ID NO: 485387 - RNA, 64 nt, Homo Sapiens; identical to SEQ ID NO: 458781

SEQ ID NO: 485388 - RNA, 64 nt, Homo Sapiens; identical to SEQ ID NO: 458782

SEQ ID NO: 485389 - RNA, 64 nt, Homo Sapiens; identical to SEQ ID NO: 458783

SEQ ID NO: 485390 - RNA, 64 nt, Homo Sapiens; identical to SEQ ID NO: 458784

SEQ ID NO: 485391 - RNA, 64 nt, Homo Sapiens; identical to SEQ ID NO: 458785

SEQ ID NO: 485392 - RNA, 64 nt, Homo Sapiens; identical to SEQ ID NO: 458786

SEQ ID NO: 485393 - RNA, 64 nt, Homo Sapiens; identical to SEQ ID NO: 458787

SEQ ID NO: 485394 - RNA, 64 nt, Homo Sapiens; identical to SEQ ID NO: 458788

SEQ ID NO: 485395 - RNA, 64 nt, Homo Sapiens; identical to SEQ ID NO: 458789

SEQ ID NO: 485396 - RNA, 64 nt, Homo Sapiens; identical to SEQ ID NO: 458790

SEQ ID NO: 485397 - RNA, 64 nt, Homo Sapiens; identical to SEQ ID NO: 458791

SEQ ID NO: 485398 - RNA, 64 nt, Homo Sapiens; identical to SEQ ID NO: 458792

SEQ ID NO: 485399 - RNA, 64 nt, Homo Sapiens; identical to SEQ ID NO: 458793

SEQ ID NO: 485400 - RNA, 64 nt, Homo Sapiens; identical to SEQ ID NO: 458794

SEQ ID NO: 485401 - RNA, 64 nt, Homo Sapiens; identical to SEQ ID NO: 458795

SEQ ID NO: 485402 - RNA, 64 nt, Homo Sapiens; identical to SEQ ID NO: 458796

SEQ ID NO: 485403 - RNA, 64 nt, Homo Sapiens; identical to SEQ ID NO: 458797

SEQ ID NO: 485404 - RNA, 64 nt, Homo Sapiens; identical to SEQ ID NO: 458798

SEQ ID NO: 485405 - RNA, 64 nt, Homo Sapiens; identical to SEQ ID NO: 458799

SEQ ID NO: 485406 - RNA, 64 nt, Homo Sapiens; identical to SEQ ID NO: 458800

SEQ ID NO: 485407 - RNA, 64 nt, Homo Sapiens; identical to SEQ ID NO: 458801

SEQ ID NO: 485408 - RNA, 64 nt, Homo Sapiens; identical to SEQ ID NO: 458802

SEQ ID NO: 485409 - RNA, 64 nt, Homo Sapiens; identical to SEQ ID NO: 458803

SEQ ID NO: 485410 - RNA, 65 nt, Homo Sapiens; identical to SEQ ID NO: 58812

SEQ ID NO: 485411 - RNA, 65 nt, Homo Sapiens; identical to SEQ ID NO: 58813

SEQ ID NO: 485412 - RNA, 65 nt, Homo Sapiens; identical to SEQ ID NO: 58814

SEQ ID NO: 485413 - RNA, 65 nt, Homo Sapiens; identical to SEQ ID NO: 58815

SEQ ID NO: 485414 - RNA, 65 nt, Homo Sapiens; identical to SEQ ID NO: 58816

SEQ ID NO: 485415 - RNA, 65 nt, Homo Sapiens; identical to SEQ ID NO: 58817

SEQ ID NO: 485416 - RNA, 65 nt, Homo Sapiens; identical to SEQ ID NO: 58818

SEQ ID NO: 485417 - RNA, 65 nt, Homo Sapiens; identical to SEQ ID NO: 58819

SEQ ID NO: 485418 - RNA, 65 nt, Homo Sapiens; identical to SEQ ID NO: 58820

SEQ ID NO: 485419 - RNA, 65 nt, Homo Sapiens; identical to SEQ ID NO: 58821

SEQ ID NO: 485420 - RNA, 65 nt, Homo Sapiens; identical to SEQ ID NO: 58822

SEQ ID NO: 485421 - RNA, 65 nt, Homo Sapiens; identical to SEQ ID NO: 58823

SEQ ID NO: 485422 - RNA, 65 nt, Homo Sapiens; identical to SEQ ID NO: 58824

SEQ ID NO: 485423 - RNA, 65 nt, Homo Sapiens; identical to SEQ ID NO: 58825

SEQ ID NO: 485424 - RNA, 65 nt, Homo Sapiens; identical to SEQ ID NO: 58826

SEQ ID NO: 485425 - RNA, 65 nt, Homo Sapiens; identical to SEQ ID NO: 58827

SEQ ID NO: 485426 - RNA, 65 nt, Homo Sapiens; identical to SEQ ID NO: 58828

SEQ ID NO: 485427 - RNA, 65 nt, Homo Sapiens; identical to SEQ ID NO: 58829

SEQ ID NO: 485428 - RNA, 65 nt, Homo Sapiens; identical to SEQ ID NO: 58830

SEQ ID NO: 485429 - RNA, 65 nt, Homo Sapiens; identical to SEQ ID NO: 58831

SEQ ID NO: 485430 - RNA, 65 nt, Homo Sapiens; identical to SEQ ID NO: 58832

SEQ ID NO: 485431 - RNA, 65 nt, Homo Sapiens; identical to SEQ ID NO: 58833

SEQ ID NO: 485432 - RNA, 65 nt, Homo Sapiens; identical to SEQ ID NO: 58834

SEQ ID NO: 485433 - RNA, 65 nt, Homo Sapiens; identical to SEQ ID NO: 58835

SEQ ID NO: 485434 - RNA, 65 nt, Homo Sapiens; identical to SEQ ID NO: 58836

SEQ ID NO: 485435 - RNA, 65 nt, Homo Sapiens; identical to SEQ ID NO: 58837

SEQ ID NO: 485436 - RNA, 65 nt, Homo Sapiens; identical to SEQ ID NO: 58838

SEQ ID NO: 485437 - RNA, 65 nt, Homo Sapiens; identical to SEQ ID NO: 58839

SEQ ID NO: 485438 - RNA, 65 nt, Homo Sapiens; identical to SEQ ID NO: 58840

SEQ ID NO: 485439 - RNA, 65 nt, Homo Sapiens; identical to SEQ ID NO: 58841

SEQ ID NO: 485440 - RNA, 65 nt, Homo Sapiens; identical to SEQ ID NO: 58842

SEQ ID NO: 485441 - RNA, 65 nt, Homo Sapiens; identical to SEQ ID NO: 58843

SEQ ID NO: 485442 - RNA, 65 nt, Homo Sapiens; identical to SEQ ID NO: 58844

SEQ ID NO: 485443 - RNA, 65 nt, Homo Sapiens; identical to SEQ ID NO: 58845

SEQ ID NO: 485444 - RNA, 65 nt, Homo Sapiens; identical to SEQ ID NO: 58846

SEQ ID NO: 485445 - RNA, 65 nt, Homo Sapiens; identical to SEQ ID NO: 58847

SEQ ID NO: 485446 - RNA, 65 nt, Homo Sapiens; identical to SEQ ID NO: 58848

SEQ ID NO: 485447 - RNA, 65 nt, Homo Sapiens; identical to SEQ ID NO: 58849

SEQ ID NO: 485448 - RNA, 65 nt, Homo Sapiens; identical to SEQ ID NO: 58850

SEQ ID NO: 485449 - RNA, 65 nt, Homo Sapiens; identical to SEQ ID NO: 58851

SEQ ID NO: 485450 - RNA, 65 nt, Homo Sapiens; identical to SEQ ID NO: 58852

SEQ ID NO: 485451 - RNA, 65 nt, Homo Sapiens; identical to SEQ ID NO: 58853

SEQ ID NO: 485452 - RNA, 65 nt, Homo Sapiens; identical to SEQ ID NO: 58854

SEQ ID NO: 485453 - RNA, 65 nt, Homo Sapiens; identical to SEQ ID NO: 58855

SEQ ID NO: 485454 - RNA, 65 nt, Homo Sapiens; identical to SEQ ID NO: 58856

SEQ ID NO: 485455 - RNA, 65 nt, Homo Sapiens; identical to SEQ ID NO: 58857

SEQ ID NO: 485456 - RNA, 65 nt, Homo Sapiens; identical to SEQ ID NO: 58858

SEQ ID NO: 485457 - RNA, 65 nt, Homo Sapiens; identical to SEQ ID NO: 58859

SEQ ID NO: 485458 - RNA, 65 nt, Homo Sapiens; identical to SEQ ID NO: 58860

SEQ ID NO: 485459 - RNA, 65 nt, Homo Sapiens; identical to SEQ ID NO: 58861

SEQ ID NO: 485460 - RNA, 65 nt, Homo Sapiens; identical to SEQ ID NO: 58862

SEQ ID NO: 485461 - RNA, 65 nt, Homo Sapiens; identical to SEQ ID NO: 58863

SEQ ID NO: 485462 - RNA, 65 nt, Homo Sapiens; identical to SEQ ID NO: 58864

SEQ ID NO: 485463 - RNA, 65 nt, Homo Sapiens; identical to SEQ ID NO: 58865

SEQ ID NO: 485464 - RNA, 65 nt, Homo Sapiens; identical to SEQ ID NO: 58866

SEQ ID NO: 485465 - RNA, 65 nt, Homo Sapiens; identical to SEQ ID NO: 58867

SEQ ID NO: 485466 - RNA, 65 nt, Homo Sapiens; identical to SEQ ID NO: 58868

SEQ ID NO: 485467 - RNA, 65 nt, Homo Sapiens; identical to SEQ ID NO: 58869

SEQ ID NO: 485468 - RNA, 65 nt, Homo Sapiens; identical to SEQ ID NO: 58870

SEQ ID NO: 485469 - RNA, 65 nt, Homo Sapiens; identical to SEQ ID NO: 58871

SEQ ID NO: 485470 - RNA, 65 nt, Homo Sapiens; identical to SEQ ID NO: 58872

SEQ ID NO: 485471 - RNA, 65 nt, Homo Sapiens; identical to SEQ ID NO: 58873

SEQ ID NO: 485472 - RNA, 65 nt, Homo Sapiens; identical to SEQ ID NO: 58874

SEQ ID NO: 485473 - RNA, 65 nt, Homo Sapiens; identical to SEQ ID NO: 58875

SEQ ID NO: 485474 - RNA, 65 nt, Homo Sapiens; identical to SEQ ID NO: 58876

SEQ ID NO: 485475 - RNA, 65 nt, Homo Sapiens; identical to SEQ ID NO: 58877

SEQ ID NO: 485476 - RNA, 65 nt, Homo Sapiens; identical to SEQ ID NO: 58878

SEQ ID NO: 485477 - RNA, 65 nt, Homo Sapiens; identical to SEQ ID NO: 58879

SEQ ID NO: 485478 - RNA, 65 nt, Homo Sapiens; identical to SEQ ID NO: 58880

SEQ ID NO: 485479 - RNA, 65 nt, Homo Sapiens; identical to SEQ ID NO: 58881

SEQ ID NO: 485480 - RNA, 65 nt, Homo Sapiens; identical to SEQ ID NO: 58882

SEQ ID NO: 485481 - RNA, 65 nt, Homo Sapiens; identical to SEQ ID NO: 58883

SEQ ID NO: 485482 - RNA, 65 nt, Homo Sapiens; identical to SEQ ID NO: 58884

SEQ ID NO: 485483 - RNA, 65 nt, Homo Sapiens; identical to SEQ ID NO: 58885

SEQ ID NO: 485484 - RNA, 65 nt, Homo Sapiens; identical to SEQ ID NO: 58886

SEQ ID NO: 485485 - RNA, 65 nt, Homo Sapiens; identical to SEQ ID NO: 58887

SEQ ID NO: 485486 - RNA, 65 nt, Homo Sapiens; identical to SEQ ID NO: 58888

SEQ ID NO: 485487 - RNA, 59 nt, Homo Sapiens; identical to SEQ ID NO: 58889

SEQ ID NO: 485488 - RNA, 65 nt, Homo Sapiens; identical to SEQ ID NO: 58890

SEQ ID NO: 485489 - RNA, 65 nt, Homo Sapiens; identical to SEQ ID NO: 58891

SEQ ID NO: 485490 - RNA, 65 nt, Homo Sapiens; identical to SEQ ID NO: 58892

SEQ ID NO: 485491 - RNA, 65 nt, Homo Sapiens; identical to SEQ ID NO: 58893

SEQ ID NO: 485492 - RNA, 65 nt, Homo Sapiens; identical to SEQ ID NO: 58894

SEQ ID NO: 485493 - RNA, 65 nt, Homo Sapiens; identical to SEQ ID NO: 58895

SEQ ID NO: 485494 - RNA, 65 nt, Homo Sapiens; identical to SEQ ID NO: 58896

SEQ ID NO: 485495 - RNA, 65 nt, Homo Sapiens; identical to SEQ ID NO: 58897

SEQ ID NO: 485496 - RNA, 65 nt, Homo Sapiens; identical to SEQ ID NO: 58898

SEQ ID NO: 485497 - RNA, 65 nt, Homo Sapiens; identical to SEQ ID NO: 58899

SEQ ID NO: 485498 - RNA, 65 nt, Homo Sapiens; identical to SEQ ID NO: 58900

SEQ ID NO: 485499 - RNA, 65 nt, Homo Sapiens; identical to SEQ ID NO: 58901

SEQ ID NO: 485500 - RNA, 65 nt, Homo Sapiens; identical to SEQ ID NO: 58902

SEQ ID NO: 485501 - RNA, 65 nt, Homo Sapiens; identical to SEQ ID NO: 58903

SEQ ID NO: 485502 - RNA, 65 nt, Homo Sapiens; identical to SEQ ID NO: 58904

SEQ ID NO: 485503 - RNA, 65 nt, Homo Sapiens; identical to SEQ ID NO: 58905

SEQ ID NO: 485504 - RNA, 65 nt, Homo Sapiens; identical to SEQ ID NO: 58906

SEQ ID NO: 485505 - RNA, 65 nt, Homo Sapiens; identical to SEQ ID NO: 58907

SEQ ID NO: 485506 - RNA, 65 nt, Homo Sapiens; identical to SEQ ID NO: 58908

SEQ ID NO: 485507 - RNA, 65 nt, Homo Sapiens; identical to SEQ ID NO: 58909

SEQ ID NO: 485508 - RNA, 65 nt, Homo Sapiens; identical to SEQ ID NO: 58910

SEQ ID NO: 485509 - RNA, 65 nt, Homo Sapiens; identical to SEQ ID NO: 58911

SEQ ID NO: 485510 - RNA, 65 nt, Homo Sapiens; identical to SEQ ID NO: 58912

SEQ ID NO: 485511 - RNA, 65 nt, Homo Sapiens; identical to SEQ ID NO: 58913

SEQ ID NO: 485512 - RNA, 65 nt, Homo Sapiens; identical to SEQ ID NO: 58914

SEQ ID NO: 485513 - RNA, 65 nt, Homo Sapiens; identical to SEQ ID NO: 58915

SEQ ID NO: 485514 - RNA, 65 nt, Homo Sapiens; identical to SEQ ID NO: 58916

SEQ ID NO: 485515 - RNA, 65 nt, Homo Sapiens; identical to SEQ ID NO: 58917

SEQ ID NO: 485516 - RNA, 65 nt, Homo Sapiens; identical to SEQ ID NO: 58918

SEQ ID NO: 485517 - RNA, 65 nt, Homo Sapiens; identical to SEQ ID NO: 58919

SEQ ID NO: 485518 - RNA, 65 nt, Homo Sapiens; identical to SEQ ID NO: 58920

SEQ ID NO: 485519 - RNA, 65 nt, Homo Sapiens; identical to SEQ ID NO: 58921

SEQ ID NO: 485520 - RNA, 65 nt, Homo Sapiens; identical to SEQ ID NO: 58922

SEQ ID NO: 485521 - RNA, 65 nt, Homo Sapiens; identical to SEQ ID NO: 58923

SEQ ID NO: 485522 - RNA, 65 nt, Homo Sapiens; identical to SEQ ID NO: 58924

SEQ ID NO: 485523 - RNA, 65 nt, Homo Sapiens; identical to SEQ ID NO: 58925

SEQ ID NO: 485524 - RNA, 64 nt, Homo Sapiens; identical to SEQ ID NO: 325832

SEQ ID NO: 485525 - RNA, 64 nt, Homo Sapiens; identical to SEQ ID NO: 325833

SEQ ID NO: 485526 - RNA, 64 nt, Homo Sapiens; identical to SEQ ID NO: 325834

SEQ ID NO: 485527 - RNA, 64 nt, Homo Sapiens; identical to SEQ ID NO: 325835

SEQ ID NO: 485528 - RNA, 64 nt, Homo Sapiens; identical to SEQ ID NO: 325836

SEQ ID NO: 485529 - RNA, 64 nt, Homo Sapiens; identical to SEQ ID NO: 325837

SEQ ID NO: 485530 - RNA, 64 nt, Homo Sapiens; identical to SEQ ID NO: 325838

SEQ ID NO: 485531 - RNA, 64 nt, Homo Sapiens; identical to SEQ ID NO: 325839

SEQ ID NO: 485532 - RNA, 64 nt, Homo Sapiens; identical to SEQ ID NO: 325840

SEQ ID NO: 485533 - RNA, 64 nt, Homo Sapiens; identical to SEQ ID NO: 325841

SEQ ID NO: 485534 - RNA, 64 nt, Homo Sapiens; identical to SEQ ID NO: 325842

SEQ ID NO: 485535 - RNA, 64 nt, Homo Sapiens; identical to SEQ ID NO: 325843

SEQ ID NO: 485536 - RNA, 64 nt, Homo Sapiens; identical to SEQ ID NO: 325844

SEQ ID NO: 485537 - RNA, 64 nt, Homo Sapiens; identical to SEQ ID NO: 325845

SEQ ID NO: 485538 - RNA, 64 nt, Homo Sapiens; identical to SEQ ID NO: 325846

SEQ ID NO: 485539 - RNA, 64 nt, Homo Sapiens; identical to SEQ ID NO: 325847

SEQ ID NO: 485540 - RNA, 64 nt, Homo Sapiens; identical to SEQ ID NO: 325848

SEQ ID NO: 485541 - RNA, 64 nt, Homo Sapiens; identical to SEQ ID NO: 325849

SEQ ID NO: 485542 - RNA, 64 nt, Homo Sapiens; identical to SEQ ID NO: 325850

SEQ ID NO: 485543 - RNA, 64 nt, Homo Sapiens; identical to SEQ ID NO: 325851

SEQ ID NO: 485544 - RNA, 64 nt, Homo Sapiens; identical to SEQ ID NO: 325852

SEQ ID NO: 485545 - RNA, 64 nt, Homo Sapiens; identical to SEQ ID NO: 325853

SEQ ID NO: 485546 - RNA, 64 nt, Homo Sapiens; identical to SEQ ID NO: 325854

SEQ ID NO: 485547 - RNA, 64 nt, Homo Sapiens; identical to SEQ ID NO: 325855

SEQ ID NO: 485548 - RNA, 64 nt, Homo Sapiens; identical to SEQ ID NO: 325856

SEQ ID NO: 485549 - RNA, 64 nt, Homo Sapiens; identical to SEQ ID NO: 325857

SEQ ID NO: 485550 - RNA, 64 nt, Homo Sapiens; identical to SEQ ID NO: 325858

SEQ ID NO: 485551 - RNA, 64 nt, Homo Sapiens; identical to SEQ ID NO: 325859

SEQ ID NO: 485552 - RNA, 64 nt, Homo Sapiens; identical to SEQ ID NO: 325860

SEQ ID NO: 485553 - RNA, 64 nt, Homo Sapiens; identical to SEQ ID NO: 325861

SEQ ID NO: 485554 - RNA, 64 nt, Homo Sapiens; identical to SEQ ID NO: 325862

SEQ ID NO: 485555 - RNA, 64 nt, Homo Sapiens; identical to SEQ ID NO: 325863

SEQ ID NO: 485556 - RNA, 64 nt, Homo Sapiens; identical to SEQ ID NO: 325864

SEQ ID NO: 485557 - RNA, 64 nt, Homo Sapiens; identical to SEQ ID NO: 325865

SEQ ID NO: 485558 - RNA, 64 nt, Homo Sapiens; identical to SEQ ID NO: 325866

SEQ ID NO: 485559 - RNA, 64 nt, Homo Sapiens; identical to SEQ ID NO: 325867

SEQ ID NO: 485560 - RNA, 64 nt, Homo Sapiens; identical to SEQ ID NO: 325868

SEQ ID NO: 485561 - RNA, 64 nt, Homo Sapiens; identical to SEQ ID NO: 325869

SEQ ID NO: 485562 - RNA, 64 nt, Homo Sapiens; identical to SEQ ID NO: 325870

SEQ ID NO: 485563 - RNA, 64 nt, Homo Sapiens; identical to SEQ ID NO: 325871

SEQ ID NO: 485564 - RNA, 64 nt, Homo Sapiens; identical to SEQ ID NO: 325872

SEQ ID NO: 485565 - RNA, 64 nt, Homo Sapiens; identical to SEQ ID NO: 325873

SEQ ID NO: 485566 - RNA, 64 nt, Homo Sapiens; identical to SEQ ID NO: 325874

SEQ ID NO: 485567 - RNA, 64 nt, Homo Sapiens; identical to SEQ ID NO: 325875

SEQ ID NO: 485568 - RNA, 64 nt, Homo Sapiens
uuuguuuaagaacugugcuggauauuuuuagauuguaugccacuauaguauuucuagaaaaaga

SEQ ID NO: 485569 - RNA, 64 nt, Homo Sapiens
gcaauuagaguauccaauaaaaaaaaaaaugaauguaugccacuaggaagggagucccaucuca

SEQ ID NO: 485570 - RNA, 64 nt, Homo Sapiens; identical to SEQ ID NO: 217362

SEQ ID NO: 485571 - RNA, 64 nt, Homo Sapiens; identical to SEQ ID NO: 217363

SEQ ID NO: 485572 - RNA, 64 nt, Homo Sapiens; identical to SEQ ID NO: 217364

SEQ ID NO: 485573 - RNA, 64 nt, Homo Sapiens; identical to SEQ ID NO: 217365

SEQ ID NO: 485574 - RNA, 64 nt, Homo Sapiens; identical to SEQ ID NO: 217366

SEQ ID NO: 485575 - RNA, 64 nt, Homo Sapiens; identical to SEQ ID NO: 217367

SEQ ID NO: 485576 - RNA, 64 nt, Homo Sapiens; identical to SEQ ID NO: 217368

SEQ ID NO: 485577 - RNA, 64 nt, Homo Sapiens; identical to SEQ ID NO: 217369

SEQ ID NO: 485578 - RNA, 64 nt, Homo Sapiens; identical to SEQ ID NO: 217370

SEQ ID NO: 485579 - RNA, 64 nt, Homo Sapiens; identical to SEQ ID NO: 217371

SEQ ID NO: 485580 - RNA, 64 nt, Homo Sapiens; identical to SEQ ID NO: 217372

SEQ ID NO: 485581 - RNA, 64 nt, Homo Sapiens; identical to SEQ ID NO: 217373

SEQ ID NO: 485582 - RNA, 64 nt, Homo Sapiens; identical to SEQ ID NO: 217374

SEQ ID NO: 485583 - RNA, 64 nt, Homo Sapiens; identical to SEQ ID NO: 217375

SEQ ID NO: 485584 - RNA, 64 nt, Homo Sapiens; identical to SEQ ID NO: 217376

SEQ ID NO: 485585 - RNA, 64 nt, Homo Sapiens; identical to SEQ ID NO: 217377

SEQ ID NO: 485586 - RNA, 64 nt, Homo Sapiens; identical to SEQ ID NO: 217378

SEQ ID NO: 485587 - RNA, 64 nt, Homo Sapiens; identical to SEQ ID NO: 217379

SEQ ID NO: 485588 - RNA, 64 nt, Homo Sapiens; identical to SEQ ID NO: 217380

SEQ ID NO: 485589 - RNA, 64 nt, Homo Sapiens; identical to SEQ ID NO: 217381

SEQ ID NO: 485590 - RNA, 64 nt, Homo Sapiens; identical to SEQ ID NO: 217382

SEQ ID NO: 485591 - RNA, 64 nt, Homo Sapiens; identical to SEQ ID NO: 217383

SEQ ID NO: 485592 - RNA, 64 nt, Homo Sapiens; identical to SEQ ID NO: 217384

SEQ ID NO: 485593 - RNA, 64 nt, Homo Sapiens; identical to SEQ ID NO: 217385

SEQ ID NO: 485594 - RNA, 55 nt, Homo Sapiens; identical to SEQ ID NO: 217386

SEQ ID NO: 485595 - RNA, 64 nt, Homo Sapiens; identical to SEQ ID NO: 217387

SEQ ID NO: 485596 - RNA, 64 nt, Homo Sapiens; identical to SEQ ID NO: 217388

SEQ ID NO: 485597 - RNA, 64 nt, Homo Sapiens; identical to SEQ ID NO: 217389

SEQ ID NO: 485598 - RNA, 64 nt, Homo Sapiens; identical to SEQ ID NO: 217390

SEQ ID NO: 485599 - RNA, 64 nt, Homo Sapiens; identical to SEQ ID NO: 217391

SEQ ID NO: 485600 - RNA, 64 nt, Homo Sapiens; identical to SEQ ID NO: 217392

SEQ ID NO: 485601 - RNA, 64 nt, Homo Sapiens; identical to SEQ ID NO: 217393

SEQ ID NO: 485602 - RNA, 64 nt, Homo Sapiens; identical to SEQ ID NO: 217394

SEQ ID NO: 485603 - RNA, 64 nt, Homo Sapiens; identical to SEQ ID NO: 138909

SEQ ID NO: 485604 - RNA, 64 nt, Homo Sapiens; identical to SEQ ID NO: 138910

SEQ ID NO: 485605 - RNA, 64 nt, Homo Sapiens; identical to SEQ ID NO: 138911

SEQ ID NO: 485606 - RNA, 64 nt, Homo Sapiens; identical to SEQ ID NO: 138912

SEQ ID NO: 485607 - RNA, 64 nt, Homo Sapiens; identical to SEQ ID NO: 138913

SEQ ID NO: 485608 - RNA, 64 nt, Homo Sapiens; identical to SEQ ID NO: 138914

SEQ ID NO: 485609 - RNA, 64 nt, Homo Sapiens; identical to SEQ ID NO: 138915

SEQ ID NO: 485610 - RNA, 64 nt, Homo Sapiens; identical to SEQ ID NO: 138916

SEQ ID NO: 485611 - RNA, 64 nt, Homo Sapiens; identical to SEQ ID NO: 138917

SEQ ID NO: 485612 - RNA, 64 nt, Homo Sapiens; identical to SEQ ID NO: 138918

SEQ ID NO: 485613 - RNA, 64 nt, Homo Sapiens; identical to SEQ ID NO: 138919

SEQ ID NO: 485614 - RNA, 64 nt, Homo Sapiens; identical to SEQ ID NO: 138920

SEQ ID NO: 485615 - RNA, 64 nt, Homo Sapiens; identical to SEQ ID NO: 138921

SEQ ID NO: 485616 - RNA, 64 nt, Homo Sapiens; identical to SEQ ID NO: 138922

SEQ ID NO: 485617 - RNA, 64 nt, Homo Sapiens; identical to SEQ ID NO: 138923

SEQ ID NO: 485618 - RNA, 64 nt, Homo Sapiens; identical to SEQ ID NO: 138924

SEQ ID NO: 485619 - RNA, 64 nt, Homo Sapiens; identical to SEQ ID NO: 138925

SEQ ID NO: 485620 - RNA, 64 nt, Homo Sapiens; identical to SEQ ID NO: 138926

SEQ ID NO: 485621 - RNA, 64 nt, Homo Sapiens; identical to SEQ ID NO: 138927

SEQ ID NO: 485622 - RNA, 64 nt, Homo Sapiens; identical to SEQ ID NO: 138928

SEQ ID NO: 485623 - RNA, 64 nt, Homo Sapiens; identical to SEQ ID NO: 138929

SEQ ID NO: 485624 - RNA, 64 nt, Homo Sapiens; identical to SEQ ID NO: 138930

SEQ ID NO: 485625 - RNA, 64 nt, Homo Sapiens; identical to SEQ ID NO: 138931

SEQ ID NO: 485626 - RNA, 64 nt, Homo Sapiens; identical to SEQ ID NO: 138932

SEQ ID NO: 485627 - RNA, 64 nt, Homo Sapiens; identical to SEQ ID NO: 138933

SEQ ID NO: 485628 - RNA, 64 nt, Homo Sapiens; identical to SEQ ID NO: 138934

SEQ ID NO: 485629 - RNA, 64 nt, Homo Sapiens; identical to SEQ ID NO: 138935

SEQ ID NO: 485630 - RNA, 64 nt, Homo Sapiens; identical to SEQ ID NO: 138936

SEQ ID NO: 485631 - RNA, 64 nt, Homo Sapiens; identical to SEQ ID NO: 138937

SEQ ID NO: 485632 - RNA, 64 nt, Homo Sapiens; identical to SEQ ID NO: 138938

SEQ ID NO: 485633 - RNA, 64 nt, Homo Sapiens; identical to SEQ ID NO: 138939

SEQ ID NO: 485634 - RNA, 64 nt, Homo Sapiens; identical to SEQ ID NO: 138940

SEQ ID NO: 485635 - RNA, 64 nt, Homo Sapiens
ccuggggcucuuccugggucccacaccugacaaucacccacacugccauggaggugccccaccc

SEQ ID NO: 485636 - RNA, 64 nt, Homo Sapiens
ugacacaguuccuggaguacuauguccacuuagucacccacacugaccucugcuuccacccaca

SEQ ID NO: 485637 - RNA, 64 nt, Homo Sapiens
uguccacuuagucacccacagggaccucugcuuccacccacauaugccaaggucucucccucca

SEQ ID NO: 485638 - RNA, 64 nt, Homo Sapiens
aggcaccuaagucugccuuucucuuccaucuuuucacccacagcgugcaauaacgguaacuuga

SEQ ID NO: 485639 - RNA, 64 nt, Homo Sapiens
aucguauacccauaauauaacugauuggauaucccacccacaaguacgcaacucuuuggcugcu

SEQ ID NO: 485640 - RNA, 64 nt, Homo Sapiens
ucgauuuggucucuuuuuaggcccuccccacccacacccacaggaggccuagggagguuuuagg

SEQ ID NO: 485641 - RNA, 64 nt, Homo Sapiens
cacaggucgauuuggucucuuuuagggcccuccccacccacaccguccagaggccuagggaggu

SEQ ID NO: 485642 - RNA, 64 nt, Homo Sapiens
uugcucuucuaucuccacaaugcccggccccccacacccacagcagggggcuuccccuuucagc

SEQ ID NO: 485643 - RNA, 64 nt, Homo Sapiens
ugccaugugcacacuccuggcccacuggcuggcucacccacaggcagagucugcguaacagucu

SEQ ID NO: 485644 - RNA, 64 nt, Homo Sapiens
agccgcccccaugggaagaggccugguaccgccucacccacagaggucugugccaggugcgcuu

SEQ ID NO: 485645 - RNA, 64 nt, Homo Sapiens
gcccaggggaaggccaggcuggaccccggcuccacacccacauccagccugcaggccucucugc

SEQ ID NO: 485646 - RNA, 64 nt, Homo Sapiens
caagggagggggaugugggcacuugaagcagggacacccacagaauggucccucuucuccccaa

SEQ ID NO: 485647 - RNA, 64 nt, Homo Sapiens
acaaccuggggaugccuguccccuaccugcuccucacccacagcuaccugaggcugcucugaga

SEQ ID NO: 485648 - RNA, 64 nt, Homo Sapiens
acaacgugaccacaccacacaugccuccaacacacacccacagucuaaacaucucuccuucuca

SEQ ID NO: 485649 - RNA, 64 nt, Homo Sapiens
cagugagcccuucucccauuccagaucaucagcacacccacacccaccauaggucucucuccuc

SEQ ID NO: 485650 - RNA, 64 nt, Homo Sapiens
gagaccccaucgcagacgucaguggucucuggggcacccacacgcgccuccgugauacccucgg

SEQ ID NO: 485651 - RNA, 64 nt, Homo Sapiens
gcagcagcggaguucgcuccaggagaaggcugcgcacccacacccgccagagcccuacacggug

SEQ ID NO: 485652 - RNA, 64 nt, Homo Sapiens
cccugcugggcccaccaccuucagcuguaacccucacccacagcgcccuccccagacuccaccg

SEQ ID NO: 485653 - RNA, 64 nt, Homo Sapiens
cccuccccagacuccaccguacgccgcugacugccacccacacgcuugccaauggcggacucaa

SEQ ID NO: 485654 - RNA, 64 nt, Homo Sapiens
agugaugcagacgugacgugcguccguccaggcucacccacaguccaugggcagccccagcccc

SEQ ID NO: 485655 - RNA, 64 nt, Homo Sapiens
cacugcuuccucucggcgcaagccuggggacgcccacccacaccgcauguguguucagggacug

SEQ ID NO: 485656 - RNA, 64 nt, Homo Sapiens
ccuccaggcuugggcagggagacucgcagaugcacacccacaaguauucaguucucaaacucua

SEQ ID NO: 485657 - RNA, 64 nt, Homo Sapiens
ccagccuggggccugggggcugccccucuugaaccacccacaugcuuagccccagcuuuuugga

SEQ ID NO: 485658 - RNA, 64 nt, Homo Sapiens
ccgccugcuccccacacggacuccaggcgguccccacccacagaagcagaccuucagcucaggu

SEQ ID NO: 485659 - RNA, 64 nt, Homo Sapiens
cccgggguggcccuggaggccccugaccccaccccacccacagagcacgagggccccgucagcu

SEQ ID NO: 485660 - RNA, 64 nt, Homo Sapiens
gugucccucccaguggcuguggcagugacagugacacccacacccacaguaaagaggagacuga

SEQ ID NO: 485661 - RNA, 64 nt, Homo Sapiens
cucccaguggcuguggcagugacagugacacccacacccacaguaaagaggagacugaaugaga

SEQ ID NO: 485662 - RNA, 64 nt, Homo Sapiens
gugcucuggcugcugggagccaccagcagcuugacacccacaguucagggaacagccugcuucc

SEQ ID NO: 485663 - RNA, 64 nt, Homo Sapiens
aguggagcucacaggguagccugucgcccaccugcacccacacaccugucugugucacacacuc

SEQ ID NO: 485664 - RNA, 64 nt, Homo Sapiens
cuacaccguggcuuggucauagggugaguguaaacacccacaggacacugggggcugucacccu

SEQ ID NO: 485665 - RNA, 64 nt, Homo Sapiens
cuccccuggggacagccccaccuccgggucccuccacccacaucccccugguccuaccccuggc

SEQ ID NO: 485666 - RNA, 64 nt, Homo Sapiens
caccucgcuggggcaggggccacuuuacagauaucacccacacaaccuacaacugaagacaaug

SEQ ID NO: 485667 - RNA, 64 nt, Homo Sapiens
ugaugccagcagcaggcgcgucaucuucagccaccacccacagacaaacagggcccuaagcacu

SEQ ID NO: 485668 - RNA, 64 nt, Homo Sapiens; identical to SEQ ID NO: 137985

SEQ ID NO: 485669 - RNA, 64 nt, Homo Sapiens; identical to SEQ ID NO: 137986

SEQ ID NO: 485670 - RNA, 64 nt, Homo Sapiens; identical to SEQ ID NO: 137987

SEQ ID NO: 485671 - RNA, 64 nt, Homo Sapiens; identical to SEQ ID NO: 137988

SEQ ID NO: 485672 - RNA, 64 nt, Homo Sapiens; identical to SEQ ID NO: 137989

SEQ ID NO: 485673 - RNA, 64 nt, Homo Sapiens; identical to SEQ ID NO: 137990

SEQ ID NO: 485674 - RNA, 64 nt, Homo Sapiens; identical to SEQ ID NO: 137991

SEQ ID NO: 485675 - RNA, 64 nt, Homo Sapiens; identical to SEQ ID NO: 137992

SEQ ID NO: 485676 - RNA, 64 nt, Homo Sapiens; identical to SEQ ID NO: 137993

SEQ ID NO: 485677 - RNA, 64 nt, Homo Sapiens; identical to SEQ ID NO: 137994

SEQ ID NO: 485678 - RNA, 64 nt, Homo Sapiens; identical to SEQ ID NO: 137995

SEQ ID NO: 485679 - RNA, 64 nt, Homo Sapiens; identical to SEQ ID NO: 137996

SEQ ID NO: 485680 - RNA, 64 nt, Homo Sapiens; identical to SEQ ID NO: 137997

SEQ ID NO: 485681 - RNA, 64 nt, Homo Sapiens; identical to SEQ ID NO: 137998

SEQ ID NO: 485682 - RNA, 64 nt, Homo Sapiens; identical to SEQ ID NO: 137999

SEQ ID NO: 485683 - RNA, 64 nt, Homo Sapiens; identical to SEQ ID NO: 138000

SEQ ID NO: 485684 - RNA, 64 nt, Homo Sapiens; identical to SEQ ID NO: 138001

SEQ ID NO: 485685 - RNA, 64 nt, Homo Sapiens; identical to SEQ ID NO: 138002

SEQ ID NO: 485686 - RNA, 64 nt, Homo Sapiens; identical to SEQ ID NO: 138003

SEQ ID NO: 485687 - RNA, 64 nt, Homo Sapiens; identical to SEQ ID NO: 138004

SEQ ID NO: 485688 - RNA, 64 nt, Homo Sapiens; identical to SEQ ID NO: 138005

SEQ ID NO: 485689 - RNA, 64 nt, Homo Sapiens; identical to SEQ ID NO: 138006

SEQ ID NO: 485690 - RNA, 64 nt, Homo Sapiens; identical to SEQ ID NO: 138007

SEQ ID NO: 485691 - RNA, 64 nt, Homo Sapiens; identical to SEQ ID NO: 138008

SEQ ID NO: 485692 - RNA, 64 nt, Homo Sapiens; identical to SEQ ID NO: 138009

SEQ ID NO: 485693 - RNA, 64 nt, Homo Sapiens; identical to SEQ ID NO: 138010

SEQ ID NO: 485694 - RNA, 64 nt, Homo Sapiens; identical to SEQ ID NO: 86125

SEQ ID NO: 485695 - RNA, 64 nt, Homo Sapiens; identical to SEQ ID NO: 86126

SEQ ID NO: 485696 - RNA, 64 nt, Homo Sapiens; identical to SEQ ID NO: 86127

SEQ ID NO: 485697 - RNA, 64 nt, Homo Sapiens; identical to SEQ ID NO: 86128

SEQ ID NO: 485698 - RNA, 58 nt, Homo Sapiens; identical to SEQ ID NO: 86129

SEQ ID NO: 485699 - RNA, 64 nt, Homo Sapiens; identical to SEQ ID NO: 86130

SEQ ID NO: 485700 - RNA, 64 nt, Homo Sapiens; identical to SEQ ID NO: 86131

SEQ ID NO: 485701 - RNA, 64 nt, Homo Sapiens; identical to SEQ ID NO: 86132

SEQ ID NO: 485702 - RNA, 64 nt, Homo Sapiens; identical to SEQ ID NO: 86133

SEQ ID NO: 485703 - RNA, 64 nt, Homo Sapiens; identical to SEQ ID NO: 86134

SEQ ID NO: 485704 - RNA, 64 nt, Homo Sapiens; identical to SEQ ID NO: 86135

SEQ ID NO: 485705 - RNA, 64 nt, Homo Sapiens; identical to SEQ ID NO: 86136

SEQ ID NO: 485706 - RNA, 64 nt, Homo Sapiens; identical to SEQ ID NO: 86137

SEQ ID NO: 485707 - RNA, 64 nt, Homo Sapiens; identical to SEQ ID NO: 86138

SEQ ID NO: 485708 - RNA, 64 nt, Homo Sapiens; identical to SEQ ID NO: 86139

SEQ ID NO: 485709 - RNA, 64 nt, Homo Sapiens; identical to SEQ ID NO: 86140

SEQ ID NO: 485710 - RNA, 64 nt, Homo Sapiens; identical to SEQ ID NO: 86141

SEQ ID NO: 485711 - RNA, 64 nt, Homo Sapiens; identical to SEQ ID NO: 86142

SEQ ID NO: 485712 - RNA, 64 nt, Homo Sapiens; identical to SEQ ID NO: 86143

SEQ ID NO: 485713 - RNA, 64 nt, Homo Sapiens; identical to SEQ ID NO: 86144

SEQ ID NO: 485714 - RNA, 64 nt, Homo Sapiens; identical to SEQ ID NO: 86145

SEQ ID NO: 485715 - RNA, 64 nt, Homo Sapiens; identical to SEQ ID NO: 86146

SEQ ID NO: 485716 - RNA, 64 nt, Homo Sapiens; identical to SEQ ID NO: 86147

SEQ ID NO: 485717 - RNA, 64 nt, Homo Sapiens; identical to SEQ ID NO: 86148

SEQ ID NO: 485718 - RNA, 64 nt, Homo Sapiens; identical to SEQ ID NO: 86149

SEQ ID NO: 485719 - RNA, 64 nt, Homo Sapiens; identical to SEQ ID NO: 86150

SEQ ID NO: 485720 - RNA, 64 nt, Homo Sapiens; identical to SEQ ID NO: 86151

SEQ ID NO: 485721 - RNA, 64 nt, Homo Sapiens; identical to SEQ ID NO: 86152

SEQ ID NO: 485722 - RNA, 64 nt, Homo Sapiens; identical to SEQ ID NO: 86153

SEQ ID NO: 485723 - RNA, 64 nt, Homo Sapiens; identical to SEQ ID NO: 86154

SEQ ID NO: 485724 - RNA, 64 nt, Homo Sapiens; identical to SEQ ID NO: 86155

SEQ ID NO: 485725 - RNA, 64 nt, Homo Sapiens; identical to SEQ ID NO: 86156

SEQ ID NO: 485726 - RNA, 64 nt, Homo Sapiens; identical to SEQ ID NO: 86157

SEQ ID NO: 485727 - RNA, 64 nt, Homo Sapiens; identical to SEQ ID NO: 86158

SEQ ID NO: 485728 - RNA, 64 nt, Homo Sapiens; identical to SEQ ID NO: 86159

SEQ ID NO: 485729 - RNA, 64 nt, Homo Sapiens; identical to SEQ ID NO: 86160

SEQ ID NO: 485730 - RNA, 64 nt, Homo Sapiens; identical to SEQ ID NO: 86161

SEQ ID NO: 485731 - RNA, 64 nt, Homo Sapiens; identical to SEQ ID NO: 86162

SEQ ID NO: 485732 - RNA, 64 nt, Homo Sapiens; identical to SEQ ID NO: 86163

SEQ ID NO: 485733 - RNA, 60 nt, Homo Sapiens; identical to SEQ ID NO: 86164

SEQ ID NO: 485734 - RNA, 64 nt, Homo Sapiens; identical to SEQ ID NO: 86165

SEQ ID NO: 485735 - RNA, 64 nt, Homo Sapiens; identical to SEQ ID NO: 86166

SEQ ID NO: 485736 - RNA, 64 nt, Homo Sapiens; identical to SEQ ID NO: 86167

SEQ ID NO: 485737 - RNA, 64 nt, Homo Sapiens; identical to SEQ ID NO: 86168

SEQ ID NO: 485738 - RNA, 64 nt, Homo Sapiens; identical to SEQ ID NO: 86169

SEQ ID NO: 485739 - RNA, 64 nt, Homo Sapiens; identical to SEQ ID NO: 86170

SEQ ID NO: 485740 - RNA, 64 nt, Homo Sapiens; identical to SEQ ID NO: 86171

SEQ ID NO: 485741 - RNA, 64 nt, Homo Sapiens; identical to SEQ ID NO: 86172

SEQ ID NO: 485742 - RNA, 64 nt, Homo Sapiens; identical to SEQ ID NO: 86173

SEQ ID NO: 485743 - RNA, 64 nt, Homo Sapiens; identical to SEQ ID NO: 86174

SEQ ID NO: 485744 - RNA, 64 nt, Homo Sapiens; identical to SEQ ID NO: 86175

SEQ ID NO: 485745 - RNA, 64 nt, Homo Sapiens; identical to SEQ ID NO: 86176

SEQ ID NO: 485746 - RNA, 64 nt, Homo Sapiens; identical to SEQ ID NO: 86177

SEQ ID NO: 485747 - RNA, 64 nt, Homo Sapiens; identical to SEQ ID NO: 86178

SEQ ID NO: 485748 - RNA, 64 nt, Homo Sapiens; identical to SEQ ID NO: 86179

SEQ ID NO: 485749 - RNA, 64 nt, Homo Sapiens; identical to SEQ ID NO: 86180

SEQ ID NO: 485750 - RNA, 64 nt, Homo Sapiens; identical to SEQ ID NO: 86181

SEQ ID NO: 485751 - RNA, 64 nt, Homo Sapiens; identical to SEQ ID NO: 86182

SEQ ID NO: 485752 - RNA, 64 nt, Homo Sapiens; identical to SEQ ID NO: 86183

SEQ ID NO: 485753 - RNA, 64 nt, Homo Sapiens; identical to SEQ ID NO: 86184

SEQ ID NO: 485754 - RNA, 64 nt, Homo Sapiens; identical to SEQ ID NO: 86185

SEQ ID NO: 485755 - RNA, 64 nt, Homo Sapiens; identical to SEQ ID NO: 86186

SEQ ID NO: 485756 - RNA, 64 nt, Homo Sapiens; identical to SEQ ID NO: 72110

SEQ ID NO: 485757 - RNA, 64 nt, Homo Sapiens; identical to SEQ ID NO: 72111

SEQ ID NO: 485758 - RNA, 64 nt, Homo Sapiens; identical to SEQ ID NO: 72112

SEQ ID NO: 485759 - RNA, 64 nt, Homo Sapiens; identical to SEQ ID NO: 72113

SEQ ID NO: 485760 - RNA, 64 nt, Homo Sapiens; identical to SEQ ID NO: 72114

SEQ ID NO: 485761 - RNA, 64 nt, Homo Sapiens; identical to SEQ ID NO: 72115

SEQ ID NO: 485762 - RNA, 64 nt, Homo Sapiens; identical to SEQ ID NO: 72116

SEQ ID NO: 485763 - RNA, 64 nt, Homo Sapiens; identical to SEQ ID NO: 72117

SEQ ID NO: 485764 - RNA, 64 nt, Homo Sapiens; identical to SEQ ID NO: 72118

SEQ ID NO: 485765 - RNA, 64 nt, Homo Sapiens; identical to SEQ ID NO: 72119

SEQ ID NO: 485766 - RNA, 64 nt, Homo Sapiens; identical to SEQ ID NO: 72120

SEQ ID NO: 485767 - RNA, 64 nt, Homo Sapiens; identical to SEQ ID NO: 72121

SEQ ID NO: 485768 - RNA, 64 nt, Homo Sapiens; identical to SEQ ID NO: 72122

SEQ ID NO: 485769 - RNA, 64 nt, Homo Sapiens; identical to SEQ ID NO: 72123

SEQ ID NO: 485770 - RNA, 64 nt, Homo Sapiens; identical to SEQ ID NO: 72124

SEQ ID NO: 485771 - RNA, 64 nt, Homo Sapiens; identical to SEQ ID NO: 72125

SEQ ID NO: 485772 - RNA, 64 nt, Homo Sapiens; identical to SEQ ID NO: 72126

SEQ ID NO: 485773 - RNA, 64 nt, Homo Sapiens; identical to SEQ ID NO: 72127

SEQ ID NO: 485774 - RNA, 64 nt, Homo Sapiens; identical to SEQ ID NO: 72128

SEQ ID NO: 485775 - RNA, 64 nt, Homo Sapiens; identical to SEQ ID NO: 72129

SEQ ID NO: 485776 - RNA, 64 nt, Homo Sapiens; identical to SEQ ID NO: 72130

SEQ ID NO: 485777 - RNA, 64 nt, Homo Sapiens; identical to SEQ ID NO: 72131

SEQ ID NO: 485778 - RNA, 64 nt, Homo Sapiens; identical to SEQ ID NO: 72132

SEQ ID NO: 485779 - RNA, 64 nt, Homo Sapiens; identical to SEQ ID NO: 72133

SEQ ID NO: 485780 - RNA, 64 nt, Homo Sapiens; identical to SEQ ID NO: 72134

SEQ ID NO: 485781 - RNA, 64 nt, Homo Sapiens; identical to SEQ ID NO: 72135

SEQ ID NO: 485782 - RNA, 64 nt, Homo Sapiens; identical to SEQ ID NO: 72136

SEQ ID NO: 485783 - RNA, 64 nt, Homo Sapiens; identical to SEQ ID NO: 72137

SEQ ID NO: 485784 - RNA, 64 nt, Homo Sapiens; identical to SEQ ID NO: 72138

SEQ ID NO: 485785 - RNA, 64 nt, Homo Sapiens; identical to SEQ ID NO: 72139

SEQ ID NO: 485786 - RNA, 64 nt, Homo Sapiens; identical to SEQ ID NO: 72140

SEQ ID NO: 485787 - RNA, 64 nt, Homo Sapiens; identical to SEQ ID NO: 72141

SEQ ID NO: 485788 - RNA, 64 nt, Homo Sapiens; identical to SEQ ID NO: 72142

SEQ ID NO: 485789 - RNA, 64 nt, Homo Sapiens; identical to SEQ ID NO: 72143

SEQ ID NO: 485790 - RNA, 64 nt, Homo Sapiens; identical to SEQ ID NO: 72144

SEQ ID NO: 485791 - RNA, 64 nt, Homo Sapiens; identical to SEQ ID NO: 72145

SEQ ID NO: 485792 - RNA, 64 nt, Homo Sapiens; identical to SEQ ID NO: 72146

SEQ ID NO: 485793 - RNA, 64 nt, Homo Sapiens; identical to SEQ ID NO: 72147

SEQ ID NO: 485794 - RNA, 64 nt, Homo Sapiens; identical to SEQ ID NO: 72148

SEQ ID NO: 485795 - RNA, 64 nt, Homo Sapiens; identical to SEQ ID NO: 72149

SEQ ID NO: 485796 - RNA, 64 nt, Homo Sapiens; identical to SEQ ID NO: 72150

SEQ ID NO: 485797 - RNA, 64 nt, Homo Sapiens; identical to SEQ ID NO: 72151

SEQ ID NO: 485798 - RNA, 64 nt, Homo Sapiens; identical to SEQ ID NO: 72152

SEQ ID NO: 485799 - RNA, 50 nt, Homo Sapiens; identical to SEQ ID NO: 72153

SEQ ID NO: 485800 - RNA, 64 nt, Homo Sapiens; identical to SEQ ID NO: 72154

SEQ ID NO: 485801 - RNA, 64 nt, Homo Sapiens; identical to SEQ ID NO: 72155

SEQ ID NO: 485802 - RNA, 64 nt, Homo Sapiens; identical to SEQ ID NO: 72156

SEQ ID NO: 485803 - RNA, 64 nt, Homo Sapiens; identical to SEQ ID NO: 72157

SEQ ID NO: 485804 - RNA, 64 nt, Homo Sapiens; identical to SEQ ID NO: 72158

SEQ ID NO: 485805 - RNA, 64 nt, Homo Sapiens; identical to SEQ ID NO: 72159

SEQ ID NO: 485806 - RNA, 64 nt, Homo Sapiens; identical to SEQ ID NO: 72160

SEQ ID NO: 485807 - RNA, 64 nt, Homo Sapiens; identical to SEQ ID NO: 72161

SEQ ID NO: 485808 - RNA, 64 nt, Homo Sapiens; identical to SEQ ID NO: 72162

SEQ ID NO: 485809 - RNA, 64 nt, Homo Sapiens; identical to SEQ ID NO: 72163

SEQ ID NO: 485810 - RNA, 64 nt, Homo Sapiens; identical to SEQ ID NO: 72164

SEQ ID NO: 485811 - RNA, 64 nt, Homo Sapiens; identical to SEQ ID NO: 72165

SEQ ID NO: 485812 - RNA, 64 nt, Homo Sapiens; identical to SEQ ID NO: 72166

SEQ ID NO: 485813 - RNA, 64 nt, Homo Sapiens; identical to SEQ ID NO: 72167

SEQ ID NO: 485814 - RNA, 64 nt, Homo Sapiens; identical to SEQ ID NO: 72168

SEQ ID NO: 485815 - RNA, 64 nt, Homo Sapiens; identical to SEQ ID NO: 72169

SEQ ID NO: 485816 - RNA, 64 nt, Homo Sapiens; identical to SEQ ID NO: 72170

SEQ ID NO: 485817 - RNA, 64 nt, Homo Sapiens; identical to SEQ ID NO: 72171

SEQ ID NO: 485818 - RNA, 64 nt, Homo Sapiens; identical to SEQ ID NO: 72172

SEQ ID NO: 485819 - RNA, 64 nt, Homo Sapiens; identical to SEQ ID NO: 72173

SEQ ID NO: 485820 - RNA, 64 nt, Homo Sapiens; identical to SEQ ID NO: 72174

SEQ ID NO: 485821 - RNA, 64 nt, Homo Sapiens; identical to SEQ ID NO: 72175

SEQ ID NO: 485822 - RNA, 64 nt, Homo Sapiens; identical to SEQ ID NO: 72176

SEQ ID NO: 485823 - RNA, 64 nt, Homo Sapiens; identical to SEQ ID NO: 72177

SEQ ID NO: 485824 - RNA, 64 nt, Homo Sapiens; identical to SEQ ID NO: 72178

SEQ ID NO: 485825 - RNA, 64 nt, Homo Sapiens; identical to SEQ ID NO: 72179

SEQ ID NO: 485826 - RNA, 64 nt, Homo Sapiens; identical to SEQ ID NO: 72180

SEQ ID NO: 485827 - RNA, 64 nt, Homo Sapiens; identical to SEQ ID NO: 72181

SEQ ID NO: 485828 - RNA, 64 nt, Homo Sapiens; identical to SEQ ID NO: 72182

SEQ ID NO: 485829 - RNA, 64 nt, Homo Sapiens
gggagggaacuggugcauauucaggcuggcaguggcgcgguacagggacagggccugcaugcag

SEQ ID NO: 485830 - RNA, 64 nt, Homo Sapiens
cgagcgccgaggcccagcgggcggagggcacgcggcgcgguagggggccccggaggcccacucc

SEQ ID NO: 485831 - RNA, 64 nt, Homo Sapiens
ccaguucgccuaauaaauccccucuccuggccgggcgcgguagcucuccccuguaaucucagca

SEQ ID NO: 485832 - RNA, 64 nt, Homo Sapiens
cccaccacuccugaagccuggcacucugcucccugcgcgguaacccaguagguucuucuccccu

SEQ ID NO: 485833 - RNA, 64 nt, Homo Sapiens
aggagggggagccaggcucacagagguggagacggcgcgguaagagucacagagagcaccuaag

SEQ ID NO: 485834 - RNA, 64 nt, Homo Sapiens
ccucagugguaccugaagccuuugcuuccggaaagcgcgguaggguucguagguagggcuagua

SEQ ID NO: 485835 - RNA, 64 nt, Homo Sapiens
uguacuuguuuuuuaauuacuuccuuucacugccaaccucgaauuacuguacaguauaugucuu

SEQ ID NO: 485836 - RNA, 64 nt, Homo Sapiens
gguuccagaggcccuaggcgggaugggcucgcugaaccucgaggaacuccaggacgaggaggac

SEQ ID NO: 485837 - RNA, 64 nt, Homo Sapiens
gcugggcgucuggaucaaaacugcuuugggauggaaccucgagcccuagcagugaagaagauuc

SEQ ID NO: 485838 - RNA, 64 nt, Homo Sapiens
ucucagccuccugggguuccgugagggaugccgcaaccucgacuaugccucccccaggagggca

SEQ ID NO: 485839 - RNA, 61 nt, Homo Sapiens
cccuggugcucuuugcagagguguggcuggcaaccucgacuugcaucccuaccagcgguga

SEQ ID NO: 485840 - RNA, 64 nt, Homo Sapiens
ugaaaugugugaggcaaacuuuaagcaaaaagaaaaccucgaauauagcucaugaaacuuuugc

SEQ ID NO: 485841 - RNA, 64 nt, Homo Sapiens
caugguuuuuggcaaaaacuuuagaaaugcauaaaaccucgagacucuccuaugggcaaagcca

SEQ ID NO: 485842 - RNA, 64 nt, Homo Sapiens
agagcaggcuacacaaucccugggcuucccgggaaaccucgagcgagccacuuggaucccgaag

SEQ ID NO: 485843 - RNA, 64 nt, Homo Sapiens
gggucuccacagacuaacauugaagucuuccagaaaccucgaggagcugggcuagauacuucga

SEQ ID NO: 485844 - RNA, 64 nt, Homo Sapiens
cuguuggugcggugccaugaucauaguucacuauaaccucgaacuccuggcucaagugaucucc

SEQ ID NO: 485845 - RNA, 64 nt, Homo Sapiens
aaacuugaauauaacacauuuuggaaggcugacuaaccucgauucuguguugugaugugcaaua

SEQ ID NO: 485846 - RNA, 64 nt, Homo Sapiens
uuaaaaucauccuugacaugguugaaaagugaguaaccucgauaaaguuugugcaagugaaaau

SEQ ID NO: 485847 - RNA, 64 nt, Homo Sapiens
gaggucccccucugccacuugacagggaccuucaaaccucgacagugaugcaaggacacagaga

SEQ ID NO: 485848 - RNA, 64 nt, Homo Sapiens
accuuuuuuuuuuuaaccaagcccgacucccauuaaccucgagagggcagccccagagcacccc

SEQ ID NO: 485849 - RNA, 64 nt, Homo Sapiens
ggacugcgggaaugagggagucagauaaagaacaaaccucgaaacgaacaguuaaauugaaaug

SEQ ID NO: 485850 - RNA, 64 nt, Homo Sapiens
uccugggcucaagcaacccuucauugcucacuguaaccucgaaugccagaguguaguggcacaa

SEQ ID NO: 485851 - RNA, 64 nt, Homo Sapiens
aauagucagguugauuggacuuacgacccaaaugaaccucgauacugcauuuguaaucagguaa

SEQ ID NO: 485852 - RNA, 64 nt, Homo Sapiens
cgacugugcuugaguccucucagccggggcuagaaaccucgaggcugagagugguuggugacag

SEQ ID NO: 485853 - RNA, 64 nt, Homo Sapiens
auguaaauccacccaaagauaauggugaaaggauaaccucgauggugugaacucgcuuaaaagc

SEQ ID NO: 485854 - RNA, 64 nt, Homo Sapiens
acugugggcaauuuagaaaagccuuagcuucaggaaccucgagucccccuccucugaaacagcu

SEQ ID NO: 485855 - RNA, 64 nt, Homo Sapiens
aucauucuuuauuaacccuccuuggaauuuugaaaaccucgauuaaaguugccaaauugauuac

SEQ ID NO: 485856 - RNA, 64 nt, Homo Sapiens
ccggggaaggaggccguccaucccgucgacguagaaccucgagguuucucaaagaaauuuccac

SEQ ID NO: 485857 - RNA, 64 nt, Homo Sapiens
cucuuauuuuauuccacaaccuuucuagcauaccaaccucgauaugauuaaggagaauagccuc

SEQ ID NO: 485858 - RNA, 64 nt, Homo Sapiens
auuuguuguuaugugcaauagaaggcuauaaccuaaccucgacucuugaacuagucgauuuuuu

SEQ ID NO: 485859 - RNA, 64 nt, Homo Sapiens
auuaaaaaguuguagccaucuuagauauaaaauaaaccucgaauguauucuggaaucuuuuuac

SEQ ID NO: 485860 - RNA, 64 nt, Homo Sapiens
agaggcccuaugaagguggcgggaacucagcuucaaccucgaugucuucagggucuuguccaga

SEQ ID NO: 485861 - RNA, 64 nt, Homo Sapiens
cuaaaaagagaaaguccaaaagacucuaaacaaaaaccucgacgccguugaggauguguuucau

SEQ ID NO: 485862 - RNA, 64 nt, Homo Sapiens
ugucucccaguugguugcaccucaaguuacuggaaaccucgaccgaaaagacccaauaggauaa

SEQ ID NO: 485863 - RNA, 64 nt, Homo Sapiens
cgcccgaggaaacgagggccgucccaggcauagaaaccucgaaggaggagcuacugggcugagc

SEQ ID NO: 485864 - RNA, 64 nt, Homo Sapiens
ucccgaagcucagaugguccucacagcucacugcaaccucgaccgcuggagugcagugguguga

SEQ ID NO: 485865 - RNA, 64 nt, Homo Sapiens
ccacagauaccugcuguucucagcuccagcuucaaaccucgagucucgagagggccacggggug

SEQ ID NO: 485866 - RNA, 64 nt, Homo Sapiens
ccugggcccuuuccucccucaagcccaucuccacaaccucgagccugggcucugguccacuacu

SEQ ID NO: 485867 - RNA, 64 nt, Homo Sapiens
caggaguuugagaccagccugaccaacaugaugaaaccucgauucuacuaaaaauacaaaaauu

SEQ ID NO: 485868 - RNA, 64 nt, Homo Sapiens
caggaggaggacacggccgccgagagcaaggcacaaccucgaguucuuggggcgcagagaacuu

SEQ ID NO: 485869 - RNA, 64 nt, Homo Sapiens
gcuggagugcaguggcgugaucucggcucacuacaaccucgaccuccuggguucaagcgauucu

SEQ ID NO: 485870 - RNA, 64 nt, Homo Sapiens
uucugacauuuggaaaaacaugccaacuccugggaaccucgauagauggccacuugagaaguuu

SEQ ID NO: 485871 - RNA, 64 nt, Homo Sapiens
aaguucugaaggccaugacaugucaauaaauaugaaccucgagagccaaggacucuaggucaaa

SEQ ID NO: 485872 - RNA, 64 nt, Homo Sapiens
gcuagcuccaccugccuuggggccucaguccagaaaccucgaccgaugaccgcacugggggagg

SEQ ID NO: 485873 - RNA, 64 nt, Homo Sapiens
cugggucucagauccuucuguuuuguuuuuuuuuaaccucgacauccugcauugguuuuugguu

SEQ ID NO: 485874 - RNA, 64 nt, Homo Sapiens
ccgagcuccugcagaagugguucuggccacguggaaccucgaacgcccucagagaccugagcuc

SEQ ID NO: 485875 - RNA, 64 nt, Homo Sapiens
auggguauggcacaguucaucuacaugaccauaaaaccucgaaggcuuuccuugaacagaaauu

SEQ ID NO: 485876 - RNA, 64 nt, Homo Sapiens
acaacucagcacugggcgggccuggaggagcgccaaccucgaaguccacgcagccaaucgcuuu

SEQ ID NO: 485877 - RNA, 64 nt, Homo Sapiens
gcuucauucagcccuagcucuguagagaaaugcaaaccucgacucucaaggaugugaggaacac

SEQ ID NO: 485878 - RNA, 64 nt, Homo Sapiens
cuguucucugcuuuuccauucaaggggcccuaggaaccucgaagcucucugcccccaaaagugu

SEQ ID NO: 485879 - RNA, 64 nt, Homo Sapiens
cuuuagucauacaaagaaaaacaccauaccugcuaaccucgaggcccauacuacuaccucauug

SEQ ID NO: 485880 - RNA, 64 nt, Homo Sapiens
aaauaaagaauggaauugcugaauguaaucauugaaccucgagucacuguaaaaguucaguaau

SEQ ID NO: 485881 - RNA, 64 nt, Homo Sapiens
uauaauuguauagauuuuaaauaauauauacagaaaccucgauaguguauguguacacacaugu

SEQ ID NO: 485882 - RNA, 64 nt, Homo Sapiens
gggauugaucauucucaugaaggaaucacaguuauauggcaacugcagaaggcugagccuccuc

SEQ ID NO: 485883 - RNA, 64 nt, Homo Sapiens
aaaaccugagcuccccacucacugcccuagaauuuauggcaaggagcaaaucuacagcauucuc

SEQ ID NO: 485884 - RNA, 64 nt, Homo Sapiens
auggcuagacacccauuuucaacuaaaucucuaauauggcaaaacucacuaaacuuuacccaaa

SEQ ID NO: 485885 - RNA, 64 nt, Homo Sapiens
aagcugguaaacuauuugucuuuugcaauggcuauauggcaagagucuguaccuaacgcccuau

SEQ ID NO: 485886 - RNA, 64 nt, Homo Sapiens
uguuacagcauuuauaguuagguuuauguuugguuauggcaagauauguuucccucagucauuu

SEQ ID NO: 485887 - RNA, 64 nt, Homo Sapiens
uucuucaauuucaguauuuuaauucuaugccagauauggcaaaucacuuuauuauauaauuuac

SEQ ID NO: 485888 - RNA, 64 nt, Homo Sapiens
uaccaaacacagugagccggcaagccggauaugguauggcaagucuguaauaccuccuccuaac

SEQ ID NO: 485889 - RNA, 64 nt, Homo Sapiens
ggguggcaaguaccgccuuacaguauggacaguauauggcaaauaaguguauggaaacccacaa

SEQ ID NO: 485890 - RNA, 64 nt, Homo Sapiens
acuauaaauuuggggauccuagagugaucuuaaauauggcaagauacagcucauuuagaauaaa

SEQ ID NO: 485891 - RNA, 64 nt, Homo Sapiens
aguuuuagcaaauuggaaauaauauauucauuuguauggcaagauaaaugcagucaucuuaaua

SEQ ID NO: 485892 - RNA, 54 nt, Homo Sapiens
gagaaaaauuacaaauaugaaaauuauggcaaagcuuuaaucaauuuacaaguc

SEQ ID NO: 485893 - RNA, 64 nt, Homo Sapiens
ucauacuggugagaaauucuaaaaaugugaagacuauggcaaagucuuuaaaugguugucacac

SEQ ID NO: 485894 - RNA, 64 nt, Homo Sapiens
acaaacagaaacccguguaucugggauauuuccauauggcaauaggugugaacagggaacucag

SEQ ID NO: 485895 - RNA, 64 nt, Homo Sapiens
gaaagauucucgcuuaaaaaaaauguauuuauuuuauggcaaguuggaaaauauguaacuggaa

SEQ ID NO: 485896 - RNA, 64 nt, Homo Sapiens
aauuugagugccuccuacauccuugcauagauuucucuuuuaccggggguccagaagaucauuc

SEQ ID NO: 485897 - RNA, 64 nt, Homo Sapiens
auguuuaauucaccuaucaccagaugcuauagaacucuuuuaauaguauauaaucuuuucugaa

SEQ ID NO: 485898 - RNA, 64 nt, Homo Sapiens
caagaguguauuuccccuuaaauaaaaacuuacacucuuuuauaguuauuuuuaaaaacaacuu

SEQ ID NO: 485899 - RNA, 64 nt, Homo Sapiens
cuguacuuuuuuuuuugagacuaagucucaacugcucuuuuauauagacagauacuauccagcu

SEQ ID NO: 485900 - RNA, 64 nt, Homo Sapiens
ugguauaugaauuuuugcauucauuauugaauaacucuuuuaauauuuuugagcaaugauuaua

SEQ ID NO: 485901 - RNA, 64 nt, Homo Sapiens
ucugccuggaaaccagcuuccuccucagcuccagcucuuuuaaugggcauaucaaaacugauga

SEQ ID NO: 485902 - RNA, 64 nt, Homo Sapiens
guuguauauucugguauuugaggugagauggcugcucuuuuauuaaugagacaugaauuguguc

SEQ ID NO: 485903 - RNA, 64 nt, Homo Sapiens
guuucacauuuguauuaauaauuguuuaaaaugccucuuuuaaaagcuuauauaaauuuuuuuc

SEQ ID NO: 485904 - RNA, 64 nt, Homo Sapiens
gauucuaauuggaauguucauuugccucuuuuuacucuuuuaaaugcuuguagguggcuugggg

SEQ ID NO: 485905 - RNA, 64 nt, Homo Sapiens
aauugauguuaaguguuugauucagagaugucugcucuuuuaaauuauauauaaggaaaaaaaa

SEQ ID NO: 485906 - RNA, 64 nt, Homo Sapiens
cuguaacagcagcauuauuggagauaaugacauacucuuuuacauagaauugugcaggcuggau

SEQ ID NO: 485907 - RNA, 64 nt, Homo Sapiens
uuaagauaagugaaaaguacugccacagaaagggcucuuuuaaccucacucacagauuugcuaa

SEQ ID NO: 485908 - RNA, 64 nt, Homo Sapiens
uuuuuuuacuucuuuccuuuuuugcuuuugcacucucuuuuacaaauauccacaaagcuucgcc

SEQ ID NO: 485909 - RNA, 64 nt, Homo Sapiens
aaucaaaauauggauuugauagcaauuuuuuuuucucuuuuaagcauuuuauggaaauuagcuu

SEQ ID NO: 485910 - RNA, 64 nt, Homo Sapiens
aaaaggcaacuuauucaggcguagauuaauccugcucuuuuaagcccagugggucuuggcauaa

SEQ ID NO: 485911 - RNA, 64 nt, Homo Sapiens
ugggaaagggcaggcucugguggaauuucugugccucuuuuaugaugccauuuucaugaauucc

SEQ ID NO: 485912 - RNA, 64 nt, Homo Sapiens
uaaaccucugcccuccacucaaccaacaucacugcucuuuuagaccuuuuaagggggcuccaag

SEQ ID NO: 485913 - RNA, 64 nt, Homo Sapiens
cugucaggucauuaucaggcacugacccaucccucucuuuuaaaucugguaaccaugggccucc

SEQ ID NO: 485914 - RNA, 64 nt, Homo Sapiens
ucagauaccuuugaaacauauccuugugacuucucucuuuuaaaaaauagccuuucuuaucugc

SEQ ID NO: 485915 - RNA, 64 nt, Homo Sapiens
gucaucucuugaugaaacaauguguuggcugugccucuuuuaauccucacacauggaagacacu

SEQ ID NO: 485916 - RNA, 64 nt, Homo Sapiens
uggaccaagugaggguguacucugauccacaaagcucuuuuauaaaccagguuugagguugugu

SEQ ID NO: 485917 - RNA, 64 nt, Homo Sapiens
caggaauggggaauauauaacaccugugccaccgcucuuuuaaggaggcauuaugaaugagugc

SEQ ID NO: 485918 - RNA, 64 nt, Homo Sapiens
aaauggcaccacauauucaccugaaaacuccaaacucuuuuagaaaaauaaauaaauauuuaua

SEQ ID NO: 485919 - RNA, 64 nt, Homo Sapiens
acucuuuuagaaaaauaaauaaauauuuauagaccucuuuuagauauuuuaauaaaggauccuu

SEQ ID NO: 485920 - RNA, 64 nt, Homo Sapiens
aaaaugcuuauucuuccucccuuuuauuuuuugucucuuuuaagaugguaaaaugguucucagg

SEQ ID NO: 485921 - RNA, 64 nt, Homo Sapiens
aaauugcauguucuaauuccacguaucuuccagucucuuuuauaaagucucagacuauaauaaa

SEQ ID NO: 485922 - RNA, 64 nt, Homo Sapiens
aaaaaugucaagucuuuauaugucuuugaacuuucucuuuuaacuauuuaacacuccccuuaac

SEQ ID NO: 485923 - RNA, 64 nt, Homo Sapiens
uaugucaaagggacacugucacauuauuugugcccucuuuuauaaaauauuuuuuaaaacaaaa

SEQ ID NO: 485924 - RNA, 64 nt, Homo Sapiens
caguguucuuccucuuuucuaauacaauaagccucucuuuuauuuguuuuauauguuuuccgaa

SEQ ID NO: 485925 - RNA, 64 nt, Homo Sapiens
uagauggagacaaaggacaaucacuuauaaauuucucuuuuaaacauuauugcagccuuuuugu

SEQ ID NO: 485926 - RNA, 64 nt, Homo Sapiens
cuuuuguacuccucagagcagauuaaguucauuucucuuuuacaagugcaaucuucaguuuugu

SEQ ID NO: 485927 - RNA, 64 nt, Homo Sapiens
ugcauguauauauugcccuuuuuguuuguuaauucucuuuuauauguucucuagaaaucaaggu

SEQ ID NO: 485928 - RNA, 64 nt, Homo Sapiens
ugcagugaaguucucuuuauggaauuuuugccuucucuuuuaauaugggguccuucaggaaguu

SEQ ID NO: 485929 - RNA, 64 nt, Homo Sapiens
auuuaauaauuaaauaccuaauuuuauccauguacucuuuuagugaauuacuagugauuguuuu

SEQ ID NO: 485930 - RNA, 64 nt, Homo Sapiens
gucuuugucagauaauuucauauuuuuauaaugucucuuuuaaacgugccuggccucauuugag

SEQ ID NO: 485931 - RNA, 64 nt, Homo Sapiens
uggaagauuucaauuacuuacccauucugauagucucuuuuaacuuuuuaugguguauuuugaa

SEQ ID NO: 485932 - RNA, 64 nt, Homo Sapiens
caugugggucaaccacugugcagccccagucacccucuuuuacacagauaucaggcccccaguu

SEQ ID NO: 485933 - RNA, 64 nt, Homo Sapiens
cugugguuaguggccauuguuuagaagugccagccucuuuuaggccuuggaccuucucccuugc

SEQ ID NO: 485934 - RNA, 64 nt, Homo Sapiens
cugaccaaacaaauucccacuaauguaacugguaguaucuuagaggugaacucuccugugggca

SEQ ID NO: 485935 - RNA, 64 nt, Homo Sapiens
cuuagaggugaacucuccugugggcauuuuauuuguaucuuagaagaauuuuuguuuuaaaucu

SEQ ID NO: 485936 - RNA, 64 nt, Homo Sapiens; identical to SEQ ID NO: 323034

SEQ ID NO: 485937 - RNA, 64 nt, Homo Sapiens; identical to SEQ ID NO: 323035

SEQ ID NO: 485938 - RNA, 64 nt, Homo Sapiens; identical to SEQ ID NO: 323036

SEQ ID NO: 485939 - RNA, 64 nt, Homo Sapiens; identical to SEQ ID NO: 323037

SEQ ID NO: 485940 - RNA, 64 nt, Homo Sapiens; identical to SEQ ID NO: 323038

SEQ ID NO: 485941 - RNA, 64 nt, Homo Sapiens; identical to SEQ ID NO: 323039

SEQ ID NO: 485942 - RNA, 64 nt, Homo Sapiens; identical to SEQ ID NO: 323040

SEQ ID NO: 485943 - RNA, 64 nt, Homo Sapiens; identical to SEQ ID NO: 323041

SEQ ID NO: 485944 - RNA, 64 nt, Homo Sapiens; identical to SEQ ID NO: 323042

SEQ ID NO: 485945 - RNA, 64 nt, Homo Sapiens; identical to SEQ ID NO: 323043

SEQ ID NO: 485946 - RNA, 64 nt, Homo Sapiens; identical to SEQ ID NO: 323044

SEQ ID NO: 485947 - RNA, 64 nt, Homo Sapiens; identical to SEQ ID NO: 323045

SEQ ID NO: 485948 - RNA, 64 nt, Homo Sapiens; identical to SEQ ID NO: 323046

SEQ ID NO: 485949 - RNA, 64 nt, Homo Sapiens; identical to SEQ ID NO: 323047

SEQ ID NO: 485950 - RNA, 64 nt, Homo Sapiens; identical to SEQ ID NO: 323048

SEQ ID NO: 485951 - RNA, 64 nt, Homo Sapiens; identical to SEQ ID NO: 323049

SEQ ID NO: 485952 - RNA, 64 nt, Homo Sapiens; identical to SEQ ID NO: 323050

SEQ ID NO: 485953 - RNA, 64 nt, Homo Sapiens; identical to SEQ ID NO: 323051

SEQ ID NO: 485954 - RNA, 64 nt, Homo Sapiens; identical to SEQ ID NO: 323052

SEQ ID NO: 485955 - RNA, 64 nt, Homo Sapiens; identical to SEQ ID NO: 323053

SEQ ID NO: 485956 - RNA, 64 nt, Homo Sapiens; identical to SEQ ID NO: 323054

SEQ ID NO: 485957 - RNA, 64 nt, Homo Sapiens; identical to SEQ ID NO: 323055

SEQ ID NO: 485958 - RNA, 64 nt, Homo Sapiens; identical to SEQ ID NO: 323056

SEQ ID NO: 485959 - RNA, 64 nt, Homo Sapiens; identical to SEQ ID NO: 323057

SEQ ID NO: 485960 - RNA, 64 nt, Homo Sapiens; identical to SEQ ID NO: 323058

SEQ ID NO: 485961 - RNA, 64 nt, Homo Sapiens; identical to SEQ ID NO: 323059

SEQ ID NO: 485962 - RNA, 64 nt, Homo Sapiens; identical to SEQ ID NO: 323060

SEQ ID NO: 485963 - RNA, 64 nt, Homo Sapiens
cagccuccucccuccaugccuuagcagggguccccagggcaaguaggggaagggugggucucag

SEQ ID NO: 485964 - RNA, 64 nt, Homo Sapiens
ggaccagggaccuggaaccccuaugaagucucugcagggcaaggagacagacaaacccucugau

SEQ ID NO: 485965 - RNA, 64 nt, Homo Sapiens
uaaaaauccgauacugcaacuggaagguaagauucagggcaagcuguguagggagggauguaug

SEQ ID NO: 485966 - RNA, 64 nt, Homo Sapiens
uccuccugugacgguugcuggugugacaauuucgcagggcaauuuugugagaaauguuuugaau

SEQ ID NO: 485967 - RNA, 64 nt, Homo Sapiens
acuucuucccaccucaagauaaccacuggacuggcagggcaacgcugggcuggauucauguuca

SEQ ID NO: 485968 - RNA, 64 nt, Homo Sapiens
acgugagccagugggagcuguccuacuucuuguccagggcaagguuguggccuucuucauccuc

SEQ ID NO: 485969 - RNA, 64 nt, Homo Sapiens
gaacauggggguagagugguuauaggccaaaccucagggcaagggauuccuuucuccugcuuca

SEQ ID NO: 485970 - RNA, 64 nt, Homo Sapiens
uguauuugaucagaaguggcaucucuugccuuuucagggcaaaguugacaugccuuuuccacaa

SEQ ID NO: 485971 - RNA, 64 nt, Homo Sapiens; identical to SEQ ID NO: 289049

SEQ ID NO: 485972 - RNA, 64 nt, Homo Sapiens; identical to SEQ ID NO: 289050

SEQ ID NO: 485973 - RNA, 64 nt, Homo Sapiens; identical to SEQ ID NO: 289051

SEQ ID NO: 485974 - RNA, 64 nt, Homo Sapiens; identical to SEQ ID NO: 289052

SEQ ID NO: 485975 - RNA, 50 nt, Homo Sapiens; identical to SEQ ID NO: 289053

SEQ ID NO: 485976 - RNA, 64 nt, Homo Sapiens; identical to SEQ ID NO: 289054

SEQ ID NO: 485977 - RNA, 64 nt, Homo Sapiens; identical to SEQ ID NO: 289055

SEQ ID NO: 485978 - RNA, 64 nt, Homo Sapiens; identical to SEQ ID NO: 289056

SEQ ID NO: 485979 - RNA, 64 nt, Homo Sapiens; identical to SEQ ID NO: 289057

SEQ ID NO: 485980 - RNA, 64 nt, Homo Sapiens; identical to SEQ ID NO: 289058

SEQ ID NO: 485981 - RNA, 64 nt, Homo Sapiens; identical to SEQ ID NO: 289059

SEQ ID NO: 485982 - RNA, 64 nt, Homo Sapiens; identical to SEQ ID NO: 289060

SEQ ID NO: 485983 - RNA, 64 nt, Homo Sapiens; identical to SEQ ID NO: 289061

SEQ ID NO: 485984 - RNA, 64 nt, Homo Sapiens; identical to SEQ ID NO: 289062

SEQ ID NO: 485985 - RNA, 64 nt, Homo Sapiens; identical to SEQ ID NO: 289063

SEQ ID NO: 485986 - RNA, 64 nt, Homo Sapiens; identical to SEQ ID NO: 289064

SEQ ID NO: 485987 - RNA, 64 nt, Homo Sapiens; identical to SEQ ID NO: 289065

SEQ ID NO: 485988 - RNA, 64 nt, Homo Sapiens; identical to SEQ ID NO: 289066

SEQ ID NO: 485989 - RNA, 64 nt, Homo Sapiens; identical to SEQ ID NO: 289067

SEQ ID NO: 485990 - RNA, 64 nt, Homo Sapiens; identical to SEQ ID NO: 289068

SEQ ID NO: 485991 - RNA, 64 nt, Homo Sapiens; identical to SEQ ID NO: 289069

SEQ ID NO: 485992 - RNA, 64 nt, Homo Sapiens; identical to SEQ ID NO: 289070

SEQ ID NO: 485993 - RNA, 64 nt, Homo Sapiens; identical to SEQ ID NO: 289071

SEQ ID NO: 485994 - RNA, 64 nt, Homo Sapiens; identical to SEQ ID NO: 289072

SEQ ID NO: 485995 - RNA, 64 nt, Homo Sapiens; identical to SEQ ID NO: 289073

SEQ ID NO: 485996 - RNA, 64 nt, Homo Sapiens; identical to SEQ ID NO: 289074

SEQ ID NO: 485997 - RNA, 64 nt, Homo Sapiens; identical to SEQ ID NO: 289075

SEQ ID NO: 485998 - RNA, 64 nt, Homo Sapiens; identical to SEQ ID NO: 289076

SEQ ID NO: 485999 - RNA, 64 nt, Homo Sapiens; identical to SEQ ID NO: 289077

SEQ ID NO: 486000 - RNA, 64 nt, Homo Sapiens; identical to SEQ ID NO: 289078

SEQ ID NO: 486001 - RNA, 64 nt, Homo Sapiens; identical to SEQ ID NO: 289079

SEQ ID NO: 486002 - RNA, 64 nt, Homo Sapiens; identical to SEQ ID NO: 289080

SEQ ID NO: 486003 - RNA, 64 nt, Homo Sapiens; identical to SEQ ID NO: 289081

SEQ ID NO: 486004 - RNA, 64 nt, Homo Sapiens; identical to SEQ ID NO: 289082

SEQ ID NO: 486005 - RNA, 64 nt, Homo Sapiens; identical to SEQ ID NO: 289083

SEQ ID NO: 486006 - RNA, 64 nt, Homo Sapiens; identical to SEQ ID NO: 289084

SEQ ID NO: 486007 - RNA, 64 nt, Homo Sapiens; identical to SEQ ID NO: 289085

SEQ ID NO: 486008 - RNA, 64 nt, Homo Sapiens; identical to SEQ ID NO: 289086

SEQ ID NO: 486009 - RNA, 64 nt, Homo Sapiens; identical to SEQ ID NO: 289087

SEQ ID NO: 486010 - RNA, 64 nt, Homo Sapiens; identical to SEQ ID NO: 289088

SEQ ID NO: 486011 - RNA, 64 nt, Homo Sapiens; identical to SEQ ID NO: 289089

SEQ ID NO: 486012 - RNA, 64 nt, Homo Sapiens; identical to SEQ ID NO: 289090

SEQ ID NO: 486013 - RNA, 64 nt, Homo Sapiens; identical to SEQ ID NO: 289091

SEQ ID NO: 486014 - RNA, 64 nt, Homo Sapiens; identical to SEQ ID NO: 289092

SEQ ID NO: 486015 - RNA, 64 nt, Homo Sapiens; identical to SEQ ID NO: 289093

SEQ ID NO: 486016 - RNA, 64 nt, Homo Sapiens; identical to SEQ ID NO: 289094

SEQ ID NO: 486017 - RNA, 64 nt, Homo Sapiens; identical to SEQ ID NO: 289095

SEQ ID NO: 486018 - RNA, 64 nt, Homo Sapiens; identical to SEQ ID NO: 289096

SEQ ID NO: 486019 - RNA, 64 nt, Homo Sapiens; identical to SEQ ID NO: 289097

SEQ ID NO: 486020 - RNA, 64 nt, Homo Sapiens; identical to SEQ ID NO: 289098

SEQ ID NO: 486021 - RNA, 64 nt, Homo Sapiens; identical to SEQ ID NO: 289099

SEQ ID NO: 486022 - RNA, 64 nt, Homo Sapiens; identical to SEQ ID NO: 289100

SEQ ID NO: 486023 - RNA, 64 nt, Homo Sapiens; identical to SEQ ID NO: 289101

SEQ ID NO: 486024 - RNA, 64 nt, Homo Sapiens; identical to SEQ ID NO: 289102

SEQ ID NO: 486025 - RNA, 64 nt, Homo Sapiens; identical to SEQ ID NO: 289103

SEQ ID NO: 486026 - RNA, 64 nt, Homo Sapiens; identical to SEQ ID NO: 289104

SEQ ID NO: 486027 - RNA, 64 nt, Homo Sapiens; identical to SEQ ID NO: 289105

SEQ ID NO: 486028 - RNA, 64 nt, Homo Sapiens; identical to SEQ ID NO: 289106

SEQ ID NO: 486029 - RNA, 64 nt, Homo Sapiens; identical to SEQ ID NO: 289107

SEQ ID NO: 486030 - RNA, 64 nt, Homo Sapiens; identical to SEQ ID NO: 289108

SEQ ID NO: 486031 - RNA, 64 nt, Homo Sapiens; identical to SEQ ID NO: 289109

SEQ ID NO: 486032 - RNA, 64 nt, Homo Sapiens; identical to SEQ ID NO: 289110

SEQ ID NO: 486033 - RNA, 64 nt, Homo Sapiens; identical to SEQ ID NO: 289111

SEQ ID NO: 486034 - RNA, 64 nt, Homo Sapiens; identical to SEQ ID NO: 289112

SEQ ID NO: 486035 - RNA, 64 nt, Homo Sapiens; identical to SEQ ID NO: 289113

SEQ ID NO: 486036 - RNA, 64 nt, Homo Sapiens; identical to SEQ ID NO: 289114

SEQ ID NO: 486037 - RNA, 64 nt, Homo Sapiens; identical to SEQ ID NO: 289115

SEQ ID NO: 486038 - RNA, 64 nt, Homo Sapiens; identical to SEQ ID NO: 289116

SEQ ID NO: 486039 - RNA, 64 nt, Homo Sapiens; identical to SEQ ID NO: 289117

SEQ ID NO: 486040 - RNA, 64 nt, Homo Sapiens; identical to SEQ ID NO: 289118

SEQ ID NO: 486041 - RNA, 64 nt, Homo Sapiens; identical to SEQ ID NO: 289119

SEQ ID NO: 486042 - RNA, 64 nt, Homo Sapiens; identical to SEQ ID NO: 289120

SEQ ID NO: 486043 - RNA, 64 nt, Homo Sapiens; identical to SEQ ID NO: 289121

SEQ ID NO: 486044 - RNA, 64 nt, Homo Sapiens; identical to SEQ ID NO: 289122

SEQ ID NO: 486045 - RNA, 64 nt, Homo Sapiens; identical to SEQ ID NO: 289123

SEQ ID NO: 486046 - RNA, 64 nt, Homo Sapiens; identical to SEQ ID NO: 289124

SEQ ID NO: 486047 - RNA, 64 nt, Homo Sapiens; identical to SEQ ID NO: 289125

SEQ ID NO: 486048 - RNA, 64 nt, Homo Sapiens; identical to SEQ ID NO: 289126

SEQ ID NO: 486049 - RNA, 64 nt, Homo Sapiens; identical to SEQ ID NO: 289127

SEQ ID NO: 486050 - RNA, 64 nt, Homo Sapiens; identical to SEQ ID NO: 289128

SEQ ID NO: 486051 - RNA, 64 nt, Homo Sapiens; identical to SEQ ID NO: 289129

SEQ ID NO: 486052 - RNA, 64 nt, Homo Sapiens; identical to SEQ ID NO: 289130

SEQ ID NO: 486053 - RNA, 64 nt, Homo Sapiens; identical to SEQ ID NO: 289131

SEQ ID NO: 486054 - RNA, 64 nt, Homo Sapiens; identical to SEQ ID NO: 289132

SEQ ID NO: 486055 - RNA, 64 nt, Homo Sapiens; identical to SEQ ID NO: 289133

SEQ ID NO: 486056 - RNA, 64 nt, Homo Sapiens; identical to SEQ ID NO: 289134

SEQ ID NO: 486057 - RNA, 64 nt, Homo Sapiens; identical to SEQ ID NO: 289135

SEQ ID NO: 486058 - RNA, 64 nt, Homo Sapiens; identical to SEQ ID NO: 289136

SEQ ID NO: 486059 - RNA, 64 nt, Homo Sapiens; identical to SEQ ID NO: 289137

SEQ ID NO: 486060 - RNA, 64 nt, Homo Sapiens; identical to SEQ ID NO: 289138

SEQ ID NO: 486061 - RNA, 64 nt, Homo Sapiens; identical to SEQ ID NO: 289139

SEQ ID NO: 486062 - RNA, 64 nt, Homo Sapiens; identical to SEQ ID NO: 289140

SEQ ID NO: 486063 - RNA, 64 nt, Homo Sapiens; identical to SEQ ID NO: 289141

SEQ ID NO: 486064 - RNA, 64 nt, Homo Sapiens; identical to SEQ ID NO: 289142

SEQ ID NO: 486065 - RNA, 64 nt, Homo Sapiens; identical to SEQ ID NO: 289143

SEQ ID NO: 486066 - RNA, 64 nt, Homo Sapiens; identical to SEQ ID NO: 289144

SEQ ID NO: 486067 - RNA, 64 nt, Homo Sapiens; identical to SEQ ID NO: 289145

SEQ ID NO: 486068 - RNA, 64 nt, Homo Sapiens; identical to SEQ ID NO: 289146

SEQ ID NO: 486069 - RNA, 64 nt, Homo Sapiens; identical to SEQ ID NO: 289147

SEQ ID NO: 486070 - RNA, 64 nt, Homo Sapiens; identical to SEQ ID NO: 289148

SEQ ID NO: 486071 - RNA, 64 nt, Homo Sapiens; identical to SEQ ID NO: 289149

SEQ ID NO: 486072 - RNA, 64 nt, Homo Sapiens; identical to SEQ ID NO: 289150

SEQ ID NO: 486073 - RNA, 64 nt, Homo Sapiens; identical to SEQ ID NO: 289151

SEQ ID NO: 486074 - RNA, 64 nt, Homo Sapiens; identical to SEQ ID NO: 289152

SEQ ID NO: 486075 - RNA, 64 nt, Homo Sapiens; identical to SEQ ID NO: 289153

SEQ ID NO: 486076 - RNA, 64 nt, Homo Sapiens; identical to SEQ ID NO: 289154

SEQ ID NO: 486077 - RNA, 64 nt, Homo Sapiens; identical to SEQ ID NO: 289155

SEQ ID NO: 486078 - RNA, 64 nt, Homo Sapiens; identical to SEQ ID NO: 289156

SEQ ID NO: 486079 - RNA, 64 nt, Homo Sapiens; identical to SEQ ID NO: 289157

SEQ ID NO: 486080 - RNA, 64 nt, Homo Sapiens; identical to SEQ ID NO: 289158

SEQ ID NO: 486081 - RNA, 64 nt, Homo Sapiens; identical to SEQ ID NO: 289159

SEQ ID NO: 486082 - RNA, 64 nt, Homo Sapiens; identical to SEQ ID NO: 289160

SEQ ID NO: 486083 - RNA, 64 nt, Homo Sapiens; identical to SEQ ID NO: 289161

SEQ ID NO: 486084 - RNA, 64 nt, Homo Sapiens; identical to SEQ ID NO: 289162

SEQ ID NO: 486085 - RNA, 64 nt, Homo Sapiens; identical to SEQ ID NO: 289163

SEQ ID NO: 486086 - RNA, 64 nt, Homo Sapiens; identical to SEQ ID NO: 289164

SEQ ID NO: 486087 - RNA, 64 nt, Homo Sapiens; identical to SEQ ID NO: 289165

SEQ ID NO: 486088 - RNA, 64 nt, Homo Sapiens; identical to SEQ ID NO: 289166

SEQ ID NO: 486089 - RNA, 64 nt, Homo Sapiens; identical to SEQ ID NO: 289167

SEQ ID NO: 486090 - RNA, 64 nt, Homo Sapiens; identical to SEQ ID NO: 289168

SEQ ID NO: 486091 - RNA, 64 nt, Homo Sapiens; identical to SEQ ID NO: 289169

SEQ ID NO: 486092 - RNA, 64 nt, Homo Sapiens; identical to SEQ ID NO: 289170

SEQ ID NO: 486093 - RNA, 64 nt, Homo Sapiens; identical to SEQ ID NO: 289171

SEQ ID NO: 486094 - RNA, 64 nt, Homo Sapiens; identical to SEQ ID NO: 289172

SEQ ID NO: 486095 - RNA, 64 nt, Homo Sapiens; identical to SEQ ID NO: 289173

SEQ ID NO: 486096 - RNA, 64 nt, Homo Sapiens; identical to SEQ ID NO: 289174

SEQ ID NO: 486097 - RNA, 64 nt, Homo Sapiens; identical to SEQ ID NO: 289175

SEQ ID NO: 486098 - RNA, 64 nt, Homo Sapiens; identical to SEQ ID NO: 289176

SEQ ID NO: 486099 - RNA, 64 nt, Homo Sapiens; identical to SEQ ID NO: 289177

SEQ ID NO: 486100 - RNA, 64 nt, Homo Sapiens; identical to SEQ ID NO: 289178

SEQ ID NO: 486101 - RNA, 64 nt, Homo Sapiens; identical to SEQ ID NO: 289179

SEQ ID NO: 486102 - RNA, 64 nt, Homo Sapiens; identical to SEQ ID NO: 289180

SEQ ID NO: 486103 - RNA, 64 nt, Homo Sapiens; identical to SEQ ID NO: 289181

SEQ ID NO: 486104 - RNA, 64 nt, Homo Sapiens; identical to SEQ ID NO: 289182

SEQ ID NO: 486105 - RNA, 64 nt, Homo Sapiens; identical to SEQ ID NO: 289183

SEQ ID NO: 486106 - RNA, 64 nt, Homo Sapiens; identical to SEQ ID NO: 289184

SEQ ID NO: 486107 - RNA, 64 nt, Homo Sapiens; identical to SEQ ID NO: 289185

SEQ ID NO: 486108 - RNA, 64 nt, Homo Sapiens; identical to SEQ ID NO: 289186

SEQ ID NO: 486109 - RNA, 64 nt, Homo Sapiens; identical to SEQ ID NO: 289187

SEQ ID NO: 486110 - RNA, 64 nt, Homo Sapiens; identical to SEQ ID NO: 289188

SEQ ID NO: 486111 - RNA, 64 nt, Homo Sapiens; identical to SEQ ID NO: 289189

SEQ ID NO: 486112 - RNA, 64 nt, Homo Sapiens; identical to SEQ ID NO: 289190

SEQ ID NO: 486113 - RNA, 64 nt, Homo Sapiens; identical to SEQ ID NO: 289191

SEQ ID NO: 486114 - RNA, 64 nt, Homo Sapiens; identical to SEQ ID NO: 289192

SEQ ID NO: 486115 - RNA, 64 nt, Homo Sapiens; identical to SEQ ID NO: 289193

SEQ ID NO: 486116 - RNA, 64 nt, Homo Sapiens; identical to SEQ ID NO: 289194

SEQ ID NO: 486117 - RNA, 64 nt, Homo Sapiens; identical to SEQ ID NO: 289195

SEQ ID NO: 486118 - RNA, 64 nt, Homo Sapiens; identical to SEQ ID NO: 289196

SEQ ID NO: 486119 - RNA, 64 nt, Homo Sapiens; identical to SEQ ID NO: 289197

SEQ ID NO: 486120 - RNA, 64 nt, Homo Sapiens; identical to SEQ ID NO: 289198

SEQ ID NO: 486121 - RNA, 64 nt, Homo Sapiens; identical to SEQ ID NO: 289199

SEQ ID NO: 486122 - RNA, 64 nt, Homo Sapiens; identical to SEQ ID NO: 289200

SEQ ID NO: 486123 - RNA, 64 nt, Homo Sapiens; identical to SEQ ID NO: 289201

SEQ ID NO: 486124 - RNA, 64 nt, Homo Sapiens; identical to SEQ ID NO: 289202

SEQ ID NO: 486125 - RNA, 64 nt, Homo Sapiens; identical to SEQ ID NO: 289203

SEQ ID NO: 486126 - RNA, 64 nt, Homo Sapiens; identical to SEQ ID NO: 289204

SEQ ID NO: 486127 - RNA, 64 nt, Homo Sapiens; identical to SEQ ID NO: 289205

SEQ ID NO: 486128 - RNA, 64 nt, Homo Sapiens; identical to SEQ ID NO: 289206

SEQ ID NO: 486129 - RNA, 64 nt, Homo Sapiens; identical to SEQ ID NO: 289207

SEQ ID NO: 486130 - RNA, 64 nt, Homo Sapiens; identical to SEQ ID NO: 289208

SEQ ID NO: 486131 - RNA, 64 nt, Homo Sapiens; identical to SEQ ID NO: 289209

SEQ ID NO: 486132 - RNA, 64 nt, Homo Sapiens; identical to SEQ ID NO: 289210

SEQ ID NO: 486133 - RNA, 64 nt, Homo Sapiens; identical to SEQ ID NO: 289211

SEQ ID NO: 486134 - RNA, 64 nt, Homo Sapiens; identical to SEQ ID NO: 289212

SEQ ID NO: 486135 - RNA, 64 nt, Homo Sapiens; identical to SEQ ID NO: 289213

SEQ ID NO: 486136 - RNA, 64 nt, Homo Sapiens; identical to SEQ ID NO: 289214

SEQ ID NO: 486137 - RNA, 64 nt, Homo Sapiens; identical to SEQ ID NO: 289215

SEQ ID NO: 486138 - RNA, 64 nt, Homo Sapiens; identical to SEQ ID NO: 289216

SEQ ID NO: 486139 - RNA, 64 nt, Homo Sapiens; identical to SEQ ID NO: 289217

SEQ ID NO: 486140 - RNA, 64 nt, Homo Sapiens; identical to SEQ ID NO: 289218

SEQ ID NO: 486141 - RNA, 64 nt, Homo Sapiens; identical to SEQ ID NO: 289219

SEQ ID NO: 486142 - RNA, 64 nt, Homo Sapiens; identical to SEQ ID NO: 289220

SEQ ID NO: 486143 - RNA, 64 nt, Homo Sapiens; identical to SEQ ID NO: 289221

SEQ ID NO: 486144 - RNA, 64 nt, Homo Sapiens; identical to SEQ ID NO: 289222

SEQ ID NO: 486145 - RNA, 64 nt, Homo Sapiens; identical to SEQ ID NO: 289223

SEQ ID NO: 486146 - RNA, 64 nt, Homo Sapiens; identical to SEQ ID NO: 289224

SEQ ID NO: 486147 - RNA, 64 nt, Homo Sapiens; identical to SEQ ID NO: 289225

SEQ ID NO: 486148 - RNA, 64 nt, Homo Sapiens; identical to SEQ ID NO: 289226

SEQ ID NO: 486149 - RNA, 64 nt, Homo Sapiens; identical to SEQ ID NO: 289227

SEQ ID NO: 486150 - RNA, 64 nt, Homo Sapiens; identical to SEQ ID NO: 289228

SEQ ID NO: 486151 - RNA, 64 nt, Homo Sapiens; identical to SEQ ID NO: 289229

SEQ ID NO: 486152 - RNA, 64 nt, Homo Sapiens; identical to SEQ ID NO: 289230

SEQ ID NO: 486153 - RNA, 64 nt, Homo Sapiens; identical to SEQ ID NO: 289231

SEQ ID NO: 486154 - RNA, 64 nt, Homo Sapiens; identical to SEQ ID NO: 289232

SEQ ID NO: 486155 - RNA, 64 nt, Homo Sapiens; identical to SEQ ID NO: 289233

SEQ ID NO: 486156 - RNA, 64 nt, Homo Sapiens; identical to SEQ ID NO: 289234

SEQ ID NO: 486157 - RNA, 64 nt, Homo Sapiens; identical to SEQ ID NO: 289235

SEQ ID NO: 486158 - RNA, 64 nt, Homo Sapiens; identical to SEQ ID NO: 289236

SEQ ID NO: 486159 - RNA, 64 nt, Homo Sapiens; identical to SEQ ID NO: 289237

SEQ ID NO: 486160 - RNA, 64 nt, Homo Sapiens; identical to SEQ ID NO: 289238

SEQ ID NO: 486161 - RNA, 64 nt, Homo Sapiens; identical to SEQ ID NO: 289239

SEQ ID NO: 486162 - RNA, 64 nt, Homo Sapiens; identical to SEQ ID NO: 289240

SEQ ID NO: 486163 - RNA, 64 nt, Homo Sapiens; identical to SEQ ID NO: 289241

SEQ ID NO: 486164 - RNA, 64 nt, Homo Sapiens; identical to SEQ ID NO: 289242

SEQ ID NO: 486165 - RNA, 64 nt, Homo Sapiens; identical to SEQ ID NO: 289243

SEQ ID NO: 486166 - RNA, 64 nt, Homo Sapiens; identical to SEQ ID NO: 373477

SEQ ID NO: 486167 - RNA, 64 nt, Homo Sapiens; identical to SEQ ID NO: 373478

SEQ ID NO: 486168 - RNA, 64 nt, Homo Sapiens; identical to SEQ ID NO: 373479

SEQ ID NO: 486169 - RNA, 64 nt, Homo Sapiens; identical to SEQ ID NO: 373480

SEQ ID NO: 486170 - RNA, 64 nt, Homo Sapiens; identical to SEQ ID NO: 373481

SEQ ID NO: 486171 - RNA, 64 nt, Homo Sapiens; identical to SEQ ID NO: 373482

SEQ ID NO: 486172 - RNA, 64 nt, Homo Sapiens; identical to SEQ ID NO: 373483

SEQ ID NO: 486173 - RNA, 64 nt, Homo Sapiens; identical to SEQ ID NO: 373484

SEQ ID NO: 486174 - RNA, 64 nt, Homo Sapiens; identical to SEQ ID NO: 373485

SEQ ID NO: 486175 - RNA, 64 nt, Homo Sapiens; identical to SEQ ID NO: 373486

SEQ ID NO: 486176 - RNA, 64 nt, Homo Sapiens; identical to SEQ ID NO: 373487

SEQ ID NO: 486177 - RNA, 64 nt, Homo Sapiens; identical to SEQ ID NO: 373488

SEQ ID NO: 486178 - RNA, 64 nt, Homo Sapiens; identical to SEQ ID NO: 373489

SEQ ID NO: 486179 - RNA, 64 nt, Homo Sapiens; identical to SEQ ID NO: 373490

SEQ ID NO: 486180 - RNA, 64 nt, Homo Sapiens; identical to SEQ ID NO: 373491

SEQ ID NO: 486181 - RNA, 64 nt, Homo Sapiens; identical to SEQ ID NO: 373492

SEQ ID NO: 486182 - RNA, 64 nt, Homo Sapiens; identical to SEQ ID NO: 373493

SEQ ID NO: 486183 - RNA, 64 nt, Homo Sapiens; identical to SEQ ID NO: 373494

SEQ ID NO: 486184 - RNA, 64 nt, Homo Sapiens; identical to SEQ ID NO: 373495

SEQ ID NO: 486185 - RNA, 64 nt, Homo Sapiens; identical to SEQ ID NO: 373496

SEQ ID NO: 486186 - RNA, 64 nt, Homo Sapiens; identical to SEQ ID NO: 373497

SEQ ID NO: 486187 - RNA, 64 nt, Homo Sapiens; identical to SEQ ID NO: 373498

SEQ ID NO: 486188 - RNA, 64 nt, Homo Sapiens; identical to SEQ ID NO: 373499

SEQ ID NO: 486189 - RNA, 64 nt, Homo Sapiens; identical to SEQ ID NO: 373500

SEQ ID NO: 486190 - RNA, 64 nt, Homo Sapiens; identical to SEQ ID NO: 373501

SEQ ID NO: 486191 - RNA, 64 nt, Homo Sapiens; identical to SEQ ID NO: 373502

SEQ ID NO: 486192 - RNA, 64 nt, Homo Sapiens; identical to SEQ ID NO: 373503

SEQ ID NO: 486193 - RNA, 64 nt, Homo Sapiens; identical to SEQ ID NO: 373504

SEQ ID NO: 486194 - RNA, 64 nt, Homo Sapiens; identical to SEQ ID NO: 373505

SEQ ID NO: 486195 - RNA, 64 nt, Homo Sapiens; identical to SEQ ID NO: 373506

SEQ ID NO: 486196 - RNA, 64 nt, Homo Sapiens; identical to SEQ ID NO: 373507

SEQ ID NO: 486197 - RNA, 64 nt, Homo Sapiens; identical to SEQ ID NO: 373508

SEQ ID NO: 486198 - RNA, 64 nt, Homo Sapiens; identical to SEQ ID NO: 373509

SEQ ID NO: 486199 - RNA, 64 nt, Homo Sapiens; identical to SEQ ID NO: 373510

SEQ ID NO: 486200 - RNA, 64 nt, Homo Sapiens; identical to SEQ ID NO: 373511

SEQ ID NO: 486201 - RNA, 64 nt, Homo Sapiens; identical to SEQ ID NO: 373512

SEQ ID NO: 486202 - RNA, 64 nt, Homo Sapiens; identical to SEQ ID NO: 373513

SEQ ID NO: 486203 - RNA, 64 nt, Homo Sapiens; identical to SEQ ID NO: 373514

SEQ ID NO: 486204 - RNA, 64 nt, Homo Sapiens; identical to SEQ ID NO: 373515

SEQ ID NO: 486205 - RNA, 64 nt, Homo Sapiens; identical to SEQ ID NO: 373516

SEQ ID NO: 486206 - RNA, 64 nt, Homo Sapiens; identical to SEQ ID NO: 373517

SEQ ID NO: 486207 - RNA, 64 nt, Homo Sapiens; identical to SEQ ID NO: 373518

SEQ ID NO: 486208 - RNA, 64 nt, Homo Sapiens; identical to SEQ ID NO: 373519

SEQ ID NO: 486209 - RNA, 64 nt, Homo Sapiens; identical to SEQ ID NO: 373520

SEQ ID NO: 486210 - RNA, 64 nt, Homo Sapiens; identical to SEQ ID NO: 373521

SEQ ID NO: 486211 - RNA, 64 nt, Homo Sapiens; identical to SEQ ID NO: 373522

SEQ ID NO: 486212 - RNA, 64 nt, Homo Sapiens; identical to SEQ ID NO: 373523

SEQ ID NO: 486213 - RNA, 64 nt, Homo Sapiens; identical to SEQ ID NO: 373524

SEQ ID NO: 486214 - RNA, 64 nt, Homo Sapiens; identical to SEQ ID NO: 373525

SEQ ID NO: 486215 - RNA, 64 nt, Homo Sapiens; identical to SEQ ID NO: 373526

SEQ ID NO: 486216 - RNA, 64 nt, Homo Sapiens; identical to SEQ ID NO: 373527

SEQ ID NO: 486217 - RNA, 64 nt, Homo Sapiens; identical to SEQ ID NO: 373528

SEQ ID NO: 486218 - RNA, 64 nt, Homo Sapiens; identical to SEQ ID NO: 373529

SEQ ID NO: 486219 - RNA, 64 nt, Homo Sapiens; identical to SEQ ID NO: 373530

SEQ ID NO: 486220 - RNA, 64 nt, Homo Sapiens; identical to SEQ ID NO: 373531

SEQ ID NO: 486221 - RNA, 64 nt, Homo Sapiens; identical to SEQ ID NO: 373532

SEQ ID NO: 486222 - RNA, 64 nt, Homo Sapiens; identical to SEQ ID NO: 373533

SEQ ID NO: 486223 - RNA, 64 nt, Homo Sapiens; identical to SEQ ID NO: 373534

SEQ ID NO: 486224 - RNA, 64 nt, Homo Sapiens; identical to SEQ ID NO: 373535

SEQ ID NO: 486225 - RNA, 64 nt, Homo Sapiens; identical to SEQ ID NO: 373536

SEQ ID NO: 486226 - RNA, 64 nt, Homo Sapiens; identical to SEQ ID NO: 373537

SEQ ID NO: 486227 - RNA, 64 nt, Homo Sapiens; identical to SEQ ID NO: 373538

SEQ ID NO: 486228 - RNA, 64 nt, Homo Sapiens; identical to SEQ ID NO: 373539

SEQ ID NO: 486229 - RNA, 64 nt, Homo Sapiens; identical to SEQ ID NO: 373540

SEQ ID NO: 486230 - RNA, 64 nt, Homo Sapiens; identical to SEQ ID NO: 373541

SEQ ID NO: 486231 - RNA, 64 nt, Homo Sapiens; identical to SEQ ID NO: 373542

SEQ ID NO: 486232 - RNA, 64 nt, Homo Sapiens; identical to SEQ ID NO: 373543

SEQ ID NO: 486233 - RNA, 64 nt, Homo Sapiens; identical to SEQ ID NO: 373544

SEQ ID NO: 486234 - RNA, 64 nt, Homo Sapiens; identical to SEQ ID NO: 373545

SEQ ID NO: 486235 - RNA, 64 nt, Homo Sapiens; identical to SEQ ID NO: 373546

SEQ ID NO: 486236 - RNA, 64 nt, Homo Sapiens; identical to SEQ ID NO: 373547

SEQ ID NO: 486237 - RNA, 64 nt, Homo Sapiens; identical to SEQ ID NO: 373548

SEQ ID NO: 486238 - RNA, 64 nt, Homo Sapiens; identical to SEQ ID NO: 373549

SEQ ID NO: 486239 - RNA, 64 nt, Homo Sapiens; identical to SEQ ID NO: 373550

SEQ ID NO: 486240 - RNA, 64 nt, Homo Sapiens; identical to SEQ ID NO: 373551

SEQ ID NO: 486241 - RNA, 64 nt, Homo Sapiens; identical to SEQ ID NO: 373552

SEQ ID NO: 486242 - RNA, 64 nt, Homo Sapiens; identical to SEQ ID NO: 373553

SEQ ID NO: 486243 - RNA, 64 nt, Homo Sapiens; identical to SEQ ID NO: 373554

SEQ ID NO: 486244 - RNA, 64 nt, Homo Sapiens; identical to SEQ ID NO: 373555

SEQ ID NO: 486245 - RNA, 64 nt, Homo Sapiens; identical to SEQ ID NO: 373556

SEQ ID NO: 486246 - RNA, 64 nt, Homo Sapiens; identical to SEQ ID NO: 373557

SEQ ID NO: 486247 - RNA, 64 nt, Homo Sapiens; identical to SEQ ID NO: 373558

SEQ ID NO: 486248 - RNA, 64 nt, Homo Sapiens; identical to SEQ ID NO: 373559

SEQ ID NO: 486249 - RNA, 64 nt, Homo Sapiens; identical to SEQ ID NO: 373560

SEQ ID NO: 486250 - RNA, 64 nt, Homo Sapiens; identical to SEQ ID NO: 373561

SEQ ID NO: 486251 - RNA, 64 nt, Homo Sapiens; identical to SEQ ID NO: 373562

SEQ ID NO: 486252 - RNA, 64 nt, Homo Sapiens; identical to SEQ ID NO: 373563

SEQ ID NO: 486253 - RNA, 64 nt, Homo Sapiens; identical to SEQ ID NO: 373564

SEQ ID NO: 486254 - RNA, 64 nt, Homo Sapiens; identical to SEQ ID NO: 373565

SEQ ID NO: 486255 - RNA, 64 nt, Homo Sapiens; identical to SEQ ID NO: 373566

SEQ ID NO: 486256 - RNA, 64 nt, Homo Sapiens; identical to SEQ ID NO: 373567

SEQ ID NO: 486257 - RNA, 64 nt, Homo Sapiens; identical to SEQ ID NO: 373568

SEQ ID NO: 486258 - RNA, 64 nt, Homo Sapiens; identical to SEQ ID NO: 373569

SEQ ID NO: 486259 - RNA, 64 nt, Homo Sapiens; identical to SEQ ID NO: 373570

SEQ ID NO: 486260 - RNA, 64 nt, Homo Sapiens; identical to SEQ ID NO: 373571

SEQ ID NO: 486261 - RNA, 64 nt, Homo Sapiens; identical to SEQ ID NO: 373572

SEQ ID NO: 486262 - RNA, 64 nt, Homo Sapiens; identical to SEQ ID NO: 373573

SEQ ID NO: 486263 - RNA, 64 nt, Homo Sapiens; identical to SEQ ID NO: 373574

SEQ ID NO: 486264 - RNA, 64 nt, Homo Sapiens; identical to SEQ ID NO: 373575

SEQ ID NO: 486265 - RNA, 64 nt, Homo Sapiens; identical to SEQ ID NO: 373576

SEQ ID NO: 486266 - RNA, 64 nt, Homo Sapiens; identical to SEQ ID NO: 373577

SEQ ID NO: 486267 - RNA, 64 nt, Homo Sapiens; identical to SEQ ID NO: 373578

SEQ ID NO: 486268 - RNA, 64 nt, Homo Sapiens; identical to SEQ ID NO: 373579

SEQ ID NO: 486269 - RNA, 64 nt, Homo Sapiens; identical to SEQ ID NO: 373580

SEQ ID NO: 486270 - RNA, 64 nt, Homo Sapiens; identical to SEQ ID NO: 373581

SEQ ID NO: 486271 - RNA, 64 nt, Homo Sapiens; identical to SEQ ID NO: 373582

SEQ ID NO: 486272 - RNA, 64 nt, Homo Sapiens; identical to SEQ ID NO: 373583

SEQ ID NO: 486273 - RNA, 64 nt, Homo Sapiens; identical to SEQ ID NO: 373584

SEQ ID NO: 486274 - RNA, 64 nt, Homo Sapiens; identical to SEQ ID NO: 373585

SEQ ID NO: 486275 - RNA, 64 nt, Homo Sapiens; identical to SEQ ID NO: 373586

SEQ ID NO: 486276 - RNA, 64 nt, Homo Sapiens; identical to SEQ ID NO: 373587

SEQ ID NO: 486277 - RNA, 64 nt, Homo Sapiens; identical to SEQ ID NO: 373588

SEQ ID NO: 486278 - RNA, 64 nt, Homo Sapiens; identical to SEQ ID NO: 373589

SEQ ID NO: 486279 - RNA, 64 nt, Homo Sapiens; identical to SEQ ID NO: 373590

SEQ ID NO: 486280 - RNA, 64 nt, Homo Sapiens; identical to SEQ ID NO: 373591

SEQ ID NO: 486281 - RNA, 64 nt, Homo Sapiens; identical to SEQ ID NO: 373592

SEQ ID NO: 486282 - RNA, 64 nt, Homo Sapiens; identical to SEQ ID NO: 373593

SEQ ID NO: 486283 - RNA, 64 nt, Homo Sapiens; identical to SEQ ID NO: 373594

SEQ ID NO: 486284 - RNA, 64 nt, Homo Sapiens; identical to SEQ ID NO: 373595

SEQ ID NO: 486285 - RNA, 64 nt, Homo Sapiens; identical to SEQ ID NO: 373596

SEQ ID NO: 486286 - RNA, 64 nt, Homo Sapiens; identical to SEQ ID NO: 373597

SEQ ID NO: 486287 - RNA, 64 nt, Homo Sapiens; identical to SEQ ID NO: 373598

SEQ ID NO: 486288 - RNA, 64 nt, Homo Sapiens; identical to SEQ ID NO: 373599

SEQ ID NO: 486289 - RNA, 64 nt, Homo Sapiens; identical to SEQ ID NO: 373600

SEQ ID NO: 486290 - RNA, 64 nt, Homo Sapiens; identical to SEQ ID NO: 373601

SEQ ID NO: 486291 - RNA, 64 nt, Homo Sapiens; identical to SEQ ID NO: 373602

SEQ ID NO: 486292 - RNA, 64 nt, Homo Sapiens; identical to SEQ ID NO: 373603

SEQ ID NO: 486293 - RNA, 64 nt, Homo Sapiens; identical to SEQ ID NO: 373604

SEQ ID NO: 486294 - RNA, 64 nt, Homo Sapiens; identical to SEQ ID NO: 373605

SEQ ID NO: 486295 - RNA, 64 nt, Homo Sapiens; identical to SEQ ID NO: 373606

SEQ ID NO: 486296 - RNA, 64 nt, Homo Sapiens; identical to SEQ ID NO: 373607

SEQ ID NO: 486297 - RNA, 64 nt, Homo Sapiens; identical to SEQ ID NO: 373608

SEQ ID NO: 486298 - RNA, 64 nt, Homo Sapiens; identical to SEQ ID NO: 373609

SEQ ID NO: 486299 - RNA, 64 nt, Homo Sapiens; identical to SEQ ID NO: 373610

SEQ ID NO: 486300 - RNA, 64 nt, Homo Sapiens; identical to SEQ ID NO: 373611

SEQ ID NO: 486301 - RNA, 64 nt, Homo Sapiens; identical to SEQ ID NO: 373612

SEQ ID NO: 486302 - RNA, 64 nt, Homo Sapiens; identical to SEQ ID NO: 373613

SEQ ID NO: 486303 - RNA, 64 nt, Homo Sapiens; identical to SEQ ID NO: 373614

SEQ ID NO: 486304 - RNA, 64 nt, Homo Sapiens; identical to SEQ ID NO: 373615

SEQ ID NO: 486305 - RNA, 64 nt, Homo Sapiens; identical to SEQ ID NO: 373616

SEQ ID NO: 486306 - RNA, 64 nt, Homo Sapiens; identical to SEQ ID NO: 373617

SEQ ID NO: 486307 - RNA, 64 nt, Homo Sapiens; identical to SEQ ID NO: 373618

SEQ ID NO: 486308 - RNA, 64 nt, Homo Sapiens; identical to SEQ ID NO: 373619

SEQ ID NO: 486309 - RNA, 64 nt, Homo Sapiens; identical to SEQ ID NO: 373620

SEQ ID NO: 486310 - RNA, 64 nt, Homo Sapiens; identical to SEQ ID NO: 373621

SEQ ID NO: 486311 - RNA, 64 nt, Homo Sapiens; identical to SEQ ID NO: 373622

SEQ ID NO: 486312 - RNA, 64 nt, Homo Sapiens; identical to SEQ ID NO: 373623

SEQ ID NO: 486313 - RNA, 64 nt, Homo Sapiens; identical to SEQ ID NO: 373624

SEQ ID NO: 486314 - RNA, 64 nt, Homo Sapiens; identical to SEQ ID NO: 373625

SEQ ID NO: 486315 - RNA, 64 nt, Homo Sapiens; identical to SEQ ID NO: 373626

SEQ ID NO: 486316 - RNA, 64 nt, Homo Sapiens; identical to SEQ ID NO: 373627

SEQ ID NO: 486317 - RNA, 64 nt, Homo Sapiens; identical to SEQ ID NO: 373628

SEQ ID NO: 486318 - RNA, 64 nt, Homo Sapiens; identical to SEQ ID NO: 373629

SEQ ID NO: 486319 - RNA, 64 nt, Homo Sapiens; identical to SEQ ID NO: 373630

SEQ ID NO: 486320 - RNA, 64 nt, Homo Sapiens; identical to SEQ ID NO: 373631

SEQ ID NO: 486321 - RNA, 64 nt, Homo Sapiens; identical to SEQ ID NO: 373632

SEQ ID NO: 486322 - RNA, 64 nt, Homo Sapiens; identical to SEQ ID NO: 373633

SEQ ID NO: 486323 - RNA, 64 nt, Homo Sapiens; identical to SEQ ID NO: 373634

SEQ ID NO: 486324 - RNA, 64 nt, Homo Sapiens; identical to SEQ ID NO: 373635

SEQ ID NO: 486325 - RNA, 64 nt, Homo Sapiens; identical to SEQ ID NO: 373636

SEQ ID NO: 486326 - RNA, 64 nt, Homo Sapiens; identical to SEQ ID NO: 373637

SEQ ID NO: 486327 - RNA, 64 nt, Homo Sapiens; identical to SEQ ID NO: 373638

SEQ ID NO: 486328 - RNA, 64 nt, Homo Sapiens; identical to SEQ ID NO: 373639

SEQ ID NO: 486329 - RNA, 64 nt, Homo Sapiens; identical to SEQ ID NO: 373640

SEQ ID NO: 486330 - RNA, 64 nt, Homo Sapiens; identical to SEQ ID NO: 373641

SEQ ID NO: 486331 - RNA, 64 nt, Homo Sapiens; identical to SEQ ID NO: 373642

SEQ ID NO: 486332 - RNA, 64 nt, Homo Sapiens; identical to SEQ ID NO: 373643

SEQ ID NO: 486333 - RNA, 64 nt, Homo Sapiens; identical to SEQ ID NO: 373644

SEQ ID NO: 486334 - RNA, 64 nt, Homo Sapiens; identical to SEQ ID NO: 373645

SEQ ID NO: 486335 - RNA, 64 nt, Homo Sapiens; identical to SEQ ID NO: 373646

SEQ ID NO: 486336 - RNA, 64 nt, Homo Sapiens; identical to SEQ ID NO: 373647

SEQ ID NO: 486337 - RNA, 64 nt, Homo Sapiens; identical to SEQ ID NO: 373648

SEQ ID NO: 486338 - RNA, 64 nt, Homo Sapiens; identical to SEQ ID NO: 373649

SEQ ID NO: 486339 - RNA, 64 nt, Homo Sapiens; identical to SEQ ID NO: 373650

SEQ ID NO: 486340 - RNA, 64 nt, Homo Sapiens; identical to SEQ ID NO: 373651

SEQ ID NO: 486341 - RNA, 64 nt, Homo Sapiens; identical to SEQ ID NO: 373652

SEQ ID NO: 486342 - RNA, 64 nt, Homo Sapiens; identical to SEQ ID NO: 373653

SEQ ID NO: 486343 - RNA, 64 nt, Homo Sapiens; identical to SEQ ID NO: 373654

SEQ ID NO: 486344 - RNA, 64 nt, Homo Sapiens; identical to SEQ ID NO: 373655

SEQ ID NO: 486345 - RNA, 64 nt, Homo Sapiens; identical to SEQ ID NO: 373656

SEQ ID NO: 486346 - RNA, 64 nt, Homo Sapiens; identical to SEQ ID NO: 373657

SEQ ID NO: 486347 - RNA, 64 nt, Homo Sapiens; identical to SEQ ID NO: 373658

SEQ ID NO: 486348 - RNA, 64 nt, Homo Sapiens; identical to SEQ ID NO: 373659

SEQ ID NO: 486349 - RNA, 64 nt, Homo Sapiens; identical to SEQ ID NO: 373660

SEQ ID NO: 486350 - RNA, 64 nt, Homo Sapiens; identical to SEQ ID NO: 373661

SEQ ID NO: 486351 - RNA, 64 nt, Homo Sapiens; identical to SEQ ID NO: 363631

SEQ ID NO: 486352 - RNA, 64 nt, Homo Sapiens; identical to SEQ ID NO: 363632

SEQ ID NO: 486353 - RNA, 64 nt, Homo Sapiens; identical to SEQ ID NO: 363633

SEQ ID NO: 486354 - RNA, 64 nt, Homo Sapiens; identical to SEQ ID NO: 363634

SEQ ID NO: 486355 - RNA, 64 nt, Homo Sapiens; identical to SEQ ID NO: 363635

SEQ ID NO: 486356 - RNA, 64 nt, Homo Sapiens; identical to SEQ ID NO: 363636

SEQ ID NO: 486357 - RNA, 64 nt, Homo Sapiens; identical to SEQ ID NO: 363637

SEQ ID NO: 486358 - RNA, 64 nt, Homo Sapiens; identical to SEQ ID NO: 363638

SEQ ID NO: 486359 - RNA, 64 nt, Homo Sapiens; identical to SEQ ID NO: 363639

SEQ ID NO: 486360 - RNA, 64 nt, Homo Sapiens; identical to SEQ ID NO: 363640

SEQ ID NO: 486361 - RNA, 64 nt, Homo Sapiens; identical to SEQ ID NO: 363641

SEQ ID NO: 486362 - RNA, 64 nt, Homo Sapiens; identical to SEQ ID NO: 363642

SEQ ID NO: 486363 - RNA, 63 nt, Homo Sapiens; identical to SEQ ID NO: 363643

SEQ ID NO: 486364 - RNA, 64 nt, Homo Sapiens; identical to SEQ ID NO: 363644

SEQ ID NO: 486365 - RNA, 64 nt, Homo Sapiens; identical to SEQ ID NO: 363645

SEQ ID NO: 486366 - RNA, 64 nt, Homo Sapiens; identical to SEQ ID NO: 363646

SEQ ID NO: 486367 - RNA, 64 nt, Homo Sapiens; identical to SEQ ID NO: 363647

SEQ ID NO: 486368 - RNA, 64 nt, Homo Sapiens; identical to SEQ ID NO: 363648

SEQ ID NO: 486369 - RNA, 64 nt, Homo Sapiens; identical to SEQ ID NO: 363649

SEQ ID NO: 486370 - RNA, 64 nt, Homo Sapiens; identical to SEQ ID NO: 363650

SEQ ID NO: 486371 - RNA, 64 nt, Homo Sapiens; identical to SEQ ID NO: 363651

SEQ ID NO: 486372 - RNA, 64 nt, Homo Sapiens; identical to SEQ ID NO: 363652

SEQ ID NO: 486373 - RNA, 64 nt, Homo Sapiens; identical to SEQ ID NO: 363653

SEQ ID NO: 486374 - RNA, 64 nt, Homo Sapiens; identical to SEQ ID NO: 363654

SEQ ID NO: 486375 - RNA, 64 nt, Homo Sapiens; identical to SEQ ID NO: 363655

SEQ ID NO: 486376 - RNA, 64 nt, Homo Sapiens; identical to SEQ ID NO: 363656

SEQ ID NO: 486377 - RNA, 64 nt, Homo Sapiens; identical to SEQ ID NO: 363657

SEQ ID NO: 486378 - RNA, 64 nt, Homo Sapiens; identical to SEQ ID NO: 363658

SEQ ID NO: 486379 - RNA, 64 nt, Homo Sapiens; identical to SEQ ID NO: 363659

SEQ ID NO: 486380 - RNA, 64 nt, Homo Sapiens; identical to SEQ ID NO: 363660

SEQ ID NO: 486381 - RNA, 64 nt, Homo Sapiens; identical to SEQ ID NO: 363661

SEQ ID NO: 486382 - RNA, 64 nt, Homo Sapiens; identical to SEQ ID NO: 363662

SEQ ID NO: 486383 - RNA, 64 nt, Homo Sapiens; identical to SEQ ID NO: 363663

SEQ ID NO: 486384 - RNA, 64 nt, Homo Sapiens; identical to SEQ ID NO: 363664

SEQ ID NO: 486385 - RNA, 64 nt, Homo Sapiens; identical to SEQ ID NO: 363665

SEQ ID NO: 486386 - RNA, 57 nt, Homo Sapiens; identical to SEQ ID NO: 262389

SEQ ID NO: 486387 - RNA, 64 nt, Homo Sapiens; identical to SEQ ID NO: 363667

SEQ ID NO: 486388 - RNA, 64 nt, Homo Sapiens; identical to SEQ ID NO: 363668

SEQ ID NO: 486389 - RNA, 64 nt, Homo Sapiens; identical to SEQ ID NO: 363669

SEQ ID NO: 486390 - RNA, 64 nt, Homo Sapiens; identical to SEQ ID NO: 363670

SEQ ID NO: 486391 - RNA, 64 nt, Homo Sapiens; identical to SEQ ID NO: 363671

SEQ ID NO: 486392 - RNA, 64 nt, Homo Sapiens; identical to SEQ ID NO: 363672

SEQ ID NO: 486393 - RNA, 64 nt, Homo Sapiens; identical to SEQ ID NO: 363673

SEQ ID NO: 486394 - RNA, 64 nt, Homo Sapiens; identical to SEQ ID NO: 363674

SEQ ID NO: 486395 - RNA, 64 nt, Homo Sapiens; identical to SEQ ID NO: 363675

SEQ ID NO: 486396 - RNA, 64 nt, Homo Sapiens; identical to SEQ ID NO: 363676

SEQ ID NO: 486397 - RNA, 64 nt, Homo Sapiens; identical to SEQ ID NO: 363677

SEQ ID NO: 486398 - RNA, 64 nt, Homo Sapiens; identical to SEQ ID NO: 363678

SEQ ID NO: 486399 - RNA, 64 nt, Homo Sapiens; identical to SEQ ID NO: 363679

SEQ ID NO: 486400 - RNA, 64 nt, Homo Sapiens; identical to SEQ ID NO: 363680

SEQ ID NO: 486401 - RNA, 64 nt, Homo Sapiens; identical to SEQ ID NO: 78063

SEQ ID NO: 486402 - RNA, 64 nt, Homo Sapiens; identical to SEQ ID NO: 78064

SEQ ID NO: 486403 - RNA, 64 nt, Homo Sapiens; identical to SEQ ID NO: 78065

SEQ ID NO: 486404 - RNA, 64 nt, Homo Sapiens; identical to SEQ ID NO: 78066

SEQ ID NO: 486405 - RNA, 64 nt, Homo Sapiens; identical to SEQ ID NO: 78067

SEQ ID NO: 486406 - RNA, 64 nt, Homo Sapiens; identical to SEQ ID NO: 78068

SEQ ID NO: 486407 - RNA, 64 nt, Homo Sapiens; identical to SEQ ID NO: 78069

SEQ ID NO: 486408 - RNA, 64 nt, Homo Sapiens; identical to SEQ ID NO: 78070

SEQ ID NO: 486409 - RNA, 64 nt, Homo Sapiens; identical to SEQ ID NO: 78071

SEQ ID NO: 486410 - RNA, 64 nt, Homo Sapiens; identical to SEQ ID NO: 78072

SEQ ID NO: 486411 - RNA, 64 nt, Homo Sapiens
guuuugaauaagucugggugaccgcaccuaaaaugguaagcaguacccuccggcuuuuucuuag

SEQ ID NO: 486412 - RNA, 64 nt, Homo Sapiens
auuuucuaauuuggcaccucuugaugccuaagcagguaagcagaugccuaagcuguauuucucc

SEQ ID NO: 486413 - RNA, 64 nt, Homo Sapiens
uuuguucacucauagaaacauuauuaauugguaggguaagcagacacucugaaacaaugagaaa

SEQ ID NO: 486414 - RNA, 64 nt, Homo Sapiens
cagaucaguguguuggcugguucucauuuuaagggguaagcaguuugcuauucugugacuuuag

SEQ ID NO: 486415 - RNA, 64 nt, Homo Sapiens
uggccuaugccaauaaugaagagcaagccuuucagguaagcaaauuaaaguucaguuugcucau

SEQ ID NO: 486416 - RNA, 64 nt, Homo Sapiens
uagacacuguugaaucaauacagugaaacagacagguaagcaggugguuuuaaugccucauucu

SEQ ID NO: 486417 - RNA, 64 nt, Homo Sapiens
ucuacauguuugccaguuaauuagggaguuauuugguaagcaaaucaauauaaccagcaaagau

SEQ ID NO: 486418 - RNA, 64 nt, Homo Sapiens
aguuuugcaaggcugcauaagaacuggugaaugggguaagcauuuucauucuuccugcugaagu

SEQ ID NO: 486419 - RNA, 64 nt, Homo Sapiens
uuucuguuuuuagaccaauuuuuuacaguucuuugguaagcauugucguaucuggugauggauu

SEQ ID NO: 486420 - RNA, 64 nt, Homo Sapiens
cuccaagcucacuccccaacccccaacuccgugugguaagcaacauggcuuugaugauaaacga

SEQ ID NO: 486421 - RNA, 64 nt, Homo Sapiens
uauuaggcuuugggguggggcucuuuuuugacuugguaagcaagagccugugaaucaacugugu

SEQ ID NO: 486422 - RNA, 64 nt, Homo Sapiens
uauuaaguaccugcuguauguuuuucagucuuuugguaagcauuacuuuucccuauuuuugucc

SEQ ID NO: 486423 - RNA, 64 nt, Homo Sapiens
auguuuguuaauacauauuuuuuuuagaucuucugguaagcauuuuugaugagguugguaaaug

SEQ ID NO: 486424 - RNA, 64 nt, Homo Sapiens
cuuguauaaaaauaagaaaagaaauuaaucuugagguaagcagaguagacaucaucucugauug

SEQ ID NO: 486425 - RNA, 64 nt, Homo Sapiens
gaaguauaauaaguaaccuuguaaaaaaaacaaugguaagcacuacaaaccuuaaaccaaagga

SEQ ID NO: 486426 - RNA, 64 nt, Homo Sapiens
aagcagagagaacccagguugcacauuuacuucugguaagcauacagagauacugaacuugcug

SEQ ID NO: 486427 - RNA, 64 nt, Homo Sapiens
ugcaugcucugccuuucuuggcugaagugcugcugguaagcauguaccuugugccucucagauu

SEQ ID NO: 486428 - RNA, 64 nt, Homo Sapiens
cucucccgcucuggcuucuguggcggcagugguggguaagcacuccaguguucucuuaaugagg

SEQ ID NO: 486429 - RNA, 64 nt, Homo Sapiens
cacucaggacagcuugguuuauuuuugagagugggguaagcaccccuaccugccuuacagagca

SEQ ID NO: 486430 - RNA, 64 nt, Homo Sapiens
caaaaagucauuguaaucuuucauagccauaccugguaagcaaaaacuaguaaagacauaggaa

SEQ ID NO: 486431 - RNA, 64 nt, Homo Sapiens
uauuuuauacaaaauuauaaagaaagcauagagagguaagcauuaguggcacagcugagaaaau

SEQ ID NO: 486432 - RNA, 64 nt, Homo Sapiens
caguggggcaccaaggauucuguccucauugcuggguaagcagggagaagagaaguuuucccca

SEQ ID NO: 486433 - RNA, 64 nt, Homo Sapiens
uuuauccucucauuaagugcuuuuucacccuauagguaagcauuuuugugccaacauguuguca

SEQ ID NO: 486434 - RNA, 64 nt, Homo Sapiens
auuagaguauucaugauaaaacauuuugagaagggguaagcagugaguuauuacccacaauuua

SEQ ID NO: 486435 - RNA, 64 nt, Homo Sapiens
aacauuucaaggaaaugaauauauuguuagaccagguaagcaaguuuauuuuuguuaaagagca

SEQ ID NO: 486436 - RNA, 64 nt, Homo Sapiens
gggguugggaccucagaugguguucuggacuugggguaagcaguaauugggucaggaaguccag

SEQ ID NO: 486437 - RNA, 64 nt, Homo Sapiens
uuuagaauuuuguucuugacaucacuguucaaaagguaagcacaaacaauuacugucagguguc

SEQ ID NO: 486438 - RNA, 64 nt, Homo Sapiens
uagcacaugccguggcaccaaaugaguugauuuagguaagcacccaggguuguugugaggaucc

SEQ ID NO: 486439 - RNA, 64 nt, Homo Sapiens
uuuugguugcuaaagaaaaaucugauuaaccaaggguaagcauguuuuaucuuuugaaacacgu

SEQ ID NO: 486440 - RNA, 64 nt, Homo Sapiens
agugcuagcauucuagauucgugugauacugacagguaagcaaccaguaggguuugagacuuac

SEQ ID NO: 486441 - RNA, 64 nt, Homo Sapiens
acuuggauacauaugugcauuuacuguauuucuugguaagcauauuuuugggggaaagugcugc

SEQ ID NO: 486442 - RNA, 64 nt, Homo Sapiens
aagaaggagucacggguucugggcuuugccaaaggguaagcacacagauaugcagagggacuug

SEQ ID NO: 486443 - RNA, 64 nt, Homo Sapiens
aguagaagcccauuugaguuaaugggauggaauagguaagcaaacccauuuuuguacagaauug

SEQ ID NO: 486444 - RNA, 64 nt, Homo Sapiens
gcuguuuuauacuucaacaauuuuuucccuaagugguaagcaauuacuuuaaaacauauuuuua

SEQ ID NO: 486445 - RNA, 64 nt, Homo Sapiens
uuguuugaagguauccuuuacauaccugucuguagguaagcaaguguuaguaaaaacaauuuug

SEQ ID NO: 486446 - RNA, 64 nt, Homo Sapiens
cuugacugcuuuuaaaugaccaaagaugaccugugguaagcaaccugggcaucuuaggaagcag

SEQ ID NO: 486447 - RNA, 64 nt, Homo Sapiens
auuuuuacucaugccuuuuuguuuaggauaaauagguaagcacaaagagcucuucaaaaucaga

SEQ ID NO: 486448 - RNA, 64 nt, Homo Sapiens
uggagagagcacuuccccguaacgaaagcaaagugguaagcacagggugagacccuuuuacaca

SEQ ID NO: 486449 - RNA, 64 nt, Homo Sapiens
uguauaucuaccauuuagauuugaaaaacuguuugguaagcacacauuuuuaaaaacagaaaaa

SEQ ID NO: 486450 - RNA, 64 nt, Homo Sapiens
ggcuuugggguccuagcccaugugcuuggccccugguaagcagaaagaaaguaaugccacacau

SEQ ID NO: 486451 - RNA, 64 nt, Homo Sapiens
aauguguauuuucuacaaaaccauauuuagauuggguaagcauguaagugaucaugagguccuu

SEQ ID NO: 486452 - RNA, 64 nt, Homo Sapiens
aaaacauaggggcuaucauuauaugguuuauuuagguaagcauagcuuauaugccaaauauuaa

SEQ ID NO: 486453 - RNA, 64 nt, Homo Sapiens
cuuccuuugcucugaagguuguaaccaaaauuuagguaagcaggauaacauauguaacuccuuu

SEQ ID NO: 486454 - RNA, 64 nt, Homo Sapiens
ucuuucuagguuaugaagagauaauuauuugucugguaagcauuuuuauaaacccacucauuuu

SEQ ID NO: 486455 - RNA, 64 nt, Homo Sapiens
aggguggggacugaugaugggggguuuuauuucagguaagcaguuuauaugacuuccaauaaga

SEQ ID NO: 486456 - RNA, 64 nt, Homo Sapiens
auauucaccaucucuaauucauuggucacugguagguaagcaugaguuaaggaaagucaaaaau

SEQ ID NO: 486457 - RNA, 64 nt, Homo Sapiens
guagacaaacccuuggggcuucacagccccagcagguaagcagugcaggccgccgucuccccac

SEQ ID NO: 486458 - RNA, 64 nt, Homo Sapiens
agaaaucauuggccccuucccagcacauugaauggguaagcagacaggccaugauuuaguuggc

SEQ ID NO: 486459 - RNA, 64 nt, Homo Sapiens
agaacaugcaaaucagcaggaacuggucauacaggguaagcaccagggacaauaaggauuuuua

SEQ ID NO: 486460 - RNA, 64 nt, Homo Sapiens
ucaaauggcacauagauaggcaggauauuacauagguaagcaggaauuuauacauuggguacca

SEQ ID NO: 486461 - RNA, 64 nt, Homo Sapiens
uaaugccuuuggguucgaggacugaauuucuuuugguaagcaguacgcugaggccaguugucag

SEQ ID NO: 486462 - RNA, 64 nt, Homo Sapiens
gucugaauuuauacuaaucaacuuauagucaauggguaagcagacuugaaaacaaaaaacaguu

SEQ ID NO: 486463 - RNA, 64 nt, Homo Sapiens
cauagcccauuacagguucacgagagcuagcccugguaagcaaacaggcacacgaccaagucag

SEQ ID NO: 486464 - RNA, 64 nt, Homo Sapiens
uuguuuuuucuuucucuguuuauauugugggcuugguaagcauuaaucuaaauaucuugaaagc

SEQ ID NO: 486465 - RNA, 64 nt, Homo Sapiens
aaaucccacucaucgaccccggguaaaauguuaugguaagcaugcacaguuugcagucuacagu

SEQ ID NO: 486466 - RNA, 64 nt, Homo Sapiens
ucaaacuacuuuauacuagugauaguuugaguuagguaagcaucuuaaagcuguuuggugauaa

SEQ ID NO: 486467 - RNA, 64 nt, Homo Sapiens
uauauauuaauaauguacaugguguuuaaagaaugguaagcauuguuaauuucuguaaugaaca

SEQ ID NO: 486468 - RNA, 64 nt, Homo Sapiens
ugaugcuguugcucucguccgccucccuuccacagguaagcacgcaagacacagguaccgugug

SEQ ID NO: 486469 - RNA, 64 nt, Homo Sapiens
acaugaccuugggauuacauuuuuauggggcagggguaagcaaguuuuuaaaucauuugugugc

SEQ ID NO: 486470 - RNA, 64 nt, Homo Sapiens
uuuuccgcuuugacuuuaacgcuuucuaggauaggguaagcacccuuaauucaggcacugucca

SEQ ID NO: 486471 - RNA, 64 nt, Homo Sapiens
ccggggaggagagagcagcuucugccacuucccagguaagcaggaggaggugccaacaguguua

SEQ ID NO: 486472 - RNA, 64 nt, Homo Sapiens
ucuugaaaaggaaaauaaaaucacuuucuugcuugguaagcaagaagccauaucgauuuuuuuu

SEQ ID NO: 486473 - RNA, 64 nt, Homo Sapiens
gaagcagauagaugguccagcaggcuugaagcaggguaagcaggcuggcccaggguaagggcug

SEQ ID NO: 486474 - RNA, 64 nt, Homo Sapiens
cuuaacauguauuuccacuuuagcacuuaacuaggguaagcauuuucuaaaggggggcgcuguc

SEQ ID NO: 486475 - RNA, 64 nt, Homo Sapiens
accuggucucucagcaaacagugcuuguuggguggguaagcaccggcaaacccaaagauggaaa

SEQ ID NO: 486476 - RNA, 64 nt, Homo Sapiens
uuccucagcaggaucaagccaucuggcuuccagugguaagcacagaaacacuugcugaaucugc

SEQ ID NO: 486477 - RNA, 64 nt, Homo Sapiens
cuuucuuugcaguuaagacugaagcugucaaagagguaagcacauuuuauauagacguaaggaa

SEQ ID NO: 486478 - RNA, 64 nt, Homo Sapiens
guauuguuucuuaaguaaauauugggacaaucaugguaagcaaacuuaguucuguaacugcauu

SEQ ID NO: 486479 - RNA, 64 nt, Homo Sapiens
acacacggacgugugauacacacaugcauguacagguaagcacacauguacaagcuccuacagg

SEQ ID NO: 486480 - RNA, 64 nt, Homo Sapiens
gauuuucuaaucgacuugcagaguaguugaaguggguaagcagcaggguaccuuguauaaugca

SEQ ID NO: 486481 - RNA, 64 nt, Homo Sapiens
acuuuccucccagauaauugauuaugggaaaccugguaagcaaauaccuuuuuguguuuagaga

SEQ ID NO: 486482 - RNA, 64 nt, Homo Sapiens
cagcccugugugcuuugcacauuuaccuuacagugguaagcagagaccaucugugaccauagcc

SEQ ID NO: 486483 - RNA, 64 nt, Homo Sapiens
cuguuuauuucauccucgaugggaauucuugcuagguaagcacuaauaacucggcaucuugacg

SEQ ID NO: 486484 - RNA, 64 nt, Homo Sapiens
auauagaacagugcuugccacagagcggggacucgguaagcacuuaaugaaugaaugaauucua

SEQ ID NO: 486485 - RNA, 64 nt, Homo Sapiens
auuaaccaaggccuuggauuccagaauguuucaugguaagcacuguggagaaccuacaugucag

SEQ ID NO: 486486 - RNA, 64 nt, Homo Sapiens
ggagaauuuacccuuuccaaauuuaugguuccuugguaagcacgguauucuaaaccagcagagc

SEQ ID NO: 486487 - RNA, 64 nt, Homo Sapiens
uuaccucaguauuucagggcuagaaagaaauauagguaagcagcaaauauuucucauacauaug

SEQ ID NO: 486488 - RNA, 64 nt, Homo Sapiens
ccugugaguggcgcaugaacguaagugcaguggggguaagcagucguaacucugugacugcauu

SEQ ID NO: 486489 - RNA, 64 nt, Homo Sapiens
ccuaugguuuugguaaaaacuagggguuuucuaugguaagcacaauuguaucuucaugggacau

SEQ ID NO: 486490 - RNA, 64 nt, Homo Sapiens
ugacuggccauuugugccgaucuuuaaaaaugcagguaagcaugccccaaauaccugaaagcug

SEQ ID NO: 486491 - RNA, 64 nt, Homo Sapiens
aaaucuaccucagaguuguacccucagaaggacggguaagcaggaggccaggggguccccaggg

SEQ ID NO: 486492 - RNA, 64 nt, Homo Sapiens
gaguaaaucaacaucuguauacccccuucccagggguaagcacuguuaccaauuuagcauaugu

SEQ ID NO: 486493 - RNA, 64 nt, Homo Sapiens
ucacaccucuuucugccucuuccaaggcaaaagagguaagcagauccagugagcuccagauucu

SEQ ID NO: 486494 - RNA, 64 nt, Homo Sapiens
uuccaauaaacgcaagcugauuuguggagugcuggguaagcagugucaccccgcuguaagcucc

SEQ ID NO: 486495 - RNA, 64 nt, Homo Sapiens
gccacuggugggauauuuugccaucuguaaaauggguaagcauaaccuuggugccucaguuuac

SEQ ID NO: 486496 - RNA, 64 nt, Homo Sapiens
aggacgcccucgagguugcuaccaguuuccaggugguaagcaccaggaguucucccaccaccuc

SEQ ID NO: 486497 - RNA, 64 nt, Homo Sapiens
ucaaggguguuggaggagguacugaaaauggcuggguaagcaagcugugaccacccguguagcu

SEQ ID NO: 486498 - RNA, 64 nt, Homo Sapiens
auuuauccaugcuggcagaggcacucagguacuugguaagcaaauuucuaaaacuccaaguugc

SEQ ID NO: 486499 - RNA, 64 nt, Homo Sapiens
uauaaagacggcaagaccauuauacaaauuaagugguaagcagucauucuauguuauucuagac

SEQ ID NO: 486500 - RNA, 64 nt, Homo Sapiens
cuuccccuaaauuaggaccuauuauuuaccuguagguaagcaagcuacuguagcucuucugagg

SEQ ID NO: 486501 - RNA, 64 nt, Homo Sapiens
agcagaugacacugauuggccucacggggacuuggguaagcaacaggcggcauucaggacucuu

SEQ ID NO: 486502 - RNA, 64 nt, Homo Sapiens
cacugcacugaaccaacugcccuggcagugcacugguaagcagagaggcuuagccaucccugac

SEQ ID NO: 486503 - RNA, 64 nt, Homo Sapiens
uuuaauuaucaaaggccccagccccaccuuaagugguaagcauggguggccuugaucucuccau

SEQ ID NO: 486504 - RNA, 64 nt, Homo Sapiens
uuccuguccugaaauauuuuauucaugaaaauaagguaagcaaaaaccaacuccauuuugccag

SEQ ID NO: 486505 - RNA, 64 nt, Homo Sapiens
uccucagggucccuucugccaucuaggccuuagggguaagcaggucucaguccuggcaccaugc

SEQ ID NO: 486506 - RNA, 64 nt, Homo Sapiens
ggggcuggguggggggagaagaccgacuaacagcugaaguaaugacagauuguugcugggucau

SEQ ID NO: 486507 - RNA, 64 nt, Homo Sapiens
gaggaaaaagaaaaacauuuccucuuauaacuucugaaguaauuuguaaaaaagauuuguagag

SEQ ID NO: 486508 - RNA, 64 nt, Homo Sapiens
ucuauaugacagauguauuuuaaaaguuucaucuugaaguaaaaguacaacagcuugaaguguu

SEQ ID NO: 486509 - RNA, 64 nt, Homo Sapiens
gcuuuguugguaaaagugacauguuaaggggcuaugaaguaaauaugcugcaguuaauuaugcu

SEQ ID NO: 486510 - RNA, 64 nt, Homo Sapiens
aauuggccuaaguauucaugagcccauguuucugugaaguaauuauuaaaccaacuuaaugauu

SEQ ID NO: 486511 - RNA, 64 nt, Homo Sapiens
uugaggaaucuuaaauuucauagacauguaaagcugaaguaacucuaaagagcagaugcuucag

SEQ ID NO: 486512 - RNA, 64 nt, Homo Sapiens
aacugauggcauuugagaauagugaagaauugcuugaaguaagccagaagaaaauccucagcaa

SEQ ID NO: 486513 - RNA, 64 nt, Homo Sapiens
gccaguggucuuuaaacuaauguaccuuuguuccugaaguaaccgacauuuauauuaugaaaua

SEQ ID NO: 486514 - RNA, 64 nt, Homo Sapiens
augcugcaguuaauugugcuauguuaaggggcuaugaaguaaaugcuuuguugguaaaagugac

SEQ ID NO: 486515 - RNA, 64 nt, Homo Sapiens
guacaacagcuugaaguguuuaaaaguuucaacuugaaguaaaaucuguaugacagauguauuu

SEQ ID NO: 486516 - RNA, 64 nt, Homo Sapiens
uauuaaaauauccuauuuaauuauauaauaucuuugaaguaaauaagaucucuugggaucagaa

SEQ ID NO: 486517 - RNA, 64 nt, Homo Sapiens
guuacuuguugcaacccgagguccacuuuguugcugaaguaaacaacaaauaaucucuagagag

SEQ ID NO: 486518 - RNA, 64 nt, Homo Sapiens
ugcauguagucuuuggacugguuauuucugguuuugaaguaaucgaacaaauugaaaaucugaa

SEQ ID NO: 486519 - RNA, 64 nt, Homo Sapiens
gcaaaaauaaaguucggccugggucucucuuugaugaaguaagaaagacagcacgcuuaaaccg

SEQ ID NO: 486520 - RNA, 64 nt, Homo Sapiens
aaguuuucucaguggggcaggggcacuggaugccugaaguaaguagggccugaacccugggugg

SEQ ID NO: 486521 - RNA, 64 nt, Homo Sapiens
aagaaacacaagacggcuaagacaaauuugguugugaaguaaacccuuaacagagagaagaggg

SEQ ID NO: 486522 - RNA, 64 nt, Homo Sapiens
ugaggcccuuauauaauuacucccauuuugcagaugaaguaacugaggcuuagaaagguuaaua

SEQ ID NO: 486523 - RNA, 64 nt, Homo Sapiens
guugaaugucaaucauauuuaaagggaaugacuuugaaguaaaaccuuuuuucuugcuacugaa

SEQ ID NO: 486524 - RNA, 64 nt, Homo Sapiens
guuagcucuacauauaaaucucaauguuuuauucugaaguaaacuucucuuccuucccuguuug

SEQ ID NO: 486525 - RNA, 56 nt, Homo Sapiens
uuacaacagagcagaacuuguaaauaugaaguaagaucucucucuuuuaggaauaa

SEQ ID NO: 486526 - RNA, 64 nt, Homo Sapiens
auuacaaacauuggauacgguuuuuagauucacuugaaguaaaccauaaacuaaauuuagaaau

SEQ ID NO: 486527 - RNA, 64 nt, Homo Sapiens
uucuguuaaaauauauuugaauaauaauuuggaaugaaguaagguuuugauuuugaaauaucug

SEQ ID NO: 486528 - RNA, 64 nt, Homo Sapiens
aguuaauaauuauauuagcaaaguguuaaucuaaugaaguaaaaaacuccuguguggcagaaag

SEQ ID NO: 486529 - RNA, 64 nt, Homo Sapiens
acacaauagacuacuuacuacucagcaauaaaaaugaaguaacuuucaauaaaugcaauauuau

SEQ ID NO: 486530 - RNA, 64 nt, Homo Sapiens
cagcugacuuuguuaguaucauguugaaauagcuugaaguaauaucuuuuauccccuugcaaau

SEQ ID NO: 486531 - RNA, 64 nt, Homo Sapiens
uucuuuuaccauugaccauuauuauagggacccaugaaguaaaugucacaaucaucuuacuagc

SEQ ID NO: 486532 - RNA, 64 nt, Homo Sapiens
ggcuaccgggcugggggcgaccuuuaccauaggaugaaguaaccuugcauucggcugcaaggug

SEQ ID NO: 486533 - RNA, 64 nt, Homo Sapiens
auaaaccuccaagcucacauuuaauauaacagacugaaguaaacauuagaauccuguuuagagc

SEQ ID NO: 486534 - RNA, 64 nt, Homo Sapiens
ugucaggauacaauacacacugauauauacauguugaaguaaugguaugcaguaagauuuuuuu

SEQ ID NO: 486535 - RNA, 64 nt, Homo Sapiens
uuacuuucaucucaaguuauuaaaaacccacaacugaaguaaauuuuauuucaagaaucagcag

SEQ ID NO: 486536 - RNA, 64 nt, Homo Sapiens
uaacauucagcuugucucauaaacccagagugacugagagcacuaucucccaccuguggccccu

SEQ ID NO: 486537 - RNA, 64 nt, Homo Sapiens
cagaggaccgaggacaggggggcagcuggggggcugagagcaccaaauugaggacagcgaugcg

SEQ ID NO: 486538 - RNA, 64 nt, Homo Sapiens
acuguguagccuuuucuuugcuucacaaaugugcugagagcauucaucugucagcucacuccag

SEQ ID NO: 486539 - RNA, 64 nt, Homo Sapiens
cagaacggucuugggacuugcugagacagugguuugagagcaggugggcugcugauggucagcu

SEQ ID NO: 486540 - RNA, 64 nt, Homo Sapiens
caauucuguguaaucaagaauaccuccuuaauucugagagcaugaauauuugaccuuaaaucuc

SEQ ID NO: 486541 - RNA, 64 nt, Homo Sapiens
cugauauguaaaugaugauuuauguuggcgagucugagagcaagcccaaauguguucuucaaag

SEQ ID NO: 486542 - RNA, 64 nt, Homo Sapiens
auccaugucauuccuuuauuaguuguaagcuccuugagagcagggaaucuugucuuuccguaua

SEQ ID NO: 486543 - RNA, 64 nt, Homo Sapiens
cucuuuuuaaagugugauguuuucuugcuuuggcugagagcagcuaggcuuaaugaaagagguc

SEQ ID NO: 486544 - RNA, 64 nt, Homo Sapiens
ugccugaucacucuggccaauggaagcucuaagaugagagcaaauuacaaauuaugugauuauc

SEQ ID NO: 486545 - RNA, 64 nt, Homo Sapiens
guagcccagccugcuggucaggagagagagagcaugagagcacauauuuacaaauguccaugug

SEQ ID NO: 486546 - RNA, 64 nt, Homo Sapiens
uuuuauauggauuauccauaugggcaaaauaucuugagagcagucauuuguaaacaaauucuaa

SEQ ID NO: 486547 - RNA, 64 nt, Homo Sapiens
ugcagcaaucugguccccagcuucccagugauguugagagcaccuuuuccuuuggcuggcagcu

SEQ ID NO: 486548 - RNA, 64 nt, Homo Sapiens
aaucagaauggaagcacuuugaguaucugaagagugagagcauucauguuugacagguccugcu

SEQ ID NO: 486549 - RNA, 64 nt, Homo Sapiens
aggggcuagguguugaacuuaguuaauggaagacugagagcagaacagguuugucaucuccgca

SEQ ID NO: 486550 - RNA, 64 nt, Homo Sapiens
uguaaauauaaagccuaaagaugaaguggcuucaggaguauaaauucagcuaauuauuucuaua

SEQ ID NO: 486551 - RNA, 64 nt, Homo Sapiens
agaauucaguauuaaguacauagguauuuacuauggaguauaauucucacaauuguauuuucag

SEQ ID NO: 486552 - RNA, 64 nt, Homo Sapiens
auagacuucagcccuuuguaaauauuguaacuggggaguauagaguagaaaaaaaguauaguua

SEQ ID NO: 486553 - RNA, 64 nt, Homo Sapiens
gaaacuuggcccuuuccaauguugucuucacauuggaguauaagaauucucuauaggacucuuu

SEQ ID NO: 486554 - RNA, 64 nt, Homo Sapiens
auuguuugcuagauuuuguuuugugaaguacuauguaacagaugaagucuuagcauuauuuccu

SEQ ID NO: 486555 - RNA, 64 nt, Homo Sapiens
caucugguucugugaauaaagauauguauuuuuaguaacagaagaaaaggauauaaaagcuuug

SEQ ID NO: 486556 - RNA, 64 nt, Homo Sapiens
uugcuuauaaguuuuuuaucgcaagaucgauuuuguaacagaaauuauacaccaagaccuguua

SEQ ID NO: 486557 - RNA, 64 nt, Homo Sapiens
cacacguuaucuacuucaaccuggaguacuuacuguaacagaugaguaucauuugugcuucucu

SEQ ID NO: 486558 - RNA, 64 nt, Homo Sapiens
agacaugaauuucuaucaaaauguucuuugcacuguaacagagauuccuuuuuucaauaaucuu

SEQ ID NO: 486559 - RNA, 64 nt, Homo Sapiens
uaaguguuucugucauuguucaaguguauuuucuguaacagaaacauauuuggaauguuuuucu

SEQ ID NO: 486560 - RNA, 64 nt, Homo Sapiens
ggcacaugugccagcugaaucaaacaagcagcauguaacagacuaauauguaaccaacauguca

SEQ ID NO: 486561 - RNA, 64 nt, Homo Sapiens
gagcaaggcuguuuuugaaaaugaucaggagggaguaacagaaacggacacuggaaacauuuaa

SEQ ID NO: 486562 - RNA, 64 nt, Homo Sapiens
agaguggcagcugccugccaaaaucuguuccgcuguaacagaacugaauuuggaccccagcaca

SEQ ID NO: 486563 - RNA, 64 nt, Homo Sapiens
ggaccucugauugcaccacugcacuccaggcuggguaacagaaugagaccuuaucucaaaaaua

SEQ ID NO: 486564 - RNA, 64 nt, Homo Sapiens
aauaacuuauaugaaaaccagauguaacuuucauguaacagauuuaguaucuggcuuccuuaag

SEQ ID NO: 486565 - RNA, 64 nt, Homo Sapiens
ccuggguguuuuucuuucucguggaacacauuguguaacagacuaguuaugugaguuguucguu

SEQ ID NO: 486566 - RNA, 64 nt, Homo Sapiens
auccacauaaaagugcucuccugccugggcagcaacaaccaagaacaaagccccgggacuguuu

SEQ ID NO: 486567 - RNA, 64 nt, Homo Sapiens
gcucuuuaaauagcugcccaucuccugugauugcacaaccaagcacuuugacauuugcaccuua

SEQ ID NO: 486568 - RNA, 64 nt, Homo Sapiens
aauaccgcgauccaugagggcuccccaaaucaccacaaccaacccugcauugcucucccucgug

SEQ ID NO: 486569 - RNA, 64 nt, Homo Sapiens
cauaacauauagcagaccaaaccaauacacggacacaaccaaauguucagccugaccccgccuc

SEQ ID NO: 486570 - RNA, 64 nt, Homo Sapiens
agaaaauauggguccauuccuuucuagaaaggggacaaccaagugucucaguuugccuugcggg

SEQ ID NO: 486571 - RNA, 64 nt, Homo Sapiens
uaccugggaugaagaauaaagagagcaaacuaccacaaccaaugguugagccccugucaagugc

SEQ ID NO: 486572 - RNA, 64 nt, Homo Sapiens; identical to SEQ ID NO: 48356

SEQ ID NO: 486573 - RNA, 64 nt, Homo Sapiens; identical to SEQ ID NO: 48357

SEQ ID NO: 486574 - RNA, 64 nt, Homo Sapiens; identical to SEQ ID NO: 48358

SEQ ID NO: 486575 - RNA, 64 nt, Homo Sapiens; identical to SEQ ID NO: 48359

SEQ ID NO: 486576 - RNA, 64 nt, Homo Sapiens; identical to SEQ ID NO: 45399

SEQ ID NO: 486577 - RNA, 64 nt, Homo Sapiens; identical to SEQ ID NO: 45400

SEQ ID NO: 486578 - RNA, 64 nt, Homo Sapiens; identical to SEQ ID NO: 45401

SEQ ID NO: 486579 - RNA, 64 nt, Homo Sapiens; identical to SEQ ID NO: 45402

SEQ ID NO: 486580 - RNA, 64 nt, Homo Sapiens; identical to SEQ ID NO: 45403

SEQ ID NO: 486581 - RNA, 64 nt, Homo Sapiens; identical to SEQ ID NO: 45404

SEQ ID NO: 486582 - RNA, 64 nt, Homo Sapiens; identical to SEQ ID NO: 45405

SEQ ID NO: 486583 - RNA, 64 nt, Homo Sapiens; identical to SEQ ID NO: 45406

SEQ ID NO: 486584 - RNA, 64 nt, Homo Sapiens; identical to SEQ ID NO: 45407

SEQ ID NO: 486585 - RNA, 64 nt, Homo Sapiens; identical to SEQ ID NO: 45408

SEQ ID NO: 486586 - RNA, 64 nt, Homo Sapiens; identical to SEQ ID NO: 45409

SEQ ID NO: 486587 - RNA, 64 nt, Homo Sapiens; identical to SEQ ID NO: 45410

SEQ ID NO: 486588 - RNA, 64 nt, Homo Sapiens; identical to SEQ ID NO: 45411

SEQ ID NO: 486589 - RNA, 64 nt, Homo Sapiens; identical to SEQ ID NO: 45412

SEQ ID NO: 486590 - RNA, 64 nt, Homo Sapiens; identical to SEQ ID NO: 45413

SEQ ID NO: 486591 - RNA, 64 nt, Homo Sapiens; identical to SEQ ID NO: 45414

SEQ ID NO: 486592 - RNA, 64 nt, Homo Sapiens; identical to SEQ ID NO: 45415

SEQ ID NO: 486593 - RNA, 64 nt, Homo Sapiens; identical to SEQ ID NO: 45416

SEQ ID NO: 486594 - RNA, 64 nt, Homo Sapiens; identical to SEQ ID NO: 45417

SEQ ID NO: 486595 - RNA, 64 nt, Homo Sapiens; identical to SEQ ID NO: 45418

SEQ ID NO: 486596 - RNA, 64 nt, Homo Sapiens; identical to SEQ ID NO: 45419

SEQ ID NO: 486597 - RNA, 64 nt, Homo Sapiens; identical to SEQ ID NO: 45420

SEQ ID NO: 486598 - RNA, 64 nt, Homo Sapiens; identical to SEQ ID NO: 45421

SEQ ID NO: 486599 - RNA, 64 nt, Homo Sapiens; identical to SEQ ID NO: 45422

SEQ ID NO: 486600 - RNA, 64 nt, Homo Sapiens; identical to SEQ ID NO: 45423

SEQ ID NO: 486601 - RNA, 64 nt, Homo Sapiens; identical to SEQ ID NO: 45424

SEQ ID NO: 486602 - RNA, 64 nt, Homo Sapiens
aagggaaugugaaagcugucauuuggauccuuuggguuuggagacuuuuucuuggacuacuuua

SEQ ID NO: 486603 - RNA, 64 nt, Homo Sapiens
guuggaaugaccaagagacauaaaaccagaaaaagguuuggaauuaugacccuccccacuuuuu

SEQ ID NO: 486604 - RNA, 64 nt, Homo Sapiens
aaugacuuuucaguuaugucgaaugcaagcucaagguuuggaaaugaggguuagacagguaggu

SEQ ID NO: 486605 - RNA, 64 nt, Homo Sapiens
gcucuagaucucuuuugugcguugccauuccauagguuuggagaaaaaccugggcgugguuuug

SEQ ID NO: 486606 - RNA, 64 nt, Homo Sapiens
agcacaccagcugcagguguuuagccuacugauugguuuggaugguauggaauuuuaaauucuc

SEQ ID NO: 486607 - RNA, 64 nt, Homo Sapiens
cuguccauguguaggucauugacaucuuccagaugguuuggaccugcuuuucagccuggaauca

SEQ ID NO: 486608 - RNA, 64 nt, Homo Sapiens
uuuuuuuuuucugcugccuuucccaaagugguuagguuuggaaaagagaugaugaugguaauau

SEQ ID NO: 486609 - RNA, 64 nt, Homo Sapiens
cuuguuuucaguauaccguggccugccucaugaugguuuggagauacugucuguggaugugagg

SEQ ID NO: 486610 - RNA, 64 nt, Homo Sapiens
uaugaauuaaaaugaacuaaaccuuccacuucaggguuuggaugaaacuauuuaaaggacaaau

SEQ ID NO: 486611 - RNA, 64 nt, Homo Sapiens
aaucaaaguguggaggagguggcccccacagcaggguuuggaaccuacagacccuggccccuga

SEQ ID NO: 486612 - RNA, 64 nt, Homo Sapiens
uguuaggacuagaagaaaaugcacaauuuguagggguuuggaugaagcagcuguaacugcccua

SEQ ID NO: 486613 - RNA, 64 nt, Homo Sapiens
aacaucaguauguucgaggguacuaugauauuuugguuuggaauugcccugcccaagucacugu

SEQ ID NO: 486614 - RNA, 64 nt, Homo Sapiens
acacugccuguggggaccugcccugccccucuuagguuuggagcagaaguggaggugcccacag

SEQ ID NO: 486615 - RNA, 64 nt, Homo Sapiens
uaccccuaguuccccugacaggaaguucuuggcggguuuggagccaggggauggcauggaguga

SEQ ID NO: 486616 - RNA, 64 nt, Homo Sapiens
cuuagagguaugucagaaaaugaucguuguggaagguuuggagcuuuaaacaagucauuuuucu

SEQ ID NO: 486617 - RNA, 64 nt, Homo Sapiens
cuucuccugaaugcauccuuggugauuccaggaugguuuggaaaagggccacuuaccaaacuca

SEQ ID NO: 486618 - RNA, 64 nt, Homo Sapiens; identical to SEQ ID NO: 346181

SEQ ID NO: 486619 - RNA, 64 nt, Homo Sapiens; identical to SEQ ID NO: 346182

SEQ ID NO: 486620 - RNA, 64 nt, Homo Sapiens; identical to SEQ ID NO: 346183

SEQ ID NO: 486621 - RNA, 64 nt, Homo Sapiens; identical to SEQ ID NO: 346184

SEQ ID NO: 486622 - RNA, 64 nt, Homo Sapiens; identical to SEQ ID NO: 346185

SEQ ID NO: 486623 - RNA, 64 nt, Homo Sapiens; identical to SEQ ID NO: 346186

SEQ ID NO: 486624 - RNA, 64 nt, Homo Sapiens; identical to SEQ ID NO: 346187

SEQ ID NO: 486625 - RNA, 64 nt, Homo Sapiens; identical to SEQ ID NO: 346188

SEQ ID NO: 486626 - RNA, 64 nt, Homo Sapiens; identical to SEQ ID NO: 346189

SEQ ID NO: 486627 - RNA, 64 nt, Homo Sapiens; identical to SEQ ID NO: 346190

SEQ ID NO: 486628 - RNA, 64 nt, Homo Sapiens; identical to SEQ ID NO: 346191

SEQ ID NO: 486629 - RNA, 64 nt, Homo Sapiens; identical to SEQ ID NO: 346192

SEQ ID NO: 486630 - RNA, 64 nt, Homo Sapiens; identical to SEQ ID NO: 346193

SEQ ID NO: 486631 - RNA, 64 nt, Homo Sapiens; identical to SEQ ID NO: 346194

SEQ ID NO: 486632 - RNA, 64 nt, Homo Sapiens; identical to SEQ ID NO: 346195

SEQ ID NO: 486633 - RNA, 64 nt, Homo Sapiens; identical to SEQ ID NO: 346196

SEQ ID NO: 486634 - RNA, 64 nt, Homo Sapiens; identical to SEQ ID NO: 346197

SEQ ID NO: 486635 - RNA, 64 nt, Homo Sapiens; identical to SEQ ID NO: 346198

SEQ ID NO: 486636 - RNA, 64 nt, Homo Sapiens; identical to SEQ ID NO: 346199

SEQ ID NO: 486637 - RNA, 64 nt, Homo Sapiens; identical to SEQ ID NO: 346200

SEQ ID NO: 486638 - RNA, 64 nt, Homo Sapiens; identical to SEQ ID NO: 346201

SEQ ID NO: 486639 - RNA, 64 nt, Homo Sapiens; identical to SEQ ID NO: 346202

SEQ ID NO: 486640 - RNA, 64 nt, Homo Sapiens; identical to SEQ ID NO: 346203

SEQ ID NO: 486641 - RNA, 64 nt, Homo Sapiens; identical to SEQ ID NO: 346204

SEQ ID NO: 486642 - RNA, 64 nt, Homo Sapiens; identical to SEQ ID NO: 346205

SEQ ID NO: 486643 - RNA, 64 nt, Homo Sapiens; identical to SEQ ID NO: 346206

SEQ ID NO: 486644 - RNA, 64 nt, Homo Sapiens; identical to SEQ ID NO: 346207

SEQ ID NO: 486645 - RNA, 64 nt, Homo Sapiens; identical to SEQ ID NO: 346208

SEQ ID NO: 486646 - RNA, 64 nt, Homo Sapiens; identical to SEQ ID NO: 346209

SEQ ID NO: 486647 - RNA, 64 nt, Homo Sapiens; identical to SEQ ID NO: 346210

SEQ ID NO: 486648 - RNA, 64 nt, Homo Sapiens; identical to SEQ ID NO: 346211

SEQ ID NO: 486649 - RNA, 64 nt, Homo Sapiens; identical to SEQ ID NO: 346212

SEQ ID NO: 486650 - RNA, 64 nt, Homo Sapiens; identical to SEQ ID NO: 346213

SEQ ID NO: 486651 - RNA, 64 nt, Homo Sapiens; identical to SEQ ID NO: 346214

SEQ ID NO: 486652 - RNA, 64 nt, Homo Sapiens; identical to SEQ ID NO: 346215

SEQ ID NO: 486653 - RNA, 64 nt, Homo Sapiens; identical to SEQ ID NO: 346216

SEQ ID NO: 486654 - RNA, 64 nt, Homo Sapiens; identical to SEQ ID NO: 346217

SEQ ID NO: 486655 - RNA, 64 nt, Homo Sapiens; identical to SEQ ID NO: 346218

SEQ ID NO: 486656 - RNA, 64 nt, Homo Sapiens; identical to SEQ ID NO: 346219

SEQ ID NO: 486657 - RNA, 64 nt, Homo Sapiens; identical to SEQ ID NO: 346220

SEQ ID NO: 486658 - RNA, 64 nt, Homo Sapiens; identical to SEQ ID NO: 346221

SEQ ID NO: 486659 - RNA, 64 nt, Homo Sapiens; identical to SEQ ID NO: 346222

SEQ ID NO: 486660 - RNA, 64 nt, Homo Sapiens; identical to SEQ ID NO: 346223

SEQ ID NO: 486661 - RNA, 64 nt, Homo Sapiens; identical to SEQ ID NO: 346224

SEQ ID NO: 486662 - RNA, 64 nt, Homo Sapiens; identical to SEQ ID NO: 346225

SEQ ID NO: 486663 - RNA, 64 nt, Homo Sapiens; identical to SEQ ID NO: 346226

SEQ ID NO: 486664 - RNA, 64 nt, Homo Sapiens; identical to SEQ ID NO: 346227

SEQ ID NO: 486665 - RNA, 64 nt, Homo Sapiens; identical to SEQ ID NO: 346228

SEQ ID NO: 486666 - RNA, 64 nt, Homo Sapiens; identical to SEQ ID NO: 346229

SEQ ID NO: 486667 - RNA, 64 nt, Homo Sapiens; identical to SEQ ID NO: 346230

SEQ ID NO: 486668 - RNA, 64 nt, Homo Sapiens; identical to SEQ ID NO: 346231

SEQ ID NO: 486669 - RNA, 64 nt, Homo Sapiens; identical to SEQ ID NO: 346232

SEQ ID NO: 486670 - RNA, 64 nt, Homo Sapiens; identical to SEQ ID NO: 346233

SEQ ID NO: 486671 - RNA, 64 nt, Homo Sapiens; identical to SEQ ID NO: 346234

SEQ ID NO: 486672 - RNA, 64 nt, Homo Sapiens; identical to SEQ ID NO: 346235

SEQ ID NO: 486673 - RNA, 64 nt, Homo Sapiens; identical to SEQ ID NO: 449012

SEQ ID NO: 486674 - RNA, 64 nt, Homo Sapiens; identical to SEQ ID NO: 449013

SEQ ID NO: 486675 - RNA, 64 nt, Homo Sapiens; identical to SEQ ID NO: 449014

SEQ ID NO: 486676 - RNA, 64 nt, Homo Sapiens; identical to SEQ ID NO: 449015

SEQ ID NO: 486677 - RNA, 64 nt, Homo Sapiens; identical to SEQ ID NO: 449035

SEQ ID NO: 486678 - RNA, 64 nt, Homo Sapiens; identical to SEQ ID NO: 449036

SEQ ID NO: 486679 - RNA, 64 nt, Homo Sapiens; identical to SEQ ID NO: 449044

SEQ ID NO: 486680 - RNA, 64 nt, Homo Sapiens; identical to SEQ ID NO: 449045

SEQ ID NO: 486681 - RNA, 64 nt, Homo Sapiens; identical to SEQ ID NO: 449070

SEQ ID NO: 486682 - RNA, 64 nt, Homo Sapiens; identical to SEQ ID NO: 449071

SEQ ID NO: 486683 - RNA, 64 nt, Homo Sapiens; identical to SEQ ID NO: 449081

SEQ ID NO: 486684 - RNA, 64 nt, Homo Sapiens; identical to SEQ ID NO: 449082

SEQ ID NO: 486685 - RNA, 64 nt, Homo Sapiens; identical to SEQ ID NO: 449091

SEQ ID NO: 486686 - RNA, 64 nt, Homo Sapiens; identical to SEQ ID NO: 449092

SEQ ID NO: 486687 - RNA, 64 nt, Homo Sapiens; identical to SEQ ID NO: 449151

SEQ ID NO: 486688 - RNA, 64 nt, Homo Sapiens; identical to SEQ ID NO: 449152

SEQ ID NO: 486689 - RNA, 64 nt, Homo Sapiens; identical to SEQ ID NO: 449155

SEQ ID NO: 486690 - RNA, 64 nt, Homo Sapiens; identical to SEQ ID NO: 449156

SEQ ID NO: 486691 - RNA, 64 nt, Homo Sapiens; identical to SEQ ID NO: 449209

SEQ ID NO: 486692 - RNA, 64 nt, Homo Sapiens; identical to SEQ ID NO: 449210

SEQ ID NO: 486693 - RNA, 64 nt, Homo Sapiens; identical to SEQ ID NO: 449236

SEQ ID NO: 486694 - RNA, 64 nt, Homo Sapiens; identical to SEQ ID NO: 449237

SEQ ID NO: 486695 - RNA, 64 nt, Homo Sapiens; identical to SEQ ID NO: 449256

SEQ ID NO: 486696 - RNA, 64 nt, Homo Sapiens; identical to SEQ ID NO: 449257

SEQ ID NO: 486697 - RNA, 64 nt, Homo Sapiens; identical to SEQ ID NO: 449258

SEQ ID NO: 486698 - RNA, 64 nt, Homo Sapiens; identical to SEQ ID NO: 449259

SEQ ID NO: 486699 - RNA, 64 nt, Homo Sapiens; identical to SEQ ID NO: 449265

SEQ ID NO: 486700 - RNA, 64 nt, Homo Sapiens; identical to SEQ ID NO: 449266

SEQ ID NO: 486701 - RNA, 64 nt, Homo Sapiens; identical to SEQ ID NO: 449324

SEQ ID NO: 486702 - RNA, 64 nt, Homo Sapiens; identical to SEQ ID NO: 449325

SEQ ID NO: 486703 - RNA, 64 nt, Homo Sapiens; identical to SEQ ID NO: 449328

SEQ ID NO: 486704 - RNA, 64 nt, Homo Sapiens; identical to SEQ ID NO: 449329

SEQ ID NO: 486705 - RNA, 64 nt, Homo Sapiens; identical to SEQ ID NO: 449400

SEQ ID NO: 486706 - RNA, 64 nt, Homo Sapiens; identical to SEQ ID NO: 449401

SEQ ID NO: 486707 - RNA, 64 nt, Homo Sapiens; identical to SEQ ID NO: 449423

SEQ ID NO: 486708 - RNA, 64 nt, Homo Sapiens; identical to SEQ ID NO: 449424

SEQ ID NO: 486709 - RNA, 64 nt, Homo Sapiens; identical to SEQ ID NO: 449449

SEQ ID NO: 486710 - RNA, 64 nt, Homo Sapiens; identical to SEQ ID NO: 449450

SEQ ID NO: 486711 - RNA, 64 nt, Homo Sapiens; identical to SEQ ID NO: 449474

SEQ ID NO: 486712 - RNA, 64 nt, Homo Sapiens; identical to SEQ ID NO: 449475

SEQ ID NO: 486713 - RNA, 64 nt, Homo Sapiens; identical to SEQ ID NO: 449477

SEQ ID NO: 486714 - RNA, 64 nt, Homo Sapiens; identical to SEQ ID NO: 449478

SEQ ID NO: 486715 - RNA, 64 nt, Homo Sapiens; identical to SEQ ID NO: 449488

SEQ ID NO: 486716 - RNA, 64 nt, Homo Sapiens; identical to SEQ ID NO: 449489

SEQ ID NO: 486717 - RNA, 64 nt, Homo Sapiens; identical to SEQ ID NO: 449560

SEQ ID NO: 486718 - RNA, 64 nt, Homo Sapiens; identical to SEQ ID NO: 449561

SEQ ID NO: 486719 - RNA, 64 nt, Homo Sapiens; identical to SEQ ID NO: 107849

SEQ ID NO: 486720 - RNA, 64 nt, Homo Sapiens; identical to SEQ ID NO: 107850

SEQ ID NO: 486721 - RNA, 64 nt, Homo Sapiens; identical to SEQ ID NO: 107851

SEQ ID NO: 486722 - RNA, 64 nt, Homo Sapiens; identical to SEQ ID NO: 107852

SEQ ID NO: 486723 - RNA, 64 nt, Homo Sapiens; identical to SEQ ID NO: 107853

SEQ ID NO: 486724 - RNA, 64 nt, Homo Sapiens; identical to SEQ ID NO: 107854

SEQ ID NO: 486725 - RNA, 64 nt, Homo Sapiens; identical to SEQ ID NO: 107855

SEQ ID NO: 486726 - RNA, 64 nt, Homo Sapiens; identical to SEQ ID NO: 107856

SEQ ID NO: 486727 - RNA, 64 nt, Homo Sapiens; identical to SEQ ID NO: 107857

SEQ ID NO: 486728 - RNA, 64 nt, Homo Sapiens; identical to SEQ ID NO: 107858

SEQ ID NO: 486729 - RNA, 64 nt, Homo Sapiens; identical to SEQ ID NO: 107859

SEQ ID NO: 486730 - RNA, 64 nt, Homo Sapiens; identical to SEQ ID NO: 107860

SEQ ID NO: 486731 - RNA, 64 nt, Homo Sapiens; identical to SEQ ID NO: 107861

SEQ ID NO: 486732 - RNA, 64 nt, Homo Sapiens; identical to SEQ ID NO: 107862

SEQ ID NO: 486733 - RNA, 64 nt, Homo Sapiens; identical to SEQ ID NO: 107863

SEQ ID NO: 486734 - RNA, 63 nt, Homo Sapiens; identical to SEQ ID NO: 107864

SEQ ID NO: 486735 - RNA, 64 nt, Homo Sapiens; identical to SEQ ID NO: 107865

SEQ ID NO: 486736 - RNA, 64 nt, Homo Sapiens; identical to SEQ ID NO: 107866

SEQ ID NO: 486737 - RNA, 64 nt, Homo Sapiens; identical to SEQ ID NO: 107867

SEQ ID NO: 486738 - RNA, 64 nt, Homo Sapiens; identical to SEQ ID NO: 107868

SEQ ID NO: 486739 - RNA, 64 nt, Homo Sapiens; identical to SEQ ID NO: 107869

SEQ ID NO: 486740 - RNA, 64 nt, Homo Sapiens; identical to SEQ ID NO: 107870

SEQ ID NO: 486741 - RNA, 64 nt, Homo Sapiens; identical to SEQ ID NO: 107871

SEQ ID NO: 486742 - RNA, 64 nt, Homo Sapiens; identical to SEQ ID NO: 107872

SEQ ID NO: 486743 - RNA, 64 nt, Homo Sapiens; identical to SEQ ID NO: 107873

SEQ ID NO: 486744 - RNA, 64 nt, Homo Sapiens; identical to SEQ ID NO: 107874

SEQ ID NO: 486745 - RNA, 64 nt, Homo Sapiens; identical to SEQ ID NO: 107875

SEQ ID NO: 486746 - RNA, 64 nt, Homo Sapiens; identical to SEQ ID NO: 107876

SEQ ID NO: 486747 - RNA, 64 nt, Homo Sapiens; identical to SEQ ID NO: 107877

SEQ ID NO: 486748 - RNA, 64 nt, Homo Sapiens; identical to SEQ ID NO: 107878

SEQ ID NO: 486749 - RNA, 64 nt, Homo Sapiens; identical to SEQ ID NO: 107879

SEQ ID NO: 486750 - RNA, 64 nt, Homo Sapiens; identical to SEQ ID NO: 107880

SEQ ID NO: 486751 - RNA, 64 nt, Homo Sapiens; identical to SEQ ID NO: 107881

SEQ ID NO: 486752 - RNA, 64 nt, Homo Sapiens; identical to SEQ ID NO: 107882

SEQ ID NO: 486753 - RNA, 64 nt, Homo Sapiens; identical to SEQ ID NO: 107883

SEQ ID NO: 486754 - RNA, 64 nt, Homo Sapiens; identical to SEQ ID NO: 107884

SEQ ID NO: 486755 - RNA, 64 nt, Homo Sapiens; identical to SEQ ID NO: 107885

SEQ ID NO: 486756 - RNA, 64 nt, Homo Sapiens; identical to SEQ ID NO: 107886

SEQ ID NO: 486757 - RNA, 64 nt, Homo Sapiens; identical to SEQ ID NO: 107887

SEQ ID NO: 486758 - RNA, 64 nt, Homo Sapiens; identical to SEQ ID NO: 107888

SEQ ID NO: 486759 - RNA, 64 nt, Homo Sapiens; identical to SEQ ID NO: 107889

SEQ ID NO: 486760 - RNA, 64 nt, Homo Sapiens; identical to SEQ ID NO: 107890

SEQ ID NO: 486761 - RNA, 64 nt, Homo Sapiens; identical to SEQ ID NO: 107891

SEQ ID NO: 486762 - RNA, 64 nt, Homo Sapiens; identical to SEQ ID NO: 107892

SEQ ID NO: 486763 - RNA, 64 nt, Homo Sapiens; identical to SEQ ID NO: 107893

SEQ ID NO: 486764 - RNA, 64 nt, Homo Sapiens; identical to SEQ ID NO: 107894

SEQ ID NO: 486765 - RNA, 64 nt, Homo Sapiens; identical to SEQ ID NO: 107895

SEQ ID NO: 486766 - RNA, 64 nt, Homo Sapiens; identical to SEQ ID NO: 107896

SEQ ID NO: 486767 - RNA, 64 nt, Homo Sapiens; identical to SEQ ID NO: 107897

SEQ ID NO: 486768 - RNA, 64 nt, Homo Sapiens; identical to SEQ ID NO: 107898

SEQ ID NO: 486769 - RNA, 64 nt, Homo Sapiens; identical to SEQ ID NO: 107899

SEQ ID NO: 486770 - RNA, 64 nt, Homo Sapiens; identical to SEQ ID NO: 107900

SEQ ID NO: 486771 - RNA, 64 nt, Homo Sapiens; identical to SEQ ID NO: 107901

SEQ ID NO: 486772 - RNA, 64 nt, Homo Sapiens; identical to SEQ ID NO: 107902

SEQ ID NO: 486773 - RNA, 64 nt, Homo Sapiens; identical to SEQ ID NO: 107903

SEQ ID NO: 486774 - RNA, 64 nt, Homo Sapiens; identical to SEQ ID NO: 107904

SEQ ID NO: 486775 - RNA, 64 nt, Homo Sapiens; identical to SEQ ID NO: 107905

SEQ ID NO: 486776 - RNA, 64 nt, Homo Sapiens; identical to SEQ ID NO: 107906

SEQ ID NO: 486777 - RNA, 64 nt, Homo Sapiens; identical to SEQ ID NO: 107907

SEQ ID NO: 486778 - RNA, 64 nt, Homo Sapiens; identical to SEQ ID NO: 107908

SEQ ID NO: 486779 - RNA, 64 nt, Homo Sapiens; identical to SEQ ID NO: 107909

SEQ ID NO: 486780 - RNA, 64 nt, Homo Sapiens; identical to SEQ ID NO: 107910

SEQ ID NO: 486781 - RNA, 64 nt, Homo Sapiens; identical to SEQ ID NO: 107911

SEQ ID NO: 486782 - RNA, 64 nt, Homo Sapiens; identical to SEQ ID NO: 107912

SEQ ID NO: 486783 - RNA, 64 nt, Homo Sapiens; identical to SEQ ID NO: 107913

SEQ ID NO: 486784 - RNA, 64 nt, Homo Sapiens; identical to SEQ ID NO: 107914

SEQ ID NO: 486785 - RNA, 64 nt, Homo Sapiens; identical to SEQ ID NO: 107915

SEQ ID NO: 486786 - RNA, 64 nt, Homo Sapiens; identical to SEQ ID NO: 107916

SEQ ID NO: 486787 - RNA, 64 nt, Homo Sapiens; identical to SEQ ID NO: 107917

SEQ ID NO: 486788 - RNA, 64 nt, Homo Sapiens; identical to SEQ ID NO: 107918

SEQ ID NO: 486789 - RNA, 64 nt, Homo Sapiens; identical to SEQ ID NO: 107919

SEQ ID NO: 486790 - RNA, 64 nt, Homo Sapiens; identical to SEQ ID NO: 107920

SEQ ID NO: 486791 - RNA, 64 nt, Homo Sapiens; identical to SEQ ID NO: 107921

SEQ ID NO: 486792 - RNA, 64 nt, Homo Sapiens; identical to SEQ ID NO: 107922

SEQ ID NO: 486793 - RNA, 64 nt, Homo Sapiens; identical to SEQ ID NO: 107923

SEQ ID NO: 486794 - RNA, 64 nt, Homo Sapiens; identical to SEQ ID NO: 107924

SEQ ID NO: 486795 - RNA, 64 nt, Homo Sapiens; identical to SEQ ID NO: 107925

SEQ ID NO: 486796 - RNA, 64 nt, Homo Sapiens; identical to SEQ ID NO: 107926

SEQ ID NO: 486797 - RNA, 64 nt, Homo Sapiens; identical to SEQ ID NO: 107927

SEQ ID NO: 486798 - RNA, 64 nt, Homo Sapiens; identical to SEQ ID NO: 107928

SEQ ID NO: 486799 - RNA, 64 nt, Homo Sapiens; identical to SEQ ID NO: 107929

SEQ ID NO: 486800 - RNA, 64 nt, Homo Sapiens; identical to SEQ ID NO: 107930

SEQ ID NO: 486801 - RNA, 64 nt, Homo Sapiens; identical to SEQ ID NO: 107931

SEQ ID NO: 486802 - RNA, 64 nt, Homo Sapiens; identical to SEQ ID NO: 107932

SEQ ID NO: 486803 - RNA, 64 nt, Homo Sapiens; identical to SEQ ID NO: 107933

SEQ ID NO: 486804 - RNA, 64 nt, Homo Sapiens; identical to SEQ ID NO: 357423

SEQ ID NO: 486805 - RNA, 64 nt, Homo Sapiens; identical to SEQ ID NO: 357424

SEQ ID NO: 486806 - RNA, 64 nt, Homo Sapiens; identical to SEQ ID NO: 357425

SEQ ID NO: 486807 - RNA, 64 nt, Homo Sapiens; identical to SEQ ID NO: 357426

SEQ ID NO: 486808 - RNA, 64 nt, Homo Sapiens; identical to SEQ ID NO: 357427

SEQ ID NO: 486809 - RNA, 64 nt, Homo Sapiens; identical to SEQ ID NO: 357428

SEQ ID NO: 486810 - RNA, 64 nt, Homo Sapiens; identical to SEQ ID NO: 357429

SEQ ID NO: 486811 - RNA, 64 nt, Homo Sapiens; identical to SEQ ID NO: 357430

SEQ ID NO: 486812 - RNA, 64 nt, Homo Sapiens; identical to SEQ ID NO: 357431

SEQ ID NO: 486813 - RNA, 64 nt, Homo Sapiens; identical to SEQ ID NO: 357432

SEQ ID NO: 486814 - RNA, 64 nt, Homo Sapiens; identical to SEQ ID NO: 357433

SEQ ID NO: 486815 - RNA, 64 nt, Homo Sapiens; identical to SEQ ID NO: 357434

SEQ ID NO: 486816 - RNA, 64 nt, Homo Sapiens; identical to SEQ ID NO: 357435

SEQ ID NO: 486817 - RNA, 64 nt, Homo Sapiens; identical to SEQ ID NO: 357436

SEQ ID NO: 486818 - RNA, 64 nt, Homo Sapiens; identical to SEQ ID NO: 357437

SEQ ID NO: 486819 - RNA, 64 nt, Homo Sapiens; identical to SEQ ID NO: 357438

SEQ ID NO: 486820 - RNA, 64 nt, Homo Sapiens; identical to SEQ ID NO: 357439

SEQ ID NO: 486821 - RNA, 64 nt, Homo Sapiens; identical to SEQ ID NO: 357440

SEQ ID NO: 486822 - RNA, 64 nt, Homo Sapiens; identical to SEQ ID NO: 357441

SEQ ID NO: 486823 - RNA, 64 nt, Homo Sapiens; identical to SEQ ID NO: 357442

SEQ ID NO: 486824 - RNA, 64 nt, Homo Sapiens; identical to SEQ ID NO: 357443

SEQ ID NO: 486825 - RNA, 66 nt, Homo Sapiens
gacugcguuugcauuuuuaugauaaugcaggggugagugugagaggcagaaugugagugugagagu

SEQ ID NO: 486826 - RNA, 66 nt, Homo Sapiens
gauaaugcaggggugaguguucuugccagaaugugagugugagagucgccugagggugggcaugag

SEQ ID NO: 486827 - RNA, 66 nt, Homo Sapiens
cucaucccgaucucuuccugucagaggaccggagaagugugagaaggugccccuucaggcaccuag

SEQ ID NO: 486828 - RNA, 66 nt, Homo Sapiens
gaacuaguuguuacacagcucccagccaagaagaaagugugagaaguugaugggcagcaaaccugc

SEQ ID NO: 486829 - RNA, 66 nt, Homo Sapiens
ucggcggaccauuaggaaugacuccgucugucuacugugugagacucugcauccuccagcaucuca

SEQ ID NO: 486830 - RNA, 66 nt, Homo Sapiens
uucccccugcuguaaaugcauuuaacuuaugcaagggugugagauggauguguacguaauauuuau

SEQ ID NO: 486831 - RNA, 66 nt, Homo Sapiens
cauguucgugucugugcgcuagcugcguucuggggugugugagagguuugugcccaacuccagcac

SEQ ID NO: 486832 - RNA, 66 nt, Homo Sapiens
ggagugauuuaagcaauggucagggguuuucucucugugugagagguaguguuuuugugcacuugc

SEQ ID NO: 486833 - RNA, 66 nt, Homo Sapiens
aauaagaggguaugggggaaagguucauagacuuaggugugagaaugaggugggaggugucuggua

SEQ ID NO: 486834 - RNA, 66 nt, Homo Sapiens
gagagaggagauaggcagauguggguauggggcccagugugagaaggaagacagagaaguucuuga

SEQ ID NO: 486835 - RNA, 66 nt, Homo Sapiens
cucccgaccuuagcuuauugaucccacauuuccauggugugagauccucuuuacucugggcagaag

SEQ ID NO: 486836 - RNA, 66 nt, Homo Sapiens
uuuuacaaucuguaucuuugacaauucugggugcgagugugagagugugagcagggcuugcuccug

SEQ ID NO: 486837 - RNA, 66 nt, Homo Sapiens
gacagcucacgaggcuuggagugcccagcagacguggugugagagggcuuggaccugccauggagg

SEQ ID NO: 486838 - RNA, 66 nt, Homo Sapiens
gacgguucacaaggcuuggaagggugcccggcagacgugugagaggacgaggcuuggaccuggugg

SEQ ID NO: 486839 - RNA, 66 nt, Homo Sapiens
gacggcucacagggcuuggagugcccagcagacguggugugagaggagacuuggaccugguggagg

SEQ ID NO: 486840 - RNA, 66 nt, Homo Sapiens
aacggcucacgagacuuggagugcccagcagacguggugugagagggcuuggaccugcuguggagg

SEQ ID NO: 486841 - RNA, 64 nt, Homo Sapiens
gaugcacuuuaacugaagauuuuuaguaauguauaacaugcaauaacaauuaugcacuguguaa

SEQ ID NO: 486842 - RNA, 64 nt, Homo Sapiens
ucaaugaucaaaaucauguuuaaaaguuuacaagaacaugcaguuagaucuugcaucauaacac

SEQ ID NO: 486843 - RNA, 64 nt, Homo Sapiens
cacuuuuaguuuacaucccuuauguaaagacaguaacaugcaaauucucccaaucaugucucuu

SEQ ID NO: 486844 - RNA, 64 nt, Homo Sapiens
cuuugggcauaaugugaacuugcauccacugaugaacaugcaaaaacauauuuuuguuaccuaa

SEQ ID NO: 486845 - RNA, 64 nt, Homo Sapiens
uuuuaaauaguaagucacagguccacacuguguaaacaugcaucugauaagauacugcugauau

SEQ ID NO: 486846 - RNA, 64 nt, Homo Sapiens
gugguuucggggugagaauaaaacacccccacauaacaugcauuugcaugggcccgaaccugug

SEQ ID NO: 486847 - RNA, 64 nt, Homo Sapiens
auacugcagauuuauuuugaagcacuguauuacuaacaugcaaaugauuuuaccugucaauacc

SEQ ID NO: 486848 - RNA, 64 nt, Homo Sapiens
guguaucuuuuuuuaaauuuguaugccccuucagaacaugcagacuaaccacuaacuagguagu

SEQ ID NO: 486849 - RNA, 64 nt, Homo Sapiens
agaacugugcaguagccguuugugguuuaaagcaaacaugcaagaugaaccugagggaugauag

SEQ ID NO: 486850 - RNA, 64 nt, Homo Sapiens
agaggguaagaaacgauuccggugggaugauuuuaacaugcaaaaugucccuggggguuucuuc

SEQ ID NO: 486851 - RNA, 64 nt, Homo Sapiens
aaccuccccucugcuuagguugccccccaaagacugauacaagugauccuccagccucaucuaa

SEQ ID NO: 486852 - RNA, 64 nt, Homo Sapiens
ccccgaucuagauuuauuccaggguuguagcuuuugauacaacuaacacagaacgagguuaucu

SEQ ID NO: 486853 - RNA, 64 nt, Homo Sapiens
uugcaccgccuacuuaauucuuuuccauauauugugauacaaacuuuugaauauggaaucuuac

SEQ ID NO: 486854 - RNA, 64 nt, Homo Sapiens
uguguauggggaaaauaguucugaaaggcuagaaugauacaagugagcaaaaguuggucagcuu

SEQ ID NO: 486855 - RNA, 64 nt, Homo Sapiens
acacggguuguacagaaacugguauuuuuggugcugauacaagagaaauguauuuuuaaauauc

SEQ ID NO: 486856 - RNA, 64 nt, Homo Sapiens
aacucagaacuuaauuuaaaagucuuaaauauucugauacaauucagcugucuucucuaccuua

SEQ ID NO: 486857 - RNA, 64 nt, Homo Sapiens
aucauagguguuauuuuuaguugcauaggguauuugauacaaucauuaauggaucauacacaau

SEQ ID NO: 486858 - RNA, 64 nt, Homo Sapiens
aagauuuguuaaacuggaaacguuuuacaugaucugauacaaccauuaaugaaucauacacaau

SEQ ID NO: 486859 - RNA, 64 nt, Homo Sapiens
guugacuuuucuuuuacuauaacaggggaaguacugauacaauuagguggcacucaguuaucuu

SEQ ID NO: 486860 - RNA, 64 nt, Homo Sapiens
ugagggaggcagaagucugcuucccuugagauuuugauacaauuauauuccaguuaccuagaua

SEQ ID NO: 486861 - RNA, 64 nt, Homo Sapiens
uauuucugaugaauaugaaauuaaaacaugccucccacagaaucgcgucagcccgaguucugaa

SEQ ID NO: 486862 - RNA, 64 nt, Homo Sapiens
gugaguugauuaaaucucuugaagcauguaaagcccacagaacccugaggccuccccagaagca

SEQ ID NO: 486863 - RNA, 64 nt, Homo Sapiens
acaagugacgacaaagauucuguuucaaauauagccacagaaauaaaggagggaccaauaucug

SEQ ID NO: 486864 - RNA, 64 nt, Homo Sapiens
acaagugacgagaaagauucuguuucaaauauagccacagaaauaaagaagggacaacaaucug

SEQ ID NO: 486865 - RNA, 64 nt, Homo Sapiens
acaacugacgaggaagacucuguuucgaauauagccacagaaauaaaggauggagaaaaaucug

SEQ ID NO: 486866 - RNA, 64 nt, Homo Sapiens
acaacugaugagaaagauucuguuucgaacauagccacagaaauaaaggauggagaaaaaucug

SEQ ID NO: 486867 - RNA, 64 nt, Homo Sapiens
cccuaaacgccgccucgucagagaaagggcagcgccacagaagcgucuaguaacuuaagugaga

SEQ ID NO: 486868 - RNA, 64 nt, Homo Sapiens
gaauaaauuauacaccacuggacugagucuugaaccacagaaggaggauccuuuuggggcugga

SEQ ID NO: 486869 - RNA, 64 nt, Homo Sapiens
aaaaaaaaaaaaaaucagaaaacccccaccuaauccacagaaaguaaugucuuuccccuccccu

SEQ ID NO: 486870 - RNA, 64 nt, Homo Sapiens
cuucaggucacgcagcccuguacuguauccagcaccacagaaaccucaguguuuuuccucugcu

SEQ ID NO: 486871 - RNA, 64 nt, Homo Sapiens
gaauucaguguauccguuauuuuaaugcacuacaccacagaaauguuaaguuggucaagggcuu

SEQ ID NO: 486872 - RNA, 64 nt, Homo Sapiens
gaaacccuucccuccaggaggcccccgcugacucccacagaaacccaccuaccauaagaugucu

SEQ ID NO: 486873 - RNA, 64 nt, Homo Sapiens
guggcagugagaccagcccacccaccaccacccaccacagaaaagcacaaaccucugggaaaga

SEQ ID NO: 486874 - RNA, 64 nt, Homo Sapiens
uaaacacacccaccagugcagccugaaguaacucccacagaaaccaucaucgucuuuguacauc

SEQ ID NO: 486875 - RNA, 64 nt, Homo Sapiens
ccaagacagcugaaggagaaugaaacacacacauccacagaaacagagaggcguagguggcccu

SEQ ID NO: 486876 - RNA, 64 nt, Homo Sapiens
ccccacccacccugcaccccucgcccuccccccaccacagaaucuaagaccuuucagcuucgag

SEQ ID NO: 486877 - RNA, 64 nt, Homo Sapiens
ucaguugaaauuuuuuucacuuugaacugaugagccacagaacuaaaaaaaaugccaugaaaca

SEQ ID NO: 486878 - RNA, 64 nt, Homo Sapiens
caguaaguuuacauuucaaucaguggggaaaaucccacagaaauucaaauuuuccaauuugaac

SEQ ID NO: 486879 - RNA, 64 nt, Homo Sapiens
uuaaucggguacuaccagucuugaaauuuugccaccacagaaagaaagauguuuuuaaaagcuu

SEQ ID NO: 486880 - RNA, 64 nt, Homo Sapiens
uuagucuccauuucauagaugaaaauagugaagcccacagaaaauaaguagcuccuccacaggu

SEQ ID NO: 486881 - RNA, 64 nt, Homo Sapiens
caccagucuuucugggaacuguaugcacucagccccacagaacccagggaccacccuccccaca

SEQ ID NO: 486882 - RNA, 64 nt, Homo Sapiens
ccucuucgggcagccccccugcucugccucccuuccacagaagccccauucccucccagccucc

SEQ ID NO: 486883 - RNA, 64 nt, Homo Sapiens
gcuuucaccauuuuauauacaaaggggaccagugccacagaaggguacccgaagaaaugagaag

SEQ ID NO: 486884 - RNA, 64 nt, Homo Sapiens
auauacauccagauggccugaaguuacugaagauccacagaagugaaaauagccuuaacugaug

SEQ ID NO: 486885 - RNA, 64 nt, Homo Sapiens
gcaagaagcucucuuaagaaagugaagaaauuggccacagaagauuacuucaaagugucaggag

SEQ ID NO: 486886 - RNA, 64 nt, Homo Sapiens
uuugcagagcugggcaguugucuccaccuucucuccacagaauguagaggcacugcccaucucu

SEQ ID NO: 486887 - RNA, 64 nt, Homo Sapiens
uuuuuagaaucaagaagucugcaaacugaauaaacuacagaaaugcacacuuucuucugaauua

SEQ ID NO: 486888 - RNA, 64 nt, Homo Sapiens
aggcuggguuccaggagcccgccccucuggggcucuacagaaacucuggucuuuccuguuguug

SEQ ID NO: 486889 - RNA, 64 nt, Homo Sapiens
guguuuuacucauuugaggagacucauuccagcacuacagaagucaauguacuuugaacuaccu

SEQ ID NO: 486890 - RNA, 64 nt, Homo Sapiens
gcuguuuacucauuggaggagacuuaggccagcccuacagaagucagguuaucuugaacugccu

SEQ ID NO: 486891 - RNA, 64 nt, Homo Sapiens
gccuuuuacguauuggagcagacucaugccagcccuacagaagucaguuuaucuuggacugacu

SEQ ID NO: 486892 - RNA, 64 nt, Homo Sapiens
gaaauacuucacagaauuauaucuauuucaccaucuacagaagauugggaaagucacuccuagu

SEQ ID NO: 486893 - RNA, 64 nt, Homo Sapiens
auuaguaauacccaaguaaugauuuuaucuuugucuacagaacaguauuugcuaaugaucuuca

SEQ ID NO: 486894 - RNA, 64 nt, Homo Sapiens
uugauuauaaauauguuccuauuuugccauuuaucuacagaaauuucaagcuaguucucugaaa

SEQ ID NO: 486895 - RNA, 64 nt, Homo Sapiens
aagagcaaucuggaaggaacuagcauauaauugucuacagaagccuguuauguugaauaauaau

SEQ ID NO: 486896 - RNA, 64 nt, Homo Sapiens
cacuucucagagggcagaguggcagccgggcacccuacagaaacucagagggcagaguggcagc

SEQ ID NO: 486897 - RNA, 64 nt, Homo Sapiens
uaucuggggcgaguguuggggguaaaagcccacccuacagaaaguggaacagcccggagccuga

SEQ ID NO: 486898 - RNA, 64 nt, Homo Sapiens
gucagaauauuaauacaauuaauauuaauauuaacuacagaaaagacaaacaguagagaacagc

SEQ ID NO: 486899 - RNA, 64 nt, Homo Sapiens
ugaguccugagcgaaaacaggagaguuagucgcccuacagaaaacccagcuagacuauugggua

SEQ ID NO: 486900 - RNA, 64 nt, Homo Sapiens
ccccauaccaaauaaacaaauaauuuugugugagcuacagaagauggguuauuuauuuucccaa

SEQ ID NO: 486901 - RNA, 64 nt, Homo Sapiens
ggugggcccccagacacugcagaggacgaugacccuacagaacauucuacgagccgcggcggcc

SEQ ID NO: 486902 - RNA, 64 nt, Homo Sapiens
gugguauuuuaacauagcagcugguuaaccgggacuacagaaguggaaggauaaugagauguaa

SEQ ID NO: 486903 - RNA, 64 nt, Homo Sapiens
gguagaaacuuuggaaguuuuacuugauuaaggacuacagaauugggcccuuagaaugugaaaa

SEQ ID NO: 486904 - RNA, 64 nt, Homo Sapiens; identical to SEQ ID NO: 180773

SEQ ID NO: 486905 - RNA, 64 nt, Homo Sapiens; identical to SEQ ID NO: 180774

SEQ ID NO: 486906 - RNA, 64 nt, Homo Sapiens; identical to SEQ ID NO: 180775

SEQ ID NO: 486907 - RNA, 64 nt, Homo Sapiens; identical to SEQ ID NO: 180776

SEQ ID NO: 486908 - RNA, 64 nt, Homo Sapiens; identical to SEQ ID NO: 180777

SEQ ID NO: 486909 - RNA, 64 nt, Homo Sapiens; identical to SEQ ID NO: 180778

SEQ ID NO: 486910 - RNA, 64 nt, Homo Sapiens; identical to SEQ ID NO: 180779

SEQ ID NO: 486911 - RNA, 64 nt, Homo Sapiens; identical to SEQ ID NO: 180780

SEQ ID NO: 486912 - RNA, 64 nt, Homo Sapiens; identical to SEQ ID NO: 180781

SEQ ID NO: 486913 - RNA, 64 nt, Homo Sapiens; identical to SEQ ID NO: 180782

SEQ ID NO: 486914 - RNA, 64 nt, Homo Sapiens; identical to SEQ ID NO: 180783

SEQ ID NO: 486915 - RNA, 64 nt, Homo Sapiens; identical to SEQ ID NO: 180784

SEQ ID NO: 486916 - RNA, 64 nt, Homo Sapiens; identical to SEQ ID NO: 180785

SEQ ID NO: 486917 - RNA, 64 nt, Homo Sapiens; identical to SEQ ID NO: 180786

SEQ ID NO: 486918 - RNA, 64 nt, Homo Sapiens; identical to SEQ ID NO: 180787

SEQ ID NO: 486919 - RNA, 64 nt, Homo Sapiens; identical to SEQ ID NO: 180788

SEQ ID NO: 486920 - RNA, 64 nt, Homo Sapiens; identical to SEQ ID NO: 180789

SEQ ID NO: 486921 - RNA, 64 nt, Homo Sapiens; identical to SEQ ID NO: 180790

SEQ ID NO: 486922 - RNA, 64 nt, Homo Sapiens; identical to SEQ ID NO: 180791

SEQ ID NO: 486923 - RNA, 64 nt, Homo Sapiens; identical to SEQ ID NO: 180792

SEQ ID NO: 486924 - RNA, 64 nt, Homo Sapiens; identical to SEQ ID NO: 180793

SEQ ID NO: 486925 - RNA, 64 nt, Homo Sapiens; identical to SEQ ID NO: 180794

SEQ ID NO: 486926 - RNA, 64 nt, Homo Sapiens; identical to SEQ ID NO: 180795

SEQ ID NO: 486927 - RNA, 64 nt, Homo Sapiens; identical to SEQ ID NO: 180796

SEQ ID NO: 486928 - RNA, 64 nt, Homo Sapiens; identical to SEQ ID NO: 180797

SEQ ID NO: 486929 - RNA, 64 nt, Homo Sapiens; identical to SEQ ID NO: 180798

SEQ ID NO: 486930 - RNA, 64 nt, Homo Sapiens
cccaccgugccccagguaacccaagaagaggaagaagaccaaggauugcaggaauuaaaaagga

SEQ ID NO: 486931 - RNA, 64 nt, Homo Sapiens
cccaucaugccccagguaacccaagaaguggaagaagaccaagaauugcagaaauugaaaagua

SEQ ID NO: 486932 - RNA, 64 nt, Homo Sapiens
uuaaacuccuggaucuucacgucccauuaccagaaagaccaaaacaaacuaugaagaaacagaa

SEQ ID NO: 486933 - RNA, 64 nt, Homo Sapiens
ucccuuugauggcugugugauuuuucucuuuuuaaagaccaacuuguguccuuguuuuuccuug

SEQ ID NO: 486934 - RNA, 64 nt, Homo Sapiens
guagaaaucccugcacucaugcuuugauggcagcaagaccaaaaguugcugcugucaugaccua

SEQ ID NO: 486935 - RNA, 64 nt, Homo Sapiens
aaaaauaaagaaaagaugaugccgaaaauaugcaaagaccaagaugccugagaccaucgaggaa

SEQ ID NO: 486936 - RNA, 64 nt, Homo Sapiens
uaucaucucaccacaccacaaaugaugaagaccaaagaccaaguacaaaaccaaaacuaguuca

SEQ ID NO: 486937 - RNA, 64 nt, Homo Sapiens
accaaguuaucaucucaccauaguucaaaugaugaagaccaaagggacaagacaaaaccaaaac

SEQ ID NO: 486938 - RNA, 64 nt, Homo Sapiens
ugagcguguccaccuucucccucuccacucccagaagaccaaacugccuuccccucagggcuca

SEQ ID NO: 486939 - RNA, 64 nt, Homo Sapiens
gcugcucugccugagcaucagggagggggcaggaaagaccaagcuggguuugcacaucugucug

SEQ ID NO: 486940 - RNA, 64 nt, Homo Sapiens
aauuuuuuaucuagagaccagcauguucuccccaaagaccaagauauucugccaaaauaucagg

SEQ ID NO: 486941 - RNA, 64 nt, Homo Sapiens
gauuuucuacccagagaccaagguguucuucccaaagaccaaaauauucuacccauaugucagg

SEQ ID NO: 486942 - RNA, 64 nt, Homo Sapiens
gauuuucuacccagagaccaagguuaucuuccuaaagaccaaaauauucuacccauaugucagg

SEQ ID NO: 486943 - RNA, 64 nt, Homo Sapiens; identical to SEQ ID NO: 243972

SEQ ID NO: 486944 - RNA, 64 nt, Homo Sapiens; identical to SEQ ID NO: 243973

SEQ ID NO: 486945 - RNA, 64 nt, Homo Sapiens; identical to SEQ ID NO: 243974

SEQ ID NO: 486946 - RNA, 64 nt, Homo Sapiens; identical to SEQ ID NO: 243975

SEQ ID NO: 486947 - RNA, 64 nt, Homo Sapiens; identical to SEQ ID NO: 243976

SEQ ID NO: 486948 - RNA, 64 nt, Homo Sapiens; identical to SEQ ID NO: 243977

SEQ ID NO: 486949 - RNA, 64 nt, Homo Sapiens; identical to SEQ ID NO: 243978

SEQ ID NO: 486950 - RNA, 64 nt, Homo Sapiens; identical to SEQ ID NO: 243979

SEQ ID NO: 486951 - RNA, 64 nt, Homo Sapiens; identical to SEQ ID NO: 243980

SEQ ID NO: 486952 - RNA, 64 nt, Homo Sapiens; identical to SEQ ID NO: 243981

SEQ ID NO: 486953 - RNA, 64 nt, Homo Sapiens; identical to SEQ ID NO: 243982

SEQ ID NO: 486954 - RNA, 64 nt, Homo Sapiens; identical to SEQ ID NO: 243983

SEQ ID NO: 486955 - RNA, 64 nt, Homo Sapiens; identical to SEQ ID NO: 243984

SEQ ID NO: 486956 - RNA, 64 nt, Homo Sapiens; identical to SEQ ID NO: 243985

SEQ ID NO: 486957 - RNA, 64 nt, Homo Sapiens; identical to SEQ ID NO: 243986

SEQ ID NO: 486958 - RNA, 64 nt, Homo Sapiens; identical to SEQ ID NO: 243987

SEQ ID NO: 486959 - RNA, 64 nt, Homo Sapiens; identical to SEQ ID NO: 243988

SEQ ID NO: 486960 - RNA, 64 nt, Homo Sapiens; identical to SEQ ID NO: 243989

SEQ ID NO: 486961 - RNA, 64 nt, Homo Sapiens
augaagagaaaaugaucugauuuucccuuauacuucauuuuacaauacauauucccuuuuaacu

SEQ ID NO: 486962 - RNA, 64 nt, Homo Sapiens
uccauuccaaguuuaguuuuugucaaaauaugaaucauuuuauuugacuguacuaucaguacac

SEQ ID NO: 486963 - RNA, 64 nt, Homo Sapiens
aggacuggcuuuagaagcaguguaguucuaccucucauuuuacagaugagaaaaccgaagccca

SEQ ID NO: 486964 - RNA, 64 nt, Homo Sapiens
aaaaaagccauugaauuucaagaaaugccuugauucauuuuagaucucuggggaagaaaaagga

SEQ ID NO: 486965 - RNA, 64 nt, Homo Sapiens
uuccucuuuucaaccugggaacaaauuuuaguuuucauuuuagguuucuguacuuucuguaguu

SEQ ID NO: 486966 - RNA, 64 nt, Homo Sapiens
uuuguuuaacacgguuacuguaagcuguaacuugucauuuuaauauuugaaauagacugugaag

SEQ ID NO: 486967 - RNA, 64 nt, Homo Sapiens
ugauagauaguggagaaaauuuguaagaaaauguucauuuuaagcaguuucuuacaaauaaagu

SEQ ID NO: 486968 - RNA, 64 nt, Homo Sapiens
gcaccuauuucuuucuuggaaugccaacacuuaaucauuuuauguccugacagcagguguacac

SEQ ID NO: 486969 - RNA, 64 nt, Homo Sapiens
auauaauuuaauguaaauaauuagauuaagcuuuucauuuuaaucagucaaaagauccuucauu

SEQ ID NO: 486970 - RNA, 64 nt, Homo Sapiens
uuaagcuuuucauuuuaauaagucaaaagauccuucauuuuagaauuuuaauucaagaaaugac

SEQ ID NO: 486971 - RNA, 64 nt, Homo Sapiens
aaaugagucacggcacuaacucaugguucuauacucauuuuaagaaauuguaaagguugaggug

SEQ ID NO: 486972 - RNA, 64 nt, Homo Sapiens
accuuccaaauaaaaagcuaaauauuccuccuugucauuuuaaugucauuauugaaauacuuuu

SEQ ID NO: 486973 - RNA, 64 nt, Homo Sapiens
auuucccaagugcuauugcaauaacaguugauacucauuuuagguaccaaaccuuuugaguuca

SEQ ID NO: 486974 - RNA, 64 nt, Homo Sapiens
gaaaauguuuaggauuauuccuugcuauuaguacucauuuuauguauguuacccuucaguaagu

SEQ ID NO: 486975 - RNA, 64 nt, Homo Sapiens
uagcugcucuugugauuuuucucaggcuguuuugucauuuuaaaauccagugguagauguagcu

SEQ ID NO: 486976 - RNA, 64 nt, Homo Sapiens
cuuaagauuuuuuuauaucuaauugcugcugccuucauuuuagguucagcaguuacuuuuaacu

SEQ ID NO: 486977 - RNA, 64 nt, Homo Sapiens
uauuaauaccaaauauuuuagccuuaaauuuuugucauuuuaaaaucugauuuaauguuuucug

SEQ ID NO: 486978 - RNA, 64 nt, Homo Sapiens
uuuuucuggaaauuuuguccauuuuaaaaaccaaucauuuuaagaagacaugacaaugcaauga

SEQ ID NO: 486979 - RNA, 64 nt, Homo Sapiens
aguaauauugauucauucacauuccuguguuaagucauuuuauauggaaaggcuuacaaaucaa

SEQ ID NO: 486980 - RNA, 64 nt, Homo Sapiens
ucucagaucacugucacguauauaaauugcuucuucauuuuaauuuguagaaguacuuuacagu

SEQ ID NO: 486981 - RNA, 64 nt, Homo Sapiens
cgguaggauucugcauuccagcauuaaaucugcuucauuuuagaaccuuuauaaaagcaauagc

SEQ ID NO: 486982 - RNA, 64 nt, Homo Sapiens
cuguuuuuuuuuuuucauugucaacaguggugugucauuuuauguauguuccuaaugcuuaugg

SEQ ID NO: 486983 - RNA, 64 nt, Homo Sapiens
ugcuuuagcuuuccaauaugcuguauagccuuugucauuuuauaauuuuaauuccugauuaaaa

SEQ ID NO: 486984 - RNA, 64 nt, Homo Sapiens
auacauuguuuucaauaccacuuuuaauuguuacucauuuuauucacuaagcucgauaaaucua

SEQ ID NO: 486985 - RNA, 64 nt, Homo Sapiens
auuacugcuaaucugcuguuaagugaacgguuuuucauuuuacccuuuuguuuuucaguccagg

SEQ ID NO: 486986 - RNA, 64 nt, Homo Sapiens
ucagccacaccuuccugcauccuauuggccuuauucauuuuaaaugaguuaaugaaucugccag

SEQ ID NO: 486987 - RNA, 64 nt, Homo Sapiens
uauaucuauguaaaguuauuagaaugguaucuguucauuuuagugauaugaagaucacaacuaa

SEQ ID NO: 486988 - RNA, 64 nt, Homo Sapiens
acugaaugauaagauuugcaccuuagaacaauaaucauuuuaaggauaacaaguaaaugucuga

SEQ ID NO: 486989 - RNA, 64 nt, Homo Sapiens
uuuaacuucacuucaugcugaugauguaucaaauucauuuuauagaaagauuuaaaguuuuuuu

SEQ ID NO: 486990 - RNA, 64 nt, Homo Sapiens
auuuucuacuaaauuugaguaaauaaaaaaaagcucauuuuauaauuuuuuuuuaaccugccaa

SEQ ID NO: 486991 - RNA, 64 nt, Homo Sapiens
gacugauauuuugcuguguaaauaaggaaggauuucauuuuauguuaaucacugagcuaaccua

SEQ ID NO: 486992 - RNA, 64 nt, Homo Sapiens
aacguucauuuaauuauguacuuucugaaaacucucauuuuaaacuaaaauguguuuaauuuuc

SEQ ID NO: 486993 - RNA, 64 nt, Homo Sapiens
aaaaauacuuuuuaagaaaaauaauaagguugaaucauuuuauucucugucuuccaggguaaaa

SEQ ID NO: 486994 - RNA, 64 nt, Homo Sapiens
aaugcuccaagucuaugaacuguuaaaucagcauucauuuuaagaaaagcaacuuuaguuucaa

SEQ ID NO: 486995 - RNA, 64 nt, Homo Sapiens
uuuuauaucuguugccuaguuuuguacauggaucucauuuuacaagagaaucucucugcaaaaa

SEQ ID NO: 486996 - RNA, 64 nt, Homo Sapiens
aguuucaacgcugaccuuuucuugcauuauuguuucauuuuaaugauaguguuacuugucccac

SEQ ID NO: 486997 - RNA, 64 nt, Homo Sapiens
auaauugcuagauuaaaaauagacuagaacagguucauuuuaagauuuacuuggaagagcaaag

SEQ ID NO: 486998 - RNA, 64 nt, Homo Sapiens
uuuuauuugaauaucagaacggcuuuggaauaaaucauuuuauaucauuguauguuuuggguau

SEQ ID NO: 486999 - RNA, 64 nt, Homo Sapiens
aagcaugugaaaaugggauauuugucuucuuaccucauuuuaagaucugaaaaaaguuucaccg

SEQ ID NO: 487000 - RNA, 64 nt, Homo Sapiens
aauaucauugauuuuauaauaugauccuuuuuugucauuuuaugccucugacuaguagauuucu

SEQ ID NO: 487001 - RNA, 64 nt, Homo Sapiens
augauuucaaaaucaguuuuaauuaaaacauauuucauuuuaacuauagccaacugcuaaugca

SEQ ID NO: 487002 - RNA, 64 nt, Homo Sapiens
aacuuuauuggguuuuuauucucuuauugggauaucauuuuaaaacaaauugucguuuuuauuc

SEQ ID NO: 487003 - RNA, 64 nt, Homo Sapiens
aucaguuaggcauaauauuucugaucagcagcucucauuuuaacuccauuaacaguauauugua

SEQ ID NO: 487004 - RNA, 64 nt, Homo Sapiens
auagauuuuggcagucucauuugccauauuuuuuucauuuuagaguagcauccauacuggaauc

SEQ ID NO: 487005 - RNA, 64 nt, Homo Sapiens
uaauauaugaaguguaaauaaugcauaaauauuuucauuuuaaguugaauggcaaacgcuauuu

SEQ ID NO: 487006 - RNA, 64 nt, Homo Sapiens
uuuccauucagugaauggagcugauguuugccugucauuuuaagaugauaccauaccuucuuug

SEQ ID NO: 487007 - RNA, 64 nt, Homo Sapiens
agcaguuuguuauuaugcaggaaaaucaguuucaucauuuuaguuacacuaaacacuuuuggca

SEQ ID NO: 487008 - RNA, 64 nt, Homo Sapiens
acuuuuauuauuuuaauuaauaugacauaagcaaucauuuuaugcuguuuaugaauuauaaaug

SEQ ID NO: 487009 - RNA, 64 nt, Homo Sapiens
cuuaagaaaauuuacaaaauuuauucucagguaaucauuuuaauaaaguucugcaaaauacacg

SEQ ID NO: 487010 - RNA, 64 nt, Homo Sapiens
gccacaaauauguaguucugaagauguugaauaaucauuuuacaaagcaguuuucugaaugggg

SEQ ID NO: 487011 - RNA, 64 nt, Homo Sapiens
guuaaagaaugcagcuguauagauuauauagcuuucauuuuauugcuauuugaagcagauguuc

SEQ ID NO: 487012 - RNA, 64 nt, Homo Sapiens
agauggaaaaguaauugacaguuucaccuuugucucauuuuauaugauuuauuacaguguaagu

SEQ ID NO: 487013 - RNA, 64 nt, Homo Sapiens
cuaucaaugaggcucccaucaugccauuuuuuguucauuuuaaucuuuaaaaaauaaaaauuag

SEQ ID NO: 487014 - RNA, 64 nt, Homo Sapiens
aacuggaauaagugcgaaaguaucaauuauaauuucauuuuauuaaaugaguuacuuuuuauua

SEQ ID NO: 487015 - RNA, 64 nt, Homo Sapiens
auuauauucagaauugaccuagcugaguugugauucauuuuaccaauauauaauuuuucuuaau

SEQ ID NO: 487016 - RNA, 64 nt, Homo Sapiens
auauauaaaaauauaaauguuguugguaaacuaaucauuuuauuugggaucuuuuuauuuugau

SEQ ID NO: 487017 - RNA, 64 nt, Homo Sapiens
uaaugaaauaaacaauguuguugcuuuauaauuuucauuuuauguaaguguauuaauuguuugg

SEQ ID NO: 487018 - RNA, 64 nt, Homo Sapiens
cauccuaaauuuauauuuuaccucauguuucauuucauuuuaaauguacuuauuuauugaccug

SEQ ID NO: 487019 - RNA, 64 nt, Homo Sapiens
gaaaagagaacuuucucuuaagaaguuggaaacuucauuuuaccuucgugacccugguagacca

SEQ ID NO: 487020 - RNA, 64 nt, Homo Sapiens
aaagugugagcuguguuaaaaggcauucuuagauucauuuuaaccacauuuuuaaaaacucaca

SEQ ID NO: 487021 - RNA, 64 nt, Homo Sapiens
uacuguguuuuauuuugaaauaaguuauugugauucauuuuaguuguaaacuuugcuucucuua

SEQ ID NO: 487022 - RNA, 64 nt, Homo Sapiens
uuuacaaguccaaaaacacaaccuaauuuaaauuucauuuuagcuaagucauaucagauaucag

SEQ ID NO: 487023 - RNA, 64 nt, Homo Sapiens
acagcccaguauuccuuuguucuucucaguuuucucauuuuaaagggcuagaaaccuaacugau

SEQ ID NO: 487024 - RNA, 64 nt, Homo Sapiens
cacacaagauuuaauugaaaaggcugcguguuuuucauuuuaaagaaauauggauauuuguacc

SEQ ID NO: 487025 - RNA, 64 nt, Homo Sapiens
auagccuauuguguaugaaaauacaccauaugccucauuuuaucuuuucauuaauacuguaguu

SEQ ID NO: 487026 - RNA, 64 nt, Homo Sapiens
auauauuaaaagaaaccuaauuuuuuauauaacuucauuuuaaaaggcaaccgugguuacugua

SEQ ID NO: 487027 - RNA, 64 nt, Homo Sapiens
agaucaaaacaaacaaacaaccugauaauaaacaucauuuuaaacaccccauggaaacacuagu

SEQ ID NO: 487028 - RNA, 64 nt, Homo Sapiens
guaacaccacaccccauggagcugugcaggggggucauuuuaaucaaugaaauauucaaccccu

SEQ ID NO: 487029 - RNA, 64 nt, Homo Sapiens
uucacccugugacuauccugaaaagaaauaauaaucauuuuaugauugaugggccaaaaaaagc

SEQ ID NO: 487030 - RNA, 64 nt, Homo Sapiens
uucaucaguacuuucuccucccauccuaagcuucucauuuuaggaacugacaugauaagguggu

SEQ ID NO: 487031 - RNA, 64 nt, Homo Sapiens
uccuacuuaugcagaaaaauaggcaauaagaacuucauuuuacaauuuaguuuucaaaaaaaaa

SEQ ID NO: 487032 - RNA, 64 nt, Homo Sapiens
uugccuguuugcuaauuuaaaaauauuuauuuuaucauuuuaauguuuucauggacuuuuuugc

SEQ ID NO: 487033 - RNA, 64 nt, Homo Sapiens
uaucagauuauuauuuuguauaaugaaaaccaauucauuuuaaauuuuaccauuucgacuuaca

SEQ ID NO: 487034 - RNA, 64 nt, Homo Sapiens
uaaggcuucauguugacucgauauccugaaucauucauuuuagcuuugugagaauuucucauua

SEQ ID NO: 487035 - RNA, 64 nt, Homo Sapiens
ccucugguguuuauuauaaagcuuaaauuuuauaucauuuuaaaaugucuuggucuucuacugc

SEQ ID NO: 487036 - RNA, 64 nt, Homo Sapiens
agagcucuuugaucgcuuuuaauaaacugcaaguucauuuuaaaugaagggccagcauauauac

SEQ ID NO: 487037 - RNA, 64 nt, Homo Sapiens
aggaauuucuugcuuauagaggcaaaccacaguaucauuuuaacucuagaauugggcuuguaca

SEQ ID NO: 487038 - RNA, 64 nt, Homo Sapiens
acuucuauuauuuguuuaguauguuguaaguagaucauuuuaaaaaacugaaucuauauuaugu

SEQ ID NO: 487039 - RNA, 64 nt, Homo Sapiens
gauuuuauuguauugcguuauuagcugauuuuacucauuuuauauuugcaaaauaaauuucuaa

SEQ ID NO: 487040 - RNA, 64 nt, Homo Sapiens
gaggcaauacuguuggaauuauguggauucuaacucauuuuaacaagguagccugaccugcaua

SEQ ID NO: 487041 - RNA, 64 nt, Homo Sapiens
gccugucacuuugggagccggaaggaggugcuagucauuuuauuuuuacgugaaauagaugacc

SEQ ID NO: 487042 - RNA, 64 nt, Homo Sapiens
auuucccaccuacauuucuguuuggugacauugcucauuuuaacaaauaugaccgagucuaguu

SEQ ID NO: 487043 - RNA, 64 nt, Homo Sapiens
uuuucagcacccauaccacaaguaaaauuaugucucauuuuauuaaaaugcaaagugaaugauu

SEQ ID NO: 487044 - RNA, 64 nt, Homo Sapiens
acuaguguaauucuugauaaaacagaaaauucacucauuuuagaguucuucauuuccugucucc

SEQ ID NO: 487045 - RNA, 64 nt, Homo Sapiens
uacaggcaugagccaccacgccuggccaguuucuucauuuuacauauggucacauuggcgccua

SEQ ID NO: 487046 - RNA, 64 nt, Homo Sapiens
ucacaacagugggaggucuguauccugaauguccucauuuuacagaugaggacauugaggagaa

SEQ ID NO: 487047 - RNA, 64 nt, Homo Sapiens
gguauggcaaaaaaucacccgcuaccuggauccaucauuuuacuccauccagauugugacgguu

SEQ ID NO: 487048 - RNA, 64 nt, Homo Sapiens
ccaggcacauaguccagauucaccagcaccaauuucauuuuacuacacaggcugguaaucucuu

SEQ ID NO: 487049 - RNA, 64 nt, Homo Sapiens
gauauuuuucaacuucaccaauacuaaauuauaaucauuuuaguagagcagcaggagaaaauua

SEQ ID NO: 487050 - RNA, 64 nt, Homo Sapiens
uauuauuuacaugacuuuucaaucauaaaacaaaucauuuuacucaaacuggacauggugaaua

SEQ ID NO: 487051 - RNA, 64 nt, Homo Sapiens
guguuugcaaucgcuccgcuuuugcauugugucuucauuuuaaucuuaagguuugugaagagua

SEQ ID NO: 487052 - RNA, 64 nt, Homo Sapiens
aaaauaauguauuuauaaguuuuuuaguuacuaaucauuuuaugcaggauucccucacucuuuu

SEQ ID NO: 487053 - RNA, 64 nt, Homo Sapiens
uuuugaauuggcaauauauagagguucauccaugucauuuuaaaucacccagcauaaugacuuu

SEQ ID NO: 487054 - RNA, 64 nt, Homo Sapiens
auguauaaaguaacaauucacaccaagauacuuuucauuuuaaauucuuggauuccaaacuaaa

SEQ ID NO: 487055 - RNA, 64 nt, Homo Sapiens
ccuuacugauccuaaccccagaggcucccugcucucauuuuagcuuucuuaggguaagucccac

SEQ ID NO: 487056 - RNA, 64 nt, Homo Sapiens
auagggguuauaguuggcuugugcuacucuggaaucauuuuacuguuuguuuuuauuaucuuaa

SEQ ID NO: 487057 - RNA, 64 nt, Homo Sapiens
ucaggguacauuacauaaaacaauggaggaugccucauuuuagcaaacuagguuucuuuguauu

SEQ ID NO: 487058 - RNA, 64 nt, Homo Sapiens
uguaaauuuugucauuguaguguacauggagugaucauuuuacuaacauaaauauuuucuaugu

SEQ ID NO: 487059 - RNA, 64 nt, Homo Sapiens
uauaaaagauacauuuuauggugguuucaguaggucauuuuaaaaaccaaugugcauuaguuuu

SEQ ID NO: 487060 - RNA, 64 nt, Homo Sapiens
ccacccaacugccaaguuaguauuguuagagauuucauuuuacaacacaaaaauaagccugugu

SEQ ID NO: 487061 - RNA, 62 nt, Homo Sapiens
agaaagaccuuagagaaccagccaaccaacucucucauuuuaaaagugaaggauucauagca

SEQ ID NO: 487062 - RNA, 64 nt, Homo Sapiens
cuuuguaauucuagacacuaagaaaucuuugauuucauuuuauuaacauuucauuuuacuagcg

SEQ ID NO: 487063 - RNA, 64 nt, Homo Sapiens
agcgagaaaucuuugauuuccuguuccuaacauuucauuuuacuguaggaccuauauuuuaaua

SEQ ID NO: 487064 - RNA, 64 nt, Homo Sapiens
caauauuuaauuaaaguauucuguauaaaaauguucauuuuacaacauuuuuucagauauuuaa

SEQ ID NO: 487065 - RNA, 64 nt, Homo Sapiens
ugccacccauugacuuugccuagaauguaaaaagucauuuuagauauuuuauuuuauuuuuuug

SEQ ID NO: 487066 - RNA, 64 nt, Homo Sapiens
aaaugcucgugcugcuaauggaauuagagugcguucauuuuacaggcuaguauuuuaaaaguag

SEQ ID NO: 487067 - RNA, 64 nt, Homo Sapiens
acgucuaaugccuuauuauuucugauuuccuuuuucauuuuaagugguguggagauuccagcac

SEQ ID NO: 487068 - RNA, 64 nt, Homo Sapiens
uaacacauguuaaaaggacauuguuuuuauagggucauuuuaggcccuuugacuaaguugauau

SEQ ID NO: 487069 - RNA, 64 nt, Homo Sapiens
gguuuuaugcaaaagaaagugcuacaauuccuaaucauuuuagacacuuuaggagggggugaag

SEQ ID NO: 487070 - RNA, 64 nt, Homo Sapiens
auuuaggcaacggguaucauauccaugaaaaaugucauuuuaagacacuaauaucaacaguaua

SEQ ID NO: 487071 - RNA, 64 nt, Homo Sapiens
auuuaucuuccaaacccaaucuaguaggauguucucauuuuaaaaacgaggggaaaagaccaga

SEQ ID NO: 487072 - RNA, 64 nt, Homo Sapiens
uugaacuaaaaaggauuaaauauuuuuuucuuucucauuuuauguucuuugaaaaugucagaaa

SEQ ID NO: 487073 - RNA, 64 nt, Homo Sapiens
uugugcuauaaaaaggauugggcaucuuucauucucauuuuauacagugcacuaugcuuucuau

SEQ ID NO: 487074 - RNA, 64 nt, Homo Sapiens
uaagugacagguccaagugucaauaucucguguuucauuuuaauaaacuggaaaaaacuuuagu

SEQ ID NO: 487075 - RNA, 64 nt, Homo Sapiens
uacaggaggcaacuaagacuaccaguauuauuccucauuuuacauccucucaaaauuucugugc

SEQ ID NO: 487076 - RNA, 64 nt, Homo Sapiens
cuguucagaagaugcuucaauuucuguguuuuacucauuuuaggaaggaaugcaaggagaagga

SEQ ID NO: 487077 - RNA, 64 nt, Homo Sapiens
agacuuucuuuugcuugaucaaaacuguccuaucucauuuuaaauuucuuccaguauuuuuuaa

SEQ ID NO: 487078 - RNA, 64 nt, Homo Sapiens
acaagguguuuuuuucaagaaaauaaugguacuuucauuuuauaugccuuuguuuguaaaaaua

SEQ ID NO: 487079 - RNA, 64 nt, Homo Sapiens
gaaaacuaagagcagaaaaugcguuuaaaucuucucauuuuauuuuggaaaugcaccaaaguga

SEQ ID NO: 487080 - RNA, 64 nt, Homo Sapiens
uuggcauuucugccugguucuuauauaaacauuuucauuuuaaguuuaaacuggauggguuaau

SEQ ID NO: 487081 - RNA, 64 nt, Homo Sapiens
uuuuaauauaaaaagggguuucuggauuugucuuucauuuuaacuuugcaaucacuauguucaa

SEQ ID NO: 487082 - RNA, 64 nt, Homo Sapiens
cugggucacuugcugccagcggcuuguuucuacuucauuuuaccguucugaauuuccuuuucuu

SEQ ID NO: 487083 - RNA, 64 nt, Homo Sapiens
gucagauggugguguucaccacugaauuuguauuucauuuuauugugaaauaauuaaagcuuaa

SEQ ID NO: 487084 - RNA, 64 nt, Homo Sapiens
uccagacuuucuuuuucuacaugugagauaguuuucauuuuaacuggcaugucauuugcacaca

SEQ ID NO: 487085 - RNA, 64 nt, Homo Sapiens
uaaggcuguccacguacuuaauuuacuuaaguguucauuuuaaguaacgugcucacuguguaua

SEQ ID NO: 487086 - RNA, 64 nt, Homo Sapiens
gggagauggauggugggguagguuuucuagucuaucauuuuacauuuuucauggagucccugcu

SEQ ID NO: 487087 - RNA, 64 nt, Homo Sapiens
ugacuauaauagcaggaagaauuauagcaaucugucauuuuaccugaaacagacaagccuaugu

SEQ ID NO: 487088 - RNA, 64 nt, Homo Sapiens
ugccuuucagauucuaaaugauauucaucucuccucauuuuaguuguaguacuauaguaccgua

SEQ ID NO: 487089 - RNA, 64 nt, Homo Sapiens
guuucuggugcaugcaggguuuauaauauuuuggucauuuuacuaugcacuuuauugguuaauu

SEQ ID NO: 487090 - RNA, 64 nt, Homo Sapiens
uucuuuggacuacaggugggagcacaucauuuuaucauuuuauccagcugacuguugagagagc

SEQ ID NO: 487091 - RNA, 64 nt, Homo Sapiens
auuuuaucuucuuuggacuagagagagcagcacaucauuuuaucuucagacucagcugacuguu

SEQ ID NO: 487092 - RNA, 64 nt, Homo Sapiens
ucuuuuuuguaaguauauaaacaguggccuuuggucauuuuacuuuuucgcaaaaggagaaaaa

SEQ ID NO: 487093 - RNA, 64 nt, Homo Sapiens
ucuccuuuuaauguauuuaaggacgucagcuucuucauuuuaauuggugugggcaggcacuagu

SEQ ID NO: 487094 - RNA, 64 nt, Homo Sapiens
cugaugaguucuuaaaauuuugucagagccuucuucauuuuacaauauuuuguuauuuuuauuu

SEQ ID NO: 487095 - RNA, 64 nt, Homo Sapiens
uuuacaauauuuuguuauuuuuauuuuaccuuuuucauuuuacaauauuucguuauuuuuauuu

SEQ ID NO: 487096 - RNA, 64 nt, Homo Sapiens
uuuacaauauuucguuauuuuuauuuuaccuuuuucauuuuacaaguugcaauauauuguuucg

SEQ ID NO: 487097 - RNA, 64 nt, Homo Sapiens
uaacuugauguguauauuaauaaaaguaauucagucauuuuaguuuuugauugaaaauaaaggu

SEQ ID NO: 487098 - RNA, 64 nt, Homo Sapiens
ccauacaucuuaaugaacauacgccuuuguucugucauuuuaaagagugguguuuacuaugugu

SEQ ID NO: 487099 - RNA, 64 nt, Homo Sapiens
cauauacauguaaguaacaugggaaagcuuucaaucauuuuaguuccuuucaaauacaugaaag

SEQ ID NO: 487100 - RNA, 64 nt, Homo Sapiens
uugguaaauguaaagagugugggagagccuuuagucauuuuaguuccacuugaagccaugaaag

SEQ ID NO: 487101 - RNA, 64 nt, Homo Sapiens
ugguaguuggauuucauuaucuuagugaauuuagucauuuuacaauauguuuguauuuggccau

SEQ ID NO: 487102 - RNA, 64 nt, Homo Sapiens
augacauagccauguguuuuugguuuuuuauauuucauuuuaaaauuugaguaucaccauacau

SEQ ID NO: 487103 - RNA, 64 nt, Homo Sapiens
agugggcaucuccacgcaccuguguaugugaaagucauuuuacauuucaaagcaguguguguuu

SEQ ID NO: 487104 - RNA, 64 nt, Homo Sapiens
uagaucaaguauaaaauuuguaugacuucaagucucauuuuaucugaaagguuuuuuucucauu

SEQ ID NO: 487105 - RNA, 64 nt, Homo Sapiens
aguuacauuugcaaauauuuuuuaaauuauauccucauuuuaaagcaaaaacugcucaaagcca

SEQ ID NO: 487106 - RNA, 64 nt, Homo Sapiens
gcauuuuagcacaguucauauguuuugaaaguugucauuuuaaagaacgggagaugaugcacug

SEQ ID NO: 487107 - RNA, 64 nt, Homo Sapiens
guguauucauauagcuguauacauauucaguugaucauuuuauaaacauaugaaggcauaaaga

SEQ ID NO: 487108 - RNA, 64 nt, Homo Sapiens
auaaagauauacagaagaaaaauuauuaaacaacucauuuuaagauucaaauuaacuaauuccu

SEQ ID NO: 487109 - RNA, 64 nt, Homo Sapiens
ucauauuuuauucauuuucucccuuuagcaauuuucauuuuauuucucauaauuugaacagaga

SEQ ID NO: 487110 - RNA, 64 nt, Homo Sapiens
gauuaccaugcuggaauaagaagaguugcauuucucauuuuaaugagcauauggaaagauggga

SEQ ID NO: 487111 - RNA, 64 nt, Homo Sapiens
uaccauuuuaacuggcccaguucauuuucuccuuucauuuuacaaaagaaaucaugcagaagca

SEQ ID NO: 487112 - RNA, 64 nt, Homo Sapiens
aaugcaaguucugggaccuuuuggggcacauguaucauuuuacaaaugagcuuucaagaccauu

SEQ ID NO: 487113 - RNA, 64 nt, Homo Sapiens
aaauaucugucaccaaaccacaagaaauccaaaaucauuuuagguuuaccaaacauugguggaa

SEQ ID NO: 487114 - RNA, 64 nt, Homo Sapiens
uaauguagauguuuuuauaacauacuauguacuuucauuuuagaccaaacuagagucagaacga

SEQ ID NO: 487115 - RNA, 64 nt, Homo Sapiens
agaagguugguuuuaaacaaugguuucuuaucuuucauuuuauaguuuuuagacauuucugauu

SEQ ID NO: 487116 - RNA, 64 nt, Homo Sapiens
cucggcaacaucuggagaagguaugaaaaucaacucauuuuauuccuuuuacacaaugugagau

SEQ ID NO: 487117 - RNA, 64 nt, Homo Sapiens
guggauuuugcuauacuuauauuccgggcaguuuucauuuuacucugugcugucaagcaucaug

SEQ ID NO: 487118 - RNA, 64 nt, Homo Sapiens
gcuucucugaauugugcucagcgcugcuucucauucauuuuaagacaauacuggaaucauuuug

SEQ ID NO: 487119 - RNA, 64 nt, Homo Sapiens; identical to SEQ ID NO: 180891

SEQ ID NO: 487120 - RNA, 64 nt, Homo Sapiens; identical to SEQ ID NO: 180892

SEQ ID NO: 487121 - RNA, 64 nt, Homo Sapiens; identical to SEQ ID NO: 180893

SEQ ID NO: 487122 - RNA, 64 nt, Homo Sapiens; identical to SEQ ID NO: 180894

SEQ ID NO: 487123 - RNA, 64 nt, Homo Sapiens; identical to SEQ ID NO: 180895

SEQ ID NO: 487124 - RNA, 60 nt, Homo Sapiens; identical to SEQ ID NO: 180896

SEQ ID NO: 487125 - RNA, 64 nt, Homo Sapiens; identical to SEQ ID NO: 180897

SEQ ID NO: 487126 - RNA, 64 nt, Homo Sapiens; identical to SEQ ID NO: 180898

SEQ ID NO: 487127 - RNA, 64 nt, Homo Sapiens; identical to SEQ ID NO: 180899

SEQ ID NO: 487128 - RNA, 64 nt, Homo Sapiens; identical to SEQ ID NO: 180900

SEQ ID NO: 487129 - RNA, 64 nt, Homo Sapiens; identical to SEQ ID NO: 180901

SEQ ID NO: 487130 - RNA, 64 nt, Homo Sapiens; identical to SEQ ID NO: 180902

SEQ ID NO: 487131 - RNA, 64 nt, Homo Sapiens; identical to SEQ ID NO: 180903

SEQ ID NO: 487132 - RNA, 64 nt, Homo Sapiens; identical to SEQ ID NO: 180904

SEQ ID NO: 487133 - RNA, 64 nt, Homo Sapiens; identical to SEQ ID NO: 180905

SEQ ID NO: 487134 - RNA, 64 nt, Homo Sapiens; identical to SEQ ID NO: 180906

SEQ ID NO: 487135 - RNA, 64 nt, Homo Sapiens; identical to SEQ ID NO: 180907

SEQ ID NO: 487136 - RNA, 64 nt, Homo Sapiens; identical to SEQ ID NO: 180908

SEQ ID NO: 487137 - RNA, 64 nt, Homo Sapiens; identical to SEQ ID NO: 180909

SEQ ID NO: 487138 - RNA, 64 nt, Homo Sapiens; identical to SEQ ID NO: 180910

SEQ ID NO: 487139 - RNA, 64 nt, Homo Sapiens; identical to SEQ ID NO: 180911

SEQ ID NO: 487140 - RNA, 64 nt, Homo Sapiens; identical to SEQ ID NO: 180912

SEQ ID NO: 487141 - RNA, 64 nt, Homo Sapiens; identical to SEQ ID NO: 180913

SEQ ID NO: 487142 - RNA, 64 nt, Homo Sapiens; identical to SEQ ID NO: 182142

SEQ ID NO: 487143 - RNA, 64 nt, Homo Sapiens; identical to SEQ ID NO: 182143

SEQ ID NO: 487144 - RNA, 64 nt, Homo Sapiens; identical to SEQ ID NO: 182144

SEQ ID NO: 487145 - RNA, 64 nt, Homo Sapiens; identical to SEQ ID NO: 182145

SEQ ID NO: 487146 - RNA, 64 nt, Homo Sapiens; identical to SEQ ID NO: 182146

SEQ ID NO: 487147 - RNA, 64 nt, Homo Sapiens; identical to SEQ ID NO: 182147

SEQ ID NO: 487148 - RNA, 64 nt, Homo Sapiens; identical to SEQ ID NO: 182148

SEQ ID NO: 487149 - RNA, 64 nt, Homo Sapiens; identical to SEQ ID NO: 182149

SEQ ID NO: 487150 - RNA, 64 nt, Homo Sapiens; identical to SEQ ID NO: 182150

SEQ ID NO: 487151 - RNA, 64 nt, Homo Sapiens; identical to SEQ ID NO: 182151

SEQ ID NO: 487152 - RNA, 64 nt, Homo Sapiens; identical to SEQ ID NO: 182152

SEQ ID NO: 487153 - RNA, 64 nt, Homo Sapiens; identical to SEQ ID NO: 182153

SEQ ID NO: 487154 - RNA, 64 nt, Homo Sapiens; identical to SEQ ID NO: 182154

SEQ ID NO: 487155 - RNA, 64 nt, Homo Sapiens; identical to SEQ ID NO: 182155

SEQ ID NO: 487156 - RNA, 64 nt, Homo Sapiens; identical to SEQ ID NO: 182156

SEQ ID NO: 487157 - RNA, 64 nt, Homo Sapiens; identical to SEQ ID NO: 182157

SEQ ID NO: 487158 - RNA, 64 nt, Homo Sapiens; identical to SEQ ID NO: 182158

SEQ ID NO: 487159 - RNA, 64 nt, Homo Sapiens; identical to SEQ ID NO: 182159

SEQ ID NO: 487160 - RNA, 64 nt, Homo Sapiens; identical to SEQ ID NO: 182160

SEQ ID NO: 487161 - RNA, 64 nt, Homo Sapiens; identical to SEQ ID NO: 182161

SEQ ID NO: 487162 - RNA, 57 nt, Homo Sapiens; identical to SEQ ID NO: 182162

SEQ ID NO: 487163 - RNA, 64 nt, Homo Sapiens; identical to SEQ ID NO: 182163

SEQ ID NO: 487164 - RNA, 64 nt, Homo Sapiens; identical to SEQ ID NO: 182164

SEQ ID NO: 487165 - RNA, 64 nt, Homo Sapiens; identical to SEQ ID NO: 182165

SEQ ID NO: 487166 - RNA, 64 nt, Homo Sapiens; identical to SEQ ID NO: 182166

SEQ ID NO: 487167 - RNA, 64 nt, Homo Sapiens; identical to SEQ ID NO: 182167

SEQ ID NO: 487168 - RNA, 62 nt, Homo Sapiens; identical to SEQ ID NO: 182168

SEQ ID NO: 487169 - RNA, 64 nt, Homo Sapiens; identical to SEQ ID NO: 182169

SEQ ID NO: 487170 - RNA, 64 nt, Homo Sapiens; identical to SEQ ID NO: 182170

SEQ ID NO: 487171 - RNA, 64 nt, Homo Sapiens; identical to SEQ ID NO: 182171

SEQ ID NO: 487172 - RNA, 64 nt, Homo Sapiens; identical to SEQ ID NO: 182172

SEQ ID NO: 487173 - RNA, 64 nt, Homo Sapiens; identical to SEQ ID NO: 182173

SEQ ID NO: 487174 - RNA, 64 nt, Homo Sapiens; identical to SEQ ID NO: 182174

SEQ ID NO: 487175 - RNA, 64 nt, Homo Sapiens; identical to SEQ ID NO: 182175

SEQ ID NO: 487176 - RNA, 64 nt, Homo Sapiens; identical to SEQ ID NO: 182176

SEQ ID NO: 487177 - RNA, 64 nt, Homo Sapiens; identical to SEQ ID NO: 182177

SEQ ID NO: 487178 - RNA, 64 nt, Homo Sapiens; identical to SEQ ID NO: 182178

SEQ ID NO: 487179 - RNA, 64 nt, Homo Sapiens; identical to SEQ ID NO: 182179

SEQ ID NO: 487180 - RNA, 64 nt, Homo Sapiens; identical to SEQ ID NO: 182180

SEQ ID NO: 487181 - RNA, 64 nt, Homo Sapiens; identical to SEQ ID NO: 182181

SEQ ID NO: 487182 - RNA, 64 nt, Homo Sapiens; identical to SEQ ID NO: 182182

SEQ ID NO: 487183 - RNA, 64 nt, Homo Sapiens; identical to SEQ ID NO: 182183

SEQ ID NO: 487184 - RNA, 64 nt, Homo Sapiens; identical to SEQ ID NO: 182184

SEQ ID NO: 487185 - RNA, 64 nt, Homo Sapiens; identical to SEQ ID NO: 182185

SEQ ID NO: 487186 - RNA, 64 nt, Homo Sapiens; identical to SEQ ID NO: 182186

SEQ ID NO: 487187 - RNA, 64 nt, Homo Sapiens; identical to SEQ ID NO: 182187

SEQ ID NO: 487188 - RNA, 64 nt, Homo Sapiens; identical to SEQ ID NO: 182188

SEQ ID NO: 487189 - RNA, 64 nt, Homo Sapiens; identical to SEQ ID NO: 182189

SEQ ID NO: 487190 - RNA, 64 nt, Homo Sapiens; identical to SEQ ID NO: 182190

SEQ ID NO: 487191 - RNA, 64 nt, Homo Sapiens; identical to SEQ ID NO: 182191

SEQ ID NO: 487192 - RNA, 64 nt, Homo Sapiens; identical to SEQ ID NO: 182192

SEQ ID NO: 487193 - RNA, 64 nt, Homo Sapiens; identical to SEQ ID NO: 182193

SEQ ID NO: 487194 - RNA, 64 nt, Homo Sapiens; identical to SEQ ID NO: 182194

SEQ ID NO: 487195 - RNA, 64 nt, Homo Sapiens; identical to SEQ ID NO: 182195

SEQ ID NO: 487196 - RNA, 64 nt, Homo Sapiens; identical to SEQ ID NO: 182196

SEQ ID NO: 487197 - RNA, 64 nt, Homo Sapiens; identical to SEQ ID NO: 182197

SEQ ID NO: 487198 - RNA, 64 nt, Homo Sapiens; identical to SEQ ID NO: 182198

SEQ ID NO: 487199 - RNA, 64 nt, Homo Sapiens; identical to SEQ ID NO: 182199

SEQ ID NO: 487200 - RNA, 64 nt, Homo Sapiens; identical to SEQ ID NO: 182200

SEQ ID NO: 487201 - RNA, 64 nt, Homo Sapiens; identical to SEQ ID NO: 182201

SEQ ID NO: 487202 - RNA, 64 nt, Homo Sapiens; identical to SEQ ID NO: 182202

SEQ ID NO: 487203 - RNA, 64 nt, Homo Sapiens; identical to SEQ ID NO: 182203

SEQ ID NO: 487204 - RNA, 64 nt, Homo Sapiens; identical to SEQ ID NO: 182204

SEQ ID NO: 487205 - RNA, 64 nt, Homo Sapiens; identical to SEQ ID NO: 182205

SEQ ID NO: 487206 - RNA, 64 nt, Homo Sapiens; identical to SEQ ID NO: 182206

SEQ ID NO: 487207 - RNA, 64 nt, Homo Sapiens; identical to SEQ ID NO: 182207

SEQ ID NO: 487208 - RNA, 64 nt, Homo Sapiens; identical to SEQ ID NO: 182208

SEQ ID NO: 487209 - RNA, 64 nt, Homo Sapiens; identical to SEQ ID NO: 182209

SEQ ID NO: 487210 - RNA, 64 nt, Homo Sapiens; identical to SEQ ID NO: 182210

SEQ ID NO: 487211 - RNA, 64 nt, Homo Sapiens; identical to SEQ ID NO: 182211

SEQ ID NO: 487212 - RNA, 64 nt, Homo Sapiens; identical to SEQ ID NO: 182212

SEQ ID NO: 487213 - RNA, 64 nt, Homo Sapiens; identical to SEQ ID NO: 182213

SEQ ID NO: 487214 - RNA, 64 nt, Homo Sapiens; identical to SEQ ID NO: 182214

SEQ ID NO: 487215 - RNA, 64 nt, Homo Sapiens; identical to SEQ ID NO: 182215

SEQ ID NO: 487216 - RNA, 64 nt, Homo Sapiens; identical to SEQ ID NO: 182216

SEQ ID NO: 487217 - RNA, 64 nt, Homo Sapiens; identical to SEQ ID NO: 182217

SEQ ID NO: 487218 - RNA, 64 nt, Homo Sapiens; identical to SEQ ID NO: 182218

SEQ ID NO: 487219 - RNA, 64 nt, Homo Sapiens; identical to SEQ ID NO: 182219

SEQ ID NO: 487220 - RNA, 64 nt, Homo Sapiens; identical to SEQ ID NO: 182220

SEQ ID NO: 487221 - RNA, 64 nt, Homo Sapiens; identical to SEQ ID NO: 182221

SEQ ID NO: 487222 - RNA, 64 nt, Homo Sapiens; identical to SEQ ID NO: 182222

SEQ ID NO: 487223 - RNA, 64 nt, Homo Sapiens; identical to SEQ ID NO: 182223

SEQ ID NO: 487224 - RNA, 64 nt, Homo Sapiens; identical to SEQ ID NO: 182224

SEQ ID NO: 487225 - RNA, 64 nt, Homo Sapiens; identical to SEQ ID NO: 182225

SEQ ID NO: 487226 - RNA, 64 nt, Homo Sapiens; identical to SEQ ID NO: 182226

SEQ ID NO: 487227 - RNA, 64 nt, Homo Sapiens; identical to SEQ ID NO: 106040

SEQ ID NO: 487228 - RNA, 64 nt, Homo Sapiens; identical to SEQ ID NO: 106041

SEQ ID NO: 487229 - RNA, 64 nt, Homo Sapiens; identical to SEQ ID NO: 106042

SEQ ID NO: 487230 - RNA, 64 nt, Homo Sapiens; identical to SEQ ID NO: 106043

SEQ ID NO: 487231 - RNA, 64 nt, Homo Sapiens; identical to SEQ ID NO: 106044

SEQ ID NO: 487232 - RNA, 64 nt, Homo Sapiens; identical to SEQ ID NO: 106045

SEQ ID NO: 487233 - RNA, 64 nt, Homo Sapiens; identical to SEQ ID NO: 106046

SEQ ID NO: 487234 - RNA, 64 nt, Homo Sapiens; identical to SEQ ID NO: 106047

SEQ ID NO: 487235 - RNA, 64 nt, Homo Sapiens; identical to SEQ ID NO: 106048

SEQ ID NO: 487236 - RNA, 64 nt, Homo Sapiens; identical to SEQ ID NO: 106049

SEQ ID NO: 487237 - RNA, 64 nt, Homo Sapiens; identical to SEQ ID NO: 106050

SEQ ID NO: 487238 - RNA, 64 nt, Homo Sapiens; identical to SEQ ID NO: 106051

SEQ ID NO: 487239 - RNA, 64 nt, Homo Sapiens; identical to SEQ ID NO: 106052

SEQ ID NO: 487240 - RNA, 64 nt, Homo Sapiens; identical to SEQ ID NO: 106053

SEQ ID NO: 487241 - RNA, 64 nt, Homo Sapiens; identical to SEQ ID NO: 106054

SEQ ID NO: 487242 - RNA, 64 nt, Homo Sapiens; identical to SEQ ID NO: 106055

SEQ ID NO: 487243 - RNA, 64 nt, Homo Sapiens; identical to SEQ ID NO: 106056

SEQ ID NO: 487244 - RNA, 64 nt, Homo Sapiens; identical to SEQ ID NO: 106057

SEQ ID NO: 487245 - RNA, 64 nt, Homo Sapiens; identical to SEQ ID NO: 106058

SEQ ID NO: 487246 - RNA, 64 nt, Homo Sapiens; identical to SEQ ID NO: 106059

SEQ ID NO: 487247 - RNA, 64 nt, Homo Sapiens; identical to SEQ ID NO: 106060

SEQ ID NO: 487248 - RNA, 64 nt, Homo Sapiens; identical to SEQ ID NO: 106061

SEQ ID NO: 487249 - RNA, 64 nt, Homo Sapiens; identical to SEQ ID NO: 106062

SEQ ID NO: 487250 - RNA, 64 nt, Homo Sapiens; identical to SEQ ID NO: 106063

SEQ ID NO: 487251 - RNA, 64 nt, Homo Sapiens; identical to SEQ ID NO: 106064

SEQ ID NO: 487252 - RNA, 64 nt, Homo Sapiens; identical to SEQ ID NO: 106065

SEQ ID NO: 487253 - RNA, 64 nt, Homo Sapiens; identical to SEQ ID NO: 106066

SEQ ID NO: 487254 - RNA, 64 nt, Homo Sapiens; identical to SEQ ID NO: 106067

SEQ ID NO: 487255 - RNA, 64 nt, Homo Sapiens; identical to SEQ ID NO: 106068

SEQ ID NO: 487256 - RNA, 64 nt, Homo Sapiens; identical to SEQ ID NO: 106069

SEQ ID NO: 487257 - RNA, 64 nt, Homo Sapiens; identical to SEQ ID NO: 106070

SEQ ID NO: 487258 - RNA, 64 nt, Homo Sapiens; identical to SEQ ID NO: 106071

SEQ ID NO: 487259 - RNA, 64 nt, Homo Sapiens; identical to SEQ ID NO: 106072

SEQ ID NO: 487260 - RNA, 64 nt, Homo Sapiens; identical to SEQ ID NO: 106073

SEQ ID NO: 487261 - RNA, 64 nt, Homo Sapiens; identical to SEQ ID NO: 106074

SEQ ID NO: 487262 - RNA, 64 nt, Homo Sapiens; identical to SEQ ID NO: 106075

SEQ ID NO: 487263 - RNA, 64 nt, Homo Sapiens; identical to SEQ ID NO: 106076

SEQ ID NO: 487264 - RNA, 64 nt, Homo Sapiens; identical to SEQ ID NO: 106077

SEQ ID NO: 487265 - RNA, 64 nt, Homo Sapiens; identical to SEQ ID NO: 106078

SEQ ID NO: 487266 - RNA, 64 nt, Homo Sapiens; identical to SEQ ID NO: 106079

SEQ ID NO: 487267 - RNA, 64 nt, Homo Sapiens; identical to SEQ ID NO: 106080

SEQ ID NO: 487268 - RNA, 64 nt, Homo Sapiens; identical to SEQ ID NO: 106081

SEQ ID NO: 487269 - RNA, 64 nt, Homo Sapiens; identical to SEQ ID NO: 106082

SEQ ID NO: 487270 - RNA, 64 nt, Homo Sapiens; identical to SEQ ID NO: 106083

SEQ ID NO: 487271 - RNA, 64 nt, Homo Sapiens; identical to SEQ ID NO: 106084

SEQ ID NO: 487272 - RNA, 64 nt, Homo Sapiens; identical to SEQ ID NO: 106085

SEQ ID NO: 487273 - RNA, 64 nt, Homo Sapiens; identical to SEQ ID NO: 106086

SEQ ID NO: 487274 - RNA, 64 nt, Homo Sapiens; identical to SEQ ID NO: 106087

SEQ ID NO: 487275 - RNA, 64 nt, Homo Sapiens; identical to SEQ ID NO: 106088

SEQ ID NO: 487276 - RNA, 64 nt, Homo Sapiens; identical to SEQ ID NO: 288178

SEQ ID NO: 487277 - RNA, 64 nt, Homo Sapiens; identical to SEQ ID NO: 288179

SEQ ID NO: 487278 - RNA, 64 nt, Homo Sapiens; identical to SEQ ID NO: 288180

SEQ ID NO: 487279 - RNA, 64 nt, Homo Sapiens; identical to SEQ ID NO: 288181

SEQ ID NO: 487280 - RNA, 64 nt, Homo Sapiens; identical to SEQ ID NO: 288182

SEQ ID NO: 487281 - RNA, 64 nt, Homo Sapiens; identical to SEQ ID NO: 288183

SEQ ID NO: 487282 - RNA, 64 nt, Homo Sapiens; identical to SEQ ID NO: 288184

SEQ ID NO: 487283 - RNA, 64 nt, Homo Sapiens; identical to SEQ ID NO: 288185

SEQ ID NO: 487284 - RNA, 64 nt, Homo Sapiens; identical to SEQ ID NO: 288186

SEQ ID NO: 487285 - RNA, 64 nt, Homo Sapiens; identical to SEQ ID NO: 288187

SEQ ID NO: 487286 - RNA, 64 nt, Homo Sapiens; identical to SEQ ID NO: 288188

SEQ ID NO: 487287 - RNA, 64 nt, Homo Sapiens; identical to SEQ ID NO: 288189

SEQ ID NO: 487288 - RNA, 64 nt, Homo Sapiens; identical to SEQ ID NO: 288190

SEQ ID NO: 487289 - RNA, 64 nt, Homo Sapiens; identical to SEQ ID NO: 288191

SEQ ID NO: 487290 - RNA, 64 nt, Homo Sapiens; identical to SEQ ID NO: 288192

SEQ ID NO: 487291 - RNA, 64 nt, Homo Sapiens; identical to SEQ ID NO: 288193

SEQ ID NO: 487292 - RNA, 64 nt, Homo Sapiens; identical to SEQ ID NO: 288194

SEQ ID NO: 487293 - RNA, 64 nt, Homo Sapiens; identical to SEQ ID NO: 288195

SEQ ID NO: 487294 - RNA, 64 nt, Homo Sapiens
uuuagaagaaaaauuaaguacagaaaagcccagauuuaaauacauuuaauaugucauuuuaaaa

SEQ ID NO: 487295 - RNA, 64 nt, Homo Sapiens
caugcuguuaugauuucaccuggugaaucaguguuuuaaauaagaaagguaauaguugguaagg

SEQ ID NO: 487296 - RNA, 64 nt, Homo Sapiens
gaguuauucuuuacauacaauauaguucauaaauuuuaaauauauuguuuaauaaauuuugaua

SEQ ID NO: 487297 - RNA, 64 nt, Homo Sapiens
cuagucuuucucuugcugcccuguauccuuugccuuuaaauaaaaaucuuaagugauuaugcuc

SEQ ID NO: 487298 - RNA, 64 nt, Homo Sapiens
uccauuggaaauggaauucauugccuuaggucuuuuuaaauaguguauuauuaucguuggggcu

SEQ ID NO: 487299 - RNA, 64 nt, Homo Sapiens
guuaauauggugauaauggaaagucaaguuaaauuuuaaauauuaagaauucugauuuauugag

SEQ ID NO: 487300 - RNA, 64 nt, Homo Sapiens
cugacaaugugaaacucgaagaaaauguucucuuuuuaaauauacagucauaaacuguucaagg

SEQ ID NO: 487301 - RNA, 64 nt, Homo Sapiens
uaauauaugcagaccaacaggucuuugcauuccuuuuaaauaacugguugugacaaagcuuguu

SEQ ID NO: 487302 - RNA, 64 nt, Homo Sapiens
gugaaguucuugcaaacucuuacuacagaaauguuuuaaauacauucucaggcauguuugcaaa

SEQ ID NO: 487303 - RNA, 64 nt, Homo Sapiens
guuuguugagcuuuaaaauguauuugaaguaauauuuaaauaggcauuuaaaauuucaaauuag

SEQ ID NO: 487304 - RNA, 64 nt, Homo Sapiens
uuaugauuauuacuggauuugucauuuuugauaauuuaaauauugcugcugcuuuguagaugau

SEQ ID NO: 487305 - RNA, 64 nt, Homo Sapiens
ucaugcugaaguauaguuuuugggaaagaaugauuuuaaauaaagagauuguaaaaguaaaaaa

SEQ ID NO: 487306 - RNA, 64 nt, Homo Sapiens
aaaaacaaaaaaacaagaaaaggcaacaucucauuuuaaauaguacaauucagaagggauacua

SEQ ID NO: 487307 - RNA, 64 nt, Homo Sapiens
aucauuuaugcuuuuuucuagcauguauaacuuuuuuaaauaaagguaguauuuaccauuaaaa

SEQ ID NO: 487308 - RNA, 64 nt, Homo Sapiens
gcaaugaauucuccauuuccuacuggaggauuuauuuaaauaaaauaugcuuauuaaacacucc

SEQ ID NO: 487309 - RNA, 64 nt, Homo Sapiens
ugcacuaauucaaucacagguguuucuaucuagauuuaaauauauuugucaaugaauguggaau

SEQ ID NO: 487310 - RNA, 64 nt, Homo Sapiens
auuaaaauuaaauaauuuaaaucuagcauuuaaauuuaaauaauuuaagucuagcauuuacuuu

SEQ ID NO: 487311 - RNA, 64 nt, Homo Sapiens
uuuaaauuuaaauaauuuaagucuagcauuuacuuuuaaauaauuauaaugaaguuuugaaaua

SEQ ID NO: 487312 - RNA, 64 nt, Homo Sapiens
agcucguaacacaacuaauuuauuaaaugugcuuuuuaaauaaauaucugcgaaacuauacuug

SEQ ID NO: 487313 - RNA, 64 nt, Homo Sapiens
aacuaaaauaucauaguucuauugaguuaauuuuuuuaaauauccauuagcugcuuaaaaaagc

SEQ ID NO: 487314 - RNA, 64 nt, Homo Sapiens
aggaaagagcaaguuugcucguuuuguuuuguguuuuaaauaaacugugacuuuaguucaggaa

SEQ ID NO: 487315 - RNA, 64 nt, Homo Sapiens
ggaaauauuuuauauaccaguuacagaaacauuuuuuaaauaaguuucaugacuccgaaguauu

SEQ ID NO: 487316 - RNA, 64 nt, Homo Sapiens
uauaauguagcuucuuucaaauuuuuaacguuucuuuaaauauucuaaucugauuuucacucug

SEQ ID NO: 487317 - RNA, 64 nt, Homo Sapiens
guuaauggauacauuuggcaaggcaaucagaaauuuuaaauacauagcaauaacauggucaaaa

SEQ ID NO: 487318 - RNA, 64 nt, Homo Sapiens
gugaaauuuauguauguuuuccucuuucauauguuuuaaauaaauuuagugugguuugaaauua

SEQ ID NO: 487319 - RNA, 64 nt, Homo Sapiens
guguauggccgcuuugugcucccaugcucacccuuuuaaauauuuaaaguuuuauuggggcaca

SEQ ID NO: 487320 - RNA, 64 nt, Homo Sapiens
ugggaaaaaaauuccaaagaccaguuuuuacuuuuuuaaauagucaagcuauugcagucagcug

SEQ ID NO: 487321 - RNA, 64 nt, Homo Sapiens
gaguauaguacugcugcuacuauacugggacauauuuaaauacuauuaauugaaguuaugcuuc

SEQ ID NO: 487322 - RNA, 64 nt, Homo Sapiens
ugaaguagaagaaauugaguaguccugucuggguuuuaaauaaguuauaccucaacuaccuuuc

SEQ ID NO: 487323 - RNA, 64 nt, Homo Sapiens
uugacuuguugaggguauguuuugaaacacugguuuuaaauauucauagcugugauuuuuggua

SEQ ID NO: 487324 - RNA, 64 nt, Homo Sapiens
ugacauugacuauuuuuguuacaaaggauacuuauuuaaauagaaauaacuggaacacucuaua

SEQ ID NO: 487325 - RNA, 64 nt, Homo Sapiens
uacuguucuaauuuuguauugaaacauugguaaauuuaaauacaguuaaaauguuccuguaaaa

SEQ ID NO: 487326 - RNA, 64 nt, Homo Sapiens
aauugaccauugaugauaucauuugaguuauaaauuuaaauauaauuaaugcaaaucaugcaga

SEQ ID NO: 487327 - RNA, 64 nt, Homo Sapiens
cagcaggcugagugcagguaauuuggggauguuauuuaaauacugccaaaguccacauauggau

SEQ ID NO: 487328 - RNA, 64 nt, Homo Sapiens
aauggaguauaaauggaguccagaaugaccaucuuuuaaauauuuuuucuaggguugucuauga

SEQ ID NO: 487329 - RNA, 64 nt, Homo Sapiens
ggugcaucucagaugcacuuaggaaggggaacaauuuaaauauugaaauucugauucuaggcag

SEQ ID NO: 487330 - RNA, 64 nt, Homo Sapiens
uccgugaguuguaaauagauugugaguuaauuuuuuuaaauaucgugacaaaugccaauagaua

SEQ ID NO: 487331 - RNA, 64 nt, Homo Sapiens
ccaaaaaaaaacagaaaagaugcuguuuucuauuuuuaaauaaagcuauaaaacaaaaaaaggu

SEQ ID NO: 487332 - RNA, 64 nt, Homo Sapiens
uaauuucucauuuugggggguguaauugaauauguuuaaauauuaagauuugucuaguaaaaau

SEQ ID NO: 487333 - RNA, 64 nt, Homo Sapiens
augcaucuuccuuugucugcaauugacagugauuuuuaaauauauauauucuaaauccuaguaa

SEQ ID NO: 487334 - RNA, 64 nt, Homo Sapiens
cagaauauccugcaauugaaagggauucccuaacuuuaaauaauauuggguggggggauaaaaa

SEQ ID NO: 487335 - RNA, 64 nt, Homo Sapiens
ccaacaugagacaucaguaggauucaaaaagaauuuuaaauacaccgaucuugaagaaauucaa

SEQ ID NO: 487336 - RNA, 64 nt, Homo Sapiens
guguuucuggaacuuuauacuuuacaacuccauuuuuaaauaaauuauguuauuuuguuaugca

SEQ ID NO: 487337 - RNA, 64 nt, Homo Sapiens
aaaaaaaaaagguaaaugaaaucuccuauuuuucuuuaaauacauaaaaacaaaacuauaaugg

SEQ ID NO: 487338 - RNA, 64 nt, Homo Sapiens
acaauuucucuuguaaauggaaugguuugggguuuuuaaauaagcauuaacuaacaaccuuucu

SEQ ID NO: 487339 - RNA, 64 nt, Homo Sapiens
uaaauuugaguguuaacggucuuuuuaaagugcauuuaaauacaaaccaggaauuucuuuagaa

SEQ ID NO: 487340 - RNA, 64 nt, Homo Sapiens
aaucauuuaguggcauagaugcagccacuuguuuuuuaaauagaaguggcugucauacgugaaa

SEQ ID NO: 487341 - RNA, 64 nt, Homo Sapiens
uuaaaaccuuuauugucucuccuuagucuaauuuuuuaaauauggauuaugcuugaauuacuau

SEQ ID NO: 487342 - RNA, 64 nt, Homo Sapiens
uuagagcugaauuaccuacagaaacuguuucugguuuaaauaauuagcacaaauuggccuaagu

SEQ ID NO: 487343 - RNA, 64 nt, Homo Sapiens
aucuuggagucuagguugccuugucucuccuauuuuuaaauaagugaaauuugggagauuguaa

SEQ ID NO: 487344 - RNA, 64 nt, Homo Sapiens
aauuuuuaaaauuugauuuuaaauuucaaauaaauuuaaauaaauuuuaaauaaauuuuaaaua

SEQ ID NO: 487345 - RNA, 64 nt, Homo Sapiens
uuugauuuuaaauuucaaauaaauuuaaauaaauuuuaaauaaauuuuaaauaaaauuuuacag

SEQ ID NO: 487346 - RNA, 64 nt, Homo Sapiens
auuucaaauaaauuuaaauaaauuuuaaauaaauuuuaaauaaaauuuuacagagacguggucu

SEQ ID NO: 487347 - RNA, 64 nt, Homo Sapiens
aguuugaaaaagaaaaucuccagcaagcaucucauuuaaauaaagguuugucaucuuuaaaaau

SEQ ID NO: 487348 - RNA, 64 nt, Homo Sapiens
uaugcguauauaagcaaauauguaaucuuuauuuuuuaaauaaaugggaucauauuauauauuc

SEQ ID NO: 487349 - RNA, 64 nt, Homo Sapiens
agaaucuacaaccuggagcauuucagguuugcucuuuaaauauagacaccccucaccaugagcu

SEQ ID NO: 487350 - RNA, 64 nt, Homo Sapiens
caucaaagcugaacuugaaacguuuuagcagaauuuuaaauaugugaaaguucauuguggucau

SEQ ID NO: 487351 - RNA, 64 nt, Homo Sapiens
uaaauagcuguccuuuccaacacauugcuacuuuuuuaaauacuguaucauaaguucagccugu

SEQ ID NO: 487352 - RNA, 64 nt, Homo Sapiens
aauguacuggugugauaucuuguaugaaugaucauuuaaauacaguacauuacuguagaagcua

SEQ ID NO: 487353 - RNA, 64 nt, Homo Sapiens
uuuaggggagaaggguuaugguuuuguaagaaacuuuaaauauacuuuuaggagacccacaauc

SEQ ID NO: 487354 - RNA, 64 nt, Homo Sapiens
ggauaagccuucuccuuucauaagaaaggauguauuuaaauacauuuuauuuugcuaaauccug

SEQ ID NO: 487355 - RNA, 64 nt, Homo Sapiens
cgcuaaaggaaauguaagagguuuuguugucuguuuuaaauaaauuuaauucggaacacaugau

SEQ ID NO: 487356 - RNA, 63 nt, Homo Sapiens
acuuuaucacauguacagaucacaaauaaauuuuuuuaaauacaaaaugaacauuuauuuagu

SEQ ID NO: 487357 - RNA, 64 nt, Homo Sapiens
agcacccccucccaccccugcaacaaagacuugcuuuaaauagauuucagcuaugcagaaaaau

SEQ ID NO: 487358 - RNA, 64 nt, Homo Sapiens
auaaucuccucuaaaacaaccucugcauguuuuuuuuaaauaaagcacuuucugucaaauaaug

SEQ ID NO: 487359 - RNA, 64 nt, Homo Sapiens
aguaaaccaaucccuugaguuauauaacaagauuuuuaaauaaauguuauuguccucaccuuca

SEQ ID NO: 487360 - RNA, 64 nt, Homo Sapiens
guuuaugaaauguuacauguagaaaaauacugauuuuaaauauuuuccauauuaacaauuuaac

SEQ ID NO: 487361 - RNA, 64 nt, Homo Sapiens
aaaaagucucuccccaagggcagccuuuguuacuuuuaaauauuuucuguuauuacaagugcuc

SEQ ID NO: 487362 - RNA, 64 nt, Homo Sapiens
uuuucuguuauuacaagugcucuaauugugaacuuuuaaauaaaauacuauuaagagguaaugc

SEQ ID NO: 487363 - RNA, 64 nt, Homo Sapiens
caccuuaaaccauggauauuuuuuccucaggggcuuuaaauaguuuccuaugcaacgugucuug

SEQ ID NO: 487364 - RNA, 64 nt, Homo Sapiens
uaaguguguguguguuuucuguacccaaccagacuuuaaauaaaacaaacaugaaaccuaaugu

SEQ ID NO: 487365 - RNA, 64 nt, Homo Sapiens
ucaucuggccaggcauggugaguuugguaugauauuuaaauacacucuuuauauaaauacacag

SEQ ID NO: 487366 - RNA, 64 nt, Homo Sapiens
auccucagacaugcagcuguaugcauuuuaaauauuuaaauaugaaaacuaagacagacuguag

SEQ ID NO: 487367 - RNA, 64 nt, Homo Sapiens
uaaauaugauccucagacaugacuguagaugcauuuuaaauauuauauaaagaaaacuaagaca

SEQ ID NO: 487368 - RNA, 64 nt, Homo Sapiens
gaacugcugugucugacuuacaaacuauccacaauuuaaauaaacucucucucccccuaccuac

SEQ ID NO: 487369 - RNA, 64 nt, Homo Sapiens
uucuugggcauuuaucuuuuucaaaucaaaaagcuuuaaauaaaaaaaauucagucugauaacc

SEQ ID NO: 487370 - RNA, 64 nt, Homo Sapiens
guuuuauggguuaagcagaaaucuaguuaaauuuuuuaaauaaaaccaaugaauguuuuguacc

SEQ ID NO: 487371 - RNA, 64 nt, Homo Sapiens
aagugguacuagggaacuaccuaauaugacaauauuuaaauacuauuuacaugauaaucugaag

SEQ ID NO: 487372 - RNA, 64 nt, Homo Sapiens
uuugauaauuguuauuuuuuguacaucccauacauuuaaauaucuggggaauaagugauuuuaa

SEQ ID NO: 487373 - RNA, 64 nt, Homo Sapiens
auauauucaguggcauuuugucuuaaauagaauuuuuaaauaguaaaaaaaacguuucucacug

SEQ ID NO: 487374 - RNA, 64 nt, Homo Sapiens
uuucaauacaacaguuuaggaaguuuuaauugauuuuaaauauuuuauuuuacuuacaauccuc

SEQ ID NO: 487375 - RNA, 64 nt, Homo Sapiens
agucagauuguauauucaaauuguaauuaagagauuuaaauauuagaacgguauguaagguagu

SEQ ID NO: 487376 - RNA, 64 nt, Homo Sapiens
agaacgguauguaagguaguauaauuaccacuauuuuaaauaauucaguuaaacacugcugcaa

SEQ ID NO: 487377 - RNA, 64 nt, Homo Sapiens
guaaaccagucauucugaauuauagugaugagaauuuaaauauaugcuuuucuagaauuugaug

SEQ ID NO: 487378 - RNA, 64 nt, Homo Sapiens
cuguaaaaauguaaacacauuauuagcauggacuuuuaaauaaagauuuaaagaaagcaagauc

SEQ ID NO: 487379 - RNA, 64 nt, Homo Sapiens
ggggugccaaauauagcauccuucuguuguuuauuuuaaauauauuuuuaaugaaaagggacuu

SEQ ID NO: 487380 - RNA, 64 nt, Homo Sapiens
cuguaccuuuuuuuuuuuuuuuuacuuugaagucuuuaaauaaaauguauaauacccauugaga

SEQ ID NO: 487381 - RNA, 64 nt, Homo Sapiens
aaaucuuaacauauggagcagccuuuccuaugaauuuaaauaugccuuuaaaauaagucacugu

SEQ ID NO: 487382 - RNA, 64 nt, Homo Sapiens
auaauuuguguguguguauguguauguauaugacuuuaaauagcuauggguacaauauuaaaaa

SEQ ID NO: 487383 - RNA, 64 nt, Homo Sapiens
caugucucaaauuuuuuuaaaaaaaauuaaugguuuuaaauauaugcuauagggacguuccaug

SEQ ID NO: 487384 - RNA, 64 nt, Homo Sapiens
gguaucagaaaaaggcuuucuuucauaagacuauuuuaaauagaaauuauuucaacaauuaaag

SEQ ID NO: 487385 - RNA, 64 nt, Homo Sapiens
auuacaauacuaccuucacaacauuuucauguguuuuaaauaaauauuuuuuaauuggcuaaag

SEQ ID NO: 487386 - RNA, 64 nt, Homo Sapiens
aagaauaaaauaauuuggaugaaaaucauguuuauuuaaauaguaaugucaugagacuauuaaa

SEQ ID NO: 487387 - RNA, 64 nt, Homo Sapiens
cagaguaugucaggaagacaacucagauugccauuuuaaauaaaguuguacaugaacaauaauu

SEQ ID NO: 487388 - RNA, 64 nt, Homo Sapiens
uaaaaauugaauuuuauuguaauguuuaacuacguuuaaauaaacaugggggagauugucuucc

SEQ ID NO: 487389 - RNA, 64 nt, Homo Sapiens
guugccuuaaauaaguguauuacauauauugauuuuuaaauaaacagugacagauauaauuuac

SEQ ID NO: 487390 - RNA, 64 nt, Homo Sapiens
uccauuuaauuaaaacguucgauuuuauagucuuuuuaaauaaauuuuaucucucuugauguca

SEQ ID NO: 487391 - RNA, 64 nt, Homo Sapiens
aauugaaacuuaucucaaauaaaaaaaauuuuuuuuuaaauaaucaaaguaggccagauaaguu

SEQ ID NO: 487392 - RNA, 64 nt, Homo Sapiens
caaauguaccaaaaaacaaguucauuuccugugcuuuaaauaaaacuuuuuagguggcauuuua

SEQ ID NO: 487393 - RNA, 64 nt, Homo Sapiens
uaccaaacaguggcccccugauccucuaaaaauguuuaaauauagaaauuuagagaauauucuc

SEQ ID NO: 487394 - RNA, 64 nt, Homo Sapiens
guuuuuauaauuucauucguuguagaacuuuguuuuuaaauaauuuuuggcccaauguugaaga

SEQ ID NO: 487395 - RNA, 64 nt, Homo Sapiens
uuuaguugaccuuuuuccuuucacauuuuuuuccuuuaaauauuuuuuaucauuugauucauuc

SEQ ID NO: 487396 - RNA, 64 nt, Homo Sapiens
guuugcugaauuaagccgaucugagugucccuucuuuaaauaguaaccuguauucuauuccuua

SEQ ID NO: 487397 - RNA, 64 nt, Homo Sapiens
aucuaugcuuccaccaauaaauugucucguuuauuuuaaauagaugugaaguagacccuagaaa

SEQ ID NO: 487398 - RNA, 64 nt, Homo Sapiens
ggauaccacagugcaugcuggucagcucacaauuuuuaaauaaaaugagaacacuacaacugua

SEQ ID NO: 487399 - RNA, 64 nt, Homo Sapiens
uucuuagaccugguaaaugcccuugcccccaaccuuuaaauauauuaaaugugcaucaaucaug

SEQ ID NO: 487400 - RNA, 64 nt, Homo Sapiens
uauacaaugguuaauaguaauauucuuuauggcuuuuaaauaaaugugcguucaugcuuuuucg

SEQ ID NO: 487401 - RNA, 64 nt, Homo Sapiens
aaaucagacaaacaauauucaaugaugucugauauuuaaauaggguagacuauguauuuccuau

SEQ ID NO: 487402 - RNA, 64 nt, Homo Sapiens
cgcaaaugaaaagaaaaauguuuugagaacuguguuuaaauaaaggcccaauuucacucaaaug

SEQ ID NO: 487403 - RNA, 64 nt, Homo Sapiens
auuuucagguccuuugcuuauugccuguucauuuuuuaaauauuucauggaugaacugaagacu

SEQ ID NO: 487404 - RNA, 64 nt, Homo Sapiens
ucacuugacuuugcaauggugcuaagcugauagauuuaaauacacagacgggcgaguggcgccc

SEQ ID NO: 487405 - RNA, 64 nt, Homo Sapiens
cuuaacaugaucaauguauuucucugccuugacauuuaaauacauaaauugagauaaguagauu

SEQ ID NO: 487406 - RNA, 64 nt, Homo Sapiens
auuuauuugaaucuacaaaaaacaacaaauaauuuuuaaauauaaggauuuuccuagauauugc

SEQ ID NO: 487407 - RNA, 64 nt, Homo Sapiens
uagauucuuauaauauuauuuaaaugacugcauuuuuaaauacaaggcuuuauauuuuuaacuu

SEQ ID NO: 487408 - RNA, 64 nt, Homo Sapiens
aauacagcugaagucaaaauauguaagaacacauuuuaaauacucuacuuacaguuggcccucu

SEQ ID NO: 487409 - RNA, 64 nt, Homo Sapiens
guauauuuuaauguuuuuaaaaagaguaauuucauuuaaauaucuguuauucaaauuugaugau

SEQ ID NO: 487410 - RNA, 64 nt, Homo Sapiens
acuggaccaacauucuuguuuuugcuuuuguuuuuuuaaauaauucuagucuggagcuaacugu

SEQ ID NO: 487411 - RNA, 64 nt, Homo Sapiens
aagucuaguuuguauguagguaugaagggaauuuuuuaaauaaauugaaaagcugugaacagca

SEQ ID NO: 487412 - RNA, 64 nt, Homo Sapiens
aaacugaagauaaugaaauaguuauuuuaauaccuuuaaauaucauucuuuguaucuuaaaucu

SEQ ID NO: 487413 - RNA, 64 nt, Homo Sapiens
ccacuuaaucuucucucuugauugauuuuuaaaguuuaaauaccaguacuugagggaccaauau

SEQ ID NO: 487414 - RNA, 64 nt, Homo Sapiens
guuuuguuuuuauuuuugcugaugaagagauauguuuaaauauguuguauuguuuuguuuaguu

SEQ ID NO: 487415 - RNA, 64 nt, Homo Sapiens
cuaaaguacauugcauguuuuccuaaauacagaguuuaaauaauuucaguaauucuuagaugau

SEQ ID NO: 487416 - RNA, 64 nt, Homo Sapiens
augauuuuaguagauugaaauacaagagaggagcuuuaaauaaguacacaaaacacuuugauuu

SEQ ID NO: 487417 - RNA, 64 nt, Homo Sapiens
aucuauaauuguuuuguaauuaauacauauuuuguuuaaauauauuuuaaagauggaauaauuu

SEQ ID NO: 487418 - RNA, 64 nt, Homo Sapiens
uuaauagaaucaguaguaaucagaauauacaaauuuuaaauaaaugcaaaagauuuaugaugaa

SEQ ID NO: 487419 - RNA, 64 nt, Homo Sapiens
aacaaauauucuuuacuaaaucuuuuuaaauguuuuuaaauauagaugaugaaaaugcagaaug

SEQ ID NO: 487420 - RNA, 64 nt, Homo Sapiens
gguguauuuucagaacaguauugacaugagcuguuuuaaauacuuacccaaguuucuucaugag

SEQ ID NO: 487421 - RNA, 64 nt, Homo Sapiens
cacuaaaaugauuugugagacuaaaaucacuagauuuaaauaauauagugauuuuaaauaauca

SEQ ID NO: 487422 - RNA, 64 nt, Homo Sapiens
cacuaaaaucacuagauuuagcuaggauagugauuuuaaauaauucagccuaugcuuaaugcaa

SEQ ID NO: 487423 - RNA, 64 nt, Homo Sapiens
aauggaaauacaagggaaaauuucaccacugagcuuuaaauaagauuccuuuguguacuugguu

SEQ ID NO: 487424 - RNA, 64 nt, Homo Sapiens
aauaaagaaaagauuucccaaaaauauaaaauguuuuaaauaaaaccuaauacccacaaaacuu

SEQ ID NO: 487425 - RNA, 64 nt, Homo Sapiens
auagacuuuguaccuguuaugaacauaaaagagcuuuaaauauuaauauuuacauuuaauaugg

SEQ ID NO: 487426 - RNA, 64 nt, Homo Sapiens
caugaauguugauuucauuaagcuuuuaaggcauuuuaaauaacuuacuauguauauuaugcuu

SEQ ID NO: 487427 - RNA, 64 nt, Homo Sapiens
ugguuuuuguguuuucugaaugcuuggggauuauuuuaaauaauuucuugcacugagguuuuuu

SEQ ID NO: 487428 - RNA, 64 nt, Homo Sapiens
caaauuuuacucaaguuuaaccaauaaggucuuuuuuaaauauacuccauuuacuuaagguaau

SEQ ID NO: 487429 - RNA, 64 nt, Homo Sapiens
auguaucaaaaaccuuuauucauuguuuuugcuauuuaaauauauaaguaaaaauguaguacuc

SEQ ID NO: 487430 - RNA, 64 nt, Homo Sapiens
ccauaugacacugguuccgauuuuaaaaauuauuuuuaaauaaccgauuauugauuacuguauu

SEQ ID NO: 487431 - RNA, 64 nt, Homo Sapiens
uaaacacaaaagcuuuauacaaaauauuguugaauuuaaauaagguaaaucuuuuuuaguuuau

SEQ ID NO: 487432 - RNA, 64 nt, Homo Sapiens
ucuccccaccuccacacacuacauuuuuuuuagauuuaaauaguuuuacuauuuuaaaugauug

SEQ ID NO: 487433 - RNA, 64 nt, Homo Sapiens
gauugccguacaauuaguagacuugaagacaaguuuuaaauauuuuucuucaaaggcuuguuaa

SEQ ID NO: 487434 - RNA, 64 nt, Homo Sapiens
ucuccgcaggcuauuuguucagagaggccuuuuguuuaaauauaaauguuuaaauauaaauguu

SEQ ID NO: 487435 - RNA, 64 nt, Homo Sapiens
uuguucagagaggccuuuuguuuaaauauaaauguuuaaauauaaauguuugucuggauuggcu

SEQ ID NO: 487436 - RNA, 64 nt, Homo Sapiens
ugacaucaguauaaaagugccaaaccugcccucuuuuaaauaaaaauguaaaaaggccacuccc

SEQ ID NO: 487437 - RNA, 64 nt, Homo Sapiens
auugcaugaaaacauuaugacuuuuuucucuuaguuuaaauaaacuccaagguaacuggacuuc

SEQ ID NO: 487438 - RNA, 64 nt, Homo Sapiens
ugaagauuuuuuaaauucuaucuugcugauuuuuuuuaaauauaagaaacugguacuugguaaa

SEQ ID NO: 487439 - RNA, 64 nt, Homo Sapiens
acuguauauuucuuaaaugaagagacuuucauucuuuaaauauuauugacuuacaguuuaaaaa

SEQ ID NO: 487440 - RNA, 64 nt, Homo Sapiens
uguagagcacauuuaguccaaugaagauaaaugcuuuaaauaguuuacuucacuuucaucugag

SEQ ID NO: 487441 - RNA, 64 nt, Homo Sapiens
uagcaauauauuuguagguauacuauguaagggcuuuaaauaaaagagguccauuaauacuucc

SEQ ID NO: 487442 - RNA, 64 nt, Homo Sapiens
ugcaucaguaaagcagcauauucaaauguggauuuuuaaauauuuuaauuacuauuuaaauauc

SEQ ID NO: 487443 - RNA, 64 nt, Homo Sapiens
uucaaauguggauuuuuaaauauuuuaauuacuauuuaaauaucucuuuacuuuguaauccuau

SEQ ID NO: 487444 - RNA, 64 nt, Homo Sapiens
gcacuucuauaaauaguauguuauuuugaaaauauuuaaauauuuucauuuuaguuacuguguu

SEQ ID NO: 487445 - RNA, 64 nt, Homo Sapiens
aguucaaaacuguauuuacuuaauagaaguuccauuuaaauaugaauuugaaagcuguacaaag

SEQ ID NO: 487446 - RNA, 64 nt, Homo Sapiens
uuaauguuagaaacauuauuugauguaaaaguuauuuaaauaaguauauguguuggccuauuau

SEQ ID NO: 487447 - RNA, 64 nt, Homo Sapiens
aauagcuuagucagauugaugacuaaccacauucuuuaaauaucaguuauaccagggagagagu

SEQ ID NO: 487448 - RNA, 64 nt, Homo Sapiens
uuauuuuauagcuuauuuugaaaaacagcagauguuuaaauagacauuaacaaaacaaucacug

SEQ ID NO: 487449 - RNA, 64 nt, Homo Sapiens
gcaauauacuggucuagcugggauauugagccaauuuaaauaaacacuggucuagcuuuagaua

SEQ ID NO: 487450 - RNA, 64 nt, Homo Sapiens
cucuuacagccuuuggaauacauuguuuccauuuuuuaaauaucuucuauauccauauaguauu

SEQ ID NO: 487451 - RNA, 64 nt, Homo Sapiens
aaacuuauucugaaauaaaguaaaauucuaauuguuuaaauacugugaugaauucuggauguua

SEQ ID NO: 487452 - RNA, 64 nt, Homo Sapiens
uuaucuacauauauagguacaugccauccauuauuuuaaauaaacuaauagguuuucagaauua

SEQ ID NO: 487453 - RNA, 64 nt, Homo Sapiens
gagaauuauuuuuaacugaacguuuuuguuguuuuuuaaauaaaguagccauauguaacgggau

SEQ ID NO: 487454 - RNA, 64 nt, Homo Sapiens
gcugaucugcaucuguuuauccauuuuaguagcuuuuaaauaugauuuuaugugaagugccauu

SEQ ID NO: 487455 - RNA, 64 nt, Homo Sapiens
gauccuaguguuuuaauuaccugugugcagcuauuuuaaauagcauuuuacuugaauaauaugu

SEQ ID NO: 487456 - RNA, 64 nt, Homo Sapiens
aaugaaaaauuuuuaaaaaaagaaggaaaaauguuuuaaauacaaaaggaaaaacagacaaaaa

SEQ ID NO: 487457 - RNA, 64 nt, Homo Sapiens
gagcugguugacugagacgcacgaacuuuuuaauuuuaaauauauuuuuaggaaacucucgcag

SEQ ID NO: 487458 - RNA, 64 nt, Homo Sapiens
guauguaacagaacacauuucagauuguauuuaauuuaaauauuuguauauaagagcaaauguc

SEQ ID NO: 487459 - RNA, 64 nt, Homo Sapiens
uaagagcaaaugucugaauguggccugaaucaaguuuaaauauuguuggcucauacugauuaug

SEQ ID NO: 487460 - RNA, 64 nt, Homo Sapiens
uauucuuagggcuuuuguguaugucugacuuguuuuuaaauaacuuccucagcaaugcagaccu

SEQ ID NO: 487461 - RNA, 64 nt, Homo Sapiens
ucaaugauauugguagaaauaguaaaauacauccuuuaaauauauaucuaagcauauauuuuaa

SEQ ID NO: 487462 - RNA, 64 nt, Homo Sapiens
aaaauacagccuuugguucaguagauuuuaaugcuuuaaauagacugacgucgcauacccuuau

SEQ ID NO: 487463 - RNA, 64 nt, Homo Sapiens
guccucguaauaccauuuggauuuuauuucugaauuuaaauaguaaaauauuuaugaugcugau

SEQ ID NO: 487464 - RNA, 64 nt, Homo Sapiens
aggggucugagguuguuuuuacuuuauuguguuguuuaaauauuuuaaaaauaucuuuagcguu

SEQ ID NO: 487465 - RNA, 64 nt, Homo Sapiens
aacaacauugcacuuucuguauaugaaaucaauauuuaaauaacuuauuuuucuccauugcugu

SEQ ID NO: 487466 - RNA, 64 nt, Homo Sapiens
uuuuuaagcuugacaaaugcacugauuguuauacuuuaaauaacuaaaaaucugagaauccaca

SEQ ID NO: 487467 - RNA, 64 nt, Homo Sapiens
ugggaaauuuauuuucuacgcuauucaaagauauuuuaaauaauauuuuaaaaacaugaaauuu

SEQ ID NO: 487468 - RNA, 64 nt, Homo Sapiens
acgugacaguucuucacaauuccuuucaucauuuuuuaaauauuuuuuuuacugccuaugggcu

SEQ ID NO: 487469 - RNA, 64 nt, Homo Sapiens
uuucaugaugugguaacuacgaagugaugguagauuuaaauaauuuuuuauuuuuauuuuauau

SEQ ID NO: 487470 - RNA, 64 nt, Homo Sapiens
uuuuuagguccugacacugauccugccuuauuuuuuuaaauaagugaagucacuucaucuucuc

SEQ ID NO: 487471 - RNA, 64 nt, Homo Sapiens
aguuauucuaaggagaaaaaaaauugguauuuauuuuaaauauuaauuuagugauaugguaaug

SEQ ID NO: 487472 - RNA, 64 nt, Homo Sapiens
ucuuguauaguucauauucaacuuugaguuaucuuuuaaauaugaguuacuguaaugcaauuca

SEQ ID NO: 487473 - RNA, 64 nt, Homo Sapiens
ucuucugggaaguugguuuacucucucuuuuuuuuuuaaauaacugaguucuuucuccuucucu

SEQ ID NO: 487474 - RNA, 64 nt, Homo Sapiens
uuuuuaaaauuucagauguagcuuuauuuggauuuuuaaauacaaggaaauaaggaaauuguaa

SEQ ID NO: 487475 - RNA, 64 nt, Homo Sapiens
aauuuucgauuuuucuuuccacuucagauccauuuuuaaauaagagcucuuaagaaauacaagg

SEQ ID NO: 487476 - RNA, 64 nt, Homo Sapiens
uuauaacuuuuaaauggaaauucuguuuucucuuuuuaaauauuaaacuaagguuauuugaaug

SEQ ID NO: 487477 - RNA, 64 nt, Homo Sapiens
aaugucacaaguuuaauagaucuuguuuauucuuuuuaaauaaauaaaauaauaccauugauau

SEQ ID NO: 487478 - RNA, 64 nt, Homo Sapiens
auuuuaauacuuguuugacacuuaaaaacguucauuuaaauaaacccuuaacauggcucaauaa

SEQ ID NO: 487479 - RNA, 64 nt, Homo Sapiens
agaauacuuauuucucaguggccucaccagucauuuuaaauaguaaagacuaaucaauuguuuu

SEQ ID NO: 487480 - RNA, 64 nt, Homo Sapiens
gguugcaauugaacauauuaggaauacaggugguuuuaaauauauagaugcaaauugcagcacu

SEQ ID NO: 487481 - RNA, 64 nt, Homo Sapiens
guuuuaaauauauagaugcaaauugcagcacuacuuuaaauauuagauuaugucucacauagca

SEQ ID NO: 487482 - RNA, 64 nt, Homo Sapiens
aagaagggaaguuuucuaguauuguaugaaaauguuuaaauauuuucaaggaagcuaguacauu

SEQ ID NO: 487483 - RNA, 64 nt, Homo Sapiens
uucaaguucgaauuacaguugugagauugauuuauuuaaauaaaaauaugccuuugccaguuuu

SEQ ID NO: 487484 - RNA, 64 nt, Homo Sapiens
uugguuuauuuugaaaaacauggguauagaauuauuuaaauauuauuuuauuuauuuaaauauu

SEQ ID NO: 487485 - RNA, 64 nt, Homo Sapiens
uggguauagaauuauuuaaauauuauuuuauuuauuuaaauauuuauuaaauauauuuauuuau

SEQ ID NO: 487486 - RNA, 64 nt, Homo Sapiens
uaaauauauuuauuuauuuaaauguuauuauuacuuuaaauauuauuuuaaauauuuuggaaau

SEQ ID NO: 487487 - RNA, 64 nt, Homo Sapiens
uuuauuuaaauguuauuauuacuuuaaauauuauuuuaaauauuuuggaaauacugguauuuuu

SEQ ID NO: 487488 - RNA, 64 nt, Homo Sapiens
uaugucuccucuauuaagaguauuuaaaaucauauuuaaauaugaaucuauucaugcuaacauu

SEQ ID NO: 487489 - RNA, 64 nt, Homo Sapiens
cuuguguaaaagggcuucaagaauauauccaauuuuuaaauauuuuaauauaucuccuaucuga

SEQ ID NO: 487490 - RNA, 64 nt, Homo Sapiens
auuuaugaaauauuuaaaguuucuaaugugguauuuuaaauaaaguaucauaaauguaauaagu

SEQ ID NO: 487491 - RNA, 64 nt, Homo Sapiens
accaagacccccgucucuuuaaaaauauauauauuuuaaauauacuuaaauauauauuucuaau

SEQ ID NO: 487492 - RNA, 64 nt, Homo Sapiens
uuuuaaauauacuuaaauauauauuucuaauaucuuuaaauauauauauauauuuuaaagacca

SEQ ID NO: 487493 - RNA, 64 nt, Homo Sapiens
uuauaguauaaaguauuuauacuuauaccucucauuuaaauauuaagacaggaucauacacaug

SEQ ID NO: 487494 - RNA, 64 nt, Homo Sapiens
ucaucuuacaagucagguaauaaaugaucacaauuuuaaauaaugagauguauuuuuaucauag

SEQ ID NO: 487495 - RNA, 64 nt, Homo Sapiens
uccuguuguauaugucuauugaaugguuaagcaguuuaaauaauauaccuacucauuuuugugg

SEQ ID NO: 487496 - RNA, 64 nt, Homo Sapiens
ccuacucauuuuugugggaauuaaaaaaguuuucuuuaaauauauauuguagauaacuucugcu

SEQ ID NO: 487497 - RNA, 64 nt, Homo Sapiens
augaauguaaaagagaaagcugugacagcaaagauuuaaauaaguuucuaaauuauuucuucac

SEQ ID NO: 487498 - RNA, 64 nt, Homo Sapiens
cauuuucagacucaaauaaucaaucuuuuaauguuuuaaauaugagcuuggcacaaaguggagu

SEQ ID NO: 487499 - RNA, 64 nt, Homo Sapiens
auauauuagucgacuguguuuucaaaaguaaauuuuuaaauaaagaauuuauccauuuauaggc

SEQ ID NO: 487500 - RNA, 64 nt, Homo Sapiens
acuuguuauuuuggcauauucaaagaccucauucuuuaaauaaaaccccucauuucuuucugcc

SEQ ID NO: 487501 - RNA, 64 nt, Homo Sapiens
aacauauuuuucucacauugagaaaauuaucugauuuaaauacaaccuacuuuaaauuuuaggu

SEQ ID NO: 487502 - RNA, 64 nt, Homo Sapiens
auaugugagacugacaaaaacaucaacaagggaguuuaaauacuuuugugaauauuuuucauuc

SEQ ID NO: 487503 - RNA, 64 nt, Homo Sapiens
aucuauaguaugcuuuuugugguguccugcugaauuuaaauauuuauguguuuuuccuguuagg

SEQ ID NO: 487504 - RNA, 64 nt, Homo Sapiens
gaaagaaaacuuuugaugaugaaacaauaaagauuuuaaauaucuauuuuaguuuguggguguu

SEQ ID NO: 487505 - RNA, 64 nt, Homo Sapiens
uuuuuuuuuagauguuugauacauuuuaaguauuuuuaaauagaugaaaauucuaaaugauuuu

SEQ ID NO: 487506 - RNA, 64 nt, Homo Sapiens
aguccucaaaggcauuuaaguccaauagucaugcuuuaaauauggcuuuaaauuaugccaccaa

SEQ ID NO: 487507 - RNA, 64 nt, Homo Sapiens
gaauguggcuucuuauuuuggaggagcucuugcauuuaaauaccccagccaagaaaaauugcac

SEQ ID NO: 487508 - RNA, 64 nt, Homo Sapiens
uucugaagacaggugcuugaacuugucaguuuguuuuaaauaaauacaauaguugaaaauuuuu

SEQ ID NO: 487509 - RNA, 64 nt, Homo Sapiens
cauuuuuguaccaugacuguuugcaaauauuuaauuuaaauaaacaguugucaauauuaauuug

SEQ ID NO: 487510 - RNA, 64 nt, Homo Sapiens
cauuuuaaagcaguucuuuuuaaaacuauuuuauuuuaaauauacacagaaaaugggauugagu

SEQ ID NO: 487511 - RNA, 64 nt, Homo Sapiens
ugucacaccguaugaauaugugaugccuccccucuuuaaauaccagguuuauaaauagcuuuag

SEQ ID NO: 487512 - RNA, 64 nt, Homo Sapiens
caugauguggaaauaccauccuauuauauuugcuuuuaaauagguuuaugaccaggcauaguau

SEQ ID NO: 487513 - RNA, 64 nt, Homo Sapiens
uacuuauuuuuucugauuguuuagagguuugacuuuuaaauaauccagcaguuguugacaauug

SEQ ID NO: 487514 - RNA, 64 nt, Homo Sapiens
cccaaauagaccagaauugguacuuccaauuuucuuuaaauaaugaaggaaucugaaacacuug

SEQ ID NO: 487515 - RNA, 64 nt, Homo Sapiens
uauaucuaauaguacaaaauaaguuaaauauuuuuuuaaauauguuuaauuucuucauaaaaau

SEQ ID NO: 487516 - RNA, 64 nt, Homo Sapiens
aaaauauuguauuguaaaagccauuuagaggucauuuaaauaacagauauucauugcacauuaa

SEQ ID NO: 487517 - RNA, 64 nt, Homo Sapiens
auccuuugucuuuccauaugguuucuuuuaaguuuuuaaauauccaaagaaguuuuagaauagg

SEQ ID NO: 487518 - RNA, 64 nt, Homo Sapiens
ggaaaacuguuuaagcaaaauuuuuuuggggggauuuaaauacagcuuuuucagccacuggaac

SEQ ID NO: 487519 - RNA, 64 nt, Homo Sapiens
gaaagaauggagaaucuagaacaaacuacucuauuuuaaauaaguaacugaauccacuucuuaa

SEQ ID NO: 487520 - RNA, 64 nt, Homo Sapiens
gaauucagugucacuaguucguuacaaaaauuuuuuuaaauaaagagaagaggagguacugugu

SEQ ID NO: 487521 - RNA, 64 nt, Homo Sapiens
ugcaaauauauauaucauuauucccucaugaaauuuuaaauauacuagaauaguuuauuaccuu

SEQ ID NO: 487522 - RNA, 64 nt, Homo Sapiens
uuagugggaaaacuuuaagagacagauauuuacauuuaaauagaaugaaggacuccaacuagaa

SEQ ID NO: 487523 - RNA, 64 nt, Homo Sapiens
uuagguuauacauuagucaguguuugggggugucuuuaaauauaacauaucaauauaauuacag

SEQ ID NO: 487524 - RNA, 64 nt, Homo Sapiens
cuaacaucacugucauagaauuuugcauuuuacauuuaaauauggcauauuuaaaaauuaauca

SEQ ID NO: 487525 - RNA, 64 nt, Homo Sapiens
uauauuaaaguaucaaaauauuaauugaauauacuuuaaauauaugcuuuugucuauuuccuca

SEQ ID NO: 487526 - RNA, 64 nt, Homo Sapiens
gccuauguacucccaaaugaagauagcaccauuguuuaaauacccaguugauauuugguguuua

SEQ ID NO: 487527 - RNA, 64 nt, Homo Sapiens
ucuuuaaaaauaggucuuuuuuuucaaagccaucuuuaaauaguuguuguaaauaaaaguguug

SEQ ID NO: 487528 - RNA, 64 nt, Homo Sapiens
aauuuauaaaauauuuaugagauuuuuaucauguuuuaaauagguaguaccuuguauuuuuguu

SEQ ID NO: 487529 - RNA, 64 nt, Homo Sapiens
gaauuauuaaaaaucuuuaugaaacaaaagaccauuuaaauaguguauuguuguaaaacuucau

SEQ ID NO: 487530 - RNA, 64 nt, Homo Sapiens
auaugucuaaauacauauguuaucccuugauuuuuuuaaauaacugagagcucuauuuauuuau

SEQ ID NO: 487531 - RNA, 64 nt, Homo Sapiens
ucuuauucugcaaacauuagaccacuugauauucuuuaaauaugucauguacuuuucuuguguc

SEQ ID NO: 487532 - RNA, 64 nt, Homo Sapiens
gugugaacuucuucucugaccuuuucaauaauauuuuaaauacaguuuuucuuccucaggaaau

SEQ ID NO: 487533 - RNA, 64 nt, Homo Sapiens
uguauaugcuggguaguaugaacuccaaggcaauuuuaaauaggcagagagaaguuuauaguuu

SEQ ID NO: 487534 - RNA, 64 nt, Homo Sapiens
guuuuggacuguuuaguagucuuuguuuuauguuuuuaaauacagaaauugcuuucacaaauuu

SEQ ID NO: 487535 - RNA, 64 nt, Homo Sapiens
cuuuucuuacaaaaaaaaucuagaagacacuguguuuaaauagauauuuaaauguuuuugagau

SEQ ID NO: 487536 - RNA, 64 nt, Homo Sapiens
gggagggguauugagcauuuuuuuauugugguguuuuaaauaugaacuugaauuuccuauguau

SEQ ID NO: 487537 - RNA, 64 nt, Homo Sapiens
aguuuguaguauuuuaaagauuguuguguuuuuuuuuaaauaguucugauuucugaauguaaag

SEQ ID NO: 487538 - RNA, 64 nt, Homo Sapiens
uauggauuuguguauuuuuuaaaaauccuaaguuuuuaaauaacuuuuuauagacauguuuuuu

SEQ ID NO: 487539 - RNA, 64 nt, Homo Sapiens
cggagaauguauauugccuccaagaaauuuuauguuuaaauauggucauuuuuguucuuuacau

SEQ ID NO: 487540 - RNA, 64 nt, Homo Sapiens
aguaaauucucuugcauguuuccuggaaaaugcauuuaaauaauuaucuguauuggaaauaugu

SEQ ID NO: 487541 - RNA, 64 nt, Homo Sapiens
agcaaauaaacucacuauuuuucagcccucagauuuuaaauacacugugaggaguauaacuucu

SEQ ID NO: 487542 - RNA, 64 nt, Homo Sapiens
ccuauaauauuuuaucugaaggugagaauuaaguuuuaaauaaauuuguauuuugcauacucaa

SEQ ID NO: 487543 - RNA, 64 nt, Homo Sapiens
cuaaaugauggugcuuggugguacagaaaacauguuuaaauagcaagaagaggaagaaauucag

SEQ ID NO: 487544 - RNA, 64 nt, Homo Sapiens
augcauauugaucacuauaauucuaaaacaauuuuuuaaauaaaccagcagguugcuaaaagaa

SEQ ID NO: 487545 - RNA, 64 nt, Homo Sapiens
uagaagcuauuuauuaugagcuucuacagguauuuuuaaauagagcaagcauguugaauuuaaa

SEQ ID NO: 487546 - RNA, 64 nt, Homo Sapiens
cucucuaagacauucuccaaauugauuuuaucucuuuaaauaaaaacuuuaaauaaaaguauua

SEQ ID NO: 487547 - RNA, 63 nt, Homo Sapiens
ucuccaaauugauuuuaucucuuuaaauaaaaacuuuaaauaaaaguauuagaaauguuuucu

SEQ ID NO: 487548 - RNA, 64 nt, Homo Sapiens
cccucuguuuuuauaaguugccaucgaaaagugauuuaaauaagcagguuaucuuuauagauuu

SEQ ID NO: 487549 - RNA, 64 nt, Homo Sapiens
uuugcccugaauuugaacacucaacaucacuagauuuaaauauuuaguauauuuugauaguaaa

SEQ ID NO: 487550 - RNA, 64 nt, Homo Sapiens
uauuuauguaaaguauauguauuugagugcagaauuuaaauaaggcucuaccucaaagaccuuu

SEQ ID NO: 487551 - RNA, 64 nt, Homo Sapiens
uaagauuuaagauucuccuuacuacuauccuacguuuaaauaucuuugaaaguuuguauuaaau

SEQ ID NO: 487552 - RNA, 64 nt, Homo Sapiens
aaagaaacauguauaagaaaccagauuuaaguguuuuaaauaaaauguaaacaguuuuuauuug

SEQ ID NO: 487553 - RNA, 64 nt, Homo Sapiens
augaugugcuuguauaucgauuagcugugucacuuuuaaauaagaaguccacacaagcaagcca

SEQ ID NO: 487554 - RNA, 64 nt, Homo Sapiens
aaacaaacagacaaacaaaaaaaaacacuacuauuuuaaauaguggaacuuucagcccagcguu

SEQ ID NO: 487555 - RNA, 64 nt, Homo Sapiens
gcauuuaugaaggcuuaauaaauuguaaauaauuuuuaaauaaaaugaaaaugccuuuccugga

SEQ ID NO: 487556 - RNA, 64 nt, Homo Sapiens
aucaauaguaaagacuguucuuacacaaauaauuuuuaaauauaauuuacaauucaauauauaa

SEQ ID NO: 487557 - RNA, 64 nt, Homo Sapiens
ucuauuucccuuaucacuucuguuugguuuuguuuuuaaauagauuaaucuagacagaaauagc

SEQ ID NO: 487558 - RNA, 64 nt, Homo Sapiens
aggcacccuucccauugugcauagccaaguguucuuuaaauaggucaggggauuuuauaaacca

SEQ ID NO: 487559 - RNA, 64 nt, Homo Sapiens
aauuuuuuuaaaacccaagaaaaacauuuauucuuuuaaauaauuuuauaagauuggcaaugga

SEQ ID NO: 487560 - RNA, 64 nt, Homo Sapiens
ucauugacauacugugaucucucuguacaguguauuuaaauauugaaauccauuaaaaagcaau

SEQ ID NO: 487561 - RNA, 64 nt, Homo Sapiens
aaaaauucagaagaugaauuuucucauaaugcuuuuuaaauaaguuccuccauccuugaaucag

SEQ ID NO: 487562 - RNA, 64 nt, Homo Sapiens
caggaaauuagaaguguuagaauugauugaagauuuuaaauaaauaugauguacuuuguaaaaa

SEQ ID NO: 487563 - RNA, 64 nt, Homo Sapiens
gcaauaaguucauacuguguaaaauucauuuucuuuuaaauagaccaaaaaaaccaaauuggua

SEQ ID NO: 487564 - RNA, 64 nt, Homo Sapiens
aacuaauugucgagcacugaguuuuguuuuguuuuuuaaauaauucaguguuuaacaguuuuuu

SEQ ID NO: 487565 - RNA, 64 nt, Homo Sapiens
uuucagguaguuacaucauguuuucauuaauacuuuuaaauaccuacaggcuuucuagagaucu

SEQ ID NO: 487566 - RNA, 64 nt, Homo Sapiens
uuuacuuuggcagaguuuauaauuccaugcaguauuuaaauacaaaaagguucaggcuguuaac

SEQ ID NO: 487567 - RNA, 64 nt, Homo Sapiens
uuguaaaauccugcuaacuaaauugcucagcugauuuaaauaauaaaguuucauaucacucaug

SEQ ID NO: 487568 - RNA, 64 nt, Homo Sapiens
guuuacauaacuguaaguccauguuggaauaauuuuuaaauaauuuagcuuuaaaagaguauuu

SEQ ID NO: 487569 - RNA, 64 nt, Homo Sapiens
auuuuaagugaugcuguauucugaaucaacugucuuuaaauaaacuuuccaguccaaggcaggc

SEQ ID NO: 487570 - RNA, 64 nt, Homo Sapiens
gaaaaccuccuguuuagacugcuuuacuaagauuuuuaaauaguuuuugaaguugucaucaauu

SEQ ID NO: 487571 - RNA, 64 nt, Homo Sapiens
ugcuugggguaaauuuucauugucauauguggaauuuaaauauaccaucaucuacaaagaauuc

SEQ ID NO: 487572 - RNA, 64 nt, Homo Sapiens
uuuucuuaauguuguagagcauuuuguagagugguuuaaauaguugaaaauaaaguucagaaca

SEQ ID NO: 487573 - RNA, 64 nt, Homo Sapiens
cuaauuacauaaugaccgauuugagauagaggccuuuaaauacauuccaugcccuccccagaaa

SEQ ID NO: 487574 - RNA, 64 nt, Homo Sapiens
uucauuuugagguaacguucaguuuugcauuuuguuuaaauauugaaggccuagacaaagaacu

SEQ ID NO: 487575 - RNA, 64 nt, Homo Sapiens
aagaaaagaggauauauuuauuuaaauaauugauuuuaaauaggagacauucuuacuagcucaa

SEQ ID NO: 487576 - RNA, 64 nt, Homo Sapiens
ugauuuuaaauaggaagaaaucuuacuagcucaauuuaaauaaucuagcuucaagaguagacau

SEQ ID NO: 487577 - RNA, 64 nt, Homo Sapiens
auucauuuuuauuuaaaugccuuuugugauuucuuuuaaauacuaaaacagguucagauuucau

SEQ ID NO: 487578 - RNA, 64 nt, Homo Sapiens
uuuucaaaguacauaaaaucgaauuuuuaauguuuuuaaauauauaauauauguuuuaaauaua

SEQ ID NO: 487579 - RNA, 64 nt, Homo Sapiens
gaauuuuuaauguuuuuaaacauauaauauauguuuuaaauauauauuuaaguguacuaauuaa

SEQ ID NO: 487580 - RNA, 64 nt, Homo Sapiens
aauauguuucacacuauaguauuuuuuuuuguuuuuuaaauacuuauugauuuucccauuaaca

SEQ ID NO: 487581 - RNA, 64 nt, Homo Sapiens
cugcauuuacaugccuaguuguuacauacuguaauuuaaauaaaagguuuuaagaucaacuuuu

SEQ ID NO: 487582 - RNA, 64 nt, Homo Sapiens
uguacagauaguuuauaagcuucuuuacugcaaguuuaaauaguaauuuagcaauuuaaaaucu

SEQ ID NO: 487583 - RNA, 64 nt, Homo Sapiens
auauuuuaggaauucuaaacgcgugacuucucauuuuaaauaaauaaauuguauuagaaaauua

SEQ ID NO: 487584 - RNA, 64 nt, Homo Sapiens
acaaaauguguaauuugugacaaggcccaagggauuuaaauauaugcaugugcuucuuugauua

SEQ ID NO: 487585 - RNA, 64 nt, Homo Sapiens
auuuuguuuuucuguaauguugauguaacaauuuuuuaaauaaagauuugaaggaaaaaaauuu

SEQ ID NO: 487586 - RNA, 64 nt, Homo Sapiens
uauauuugugaaagaacuuuagccuauuuuaauauuuaaauauaauuuuauaaaaauccuaggu

SEQ ID NO: 487587 - RNA, 64 nt, Homo Sapiens
acaaagaaauuaauguaaauaagauuucuaacuguuuaaauaagacuuuauauaaauguuuaaa

SEQ ID NO: 487588 - RNA, 64 nt, Homo Sapiens
accucacuuuacagggauaagagugguguggcauuuuaaauacaaugguauguuauugccaggg

SEQ ID NO: 487589 - RNA, 64 nt, Homo Sapiens
uaacuacauuuaaaugaaacaacuguauuaauauuuuaaauauaauaguauuuuucuauuagau

SEQ ID NO: 487590 - RNA, 64 nt, Homo Sapiens
aagaucaaauaaguggaauugggauaucgaucacuuuaaauauuuaucuuuucuuuaugcuagg

SEQ ID NO: 487591 - RNA, 64 nt, Homo Sapiens
uuucuauuuuuauaauccauaaggauaugccuguuuuaaauaacauacauauuaacaauaucua

SEQ ID NO: 487592 - RNA, 64 nt, Homo Sapiens
uuuguugauauucaggccuucagaauuuaaggguuuuaaauauagcauucagauuguaauuggu

SEQ ID NO: 487593 - RNA, 64 nt, Homo Sapiens
agaaaacuguuaaauagggaagaacuacauuaaauuuaaauauucacauuaugccuguguuuga

SEQ ID NO: 487594 - RNA, 64 nt, Homo Sapiens
agcuuggacagaauuuuuuguauuuguaaauugguuuaaauacauggaauuuuauacagguuuu

SEQ ID NO: 487595 - RNA, 64 nt, Homo Sapiens
auggcuuuauuuacuuuggugacuguuuauaguuuuuaaauaaaagacugaacauuuucuugag

SEQ ID NO: 487596 - RNA, 64 nt, Homo Sapiens
agugaaaaagccucaguuuccauauuaaaaauguuuuaaauauuuugauugaauuaguaccaau

SEQ ID NO: 487597 - RNA, 64 nt, Homo Sapiens
uuuucagcacuucauucaauuaaaauacaugaauuuuaaauauuuuacaugaugugaauaggca

SEQ ID NO: 487598 - RNA, 64 nt, Homo Sapiens
aaauuauaucaggcuuuaccgguuuuuuuaguuguuuaaauaaguaauauuuucaaaagaauaa

SEQ ID NO: 487599 - RNA, 64 nt, Homo Sapiens
uuccuggaaguggacacauuuuacaaaaacguuuuuuaaauacacgccagcucuucgagaagca

SEQ ID NO: 487600 - RNA, 64 nt, Homo Sapiens
agggaacacacuuucagaaccacugcuuuaauauuuuaaauaagauaauaugugaggugucaua

SEQ ID NO: 487601 - RNA, 64 nt, Homo Sapiens
aagccuuuuuaaaauuugguacauuuuucuauuguuuaaauagagguaccaccaucuuacugua

SEQ ID NO: 487602 - RNA, 64 nt, Homo Sapiens
uagguuuuuacugauuauuucacuaccuacauuuuuuaaauagcugaucuuacccaugaaugug

SEQ ID NO: 487603 - RNA, 64 nt, Homo Sapiens
gaauccuuugucuucuaaauuuaaaaauaagaguuuuaaauacucaauacuuuuauaacuguuc

SEQ ID NO: 487604 - RNA, 64 nt, Homo Sapiens
uuccuaaaccaaaacuguaauucuuggauccaaauuuaaauaucguuucagcaguuaaugugcu

SEQ ID NO: 487605 - RNA, 64 nt, Homo Sapiens
ccauuguuaacugaauguuaagaaaacuauuuuuuuuaaauauuccacaaguuacaauuugaaa

SEQ ID NO: 487606 - RNA, 64 nt, Homo Sapiens
uuucuaaccacagagaauuuuggucuguggcuaguuuaaauaugggaugaaugcagaucuaguu

SEQ ID NO: 487607 - RNA, 64 nt, Homo Sapiens
aguuacuucauuauauuuuggccuuguaccauuuuuuaaauagaaagcauuuuaaauaauaccu

SEQ ID NO: 487608 - RNA, 64 nt, Homo Sapiens
accugccuuguaccauuuuuaguuacuaaagcauuuuaaauaauauuucuuuuuauggaaaaug

SEQ ID NO: 487609 - RNA, 64 nt, Homo Sapiens
uuucuuuuaacguaaagcuggugcuauuucuguauuuaaauaacucucaauuccuuuuuguaag

SEQ ID NO: 487610 - RNA, 64 nt, Homo Sapiens
uagcuguagcgccaucagaucccugcauuuuuuauuuaaauauuccaguuuccuucacuacaug

SEQ ID NO: 487611 - RNA, 64 nt, Homo Sapiens
cacuauauaguauaguuguuccagaaaucuucauuuuaaauagaaguguuuacaaugccuuuuu

SEQ ID NO: 487612 - RNA, 64 nt, Homo Sapiens
uaaauuauuugugcaaaauuugaaauguuuuuuauuuaaauauuagaaauagcacaaagucaug

SEQ ID NO: 487613 - RNA, 64 nt, Homo Sapiens
agcaaauuucaugcacugauuaaaauaggauuauuuuaaauacaaaaggcauuuuauaugaauu

SEQ ID NO: 487614 - RNA, 64 nt, Homo Sapiens
uaguuaaucuauuaauacugacucagugucugccuuuaaauauaaaugauauguugaaaacuua

SEQ ID NO: 487615 - RNA, 64 nt, Homo Sapiens
aauuaugaagaauaugaguccuuagacugcaacuuuuaaauaaauaaucauguuaaaguuaaga

SEQ ID NO: 487616 - RNA, 64 nt, Homo Sapiens
aaguaccuuggccuauaguguuauaaaccuuuuauuuaaauacaaauaugaauuuuagacuucc

SEQ ID NO: 487617 - RNA, 64 nt, Homo Sapiens
uuuuuaaucuacuacuucagcaucuaugaauuaauuuaaauauaauaugccuuuuuuccccagc

SEQ ID NO: 487618 - RNA, 64 nt, Homo Sapiens
gccugaaccagggaaaagaauuuugaacaaagaguuuaaauaaaacuaucacucuguucauuuu

SEQ ID NO: 487619 - RNA, 64 nt, Homo Sapiens
guuuuaaccuuuauguguaaaaaguuuuuaaaauuuuaaauaugauuuuggcuuuauguaauau

SEQ ID NO: 487620 - RNA, 64 nt, Homo Sapiens
auauuuaaugcacuauuaaaguuauacuucuuaauuuaaauaaagaacaaauguaugugauuuu

SEQ ID NO: 487621 - RNA, 64 nt, Homo Sapiens
aaauguaaacaaauuuguuuuuuaaaaugucccauuuaaauaugauaugucuuuuuacucaggg

SEQ ID NO: 487622 - RNA, 64 nt, Homo Sapiens
aaguuuacagcaugauaguccaaguggugauaacuuuaaauaaaacucaaauuuuuacuguuug

SEQ ID NO: 487623 - RNA, 64 nt, Homo Sapiens
gacuucagaaucccaacuacaauacaaauguuuauuuaaauaaagaagaaagcuauuguacaaa

SEQ ID NO: 487624 - RNA, 64 nt, Homo Sapiens
uucuaaugaauauuuguagaaucucauaaaacaguuuaaauacaagcuuaaguggcuuaugaau

SEQ ID NO: 487625 - RNA, 64 nt, Homo Sapiens
uaacaaaaccaagucaaacuugguguauuuuuauuuuaaauauuaacucuaaagcaggauuacu

SEQ ID NO: 487626 - RNA, 64 nt, Homo Sapiens
uugauaagauuuucuguuucugugaaacaauuauuuuaaauauuuuucuuuuaaaaauaacuuu

SEQ ID NO: 487627 - RNA, 64 nt, Homo Sapiens
uucucucagaagaucauguugugggaaucuuuuuuuuaaauagugaaauauugaggcagcaauu

SEQ ID NO: 487628 - RNA, 64 nt, Homo Sapiens
ggaaguuccaaauuuguagccaguuccaaacaaauuuaaauauugaguugagaccuguauggaa

SEQ ID NO: 487629 - RNA, 64 nt, Homo Sapiens
uacugaagauaauuuuugaaauguaaaaauuagauuuaaauaguauauuuuaaaugacagaacu

SEQ ID NO: 487630 - RNA, 64 nt, Homo Sapiens
uugcaucucugcagaagaaauuuauuuuaaauuguuuaaauaucuggaaauacuuuuagcuauc

SEQ ID NO: 487631 - RNA, 64 nt, Homo Sapiens
uuguagcuuaauauuaaagauggauuuaaauaauuuuaaauaauacauuuauuugagaaaacac

SEQ ID NO: 487632 - RNA, 64 nt, Homo Sapiens
uuuaaauaauuuguagcuuagagaaaacacuggauuuaaauaauuucuuccuguacauuuauuu

SEQ ID NO: 487633 - RNA, 64 nt, Homo Sapiens
ucaaauguuaacaaaagagcuugcaguuaaggacuuuaaauaaauggaaaauguucuugaucau

SEQ ID NO: 487634 - RNA, 64 nt, Homo Sapiens
aaaaauaauaccagauuuuauaaaaauauuuugauuuaaauaacuuuaucaaugugauuguaau

SEQ ID NO: 487635 - RNA, 64 nt, Homo Sapiens
auaaguggucaugaaauuuuuuuaaauuugauuuuuuaaauauuuucaauguauggucauacuu

SEQ ID NO: 487636 - RNA, 64 nt, Homo Sapiens
aagugaaaauuuagaaaggcaucacuuauaaaauuuuaaauaucuuaauuugaugacauaauaa

SEQ ID NO: 487637 - RNA, 64 nt, Homo Sapiens
uuuuuuauagaauucuaugugcaacucugauucauuuaaauaugacauccuuguucuuuauuua

SEQ ID NO: 487638 - RNA, 64 nt, Homo Sapiens
uggagacaaaggacaagguguuauaaauuucucuuuuaaauagaauugcagccuuuuuguucac

SEQ ID NO: 487639 - RNA, 64 nt, Homo Sapiens
ggaaaagcaguauuguccugagguuguaguuuuuuuuaaauaaauuaugaccaauacagucacu

SEQ ID NO: 487640 - RNA, 64 nt, Homo Sapiens
ucucagauauuaagaaguugugcauuuagaauauuuuaaauaguagccaaaaucuuuauuuuua

SEQ ID NO: 487641 - RNA, 64 nt, Homo Sapiens
caauucagugaguuuugauauaaaauguuccuacuuuaaauauagagguguaauuuauuuacaa

SEQ ID NO: 487642 - RNA, 64 nt, Homo Sapiens
cgugagcguguucaucaugucaaauauguuuauauuuaaauauauguacuuacuuuuuaaaguc

SEQ ID NO: 487643 - RNA, 64 nt, Homo Sapiens
gaguauguuagauuugauuaucugauaaugauuauuuaaauauuccuaucugcuuauaaaaugg

SEQ ID NO: 487644 - RNA, 64 nt, Homo Sapiens
cauuuuaaaaggguaaaacaugacuauacagaaauuuaaauagaaauaguguauauacauauaa

SEQ ID NO: 487645 - RNA, 64 nt, Homo Sapiens
uuuuuucaauaagcuauuuuuuuucuuuucuuauuuuaaauagagagagagucuugcuauguuu

SEQ ID NO: 487646 - RNA, 64 nt, Homo Sapiens
agaacugggccagagccaguccauugccuguuuuuuuaaauaagguuuuacugagcacagccac

SEQ ID NO: 487647 - RNA, 64 nt, Homo Sapiens
aauauaagaaaauaaaacuuaggggauauacagauuuaaauauucaaaucucccugcuccccug

SEQ ID NO: 487648 - RNA, 64 nt, Homo Sapiens
uaugucuaauaagugcugguguccuuuuaaaguauuuaaauauauauguugcuguugcugaaua

SEQ ID NO: 487649 - RNA, 64 nt, Homo Sapiens
aaggcuguguauaguccauuucccaggucugagauuuaaauauauuuguaauucuugugucacu

SEQ ID NO: 487650 - RNA, 64 nt, Homo Sapiens
ucuuuuaguauguaaaaugaaauaguaccuugaguuuaaauagaaugcauuuaggcauuguaga

SEQ ID NO: 487651 - RNA, 64 nt, Homo Sapiens
guuuaauauugauugggggugagaugauaagcuguuuaaauagucauagauacagacaaggcaa

SEQ ID NO: 487652 - RNA, 64 nt, Homo Sapiens
acccaaauuguguaaaaaugagccaguuuuuuuuuuuaaauagaggcuccauauuuaaagauag

SEQ ID NO: 487653 - RNA, 64 nt, Homo Sapiens
auguuugugaacuaucuaaguuuugccacaauuauuuaaauauuuuauuuuuguuaaaacagga

SEQ ID NO: 487654 - RNA, 64 nt, Homo Sapiens
guguugcauuuacacaguuguauuuuuaaucacuuuuaaauaaugaagaaauaguacgacaacu

SEQ ID NO: 487655 - RNA, 64 nt, Homo Sapiens
gaaccuuuugagaugaauuaauguaagaauauuuuuuaaauaggcuuacugucaaauugcaacu

SEQ ID NO: 487656 - RNA, 64 nt, Homo Sapiens
gcuccuugguuuuuuacuucugcacuuaaauuuuuuuaaauaacaugaugaugguacauuuucc

SEQ ID NO: 487657 - RNA, 64 nt, Homo Sapiens
caggcauggguucagcuuaaaagccgcuuuguuuuuuaaauauggaguuugauacuauuaaaau

SEQ ID NO: 487658 - RNA, 64 nt, Homo Sapiens
uauuuuuucucaacuaauuuaugaaggcuuauauuuuaaauaaugagaaauauuguacaauaau

SEQ ID NO: 487659 - RNA, 64 nt, Homo Sapiens
caacaugcaguuaaaaugcaacuagaaaacuaauuuuaaauauuguuaguuuuaauauuccuga

SEQ ID NO: 487660 - RNA, 64 nt, Homo Sapiens
auacguuugcuuuuucagaaacucuagcauucucuuuaaauacugacgcaauccuuaauggaaa

SEQ ID NO: 487661 - RNA, 64 nt, Homo Sapiens
cuuacuugcugccuuuuuuuuuucuugguacacauuuaaauaaaguaauccuuaaccugugcug

SEQ ID NO: 487662 - RNA, 64 nt, Homo Sapiens
aacaugucagcagagcauaggcagaauaaaaugguuuaaauaccccacagcaaauagaguaacu

SEQ ID NO: 487663 - RNA, 64 nt, Homo Sapiens
uugaacuuguuaauuagaaucagauaaaaacagcuuuaaauaauuacauaauggacgcaaauga

SEQ ID NO: 487664 - RNA, 64 nt, Homo Sapiens
aaaaacaguauguuuucaguuuuggccccauuauuuuaaauagguuugguuuguauuauuuuua

SEQ ID NO: 487665 - RNA, 64 nt, Homo Sapiens
acaaacacauacacacaacacuaagugccuagacuuuaaauagaucuagcaauuggaaaguuag

SEQ ID NO: 487666 - RNA, 64 nt, Homo Sapiens
uuuuacauaauugcauuccuacauucuuguaaaauuuaaauagcuaccauuggcaaucugcuuu

SEQ ID NO: 487667 - RNA, 64 nt, Homo Sapiens
uuuuuaagauaaaggcacaauaucuuuguuuuuguuuaaauauauuuaugggaaaauucaauau

SEQ ID NO: 487668 - RNA, 64 nt, Homo Sapiens
agucugauugauacaguuugaaugucagaaccuuuuuaaauaauaaacaaucuagcagagaauu

SEQ ID NO: 487669 - RNA, 64 nt, Homo Sapiens
uggccaaguguaauuucuuaaaauuuagcauuacuuuaaauagccagcauguaauacaaguaac

SEQ ID NO: 487670 - RNA, 64 nt, Homo Sapiens
uuaacaguuugcuauagcuuacugcuuaacuaauuuuaaauaaggaaauaaguauguuagaugc

SEQ ID NO: 487671 - RNA, 64 nt, Homo Sapiens
uggaaauguuaccuuugauuuucuuauaaaggaguuuaaauaggauuuuuaaauaauguaguaa

SEQ ID NO: 487672 - RNA, 64 nt, Homo Sapiens
uuugauuuucuuauaaaggaguuuaaauaggauuuuuaaauaauguaguaacacuccugauaca

SEQ ID NO: 487673 - RNA, 64 nt, Homo Sapiens
uccuauuugcaaauuagaauuccugaaguuggaauuuaaauaauggcaggcagcucaucucaug

SEQ ID NO: 487674 - RNA, 64 nt, Homo Sapiens
cacacuuggacucuuuucaauuucuauuauuauuuuuaaauaauuauaaaagcuguguuauugu

SEQ ID NO: 487675 - RNA, 63 nt, Homo Sapiens
aauguuugugugugcuuauaaauaaaauaaauguuuuaaauauucuaaaauuuaaauauguau

SEQ ID NO: 487676 - RNA, 64 nt, Homo Sapiens
uauaauaaaauaaauguuuuauaacuuucuaaaauuuaaauauggaggaauguacaucuaccua

SEQ ID NO: 487677 - RNA, 64 nt, Homo Sapiens
uaaaauguuacucuuuuguaauuugcuucugauuuuuaaauaaauucacauacuauuuugccau

SEQ ID NO: 487678 - RNA, 64 nt, Homo Sapiens
accuucucuggaaaauuauucagugagcauuacuuuuaaauaggaaguguggauguggggaagc

SEQ ID NO: 487679 - RNA, 64 nt, Homo Sapiens
uacaaauagaauuauuacuucuaguugacuuuuuuuuaaauauacauuuugcucaguagugugu

SEQ ID NO: 487680 - RNA, 64 nt, Homo Sapiens
uaccgaaguuuuauaucuuagaauuuuauauuuauuuaaauauuuaccuugcuuaccuugaugg

SEQ ID NO: 487681 - RNA, 64 nt, Homo Sapiens
guuauuuguguuagcauguaauggguuuacuauguuuaaauaaguuaauacuuuaaaaauuuuc

SEQ ID NO: 487682 - RNA, 64 nt, Homo Sapiens
uaaggaguaacugaauugaaucaaccaguuugcauuuaaauaaaagaacaggcucaguggucuu

SEQ ID NO: 487683 - RNA, 64 nt, Homo Sapiens
uaaaugcuuaaaacgucaaucaacaaaacuuuguuuuaaauauuguaauuguggagaaaaguaa

SEQ ID NO: 487684 - RNA, 64 nt, Homo Sapiens
cagcuuauuagagugugggaauagggaucuaaauuuuaaauaaaauuauauauauauauaaauu

SEQ ID NO: 487685 - RNA, 64 nt, Homo Sapiens
aaaaauaaaacaccuuguacuuuauuuucuauaauuuaaauauaugcuaagucuuauauauugu

SEQ ID NO: 487686 - RNA, 64 nt, Homo Sapiens
aaaaagcuuuuuuugaaucaucaagucuuucacauuuaaauaaaguguuugaaagcuuuauuua

SEQ ID NO: 487687 - RNA, 64 nt, Homo Sapiens
ugcaauggauuaaaaaugauuuuguuuuagauguuuuaaauagucuaaaaggcucauuuuuaua

SEQ ID NO: 487688 - RNA, 64 nt, Homo Sapiens
gcauaccauuucuuccugacuuacuuuuuuuuuuuuuaaauagggccaaucuuccauauuaguu

SEQ ID NO: 487689 - RNA, 64 nt, Homo Sapiens
auuuguuaugcauuuuuaaguuuucugguaaugguuuaaauaucuaaguagacucuucauuuac

SEQ ID NO: 487690 - RNA, 64 nt, Homo Sapiens
uaaucauuuaaccaaagaaguuuuuuucaagugauuuaaauaguuguauauuuuguauuaccuc

SEQ ID NO: 487691 - RNA, 64 nt, Homo Sapiens
cuaaauuaauuuuuaggggaacaguuauuucuuguuuaaauaaaucaagggaaacuuuccauuu

SEQ ID NO: 487692 - RNA, 64 nt, Homo Sapiens
gcaaaaguccugaugcuaaagucaauugguugucuuuaaauauuuguaacuuccuccccuuucu

SEQ ID NO: 487693 - RNA, 64 nt, Homo Sapiens; identical to SEQ ID NO: 293419

SEQ ID NO: 487694 - RNA, 64 nt, Homo Sapiens; identical to SEQ ID NO: 293420

SEQ ID NO: 487695 - RNA, 64 nt, Homo Sapiens; identical to SEQ ID NO: 293421

SEQ ID NO: 487696 - RNA, 64 nt, Homo Sapiens; identical to SEQ ID NO: 293422

SEQ ID NO: 487697 - RNA, 64 nt, Homo Sapiens; identical to SEQ ID NO: 293423

SEQ ID NO: 487698 - RNA, 64 nt, Homo Sapiens; identical to SEQ ID NO: 293424

SEQ ID NO: 487699 - RNA, 64 nt, Homo Sapiens; identical to SEQ ID NO: 293425

SEQ ID NO: 487700 - RNA, 64 nt, Homo Sapiens; identical to SEQ ID NO: 293426

SEQ ID NO: 487701 - RNA, 64 nt, Homo Sapiens; identical to SEQ ID NO: 293427

SEQ ID NO: 487702 - RNA, 64 nt, Homo Sapiens; identical to SEQ ID NO: 293428

SEQ ID NO: 487703 - RNA, 64 nt, Homo Sapiens; identical to SEQ ID NO: 293429

SEQ ID NO: 487704 - RNA, 64 nt, Homo Sapiens; identical to SEQ ID NO: 293430

SEQ ID NO: 487705 - RNA, 64 nt, Homo Sapiens; identical to SEQ ID NO: 293431

SEQ ID NO: 487706 - RNA, 64 nt, Homo Sapiens; identical to SEQ ID NO: 293432

SEQ ID NO: 487707 - RNA, 64 nt, Homo Sapiens; identical to SEQ ID NO: 293433

SEQ ID NO: 487708 - RNA, 64 nt, Homo Sapiens; identical to SEQ ID NO: 293434

SEQ ID NO: 487709 - RNA, 64 nt, Homo Sapiens; identical to SEQ ID NO: 293435

SEQ ID NO: 487710 - RNA, 64 nt, Homo Sapiens; identical to SEQ ID NO: 293436

SEQ ID NO: 487711 - RNA, 64 nt, Homo Sapiens; identical to SEQ ID NO: 293437

SEQ ID NO: 487712 - RNA, 64 nt, Homo Sapiens; identical to SEQ ID NO: 293438

SEQ ID NO: 487713 - RNA, 64 nt, Homo Sapiens; identical to SEQ ID NO: 293439

SEQ ID NO: 487714 - RNA, 64 nt, Homo Sapiens; identical to SEQ ID NO: 293440

SEQ ID NO: 487715 - RNA, 64 nt, Homo Sapiens; identical to SEQ ID NO: 293441

SEQ ID NO: 487716 - RNA, 64 nt, Homo Sapiens; identical to SEQ ID NO: 293442

SEQ ID NO: 487717 - RNA, 64 nt, Homo Sapiens; identical to SEQ ID NO: 293443

SEQ ID NO: 487718 - RNA, 64 nt, Homo Sapiens; identical to SEQ ID NO: 293444

SEQ ID NO: 487719 - RNA, 64 nt, Homo Sapiens; identical to SEQ ID NO: 293445

SEQ ID NO: 487720 - RNA, 64 nt, Homo Sapiens; identical to SEQ ID NO: 293446

SEQ ID NO: 487721 - RNA, 64 nt, Homo Sapiens; identical to SEQ ID NO: 293447

SEQ ID NO: 487722 - RNA, 64 nt, Homo Sapiens; identical to SEQ ID NO: 293448

SEQ ID NO: 487723 - RNA, 64 nt, Homo Sapiens; identical to SEQ ID NO: 293449

SEQ ID NO: 487724 - RNA, 64 nt, Homo Sapiens; identical to SEQ ID NO: 293450

SEQ ID NO: 487725 - RNA, 64 nt, Homo Sapiens; identical to SEQ ID NO: 293451

SEQ ID NO: 487726 - RNA, 64 nt, Homo Sapiens; identical to SEQ ID NO: 293452

SEQ ID NO: 487727 - RNA, 64 nt, Homo Sapiens; identical to SEQ ID NO: 293453

SEQ ID NO: 487728 - RNA, 64 nt, Homo Sapiens; identical to SEQ ID NO: 293454

SEQ ID NO: 487729 - RNA, 64 nt, Homo Sapiens; identical to SEQ ID NO: 293455

SEQ ID NO: 487730 - RNA, 64 nt, Homo Sapiens; identical to SEQ ID NO: 293456

SEQ ID NO: 487731 - RNA, 64 nt, Homo Sapiens; identical to SEQ ID NO: 293457

SEQ ID NO: 487732 - RNA, 64 nt, Homo Sapiens; identical to SEQ ID NO: 293458

SEQ ID NO: 487733 - RNA, 64 nt, Homo Sapiens; identical to SEQ ID NO: 293459

SEQ ID NO: 487734 - RNA, 64 nt, Homo Sapiens; identical to SEQ ID NO: 293460

SEQ ID NO: 487735 - RNA, 64 nt, Homo Sapiens; identical to SEQ ID NO: 288961

SEQ ID NO: 487736 - RNA, 64 nt, Homo Sapiens; identical to SEQ ID NO: 288962

SEQ ID NO: 487737 - RNA, 64 nt, Homo Sapiens; identical to SEQ ID NO: 288963

SEQ ID NO: 487738 - RNA, 64 nt, Homo Sapiens; identical to SEQ ID NO: 288964

SEQ ID NO: 487739 - RNA, 64 nt, Homo Sapiens; identical to SEQ ID NO: 288965

SEQ ID NO: 487740 - RNA, 64 nt, Homo Sapiens; identical to SEQ ID NO: 288966

SEQ ID NO: 487741 - RNA, 64 nt, Homo Sapiens; identical to SEQ ID NO: 288967

SEQ ID NO: 487742 - RNA, 64 nt, Homo Sapiens; identical to SEQ ID NO: 288968

SEQ ID NO: 487743 - RNA, 64 nt, Homo Sapiens; identical to SEQ ID NO: 288969

SEQ ID NO: 487744 - RNA, 64 nt, Homo Sapiens; identical to SEQ ID NO: 288970

SEQ ID NO: 487745 - RNA, 64 nt, Homo Sapiens; identical to SEQ ID NO: 288971

SEQ ID NO: 487746 - RNA, 64 nt, Homo Sapiens; identical to SEQ ID NO: 288972

SEQ ID NO: 487747 - RNA, 64 nt, Homo Sapiens; identical to SEQ ID NO: 288973

SEQ ID NO: 487748 - RNA, 64 nt, Homo Sapiens; identical to SEQ ID NO: 288974

SEQ ID NO: 487749 - RNA, 64 nt, Homo Sapiens; identical to SEQ ID NO: 288975

SEQ ID NO: 487750 - RNA, 64 nt, Homo Sapiens; identical to SEQ ID NO: 288976

SEQ ID NO: 487751 - RNA, 64 nt, Homo Sapiens; identical to SEQ ID NO: 288977

SEQ ID NO: 487752 - RNA, 64 nt, Homo Sapiens; identical to SEQ ID NO: 288978

SEQ ID NO: 487753 - RNA, 64 nt, Homo Sapiens; identical to SEQ ID NO: 288979

SEQ ID NO: 487754 - RNA, 52 nt, Homo Sapiens; identical to SEQ ID NO: 69449

SEQ ID NO: 487755 - RNA, 64 nt, Homo Sapiens; identical to SEQ ID NO: 288981

SEQ ID NO: 487756 - RNA, 64 nt, Homo Sapiens; identical to SEQ ID NO: 288982

SEQ ID NO: 487757 - RNA, 64 nt, Homo Sapiens; identical to SEQ ID NO: 288983

SEQ ID NO: 487758 - RNA, 64 nt, Homo Sapiens; identical to SEQ ID NO: 288984

SEQ ID NO: 487759 - RNA, 64 nt, Homo Sapiens; identical to SEQ ID NO: 288985

SEQ ID NO: 487760 - RNA, 64 nt, Homo Sapiens; identical to SEQ ID NO: 288986

SEQ ID NO: 487761 - RNA, 64 nt, Homo Sapiens; identical to SEQ ID NO: 288987

SEQ ID NO: 487762 - RNA, 64 nt, Homo Sapiens; identical to SEQ ID NO: 288988

SEQ ID NO: 487763 - RNA, 64 nt, Homo Sapiens; identical to SEQ ID NO: 288989

SEQ ID NO: 487764 - RNA, 64 nt, Homo Sapiens; identical to SEQ ID NO: 288990

SEQ ID NO: 487765 - RNA, 64 nt, Homo Sapiens; identical to SEQ ID NO: 288991

SEQ ID NO: 487766 - RNA, 64 nt, Homo Sapiens; identical to SEQ ID NO: 288992

SEQ ID NO: 487767 - RNA, 64 nt, Homo Sapiens; identical to SEQ ID NO: 288993

SEQ ID NO: 487768 - RNA, 64 nt, Homo Sapiens; identical to SEQ ID NO: 288994

SEQ ID NO: 487769 - RNA, 64 nt, Homo Sapiens; identical to SEQ ID NO: 288995

SEQ ID NO: 487770 - RNA, 64 nt, Homo Sapiens; identical to SEQ ID NO: 288996

SEQ ID NO: 487771 - RNA, 64 nt, Homo Sapiens; identical to SEQ ID NO: 288997

SEQ ID NO: 487772 - RNA, 64 nt, Homo Sapiens; identical to SEQ ID NO: 288998

SEQ ID NO: 487773 - RNA, 64 nt, Homo Sapiens; identical to SEQ ID NO: 288999

SEQ ID NO: 487774 - RNA, 64 nt, Homo Sapiens; identical to SEQ ID NO: 289000

SEQ ID NO: 487775 - RNA, 64 nt, Homo Sapiens; identical to SEQ ID NO: 289001

SEQ ID NO: 487776 - RNA, 64 nt, Homo Sapiens; identical to SEQ ID NO: 289002

SEQ ID NO: 487777 - RNA, 64 nt, Homo Sapiens; identical to SEQ ID NO: 289003

SEQ ID NO: 487778 - RNA, 64 nt, Homo Sapiens; identical to SEQ ID NO: 289004

SEQ ID NO: 487779 - RNA, 64 nt, Homo Sapiens; identical to SEQ ID NO: 289005

SEQ ID NO: 487780 - RNA, 64 nt, Homo Sapiens; identical to SEQ ID NO: 289006

SEQ ID NO: 487781 - RNA, 64 nt, Homo Sapiens; identical to SEQ ID NO: 289007

SEQ ID NO: 487782 - RNA, 64 nt, Homo Sapiens; identical to SEQ ID NO: 289008

SEQ ID NO: 487783 - RNA, 64 nt, Homo Sapiens; identical to SEQ ID NO: 225411

SEQ ID NO: 487784 - RNA, 64 nt, Homo Sapiens; identical to SEQ ID NO: 225412

SEQ ID NO: 487785 - RNA, 64 nt, Homo Sapiens; identical to SEQ ID NO: 225413

SEQ ID NO: 487786 - RNA, 64 nt, Homo Sapiens; identical to SEQ ID NO: 225414

SEQ ID NO: 487787 - RNA, 64 nt, Homo Sapiens; identical to SEQ ID NO: 225415

SEQ ID NO: 487788 - RNA, 64 nt, Homo Sapiens; identical to SEQ ID NO: 225416

SEQ ID NO: 487789 - RNA, 64 nt, Homo Sapiens; identical to SEQ ID NO: 225417

SEQ ID NO: 487790 - RNA, 64 nt, Homo Sapiens; identical to SEQ ID NO: 225418

SEQ ID NO: 487791 - RNA, 64 nt, Homo Sapiens; identical to SEQ ID NO: 225419

SEQ ID NO: 487792 - RNA, 64 nt, Homo Sapiens; identical to SEQ ID NO: 225420

SEQ ID NO: 487793 - RNA, 64 nt, Homo Sapiens; identical to SEQ ID NO: 225421

SEQ ID NO: 487794 - RNA, 64 nt, Homo Sapiens; identical to SEQ ID NO: 225422

SEQ ID NO: 487795 - RNA, 64 nt, Homo Sapiens; identical to SEQ ID NO: 225423

SEQ ID NO: 487796 - RNA, 64 nt, Homo Sapiens; identical to SEQ ID NO: 225424

SEQ ID NO: 487797 - RNA, 64 nt, Homo Sapiens; identical to SEQ ID NO: 225425

SEQ ID NO: 487798 - RNA, 64 nt, Homo Sapiens; identical to SEQ ID NO: 225426

SEQ ID NO: 487799 - RNA, 64 nt, Homo Sapiens; identical to SEQ ID NO: 225427

SEQ ID NO: 487800 - RNA, 64 nt, Homo Sapiens; identical to SEQ ID NO: 297865

SEQ ID NO: 487801 - RNA, 64 nt, Homo Sapiens; identical to SEQ ID NO: 297866

SEQ ID NO: 487802 - RNA, 64 nt, Homo Sapiens; identical to SEQ ID NO: 297867

SEQ ID NO: 487803 - RNA, 64 nt, Homo Sapiens; identical to SEQ ID NO: 297868

SEQ ID NO: 487804 - RNA, 64 nt, Homo Sapiens; identical to SEQ ID NO: 297869

SEQ ID NO: 487805 - RNA, 64 nt, Homo Sapiens; identical to SEQ ID NO: 297870

SEQ ID NO: 487806 - RNA, 64 nt, Homo Sapiens; identical to SEQ ID NO: 297871

SEQ ID NO: 487807 - RNA, 64 nt, Homo Sapiens; identical to SEQ ID NO: 297872

SEQ ID NO: 487808 - RNA, 64 nt, Homo Sapiens; identical to SEQ ID NO: 297873

SEQ ID NO: 487809 - RNA, 64 nt, Homo Sapiens; identical to SEQ ID NO: 297874

SEQ ID NO: 487810 - RNA, 64 nt, Homo Sapiens; identical to SEQ ID NO: 297875

SEQ ID NO: 487811 - RNA, 64 nt, Homo Sapiens; identical to SEQ ID NO: 297876

SEQ ID NO: 487812 - RNA, 64 nt, Homo Sapiens; identical to SEQ ID NO: 297877

SEQ ID NO: 487813 - RNA, 64 nt, Homo Sapiens; identical to SEQ ID NO: 297878

SEQ ID NO: 487814 - RNA, 64 nt, Homo Sapiens; identical to SEQ ID NO: 297879

SEQ ID NO: 487815 - RNA, 64 nt, Homo Sapiens; identical to SEQ ID NO: 297880

SEQ ID NO: 487816 - RNA, 64 nt, Homo Sapiens; identical to SEQ ID NO: 297881

SEQ ID NO: 487817 - RNA, 64 nt, Homo Sapiens; identical to SEQ ID NO: 297882

SEQ ID NO: 487818 - RNA, 64 nt, Homo Sapiens; identical to SEQ ID NO: 297883

SEQ ID NO: 487819 - RNA, 64 nt, Homo Sapiens; identical to SEQ ID NO: 297884

SEQ ID NO: 487820 - RNA, 64 nt, Homo Sapiens; identical to SEQ ID NO: 297885

SEQ ID NO: 487821 - RNA, 64 nt, Homo Sapiens; identical to SEQ ID NO: 297886

SEQ ID NO: 487822 - RNA, 64 nt, Homo Sapiens; identical to SEQ ID NO: 297887

SEQ ID NO: 487823 - RNA, 64 nt, Homo Sapiens; identical to SEQ ID NO: 297888

SEQ ID NO: 487824 - RNA, 64 nt, Homo Sapiens
ugcccacaggcucuccagaauccauagccaucuacaauaguaacaaaaugcaguccauguccca

SEQ ID NO: 487825 - RNA, 64 nt, Homo Sapiens
ccugaaauaccuagaaauuucccuaagcaacuggcaauaguauuuaaaaugaggggagaauauu

SEQ ID NO: 487826 - RNA, 64 nt, Homo Sapiens
aguagucauaauaacaauaaaguaguagcagcagcaauaguagagcaggaauggcaauaguagu

SEQ ID NO: 487827 - RNA, 64 nt, Homo Sapiens
aguaguagcagcagcaauagacuagcaggaauggcaauaguaguauuaccacucaucaucauau

SEQ ID NO: 487828 - RNA, 64 nt, Homo Sapiens
ggaagaccuggcaaggacacagaugaaacacaaacaauaguaauucucaggccaucaucagugg

SEQ ID NO: 487829 - RNA, 64 nt, Homo Sapiens
aggcugagaacacugugaaaacauuuugcgcgcacaauaguaaccuggguaaaugcagcgugaa

SEQ ID NO: 487830 - RNA, 64 nt, Homo Sapiens
aaacaccaguuguuuauauuuugugcuuauucauacaagacaggaagcacggucuuaggcggau

SEQ ID NO: 487831 - RNA, 64 nt, Homo Sapiens
augagcacgguuacccccaaguggagggguuuguacaagacaugcgccucaucuuccagaacca

SEQ ID NO: 487832 - RNA, 64 nt, Homo Sapiens
ugugacauccuccagggccauagcuccccgcuccacaagacacccaaucccgaucggcucuuau

SEQ ID NO: 487833 - RNA, 64 nt, Homo Sapiens
ugugaucuggaaaucuaccauagcuccccgcuccacaagacacccaaucccgaucggcucuuau

SEQ ID NO: 487834 - RNA, 64 nt, Homo Sapiens
ugugcuuuggaaauccaccauagcuccccgcuccacaagacacccaaucccgaucggcucuuau

SEQ ID NO: 487835 - RNA, 64 nt, Homo Sapiens
gaauaguuuacacacugugugguuaucguuaagcacaagacacaucgggccgguggggcguaag

SEQ ID NO: 487836 - RNA, 64 nt, Homo Sapiens
ucuuucuguuuuguuuuuuuugugcaugcauaccacaagacauuggcgcuccgggaacagugca

SEQ ID NO: 487837 - RNA, 64 nt, Homo Sapiens
uugauauuucuaucaaacaacuucaguguguuugacaagacagcugaaauauauuuuuggguua

SEQ ID NO: 487838 - RNA, 64 nt, Homo Sapiens
uaaagggcuguuugguuagcuaguguauggaaauacaagacagccaguuucugaaauacacauu

SEQ ID NO: 487839 - RNA, 62 nt, Homo Sapiens
aauccaggugcuuuccagacaauccaggcuccucucccaagaacagcccuccucucccaaga

SEQ ID NO: 487840 - RNA, 62 nt, Homo Sapiens
aauccaggcuccucucccaaccacagcccuccucucccaagaagaagaacugauuggggcuu

SEQ ID NO: 487841 - RNA, 62 nt, Homo Sapiens
aucuuuuuaagauuaaaaaugaauaccuuaaaucucccaaaagagauaaccaguaucugaag

SEQ ID NO: 487842 - RNA, 62 nt, Homo Sapiens
acuccugaccgcaagugauccacacgccuuggucucccaaagugcugggauuacgguguuag

SEQ ID NO: 487843 - RNA, 62 nt, Homo Sapiens
gaaacugcagccccacuucuguuucccuggagucucccaauggaucauucaggaguguccua

SEQ ID NO: 487844 - RNA, 62 nt, Homo Sapiens
cugaaggggaagagggugaccucagcggcuuuucucccaaaaaucggcugaaggcugguugu

SEQ ID NO: 487845 - RNA, 62 nt, Homo Sapiens
cugcucccuuuuguuuugugucacaaucaucuucucccaagaguacuacccucagucuacac

SEQ ID NO: 487846 - RNA, 62 nt, Homo Sapiens
agugcucuuuccaccccaaaguccagcaggggucucccaacaugccuuugugcucuguuccu

SEQ ID NO: 487847 - RNA, 62 nt, Homo Sapiens
ugcagugggagagcuuugcugaaauaccugauucucccaaucuggcagccccccauguggga

SEQ ID NO: 487848 - RNA, 62 nt, Homo Sapiens
gaaaccaaaugcgccccuuccccgcucucuuuucucccaagcucacugcgccagccuccccg

SEQ ID NO: 487849 - RNA, 62 nt, Homo Sapiens
accuuagaguagggacacugcucucccaagucucucccaaaugugagacaguccacccagag

SEQ ID NO: 487850 - RNA, 62 nt, Homo Sapiens
cucucccaaauaccuuagaguccacccagagcucucccaaguauuugaacagggugagacag

SEQ ID NO: 487851 - RNA, 62 nt, Homo Sapiens
ccgaacguggaacaguaucacaaaagauuccaucucccaacgauuucagaacucugagcuca

SEQ ID NO: 487852 - RNA, 62 nt, Homo Sapiens
agagaagaaagauaaggaggcucccacccaccucucccaagagcagacauuaaacaucuuug

SEQ ID NO: 487853 - RNA, 62 nt, Homo Sapiens
cauauuuuugauaggaaaaaagagccucuuuuucucccaacuaaggggaaagaaacuacuuu

SEQ ID NO: 487854 - RNA, 62 nt, Homo Sapiens
uuuaaaaacaaauuggaagagagaaaggggaaucucccaaaaguguaugcuuccagguggag

SEQ ID NO: 487855 - RNA, 62 nt, Homo Sapiens
acagcaagacugucagccucugcagcucguuuucucccaauuacucaaucugccaaaugugc

SEQ ID NO: 487856 - RNA, 62 nt, Homo Sapiens
gaagcguuggcagcaaagggcccucuccagccucucccaaagcacuaggagauuuuuauaaa

SEQ ID NO: 487857 - RNA, 62 nt, Homo Sapiens
cugcccugggccauaugugcuauggagaggacucucccaaacccccaauagcuagugacagc

SEQ ID NO: 487858 - RNA, 62 nt, Homo Sapiens
ccaaagcuuccccuuaucguccccugugauuaucucccaaccccgugacaaagguagagcaa

SEQ ID NO: 487859 - RNA, 62 nt, Homo Sapiens
cacguuugucacugccguuuauuacauugacuucucccaagaugaaucuuccuuccaaaugu

SEQ ID NO: 487860 - RNA, 62 nt, Homo Sapiens
cccugaagauaaucaaggccaguuacucaucaucucccaaccacuguuuccucaacugcccu

SEQ ID NO: 487861 - RNA, 64 nt, Homo Sapiens
gaugaucagaacuugcguucuguuaauggugccgaaauaacaaugugaaccugagacuggccug

SEQ ID NO: 487862 - RNA, 64 nt, Homo Sapiens
ucccaucauggcccaccugguuuccugauguuguaaauaacaucaaugcaucugcugugggucc

SEQ ID NO: 487863 - RNA, 64 nt, Homo Sapiens
ccaagauucuuaaauuugccagcguuaaaguagaaaauaacauuucagaagagcacaauaugca

SEQ ID NO: 487864 - RNA, 64 nt, Homo Sapiens
auguguaggaauuguauguauguauaucuucuguaaauaacaucuaguaucuucacuaaauaua

SEQ ID NO: 487865 - RNA, 64 nt, Homo Sapiens
aacuuuaacuucuguuuuaccagcauacccacacaaauaacaagaauacuacuuaugaaaugug

SEQ ID NO: 487866 - RNA, 64 nt, Homo Sapiens
uggggcuucaacuuuggaauuucacagcgugcuaaaauaacagauuucucagaagucuuucagc

SEQ ID NO: 487867 - RNA, 64 nt, Homo Sapiens
uucucugagccagagaagacacuaagcaagggaaaaauaacaguccuaugcuuuuagcugcguu

SEQ ID NO: 487868 - RNA, 64 nt, Homo Sapiens
gucuaaguauuuuaaaugugaaauuguagcuuuaaaauaacagggcaacugauuuugcaaaaaa

SEQ ID NO: 487869 - RNA, 64 nt, Homo Sapiens
augaaggaaaugaaccacauagacuuuaugcaauaaauaacagugcaagugaguauaacucuaa

SEQ ID NO: 487870 - RNA, 64 nt, Homo Sapiens
ugcauuuuauucuugaagugaaaucugugcaauaaaauaacagacugucugcaaaacuggccuu

SEQ ID NO: 487871 - RNA, 64 nt, Homo Sapiens
acuaauaauauuuucuuauuaaauauuuagguacaaauaacaagauuuguguuucaaauugaua

SEQ ID NO: 487872 - RNA, 64 nt, Homo Sapiens
aacagaacaacuucacuuugugagaggaauauuuaaauaacaucugaaguuguggcugagaaga

SEQ ID NO: 487873 - RNA, 64 nt, Homo Sapiens
accacaaccaaguuccagcuggcaagaagaggaaaaauaacacagaggaguuaugaccaguguu

SEQ ID NO: 487874 - RNA, 64 nt, Homo Sapiens
aaugaacauguuuuauuuuuacuuuuguuaaaauaaauaacauuuaauuugacggaaaauucua

SEQ ID NO: 487875 - RNA, 64 nt, Homo Sapiens
uaguaaaauauguaaccauugucccaguaaagaaaaauaacaaaaguuguaaaauguauauucu

SEQ ID NO: 487876 - RNA, 64 nt, Homo Sapiens
uuuuuauuauuuuaauauacuguaagccaaacugaaauaacauuugcuguuuuauagguuugaa

SEQ ID NO: 487877 - RNA, 64 nt, Homo Sapiens
cuuguacagauacaaucuaaggauuuaaaaucaaaaauaacacaaacugauaauucuuacuucu

SEQ ID NO: 487878 - RNA, 64 nt, Homo Sapiens
guuuccaaaugcaacuaagaaauuaauugccauaaaauaacaauuagucuguggaguuuguggc

SEQ ID NO: 487879 - RNA, 64 nt, Homo Sapiens
acccuuacgaauuuuuugguuuuugaaaaaaguaaaauaacaaucuauaguuuauuuggauuau

SEQ ID NO: 487880 - RNA, 64 nt, Homo Sapiens
cacuauauguuggaguuggggacacauuggggguaaauaacagaugagguuuagagguuaaaau

SEQ ID NO: 487881 - RNA, 64 nt, Homo Sapiens
uggaaagggaaugcuacuauaccuacuucauuuaaaauaacaugaguuaaacacuuagcugagu

SEQ ID NO: 487882 - RNA, 64 nt, Homo Sapiens
aaugaaugaauuacaaugaacaaagaaaagugcaaaauaacacuaacaaguaaauauuacaaga

SEQ ID NO: 487883 - RNA, 64 nt, Homo Sapiens
guacguauguuuaucuuacucuuccuauaaacuaaaauaacauuacaguuuccgaauuuagcau

SEQ ID NO: 487884 - RNA, 64 nt, Homo Sapiens
ccuacucaguaaacaggugugaugaguuaacaagaaauaacacuguuugagaacuagcuuugaa

SEQ ID NO: 487885 - RNA, 64 nt, Homo Sapiens
aaaaauuaaaugcauaagcauaagguagaaauuaaaauaacaaaauugucuacagcuucuuacu

SEQ ID NO: 487886 - RNA, 64 nt, Homo Sapiens
uaaugcaccuugagaaaaaucuggcauacugaauaaauaacauuaacuugggagccaagagcug

SEQ ID NO: 487887 - RNA, 64 nt, Homo Sapiens
auuaaaacaggcaguuguuucuuugaauaugccuaaauaacaguauucuuaaaaucugacagac

SEQ ID NO: 487888 - RNA, 64 nt, Homo Sapiens
cuaucacaagcuacacauaaauugggugguuuauaaauaacaaacauuucuuucuuacaguucu

SEQ ID NO: 487889 - RNA, 64 nt, Homo Sapiens
caaauguauaugguucuggccacauuaaaguugcaaauaacacuuuuuuugagacugaaauaaa

SEQ ID NO: 487890 - RNA, 64 nt, Homo Sapiens
uuagacacacuuuaaaccuucaaacagguauuauaaauaacaugugacuccuuaauggacuuau

SEQ ID NO: 487891 - RNA, 64 nt, Homo Sapiens
uaaacaaaacuaauaacuguuuuacugcuuuaagaaauaacaauuacaauguguauuauuuaaa

SEQ ID NO: 487892 - RNA, 64 nt, Homo Sapiens
gugacauaaagugcccuuccaauaacaauagcagaaauaacaguagaguauugaaggaacaaca

SEQ ID NO: 487893 - RNA, 64 nt, Homo Sapiens
agcagaaauaacagugugacauugaaggaacaacaaauaacaauggauuggcaauguaaagagu

SEQ ID NO: 487894 - RNA, 64 nt, Homo Sapiens
auaaugacaugggcauauaccguaacauucuggcaaauaacaauuagaaaagauagguuuaaca

SEQ ID NO: 487895 - RNA, 64 nt, Homo Sapiens
aagggcacucuaugaauugauuuauugucuaagaaaauaacaccacaaguagggaaauuguuac

SEQ ID NO: 487896 - RNA, 64 nt, Homo Sapiens
cugaaacaagaauuagaaugacuugagaacgggcaaauaacaaagcaaaccaauauaauuauau

SEQ ID NO: 487897 - RNA, 64 nt, Homo Sapiens
uaccauagaaacuauuaaaguaacuagaacugucaaauaacaaaacggcucauguuuuuaaaau

SEQ ID NO: 487898 - RNA, 64 nt, Homo Sapiens
ucagaguaagagggaauucacacccccagacuugaaauaacacuuacaccucuuugccuguucc

SEQ ID NO: 487899 - RNA, 64 nt, Homo Sapiens
ugagaauauauuauauucaccuugguuaacaugaaaauaacaauguaaaguaaaacaaaccuau

SEQ ID NO: 487900 - RNA, 64 nt, Homo Sapiens
cugccauucuugauugcuaguguugauuguuauaaaauaacaugcaaauuuuaaaagccacagg

SEQ ID NO: 487901 - RNA, 64 nt, Homo Sapiens
cugaaucaagcacacuguauuuuuaauuucuacaaaauaacauuuauuuuucaccagguuaaaa

SEQ ID NO: 487902 - RNA, 64 nt, Homo Sapiens
ugaaaagaaaugcuaauguaaaaugaguuuaaaaaaauaacaucuucuaucugcaaauaguuuc

SEQ ID NO: 487903 - RNA, 64 nt, Homo Sapiens
uucuugcuuucacaaauauacacccaauuuuaaaaaauaacauauaugcuuaggccagucagua

SEQ ID NO: 487904 - RNA, 64 nt, Homo Sapiens
uugucaaccuggauccuuuguuagaaauauugacaaauaacacauuucuaagaucuguuuuuca

SEQ ID NO: 487905 - RNA, 64 nt, Homo Sapiens
uaaaaacacauuuucagugucacugauuaacuguaaauaacaauauuaagcuaaacacugguau

SEQ ID NO: 487906 - RNA, 64 nt, Homo Sapiens
aaccugcugacauuaauaaguuguagaaaauucuaaauaacaaacucaaauaacaugauugucu

SEQ ID NO: 487907 - RNA, 64 nt, Homo Sapiens
auugucuuuguagaaaauuccugucuuuguucucaaauaacauguuuggaaggaggaaauacaa

SEQ ID NO: 487908 - RNA, 64 nt, Homo Sapiens
uuaucugaaaaaaaaucuauaaaguuauaaaucaaaauaacagaagcuaauguuuauccauuua

SEQ ID NO: 487909 - RNA, 64 nt, Homo Sapiens
uuauuuuauccguuauuugauucuuucucuauaaaaauaacacauagauuguguugcuauuuuu

SEQ ID NO: 487910 - RNA, 64 nt, Homo Sapiens
gcuaggacacuuguuagggaauuuuaucaaaucuaaauaacauauauuuuuaaaaaugucuaau

SEQ ID NO: 487911 - RNA, 64 nt, Homo Sapiens
uuaaaaucuauuuuauacuuacaauagacuuaagaaauaacauucaauaaaauuguaaagauug

SEQ ID NO: 487912 - RNA, 64 nt, Homo Sapiens
uugugaacuuacuucccuaugcuuuagcuuuagaaaauaacagucauagcaaggccuaauguua

SEQ ID NO: 487913 - RNA, 64 nt, Homo Sapiens
ccuaagaacuccuaaaguccaauaaauagcucugaaauaacaguaagagcucuguaauaacagu

SEQ ID NO: 487914 - RNA, 64 nt, Homo Sapiens
agcucuguaauaacaguaaucuacaguagcucugaaauaacaagcuguugguugugcccaaggg

SEQ ID NO: 487915 - RNA, 64 nt, Homo Sapiens
uuagguaaaaugagauuacaauucuuaaguggccaaauaacagaucuuugauacauuuauuuua

SEQ ID NO: 487916 - RNA, 64 nt, Homo Sapiens
gcuguugacaguggaauucacccucucccaacaaaaauaacaauaacguaacuccaguccucca

SEQ ID NO: 487917 - RNA, 64 nt, Homo Sapiens
uuauaaauguacauauauauucucacauucugaaaaauaacauucucagaauccacagaaaaua

SEQ ID NO: 487918 - RNA, 64 nt, Homo Sapiens
uguuaaggcaagaagugucaaaugcuuuagaguuaaauaacagaucacugauuucaaagacuug

SEQ ID NO: 487919 - RNA, 64 nt, Homo Sapiens
aaaauguggugaacucuuaaaauguuuaugcuaaaaauaacaccauacuucuuauagaaaaaca

SEQ ID NO: 487920 - RNA, 64 nt, Homo Sapiens
cauugacauuucugugguuuugauuauacaauggaaauaacauucucuguaggugacuuuuaaa

SEQ ID NO: 487921 - RNA, 64 nt, Homo Sapiens
gugaaagaaaauaacgauaaaagacagugaaagaaaauaacaauaaaagacaaggaaaaaauaa

SEQ ID NO: 487922 - RNA, 64 nt, Homo Sapiens
cagugaaagaaaauaacaauaaaagacaaggaaaaaauaacaaugaaaguugauaaguacauga

SEQ ID NO: 487923 - RNA, 64 nt, Homo Sapiens
aaacaguauuuuuaggauucuaguaaauaacauaaaauaacauauguuccagauuuaacauaag

SEQ ID NO: 487924 - RNA, 64 nt, Homo Sapiens
aaauaacauaaaacaguauuuuaacauaaguaguaaauaacauauugaauguguuguuccagau

SEQ ID NO: 487925 - RNA, 64 nt, Homo Sapiens
acaaaaauguaacaggggaauaauuuccugcugaaaauaacacaaguuuacucucucccucuac

SEQ ID NO: 487926 - RNA, 64 nt, Homo Sapiens
gucuucuugaaauuugugauaaagcuuugaaauaaaauaacaauucaggaggaugcaauuguug

SEQ ID NO: 487927 - RNA, 64 nt, Homo Sapiens
aaauuuauuugcauuuaugcauuuucaucuguauuugccauaaauuaauaaauuagcccauuau

SEQ ID NO: 487928 - RNA, 64 nt, Homo Sapiens
ugcuguuuuuauggauaaauucuugccuugucucuugccauauuauucacuucccuuaauuuua

SEQ ID NO: 487929 - RNA, 64 nt, Homo Sapiens
uauaacacagcaagaguauugucauguuuauuucuugccauauucaagaagucuauugauauug

SEQ ID NO: 487930 - RNA, 64 nt, Homo Sapiens
uuacucuauucaaauaaacaaauuuggucauucuuugccauagcgcugauuucuauuucuagcu

SEQ ID NO: 487931 - RNA, 64 nt, Homo Sapiens
ggucacacccaagugguccaaaugaaaugcuguauugccauaguuacaaaguagccagucccau

SEQ ID NO: 487932 - RNA, 64 nt, Homo Sapiens
gaauacaccaucaaagaaaaauauuaaaacucucuugccauagaucuucuuagcaguugauaaa

SEQ ID NO: 487933 - RNA, 64 nt, Homo Sapiens
gauaaaauuuguaagguugcauauuuuauuuuuuuugccauacauguauacuuguauuuucagg

SEQ ID NO: 487934 - RNA, 64 nt, Homo Sapiens
uugauguauaggacaagucauugugauugaaaaauugccauauucugaauaacauuuagcagua

SEQ ID NO: 487935 - RNA, 64 nt, Homo Sapiens
uuuccauauaacugaaaaacuaauggcugccauuuugccauagaaacauaucccuucauugcca

SEQ ID NO: 487936 - RNA, 64 nt, Homo Sapiens
ggcugccauuuugccauagaaacauaucccuucauugccauaauaauaucaucuaacagucuaa

SEQ ID NO: 487937 - RNA, 64 nt, Homo Sapiens
uagaagguaucuguaauauauaauccaacauaaauugccauagaugugauugccauagguggaa

SEQ ID NO: 487938 - RNA, 64 nt, Homo Sapiens
uggaauaauccaacauaaauaaaacuugaugugauugccauaggcucuuaaaaaaaaaggaaag

SEQ ID NO: 487939 - RNA, 64 nt, Homo Sapiens; identical to SEQ ID NO: 322895

SEQ ID NO: 487940 - RNA, 64 nt, Homo Sapiens; identical to SEQ ID NO: 322896

SEQ ID NO: 487941 - RNA, 64 nt, Homo Sapiens; identical to SEQ ID NO: 322897

SEQ ID NO: 487942 - RNA, 64 nt, Homo Sapiens; identical to SEQ ID NO: 322898

SEQ ID NO: 487943 - RNA, 64 nt, Homo Sapiens; identical to SEQ ID NO: 322899

SEQ ID NO: 487944 - RNA, 64 nt, Homo Sapiens; identical to SEQ ID NO: 322900

SEQ ID NO: 487945 - RNA, 64 nt, Homo Sapiens; identical to SEQ ID NO: 322901

SEQ ID NO: 487946 - RNA, 64 nt, Homo Sapiens; identical to SEQ ID NO: 322902

SEQ ID NO: 487947 - RNA, 64 nt, Homo Sapiens; identical to SEQ ID NO: 322903

SEQ ID NO: 487948 - RNA, 64 nt, Homo Sapiens; identical to SEQ ID NO: 322904

SEQ ID NO: 487949 - RNA, 64 nt, Homo Sapiens; identical to SEQ ID NO: 322905

SEQ ID NO: 487950 - RNA, 64 nt, Homo Sapiens; identical to SEQ ID NO: 322906

SEQ ID NO: 487951 - RNA, 64 nt, Homo Sapiens; identical to SEQ ID NO: 322907

SEQ ID NO: 487952 - RNA, 64 nt, Homo Sapiens; identical to SEQ ID NO: 322908

SEQ ID NO: 487953 - RNA, 64 nt, Homo Sapiens; identical to SEQ ID NO: 322909

SEQ ID NO: 487954 - RNA, 64 nt, Homo Sapiens; identical to SEQ ID NO: 322910

SEQ ID NO: 487955 - RNA, 64 nt, Homo Sapiens; identical to SEQ ID NO: 322911

SEQ ID NO: 487956 - RNA, 64 nt, Homo Sapiens; identical to SEQ ID NO: 322912

SEQ ID NO: 487957 - RNA, 64 nt, Homo Sapiens; identical to SEQ ID NO: 322913

SEQ ID NO: 487958 - RNA, 64 nt, Homo Sapiens; identical to SEQ ID NO: 322914

SEQ ID NO: 487959 - RNA, 64 nt, Homo Sapiens; identical to SEQ ID NO: 322915

SEQ ID NO: 487960 - RNA, 64 nt, Homo Sapiens; identical to SEQ ID NO: 322916

SEQ ID NO: 487961 - RNA, 64 nt, Homo Sapiens; identical to SEQ ID NO: 322917

SEQ ID NO: 487962 - RNA, 64 nt, Homo Sapiens; identical to SEQ ID NO: 322918

SEQ ID NO: 487963 - RNA, 64 nt, Homo Sapiens; identical to SEQ ID NO: 322919

SEQ ID NO: 487964 - RNA, 64 nt, Homo Sapiens; identical to SEQ ID NO: 322920

SEQ ID NO: 487965 - RNA, 64 nt, Homo Sapiens; identical to SEQ ID NO: 322921

SEQ ID NO: 487966 - RNA, 64 nt, Homo Sapiens; identical to SEQ ID NO: 322922

SEQ ID NO: 487967 - RNA, 64 nt, Homo Sapiens; identical to SEQ ID NO: 322923

SEQ ID NO: 487968 - RNA, 64 nt, Homo Sapiens; identical to SEQ ID NO: 322924

SEQ ID NO: 487969 - RNA, 64 nt, Homo Sapiens; identical to SEQ ID NO: 322925

SEQ ID NO: 487970 - RNA, 64 nt, Homo Sapiens; identical to SEQ ID NO: 322926

SEQ ID NO: 487971 - RNA, 64 nt, Homo Sapiens; identical to SEQ ID NO: 322927

SEQ ID NO: 487972 - RNA, 64 nt, Homo Sapiens; identical to SEQ ID NO: 322928

SEQ ID NO: 487973 - RNA, 64 nt, Homo Sapiens; identical to SEQ ID NO: 322929

SEQ ID NO: 487974 - RNA, 64 nt, Homo Sapiens; identical to SEQ ID NO: 322930

SEQ ID NO: 487975 - RNA, 64 nt, Homo Sapiens; identical to SEQ ID NO: 322931

SEQ ID NO: 487976 - RNA, 64 nt, Homo Sapiens; identical to SEQ ID NO: 322932

SEQ ID NO: 487977 - RNA, 51 nt, Homo Sapiens; identical to SEQ ID NO: 201885

SEQ ID NO: 487978 - RNA, 64 nt, Homo Sapiens; identical to SEQ ID NO: 322934

SEQ ID NO: 487979 - RNA, 64 nt, Homo Sapiens; identical to SEQ ID NO: 322935

SEQ ID NO: 487980 - RNA, 64 nt, Homo Sapiens; identical to SEQ ID NO: 322936

SEQ ID NO: 487981 - RNA, 64 nt, Homo Sapiens; identical to SEQ ID NO: 322937

SEQ ID NO: 487982 - RNA, 64 nt, Homo Sapiens; identical to SEQ ID NO: 322938

SEQ ID NO: 487983 - RNA, 64 nt, Homo Sapiens; identical to SEQ ID NO: 322939

SEQ ID NO: 487984 - RNA, 64 nt, Homo Sapiens; identical to SEQ ID NO: 322940

SEQ ID NO: 487985 - RNA, 64 nt, Homo Sapiens; identical to SEQ ID NO: 322941

SEQ ID NO: 487986 - RNA, 64 nt, Homo Sapiens; identical to SEQ ID NO: 322942

SEQ ID NO: 487987 - RNA, 64 nt, Homo Sapiens; identical to SEQ ID NO: 322943

SEQ ID NO: 487988 - RNA, 64 nt, Homo Sapiens; identical to SEQ ID NO: 322944

SEQ ID NO: 487989 - RNA, 64 nt, Homo Sapiens; identical to SEQ ID NO: 322945

SEQ ID NO: 487990 - RNA, 64 nt, Homo Sapiens; identical to SEQ ID NO: 322946

SEQ ID NO: 487991 - RNA, 64 nt, Homo Sapiens; identical to SEQ ID NO: 322947

SEQ ID NO: 487992 - RNA, 64 nt, Homo Sapiens; identical to SEQ ID NO: 322948

SEQ ID NO: 487993 - RNA, 64 nt, Homo Sapiens; identical to SEQ ID NO: 322949

SEQ ID NO: 487994 - RNA, 64 nt, Homo Sapiens; identical to SEQ ID NO: 322950

SEQ ID NO: 487995 - RNA, 64 nt, Homo Sapiens; identical to SEQ ID NO: 322951

SEQ ID NO: 487996 - RNA, 64 nt, Homo Sapiens; identical to SEQ ID NO: 322952

SEQ ID NO: 487997 - RNA, 64 nt, Homo Sapiens; identical to SEQ ID NO: 322953

SEQ ID NO: 487998 - RNA, 64 nt, Homo Sapiens; identical to SEQ ID NO: 322954

SEQ ID NO: 487999 - RNA, 64 nt, Homo Sapiens; identical to SEQ ID NO: 322955

SEQ ID NO: 488000 - RNA, 64 nt, Homo Sapiens; identical to SEQ ID NO: 322956

SEQ ID NO: 488001 - RNA, 64 nt, Homo Sapiens; identical to SEQ ID NO: 322957

SEQ ID NO: 488002 - RNA, 64 nt, Homo Sapiens; identical to SEQ ID NO: 322958

SEQ ID NO: 488003 - RNA, 64 nt, Homo Sapiens; identical to SEQ ID NO: 322959

SEQ ID NO: 488004 - RNA, 64 nt, Homo Sapiens; identical to SEQ ID NO: 322960

SEQ ID NO: 488005 - RNA, 64 nt, Homo Sapiens; identical to SEQ ID NO: 322961

SEQ ID NO: 488006 - RNA, 64 nt, Homo Sapiens; identical to SEQ ID NO: 322962

SEQ ID NO: 488007 - RNA, 64 nt, Homo Sapiens; identical to SEQ ID NO: 322963

SEQ ID NO: 488008 - RNA, 64 nt, Homo Sapiens; identical to SEQ ID NO: 322964

SEQ ID NO: 488009 - RNA, 64 nt, Homo Sapiens; identical to SEQ ID NO: 322965

SEQ ID NO: 488010 - RNA, 64 nt, Homo Sapiens; identical to SEQ ID NO: 322966

SEQ ID NO: 488011 - RNA, 64 nt, Homo Sapiens; identical to SEQ ID NO: 322967

SEQ ID NO: 488012 - RNA, 64 nt, Homo Sapiens; identical to SEQ ID NO: 322968

SEQ ID NO: 488013 - RNA, 64 nt, Homo Sapiens; identical to SEQ ID NO: 322969

SEQ ID NO: 488014 - RNA, 64 nt, Homo Sapiens; identical to SEQ ID NO: 322970

SEQ ID NO: 488015 - RNA, 64 nt, Homo Sapiens; identical to SEQ ID NO: 322971

SEQ ID NO: 488016 - RNA, 54 nt, Homo Sapiens; identical to SEQ ID NO: 201924

SEQ ID NO: 488017 - RNA, 64 nt, Homo Sapiens; identical to SEQ ID NO: 322973

SEQ ID NO: 488018 - RNA, 64 nt, Homo Sapiens; identical to SEQ ID NO: 322974

SEQ ID NO: 488019 - RNA, 64 nt, Homo Sapiens; identical to SEQ ID NO: 322975

SEQ ID NO: 488020 - RNA, 64 nt, Homo Sapiens; identical to SEQ ID NO: 322976

SEQ ID NO: 488021 - RNA, 64 nt, Homo Sapiens; identical to SEQ ID NO: 322977

SEQ ID NO: 488022 - RNA, 64 nt, Homo Sapiens; identical to SEQ ID NO: 322978

SEQ ID NO: 488023 - RNA, 64 nt, Homo Sapiens; identical to SEQ ID NO: 322979

SEQ ID NO: 488024 - RNA, 64 nt, Homo Sapiens; identical to SEQ ID NO: 322980

SEQ ID NO: 488025 - RNA, 64 nt, Homo Sapiens; identical to SEQ ID NO: 322981

SEQ ID NO: 488026 - RNA, 64 nt, Homo Sapiens; identical to SEQ ID NO: 322982

SEQ ID NO: 488027 - RNA, 64 nt, Homo Sapiens; identical to SEQ ID NO: 322983

SEQ ID NO: 488028 - RNA, 64 nt, Homo Sapiens; identical to SEQ ID NO: 322984

SEQ ID NO: 488029 - RNA, 64 nt, Homo Sapiens; identical to SEQ ID NO: 322985

SEQ ID NO: 488030 - RNA, 64 nt, Homo Sapiens; identical to SEQ ID NO: 322986

SEQ ID NO: 488031 - RNA, 64 nt, Homo Sapiens; identical to SEQ ID NO: 322987

SEQ ID NO: 488032 - RNA, 64 nt, Homo Sapiens; identical to SEQ ID NO: 322988

SEQ ID NO: 488033 - RNA, 64 nt, Homo Sapiens; identical to SEQ ID NO: 322989

SEQ ID NO: 488034 - RNA, 64 nt, Homo Sapiens; identical to SEQ ID NO: 322990

SEQ ID NO: 488035 - RNA, 64 nt, Homo Sapiens; identical to SEQ ID NO: 322991

SEQ ID NO: 488036 - RNA, 64 nt, Homo Sapiens; identical to SEQ ID NO: 322992

SEQ ID NO: 488037 - RNA, 64 nt, Homo Sapiens; identical to SEQ ID NO: 322993

SEQ ID NO: 488038 - RNA, 64 nt, Homo Sapiens; identical to SEQ ID NO: 322994

SEQ ID NO: 488039 - RNA, 58 nt, Homo Sapiens
gcgagcccagcugcccagcccugcccccccuccccauagccagcacagcuaucccgcg

SEQ ID NO: 488040 - RNA, 58 nt, Homo Sapiens
acacgaucugggggggggauccugucuuccuccccaccccaccccacucuuacccaau

SEQ ID NO: 488041 - RNA, 58 nt, Homo Sapiens
ugaauagccaguggggcacacugacuguccuccccaggggaacugcagcgcccuccuc

SEQ ID NO: 488042 - RNA, 58 nt, Homo Sapiens
guccuccccaggggaacugcagcgcccuccuccccacugcccccugcagccccugaga

SEQ ID NO: 488043 - RNA, 58 nt, Homo Sapiens
cagccccugagauauuuugcucacuaucccuccccacuugcuucccugauaugugcuc

SEQ ID NO: 488044 - RNA, 58 nt, Homo Sapiens
uucccugaagcccccaaucuggccccccccuccccagacuuccuccccaaaacacccc

SEQ ID NO: 488045 - RNA, 58 nt, Homo Sapiens
ccaaucuggccccccccuccccagacuuccuccccaaaacaccccagcuuucuggcuu

SEQ ID NO: 488046 - RNA, 58 nt, Homo Sapiens
gcuuagccaucucccuguccccagcaccccuccccagcccacagugguggccucugcc

SEQ ID NO: 488047 - RNA, 58 nt, Homo Sapiens
gacaguguuugaaaagggccgccugcccccuccccacugugcuuuugaugccuuugga

SEQ ID NO: 488048 - RNA, 58 nt, Homo Sapiens
gguuuuggcaaacgcuaaagagcccuugccuccccauuucccaucugcaccccuucuc

SEQ ID NO: 488049 - RNA, 58 nt, Homo Sapiens
ccccauuucccaucugcaccccuucucuccuccccaaaucaauacacuaguuguuucu

SEQ ID NO: 488050 - RNA, 58 nt, Homo Sapiens
guccugggacucggagacuauggccucgccuccccacccuccucuuggaauuacaagc

SEQ ID NO: 488051 - RNA, 58 nt, Homo Sapiens
uagagaucuauuuuuucuaaaacauuccccuccccacuccucucccacagagugcugg

SEQ ID NO: 488052 - RNA, 58 nt, Homo Sapiens
auccuucaagggagcugcuuggaaguggccuccccaggugccuuuggagagaacuguu

SEQ ID NO: 488053 - RNA, 58 nt, Homo Sapiens
caccccacuuccucuacccccagguucuccuccccacagccaguccccuuuccuggau

SEQ ID NO: 488054 - RNA, 58 nt, Homo Sapiens
gcuguuucuucuuugugcuucccgugugccuccccaguagcccucaccugcauaccaa

SEQ ID NO: 488055 - RNA, 58 nt, Homo Sapiens
ugaccucagcucccgaaggcucgcacagccuccccauccuuccuucccagcccuugug

SEQ ID NO: 488056 - RNA, 58 nt, Homo Sapiens
ugcccaccucaggcccccacccuccacuccuccccacgguacugugaacgucguguga

SEQ ID NO: 488057 - RNA, 58 nt, Homo Sapiens
ggcuuuccacccacacugcagccauuggccuccccagguuuggagaggcugagcugga

SEQ ID NO: 488058 - RNA, 58 nt, Homo Sapiens
gacgccaggcaggccaggcccgccggcgccuccccacgugggcuccgcguccuaggac

SEQ ID NO: 488059 - RNA, 58 nt, Homo Sapiens
gcacccccugccaucagggguccucucuccuccccagauuccaaaacagccuguucuc

SEQ ID NO: 488060 - RNA, 58 nt, Homo Sapiens
ccccagagggagaggcccacggguccucccuccccagagagcacgggcucuucccgcc

SEQ ID NO: 488061 - RNA, 58 nt, Homo Sapiens
gcccacccaucugggcuguccuccccacccuccccauggcccgugggcugcccccugc

SEQ ID NO: 488062 - RNA, 58 nt, Homo Sapiens
cuccccauggcccacccaucgcccccugccuccccaccccaacaccagcccgugggcu

SEQ ID NO: 488063 - RNA, 58 nt, Homo Sapiens
ccauuuggcagaacugcuggcagagcugccuccccaauccgggaagcauccuccccac

SEQ ID NO: 488064 - RNA, 58 nt, Homo Sapiens
agagcugccuccccaauccaggaagcauccuccccaccuccuccccugccgccucccg

SEQ ID NO: 488065 - RNA, 58 nt, Homo Sapiens
ggcugcauugaggagacuccggaaccacccuccccagaucccaccuccucccuuugau

SEQ ID NO: 488066 - RNA, 58 nt, Homo Sapiens
gggugcacagugcagaggggguguggucccuccccauuacagucgccauccuccaggc

SEQ ID NO: 488067 - RNA, 58 nt, Homo Sapiens
uugaccuuggggaauuauucgguaauuuccuccccaaaauuccaccucucuaaaagaa

SEQ ID NO: 488068 - RNA, 58 nt, Homo Sapiens
ccaccgugccgaaggagcucucuucaagccuccccacuuuuguucuucaucuccuguc

SEQ ID NO: 488069 - RNA, 58 nt, Homo Sapiens
uuccucacuucuccaucaccuaccacgaccuccccauaccacucaaugugaacucuac

SEQ ID NO: 488070 - RNA, 58 nt, Homo Sapiens
cagggagccugggaugggcauggaggccccuccccaagcauaaaacacuggagguuag

SEQ ID NO: 488071 - RNA, 58 nt, Homo Sapiens
cugguuuccaccccgggcugugggucucccuccccaucaggaguggacucuccacuga

SEQ ID NO: 488072 - RNA, 58 nt, Homo Sapiens
auggauuaacagcugcguggaguucucuccuccccagaagaaugugagcagauggcua

SEQ ID NO: 488073 - RNA, 58 nt, Homo Sapiens
cugcuggcucuguaacccagugcaccucccuccccagcuccggaggggguccuccucg

SEQ ID NO: 488074 - RNA, 58 nt, Homo Sapiens
gaccuuccccagaugcugccaggcagccccuccccaagccucaaagaagcauuugcug

SEQ ID NO: 488075 - RNA, 58 nt, Homo Sapiens
cugcagggccaggacugagccccgcagaccuccccagccccuagcccaggagagagaa

SEQ ID NO: 488076 - RNA, 58 nt, Homo Sapiens
ggucucaggcuggugggaggggcgcccaccuccccacgcccuccccuccccugcugca

SEQ ID NO: 488077 - RNA, 58 nt, Homo Sapiens
cugccggcccggacccgucccagccuccccuccccaccccaugcagcccccaggggga

SEQ ID NO: 488078 - RNA, 58 nt, Homo Sapiens
gauagcccaugggccccuguggacccucccuccccaaguggacacauggcugugcagg

SEQ ID NO: 488079 - RNA, 58 nt, Homo Sapiens
gcaggacacuggucgagagccaaaggucccuccccagacaucuggacacugggcauag

SEQ ID NO: 488080 - RNA, 58 nt, Homo Sapiens
agauuucucaagaaggaagacuccccugccuccccagggccucugcucuccugggaga

SEQ ID NO: 488081 - RNA, 58 nt, Homo Sapiens
ggcccucagcacccgaacacaucuuccuccuccccacccgagccuggagcacucuaac

SEQ ID NO: 488082 - RNA, 58 nt, Homo Sapiens
uuuccuggagccccgagccagcccugucccuccccagugcagcauggcacucaggaga

SEQ ID NO: 488083 - RNA, 58 nt, Homo Sapiens
cucucccagcacaaguggggccccaugcccuccccagcccccacuuccucccugaccu

SEQ ID NO: 488084 - RNA, 58 nt, Homo Sapiens
cccuccccagccucucccagcucccugaccuccccaugucaaccccaagccccacuuc

SEQ ID NO: 488085 - RNA, 58 nt, Homo Sapiens
acaggucccuccacucauauggccucucccuccccagcuaguggaggggaagcagucu

SEQ ID NO: 488086 - RNA, 58 nt, Homo Sapiens
aucuauuuaagccucucucucuuucucuccuccccaacuuuuuucugaaagccuugau

SEQ ID NO: 488087 - RNA, 58 nt, Homo Sapiens
cuauccauccgguggacugggcagcauuccuccccagggcucuucccuugggggccuc

SEQ ID NO: 488088 - RNA, 58 nt, Homo Sapiens
ggauagauacacucauaaaacccccaccccuccccaccccaccccugcucccauugug

SEQ ID NO: 488089 - RNA, 58 nt, Homo Sapiens
gacgguggccuggccagcccucgggaccccuccccaccuaacugcacugaaaccauuu

SEQ ID NO: 488090 - RNA, 58 nt, Homo Sapiens
uucagacaguauggguuaaguucucugcccuccccaggggucugaggaggcucugggu

SEQ ID NO: 488091 - RNA, 58 nt, Homo Sapiens
aagcugggacuucuccaggccuguguucccuccccaggaagugcgccccaaaccucuu

SEQ ID NO: 488092 - RNA, 58 nt, Homo Sapiens
agauggauuaggagagggggugaugaccccuccccaagccccucagggcccagaccuu

SEQ ID NO: 488093 - RNA, 58 nt, Homo Sapiens
ccggguucaagcgauuuuccugccucagccuccccaguagcugggacuacagacgugu

SEQ ID NO: 488094 - RNA, 58 nt, Homo Sapiens
uccugaccucaucguccaccugccucggccuccccaaagugcugagauuaggcguuag

SEQ ID NO: 488095 - RNA, 58 nt, Homo Sapiens
gcugagccccgcccugccaugagguuuuccuccccaggcaggcaggaggccgcgggga

SEQ ID NO: 488096 - RNA, 58 nt, Homo Sapiens
aaguuggcugcugccuggggaagcuucuccuccccaaggcggccauggggcagccugc

SEQ ID NO: 488097 - RNA, 58 nt, Homo Sapiens
gccugcacagaggacccugaugggacccccuccccacuccucccucugucagggaacc

SEQ ID NO: 488098 - RNA, 58 nt, Homo Sapiens
ggcuggcaggggccugcuugaguguugcccuccccaguggggcugugaccuggucccc

SEQ ID NO: 488099 - RNA, 58 nt, Homo Sapiens
ccaucucccccaucccccacugccacacccuccccauucagacacuucauggaccaag

SEQ ID NO: 488100 - RNA, 58 nt, Homo Sapiens
aagucauggcccaaauccagugugcaccccuccccauucacagagccuuuuucacaau

SEQ ID NO: 488101 - RNA, 58 nt, Homo Sapiens
ucuccuucuaccacucuuaaauuuacucccuccccacccagaacccagauggggugga

SEQ ID NO: 488102 - RNA, 58 nt, Homo Sapiens
uuccccaccucaggcccuaccccuggacccuccccaaccuuccuucucucuucuuugg

SEQ ID NO: 488103 - RNA, 58 nt, Homo Sapiens
gcccccuccccccccgccccucugcuucccuccccacccaccaccucaaggguaggga

SEQ ID NO: 488104 - RNA, 58 nt, Homo Sapiens
accuguuuuauuuuguuuucucguucucccuccccaccccacucccagccuuaucuau

SEQ ID NO: 488105 - RNA, 58 nt, Homo Sapiens
ugggccggcuucaugccagcuacuuccuccuccccacuuguccgcugggugguacccu

SEQ ID NO: 488106 - RNA, 58 nt, Homo Sapiens
uccagcgaccuuccucauccaccccaucccuccccaguucauugcacuuugauuagca

SEQ ID NO: 488107 - RNA, 58 nt, Homo Sapiens
cacacacacacacauacauccugcuuucccuccccaaacccaucagacagguaaaugg

SEQ ID NO: 488108 - RNA, 58 nt, Homo Sapiens
cucucucucccuuuuaaauggugggaacccuccccaaaaccuuuccccagacacauuc

SEQ ID NO: 488109 - RNA, 58 nt, Homo Sapiens
cacggaggguucagaccccuccucagacccuccccacaucugaaacugccucccccca

SEQ ID NO: 488110 - RNA, 58 nt, Homo Sapiens
aacuuuuuguuggcuuuuuccuuugucgccuccccagcaccugcccucccagucuccc

SEQ ID NO: 488111 - RNA, 58 nt, Homo Sapiens
cuccugagaggcagggggcccuccgcccccuccccauguauuccccaccuguguuccg

SEQ ID NO: 488112 - RNA, 58 nt, Homo Sapiens
gucauggguagcccacgccguccuuuccccuccccaaguguuucucuccugacccagg

SEQ ID NO: 488113 - RNA, 58 nt, Homo Sapiens
ccggagaccaaacucaccaucccucaguccuccccaacaggguacuaggacugcagcc

SEQ ID NO: 488114 - RNA, 58 nt, Homo Sapiens
gggucugcucaccccaacacaugccuucccuccccagccacaccgugcacgaaggggg

SEQ ID NO: 488115 - RNA, 58 nt, Homo Sapiens
guuuacaugccaaacagaauguaacaccccuccccaagcccuucccagucacugcaug

SEQ ID NO: 488116 - RNA, 58 nt, Homo Sapiens
uaauaauuuauuagaucuaaagccccuuccuccccagccccugcuuucauuaagguau

SEQ ID NO: 488117 - RNA, 58 nt, Homo Sapiens
gaguucccccagaucaguaccccccaccccuccccagcuaguagcaugaccaggagag

SEQ ID NO: 488118 - RNA, 58 nt, Homo Sapiens
uucaaucugagcccagcaggaauaaauaccuccccaaauggugggaaaugggcaugag

SEQ ID NO: 488119 - RNA, 58 nt, Homo Sapiens
ccccaaaaaauaaaagggggccucuucaccuccccaccgaaaagcuugugugaaauuc

SEQ ID NO: 488120 - RNA, 58 nt, Homo Sapiens
cgacaggcagcccaagggccuggacaccccuccccaggcaggugcugccccaggagga

SEQ ID NO: 488121 - RNA, 58 nt, Homo Sapiens
uggacugaggucccuguggccucggucuccuccccaugaagugggagcgaggcucccc

SEQ ID NO: 488122 - RNA, 58 nt, Homo Sapiens
uuggggaggggucagcucuggccacaauccuccccaccagucucacccacuaggauag

SEQ ID NO: 488123 - RNA, 58 nt, Homo Sapiens
uuaacccuccaccuccucucuuggacucccuccccaccccaaccacucuuucuuucuc

SEQ ID NO: 488124 - RNA, 58 nt, Homo Sapiens
ucacuuuucuguuaagaaaacugagcccccuccccacagguuaaaaaacuuuaguaac

SEQ ID NO: 488125 - RNA, 58 nt, Homo Sapiens
cuggguucacgccauucuccugccucagccuccccagcagcugggacuacaggcacac

SEQ ID NO: 488126 - RNA, 58 nt, Homo Sapiens
aaucucauccaaauaacauuguucccauccuccccacccaccacaucaaaacauaaca

SEQ ID NO: 488127 - RNA, 58 nt, Homo Sapiens
cacaucacagcacucaguagagguccugccuccccauuucucaagggaagccaguagg

SEQ ID NO: 488128 - RNA, 58 nt, Homo Sapiens
gccgcccggguguggcucagccauguccccuccccagguccuucauucaccccucccc

SEQ ID NO: 488129 - RNA, 58 nt, Homo Sapiens
ccuccccagguccuucauucaccccuccccuccccacaguggaauuguugaagugugg

SEQ ID NO: 488130 - RNA, 58 nt, Homo Sapiens
cucagaguccacuguggcacuggccaccccuccccaguacaggggugcugcagguggc

SEQ ID NO: 488131 - RNA, 58 nt, Homo Sapiens
ggcccaacucuccuggccuggccaucucccuccccagaaacagugugcauggguuauu

SEQ ID NO: 488132 - RNA, 58 nt, Homo Sapiens
agucaaggucccuugaaucccaaaagugccuccccagccucagcccccaccuccagcc

SEQ ID NO: 488133 - RNA, 58 nt, Homo Sapiens
cugccuugggggugaagugaaggcccagccuccccaccccaccgcgccccagggguug

SEQ ID NO: 488134 - RNA, 58 nt, Homo Sapiens
ugccccccucaccuugauggucucccagccuccccaggggaaaaggaagugcccaaca

SEQ ID NO: 488135 - RNA, 58 nt, Homo Sapiens
uuccggggcagaguggggacggacaccgccuccccauugcaggaacuccccaccccag

SEQ ID NO: 488136 - RNA, 58 nt, Homo Sapiens
uguaaauaguauuuauuagccagcuucuccuccccagucauccauaguucugccuccc

SEQ ID NO: 488137 - RNA, 58 nt, Homo Sapiens
uucuccuccccaguuguaaauaguucugccuccccagcccugguuccccacacaucca

SEQ ID NO: 488138 - RNA, 58 nt, Homo Sapiens
gcuggcgcucagcagcccuacaagcccuccuccccagaaacaacauauaaaacuguuu

SEQ ID NO: 488139 - RNA, 58 nt, Homo Sapiens
gaaggcgggcugaggagacacuguuuugccuccccacgccccacccaacuccacaggg

SEQ ID NO: 488140 - RNA, 58 nt, Homo Sapiens
uccagcucucccagaccuacuccugggcccuccccagcaacaucuccucuuggugccu

SEQ ID NO: 488141 - RNA, 58 nt, Homo Sapiens
uguccuccaagacuccacucucaccagcccuccccauuaugagcacuucccugagucc

SEQ ID NO: 488142 - RNA, 58 nt, Homo Sapiens
cuggagacccccccccaacuuggcucccccuccccaggacggagacagaggaaagggc

SEQ ID NO: 488143 - RNA, 58 nt, Homo Sapiens
aucaagcuuuugcuugauccuguuuuucccuccccagaggccggcggcuacucuggaa

SEQ ID NO: 488144 - RNA, 58 nt, Homo Sapiens
uguccagcuggggccagaggucagggagccuccccaucguguggcuuuccaggcaccc

SEQ ID NO: 488145 - RNA, 58 nt, Homo Sapiens
gugugcccagaacaucccuggggcccugccuccccauuggggugggggaugcuucugg

SEQ ID NO: 488146 - RNA, 58 nt, Homo Sapiens
ggagggcaagcccccccaccgugccuuuccuccccacucuaaaccauaauuguaacca

SEQ ID NO: 488147 - RNA, 58 nt, Homo Sapiens
auaauuaguaacugguuguugaaaauaaccuccccaaaaaauuguugcuguguucugu

SEQ ID NO: 488148 - RNA, 58 nt, Homo Sapiens
uuuccaggaacccuacuggcacaccuacccuccccagcccuaccagugcaugagacac

SEQ ID NO: 488149 - RNA, 58 nt, Homo Sapiens
ugggcuguggucucugacccccuggaggccuccccacgccucacagaacacagugcag

SEQ ID NO: 488150 - RNA, 58 nt, Homo Sapiens
cccagcccugcaggugggacuggcucucccuccccagccacgaguaugccacaggggg

SEQ ID NO: 488151 - RNA, 58 nt, Homo Sapiens
cucucccucucucucccucucucuuuacccuccccagggcuccaucuccgccucaggg

SEQ ID NO: 488152 - RNA, 58 nt, Homo Sapiens
gcccgccucaguuccuuugcgucuguugccuccccagcccugcacgcccuggcuggca

SEQ ID NO: 488153 - RNA, 58 nt, Homo Sapiens
cguccuccuccacagccugucacugcccccuccccagccuguguccacagugcuguga

SEQ ID NO: 488154 - RNA, 58 nt, Homo Sapiens
caagaacuagcgugagcccagccaggcgccuccccaccgggcucucaggacacccugc

SEQ ID NO: 488155 - RNA, 58 nt, Homo Sapiens
uccccguucagaccagagugccccggccccuccccagccugagucuucuccuugcucu

SEQ ID NO: 488156 - RNA, 58 nt, Homo Sapiens
cagagggagccucuguucugccuuugcaccuccccaggcagucagguuguuuaccagc

SEQ ID NO: 488157 - RNA, 58 nt, Homo Sapiens
ugggcagggcggagggagccuccccaacccuccccaggacugugcagaacucuccacu

SEQ ID NO: 488158 - RNA, 58 nt, Homo Sapiens
guauuaacgcuccaagaguaugccugccccuccccagaaugcccuagggccccccaag

SEQ ID NO: 488159 - RNA, 58 nt, Homo Sapiens
cccaagugccuucaugcccucccuguccccuccccaacgcccagucccgcaguacauc

SEQ ID NO: 488160 - RNA, 58 nt, Homo Sapiens
ccccuggggaccccaaggccuuuauuucccuccccaugaucccccaugguguuuauua

SEQ ID NO: 488161 - RNA, 58 nt, Homo Sapiens
cacacccccauuccuccuggaucgagcaccuccccauucuuuagugccacaaauaagc

SEQ ID NO: 488162 - RNA, 58 nt, Homo Sapiens
acuuuccugucccugagaacacgccuguccuccccaucccaccggccaugaggagccc

SEQ ID NO: 488163 - RNA, 58 nt, Homo Sapiens
ccgcgcaggccacugagacgucgcucccccuccccaccauggcucgggucaguccuca

SEQ ID NO: 488164 - RNA, 58 nt, Homo Sapiens
ugcagaaucucaguggcaucuggguucaccuccccacucugaugaucuccagccucca

SEQ ID NO: 488165 - RNA, 58 nt, Homo Sapiens
cccucccuuuccuuuuccccucuucuacccuccccaagaaaaagggccuucaaggcag

SEQ ID NO: 488166 - RNA, 58 nt, Homo Sapiens
cgaaggugcuuggcggucuugccuucccccuccccacaggcucuccuugugggguccc

SEQ ID NO: 488167 - RNA, 58 nt, Homo Sapiens
agucccgccuggugggcauuugccgccgccuccccaccaccagucacugccucgcaga

SEQ ID NO: 488168 - RNA, 58 nt, Homo Sapiens
cuaugaaaucccuggagaaugccacucuccuccccagaugaaugccgagcuaacuguu

SEQ ID NO: 488169 - RNA, 58 nt, Homo Sapiens
ccuccgcucugcucccuggcgaugcuguccuccccacugucgguuuccgcccucuagc

SEQ ID NO: 488170 - RNA, 58 nt, Homo Sapiens
uccccgcaagcuggucccaucacagccaccuccccaccagcuguggagcuggcugagu

SEQ ID NO: 488171 - RNA, 58 nt, Homo Sapiens
caggccugguggcaggaagggccugccaccuccccauugugaccugcccucaaaccuu

SEQ ID NO: 488172 - RNA, 58 nt, Homo Sapiens
agaugaccucuuuuaaaagcaaagccccccuccccauacaccccaagccugagcccug

SEQ ID NO: 488173 - RNA, 58 nt, Homo Sapiens
uggcugugcuuccuggggaaaugaacccccuccccacagacaccacccuggguggauc

SEQ ID NO: 488174 - RNA, 58 nt, Homo Sapiens
gagcugcuucucucuucucccaguucuaccuccccagaagccuuccuccccagguggg

SEQ ID NO: 488175 - RNA, 58 nt, Homo Sapiens
cucccaguucuaccuccccagaagccuuccuccccagguggggcugauggagcaaggg

SEQ ID NO: 488176 - RNA, 58 nt, Homo Sapiens
cugggcuuucacgggccccauuccaccgccuccccaacuugagccugugaccuuggga

SEQ ID NO: 488177 - RNA, 58 nt, Homo Sapiens
cacuggagcugggaggucucgucccagcccuccccaucucggggcugcuguguggacg

SEQ ID NO: 488178 - RNA, 58 nt, Homo Sapiens
ccugggcucugggagugggggcuccagcccuccccacuaugcccaggagucuucccaa

SEQ ID NO: 488179 - RNA, 58 nt, Homo Sapiens
ggccuggggcugugggaugccccaucccccuccccaucaccuuuggugggggcagggc

SEQ ID NO: 488180 - RNA, 58 nt, Homo Sapiens
cccuggccucaauuucccuuuugccaggccuccccaacccuaccaugcaccauguucc

SEQ ID NO: 488181 - RNA, 58 nt, Homo Sapiens
cucagucuucccaucugaacaagacacaccuccccaaccgagcccagcuuccuaaccc

SEQ ID NO: 488182 - RNA, 58 nt, Homo Sapiens
gucuacugcugauuucuagacucucuuuccuccccagggggagaagaagggcaccauc

SEQ ID NO: 488183 - RNA, 58 nt, Homo Sapiens
gucauagagggggccaugagagcccuccccuccccaggggugcuggugaggguucgcc

SEQ ID NO: 488184 - RNA, 58 nt, Homo Sapiens
ccucuggggcccacuggaaaacuccugcccuccccagggaaagaacagugugccucaa

SEQ ID NO: 488185 - RNA, 58 nt, Homo Sapiens
gcccaccucggcugcuaggcacacacugccuccccaccaccccacggccccacugucc

SEQ ID NO: 488186 - RNA, 58 nt, Homo Sapiens
gcuccccgcacugacggggcccagcgcaccuccccagagcaccagccaagcuggugcu

SEQ ID NO: 488187 - RNA, 58 nt, Homo Sapiens
aacugccccaucuccucccauggccuucccuccccacaguccucacagccucucccuu

SEQ ID NO: 488188 - RNA, 58 nt, Homo Sapiens
cucccuuaaugagcaaggacaaccugccccuccccagcccuuugcaggcccagcagac

SEQ ID NO: 488189 - RNA, 58 nt, Homo Sapiens
aggagaagauggccuacuuggaucaaacccuccccagagcccccggccaggcaccccc

SEQ ID NO: 488190 - RNA, 58 nt, Homo Sapiens
gucaguccuaccuuuuucuuucugagagccuccccaccccgagaucacauuucucacu

SEQ ID NO: 488191 - RNA, 58 nt, Homo Sapiens
cuucccgguuccuaguucuuugccagcuccuccccacucugugcgaccuuuccaagcc

SEQ ID NO: 488192 - RNA, 58 nt, Homo Sapiens
aggucuggguacugaguguccagagcugccuccccaggagguuaaggugggggcaaag

SEQ ID NO: 488193 - RNA, 58 nt, Homo Sapiens
cguaucuuuucuccuccucccuaguguuccuccccauuuuuucagaaaacacuucuga

SEQ ID NO: 488194 - RNA, 58 nt, Homo Sapiens
uagucccuccauccuuaauccccccaucccuccccaucaugcaaccagugguuuaauc

SEQ ID NO: 488195 - RNA, 58 nt, Homo Sapiens
uccagacucuuccuggacuggcuugccuccuccccaccuccccacccuggaaccccug

SEQ ID NO: 488196 - RNA, 58 nt, Homo Sapiens
cuuccuggacuggcuugccuccuccccaccuccccacccuggaaccccugagggccaa

SEQ ID NO: 488197 - RNA, 58 nt, Homo Sapiens
ccugucuucucaucagccacuccucagaccuccccagagcaggaucuggcccgagcuc

SEQ ID NO: 488198 - RNA, 58 nt, Homo Sapiens
cuuccuacucccagcuuucagccccaucccuccccaccaggugugcuguuccuuccca

SEQ ID NO: 488199 - RNA, 58 nt, Homo Sapiens
uccccagggaaggaaacuguuggagacgccuccccaauuuuccaauccuuuauagcuu

SEQ ID NO: 488200 - RNA, 58 nt, Homo Sapiens
cccacccauaccagcuagaagcaaauccccuccccaaagaacccauccaauggauugu

SEQ ID NO: 488201 - RNA, 58 nt, Homo Sapiens
uacucaggaaaaugucaccaagcacccuccuccccaguucacaaaaggaagaagauga

SEQ ID NO: 488202 - RNA, 58 nt, Homo Sapiens
aagaugaagauucugucucccuguucccccuccccaguuuuccaaagugucugagcau

SEQ ID NO: 488203 - RNA, 58 nt, Homo Sapiens
cccauagcuccagugcacgcccgagcauccuccccaccccucugcaagugggagagac

SEQ ID NO: 488204 - RNA, 58 nt, Homo Sapiens
agugcaacagaaaccaccugcaccccacccuccccaccgcccccagaggaccgggagg

SEQ ID NO: 488205 - RNA, 58 nt, Homo Sapiens
uagaaauaugcauagguagaauguacccccuccccaagcaugaaaaucaucucacuga

SEQ ID NO: 488206 - RNA, 58 nt, Homo Sapiens
cucaaucucccaccccauguaggcacuaccuccccaauuacccuuagaaaaugaucac

SEQ ID NO: 488207 - RNA, 58 nt, Homo Sapiens
gcgcagaggaaacaggccagccuccacuccuccccacacuucaugagaguacuagccu

SEQ ID NO: 488208 - RNA, 58 nt, Homo Sapiens
ucccugcagccaccucccagcccuccauccuccccacagaugagcuggcgcagccccg

SEQ ID NO: 488209 - RNA, 58 nt, Homo Sapiens
uuuugcuauguuaauauuugaauuguguccuccccacauagggauauuuuuauaaaac

SEQ ID NO: 488210 - RNA, 58 nt, Homo Sapiens
ccaucucaccauauccaucuucuaacauccuccccacagugauaaacaccuccagcuu

SEQ ID NO: 488211 - RNA, 58 nt, Homo Sapiens
ggaccucgaaggcugcaacggcauuucuccuccccagaagcucacccacuuuggagca

SEQ ID NO: 488212 - RNA, 58 nt, Homo Sapiens
ggcggaauugcuuucuucugcuuccucuccuccccacauguguccuccccuccccucc

SEQ ID NO: 488213 - RNA, 58 nt, Homo Sapiens
agggaugaagaaaacccuguuuccacuuccuccccaaaaagaagcucagagcugcccc

SEQ ID NO: 488214 - RNA, 58 nt, Homo Sapiens
gaaugggcuguauguccugcggccucauccuccccauggugccucacugacccccagg

SEQ ID NO: 488215 - RNA, 58 nt, Homo Sapiens
ccucuucgugggaaggcccccccgagagccuccccaggggagggagggcagacggagg

SEQ ID NO: 488216 - RNA, 58 nt, Homo Sapiens
ugggcugggcuaaaugggagggguugucccuccccaucauccauuccugugagguguc

SEQ ID NO: 488217 - RNA, 58 nt, Homo Sapiens
cacccuccccgugcugcuguguucugcuccuccccacgcuucccugcuauaguuccca

SEQ ID NO: 488218 - RNA, 58 nt, Homo Sapiens
acucauccuuuccccagcccucuucagcccuccccaguccuccccagccuucuucagc

SEQ ID NO: 488219 - RNA, 58 nt, Homo Sapiens
uccccagcccucuucagcccuccccaguccuccccagccuucuucagccuucuucagc

SEQ ID NO: 488220 - RNA, 58 nt, Homo Sapiens
ccccagcugaccagggaggcagaggacaccuccccaucacucagcauucccagcucag

SEQ ID NO: 488221 - RNA, 58 nt, Homo Sapiens
gauuccuuagugaucugugcccuaaugcccuccccaugucuggaggaccaagcccucc

SEQ ID NO: 488222 - RNA, 58 nt, Homo Sapiens
acaccuaggcugucagucuccaucuauaccuccccauggcugugaccuguuuggcucc

SEQ ID NO: 488223 - RNA, 58 nt, Homo Sapiens
gucugcuugugggcacgcuccucuucucccuccccaaggcgacuaggagcagggcugc

SEQ ID NO: 488224 - RNA, 58 nt, Homo Sapiens
agcugggauuacaggcacccugucucagccuccccaguccggguucaagcauuucucc

SEQ ID NO: 488225 - RNA, 58 nt, Homo Sapiens
cgggaaucuuggucggaaacaagccgggccuccccagcugccugggcuugaccggcgg

SEQ ID NO: 488226 - RNA, 58 nt, Homo Sapiens
agcccacauuuuuguugcuccccaaaucccuccccacguggggaugagaaccuuccug

SEQ ID NO: 488227 - RNA, 58 nt, Homo Sapiens
ccucgcucaguugugauccagcagccccccuccccacugccuccccagcucucaguga

SEQ ID NO: 488228 - RNA, 58 nt, Homo Sapiens
ugugauccagcagccccccuccccacugccuccccagcucucagugaccccgacuguc

SEQ ID NO: 488229 - RNA, 58 nt, Homo Sapiens
accccuaguggggaggggcacagccccuccuccccacauggucaggagccaguuucuc

SEQ ID NO: 488230 - RNA, 58 nt, Homo Sapiens
uucccaaacuucugucugccacuucaccccuccccagcuagccugcccccccaccccc

SEQ ID NO: 488231 - RNA, 58 nt, Homo Sapiens
gacauacagauugcccucccucacuacuccuccccagacaccgcaucaguccccauca

SEQ ID NO: 488232 - RNA, 58 nt, Homo Sapiens
ccaagaggggucugaguggggcccccaaccuccccaccuguuuuggccaccuggggcc

SEQ ID NO: 488233 - RNA, 58 nt, Homo Sapiens
gggccucgggaccucaggugccacccgcccuccccacgaggccaaggccuucuccucc

SEQ ID NO: 488234 - RNA, 58 nt, Homo Sapiens
cgcccuccccacggggccucggccuucuccuccccaccuccagcuucaggcaggccaa

SEQ ID NO: 488235 - RNA, 58 nt, Homo Sapiens
cauaagucuguucauccugcugaaguccccuccccauugcuccuucaagccaaaacua

SEQ ID NO: 488236 - RNA, 58 nt, Homo Sapiens
gucccucucucuuugacucucccuuuguccuccccauagagcuggggugggguggauc

SEQ ID NO: 488237 - RNA, 58 nt, Homo Sapiens
cuguccagagagagaagugccccugcugccuccccaacccugccccugccccgucacc

SEQ ID NO: 488238 - RNA, 58 nt, Homo Sapiens
ugggacagagucuggguguauuuauuuuccuccccagcagguggggaggggguuuggg

SEQ ID NO: 488239 - RNA, 58 nt, Homo Sapiens
aggggccaagacacugccuagccccaucccuccccauggagucugggcccuaggccua

SEQ ID NO: 488240 - RNA, 58 nt, Homo Sapiens
gcucaccccucaaccccaagagcugugaccuccccaacggcuccaguucugggcuggg

SEQ ID NO: 488241 - RNA, 58 nt, Homo Sapiens
uccccagcugccuggcugggaucagccuccuccccacacagcugccuguuuccucccc

SEQ ID NO: 488242 - RNA, 58 nt, Homo Sapiens
agccuccuccccacauccccgccuguuuccuccccaucgcucuaccgggaggacagcu

SEQ ID NO: 488243 - RNA, 58 nt, Homo Sapiens
aaaggggguuugucagaagccccuuguuccuccccauuagguucucaagacacgaguc

SEQ ID NO: 488244 - RNA, 58 nt, Homo Sapiens
ccuccaggaacuccacuccccacgccccccuccccacaagauuuuucuaaauugaaaa

SEQ ID NO: 488245 - RNA, 58 nt, Homo Sapiens
cccacaacacugccaaaaauguuucucuccuccccagucuuguucugguggagcuggg

SEQ ID NO: 488246 - RNA, 58 nt, Homo Sapiens
gaauugaaacgucagcucagccccgccaccuccccaaacaucuuuccucccgucccug

SEQ ID NO: 488247 - RNA, 58 nt, Homo Sapiens
gcagagauuggcuuggggccagaaggacccuccccaacccuggagacacccugaaggu

SEQ ID NO: 488248 - RNA, 58 nt, Homo Sapiens
uacagaagcuugacaagcauguccucacccuccccaccacauaaacacauggacacac

SEQ ID NO: 488249 - RNA, 58 nt, Homo Sapiens
ccugaucugugcggcuccagccucgcccccuccccacgugcaccauaccuggggaguu

SEQ ID NO: 488250 - RNA, 58 nt, Homo Sapiens
acaacuuuggacaccccaggcugccaccccuccccacccguucacccccaggaugcug

SEQ ID NO: 488251 - RNA, 58 nt, Homo Sapiens
ugcuguaggacgccugcugcccuggagcccuccccaggaugugagccaguccccucgc

SEQ ID NO: 488252 - RNA, 58 nt, Homo Sapiens
ggcugccacaagcucucugcggguccauccuccccaccgggguccguccucgcaggcc

SEQ ID NO: 488253 - RNA, 58 nt, Homo Sapiens
ccagcugcuucggccuucaggugaccucccuccccacggcauccugcucuccgggugg

SEQ ID NO: 488254 - RNA, 58 nt, Homo Sapiens
cagaggugccuggccaugccugcacacuccuccccauuuuaauaaauggucgcaacuu

SEQ ID NO: 488255 - RNA, 58 nt, Homo Sapiens
ggugacguauguagaaugcuuaggguguccuccccacagagcagauacuugaaccgac

SEQ ID NO: 488256 - RNA, 58 nt, Homo Sapiens
uaaagagcacuuuguccugcuucacggaccuccccaaagugugcagaguucuauauag

SEQ ID NO: 488257 - RNA, 58 nt, Homo Sapiens
ccgggccagacagcuguccccccguccuccuccccagcccagccugcucagagaagcu

SEQ ID NO: 488258 - RNA, 58 nt, Homo Sapiens
agggcaaguccugaaaggcccaaggcccccuccccagucuggccuuggccuccagccu

SEQ ID NO: 488259 - RNA, 58 nt, Homo Sapiens
ccaucuuggucaugagcuacugucugucccuccccaggacccgcggugggugcugcau

SEQ ID NO: 488260 - RNA, 58 nt, Homo Sapiens
gggcuggccugggggucuugggaaggccccuccccaggcccuaggccaccucgcggaa

SEQ ID NO: 488261 - RNA, 58 nt, Homo Sapiens
ggcccucguccucccugccucucaucugccuccccaacccccaccuacccacugcucc

SEQ ID NO: 488262 - RNA, 58 nt, Homo Sapiens
ccacccuguccacgugaagugccaacgcccuccccacccugggccgagcccccacccc

SEQ ID NO: 488263 - RNA, 58 nt, Homo Sapiens
gccaccagaaggugacacccccagaaucccuccccagagacugcaccagcgcagccag

SEQ ID NO: 488264 - RNA, 58 nt, Homo Sapiens
ccccaucucccugccagccccuaacuacccuccccagccuccaggaacuauccaucca

SEQ ID NO: 488265 - RNA, 58 nt, Homo Sapiens
aaggccugaugcauucauaaguugaagcccuccccagauccccuuggggagccucugc

SEQ ID NO: 488266 - RNA, 58 nt, Homo Sapiens
uguucauuucaucuggcuccccccaccaccuccccaccccaccccccacccccugcuu

SEQ ID NO: 488267 - RNA, 58 nt, Homo Sapiens
cccacagggagccccggccauuugcugcccuccccaccccugccccagccucaggacu

SEQ ID NO: 488268 - RNA, 58 nt, Homo Sapiens
aggagccauccgccccccucagccccuuccuccccagggagcaaagccauaaggggca

SEQ ID NO: 488269 - RNA, 58 nt, Homo Sapiens
cuggcuugggagccugggcccugacuccccuccccagacccaggagauccuggacugc

SEQ ID NO: 488270 - RNA, 58 nt, Homo Sapiens
ccccccuaagcugcucuccccacaacgcccuccccagguggcccccagggcuacccua

SEQ ID NO: 488271 - RNA, 58 nt, Homo Sapiens
gccaugggagggguguccucaccugcguccuccccaaaucugcccugugacuccugga

SEQ ID NO: 488272 - RNA, 58 nt, Homo Sapiens
ccggccacgcccccacccacgcacagccccuccccacugccacccccaggugcugggg

SEQ ID NO: 488273 - RNA, 58 nt, Homo Sapiens
agcugggacuacaggcacccugccucagccuccccagcccagauucacgccauucucc

SEQ ID NO: 488274 - RNA, 58 nt, Homo Sapiens
cucuuccauuuuucuacagacuuuccucccuccccaauaaccuggacccaggcagccu

SEQ ID NO: 488275 - RNA, 58 nt, Homo Sapiens
aauaaaacucuguuuacaaccccagcccccuccccaucccucucuggaguuugccucc

SEQ ID NO: 488276 - RNA, 58 nt, Homo Sapiens
ccaggccccuggcguguguggaaaggucccuccccaacuaagcccucccccaccccug

SEQ ID NO: 488277 - RNA, 58 nt, Homo Sapiens
ccagccgcccagccacauguggcuguccccuccccagcacgcucugcuggucaguggc

SEQ ID NO: 488278 - RNA, 58 nt, Homo Sapiens
uugauguuuguguuuuguuuccggccagccuccccaaccaugcaauugccuguccccc

SEQ ID NO: 488279 - RNA, 58 nt, Homo Sapiens
acagcuacguuuguacaucaccccacccccuccccaaugucccucccccauccccccu

SEQ ID NO: 488280 - RNA, 58 nt, Homo Sapiens
cccuccccaauacagcuacgccauccccccuccccaccaagacugacccgucccuccc

SEQ ID NO: 488281 - RNA, 58 nt, Homo Sapiens
cucaccuugccaugccaggugccccccaccuccccaggucugcaaauccccucccccu

SEQ ID NO: 488282 - RNA, 58 nt, Homo Sapiens
guuaagcacuggaugucuccgugcuaccccuccccagagcugcccuucacaccuuuug

SEQ ID NO: 488283 - RNA, 58 nt, Homo Sapiens
ccuugaacccccaugcaaugaagccucaccuccccaccucuccccucccuccccaccc

SEQ ID NO: 488284 - RNA, 58 nt, Homo Sapiens
caagccucaccuccccaccccuccccucccuccccaccauacugcagucuggcucuuu

SEQ ID NO: 488285 - RNA, 58 nt, Homo Sapiens
caccccccccccaccgaggcagggggcaccuccccacagggggggccaggcuccagag

SEQ ID NO: 488286 - RNA, 58 nt, Homo Sapiens
accuagguggggccugggguugcccaggccuccccagcggugcccucccagacccccu

SEQ ID NO: 488287 - RNA, 58 nt, Homo Sapiens
ucccacgccccagccccuccucgggccuccuccccaccauccucaacuuucuguccau

SEQ ID NO: 488288 - RNA, 58 nt, Homo Sapiens
ccccuucccucaacucuaggcaggccagccuccccagccccccuccucuccagccugu

SEQ ID NO: 488289 - RNA, 58 nt, Homo Sapiens
ggcccgggggagaccucuuccccccuucccuccccaccccaggaccagaggccugucu

SEQ ID NO: 488290 - RNA, 58 nt, Homo Sapiens
ucuaaccagaccccaucccccuaggcccccuccccaacccagacucugcacggauguc

SEQ ID NO: 488291 - RNA, 58 nt, Homo Sapiens
cucugcacggauguccuaggcaccccaaccuccccagaccaaacuguacagacucucc

SEQ ID NO: 488292 - RNA, 58 nt, Homo Sapiens
guggcauuuccugccaggggcuggagacccuccccagugcagccccgcgccccugaga

SEQ ID NO: 488293 - RNA, 58 nt, Homo Sapiens
cugugcccugccauauacguguuacagcccuccccauguuuggaugggaggccucucu

SEQ ID NO: 488294 - RNA, 58 nt, Homo Sapiens
cccccaccccuuccccgacacccaagccccuccccacgucgcccccuccugcacagcc

SEQ ID NO: 488295 - RNA, 58 nt, Homo Sapiens
aucucucugccccgccccgccccuccggccuccccacaccccccuugcccucacuacc

SEQ ID NO: 488296 - RNA, 58 nt, Homo Sapiens
gacaccucacuucccuagagaaggccugccuccccauagggaaucuggggguuucuuc

SEQ ID NO: 488297 - RNA, 58 nt, Homo Sapiens
uaaugagccccuuauuuucuuuuuuuucccuccccaggucuaguagcucuaacuaaaa

SEQ ID NO: 488298 - RNA, 58 nt, Homo Sapiens
aguguggccuggauccauccugcuagcaccuccccagacagggcuccagccugucggc

SEQ ID NO: 488299 - RNA, 58 nt, Homo Sapiens
aggcccccguugaagccgcucccgguucccuccccagcuccucgucuuugaacugccg

SEQ ID NO: 488300 - RNA, 58 nt, Homo Sapiens
gugagagaggaccuccaugcccccgccaccuccccacuccagcagauaaggccgagcc

SEQ ID NO: 488301 - RNA, 58 nt, Homo Sapiens
uccugcagggagccuucugccaccagccccuccccagacucucagguggaggcaacag

SEQ ID NO: 488302 - RNA, 58 nt, Homo Sapiens
aaguuccacuuccaggucugccugguucccuccccaaggccacagggagcuccgucag

SEQ ID NO: 488303 - RNA, 58 nt, Homo Sapiens
cccuuucucuggcccuguccgcuuuccaccuccccaguuccugagccugcuucugccu

SEQ ID NO: 488304 - RNA, 58 nt, Homo Sapiens
uggcccugggcucaggggacuccucuuuccuccccauuuuauugccucuuucucagaa

SEQ ID NO: 488305 - RNA, 58 nt, Homo Sapiens
ccccgcccuacugucucuucuucccgaaccuccccaaaugagggcagaugccacaaga

SEQ ID NO: 488306 - RNA, 58 nt, Homo Sapiens
ucuucccugccuucuagagacuggucuuccuccccacuuggccuucagaaccuucucu

SEQ ID NO: 488307 - RNA, 58 nt, Homo Sapiens
cuguguccggagccuggcggggaggcggccuccccaguaugugagugcagggaucugc

SEQ ID NO: 488308 - RNA, 58 nt, Homo Sapiens
cagccucuacgggcagaguccggcauccccuccccagacugccugcugucaaaccacg

SEQ ID NO: 488309 - RNA, 58 nt, Homo Sapiens
gccccacccacagggaccucucgcacccccuccccacgaagccugggcauggccuggg

SEQ ID NO: 488310 - RNA, 58 nt, Homo Sapiens
cagagagaggcuucccucccgaggaccaccuccccauaccucaccacggacacggaca

SEQ ID NO: 488311 - RNA, 58 nt, Homo Sapiens
ccuucccuacucaacggucaagauuccuccuccccaggucagcagccacucauagcac

SEQ ID NO: 488312 - RNA, 58 nt, Homo Sapiens
cccgcuggccccagacccgcacccacugccuccccauccugccccccacgggcauccu

SEQ ID NO: 488313 - RNA, 58 nt, Homo Sapiens
ggggaccaggaccccacagcgcacccccccuccccaccaacuucucugccccagggac

SEQ ID NO: 488314 - RNA, 58 nt, Homo Sapiens
cacagggggcuggugacacccagagcccccuccccagcccucaggcccucccugccaa

SEQ ID NO: 488315 - RNA, 58 nt, Homo Sapiens
cucagccacgccccuccggccucagcucccuccccaaagugccugagcgccgccucug

SEQ ID NO: 488316 - RNA, 58 nt, Homo Sapiens
ucccucccccaacacuguccacacugccccuccccacuguuuauuuauugcacggauc

SEQ ID NO: 488317 - RNA, 58 nt, Homo Sapiens
ugagccacagugaccgccugcccccgccccuccccaucuguccccucucuccacaccc

SEQ ID NO: 488318 - RNA, 58 nt, Homo Sapiens
gcagcuggacccugcaggguggcucccuccuccccaucaagcacaagagagggcccag

SEQ ID NO: 488319 - RNA, 58 nt, Homo Sapiens
accgcagugggccugcaagccgcccgagccuccccagcagccuccuacagagcaggaa

SEQ ID NO: 488320 - RNA, 58 nt, Homo Sapiens
uauccaggaccccccggauucuccacgcccuccccaucucccagucucccugcccccc

SEQ ID NO: 488321 - RNA, 58 nt, Homo Sapiens
uacugcuuuaaaacacaacuccagagccccuccccaagcuccccuccccaagcuccug

SEQ ID NO: 488322 - RNA, 58 nt, Homo Sapiens
acaacuccagagccccuccccaagcuccccuccccaagcuccugaagacccgguuucu

SEQ ID NO: 488323 - RNA, 58 nt, Homo Sapiens
cuuucucucagacagcuuauaauuuccaccuccccaacaaucacacccuuggaauaga

SEQ ID NO: 488324 - RNA, 58 nt, Homo Sapiens
uuuuuccccaagacaagacacucccccaccuccccacuuuuuagggugguuaggacau

SEQ ID NO: 488325 - RNA, 58 nt, Homo Sapiens
gaagaacaaauaugauucucagaaccccccuccccaagaacccuucgguauuguucaa

SEQ ID NO: 488326 - RNA, 58 nt, Homo Sapiens
gugcagugaagaaaauguuugggcagccccuccccauguuccauggugguuucagaaa

SEQ ID NO: 488327 - RNA, 58 nt, Homo Sapiens
aggaggcaggcauggaccacugcccuccccuccccagccaacugcucaauaaaccucc

SEQ ID NO: 488328 - RNA, 58 nt, Homo Sapiens
ugcucaauaaaccuccugccuucccaccccuccccaaccugcguccacgcccucugaa

SEQ ID NO: 488329 - RNA, 58 nt, Homo Sapiens
uccucccugccuugggacccaauguccuccuccccaugaaaauauauauacacauagc

SEQ ID NO: 488330 - RNA, 58 nt, Homo Sapiens
agcccccacccuugccccaguucccccaccuccccagccccaccccagcagcccucuc

SEQ ID NO: 488331 - RNA, 64 nt, Homo Sapiens; identical to SEQ ID NO: 53335

SEQ ID NO: 488332 - RNA, 64 nt, Homo Sapiens; identical to SEQ ID NO: 53336

SEQ ID NO: 488333 - RNA, 64 nt, Homo Sapiens; identical to SEQ ID NO: 53337

SEQ ID NO: 488334 - RNA, 64 nt, Homo Sapiens; identical to SEQ ID NO: 53338

SEQ ID NO: 488335 - RNA, 64 nt, Homo Sapiens; identical to SEQ ID NO: 53339

SEQ ID NO: 488336 - RNA, 64 nt, Homo Sapiens; identical to SEQ ID NO: 53340

SEQ ID NO: 488337 - RNA, 64 nt, Homo Sapiens; identical to SEQ ID NO: 53341

SEQ ID NO: 488338 - RNA, 64 nt, Homo Sapiens; identical to SEQ ID NO: 53342

SEQ ID NO: 488339 - RNA, 51 nt, Homo Sapiens; identical to SEQ ID NO: 53343

SEQ ID NO: 488340 - RNA, 64 nt, Homo Sapiens; identical to SEQ ID NO: 53344

SEQ ID NO: 488341 - RNA, 64 nt, Homo Sapiens; identical to SEQ ID NO: 53345

SEQ ID NO: 488342 - RNA, 64 nt, Homo Sapiens; identical to SEQ ID NO: 53346

SEQ ID NO: 488343 - RNA, 64 nt, Homo Sapiens; identical to SEQ ID NO: 53347

SEQ ID NO: 488344 - RNA, 64 nt, Homo Sapiens; identical to SEQ ID NO: 53348

SEQ ID NO: 488345 - RNA, 64 nt, Homo Sapiens; identical to SEQ ID NO: 53349

SEQ ID NO: 488346 - RNA, 64 nt, Homo Sapiens; identical to SEQ ID NO: 53350

SEQ ID NO: 488347 - RNA, 64 nt, Homo Sapiens; identical to SEQ ID NO: 53351

SEQ ID NO: 488348 - RNA, 64 nt, Homo Sapiens; identical to SEQ ID NO: 53352

SEQ ID NO: 488349 - RNA, 64 nt, Homo Sapiens; identical to SEQ ID NO: 53353

SEQ ID NO: 488350 - RNA, 64 nt, Homo Sapiens; identical to SEQ ID NO: 53354

SEQ ID NO: 488351 - RNA, 64 nt, Homo Sapiens; identical to SEQ ID NO: 53355

SEQ ID NO: 488352 - RNA, 64 nt, Homo Sapiens; identical to SEQ ID NO: 53356

SEQ ID NO: 488353 - RNA, 64 nt, Homo Sapiens; identical to SEQ ID NO: 53357

SEQ ID NO: 488354 - RNA, 64 nt, Homo Sapiens; identical to SEQ ID NO: 53358

SEQ ID NO: 488355 - RNA, 64 nt, Homo Sapiens; identical to SEQ ID NO: 53359

SEQ ID NO: 488356 - RNA, 64 nt, Homo Sapiens; identical to SEQ ID NO: 53360

SEQ ID NO: 488357 - RNA, 64 nt, Homo Sapiens; identical to SEQ ID NO: 53361

SEQ ID NO: 488358 - RNA, 64 nt, Homo Sapiens; identical to SEQ ID NO: 53362

SEQ ID NO: 488359 - RNA, 64 nt, Homo Sapiens; identical to SEQ ID NO: 53363

SEQ ID NO: 488360 - RNA, 64 nt, Homo Sapiens; identical to SEQ ID NO: 53364

SEQ ID NO: 488361 - RNA, 64 nt, Homo Sapiens; identical to SEQ ID NO: 53365

SEQ ID NO: 488362 - RNA, 64 nt, Homo Sapiens; identical to SEQ ID NO: 53366

SEQ ID NO: 488363 - RNA, 64 nt, Homo Sapiens; identical to SEQ ID NO: 53367

SEQ ID NO: 488364 - RNA, 64 nt, Homo Sapiens; identical to SEQ ID NO: 53368

SEQ ID NO: 488365 - RNA, 64 nt, Homo Sapiens; identical to SEQ ID NO: 53369

SEQ ID NO: 488366 - RNA, 64 nt, Homo Sapiens; identical to SEQ ID NO: 53370

SEQ ID NO: 488367 - RNA, 64 nt, Homo Sapiens; identical to SEQ ID NO: 53371

SEQ ID NO: 488368 - RNA, 64 nt, Homo Sapiens; identical to SEQ ID NO: 53372

SEQ ID NO: 488369 - RNA, 64 nt, Homo Sapiens; identical to SEQ ID NO: 277176

SEQ ID NO: 488370 - RNA, 64 nt, Homo Sapiens; identical to SEQ ID NO: 277177

SEQ ID NO: 488371 - RNA, 64 nt, Homo Sapiens; identical to SEQ ID NO: 277178

SEQ ID NO: 488372 - RNA, 64 nt, Homo Sapiens; identical to SEQ ID NO: 277179

SEQ ID NO: 488373 - RNA, 64 nt, Homo Sapiens; identical to SEQ ID NO: 277180

SEQ ID NO: 488374 - RNA, 64 nt, Homo Sapiens; identical to SEQ ID NO: 277181

SEQ ID NO: 488375 - RNA, 64 nt, Homo Sapiens; identical to SEQ ID NO: 277182

SEQ ID NO: 488376 - RNA, 64 nt, Homo Sapiens; identical to SEQ ID NO: 277183

SEQ ID NO: 488377 - RNA, 64 nt, Homo Sapiens; identical to SEQ ID NO: 277184

SEQ ID NO: 488378 - RNA, 64 nt, Homo Sapiens; identical to SEQ ID NO: 277185

SEQ ID NO: 488379 - RNA, 52 nt, Homo Sapiens; identical to SEQ ID NO: 277186

SEQ ID NO: 488380 - RNA, 64 nt, Homo Sapiens; identical to SEQ ID NO: 277187

SEQ ID NO: 488381 - RNA, 64 nt, Homo Sapiens; identical to SEQ ID NO: 277188

SEQ ID NO: 488382 - RNA, 64 nt, Homo Sapiens; identical to SEQ ID NO: 277189

SEQ ID NO: 488383 - RNA, 64 nt, Homo Sapiens; identical to SEQ ID NO: 277190

SEQ ID NO: 488384 - RNA, 64 nt, Homo Sapiens; identical to SEQ ID NO: 277191

SEQ ID NO: 488385 - RNA, 64 nt, Homo Sapiens; identical to SEQ ID NO: 277192

SEQ ID NO: 488386 - RNA, 64 nt, Homo Sapiens; identical to SEQ ID NO: 277193

SEQ ID NO: 488387 - RNA, 64 nt, Homo Sapiens; identical to SEQ ID NO: 277194

SEQ ID NO: 488388 - RNA, 64 nt, Homo Sapiens; identical to SEQ ID NO: 277195

SEQ ID NO: 488389 - RNA, 64 nt, Homo Sapiens; identical to SEQ ID NO: 277196

SEQ ID NO: 488390 - RNA, 64 nt, Homo Sapiens; identical to SEQ ID NO: 277197

SEQ ID NO: 488391 - RNA, 64 nt, Homo Sapiens; identical to SEQ ID NO: 277198

SEQ ID NO: 488392 - RNA, 64 nt, Homo Sapiens; identical to SEQ ID NO: 277199

SEQ ID NO: 488393 - RNA, 64 nt, Homo Sapiens; identical to SEQ ID NO: 53335

SEQ ID NO: 488394 - RNA, 64 nt, Homo Sapiens; identical to SEQ ID NO: 53336

SEQ ID NO: 488395 - RNA, 64 nt, Homo Sapiens; identical to SEQ ID NO: 53337

SEQ ID NO: 488396 - RNA, 64 nt, Homo Sapiens; identical to SEQ ID NO: 53338

SEQ ID NO: 488397 - RNA, 64 nt, Homo Sapiens; identical to SEQ ID NO: 53339

SEQ ID NO: 488398 - RNA, 64 nt, Homo Sapiens; identical to SEQ ID NO: 53340

SEQ ID NO: 488399 - RNA, 64 nt, Homo Sapiens; identical to SEQ ID NO: 53341

SEQ ID NO: 488400 - RNA, 64 nt, Homo Sapiens; identical to SEQ ID NO: 53342

SEQ ID NO: 488401 - RNA, 51 nt, Homo Sapiens; identical to SEQ ID NO: 53343

SEQ ID NO: 488402 - RNA, 64 nt, Homo Sapiens; identical to SEQ ID NO: 53344

SEQ ID NO: 488403 - RNA, 64 nt, Homo Sapiens; identical to SEQ ID NO: 53345

SEQ ID NO: 488404 - RNA, 64 nt, Homo Sapiens; identical to SEQ ID NO: 53346

SEQ ID NO: 488405 - RNA, 64 nt, Homo Sapiens; identical to SEQ ID NO: 53347

SEQ ID NO: 488406 - RNA, 64 nt, Homo Sapiens; identical to SEQ ID NO: 53348

SEQ ID NO: 488407 - RNA, 64 nt, Homo Sapiens; identical to SEQ ID NO: 53349

SEQ ID NO: 488408 - RNA, 64 nt, Homo Sapiens; identical to SEQ ID NO: 53350

SEQ ID NO: 488409 - RNA, 64 nt, Homo Sapiens; identical to SEQ ID NO: 53351

SEQ ID NO: 488410 - RNA, 64 nt, Homo Sapiens; identical to SEQ ID NO: 53352

SEQ ID NO: 488411 - RNA, 64 nt, Homo Sapiens; identical to SEQ ID NO: 53353

SEQ ID NO: 488412 - RNA, 64 nt, Homo Sapiens; identical to SEQ ID NO: 53354

SEQ ID NO: 488413 - RNA, 64 nt, Homo Sapiens; identical to SEQ ID NO: 53355

SEQ ID NO: 488414 - RNA, 64 nt, Homo Sapiens; identical to SEQ ID NO: 53356

SEQ ID NO: 488415 - RNA, 64 nt, Homo Sapiens; identical to SEQ ID NO: 53357

SEQ ID NO: 488416 - RNA, 64 nt, Homo Sapiens; identical to SEQ ID NO: 53358

SEQ ID NO: 488417 - RNA, 64 nt, Homo Sapiens; identical to SEQ ID NO: 53359

SEQ ID NO: 488418 - RNA, 64 nt, Homo Sapiens; identical to SEQ ID NO: 53360

SEQ ID NO: 488419 - RNA, 64 nt, Homo Sapiens; identical to SEQ ID NO: 53361

SEQ ID NO: 488420 - RNA, 64 nt, Homo Sapiens; identical to SEQ ID NO: 53362

SEQ ID NO: 488421 - RNA, 64 nt, Homo Sapiens; identical to SEQ ID NO: 53363

SEQ ID NO: 488422 - RNA, 64 nt, Homo Sapiens; identical to SEQ ID NO: 53364

SEQ ID NO: 488423 - RNA, 64 nt, Homo Sapiens; identical to SEQ ID NO: 53365

SEQ ID NO: 488424 - RNA, 64 nt, Homo Sapiens; identical to SEQ ID NO: 53366

SEQ ID NO: 488425 - RNA, 64 nt, Homo Sapiens; identical to SEQ ID NO: 53367

SEQ ID NO: 488426 - RNA, 64 nt, Homo Sapiens; identical to SEQ ID NO: 53368

SEQ ID NO: 488427 - RNA, 64 nt, Homo Sapiens; identical to SEQ ID NO: 53369

SEQ ID NO: 488428 - RNA, 64 nt, Homo Sapiens; identical to SEQ ID NO: 53370

SEQ ID NO: 488429 - RNA, 64 nt, Homo Sapiens; identical to SEQ ID NO: 53371

SEQ ID NO: 488430 - RNA, 64 nt, Homo Sapiens; identical to SEQ ID NO: 53372

SEQ ID NO: 488431 - RNA, 64 nt, Homo Sapiens; identical to SEQ ID NO: 265198

SEQ ID NO: 488432 - RNA, 64 nt, Homo Sapiens; identical to SEQ ID NO: 265199

SEQ ID NO: 488433 - RNA, 64 nt, Homo Sapiens; identical to SEQ ID NO: 265200

SEQ ID NO: 488434 - RNA, 64 nt, Homo Sapiens; identical to SEQ ID NO: 265201

SEQ ID NO: 488435 - RNA, 64 nt, Homo Sapiens; identical to SEQ ID NO: 265202

SEQ ID NO: 488436 - RNA, 64 nt, Homo Sapiens; identical to SEQ ID NO: 265203

SEQ ID NO: 488437 - RNA, 64 nt, Homo Sapiens; identical to SEQ ID NO: 265204

SEQ ID NO: 488438 - RNA, 64 nt, Homo Sapiens; identical to SEQ ID NO: 265205

SEQ ID NO: 488439 - RNA, 64 nt, Homo Sapiens; identical to SEQ ID NO: 83782

SEQ ID NO: 488440 - RNA, 64 nt, Homo Sapiens; identical to SEQ ID NO: 83783

SEQ ID NO: 488441 - RNA, 64 nt, Homo Sapiens; identical to SEQ ID NO: 83784

SEQ ID NO: 488442 - RNA, 64 nt, Homo Sapiens; identical to SEQ ID NO: 83785

SEQ ID NO: 488443 - RNA, 64 nt, Homo Sapiens; identical to SEQ ID NO: 83786

SEQ ID NO: 488444 - RNA, 64 nt, Homo Sapiens; identical to SEQ ID NO: 83787

SEQ ID NO: 488445 - RNA, 64 nt, Homo Sapiens; identical to SEQ ID NO: 83788

SEQ ID NO: 488446 - RNA, 64 nt, Homo Sapiens; identical to SEQ ID NO: 83789

SEQ ID NO: 488447 - RNA, 64 nt, Homo Sapiens; identical to SEQ ID NO: 83790

SEQ ID NO: 488448 - RNA, 64 nt, Homo Sapiens; identical to SEQ ID NO: 83791

SEQ ID NO: 488449 - RNA, 64 nt, Homo Sapiens; identical to SEQ ID NO: 83792

SEQ ID NO: 488450 - RNA, 64 nt, Homo Sapiens; identical to SEQ ID NO: 83793

SEQ ID NO: 488451 - RNA, 64 nt, Homo Sapiens; identical to SEQ ID NO: 83794

SEQ ID NO: 488452 - RNA, 64 nt, Homo Sapiens; identical to SEQ ID NO: 83795

SEQ ID NO: 488453 - RNA, 64 nt, Homo Sapiens; identical to SEQ ID NO: 83796

SEQ ID NO: 488454 - RNA, 64 nt, Homo Sapiens; identical to SEQ ID NO: 83797

SEQ ID NO: 488455 - RNA, 64 nt, Homo Sapiens; identical to SEQ ID NO: 83798

SEQ ID NO: 488456 - RNA, 64 nt, Homo Sapiens; identical to SEQ ID NO: 83799

SEQ ID NO: 488457 - RNA, 64 nt, Homo Sapiens; identical to SEQ ID NO: 83800

SEQ ID NO: 488458 - RNA, 64 nt, Homo Sapiens; identical to SEQ ID NO: 83801

SEQ ID NO: 488459 - RNA, 64 nt, Homo Sapiens; identical to SEQ ID NO: 83802

SEQ ID NO: 488460 - RNA, 64 nt, Homo Sapiens; identical to SEQ ID NO: 83803

SEQ ID NO: 488461 - RNA, 64 nt, Homo Sapiens; identical to SEQ ID NO: 83804

SEQ ID NO: 488462 - RNA, 64 nt, Homo Sapiens; identical to SEQ ID NO: 83805

SEQ ID NO: 488463 - RNA, 64 nt, Homo Sapiens; identical to SEQ ID NO: 83806

SEQ ID NO: 488464 - RNA, 64 nt, Homo Sapiens; identical to SEQ ID NO: 83807

SEQ ID NO: 488465 - RNA, 64 nt, Homo Sapiens; identical to SEQ ID NO: 83808

SEQ ID NO: 488466 - RNA, 64 nt, Homo Sapiens; identical to SEQ ID NO: 83809

SEQ ID NO: 488467 - RNA, 64 nt, Homo Sapiens; identical to SEQ ID NO: 83810

SEQ ID NO: 488468 - RNA, 64 nt, Homo Sapiens; identical to SEQ ID NO: 83811

SEQ ID NO: 488469 - RNA, 64 nt, Homo Sapiens; identical to SEQ ID NO: 83812

SEQ ID NO: 488470 - RNA, 64 nt, Homo Sapiens; identical to SEQ ID NO: 83813

SEQ ID NO: 488471 - RNA, 64 nt, Homo Sapiens; identical to SEQ ID NO: 101897

SEQ ID NO: 488472 - RNA, 64 nt, Homo Sapiens; identical to SEQ ID NO: 101898

SEQ ID NO: 488473 - RNA, 64 nt, Homo Sapiens; identical to SEQ ID NO: 101899

SEQ ID NO: 488474 - RNA, 64 nt, Homo Sapiens; identical to SEQ ID NO: 101900

SEQ ID NO: 488475 - RNA, 64 nt, Homo Sapiens; identical to SEQ ID NO: 101901

SEQ ID NO: 488476 - RNA, 64 nt, Homo Sapiens; identical to SEQ ID NO: 101902

SEQ ID NO: 488477 - RNA, 64 nt, Homo Sapiens; identical to SEQ ID NO: 334267

SEQ ID NO: 488478 - RNA, 64 nt, Homo Sapiens; identical to SEQ ID NO: 334268

SEQ ID NO: 488479 - RNA, 64 nt, Homo Sapiens; identical to SEQ ID NO: 334269

SEQ ID NO: 488480 - RNA, 64 nt, Homo Sapiens; identical to SEQ ID NO: 334270

SEQ ID NO: 488481 - RNA, 64 nt, Homo Sapiens; identical to SEQ ID NO: 334271

SEQ ID NO: 488482 - RNA, 64 nt, Homo Sapiens; identical to SEQ ID NO: 334272

SEQ ID NO: 488483 - RNA, 64 nt, Homo Sapiens; identical to SEQ ID NO: 334273

SEQ ID NO: 488484 - RNA, 64 nt, Homo Sapiens; identical to SEQ ID NO: 334274

SEQ ID NO: 488485 - RNA, 64 nt, Homo Sapiens; identical to SEQ ID NO: 334275

SEQ ID NO: 488486 - RNA, 64 nt, Homo Sapiens; identical to SEQ ID NO: 334276

SEQ ID NO: 488487 - RNA, 64 nt, Homo Sapiens
uguugguggugcagccccaggaccaagcuuaaggagaggagagcaucugcucugagacggaugg

SEQ ID NO: 488488 - RNA, 64 nt, Homo Sapiens
gugaccccaucucugcugcuucugggccugauggagaggagaacacuagacaugccaacucggg

SEQ ID NO: 488489 - RNA, 64 nt, Homo Sapiens
gccccugggguggguuuagcaggcugcagcaggcagaggagaguaccccccugagagcaugugg

SEQ ID NO: 488490 - RNA, 64 nt, Homo Sapiens
gacacacacuggcuccuggaacugggcccagaggagaggagacaccccagucaccuaagcaauc

SEQ ID NO: 488491 - RNA, 64 nt, Homo Sapiens
agacagacacacacuggcuccaaucacugggcccagaggagaggugucaccccagucaccuaag

SEQ ID NO: 488492 - RNA, 64 nt, Homo Sapiens
cugagugcuggacacugcguuccagaaaugaggaagaggagagagaagagauggacagaccuca

SEQ ID NO: 488493 - RNA, 64 nt, Homo Sapiens
cuguacauaguugguguuuaaugaguguuuauggagaggagaguucuaaggucaccucuggcug

SEQ ID NO: 488494 - RNA, 64 nt, Homo Sapiens
uuucuuuggucugugagcaacucaaagaggcagaagaggagaaugacuuuuccagaauagaagu

SEQ ID NO: 488495 - RNA, 64 nt, Homo Sapiens
uuguaacuggucaccacuggacgggaaggagaacagaggagagggaaagagaagcccaaccucu

SEQ ID NO: 488496 - RNA, 64 nt, Homo Sapiens
agaaggagagaaagugggugagaugcuggagaagagaggagaggagagaggcagagagcggucu

SEQ ID NO: 488497 - RNA, 64 nt, Homo Sapiens
gagagaaagugggugagaugcuggagaagagaggagaggagagaggcagagagcggucucaggc

SEQ ID NO: 488498 - RNA, 64 nt, Homo Sapiens
acuucuauuagcagugaugauggaaggcgagcuaagaggagacuuagauccagugggaaaaaaa

SEQ ID NO: 488499 - RNA, 64 nt, Homo Sapiens
ucugcacuccugauaggaguuccccagcaaaaguagaggagacuuccccucuaggaaaugcacg

SEQ ID NO: 488500 - RNA, 64 nt, Homo Sapiens
cgcgcaggcagggagaagggccgggggggguaggagaggagaaaaaaaaagugaaaaaaagaaa

SEQ ID NO: 488501 - RNA, 64 nt, Homo Sapiens
aggugagacuucccagaccccggaggcguggaggagaggagacuguuugaugugguacaggggc

SEQ ID NO: 488502 - RNA, 64 nt, Homo Sapiens
uuggaaugaggccuacaggguucaccaggauguaagaggagagaggaauccacaggaccaccag

SEQ ID NO: 488503 - RNA, 64 nt, Homo Sapiens
uguaagaggagagaggaauccacaggaccaccagagaggagagggaaccagauaugcagaucag

SEQ ID NO: 488504 - RNA, 64 nt, Homo Sapiens
uaucgcaaauuuucuaagccacguccuauaggacagaggagacuggccccacuucuaugggucu

SEQ ID NO: 488505 - RNA, 64 nt, Homo Sapiens
gagcagggaugaagggucaggcagaaagcgugauagaggagagaauuuuugacaaaacucaaaa

SEQ ID NO: 488506 - RNA, 64 nt, Homo Sapiens
gagagagaaugugauuuuuggaaugguagagaggagaggagagauccccaccuggcacugagga

SEQ ID NO: 488507 - RNA, 64 nt, Homo Sapiens
agagagagagagaaugugaugaggagaaugguagagaggagaggaucuguccccaccuggcacu

SEQ ID NO: 488508 - RNA, 64 nt, Homo Sapiens
gcuucguccgagaaacgccaggacagacgauggcagaggagagggcuccugugacggcggcgag

SEQ ID NO: 488509 - RNA, 64 nt, Homo Sapiens
uuguggaaaaggaacacgcaaagggagaagugugagaggagaaacaaaauaugagcguuuaaaa

SEQ ID NO: 488510 - RNA, 64 nt, Homo Sapiens
gauggaguggggccucaaagccugggcacgccccagaggagagacgaugauggcucaggcucag

SEQ ID NO: 488511 - RNA, 64 nt, Homo Sapiens
aucaugucggugagauggugccccacaguaucuuagaggagacacuucucugcccucaagggaa

SEQ ID NO: 488512 - RNA, 64 nt, Homo Sapiens
caugcauggacaccagaagacgauucagaacacaagaggagaaugagcuggagcgccagcacca

SEQ ID NO: 488513 - RNA, 64 nt, Homo Sapiens
ccuucccagaagguugauucuuggccugggugguagaggagauauccugacccuaaagucuucc

SEQ ID NO: 488514 - RNA, 64 nt, Homo Sapiens
ucuagaaacaggguugaaguucccagauucccugagaggagaauguguauaggaggguuuggcu

SEQ ID NO: 488515 - RNA, 64 nt, Homo Sapiens
cuuugguaucguaucgccucuguguccuuuuaagagaggagaguucaguaccccgugcuuucuu

SEQ ID NO: 488516 - RNA, 64 nt, Homo Sapiens
gagaauauguaugccugcaauaugggaacaaauuagaggagacuuuuuuuuuucauguuaugag

SEQ ID NO: 488517 - RNA, 64 nt, Homo Sapiens
ggucaggggcacacauggcuuaagugacaaagccagaggagaagacaacccugacagcaucacg

SEQ ID NO: 488518 - RNA, 64 nt, Homo Sapiens
uccuauaccuuguccuuccugcuugccuaggggaagaggagaagaggguaagggggcuucacuc

SEQ ID NO: 488519 - RNA, 64 nt, Homo Sapiens
acguggauggacccccaugucugagaggggugaaagaggagaccaauggcaguucagguucaag

SEQ ID NO: 488520 - RNA, 64 nt, Homo Sapiens
uucucuuuugagagugguuguuucuuccuggagaagaggagauuuuuaaagaucagaugccauc

SEQ ID NO: 488521 - RNA, 64 nt, Homo Sapiens
gugcauuuuugaccucaacaguuuuucuucugggagaggagaaucaguaauucuacaauaaugc

SEQ ID NO: 488522 - RNA, 64 nt, Homo Sapiens
ugucaggcucacugcccuuauagugauaaggguaagaggagagagggccgugccagcugugccc

SEQ ID NO: 488523 - RNA, 64 nt, Homo Sapiens
gcaacuguucuuucuuuuuuagcccagagggaugagaggagagaacauagaucucucccacuag

SEQ ID NO: 488524 - RNA, 64 nt, Homo Sapiens
cugcuggagcuugaguggaaaggaugcuggagcaagaggagagggguugcuggagcaagaggag

SEQ ID NO: 488525 - RNA, 64 nt, Homo Sapiens
augcuggagcaagaggagagagguugcuggagcaagaggagaggccugaaccaagagcaggaag

SEQ ID NO: 488526 - RNA, 64 nt, Homo Sapiens
uugcuggagcugcaggagagagguugcuggagcaagaggagagggguuguuggagcaagaggag

SEQ ID NO: 488527 - RNA, 64 nt, Homo Sapiens
uugcuggagcaagaggagagagguuguuggagcaagaggagagggauuguuggaacaagacgag

SEQ ID NO: 488528 - RNA, 64 nt, Homo Sapiens
cuacuggagcugcaggagagagguugcuggagcaagaggagagggguugcuggagcaagaggag

SEQ ID NO: 488529 - RNA, 64 nt, Homo Sapiens
uugcuggagcaagaggagagagguugcuggagcaagaggagaggaguugcuggagcaagaggag

SEQ ID NO: 488530 - RNA, 64 nt, Homo Sapiens
uugcuggagcaagaggagagaaguugcuggagcaagaggagagggguuguuggagcaagaggag

SEQ ID NO: 488531 - RNA, 64 nt, Homo Sapiens
uugcuggagcaagaggagagagguuguuggagcaagaggagaagagagcaggaagagguugcuc

SEQ ID NO: 488532 - RNA, 64 nt, Homo Sapiens
guagcaguagccacuugguucuuagggggccccaagaggagaggagaagugcugagguugaugu

SEQ ID NO: 488533 - RNA, 64 nt, Homo Sapiens
aguagccacuugguucuuagggggccccaagaggagaggagaagugcugagguugauguuacga

SEQ ID NO: 488534 - RNA, 64 nt, Homo Sapiens
uguucugcccacucuggggaauagggaggggaggagaggagaggagagggaggauccuggagga

SEQ ID NO: 488535 - RNA, 64 nt, Homo Sapiens
ugcccacucuggggaauagggaggggaggagaggagaggagagggaggauccuggaggacuggg

SEQ ID NO: 488536 - RNA, 64 nt, Homo Sapiens
accagagaaagaugaagagguccaaauuacucauagaggagaaaccucaagcuggacugugggu

SEQ ID NO: 488537 - RNA, 64 nt, Homo Sapiens
gauugguguaaucugcuuuccaggcuuggacuagagaggagaaacgcuucaggguaggugggca

SEQ ID NO: 488538 - RNA, 64 nt, Homo Sapiens
uacagcacaaauaaauaaugacugucauacauccagaggagaccgaaccugcccagcugaugua

SEQ ID NO: 488539 - RNA, 64 nt, Homo Sapiens
ggaucccaguuggucucuggcagugggauccuggagaggagaaauccuggccucugcucaugcg

SEQ ID NO: 488540 - RNA, 64 nt, Homo Sapiens
uucuguuuguuuuuccccuccagcaagagaaagaagaggagauucuggaguacccuggggucag

SEQ ID NO: 488541 - RNA, 64 nt, Homo Sapiens
aacaagggccuccgaaacccggcugagggaagggagaggagaggcgacugccugcucaccccug

SEQ ID NO: 488542 - RNA, 64 nt, Homo Sapiens
gggaggaagcugggcuguguagugcagggggaggagaggagaaaugcuccaggcaggucagagc

SEQ ID NO: 488543 - RNA, 64 nt, Homo Sapiens
gcagcagagccaggggucugcaccagugucccaaagaggagagccagccaguccuggucggcca

SEQ ID NO: 488544 - RNA, 64 nt, Homo Sapiens
gaauggugaaagagaguggagauacggaagggggagaggagaggagaaauguggacagagggcu

SEQ ID NO: 488545 - RNA, 64 nt, Homo Sapiens
gugaaagagaguggagauacggaagggggagaggagaggagaaauguggacagagggcuugaag

SEQ ID NO: 488546 - RNA, 64 nt, Homo Sapiens
gcugugaaguugggcgugcuagccaaagguccuaagaggagacauucaaagcuucucucacccu

SEQ ID NO: 488547 - RNA, 64 nt, Homo Sapiens
cuuccccaggguuuaguccuacaaauuccauccaagaggagaauaaaagucuugauagcacaac

SEQ ID NO: 488548 - RNA, 64 nt, Homo Sapiens
cagacacagagcaggaggacuuccaagagacagaagaggagacaaaaugccaugacaggugucc

SEQ ID NO: 488549 - RNA, 64 nt, Homo Sapiens
cagacacaaagcaggaggcccuaugagagacggaagaggagacaaugggcccaauccagugucc

SEQ ID NO: 488550 - RNA, 64 nt, Homo Sapiens; identical to SEQ ID NO: 363148

SEQ ID NO: 488551 - RNA, 64 nt, Homo Sapiens; identical to SEQ ID NO: 363149

SEQ ID NO: 488552 - RNA, 64 nt, Homo Sapiens; identical to SEQ ID NO: 363150

SEQ ID NO: 488553 - RNA, 64 nt, Homo Sapiens; identical to SEQ ID NO: 363151

SEQ ID NO: 488554 - RNA, 64 nt, Homo Sapiens; identical to SEQ ID NO: 363152

SEQ ID NO: 488555 - RNA, 64 nt, Homo Sapiens; identical to SEQ ID NO: 363153

SEQ ID NO: 488556 - RNA, 64 nt, Homo Sapiens; identical to SEQ ID NO: 363154

SEQ ID NO: 488557 - RNA, 64 nt, Homo Sapiens; identical to SEQ ID NO: 363155

SEQ ID NO: 488558 - RNA, 64 nt, Homo Sapiens; identical to SEQ ID NO: 363156

SEQ ID NO: 488559 - RNA, 64 nt, Homo Sapiens; identical to SEQ ID NO: 363157

SEQ ID NO: 488560 - RNA, 64 nt, Homo Sapiens; identical to SEQ ID NO: 363158

SEQ ID NO: 488561 - RNA, 64 nt, Homo Sapiens; identical to SEQ ID NO: 363159

SEQ ID NO: 488562 - RNA, 64 nt, Homo Sapiens; identical to SEQ ID NO: 363160

SEQ ID NO: 488563 - RNA, 64 nt, Homo Sapiens; identical to SEQ ID NO: 363161

SEQ ID NO: 488564 - RNA, 64 nt, Homo Sapiens; identical to SEQ ID NO: 363162

SEQ ID NO: 488565 - RNA, 64 nt, Homo Sapiens; identical to SEQ ID NO: 363163

SEQ ID NO: 488566 - RNA, 64 nt, Homo Sapiens; identical to SEQ ID NO: 363164

SEQ ID NO: 488567 - RNA, 64 nt, Homo Sapiens; identical to SEQ ID NO: 363165

SEQ ID NO: 488568 - RNA, 64 nt, Homo Sapiens; identical to SEQ ID NO: 363166

SEQ ID NO: 488569 - RNA, 64 nt, Homo Sapiens; identical to SEQ ID NO: 363167

SEQ ID NO: 488570 - RNA, 64 nt, Homo Sapiens; identical to SEQ ID NO: 363168

SEQ ID NO: 488571 - RNA, 64 nt, Homo Sapiens; identical to SEQ ID NO: 363169

SEQ ID NO: 488572 - RNA, 64 nt, Homo Sapiens; identical to SEQ ID NO: 363170

SEQ ID NO: 488573 - RNA, 64 nt, Homo Sapiens; identical to SEQ ID NO: 363171

SEQ ID NO: 488574 - RNA, 64 nt, Homo Sapiens; identical to SEQ ID NO: 363172

SEQ ID NO: 488575 - RNA, 64 nt, Homo Sapiens; identical to SEQ ID NO: 363173

SEQ ID NO: 488576 - RNA, 64 nt, Homo Sapiens; identical to SEQ ID NO: 363174

SEQ ID NO: 488577 - RNA, 64 nt, Homo Sapiens; identical to SEQ ID NO: 363175

SEQ ID NO: 488578 - RNA, 64 nt, Homo Sapiens; identical to SEQ ID NO: 363176

SEQ ID NO: 488579 - RNA, 64 nt, Homo Sapiens; identical to SEQ ID NO: 363177

SEQ ID NO: 488580 - RNA, 64 nt, Homo Sapiens; identical to SEQ ID NO: 363178

SEQ ID NO: 488581 - RNA, 64 nt, Homo Sapiens; identical to SEQ ID NO: 363179

SEQ ID NO: 488582 - RNA, 64 nt, Homo Sapiens; identical to SEQ ID NO: 363180

SEQ ID NO: 488583 - RNA, 64 nt, Homo Sapiens; identical to SEQ ID NO: 363181

SEQ ID NO: 488584 - RNA, 64 nt, Homo Sapiens; identical to SEQ ID NO: 363182

SEQ ID NO: 488585 - RNA, 64 nt, Homo Sapiens; identical to SEQ ID NO: 363183

SEQ ID NO: 488586 - RNA, 64 nt, Homo Sapiens; identical to SEQ ID NO: 363184

SEQ ID NO: 488587 - RNA, 64 nt, Homo Sapiens; identical to SEQ ID NO: 363185

SEQ ID NO: 488588 - RNA, 64 nt, Homo Sapiens; identical to SEQ ID NO: 363186

SEQ ID NO: 488589 - RNA, 64 nt, Homo Sapiens; identical to SEQ ID NO: 363187

SEQ ID NO: 488590 - RNA, 64 nt, Homo Sapiens; identical to SEQ ID NO: 363188

SEQ ID NO: 488591 - RNA, 64 nt, Homo Sapiens; identical to SEQ ID NO: 363189

SEQ ID NO: 488592 - RNA, 64 nt, Homo Sapiens; identical to SEQ ID NO: 363190

SEQ ID NO: 488593 - RNA, 64 nt, Homo Sapiens; identical to SEQ ID NO: 363191

SEQ ID NO: 488594 - RNA, 64 nt, Homo Sapiens; identical to SEQ ID NO: 363192

SEQ ID NO: 488595 - RNA, 64 nt, Homo Sapiens; identical to SEQ ID NO: 363193

SEQ ID NO: 488596 - RNA, 64 nt, Homo Sapiens; identical to SEQ ID NO: 363194

SEQ ID NO: 488597 - RNA, 64 nt, Homo Sapiens; identical to SEQ ID NO: 363195

SEQ ID NO: 488598 - RNA, 64 nt, Homo Sapiens
gugguggcacgugccuguagucccagcuacuugggaggcugaggcaggagaaucacuugacccc

SEQ ID NO: 488599 - RNA, 64 nt, Homo Sapiens
auggugccgcauaacuauaaucccagcuacuugggaggcugaggcaggagaaucgcuugaaccc

SEQ ID NO: 488600 - RNA, 64 nt, Homo Sapiens
augguggugggcuccuguagucccagcuacuugggaggcugaggcaggagaaucgcuugaaccu

SEQ ID NO: 488601 - RNA, 64 nt, Homo Sapiens
agucacccaugaagacaggacagugcuucagccugaggcugagacugcgggaugguccuggggc

SEQ ID NO: 488602 - RNA, 64 nt, Homo Sapiens
gcaguggcucacgccuaugaucccagcacuuugggaggcugaggcggguggaucaccugagguu

SEQ ID NO: 488603 - RNA, 64 nt, Homo Sapiens
cuggcuggcugcagugacgugcaccuguacucaggaggcugaggggaggaucacuggagcccag

SEQ ID NO: 488604 - RNA, 64 nt, Homo Sapiens
gcaguggcucacaccucuaaucccagcacuuugggaggcugagguagguggaucacccaagguc

SEQ ID NO: 488605 - RNA, 64 nt, Homo Sapiens
augguagcaggcgcuuguaaucccagcuacuugggaggcugaggcuggagaaucgcuugaaccc

SEQ ID NO: 488606 - RNA, 64 nt, Homo Sapiens
auggugacaggcaccuaugguuccagcuacucaggaggcugaggugggaggaucgcuugugccu

SEQ ID NO: 488607 - RNA, 64 nt, Homo Sapiens
auaguggcacacgccuguagucccaguuacuugggaggcugaggcaggagaauugcuugaaccu

SEQ ID NO: 488608 - RNA, 64 nt, Homo Sapiens
gugguggcaccugccuguaaucccagcuacuugggaggcugaggcaggagaaucgcuugaaccc

SEQ ID NO: 488609 - RNA, 64 nt, Homo Sapiens
augauggcucacacguauaauccuaaugcuuugagaggcugagguaggagcaucaccuggggcu

SEQ ID NO: 488610 - RNA, 64 nt, Homo Sapiens
caugguggcaaucagcucuagucccaacuacuuggaggcugaagcaggaagaucacgugagccc

SEQ ID NO: 488611 - RNA, 64 nt, Homo Sapiens
uacagguguuaacagaacugaaauccgacaaccagaggcugaaagaugaaaauggugcccucau

SEQ ID NO: 488612 - RNA, 64 nt, Homo Sapiens
gugguggcaggcgccuguagucccagcuacucaggaggcugaggcaggagaauggcgugaaccc

SEQ ID NO: 488613 - RNA, 64 nt, Homo Sapiens
cauaguggcgcgcgccuauaaucccagcuacugggaggcugaggcgggagaaucgcuugagccg

SEQ ID NO: 488614 - RNA, 64 nt, Homo Sapiens
gcggugguacaugccuguagucccagcuacuugggaggcugaggcaggagaauugcuugaaccc

SEQ ID NO: 488615 - RNA, 64 nt, Homo Sapiens
agugcuucaguggauucacugguuagauuaaaaagaggcugagaugagcagugaacuaagaggc

SEQ ID NO: 488616 - RNA, 64 nt, Homo Sapiens
gugguggugugccccuguaaucccagcuacucaggaggcugaagcaggagaaucgcuugaaccc

SEQ ID NO: 488617 - RNA, 64 nt, Homo Sapiens
caggagaauugcuugaaccgucccagcuacucgggaggcugagggugguggcaggagccuguag

SEQ ID NO: 488618 - RNA, 64 nt, Homo Sapiens
caggagaauggcaugaaccuucccagcuacuugggaggcugaggaugguggcgggcgccuguaa

SEQ ID NO: 488619 - RNA, 64 nt, Homo Sapiens
caagagaaucacuugaacccuggcaugguggugggaggcugaaguaaaaauacaaaaauuagcc

SEQ ID NO: 488620 - RNA, 64 nt, Homo Sapiens
caggagaauugcuugaaccuucccagcuacuugcgaggcugagggugguggcgugugccuguag

SEQ ID NO: 488621 - RNA, 64 nt, Homo Sapiens
cgggugaaaucaccugagguucccagcacuuugggaggcugagggcaguggcucacgccuguaa

SEQ ID NO: 488622 - RNA, 64 nt, Homo Sapiens
cgucugugugaugcagugugggguaaaguugugugaggcugacaaccuggauuuuaccccauga

SEQ ID NO: 488623 - RNA, 64 nt, Homo Sapiens
uguuccccgccacuguugaggaauaaggagggcugaggcugaguguggguagggcuguuugcug

SEQ ID NO: 488624 - RNA, 64 nt, Homo Sapiens
caggagaauugcuugagcccucccagcuacuugggaggcugaggcugguggcacacgccuguag

SEQ ID NO: 488625 - RNA, 64 nt, Homo Sapiens
caggaggaucacuugaggccucccaguuauaggggaggcugaaggugaugacuuguaacuguaa

SEQ ID NO: 488626 - RNA, 64 nt, Homo Sapiens
caggagaaucgcuugaaccuguaccgcuacuugggaggcugagguuagccgggugugguggugg

SEQ ID NO: 488627 - RNA, 64 nt, Homo Sapiens
ugggaggaucacuugagcccucccagcuacccaggaggcugagggcgcaauugcucaugcauag

SEQ ID NO: 488628 - RNA, 64 nt, Homo Sapiens
ugagaggaucaguugaggccuaacaacaccuucagaggcugagggugguugcucacagcuguaa

SEQ ID NO: 488629 - RNA, 64 nt, Homo Sapiens
caggagaauugcuugaaccuucccagcuacucaggaggcugaggaugguggcaugugccuauag

SEQ ID NO: 488630 - RNA, 64 nt, Homo Sapiens
ugggcagaucacgaggucaaucccagcacuuugggaggcugagguugguggcucacgccuguaa

SEQ ID NO: 488631 - RNA, 64 nt, Homo Sapiens
uaggaggaucgucuugagccucccaacacuuugggaggcugaagguaguggcucaugccuguaa

SEQ ID NO: 488632 - RNA, 64 nt, Homo Sapiens
cacgagauuccuugaacccaucccagcuacuugggaggcugaggacgguggugcaugccuguaa

SEQ ID NO: 488633 - RNA, 64 nt, Homo Sapiens
caggagaauugcuugaacccucccagcuacucaggaggcugaggaugguggcguacgccuguag

SEQ ID NO: 488634 - RNA, 64 nt, Homo Sapiens
caggagaaucgcuugaacccucccagcuacucaggaggcugagggugguggugggcgccuguaa

SEQ ID NO: 488635 - RNA, 64 nt, Homo Sapiens
caggagaaucacuugaacccucccagcuacuugggaggcugaggaugcuggcacgcaccaguaa

SEQ ID NO: 488636 - RNA, 64 nt, Homo Sapiens
caggagaaucgcuugaaccuuccaagauacucaggaggcugagggugguggugcaugccuguaa

SEQ ID NO: 488637 - RNA, 64 nt, Homo Sapiens
cgggcggaucacaagguccaucucagcacuuugggaggcugaggaugguggcucacgccuguaa

SEQ ID NO: 488638 - RNA, 64 nt, Homo Sapiens
caagagaauugcuugaacccucccagcuacuugggaggcugaggaugguggcgcgcaccuguaa

SEQ ID NO: 488639 - RNA, 64 nt, Homo Sapiens
cggguggaucacuugaggucucccagcacuuugggaggcugagggcgguggcucacgccuguaa

SEQ ID NO: 488640 - RNA, 64 nt, Homo Sapiens
caggagaauggugugaaccuucccagcuacuugggaggcugaggaugguggcaggcgccuguag

SEQ ID NO: 488641 - RNA, 64 nt, Homo Sapiens
ugggcggcucacgaggagauucccagcacuuugggaggcugagggugguugcucacgccuguaa

SEQ ID NO: 488642 - RNA, 64 nt, Homo Sapiens
guggcggugcgcaacuguagucccagcuacucgggaggcugaggcaggagaaucucuugaaccu

SEQ ID NO: 488643 - RNA, 64 nt, Homo Sapiens
gcaauggcucaugccuguaaucccagcacuuugggaggcugagaugggaggaucacuugaagcc

SEQ ID NO: 488644 - RNA, 64 nt, Homo Sapiens
gcaguggcucacaccuguauucccaacacuuuuggaggcugagguuggaggauugcuugagccc

SEQ ID NO: 488645 - RNA, 64 nt, Homo Sapiens
ugguggcacgugccugggagucccagcgacuugggaggcugaggugggaggauuguuugagccu

SEQ ID NO: 488646 - RNA, 64 nt, Homo Sapiens
gugguggcucaugccuguaaucccagcacuuugggaggcugaggugggcauaucaccugagguc

SEQ ID NO: 488647 - RNA, 64 nt, Homo Sapiens
auggugguacaugccuguaaucccagcuacucaggaggcugagacaggagaaucacuugaaccu

SEQ ID NO: 488648 - RNA, 64 nt, Homo Sapiens
augguaaugcgcgccuguggucccagcugcucgggaggcugaggugggaggaucacuugagccu

SEQ ID NO: 488649 - RNA, 64 nt, Homo Sapiens
uguaaucccagcuacuguaaucucagcuacuugggaggcugaggcaggagaauugccucaaccg

SEQ ID NO: 488650 - RNA, 64 nt, Homo Sapiens
uuaggcuggguaugguggcucaccagcacuuugggaggcugaggcagguggaucucuugagguc

SEQ ID NO: 488651 - RNA, 64 nt, Homo Sapiens
augguggcgugugccaguaaucccagcuacuugggaggcugaggcgcgagaaucgcuugaaccc

SEQ ID NO: 488652 - RNA, 64 nt, Homo Sapiens
gcaguggcucaugccuguaaucccagcacuuugggaggcugaggcgggcggaucaccugagguc

SEQ ID NO: 488653 - RNA, 64 nt, Homo Sapiens
augguggugcaugccuguaauuccagcuacucgggaggcugaggcaagagaaucgcuugaaucc

SEQ ID NO: 488654 - RNA, 64 nt, Homo Sapiens
ugguggcagaucccuuguagucccagcuacucgggaggcugaggcaggagaauagcuugaaccc

SEQ ID NO: 488655 - RNA, 64 nt, Homo Sapiens
augguggcucaugccuguaaucccagcacucugggaggcugaggugggcggaucacuugagcuc

SEQ ID NO: 488656 - RNA, 64 nt, Homo Sapiens
gugguggcucacgccuauaaucccagcacuuugggaggcugaaguggguggaucaccagagguc

SEQ ID NO: 488657 - RNA, 64 nt, Homo Sapiens
augguggcacacgccuguaaucccagcuacaccugaggcugaggcaggagaauugcuugaaccg

SEQ ID NO: 488658 - RNA, 64 nt, Homo Sapiens
gcaguggcucaugccuguaaucccagcacuaugggaggcugaggcgggcagaucuccugagcuc

SEQ ID NO: 488659 - RNA, 64 nt, Homo Sapiens
gugguggcauguggcuguagucccagcuacucgggaggcugaggcacgagaaucgcuugagccc

SEQ ID NO: 488660 - RNA, 64 nt, Homo Sapiens
auggugcugugcaucuauagucccugcuauuugagaggcugaggugggaggaucauuugagugc

SEQ ID NO: 488661 - RNA, 64 nt, Homo Sapiens
auaguggcacaccccuguagucccagcuacuugggaggcugaggugggaggauugcuugaaccc

SEQ ID NO: 488662 - RNA, 64 nt, Homo Sapiens
gugguggcacaugccuguaguuccagcuacucaggaggcugaggugggagaaucuccugagccu

SEQ ID NO: 488663 - RNA, 64 nt, Homo Sapiens
ggcacccacuucccugcaggacaguauuccugccgaggcugacuuccuacuuggucuggccacu

SEQ ID NO: 488664 - RNA, 64 nt, Homo Sapiens
guggcggcgagcaccuguaaucccagcuacucgggaggcugagacaggagaaucucuugaaucc

SEQ ID NO: 488665 - RNA, 64 nt, Homo Sapiens
caugagaaucgcuugggcccauccaacuacccaggaggcugaggcgugguggugggugccugua

SEQ ID NO: 488666 - RNA, 64 nt, Homo Sapiens
ugggcagaucacuugaggccucccagcauuuugggaggcugagggccguggcucacgccuguaa

SEQ ID NO: 488667 - RNA, 64 nt, Homo Sapiens
cgggcagaucgcuugaggucucucagcacuuugggaggcugagguuaguggcucacgccuguaa

SEQ ID NO: 488668 - RNA, 64 nt, Homo Sapiens
caggagaaucgcuugaaucuucccagcuacucaggaggcugagggugguggcgggugccuguaa

SEQ ID NO: 488669 - RNA, 64 nt, Homo Sapiens
cagaagaauugcuugaacccucccagcuacucaggaggcugaggguggagguacaugccuguaa

SEQ ID NO: 488670 - RNA, 64 nt, Homo Sapiens
caggagaauggcgugaacccucccagcuacuccggaggcugagggugguggcacgugccuguag

SEQ ID NO: 488671 - RNA, 64 nt, Homo Sapiens
caggcggaucacgaggucagucccagcacuuugggaggcugagggcgguggcucacgcuuguaa

SEQ ID NO: 488672 - RNA, 64 nt, Homo Sapiens
gcaggagaauugcuugaaucucccagcuacuugggaggcugagggugauggugggcaccucuaa

SEQ ID NO: 488673 - RNA, 64 nt, Homo Sapiens
cggguggauuaccugaggucucccagcacuuugggaggcugagaaugguggcucaugccuguaa

SEQ ID NO: 488674 - RNA, 64 nt, Homo Sapiens
caggaaaaucucuugaaccaucccagcuaccugggaggcugaguaugguggugugggccugcag

SEQ ID NO: 488675 - RNA, 64 nt, Homo Sapiens
ugggcagaucacuugaggccuccuagcacuuugggaggcugagggcuguggcucaugccuguaa

SEQ ID NO: 488676 - RNA, 64 nt, Homo Sapiens
gcgguggcucgugccuguaaucccagcacuuugggaggcugaggcggguggaucaugaggucag

SEQ ID NO: 488677 - RNA, 64 nt, Homo Sapiens
augguggcgcaugccuguaaucccagcuacuagagaggcugaggcaggagaaucacuugaaucc

SEQ ID NO: 488678 - RNA, 64 nt, Homo Sapiens
augguggcucacgccuguaaucccaacacuuugggaggcugaggcaggcagaucacgaggucag

SEQ ID NO: 488679 - RNA, 64 nt, Homo Sapiens
gugguggcacacaccaguaaucccagcuacucaggaggcugaagcaggagauuugcuugaaccu

SEQ ID NO: 488680 - RNA, 64 nt, Homo Sapiens
augguggcacacaccuguaaucccagcuacucgggaggcugaggaaggagaauugcuugaaccu

SEQ ID NO: 488681 - RNA, 64 nt, Homo Sapiens
augguggcacacaccuguagucccagcuacuugggaggcugaggcaggagaaucacaaggauug

SEQ ID NO: 488682 - RNA, 64 nt, Homo Sapiens
augacggccagagcccauggucccagcuacucgagaggcugagguaagagcaucccuugagcca

SEQ ID NO: 488683 - RNA, 64 nt, Homo Sapiens
acaguggcucacgccuguaauccuagcacuuugggaggcugaggaggaaggaucacuugagccc

SEQ ID NO: 488684 - RNA, 64 nt, Homo Sapiens
augguggccuacaccuguagucccagcauuccgggaggcugaggugggaggaucacuugagccc

SEQ ID NO: 488685 - RNA, 64 nt, Homo Sapiens
gcgguggcucacgucuguaaucccagcacuuugggaggcugagacagguggaucacuugagguc

SEQ ID NO: 488686 - RNA, 64 nt, Homo Sapiens
guuuuggcaccugccuguaaucucagcuacucaggaggcugaggcacaagaaucgcuugaaucc

SEQ ID NO: 488687 - RNA, 64 nt, Homo Sapiens
caggaggaucacuugagcccucccaguuacucaggaggcugaggaccuguaucaucugcugugg

SEQ ID NO: 488688 - RNA, 64 nt, Homo Sapiens
ugggcggauaguugagcccaucccagcacuuugggaggcugauggugguggcucaugccuguaa

SEQ ID NO: 488689 - RNA, 64 nt, Homo Sapiens
caggagaauugcuugaacccucccagcuacucaggaggcugaggggcguggugggcacccguaa

SEQ ID NO: 488690 - RNA, 64 nt, Homo Sapiens
ugggaaaaucacuugagcccucccagcuacucaggaggcugagggugguggcaugugccugugg

SEQ ID NO: 488691 - RNA, 64 nt, Homo Sapiens
caagcagguuguuugagcccucccagcacuaugggaggcugaggacgguggcucacaccuauaa

SEQ ID NO: 488692 - RNA, 64 nt, Homo Sapiens
caggagaaucgcuugaaccuuccuagcuacucaggaggcugaggaugguggcaguugccuguaa

SEQ ID NO: 488693 - RNA, 64 nt, Homo Sapiens
uggguggaucacaaggucagucucagcacuuugggaggcugaggcuuacagcucacgccuguaa

SEQ ID NO: 488694 - RNA, 64 nt, Homo Sapiens
gaggaagaaaacacggagccuaagcgacuucugugaggcugagaaugcaugagcauuuucagga

SEQ ID NO: 488695 - RNA, 64 nt, Homo Sapiens
acaguggcucacaccuacgaucacagcacuucgggaggcugaagcaagcagaucacuugagguc

SEQ ID NO: 488696 - RNA, 64 nt, Homo Sapiens
gugaugacaggcaccuguaaucccagcuacucgggaggcugaggcaugagaauugcuugaaccc

SEQ ID NO: 488697 - RNA, 64 nt, Homo Sapiens
gcaguggcacgcgccuguaaucccagcuacucaagaggcugaggcacgagaaucacuugaaccc

SEQ ID NO: 488698 - RNA, 64 nt, Homo Sapiens
augguggggcgugccuguagucccauguacuugggaggcugaggcaggaaaauucuugaaccca

SEQ ID NO: 488699 - RNA, 64 nt, Homo Sapiens
augguggcguguacauguggucucagauacuugggaggcugaggugggaggguugaucacuuga

SEQ ID NO: 488700 - RNA, 64 nt, Homo Sapiens
acuugggaggcugaggugggaggguugaucacuugaggcugagaggucaagguugcagugagcc

SEQ ID NO: 488701 - RNA, 64 nt, Homo Sapiens
caggagaauugcuugaacccucucagcuauugaggaggcugaggaugguggcacaugcugguaa

SEQ ID NO: 488702 - RNA, 64 nt, Homo Sapiens
ggguggaucaccugaggucgucccagcacuuugggaggcugaggaugguggcuuacaucuguaa

SEQ ID NO: 488703 - RNA, 64 nt, Homo Sapiens
cagaagaacugcuugaaaccucccagcuacucgggaggcugagagugauggcggacgccuguag

SEQ ID NO: 488704 - RNA, 64 nt, Homo Sapiens
cgggcagaucaugaggucagucccagcacuuugggaggcugagggcaguggcucacgucuguaa

SEQ ID NO: 488705 - RNA, 64 nt, Homo Sapiens
gcgguggcucacgccuguaaucccagcacuuugggaggcugaggcggguggaucacgaggucag

SEQ ID NO: 488706 - RNA, 64 nt, Homo Sapiens
gugguggcaggcaccuguagucccagcuacucgggaggcugaggcaggagacuggcgugaaccc

SEQ ID NO: 488707 - RNA, 64 nt, Homo Sapiens
gcggugccucaugccuguaauccuagcacuuugggaggcugaggcaggcaaucacuugagguca

SEQ ID NO: 488708 - RNA, 64 nt, Homo Sapiens
uguguggugcacguuuguaaucccaguuacucaggaggcugaggcacaagaauugaguaucacu

SEQ ID NO: 488709 - RNA, 64 nt, Homo Sapiens
gugguucuccaugccuauaaucccggcuacucgggaggcugaggcaggagaaucaccugaaccc

SEQ ID NO: 488710 - RNA, 64 nt, Homo Sapiens
gcaguggcucauguguguaaucccagcacucugggaggcugagacagguagaucauuugagguc

SEQ ID NO: 488711 - RNA, 64 nt, Homo Sapiens
gugguggcgcaugccuguagucccaacuacuagggaggcugaggcaggagaaucacuugaaccc

SEQ ID NO: 488712 - RNA, 64 nt, Homo Sapiens
caggagaauugcuugaaccuucccagcuacuagggaggcugagggugguggugcaugccuguaa

SEQ ID NO: 488713 - RNA, 64 nt, Homo Sapiens
caggagaaucgcuugaaccuucuuagcuacuugagaggcugagggugguggcaugugccuguag

SEQ ID NO: 488714 - RNA, 64 nt, Homo Sapiens
augguggcucaugccuguaaucccagcacuuugggaggcugagguagguggaaaaccugagguc

SEQ ID NO: 488715 - RNA, 64 nt, Homo Sapiens
uugauggugugcaccuguaaucucagcuacucgggaggcugaggcaagagaaucgcuugaaccc

SEQ ID NO: 488716 - RNA, 64 nt, Homo Sapiens
ggcagucaccagcaccaggacagcacaugaggcugaggcugagguuauugaagggaagagggac

SEQ ID NO: 488717 - RNA, 64 nt, Homo Sapiens
cugaggggcagucaccagcaagggaccagcacaugaggcugaggaccuccuuauugaagggaag

SEQ ID NO: 488718 - RNA, 64 nt, Homo Sapiens
caggagaaucgcuugaacccucccagcuacucgggaggcugagggugguggcaugcaccuguca

SEQ ID NO: 488719 - RNA, 64 nt, Homo Sapiens
cgggcggaucaccugagucaauccaacacuuugagaggcugaggcgccguggcucacgccugua

SEQ ID NO: 488720 - RNA, 64 nt, Homo Sapiens
ugggagaauugcucaagcccuccuagcuacuugggaggcugaggguaauggugugcaccuguga

SEQ ID NO: 488721 - RNA, 64 nt, Homo Sapiens
caggagaaucgcuugaaccuucccagguacucaagaggcugagggugguggugggcacugguaa

SEQ ID NO: 488722 - RNA, 64 nt, Homo Sapiens
uuggagaaucgcuugaggccuccuggcauuuuaggaggcugagguugguggcucaugccuauaa

SEQ ID NO: 488723 - RNA, 64 nt, Homo Sapiens
cagaagaaucgcuugaaccuucccagcuacucgggaggcugagggugguggcacacgccuguag

SEQ ID NO: 488724 - RNA, 64 nt, Homo Sapiens
ugggaggaugucuugagcccuccuagcuacuugggaggcugagaauggugguaagugccuguag

SEQ ID NO: 488725 - RNA, 64 nt, Homo Sapiens
cagaucgcuggagcuuaugauugcagcacuuugggaggcugaagacagugucucauaccuguau

SEQ ID NO: 488726 - RNA, 64 nt, Homo Sapiens
ugggaggauugcuugagcccucccagcuacugaggaggcugagguuuguagcauaugccugugg

SEQ ID NO: 488727 - RNA, 64 nt, Homo Sapiens
uggguagauuacuugagcccucccagcacuuugggaggcugaggacgguagcucacccuuguaa

SEQ ID NO: 488728 - RNA, 64 nt, Homo Sapiens
cuggccuuuccucaaggcaugguagucuuuccuugaggcugauagcuagggcuugaccaggaag

SEQ ID NO: 488729 - RNA, 64 nt, Homo Sapiens
acucgagcacacaccuguaguaccagcuacucuggaggcugaggcaggaggaucacuugagccc

SEQ ID NO: 488730 - RNA, 64 nt, Homo Sapiens
acaguggcucuugucuguaaucccagcgcucugggaggcugaggcaggaggaucacuugagguc

SEQ ID NO: 488731 - RNA, 64 nt, Homo Sapiens
gccgugggucacgccuguaaucccagcacuuugggaggcugaggcagguggaucaccucaaguc

SEQ ID NO: 488732 - RNA, 64 nt, Homo Sapiens
gugguugcacacgccuguaaucccagcuacucaggaggcugagggaggagaaucccuugaaccc

SEQ ID NO: 488733 - RNA, 64 nt, Homo Sapiens
aaacgccagucaugggaggcagagcugggggagcgaggcugacaaugacuccuguuuucacgcu

SEQ ID NO: 488734 - RNA, 64 nt, Homo Sapiens
augguggugcacgucuguagucccagcuacucaggaggcugaggcagaagaaucgcuugaaccc

SEQ ID NO: 488735 - RNA, 64 nt, Homo Sapiens
acaguggcuuaugccuguaauugcagcacuuuuagaggcugaggcaggagaauugguugaaccc

SEQ ID NO: 488736 - RNA, 64 nt, Homo Sapiens
guuauggugcaugccuguaaucccagcuacucgggaggcugaggcaggagaauugcuugaacuc

SEQ ID NO: 488737 - RNA, 64 nt, Homo Sapiens
augguggcucacaccuguaaucccagcacuuugggaggcugaggcggauggaucacgaggucag

SEQ ID NO: 488738 - RNA, 64 nt, Homo Sapiens
gugguggcacgcgccuguaaucccagcuacucaggaggcugaggcaggagaacugcuugaaccu

SEQ ID NO: 488739 - RNA, 64 nt, Homo Sapiens
gcgguggcucaugccuguaauccuagcacuuugggaggcugagguggguggaucaccugagguc

SEQ ID NO: 488740 - RNA, 64 nt, Homo Sapiens
gugguggcagaggccuguaaucccagcuccuugggaggcugaggcgggagaauugcuugaaccc

SEQ ID NO: 488741 - RNA, 64 nt, Homo Sapiens
caggagauuugcuugaacccucccagcuacucgggaggcugagagugguggugcacaccuguag

SEQ ID NO: 488742 - RNA, 64 nt, Homo Sapiens
cgggcggaucaccugagguuucccagcacuuugggaggcugaggaugguggcucaugccuguaa

SEQ ID NO: 488743 - RNA, 64 nt, Homo Sapiens
gauugacaaacacagguuggugcccaacuguguggaggcugaguuaggaaccagugaccuuggc

SEQ ID NO: 488744 - RNA, 64 nt, Homo Sapiens
ucaggguugccacagaagagacccucaguuccaagaggcugacugagacucucugcugagguca

SEQ ID NO: 488745 - RNA, 64 nt, Homo Sapiens
caggagaaucacuugaacccucccagcuacuggggaggcugaggaugguggcaggcgccuauaa

SEQ ID NO: 488746 - RNA, 64 nt, Homo Sapiens
caggagaaucaccugaacccucccagcuacucaggaggcugagaguagugacgggugcccguaa

SEQ ID NO: 488747 - RNA, 64 nt, Homo Sapiens
ugguaggaucaccugaggucucccagcacuuugagaggcugaggacaguggcucacgccuguaa

SEQ ID NO: 488748 - RNA, 64 nt, Homo Sapiens
caggagaaucacuugaaccuaucucacuacacaggaggcugagggcaugguggacucgccugua

SEQ ID NO: 488749 - RNA, 64 nt, Homo Sapiens
cggguggaucgccugaggucuccuagcaguuugggaggcugagcacaguggcucacgccuguaa

SEQ ID NO: 488750 - RNA, 64 nt, Homo Sapiens
aucucuaccaccauucccuuuacagcucaaaauggaggcugagagaaauguuuguuuauucugu

SEQ ID NO: 488751 - RNA, 64 nt, Homo Sapiens
caggagaaucacuugaacccucccagcuacuugggaggcugagggugauggcgcaugccuguaa

SEQ ID NO: 488752 - RNA, 64 nt, Homo Sapiens
uggguguaucacuugaggucucccagcccuuugggaggcugaggacgguggcucacaccuguaa

SEQ ID NO: 488753 - RNA, 64 nt, Homo Sapiens
gcgguggcucacgccuguaaucccagcacuuugggaggcugaggcgggcagaucaccugagguc

SEQ ID NO: 488754 - RNA, 64 nt, Homo Sapiens
augguggcacaugccuuuagucccagcuacucuggaggcugaaguuggaggauggcuugagccc

SEQ ID NO: 488755 - RNA, 64 nt, Homo Sapiens
acgguaucucaugccuauaaucccagcacuuugggaggcugaggcaguugagaccaggaguucg

SEQ ID NO: 488756 - RNA, 64 nt, Homo Sapiens
augguggcaggcaccuguaaucccagcuacuugggaggcugagucaggagaaucgcuugagccc

SEQ ID NO: 488757 - RNA, 64 nt, Homo Sapiens
cacgagaaucaguugaacugucccagcugcucgagaggcugagggugguggcacacaccuguag

SEQ ID NO: 488758 - RNA, 64 nt, Homo Sapiens
cgggaagaucacuugaggccucccagcacuuugagaggcugagggcaggggcucacaccgguaa

SEQ ID NO: 488759 - RNA, 64 nt, Homo Sapiens
caggagaaucacuugaacccauccagcuacucgggaggcugaggugugguggcaggcgccugua

SEQ ID NO: 488760 - RNA, 64 nt, Homo Sapiens
caggagaauggcgggaaccuucccagcuacuugggaggcugagggugguggcgggcgccuguag

SEQ ID NO: 488761 - RNA, 64 nt, Homo Sapiens
cacaagaaucgcuugagccaucucagcugcucgggaggcugagggugguggcagacagcuguaa

SEQ ID NO: 488762 - RNA, 64 nt, Homo Sapiens
cgggugaaucacuugauugaucccagcacuuugggaggcugagggcgguggcucacgccuguaa

SEQ ID NO: 488763 - RNA, 64 nt, Homo Sapiens
caggggaaucacuugaacccucguagcuacuugggaggcugagggugguggcgcaaaccuguag

SEQ ID NO: 488764 - RNA, 64 nt, Homo Sapiens
uaggcggaucacaaggucagucccagcauuuugggaggcugagggcaguggcucacgccuguaa

SEQ ID NO: 488765 - RNA, 64 nt, Homo Sapiens
cagaagaauggcguaaacccucccagcuacucgggaggcugagggugguggcaggcgccuguag

SEQ ID NO: 488766 - RNA, 64 nt, Homo Sapiens
cggguagaucacaaggucaguccuagcacuuugggaggcugagggggguggcucacgccuguaa

SEQ ID NO: 488767 - RNA, 64 nt, Homo Sapiens
gugguggcgcauaccuguagucccagcuacuugggaggcugaggcaggagaaucacuugaacuc

SEQ ID NO: 488768 - RNA, 64 nt, Homo Sapiens
gcaguggcucacgccuguaaucccagcacuuugggaggcugaggugaguggauuacaaggucag

SEQ ID NO: 488769 - RNA, 64 nt, Homo Sapiens
augguggugcgugccuguagucucagcuacucaggaggcugaggcaggagaaucgccugaaccc

SEQ ID NO: 488770 - RNA, 64 nt, Homo Sapiens
gcaguggcucacaccuguaaucccagcacuuugggaggcugaggcggguggaucaccugagguc

SEQ ID NO: 488771 - RNA, 64 nt, Homo Sapiens
gcgauagcacgugccuguagucccagcuacucgggaggcugaggcuggagaguugcucaaaccc

SEQ ID NO: 488772 - RNA, 64 nt, Homo Sapiens
augguggugcaugccuguaaucccagcuacucgggaggcugaggcaggagaaucacuugaacuc

SEQ ID NO: 488773 - RNA, 64 nt, Homo Sapiens
gugguggcacaucccuauagucccagcuacuugggaggcugagguggaaggauugcuugagcga

SEQ ID NO: 488774 - RNA, 64 nt, Homo Sapiens
augguggugcauaccuauaguccuggcuauuugggaggcugaggcaggaggauugcuuuagccc

SEQ ID NO: 488775 - RNA, 64 nt, Homo Sapiens
gugguggugcaugccuguaaucccagcuacucgggaggcugaggcaggagaaucgcuugaaccc

SEQ ID NO: 488776 - RNA, 64 nt, Homo Sapiens
caggagaaucgcuugaaccuucccagcuacucgggaggcugaggaugguggcacgugccuguaa

SEQ ID NO: 488777 - RNA, 64 nt, Homo Sapiens
uugggaguucaagaccagcccccagcacuuuugggaggcugaggcaguggcucacgccuguaau

SEQ ID NO: 488778 - RNA, 64 nt, Homo Sapiens
gugguggugggcaccugugaucccagcuuccugggaggcugaggcaagagaaucgcuugaaucu

SEQ ID NO: 488779 - RNA, 64 nt, Homo Sapiens
gugguggcaugcgcuuguagucucagcuacuccggaggcugaggcaggagaauugcuugaaccu

SEQ ID NO: 488780 - RNA, 64 nt, Homo Sapiens
gcugcggcuugcgccuguaaucucagcacuuugggaggcugagauggguggaucaccugagguu

SEQ ID NO: 488781 - RNA, 64 nt, Homo Sapiens
gugguggugggugucuguaaucccagcuauucgggaggcugaggcaggagaaucgcuugaaccc

SEQ ID NO: 488782 - RNA, 64 nt, Homo Sapiens
gugguggcucacaccugugaucccagcacuuugggaggcugagguaggaggaucacgugagguc

SEQ ID NO: 488783 - RNA, 64 nt, Homo Sapiens
gugguggcacacgccuguagucccagcuacucaggaggcugaggcaggagaaucacuugaauuc

SEQ ID NO: 488784 - RNA, 64 nt, Homo Sapiens
gguucaugccuguaaucccagcacuucacuuugggaggcugaggcggguggaucacaaggucag

SEQ ID NO: 488785 - RNA, 64 nt, Homo Sapiens
augguggcaugcguguguagucgaagcuacucaggaggcugaggcagaagaaucacuugaaccu

SEQ ID NO: 488786 - RNA, 64 nt, Homo Sapiens
acaguggcucccaccuuuaaucccagcaccuggggaggcugaggugaguggaucacuagagguc

SEQ ID NO: 488787 - RNA, 64 nt, Homo Sapiens
gugguggcacacacuuguaaucccagcuacucaggaggcugaggcaugagaaucgcuuaaaccc

SEQ ID NO: 488788 - RNA, 64 nt, Homo Sapiens
gugguggcucacgccuguaaucccggcacuuugggaggcugaggcaggcggauugccugagauc

SEQ ID NO: 488789 - RNA, 64 nt, Homo Sapiens
gugguggcgggcgccuguaaucccagcuacucaggaggcugaggcagcagaaucguuugaaccc

SEQ ID NO: 488790 - RNA, 64 nt, Homo Sapiens
gcgguggcucaugccuguaaucccagcacuuugggaggcugaggcggguggauugcuugagccc

SEQ ID NO: 488791 - RNA, 64 nt, Homo Sapiens
gugguggcacacuccuguaaucccagcuacuggggaggcugaggcacgagaaucacuugaaccc

SEQ ID NO: 488792 - RNA, 64 nt, Homo Sapiens
cacgagaauugcuugaacccucccagcuacuugagaggcugagguguggggugcaugccuggaa

SEQ ID NO: 488793 - RNA, 64 nt, Homo Sapiens
cggguggauugcuugaggccucccagcacuuuuggaggcugagggccauggcucacaucuguaa

SEQ ID NO: 488794 - RNA, 64 nt, Homo Sapiens
cagagaaucuuccagaugauuguucccugaggcugaggcugagguacccugcaggguaagcugu

SEQ ID NO: 488795 - RNA, 64 nt, Homo Sapiens
cugaggcagagaaucuuccaagcuguuguucccugaggcugaggucuguauacccugcagggua

SEQ ID NO: 488796 - RNA, 64 nt, Homo Sapiens
ucauucaggaguuuguugggcagaaaaggagagagaggcugagauuucaacaaaggaguguguu

SEQ ID NO: 488797 - RNA, 64 nt, Homo Sapiens
cuguuuucuuuucuuuguucaaaagggaaggcuggaggcugaggugcauugugaggcagguccc

SEQ ID NO: 488798 - RNA, 64 nt, Homo Sapiens
caugcagcagcccccagcuaggacggugccagcugaggcugagggcagaggcagugagggaggu

SEQ ID NO: 488799 - RNA, 64 nt, Homo Sapiens
ccauggcucugccaccguuguccuacagcauggagaggcugaccaagacggacuugcuugccuc

SEQ ID NO: 488800 - RNA, 64 nt, Homo Sapiens
gucauggggcaugccuguagucccaccuacuugggaggcugaagcaggagaauugcucgaaccu

SEQ ID NO: 488801 - RNA, 64 nt, Homo Sapiens
augauggcgggugccucuaaucccagcuacuggggaggcugaggugggagaaucgcuugaacuc

SEQ ID NO: 488802 - RNA, 64 nt, Homo Sapiens
ccagagcccugcugaguuccugcuuucugaccuggaggcugagcaggccggaguggauggaugc

SEQ ID NO: 488803 - RNA, 64 nt, Homo Sapiens
ugcgugugugguacguguguguguguguggcuaugaggcugauuccuguuuggauuuuuguccu

SEQ ID NO: 488804 - RNA, 64 nt, Homo Sapiens
gcgguggcucacgccuguaaucccagcaccuugggaggcugaggcgggcagaucaugaggucag

SEQ ID NO: 488805 - RNA, 64 nt, Homo Sapiens
acaguggcacaggccuuuaauuccagcuacuugggaggcugaggcaggagaauuacuugaaccc

SEQ ID NO: 488806 - RNA, 64 nt, Homo Sapiens
gagguggcucacgccuguaaucccagcacuuugggaggcugaggaggucggaucaugaggucaa

SEQ ID NO: 488807 - RNA, 64 nt, Homo Sapiens
auaguggcucgugccuguaaucucagcuauuugggaggcugaggcaggagaaucacuugaaccu

SEQ ID NO: 488808 - RNA, 64 nt, Homo Sapiens
caugguggcacgcaccucuacucccagcuacuaggaggcugaggcaggagaaucguuugaaccc

SEQ ID NO: 488809 - RNA, 64 nt, Homo Sapiens
uuggugguaugugccuguggucccagcuacuggggaggcugaggugggaggaucguuugagccu

SEQ ID NO: 488810 - RNA, 64 nt, Homo Sapiens
gcgguggcucaugccuguaauccuagcacuuugggaggcugagguaggcagaucacuugagguc

SEQ ID NO: 488811 - RNA, 64 nt, Homo Sapiens
guaguggugcgcaccuguagucucagauacuugggaggcugaggguggagaaucgcuugaaccu

SEQ ID NO: 488812 - RNA, 64 nt, Homo Sapiens
acgguggcucacgccuguaaucccagcacuuugggaggcugaggcggguggaucaagaggucag

SEQ ID NO: 488813 - RNA, 64 nt, Homo Sapiens
gugguggcacgcgccuguagucccagcuacucgggaggcugaggcaggaagaaucgcuugaacc

SEQ ID NO: 488814 - RNA, 64 nt, Homo Sapiens
caggagaauggcgugaacccucccagcuacuccggaggcugaggauggugguggguaccuguag

SEQ ID NO: 488815 - RNA, 64 nt, Homo Sapiens
cgggcagaucacgaagucagucccagcacuuugggaggcugagggcgguggcucacgccuguaa

SEQ ID NO: 488816 - RNA, 64 nt, Homo Sapiens
ugggaggaucucuugagcccuagcagcuacuccagaggcugaaauuaguaaugcgaaccuauag

SEQ ID NO: 488817 - RNA, 64 nt, Homo Sapiens
caggaggauugcuugaggccuaccagcgcuuugggaggcugagguugguggcucacaucuguaa

SEQ ID NO: 488818 - RNA, 64 nt, Homo Sapiens
uugcagugagccgaaaucacuugcuugaaccuaggaggcugagagggaggcugaggcaggagaa

SEQ ID NO: 488819 - RNA, 64 nt, Homo Sapiens
caggagaauugcuugaaccuucccagcuacucgggaggcugagggugguggugggcaccuguag

SEQ ID NO: 488820 - RNA, 64 nt, Homo Sapiens
cagguggaucacaaugucagucccagcacuuugggaggcugagggcaguggcucacgccuguaa

SEQ ID NO: 488821 - RNA, 64 nt, Homo Sapiens
caggagaaucacuugcacucucccagcuacucaagaggcugaggguagugacgcaugcccucaa

SEQ ID NO: 488822 - RNA, 64 nt, Homo Sapiens
cgggcagaucaccagaggucucccagcccuuugggaggcugagggcaguggcucacgccuguaa

SEQ ID NO: 488823 - RNA, 64 nt, Homo Sapiens
guuguggcucaugccuguaaucccagcacuuugggaggcugaggcggguggaucacuaggucag

SEQ ID NO: 488824 - RNA, 64 nt, Homo Sapiens
augguggcgugugccuguaaucucagcuacucaggaggcugaggcaggagaaucgcuugaaccc

SEQ ID NO: 488825 - RNA, 64 nt, Homo Sapiens
augguggcucaugccuguaaucucagcacuuugggaggcugaggcagaaggauuaccugaggca

SEQ ID NO: 488826 - RNA, 64 nt, Homo Sapiens
uggcucaugccuguaaucccagccagcacuuugggaggcugagaugggaagaucacuugagccc

SEQ ID NO: 488827 - RNA, 64 nt, Homo Sapiens
ugaccugguucagcauguaauccgagcacuuugggaggcugaggcaggcggaucacuugagguc

SEQ ID NO: 488828 - RNA, 64 nt, Homo Sapiens
ugaaaauacaaaaauaagccaggcgugguggcgggaggcugaggcaaggagaaucacuugaaua

SEQ ID NO: 488829 - RNA, 64 nt, Homo Sapiens
augguggcaugcaccugcaaucccagcuacucgggaggcugaggcacaagaaucacuugaaccc

SEQ ID NO: 488830 - RNA, 64 nt, Homo Sapiens
gugacauugugucaguuucagauccugaucuuaagaggcugacagcuucuacuugcugucccuu

SEQ ID NO: 488831 - RNA, 64 nt, Homo Sapiens
gcauggugcgggcaccuguaguccuagcuaucaagaggcugagacaggagaaacacuugaaccu

SEQ ID NO: 488832 - RNA, 64 nt, Homo Sapiens
acuccgaucgcgaugucucacgccgccgccaagcgaggcugaggggucccgcuuagcgacccgc

SEQ ID NO: 488833 - RNA, 64 nt, Homo Sapiens
ccugccaggaggagcuggcaaggaggaagcccaggaggcugaugagaccguguaaaugagcucc

SEQ ID NO: 488834 - RNA, 64 nt, Homo Sapiens
caagaggaucgcuugagcccccccagccacucaggaggcugauggcaaugaugcacacuuauac

SEQ ID NO: 488835 - RNA, 64 nt, Homo Sapiens
caggagaaucacuugaaccuucccagcuacucgggaggcugaggguggugacacgugccuguag

SEQ ID NO: 488836 - RNA, 64 nt, Homo Sapiens
caggagaaucguuuaaacacuuccagcuacucaggaggcugaagggugguggcagggccuguaa

SEQ ID NO: 488837 - RNA, 64 nt, Homo Sapiens
caggagaauggcgugaacccgggugccuguacaggaggcugaggaauuagccgggcgugguggc

SEQ ID NO: 488838 - RNA, 64 nt, Homo Sapiens
cagaagaaucgcuugaaccuucccagcuacucaggaggcugagaaugguggcaugcgccuguaa

SEQ ID NO: 488839 - RNA, 64 nt, Homo Sapiens
cagguggaucaccugaggucucccaggacuuugggaggcugaggaugguggcucacgucuguaa

SEQ ID NO: 488840 - RNA, 64 nt, Homo Sapiens
cgggagaaucaccugagccuucccaacuaccugggaggcugaggggaguuaugcacgcuuguag

SEQ ID NO: 488841 - RNA, 64 nt, Homo Sapiens
cgggaugaucaccugaggucucccagcacugugagaggcugagggcgguggcucacgccuguaa

SEQ ID NO: 488842 - RNA, 64 nt, Homo Sapiens
caggagaaaucgccugaaccucccagcuacuugggaggcugagggugguggcaggcaccuguaa

SEQ ID NO: 488843 - RNA, 64 nt, Homo Sapiens
caggcggaucacuugaggucucccagcacuuugggaggcugaggacgguggcucaugccuguaa

SEQ ID NO: 488844 - RNA, 64 nt, Homo Sapiens
caggagaaucgcuugaaccuucccagcuacuggggaggcugagggugguggugcaugccuguaa

SEQ ID NO: 488845 - RNA, 64 nt, Homo Sapiens
caggagaaucgcuugaacccucgcagccuuucaggaggcugagagugguggcgggcaccuguaa

SEQ ID NO: 488846 - RNA, 64 nt, Homo Sapiens
caggagaaucgcuagaaacuucccaucuucuugggaggcugaggaugguagcgcacgccuguaa

SEQ ID NO: 488847 - RNA, 64 nt, Homo Sapiens
caggagaaucgcuugaacccuuccagcuacucaggaggcugaggaugguggcgcacgccuguag

SEQ ID NO: 488848 - RNA, 64 nt, Homo Sapiens
cggguggaucaccugaggucucccagcacuuugggaggcugaggaccguggcucacgccuguaa

SEQ ID NO: 488849 - RNA, 64 nt, Homo Sapiens
gggauggcucacgccuguaaucccagcacuuugggaggcugaggcgggcagaucacuugaggcc

SEQ ID NO: 488850 - RNA, 64 nt, Homo Sapiens
ugcaguggugaggccuguaaucccagcuacucaggaggcugaggcaggagaaucgcuugcaccc

SEQ ID NO: 488851 - RNA, 64 nt, Homo Sapiens
gugguggcacgugccuguaaucccagcuacucaggaggcugaggcaggagaaucgcuugaaccc

SEQ ID NO: 488852 - RNA, 64 nt, Homo Sapiens
cacagagccagaagccagagggccagggauaugagaggcugacaaacaucaggggacaucuggg

SEQ ID NO: 488853 - RNA, 64 nt, Homo Sapiens
acgguggcucacaccuauaauccuagcacuuggggaggcugaggcagacggauuaccugagguc

SEQ ID NO: 488854 - RNA, 64 nt, Homo Sapiens
gcaguggcgugcaccuguaaucccagcuacucuggaggcugaggcaggagaaucaccugaaccu

SEQ ID NO: 488855 - RNA, 64 nt, Homo Sapiens
cgcaaggaucacuugagcccucccagcuacaggggaggcugagacuuguggcacacaacugugg

SEQ ID NO: 488856 - RNA, 64 nt, Homo Sapiens
ugggaggaucacuugaggccuccuagcacuuugggaggcugagaacggaggcucgugcauguaa

SEQ ID NO: 488857 - RNA, 64 nt, Homo Sapiens
caggagaaucgcuugaaccuuaaucccaccucaggaggcugaggggugugguggcaagugccuu

SEQ ID NO: 488858 - RNA, 64 nt, Homo Sapiens
caggagaaucgcuugaaccuucccagcuacuugggaggcugaggguaacggcggaugccuguaa

SEQ ID NO: 488859 - RNA, 64 nt, Homo Sapiens
gcgguggcucacgccuguaaucccagcacuuugggaggcugaggcgggcagaucacaagaucag

SEQ ID NO: 488860 - RNA, 64 nt, Homo Sapiens
gugguggggugcgcuuguaaucccagcuacucaggaggcugaggcaggagaaucgcuuaaacuc

SEQ ID NO: 488861 - RNA, 64 nt, Homo Sapiens
augguggcgggugccuguaaucucagcuacuugagaggcugaggcaggagaaucgcuugaacuu

SEQ ID NO: 488862 - RNA, 64 nt, Homo Sapiens
guggugacgcaugccuguaguccuagcuacucaggaggcugaggugggaggaucaccuaaggcc

SEQ ID NO: 488863 - RNA, 64 nt, Homo Sapiens
gugggggcgugcgccuguagucccagcuacuugggaggcugaggcaggagaauugcuugaaccc

SEQ ID NO: 488864 - RNA, 64 nt, Homo Sapiens
gugauggcucacaccuguaaucccagugcuuugggaggcugaggugggaagauucuuugagccc

SEQ ID NO: 488865 - RNA, 64 nt, Homo Sapiens
caggagaaucacuugaacccucucagcuacucaggaggcugagaguggugguaugugccuguag

SEQ ID NO: 488866 - RNA, 64 nt, Homo Sapiens
caggagaaucgcuugaacccucccagcugcucaggaggcugaggggcguggugggcgccuguaa

SEQ ID NO: 488867 - RNA, 64 nt, Homo Sapiens
caggcagaucaccugaggcuucccagcacuuugggaggcugagggugguggcucacgccuguaa

SEQ ID NO: 488868 - RNA, 64 nt, Homo Sapiens
accugcggaaggagcuggagagcagcuacaagcagaggcugaacagggcccuccgagguggagc

SEQ ID NO: 488869 - RNA, 64 nt, Homo Sapiens
accugcggaaggagcuggagagcagcuacaagcagaggcugaacagggcccuccgagguggaac

SEQ ID NO: 488870 - RNA, 64 nt, Homo Sapiens
caggagaaucgcuugaaccuucccagguacucgggaggcugagaaugguggcaggugccuguag

SEQ ID NO: 488871 - RNA, 64 nt, Homo Sapiens
gagguagaucaccugaggucucccagcacuuugggaggcugagggugguggcucaugccuguaa

SEQ ID NO: 488872 - RNA, 64 nt, Homo Sapiens
acgauggcucacaccuguaaucccagcacuuugggaggcugaggcgggaagaucacuugaguuc

SEQ ID NO: 488873 - RNA, 64 nt, Homo Sapiens
gugguggcacgcgccuguaaucccagcuacuuaggaggcugaggcaggagaaucgcuugaaccc

SEQ ID NO: 488874 - RNA, 64 nt, Homo Sapiens
acaguagcucacaccugaaaucuuagcacuucgggaggcugaggcagguggaucacuugagguu

SEQ ID NO: 488875 - RNA, 64 nt, Homo Sapiens
augauggugcaugccuuuaaacccagcuacugaggaggcugaggcaugagaauugcuugaacca

SEQ ID NO: 488876 - RNA, 64 nt, Homo Sapiens
cugaagaaacgauagaugugcagguugugcggaagaggcugaguggaaaauggugugagcccca

SEQ ID NO: 488877 - RNA, 64 nt, Homo Sapiens
gugguggcucaugccuauaaucccagcacguugggaggcugaggcgggcggaucgguugagcuc

SEQ ID NO: 488878 - RNA, 64 nt, Homo Sapiens
cugguggcgcacgccuguagucccagcuacucgggaggcugagguaggaggaucgcuugagccu

SEQ ID NO: 488879 - RNA, 64 nt, Homo Sapiens
ucggcggcucacaccuguaaccccagcacuuugggaggcugagguggguggaucacuugagguc

SEQ ID NO: 488880 - RNA, 64 nt, Homo Sapiens
gugguggcgggcgccuguaaucccagcuacuugggaggcugaggcaggagaaucgcuugaaucu

SEQ ID NO: 488881 - RNA, 64 nt, Homo Sapiens
ugggagaaucacuugagcccucccagcugcuugggaggcugaggaugguggcgcacgccuguag

SEQ ID NO: 488882 - RNA, 64 nt, Homo Sapiens
gagaggaucacuugagcucaucccagcauuuugggaggcugagugcaguggcucacaccuguaa

SEQ ID NO: 488883 - RNA, 64 nt, Homo Sapiens
caggagaaucucuugaacccucccaacuacuugggaggcugaggaugguggcaaacgccuguaa

SEQ ID NO: 488884 - RNA, 64 nt, Homo Sapiens
cgggcagaucaccugaggccucccagcacucugggaggcugagggugguggcucacgcauguaa

SEQ ID NO: 488885 - RNA, 64 nt, Homo Sapiens
aaagagaauuguuugaaccuucccagcucuucaggaggcugagaguaguggugugcaccuguag

SEQ ID NO: 488886 - RNA, 64 nt, Homo Sapiens
gauugagccugcagugagcuggcaaggauugcuugaggcugagaagcuacuuaggaggcugagg

SEQ ID NO: 488887 - RNA, 64 nt, Homo Sapiens
ggcaaggauugcuugaggcuucccagcuacuuaggaggcugaggaaaauuagcuggacguguag

SEQ ID NO: 488888 - RNA, 64 nt, Homo Sapiens
cagcagaauugcuugaacccucccaccuacucgagaggcugaggaugguggaaugugccuguaa

SEQ ID NO: 488889 - RNA, 64 nt, Homo Sapiens
cuagaggauccuugagcccauuccagcuacucaggaggcugagggugguggugcaugcauguag

SEQ ID NO: 488890 - RNA, 64 nt, Homo Sapiens
caggaggaucacuugagcccucgcagcacuuugggaggcugagggcgguggcucacgcuuguaa

SEQ ID NO: 488891 - RNA, 64 nt, Homo Sapiens
ugggagaaucacuuggacucucccagcuacuuaggaggcugagggugguggcacacuccuguaa

SEQ ID NO: 488892 - RNA, 64 nt, Homo Sapiens
cggguggaucaccugaggucucccagcauuuugagaggcugagggcgguggcucaugccuguaa

SEQ ID NO: 488893 - RNA, 64 nt, Homo Sapiens
caggagaauuuuuugagcccucccagcuacuugggaggcugaggaggguggugcaugccuguag

SEQ ID NO: 488894 - RNA, 64 nt, Homo Sapiens
gacgacaucuacauuucagugaucaauaaugccugaggcugauuaggguguguggauggcacag

SEQ ID NO: 488895 - RNA, 64 nt, Homo Sapiens
guggugguacaugccuguaaucccagcuacuagggaggcugaggcaggagaaucacucgaaccc

SEQ ID NO: 488896 - RNA, 64 nt, Homo Sapiens
auggucgcucaggccaguaaucccagugacuuaggaggcugaggugggaggauuacuugaaacc

SEQ ID NO: 488897 - RNA, 64 nt, Homo Sapiens
augacggcucaugccuguaaucccagcacuuugggaggcugaggcagguggaucacuggagguc

SEQ ID NO: 488898 - RNA, 64 nt, Homo Sapiens
uaaucccagcuggccuguaaucccagcuacuugggaggcugaggcagaacugcuugaacccagg

SEQ ID NO: 488899 - RNA, 64 nt, Homo Sapiens
gcaguggcucacgccuguaaucccagcacuuugggaggcugaggcgggcggaucacgaggucag

SEQ ID NO: 488900 - RNA, 64 nt, Homo Sapiens
gugguggcacgcgccuguagucccagcugcucaggaggcugaggcaggagaauggcguaaaccc

SEQ ID NO: 488901 - RNA, 64 nt, Homo Sapiens
augguggcaggcaccuguagucccagcuacucgggaggcugaggcaggagaauggcgugaaccc

SEQ ID NO: 488902 - RNA, 64 nt, Homo Sapiens
acaguggcucacgccuguaaucucagcacauugggaggcugaggugggcggaucaccugagguc

SEQ ID NO: 488903 - RNA, 64 nt, Homo Sapiens
gggguagugcaugccuguaaucccagcuacucaggaggcugaggccggagaaucgcuugagccc

SEQ ID NO: 488904 - RNA, 64 nt, Homo Sapiens
gugguggcucacgccuauaaucccagcacuuugggaggcugagguggguggaccacuugaggcc

SEQ ID NO: 488905 - RNA, 64 nt, Homo Sapiens
cugguggugcgugccuguaaucccagcuacucaggaggcugaggcaggagaaucacuugaaccc

SEQ ID NO: 488906 - RNA, 64 nt, Homo Sapiens
ggcguggugcaugccuguaaucccagccacucaggaggcugaggcggggaggauccauugagcc

SEQ ID NO: 488907 - RNA, 64 nt, Homo Sapiens
gcggcagcucaugccuguaaucccaacacuuugggaggcugaggcaggcggaucacgaggucag

SEQ ID NO: 488908 - RNA, 64 nt, Homo Sapiens
acaccuguaguccccuguagucccagcuacucgggaggcugaggcaggagaaucguuugaaccu

SEQ ID NO: 488909 - RNA, 64 nt, Homo Sapiens
cccauagcacuggaagccagagaaaauguuggaagaggcugagacauucuucaccuccuuggcg

SEQ ID NO: 488910 - RNA, 64 nt, Homo Sapiens
cuggaacuucuaccaggacgacgauuucagcuaggaggcugaggcaggagaaucacuggaaccu

SEQ ID NO: 488911 - RNA, 64 nt, Homo Sapiens
gugguggcucacaccuguaaucccagcauuuugggaggcugagguggccagaucccaaggucag

SEQ ID NO: 488912 - RNA, 64 nt, Homo Sapiens
gugguggcggguaccuguaguccuagcuacuugggaggcugaggcaggagaauggcgugaaccu

SEQ ID NO: 488913 - RNA, 64 nt, Homo Sapiens
caggaggaucacuugagcccucccagcuacuagggaggcugagcgugguggggugcaccuguag

SEQ ID NO: 488914 - RNA, 64 nt, Homo Sapiens
ugggaggguugcuugagcccucccagcacuuugggaggcugaggcugauggcucgugccuguac

SEQ ID NO: 488915 - RNA, 64 nt, Homo Sapiens
caggcggaucaccugaagucucccagcacuuugggaggcugagggcaguggcucacgccuguaa

SEQ ID NO: 488916 - RNA, 64 nt, Homo Sapiens
caagagaaucacuugaacccugccagcuacuccagaggcugaggugaugggggucugccuguaa

SEQ ID NO: 488917 - RNA, 64 nt, Homo Sapiens
ugggcagaucaccugaggucucccagcacuuugggaggcugagggugguggcucaugccuguaa

SEQ ID NO: 488918 - RNA, 64 nt, Homo Sapiens
cgggaggaucgccagagcccucucagcuacuugggaggcugaggaugguggcacgugccugugg

SEQ ID NO: 488919 - RNA, 64 nt, Homo Sapiens
uggggagaauugcuugaaccucccagcuacuuuggaggcugaggaugguugcgcaugccuguaa

SEQ ID NO: 488920 - RNA, 64 nt, Homo Sapiens
ugggaggaucgcuugagccuuaccagcacuuugggaggcugaagaugguggcucauaccuguua

SEQ ID NO: 488921 - RNA, 64 nt, Homo Sapiens
ucgaagcagccucccaccagaauaguucucauuggaggcugaggccagauauuugcuuccuaag

SEQ ID NO: 488922 - RNA, 64 nt, Homo Sapiens
gcagcuggaaguuuggguuuuuuaagcccgacuugaggcugagaggggacguaaaucccuaauc

SEQ ID NO: 488923 - RNA, 64 nt, Homo Sapiens
acgagggcccaggaccagaaagauucaagcccaggaggcugaaacaccagccccagcugccauc

SEQ ID NO: 488924 - RNA, 64 nt, Homo Sapiens
caggagaaucgcuugaacucccccagcuacucgggaggcugagggccuucacuucaagggcccu

SEQ ID NO: 488925 - RNA, 64 nt, Homo Sapiens
caggagaauggccugaacccucccagcuacuugggaggcugaggaugguugcaggcgccuguag

SEQ ID NO: 488926 - RNA, 64 nt, Homo Sapiens
acgguggcucacgccuguaaucccagcacuuugggaggcugaggcaggugguucacuggagguu

SEQ ID NO: 488927 - RNA, 64 nt, Homo Sapiens
gugguggugcacaccugugaucccagcuacuugggaggcugaggugggagaauugcuugaaccu

SEQ ID NO: 488928 - RNA, 64 nt, Homo Sapiens
gcgguggcuuacgcuuguaaucccagcacuuugggaggcugaagcaggcggaucacaaggucag

SEQ ID NO: 488929 - RNA, 64 nt, Homo Sapiens
guguuggcgggcaucuguaauaccagcuacuugggaggcugaggcagaagaaucacuugaaccc

SEQ ID NO: 488930 - RNA, 64 nt, Homo Sapiens
caggagaaucccuugagccccuauaauaccagcugaggcugaggccaagcaugguagcaagugc

SEQ ID NO: 488931 - RNA, 64 nt, Homo Sapiens
cggguggaucacuugaggucucccagcacuuugggaggcugaggacaguggcucacaccuguaa

SEQ ID NO: 488932 - RNA, 64 nt, Homo Sapiens
caggagaauuacuuuaaccuucccagcuacucaggaggcugaggguguuggcacacaccuguaa

SEQ ID NO: 488933 - RNA, 64 nt, Homo Sapiens
cggggagaucacaaggucagucccagcacuuugggaggcugagggugguagcccacgccucuaa

SEQ ID NO: 488934 - RNA, 64 nt, Homo Sapiens
ggagccccugccccacgcuaauaaaauguguugcgaggcugacgcugguguguaugcgagcgcc

SEQ ID NO: 488935 - RNA, 64 nt, Homo Sapiens
gugguggcaggcgccuguaaucccagcuacucaggaggcugaggcaggagaauaacuugaaccc

SEQ ID NO: 488936 - RNA, 64 nt, Homo Sapiens
auggaggugggugcuuguaguuccagcuacucaggaggcugaggugggaggaugacuugaacgc

SEQ ID NO: 488937 - RNA, 64 nt, Homo Sapiens
aggaggcugaggugggaggaugacuugaacgcaggaggcugaggcugcagugaguugugauugc

SEQ ID NO: 488938 - RNA, 64 nt, Homo Sapiens
gugguggcaggugccuguaaucccagcuacuugggaggcugaggcaugagaaucacuuaaaccu

SEQ ID NO: 488939 - RNA, 64 nt, Homo Sapiens
acaguggcucaugccuguaaucccagcacucugggaggcugagguggguggaucaccugagguc

SEQ ID NO: 488940 - RNA, 64 nt, Homo Sapiens
augguggugcaugccuguaaucccagcuacucgggaggcugaggcaggagaacugcuugaaccc

SEQ ID NO: 488941 - RNA, 64 nt, Homo Sapiens
gugguggcgggcaccuguagucccagcuacucgggaggcugaggcaggagaauggugugaaccc

SEQ ID NO: 488942 - RNA, 64 nt, Homo Sapiens
caucagcagcccauggccucuggccaggcauggcgaggcugaggugggaggaugguuugagcuc

SEQ ID NO: 488943 - RNA, 64 nt, Homo Sapiens
caggugccucacgccuguaaucccagcacuuugggaggcugagcuggaucacuugaguucagga

SEQ ID NO: 488944 - RNA, 64 nt, Homo Sapiens
acgguggcacgugccugugaucccagcuacuugggaggcugaggcaggaggaucgccugagccc

SEQ ID NO: 488945 - RNA, 64 nt, Homo Sapiens
cccucuugauggaugaagacacugaggacucagagaggcugagucacuuaccugaggacaccca

SEQ ID NO: 488946 - RNA, 64 nt, Homo Sapiens
augauggcacacaccuguaguccgagccacuugggaggcugaggugggaggaucgguugagccc

SEQ ID NO: 488947 - RNA, 64 nt, Homo Sapiens
acgguggcucaugccucuaaucccagcacuuugggaggcugaggcugggggaucaccugagguc

SEQ ID NO: 488948 - RNA, 64 nt, Homo Sapiens
uugguggcaugcaccuguaaucccagcuacuugggaggcugaggcaggagaauucuuugaaccc

SEQ ID NO: 488949 - RNA, 64 nt, Homo Sapiens
ccuguacuggggaggugcccacccagcuacuggggaggcugagucaggagaaucgcuugaaccu

SEQ ID NO: 488950 - RNA, 64 nt, Homo Sapiens
auucccuggagacucacugcaaguuccugcccaggaggcugagggcaccccauccucagugccc

SEQ ID NO: 488951 - RNA, 64 nt, Homo Sapiens
gcgguggcucacaccuguaaucccagcacuuugggaggcugagacgggugaauuacaugagguu

SEQ ID NO: 488952 - RNA, 64 nt, Homo Sapiens
guaguggugcaugccuguaaucccagcuacucgggaggcugaggcaggagaauugcuugaaccc

SEQ ID NO: 488953 - RNA, 64 nt, Homo Sapiens
cgaacuaaacccaggcaacaggcgaggcaggacagaggcugaguggaaagguggucuggagccc

SEQ ID NO: 488954 - RNA, 64 nt, Homo Sapiens
gaaugcacagcucagggaagcugguggaugccuagaggcugaaggacagggaacucuccauuau

SEQ ID NO: 488955 - RNA, 64 nt, Homo Sapiens
uaaaauggaugcagcccuaacugcaaaagucagagaggcugacaaggaccaaugcuucuuuauc

SEQ ID NO: 488956 - RNA, 64 nt, Homo Sapiens
gugguggcacacaccuguagucccagcuacucgggaggcugaggcaggagaaucguuugaaccu

SEQ ID NO: 488957 - RNA, 64 nt, Homo Sapiens
ugugguggugcgugcccagguucccagguacucggaggcugagaggugggaggaugccuugagc

SEQ ID NO: 488958 - RNA, 64 nt, Homo Sapiens
ugguggcgggcgccugugguggccagcuacucaggaggcugaggcaggagaauggcgugaaccc

SEQ ID NO: 488959 - RNA, 64 nt, Homo Sapiens
cugguggcacaugccuguaauccgagugcuuugggaggcugaggcaggaggaucacucgagcuc

SEQ ID NO: 488960 - RNA, 64 nt, Homo Sapiens
augguggugcacaccaguauucccagcuacucuggaggcugaggcggaggcaggauugcuugau

SEQ ID NO: 488961 - RNA, 64 nt, Homo Sapiens
gugguggugcacaccuguaaucccagcuacucgggaggcugaggcaagagaaucacuugaaccc

SEQ ID NO: 488962 - RNA, 64 nt, Homo Sapiens
acagucauggaguuggguauucccagcuaccagggaggcugaggugggaggauugcuugaugcc

SEQ ID NO: 488963 - RNA, 64 nt, Homo Sapiens
gccuauagccugauuuaugucacugccaauuucugaggcugaagccauuucacauuucaccccu

SEQ ID NO: 488964 - RNA, 64 nt, Homo Sapiens
guggcagcaugcgccuauagucccagccacuugggaggcugaggcaggagaaucgcuugaaccc

SEQ ID NO: 488965 - RNA, 64 nt, Homo Sapiens
augguggcgcauaccuguaguccuagcuacucaggaggcugaggugggaggaucacuugagcuu

SEQ ID NO: 488966 - RNA, 64 nt, Homo Sapiens
augguggcgggcuccuguagucccagcuacucaggaggcugaggcaggagaauggcgcgaacau

SEQ ID NO: 488967 - RNA, 64 nt, Homo Sapiens
caggagaaucgcuugaacccucccagcuacucgggaggcugagggugguggcgcgugccuauaa

SEQ ID NO: 488968 - RNA, 64 nt, Homo Sapiens
cgggcggaucaccugagguuucccagcacuuugggaggcugagggcgguggcucacgucuguaa

SEQ ID NO: 488969 - RNA, 64 nt, Homo Sapiens
caagagaaucucuugaaccuguuaucccaguuaggaggcugagggggcaugguagcaggugucu

SEQ ID NO: 488970 - RNA, 64 nt, Homo Sapiens
cgggcggaacaccugaggucucccagcacuuugggaggcugagggcgguggcucacaccuguaa

SEQ ID NO: 488971 - RNA, 64 nt, Homo Sapiens
caagugaaucacuugaacccucccagcuacuugggaggcugagggguguggugggcaccuguaa

SEQ ID NO: 488972 - RNA, 64 nt, Homo Sapiens
uggguggaucacuugaggucucccagcauuuugagaggcugaggaaauuacuuaauuccuguaa

SEQ ID NO: 488973 - RNA, 64 nt, Homo Sapiens
caggauaaucacuugaauccucccagcuacucaggaggcugagggugauggcacaugccuguaa

SEQ ID NO: 488974 - RNA, 64 nt, Homo Sapiens
ugggaagaucucuugagcccucccagcuacuugggaggcugaggguggugguaugccccuguag

SEQ ID NO: 488975 - RNA, 64 nt, Homo Sapiens
caggagaaucgcuugaacucuccuagcuccucgggaggcugaggaugguggcacgcgucugugg

SEQ ID NO: 488976 - RNA, 64 nt, Homo Sapiens
ugggcagaucacuugaggucccccagcacuuugggaggcugagagcaguggcucacaucuguaa

SEQ ID NO: 488977 - RNA, 64 nt, Homo Sapiens
caggagaaucacuugagcccucccagcuacuugggaggcugaggaugguggcaccugccuguaa

SEQ ID NO: 488978 - RNA, 64 nt, Homo Sapiens
uggguggaucacuggaguuuucucagcacuuugggaggcugagggugguggcucaugccuguaa

SEQ ID NO: 488979 - RNA, 64 nt, Homo Sapiens
caggagaaucacuugaauucucccagcuacuggggaggcugaggaugguggcgggugccuguaa

SEQ ID NO: 488980 - RNA, 64 nt, Homo Sapiens
cagguggaucaccugagguuucccagcacuuugggaggcugaggacaguggcccaugccuauaa

SEQ ID NO: 488981 - RNA, 64 nt, Homo Sapiens
agagcuaugacugcaucacugagcccaggaguuggaggcugaagugagacaaaggggaucgcuu

SEQ ID NO: 488982 - RNA, 64 nt, Homo Sapiens
ugggaggacugcuuaagcucucccgguacuuugggaggcugaggauaguggcuuaugccuguaa

SEQ ID NO: 488983 - RNA, 64 nt, Homo Sapiens
caugagaauugcuugaacccucccagcuacuugggaggcugaugguaguggcgcaugccuguag

SEQ ID NO: 488984 - RNA, 64 nt, Homo Sapiens
cggguggaucaccugaggucucccagcacuuugggaggcugagggcggugacucacgccuauaa

SEQ ID NO: 488985 - RNA, 64 nt, Homo Sapiens
ugggaggaucauuugugcccuccaagcuacuugggaggcugaagacaguaguacacaccuguag

SEQ ID NO: 488986 - RNA, 64 nt, Homo Sapiens
caggagaauugcuugagcccuuccagcuacucgggaggcugagguugguggugugcaccuguaa

SEQ ID NO: 488987 - RNA, 64 nt, Homo Sapiens
caggcggaucaccugaggucucccagcacuuugggaggcugaggacaguggcucaugccuguaa

SEQ ID NO: 488988 - RNA, 64 nt, Homo Sapiens
uugcccacacugggggccagggcgagggugggcugaggcugaagaggcgggcgaggcggccaca

SEQ ID NO: 488989 - RNA, 64 nt, Homo Sapiens
ccaaaggggcuggggaggcacucgggugggggcugaggcugaggugccaucucacuccccaagg

SEQ ID NO: 488990 - RNA, 64 nt, Homo Sapiens
gggcugggcgagcuaccaagagguggcuaaggcagaggcugaggguuuggacucucggggccaa

SEQ ID NO: 488991 - RNA, 64 nt, Homo Sapiens
uggcugcaggagcucguuucggaaagccaagguggaggcugaggcgccgccgcuccucccccca

SEQ ID NO: 488992 - RNA, 64 nt, Homo Sapiens
cuggaggaucacuggaguucucccagcuacuggugaggcugaggacgguggugugugccuguag

SEQ ID NO: 488993 - RNA, 64 nt, Homo Sapiens
ccggaggauugcuugagcccucccaacacuuugggaggcugaggacgguggcucaugccuguaa

SEQ ID NO: 488994 - RNA, 64 nt, Homo Sapiens
caggagaauugcuugaacuuuccuagcuacuugggaggcugagggugguggugggugccuguaa

SEQ ID NO: 488995 - RNA, 64 nt, Homo Sapiens
caggagaauugcuugaacccucccagcuacucgggaggcugagggugguggggugcgcuuguaa

SEQ ID NO: 488996 - RNA, 64 nt, Homo Sapiens
cagaugaauugcuugaauccucccagcuacucaggaggcugagggugguggcgcgcgccuguaa

SEQ ID NO: 488997 - RNA, 64 nt, Homo Sapiens
caggucgaucacgaggucagucccagcacuuugggaggcugaggacgguggcucacgccuguaa

SEQ ID NO: 488998 - RNA, 64 nt, Homo Sapiens
cacaagagucgcuuaaaccuuuccagcuacuugagaggcugagggugguggugugcaccuuuag

SEQ ID NO: 488999 - RNA, 64 nt, Homo Sapiens
caggagaauggugugaauccuccuagcugcuugggaggcugagggugguggcaggugccuguag

SEQ ID NO: 489000 - RNA, 64 nt, Homo Sapiens
caggagaauggcaugaaccgucccagcuacucaggaggcugagggugguugugggcgccuguag

SEQ ID NO: 489001 - RNA, 64 nt, Homo Sapiens
caguugggucacgugggcccucccauaauuuucagaggcugagagcuguggcucaggccuguaa

SEQ ID NO: 489002 - RNA, 64 nt, Homo Sapiens
caggagaauugcuugaauccucucagcuacuugggaggcugagguuaguggugcaugccuguag

SEQ ID NO: 489003 - RNA, 64 nt, Homo Sapiens
caggagagugcuugaacccaucccagcuacuugggaggcugagggugguggcaggugccuguaa

SEQ ID NO: 489004 - RNA, 64 nt, Homo Sapiens
cagguggaucaccugaggucucccagcacuuugggaggcugagggcgguggcucacaccuguaa

SEQ ID NO: 489005 - RNA, 64 nt, Homo Sapiens
caggagaauugcuugaaccuucccagcuacccgggaggcugaggauaguugugggcaccuguaa

SEQ ID NO: 489006 - RNA, 64 nt, Homo Sapiens
ugggcgcaucaccugaggucucccaguacuuugggaggcugagggguggcucaaaugccuguaa

SEQ ID NO: 489007 - RNA, 64 nt, Homo Sapiens
caggagaauucguuaaaccuucccagcugcuugggaggcugaggauaguggugggugccuguag

SEQ ID NO: 489008 - RNA, 64 nt, Homo Sapiens
uggguggcuuacaaggucagucccagcacuuugggaggcugaggguuuuggcucaggccuguaa

SEQ ID NO: 489009 - RNA, 64 nt, Homo Sapiens
ugcaguagcucacacuguaaucacagugacucaggaggcugaggugagaggauuccuugaggcc

SEQ ID NO: 489010 - RNA, 64 nt, Homo Sapiens
augguggcacaugccuauagucucagcuacuugugaggcugaggcaggaggauucuuugagccc

SEQ ID NO: 489011 - RNA, 64 nt, Homo Sapiens
caggaaaaucgcuugaacccucccaguuacucgagaggcugaggguaguggugcaugccuguaa

SEQ ID NO: 489012 - RNA, 64 nt, Homo Sapiens
cuggcguaucaccugagguuucccagcacuuugggaggcugaggacaguggcuuacgccuguaa

SEQ ID NO: 489013 - RNA, 64 nt, Homo Sapiens
caggauugcuugagcccagguccuagcuucuugggaggcugaggaugguggugcacaccuguag

SEQ ID NO: 489014 - RNA, 64 nt, Homo Sapiens
ugguuguauugcuugaggccucccagcacugugggaggcugagggugguggcucaugccuguaa

SEQ ID NO: 489015 - RNA, 64 nt, Homo Sapiens
cagcagacuggugugaacccucccagcuacgugggaggcugagggugggggugggcgccuguag

SEQ ID NO: 489016 - RNA, 64 nt, Homo Sapiens
cagguggaucacgaggucagucccagcacuuugggaggcugaggacgguggcucaugccuguaa

SEQ ID NO: 489017 - RNA, 64 nt, Homo Sapiens
gugguggcucauaccuguaaccccagcacuuugggaggcugagguaggaggauugugggaagcc

SEQ ID NO: 489018 - RNA, 64 nt, Homo Sapiens
augauggugugcaccuauagucccagcuacucgggaggcugaagcagaaggaucacuugagucu

SEQ ID NO: 489019 - RNA, 64 nt, Homo Sapiens
caggguggcaugugccuuuaaucccagcuacagggaggcugaggcaggagaaucacuugaaccu

SEQ ID NO: 489020 - RNA, 64 nt, Homo Sapiens
acgguggcucacaccuguaaucccagcacuuugggaggcugaggcaggcagaucaugaggucaa

SEQ ID NO: 489021 - RNA, 64 nt, Homo Sapiens
gugguggcgcgcgccuguugucuuagcuacucaggaggcugaggcaggagaaucgcuugaaaac

SEQ ID NO: 489022 - RNA, 64 nt, Homo Sapiens
ggagggaggccaggccucgcuugcaccgcgggacgaggcugaccgggcuguucuguagacucag

SEQ ID NO: 489023 - RNA, 64 nt, Homo Sapiens
gugguggcacaugccuguaaucccagcuacucgggaggcugaggcaggagaauugcuugaaccu

SEQ ID NO: 489024 - RNA, 64 nt, Homo Sapiens
guacaaaccagcugccucacuucuguuucacagggaggcugauggaaaaaggaagcaagcugga

SEQ ID NO: 489025 - RNA, 64 nt, Homo Sapiens
gugguggugggcgccuguagucccagcuacuugggaggcugaggcaggagaaugguaugaacca

SEQ ID NO: 489026 - RNA, 64 nt, Homo Sapiens
guggugguucaugccuguaauaccagcguuuugggaggcugagaugggaggauugcuugagccc

SEQ ID NO: 489027 - RNA, 64 nt, Homo Sapiens
auagugguucaugccuguaaucccagcacuuugggaggcugaggaggguggaucacuugaggcc

SEQ ID NO: 489028 - RNA, 64 nt, Homo Sapiens
caugguggcacacaccuguaaucccagcuacucggaggcugaggcacaagaauugcuugaaccu

SEQ ID NO: 489029 - RNA, 64 nt, Homo Sapiens
gcagcgccucgcucgagagaagcagaugagggaggaggcugaacgcacgagggaugaguuggag

SEQ ID NO: 489030 - RNA, 64 nt, Homo Sapiens
ggaggaggcaaaacuucuggcccagaaggccgcagaggcugagcaggaaaugcagcgcaucaag

SEQ ID NO: 489031 - RNA, 64 nt, Homo Sapiens
gugaugauacaugccuguaauccuggcuacuugggaggcugaggcaugagaauugcuugaaccu

SEQ ID NO: 489032 - RNA, 64 nt, Homo Sapiens
gugguggcggaugccuguagucccagcuacucaggaggcugaggcaggagaauggcgugaaccc

SEQ ID NO: 489033 - RNA, 64 nt, Homo Sapiens
cgcaguggcuuacacuuguaacccuagaacuugggaggcugaggugggcggauuacuugagccc

SEQ ID NO: 489034 - RNA, 64 nt, Homo Sapiens
gugguagugcaugccuguagucccagcuacuugggaggcugaagugggaggauggccugagcuc

SEQ ID NO: 489035 - RNA, 64 nt, Homo Sapiens
acacacggggccaugucuggacgagcaggggagagaggcugaacuggccagaaguggccccucc

SEQ ID NO: 489036 - RNA, 64 nt, Homo Sapiens
gugguggcacaugacuguaaucccagcuacucaggaggcugaggcaggaggaucacuugaaccu

SEQ ID NO: 489037 - RNA, 64 nt, Homo Sapiens
gugguggcacaugccaguaauuccaucuacucgggaggcugaggcaggagaaucgucuaagccc

SEQ ID NO: 489038 - RNA, 64 nt, Homo Sapiens
gacaccuucccggguggaagcuugagacugugaagaggcugaaacuguggcuucagucaauugu

SEQ ID NO: 489039 - RNA, 64 nt, Homo Sapiens
cacgagaaucacuugaacccucccagcuacucgggaggcugaggaugguggcgcaugccuuuaa

SEQ ID NO: 489040 - RNA, 64 nt, Homo Sapiens
caggagaaucgcuuguacccucccagcuacucaggaggcugaggaugguggcgugcaccuguaa

SEQ ID NO: 489041 - RNA, 64 nt, Homo Sapiens
ugggcagaucaccugagaucucccagcaguuugggaggcugagugugguggcucacgccuauaa

SEQ ID NO: 489042 - RNA, 64 nt, Homo Sapiens
ggucggggggcuuucugucucugaggaggcugaagaggcugacaggugguggcaguggaggagg

SEQ ID NO: 489043 - RNA, 64 nt, Homo Sapiens
aggcugacaggucggggggcuggaggaggcugaggaggcugaagcucaggccuggugguggcag

SEQ ID NO: 489044 - RNA, 64 nt, Homo Sapiens
aggcugaagaggcugacaggugguggcaguggaggaggcugaggcuugcccaccucaggccugg

SEQ ID NO: 489045 - RNA, 64 nt, Homo Sapiens
ucaguggcucacgccuguaaucccagcacuuugggaggcugaggcagguggaucacgaggucag

SEQ ID NO: 489046 - RNA, 64 nt, Homo Sapiens
gugguggcgggcgccuguagucccagcuacucgggaggcugaggcaggagaauggugugaaccc

SEQ ID NO: 489047 - RNA, 64 nt, Homo Sapiens
cugcaaugagcuauaauuauucauuugagcccaggaggcugaggcagaggcugaggugggaaga

SEQ ID NO: 489048 - RNA, 64 nt, Homo Sapiens
ugggaagaucauuugagcccucccagcuacuccagaggcugaggaugguggugugcaccugugg

SEQ ID NO: 489049 - RNA, 64 nt, Homo Sapiens
caggagaaucgcuugaacccuccuggcuacucgggaggcugagggugguggcgggcaccuguaa

SEQ ID NO: 489050 - RNA, 64 nt, Homo Sapiens
ugagaggaucacuugagccuucucagcuacucaggaggcugagaaugguggcacgugaguguag

SEQ ID NO: 489051 - RNA, 64 nt, Homo Sapiens
uggguggauugcuugagcccucccagcacuuugggaggcugagggcaguggcuuguuccuauag

SEQ ID NO: 489052 - RNA, 64 nt, Homo Sapiens
caggagaaucgcuugauccuuuccaucuacucgggaggcugaggguaguggcgcgugccuguaa

SEQ ID NO: 489053 - RNA, 64 nt, Homo Sapiens
cgggcagaucacuugagguucccuagcacuuugggaggcugagggcgguggcucaugccuguaa

SEQ ID NO: 489054 - RNA, 64 nt, Homo Sapiens
cacgagaaucacuugaacucucccagcuacacaggaggcugagggugguggcaggagccuguaa

SEQ ID NO: 489055 - RNA, 64 nt, Homo Sapiens
cacgagacuugcuuaauaccuccuagcuacuugggaggcugagguugguggcucaugccuauaa

SEQ ID NO: 489056 - RNA, 64 nt, Homo Sapiens
cggaagauucgcuugagcccucccagcuacucgggaggcugagggcgguggcacccgccuguaa

SEQ ID NO: 489057 - RNA, 64 nt, Homo Sapiens
ccagagaaucgcuugaaccuaaucccagcuucuggaggcugagggacugauggcaugugccugu

SEQ ID NO: 489058 - RNA, 64 nt, Homo Sapiens; identical to SEQ ID NO: 299681

SEQ ID NO: 489059 - RNA, 64 nt, Homo Sapiens; identical to SEQ ID NO: 299682

SEQ ID NO: 489060 - RNA, 64 nt, Homo Sapiens; identical to SEQ ID NO: 299683

SEQ ID NO: 489061 - RNA, 64 nt, Homo Sapiens; identical to SEQ ID NO: 299684

SEQ ID NO: 489062 - RNA, 64 nt, Homo Sapiens; identical to SEQ ID NO: 299685

SEQ ID NO: 489063 - RNA, 64 nt, Homo Sapiens; identical to SEQ ID NO: 299686

SEQ ID NO: 489064 - RNA, 64 nt, Homo Sapiens; identical to SEQ ID NO: 299687

SEQ ID NO: 489065 - RNA, 64 nt, Homo Sapiens; identical to SEQ ID NO: 299688

SEQ ID NO: 489066 - RNA, 64 nt, Homo Sapiens; identical to SEQ ID NO: 299689

SEQ ID NO: 489067 - RNA, 64 nt, Homo Sapiens; identical to SEQ ID NO: 299690

SEQ ID NO: 489068 - RNA, 64 nt, Homo Sapiens; identical to SEQ ID NO: 299691

SEQ ID NO: 489069 - RNA, 64 nt, Homo Sapiens; identical to SEQ ID NO: 299692

SEQ ID NO: 489070 - RNA, 53 nt, Homo Sapiens; identical to SEQ ID NO: 299693

SEQ ID NO: 489071 - RNA, 64 nt, Homo Sapiens; identical to SEQ ID NO: 299694

SEQ ID NO: 489072 - RNA, 64 nt, Homo Sapiens; identical to SEQ ID NO: 299695

SEQ ID NO: 489073 - RNA, 64 nt, Homo Sapiens; identical to SEQ ID NO: 299696

SEQ ID NO: 489074 - RNA, 64 nt, Homo Sapiens; identical to SEQ ID NO: 299697

SEQ ID NO: 489075 - RNA, 64 nt, Homo Sapiens; identical to SEQ ID NO: 299698

SEQ ID NO: 489076 - RNA, 64 nt, Homo Sapiens; identical to SEQ ID NO: 299699

SEQ ID NO: 489077 - RNA, 64 nt, Homo Sapiens; identical to SEQ ID NO: 299700

SEQ ID NO: 489078 - RNA, 64 nt, Homo Sapiens; identical to SEQ ID NO: 299701

SEQ ID NO: 489079 - RNA, 64 nt, Homo Sapiens; identical to SEQ ID NO: 299702

SEQ ID NO: 489080 - RNA, 64 nt, Homo Sapiens; identical to SEQ ID NO: 299703

SEQ ID NO: 489081 - RNA, 64 nt, Homo Sapiens; identical to SEQ ID NO: 299704

SEQ ID NO: 489082 - RNA, 64 nt, Homo Sapiens; identical to SEQ ID NO: 299705

SEQ ID NO: 489083 - RNA, 64 nt, Homo Sapiens; identical to SEQ ID NO: 299706

SEQ ID NO: 489084 - RNA, 64 nt, Homo Sapiens; identical to SEQ ID NO: 299707

SEQ ID NO: 489085 - RNA, 64 nt, Homo Sapiens; identical to SEQ ID NO: 299708

SEQ ID NO: 489086 - RNA, 64 nt, Homo Sapiens; identical to SEQ ID NO: 299709

SEQ ID NO: 489087 - RNA, 64 nt, Homo Sapiens; identical to SEQ ID NO: 299710

SEQ ID NO: 489088 - RNA, 64 nt, Homo Sapiens; identical to SEQ ID NO: 299711

SEQ ID NO: 489089 - RNA, 63 nt, Homo Sapiens
ugccaugcggcugccugcaccccagacaauaaagggaccaaaaccacccaacccccacccugc

SEQ ID NO: 489090 - RNA, 63 nt, Homo Sapiens
cuaggaucauuccacaccccugcaccugaccaagggaccaaugaggcagaggcuugccccaag

SEQ ID NO: 489091 - RNA, 63 nt, Homo Sapiens
ugucaagcuggccguggagugugugagggugcagggaccaagaucuuccauucccagacagca

SEQ ID NO: 489092 - RNA, 63 nt, Homo Sapiens
cugccuacccaccccuucccugcacuuuaucuugggaccaaaaaucauaaggucuuauucuug

SEQ ID NO: 489093 - RNA, 63 nt, Homo Sapiens
cuuuguauaaccuaccugaacagcccaggccucgggaccaacuacuucccagggcccaggccu

SEQ ID NO: 489094 - RNA, 63 nt, Homo Sapiens
caagaccuuguuuugcugucgaauggacgugcugggaccaacuagucaugagcugucugggaa

SEQ ID NO: 489095 - RNA, 63 nt, Homo Sapiens
uuaacuuuuuggugcaucuagguuggcacuguagggaccaagaauaagcacuggggacugcca

SEQ ID NO: 489096 - RNA, 63 nt, Homo Sapiens
ccugccucugcccaucagaucgugacagucucagggaccaaucaaaggggguggagacaggac

SEQ ID NO: 489097 - RNA, 63 nt, Homo Sapiens
gggggccacgcagccagccauugagcugcaagagggaccaagaaugcugugccuugucaccca

SEQ ID NO: 489098 - RNA, 63 nt, Homo Sapiens
ccucccuggggacgugccccaccucucugguucgggaccaaucaauccucucccccacgggac

SEQ ID NO: 489099 - RNA, 63 nt, Homo Sapiens
ccaagaagcacugggugaccagcuggcagacucgggaccaauacuacugacguccucccugau

SEQ ID NO: 489100 - RNA, 63 nt, Homo Sapiens
cuggggcacggcgggauccuccacagagaggaggggaccaauucuggacagacagauguuggg

SEQ ID NO: 489101 - RNA, 64 nt, Homo Sapiens; identical to SEQ ID NO: 160525

SEQ ID NO: 489102 - RNA, 64 nt, Homo Sapiens; identical to SEQ ID NO: 160526

SEQ ID NO: 489103 - RNA, 64 nt, Homo Sapiens; identical to SEQ ID NO: 160527

SEQ ID NO: 489104 - RNA, 64 nt, Homo Sapiens; identical to SEQ ID NO: 160528

SEQ ID NO: 489105 - RNA, 64 nt, Homo Sapiens; identical to SEQ ID NO: 160529

SEQ ID NO: 489106 - RNA, 64 nt, Homo Sapiens; identical to SEQ ID NO: 160530

SEQ ID NO: 489107 - RNA, 64 nt, Homo Sapiens; identical to SEQ ID NO: 160531

SEQ ID NO: 489108 - RNA, 64 nt, Homo Sapiens; identical to SEQ ID NO: 160532

SEQ ID NO: 489109 - RNA, 64 nt, Homo Sapiens; identical to SEQ ID NO: 160533

SEQ ID NO: 489110 - RNA, 64 nt, Homo Sapiens; identical to SEQ ID NO: 160534

SEQ ID NO: 489111 - RNA, 64 nt, Homo Sapiens; identical to SEQ ID NO: 160535

SEQ ID NO: 489112 - RNA, 64 nt, Homo Sapiens; identical to SEQ ID NO: 160536

SEQ ID NO: 489113 - RNA, 64 nt, Homo Sapiens; identical to SEQ ID NO: 160537

SEQ ID NO: 489114 - RNA, 64 nt, Homo Sapiens; identical to SEQ ID NO: 160538

SEQ ID NO: 489115 - RNA, 64 nt, Homo Sapiens; identical to SEQ ID NO: 160539

SEQ ID NO: 489116 - RNA, 64 nt, Homo Sapiens; identical to SEQ ID NO: 160540

SEQ ID NO: 489117 - RNA, 64 nt, Homo Sapiens; identical to SEQ ID NO: 160541

SEQ ID NO: 489118 - RNA, 64 nt, Homo Sapiens; identical to SEQ ID NO: 160542

SEQ ID NO: 489119 - RNA, 64 nt, Homo Sapiens; identical to SEQ ID NO: 160543

SEQ ID NO: 489120 - RNA, 64 nt, Homo Sapiens; identical to SEQ ID NO: 160544

SEQ ID NO: 489121 - RNA, 64 nt, Homo Sapiens; identical to SEQ ID NO: 160545

SEQ ID NO: 489122 - RNA, 64 nt, Homo Sapiens; identical to SEQ ID NO: 160546

SEQ ID NO: 489123 - RNA, 64 nt, Homo Sapiens; identical to SEQ ID NO: 160547

SEQ ID NO: 489124 - RNA, 64 nt, Homo Sapiens; identical to SEQ ID NO: 160548

SEQ ID NO: 489125 - RNA, 64 nt, Homo Sapiens; identical to SEQ ID NO: 160549

SEQ ID NO: 489126 - RNA, 64 nt, Homo Sapiens; identical to SEQ ID NO: 160550

SEQ ID NO: 489127 - RNA, 64 nt, Homo Sapiens; identical to SEQ ID NO: 160551

SEQ ID NO: 489128 - RNA, 64 nt, Homo Sapiens; identical to SEQ ID NO: 160552

SEQ ID NO: 489129 - RNA, 64 nt, Homo Sapiens; identical to SEQ ID NO: 160553

SEQ ID NO: 489130 - RNA, 64 nt, Homo Sapiens
auuugaguggaggauuuuuuuucucauuuuucuaguguuaaauuuuaaccagcauuaacauggu

SEQ ID NO: 489131 - RNA, 64 nt, Homo Sapiens
auccauuacaguuaccuuacauagcacuugauacguguuaaaugaacauaugaauguaauuuau

SEQ ID NO: 489132 - RNA, 64 nt, Homo Sapiens
uuugaauaaauucaguugcuaaaguagauccaaaguguuaaaaaugcugaagucaugucaagua

SEQ ID NO: 489133 - RNA, 64 nt, Homo Sapiens
agagauaagggcauuuguuucaaugaaaaaguuaguguuaaaggaagugagucagggagggcgg

SEQ ID NO: 489134 - RNA, 64 nt, Homo Sapiens
ucauuaaaauaauaguggugaauuauauguuauuguguuaaaaccucacuugccaaauucuggc

SEQ ID NO: 489135 - RNA, 64 nt, Homo Sapiens
uugucuuccgaguuuuuugguuccuuuuuuaacuguguuaaaguacuugaaauguauugacugc

SEQ ID NO: 489136 - RNA, 64 nt, Homo Sapiens
uuuuaauguuuuuugccuuuaauaauaggggugaguguuaaaggccagagagccuaacuugaua

SEQ ID NO: 489137 - RNA, 64 nt, Homo Sapiens
ugugaauucucugguguucauuaaagugugagcuguguuaaaaggcauucuuagauucauuuua

SEQ ID NO: 489138 - RNA, 64 nt, Homo Sapiens
aguuuguuuuaaagucaucuuuacuuucccaaauguguuaaauuuguaacuccucuuugggguc

SEQ ID NO: 489139 - RNA, 64 nt, Homo Sapiens
uuuuuaagcuuauuguguuuaagaaaguagcuauguguuaaacagaggugauggcagcccuucc

SEQ ID NO: 489140 - RNA, 64 nt, Homo Sapiens
uuacgauaaguauucuauugauagccauuguaaaguguuaaaauuacagauuuuuagcacaaaa

SEQ ID NO: 489141 - RNA, 64 nt, Homo Sapiens
uugcaucacgucgccuuccuuuuaauaaaaucuuguguuaaaaugccucaccaauuugcccguc

SEQ ID NO: 489142 - RNA, 64 nt, Homo Sapiens
gcagacugaccguacaguaauuuauuugucguuaguguuaaagauuaagcauaguaacugacuc

SEQ ID NO: 489143 - RNA, 64 nt, Homo Sapiens
guguuaaagauuaagcauaguaacugacucuuaaguguuaaauaauguagaaguaaaaaaauuu

SEQ ID NO: 489144 - RNA, 64 nt, Homo Sapiens
acaguauaucuaauaacuagagcuuuauucuuuaguguuaaaauuaagauaaauacgaagauaa

SEQ ID NO: 489145 - RNA, 64 nt, Homo Sapiens
ugcuauaaucauuaagaauaguggauggcugaagguguuaaaugcaauaugaucugaaaaccca

SEQ ID NO: 489146 - RNA, 64 nt, Homo Sapiens; identical to SEQ ID NO: 117511

SEQ ID NO: 489147 - RNA, 64 nt, Homo Sapiens; identical to SEQ ID NO: 117512

SEQ ID NO: 489148 - RNA, 64 nt, Homo Sapiens; identical to SEQ ID NO: 117513

SEQ ID NO: 489149 - RNA, 64 nt, Homo Sapiens; identical to SEQ ID NO: 117514

SEQ ID NO: 489150 - RNA, 64 nt, Homo Sapiens; identical to SEQ ID NO: 256782

SEQ ID NO: 489151 - RNA, 64 nt, Homo Sapiens; identical to SEQ ID NO: 256783

SEQ ID NO: 489152 - RNA, 53 nt, Homo Sapiens; identical to SEQ ID NO: 256784

SEQ ID NO: 489153 - RNA, 64 nt, Homo Sapiens; identical to SEQ ID NO: 256785

SEQ ID NO: 489154 - RNA, 64 nt, Homo Sapiens; identical to SEQ ID NO: 256786

SEQ ID NO: 489155 - RNA, 64 nt, Homo Sapiens; identical to SEQ ID NO: 256787

SEQ ID NO: 489156 - RNA, 64 nt, Homo Sapiens; identical to SEQ ID NO: 256788

SEQ ID NO: 489157 - RNA, 64 nt, Homo Sapiens; identical to SEQ ID NO: 256789

SEQ ID NO: 489158 - RNA, 64 nt, Homo Sapiens; identical to SEQ ID NO: 476338

SEQ ID NO: 489159 - RNA, 64 nt, Homo Sapiens; identical to SEQ ID NO: 476339

SEQ ID NO: 489160 - RNA, 64 nt, Homo Sapiens; identical to SEQ ID NO: 476340

SEQ ID NO: 489161 - RNA, 64 nt, Homo Sapiens; identical to SEQ ID NO: 476341

SEQ ID NO: 489162 - RNA, 64 nt, Homo Sapiens; identical to SEQ ID NO: 476342

SEQ ID NO: 489163 - RNA, 64 nt, Homo Sapiens; identical to SEQ ID NO: 476343

SEQ ID NO: 489164 - RNA, 64 nt, Homo Sapiens; identical to SEQ ID NO: 476344

SEQ ID NO: 489165 - RNA, 64 nt, Homo Sapiens; identical to SEQ ID NO: 476345

SEQ ID NO: 489166 - RNA, 64 nt, Homo Sapiens; identical to SEQ ID NO: 476346

SEQ ID NO: 489167 - RNA, 64 nt, Homo Sapiens; identical to SEQ ID NO: 476347

SEQ ID NO: 489168 - RNA, 64 nt, Homo Sapiens; identical to SEQ ID NO: 476348

SEQ ID NO: 489169 - RNA, 64 nt, Homo Sapiens; identical to SEQ ID NO: 476349

SEQ ID NO: 489170 - RNA, 64 nt, Homo Sapiens; identical to SEQ ID NO: 476350

SEQ ID NO: 489171 - RNA, 64 nt, Homo Sapiens; identical to SEQ ID NO: 476351

SEQ ID NO: 489172 - RNA, 64 nt, Homo Sapiens; identical to SEQ ID NO: 476352

SEQ ID NO: 489173 - RNA, 64 nt, Homo Sapiens; identical to SEQ ID NO: 476353

SEQ ID NO: 489174 - RNA, 64 nt, Homo Sapiens; identical to SEQ ID NO: 476354

SEQ ID NO: 489175 - RNA, 64 nt, Homo Sapiens; identical to SEQ ID NO: 476355

SEQ ID NO: 489176 - RNA, 64 nt, Homo Sapiens; identical to SEQ ID NO: 476356

SEQ ID NO: 489177 - RNA, 64 nt, Homo Sapiens; identical to SEQ ID NO: 476357

SEQ ID NO: 489178 - RNA, 64 nt, Homo Sapiens; identical to SEQ ID NO: 476358

SEQ ID NO: 489179 - RNA, 64 nt, Homo Sapiens; identical to SEQ ID NO: 476359

SEQ ID NO: 489180 - RNA, 64 nt, Homo Sapiens; identical to SEQ ID NO: 476360

SEQ ID NO: 489181 - RNA, 64 nt, Homo Sapiens; identical to SEQ ID NO: 476361

SEQ ID NO: 489182 - RNA, 64 nt, Homo Sapiens; identical to SEQ ID NO: 476362

SEQ ID NO: 489183 - RNA, 64 nt, Homo Sapiens; identical to SEQ ID NO: 476363

SEQ ID NO: 489184 - RNA, 64 nt, Homo Sapiens
agugggggcuguacuggggaacccuuacccuaccucugccaaaaguaggaggagggugcacaua

SEQ ID NO: 489185 - RNA, 64 nt, Homo Sapiens
cuggaccaaggcuaaccuuuucugugggccucauucugccaaaggguugugccuuauuguccca

SEQ ID NO: 489186 - RNA, 64 nt, Homo Sapiens
ccaccacccauucaguuugcgaacugguauccauucugccaauuuaguggggucaggaauguag

SEQ ID NO: 489187 - RNA, 64 nt, Homo Sapiens
ucccugcuggcccaggugagcaucuuuccugcccucugccaaccauuccauuuaaguuuugggg

SEQ ID NO: 489188 - RNA, 64 nt, Homo Sapiens
aauuaucuagaagcacaucaccaauucauucuuaucugccaaaggggauggugggucugggacc

SEQ ID NO: 489189 - RNA, 64 nt, Homo Sapiens
guuuaaacacccaggagaccacccaaagggaugcucugccaaagagagacucagcuguugucac

SEQ ID NO: 489190 - RNA, 64 nt, Homo Sapiens
gcagugcaaagaaggaaggcagucuaccccaaagucugccaaagcaugcccuacacacccccac

SEQ ID NO: 489191 - RNA, 64 nt, Homo Sapiens
ccaaaucuuuuaagaaaauugugaaucacgguauucugccaaaaagaugaggauguuuuugucu

SEQ ID NO: 489192 - RNA, 64 nt, Homo Sapiens
acuauaggcagucuucauuuccauuuucauguucucugccaauuaaaucucuuuaccuccuugg

SEQ ID NO: 489193 - RNA, 64 nt, Homo Sapiens
cauaccacccuugguacuguguuuccugaguggcucugccaaucggaaguauaagucauugaca

SEQ ID NO: 489194 - RNA, 64 nt, Homo Sapiens
uaaaccuguucuuccuuuuucucuauuuuacuuuucugccaaaaaaagacaaauuuugcauauu

SEQ ID NO: 489195 - RNA, 64 nt, Homo Sapiens
uaaaacaauacaucaacaagggguuuauuuucauucugccaaaguugaacaaagacauuuauau

SEQ ID NO: 489196 - RNA, 64 nt, Homo Sapiens
ccuuagagcaucucugccuccaacccagcaguucucugccaaagcuuguggaggagggagagcc

SEQ ID NO: 489197 - RNA, 64 nt, Homo Sapiens
cuccucuucccagagucacaaguagccucugggaucugccaacacacguccacucccaagccac

SEQ ID NO: 489198 - RNA, 64 nt, Homo Sapiens
ggguagaauuacacuucuuuucuuaguuuacacaucugccaaagcuucugugggccuugcaccg

SEQ ID NO: 489199 - RNA, 64 nt, Homo Sapiens
uccucugauucuagguguggcuuagcucugacacucugccaacaagcugguaccugaagccccg

SEQ ID NO: 489200 - RNA, 64 nt, Homo Sapiens
gauuggaauagcaaguuuaaaccuuuguuguccaucugccaaaugaacuagugauugucagacu

SEQ ID NO: 489201 - RNA, 64 nt, Homo Sapiens
aucuuaauuaucaucugcaaguuucaagaaguauucugccaaaaguauuuacaaguauggacuc

SEQ ID NO: 489202 - RNA, 64 nt, Homo Sapiens
auccagaccacaaaugcagggcccucagcaugacucugccaagccuggagcaaugggugugcca

SEQ ID NO: 489203 - RNA, 64 nt, Homo Sapiens
gcagagagggaggccaguguuguucacuuuaccuucugccaaauggggugcuggacuggacucu

SEQ ID NO: 489204 - RNA, 64 nt, Homo Sapiens
uuauaaauguaagauaugugggaggggcuuuuauucugccaagucauuucaaauacaugaaaaa

SEQ ID NO: 489205 - RNA, 64 nt, Homo Sapiens
cugugaauguaagcauugugggaaagcauucauaucugccaagauccuuugaauacaugcaaga

SEQ ID NO: 489206 - RNA, 64 nt, Homo Sapiens
uuauaaauauaagauauaugggaaacacuuuuauucugccaaguuauuucaaacacaugaaaaa

SEQ ID NO: 489207 - RNA, 64 nt, Homo Sapiens
cuaagaauguaagcauugugggaaagcauucauaucugccaagaucguuugaauacaugcaaaa

SEQ ID NO: 489208 - RNA, 64 nt, Homo Sapiens
uuauaaauguuagauaugugggaaaggccuuuauucugccaagucauuucgaagacaugaaaaa

SEQ ID NO: 489209 - RNA, 64 nt, Homo Sapiens
cuaugaguguaaggaaugugggaaagccuucagaucugccaagaaccuucgaauucaugaaagg

SEQ ID NO: 489210 - RNA, 64 nt, Homo Sapiens
uuauaaauguaagauaugugggaaaggcuuuuauucugccaagucauuucaaauaccugaaaaa

SEQ ID NO: 489211 - RNA, 64 nt, Homo Sapiens
cucccuggcaaggcucuuccuuuucagggauaucucugccaaccccuccccuguccucggguug

SEQ ID NO: 489212 - RNA, 64 nt, Homo Sapiens
agucccagcucugccucugacucgcugugugcccucugccaagucaugcccauucucuaguucu

SEQ ID NO: 489213 - RNA, 64 nt, Homo Sapiens
uuuuagcgaacuuaacagguagacauacgaaacaucugccaacuuguuggccaaaauccuuuaa

SEQ ID NO: 489214 - RNA, 64 nt, Homo Sapiens
ggugucugauguggggugggggcagaacaggauaucugccaaagucgggaggccucgguagcca

SEQ ID NO: 489215 - RNA, 64 nt, Homo Sapiens
aucccacccucgaggcagggaaaagccaucuauucuucugcagccucaggagcgagacuucaag

SEQ ID NO: 489216 - RNA, 64 nt, Homo Sapiens
aagcaaccuggugcuucggccuggauaagagccccuucugcaucuuauucacagcuugcagccu

SEQ ID NO: 489217 - RNA, 64 nt, Homo Sapiens
gugaggagcaagcuguuagaaguguguccuuacccuucugcagaggauacacuugcucucugga

SEQ ID NO: 489218 - RNA, 64 nt, Homo Sapiens
guaaagucuccaacguacugaaucacccagaaugcuucugcaaguauuguuggccaugaaggaa

SEQ ID NO: 489219 - RNA, 64 nt, Homo Sapiens
auuuaaggcuucuuuucaccugagagcuucaguucuucugcagaauggcugcaaauuuaauugc

SEQ ID NO: 489220 - RNA, 64 nt, Homo Sapiens
uggaguucucaagaguuggugacuuggaaggccgcuucugcaaggcaagucucaggaacccaug

SEQ ID NO: 489221 - RNA, 64 nt, Homo Sapiens
acauuuuugcacagauuaugcuccaucccauucacuucugcauuccuguaacuuuuaaucccua

SEQ ID NO: 489222 - RNA, 64 nt, Homo Sapiens
auucugaaaccacaguuucauuauucucauaauccuucugcaacugaaauuacauauugcagga

SEQ ID NO: 489223 - RNA, 64 nt, Homo Sapiens
aucacuagcuaguuuucuaggaaugaaagggucacuucugcaucgcacucaccuccgccuuggg

SEQ ID NO: 489224 - RNA, 64 nt, Homo Sapiens
cucuguucucaaggcaccuguuucaacagugccacuucugcauuccuuucuccuuucagcuaaa

SEQ ID NO: 489225 - RNA, 64 nt, Homo Sapiens
aaaauaagcuugcaaaugacagcagagacauuuacuucugcaguuaguuaacuuuauaggaguu

SEQ ID NO: 489226 - RNA, 64 nt, Homo Sapiens
accuaaaaauguacaaauuagugaaaugguuaaacuucugcacuuucuuaguuaccacagucuu

SEQ ID NO: 489227 - RNA, 64 nt, Homo Sapiens
ccaagugguucugcaaggucccacacaccuuggccuucugcaagcccucccuaccucauccauc

SEQ ID NO: 489228 - RNA, 64 nt, Homo Sapiens
ggauguccacagagagggaaucggggacuugagccuucugcaggguuagcacagauugagaacc

SEQ ID NO: 489229 - RNA, 64 nt, Homo Sapiens
uccuucccugcuccuaacaacccucauuucucagcuucugcauucuacugccuggcuuucuugg

SEQ ID NO: 489230 - RNA, 64 nt, Homo Sapiens
aguuuccuuaccaccuccucuguccugugagaagcuucugcacaguuccagucuggcuaaucuc

SEQ ID NO: 489231 - RNA, 64 nt, Homo Sapiens
ccuagguuucaucauuuuugaacacuaaguucugcuucugcauuuaaaucauauuuuuuauuac

SEQ ID NO: 489232 - RNA, 64 nt, Homo Sapiens
gggggacuggaugcuagccaaacugagcuucuuucuucugcacucgguccuugcccauuuggga

SEQ ID NO: 489233 - RNA, 64 nt, Homo Sapiens
agauucuguuucuuuuucccugcagaagaggggacuucugcaacgcuguuacauaacuccuccc

SEQ ID NO: 489234 - RNA, 64 nt, Homo Sapiens
caggugugguaggaguccaggacagacaacaggccuucugcagcagggaaaugaccucaacagu

SEQ ID NO: 489235 - RNA, 64 nt, Homo Sapiens
uugaguccagaugcuucucagagugaacgccucgcuucugcagguuuugcucgucuucauggac

SEQ ID NO: 489236 - RNA, 64 nt, Homo Sapiens
caauagcaauugggcuggcuagcgaauguggcgucuucugcaaaucuaugggaaucuggcuuuu

SEQ ID NO: 489237 - RNA, 64 nt, Homo Sapiens
ggcagggaccaucaagaaccuacagacuccaucucuucugcaagccucaugccaacccugggcu

SEQ ID NO: 489238 - RNA, 64 nt, Homo Sapiens
aaagaauuaaugacuuacuuuaauuacuggaauucuucugcaacauuugacaaaacuaaccuug

SEQ ID NO: 489239 - RNA, 64 nt, Homo Sapiens
gcauagcaccuuuuguauaaacaaugugauauugcuucugcacauccaaaaauucugggucuuu

SEQ ID NO: 489240 - RNA, 64 nt, Homo Sapiens
aaaagggccuacuacauuggcgcuauucuuaggacuucugcaacuuuuaaagucuuacuugucu

SEQ ID NO: 489241 - RNA, 64 nt, Homo Sapiens
ugcuuuuucucggcacgugguaucuccaccauuucuucugcacaaagaugucuucuguucaucc

SEQ ID NO: 489242 - RNA, 64 nt, Homo Sapiens
gauauuuacguaaagaaaaucauaaaauccaaugcuucugcauacuguguuauguuacagucca

SEQ ID NO: 489243 - RNA, 64 nt, Homo Sapiens
ugugccucggcucacaacacacaccucagacacgcuucugcagcucggcugccaccuccaccgg

SEQ ID NO: 489244 - RNA, 53 nt, Homo Sapiens
gaucugccugcauccugacgacacuucugcagguagaggagugugaauuuuag

SEQ ID NO: 489245 - RNA, 64 nt, Homo Sapiens
gccuucacuacacugccuuauccagucuguuuaacuucugcagugcucauuuuuuaccauguuu

SEQ ID NO: 489246 - RNA, 64 nt, Homo Sapiens
gaugaaaaagaaacauaguuacaauauuucaacgcuucugcaauaccccaaacccccaccuuca

SEQ ID NO: 489247 - RNA, 64 nt, Homo Sapiens
cuucuuuuucucaugcccugccuucaucugucuccuucugcacccagaguagggguggaguaua

SEQ ID NO: 489248 - RNA, 64 nt, Homo Sapiens
gaagagauuucucccucuagcacuugcuaccucucuucugcacacauaucacacaucaguacug

SEQ ID NO: 489249 - RNA, 64 nt, Homo Sapiens; identical to SEQ ID NO: 87818

SEQ ID NO: 489250 - RNA, 64 nt, Homo Sapiens; identical to SEQ ID NO: 87819

SEQ ID NO: 489251 - RNA, 64 nt, Homo Sapiens; identical to SEQ ID NO: 87820

SEQ ID NO: 489252 - RNA, 64 nt, Homo Sapiens; identical to SEQ ID NO: 87821

SEQ ID NO: 489253 - RNA, 64 nt, Homo Sapiens; identical to SEQ ID NO: 87822

SEQ ID NO: 489254 - RNA, 64 nt, Homo Sapiens; identical to SEQ ID NO: 87823

SEQ ID NO: 489255 - RNA, 64 nt, Homo Sapiens; identical to SEQ ID NO: 87824

SEQ ID NO: 489256 - RNA, 64 nt, Homo Sapiens; identical to SEQ ID NO: 87825

SEQ ID NO: 489257 - RNA, 64 nt, Homo Sapiens; identical to SEQ ID NO: 87826

SEQ ID NO: 489258 - RNA, 64 nt, Homo Sapiens; identical to SEQ ID NO: 87827

SEQ ID NO: 489259 - RNA, 64 nt, Homo Sapiens; identical to SEQ ID NO: 87828

SEQ ID NO: 489260 - RNA, 64 nt, Homo Sapiens; identical to SEQ ID NO: 87829

SEQ ID NO: 489261 - RNA, 64 nt, Homo Sapiens; identical to SEQ ID NO: 87830

SEQ ID NO: 489262 - RNA, 64 nt, Homo Sapiens; identical to SEQ ID NO: 87831

SEQ ID NO: 489263 - RNA, 64 nt, Homo Sapiens; identical to SEQ ID NO: 87832

SEQ ID NO: 489264 - RNA, 64 nt, Homo Sapiens; identical to SEQ ID NO: 87833

SEQ ID NO: 489265 - RNA, 64 nt, Homo Sapiens; identical to SEQ ID NO: 87834

SEQ ID NO: 489266 - RNA, 64 nt, Homo Sapiens; identical to SEQ ID NO: 87835

SEQ ID NO: 489267 - RNA, 64 nt, Homo Sapiens; identical to SEQ ID NO: 87836

SEQ ID NO: 489268 - RNA, 64 nt, Homo Sapiens; identical to SEQ ID NO: 87837

SEQ ID NO: 489269 - RNA, 64 nt, Homo Sapiens; identical to SEQ ID NO: 87838

SEQ ID NO: 489270 - RNA, 64 nt, Homo Sapiens; identical to SEQ ID NO: 87839

SEQ ID NO: 489271 - RNA, 64 nt, Homo Sapiens; identical to SEQ ID NO: 87840

SEQ ID NO: 489272 - RNA, 64 nt, Homo Sapiens; identical to SEQ ID NO: 87841

SEQ ID NO: 489273 - RNA, 64 nt, Homo Sapiens; identical to SEQ ID NO: 87842

SEQ ID NO: 489274 - RNA, 64 nt, Homo Sapiens; identical to SEQ ID NO: 87843

SEQ ID NO: 489275 - RNA, 64 nt, Homo Sapiens; identical to SEQ ID NO: 87844

SEQ ID NO: 489276 - RNA, 64 nt, Homo Sapiens; identical to SEQ ID NO: 87845

SEQ ID NO: 489277 - RNA, 64 nt, Homo Sapiens; identical to SEQ ID NO: 87846

SEQ ID NO: 489278 - RNA, 64 nt, Homo Sapiens; identical to SEQ ID NO: 87847

SEQ ID NO: 489279 - RNA, 64 nt, Homo Sapiens; identical to SEQ ID NO: 87848

SEQ ID NO: 489280 - RNA, 64 nt, Homo Sapiens; identical to SEQ ID NO: 87849

SEQ ID NO: 489281 - RNA, 64 nt, Homo Sapiens; identical to SEQ ID NO: 87850

SEQ ID NO: 489282 - RNA, 64 nt, Homo Sapiens; identical to SEQ ID NO: 87851

SEQ ID NO: 489283 - RNA, 64 nt, Homo Sapiens; identical to SEQ ID NO: 114926

SEQ ID NO: 489284 - RNA, 64 nt, Homo Sapiens; identical to SEQ ID NO: 114927

SEQ ID NO: 489285 - RNA, 64 nt, Homo Sapiens; identical to SEQ ID NO: 357146

SEQ ID NO: 489286 - RNA, 64 nt, Homo Sapiens; identical to SEQ ID NO: 357147

SEQ ID NO: 489287 - RNA, 64 nt, Homo Sapiens; identical to SEQ ID NO: 357148

SEQ ID NO: 489288 - RNA, 64 nt, Homo Sapiens; identical to SEQ ID NO: 357149

SEQ ID NO: 489289 - RNA, 64 nt, Homo Sapiens; identical to SEQ ID NO: 357150

SEQ ID NO: 489290 - RNA, 64 nt, Homo Sapiens; identical to SEQ ID NO: 357151

SEQ ID NO: 489291 - RNA, 64 nt, Homo Sapiens; identical to SEQ ID NO: 357152

SEQ ID NO: 489292 - RNA, 64 nt, Homo Sapiens; identical to SEQ ID NO: 357153

SEQ ID NO: 489293 - RNA, 64 nt, Homo Sapiens; identical to SEQ ID NO: 357154

SEQ ID NO: 489294 - RNA, 64 nt, Homo Sapiens; identical to SEQ ID NO: 357155

SEQ ID NO: 489295 - RNA, 64 nt, Homo Sapiens; identical to SEQ ID NO: 357156

SEQ ID NO: 489296 - RNA, 64 nt, Homo Sapiens; identical to SEQ ID NO: 357157

SEQ ID NO: 489297 - RNA, 64 nt, Homo Sapiens; identical to SEQ ID NO: 288888

SEQ ID NO: 489298 - RNA, 64 nt, Homo Sapiens; identical to SEQ ID NO: 288889

SEQ ID NO: 489299 - RNA, 64 nt, Homo Sapiens; identical to SEQ ID NO: 288890

SEQ ID NO: 489300 - RNA, 64 nt, Homo Sapiens; identical to SEQ ID NO: 288891

SEQ ID NO: 489301 - RNA, 64 nt, Homo Sapiens; identical to SEQ ID NO: 453097

SEQ ID NO: 489302 - RNA, 64 nt, Homo Sapiens; identical to SEQ ID NO: 453098

SEQ ID NO: 489303 - RNA, 64 nt, Homo Sapiens; identical to SEQ ID NO: 453099

SEQ ID NO: 489304 - RNA, 64 nt, Homo Sapiens; identical to SEQ ID NO: 453100

SEQ ID NO: 489305 - RNA, 64 nt, Homo Sapiens; identical to SEQ ID NO: 453101

SEQ ID NO: 489306 - RNA, 64 nt, Homo Sapiens; identical to SEQ ID NO: 453102

SEQ ID NO: 489307 - RNA, 64 nt, Homo Sapiens; identical to SEQ ID NO: 453103

SEQ ID NO: 489308 - RNA, 64 nt, Homo Sapiens; identical to SEQ ID NO: 453104

SEQ ID NO: 489309 - RNA, 64 nt, Homo Sapiens; identical to SEQ ID NO: 453105

SEQ ID NO: 489310 - RNA, 64 nt, Homo Sapiens; identical to SEQ ID NO: 453106

SEQ ID NO: 489311 - RNA, 64 nt, Homo Sapiens; identical to SEQ ID NO: 159322

SEQ ID NO: 489312 - RNA, 64 nt, Homo Sapiens; identical to SEQ ID NO: 159323

SEQ ID NO: 489313 - RNA, 64 nt, Homo Sapiens; identical to SEQ ID NO: 159324

SEQ ID NO: 489314 - RNA, 64 nt, Homo Sapiens; identical to SEQ ID NO: 159325

SEQ ID NO: 489315 - RNA, 64 nt, Homo Sapiens; identical to SEQ ID NO: 159326

SEQ ID NO: 489316 - RNA, 64 nt, Homo Sapiens; identical to SEQ ID NO: 159327

SEQ ID NO: 489317 - RNA, 64 nt, Homo Sapiens; identical to SEQ ID NO: 159328

SEQ ID NO: 489318 - RNA, 64 nt, Homo Sapiens; identical to SEQ ID NO: 159329

SEQ ID NO: 489319 - RNA, 64 nt, Homo Sapiens; identical to SEQ ID NO: 159330

SEQ ID NO: 489320 - RNA, 64 nt, Homo Sapiens; identical to SEQ ID NO: 159331

SEQ ID NO: 489321 - RNA, 64 nt, Homo Sapiens; identical to SEQ ID NO: 159332

SEQ ID NO: 489322 - RNA, 64 nt, Homo Sapiens; identical to SEQ ID NO: 159333

SEQ ID NO: 489323 - RNA, 64 nt, Homo Sapiens; identical to SEQ ID NO: 159334

SEQ ID NO: 489324 - RNA, 64 nt, Homo Sapiens; identical to SEQ ID NO: 159335

SEQ ID NO: 489325 - RNA, 64 nt, Homo Sapiens; identical to SEQ ID NO: 159336

SEQ ID NO: 489326 - RNA, 64 nt, Homo Sapiens; identical to SEQ ID NO: 159337

SEQ ID NO: 489327 - RNA, 64 nt, Homo Sapiens; identical to SEQ ID NO: 159338

SEQ ID NO: 489328 - RNA, 64 nt, Homo Sapiens; identical to SEQ ID NO: 159339

SEQ ID NO: 489329 - RNA, 64 nt, Homo Sapiens; identical to SEQ ID NO: 159340

SEQ ID NO: 489330 - RNA, 64 nt, Homo Sapiens; identical to SEQ ID NO: 159341

SEQ ID NO: 489331 - RNA, 64 nt, Homo Sapiens; identical to SEQ ID NO: 159342

SEQ ID NO: 489332 - RNA, 64 nt, Homo Sapiens; identical to SEQ ID NO: 159343

SEQ ID NO: 489333 - RNA, 64 nt, Homo Sapiens; identical to SEQ ID NO: 159344

SEQ ID NO: 489334 - RNA, 64 nt, Homo Sapiens; identical to SEQ ID NO: 159345

SEQ ID NO: 489335 - RNA, 64 nt, Homo Sapiens; identical to SEQ ID NO: 159346

SEQ ID NO: 489336 - RNA, 64 nt, Homo Sapiens; identical to SEQ ID NO: 159347

SEQ ID NO: 489337 - RNA, 64 nt, Homo Sapiens; identical to SEQ ID NO: 159348

SEQ ID NO: 489338 - RNA, 64 nt, Homo Sapiens; identical to SEQ ID NO: 159349

SEQ ID NO: 489339 - RNA, 64 nt, Homo Sapiens; identical to SEQ ID NO: 159350

SEQ ID NO: 489340 - RNA, 64 nt, Homo Sapiens; identical to SEQ ID NO: 159351

SEQ ID NO: 489341 - RNA, 64 nt, Homo Sapiens; identical to SEQ ID NO: 159352

SEQ ID NO: 489342 - RNA, 64 nt, Homo Sapiens; identical to SEQ ID NO: 159353

SEQ ID NO: 489343 - RNA, 64 nt, Homo Sapiens; identical to SEQ ID NO: 159354

SEQ ID NO: 489344 - RNA, 64 nt, Homo Sapiens; identical to SEQ ID NO: 159355

SEQ ID NO: 489345 - RNA, 64 nt, Homo Sapiens; identical to SEQ ID NO: 159356

SEQ ID NO: 489346 - RNA, 64 nt, Homo Sapiens; identical to SEQ ID NO: 159357

SEQ ID NO: 489347 - RNA, 64 nt, Homo Sapiens; identical to SEQ ID NO: 159358

SEQ ID NO: 489348 - RNA, 64 nt, Homo Sapiens; identical to SEQ ID NO: 159359

SEQ ID NO: 489349 - RNA, 64 nt, Homo Sapiens; identical to SEQ ID NO: 159360

SEQ ID NO: 489350 - RNA, 64 nt, Homo Sapiens; identical to SEQ ID NO: 159361

SEQ ID NO: 489351 - RNA, 64 nt, Homo Sapiens; identical to SEQ ID NO: 159362

SEQ ID NO: 489352 - RNA, 64 nt, Homo Sapiens; identical to SEQ ID NO: 159363

SEQ ID NO: 489353 - RNA, 64 nt, Homo Sapiens; identical to SEQ ID NO: 159364

SEQ ID NO: 489354 - RNA, 64 nt, Homo Sapiens; identical to SEQ ID NO: 159365

SEQ ID NO: 489355 - RNA, 64 nt, Homo Sapiens; identical to SEQ ID NO: 159366

SEQ ID NO: 489356 - RNA, 64 nt, Homo Sapiens; identical to SEQ ID NO: 159365

SEQ ID NO: 489357 - RNA, 64 nt, Homo Sapiens; identical to SEQ ID NO: 159368

SEQ ID NO: 489358 - RNA, 64 nt, Homo Sapiens; identical to SEQ ID NO: 159369

SEQ ID NO: 489359 - RNA, 64 nt, Homo Sapiens; identical to SEQ ID NO: 159370

SEQ ID NO: 489360 - RNA, 64 nt, Homo Sapiens; identical to SEQ ID NO: 159371

SEQ ID NO: 489361 - RNA, 64 nt, Homo Sapiens; identical to SEQ ID NO: 159372

SEQ ID NO: 489362 - RNA, 64 nt, Homo Sapiens; identical to SEQ ID NO: 159373

SEQ ID NO: 489363 - RNA, 64 nt, Homo Sapiens; identical to SEQ ID NO: 159374

SEQ ID NO: 489364 - RNA, 64 nt, Homo Sapiens; identical to SEQ ID NO: 159375

SEQ ID NO: 489365 - RNA, 64 nt, Homo Sapiens; identical to SEQ ID NO: 159376

SEQ ID NO: 489366 - RNA, 64 nt, Homo Sapiens; identical to SEQ ID NO: 159377

SEQ ID NO: 489367 - RNA, 64 nt, Homo Sapiens; identical to SEQ ID NO: 210821

SEQ ID NO: 489368 - RNA, 64 nt, Homo Sapiens; identical to SEQ ID NO: 210822

SEQ ID NO: 489369 - RNA, 64 nt, Homo Sapiens; identical to SEQ ID NO: 210823

SEQ ID NO: 489370 - RNA, 64 nt, Homo Sapiens; identical to SEQ ID NO: 210824

SEQ ID NO: 489371 - RNA, 64 nt, Homo Sapiens; identical to SEQ ID NO: 210825

SEQ ID NO: 489372 - RNA, 64 nt, Homo Sapiens; identical to SEQ ID NO: 210826

SEQ ID NO: 489373 - RNA, 64 nt, Homo Sapiens; identical to SEQ ID NO: 210827

SEQ ID NO: 489374 - RNA, 64 nt, Homo Sapiens; identical to SEQ ID NO: 210828

SEQ ID NO: 489375 - RNA, 64 nt, Homo Sapiens; identical to SEQ ID NO: 210829

SEQ ID NO: 489376 - RNA, 64 nt, Homo Sapiens; identical to SEQ ID NO: 210830

SEQ ID NO: 489377 - RNA, 64 nt, Homo Sapiens; identical to SEQ ID NO: 210831

SEQ ID NO: 489378 - RNA, 64 nt, Homo Sapiens; identical to SEQ ID NO: 210832

SEQ ID NO: 489379 - RNA, 64 nt, Homo Sapiens; identical to SEQ ID NO: 210833

SEQ ID NO: 489380 - RNA, 64 nt, Homo Sapiens; identical to SEQ ID NO: 210834

SEQ ID NO: 489381 - RNA, 64 nt, Homo Sapiens; identical to SEQ ID NO: 210835

SEQ ID NO: 489382 - RNA, 64 nt, Homo Sapiens; identical to SEQ ID NO: 210836

SEQ ID NO: 489383 - RNA, 64 nt, Homo Sapiens; identical to SEQ ID NO: 210837

SEQ ID NO: 489384 - RNA, 64 nt, Homo Sapiens; identical to SEQ ID NO: 210838

SEQ ID NO: 489385 - RNA, 64 nt, Homo Sapiens; identical to SEQ ID NO: 210839

SEQ ID NO: 489386 - RNA, 64 nt, Homo Sapiens; identical to SEQ ID NO: 210840

SEQ ID NO: 489387 - RNA, 64 nt, Homo Sapiens; identical to SEQ ID NO: 210841

SEQ ID NO: 489388 - RNA, 64 nt, Homo Sapiens
uauucuuaaucauuaauaaaauccaugaaaacgcuuagugaauauauaggaacaagacucccaa

SEQ ID NO: 489389 - RNA, 64 nt, Homo Sapiens
acuuuugaaaagugcccuuuacuuuuauuauuuuuuagugaaaguuagaauuuguuuaacuggu

SEQ ID NO: 489390 - RNA, 64 nt, Homo Sapiens
cagaguauaagaaugcuuugaacaauuuguagacuuagugaaauaaaauaagaggaaagccaaa

SEQ ID NO: 489391 - RNA, 64 nt, Homo Sapiens
ugaauacauaauuucucauguauucguguauccauuagugaauaguucaagucuguuuaagagu

SEQ ID NO: 489392 - RNA, 64 nt, Homo Sapiens
gguaggacucuagacaaaaccuucuauuuuagcuuuagugaauuucaaaaguaaugggucuugg

SEQ ID NO: 489393 - RNA, 64 nt, Homo Sapiens
uucuaaaauuuguaauuugcuaacuugauuugaguuagugaaaacugguacaguguucugcuug

SEQ ID NO: 489394 - RNA, 64 nt, Homo Sapiens
cuaaggaacucagggggcacugaaugauauggacuuagugaauuaacugggguuuuguaaccuc

SEQ ID NO: 489395 - RNA, 64 nt, Homo Sapiens
uauugaaaauacuaaauuauauuuaugaugucaauuagugaaagugcaaagaaaaaucuugaac

SEQ ID NO: 489396 - RNA, 64 nt, Homo Sapiens
uugcuuugcuuuaucaguucauuccagcucccuguuagugaaggacacugcuguuagugaagga

SEQ ID NO: 489397 - RNA, 64 nt, Homo Sapiens
cauuccagcucccuguuagugaaggacacugcuguuagugaaggaacaaagucuaugaguccua

SEQ ID NO: 489398 - RNA, 64 nt, Homo Sapiens
cugaauccaaguuucauguauguuucuaaaagcuuuagugaaggauauacucacuuuauaugua

SEQ ID NO: 489399 - RNA, 64 nt, Homo Sapiens
uuuuuuaaacuuacagcauguuucaacuaauuuuuuagugaauuucuaguguuaaguguauuuu

SEQ ID NO: 489400 - RNA, 64 nt, Homo Sapiens
uuguucacucuuccgugucucugcuguauuuuacuuagugaauaacaugugagagacaucucau

SEQ ID NO: 489401 - RNA, 64 nt, Homo Sapiens
gaaaauugcuuuggaagagauuagugccuguagauuagugaacaggguuuuaauuacaguucca

SEQ ID NO: 489402 - RNA, 64 nt, Homo Sapiens
cugaaugauuguugcuagggcugugcacacugaauuagugaaugaguuagguucugugaauuuu

SEQ ID NO: 489403 - RNA, 64 nt, Homo Sapiens
cauaguggugacauaccuuuaaguguguuugucuuuagugaacugauacaggaaggccuauuac

SEQ ID NO: 489404 - RNA, 64 nt, Homo Sapiens
aaauaauccucaguuuuugugaaaagcuccauuuuuagugaaauauuauuuuauagcuacuaau

SEQ ID NO: 489405 - RNA, 64 nt, Homo Sapiens
gauuguguauggguguuggugaacuugguuuuaauuagugaacugcugagagacagagcuauuc

SEQ ID NO: 489406 - RNA, 65 nt, Homo Sapiens
uuguauuguacuaaccccucaugcugggaugagcgacugccuagcaagcaacccacugccuacua

SEQ ID NO: 489407 - RNA, 65 nt, Homo Sapiens
caugcugggaugagcgacugccuagcaagcaacccacugccuacuaacaucaagaggggcuaaau

SEQ ID NO: 489408 - RNA, 63 nt, Homo Sapiens
aggccuuuucagccaggaguaagaaaagaugguuagugauauuuggaaauaccuggauauuug

SEQ ID NO: 489409 - RNA, 50 nt, Homo Sapiens
ugguaggauuuucugucuaauagugauauaauuugcaauuugguuaaaug

SEQ ID NO: 489410 - RNA, 63 nt, Homo Sapiens
auguuuaaguuauaacuuauugagcacuuuuaguagugauaacuguuuuuaaacuugccuaau

SEQ ID NO: 489411 - RNA, 63 nt, Homo Sapiens
gaaauuuauugauugagacacagaaauccugauuagugauaggccugucuucugggcaauauu

SEQ ID NO: 489412 - RNA, 63 nt, Homo Sapiens
ugauugggcauuugccuacuuuucuuucauaauuagugauauaugcgauguaaaaccacuagu

SEQ ID NO: 489413 - RNA, 63 nt, Homo Sapiens
uagaauacacagaauagugagagucauuuagaauagugauaaaauaaucaauuagccaaccau

SEQ ID NO: 489414 - RNA, 63 nt, Homo Sapiens
cacuauucacagcuucucauaguaaaaguccccuagugauagccaaaaaagaaauaaaaagaa

SEQ ID NO: 489415 - RNA, 63 nt, Homo Sapiens
aaugauugcaauuuuucuaacuguauccuaguuuagugauacaguuuuuuacugcuuucaaag

SEQ ID NO: 489416 - RNA, 63 nt, Homo Sapiens
cauaaugaaaauagaugcaaccuaaauuugaaauagugauaagaaauaagaguuaauagcuau

SEQ ID NO: 489417 - RNA, 63 nt, Homo Sapiens
gugacauuauaucuauauauaaggaaugccuuauagugauauuagauauaaaaagaauggaag

SEQ ID NO: 489418 - RNA, 63 nt, Homo Sapiens
gaccugugauaauauaauucuuuugaauguucuuagugauacuauaauccagaauuucaaugc

SEQ ID NO: 489419 - RNA, 63 nt, Homo Sapiens
uaggcugcauuuagaucacccugcauacacauguagugauaccauguaugcuuuaaccuuaaa

SEQ ID NO: 489420 - RNA, 63 nt, Homo Sapiens
cuggaagauugugucaauauuucuguucuauuuuagugauaauacaugauccuaagaggaaag

SEQ ID NO: 489421 - RNA, 63 nt, Homo Sapiens
uagcucaaugaugcguuuguaagaaauaagcucuagugauaucugugggggcaaaauuuaauu

SEQ ID NO: 489422 - RNA, 63 nt, Homo Sapiens
augaaauagaaacuuucuggaaaaauauuuuaauagugauaauaacaucagauuuuaauauaa

SEQ ID NO: 489423 - RNA, 63 nt, Homo Sapiens
aaaaaaucugccccaugauucuaacacucgcaguagugauaguguaucuaguuguucugcugg

SEQ ID NO: 489424 - RNA, 63 nt, Homo Sapiens
cuuaacuaucuuauguuucuagucuuucaagcuuagugauaagguggaagcacaagaaaaauu

SEQ ID NO: 489425 - RNA, 63 nt, Homo Sapiens
uuaggauguugaaaaaguucugcagauaaacaguagugauaguuguaccgcaaugugacuuaa

SEQ ID NO: 489426 - RNA, 63 nt, Homo Sapiens
auguaaaguuauuagaaugguaucuguucauuuuagugauaugaagaucacaacuaacaacug

SEQ ID NO: 489427 - RNA, 63 nt, Homo Sapiens
uuaaguagaaaugaguuguauggugaaucuguguagugauaauuauauaauuuauuuauuuug

SEQ ID NO: 489428 - RNA, 63 nt, Homo Sapiens
uauauuuccacauugugcauauguaaaauguaguagugauaccuuuauugauacuucccuuuu

SEQ ID NO: 489429 - RNA, 63 nt, Homo Sapiens
auuacuagaaugaaagaauauuaauguucuaaguagugauaauauaagugaaaauaucuuccu

SEQ ID NO: 489430 - RNA, 63 nt, Homo Sapiens
acuuguuggacauuuuuccaccccuucagcugcuagugauauccucccccucucaccuggcag

SEQ ID NO: 489431 - RNA, 63 nt, Homo Sapiens
aaucuuuccauauuucccauuauaaaaaauuuauagugauauuauccauaaugaaauaggagu

SEQ ID NO: 489432 - RNA, 63 nt, Homo Sapiens
aacuuuaagaaaacaggauaaucuguuauagacuagugauacagcuagaacuaucucauugcu

SEQ ID NO: 489433 - RNA, 63 nt, Homo Sapiens
caguagcagccugcguuaauaagccuuuccuuuuagugauaaaugcugguaaaauaauguccc

SEQ ID NO: 489434 - RNA, 63 nt, Homo Sapiens
guagcgauauaaauuuaucagcaugguagcacauagugauaggucagaggggcaaagucaccu

SEQ ID NO: 489435 - RNA, 63 nt, Homo Sapiens
auuuaaaauauauccucauuaauuuguaguuuuuagugauaguaggagaagaaaaugauguau

SEQ ID NO: 489436 - RNA, 63 nt, Homo Sapiens
aaauaaguauauucaguucaugauuuagaaaacuagugauaccccuguuuugggcugaaagaa

SEQ ID NO: 489437 - RNA, 63 nt, Homo Sapiens
auaguauucaucuguguguaugauuauuuuagauagugauauuugaaaaagaacuguauuuag

SEQ ID NO: 489438 - RNA, 63 nt, Homo Sapiens
gugcagugauguuugccauuagcccauaauucauagugauagagcaggugcuuuuauuuucac

SEQ ID NO: 489439 - RNA, 63 nt, Homo Sapiens
ccaucugcucaucguaagugaucuguuacuauauagugauaaaucuccuaaaguguaaaaaaa

SEQ ID NO: 489440 - RNA, 63 nt, Homo Sapiens
aaauagcccaucucuagacuucugacacuggaguagugauaacguguagaugucugugccaca

SEQ ID NO: 489441 - RNA, 63 nt, Homo Sapiens
uuucucguuaguggcaguagugccuccgucuccuagugauaaugcuccaagucuaugaacugu

SEQ ID NO: 489442 - RNA, 63 nt, Homo Sapiens
auacauaggaauaaauauauacaagguaucauguagugauaauugcuguggagaaaaauaaag

SEQ ID NO: 489443 - RNA, 63 nt, Homo Sapiens
aaaguacuuagauuuauaaggcagcuuccccuguagugauaaauuacaagcagacaaucuuau

SEQ ID NO: 489444 - RNA, 63 nt, Homo Sapiens
cauagagccaaauucugaaaauaauuguaguaguagugauauagucaauggacacagugaaau

SEQ ID NO: 489445 - RNA, 63 nt, Homo Sapiens
cacuuauaaacuguuauuucaaagcaaacauacuagugauauauauaugauuuauggauguug

SEQ ID NO: 489446 - RNA, 63 nt, Homo Sapiens
aaauuuuugucaccagcaaaacuuuucacuaauuagugauaugaaaugugauuuuuguguugu

SEQ ID NO: 489447 - RNA, 63 nt, Homo Sapiens
ucacacaucacaucccagaagaauucugccugcuagugauagcgaaggacaucacuguauuug

SEQ ID NO: 489448 - RNA, 63 nt, Homo Sapiens
acagauuguaccaacuauuaccaauaaguauguuagugauauccauuucuaggcaaguaucag

SEQ ID NO: 489449 - RNA, 63 nt, Homo Sapiens
aagaauuauauccaagguaaaauaaauaugcaguagugauauaauuguguuuagaaauacugu

SEQ ID NO: 489450 - RNA, 63 nt, Homo Sapiens
agcauuguuuuuauugcagcuuuuuuuaauaauuagugauauauccuauauucuuuucuggau

SEQ ID NO: 489451 - RNA, 63 nt, Homo Sapiens
uucucuugguacugaacacuauuagaauaucauuagugauauuuuuucucuuuagagcauuuu

SEQ ID NO: 489452 - RNA, 63 nt, Homo Sapiens
gcuguguugcuaaugguuaaagaagucuguaucuagugauaaauauaccaguuuuuuuaaaaa

SEQ ID NO: 489453 - RNA, 63 nt, Homo Sapiens
ugcccacugugacagaacaagacacucacagauuagugauacguuuuauuuuuaacaaaauga

SEQ ID NO: 489454 - RNA, 63 nt, Homo Sapiens
cagccugaagccaugguuuuucauuucugucucuagugauaagcaggaaagagggaugaagaa

SEQ ID NO: 489455 - RNA, 63 nt, Homo Sapiens
gauuuagcuaacaaaagauauauuggcaauaccuagugauacgugaguugugccucauuuauu

SEQ ID NO: 489456 - RNA, 63 nt, Homo Sapiens
agcauaaugauuuugaggucacaugagaggagauagugauaucgugcaucaugaauuacaugu

SEQ ID NO: 489457 - RNA, 63 nt, Homo Sapiens
cuccuaaggauuuuuaacuuacccaugaguugauagugauaagaagggguuggguggggcaau

SEQ ID NO: 489458 - RNA, 63 nt, Homo Sapiens
auuaugaacaauucuaaaagauuuucagaaacuuagugauaaccaauuaaucuagauuuuaac

SEQ ID NO: 489459 - RNA, 63 nt, Homo Sapiens
uuuguguuuuuauuucaaguuuguuugaaaguguagugauauaagaggccccuauagaaugua

SEQ ID NO: 489460 - RNA, 63 nt, Homo Sapiens
uggacuuaagaaaaugaacuaauugucaauagcuagugauacucagccuucuuccauuucaga

SEQ ID NO: 489461 - RNA, 63 nt, Homo Sapiens
aggcuauguauaaaauacauagugaaaauuguuuagugauauuacauuuauuuauccagaaaa

SEQ ID NO: 489462 - RNA, 63 nt, Homo Sapiens
aauguaccuagcaagcugguucuugcuuauauauagugauaaacuuuguagcugccucuuuaa

SEQ ID NO: 489463 - RNA, 63 nt, Homo Sapiens
cagcuguuuucccuuaaagauguccuguugcuuuagugauauuuagaccccucucaguuaaga

SEQ ID NO: 489464 - RNA, 63 nt, Homo Sapiens
uacauauuuguugaauaaaugaaaauuuauuuuuagugauaagauucauacacucuguauuug

SEQ ID NO: 489465 - RNA, 63 nt, Homo Sapiens
agaaguagcaaaugaaugguuuaggauuucaaauagugauacccuccugagacaugagcauuu

SEQ ID NO: 489466 - RNA, 63 nt, Homo Sapiens
augguccacugguuucaggccaaaucuagaauuuagugauacuggcucagaagaauuuaaguu

SEQ ID NO: 489467 - RNA, 63 nt, Homo Sapiens
guuaacauguuuguaauugcugagucaaauauauagugauaauuauaaauugguuaaaauuua

SEQ ID NO: 489468 - RNA, 63 nt, Homo Sapiens
ucgggaaauuuacacacacauaguuacucacucuagugauaaauuauaaagcaguuaguuagu

SEQ ID NO: 489469 - RNA, 63 nt, Homo Sapiens
cucaugccuggacaaaaucuucacaauaaaaauuagugauauuuaaauguuacagacuuaaag

SEQ ID NO: 489470 - RNA, 63 nt, Homo Sapiens
aauuacaguuaucaaaguauuuuuaaaacuucauagugauaaaugagacuauauaguuauauu

SEQ ID NO: 489471 - RNA, 63 nt, Homo Sapiens
auaugggagaucaguagguuauacuuauauagauagugauauauuucauuuuuaauuugucau

SEQ ID NO: 489472 - RNA, 63 nt, Homo Sapiens
guaaugaaauugguauuuaucugauucuaaauuuagugauaugucagauucccacaaccacuc

SEQ ID NO: 489473 - RNA, 63 nt, Homo Sapiens
auuaaccagccauuaaaaauuugcaauaaaauguagugauauagugcuuaaaugaguacuaua

SEQ ID NO: 489474 - RNA, 63 nt, Homo Sapiens
guagaagcagugaugauauuugcgaucacacuguagugauauaucaaaccuuuuaaaucugaa

SEQ ID NO: 489475 - RNA, 63 nt, Homo Sapiens
gaggguaaaaaaaaauugauaaggaaaaguagauagugauacuauuuaaauauuuuaagaaaa

SEQ ID NO: 489476 - RNA, 63 nt, Homo Sapiens
cagcaaguauuuauuguugacauuauucagaauuagugauaauaaaaagcagagugauuuugg

SEQ ID NO: 489477 - RNA, 63 nt, Homo Sapiens
uuguauaucagaaagauuaucuagggucuauccuagugauaauacauugucagccuuuucugu

SEQ ID NO: 489478 - RNA, 63 nt, Homo Sapiens
guugaaacuuguuaaaugagauuucaacugacuuagugauagaguuuucuucaaguuaauuuu

SEQ ID NO: 489479 - RNA, 63 nt, Homo Sapiens
uuuuuagguugguuguuuuguggauuucuuuaguagugauaguagccugaaccacauuuuaga

SEQ ID NO: 489480 - RNA, 63 nt, Homo Sapiens
guaauauuaauuguuaauaauuagaccuguagauagugauaucaaaaugaaaaaaaaaaaccc

SEQ ID NO: 489481 - RNA, 63 nt, Homo Sapiens
gacaaggaaacgcugcagggucauggguuuccauagugauaaagguugucuucgugcuguguc

SEQ ID NO: 489482 - RNA, 63 nt, Homo Sapiens
gaugaagagccaacuugaugucauuuaggaaaguagugauauaucaccagauaucuuauuguu

SEQ ID NO: 489483 - RNA, 63 nt, Homo Sapiens
uguuuccuguccuuuguugcugggcauuacucuuagugauauuacuagauaucuuuauaugua

SEQ ID NO: 489484 - RNA, 63 nt, Homo Sapiens
ugccuguggcuugugcugggagugggucugacuuagugauaaaaggacucuauucacuaagua

SEQ ID NO: 489485 - RNA, 63 nt, Homo Sapiens
cuauauauucaccauguaaacugcagccaccuuuagugauacuuuugaaaaaaaaaaauaaag

SEQ ID NO: 489486 - RNA, 63 nt, Homo Sapiens
uacccaugaaaugauaauuuguaaaauaacacuuagugauaucuggaaauaauaauucaauua

SEQ ID NO: 489487 - RNA, 63 nt, Homo Sapiens
ccagaucucucucucuuuuuuuuuuauuuuuuuuagugauagagucucacucugucacccagg

SEQ ID NO: 489488 - RNA, 63 nt, Homo Sapiens
uguucuaauucaugugcugccaacugaguuaucuagugauaugaccucacugucuugaccaaa

SEQ ID NO: 489489 - RNA, 63 nt, Homo Sapiens
uuguguuaauuuggacaguacauuuguggaauauagugauauaugugcuuuauuuuucuuagu

SEQ ID NO: 489490 - RNA, 63 nt, Homo Sapiens
aaaaugguuauguaacuacauaauggaaaugaguagugauaugaucaaagaugaauugguaaa

SEQ ID NO: 489491 - RNA, 63 nt, Homo Sapiens
cuguaucuaaaaaauaacugcgcaaccacuugcuagugauacaggauaacuagaguugguggc

SEQ ID NO: 489492 - RNA, 63 nt, Homo Sapiens
ucucuaguaguuaaaaaaaauaucuguauguauuagugauauuaucuuucuaugcugcuuuua

SEQ ID NO: 489493 - RNA, 63 nt, Homo Sapiens
uuauugaaaccacuaaagagagggauaagugguuagugauauuugaagaaaacuugaggcuuu

SEQ ID NO: 489494 - RNA, 63 nt, Homo Sapiens
gugguguccccggggccaggccucuggguuuuauagugauacacuugcacuuguuccuuguuu

SEQ ID NO: 489495 - RNA, 63 nt, Homo Sapiens
acuaguuuuuauuuuauugaaaaguggaauuuuuagugauaaaauacauuuguaaguguaaag

SEQ ID NO: 489496 - RNA, 63 nt, Homo Sapiens
ccuauaagacagggcaccuuuuaacucuaaaacuagugauacucagugacauagacuuugucu

SEQ ID NO: 489497 - RNA, 63 nt, Homo Sapiens
gcaguuuuaguauggcucaacaugggucagauuuagugauaaagcaaauucuccuuggccuca

SEQ ID NO: 489498 - RNA, 63 nt, Homo Sapiens
aagcucuugcuauguugcuauaagacaguaauauagugauaauuuaccaacuuuauugaaaau

SEQ ID NO: 489499 - RNA, 63 nt, Homo Sapiens
auuuuuuaaaaaacuaauuuguauugucugcucuagugauacaaguuuuacuagugauaaacu

SEQ ID NO: 489500 - RNA, 63 nt, Homo Sapiens
uuguauugucugcucuagugauacaaguuuuacuagugauaaacuauuuuaaucaaccauacu

SEQ ID NO: 489501 - RNA, 63 nt, Homo Sapiens
uuucaacuucaccacaguaaauuauaaucauuuuagugauauucaggagaaaauuaauacuaa

SEQ ID NO: 489502 - RNA, 63 nt, Homo Sapiens
gcaucguugcauuuuacaguuauuuccaauaacuagugauaugaaauauaaguaaugaaggca

SEQ ID NO: 489503 - RNA, 57 nt, Homo Sapiens
uaaugcaagucagaaaguagcaagacuuagugauaaaacugggccuguagcucaaga

SEQ ID NO: 489504 - RNA, 63 nt, Homo Sapiens
uugaaguagaggggccuucaaacuacuuuauacuagugauaguuugaguuagguaagcaucuu

SEQ ID NO: 489505 - RNA, 63 nt, Homo Sapiens
uugaggaaagaaauaauacacauuuaguagaaauagugauaagaccuuugauagaaauguugg

SEQ ID NO: 489506 - RNA, 63 nt, Homo Sapiens
gacaacaucuuaggauugcuucccauaaaagaguagugauaguucucugugccucaguuccca

SEQ ID NO: 489507 - RNA, 63 nt, Homo Sapiens
ggguauucuugucucauccuugcugacuauaaguagugauaguggcuaggaccuccagcagaa

SEQ ID NO: 489508 - RNA, 63 nt, Homo Sapiens
uuggacaaggaguucuggugcucguacaauuaauagugauauuauuuuauuauaggacuuugc

SEQ ID NO: 489509 - RNA, 63 nt, Homo Sapiens
uugaucuuucccacuuucuguuucauugaccucuagugauaccauccacuauuguauguuuug

SEQ ID NO: 489510 - RNA, 63 nt, Homo Sapiens
aaauauucuguuguuuccaagccauguaaaauauagugauaucguaauuauaugguuauaugu

SEQ ID NO: 489511 - RNA, 63 nt, Homo Sapiens
cucucuccuaaaagaguuaaaggcagaaagcuguagugauaacgcugcacauuguaacaguaa

SEQ ID NO: 489512 - RNA, 63 nt, Homo Sapiens
auugaauuaauauuuuugucuugaagcauuuucuagugauagaauguauuugucuuuuuuccu

SEQ ID NO: 489513 - RNA, 63 nt, Homo Sapiens
cagccucuaccugucgccccagggagaaagggguagugauacaagucucauagccagagaugg

SEQ ID NO: 489514 - RNA, 63 nt, Homo Sapiens
uaacuaucaacuugauaaauaacuuauaggugauagugauaauuccugauuccaagaaugcca

SEQ ID NO: 489515 - RNA, 63 nt, Homo Sapiens
aaauuauaaaauaauucaacauguccaucuuuuuagugauaauaaaagaaagcaugguauuaa

SEQ ID NO: 489516 - RNA, 63 nt, Homo Sapiens
ggauucacgcuccagccuccuucuugguugucauagugauaggguagccuuauugcccccucu

SEQ ID NO: 489517 - RNA, 63 nt, Homo Sapiens
uuuguauuuucacaaaaaaauggcaguauauuauagugauaaucaaauacagauaaacagagu

SEQ ID NO: 489518 - RNA, 63 nt, Homo Sapiens
gccacugcaauucagccuggcagugaacugagauagugauaguagcccgggaagcagagguug

SEQ ID NO: 489519 - RNA, 63 nt, Homo Sapiens
aaaguagguauaaaugauauugaauguuggguauagugauacucugccauaguucuuacugca

SEQ ID NO: 489520 - RNA, 63 nt, Homo Sapiens
aaggcagaacaaauaaugcaaaauucucaguaauagugauacauggauauacuuccuuuuaaa

SEQ ID NO: 489521 - RNA, 63 nt, Homo Sapiens
guuuccucaguggauagcacucaauuuauuccguagugauauuguaacaauacugccauuccc

SEQ ID NO: 489522 - RNA, 63 nt, Homo Sapiens
auguuucaguuggcuucuaggaaauaauuaaauuagugauauuuuaaucagguuuuacuaucu

SEQ ID NO: 489523 - RNA, 63 nt, Homo Sapiens
uggacacacaaggaauucacaaauaucauuacauagugauagcuauguauuacugagaacgua

SEQ ID NO: 489524 - RNA, 63 nt, Homo Sapiens
uuuuucuauucuuuucccuuuuaacagugguguuagugauagauauuauuugauucauuugag

SEQ ID NO: 489525 - RNA, 63 nt, Homo Sapiens
aacugcaaacagcaauuugaaguguuagauucauagugauaaguuugggaagaugugaauuuc

SEQ ID NO: 489526 - RNA, 63 nt, Homo Sapiens
gguaagaggagagaugucaggccagcugugcccuagugauaagcccucugaagcaugggccgu

SEQ ID NO: 489527 - RNA, 63 nt, Homo Sapiens
ggucugauuucgaucucuucuauaguugccgauuagugauaugauuuggcaacaugucagcuu

SEQ ID NO: 489528 - RNA, 63 nt, Homo Sapiens
gugcuguuuaagcuacuaacuuugaauagcaauuagugauauauucaaaaacagguuuuugau

SEQ ID NO: 489529 - RNA, 63 nt, Homo Sapiens
gccauugguuuuuguaguauuggggcccucuuuuagugauacuggauuggcguuguuuguggc

SEQ ID NO: 489530 - RNA, 63 nt, Homo Sapiens
aguuuuacuuugaacuuucacgcugaaacaugcuagugauaucuagaaagggcuaauuagguc

SEQ ID NO: 489531 - RNA, 63 nt, Homo Sapiens
gucagaauaaugucaaagugcuuacagugcagguagugauaugugcaucuacugcagugaagg

SEQ ID NO: 489532 - RNA, 63 nt, Homo Sapiens
uaauguuaaagugccaugaaauauuuugccuuuuagugauauuuuguaacuaugaauauuuac

SEQ ID NO: 489533 - RNA, 63 nt, Homo Sapiens
uuuuaugggugggaauaaaauuuuucagcuauuuagugauauaguuuuaaaauaauauguaaa

SEQ ID NO: 489534 - RNA, 63 nt, Homo Sapiens
aauggcuauuuuauuaugauaauauuucucuaauagugauauaugaaaguauguuuucucuaa

SEQ ID NO: 489535 - RNA, 63 nt, Homo Sapiens
uagcaucuuuagcugcacagagggcugcaguucuagugauaaacaagcaauuucccuccaaca

SEQ ID NO: 489536 - RNA, 63 nt, Homo Sapiens
uauuuguugcagagcugaggaacagagcaaauguagugauagaagcgcaaugagagaagcagc

SEQ ID NO: 489537 - RNA, 63 nt, Homo Sapiens
cugcccuaaauuuuacuaauaaauccauuuuucuagugauacacaaauuguuuaagguuauac

SEQ ID NO: 489538 - RNA, 63 nt, Homo Sapiens
gcagcacggauauaacacuaggcaagccuauuuuagugauaugucauacaccucaccugccuu

SEQ ID NO: 489539 - RNA, 63 nt, Homo Sapiens
cccuuuuuucucagaacuccgauuuauuuucuauagugauaaaugaacauaauuuaagaacca

SEQ ID NO: 489540 - RNA, 63 nt, Homo Sapiens
auucuagccacacacaaauaaauaucugcggcuuagugauaggacucuaccuuuucuccuaga

SEQ ID NO: 489541 - RNA, 63 nt, Homo Sapiens
aauuugauuauguauuauaauguaaucuguaaauagugauaugauuaacaucuuaaucacauc

SEQ ID NO: 489542 - RNA, 63 nt, Homo Sapiens
ggauuggguuuagauuggggccagugcugguguuagugauagugucaggauggagguuagguu

SEQ ID NO: 489543 - RNA, 63 nt, Homo Sapiens
uuuaucucaaguagauauagacacuaaccuugauagugauacguuagaggguuccuauucuuc

SEQ ID NO: 489544 - RNA, 63 nt, Homo Sapiens
ccaucucuuaaaaaaaaaaaagccugggcaacauagugauaccgaguccaggaguuugagacc

SEQ ID NO: 489545 - RNA, 63 nt, Homo Sapiens
gaacuagcuuguaguuaguguugcacugaguuuuagugauauaguucccauuugaguuccucc

SEQ ID NO: 489546 - RNA, 63 nt, Homo Sapiens
ugcuauuugcguucuccagaacagcauggcauauagugauauaaggaaccauacuucucuggg

SEQ ID NO: 489547 - RNA, 63 nt, Homo Sapiens
ccuuaauuuagugggcuuuguuauguucuacuuuagugauauaacauguauauauaccauuua

SEQ ID NO: 489548 - RNA, 63 nt, Homo Sapiens
cugaugcugaagaucaaauacccaccucugcaauagugauaaucuucuuuuugcaugguuuug

SEQ ID NO: 489549 - RNA, 63 nt, Homo Sapiens
cuuuuguaaaguacagcaaacacugcugccaucuagugauacaauuggcaaagcucuaaaaug

SEQ ID NO: 489550 - RNA, 63 nt, Homo Sapiens
ucagauucuucaaugugguuuacccaacuggaguagugauaaacaccuuaaucauaaaaugaa

SEQ ID NO: 489551 - RNA, 63 nt, Homo Sapiens
gguuggucagcagucagacaacucuaauguguguagugauaagagauucaaguaacaucaguu

SEQ ID NO: 489552 - RNA, 63 nt, Homo Sapiens
gagcucaggaguccuaaaccagccugggcaacauagugauaccuugucucuaccaaaaguuaa

SEQ ID NO: 489553 - RNA, 63 nt, Homo Sapiens
cagauuuccuuucagaacacucaaagguucgacuagugauaguggaugguauugcuuuuccau

SEQ ID NO: 489554 - RNA, 63 nt, Homo Sapiens
auguucaucccagcauugcauuaaggauuuaguuagugauaagaauuuauccuaagaaaauac

SEQ ID NO: 489555 - RNA, 51 nt, Homo Sapiens
aggaaguuuagcauaaauuaguagugauaaaaugugaugaaugaaacuuaa

SEQ ID NO: 489556 - RNA, 63 nt, Homo Sapiens
caugaacaaagccauauccuucccggcuucgaguagugauacguagccccgcccaccaacgag

SEQ ID NO: 489557 - RNA, 63 nt, Homo Sapiens
uuauuuuauauaauauuuuucccuauuuguuauuagugauacuagacuguuuuaccuccacaa

SEQ ID NO: 489558 - RNA, 63 nt, Homo Sapiens
auuccuuguugcuuggucccagucuuauaaauguagugauaggacccucuacucuccagcuuu

SEQ ID NO: 489559 - RNA, 63 nt, Homo Sapiens
uuugcacucuaacuuaagaguuuuuacuuuauguagugauaccuaauacaauuuugaaaauac

SEQ ID NO: 489560 - RNA, 63 nt, Homo Sapiens
gagucaaggauucuucugauucuaguguguguuuagugauagauguagucuugacgaauauug

SEQ ID NO: 489561 - RNA, 63 nt, Homo Sapiens
ucgauggaauugugugaucagaagguggaauucuagugauaggcgaccucagacccgcauuca

SEQ ID NO: 489562 - RNA, 63 nt, Homo Sapiens
acaauuccaacacacagcaaucacugcuguuaauagugauauacauccuucccuauuaugugu

SEQ ID NO: 489563 - RNA, 63 nt, Homo Sapiens
cucaagguguaaaaaauauaggaacaauuggaauagugauaucaccacaccuguauucauaug

SEQ ID NO: 489564 - RNA, 63 nt, Homo Sapiens
cuuucauggcagagcacgucaugaaaaaugccuuagugauaaguaauuagggaaaucccacag

SEQ ID NO: 489565 - RNA, 63 nt, Homo Sapiens
augggacaugugaagaauacuuauaaaaauguauagugauacaucuuaauuuacgauuuuuua

SEQ ID NO: 489566 - RNA, 63 nt, Homo Sapiens
cauaccugcugucagcaaggguguaauauaccauagugauaaauaugaccaaaagccauaaau

SEQ ID NO: 489567 - RNA, 63 nt, Homo Sapiens
cauaccugcugucagcaaguguguaauauaccauagugauaaauaugaccaaaagccauaaau

SEQ ID NO: 489568 - RNA, 63 nt, Homo Sapiens
aagcaguuacugaucagauuaagaaucaggcacuagugauacacauucauuuuuaaaauucau

SEQ ID NO: 489569 - RNA, 63 nt, Homo Sapiens
acaccugaagagcacugacugugugccgggcacuagugauacaaaagagugugacaguuguuc

SEQ ID NO: 489570 - RNA, 63 nt, Homo Sapiens
ucacccccuccucccugaucugucagggccacuuagugauaauaaauucuucccaacugcaga

SEQ ID NO: 489571 - RNA, 63 nt, Homo Sapiens
gcgaauagccacugcacugcggccuggacgacguagugauacccugacucuuauaaauaaaua

SEQ ID NO: 489572 - RNA, 63 nt, Homo Sapiens
uaagaccuccucggaucauugucccuucuuauguagugauaaaguaaccuuccuugaagugua

SEQ ID NO: 489573 - RNA, 63 nt, Homo Sapiens
agcuaagaaaaaaaaaaagucugugcauaguuuuagugauacaccaccuccgauaagcaaaaa

SEQ ID NO: 489574 - RNA, 63 nt, Homo Sapiens
uaaccaguuuuaucucucucuaaguacagaucuuagugauacauccuguguccuuuaacacuu

SEQ ID NO: 489575 - RNA, 63 nt, Homo Sapiens
uaccauuuuaucugucucaauaauuacagaucuuagugauacauccuguguccuuuaacacuu

SEQ ID NO: 489576 - RNA, 63 nt, Homo Sapiens
auuuuuauuuccauuuuauaaacauguaaauaauagugauaacuuguuaauaauaguaaaccu

SEQ ID NO: 489577 - RNA, 63 nt, Homo Sapiens
uuuuauucugagugcaauauuucaauagccuuguagugauaacuaguguugcuuuuguuuuag

SEQ ID NO: 489578 - RNA, 63 nt, Homo Sapiens
gguuuuguaccaucugaugcuggaaguuuugauuagugauauuuucuacuacuacauauuuag

SEQ ID NO: 489579 - RNA, 63 nt, Homo Sapiens
ugggaaggaggacgguuguaagcaguuguuauuuagugauauuguggguaacgugagaagaua

SEQ ID NO: 489580 - RNA, 63 nt, Homo Sapiens
ggaaaguacuaugaacgucucgaagcaguauucuagugauaagaauucuuaacauagccaagc

SEQ ID NO: 489581 - RNA, 63 nt, Homo Sapiens
ggcucccagugggggccccguggagggcgcccguagugauaagcacaccggcacgaacgucag

SEQ ID NO: 489582 - RNA, 63 nt, Homo Sapiens
cauuguuauaaaaacuuguaauaagggcuucaguagugauagaaaguccccuacagucaguuu

SEQ ID NO: 489583 - RNA, 63 nt, Homo Sapiens
aguauucuugguguaacuuaugaauaaaauuuguagugauaacaacauacaaagauggguuuc

SEQ ID NO: 489584 - RNA, 63 nt, Homo Sapiens
agacuccugucucuggaggucugcaagcacugguagugauauugcagcagacaaggucugggu

SEQ ID NO: 489585 - RNA, 63 nt, Homo Sapiens
ucaagauuacuugcccagaaucacucaggcagcuagugauagagguggggccaagcccaggcu

SEQ ID NO: 489586 - RNA, 63 nt, Homo Sapiens
aucacacauuuauugcuguuuaucagguugguuuagugauaauaauuuuguuuuugaaauaca

SEQ ID NO: 489587 - RNA, 63 nt, Homo Sapiens
uuuucccuuaaaggaaugucaaagauuguuugauagugauaaguuacauuuauguggagcucu

SEQ ID NO: 489588 - RNA, 63 nt, Homo Sapiens
uauaauauuuuucauaggcaaguuuccucucaguagugauaacaacauuuuuagacauucaaa

SEQ ID NO: 489589 - RNA, 63 nt, Homo Sapiens
ccauccugaaccauucguuuugacccauaauaauagugauaguauaauggcuaccaguuauug

SEQ ID NO: 489590 - RNA, 63 nt, Homo Sapiens
uuuagaaaggauuuucacacuggcauuucuagguagugauauuuucuuccacuuaccugcuga

SEQ ID NO: 489591 - RNA, 63 nt, Homo Sapiens
ucuuaucucauauuucaugacuuaagaauuuuuuagugauaauaaacauagacuuaauuccaa

SEQ ID NO: 489592 - RNA, 63 nt, Homo Sapiens
ucaguguuugagagugaccuuacacucaaacuauagugauauaaccuuugauuacugaauccc

SEQ ID NO: 489593 - RNA, 63 nt, Homo Sapiens
aaaugggucacuaucugguguuaugucgacuauuagugauaacucccuucaguggaaaccaug

SEQ ID NO: 489594 - RNA, 63 nt, Homo Sapiens
ugugaaaucacagguuugauuuuucaucccaaguagugauaucaacauuguuauccuauauca

SEQ ID NO: 489595 - RNA, 63 nt, Homo Sapiens
ugguaaggugcuucuuccucugagggaacccaauagugauaccggaugagugcagggcagagg

SEQ ID NO: 489596 - RNA, 63 nt, Homo Sapiens
aacuuugauuacugaauccauacacucaaacuauagugauauaucaguguuugggagugaccu

SEQ ID NO: 489597 - RNA, 63 nt, Homo Sapiens
ccauaaauaauugcuggaaaguuguagucaccauagugauagccuuuuagugugauuuauuaa

SEQ ID NO: 489598 - RNA, 65 nt, Homo Sapiens
ucuauaauuguacuuguuuuuuaauuacuuccuuucacugccaaccucgaauuacuguacaguau

SEQ ID NO: 489599 - RNA, 65 nt, Homo Sapiens
auuccacagaccaggacauuccaugugccucauggcacugccaccuggcccuuugcccuauuuuc

SEQ ID NO: 489600 - RNA, 65 nt, Homo Sapiens
ucccccaggggcacguguggcuccugcccccuggccacugccaagagaaugaagcacccagucuc

SEQ ID NO: 489601 - RNA, 65 nt, Homo Sapiens
aagcagaggaagaagcugccgaaggggacagacuccacugccagacggccagccguuugcugucc

SEQ ID NO: 489602 - RNA, 65 nt, Homo Sapiens
uuucucgcacguugaggcuuaguggagaugggcaccacugccauuugcucagaagaaggcugguc

SEQ ID NO: 489603 - RNA, 65 nt, Homo Sapiens
ccuccucccaccugccaccaggccucaccaaagcccacugccauggggccaucugggccauucag

SEQ ID NO: 489604 - RNA, 65 nt, Homo Sapiens
agaaagugggaauagggugcauuggggcuaguuggcacugccauguaucucaggcuuggguucac

SEQ ID NO: 489605 - RNA, 65 nt, Homo Sapiens
gcaggcugugaauuugucucucagucacugauugccacugccaucuggaaauguuugcuaaaggc

SEQ ID NO: 489606 - RNA, 65 nt, Homo Sapiens
auucagcaggagguccuauuacccucuccagcugccacugccagagcuggauuccuguaaaggag

SEQ ID NO: 489607 - RNA, 65 nt, Homo Sapiens
aagauagugaaguggucuugauugauuuugauuuucacugccaagccaaucaugugaaggacaga

SEQ ID NO: 489608 - RNA, 65 nt, Homo Sapiens
cccagaauccgcauguuuccccagugauuacacuccacugccaccguggugccuggcuuuaacuc

SEQ ID NO: 489609 - RNA, 65 nt, Homo Sapiens
aacagauguaaugcaugucacagugacggagauaacacugccaugauaaaaguacucauguuucc

SEQ ID NO: 489610 - RNA, 65 nt, Homo Sapiens
ucacuaaccaguugacgagcagugcauuuacaaggcacugccaaacaagaugcccuugggagcug

SEQ ID NO: 489611 - RNA, 65 nt, Homo Sapiens
gccuucugaggagaaaagcaacccuguuucaaauccacugccaauucagcuccucuggaguggag

SEQ ID NO: 489612 - RNA, 65 nt, Homo Sapiens
cccugccucccuaauuagcuagggcuggggucagccacugccaauccugccuuacucaggaaggc

SEQ ID NO: 489613 - RNA, 65 nt, Homo Sapiens
gggagaucauagcccuuccuaggcagaauccuguucacugccaggcuauaguaauuauuacuauu

SEQ ID NO: 489614 - RNA, 65 nt, Homo Sapiens
auaaaacacaaacgggcucagcaaaagaugcuucucacugccaugccagcuuaucucaggggugu

SEQ ID NO: 489615 - RNA, 65 nt, Homo Sapiens
auguucaagguaauaugccaggcgcuguaugucuccacugccaaguagaagugacucaaaacccu

SEQ ID NO: 489616 - RNA, 65 nt, Homo Sapiens
ccaugaccccaccuuuacuaagcacaaguacuugccacugccaucacugccaaguaacuagaugu

SEQ ID NO: 489617 - RNA, 65 nt, Homo Sapiens
caccuuuacuaagcacaaguacuugccacugccaucacugccaaguaacuagaugucucuguuuc

SEQ ID NO: 489618 - RNA, 65 nt, Homo Sapiens
ucugguuaucuuccuguuccuguagcauagccaggcacugccagucaccugugcccccauugcug

SEQ ID NO: 489619 - RNA, 65 nt, Homo Sapiens
uggguccugaguguggguauccacuuuuacccgcucacugccaccuguggacacucugugucuac

SEQ ID NO: 489620 - RNA, 65 nt, Homo Sapiens
aggcuucuccgccagccuccucuggacggcaggcucacugccaggccagccuccgagagggagag

SEQ ID NO: 489621 - RNA, 65 nt, Homo Sapiens
uggaauuugcuggaggacuaggccagagcaagccucacugccacugugccuuuggggcacccuug

SEQ ID NO: 489622 - RNA, 52 nt, Homo Sapiens
aggcagacacucaggccuaacccacugccagccccugagaggacacgcuccu

SEQ ID NO: 489623 - RNA, 65 nt, Homo Sapiens
caugcccaucccgaugaaccugcaucauuccccgacacugccaagccaacccuggaaaaggaguu

SEQ ID NO: 489624 - RNA, 65 nt, Homo Sapiens
acauauauauucuacauauauguauauuaaaacugcacugccaugucugcccuuuuuuguggugu

SEQ ID NO: 489625 - RNA, 65 nt, Homo Sapiens
ccaccaaauugcuuuauuccccuuugcaagaugggcacugccauaguucugccucuuugcugggg

SEQ ID NO: 489626 - RNA, 65 nt, Homo Sapiens
uccucccucaccagcucuuacgccucagccagcaccacugccaccagggcaacugcagcagcauc

SEQ ID NO: 489627 - RNA, 65 nt, Homo Sapiens
cagauuuucucacagacccuucccaauuccaucaccacugccaacaacuccucccccagagaucu

SEQ ID NO: 489628 - RNA, 65 nt, Homo Sapiens
ccugaaggauugucgaggccaggguucgggaaguacacugccaucggucaggggacagcugccuc

SEQ ID NO: 489629 - RNA, 65 nt, Homo Sapiens
agucacaacccaggugacgaugcccucucagccaacacugccaaccugacccugucaucccgauu

SEQ ID NO: 489630 - RNA, 65 nt, Homo Sapiens
gcucucuccgcucccuugugauuucugagggucaccacugccagccucaggcaacauagagagcc

SEQ ID NO: 489631 - RNA, 65 nt, Homo Sapiens
agaacaucuuuaugguaaagaugggagcccaguuucacugccauauacucuucaaggacuuucug

SEQ ID NO: 489632 - RNA, 65 nt, Homo Sapiens
aaagaaacugagccuggggcaaacgaggcuucccacacugccaggggagccucacugugaagucu

SEQ ID NO: 489633 - RNA, 65 nt, Homo Sapiens
caccuggccugcugggaaccccagugcugccaugccacugccaggucugccccuugggcauccac

SEQ ID NO: 489634 - RNA, 65 nt, Homo Sapiens
cacuggggugaggcuggggguccagcuugcccuuccacugccacugaguuaacggugugggccac

SEQ ID NO: 489635 - RNA, 65 nt, Homo Sapiens
ugcaagagcccugcccaggaacaaccuccugggaccacugccaccaguccaggcagaaggagacc

SEQ ID NO: 489636 - RNA, 65 nt, Homo Sapiens
ggaagggagugcguaggcuucugaagggcuaguggcacugccaggggagaggcagaaucuauaua

SEQ ID NO: 489637 - RNA, 65 nt, Homo Sapiens
cccagcuaauuuuuugcauugggacugcaggcacacacugccacgccucagccucccgaguagcu

SEQ ID NO: 489638 - RNA, 65 nt, Homo Sapiens
gaaucagaaagagcuagaagcuggacuuguuccuucacugccacagauuggguuuaguuucagaa

SEQ ID NO: 489639 - RNA, 65 nt, Homo Sapiens
agauaugauguaaagugaaaaaugaucagcacagccacugccaacaaaucugaguggaauuuuca

SEQ ID NO: 489640 - RNA, 65 nt, Homo Sapiens
uucagugucccggcuccaaaacccuggggccaacucacugccauggaucccuccagaagucuccc

SEQ ID NO: 489641 - RNA, 65 nt, Homo Sapiens
aggguuuaguugaccucauagggaauugcacuucacacugccaucuucuuauuuuggagggagaa

SEQ ID NO: 489642 - RNA, 65 nt, Homo Sapiens
gucuuagcagggucuugugaacccaaggcuuggcacacugccagugaaggguguucacccauccc

SEQ ID NO: 489643 - RNA, 65 nt, Homo Sapiens
gaaauugcuuuccuaugguaaguauauacauaccucacugccaguaauaaggaguauuuugguag

SEQ ID NO: 489644 - RNA, 65 nt, Homo Sapiens
ugucuuaugugaaaaauuaaaguuaauuggauguucacugccaguuaguuaaauaacuguguggc

SEQ ID NO: 489645 - RNA, 65 nt, Homo Sapiens
agaauaucagccugggggcaucucucccugccucucacugccauaaugucuuccuuauucauuuu

SEQ ID NO: 489646 - RNA, 65 nt, Homo Sapiens
cuccuucucauuuaaugcuuaaucugcauaauguucacugccaaaacgaggauaccuucaguuug

SEQ ID NO: 489647 - RNA, 65 nt, Homo Sapiens
uucaaggaaagaaaauuuuuugaaucuuuauuuuucacugccagcugugcacaaagaaaaugaca

SEQ ID NO: 489648 - RNA, 65 nt, Homo Sapiens
caaaaagucugccaaguggguugacuuuguaucuucacugccaagcgggcgauggcugucuuuuc

SEQ ID NO: 489649 - RNA, 65 nt, Homo Sapiens
ggaauguuucuacacgauccguuuuauuuugagaacacugccauuaggucuucuaauguaauuuu

SEQ ID NO: 489650 - RNA, 65 nt, Homo Sapiens
gacagucuauuuucuuuuaacacuaauauggaaaucacugccagagcauaugggaaguaacauug

SEQ ID NO: 489651 - RNA, 65 nt, Homo Sapiens
acacuaggcaaaaaauauuuaccguauacuacuuucacugccaugauaugcauauguggggugaa

SEQ ID NO: 489652 - RNA, 65 nt, Homo Sapiens
ucggacuugcuagacgcuucucaaaacuggacagucacugccacuuugcacauuuugauuuuuuu

SEQ ID NO: 489653 - RNA, 65 nt, Homo Sapiens
uguauggauuuacuuugggguucaaaucaaaaugucacugccagaaagagcuguuccagcugauc

SEQ ID NO: 489654 - RNA, 65 nt, Homo Sapiens
ccauuugguaaaccaguugauuauuuggaaauguucacugccaaaauaguaagugcuauaacuaa

SEQ ID NO: 489655 - RNA, 65 nt, Homo Sapiens
cuuccugauuaaaaacacaguuuuauugcucucugcacugccaaaccaauaaauuuacagaagag

SEQ ID NO: 489656 - RNA, 65 nt, Homo Sapiens
cauccuuuucuuuguuuuuacccccuggcugccaccacugccaugucacagcugcuuucucuggc

SEQ ID NO: 489657 - RNA, 65 nt, Homo Sapiens
uccuaggggacuggcgauuuaaaccaguugagaaacacugccaucagcaggcaguuucagacuca

SEQ ID NO: 489658 - RNA, 65 nt, Homo Sapiens
uuuugccaagggaauuauagcugcagguucucucucacugccaucaaacuguaaaagauuaaacu

SEQ ID NO: 489659 - RNA, 65 nt, Homo Sapiens
ugcccaugauggucacuuaaaaugugcaguaauagcacugccaggaucaagcaugaaaggcuuuu

SEQ ID NO: 489660 - RNA, 65 nt, Homo Sapiens
ccaugcccauuccucgccucauucauaggacacuucacugccauuuucuauucacauaaaagaaa

SEQ ID NO: 489661 - RNA, 65 nt, Homo Sapiens
caaaaauuaagauuaucaaagcauuuugaauagugcacugccauguguccugucugugaaugaag

SEQ ID NO: 489662 - RNA, 65 nt, Homo Sapiens
agcaguggcagcagagaguggccucggagggaagccacugccaccugagacagcccaagcagcaa

SEQ ID NO: 489663 - RNA, 65 nt, Homo Sapiens
acccaucuccuugagucauucccuuugggaaaccccacugccaguauugaucuccuuuuugccuu

SEQ ID NO: 489664 - RNA, 65 nt, Homo Sapiens
acaggaagucucagugugaaggggucuuuucucuccacugccaauguaaguagaauguucuaaau

SEQ ID NO: 489665 - RNA, 65 nt, Homo Sapiens
ccuuccuugggaccaaggaccguuccaacagcauucacugccaguucuaauaggcgaggaaaaug

SEQ ID NO: 489666 - RNA, 65 nt, Homo Sapiens
ccccugguugcaucccagaagcaucugacugucaccacugccaguggcuguggaacaguccuggg

SEQ ID NO: 489667 - RNA, 65 nt, Homo Sapiens
cuggaaaagaggcccugccauacacccugcguacccacugccaggacccucucagacaagcgugg

SEQ ID NO: 489668 - RNA, 65 nt, Homo Sapiens
gccgucuguuaggagcuuccagaguguucucucgacacugccagccccguguuagcaccugggcc

SEQ ID NO: 489669 - RNA, 65 nt, Homo Sapiens
ggggcaugauucucucaggcgccugcaccgccucccacugccagugggccugggcagggcuccca

SEQ ID NO: 489670 - RNA, 65 nt, Homo Sapiens
ucuagagcagaguggaggccaaucaggagccuggacacugccaucuagcuucccugcuuccuggg

SEQ ID NO: 489671 - RNA, 65 nt, Homo Sapiens
ccgaggcucagccccagacugcccugcccucaccccacugccaggccccccaagccugagccaug

SEQ ID NO: 489672 - RNA, 65 nt, Homo Sapiens
cuaaaaacuauuugucauugaguguagucuaugaccacugccacagagaccucuaccuaguagaa

SEQ ID NO: 489673 - RNA, 65 nt, Homo Sapiens
gaugccugggugugccacaggcuucuucaggacagcacugccagauggcagaucaauaaagaaag

SEQ ID NO: 489674 - RNA, 65 nt, Homo Sapiens
ugggauuggguucgaacagcuccccgccggaucugcacugccaacuauaaggucaguguuucucg

SEQ ID NO: 489675 - RNA, 65 nt, Homo Sapiens
auuccauccugugccccgccccgccgcgccuuucgcacugccaccgcugaccgcagcaccgcccc

SEQ ID NO: 489676 - RNA, 65 nt, Homo Sapiens
ugguguggcucaccagggcaucugcucagcacgggcacugccacuacccggccaugaggaccugc

SEQ ID NO: 489677 - RNA, 65 nt, Homo Sapiens
gccauuucugaucacaccacucucagcaaaaugggcacugccagaauacauuucgauuccuuuca

SEQ ID NO: 489678 - RNA, 65 nt, Homo Sapiens
gccuuugaccaucuguaguugagugcaccgcccaccacugccacguacaguuccacaucaaggcc

SEQ ID NO: 489679 - RNA, 65 nt, Homo Sapiens
uuugcagugguucuaagugauuuauuuuuuaauuucacugccaaguucaaugcuaagucuugccu

SEQ ID NO: 489680 - RNA, 65 nt, Homo Sapiens
acaucaaccugccagcuggcagacauugaggcaggcacugccaaauguguugcagugucugcugg

SEQ ID NO: 489681 - RNA, 65 nt, Homo Sapiens
guuaacaguuccuuucaaagaaaaaaaaaaauucacacugccagcgagauuuuuuuuuaaagaag

SEQ ID NO: 489682 - RNA, 65 nt, Homo Sapiens
uucugaaacggucccacugggggacucccugccaccacugccagugcucagcaguccucccucug

SEQ ID NO: 489683 - RNA, 65 nt, Homo Sapiens
cccccaguucaaauccuuacugcuucuuaucuguccacugccacuugaccagacgccacaccuug

SEQ ID NO: 489684 - RNA, 65 nt, Homo Sapiens
uguguucuggcuguagacaacuggaaagauggguccacugccacguuuccccccaggaagccugc

SEQ ID NO: 489685 - RNA, 65 nt, Homo Sapiens
cagucugacagcuugcgacucuggccgagagcagccacugccacuccaagcccacaucacaucuc

SEQ ID NO: 489686 - RNA, 65 nt, Homo Sapiens
gagacugccuggcuguguccaaauucagaagccuccacugccauggaggugccugggagcugccu

SEQ ID NO: 489687 - RNA, 65 nt, Homo Sapiens
cccucagccugaggucuggucccugccccuaccuccacugccagaggucugaaagcaccaagggu

SEQ ID NO: 489688 - RNA, 65 nt, Homo Sapiens
uacuuuaucugggcuuaauaagucacugacaucagcacugccaacucggcugcaauuguggaccu

SEQ ID NO: 489689 - RNA, 65 nt, Homo Sapiens
ucaccuuccuugaaauuucucagcgggagucuccucacugccacuaaaauccacccagcccacua

SEQ ID NO: 489690 - RNA, 65 nt, Homo Sapiens
gucuuucaggugggggagaaauugguuagggcucccacugccaaaugcaagcagauagcauaacc

SEQ ID NO: 489691 - RNA, 65 nt, Homo Sapiens
ucuacaaggacuuguacuagcagagaguccugagccacugccaacauuucccuucuuccaguugc

SEQ ID NO: 489692 - RNA, 65 nt, Homo Sapiens
gggagugcaggguggacaucaccuuggaggcccugcacugccagcaucuggagaccguccuggag

SEQ ID NO: 489693 - RNA, 65 nt, Homo Sapiens
gcacccccaaccuccaucgccuugcagguuuucuucacugccaggaguagugagcuguacgaguc

SEQ ID NO: 489694 - RNA, 63 nt, Homo Sapiens
agucagcugugauguacugacaccauggaauuccacugccagugacccacugccuccggccgu

SEQ ID NO: 489695 - RNA, 65 nt, Homo Sapiens
accaugauagucuacauucugauaagcugugaggccacugccaagggagggagaaauggucacuu

SEQ ID NO: 489696 - RNA, 65 nt, Homo Sapiens
acagcuccgucgccccuagcaacuccaccauugggcacugccaugcagagacguggcuggcccag

SEQ ID NO: 489697 - RNA, 65 nt, Homo Sapiens
gcuucucccagcccguggguggcagcgugcuagcacacugccaccaucucaaagccaucccccua

SEQ ID NO: 489698 - RNA, 65 nt, Homo Sapiens
ucaggcaugugacuggccuaacugcaugcccagggcacugccaggguucaaugggccagccgucu

SEQ ID NO: 489699 - RNA, 65 nt, Homo Sapiens
uuuagcaagagacaauuuucuguacuagaaucuuccacugccagaaaacacagugccaguaaggu

SEQ ID NO: 489700 - RNA, 65 nt, Homo Sapiens
uauccacugacuuccaucugacacugguugaggaccacugccagggaugcuaacucccugguaau

SEQ ID NO: 489701 - RNA, 65 nt, Homo Sapiens
cucugagccgccacucccgggccaagacagauggacacugccaagagccgacaaugcccugcugg

SEQ ID NO: 489702 - RNA, 65 nt, Homo Sapiens
ggggccgucccgggagccaggugggagcugccuuccacugccaucgggucuccucuccucuccca

SEQ ID NO: 489703 - RNA, 65 nt, Homo Sapiens
aguuuggagacucauaaauaccaugcagguguaaccacugccaauaggcuguuucuaugcuuauu

SEQ ID NO: 489704 - RNA, 65 nt, Homo Sapiens
ggccuccagaauugacuuagcccuaguaauaaaagcacugccaaaacaucucagagacuucuuuu

SEQ ID NO: 489705 - RNA, 65 nt, Homo Sapiens
aagugacagguauccacauuugcaugguuacaagccacugccaguuagcaguagcacuuuccugg

SEQ ID NO: 489706 - RNA, 65 nt, Homo Sapiens
uuuuugugaaauucaaccugugucuuauagguuuccacugccaaaacaaugcccguaagauggcu

SEQ ID NO: 489707 - RNA, 65 nt, Homo Sapiens
ggcaggggugccucacugugagcgggaugacuguucacugccacuguccuguggcucggggaagg

SEQ ID NO: 489708 - RNA, 65 nt, Homo Sapiens
ccauggcccagccacuguguugcugaccagucagccacugccaacgccucacucaggcacguacc

SEQ ID NO: 489709 - RNA, 65 nt, Homo Sapiens
uuuauauuuuaaaaggaaauaucuuugauauaaagcacugccauaaagcaauugauagauuuuac

SEQ ID NO: 489710 - RNA, 65 nt, Homo Sapiens
gccaagcauccucaugagaggaaucuccucacugucacugccauauaaugagcuguaugagaggu

SEQ ID NO: 489711 - RNA, 65 nt, Homo Sapiens
gaacuuggaaauagugauuucccccgccacccucccacugccaaaguucuuccaucaccuccccc

SEQ ID NO: 489712 - RNA, 65 nt, Homo Sapiens
aggccccaaguggcuuguaaggguggguaaacccucacugccagccuggagcaagcuggggcggg

SEQ ID NO: 489713 - RNA, 65 nt, Homo Sapiens
cugucccucauuacccaaggaagagcugagcagggcacugccagcggccuuuccuggacagacug

SEQ ID NO: 489714 - RNA, 65 nt, Homo Sapiens
uggagucuugccaugccuguauugcuaaguugggucacugccacaggacagccuggacauuggac

SEQ ID NO: 489715 - RNA, 65 nt, Homo Sapiens
uggagccacugucaugcaggcauacagugucuggacacugccacauggacgcugccacaucuggg

SEQ ID NO: 489716 - RNA, 65 nt, Homo Sapiens
uagcugggggaguggcauggaccccaaagagggggcacugccaggggcugggcuugucagggggc

SEQ ID NO: 489717 - RNA, 65 nt, Homo Sapiens
uuuauggacuggccccuuuggugguuugaagaccccacugccaccaggcuucuggaauagaaaca

SEQ ID NO: 489718 - RNA, 65 nt, Homo Sapiens
cagggaguggaucaaaaauauagguguuugggguacacugccaccaggaaaaagaaaacaggacc

SEQ ID NO: 489719 - RNA, 65 nt, Homo Sapiens
caugccacguguccccagagcauguucucaauacccacugccagaggcugcccuucuucuugacc

SEQ ID NO: 489720 - RNA, 65 nt, Homo Sapiens
gucagucccaggaguccacauaccugucuugccagcacugccagcggcuccugacccuagcagug

SEQ ID NO: 489721 - RNA, 59 nt, Homo Sapiens
ucccacuggcagaaacucucggaggguggcacugccacagacugacagccaagauauaa

SEQ ID NO: 489722 - RNA, 65 nt, Homo Sapiens
uuuuuggaaaccuguauuacuuaugcugguauucucacugccacauuagcacaaguuucucuuuu

SEQ ID NO: 489723 - RNA, 65 nt, Homo Sapiens
caauuuaguucaauaaaauuaaauaucaucucuagcacugccaucaagauaugugcccucaucau

SEQ ID NO: 489724 - RNA, 65 nt, Homo Sapiens
uguauaaaaguacagcacauuaaacaaaccuacuacacugccaguugucuguggagaugcuggug

SEQ ID NO: 489725 - RNA, 65 nt, Homo Sapiens
acauggcaaaauguuugcuagauaacggcauauaacacugccauuguuuucuuuauacaaagcaa

SEQ ID NO: 489726 - RNA, 65 nt, Homo Sapiens
aaacauuaagaaaaucauaucagcucccccucccccacugccauaugggggacugggagccgcag

SEQ ID NO: 489727 - RNA, 65 nt, Homo Sapiens
ccuuccuuucccuccuccuccuuccucuucucucucacugccacgcuccccacuccuccucucuu

SEQ ID NO: 489728 - RNA, 65 nt, Homo Sapiens
cgcccaggcuggagugcaaugccgugaucuccgcucacugccaccuccgccucucuaguucaagc

SEQ ID NO: 489729 - RNA, 65 nt, Homo Sapiens
uucugauuccauaagcuguuuuugcuuaggugauccacugccaugugauccauaauuuuucuaca

SEQ ID NO: 489730 - RNA, 65 nt, Homo Sapiens
ugauucacugcauggcucccacaggagugggaaaacacugccaucuuaguuuggauucuuaugua

SEQ ID NO: 489731 - RNA, 65 nt, Homo Sapiens
cuacucaauauucucuucaagcauuuuuuuucuuccacugccacucucuuuaccuuuaucauuuc

SEQ ID NO: 489732 - RNA, 65 nt, Homo Sapiens
ugcacauccaggaaaaaagacuaggacuugccacacacugccaauucauaauccgcaggaucugu

SEQ ID NO: 489733 - RNA, 65 nt, Homo Sapiens
uuauuuuauuuucucacaggauaucacauuggagucacugccaagucauagccauaaaugaugag

SEQ ID NO: 489734 - RNA, 65 nt, Homo Sapiens
uuucuuugguuuucuucaaacauaggugaaaaaaacacugccauucacaagucaaggaacccagg

SEQ ID NO: 489735 - RNA, 65 nt, Homo Sapiens
guugugucuuuauuuaauuuuacaucuuuuugaagcacugccacagguuauuagccaagguggcc

SEQ ID NO: 489736 - RNA, 65 nt, Homo Sapiens
gcagcccacaccaaaucacagaguugcugcuauugcacugccaguuguaacaguccuguuuuguu

SEQ ID NO: 489737 - RNA, 65 nt, Homo Sapiens
ucagggguuugcuuacaguguuacagaggacauaccacugccaugucugugccucuuaucaagug

SEQ ID NO: 489738 - RNA, 65 nt, Homo Sapiens
cucccaaggggcccaaauucuacuucauggacuuccacugccaucgcuuuuuaaagaaugcucuu

SEQ ID NO: 489739 - RNA, 65 nt, Homo Sapiens
aacaacgagguuccuauaauggccauuucaccagucacugccaacuguucagaaauggguaaugu

SEQ ID NO: 489740 - RNA, 65 nt, Homo Sapiens
aguguguuuugguaugcacuaauucccugaagcaacacugccagaaacauuaacccuacacucgg

SEQ ID NO: 489741 - RNA, 65 nt, Homo Sapiens
cccucuuucgucuacugcaaauccauaaagacaaucacugccaacggucacugcuagagacgcug

SEQ ID NO: 489742 - RNA, 53 nt, Homo Sapiens
accacuuccacccguccuagcgccacugccaagcacaccucgcucccagcaca

SEQ ID NO: 489743 - RNA, 65 nt, Homo Sapiens
ggaaccagacgcuacagagacugcaacguguaaaacacugccauucuuuucauuccuuugaauaa

SEQ ID NO: 489744 - RNA, 65 nt, Homo Sapiens
uuuuaaaagauuaauuuuggaaacagaaggagaagcacugccauuuguuuuuauuucaacaauug

SEQ ID NO: 489745 - RNA, 65 nt, Homo Sapiens
ccgccuuuggggaggucuggaccacccagggccuccacugccaccuuggcuggcaagggagaaau

SEQ ID NO: 489746 - RNA, 65 nt, Homo Sapiens
ggaccccauaccguuagcccuuguauguauaccaacacugccaaaguaaaacauuaggucaggca

SEQ ID NO: 489747 - RNA, 65 nt, Homo Sapiens
gguaguuacuuuugccauguccuauugaucagugacacugccagaggcccauaccggcaagagga

SEQ ID NO: 489748 - RNA, 65 nt, Homo Sapiens
gaaaaucuggacaauagauguggacuccaaggggccacugccaucccuuccugugugcucuuuuu

SEQ ID NO: 489749 - RNA, 65 nt, Homo Sapiens
ccuagcuaccuucucuacccaucucccccaucccccacugccacacccuccccauucagacacuu

SEQ ID NO: 489750 - RNA, 65 nt, Homo Sapiens
gcaagcaagguggacaagagcucaggacuccagcccacugccacugggugacacagacugucguu

SEQ ID NO: 489751 - RNA, 65 nt, Homo Sapiens
ccguauggccuauaguuuaaaagcacaucuauguucacugccacucugaaaaagggaauuauuuc

SEQ ID NO: 489752 - RNA, 65 nt, Homo Sapiens
ucuaaacaguuccuaagcgcugacugugcgcuagacacugccaggcccgggccucgaggaggaaa

SEQ ID NO: 489753 - RNA, 65 nt, Homo Sapiens
uguguaaucugaaggaaggcugugccaucuuugggcacugccaagggaguuggggugaugggcuu

SEQ ID NO: 489754 - RNA, 65 nt, Homo Sapiens
aguguggugacccccauacauuccucccugcuccccacugccaggaggaccacuguccccagcca

SEQ ID NO: 489755 - RNA, 65 nt, Homo Sapiens
uuccucacccccaccccacuuagguccugggcccccacugccaggcugggcccagcuugcucagu

SEQ ID NO: 489756 - RNA, 65 nt, Homo Sapiens
agaaaauuucugccuggcacacaccuggcuccaaccacugccaagugaucacucuuaggcccagg

SEQ ID NO: 489757 - RNA, 65 nt, Homo Sapiens
cucccaccucuccauggccugccuagccaggcuggcacugccacucacacucggccccagggccc

SEQ ID NO: 489758 - RNA, 65 nt, Homo Sapiens
gcccuggcugggagagcgggagcuggcagaggagccacugccaaacucaaggcuccucuggccca

SEQ ID NO: 489759 - RNA, 65 nt, Homo Sapiens
agcucaucccaccccacaccccucccaggucugcucacugccaggcuccucuccccuuuguucag

SEQ ID NO: 489760 - RNA, 65 nt, Homo Sapiens
uagcuucuacuaaccacggucugcauguuuuuaugcacugccaauaggcagguguguguucucuu

SEQ ID NO: 489761 - RNA, 65 nt, Homo Sapiens
gucccuuggcacgcacacaggcugucacaauggcacacugccacugcugacggguguggccaccc

SEQ ID NO: 489762 - RNA, 65 nt, Homo Sapiens
acacacccaggcggcccgccauccaggacacuccacacugccaggcagggggcugagcagagccc

SEQ ID NO: 489763 - RNA, 65 nt, Homo Sapiens
aggacagacagggauggaguguuuuuuagcauggacacugccagcucaaucaaucaccucgacuu

SEQ ID NO: 489764 - RNA, 65 nt, Homo Sapiens
ccucuugguuacgcugcgggguagucccagugucucacugccaaacacucccugccuuggugcgu

SEQ ID NO: 489765 - RNA, 65 nt, Homo Sapiens
gaagaggcuucugguauagacucugaacagagaaacacugccauuacaaaaguuauuguaaugac

SEQ ID NO: 489766 - RNA, 65 nt, Homo Sapiens
auaaagaggaaacagggguuuacuuuccauuuauccacugccaauuugguacaguagaguuaacu

SEQ ID NO: 489767 - RNA, 65 nt, Homo Sapiens
cuacccuccaccacuucacaucuaaccauucucuccacugccagccguccaggccaccucuaccu

SEQ ID NO: 489768 - RNA, 65 nt, Homo Sapiens
uggggauggggccucccuccagccaagugugaccccacugccaagacuucugugggccccucaac

SEQ ID NO: 489769 - RNA, 65 nt, Homo Sapiens
ccuuuucaagguucccauggcuaguuacuggucuccacugccaugcuucucaggcaagcuguaua

SEQ ID NO: 489770 - RNA, 65 nt, Homo Sapiens
aucaaaaagcaaagauacuaaacucugagaauacccacugccagcaaacuuguaaauccacacac

SEQ ID NO: 489771 - RNA, 65 nt, Homo Sapiens
caccaaggccaugggugaggcacuguauauggggacacugccaguagcugcucagaaguacgagg

SEQ ID NO: 489772 - RNA, 65 nt, Homo Sapiens
auuucaguguuguguucagccacuggggcaacagacacugccacaucauuaguaagugggagguc

SEQ ID NO: 489773 - RNA, 65 nt, Homo Sapiens
cuggccuuacgaaauguuuugggacuacugaugcacacugccaugagccauccucccaaauagau

SEQ ID NO: 489774 - RNA, 65 nt, Homo Sapiens
caggggcugggggcugagcccugagcaugggccaucacugccaguaggucagaggaucccacuuc

SEQ ID NO: 489775 - RNA, 65 nt, Homo Sapiens
ugcguagacagacggugucaccucugcccagguggcacugccaggcaugcucugaaauggcgugc

SEQ ID NO: 489776 - RNA, 65 nt, Homo Sapiens
ccacccauggucccucacccgagcccacuggcagccacugccauugagaugccugcgccagcccc

SEQ ID NO: 489777 - RNA, 65 nt, Homo Sapiens
aaggaggaggagccggggacucccaggcuggagagcacugccaggacccaccacuggaagcagga

SEQ ID NO: 489778 - RNA, 65 nt, Homo Sapiens
accucguucugcucagaggccuugcuguggagcuccacugccauguacccaguaggguuugacau

SEQ ID NO: 489779 - RNA, 65 nt, Homo Sapiens
gcaauuuuguacaaaaauagcaauuaauuuguaaacacugccagaauacuuucuagcugcuuugu

SEQ ID NO: 489780 - RNA, 65 nt, Homo Sapiens
uggcugcuaaacccuucuaauaauauaauaaauggcacugccacagccaacaugccugaaagauu

SEQ ID NO: 489781 - RNA, 65 nt, Homo Sapiens
uaggcaccuuggucccagugucuuccuuuuguucucacugccaaacugccuguccugggaucuag

SEQ ID NO: 489782 - RNA, 65 nt, Homo Sapiens
aacacuuaaauuggguuuucaacagucccagcuuucacugccagggucccagucagauuccagga

SEQ ID NO: 489783 - RNA, 65 nt, Homo Sapiens
cuguaaggguguuucguucccuuuaaaugaaucaacacugccaccuucuguacgaguuuguuugu

SEQ ID NO: 489784 - RNA, 65 nt, Homo Sapiens
uaauauuucuugcuuccuuguguucccacccuuggcacugccacccaccccucaauucaggcaac

SEQ ID NO: 489785 - RNA, 65 nt, Homo Sapiens
aauauuucuuucuuccuuuuguuccuacccuuggccacugccagccaccccucaauucagguacc

SEQ ID NO: 489786 - RNA, 65 nt, Homo Sapiens
aagauaaccacugcugcugauggauacuuuucccucacugccauggcacaccagucauggaucuu

SEQ ID NO: 489787 - RNA, 65 nt, Homo Sapiens
ugcugcggaaacauagacgugggggcauaggcucccacugccaccaccgccaucgccucaccugc

SEQ ID NO: 489788 - RNA, 65 nt, Homo Sapiens
aggggaguuuuggacaaaacagucacuggggagaucacugccauuuuuacacacuugacuuuuua

SEQ ID NO: 489789 - RNA, 52 nt, Homo Sapiens
auggggaccuguccgacugagccacugccagccgcucuccugcccaccucuc

SEQ ID NO: 489790 - RNA, 65 nt, Homo Sapiens
cugcccaguuucuuuuugaggggcuuuguuugggccacugccagcagcuguuucuggaaauggcu

SEQ ID NO: 489791 - RNA, 65 nt, Homo Sapiens
ccaacuugcaagggguuccuucugguccucccauccacugccaccuuccauuuuguccaucucau

SEQ ID NO: 489792 - RNA, 65 nt, Homo Sapiens
ccuccagauggcauucaugucuuacucagaaagggcacugccauuguccccaaggcuucugucua

SEQ ID NO: 489793 - RNA, 65 nt, Homo Sapiens
cuuuucugaagaugaagaguuuaguuuuaaaacugcacugccaacaaguucacuucauauauaaa

SEQ ID NO: 489794 - RNA, 65 nt, Homo Sapiens
uuaagauuaaauuaagacagagagagaauacauaucacugccaggccugauaggaaaaaucugcu

SEQ ID NO: 489795 - RNA, 65 nt, Homo Sapiens
aagaagccgagguucagugguggcagcaggaaggacacugccacaaauuuugucuauuucauauu

SEQ ID NO: 489796 - RNA, 65 nt, Homo Sapiens
gggcuccugucauugagggaagucguuacgccuuucacugccacaguuacagcucaagugcuuac

SEQ ID NO: 489797 - RNA, 57 nt, Homo Sapiens
gggguauucugccuucaggagcugugccacugccacagugucuaugggacacucuga

SEQ ID NO: 489798 - RNA, 57 nt, Homo Sapiens
cuguggaagccaccaucaucgggcacucacugccaucucuuccagaaagcagaguga

SEQ ID NO: 489799 - RNA, 65 nt, Homo Sapiens
ucacuuuccaccacugucagucuaggcccuucuugcacugccacccuuucccuuuguagccgauc

SEQ ID NO: 489800 - RNA, 65 nt, Homo Sapiens
auuaaaccucagcugugacaaccucugcuuuccuccacugccaucggcuggucuuacuuugcauc

SEQ ID NO: 489801 - RNA, 65 nt, Homo Sapiens
ugcucuugucaaaacugcaucgcgccaguauuuuucacugccauacaugcuucuuuuccccaugc

SEQ ID NO: 489802 - RNA, 65 nt, Homo Sapiens
auaucauuauaauguuuuugucugaauuuguuaagcacugccauagguuuuucauauaaaaauau

SEQ ID NO: 489803 - RNA, 65 nt, Homo Sapiens
acuguggcauuuucauuacaauuccucugguuguucacugccaaaguuggaaaauccuaaugggg

SEQ ID NO: 489804 - RNA, 65 nt, Homo Sapiens
uccguggccuccuucucuggcgcacaccggucguccacugccaagguaaccuguggcacugagau

SEQ ID NO: 489805 - RNA, 62 nt, Homo Sapiens
ccauccucgcaggccucugagccagccccgcccacugccagggacgccgagggccugaccag

SEQ ID NO: 489806 - RNA, 65 nt, Homo Sapiens
uuuauuugcaaaauuccuaaaaggaaaaauuuuaucacugccaucacagcagguuuccucaucca

SEQ ID NO: 489807 - RNA, 65 nt, Homo Sapiens
ugguuuucuugaucggugagaucugucucugaagucacugccagccucccugggaacgucuauag

SEQ ID NO: 489808 - RNA, 65 nt, Homo Sapiens
cuuagcaugggauguguccaguauugaaaaggcugcacugccaaccaugauuugugagccuucug

SEQ ID NO: 489809 - RNA, 65 nt, Homo Sapiens
agccaagcccugccuguggccaagcccugaguggccacugccaagcugcggggaaggguccugag

SEQ ID NO: 489810 - RNA, 65 nt, Homo Sapiens
cacaccccuccggacauccagcgugacggagcccacacugccaccuuguggccgccugagacccu

SEQ ID NO: 489811 - RNA, 65 nt, Homo Sapiens
ucgccacugcaccucggcauaugccaccuccaugccacugccagagcuggccuagcaagaugugc

SEQ ID NO: 489812 - RNA, 65 nt, Homo Sapiens
auggaaguauuugagagagagaaccuuuccacucccacugccaggauuuuguauugccaucgggu

SEQ ID NO: 489813 - RNA, 65 nt, Homo Sapiens
guuauuauugcuguuacucuggaugauauggaaaacacugccauauuuuaaaucaacuacuccac

SEQ ID NO: 489814 - RNA, 65 nt, Homo Sapiens
gcugugagggccaagaugcucauggcccgcagaggcacugccacaucaggguggggggcugggac

SEQ ID NO: 489815 - RNA, 65 nt, Homo Sapiens
aagaaggccaaagggcccuugacaagagcaaagcccacugccaguuggcugcaguccacuggugg

SEQ ID NO: 489816 - RNA, 65 nt, Homo Sapiens
caugauuugugaaccuucugguauugaaaaggcugcacugccaaccuuagcaugggaugugucca

SEQ ID NO: 489817 - RNA, 65 nt, Homo Sapiens
gaggcucaggcugccauggcgucucagucgcugaucacugccagggagggacagcccagcucuga

SEQ ID NO: 489818 - RNA, 65 nt, Homo Sapiens
acccagugccgaggacaugccaggggcagccacaccacugccauuaggccaaauccuuggagucc

SEQ ID NO: 489819 - RNA, 65 nt, Homo Sapiens
gugcucggaggugcccuggagaaaauccccaagggcacugccacugugucucucacugagggaaa

SEQ ID NO: 489820 - RNA, 65 nt, Homo Sapiens
ggccaaaagcucagacaguuucuaacccagcccuccacugccaaagaguuuuguuauaguuguuu

SEQ ID NO: 489821 - RNA, 65 nt, Homo Sapiens
uuuaugggaugccuggaucauuguuguaugaguuccacugccagacuugacccaagaacaaaggc

SEQ ID NO: 489822 - RNA, 65 nt, Homo Sapiens
caccugagaugcugaccagcucaggcgucucucaacacugccagcuccagccugaucuuggauug

SEQ ID NO: 489823 - RNA, 65 nt, Homo Sapiens
ccucccuucucccuugauaaaccugccucgcccuucacugccaccgaaggcacagacuacuuuca

SEQ ID NO: 489824 - RNA, 65 nt, Homo Sapiens
aguugguuuggcugugauuuugaccuccucuuccccacugccaucuucuaagagacuuuguagcu

SEQ ID NO: 489825 - RNA, 65 nt, Homo Sapiens
aggaauaggaaauugaaccugggguuuugacuugccacugccauaacuuguuuguaaaagagcug

SEQ ID NO: 489826 - RNA, 65 nt, Homo Sapiens
aaaaaaaaaauuaauuugguagugagagcuugugucacugccacucuguuuuaucccugaaauua

SEQ ID NO: 489827 - RNA, 65 nt, Homo Sapiens
ucucagucuccucaguagcuggggcuuuaggugggcacugccacaccguacuaauuuuuguauuu

SEQ ID NO: 489828 - RNA, 65 nt, Homo Sapiens
gcgcacguaggacugaauucagugauaucccuauacacugccauuuaguggauagguuauuguac

SEQ ID NO: 489829 - RNA, 65 nt, Homo Sapiens
guauuucuguauguccuucuauccaaacagacguucacugccacuuguaaagugaaggauguaaa

SEQ ID NO: 489830 - RNA, 65 nt, Homo Sapiens
ggucauagguuauguacacuuaaguuuuugacacucacugccaagucaucugucagaauucuaaa

SEQ ID NO: 489831 - RNA, 65 nt, Homo Sapiens
guugagccacuucccuuugaaaagacacucaaaaucacugccaugguucaauguucccaggcccc

SEQ ID NO: 489832 - RNA, 65 nt, Homo Sapiens
cgaacggggcucagcaccagagaccagggaguauucacugccauccauuggacguguuuggguca

SEQ ID NO: 489833 - RNA, 65 nt, Homo Sapiens
cuugccacacuucccuuccugagcugaccugaccucacugccaccucuugcauugggauccugag

SEQ ID NO: 489834 - RNA, 65 nt, Homo Sapiens
ucaugagauaucucugcucaauggaaauguagguucacugccacuuccauguuugcuucugauaa

SEQ ID NO: 489835 - RNA, 65 nt, Homo Sapiens
gucaagcguaacgugucagaggauacuucuccaaucacugccaaaucgaguccuucgcugaaccc

SEQ ID NO: 489836 - RNA, 65 nt, Homo Sapiens
uguacaccuuccacgcccgcuaugacgcggagcgccacugccaccaggagggcgagcugucuuuc

SEQ ID NO: 489837 - RNA, 65 nt, Homo Sapiens
acagcugaaauucucaugcaagugggacucccagacacugccaccgccuggccucccccugaguc

SEQ ID NO: 489838 - RNA, 65 nt, Homo Sapiens
ugucacauuuuaagacuuuuuauuuuguccugauucacugccaauuucaguuaaguuuaccuggg

SEQ ID NO: 489839 - RNA, 65 nt, Homo Sapiens
ugcugcaagcgagguccaagcuuuguucugcuacccacugccagaagagccugugagauuccuac

SEQ ID NO: 489840 - RNA, 65 nt, Homo Sapiens
ucuugguagccaucgcuuucuuccuuugacuggaccacugccaccggcuccugacuggccuccuu

SEQ ID NO: 489841 - RNA, 65 nt, Homo Sapiens
agacugaauuuaacuacuaagcguguaaauggaagcacugccauuggagauuggcuuugccuuua

SEQ ID NO: 489842 - RNA, 65 nt, Homo Sapiens
cugauuuuaaaacuuacaauccaauucacaaguuacacugccauugcugugauugauugcccuag

SEQ ID NO: 489843 - RNA, 65 nt, Homo Sapiens
agccaugcugauauauuagauaucuuggaugguuucacugccaucucuguuaaaagugggccuuc

SEQ ID NO: 489844 - RNA, 65 nt, Homo Sapiens
gccgaacacggcuucgggauguggaugcugggucucacugccaaacacauucaagagaggcgucc

SEQ ID NO: 489845 - RNA, 65 nt, Homo Sapiens
ucacacccgcugccagagccgagggccuggcuucucacugccacccagaggccugagcugcaccu

SEQ ID NO: 489846 - RNA, 65 nt, Homo Sapiens
gcucuugccucuugugauguuacaggcucccuucucacugccacucccuccuuugaaacauccuu

SEQ ID NO: 489847 - RNA, 65 nt, Homo Sapiens
aaggaaauacuagugaaucacccacaaggaaaagccacugccacagaggaggcggguccccuugu

SEQ ID NO: 489848 - RNA, 65 nt, Homo Sapiens
aaggugccaugaugggcuguucuaacccccacccccacugccagguaugggccagcaguuuccug

SEQ ID NO: 489849 - RNA, 65 nt, Homo Sapiens
uacuaaugaaaacagaaugucucuuccugguagaccacugccauaugauuuacauuuccucacca

SEQ ID NO: 489850 - RNA, 65 nt, Homo Sapiens
acucuggcuagaagcuaggggucccagugaagagccacugccauuaaagaauaugaaacauagau

SEQ ID NO: 489851 - RNA, 65 nt, Homo Sapiens
augcuggcccggaaggcagaaagaggcagcaugggcacugccagggacagccacauccugcuggu

SEQ ID NO: 489852 - RNA, 65 nt, Homo Sapiens
cgggaagugaagguugccgugagcugagaucacaccacugccauaaacaugacaggcuuuuggac

SEQ ID NO: 489853 - RNA, 65 nt, Homo Sapiens
aggugacuggguggauguuguggucucuggagaagcacugccauucagccuccugcuccagcugu

SEQ ID NO: 489854 - RNA, 65 nt, Homo Sapiens
cacagauggcugggaucccuccccuguacccuucucacugccaggagaacuacgugugaagguau

SEQ ID NO: 489855 - RNA, 65 nt, Homo Sapiens
aagccugugcccccaucaucucacuccuuugccugcacugccaggguggggcccaccaagauucc

SEQ ID NO: 489856 - RNA, 65 nt, Homo Sapiens
ccccgagacugcugaugucuguaaccacuggggagcacugccaaaaauacagcuuucugguuugu

SEQ ID NO: 489857 - RNA, 65 nt, Homo Sapiens
guaccagguccccggccagcugggccccucccaggcacugccaggaagccccagcugccccuggc

SEQ ID NO: 489858 - RNA, 65 nt, Homo Sapiens
auauuuuaaggagaaagaacauaccuguuagcauucacugccaccguuccugaucaaagaaauug

SEQ ID NO: 489859 - RNA, 65 nt, Homo Sapiens
uggcuauagcuacacuggucccuucgugaauccugcacugccaccccaccacacagcccagcagc

SEQ ID NO: 489860 - RNA, 65 nt, Homo Sapiens
agggcuguuaguggcaccugcuugcuguccucugacacugccaucccucacuuccccagccucac

SEQ ID NO: 489861 - RNA, 65 nt, Homo Sapiens
gaagucucccccuuugccaagccuugacacccaagcacugccacgcgucaggccggagccucaga

SEQ ID NO: 489862 - RNA, 65 nt, Homo Sapiens
uaugaaagucucuuuaugauuuuaaaaaagcucugcacugccauguugaacaaugcaacuuuuua

SEQ ID NO: 489863 - RNA, 65 nt, Homo Sapiens
agagaauucaguauuuuuuaaguggauaugacccacacugccagaggcauuuuuaaaucccagac

SEQ ID NO: 489864 - RNA, 65 nt, Homo Sapiens
uuuccuuuuuggaggaaaugguaauguacaacugacacugccauuaaaaagaaagagagauauau

SEQ ID NO: 489865 - RNA, 65 nt, Homo Sapiens
ugguucuugccgaugaccuggaagaagugugugggcacugccacggccuccaggaucagcaccuu

SEQ ID NO: 489866 - RNA, 65 nt, Homo Sapiens
caggacuuggcacaugagcaagggccccaggucuccacugccaagcaggcuguuguaacacuuua

SEQ ID NO: 489867 - RNA, 65 nt, Homo Sapiens
ugugcccaugggcaccccaguucccaggugugggucacugccacccuguacacuucccugacacc

SEQ ID NO: 489868 - RNA, 65 nt, Homo Sapiens
aggcauguguagaaggcaauuuaucaaaccuauugcacugccaugaaaaguguguauaauaauuu

SEQ ID NO: 489869 - RNA, 53 nt, Homo Sapiens
cgaacaguguggccaucugagcacacugccagucucacugugggaaggccagc

SEQ ID NO: 489870 - RNA, 65 nt, Homo Sapiens
gugggcggggaggcuagauuguuuccugguacugucacugccacuggggcuuugauuuggaggaa

SEQ ID NO: 489871 - RNA, 65 nt, Homo Sapiens
ugucacuggcauaggaaggccagccccgcaucucccacugccaacagcugaagccgagcacagac

SEQ ID NO: 489872 - RNA, 65 nt, Homo Sapiens
caacagggcaaagauaccaggccugcugcugaggucacugccacuucucacaugcugcuuaaggg

SEQ ID NO: 489873 - RNA, 65 nt, Homo Sapiens
uuacuacccacuucauuccccaccgcugccagugccacugccaacccuguucacaggcgcuucca

SEQ ID NO: 489874 - RNA, 65 nt, Homo Sapiens
gaaucuucucuauaauaagggaaguucucuuaccccacugccacauaccucuguuuuaaaagaua

SEQ ID NO: 489875 - RNA, 65 nt, Homo Sapiens
aaauaaucuuacucuagauaccuaaaacauaagaucacugccagagauaaacuaaugguccacac

SEQ ID NO: 489876 - RNA, 65 nt, Homo Sapiens
ccuugcuuugggaaacuaaaagauuuagaccaagucacugccaguuuuugccuuuguugcauuuu

SEQ ID NO: 489877 - RNA, 65 nt, Homo Sapiens
acagagagcugauugugaaacaucuacuagcacaccacugccagacaugacugugugugucccug

SEQ ID NO: 489878 - RNA, 65 nt, Homo Sapiens
uggguagaaaacacaagugagaaacccuagaugggcacugccaccugacacagcuauacagcagg

SEQ ID NO: 489879 - RNA, 65 nt, Homo Sapiens
gccccucaagagaagggcugaaccuggggagaugucacugccagggugagguggagccacauggc

SEQ ID NO: 489880 - RNA, 65 nt, Homo Sapiens
cucacacuauaacaagaaaaauuggcacagucacucacugccauucauucucagcagacuccagu

SEQ ID NO: 489881 - RNA, 65 nt, Homo Sapiens
aacuccccagaaguugcacugaaguacccacagaucacugccaucauguaaaauuuguuaagaag

SEQ ID NO: 489882 - RNA, 65 nt, Homo Sapiens
uacugaaugcagaggcucaggaaagcauacuuuuucacugccaggcuccaguacugacuuguggg

SEQ ID NO: 489883 - RNA, 65 nt, Homo Sapiens
agcuuucuacccagggacugccagggcagccuggccacugccauguaugccaaccuccuggcagc

SEQ ID NO: 489884 - RNA, 65 nt, Homo Sapiens
auaguuuauuguguggucauucccgugcuccuccucacugccauuagaucuccccacuacauuaa

SEQ ID NO: 489885 - RNA, 65 nt, Homo Sapiens
aguagguuauuuagcuugggcuguccuuucuagagcacugccaccccaagcacuucuuuuucucg

SEQ ID NO: 489886 - RNA, 65 nt, Homo Sapiens
aaugccccuggcccagugaggcagccucccguccacacugccagcgccacaggaggcagcgcccu

SEQ ID NO: 489887 - RNA, 65 nt, Homo Sapiens
cugagagggagauggcccagccugaccccacuggccacugccauccugcugccuucccagugggg

SEQ ID NO: 489888 - RNA, 65 nt, Homo Sapiens
acagcacagucagcucugcagaguuuggaggggcucacugccacuggguacucagaaccucugug

SEQ ID NO: 489889 - RNA, 65 nt, Homo Sapiens
ccuggaggcaacuguuuugauccauuucuuacacacacugccagagauacucuaggcauguaaag

SEQ ID NO: 489890 - RNA, 65 nt, Homo Sapiens
guuagugugaaauaguucugccaccucugacgcaccacugccaaugcuguacguacugcauuugc

SEQ ID NO: 489891 - RNA, 65 nt, Homo Sapiens
cuccaaucuugguccguauuuccaaagcuuguaaacacugccaucuucaaauuuaaauguaauuu

SEQ ID NO: 489892 - RNA, 65 nt, Homo Sapiens
ucccaaaugggucucuuuagaacuugauggcugggcacugccaucucuagaauugccacgagucu

SEQ ID NO: 489893 - RNA, 65 nt, Homo Sapiens
ccaggaguggccugugccucccaccucuuccuucccacugccaaaggccuguguugagaaagaug

SEQ ID NO: 489894 - RNA, 65 nt, Homo Sapiens
cccucagccccagucgagaggaaagagaaucgggccacugccagaaagagagucaagcaaaccug

SEQ ID NO: 489895 - RNA, 65 nt, Homo Sapiens
ugcggccaggggacgagcgccuuccuugcccaccucacugccacauuccagugggacggccacgg

SEQ ID NO: 489896 - RNA, 65 nt, Homo Sapiens
acgagcuggccuugccaacccucugcuugacuccgcacugccacuuguccccccacacccgucca

SEQ ID NO: 489897 - RNA, 65 nt, Homo Sapiens
agggagugggccauucccugggacucucgcuccugcacugccagccccuucuccucuccccaggg

SEQ ID NO: 489898 - RNA, 65 nt, Homo Sapiens
cugaggcccugucucccagccacuuucccuccuggcacugccaccagccucaccgccugcgggca

SEQ ID NO: 489899 - RNA, 65 nt, Homo Sapiens
agggucugccucucacucgcccaggucccgaaggacacugccacagggacgccuucccuccccuc

SEQ ID NO: 489900 - RNA, 65 nt, Homo Sapiens
ccaauugcuuccccucugugaucucauuucaucugcacugccauacguggagugagcaagacagg

SEQ ID NO: 489901 - RNA, 65 nt, Homo Sapiens
aaagugagcugagcaggacaggcccagccuuucuccacugccacgucccucaugcacaucacuca

SEQ ID NO: 489902 - RNA, 65 nt, Homo Sapiens
caaaagcagucuaucugccugugaccuccaauguacacugccaaacacaagaguaggacacaucu

SEQ ID NO: 489903 - RNA, 65 nt, Homo Sapiens
uaccuagcuaggucaccaacgugaagaaguuaugccacugccacuuuugcuugcccuccuggcug

SEQ ID NO: 489904 - RNA, 65 nt, Homo Sapiens
cacaagcacaaccacgggcauaaguuggccuuggccacugccacccacggcccuccuuuugugcu

SEQ ID NO: 489905 - RNA, 65 nt, Homo Sapiens
auggggauggaguggugagaauugaaugguuaaugcacugccauucauaauugccaauugaggac

SEQ ID NO: 489906 - RNA, 65 nt, Homo Sapiens
uggugggaggcagcgggcagaaauuuacuguuggccacugccaggucuauuucauauuucaaagg

SEQ ID NO: 489907 - RNA, 65 nt, Homo Sapiens
gccacacuagugcugaacguuguggaacccagccacacugccacccaggacacuccgggggagaa

SEQ ID NO: 489908 - RNA, 65 nt, Homo Sapiens
cgacugcugacagcuugggagagagggugugguggcacugccagcgcagcacugugcaugauucc

SEQ ID NO: 489909 - RNA, 64 nt, Homo Sapiens
cuccccauuggcaccgcuucuggcuuucucuggacacugccacuaaggauccacugacuauuga

SEQ ID NO: 489910 - RNA, 65 nt, Homo Sapiens
cucacuuguggccuauuucuauagaccuuuuuugacacugccagucuacuuugaucacuuaacuu

SEQ ID NO: 489911 - RNA, 65 nt, Homo Sapiens
uuaguuauucugaauauacuaaucaauagcaaacccacugccauaguuuuuugaacagugugcua

SEQ ID NO: 489912 - RNA, 65 nt, Homo Sapiens
aagugguagugaugggauuccucacccaaaauuuccacugccagggccucugagagguuaaguca

SEQ ID NO: 489913 - RNA, 65 nt, Homo Sapiens
acccagcugcucaugagugagccagcugccagggccacugccaugcguggccaguaaaugaucca

SEQ ID NO: 489914 - RNA, 65 nt, Homo Sapiens
ucccaagcuucagacugcugccuucuccaaagacgcacugccagguugcugcuguggcuuuuuug

SEQ ID NO: 489915 - RNA, 65 nt, Homo Sapiens
uucagagggguuccuugcugagcagcccugggagccacugccaccaguugugguguccagugugc

SEQ ID NO: 489916 - RNA, 65 nt, Homo Sapiens
ucuuuuuuuuuuuuuuuuuuggggaggggggcgugcacugccaugcagguggugguaccugguug

SEQ ID NO: 489917 - RNA, 65 nt, Homo Sapiens
ugccccuccugggagggccccccggcacugcgccccacugccagcaggaguauuaugucugagcc

SEQ ID NO: 489918 - RNA, 65 nt, Homo Sapiens
agcagcaggugauuggaccacuaacucaccagccccacugccagccacuuuacccaccuagaaca

SEQ ID NO: 489919 - RNA, 65 nt, Homo Sapiens
cucuccaucacccucuuccuuaaccccuuccagaucacugccacauuagagguccucuggagccc

SEQ ID NO: 489920 - RNA, 65 nt, Homo Sapiens
aggcacagccgccuccggaaccuaaggcugugccucacugccaccagcagagcuaggacuuccgc

SEQ ID NO: 489921 - RNA, 65 nt, Homo Sapiens
ccucaagaacaccuuuguuuagggauucuggucuucacugccaugaacagaaguagaagaggagg

SEQ ID NO: 489922 - RNA, 65 nt, Homo Sapiens
aaagucucauuggaacacaguacccaaaucuggcccacugccaaucuaguuuagaguuagcagac

SEQ ID NO: 489923 - RNA, 65 nt, Homo Sapiens
ccaguccugccaccacccuggagagccuugggagccacugccacucagaugcacauguuggagga

SEQ ID NO: 489924 - RNA, 65 nt, Homo Sapiens
gcuugggcugaaggaagcucgaccuuuguccccgucacugccagccccuucuucccugggcuuua

SEQ ID NO: 489925 - RNA, 65 nt, Homo Sapiens
gcgggugggcuaagccgccaaacugccaaucaacacacugccaauaacucaucagcucaguaccu

SEQ ID NO: 489926 - RNA, 65 nt, Homo Sapiens
acacucacauucaauggaaaugcggagccaaccaucacugccauuaaaaaaaaaaaaggcaauug

SEQ ID NO: 489927 - RNA, 65 nt, Homo Sapiens
ccacuugauuuagccauuuucuuccauugugagaccacugccaucuauccaccugcccaccuccc

SEQ ID NO: 489928 - RNA, 65 nt, Homo Sapiens
guggccgccuccugagaguuggcccucccuugugccacugccaggggaggaaaggccuugauguu

SEQ ID NO: 489929 - RNA, 65 nt, Homo Sapiens
gggauggaauauaagucagugugaaacugaguauacacugccauguuacaucaguguccauuggc

SEQ ID NO: 489930 - RNA, 65 nt, Homo Sapiens
gggacugcuuuggcauccagggccuccagucaccucacugccauacauuagaaaugagacaauca

SEQ ID NO: 489931 - RNA, 65 nt, Homo Sapiens
uucugacaaaauuagcuguuuugaauuacccauaucacugccaguuuuauuuuaaaauauuuugu

SEQ ID NO: 489932 - RNA, 65 nt, Homo Sapiens
cacuuuuauuaacaaaaguaaacauggacagaacacacugccauuucugggaagaguaaagauga

SEQ ID NO: 489933 - RNA, 65 nt, Homo Sapiens
aaaaauguuucaaaagaaagguauuuucacuaaaccacugccaguauaaaagcacccugucaagg

SEQ ID NO: 489934 - RNA, 65 nt, Homo Sapiens
ugugagggccuggacgggagaugccagccaucacucacugccaccugggccaucaacugugaauu

SEQ ID NO: 489935 - RNA, 65 nt, Homo Sapiens
cuugccuuagugaucaugauuacacaaaagaggugcacugccaauaaguaucucuaauucaauag

SEQ ID NO: 489936 - RNA, 65 nt, Homo Sapiens
cagccaccagucucuacuaaaagacagaaacaauacacugccaaaauguuaaguugaccaccgug

SEQ ID NO: 489937 - RNA, 65 nt, Homo Sapiens
uauuucuguauuaucugacauagaacaguauccuccacugccaagacagccugaguuuggagugg

SEQ ID NO: 489938 - RNA, 65 nt, Homo Sapiens
uuccuaucccaucgaaauuccccaaagcccugggccacugccauuggguuagucaagaugaagga

SEQ ID NO: 489939 - RNA, 65 nt, Homo Sapiens
guucgcagccacccugaggagucugagguccugagcacugccaggagggacaaaggagccuguga

SEQ ID NO: 489940 - RNA, 65 nt, Homo Sapiens
acauacuaaccuuauacuuucacuuuuuuuuuucucacugccaucaacaacagcuucuucccagu

SEQ ID NO: 489941 - RNA, 65 nt, Homo Sapiens
ugagacuaaaggaaacaaacuuacaccagcgguaacacugccaacagccaggaacagagaagaga

SEQ ID NO: 489942 - RNA, 65 nt, Homo Sapiens
uuuccuuauugaugcaucuuugggucccucuucaacacugccacacccuccucccuguccacagc

SEQ ID NO: 489943 - RNA, 65 nt, Homo Sapiens
cugaaccagagcuggaacacacgguuuaugcugggcacugccagacagucuuuuaucaaguuuug

SEQ ID NO: 489944 - RNA, 65 nt, Homo Sapiens
gcugaaucagagcaugcccacugaaaguuauagggcacugccacuuagcacauggagauaaucau

SEQ ID NO: 489945 - RNA, 65 nt, Homo Sapiens
ugcugccuaggccuggagggaaggaaaaaacuggacacugccaucgaccuccagcuggggguggg

SEQ ID NO: 489946 - RNA, 65 nt, Homo Sapiens
cuaugguuguucgccaccaaaucaucacaggccuccacugccagcaggaugguaccaucgaggac

SEQ ID NO: 489947 - RNA, 65 nt, Homo Sapiens
gggcuccugcuauuaggugaucugguuccuagccucacugccagcgggaggcaagauuucugguu

SEQ ID NO: 489948 - RNA, 65 nt, Homo Sapiens
acagcaccugucauuuugccgcauccggcugcagccacugccaugcacuuuguccauuucccgug

SEQ ID NO: 489949 - RNA, 65 nt, Homo Sapiens
agaaaacaaagcagcugacucucaccuugucccuccacugccaaccaugacuaccccuggcuccu

SEQ ID NO: 489950 - RNA, 65 nt, Homo Sapiens
uuuuaaugagucagagaaaauuaaugugcuuaccacacugccacaccuggauauuguauuguaau

SEQ ID NO: 489951 - RNA, 65 nt, Homo Sapiens
auaaagccaaccagacccuuuuguauaaaaaugaacacugccaaggaguaaaugcaauucaaaaa

SEQ ID NO: 489952 - RNA, 65 nt, Homo Sapiens
acauguggacaaaagugacccuacugaagcagcagcacugccacuaaaagggugugugagaaagc

SEQ ID NO: 489953 - RNA, 65 nt, Homo Sapiens
uuaucuuucuuaacuuuuucgaaagcugaaagaugcacugccauagucaaaaaucccccaaggag

SEQ ID NO: 489954 - RNA, 65 nt, Homo Sapiens
gucuuuugguugccauggucaucccacacgcacugcacugccauuaaggaagauggagcuccccc

SEQ ID NO: 489955 - RNA, 65 nt, Homo Sapiens
uggagacauuccauuucagagggcggaaagggaggcacugccauuuauuggugugguccuaggga

SEQ ID NO: 489956 - RNA, 65 nt, Homo Sapiens
gccagcaguguccuugggaaccugcuaugaaacgacacugccaguaguugucacugcugcucccu

SEQ ID NO: 489957 - RNA, 65 nt, Homo Sapiens
ucagguuguucacagauuuggagagagagcccucccacugccagcgugugugugugugugugugu

SEQ ID NO: 489958 - RNA, 65 nt, Homo Sapiens
ccccuucugugugucccucugggccaaggcccacccacugccaucguggccuggcuggcguggca

SEQ ID NO: 489959 - RNA, 65 nt, Homo Sapiens
ucaggcacaugcuuagcuguagaggaaugcugcugcacugccaacugcucuggagagguagggcc

SEQ ID NO: 489960 - RNA, 65 nt, Homo Sapiens
ugaacaacacaaccggaagcgggauuccaagcuggcacugccacuguggagggcgcugaaacuuc

SEQ ID NO: 489961 - RNA, 65 nt, Homo Sapiens
cccagcguggcugcuuucaaguggguucuccacuccacugccaccaauacugaggggagggugug

SEQ ID NO: 489962 - RNA, 65 nt, Homo Sapiens
uccuccugggcaacagaguggagccaaguucacaccacugccauucagaagcucaaggcugcagu

SEQ ID NO: 489963 - RNA, 65 nt, Homo Sapiens
ccucucaagguggacuauucuguuuucugccaggacacugccauucaugcauugucagauauuua

SEQ ID NO: 489964 - RNA, 65 nt, Homo Sapiens
uugucugcacauaacucuuuuuucacaagaagggucacugccacaacagcacagucagcggguga

SEQ ID NO: 489965 - RNA, 65 nt, Homo Sapiens
cucugagcccucccaacacagcacacuagucagcccacugccacgaccucccugccagccagaag

SEQ ID NO: 489966 - RNA, 65 nt, Homo Sapiens
acuuugccccuuucaguauguccccauaagacaaacacugccauauuguguaauuuaagugacac

SEQ ID NO: 489967 - RNA, 65 nt, Homo Sapiens
ugucaucccucacgucucuguggccacccgggugucacugccagcaccaggcacugcuuucacgu

SEQ ID NO: 489968 - RNA, 65 nt, Homo Sapiens
gcugagcagagagggagccguucaugucagagacucacugccagaaaagccuuacccauuuuggu

SEQ ID NO: 489969 - RNA, 65 nt, Homo Sapiens
gaaggaacucaaagacucaagugggaacgacugggcacugccaccaccagaaagcuguucgacga

SEQ ID NO: 489970 - RNA, 65 nt, Homo Sapiens
agaaagguuacugauaugacaaagagggucugcaucacugccaucaacaagauuugcuuggacag

SEQ ID NO: 489971 - RNA, 65 nt, Homo Sapiens
auuccacauuuggugaaauuaguuuaagacuuuuacacugccagugauuuguuagcuuuaaaguu

SEQ ID NO: 489972 - RNA, 65 nt, Homo Sapiens
uaaccagaggggccugggaaguacgugcacaaaaccacugccagagugaacugcuaauaguguaa

SEQ ID NO: 489973 - RNA, 65 nt, Homo Sapiens
acggagugugagaccaucugcugcggagccugcuccacugccacccccguggccauccgcuguga

SEQ ID NO: 489974 - RNA, 65 nt, Homo Sapiens
accuuucauguuauccaugauacugccuguuuuuacacugccauuuaugcuacuauacauugauu

SEQ ID NO: 489975 - RNA, 65 nt, Homo Sapiens
uaaugccauuucaaggaaggaauccguaauccauacacugccagauugcuauaugcacuggguau

SEQ ID NO: 489976 - RNA, 65 nt, Homo Sapiens
uaccuauuuaaauucauccuaaggauguaguucuacacugccauuuaaagguguaauugacuagg

SEQ ID NO: 489977 - RNA, 65 nt, Homo Sapiens
ucagcaguugacauccaaaucuagccagagcccuucacugccaugauagcuggggcuucaccagu

SEQ ID NO: 489978 - RNA, 65 nt, Homo Sapiens
ugcugggauuacaggcguaagccacugcgcccagccacugccaucaucuuuaggaagagagaagu

SEQ ID NO: 489979 - RNA, 65 nt, Homo Sapiens
guccagccuggagaugaaaucuuacagcuggguggcacugccaugcagggccucacacgguuuga

SEQ ID NO: 489980 - RNA, 65 nt, Homo Sapiens
agcagcugucuggcccuugcugggugagggcacaccacugccaggggucagccucgcacccaggc

SEQ ID NO: 489981 - RNA, 65 nt, Homo Sapiens
ugguuuucaggaugcugacagcugcaagcaacaggcacugccaaauucagggaacagugguggcc

SEQ ID NO: 489982 - RNA, 65 nt, Homo Sapiens
acuggcggccugggaccagcccugagguacagagccacugccaccuuggaggccccaggauuggu

SEQ ID NO: 489983 - RNA, 65 nt, Homo Sapiens
ccugcccugaaacuccagaucuuuagcagccucagcacugccaggaaauaagccugagagaccau

SEQ ID NO: 489984 - RNA, 65 nt, Homo Sapiens
gccugucuuacccgguggccaaggagcaaagggugcacugccagccacagcuacaugggcagcug

SEQ ID NO: 489985 - RNA, 65 nt, Homo Sapiens
acuccugcuguuaggagcugaugcucccucuaccucacugccaccugccagagacgaguaugccc

SEQ ID NO: 489986 - RNA, 65 nt, Homo Sapiens
aguucuugcuccuggcugcaaauuaauucucaaaucacugccagguaaaacacuagccaaacucu

SEQ ID NO: 489987 - RNA, 65 nt, Homo Sapiens
acugggguggcagccugccacacaggcacuguggccacugccagcauccugggcucacugccccc

SEQ ID NO: 489988 - RNA, 65 nt, Homo Sapiens
ugaacaaacuaugcaauaccuauguguguguguaccacugccauccuccaggccacuugugugug

SEQ ID NO: 489989 - RNA, 65 nt, Homo Sapiens
cuguguucagaaagacuaugauggacaaugcuggccacugccauuaaacaagcggaacauagaua

SEQ ID NO: 489990 - RNA, 65 nt, Homo Sapiens
cauccuuucccuccuggccugcuuuggggcugcggcacugccacacagggaggcgccccgggugg

SEQ ID NO: 489991 - RNA, 65 nt, Homo Sapiens
ugggccagcuucuggagcauccuccauagggaacccacugccaccguguugugaaugaugagcug

SEQ ID NO: 489992 - RNA, 65 nt, Homo Sapiens
ggucugagccuaccugagcccaugcagccuggggccacugccaagucaggcccugguucucuucu

SEQ ID NO: 489993 - RNA, 65 nt, Homo Sapiens
caccccguucugcucccacaaggccccccuacagucacugccacacugguggggaccugggaccc

SEQ ID NO: 489994 - RNA, 65 nt, Homo Sapiens
cucuuccaaagccccaaagccgaggguuucacccacacugccagccuggguuggggcccaaggau

SEQ ID NO: 489995 - RNA, 65 nt, Homo Sapiens
agagaaaaugccugcuuucuuucccucuuuuucugcacugccauauucacccccaaccauccaau

SEQ ID NO: 489996 - RNA, 65 nt, Homo Sapiens
gucugugaaugcuaaguccaucacccuuuccggcacacugccaaauaaacagcuauuuaaggggg

SEQ ID NO: 489997 - RNA, 65 nt, Homo Sapiens
ugaccugugaaccccagccucaccaucacccccagcacugccagggacugcccugucugcugugc

SEQ ID NO: 489998 - RNA, 65 nt, Homo Sapiens
ccuguggcugucacccuuggucaccuccgugcugucacugccaucuccccccugaccccucuaac

SEQ ID NO: 489999 - RNA, 65 nt, Homo Sapiens
uccagccaaugccuguuuacacagacaccuggccucacugccagcccaccuccccuacagcccug

SEQ ID NO: 490000 - RNA, 65 nt, Homo Sapiens
uuaccucuucugcaggcucugccaugcacgcaccucacugccaggccauuaaaaucagcacccag

SEQ ID NO: 490001 - RNA, 65 nt, Homo Sapiens
ucccugagcugcaccucuugcuaaccccaccaucacacugccacccugcccuagggucucacuag

SEQ ID NO: 490002 - RNA, 65 nt, Homo Sapiens
cauguaucacauucauauauauuguuucuuggccccacugccaaaggaagucagucaguaauuuc

SEQ ID NO: 490003 - RNA, 65 nt, Homo Sapiens
uucaucgucaggccacgugugacuucuguucuuagcacugccagggucauugacuuccaucuaag

SEQ ID NO: 490004 - RNA, 65 nt, Homo Sapiens
ucccuugccaaguugguagcagugacccagugauucacugccaucccaggccuuaacuagcaaaa

SEQ ID NO: 490005 - RNA, 65 nt, Homo Sapiens
ccagagacuguguguuuuguuucccccaccaccaucacugccaccuggcuucugccauguggcag

SEQ ID NO: 490006 - RNA, 65 nt, Homo Sapiens
cucuuacacugaauguacaggcagugggcuugcagcacugccaucuugccauguacaggcuuggg

SEQ ID NO: 490007 - RNA, 65 nt, Homo Sapiens
ucucuuuauugaguucgaggacuacaaccaauuuacacugccaucugaugccgugauccugagcc

SEQ ID NO: 490008 - RNA, 65 nt, Homo Sapiens
ccugagaucacaugcuaaagucgaugaaaaguaaccacugccacugucuugugucagaacuuuua

SEQ ID NO: 490009 - RNA, 65 nt, Homo Sapiens
gcgggcgcucgcuccucccuccaugccccagaugccacugccacacggcccucaccgccucgaag

SEQ ID NO: 490010 - RNA, 65 nt, Homo Sapiens
gagucucccuccuccuggggccgggagggcugccgcacugccaaacugccgagaagcccgugccc

SEQ ID NO: 490011 - RNA, 65 nt, Homo Sapiens
uaaagagcauuagaagaggugucauuuauaggaagcacugccaguaaucaucucuauugcuuggu

SEQ ID NO: 490012 - RNA, 65 nt, Homo Sapiens
cucaguccaugucaccccacggcugaaguuguccccacugccauaccauccacggagugagcugg

SEQ ID NO: 490013 - RNA, 65 nt, Homo Sapiens
gugccagacagcucccugcacccuaggccagacuucacugccacuaguggauggaauccuugguc

SEQ ID NO: 490014 - RNA, 65 nt, Homo Sapiens
guauuuuuuucacuguuucaccaaaauuuguuugucacugccaaacaaacacaagaaaucaaaau

SEQ ID NO: 490015 - RNA, 65 nt, Homo Sapiens
cacgccagacuucccacggcuccucgagaucccaacacugccagcauuucccuuccuuccucucc

SEQ ID NO: 490016 - RNA, 65 nt, Homo Sapiens
acucugcuccccucucacacaucugggaguagccccacugccaccugcagccgcagccuggacug

SEQ ID NO: 490017 - RNA, 65 nt, Homo Sapiens
ugugggcccugggugggagcagcccacuucagcagcacugccacugccuuuggccaccugaggug

SEQ ID NO: 490018 - RNA, 65 nt, Homo Sapiens
auggcuggcagggucuuccaaguaccuuccucccacacugccaaguauacacaacuucccaguaa

SEQ ID NO: 490019 - RNA, 65 nt, Homo Sapiens
ccucaauuuagccuuagugaaggagggguuguacacacugccauuuuuguauuuuaaaggaaaaa

SEQ ID NO: 490020 - RNA, 50 nt, Homo Sapiens
uuuaugccuacuucgccugacacugccauccuggacagaaaggcaggagc

SEQ ID NO: 490021 - RNA, 65 nt, Homo Sapiens
cuguugcccacugcacugaucaugaagccaccggccacugccacgcauguugcaccugugccauc

SEQ ID NO: 490022 - RNA, 65 nt, Homo Sapiens
agugauaaaacacuguggugugaaagugucaucuucacugccaaucaggcaaagaccggaaagau

SEQ ID NO: 490023 - RNA, 65 nt, Homo Sapiens
ccccccaggccuccagaaccuuacuggcacuguggcacugccaccagcaaugcccugccuugcug

SEQ ID NO: 490024 - RNA, 65 nt, Homo Sapiens
aagcacuaggccuacugcccagcaagccagucuggcacugccaggaccuccuguggcacccuuca

SEQ ID NO: 490025 - RNA, 65 nt, Homo Sapiens
acuugauacuaagugauuaguuuuccaaguugucccacugccauucaaagucagcccuugagugu

SEQ ID NO: 490026 - RNA, 65 nt, Homo Sapiens
cuuuggcauuuaauguuccucuccuggcaaaaauucacugccacagacaaaccacccccacuccu

SEQ ID NO: 490027 - RNA, 65 nt, Homo Sapiens
gugacaccguucccuccaaaagcagaccucggaaucacugccaaauaaguaacuagacguuuaca

SEQ ID NO: 490028 - RNA, 65 nt, Homo Sapiens
cuucaccugcucuaggccagcccugucaccaccuccacugccaugaccaggccgaaggcagggaa

SEQ ID NO: 490029 - RNA, 65 nt, Homo Sapiens
agccccgccugccucagcgggucaggccuucagaacacugccacccacccaguuuuauaaucccg

SEQ ID NO: 490030 - RNA, 65 nt, Homo Sapiens
guccuccaggaccugggaagcacuccacagccaagcacugccacgcuugccuuagauuuuacaca

SEQ ID NO: 490031 - RNA, 65 nt, Homo Sapiens
uguccaccaaggaacagaauggcgucagcacccagcacugccacaacucuccgcugaggacccag

SEQ ID NO: 490032 - RNA, 65 nt, Homo Sapiens
cuuccugugcccucaccccauaaaccaaacccagccacugccaagaaaugauucucuaccaacaa

SEQ ID NO: 490033 - RNA, 65 nt, Homo Sapiens
ggcaagaucauggcuuuuggugcccuagcagcaaucacugccaagguuuuuggggccaagauggc

SEQ ID NO: 490034 - RNA, 65 nt, Homo Sapiens
guguguaugggacuugcugggguggggguacuagucacugccaauacugcccccccugaauuuag

SEQ ID NO: 490035 - RNA, 65 nt, Homo Sapiens
aguuccccaggccucuuccgcuacaccugaaguuacacugccagccuaagccagacccggcuccc

SEQ ID NO: 490036 - RNA, 65 nt, Homo Sapiens
uucaucagguuugugucucaccuuuaccccacuuucacugccacuccaccuccuccucuuccucu

SEQ ID NO: 490037 - RNA, 65 nt, Homo Sapiens
uugccaguuucugcccagcaacuggugccagggagcacugccagcuuggggccugcgcccgugaa

SEQ ID NO: 490038 - RNA, 65 nt, Homo Sapiens
uguauaaagcaccugcaugcccugccaucacaucucacugccagauggaacuguccaagaacgaa

SEQ ID NO: 490039 - RNA, 65 nt, Homo Sapiens
gauggggguugagccucugggaagaagccucuggacacugccagaugcaacacugaagacagaaa

SEQ ID NO: 490040 - RNA, 65 nt, Homo Sapiens
cccgaacacuauccaugcuauccccaggccuacaccacugccauguggaugagaaacugaaggug

SEQ ID NO: 490041 - RNA, 65 nt, Homo Sapiens
aaucuguguaugugccauuguccccagucccacaacacugccaaauggagcugggguuucucucc

SEQ ID NO: 490042 - RNA, 65 nt, Homo Sapiens
gaggugggcauucauggggucagcacagaggcgugcacugccagggcaggcccuaagucuggcuu

SEQ ID NO: 490043 - RNA, 65 nt, Homo Sapiens
cgucugacccucuccaccccuuaaccccaguaagccacugccacagccccugggacugcugcuuc

SEQ ID NO: 490044 - RNA, 65 nt, Homo Sapiens
gccaaaccgccccucagcagccuuuccuuggcccucacugccagugucuaugggcccacccagug

SEQ ID NO: 490045 - RNA, 65 nt, Homo Sapiens
guagcucaaccaagcaguuguggggcacaaccugccacugccacaggcuccugagcccacccccu

SEQ ID NO: 490046 - RNA, 65 nt, Homo Sapiens
uuccaugggacuuagaacuuacaguccagcccaaccacugccacuggcccggugauccuccagcc

SEQ ID NO: 490047 - RNA, 65 nt, Homo Sapiens
ccacccccuuugacucugggcaccuaaccccagggcacugccagcuuaaccucagggagugcaga

SEQ ID NO: 490048 - RNA, 65 nt, Homo Sapiens
ccuccuccucugguagagcacucuugcgaugcugacacugccaaccuccaguauccucacccucg

SEQ ID NO: 490049 - RNA, 65 nt, Homo Sapiens
guacaggcagaagcuuuggccagcaccgucacucucacugccauugccgagaguccuguuauuga

SEQ ID NO: 490050 - RNA, 65 nt, Homo Sapiens
uuucuuuccagaacaacucuuucccaccccaacaccacugccaccaccccucuuuuuauccuggu

SEQ ID NO: 490051 - RNA, 65 nt, Homo Sapiens
cagcccucuuccauccgcccggcucugcccaccaccacugccaggcugaacaggggacuagugcc

SEQ ID NO: 490052 - RNA, 65 nt, Homo Sapiens
augcugcucacuuaugucauacuuugccacaguaccacugccaccggaagagccuugugcucucc

SEQ ID NO: 490053 - RNA, 65 nt, Homo Sapiens
uuugacaaaacagguuuguugugcugccuucuuuacacugccaguagacgauucauacacuucca

SEQ ID NO: 490054 - RNA, 65 nt, Homo Sapiens
gaggcacacagcugcagagaugcgcuuuugcuggucacugccaugcgccguggcugcggcacccu

SEQ ID NO: 490055 - RNA, 65 nt, Homo Sapiens
aaaacaaaacaaaaacaaaacaaaacaaaacaaaacacugccaaacuguuuccaaagcaucugca

SEQ ID NO: 490056 - RNA, 65 nt, Homo Sapiens
gaccugaccaagcuguaggccuccacuggccccaucacugccaacugcagggggccccucgggcc

SEQ ID NO: 490057 - RNA, 65 nt, Homo Sapiens
cugcugcccuucgauccuuccacacauggccaggacacugccacaauccucgggguguggucaag

SEQ ID NO: 490058 - RNA, 65 nt, Homo Sapiens
uccaccugguacucccucucaggauccaagcuaagcacugccacuggggaaaacuccaccuuccc

SEQ ID NO: 490059 - RNA, 65 nt, Homo Sapiens
uggcuccuccgucugacccucugcggccacugcgccacugccaucggacaggaggauuccuugug

SEQ ID NO: 490060 - RNA, 65 nt, Homo Sapiens
aaaagcagcccagucccccucacugcuugagcuaacacugccaccucuuuugugugagcacaaaa

SEQ ID NO: 490061 - RNA, 65 nt, Homo Sapiens
ccucacauguuuccugggcaccuaacucugucagccacugccagggaccaaggauccagcaucca

SEQ ID NO: 490062 - RNA, 65 nt, Homo Sapiens
ugauuccccucccgccccgcacagagaccccgacucacugccagccggggcggggcagggugccg

SEQ ID NO: 490063 - RNA, 65 nt, Homo Sapiens
uuuguaacugucuagagcucuugauggaauuauaucacugccagugccuguggcggaagccaucu

SEQ ID NO: 490064 - RNA, 65 nt, Homo Sapiens
ucuaaaccugcccagggaccuuaccagauucgugucacugccaguuucugcggcugaagccuuuu

SEQ ID NO: 490065 - RNA, 65 nt, Homo Sapiens
uucuaaucugccgaggccuauagccugauuuaugucacugccaauuucugaggcugaagccauuu

SEQ ID NO: 490066 - RNA, 65 nt, Homo Sapiens
ggaaguggcuuagagaauguaacugaccaaagucacacugccaggaacuggaagcacuaggauuu

SEQ ID NO: 490067 - RNA, 65 nt, Homo Sapiens
gacaggugggguccuaaugagagccaacacaugcucacugccagcuccuguccugaguacuggga

SEQ ID NO: 490068 - RNA, 65 nt, Homo Sapiens
cggccccccugccucgguuugcugccagaaugcuccacugccagcucgggacuuggucgcccggc

SEQ ID NO: 490069 - RNA, 65 nt, Homo Sapiens
cccccuuuucccccaugguccugcaucgcagaggccacugccagcuuggucaucucugacaucuc

SEQ ID NO: 490070 - RNA, 65 nt, Homo Sapiens
ugcggccugggcaccgcgggcugcucggaagagcucacugccagccggccaccccggcccugugc

SEQ ID NO: 490071 - RNA, 65 nt, Homo Sapiens
agccuccccugcuggggaccucacuugccgggcuucacugccaggcaugugacuuaccugggauu

SEQ ID NO: 490072 - RNA, 65 nt, Homo Sapiens
gcucaagaucccacacccgaaggaaguaccaucaucacugccagagggcuugaggggcugacaac

SEQ ID NO: 490073 - RNA, 65 nt, Homo Sapiens
augagaccaaagugugugaccucauuguaaguugccacugccaacccagugcucagaccuuuaga

SEQ ID NO: 490074 - RNA, 65 nt, Homo Sapiens
ucccucugccccagccccacugcuggggaagggcccacugccaacugggacauguuccauagccu

SEQ ID NO: 490075 - RNA, 65 nt, Homo Sapiens
ucuguaagaaaaacaguuucgcguuauuuauucuacacugccacuccucacacucucugucccuc

SEQ ID NO: 490076 - RNA, 65 nt, Homo Sapiens
ccuccccaggcacaccacucggcauggcacagcaccacugccaggugacuggcaggacaaggucu

SEQ ID NO: 490077 - RNA, 65 nt, Homo Sapiens
caucagggccacucgggcucccacuagacacaggucacugccaaggauaaugucccagagucccc

SEQ ID NO: 490078 - RNA, 65 nt, Homo Sapiens
gcuguacucaccuccaucaccccacacgcugcguucacugccaauaagcuaagggcugcccucug

SEQ ID NO: 490079 - RNA, 65 nt, Homo Sapiens
ugcaaggaaccagcaaagacggcuggggucccccccacugccagccaggccuaggccugggccug

SEQ ID NO: 490080 - RNA, 65 nt, Homo Sapiens
gauaaugucagccugcagcaagcaaaagacagggacacugccaucgccugugggagggcuagggg

SEQ ID NO: 490081 - RNA, 65 nt, Homo Sapiens
augguacagcuucuggagcacguggggugagggaucacugccaaacagacaggcuaaaaugugaa

SEQ ID NO: 490082 - RNA, 65 nt, Homo Sapiens
gucaggaggugcuuucuaaacagaaaaauaaaugucacugccaacuguauauaacuccccucccc

SEQ ID NO: 490083 - RNA, 65 nt, Homo Sapiens
uucgcuccacucagcccccucggauuccccaagggcacugccagcacugcuccuggaguucucau

SEQ ID NO: 490084 - RNA, 65 nt, Homo Sapiens
cuugcagucucccagauguuucagaagcauucaggcacugccaggcucagcuaacauuccauguu

SEQ ID NO: 490085 - RNA, 65 nt, Homo Sapiens
gacguccacccugcagccaggacugggguucacgucacugccagagcuacacucgccuucugcuu

SEQ ID NO: 490086 - RNA, 65 nt, Homo Sapiens
gcugaaucucccuccaacccuucuugccuacuccucacugccagcugggaccuaggcucaguccu

SEQ ID NO: 490087 - RNA, 65 nt, Homo Sapiens
uugguucccuuucauacagaggguuuucuauggaucacugccaaacauugggaucaucuccucug

SEQ ID NO: 490088 - RNA, 65 nt, Homo Sapiens
caugauagcguucuggugagcugggaaggacccaccacugccacugaggauuguuuuggaagaaa

SEQ ID NO: 490089 - RNA, 65 nt, Homo Sapiens
uugucuccucacuaggucauuuggaucaucuuuuacacugccauccauuaugacugaugguguac

SEQ ID NO: 490090 - RNA, 65 nt, Homo Sapiens
agugccuaagcgggggugaaagaggacguguuacccacugccaugcaccaggacuggcuguguaa

SEQ ID NO: 490091 - RNA, 65 nt, Homo Sapiens
ucaccauggcccccucaucauagcaauaacauucccacugccagggguucuugagccagccaggc

SEQ ID NO: 490092 - RNA, 65 nt, Homo Sapiens
aaaaggauggaaguuaagacucagagucucauuaccacugccaaugugguuuuagcaggggaggg

SEQ ID NO: 490093 - RNA, 65 nt, Homo Sapiens
gaagggcccgagaacauggccuaagggccacaucccacugccacccuugacgcccugcucuggau

SEQ ID NO: 490094 - RNA, 65 nt, Homo Sapiens
ccccagcuccagcaggaaggaccccacauccuucucacugccauggaauucccuccugagugccc

SEQ ID NO: 490095 - RNA, 65 nt, Homo Sapiens
aaguacuucauucgagaugaguuucugaggaucagcacugccaguggagaugggcgucacuacug

SEQ ID NO: 490096 - RNA, 65 nt, Homo Sapiens
uucuuaauuacaguuuaccuauuucugacaugcagcacugccaucucuuccagcaccaucagggu

SEQ ID NO: 490097 - RNA, 65 nt, Homo Sapiens
uggcuucugugcauccacccaggcccccgacccaucacugccacauucuccgggucauggccgag

SEQ ID NO: 490098 - RNA, 65 nt, Homo Sapiens
aguuaaacaaccagauugcaaccugaccaauuucacacugccaaccucuaguguaauaacuccca

SEQ ID NO: 490099 - RNA, 65 nt, Homo Sapiens
gccucagaagggagccacuguagcugcugugagcccacugccacuugugcacugugguuccagug

SEQ ID NO: 490100 - RNA, 65 nt, Homo Sapiens
uaugucuacguggauuuuuggaggacagacguucacacugccacggaagugaggagaaggaaggg

SEQ ID NO: 490101 - RNA, 65 nt, Homo Sapiens
cagggucugcaaggucuuugguacacagcucuagacacugccacaucuuugguagaaaaggcuag

SEQ ID NO: 490102 - RNA, 65 nt, Homo Sapiens
cgagcuucccacccuuccuacccaguacucugcaccacugccauagaggaaggccucuguaucac

SEQ ID NO: 490103 - RNA, 65 nt, Homo Sapiens
aauagaaagugaccaugaaaauaacauguaucacucacugccaaaccaauugcugccaauagugg

SEQ ID NO: 490104 - RNA, 65 nt, Homo Sapiens
gucuuccagagucacacccagaggccuuggccgggcacugccaguccucaacuuccauccugcgg

SEQ ID NO: 490105 - RNA, 65 nt, Homo Sapiens
uggcccucuguagggcguuuaacuggaaauacccucacugccaaguggagacuggggcgugugcc

SEQ ID NO: 490106 - RNA, 65 nt, Homo Sapiens
gugccugcugagccuuuuccuuccacgccgccucucacugccaggccagcggcuuccgcugagac

SEQ ID NO: 490107 - RNA, 65 nt, Homo Sapiens
augcaacugaucccgcuuuuggauuuugucuccugcacugccaaucuauaccucaaaguagcugc

SEQ ID NO: 490108 - RNA, 65 nt, Homo Sapiens
uuuuagugggugagaaauuuagagaauagcaguuucacugccaacgaauuuagcuuauacaauuc

SEQ ID NO: 490109 - RNA, 65 nt, Homo Sapiens
cacccacaggaagggacuggugggcuccccgcugucacugccaguggcaaauguccccaagugag

SEQ ID NO: 490110 - RNA, 65 nt, Homo Sapiens
uuuucaccugggccuggccucaccccauacucugucacugccacacuuccucucuccgugguucu

SEQ ID NO: 490111 - RNA, 65 nt, Homo Sapiens
cucuuuggggcacccucucucagccaggcuuggcccacugccaucacccagcaccccagaucacc

SEQ ID NO: 490112 - RNA, 65 nt, Homo Sapiens
uaagcuaauuauuuaaaauaaauacauguaaaggccacugccacauucucagcagacuuccacuu

SEQ ID NO: 490113 - RNA, 65 nt, Homo Sapiens
guggcgccucaucugcaucucugccucaccccauccacugccacaggcugccugaugaccacuag

SEQ ID NO: 490114 - RNA, 65 nt, Homo Sapiens
ccggaacaaaagcggaagaggggccagccucaucccacugccagcugacccucaguuccucaaac

SEQ ID NO: 490115 - RNA, 65 nt, Homo Sapiens
ccgggcccaugccccaaggagcccuucagagcccacacugccagucgaggccuggcuggaggcug

SEQ ID NO: 490116 - RNA, 65 nt, Homo Sapiens
uggcaggggaacaggaaauguggccgccucugccccacugccagccugagugggcaaggaagcag

SEQ ID NO: 490117 - RNA, 65 nt, Homo Sapiens
ucucaugggauggacccugcuguuaaagggcccuccacugccaccuccuuggucucuccgguugg

SEQ ID NO: 490118 - RNA, 65 nt, Homo Sapiens
uuucuucugcccaccaaaauagauuaguuagaauucacugccaggcgugauuugucuuuucaugc

SEQ ID NO: 490119 - RNA, 65 nt, Homo Sapiens
cuccucucccugcaguaggcuccagcccaggccagcacugccagcgcaacuguuauggcaguggg

SEQ ID NO: 490120 - RNA, 65 nt, Homo Sapiens
agcaaggauaaacauguccaauuuguauccccuuacacugccaccacaaaaugguuuccggaaau

SEQ ID NO: 490121 - RNA, 65 nt, Homo Sapiens
gccuguaugguacuguuuuguuuguuaauaaagugcacugccacccccaaugcagacucgacucc

SEQ ID NO: 490122 - RNA, 65 nt, Homo Sapiens
aguaccaguauaagcaucucccaucugcuuuucuccacugccauguguccuggucaagccccccu

SEQ ID NO: 490123 - RNA, 65 nt, Homo Sapiens
cccuccuacgaggcuuauccuggcaaugggguagucacugccacccuuccacacacacacacaca

SEQ ID NO: 490124 - RNA, 65 nt, Homo Sapiens
gaacauucccagugccccuggcuaggggcagagggcacugccaggcuguguucaguuagcacagc

SEQ ID NO: 490125 - RNA, 65 nt, Homo Sapiens
uccaaaauuugaaaaagaagcuauauccaguguuucacugccaaacagauucacuacucuuacug

SEQ ID NO: 490126 - RNA, 65 nt, Homo Sapiens
ugaggaaacucauacagucucuauuugauuugcaacacugccaaacaucagucaauugcuugagc

SEQ ID NO: 490127 - RNA, 65 nt, Homo Sapiens
augggcuugggagggggcucccuaaagccaguggacacugccagagucuaccuuccuggcaagag

SEQ ID NO: 490128 - RNA, 65 nt, Homo Sapiens
aacccagccccugcggccgucaccccgccagccuacacugccagccgccaccggggcacacgggc

SEQ ID NO: 490129 - RNA, 65 nt, Homo Sapiens
gaggugacgaugaacuauguuaaucuggcacuuugcacugccacaaaucuuuuuuuucuugaauu

SEQ ID NO: 490130 - RNA, 65 nt, Homo Sapiens
uaauaaaccuuugcaaacguuuccccucuaucagucacugccagucauguacuccccucauccga

SEQ ID NO: 490131 - RNA, 56 nt, Homo Sapiens
augggagcuacuucucgguuggaagccacugccaccgcuaucagcaguaccacuga

SEQ ID NO: 490132 - RNA, 65 nt, Homo Sapiens
ugaucuguuauagguccuuuucccaaaagcuagaacacugccaacacccccaaucugcccccaac

SEQ ID NO: 490133 - RNA, 65 nt, Homo Sapiens
accaccaaccacgaccaccaaacccuuacagacaccacugccaccagagccggcuuuaagucccc

SEQ ID NO: 490134 - RNA, 65 nt, Homo Sapiens
caguaaccuccaggagaaaauagaaauuaugcugucacugccaaaagcagaagaauaauguaguu

SEQ ID NO: 490135 - RNA, 65 nt, Homo Sapiens
gcaaucuuauaaauggaguucuaauaugugccaggcacugccacuaaccaguauuuauugagcac

SEQ ID NO: 490136 - RNA, 65 nt, Homo Sapiens
ugcagaagccuggcgggcuccuuacacuugcucgacacugccacccuucuccuucccacagacau

SEQ ID NO: 490137 - RNA, 65 nt, Homo Sapiens
ugcugcauuuguuguguuuuccucccugcaggccgcacugccaaccugggcagcgccugugcaga

SEQ ID NO: 490138 - RNA, 65 nt, Homo Sapiens
gcagcaucuucucuguguacacggaaucccucccucacugccagagauggcugccugcagcuucc

SEQ ID NO: 490139 - RNA, 65 nt, Homo Sapiens
cgcccaggcuggagugcaguggcgcaaugucagcucacugccaccuccgccucccggguucaagc

SEQ ID NO: 490140 - RNA, 65 nt, Homo Sapiens
ucccaaucuugcaguccuaacucaggcaaauugugcacugccagaggggcccuggguucugccau

SEQ ID NO: 490141 - RNA, 65 nt, Homo Sapiens
agacccagcaaggaguugccugggugcuggcuggucacugccagaggccugggcugcaugaggac

SEQ ID NO: 490142 - RNA, 65 nt, Homo Sapiens
uuuugauauccucucuccuauuaucuauaauuuuucacugccaauccucagaaggagcuuuuugc

SEQ ID NO: 490143 - RNA, 64 nt, Homo Sapiens
acuaguuaauuuugaguaauuguauugucagaaaagugauuaguacuauuuuuuuuuguuguuu

SEQ ID NO: 490144 - RNA, 64 nt, Homo Sapiens
uucauuuuggauauucuccuguuuuuauuaaaccagugauuacaccuggccaucccucuaaaug

SEQ ID NO: 490145 - RNA, 64 nt, Homo Sapiens
ggugccuggagccuguguccugcccugcuacaguagugauuaauagugucaugguagcuaaagg

SEQ ID NO: 490146 - RNA, 64 nt, Homo Sapiens
gagggacacuuccccagaauccgcauguuuccccagugauuacacuccacugccaccguggugc

SEQ ID NO: 490147 - RNA, 64 nt, Homo Sapiens; identical to SEQ ID NO: 217662

SEQ ID NO: 490148 - RNA, 64 nt, Homo Sapiens; identical to SEQ ID NO: 217663

SEQ ID NO: 490149 - RNA, 64 nt, Homo Sapiens
ucuaauuauuccauugagucaguuuuuugugauuagugauuaucagagcaaacaucauguagau

SEQ ID NO: 490150 - RNA, 64 nt, Homo Sapiens
gcuaacccaaaauguuauuuguaaucaaauguguagugauuacacuugaauuguguacuuagug

SEQ ID NO: 490151 - RNA, 64 nt, Homo Sapiens
caaggugauggcauuaagaagugggccuuugggaagugauuagaucaggagugcagagcccuca

SEQ ID NO: 490152 - RNA, 64 nt, Homo Sapiens
cugaccagcuuaguucuaauaauuuuuaguugugagugauuaaaaaacuuuggaucaauuuugg

SEQ ID NO: 490153 - RNA, 64 nt, Homo Sapiens
acccuuuccaaugcaucuucuacccugcuaccucagugauuauucuaaaauaaauauauaugau

SEQ ID NO: 490154 - RNA, 64 nt, Homo Sapiens
gcuuaggaguucagaguuccuucaucaucgaaauagugauuaagugaucccagaacaaggaaua

SEQ ID NO: 490155 - RNA, 64 nt, Homo Sapiens
auauacuuguacauacaauggaaaugcuuuuaguagugauuauuuagcaauuuuuguuuuuguu

SEQ ID NO: 490156 - RNA, 64 nt, Homo Sapiens
ggcuauugagaguuuuacaggaaaugauccuaccagugauuagucccaaucauguguuuuuguu

SEQ ID NO: 490157 - RNA, 64 nt, Homo Sapiens
agacucuuuguggacgaguguaguuccucacauuagugauuagcugcccauaggccaacaacca

SEQ ID NO: 490158 - RNA, 64 nt, Homo Sapiens
uuuagucugcacagugagcauuacuauuuaaacaagugauuaaacauaaaagauuguauuuuua

SEQ ID NO: 490159 - RNA, 64 nt, Homo Sapiens; identical to SEQ ID NO: 217664

SEQ ID NO: 490160 - RNA, 64 nt, Homo Sapiens; identical to SEQ ID NO: 217665

SEQ ID NO: 490161 - RNA, 64 nt, Homo Sapiens
uagaaucuguauuauuccuuucagcaaauacugcagugauuaguaaccgauagaaaaguaacca

SEQ ID NO: 490162 - RNA, 64 nt, Homo Sapiens
uaaaagcaacgcaagaaaaaggaagggcuggggaagugauuaaauuauccucaaaaaaggcgau

SEQ ID NO: 490163 - RNA, 64 nt, Homo Sapiens
auugaggaaaaagucaaaauuacagcaaaaccucagugauuacauggugaaaggaaauagcagu

SEQ ID NO: 490164 - RNA, 64 nt, Homo Sapiens
caaauguugcauaguuaccagggaagauuaguccagugauuacauaagaguugggcaccauaaa

SEQ ID NO: 490165 - RNA, 64 nt, Homo Sapiens
guccugugaucuagccaggagcagccauuaaccuagugauuaauaugggagacauuaccauaug

SEQ ID NO: 490166 - RNA, 64 nt, Homo Sapiens
gaccaucccagccucugaguucucuuugaguaugagugauuacuuggauuuuaguaucuguucu

SEQ ID NO: 490167 - RNA, 64 nt, Homo Sapiens
uaacaaaauuuuuaaagacccagugagagucuguagugauuauuacacggauaauguuuuaaau

SEQ ID NO: 490168 - RNA, 64 nt, Homo Sapiens
cauuuauguuugcuagaaacauuuucuaaaugauagugauuagcugguuagccaucuuccuguu

SEQ ID NO: 490169 - RNA, 64 nt, Homo Sapiens
gagaccucuugcuacagcauacaaagccucuacuagugauuaucagguauuuuaaggauuggau

SEQ ID NO: 490170 - RNA, 64 nt, Homo Sapiens
acaaauauuuguauuauuuuuguuagcaggaaagagugauuaagugagguuauuuaccccuaaa

SEQ ID NO: 490171 - RNA, 64 nt, Homo Sapiens
agccguacugcuuuuuugagcaguuauucauuccagugauuaaaacugauugugcagaauauuc

SEQ ID NO: 490172 - RNA, 64 nt, Homo Sapiens
gagugaacaaauuuacagagacagaaagcagaacagugauuaccagggacugaggggaggggag

SEQ ID NO: 490173 - RNA, 64 nt, Homo Sapiens
uuggaucaaaaguguuuaaaauuaauauguugucagugauuagaacaacacuguuuacauaaaa

SEQ ID NO: 490174 - RNA, 64 nt, Homo Sapiens
uguuuuaguauuuugaacugcuuuuuaaugcuuuagugauuaaaaaauaaauagaguguaaauu

SEQ ID NO: 490175 - RNA, 64 nt, Homo Sapiens
aaucauuagcaaauguguugugauguagcacuguagugauuaggaucaguauuuauuaaguaaa

SEQ ID NO: 490176 - RNA, 64 nt, Homo Sapiens
ucauaccaaugaaaucuuacauuuauaguaccagagugauuauuauucacuuuauucaugugac

SEQ ID NO: 490177 - RNA, 64 nt, Homo Sapiens
uggcccuucuacaagcguauuugcauucgcaaacagugauuaucuaaccagaaaaagcuggaau

SEQ ID NO: 490178 - RNA, 64 nt, Homo Sapiens
uggguucacuuccucgugagauauuguacugcucagugauuaaaacacaggauaaacccaauac

SEQ ID NO: 490179 - RNA, 64 nt, Homo Sapiens
cacacacucugcuauuuuuugcuaaguguuaaaaagugauuaaaaugcaaagcuuuuggagacu

SEQ ID NO: 490180 - RNA, 64 nt, Homo Sapiens
uccaacuuaaaaccaacaguaauuuggguaggaaagugauuaagaguucuuaaaggagugguag

SEQ ID NO: 490181 - RNA, 64 nt, Homo Sapiens
aaaacauugcuuugugguuaaauguaaaauuaugagugauuaagccuugugaugacuacuaaca

SEQ ID NO: 490182 - RNA, 64 nt, Homo Sapiens
uuagauagugauauuauaguaaagaacuguauuuagugauuauuuuugcuuguuuauuucugaa

SEQ ID NO: 490183 - RNA, 64 nt, Homo Sapiens
uacacuauacuggagggauugugaccaagaacacagugauuauauuaaacaguaaaugccagua

SEQ ID NO: 490184 - RNA, 64 nt, Homo Sapiens
ccucagguauuucugaguguuuaagaagguuuucagugauuauaaucuuuuuuuuuuuucgccu

SEQ ID NO: 490185 - RNA, 64 nt, Homo Sapiens
caauauuucucaaaccugaugcuguguuuuggaaagugauuaagugaaaucuucaauucuugca

SEQ ID NO: 490186 - RNA, 64 nt, Homo Sapiens
uaaagagaauguaguucccuacucaggcuuucguagugauuagcuuacuaaggaacugaaaaug

SEQ ID NO: 490187 - RNA, 64 nt, Homo Sapiens
uuucaaauguagugcuggugaaaagguagggcugagugauuaccuuagccacaggguggcugag

SEQ ID NO: 490188 - RNA, 64 nt, Homo Sapiens
uaaaccuccaccuccaguggcugugacuggucccagugauuauacguuauugguugcugugggu

SEQ ID NO: 490189 - RNA, 64 nt, Homo Sapiens
gcuccugguucagugccauggcuucauggcauucagugauuagugguaaugguaaacacuggug

SEQ ID NO: 490190 - RNA, 64 nt, Homo Sapiens
uuguguucccuaggaaaugacugucccaagagccagugauuauuccagguguucccuggaaagg

SEQ ID NO: 490191 - RNA, 64 nt, Homo Sapiens
cuuggaugucuuuuauagauuuuuaaauuauuuuagugauuauuauuuuauuaaaggggucugg

SEQ ID NO: 490192 - RNA, 64 nt, Homo Sapiens
ucuuuuuucaaaguuuaaugugaacuuuuagaaaagugauuaauguugcccuaauacuuuauau

SEQ ID NO: 490193 - RNA, 64 nt, Homo Sapiens
uuucuuccacuguuuuugaaaacugcuuguuuuaagugauuauauaacucauguuuagguaauu

SEQ ID NO: 490194 - RNA, 64 nt, Homo Sapiens
uaguugugagcuguuggcaugaacuccaucuacaagugauuacccaacugaaggccacaaaaau

SEQ ID NO: 490195 - RNA, 64 nt, Homo Sapiens
aauggggagugucaaaacuauuuaucagugaaguagugauuaaccagggucacacuuuuccaag

SEQ ID NO: 490196 - RNA, 64 nt, Homo Sapiens; identical to SEQ ID NO: 217666

SEQ ID NO: 490197 - RNA, 64 nt, Homo Sapiens; identical to SEQ ID NO: 217667

SEQ ID NO: 490198 - RNA, 64 nt, Homo Sapiens
cccucuggauuuggaaggcaaauaaaacucuuacagugauuauuuagauauuaaagacugagaa

SEQ ID NO: 490199 - RNA, 64 nt, Homo Sapiens
uuaauaaaugugcauuuugauuguaaucuaucgaagugauuauuacaccaguuacagcaguaau

SEQ ID NO: 490200 - RNA, 64 nt, Homo Sapiens
uauauuccauaucuacaacuauaauaucaaauaaagugauuauuuuuuacaacccucuuaacau

SEQ ID NO: 490201 - RNA, 64 nt, Homo Sapiens
uuaaaugaacuaacugaaaauaauaauuauaggaagugauuauuccauuuuaaguauuagagcu

SEQ ID NO: 490202 - RNA, 64 nt, Homo Sapiens
cuucuuuguaagaacaccaaccaaccaagguuuaagugauuaauaggcuugagcaccggguggc

SEQ ID NO: 490203 - RNA, 64 nt, Homo Sapiens
uaaucaaaacuauauauuugauauagauagauagagugauuaguaaucccgauuaaugaauuau

SEQ ID NO: 490204 - RNA, 64 nt, Homo Sapiens
uguaaaauuaugaauauggguuaaucuaauauugagugauuauucaaauauguuacuguauuaa

SEQ ID NO: 490205 - RNA, 64 nt, Homo Sapiens
aggaguuuaagcuaucauuuuuuuguaagucaaaagugauuaagaaccuguacacguugauuau

SEQ ID NO: 490206 - RNA, 64 nt, Homo Sapiens
agugcuucauccccauuuaauuuauuuuacagguagugauuauucaccaaaauaauaaauguuc

SEQ ID NO: 490207 - RNA, 64 nt, Homo Sapiens
auuuagauaauguaacaggacugcugauuugaguagugauuagcauuaccuaacgucuguguaa

SEQ ID NO: 490208 - RNA, 64 nt, Homo Sapiens
auucuuaucccaaaauucuagaguauuuugcauuagugauuauguacaacauuuaaaaaauuaa

SEQ ID NO: 490209 - RNA, 64 nt, Homo Sapiens
accuuuaaagcaagaggaggguuguaauaugcacagugauuacauuguuugccugcacauacau

SEQ ID NO: 490210 - RNA, 64 nt, Homo Sapiens; identical to SEQ ID NO: 217668

SEQ ID NO: 490211 - RNA, 64 nt, Homo Sapiens; identical to SEQ ID NO: 217669

SEQ ID NO: 490212 - RNA, 64 nt, Homo Sapiens
auuuacaagaaagaaaaauuaagaucuuaaaaucagugauuaucuuuuucuaaauaaaauauca

SEQ ID NO: 490213 - RNA, 64 nt, Homo Sapiens
aaagucuuuaacuaaauuaagauugcagaaugauagugauuauucaauuagauuuuaaguaagg

SEQ ID NO: 490214 - RNA, 64 nt, Homo Sapiens
guagcauuauugaaauaaauguuuaacuauccaaagugauuacuuucaaagaugauuuuuacuu

SEQ ID NO: 490215 - RNA, 64 nt, Homo Sapiens
auauacaggagaaaggaagcauuuaaauuuuuauagugauuauagagaaugauuauaugauguu

SEQ ID NO: 490216 - RNA, 64 nt, Homo Sapiens
cucuucacccaaauaugcuugauuauucugcaaaagugauuagaacuaagaugcaggggaaauu

SEQ ID NO: 490217 - RNA, 64 nt, Homo Sapiens
cguaugugcaacccuucugcuaguagugcacauaagugauuaucccugccagguaucgaguugg

SEQ ID NO: 490218 - RNA, 64 nt, Homo Sapiens
aacauuugagaguaagauauccuucaggaugugaagugauuauuaaguacucauaccugaaauc

SEQ ID NO: 490219 - RNA, 64 nt, Homo Sapiens
gugguccuuuuccucuugugaccaccacaugucuagugauuauuuuguuuauuugguugcuacu

SEQ ID NO: 490220 - RNA, 64 nt, Homo Sapiens
uuuuuaagcuguaaaaagagagaaaacuuauuugagugauuauuuguuauuuguacaguucagu

SEQ ID NO: 490221 - RNA, 64 nt, Homo Sapiens
gaaaaagaaugaugcuucuugcaacaaaaacaaaagugauuaugucacgagaggagaggcugga

SEQ ID NO: 490222 - RNA, 64 nt, Homo Sapiens; identical to SEQ ID NO: 217670

SEQ ID NO: 490223 - RNA, 64 nt, Homo Sapiens; identical to SEQ ID NO: 217671

SEQ ID NO: 490224 - RNA, 64 nt, Homo Sapiens
aucauacucuucauuacuauaaaacuguuucuucagugauuacauagugggugggaaaagggga

SEQ ID NO: 490225 - RNA, 64 nt, Homo Sapiens
gcugcauaaugucccucucucugucuugaauaagagugauuagacuuuucuuugggcuugacac

SEQ ID NO: 490226 - RNA, 64 nt, Homo Sapiens; identical to SEQ ID NO: 217672

SEQ ID NO: 490227 - RNA, 64 nt, Homo Sapiens; identical to SEQ ID NO: 217673

SEQ ID NO: 490228 - RNA, 64 nt, Homo Sapiens; identical to SEQ ID NO: 217674

SEQ ID NO: 490229 - RNA, 64 nt, Homo Sapiens
gguucuguuggccaaggcuuugaagggagcagacagugauuaauaaucacauuucuuacgcaaa

SEQ ID NO: 490230 - RNA, 64 nt, Homo Sapiens
uuucacaguagaacuagaaauuuuuaagcuaaagagugauuaucaaugaggacaucagggagcc

SEQ ID NO: 490231 - RNA, 64 nt, Homo Sapiens
auuaagcuguccuguuugcauaauacugccacuaagugauuauauacguuauuggcuuugucug

SEQ ID NO: 490232 - RNA, 64 nt, Homo Sapiens
uuggcaaggcuuccuuccguuauuuacaauuugcagugauuaacuguuuguuuuuagcagucau

SEQ ID NO: 490233 - RNA, 64 nt, Homo Sapiens
uuuguuuccuguuuguuuauugugcgcucuguaaagugauuacaugcuacuuuuaaguaaugua

SEQ ID NO: 490234 - RNA, 64 nt, Homo Sapiens
auguuaauugguuuuuuuuuuuaaaagguaaguuagugauuacuguuaauggugggggaguaag

SEQ ID NO: 490235 - RNA, 64 nt, Homo Sapiens
ucgacacugaacccccuaggcuucugaugaauccagugauuagcuaaauuugacauagaaagua

SEQ ID NO: 490236 - RNA, 64 nt, Homo Sapiens
ccauugauuuuuuuuuuuuuuuaccaagucuuacagugauuauuuuacguguuuccauguaucu

SEQ ID NO: 490237 - RNA, 64 nt, Homo Sapiens
acuuuucacuuaucucauguuagcuguaccagucagugauuaaguagaacuacaaguuguauag

SEQ ID NO: 490238 - RNA, 64 nt, Homo Sapiens
guaagaaagcagagagcggaaaaucaauggcuccagugauuaauagauggguuuuuaguaauug

SEQ ID NO: 490239 - RNA, 64 nt, Homo Sapiens
uuucacccaucucucaggaauuaucucuuuaguuagugauuauauaggaaguaaagugaagaau

SEQ ID NO: 490240 - RNA, 64 nt, Homo Sapiens
aaaaaaucaguggaaauaaaaugcaugaucucagagugauuaaaaaaggauuuaaaaaacaaga

SEQ ID NO: 490241 - RNA, 64 nt, Homo Sapiens
augauucccauacuccagauaggcccauaagacaagugauuauuaguaaggauaaauuuuuuaa

SEQ ID NO: 490242 - RNA, 64 nt, Homo Sapiens
auauuuauuggucauuuacuuuauuuuuuuuaacagugauuaaagucguaggaguacaagguuu

SEQ ID NO: 490243 - RNA, 64 nt, Homo Sapiens
aaggacaauuuuuuuuuuuacagaauucacauguagugauuauuaaagaaaggagauuauuacc

SEQ ID NO: 490244 - RNA, 64 nt, Homo Sapiens
augccaacugccacuacuccgggaacaaaagucuagugauuaguuacauugcuuuuccaaggaa

SEQ ID NO: 490245 - RNA, 64 nt, Homo Sapiens
aauauuaccuccaggguucaauaaauaauaggaaagugauuacauuauaguucuguuaccaaga

SEQ ID NO: 490246 - RNA, 64 nt, Homo Sapiens
uucauacuuuuaugcaggaauuuucucauucucuagugauuaccuuuugaacaauccuauucaa

SEQ ID NO: 490247 - RNA, 64 nt, Homo Sapiens
gguugguccuuugaccuucuuagagaccaaacuuagugauuagaaggcaugugcugucaaaugu

SEQ ID NO: 490248 - RNA, 64 nt, Homo Sapiens
aguccucacuguuaaauaaaacccaaucauaguaagugauuaacuagcaaaaaguaaagcuauu

SEQ ID NO: 490249 - RNA, 64 nt, Homo Sapiens
cugugccuccuauguaugucugguuugcuggaagagugauuaauacaucuuuaauuuauuaaaa

SEQ ID NO: 490250 - RNA, 64 nt, Homo Sapiens
cacuuagaaaaugaguaauaguguuuaauaagucagugauuauaugugugcucaaauaaguguu

SEQ ID NO: 490251 - RNA, 64 nt, Homo Sapiens
cuauauaaaagaacauggcuuuuugacugauaaaagugauuacagauguuggcucaaguucagg

SEQ ID NO: 490252 - RNA, 64 nt, Homo Sapiens
aaauauucauuuagaauuuccuuuagaagauggcagugauuauaauauuaauaugauuucauuu

SEQ ID NO: 490253 - RNA, 64 nt, Homo Sapiens
acauuucauugucuuagucaaagcaggauuauuaagugauuauuuaaaauucguuuuuuuaaau

SEQ ID NO: 490254 - RNA, 64 nt, Homo Sapiens
guuuaaaaaaaaaaaacaaaacaagaaaagcagcagugauuauagagaggucacacucuaagug

SEQ ID NO: 490255 - RNA, 64 nt, Homo Sapiens
ugauacguaagccuauuugaaaguuuugcuuuccagugauuaccgacauaguguauguuaaugu

SEQ ID NO: 490256 - RNA, 64 nt, Homo Sapiens
uuuccagcuccguguuucucuuuaaggucuaaucagugauuauuauguuaugcagugaacuauu

SEQ ID NO: 490257 - RNA, 64 nt, Homo Sapiens
uuaaaauguuauuaagggccaagaauuuugcagaagugauuaauuauguuaugccacauugcaa

SEQ ID NO: 490258 - RNA, 64 nt, Homo Sapiens
aacaaagacaugcaaaauacauuuguaugggcucagugauuacaugacuguuaguagugcaagg

SEQ ID NO: 490259 - RNA, 64 nt, Homo Sapiens
ugaaaaaauuauuuguagauacaaaauugaccacagugauuagaagagaccccauuuaaauaac

SEQ ID NO: 490260 - RNA, 64 nt, Homo Sapiens
gauauaguuggauuaauaucuguaccauauucaaagugauuauuugucuuaaaauuggugcaua

SEQ ID NO: 490261 - RNA, 64 nt, Homo Sapiens
ccguuguggaaauuauuggaauuaacugagccaaagugauuaugcauucuucaucuauuuuagu

SEQ ID NO: 490262 - RNA, 64 nt, Homo Sapiens
auaaaguaggaaaaaaagaaucugaaagauacaaagugauuauaaaagaauugacaggacaaua

SEQ ID NO: 490263 - RNA, 64 nt, Homo Sapiens
guagauuacguuuuccuauaaggauaauuuuugcagugauuauauugcuaacucucauugcaug

SEQ ID NO: 490264 - RNA, 64 nt, Homo Sapiens
guaacauucuuuuuuaaaaguggaagucauuaacagugauuauuauaucacuuauauccugcua

SEQ ID NO: 490265 - RNA, 64 nt, Homo Sapiens
uuaguuggcagcacucuccacacuucuguggcucagugauuacugcuauuacuauauuuacuug

SEQ ID NO: 490266 - RNA, 64 nt, Homo Sapiens
ggccucugccucacaacauguagcauuagaaauaagugauuaaaucaaauaauugaagagacaa

SEQ ID NO: 490267 - RNA, 64 nt, Homo Sapiens
guauuuuauaaauuaccuuuaguucuuuuuaaaaagugauuaauaguuaaugauacuacaacua

SEQ ID NO: 490268 - RNA, 64 nt, Homo Sapiens
caacuuccauucucucacuugcguagcuugauagagugauuauaaaaaacuuaaguccugguuu

SEQ ID NO: 490269 - RNA, 64 nt, Homo Sapiens
uauaucuagaacuaucauuuaacaucguggauguagugauuaaauauuccuagucuuuccaguc

SEQ ID NO: 490270 - RNA, 63 nt, Homo Sapiens
uaguuuacagugaccuuuuuuacaaaauaaaaguagugauuagugguugauugugaccuugaa

SEQ ID NO: 490271 - RNA, 64 nt, Homo Sapiens
cuuguucagggagaagaucacugauacaugagccagugauuauuacagccccaaccucccaccc

SEQ ID NO: 490272 - RNA, 64 nt, Homo Sapiens
cucgucuuucagcgagcauacgcccuguguccacagugauuagccugcagcugagauuccagaa

SEQ ID NO: 490273 - RNA, 64 nt, Homo Sapiens
caugggaaagcuguaguuuagugacuuagcccuuagugauuaauagauuugcauguacauagaa

SEQ ID NO: 490274 - RNA, 64 nt, Homo Sapiens
uggacuuuugcauuauuucauugugcaugcauccagugauuauacauaagcaacauauguaauc

SEQ ID NO: 490275 - RNA, 64 nt, Homo Sapiens
gacagagaacacugccugaagacacacagcaauaagugauuacagcuccuagacuaccuuccaa

SEQ ID NO: 490276 - RNA, 64 nt, Homo Sapiens
uccaugauauguuuggcucugcaugccaaaguccagugauuaagcauauauaaguugucaagga

SEQ ID NO: 490277 - RNA, 64 nt, Homo Sapiens
augaaauaauuguacauaauuaaacucaaaaggcagugauuaggucuugaaaugcuuuuguuau

SEQ ID NO: 490278 - RNA, 64 nt, Homo Sapiens
acuugggugacggcagucgagagugggagaaggcagugauuagcgaaucucccacuccagcgcu

SEQ ID NO: 490279 - RNA, 64 nt, Homo Sapiens
gcauacgaacagcuacauauaaauaaaguuucuaagugauuaaucaaaaaugugaaguuauacc

SEQ ID NO: 490280 - RNA, 64 nt, Homo Sapiens
uggcugagaaaacccuggagguuagauaacaccuagugauuaaugaauaacaacuuaagcugua

SEQ ID NO: 490281 - RNA, 64 nt, Homo Sapiens
guguauuuugcacaaaaaaauuaaccuggucaauagugauuaccaaaauauauauuaauaaucu

SEQ ID NO: 490282 - RNA, 64 nt, Homo Sapiens
aagaacauuuuuaauucuuuaggaaucugcaaugagugauuacaugcuuguaauagguaggcaa

SEQ ID NO: 490283 - RNA, 64 nt, Homo Sapiens
cugcucuuagguuguuuugauaaagugacauuauagugauuaaauucuucccccuuuaaaaaaa

SEQ ID NO: 490284 - RNA, 64 nt, Homo Sapiens
guuuuuaaaaagggagacuaaaagcaaauaccucagugauuaauauuuaagcuacagagaaugu

SEQ ID NO: 490285 - RNA, 64 nt, Homo Sapiens
cuaggcucaccacaaccucugccuuccagguucaagugauuagagacagugaaauuuuuaugga

SEQ ID NO: 490286 - RNA, 64 nt, Homo Sapiens
cuuuguugcaugcaguuggguucaaaugccaaauagugauuagaagacgaccauucugaucugu

SEQ ID NO: 490287 - RNA, 64 nt, Homo Sapiens
uggccacccucaccacuguccagcucuugucuaaagugauuagaagcagagucaguuacaccug

SEQ ID NO: 490288 - RNA, 64 nt, Homo Sapiens
ucuaacugugaucaaacuuaauuuuauauaguaaagugauuauguguuauauauugugaaauuu

SEQ ID NO: 490289 - RNA, 64 nt, Homo Sapiens
gaaugauaauuuagauccauguaaaacacagaaaagugauuaaucuuuuuaauauguuaucacu

SEQ ID NO: 490290 - RNA, 64 nt, Homo Sapiens
uuuuuuccccccaaguuaguaacugaaugucuaaagugauuaucauuuagauaaacuacauuuu

SEQ ID NO: 490291 - RNA, 64 nt, Homo Sapiens
uguauuuuuuuagaacugguuuguguauauauauagugauuauggauacuaauucaauguaauu

SEQ ID NO: 490292 - RNA, 64 nt, Homo Sapiens; identical to SEQ ID NO: 217675

SEQ ID NO: 490293 - RNA, 64 nt, Homo Sapiens; identical to SEQ ID NO: 217676

SEQ ID NO: 490294 - RNA, 64 nt, Homo Sapiens
ggccucagugccccauucucacugcuaucuggggagugauuaccccgggagacugaacugcagg

SEQ ID NO: 490295 - RNA, 64 nt, Homo Sapiens
caggcuuaaccauaacccucaagaucugcuugacagugauuaaauccuuagcucacauccauuc

SEQ ID NO: 490296 - RNA, 64 nt, Homo Sapiens
aaaggaaucucacuguuccuaaauaaauguguauagugauuaugaaaaguaucccacuguugau

SEQ ID NO: 490297 - RNA, 64 nt, Homo Sapiens
caaaaauauagagcugugcagggaugcugugucuagugauuaaaccacaauccucuacuucagu

SEQ ID NO: 490298 - RNA, 64 nt, Homo Sapiens
cuauaauccaaucauguauuuaaauguagugaucagugauuaugguuccacuauuggacugcuu

SEQ ID NO: 490299 - RNA, 64 nt, Homo Sapiens
ggagcagcuaaagaugagagauuaaggggauuagagugauuauguuuggaugaagguugcuggg

SEQ ID NO: 490300 - RNA, 64 nt, Homo Sapiens
ucggguuaaagcaaaaguguuagaaggaagcaggagugauuagucaagagaauggaagucuuaa

SEQ ID NO: 490301 - RNA, 64 nt, Homo Sapiens
gauaaguaaacaaauaaauaauguaguuugagauagugauuaagugcuaugaagaaaauaaacu

SEQ ID NO: 490302 - RNA, 64 nt, Homo Sapiens
ugguugcaguccaaguacucuggaacuacuuugcagugauuacuaucugguauuucuugcugcu

SEQ ID NO: 490303 - RNA, 64 nt, Homo Sapiens
uauuuuucuguauuuaccugaaaugcugagaacuagugauuauagagaaacaaagggauugaua

SEQ ID NO: 490304 - RNA, 64 nt, Homo Sapiens
uggaaaauuggaaccuggauucaggaugguagaaagugauuauaauugcuguuuguaaaauaaa

SEQ ID NO: 490305 - RNA, 64 nt, Homo Sapiens
ccagaugugggacccgguaccaugcucuaaagcgagugauuaggcagcagcugaagccaccccu

SEQ ID NO: 490306 - RNA, 64 nt, Homo Sapiens
aagagguaagcacauuuuauauagacguaaggaaagugauuauuguuuaauaucugugaauuua

SEQ ID NO: 490307 - RNA, 64 nt, Homo Sapiens
aucacagcauaaccccacccuuuacauuuugugcagugauuauuuuuuaaagucuucuuucaug

SEQ ID NO: 490308 - RNA, 64 nt, Homo Sapiens
aucacuaauuuuuaguugcugagguuggcauuuuagugauuauuaagcacuucugucagucuuu

SEQ ID NO: 490309 - RNA, 64 nt, Homo Sapiens
cuuggcucacugcagccucuaccucccagguucaagugauuauccugccuuagccuccugagua

SEQ ID NO: 490310 - RNA, 64 nt, Homo Sapiens
uuugauaauuuugcuuaaaccacucauucguuaaagugauuacaaaaaaguucaagaaugaugu

SEQ ID NO: 490311 - RNA, 64 nt, Homo Sapiens
acacaccucuucuuuucuugguauuucugguggcagugauuaguugaacagcacauuuaaggca

SEQ ID NO: 490312 - RNA, 64 nt, Homo Sapiens
aucagcuuaauuggauuaaaguauuaaaauucgaagugauuauuuuugggaacaugauuguauu

SEQ ID NO: 490313 - RNA, 64 nt, Homo Sapiens
gcaagcuaguugaccugcaccugaugaguuuagaagugauuaggaaacauggaaagauacucca

SEQ ID NO: 490314 - RNA, 64 nt, Homo Sapiens
agcuuggucuguaaggccggugagucuuuaacaaagugauuaagccaaaugcagguguguaggu

SEQ ID NO: 490315 - RNA, 64 nt, Homo Sapiens
ggaacacaagcugcugugaaccaaacugauaucaagugauuagcucaccgggccuugguugcuu

SEQ ID NO: 490316 - RNA, 64 nt, Homo Sapiens
ucucauuuucaguuuaaguaacugcuguuacuuaagugauuacacuuuugcucaaauugaagcu

SEQ ID NO: 490317 - RNA, 64 nt, Homo Sapiens
ggaaaagaggagaacuucauacucacaaugaaauagugauuaugaaaauacaguguucuguaau

SEQ ID NO: 490318 - RNA, 64 nt, Homo Sapiens
aucuuguuuuuuuuuuuuuuccuuuauuuugauaagugauuauuaugcuugauaaacuuugaau

SEQ ID NO: 490319 - RNA, 64 nt, Homo Sapiens
uacucuauaaauauauacauauauuuauauauaaagugauuaguugaacuggcauccugcuuua

SEQ ID NO: 490320 - RNA, 53 nt, Homo Sapiens
ccaaugagcuaaagcuguaacccagugauuaugauguaaauuaaguagcaauu

SEQ ID NO: 490321 - RNA, 64 nt, Homo Sapiens
uucacucacuguccuagcuaaauaaaagucaagcagugauuaguuguuauuuuuccuagaugaa

SEQ ID NO: 490322 - RNA, 64 nt, Homo Sapiens
auaaugacaugcuaaaaggcaauuuucaguaagaagugauuaaacaauugaggugauucaaccu

SEQ ID NO: 490323 - RNA, 64 nt, Homo Sapiens
ccaagugaacagaggagaaaugagauugccagaaagugauuaacuuuggccguugcaaucugcu

SEQ ID NO: 490324 - RNA, 64 nt, Homo Sapiens
caccugcaaaaugccuaacaaccuucuucuuuucagugauuaccacuuucuuaccaaugacuuc

SEQ ID NO: 490325 - RNA, 64 nt, Homo Sapiens
uagaauuuugguaccuacaacaugcuugauuuugagugauuaaaaaaaaauaauuuggcugggu

SEQ ID NO: 490326 - RNA, 64 nt, Homo Sapiens
gaauuugacauuguccaaaccuuuuucauuuuugagugauuaaaaaugaaauguccuuuguaua

SEQ ID NO: 490327 - RNA, 64 nt, Homo Sapiens
uuuaauggacaugagauaauguuagagguuuuaaagugauuaaacgugcagacuaugcaaacca

SEQ ID NO: 490328 - RNA, 64 nt, Homo Sapiens
ugcuuaacacagguuuuauuauuauuacuguuuaagugauuauuaccuuuaauuuagaggcaau

SEQ ID NO: 490329 - RNA, 64 nt, Homo Sapiens
caugguguacagaaaagcauugguaaacuaacagagugauuaaguuuuccacauguagaccaac

SEQ ID NO: 490330 - RNA, 64 nt, Homo Sapiens
ucuaaggaccuccagaagcaauagcacuuugugaagugauuacaagagucggaaucuaaacugu

SEQ ID NO: 490331 - RNA, 64 nt, Homo Sapiens
uuuucuucuguuaagucaugaugauugcuuuuuaagugauuaucaugaauugcaguauauacgu

SEQ ID NO: 490332 - RNA, 64 nt, Homo Sapiens
uagaaaugaagccuuaagcugcaucaaguuacgaagugauuaauuuccuucucagcaaaccucc

SEQ ID NO: 490333 - RNA, 64 nt, Homo Sapiens
gguuuugaccuugccagugaaguuucgguuuugaagugauuaaaugucacuuccucaucaguuu

SEQ ID NO: 490334 - RNA, 64 nt, Homo Sapiens
augugacuguaauuggaaauaagaccuuuaaagaagugauuaagguuaaaugaagucauaagaa

SEQ ID NO: 490335 - RNA, 64 nt, Homo Sapiens
auucaucccaacugucuuuuuuucccuaccauucagugauuacugucaaggcugcuuagaaucc

SEQ ID NO: 490336 - RNA, 64 nt, Homo Sapiens; identical to SEQ ID NO: 217677

SEQ ID NO: 490337 - RNA, 64 nt, Homo Sapiens; identical to SEQ ID NO: 217678

SEQ ID NO: 490338 - RNA, 64 nt, Homo Sapiens
acuauguaaugaauauaaucccaguucaccggacagugauuaaauaaugcuuugauuggauuug

SEQ ID NO: 490339 - RNA, 64 nt, Homo Sapiens
aaagauauguauagauaauuacugcuggaacaauagugauuaauauuauuaauuugacuugaaa

SEQ ID NO: 490340 - RNA, 64 nt, Homo Sapiens
acuaaucucugggauuuuuauguucuguuccuaaagugauuagcggaaaaugucgacuuuguuu

SEQ ID NO: 490341 - RNA, 64 nt, Homo Sapiens
uaaagucacaucccuguaaauugcagaauucaaaagugauuaucucuuugaucuacuugccuca

SEQ ID NO: 490342 - RNA, 64 nt, Homo Sapiens
ggcucaaguuggugacccaagccuauuguaaacaagugauuaucucaaagggagaugccaaugg

SEQ ID NO: 490343 - RNA, 64 nt, Homo Sapiens
ccauuaaaggaaaucuugauugcuuccaguuuucagugauuaaaaauaaagccgcuauaaacau

SEQ ID NO: 490344 - RNA, 64 nt, Homo Sapiens
cuuuccaagauacagccugcaagugguagcaagaagugauuagaggcagaucuggacuuggcaa

SEQ ID NO: 490345 - RNA, 64 nt, Homo Sapiens
ccuggguauucacaacaggccugacuugauacuaagugauuaguuuuccaaguugucccacugc

SEQ ID NO: 490346 - RNA, 64 nt, Homo Sapiens
gaauacagacuuaacaaguguaagugugaaugcaagugauuaaucuucuguuaguuuuuguuuu

SEQ ID NO: 490347 - RNA, 64 nt, Homo Sapiens
uguacccugugcuguugcuccgucucuauggugcagugauuaugcagaaaccacuugcuaaaag

SEQ ID NO: 490348 - RNA, 64 nt, Homo Sapiens
aggggugggguggcgggaauuauuaauacucugcagugauuagaaaucagccauaagaaagcac

SEQ ID NO: 490349 - RNA, 64 nt, Homo Sapiens
agguaagaaaaagcagggaaccaugggcagcaucagugauuacauagcauuucuccuuauauca

SEQ ID NO: 490350 - RNA, 64 nt, Homo Sapiens
ugugaauaauaaauacacaaagcauuugguagguagugauuaacaauccuuuaacucugcggau

SEQ ID NO: 490351 - RNA, 64 nt, Homo Sapiens
auaaauucaauggaauuugaaacggugauauuggagugauuaguaaaauaacugcuuuuguaag

SEQ ID NO: 490352 - RNA, 64 nt, Homo Sapiens
agauagugaaauuuaccuuugagauauaacaauaagugauuaacuguucacuuucagauguaau

SEQ ID NO: 490353 - RNA, 64 nt, Homo Sapiens
uguuggaaccuccuggggacauguuauauuuugaagugauuaaacuauuuaauugugugucuau

SEQ ID NO: 490354 - RNA, 64 nt, Homo Sapiens
ccuugggagcaagcagcacuaaaucacaucagggagugauuaguccuggggaaauucaguggag

SEQ ID NO: 490355 - RNA, 64 nt, Homo Sapiens
agaggaaacuacugccuuuagaaaauauaaguaaagugauuaaagugcucacguuaccuugaca

SEQ ID NO: 490356 - RNA, 64 nt, Homo Sapiens
auuuguagcucuagugaauauagaauuuucugauagugauuaugagugaauguaaauuuuauua

SEQ ID NO: 490357 - RNA, 64 nt, Homo Sapiens
uucaaaagaucuuuuuguaaauaagcucacaaauagugauuauugugaugauuuguguguauua

SEQ ID NO: 490358 - RNA, 64 nt, Homo Sapiens
uuugaucaagccauggugacccugccauugaaacagugauuaaggcugccacaacuggccaugc

SEQ ID NO: 490359 - RNA, 64 nt, Homo Sapiens
ucuguggaaaagcauaggaaugcaggcaugaaauagugauuauauucuuuuuuuuucuagguuu

SEQ ID NO: 490360 - RNA, 64 nt, Homo Sapiens
aaucgagaggaguuauaauagggaaaaauuaggaagugauuauaagauguagcucuggcccagu

SEQ ID NO: 490361 - RNA, 64 nt, Homo Sapiens
caagacauuuuuguuaacuacaaauauugacugcagugauuaacaaagcuggagaguuuaccaa

SEQ ID NO: 490362 - RNA, 64 nt, Homo Sapiens
uuaauccccuccauugcucuccaaaagccaauaaagugauuacacccgaugcaccuggcucugu

SEQ ID NO: 490363 - RNA, 64 nt, Homo Sapiens
ucugaaggcucauuuugguauuugaucuuaaccaagugauuauuagagaaauguaucaacucca

SEQ ID NO: 490364 - RNA, 64 nt, Homo Sapiens
cacuuccgagacccaacccugcacgcccagcuccagugauuacucggaccuacagagggugaaa

SEQ ID NO: 490365 - RNA, 64 nt, Homo Sapiens
gcucuguguggaauucagaggaaaacccagauucagugauuaacaaugccaaaaaaugcaagua

SEQ ID NO: 490366 - RNA, 64 nt, Homo Sapiens
uuucugaacaagguucagaaggaaaauaauuugcagugauuauauguuuuuuagaacaacacuu

SEQ ID NO: 490367 - RNA, 64 nt, Homo Sapiens
ucaagucacgaagauagagcugggaccuuugggaagugauuaagacaguguaaguauuaggagg

SEQ ID NO: 490368 - RNA, 64 nt, Homo Sapiens
uucgauuacacugaagagacuaacauuaucccccagugauuacuuucauucccaugggcacagc

SEQ ID NO: 490369 - RNA, 64 nt, Homo Sapiens
gaguauuucccuuuugccaguuuucauaaugcccagugauuaguaccuguaaggaauuuguacu

SEQ ID NO: 490370 - RNA, 64 nt, Homo Sapiens
gaagaagaaauaggacucagaauacaguggcaugagugauuacacuggcagcauuaucucaggc

SEQ ID NO: 490371 - RNA, 64 nt, Homo Sapiens
cuggaaaaguaaauuguuuauuuuacaauaagaaagugauuacauauuuuuuuuuuuacaaugg

SEQ ID NO: 490372 - RNA, 64 nt, Homo Sapiens
aauauucccagaauaguuuucaauguauuaaugaagugauuaauuggcuccauauuuagacuaa

SEQ ID NO: 490373 - RNA, 64 nt, Homo Sapiens
uugugauauguuuuggcgcauaggagacagaaauagugauuaucaggcguugagccuuuuugua

SEQ ID NO: 490374 - RNA, 64 nt, Homo Sapiens
ugcuaaaucuugcuuugcauucaguaaagugucaagugauuaaguguguauuuguacccuagau

SEQ ID NO: 490375 - RNA, 64 nt, Homo Sapiens
acuugaugaguguaacaagaaaggagagucuugcagugauuaaggucucucuuuggacucuccc

SEQ ID NO: 490376 - RNA, 64 nt, Homo Sapiens
ucauuuguaacaguccacucugucuuuaaaacauagugauuacaauauuuagaaaguuuugagc

SEQ ID NO: 490377 - RNA, 64 nt, Homo Sapiens
agaggucuauauaaaguuacuauaugauuuacggagugauuaacuacugaauauucuagugagu

SEQ ID NO: 490378 - RNA, 64 nt, Homo Sapiens
auaguugggguaaaguuguaaaaucucgaaucauagugauuaaauugggcuguuaaauccuagg

SEQ ID NO: 490379 - RNA, 64 nt, Homo Sapiens
gcuauaucauucccaguuauguauguguuucauaagugauuaaaccaguuuagacuaaguuaca

SEQ ID NO: 490380 - RNA, 64 nt, Homo Sapiens
uucaauucaguaugcagugaauuugugcuguaucagugauuacuguuuacccgacagaggcuuu

SEQ ID NO: 490381 - RNA, 65 nt, Homo Sapiens
uacuaguuaauuuugaguaauuguauugucagaaaagugauuaguacuauuuuuuuuuguuguuu

SEQ ID NO: 490382 - RNA, 65 nt, Homo Sapiens
uuucauuuuggauauucuccuguuuuuauuaaaccagugauuacaccuggccaucccucuaaaug

SEQ ID NO: 490383 - RNA, 65 nt, Homo Sapiens
uggugccuggagccuguguccugcccugcuacaguagugauuaauagugucaugguagcuaaagg

SEQ ID NO: 490384 - RNA, 65 nt, Homo Sapiens
ggagggacacuuccccagaauccgcauguuuccccagugauuacacuccacugccaccguggugc

SEQ ID NO: 490385 - RNA, 65 nt, Homo Sapiens
aaaggaacuugaaauguggggagugauaauaguccagugauuaaacuacaguccagugauuacca

SEQ ID NO: 490386 - RNA, 65 nt, Homo Sapiens
ggagugauaauaguccagugauuaaacuacaguccagugauuaccaccaacuuucugacuaagcu

SEQ ID NO: 490387 - RNA, 65 nt, Homo Sapiens
uucuaauuauuccauugagucaguuuuuugugauuagugauuaucagagcaaacaucauguagau

SEQ ID NO: 490388 - RNA, 65 nt, Homo Sapiens
ugcuaacccaaaauguuauuuguaaucaaauguguagugauuacacuugaauuguguacuuagug

SEQ ID NO: 490389 - RNA, 65 nt, Homo Sapiens
ccaaggugauggcauuaagaagugggccuuugggaagugauuagaucaggagugcagagcccuca

SEQ ID NO: 490390 - RNA, 65 nt, Homo Sapiens
ccugaccagcuuaguucuaauaauuuuuaguugugagugauuaaaaaacuuuggaucaauuuugg

SEQ ID NO: 490391 - RNA, 65 nt, Homo Sapiens
cacccuuuccaaugcaucuucuacccugcuaccucagugauuauucuaaaauaaauauauaugau

SEQ ID NO: 490392 - RNA, 65 nt, Homo Sapiens
ugcuuaggaguucagaguuccuucaucaucgaaauagugauuaagugaucccagaacaaggaaua

SEQ ID NO: 490393 - RNA, 65 nt, Homo Sapiens
uauauacuuguacauacaauggaaaugcuuuuaguagugauuauuuagcaauuuuuguuuuuguu

SEQ ID NO: 490394 - RNA, 65 nt, Homo Sapiens
ggcuauugagaguuuuacagugaaaugauccuaccagugauuagugcccaaucauguguuuuugu

SEQ ID NO: 490395 - RNA, 65 nt, Homo Sapiens
agacucuuuguggacgagugauaguuccucacauuagugauuagccugcccauaggccaacaacc

SEQ ID NO: 490396 - RNA, 65 nt, Homo Sapiens
uuuagucugcacagugagcaauuacuauuuaaacaagugauuaaaccauaaaagauuguauuuuu

SEQ ID NO: 490397 - RNA, 65 nt, Homo Sapiens
gaugaugagugauuuuuauagguaugcauuucuguagugauuagucauucugacuggugugagau

SEQ ID NO: 490398 - RNA, 65 nt, Homo Sapiens
aaagaauaucagggccugacaguuuaaaauuaaaaagugauuaucuagcaguuucauucaagaaa

SEQ ID NO: 490399 - RNA, 65 nt, Homo Sapiens
uagaaucuguauuauuccuuaucagcaaauacugcagugauuaguaaaccgauagaaaaguaacc

SEQ ID NO: 490400 - RNA, 65 nt, Homo Sapiens
uaaaagcaacgcaagaaaaauggaagggcuggggaagugauuaaacuuauccucaaaaaaggcga

SEQ ID NO: 490401 - RNA, 65 nt, Homo Sapiens
auugaggaaaaagucaaaauuuacagcaaaaccucagugauuacauuggugaaaggaaauagcag

SEQ ID NO: 490402 - RNA, 65 nt, Homo Sapiens
ccaaauguugcauaguuaccagggaagauuaguccagugauuacauaagaguugggcaccauaaa

SEQ ID NO: 490403 - RNA, 65 nt, Homo Sapiens
gguccugugaucuagccaggagcagccauuaaccuagugauuaauaugggagacauuaccauaug

SEQ ID NO: 490404 - RNA, 65 nt, Homo Sapiens
agaccaucccagccucugaguucucuuugaguaugagugauuacuuggauuuuaguaucuguucu

SEQ ID NO: 490405 - RNA, 65 nt, Homo Sapiens
uuaacaaaauuuuuaaagacccagugagagucuguagugauuauuacacggauaauguuuuaaau

SEQ ID NO: 490406 - RNA, 65 nt, Homo Sapiens
ucauuuauguuugcuagaaacauuuucuaaaugauagugauuagcugguuagccaucuuccuguu

SEQ ID NO: 490407 - RNA, 65 nt, Homo Sapiens
ugagaccucuugcuacagcauacaaagccucuacuagugauuaucagguauuuuaaggauuggau

SEQ ID NO: 490408 - RNA, 65 nt, Homo Sapiens
aacaaauauuuguauuauuuuuguuagcaggaaagagugauuaagugagguuauuuaccccuaaa

SEQ ID NO: 490409 - RNA, 65 nt, Homo Sapiens
aagccguacugcuuuuuugagcaguuauucauuccagugauuaaaacugauugugcagaauauuc

SEQ ID NO: 490410 - RNA, 65 nt, Homo Sapiens
agagugaacaaauuuacagagacagaaagcagaacagugauuaccagggacugaggggaggggag

SEQ ID NO: 490411 - RNA, 65 nt, Homo Sapiens
uuuggaucaaaaguguuuaaaauuaauauguugucagugauuagaacaacacuguuuacauaaaa

SEQ ID NO: 490412 - RNA, 65 nt, Homo Sapiens
uguuuuaguauuuugaacugucuuuuuaaugcuuuagugauuaaaaaaauaaauagaguguaaau

SEQ ID NO: 490413 - RNA, 65 nt, Homo Sapiens
aaucauuagcaaauguguugaugauguagcacuguagugauuaggaaucaguauuuauuaaguaa

SEQ ID NO: 490414 - RNA, 65 nt, Homo Sapiens
ucauaccaaugaaaucuuaccauuuauaguaccagagugauuauuaauucacuuuauucauguga

SEQ ID NO: 490415 - RNA, 65 nt, Homo Sapiens
uggcccuucuacaagcguauuuugcauucgcaaacagugauuauccuaaccagaaaaagcuggaa

SEQ ID NO: 490416 - RNA, 65 nt, Homo Sapiens
uggguucacuuccucgugagcauauuguacugcucagugauuaaauacacaggauaaacccaaua

SEQ ID NO: 490417 - RNA, 65 nt, Homo Sapiens
cacacacucugcuauuuuuuugcuaaguguuaaaaagugauuaaaaaugcaaagcuuuuggagac

SEQ ID NO: 490418 - RNA, 65 nt, Homo Sapiens
uccaacuuaaaaccaacagugaauuuggguaggaaagugauuaaggaguucuuaaaggaguggua

SEQ ID NO: 490419 - RNA, 65 nt, Homo Sapiens
aaaacauugcuuugugguuaaaauguaaaauuaugagugauuaagaccuugugaugacuacuaac

SEQ ID NO: 490420 - RNA, 65 nt, Homo Sapiens
uuagauagugauauuauaguaaaagaacuguauuuagugauuauucuuugcuuguuuauuucuga

SEQ ID NO: 490421 - RNA, 65 nt, Homo Sapiens
uacacuauacuggagggauuagugaccaagaacacagugauuauaguuaaacaguaaaugccagu

SEQ ID NO: 490422 - RNA, 65 nt, Homo Sapiens
ccucagguauuucugaguguuuuaagaagguuuucagugauuauaaaucuuuuuuuuuuuucgcc

SEQ ID NO: 490423 - RNA, 65 nt, Homo Sapiens
caauauuucucaaaccugauagcuguguuuuggaaagugauuaagaugaaaucuucaauucuugc

SEQ ID NO: 490424 - RNA, 65 nt, Homo Sapiens
auaaagagaauguaguucccuacucaggcuuucguagugauuagcuuacuaaggaacugaaaaug

SEQ ID NO: 490425 - RNA, 65 nt, Homo Sapiens
uuuucaaauguagugcuggugaaaagguagggcugagugauuaccuuagccacaggguggcugag

SEQ ID NO: 490426 - RNA, 65 nt, Homo Sapiens
uuaaaccuccaccuccaguggcugugacuggucccagugauuauacguuauugguugcugugggu

SEQ ID NO: 490427 - RNA, 65 nt, Homo Sapiens
agcuccugguucagugccauggcuucauggcauucagugauuagugguaaugguaaacacuggug

SEQ ID NO: 490428 - RNA, 65 nt, Homo Sapiens
auuguguucccuaggaaaugacugucccaagagccagugauuauuccagguguucccuggaaagg

SEQ ID NO: 490429 - RNA, 65 nt, Homo Sapiens
gcuuggaugucuuuuauagauuuuuaaauuauuuuagugauuauuauuuuauuaaaggggucugg

SEQ ID NO: 490430 - RNA, 65 nt, Homo Sapiens
aucuuuuuucaaaguuuaaugugaacuuuuagaaaagugauuaauguugcccuaauacuuuauau

SEQ ID NO: 490431 - RNA, 65 nt, Homo Sapiens
uuucuuccacuguuuuugaauaacugcuuguuuuaagugauuauaguaacucauguuuagguaau

SEQ ID NO: 490432 - RNA, 65 nt, Homo Sapiens
uaguugugagcuguuggcauugaacuccaucuacaagugauuaccucaacugaaggccacaaaaa

SEQ ID NO: 490433 - RNA, 65 nt, Homo Sapiens
aauggggagugucaaaacuaguuuaucagugaaguagugauuaacccagggucacacuuuuccaa

SEQ ID NO: 490434 - RNA, 65 nt, Homo Sapiens
ccucugguauagcuuuccuaguuuaaucauuguauagugauuauguuauaaauuguaaagguaau

SEQ ID NO: 490435 - RNA, 65 nt, Homo Sapiens
aauuguaaagguaauguuuauuauucuguaauuucagugauuauacaaaagaaaugugcauauau

SEQ ID NO: 490436 - RNA, 65 nt, Homo Sapiens
acccucuggauuuggaaggcaaauaaaacucuuacagugauuauuuagauauuaaagacugagaa

SEQ ID NO: 490437 - RNA, 65 nt, Homo Sapiens
uuuaauaaaugugcauuuugauuguaaucuaucgaagugauuauuacaccaguuacagcaguaau

SEQ ID NO: 490438 - RNA, 65 nt, Homo Sapiens
auauauuccauaucuacaacuauaauaucaaauaaagugauuauuuuuuacaacccucuuaacau

SEQ ID NO: 490439 - RNA, 65 nt, Homo Sapiens
auuaaaugaacuaacugaaaauaauaauuauaggaagugauuauuccauuuuaaguauuagagcu

SEQ ID NO: 490440 - RNA, 65 nt, Homo Sapiens
acuucuuuguaagaacaccaaccaaccaagguuuaagugauuaauaggcuugagcaccggguggc

SEQ ID NO: 490441 - RNA, 65 nt, Homo Sapiens
uaaucaaaacuauauauuuguauauagauagauagagugauuaguaaaucccgauuaaugaauua

SEQ ID NO: 490442 - RNA, 65 nt, Homo Sapiens
uguaaaauuaugaauaugggauuaaucuaauauugagugauuauuccaaauauguuacuguauua

SEQ ID NO: 490443 - RNA, 65 nt, Homo Sapiens
aggaguuuaagcuaucauuuuuuuuguaagucaaaagugauuaagaaaccuguacacguugauua

SEQ ID NO: 490444 - RNA, 65 nt, Homo Sapiens
agugcuucauccccauuuaacuuuauuuuacagguagugauuauuucaccaaaauaauaaauguu

SEQ ID NO: 490445 - RNA, 65 nt, Homo Sapiens
auuuagauaauguaacaggaacugcugauuugaguagugauuagcaauuaccuaacgucugugua

SEQ ID NO: 490446 - RNA, 65 nt, Homo Sapiens
auucuuaucccaaaauucuaagaguauuuugcauuagugauuaugauacaacauuuaaaaaauua

SEQ ID NO: 490447 - RNA, 65 nt, Homo Sapiens
accuuuaaagcaagaggagguguuguaauaugcacagugauuacaauuguuugccugcacauaca

SEQ ID NO: 490448 - RNA, 65 nt, Homo Sapiens
gaguacuuuccuuauuggcaacuuauggacucgcuagugauuaaacgaggcaaugacugugagcg

SEQ ID NO: 490449 - RNA, 65 nt, Homo Sapiens
agcauuggccuuaauauaccuaaaucuccaaaaacagugauuaaagcaagagaauuauuacaagg

SEQ ID NO: 490450 - RNA, 65 nt, Homo Sapiens
cauuuacaagaaagaaaaauuaagaucuuaaaaucagugauuaucuuuuucuaaauaaaauauca

SEQ ID NO: 490451 - RNA, 65 nt, Homo Sapiens
gaaagucuuuaacuaaauuaagauugcagaaugauagugauuauucaauuagauuuuaaguaagg

SEQ ID NO: 490452 - RNA, 65 nt, Homo Sapiens
gguagcauuauugaaauaaauguuuaacuauccaaagugauuacuuucaaagaugauuuuuacuu

SEQ ID NO: 490453 - RNA, 65 nt, Homo Sapiens
cauauacaggagaaaggaagcauuuaaauuuuuauagugauuauagagaaugauuauaugauguu

SEQ ID NO: 490454 - RNA, 65 nt, Homo Sapiens
ucucuucacccaaauaugcuugauuauucugcaaaagugauuagaacuaagaugcaggggaaauu

SEQ ID NO: 490455 - RNA, 65 nt, Homo Sapiens
acguaugugcaacccuucugcuaguagugcacauaagugauuaucccugccagguaucgaguugg

SEQ ID NO: 490456 - RNA, 65 nt, Homo Sapiens
uaacauuugagaguaagauauccuucaggaugugaagugauuauuaaguacucauaccugaaauc

SEQ ID NO: 490457 - RNA, 65 nt, Homo Sapiens
ugugguccuuuuccucuugugaccaccacaugucuagugauuauuuuguuuauuugguugcuacu

SEQ ID NO: 490458 - RNA, 65 nt, Homo Sapiens
uuuuuuaagcuguaaaaagagagaaaacuuauuugagugauuauuuguuauuuguacaguucagu

SEQ ID NO: 490459 - RNA, 65 nt, Homo Sapiens
agaaaaagaaugaugcuucuugcaacaaaaacaaaagugauuaugucacgagaggagaggcugga

SEQ ID NO: 490460 - RNA, 65 nt, Homo Sapiens
uaccuuuacaauggagacaucuaccagaucauccaagugauuaaauuuaacaucaucaaugaugg

SEQ ID NO: 490461 - RNA, 65 nt, Homo Sapiens
uuggguggcggggagaaggauacaccaaaaaacuaagugauuaucuuuggaugggaaaauguuug

SEQ ID NO: 490462 - RNA, 65 nt, Homo Sapiens
aucauacucuucauuacuauaaaaacuguuucuucagugauuacaguagugggugggaaaagggg

SEQ ID NO: 490463 - RNA, 65 nt, Homo Sapiens
gcugcauaaugucccucucuccugucuugaauaagagugauuagaccuuuucuuugggcuugaca

SEQ ID NO: 490464 - RNA, 65 nt, Homo Sapiens
cagcagggaagauauuagugaggagggaagauauuagugauuagagaagacauuagugauuagac

SEQ ID NO: 490465 - RNA, 65 nt, Homo Sapiens
caggagggaagauauuagugaggaaggaagacauuagugauuagaccuuaacucagugauuagac

SEQ ID NO: 490466 - RNA, 65 nt, Homo Sapiens
caggaaggaagacauuaguguuuuucccuuaacucagugauuagauuccuguaaguaaaugacua

SEQ ID NO: 490467 - RNA, 65 nt, Homo Sapiens
gguucuguuggccaaggcuuaugaagggagcagacagugauuaaugaaucacauuucuuacgcaa

SEQ ID NO: 490468 - RNA, 65 nt, Homo Sapiens
uuucacaguagaacuagaaacuuuuuaagcuaaagagugauuaucuaaugaggacaucagggagc

SEQ ID NO: 490469 - RNA, 65 nt, Homo Sapiens
auuaagcuguccuguuugcaguaauacugccacuaagugauuauaauacguuauuggcuuugucu

SEQ ID NO: 490470 - RNA, 65 nt, Homo Sapiens
uuggcaaggcuuccuuccguuuauuuacaauuugcagugauuaaccuguuuguuuuuagcaguca

SEQ ID NO: 490471 - RNA, 65 nt, Homo Sapiens
uuuguuuccuguuuguuuauaugugcgcucuguaaagugauuacagugcuacuuuuaaguaaugu

SEQ ID NO: 490472 - RNA, 65 nt, Homo Sapiens
uauguuaauugguuuuuuuuuuuaaaagguaaguuagugauuacuguuaauggugggggaguaag

SEQ ID NO: 490473 - RNA, 65 nt, Homo Sapiens
cucgacacugaacccccuaggcuucugaugaauccagugauuagcuaaauuugacauagaaagua

SEQ ID NO: 490474 - RNA, 65 nt, Homo Sapiens
accauugauuuuuuuuuuuuuuuaccaagucuuacagugauuauuuuacguguuuccauguaucu

SEQ ID NO: 490475 - RNA, 65 nt, Homo Sapiens
aacuuuucacuuaucucauguuagcuguaccagucagugauuaaguagaacuacaaguuguauag

SEQ ID NO: 490476 - RNA, 65 nt, Homo Sapiens
uguaagaaagcagagagcggaaaaucaauggcuccagugauuaauagauggguuuuuaguaauug

SEQ ID NO: 490477 - RNA, 65 nt, Homo Sapiens
uuucacccaucucucaggaauuuaucucuuuaguuagugauuauacuaggaaguaaagugaagaa

SEQ ID NO: 490478 - RNA, 65 nt, Homo Sapiens
aaaaaaucaguggaaauaaaaaugcaugaucucagagugauuaaaaaaaggauuuaaaaaacaag

SEQ ID NO: 490479 - RNA, 65 nt, Homo Sapiens
augauucccauacuccagauaaggcccauaagacaagugauuauugaguaaggauaaauuuuuua

SEQ ID NO: 490480 - RNA, 65 nt, Homo Sapiens
auauuuauuggucauuuacuuuuauuuuuuuuaacagugauuaaaagucguaggaguacaagguu

SEQ ID NO: 490481 - RNA, 65 nt, Homo Sapiens
aaggacaauuuuuuuuuuuaccagaauucacauguagugauuauugaaagaaaggagauuauuac

SEQ ID NO: 490482 - RNA, 65 nt, Homo Sapiens
augccaacugccacuacuccagggaacaaaagucuagugauuaguuuacauugcuuuuccaagga

SEQ ID NO: 490483 - RNA, 65 nt, Homo Sapiens
aauauuaccuccaggguucaaauaaauaauaggaaagugauuacaauuauaguucuguuaccaag

SEQ ID NO: 490484 - RNA, 65 nt, Homo Sapiens
uucauacuuuuaugcaggaaauuuucucauucucuagugauuaccguuuugaacaauccuauuca

SEQ ID NO: 490485 - RNA, 65 nt, Homo Sapiens
gguugguccuuugaccuucuuuagagaccaaacuuagugauuagagaggcaugugcugucaaaug

SEQ ID NO: 490486 - RNA, 65 nt, Homo Sapiens
uaguccucacuguuaaauaaaacccaaucauaguaagugauuaacuagcaaaaaguaaagcuauu

SEQ ID NO: 490487 - RNA, 65 nt, Homo Sapiens
gcugugccuccuauguaugucugguuugcuggaagagugauuaauacaucuuuaauuuauuaaaa

SEQ ID NO: 490488 - RNA, 65 nt, Homo Sapiens
acacuuagaaaaugaguaauaguguuuaauaagucagugauuauaugugugcucaaauaaguguu

SEQ ID NO: 490489 - RNA, 65 nt, Homo Sapiens
gcuauauaaaagaacauggcuuuuugacugauaaaagugauuacagauguuggcucaaguucagg

SEQ ID NO: 490490 - RNA, 65 nt, Homo Sapiens
caaauauucauuuagaauuuccuuuagaagauggcagugauuauaauauuaauaugauuucauuu

SEQ ID NO: 490491 - RNA, 65 nt, Homo Sapiens
cacauuucauugucuuagucaaagcaggauuauuaagugauuauuuaaaauucguuuuuuuaaau

SEQ ID NO: 490492 - RNA, 65 nt, Homo Sapiens
uguuuaaaaaaaaaaaacaaaacaagaaaagcagcagugauuauagagaggucacacucuaagug

SEQ ID NO: 490493 - RNA, 65 nt, Homo Sapiens
ugauacguaagccuauuugauaaguuuugcuuuccagugauuaccugacauaguguauguuaaug

SEQ ID NO: 490494 - RNA, 65 nt, Homo Sapiens
uuuccagcuccguguuucucuuuuaaggucuaaucagugauuauucauguuaugcagugaacuau

SEQ ID NO: 490495 - RNA, 65 nt, Homo Sapiens
uuaaaauguuauuaagggccaaagaauuuugcagaagugauuaauauauguuaugccacauugca

SEQ ID NO: 490496 - RNA, 65 nt, Homo Sapiens
aacaaagacaugcaaaauacgauuuguaugggcucagugauuacagugacuguuaguagugcaag

SEQ ID NO: 490497 - RNA, 65 nt, Homo Sapiens
ugaaaaaauuauuuguagaucacaaaauugaccacagugauuagacagagaccccauuuaaauaa

SEQ ID NO: 490498 - RNA, 65 nt, Homo Sapiens
gauauaguuggauuaauaucauguaccauauucaaagugauuauucugucuuaaaauuggugcau

SEQ ID NO: 490499 - RNA, 65 nt, Homo Sapiens
cccguuguggaaauuauuggaauuaacugagccaaagugauuaugcauucuucaucuauuuuagu

SEQ ID NO: 490500 - RNA, 65 nt, Homo Sapiens
uauaaaguaggaaaaaaagaaucugaaagauacaaagugauuauaaaagaauugacaggacaaua

SEQ ID NO: 490501 - RNA, 65 nt, Homo Sapiens
aguagauuacguuuuccuauaaggauaauuuuugcagugauuauauugcuaacucucauugcaug

SEQ ID NO: 490502 - RNA, 65 nt, Homo Sapiens
uguaacauucuuuuuuaaaaguggaagucauuaacagugauuauuauaucacuuauauccugcua

SEQ ID NO: 490503 - RNA, 65 nt, Homo Sapiens
cuuaguuggcagcacucuccacacuucuguggcucagugauuacugcuauuacuauauuuacuug

SEQ ID NO: 490504 - RNA, 65 nt, Homo Sapiens
ggccucugccucacaacaugauagcauuagaaauaagugauuaaaaucaaauaauugaagagaca

SEQ ID NO: 490505 - RNA, 65 nt, Homo Sapiens
guauuuuauaaauuaccuuuaaguucuuuuuaaaaagugauuaaugaguuaaugauacuacaacu

SEQ ID NO: 490506 - RNA, 65 nt, Homo Sapiens
caacuuccauucucucacuuugcguagcuugauagagugauuauaaaaaaacuuaaguccugguu

SEQ ID NO: 490507 - RNA, 65 nt, Homo Sapiens
uauaucuagaacuaucauuucaacaucguggauguagugauuaaauuauuccuagucuuuccagu

SEQ ID NO: 490508 - RNA, 64 nt, Homo Sapiens
uaguuuacagugaccuuuuuauacaaaauaaaaguagugauuagcugguugauugugaccuuga

SEQ ID NO: 490509 - RNA, 65 nt, Homo Sapiens
cuuguucagggagaagaucaccugauacaugagccagugauuauucacagccccaaccucccacc

SEQ ID NO: 490510 - RNA, 65 nt, Homo Sapiens
cucgucuuucagcgagcauaacgcccuguguccacagugauuagcccugcagcugagauuccaga

SEQ ID NO: 490511 - RNA, 65 nt, Homo Sapiens
ucaugggaaagcuguaguuuagugacuuagcccuuagugauuaauagauuugcauguacauagaa

SEQ ID NO: 490512 - RNA, 65 nt, Homo Sapiens
auggacuuuugcauuauuucauugugcaugcauccagugauuauacauaagcaacauauguaauc

SEQ ID NO: 490513 - RNA, 65 nt, Homo Sapiens
ugacagagaacacugccugaagacacacagcaauaagugauuacagcuccuagacuaccuuccaa

SEQ ID NO: 490514 - RNA, 65 nt, Homo Sapiens
uuccaugauauguuuggcucugcaugccaaaguccagugauuaagcauauauaaguugucaagga

SEQ ID NO: 490515 - RNA, 65 nt, Homo Sapiens
augaaauaauuguacauaauuuaaacucaaaaggcagugauuagguucuugaaaugcuuuuguua

SEQ ID NO: 490516 - RNA, 65 nt, Homo Sapiens
acuugggugacggcagucgaugagugggagaaggcagugauuagcugaaucucccacuccagcgc

SEQ ID NO: 490517 - RNA, 65 nt, Homo Sapiens
gcauacgaacagcuacauaucaaauaaaguuucuaagugauuaauccaaaaaugugaaguuauac

SEQ ID NO: 490518 - RNA, 65 nt, Homo Sapiens
uggcugagaaaacccuggagaguuagauaacaccuagugauuaauggaauaacaacuuaagcugu

SEQ ID NO: 490519 - RNA, 65 nt, Homo Sapiens
aguguauuuugcacaaaaaaauuaaccuggucaauagugauuaccaaaauauauauuaauaaucu

SEQ ID NO: 490520 - RNA, 65 nt, Homo Sapiens
gaagaacauuuuuaauucuuuaggaaucugcaaugagugauuacaugcuuguaauagguaggcaa

SEQ ID NO: 490521 - RNA, 65 nt, Homo Sapiens
acugcucuuagguuguuuugauaaagugacauuauagugauuaaauucuucccccuuuaaaaaaa

SEQ ID NO: 490522 - RNA, 65 nt, Homo Sapiens
uguuuuuaaaaagggagacuaaaagcaaauaccucagugauuaauauuuaagcuacagagaaugu

SEQ ID NO: 490523 - RNA, 65 nt, Homo Sapiens
ucuaggcucaccacaaccucugccuuccagguucaagugauuagagacagugaaauuuuuaugga

SEQ ID NO: 490524 - RNA, 65 nt, Homo Sapiens
ccuuuguugcaugcaguuggguucaaaugccaaauagugauuagaagacgaccauucugaucugu

SEQ ID NO: 490525 - RNA, 65 nt, Homo Sapiens
uggccacccucaccacugucgcagcucuugucuaaagugauuagacagcagagucaguuacaccu

SEQ ID NO: 490526 - RNA, 65 nt, Homo Sapiens
ucuaacugugaucaaacuuauauuuuauauaguaaagugauuaugcuguuauauauugugaaauu

SEQ ID NO: 490527 - RNA, 65 nt, Homo Sapiens
gaaugauaauuuagauccauuguaaaacacagaaaagugauuaauacuuuuuaauauguuaucac

SEQ ID NO: 490528 - RNA, 65 nt, Homo Sapiens
uuuuuuccccccaaguuaguuaacugaaugucuaaagugauuaucgauuuagauaaacuacauuu

SEQ ID NO: 490529 - RNA, 65 nt, Homo Sapiens
guguauuuuuuuagaacugguuuguguauauauauagugauuauggauacuaauucaauguaauu

SEQ ID NO: 490530 - RNA, 65 nt, Homo Sapiens
gaauuuuaccuauuuuuauaauuauuauuucuuaaagugauuaaaugagaacauggaugagugga

SEQ ID NO: 490531 - RNA, 65 nt, Homo Sapiens
gcuaaauaagauuuuaaacuaauucauauguaaaaagugauuaggaagaacuugaaguaucauuu

SEQ ID NO: 490532 - RNA, 65 nt, Homo Sapiens
gggccucagugccccauucucacugcuaucuggggagugauuaccccgggagacugaacugcagg

SEQ ID NO: 490533 - RNA, 65 nt, Homo Sapiens
ucaggcuuaaccauaacccucaagaucugcuugacagugauuaaauccuuagcucacauccauuc

SEQ ID NO: 490534 - RNA, 65 nt, Homo Sapiens
caaaggaaucucacuguuccuaaauaaauguguauagugauuaugaaaaguaucccacuguugau

SEQ ID NO: 490535 - RNA, 65 nt, Homo Sapiens
caaaaauauagagcugugcaugggaugcugugucuagugauuaaacccacaauccucuacuucag

SEQ ID NO: 490536 - RNA, 65 nt, Homo Sapiens
cuauaauccaaucauguauuuuaaauguagugaucagugauuauguguuccacuauuggacugcu

SEQ ID NO: 490537 - RNA, 65 nt, Homo Sapiens
ggagcagcuaaagaugagaggauuaaggggauuagagugauuauguuuuggaugaagguugcugg

SEQ ID NO: 490538 - RNA, 65 nt, Homo Sapiens
ucggguuaaagcaaaaguguauagaaggaagcaggagugauuagugcaagagaauggaagucuua

SEQ ID NO: 490539 - RNA, 65 nt, Homo Sapiens
ugauaaguaaacaaauaaauaauguaguuugagauagugauuaagugcuaugaagaaaauaaacu

SEQ ID NO: 490540 - RNA, 65 nt, Homo Sapiens
ugguugcaguccaaguacucuuggaacuacuuugcagugauuacuaaucugguauuucuugcugc

SEQ ID NO: 490541 - RNA, 65 nt, Homo Sapiens
uauuuuucuguauuuaccugaaaaugcugagaacuagugauuauaagagaaacaaagggauugau

SEQ ID NO: 490542 - RNA, 65 nt, Homo Sapiens
uggaaaauuggaaccuggauaucaggaugguagaaagugauuauaaauugcuguuuguaaaauaa

SEQ ID NO: 490543 - RNA, 65 nt, Homo Sapiens
cccagaugugggacccgguaccaugcucuaaagcgagugauuaggcagcagcugaagccaccccu

SEQ ID NO: 490544 - RNA, 65 nt, Homo Sapiens
aaagagguaagcacauuuuauauagacguaaggaaagugauuauuguuuaauaucugugaauuua

SEQ ID NO: 490545 - RNA, 65 nt, Homo Sapiens
uaucacagcauaaccccacccuuuacauuuugugcagugauuauuuuuuaaagucuucuuucaug

SEQ ID NO: 490546 - RNA, 65 nt, Homo Sapiens
aaucacuaauuuuuaguugcugagguuggcauuuuagugauuauuaagcacuucugucagucuuu

SEQ ID NO: 490547 - RNA, 65 nt, Homo Sapiens
ucuuggcucacugcagccucuaccucccagguucaagugauuauccugccuuagccuccugagua

SEQ ID NO: 490548 - RNA, 65 nt, Homo Sapiens
uuuugauaauuuugcuuaaaccacucauucguuaaagugauuacaaaaaaguucaagaaugaugu

SEQ ID NO: 490549 - RNA, 65 nt, Homo Sapiens
cacacaccucuucuuuucuugguauuucugguggcagugauuaguugaacagcacauuuaaggca

SEQ ID NO: 490550 - RNA, 65 nt, Homo Sapiens
aucagcuuaauuggauuaaauguauuaaaauucgaagugauuauuauuugggaacaugauuguau

SEQ ID NO: 490551 - RNA, 65 nt, Homo Sapiens
gcaagcuaguugaccugcacacugaugaguuuagaagugauuagguaaacauggaaagauacucc

SEQ ID NO: 490552 - RNA, 65 nt, Homo Sapiens
agcuuggucuguaaggccgguugagucuuuaacaaagugauuaagcccaaaugcagguguguagg

SEQ ID NO: 490553 - RNA, 65 nt, Homo Sapiens
uggaacacaagcugcugugaaccaaacugauaucaagugauuagcucaccgggccuugguugcuu

SEQ ID NO: 490554 - RNA, 65 nt, Homo Sapiens
aucucauuuucaguuuaaguaacugcuguuacuuaagugauuacacuuuugcucaaauugaagcu

SEQ ID NO: 490555 - RNA, 65 nt, Homo Sapiens
aggaaaagaggagaacuucauacucacaaugaaauagugauuaugaaaauacaguguucuguaau

SEQ ID NO: 490556 - RNA, 65 nt, Homo Sapiens
caucuuguuuuuuuuuuuuuuccuuuauuuugauaagugauuauuaugcuugauaaacuuugaau

SEQ ID NO: 490557 - RNA, 65 nt, Homo Sapiens
cuacucuauaaauauauacauauauuuauauauaaagugauuaguugaacuggcauccugcuuua

SEQ ID NO: 490558 - RNA, 53 nt, Homo Sapiens; identical to SEQ ID NO: 490320

SEQ ID NO: 490559 - RNA, 65 nt, Homo Sapiens
uucacucacuguccuagcuaaaauaaaagucaagcagugauuaguauguuauuuuuccuagauga

SEQ ID NO: 490560 - RNA, 65 nt, Homo Sapiens
auaaugacaugcuaaaaggcuaauuuucaguaagaagugauuaaagcaauugaggugauucaacc

SEQ ID NO: 490561 - RNA, 65 nt, Homo Sapiens
cccaagugaacagaggagaaaugagauugccagaaagugauuaacuuuggccguugcaaucugcu

SEQ ID NO: 490562 - RNA, 65 nt, Homo Sapiens
acaccugcaaaaugccuaacaaccuucuucuuuucagugauuaccacuuucuuaccaaugacuuc

SEQ ID NO: 490563 - RNA, 65 nt, Homo Sapiens
uuagaauuuugguaccuacaacaugcuugauuuugagugauuaaaaaaaaauaauuuggcugggu

SEQ ID NO: 490564 - RNA, 65 nt, Homo Sapiens
ggaauuugacauuguccaaaccuuuuucauuuuugagugauuaaaaaugaaauguccuuuguaua

SEQ ID NO: 490565 - RNA, 65 nt, Homo Sapiens
auuuaauggacaugagauaauguuagagguuuuaaagugauuaaacgugcagacuaugcaaacca

SEQ ID NO: 490566 - RNA, 65 nt, Homo Sapiens
ugcuuaacacagguuuuauuuauuauuacuguuuaagugauuauuuaccuuuaauuuagaggcaa

SEQ ID NO: 490567 - RNA, 65 nt, Homo Sapiens
caugguguacagaaaagcaucugguaaacuaacagagugauuaagauuuuccacauguagaccaa

SEQ ID NO: 490568 - RNA, 65 nt, Homo Sapiens
ucuaaggaccuccagaagcauauagcacuuugugaagugauuacacagagucggaaucuaaacug

SEQ ID NO: 490569 - RNA, 65 nt, Homo Sapiens
uuuucuucuguuaagucauguaugauugcuuuuuaagugauuaucaaugaauugcaguauauacg

SEQ ID NO: 490570 - RNA, 65 nt, Homo Sapiens
uuagaaaugaagccuuaagcugcaucaaguuacgaagugauuaauuuccuucucagcaaaccucc

SEQ ID NO: 490571 - RNA, 65 nt, Homo Sapiens
ggguuuugaccuugccagugaaguuucgguuuugaagugauuaaaugucacuuccucaucaguuu

SEQ ID NO: 490572 - RNA, 65 nt, Homo Sapiens
aaugugacuguaauuggaaauaagaccuuuaaagaagugauuaagguuaaaugaagucauaagaa

SEQ ID NO: 490573 - RNA, 65 nt, Homo Sapiens
aauucaucccaacugucuuuuuuucccuaccauucagugauuacugucaaggcugcuuagaaucc

SEQ ID NO: 490574 - RNA, 65 nt, Homo Sapiens
acauuucuugccacuuccccaacuagaccacuccuagugauuacugacuuuagugccuaaaccuu

SEQ ID NO: 490575 - RNA, 65 nt, Homo Sapiens
ucauucaggccagagacacagagaccacauagcccagugauuaaaccccgguuucacucuggccc

SEQ ID NO: 490576 - RNA, 65 nt, Homo Sapiens
acuauguaaugaauauaaucgccaguucaccggacagugauuaaacuaaugcuuugauuggauuu

SEQ ID NO: 490577 - RNA, 65 nt, Homo Sapiens
aaagauauguauagauaauuaacugcuggaacaauagugauuaaugauuauuaauuugacuugaa

SEQ ID NO: 490578 - RNA, 65 nt, Homo Sapiens
acuaaucucugggauuuuuauuguucuguuccuaaagugauuagcgggaaaaugucgacuuuguu

SEQ ID NO: 490579 - RNA, 65 nt, Homo Sapiens
uuaaagucacaucccuguaaauugcagaauucaaaagugauuaucucuuugaucuacuugccuca

SEQ ID NO: 490580 - RNA, 65 nt, Homo Sapiens
aggcucaaguuggugacccaagccuauuguaaacaagugauuaucucaaagggagaugccaaugg

SEQ ID NO: 490581 - RNA, 65 nt, Homo Sapiens
cccauuaaaggaaaucuugauugcuuccaguuuucagugauuaaaaauaaagccgcuauaaacau

SEQ ID NO: 490582 - RNA, 65 nt, Homo Sapiens
ccuuuccaagauacagccugcaagugguagcaagaagugauuagaggcagaucuggacuuggcaa

SEQ ID NO: 490583 - RNA, 65 nt, Homo Sapiens
accuggguauucacaacaggccugacuugauacuaagugauuaguuuuccaaguugucccacugc

SEQ ID NO: 490584 - RNA, 65 nt, Homo Sapiens
gaauacagacuuaacaaguguuaagugugaaugcaagugauuaauucuucuguuaguuuuuguuu

SEQ ID NO: 490585 - RNA, 65 nt, Homo Sapiens
uguacccugugcuguugcucgcgucucuauggugcagugauuaugacagaaaccacuugcuaaaa

SEQ ID NO: 490586 - RNA, 65 nt, Homo Sapiens
aggggugggguggcgggaaucuauuaauacucugcagugauuagaaaaucagccauaagaaagca

SEQ ID NO: 490587 - RNA, 65 nt, Homo Sapiens
agguaagaaaaagcagggaaaccaugggcagcaucagugauuacaguagcauuucuccuuauauc

SEQ ID NO: 490588 - RNA, 65 nt, Homo Sapiens
ugugaauaauaaauacacaauagcauuugguagguagugauuaacuaauccuuuaacucugcgga

SEQ ID NO: 490589 - RNA, 65 nt, Homo Sapiens
auaaauucaauggaauuugagaacggugauauuggagugauuaguuaaaauaacugcuuuuguaa

SEQ ID NO: 490590 - RNA, 65 nt, Homo Sapiens
uagauagugaaauuuaccuuugagauauaacaauaagugauuaacuguucacuuucagauguaau

SEQ ID NO: 490591 - RNA, 65 nt, Homo Sapiens
guguuggaaccuccuggggacauguuauauuuugaagugauuaaacuauuuaauugugugucuau

SEQ ID NO: 490592 - RNA, 65 nt, Homo Sapiens
uccuugggagcaagcagcacuaaaucacaucagggagugauuaguccuggggaaauucaguggag

SEQ ID NO: 490593 - RNA, 65 nt, Homo Sapiens
gagaggaaacuacugccuuuagaaaauauaaguaaagugauuaaagugcucacguuaccuugaca

SEQ ID NO: 490594 - RNA, 65 nt, Homo Sapiens
auuuguagcucuagugaauaauagaauuuucugauagugauuaugaagugaauguaaauuuuauu

SEQ ID NO: 490595 - RNA, 65 nt, Homo Sapiens
uucaaaagaucuuuuuguaaaauaagcucacaaauagugauuauuagugaugauuuguguguauu

SEQ ID NO: 490596 - RNA, 65 nt, Homo Sapiens
uuugaucaagccauggugaccccugccauugaaacagugauuaagagcugccacaacuggccaug

SEQ ID NO: 490597 - RNA, 65 nt, Homo Sapiens
ucuguggaaaagcauaggaauugcaggcaugaaauagugauuauacuucuuuuuuuuucuagguu

SEQ ID NO: 490598 - RNA, 65 nt, Homo Sapiens
aaucgagaggaguuauaauaugggaaaaauuaggaagugauuauaaagauguagcucuggcccag

SEQ ID NO: 490599 - RNA, 65 nt, Homo Sapiens
caagacauuuuuguuaacuaacaaauauugacugcagugauuaaccaaagcuggagaguuuacca

SEQ ID NO: 490600 - RNA, 65 nt, Homo Sapiens
auuaauccccuccauugcucuccaaaagccaauaaagugauuacacccgaugcaccuggcucugu

SEQ ID NO: 490601 - RNA, 65 nt, Homo Sapiens
uucugaaggcucauuuugguauuugaucuuaaccaagugauuauuagagaaauguaucaacucca

SEQ ID NO: 490602 - RNA, 65 nt, Homo Sapiens
ccacuuccgagacccaacccugcacgcccagcuccagugauuacucggaccuacagagggugaaa

SEQ ID NO: 490603 - RNA, 65 nt, Homo Sapiens
ugcucuguguggaauucagaggaaaacccagauucagugauuaacaaugccaaaaaaugcaagua

SEQ ID NO: 490604 - RNA, 65 nt, Homo Sapiens
uuucugaacaagguucagaauggaaaauaauuugcagugauuauauuguuuuuuagaacaacacu

SEQ ID NO: 490605 - RNA, 65 nt, Homo Sapiens
ucaagucacgaagauagagcgugggaccuuugggaagugauuaagaacaguguaaguauuaggag

SEQ ID NO: 490606 - RNA, 65 nt, Homo Sapiens
uucgauuacacugaagagaccuaacauuaucccccagugauuacuauucauucccaugggcacag

SEQ ID NO: 490607 - RNA, 65 nt, Homo Sapiens
gaguauuucccuuuugccaguuuuucauaaugcccagugauuaguuaccuguaaggaauuuguac

SEQ ID NO: 490608 - RNA, 65 nt, Homo Sapiens
ggaagaagaaauaggacucagaauacaguggcaugagugauuacacuggcagcauuaucucaggc

SEQ ID NO: 490609 - RNA, 65 nt, Homo Sapiens
ccuggaaaaguaaauuguuuauuuuacaauaagaaagugauuacauauuuuuuuuuuuacaaugg

SEQ ID NO: 490610 - RNA, 65 nt, Homo Sapiens
caauauucccagaauaguuuucaauguauuaaugaagugauuaauuggcuccauauuuagacuaa

SEQ ID NO: 490611 - RNA, 65 nt, Homo Sapiens
guugugauauguuuuggcgcauaggagacagaaauagugauuaucaggcguugagccuuuuugua

SEQ ID NO: 490612 - RNA, 65 nt, Homo Sapiens
augcuaaaucuugcuuugcauucaguaaagugucaagugauuaaguguguauuuguacccuagau

SEQ ID NO: 490613 - RNA, 65 nt, Homo Sapiens
uacuugaugaguguaacaagaaaggagagucuugcagugauuaaggucucucuuuggacucuccc

SEQ ID NO: 490614 - RNA, 65 nt, Homo Sapiens
aucauuuguaacaguccacucugucuuuaaaacauagugauuacaauauuuagaaaguuuugagc

SEQ ID NO: 490615 - RNA, 65 nt, Homo Sapiens
agaggucuauauaaaguuacuuauaugauuuacggagugauuaaccuacugaauauucuagugag

SEQ ID NO: 490616 - RNA, 65 nt, Homo Sapiens
auaguugggguaaaguuguagaaaucucgaaucauagugauuaaacuugggcuguuaaauccuag

SEQ ID NO: 490617 - RNA, 65 nt, Homo Sapiens
gcuauaucauucccaguuauaguauguguuucauaagugauuaaaaccaguuuagacuaaguuac

SEQ ID NO: 490618 - RNA, 65 nt, Homo Sapiens
uucaauucaguaugcagugauauuugugcuguaucagugauuacuuguuuacccgacagaggcuu

SEQ ID NO: 490619 - RNA, 61 nt, Homo Sapiens
cucacgugccucucggguagcauggagaaguugccaagaguucuuuaggugccuccugucu

SEQ ID NO: 490620 - RNA, 64 nt, Homo Sapiens
aagggcaauaaaugcccucucugaauguuugaacugccaagaaaaggcauggagacagcgaacu

SEQ ID NO: 490621 - RNA, 64 nt, Homo Sapiens
ucaggagccaggcuagugauacuaucccuguaacugccaagagcuguucuuggcauauuauugu

SEQ ID NO: 490622 - RNA, 64 nt, Homo Sapiens
caaggcuuuugugauaugucuggugccaaaagacugccaagaaugagggcucuggagcugugag

SEQ ID NO: 490623 - RNA, 64 nt, Homo Sapiens
ugggacagaggacacagagguggaagauugaucuugccaagagugagggcagaugucuccagcc

SEQ ID NO: 490624 - RNA, 64 nt, Homo Sapiens
cgucagagagaaccagagcuccaagucuuuaauuugccaagaugaagaaaaugaguucucaagg

SEQ ID NO: 490625 - RNA, 64 nt, Homo Sapiens
cugggcccucucuccucacugcaccaggaccugaugccaagaaagugaggauuuaggcaacaag

SEQ ID NO: 490626 - RNA, 64 nt, Homo Sapiens
agaacugaggcuuggauaucuucuucaacauccuugccaagacuucuccacccucuugcauacc

SEQ ID NO: 490627 - RNA, 64 nt, Homo Sapiens
gcaaauauuuuaccaccagucaauaauacauuuuugccaagacaugaaguuuuauaaagaucug

SEQ ID NO: 490628 - RNA, 64 nt, Homo Sapiens
auuaaugaaauaauuacauuuuauguauugaggaugccaagauuaaaaggugacagguagaugu

SEQ ID NO: 490629 - RNA, 64 nt, Homo Sapiens
ccuuuuccagggugucugcgaaauuauguauaccugccaagauaacccaaaucucucaaaaugu

SEQ ID NO: 490630 - RNA, 64 nt, Homo Sapiens
aaucggucucuaucucuaucaaauaaacacauguugccaagaugcagaaccugcacugaccaac

SEQ ID NO: 490631 - RNA, 64 nt, Homo Sapiens
uaugaccuugggaagacauuggcuccauaagcaaugccaagagaaugaucaauagugaguuugg

SEQ ID NO: 490632 - RNA, 64 nt, Homo Sapiens
aucauccucagugugaguccucagagccuccaucugccaagaacauucaguuggauuccaucgu

SEQ ID NO: 490633 - RNA, 64 nt, Homo Sapiens
ucucccaggagauauuugggacaagcugauuucuugccaagaggugaccucucaaaguugggaa

SEQ ID NO: 490634 - RNA, 64 nt, Homo Sapiens
ucuccagcuucucauucauguuggcuggucagugugccaagaccgucacauuaagguaaagguu

SEQ ID NO: 490635 - RNA, 64 nt, Homo Sapiens
caggaagcaugagugcuggauauuuuacuaccaaugccaagauaauucacucuacucagccggc

SEQ ID NO: 490636 - RNA, 64 nt, Homo Sapiens
uucacauaguucuccaguuguauggagccucuucugccaagagagggccaugcaauucauccca

SEQ ID NO: 490637 - RNA, 63 nt, Homo Sapiens
cagcgauugcgcagugcgaugcuguuagguugcgcaagcgauguuugcgcucgcauuacaggg

SEQ ID NO: 490638 - RNA, 63 nt, Homo Sapiens
agcagccagcuguggcagcgcauuaguuuuggcgcaagcgagccuaugcugcagggucacuuu

SEQ ID NO: 490639 - RNA, 64 nt, Homo Sapiens
gaacccaggaggcagagguugcagugagccaagaucgcgcuauugcacuccagccugggugaca

SEQ ID NO: 490640 - RNA, 64 nt, Homo Sapiens
cuaggugccugcccagggaggaacggaggaggacucgcgcuacaagaggccacucccagggacc

SEQ ID NO: 490641 - RNA, 64 nt, Homo Sapiens
aauaaagggaaaacggcgucagggccuaaaguaaucgcgcuaagcugccauggcuuuuucauug

SEQ ID NO: 490642 - RNA, 64 nt, Homo Sapiens
gaaccugggaggcggagguugcaaugagccgagaucgcgcuacugcacuccagccugggcaaca

SEQ ID NO: 490643 - RNA, 64 nt, Homo Sapiens
uucagugacgggugacggcuuugaagcaucacccucgcgcuauccaaacccuuaggauggugag

SEQ ID NO: 490644 - RNA, 64 nt, Homo Sapiens
gcauuccagccugggcgccggcagugagcugagaucgcgcuacugaaccugggaggcagagguu

SEQ ID NO: 490645 - RNA, 64 nt, Homo Sapiens
acagugcuggacaacacauugcaagugacuagacucgcgcuaauuuucauuuucaaaugccaag

SEQ ID NO: 490646 - RNA, 64 nt, Homo Sapiens
guguucagauuucguuuggguguuugauauuucuucgcgcuaauuggugauuucugccgugauc

SEQ ID NO: 490647 - RNA, 64 nt, Homo Sapiens; identical to SEQ ID NO: 58517

SEQ ID NO: 490648 - RNA, 64 nt, Homo Sapiens; identical to SEQ ID NO: 58518

SEQ ID NO: 490649 - RNA, 64 nt, Homo Sapiens; identical to SEQ ID NO: 58519

SEQ ID NO: 490650 - RNA, 64 nt, Homo Sapiens; identical to SEQ ID NO: 58520

SEQ ID NO: 490651 - RNA, 64 nt, Homo Sapiens; identical to SEQ ID NO: 58521

SEQ ID NO: 490652 - RNA, 64 nt, Homo Sapiens; identical to SEQ ID NO: 58522

SEQ ID NO: 490653 - RNA, 64 nt, Homo Sapiens; identical to SEQ ID NO: 58523

SEQ ID NO: 490654 - RNA, 64 nt, Homo Sapiens; identical to SEQ ID NO: 58524

SEQ ID NO: 490655 - RNA, 64 nt, Homo Sapiens; identical to SEQ ID NO: 58525

SEQ ID NO: 490656 - RNA, 64 nt, Homo Sapiens; identical to SEQ ID NO: 58526

SEQ ID NO: 490657 - RNA, 64 nt, Homo Sapiens; identical to SEQ ID NO: 58527

SEQ ID NO: 490658 - RNA, 64 nt, Homo Sapiens; identical to SEQ ID NO: 58528

SEQ ID NO: 490659 - RNA, 64 nt, Homo Sapiens; identical to SEQ ID NO: 58529

SEQ ID NO: 490660 - RNA, 64 nt, Homo Sapiens; identical to SEQ ID NO: 58530

SEQ ID NO: 490661 - RNA, 64 nt, Homo Sapiens; identical to SEQ ID NO: 58531

SEQ ID NO: 490662 - RNA, 64 nt, Homo Sapiens; identical to SEQ ID NO: 58532

SEQ ID NO: 490663 - RNA, 64 nt, Homo Sapiens; identical to SEQ ID NO: 77283

SEQ ID NO: 490664 - RNA, 64 nt, Homo Sapiens; identical to SEQ ID NO: 77284

SEQ ID NO: 490665 - RNA, 64 nt, Homo Sapiens; identical to SEQ ID NO: 77285

SEQ ID NO: 490666 - RNA, 57 nt, Homo Sapiens; identical to SEQ ID NO: 77286

SEQ ID NO: 490667 - RNA, 64 nt, Homo Sapiens; identical to SEQ ID NO: 77287

SEQ ID NO: 490668 - RNA, 64 nt, Homo Sapiens; identical to SEQ ID NO: 77288

SEQ ID NO: 490669 - RNA, 64 nt, Homo Sapiens; identical to SEQ ID NO: 77289

SEQ ID NO: 490670 - RNA, 64 nt, Homo Sapiens; identical to SEQ ID NO: 77290

SEQ ID NO: 490671 - RNA, 64 nt, Homo Sapiens; identical to SEQ ID NO: 77291

SEQ ID NO: 490672 - RNA, 64 nt, Homo Sapiens; identical to SEQ ID NO: 77292

SEQ ID NO: 490673 - RNA, 64 nt, Homo Sapiens; identical to SEQ ID NO: 77293

SEQ ID NO: 490674 - RNA, 64 nt, Homo Sapiens; identical to SEQ ID NO: 77294

SEQ ID NO: 490675 - RNA, 64 nt, Homo Sapiens; identical to SEQ ID NO: 77295

SEQ ID NO: 490676 - RNA, 64 nt, Homo Sapiens; identical to SEQ ID NO: 77296

SEQ ID NO: 490677 - RNA, 64 nt, Homo Sapiens; identical to SEQ ID NO: 77297

SEQ ID NO: 490678 - RNA, 64 nt, Homo Sapiens; identical to SEQ ID NO: 77298

SEQ ID NO: 490679 - RNA, 64 nt, Homo Sapiens; identical to SEQ ID NO: 77299

SEQ ID NO: 490680 - RNA, 64 nt, Homo Sapiens; identical to SEQ ID NO: 77300

SEQ ID NO: 490681 - RNA, 64 nt, Homo Sapiens; identical to SEQ ID NO: 77301

SEQ ID NO: 490682 - RNA, 64 nt, Homo Sapiens; identical to SEQ ID NO: 77302

SEQ ID NO: 490683 - RNA, 64 nt, Homo Sapiens; identical to SEQ ID NO: 77303

SEQ ID NO: 490684 - RNA, 64 nt, Homo Sapiens; identical to SEQ ID NO: 77304

SEQ ID NO: 490685 - RNA, 64 nt, Homo Sapiens; identical to SEQ ID NO: 77305

SEQ ID NO: 490686 - RNA, 64 nt, Homo Sapiens; identical to SEQ ID NO: 77306

SEQ ID NO: 490687 - RNA, 64 nt, Homo Sapiens; identical to SEQ ID NO: 77307

SEQ ID NO: 490688 - RNA, 64 nt, Homo Sapiens; identical to SEQ ID NO: 77308

SEQ ID NO: 490689 - RNA, 64 nt, Homo Sapiens; identical to SEQ ID NO: 77309

SEQ ID NO: 490690 - RNA, 64 nt, Homo Sapiens; identical to SEQ ID NO: 77310

SEQ ID NO: 490691 - RNA, 64 nt, Homo Sapiens; identical to SEQ ID NO: 77311

SEQ ID NO: 490692 - RNA, 64 nt, Homo Sapiens; identical to SEQ ID NO: 77312

SEQ ID NO: 490693 - RNA, 64 nt, Homo Sapiens; identical to SEQ ID NO: 77313

SEQ ID NO: 490694 - RNA, 64 nt, Homo Sapiens; identical to SEQ ID NO: 77314

SEQ ID NO: 490695 - RNA, 64 nt, Homo Sapiens; identical to SEQ ID NO: 77315

SEQ ID NO: 490696 - RNA, 64 nt, Homo Sapiens; identical to SEQ ID NO: 77316

SEQ ID NO: 490697 - RNA, 64 nt, Homo Sapiens; identical to SEQ ID NO: 77317

SEQ ID NO: 490698 - RNA, 64 nt, Homo Sapiens; identical to SEQ ID NO: 77318

SEQ ID NO: 490699 - RNA, 64 nt, Homo Sapiens; identical to SEQ ID NO: 77319

SEQ ID NO: 490700 - RNA, 64 nt, Homo Sapiens; identical to SEQ ID NO: 77320

SEQ ID NO: 490701 - RNA, 64 nt, Homo Sapiens; identical to SEQ ID NO: 77321

SEQ ID NO: 490702 - RNA, 64 nt, Homo Sapiens; identical to SEQ ID NO: 77322

SEQ ID NO: 490703 - RNA, 64 nt, Homo Sapiens; identical to SEQ ID NO: 77323

SEQ ID NO: 490704 - RNA, 64 nt, Homo Sapiens; identical to SEQ ID NO: 77324

SEQ ID NO: 490705 - RNA, 64 nt, Homo Sapiens; identical to SEQ ID NO: 77325

SEQ ID NO: 490706 - RNA, 64 nt, Homo Sapiens; identical to SEQ ID NO: 77326

SEQ ID NO: 490707 - RNA, 64 nt, Homo Sapiens; identical to SEQ ID NO: 77327

SEQ ID NO: 490708 - RNA, 64 nt, Homo Sapiens; identical to SEQ ID NO: 77328

SEQ ID NO: 490709 - RNA, 64 nt, Homo Sapiens; identical to SEQ ID NO: 77329

SEQ ID NO: 490710 - RNA, 64 nt, Homo Sapiens; identical to SEQ ID NO: 77330

SEQ ID NO: 490711 - RNA, 64 nt, Homo Sapiens; identical to SEQ ID NO: 77331

SEQ ID NO: 490712 - RNA, 64 nt, Homo Sapiens; identical to SEQ ID NO: 77332

SEQ ID NO: 490713 - RNA, 64 nt, Homo Sapiens; identical to SEQ ID NO: 77333

SEQ ID NO: 490714 - RNA, 64 nt, Homo Sapiens; identical to SEQ ID NO: 77334

SEQ ID NO: 490715 - RNA, 64 nt, Homo Sapiens; identical to SEQ ID NO: 77335

SEQ ID NO: 490716 - RNA, 64 nt, Homo Sapiens; identical to SEQ ID NO: 77336

SEQ ID NO: 490717 - RNA, 64 nt, Homo Sapiens; identical to SEQ ID NO: 77337

SEQ ID NO: 490718 - RNA, 64 nt, Homo Sapiens; identical to SEQ ID NO: 77338

SEQ ID NO: 490719 - RNA, 64 nt, Homo Sapiens; identical to SEQ ID NO: 77339

SEQ ID NO: 490720 - RNA, 64 nt, Homo Sapiens; identical to SEQ ID NO: 77340

SEQ ID NO: 490721 - RNA, 64 nt, Homo Sapiens; identical to SEQ ID NO: 77341

SEQ ID NO: 490722 - RNA, 64 nt, Homo Sapiens; identical to SEQ ID NO: 77342

SEQ ID NO: 490723 - RNA, 64 nt, Homo Sapiens; identical to SEQ ID NO: 77343

SEQ ID NO: 490724 - RNA, 64 nt, Homo Sapiens; identical to SEQ ID NO: 77344

SEQ ID NO: 490725 - RNA, 64 nt, Homo Sapiens; identical to SEQ ID NO: 77345

SEQ ID NO: 490726 - RNA, 64 nt, Homo Sapiens; identical to SEQ ID NO: 77346

SEQ ID NO: 490727 - RNA, 64 nt, Homo Sapiens; identical to SEQ ID NO: 77347

SEQ ID NO: 490728 - RNA, 64 nt, Homo Sapiens; identical to SEQ ID NO: 77348

SEQ ID NO: 490729 - RNA, 64 nt, Homo Sapiens; identical to SEQ ID NO: 77349

SEQ ID NO: 490730 - RNA, 64 nt, Homo Sapiens; identical to SEQ ID NO: 77350

SEQ ID NO: 490731 - RNA, 64 nt, Homo Sapiens; identical to SEQ ID NO: 77351

SEQ ID NO: 490732 - RNA, 64 nt, Homo Sapiens; identical to SEQ ID NO: 77352

SEQ ID NO: 490733 - RNA, 64 nt, Homo Sapiens; identical to SEQ ID NO: 77353

SEQ ID NO: 490734 - RNA, 64 nt, Homo Sapiens; identical to SEQ ID NO: 77354

SEQ ID NO: 490735 - RNA, 64 nt, Homo Sapiens; identical to SEQ ID NO: 77355

SEQ ID NO: 490736 - RNA, 64 nt, Homo Sapiens; identical to SEQ ID NO: 77356

SEQ ID NO: 490737 - RNA, 64 nt, Homo Sapiens; identical to SEQ ID NO: 77357

SEQ ID NO: 490738 - RNA, 64 nt, Homo Sapiens; identical to SEQ ID NO: 77358

SEQ ID NO: 490739 - RNA, 64 nt, Homo Sapiens; identical to SEQ ID NO: 77359

SEQ ID NO: 490740 - RNA, 64 nt, Homo Sapiens; identical to SEQ ID NO: 77360

SEQ ID NO: 490741 - RNA, 64 nt, Homo Sapiens; identical to SEQ ID NO: 77361

SEQ ID NO: 490742 - RNA, 64 nt, Homo Sapiens; identical to SEQ ID NO: 77362

SEQ ID NO: 490743 - RNA, 64 nt, Homo Sapiens; identical to SEQ ID NO: 77363

SEQ ID NO: 490744 - RNA, 64 nt, Homo Sapiens; identical to SEQ ID NO: 77364

SEQ ID NO: 490745 - RNA, 64 nt, Homo Sapiens; identical to SEQ ID NO: 77365

SEQ ID NO: 490746 - RNA, 64 nt, Homo Sapiens; identical to SEQ ID NO: 77366

SEQ ID NO: 490747 - RNA, 64 nt, Homo Sapiens; identical to SEQ ID NO: 77367

SEQ ID NO: 490748 - RNA, 64 nt, Homo Sapiens; identical to SEQ ID NO: 77368

SEQ ID NO: 490749 - RNA, 64 nt, Homo Sapiens; identical to SEQ ID NO: 77369

SEQ ID NO: 490750 - RNA, 64 nt, Homo Sapiens; identical to SEQ ID NO: 77370

SEQ ID NO: 490751 - RNA, 64 nt, Homo Sapiens; identical to SEQ ID NO: 77371

SEQ ID NO: 490752 - RNA, 64 nt, Homo Sapiens; identical to SEQ ID NO: 77372

SEQ ID NO: 490753 - RNA, 64 nt, Homo Sapiens; identical to SEQ ID NO: 77373

SEQ ID NO: 490754 - RNA, 64 nt, Homo Sapiens; identical to SEQ ID NO: 77374

SEQ ID NO: 490755 - RNA, 64 nt, Homo Sapiens; identical to SEQ ID NO: 77375

SEQ ID NO: 490756 - RNA, 64 nt, Homo Sapiens; identical to SEQ ID NO: 77376

SEQ ID NO: 490757 - RNA, 64 nt, Homo Sapiens; identical to SEQ ID NO: 77377

SEQ ID NO: 490758 - RNA, 64 nt, Homo Sapiens; identical to SEQ ID NO: 77378

SEQ ID NO: 490759 - RNA, 64 nt, Homo Sapiens; identical to SEQ ID NO: 77379

SEQ ID NO: 490760 - RNA, 64 nt, Homo Sapiens; identical to SEQ ID NO: 77380

SEQ ID NO: 490761 - RNA, 64 nt, Homo Sapiens; identical to SEQ ID NO: 77381

SEQ ID NO: 490762 - RNA, 64 nt, Homo Sapiens; identical to SEQ ID NO: 77382

SEQ ID NO: 490763 - RNA, 64 nt, Homo Sapiens; identical to SEQ ID NO: 77383

SEQ ID NO: 490764 - RNA, 64 nt, Homo Sapiens; identical to SEQ ID NO: 77384

SEQ ID NO: 490765 - RNA, 64 nt, Homo Sapiens; identical to SEQ ID NO: 77385

SEQ ID NO: 490766 - RNA, 64 nt, Homo Sapiens; identical to SEQ ID NO: 77386

SEQ ID NO: 490767 - RNA, 64 nt, Homo Sapiens; identical to SEQ ID NO: 77387

SEQ ID NO: 490768 - RNA, 64 nt, Homo Sapiens; identical to SEQ ID NO: 77388

SEQ ID NO: 490769 - RNA, 64 nt, Homo Sapiens; identical to SEQ ID NO: 77389

SEQ ID NO: 490770 - RNA, 64 nt, Homo Sapiens; identical to SEQ ID NO: 77390

SEQ ID NO: 490771 - RNA, 64 nt, Homo Sapiens; identical to SEQ ID NO: 77391

SEQ ID NO: 490772 - RNA, 64 nt, Homo Sapiens; identical to SEQ ID NO: 77392

SEQ ID NO: 490773 - RNA, 64 nt, Homo Sapiens; identical to SEQ ID NO: 77393

SEQ ID NO: 490774 - RNA, 64 nt, Homo Sapiens; identical to SEQ ID NO: 77394

SEQ ID NO: 490775 - RNA, 64 nt, Homo Sapiens; identical to SEQ ID NO: 77395

SEQ ID NO: 490776 - RNA, 64 nt, Homo Sapiens; identical to SEQ ID NO: 77396

SEQ ID NO: 490777 - RNA, 64 nt, Homo Sapiens; identical to SEQ ID NO: 77397

SEQ ID NO: 490778 - RNA, 64 nt, Homo Sapiens; identical to SEQ ID NO: 77398

SEQ ID NO: 490779 - RNA, 64 nt, Homo Sapiens; identical to SEQ ID NO: 77399

SEQ ID NO: 490780 - RNA, 64 nt, Homo Sapiens; identical to SEQ ID NO: 77400

SEQ ID NO: 490781 - RNA, 64 nt, Homo Sapiens; identical to SEQ ID NO: 77401

SEQ ID NO: 490782 - RNA, 64 nt, Homo Sapiens; identical to SEQ ID NO: 77402

SEQ ID NO: 490783 - RNA, 64 nt, Homo Sapiens; identical to SEQ ID NO: 77403

SEQ ID NO: 490784 - RNA, 64 nt, Homo Sapiens; identical to SEQ ID NO: 77404

SEQ ID NO: 490785 - RNA, 64 nt, Homo Sapiens; identical to SEQ ID NO: 77405

SEQ ID NO: 490786 - RNA, 64 nt, Homo Sapiens; identical to SEQ ID NO: 77406

SEQ ID NO: 490787 - RNA, 64 nt, Homo Sapiens; identical to SEQ ID NO: 77407

SEQ ID NO: 490788 - RNA, 64 nt, Homo Sapiens; identical to SEQ ID NO: 77408

SEQ ID NO: 490789 - RNA, 64 nt, Homo Sapiens; identical to SEQ ID NO: 77409

SEQ ID NO: 490790 - RNA, 64 nt, Homo Sapiens; identical to SEQ ID NO: 77410

SEQ ID NO: 490791 - RNA, 64 nt, Homo Sapiens; identical to SEQ ID NO: 77411

SEQ ID NO: 490792 - RNA, 64 nt, Homo Sapiens; identical to SEQ ID NO: 77412

SEQ ID NO: 490793 - RNA, 64 nt, Homo Sapiens; identical to SEQ ID NO: 77413

SEQ ID NO: 490794 - RNA, 62 nt, Homo Sapiens; identical to SEQ ID NO: 77414

SEQ ID NO: 490795 - RNA, 64 nt, Homo Sapiens; identical to SEQ ID NO: 77415

SEQ ID NO: 490796 - RNA, 64 nt, Homo Sapiens; identical to SEQ ID NO: 77416

SEQ ID NO: 490797 - RNA, 64 nt, Homo Sapiens; identical to SEQ ID NO: 77417

SEQ ID NO: 490798 - RNA, 64 nt, Homo Sapiens; identical to SEQ ID NO: 77418

SEQ ID NO: 490799 - RNA, 64 nt, Homo Sapiens; identical to SEQ ID NO: 77419

SEQ ID NO: 490800 - RNA, 64 nt, Homo Sapiens; identical to SEQ ID NO: 77420

SEQ ID NO: 490801 - RNA, 64 nt, Homo Sapiens; identical to SEQ ID NO: 77421

SEQ ID NO: 490802 - RNA, 64 nt, Homo Sapiens; identical to SEQ ID NO: 77422

SEQ ID NO: 490803 - RNA, 64 nt, Homo Sapiens
ugugggggccccaggaauccuuagcugaagcggggagacucacucuccaucucaggaaauucua

SEQ ID NO: 490804 - RNA, 64 nt, Homo Sapiens
ugggugggcaagucugggcccugggguagggagggagacucaggcccacacuuggguauuuucu

SEQ ID NO: 490805 - RNA, 64 nt, Homo Sapiens
auuguuuacuggacaucaggagaagacuucauaggagacucauuguucuucauaggagacucag

SEQ ID NO: 490806 - RNA, 64 nt, Homo Sapiens
gaagacuucauaggagacucgcuguucuucauaggagacucagacccagguacccacagcauug

SEQ ID NO: 490807 - RNA, 64 nt, Homo Sapiens
ggcugggccgugguagacucauuuacucuccaaugagacucaaucaacacuaguuugauauuug

SEQ ID NO: 490808 - RNA, 64 nt, Homo Sapiens
ggcaagaucuuucaggcuucgggcaagggucaaagagacucaugauauguacuagaaaggaaau

SEQ ID NO: 490809 - RNA, 64 nt, Homo Sapiens
uaauccaggggggacccagaccccacaagccauggagacucaggaccccagaaggcauggaagc

SEQ ID NO: 490810 - RNA, 64 nt, Homo Sapiens
agcccagggaggacccagaccuccacacuccauggagacucaguucuccuaggaccauuuauuc

SEQ ID NO: 490811 - RNA, 64 nt, Homo Sapiens
aaacacuaucugaugcacagaacaccucuacuuugagacucaccucucauaaagcuucuuuuuc

SEQ ID NO: 490812 - RNA, 64 nt, Homo Sapiens
aaucaggcagggaaucgaaacgacagugcuggaggagacucaggaagcagaggcgucccugccg

SEQ ID NO: 490813 - RNA, 64 nt, Homo Sapiens; identical to SEQ ID NO: 220328

SEQ ID NO: 490814 - RNA, 64 nt, Homo Sapiens; identical to SEQ ID NO: 220329

SEQ ID NO: 490815 - RNA, 64 nt, Homo Sapiens; identical to SEQ ID NO: 220330

SEQ ID NO: 490816 - RNA, 64 nt, Homo Sapiens; identical to SEQ ID NO: 220331

SEQ ID NO: 490817 - RNA, 64 nt, Homo Sapiens; identical to SEQ ID NO: 220332

SEQ ID NO: 490818 - RNA, 64 nt, Homo Sapiens; identical to SEQ ID NO: 220333

SEQ ID NO: 490819 - RNA, 64 nt, Homo Sapiens; identical to SEQ ID NO: 220334

SEQ ID NO: 490820 - RNA, 64 nt, Homo Sapiens; identical to SEQ ID NO: 220335

SEQ ID NO: 490821 - RNA, 64 nt, Homo Sapiens; identical to SEQ ID NO: 220336

SEQ ID NO: 490822 - RNA, 64 nt, Homo Sapiens; identical to SEQ ID NO: 220337

SEQ ID NO: 490823 - RNA, 64 nt, Homo Sapiens; identical to SEQ ID NO: 220338

SEQ ID NO: 490824 - RNA, 64 nt, Homo Sapiens; identical to SEQ ID NO: 220339

SEQ ID NO: 490825 - RNA, 64 nt, Homo Sapiens; identical to SEQ ID NO: 220340

SEQ ID NO: 490826 - RNA, 64 nt, Homo Sapiens; identical to SEQ ID NO: 220341

SEQ ID NO: 490827 - RNA, 64 nt, Homo Sapiens; identical to SEQ ID NO: 220342

SEQ ID NO: 490828 - RNA, 64 nt, Homo Sapiens; identical to SEQ ID NO: 220343

SEQ ID NO: 490829 - RNA, 64 nt, Homo Sapiens; identical to SEQ ID NO: 220344

SEQ ID NO: 490830 - RNA, 64 nt, Homo Sapiens; identical to SEQ ID NO: 220345

SEQ ID NO: 490831 - RNA, 64 nt, Homo Sapiens; identical to SEQ ID NO: 220346

SEQ ID NO: 490832 - RNA, 64 nt, Homo Sapiens; identical to SEQ ID NO: 220347

SEQ ID NO: 490833 - RNA, 64 nt, Homo Sapiens
ucccgcuacagcauguucucugaggacacuaaccacgcuggaccuugaacuggguacuugugga

SEQ ID NO: 490834 - RNA, 64 nt, Homo Sapiens
uuuuuuugagacagaguuuucacucuuauugcccacgcuggagugcaguggcaugaucucggcu

SEQ ID NO: 490835 - RNA, 64 nt, Homo Sapiens
ucuguuuuuagcagagacaugcaacaacaacacacacgcacacacgcacacacacacacguaca

SEQ ID NO: 490836 - RNA, 64 nt, Homo Sapiens
uagcagagacaugcaacaacaacacacacgcacacacgcacacacacacacguacacacacaua

SEQ ID NO: 490837 - RNA, 64 nt, Homo Sapiens
cacacacacauauagcaguacgugugcacccgcgcacgcacauacacacacacacgcacacaug

SEQ ID NO: 490838 - RNA, 64 nt, Homo Sapiens
ugcgugugcacccgcgcacgcgcacacacacacacacgcacacacuucuucagcaccacacaca

SEQ ID NO: 490839 - RNA, 64 nt, Homo Sapiens
cacacacacgcacacaugcguucagcaccacacacacgcacacaggccaagcaaccuccacuuc

SEQ ID NO: 490840 - RNA, 64 nt, Homo Sapiens
gcacacgugcucccugaaggcacacguacgcacacacgcacaugcacagauaugccgccugggc

SEQ ID NO: 490841 - RNA, 64 nt, Homo Sapiens
ugccgccugggcacacagauaagcugcccaaaugcacgcacacgcacagagacaugccagaaca

SEQ ID NO: 490842 - RNA, 64 nt, Homo Sapiens
cugggcacacagauaagcugcccaaaugcacgcacacgcacagagacaugccagaacauacaag

SEQ ID NO: 490843 - RNA, 64 nt, Homo Sapiens
cagaacauacaaggacaugcugccugaacauacacacgcacacccaugcgcagaugugcugccu

SEQ ID NO: 490844 - RNA, 64 nt, Homo Sapiens
acacacacacgugugcacagauaugcugucuggacacgcacacacaugcagauaugcugccugg

SEQ ID NO: 490845 - RNA, 64 nt, Homo Sapiens
acacacgugcagauaugcuguccggauacacacgcacgcacacaugcagauaugcugccugggc

SEQ ID NO: 490846 - RNA, 64 nt, Homo Sapiens
uacaaucuggguuaucuuugcacgcacaugugugcacgcacacaugcagcaacaugugcacagg

SEQ ID NO: 490847 - RNA, 64 nt, Homo Sapiens
ugugcacgcacacauacaauaacaugugcacaggcacgcacaugaagagagggaggggugcagc

SEQ ID NO: 490848 - RNA, 64 nt, Homo Sapiens
cugugcaaauucugaugauggccccacccccgcacacgcacacgcacaucaugcuuuuccagcu

SEQ ID NO: 490849 - RNA, 64 nt, Homo Sapiens
aaauucugaugauggccccacccccgcacacgcacacgcacaucaugcuuuuccagcucaucac

SEQ ID NO: 490850 - RNA, 64 nt, Homo Sapiens
ccucccucccuucuuccucucucucucucucacucacgcacacgcacacacacacacacacaca

SEQ ID NO: 490851 - RNA, 64 nt, Homo Sapiens
ucccuucuuccucucucucucucucacucacgcacacgcacacacacacacacacacacacaca

SEQ ID NO: 490852 - RNA, 64 nt, Homo Sapiens
augcuuuuccagcucaucaccccccgcacacgcacacgcacaucaaauucugaugaugacccca

SEQ ID NO: 490853 - RNA, 64 nt, Homo Sapiens
cacaucaugcuuuuccagcuaccccacccccgcacacgcacacgcugugcaaauucugaugaug

SEQ ID NO: 490854 - RNA, 64 nt, Homo Sapiens
cgccagugcgcacguguacacgcacacacacauacacgcacaaggguagcaaaugacacaugca

SEQ ID NO: 490855 - RNA, 64 nt, Homo Sapiens
cacauacacgcacaagcgccgcaaaugacacaugcacgcacacaacugaaacauucaccuggua

SEQ ID NO: 490856 - RNA, 64 nt, Homo Sapiens
ugcacacacaugcaugcacacacaugcacacauacacgcacaugcacacauacacaugcaugca

SEQ ID NO: 490857 - RNA, 64 nt, Homo Sapiens
cauacacaggcauacaugcaugcacacacacaugcacgcacacacacaugcacacauacacgug

SEQ ID NO: 490858 - RNA, 64 nt, Homo Sapiens
uucacacccagucccugccacagaccgucucagacacgcacagugggccugcugcaugauucac

SEQ ID NO: 490859 - RNA, 64 nt, Homo Sapiens; identical to SEQ ID NO: 490858

SEQ ID NO: 490860 - RNA, 64 nt, Homo Sapiens
uucacacccagucccugccacagaccgucucagacacgcacagugggccugcugcaugcguguu

SEQ ID NO: 490861 - RNA, 64 nt, Homo Sapiens
acguaugagcuucuacugcacacaugcacacacacacgcacacguacauucacuacaaacgugc

SEQ ID NO: 490862 - RNA, 64 nt, Homo Sapiens
acguacacacagaugcacauggacacaccccaaacacgcacaggcuccuacacacaugcacaca

SEQ ID NO: 490863 - RNA, 64 nt, Homo Sapiens
uggucacacagagauacgcaaacacaccgaugcacacgcacauagagauaugcacacacagaug

SEQ ID NO: 490864 - RNA, 64 nt, Homo Sapiens
cacacagaugcacacacagauauacacauggaugcacgcacaugccaaugcacgcacacaucag

SEQ ID NO: 490865 - RNA, 64 nt, Homo Sapiens
cagauauacacauggaugcacgcacaugccaaugcacgcacacaucagugcacacggaugcaca

SEQ ID NO: 490866 - RNA, 64 nt, Homo Sapiens
uuucaggacgucccuaagcugagcuaggaggcaccacgcacaggccggaggcaccacgcacagg

SEQ ID NO: 490867 - RNA, 64 nt, Homo Sapiens
gagcuaggaggcaccacgcacaggccggaggcaccacgcacaggccagagucucccaaauccug

SEQ ID NO: 490868 - RNA, 64 nt, Homo Sapiens
cacacacacaaaugcacgcccacuugcacaugcucacgcacauguucacacaugcacacucacg

SEQ ID NO: 490869 - RNA, 64 nt, Homo Sapiens
cacucacgcucacacaugcugucacgcauacacacacgcacauacuccugcacauguucccaug

SEQ ID NO: 490870 - RNA, 64 nt, Homo Sapiens
ucuuaccucucaugcguguucacacacgcacgcacacgcacacacacacacacacacacacaca

SEQ ID NO: 490871 - RNA, 64 nt, Homo Sapiens
cacacaucuuaccucucaugcacacacacacacgcacgcacacggggacacacacacacacaca

SEQ ID NO: 490872 - RNA, 64 nt, Homo Sapiens
gccugguuuuguccucaugcccccugcacacgcacacgcacacaggaaugaaccgaggccgucg

SEQ ID NO: 490873 - RNA, 64 nt, Homo Sapiens
cacacagccugguuuuguccccgucgccccugcacacgcacacguccccaggaaugaaccgagg

SEQ ID NO: 490874 - RNA, 64 nt, Homo Sapiens
cccucuaacaagaacuugucucagcacaugcgcacacgcacacucggacucacacgaagucaca

SEQ ID NO: 490875 - RNA, 64 nt, Homo Sapiens
ugcgcacacgcacacucggacucacacgaagucacacgcacacaugcacgcacacacacauaug

SEQ ID NO: 490876 - RNA, 64 nt, Homo Sapiens
cacucggacucacacgaagucacacgcacacaugcacgcacacacacauauggggaccugcaca

SEQ ID NO: 490877 - RNA, 64 nt, Homo Sapiens
guggcagaagggauuuauaucaaacacacacacgcacgcacacacaugugugggcacacacgca

SEQ ID NO: 490878 - RNA, 64 nt, Homo Sapiens
cacacacacgcacgcacacacaugugugggcacacacgcacaaaucugugaauuaaaauaugcu

SEQ ID NO: 490879 - RNA, 64 nt, Homo Sapiens
cacacccagugcucucuccaugugcuugcacgugcacgcacacaccaucccccaugcucuugcg

SEQ ID NO: 490880 - RNA, 64 nt, Homo Sapiens
ucuccucgucugggugugcggugcucgcugugcgcacgcacacagugugugugugcgcgcgcgc

SEQ ID NO: 490881 - RNA, 64 nt, Homo Sapiens
gaugcaguuuccauagcaacgaaguuacuaauucggaccugacuggcagacaccccuuccagcg

SEQ ID NO: 490882 - RNA, 64 nt, Homo Sapiens
aaguggaaagcacacuucauauucaucaaggaaaggaccugaagguuuuauacauuuccagacc

SEQ ID NO: 490883 - RNA, 64 nt, Homo Sapiens
gcacugggcuguguccugauuccucagaguauggggaccugacaucuuuggguccccaagaguu

SEQ ID NO: 490884 - RNA, 64 nt, Homo Sapiens
gaugcuccguucacauaagccagugugguucuggggaccugaggagcccuguggcacccacagg

SEQ ID NO: 490885 - RNA, 64 nt, Homo Sapiens
gcuccagugguagaggaccaaggauugagguuugggaccugaagcuccagugugugccuuuggc

SEQ ID NO: 490886 - RNA, 64 nt, Homo Sapiens
cuggagcccaagcagcuccccuaggggacugaccggaccugaccuccccucccugugucugggu

SEQ ID NO: 490887 - RNA, 64 nt, Homo Sapiens
gcaccuggaauuuguuggaaaugaaugucuguggggaccugagacuagucuuucuaugcuccaa

SEQ ID NO: 490888 - RNA, 64 nt, Homo Sapiens
gggugggagcugguuauguggcacacacagaaggggaccugauuguggagucguaguaauaugu

SEQ ID NO: 490889 - RNA, 64 nt, Homo Sapiens
cccuuggcacacuuguacccacaggugaggggcaggaccugaagguauuggccuguucaacaau

SEQ ID NO: 490890 - RNA, 64 nt, Homo Sapiens
uggggaccaaaggucagggacacauccccuuagaggaccugaguuugggagaguggugagugga

SEQ ID NO: 490891 - RNA, 64 nt, Homo Sapiens
gauuugaucaccgaagcagccaccugcuguaguuggaccugaggucagaggcggggcaucagag

SEQ ID NO: 490892 - RNA, 64 nt, Homo Sapiens
ccuugcugugugugagggcccagguggaaggcgcggaccugacagcauuccaauaaagcauacg

SEQ ID NO: 490893 - RNA, 64 nt, Homo Sapiens; identical to SEQ ID NO: 119910

SEQ ID NO: 490894 - RNA, 64 nt, Homo Sapiens; identical to SEQ ID NO: 119911

SEQ ID NO: 490895 - RNA, 64 nt, Homo Sapiens; identical to SEQ ID NO: 119912

SEQ ID NO: 490896 - RNA, 64 nt, Homo Sapiens; identical to SEQ ID NO: 119913

SEQ ID NO: 490897 - RNA, 64 nt, Homo Sapiens; identical to SEQ ID NO: 119914

SEQ ID NO: 490898 - RNA, 64 nt, Homo Sapiens; identical to SEQ ID NO: 119915

SEQ ID NO: 490899 - RNA, 64 nt, Homo Sapiens; identical to SEQ ID NO: 119916

SEQ ID NO: 490900 - RNA, 64 nt, Homo Sapiens; identical to SEQ ID NO: 119917

SEQ ID NO: 490901 - RNA, 64 nt, Homo Sapiens; identical to SEQ ID NO: 119918

SEQ ID NO: 490902 - RNA, 64 nt, Homo Sapiens; identical to SEQ ID NO: 119919

SEQ ID NO: 490903 - RNA, 64 nt, Homo Sapiens; identical to SEQ ID NO: 119920

SEQ ID NO: 490904 - RNA, 64 nt, Homo Sapiens; identical to SEQ ID NO: 119921

SEQ ID NO: 490905 - RNA, 64 nt, Homo Sapiens; identical to SEQ ID NO: 119922

SEQ ID NO: 490906 - RNA, 64 nt, Homo Sapiens; identical to SEQ ID NO: 119923

SEQ ID NO: 490907 - RNA, 64 nt, Homo Sapiens; identical to SEQ ID NO: 119924

SEQ ID NO: 490908 - RNA, 64 nt, Homo Sapiens; identical to SEQ ID NO: 119925

SEQ ID NO: 490909 - RNA, 64 nt, Homo Sapiens; identical to SEQ ID NO: 119926

SEQ ID NO: 490910 - RNA, 64 nt, Homo Sapiens; identical to SEQ ID NO: 119927

SEQ ID NO: 490911 - RNA, 64 nt, Homo Sapiens; identical to SEQ ID NO: 119928

SEQ ID NO: 490912 - RNA, 64 nt, Homo Sapiens; identical to SEQ ID NO: 119929

SEQ ID NO: 490913 - RNA, 64 nt, Homo Sapiens; identical to SEQ ID NO: 119930

SEQ ID NO: 490914 - RNA, 64 nt, Homo Sapiens; identical to SEQ ID NO: 119931

SEQ ID NO: 490915 - RNA, 64 nt, Homo Sapiens; identical to SEQ ID NO: 119932

SEQ ID NO: 490916 - RNA, 64 nt, Homo Sapiens; identical to SEQ ID NO: 119933

SEQ ID NO: 490917 - RNA, 64 nt, Homo Sapiens; identical to SEQ ID NO: 119934

SEQ ID NO: 490918 - RNA, 64 nt, Homo Sapiens; identical to SEQ ID NO: 119935

SEQ ID NO: 490919 - RNA, 64 nt, Homo Sapiens; identical to SEQ ID NO: 119936

SEQ ID NO: 490920 - RNA, 64 nt, Homo Sapiens; identical to SEQ ID NO: 119937

SEQ ID NO: 490921 - RNA, 64 nt, Homo Sapiens; identical to SEQ ID NO: 119938

SEQ ID NO: 490922 - RNA, 64 nt, Homo Sapiens; identical to SEQ ID NO: 119939

SEQ ID NO: 490923 - RNA, 64 nt, Homo Sapiens; identical to SEQ ID NO: 119940

SEQ ID NO: 490924 - RNA, 64 nt, Homo Sapiens; identical to SEQ ID NO: 119941

SEQ ID NO: 490925 - RNA, 64 nt, Homo Sapiens; identical to SEQ ID NO: 119942

SEQ ID NO: 490926 - RNA, 64 nt, Homo Sapiens; identical to SEQ ID NO: 119943

SEQ ID NO: 490927 - RNA, 64 nt, Homo Sapiens; identical to SEQ ID NO: 119944

SEQ ID NO: 490928 - RNA, 64 nt, Homo Sapiens; identical to SEQ ID NO: 119945

SEQ ID NO: 490929 - RNA, 64 nt, Homo Sapiens; identical to SEQ ID NO: 119946

SEQ ID NO: 490930 - RNA, 64 nt, Homo Sapiens; identical to SEQ ID NO: 119947

SEQ ID NO: 490931 - RNA, 64 nt, Homo Sapiens; identical to SEQ ID NO: 119948

SEQ ID NO: 490932 - RNA, 64 nt, Homo Sapiens; identical to SEQ ID NO: 119949

SEQ ID NO: 490933 - RNA, 64 nt, Homo Sapiens; identical to SEQ ID NO: 119950

SEQ ID NO: 490934 - RNA, 64 nt, Homo Sapiens; identical to SEQ ID NO: 119951

SEQ ID NO: 490935 - RNA, 64 nt, Homo Sapiens; identical to SEQ ID NO: 119952

SEQ ID NO: 490936 - RNA, 64 nt, Homo Sapiens; identical to SEQ ID NO: 119953

SEQ ID NO: 490937 - RNA, 64 nt, Homo Sapiens; identical to SEQ ID NO: 119954

SEQ ID NO: 490938 - RNA, 64 nt, Homo Sapiens; identical to SEQ ID NO: 119955

SEQ ID NO: 490939 - RNA, 64 nt, Homo Sapiens; identical to SEQ ID NO: 119956

SEQ ID NO: 490940 - RNA, 64 nt, Homo Sapiens; identical to SEQ ID NO: 119957

SEQ ID NO: 490941 - RNA, 64 nt, Homo Sapiens; identical to SEQ ID NO: 119958

SEQ ID NO: 490942 - RNA, 64 nt, Homo Sapiens; identical to SEQ ID NO: 119959

SEQ ID NO: 490943 - RNA, 64 nt, Homo Sapiens; identical to SEQ ID NO: 119960

SEQ ID NO: 490944 - RNA, 64 nt, Homo Sapiens; identical to SEQ ID NO: 119961

SEQ ID NO: 490945 - RNA, 58 nt, Homo Sapiens; identical to SEQ ID NO: 119962

SEQ ID NO: 490946 - RNA, 64 nt, Homo Sapiens; identical to SEQ ID NO: 119963

SEQ ID NO: 490947 - RNA, 64 nt, Homo Sapiens; identical to SEQ ID NO: 119964

SEQ ID NO: 490948 - RNA, 64 nt, Homo Sapiens; identical to SEQ ID NO: 119965

SEQ ID NO: 490949 - RNA, 64 nt, Homo Sapiens; identical to SEQ ID NO: 119966

SEQ ID NO: 490950 - RNA, 64 nt, Homo Sapiens; identical to SEQ ID NO: 119967

SEQ ID NO: 490951 - RNA, 64 nt, Homo Sapiens; identical to SEQ ID NO: 119968

SEQ ID NO: 490952 - RNA, 64 nt, Homo Sapiens; identical to SEQ ID NO: 119969

SEQ ID NO: 490953 - RNA, 64 nt, Homo Sapiens; identical to SEQ ID NO: 119970

SEQ ID NO: 490954 - RNA, 55 nt, Homo Sapiens; identical to SEQ ID NO: 119971

SEQ ID NO: 490955 - RNA, 64 nt, Homo Sapiens; identical to SEQ ID NO: 119972

SEQ ID NO: 490956 - RNA, 64 nt, Homo Sapiens; identical to SEQ ID NO: 119973

SEQ ID NO: 490957 - RNA, 64 nt, Homo Sapiens; identical to SEQ ID NO: 119974

SEQ ID NO: 490958 - RNA, 64 nt, Homo Sapiens; identical to SEQ ID NO: 119975

SEQ ID NO: 490959 - RNA, 64 nt, Homo Sapiens; identical to SEQ ID NO: 119976

SEQ ID NO: 490960 - RNA, 64 nt, Homo Sapiens; identical to SEQ ID NO: 119977

SEQ ID NO: 490961 - RNA, 64 nt, Homo Sapiens; identical to SEQ ID NO: 119978

SEQ ID NO: 490962 - RNA, 64 nt, Homo Sapiens; identical to SEQ ID NO: 119979

SEQ ID NO: 490963 - RNA, 64 nt, Homo Sapiens; identical to SEQ ID NO: 119980

SEQ ID NO: 490964 - RNA, 64 nt, Homo Sapiens; identical to SEQ ID NO: 119981

SEQ ID NO: 490965 - RNA, 64 nt, Homo Sapiens; identical to SEQ ID NO: 119982

SEQ ID NO: 490966 - RNA, 64 nt, Homo Sapiens; identical to SEQ ID NO: 119983

SEQ ID NO: 490967 - RNA, 64 nt, Homo Sapiens; identical to SEQ ID NO: 119984

SEQ ID NO: 490968 - RNA, 64 nt, Homo Sapiens; identical to SEQ ID NO: 119985

SEQ ID NO: 490969 - RNA, 64 nt, Homo Sapiens; identical to SEQ ID NO: 119986

SEQ ID NO: 490970 - RNA, 64 nt, Homo Sapiens; identical to SEQ ID NO: 119987

SEQ ID NO: 490971 - RNA, 55 nt, Homo Sapiens; identical to SEQ ID NO: 119988

SEQ ID NO: 490972 - RNA, 64 nt, Homo Sapiens; identical to SEQ ID NO: 119989

SEQ ID NO: 490973 - RNA, 64 nt, Homo Sapiens; identical to SEQ ID NO: 119990

SEQ ID NO: 490974 - RNA, 64 nt, Homo Sapiens; identical to SEQ ID NO: 119991

SEQ ID NO: 490975 - RNA, 64 nt, Homo Sapiens; identical to SEQ ID NO: 119992

SEQ ID NO: 490976 - RNA, 64 nt, Homo Sapiens; identical to SEQ ID NO: 119993

SEQ ID NO: 490977 - RNA, 64 nt, Homo Sapiens; identical to SEQ ID NO: 119994

SEQ ID NO: 490978 - RNA, 64 nt, Homo Sapiens; identical to SEQ ID NO: 119995

SEQ ID NO: 490979 - RNA, 64 nt, Homo Sapiens; identical to SEQ ID NO: 119996

SEQ ID NO: 490980 - RNA, 64 nt, Homo Sapiens; identical to SEQ ID NO: 119997

SEQ ID NO: 490981 - RNA, 64 nt, Homo Sapiens; identical to SEQ ID NO: 119998

SEQ ID NO: 490982 - RNA, 62 nt, Homo Sapiens; identical to SEQ ID NO: 119999

SEQ ID NO: 490983 - RNA, 64 nt, Homo Sapiens; identical to SEQ ID NO: 120000

SEQ ID NO: 490984 - RNA, 64 nt, Homo Sapiens; identical to SEQ ID NO: 120001

SEQ ID NO: 490985 - RNA, 64 nt, Homo Sapiens; identical to SEQ ID NO: 120002

SEQ ID NO: 490986 - RNA, 64 nt, Homo Sapiens; identical to SEQ ID NO: 120003

SEQ ID NO: 490987 - RNA, 64 nt, Homo Sapiens; identical to SEQ ID NO: 120004

SEQ ID NO: 490988 - RNA, 64 nt, Homo Sapiens; identical to SEQ ID NO: 120005

SEQ ID NO: 490989 - RNA, 64 nt, Homo Sapiens; identical to SEQ ID NO: 120006

SEQ ID NO: 490990 - RNA, 64 nt, Homo Sapiens; identical to SEQ ID NO: 120007

SEQ ID NO: 490991 - RNA, 64 nt, Homo Sapiens; identical to SEQ ID NO: 120008

SEQ ID NO: 490992 - RNA, 64 nt, Homo Sapiens; identical to SEQ ID NO: 486536

SEQ ID NO: 490993 - RNA, 64 nt, Homo Sapiens; identical to SEQ ID NO: 486537

SEQ ID NO: 490994 - RNA, 64 nt, Homo Sapiens; identical to SEQ ID NO: 486538

SEQ ID NO: 490995 - RNA, 64 nt, Homo Sapiens; identical to SEQ ID NO: 486539

SEQ ID NO: 490996 - RNA, 64 nt, Homo Sapiens; identical to SEQ ID NO: 486540

SEQ ID NO: 490997 - RNA, 64 nt, Homo Sapiens; identical to SEQ ID NO: 486541

SEQ ID NO: 490998 - RNA, 64 nt, Homo Sapiens; identical to SEQ ID NO: 486542

SEQ ID NO: 490999 - RNA, 64 nt, Homo Sapiens; identical to SEQ ID NO: 486543

SEQ ID NO: 491000 - RNA, 64 nt, Homo Sapiens; identical to SEQ ID NO: 486544

SEQ ID NO: 491001 - RNA, 64 nt, Homo Sapiens; identical to SEQ ID NO: 486545

SEQ ID NO: 491002 - RNA, 64 nt, Homo Sapiens; identical to SEQ ID NO: 486546

SEQ ID NO: 491003 - RNA, 64 nt, Homo Sapiens; identical to SEQ ID NO: 486547

SEQ ID NO: 491004 - RNA, 64 nt, Homo Sapiens; identical to SEQ ID NO: 486548

SEQ ID NO: 491005 - RNA, 64 nt, Homo Sapiens; identical to SEQ ID NO: 486549

SEQ ID NO: 491006 - RNA, 64 nt, Homo Sapiens
gcuagagccacucacugucauccuccuugcccggaaaagggagacuuugacuaaauuaccccca

SEQ ID NO: 491007 - RNA, 64 nt, Homo Sapiens
aaaaaaguaauuuuaaggggacccguagggggagaaaagggagguuugaugccaaccccaacag

SEQ ID NO: 491008 - RNA, 64 nt, Homo Sapiens
gcauuauuuauugcuguguaaugaccagaaaucaaaaagggaauccuggggcuagaucgaugau

SEQ ID NO: 491009 - RNA, 64 nt, Homo Sapiens
aaggauauguggagaaucauuggguauaaaggcuaaaagggaaaguguccagcugaguuucucu

SEQ ID NO: 491010 - RNA, 64 nt, Homo Sapiens
gaacuuaaagaacuggugauuuuuuuuuaacaaaaaaagggaccauugcaacuuuuguuaauuu

SEQ ID NO: 491011 - RNA, 64 nt, Homo Sapiens
auuaauauauuuucaggcguauuuuuguacagugaaaagggaacauucuugcuguguuuuuuca

SEQ ID NO: 491012 - RNA, 64 nt, Homo Sapiens
uagugacuugacugagaaguuaggguagaaaacaaaaagggaguggauucugggagccucuucc

SEQ ID NO: 491013 - RNA, 64 nt, Homo Sapiens
aagagcguccauaggagaagugagaauacugugaaaaagggauguuagcauucauuagaguaug

SEQ ID NO: 491014 - RNA, 64 nt, Homo Sapiens
gccacggaaugugugugaagggaagucacaucagaaaagggaaaggaggugugggguaagggag

SEQ ID NO: 491015 - RNA, 64 nt, Homo Sapiens
cuaaugaggcuuaacucaaauacacugucaagggaaaagggagaagugcuacgcugcacaguuc

SEQ ID NO: 491016 - RNA, 64 nt, Homo Sapiens
cauaguguuuguaacaccgucagaaaauccugacaaaagggacaugggcacaaguauuacacau

SEQ ID NO: 491017 - RNA, 64 nt, Homo Sapiens
agcauguugauucuagguugaaauaaauacauaaaaaagggacauguguuugcaaaaaaaaaga

SEQ ID NO: 491018 - RNA, 64 nt, Homo Sapiens
aagcacugucuaaguuuauguugcauuuuuagucaaaagggagaaaucuuauuccuucuugaaa

SEQ ID NO: 491019 - RNA, 64 nt, Homo Sapiens
uguuuaaucuguaaauaagaaauguauuuaaauuaaaagggaucuuuuuguaaaaggaccaaau

SEQ ID NO: 491020 - RNA, 64 nt, Homo Sapiens
cauuuuucacuguacauuaugauacacaggacugaaaagggaaucccaaagcccugguaaaagg

SEQ ID NO: 491021 - RNA, 64 nt, Homo Sapiens
cacaggacugaaaagggaaucccaaagcccugguaaaagggauauuuccuacuuucuccugaaa

SEQ ID NO: 491022 - RNA, 64 nt, Homo Sapiens
uuuucgaauuauuuuuauauugagaguguacaguaaaagggauuguuguuucucuuucuugcuu

SEQ ID NO: 491023 - RNA, 64 nt, Homo Sapiens
uuagcucuggaacucaaaauuucagaaauguuuuaaaagggacuucauccugcuucaagucagc

SEQ ID NO: 491024 - RNA, 64 nt, Homo Sapiens
aaggcagugggaaaagagguccacugugagcuggaaaagggagauaaaaaggcccggcccagga

SEQ ID NO: 491025 - RNA, 64 nt, Homo Sapiens
uguccuagguuuucuuugugcccaguuuaaaacaaaaagggaaaccuccaaggaguuagaauuu

SEQ ID NO: 491026 - RNA, 64 nt, Homo Sapiens
uaaaagucuuuugaagguagugcauaaugaauguaaaagggaaaaaaagaauagaagugaaauu

SEQ ID NO: 491027 - RNA, 64 nt, Homo Sapiens
uuuaaaagcacaucuauguucacugccacucugaaaaagggaauuauuucucagucuuucaagg

SEQ ID NO: 491028 - RNA, 64 nt, Homo Sapiens
cccaagguuggagggugggaugaguacccucugaaaaagggaauuugcuggugaaaagaggcug

SEQ ID NO: 491029 - RNA, 64 nt, Homo Sapiens
aaagaaaagcaaggaaaaggaaaaagaaaagaaaaaaagggaaaauguauguuguaagaaaaga

SEQ ID NO: 491030 - RNA, 64 nt, Homo Sapiens
uuuguuuacucuaucaugaauugcucaagcacacaaaagggacuuuucuccucuugguuuucau

SEQ ID NO: 491031 - RNA, 64 nt, Homo Sapiens
aacgucccauuccucuuuucuuauuugcuagcagaaaagggacuauuucaauacggugauaucc

SEQ ID NO: 491032 - RNA, 64 nt, Homo Sapiens
auguagcucuuaguuuacacaagggagauguaguaaaagggaaaucuuguagugcuuuucuuuu

SEQ ID NO: 491033 - RNA, 64 nt, Homo Sapiens
cagguuauuuggggugagugucagggaaaugaacaaaagggacggggacagacaagcugggacg

SEQ ID NO: 491034 - RNA, 64 nt, Homo Sapiens
agaaacgaaaaggacagacgaagaguuuaaagagaaaagggaaaaaagaaagaaaaaguaagca

SEQ ID NO: 491035 - RNA, 64 nt, Homo Sapiens
guccagaggcuuuaaaacuggugcaauuacagcaaaaagggauucuguagcuuuaacuuguaaa

SEQ ID NO: 491036 - RNA, 64 nt, Homo Sapiens
agaucccaauggugugagucugacuuuggaaagaaaaagggacuaaagagaaauguaacaaacu

SEQ ID NO: 491037 - RNA, 64 nt, Homo Sapiens
ugccaaaacaguguugccauuuucaagggcagggaaaagggaguaaaagguguauuuuugucgu

SEQ ID NO: 491038 - RNA, 64 nt, Homo Sapiens
gaaauguugucuuuuauacuuaguuauauaagaaaaaagggaguuaugcaauuaauaucuauca

SEQ ID NO: 491039 - RNA, 64 nt, Homo Sapiens
uuuuacaaaagguguagcuuuuauaagagugcagaaaagggaaggauguguuuuuuucucucac

SEQ ID NO: 491040 - RNA, 64 nt, Homo Sapiens
aaaucauuguuuauuacuggucacuuagaaaauuaaaagggauagggccaggcacaguggcuua

SEQ ID NO: 491041 - RNA, 64 nt, Homo Sapiens
caagacuccgucucaaagaaacaaacaaaaaauuaaaagggauagaauauaaugaaauauauuu

SEQ ID NO: 491042 - RNA, 64 nt, Homo Sapiens
auacgaaacacagaaagggacucauuuacugacaaaaagggaaagauuuccaaucaguguauug

SEQ ID NO: 491043 - RNA, 64 nt, Homo Sapiens
gaccuuuucuucuaguaagugacuagaauuagagaaaagggaaacuggaguuaccucagcagaa

SEQ ID NO: 491044 - RNA, 64 nt, Homo Sapiens
aacauuaaauaaaaguaguuaaaaaaaaaaaaaaaaaagggauucuuagcuugguuaaaaaaaa

SEQ ID NO: 491045 - RNA, 64 nt, Homo Sapiens
accaggauuuauuaaguaaacacugcuaauuuaaaaaagggaguuggccuuaguaggcuguauu

SEQ ID NO: 491046 - RNA, 64 nt, Homo Sapiens
aacacgaaagaaaagucaggaagguagagagagaaaaagggagggaaggagaaagaaugggaau

SEQ ID NO: 491047 - RNA, 64 nt, Homo Sapiens
gcuucaggaguggagugagaauuucuuuuuuaugaaaagggauauaaaggcaccgagcugaugc

SEQ ID NO: 491048 - RNA, 64 nt, Homo Sapiens
aaugguccaagccgcauaauaagucuggaagagcaaaagggaguuacuaggauauggggugggc

SEQ ID NO: 491049 - RNA, 64 nt, Homo Sapiens
cuucccauaucugguggaggugagggggcuccucaaaagggaacugagaggcugcucuuaggga

SEQ ID NO: 491050 - RNA, 64 nt, Homo Sapiens
caggcuuaucugccugcuccucucccuccuaaggaaaagggaguagcagauugaucugagggga

SEQ ID NO: 491051 - RNA, 64 nt, Homo Sapiens
ugcauuuuuaccgugcacguaaauuggucagcagaaaagggagcccagaaaaggcagcagaugg

SEQ ID NO: 491052 - RNA, 64 nt, Homo Sapiens
aaagcugcucauuucauuuuguccaaccaaaaagaaaagggagauaacuaaugagcuucuagug

SEQ ID NO: 491053 - RNA, 64 nt, Homo Sapiens
auauuagaaaauuggcauauguacuuuauuuuugaaaagggaagagaugggugugggguggcaa

SEQ ID NO: 491054 - RNA, 64 nt, Homo Sapiens
gcugaaaaccacggagcuccauggcucuucauucaaaagggaaaauaaugauuccacguugcuu

SEQ ID NO: 491055 - RNA, 64 nt, Homo Sapiens
aagguccuugacuuucuccccaggaauucacuuaaaaagggacugagcauugugucaaccuguu

SEQ ID NO: 491056 - RNA, 64 nt, Homo Sapiens
gaacugauuugaggcuaaacgaaaagggauugagaaaagggaugacuuuaacuguuagacauca

SEQ ID NO: 491057 - RNA, 57 nt, Homo Sapiens
gagaaaagggauggaacugaacaucagaaaagggauucacaggacuuuaacuguuag

SEQ ID NO: 491058 - RNA, 64 nt, Homo Sapiens
aaaaaaauucuguagauagccucuaauagagguuaaaagggaaaaauuccaccuccuuccugaa

SEQ ID NO: 491059 - RNA, 64 nt, Homo Sapiens
ggugggcucuucugccaguuuugagccaacaccuaaaagggagaacuuggccaaguuugcagcc

SEQ ID NO: 491060 - RNA, 64 nt, Homo Sapiens
aauauauucugcuggaagccacucuucuauaaauaaaagggaggguccaaaugaauuucuguau

SEQ ID NO: 491061 - RNA, 64 nt, Homo Sapiens
uauuuugcauucucaaugguucugcaaaaaacaaaaaagggacuacacgcuuucuuguagugcu

SEQ ID NO: 491062 - RNA, 64 nt, Homo Sapiens
cagggugggcuuccguucucacugcuucagauggaaaagggaggagaggagccagccuccccgc

SEQ ID NO: 491063 - RNA, 64 nt, Homo Sapiens
acagacuuccaagaguuacuuuuuauuaaugaagaaaagggaagacuuagucauuguucugugu

SEQ ID NO: 491064 - RNA, 64 nt, Homo Sapiens
uagggaaaagauucuuggacucaauuuuagaaucaaaagggaaaggaucaaaagguucaguaac

SEQ ID NO: 491065 - RNA, 64 nt, Homo Sapiens
agagaaugggagagugagagaaaauaaaaaaggcaaaagggagagagaggggaagggggucuca

SEQ ID NO: 491066 - RNA, 64 nt, Homo Sapiens
cccucccaagcucccaucuauggggcuuagcaaaaaaagggaggaagugggggcuggauaugcc

SEQ ID NO: 491067 - RNA, 64 nt, Homo Sapiens
uacugccuucuaacuccugcauccucagaaggggaaaagggacugggaaguaaagggaaaccau

SEQ ID NO: 491068 - RNA, 64 nt, Homo Sapiens
ugacaugucacauaucaaauuguaaaaaaaaaaaaaaagggaauuagugcagcauuucagcaua

SEQ ID NO: 491069 - RNA, 64 nt, Homo Sapiens
uuuaguuaauuaagugauaacacaauuuuuuuuuaaaagggaacagccgcuucauucaugccua

SEQ ID NO: 491070 - RNA, 64 nt, Homo Sapiens
aaaaguuauuuuagcuuccucagcacauuuuaagaaaagggaccgauuuuaaaggugguuucuc

SEQ ID NO: 491071 - RNA, 64 nt, Homo Sapiens
uuguauccaugguaaauuaauagcaaugccuuugaaaagggauaaaauuuaguuaugaccuauu

SEQ ID NO: 491072 - RNA, 64 nt, Homo Sapiens; identical to SEQ ID NO: 171676

SEQ ID NO: 491073 - RNA, 64 nt, Homo Sapiens; identical to SEQ ID NO: 171677

SEQ ID NO: 491074 - RNA, 64 nt, Homo Sapiens; identical to SEQ ID NO: 171678

SEQ ID NO: 491075 - RNA, 64 nt, Homo Sapiens; identical to SEQ ID NO: 171679

SEQ ID NO: 491076 - RNA, 64 nt, Homo Sapiens; identical to SEQ ID NO: 171680

SEQ ID NO: 491077 - RNA, 64 nt, Homo Sapiens; identical to SEQ ID NO: 171681

SEQ ID NO: 491078 - RNA, 64 nt, Homo Sapiens; identical to SEQ ID NO: 171682

SEQ ID NO: 491079 - RNA, 64 nt, Homo Sapiens; identical to SEQ ID NO: 171683

SEQ ID NO: 491080 - RNA, 64 nt, Homo Sapiens; identical to SEQ ID NO: 171684

SEQ ID NO: 491081 - RNA, 64 nt, Homo Sapiens; identical to SEQ ID NO: 171685

SEQ ID NO: 491082 - RNA, 64 nt, Homo Sapiens; identical to SEQ ID NO: 171686

SEQ ID NO: 491083 - RNA, 64 nt, Homo Sapiens; identical to SEQ ID NO: 171687

SEQ ID NO: 491084 - RNA, 64 nt, Homo Sapiens; identical to SEQ ID NO: 171688

SEQ ID NO: 491085 - RNA, 64 nt, Homo Sapiens; identical to SEQ ID NO: 171689

SEQ ID NO: 491086 - RNA, 64 nt, Homo Sapiens; identical to SEQ ID NO: 171690

SEQ ID NO: 491087 - RNA, 64 nt, Homo Sapiens; identical to SEQ ID NO: 171691

SEQ ID NO: 491088 - RNA, 64 nt, Homo Sapiens; identical to SEQ ID NO: 171692

SEQ ID NO: 491089 - RNA, 64 nt, Homo Sapiens; identical to SEQ ID NO: 171693

SEQ ID NO: 491090 - RNA, 64 nt, Homo Sapiens; identical to SEQ ID NO: 171694

SEQ ID NO: 491091 - RNA, 64 nt, Homo Sapiens; identical to SEQ ID NO: 171695

SEQ ID NO: 491092 - RNA, 64 nt, Homo Sapiens; identical to SEQ ID NO: 171696

SEQ ID NO: 491093 - RNA, 64 nt, Homo Sapiens; identical to SEQ ID NO: 171697

SEQ ID NO: 491094 - RNA, 64 nt, Homo Sapiens; identical to SEQ ID NO: 171698

SEQ ID NO: 491095 - RNA, 64 nt, Homo Sapiens; identical to SEQ ID NO: 171699

SEQ ID NO: 491096 - RNA, 64 nt, Homo Sapiens; identical to SEQ ID NO: 171700

SEQ ID NO: 491097 - RNA, 64 nt, Homo Sapiens; identical to SEQ ID NO: 171701

SEQ ID NO: 491098 - RNA, 64 nt, Homo Sapiens; identical to SEQ ID NO: 171702

SEQ ID NO: 491099 - RNA, 64 nt, Homo Sapiens; identical to SEQ ID NO: 171703

SEQ ID NO: 491100 - RNA, 64 nt, Homo Sapiens; identical to SEQ ID NO: 171704

SEQ ID NO: 491101 - RNA, 64 nt, Homo Sapiens; identical to SEQ ID NO: 171705

SEQ ID NO: 491102 - RNA, 64 nt, Homo Sapiens; identical to SEQ ID NO: 171706

SEQ ID NO: 491103 - RNA, 64 nt, Homo Sapiens; identical to SEQ ID NO: 171707

SEQ ID NO: 491104 - RNA, 61 nt, Homo Sapiens; identical to SEQ ID NO: 171708

SEQ ID NO: 491105 - RNA, 64 nt, Homo Sapiens; identical to SEQ ID NO: 171709

SEQ ID NO: 491106 - RNA, 64 nt, Homo Sapiens; identical to SEQ ID NO: 171710

SEQ ID NO: 491107 - RNA, 64 nt, Homo Sapiens; identical to SEQ ID NO: 171711

SEQ ID NO: 491108 - RNA, 64 nt, Homo Sapiens; identical to SEQ ID NO: 171712

SEQ ID NO: 491109 - RNA, 64 nt, Homo Sapiens; identical to SEQ ID NO: 171713

SEQ ID NO: 491110 - RNA, 64 nt, Homo Sapiens; identical to SEQ ID NO: 171714

SEQ ID NO: 491111 - RNA, 64 nt, Homo Sapiens; identical to SEQ ID NO: 171715

SEQ ID NO: 491112 - RNA, 64 nt, Homo Sapiens; identical to SEQ ID NO: 171716

SEQ ID NO: 491113 - RNA, 64 nt, Homo Sapiens; identical to SEQ ID NO: 171717

SEQ ID NO: 491114 - RNA, 64 nt, Homo Sapiens; identical to SEQ ID NO: 171718

SEQ ID NO: 491115 - RNA, 64 nt, Homo Sapiens; identical to SEQ ID NO: 171719

SEQ ID NO: 491116 - RNA, 64 nt, Homo Sapiens; identical to SEQ ID NO: 171720

SEQ ID NO: 491117 - RNA, 64 nt, Homo Sapiens; identical to SEQ ID NO: 171721

SEQ ID NO: 491118 - RNA, 64 nt, Homo Sapiens; identical to SEQ ID NO: 171722

SEQ ID NO: 491119 - RNA, 64 nt, Homo Sapiens; identical to SEQ ID NO: 171723

SEQ ID NO: 491120 - RNA, 64 nt, Homo Sapiens; identical to SEQ ID NO: 171724

SEQ ID NO: 491121 - RNA, 64 nt, Homo Sapiens; identical to SEQ ID NO: 171725

SEQ ID NO: 491122 - RNA, 64 nt, Homo Sapiens; identical to SEQ ID NO: 171726

SEQ ID NO: 491123 - RNA, 64 nt, Homo Sapiens; identical to SEQ ID NO: 171727

SEQ ID NO: 491124 - RNA, 64 nt, Homo Sapiens; identical to SEQ ID NO: 171728

SEQ ID NO: 491125 - RNA, 64 nt, Homo Sapiens; identical to SEQ ID NO: 171729

SEQ ID NO: 491126 - RNA, 64 nt, Homo Sapiens; identical to SEQ ID NO: 171730

SEQ ID NO: 491127 - RNA, 64 nt, Homo Sapiens; identical to SEQ ID NO: 171731

SEQ ID NO: 491128 - RNA, 64 nt, Homo Sapiens; identical to SEQ ID NO: 171732

SEQ ID NO: 491129 - RNA, 64 nt, Homo Sapiens; identical to SEQ ID NO: 171733

SEQ ID NO: 491130 - RNA, 64 nt, Homo Sapiens; identical to SEQ ID NO: 171734

SEQ ID NO: 491131 - RNA, 64 nt, Homo Sapiens; identical to SEQ ID NO: 171735

SEQ ID NO: 491132 - RNA, 64 nt, Homo Sapiens; identical to SEQ ID NO: 171736

SEQ ID NO: 491133 - RNA, 64 nt, Homo Sapiens; identical to SEQ ID NO: 171737

SEQ ID NO: 491134 - RNA, 64 nt, Homo Sapiens; identical to SEQ ID NO: 171738

SEQ ID NO: 491135 - RNA, 64 nt, Homo Sapiens; identical to SEQ ID NO: 171739

SEQ ID NO: 491136 - RNA, 64 nt, Homo Sapiens; identical to SEQ ID NO: 171740

SEQ ID NO: 491137 - RNA, 64 nt, Homo Sapiens; identical to SEQ ID NO: 171741

SEQ ID NO: 491138 - RNA, 64 nt, Homo Sapiens; identical to SEQ ID NO: 171742

SEQ ID NO: 491139 - RNA, 64 nt, Homo Sapiens; identical to SEQ ID NO: 171743

SEQ ID NO: 491140 - RNA, 64 nt, Homo Sapiens; identical to SEQ ID NO: 171744

SEQ ID NO: 491141 - RNA, 64 nt, Homo Sapiens; identical to SEQ ID NO: 171745

SEQ ID NO: 491142 - RNA, 64 nt, Homo Sapiens; identical to SEQ ID NO: 171746

SEQ ID NO: 491143 - RNA, 64 nt, Homo Sapiens; identical to SEQ ID NO: 171747

SEQ ID NO: 491144 - RNA, 64 nt, Homo Sapiens; identical to SEQ ID NO: 171748

SEQ ID NO: 491145 - RNA, 64 nt, Homo Sapiens; identical to SEQ ID NO: 171749

SEQ ID NO: 491146 - RNA, 64 nt, Homo Sapiens; identical to SEQ ID NO: 171750

SEQ ID NO: 491147 - RNA, 64 nt, Homo Sapiens; identical to SEQ ID NO: 171751

SEQ ID NO: 491148 - RNA, 64 nt, Homo Sapiens; identical to SEQ ID NO: 171752

SEQ ID NO: 491149 - RNA, 64 nt, Homo Sapiens; identical to SEQ ID NO: 171753

SEQ ID NO: 491150 - RNA, 64 nt, Homo Sapiens; identical to SEQ ID NO: 171754

SEQ ID NO: 491151 - RNA, 64 nt, Homo Sapiens; identical to SEQ ID NO: 171755

SEQ ID NO: 491152 - RNA, 64 nt, Homo Sapiens; identical to SEQ ID NO: 171756

SEQ ID NO: 491153 - RNA, 64 nt, Homo Sapiens; identical to SEQ ID NO: 171757

SEQ ID NO: 491154 - RNA, 64 nt, Homo Sapiens; identical to SEQ ID NO: 171758

SEQ ID NO: 491155 - RNA, 64 nt, Homo Sapiens; identical to SEQ ID NO: 171759

SEQ ID NO: 491156 - RNA, 64 nt, Homo Sapiens; identical to SEQ ID NO: 171760

SEQ ID NO: 491157 - RNA, 64 nt, Homo Sapiens; identical to SEQ ID NO: 171761

SEQ ID NO: 491158 - RNA, 64 nt, Homo Sapiens; identical to SEQ ID NO: 171762

SEQ ID NO: 491159 - RNA, 64 nt, Homo Sapiens; identical to SEQ ID NO: 171763

SEQ ID NO: 491160 - RNA, 64 nt, Homo Sapiens; identical to SEQ ID NO: 171764

SEQ ID NO: 491161 - RNA, 64 nt, Homo Sapiens; identical to SEQ ID NO: 171765

SEQ ID NO: 491162 - RNA, 64 nt, Homo Sapiens; identical to SEQ ID NO: 171766

SEQ ID NO: 491163 - RNA, 64 nt, Homo Sapiens; identical to SEQ ID NO: 171767

SEQ ID NO: 491164 - RNA, 64 nt, Homo Sapiens; identical to SEQ ID NO: 171768

SEQ ID NO: 491165 - RNA, 64 nt, Homo Sapiens; identical to SEQ ID NO: 171769

SEQ ID NO: 491166 - RNA, 64 nt, Homo Sapiens; identical to SEQ ID NO: 171770

SEQ ID NO: 491167 - RNA, 64 nt, Homo Sapiens; identical to SEQ ID NO: 171771

SEQ ID NO: 491168 - RNA, 64 nt, Homo Sapiens; identical to SEQ ID NO: 171772

SEQ ID NO: 491169 - RNA, 64 nt, Homo Sapiens; identical to SEQ ID NO: 171773

SEQ ID NO: 491170 - RNA, 64 nt, Homo Sapiens; identical to SEQ ID NO: 171774

SEQ ID NO: 491171 - RNA, 64 nt, Homo Sapiens; identical to SEQ ID NO: 171775

SEQ ID NO: 491172 - RNA, 64 nt, Homo Sapiens; identical to SEQ ID NO: 171776

SEQ ID NO: 491173 - RNA, 64 nt, Homo Sapiens; identical to SEQ ID NO: 171777

SEQ ID NO: 491174 - RNA, 64 nt, Homo Sapiens; identical to SEQ ID NO: 171778

SEQ ID NO: 491175 - RNA, 64 nt, Homo Sapiens; identical to SEQ ID NO: 171779

SEQ ID NO: 491176 - RNA, 64 nt, Homo Sapiens; identical to SEQ ID NO: 171780

SEQ ID NO: 491177 - RNA, 64 nt, Homo Sapiens; identical to SEQ ID NO: 171781

SEQ ID NO: 491178 - RNA, 64 nt, Homo Sapiens; identical to SEQ ID NO: 171782

SEQ ID NO: 491179 - RNA, 64 nt, Homo Sapiens; identical to SEQ ID NO: 171783

SEQ ID NO: 491180 - RNA, 64 nt, Homo Sapiens; identical to SEQ ID NO: 171784

SEQ ID NO: 491181 - RNA, 64 nt, Homo Sapiens; identical to SEQ ID NO: 171785

SEQ ID NO: 491182 - RNA, 64 nt, Homo Sapiens; identical to SEQ ID NO: 171786

SEQ ID NO: 491183 - RNA, 64 nt, Homo Sapiens; identical to SEQ ID NO: 171787

SEQ ID NO: 491184 - RNA, 64 nt, Homo Sapiens; identical to SEQ ID NO: 171788

SEQ ID NO: 491185 - RNA, 64 nt, Homo Sapiens; identical to SEQ ID NO: 171789

SEQ ID NO: 491186 - RNA, 64 nt, Homo Sapiens; identical to SEQ ID NO: 171790

SEQ ID NO: 491187 - RNA, 64 nt, Homo Sapiens; identical to SEQ ID NO: 171791

SEQ ID NO: 491188 - RNA, 64 nt, Homo Sapiens; identical to SEQ ID NO: 171792

SEQ ID NO: 491189 - RNA, 64 nt, Homo Sapiens; identical to SEQ ID NO: 171793

SEQ ID NO: 491190 - RNA, 64 nt, Homo Sapiens; identical to SEQ ID NO: 171794

SEQ ID NO: 491191 - RNA, 64 nt, Homo Sapiens; identical to SEQ ID NO: 171795

SEQ ID NO: 491192 - RNA, 64 nt, Homo Sapiens; identical to SEQ ID NO: 171796

SEQ ID NO: 491193 - RNA, 64 nt, Homo Sapiens; identical to SEQ ID NO: 171797

SEQ ID NO: 491194 - RNA, 64 nt, Homo Sapiens; identical to SEQ ID NO: 171798

SEQ ID NO: 491195 - RNA, 64 nt, Homo Sapiens; identical to SEQ ID NO: 171799

SEQ ID NO: 491196 - RNA, 64 nt, Homo Sapiens; identical to SEQ ID NO: 89598

SEQ ID NO: 491197 - RNA, 64 nt, Homo Sapiens; identical to SEQ ID NO: 89599

SEQ ID NO: 491198 - RNA, 64 nt, Homo Sapiens; identical to SEQ ID NO: 89600

SEQ ID NO: 491199 - RNA, 64 nt, Homo Sapiens; identical to SEQ ID NO: 89601

SEQ ID NO: 491200 - RNA, 64 nt, Homo Sapiens; identical to SEQ ID NO: 89602

SEQ ID NO: 491201 - RNA, 64 nt, Homo Sapiens; identical to SEQ ID NO: 89603

SEQ ID NO: 491202 - RNA, 64 nt, Homo Sapiens; identical to SEQ ID NO: 89604

SEQ ID NO: 491203 - RNA, 64 nt, Homo Sapiens; identical to SEQ ID NO: 89605

SEQ ID NO: 491204 - RNA, 64 nt, Homo Sapiens; identical to SEQ ID NO: 89606

SEQ ID NO: 491205 - RNA, 64 nt, Homo Sapiens; identical to SEQ ID NO: 89607

SEQ ID NO: 491206 - RNA, 64 nt, Homo Sapiens; identical to SEQ ID NO: 89608

SEQ ID NO: 491207 - RNA, 64 nt, Homo Sapiens; identical to SEQ ID NO: 89609

SEQ ID NO: 491208 - RNA, 64 nt, Homo Sapiens; identical to SEQ ID NO: 89610

SEQ ID NO: 491209 - RNA, 64 nt, Homo Sapiens; identical to SEQ ID NO: 89611

SEQ ID NO: 491210 - RNA, 64 nt, Homo Sapiens; identical to SEQ ID NO: 89612

SEQ ID NO: 491211 - RNA, 64 nt, Homo Sapiens; identical to SEQ ID NO: 89613

SEQ ID NO: 491212 - RNA, 64 nt, Homo Sapiens; identical to SEQ ID NO: 89614

SEQ ID NO: 491213 - RNA, 64 nt, Homo Sapiens; identical to SEQ ID NO: 89615

SEQ ID NO: 491214 - RNA, 64 nt, Homo Sapiens; identical to SEQ ID NO: 89616

SEQ ID NO: 491215 - RNA, 64 nt, Homo Sapiens; identical to SEQ ID NO: 89617

SEQ ID NO: 491216 - RNA, 64 nt, Homo Sapiens; identical to SEQ ID NO: 89618

SEQ ID NO: 491217 - RNA, 64 nt, Homo Sapiens; identical to SEQ ID NO: 89619

SEQ ID NO: 491218 - RNA, 64 nt, Homo Sapiens; identical to SEQ ID NO: 89620

SEQ ID NO: 491219 - RNA, 64 nt, Homo Sapiens; identical to SEQ ID NO: 89621

SEQ ID NO: 491220 - RNA, 64 nt, Homo Sapiens; identical to SEQ ID NO: 89622

SEQ ID NO: 491221 - RNA, 64 nt, Homo Sapiens; identical to SEQ ID NO: 89623

SEQ ID NO: 491222 - RNA, 64 nt, Homo Sapiens; identical to SEQ ID NO: 89624

SEQ ID NO: 491223 - RNA, 64 nt, Homo Sapiens; identical to SEQ ID NO: 89625

SEQ ID NO: 491224 - RNA, 64 nt, Homo Sapiens; identical to SEQ ID NO: 89626

SEQ ID NO: 491225 - RNA, 64 nt, Homo Sapiens; identical to SEQ ID NO: 89627

SEQ ID NO: 491226 - RNA, 64 nt, Homo Sapiens; identical to SEQ ID NO: 89628

SEQ ID NO: 491227 - RNA, 64 nt, Homo Sapiens; identical to SEQ ID NO: 89629

SEQ ID NO: 491228 - RNA, 64 nt, Homo Sapiens; identical to SEQ ID NO: 89630

SEQ ID NO: 491229 - RNA, 64 nt, Homo Sapiens; identical to SEQ ID NO: 89631

SEQ ID NO: 491230 - RNA, 64 nt, Homo Sapiens; identical to SEQ ID NO: 89632

SEQ ID NO: 491231 - RNA, 64 nt, Homo Sapiens; identical to SEQ ID NO: 89633

SEQ ID NO: 491232 - RNA, 64 nt, Homo Sapiens
ugacacacauuucuuauccccauuuuacaaccaaggcaucuaaagcaacaagaaaugaacuugc

SEQ ID NO: 491233 - RNA, 64 nt, Homo Sapiens
ggauacuuuuagauauauuuaaaauuuuaacauuggcaucuaaaguguuauuugaaaauaaaau

SEQ ID NO: 491234 - RNA, 64 nt, Homo Sapiens; identical to SEQ ID NO: 246041

SEQ ID NO: 491235 - RNA, 64 nt, Homo Sapiens; identical to SEQ ID NO: 246042

SEQ ID NO: 491236 - RNA, 64 nt, Homo Sapiens; identical to SEQ ID NO: 246043

SEQ ID NO: 491237 - RNA, 64 nt, Homo Sapiens; identical to SEQ ID NO: 246044

SEQ ID NO: 491238 - RNA, 64 nt, Homo Sapiens; identical to SEQ ID NO: 246045

SEQ ID NO: 491239 - RNA, 64 nt, Homo Sapiens; identical to SEQ ID NO: 246046

SEQ ID NO: 491240 - RNA, 64 nt, Homo Sapiens; identical to SEQ ID NO: 246047

SEQ ID NO: 491241 - RNA, 64 nt, Homo Sapiens; identical to SEQ ID NO: 246048

SEQ ID NO: 491242 - RNA, 64 nt, Homo Sapiens; identical to SEQ ID NO: 246049

SEQ ID NO: 491243 - RNA, 64 nt, Homo Sapiens; identical to SEQ ID NO: 246050

SEQ ID NO: 491244 - RNA, 64 nt, Homo Sapiens; identical to SEQ ID NO: 246051

SEQ ID NO: 491245 - RNA, 64 nt, Homo Sapiens; identical to SEQ ID NO: 246052

SEQ ID NO: 491246 - RNA, 64 nt, Homo Sapiens; identical to SEQ ID NO: 246053

SEQ ID NO: 491247 - RNA, 64 nt, Homo Sapiens; identical to SEQ ID NO: 246054

SEQ ID NO: 491248 - RNA, 64 nt, Homo Sapiens; identical to SEQ ID NO: 246055

SEQ ID NO: 491249 - RNA, 64 nt, Homo Sapiens; identical to SEQ ID NO: 246056

SEQ ID NO: 491250 - RNA, 64 nt, Homo Sapiens
aggcucucacuagaguuaccaugguucccuaagccuguucaagugcuucuucauguuuguaggg

SEQ ID NO: 491251 - RNA, 64 nt, Homo Sapiens
gaaaauuguuuaucucucuuuguuucguaccacacuguucaaaguugcaaaagaaucccauuuu

SEQ ID NO: 491252 - RNA, 64 nt, Homo Sapiens
uuuagcugacaaaauacuugucuguuuuaaaaaccuguucaagucuaccaaccuguucaagucu

SEQ ID NO: 491253 - RNA, 64 nt, Homo Sapiens
ugucuguuuuaaaaaccuguucaagucuaccaaccuguucaagucuaccaauuauaagggcaaa

SEQ ID NO: 491254 - RNA, 64 nt, Homo Sapiens
ugcugccaaagaccaacuguagaauccuuaaguccuguucaagugucacuucauuuuuuauuag

SEQ ID NO: 491255 - RNA, 64 nt, Homo Sapiens
ccucgucuggccugcaggucuuuuuaagcauuugcuguucaauaauaagcaucuucuuuaugcc

SEQ ID NO: 491256 - RNA, 64 nt, Homo Sapiens
aggaggagccugucaaaaaguagaaucauaaggacuguucaaaccauaaggacuguucaaauca

SEQ ID NO: 491257 - RNA, 64 nt, Homo Sapiens
aguagaaucauaaggacuguucaaaccauaaggacuguucaaaucauaccagugacuguucaaa

SEQ ID NO: 491258 - RNA, 64 nt, Homo Sapiens
caaaccauaaggacuguucaaaucauaccagugacuguucaaaccaaccauacuuuuuauuaga

SEQ ID NO: 491259 - RNA, 64 nt, Homo Sapiens
caauccauuacuuauauacuaacuacauaaugaccuguucaaaccagacucuauuuaaugaacu

SEQ ID NO: 491260 - RNA, 64 nt, Homo Sapiens
cucaaaaacaguccacaguggcaauaccggacuucuguucaagcuuuuuaaagugcugagccuu

SEQ ID NO: 491261 - RNA, 64 nt, Homo Sapiens
uacacagagaacagaaauaugcuuaggugcacagcuguucaauaacuuccuacucaggcacccu

SEQ ID NO: 491262 - RNA, 64 nt, Homo Sapiens
auugugacauugggcaugagaggaaggaggccaucuguucaaaauugcaugucaguaaacagga

SEQ ID NO: 491263 - RNA, 64 nt, Homo Sapiens; identical to SEQ ID NO: 293702

SEQ ID NO: 491264 - RNA, 64 nt, Homo Sapiens; identical to SEQ ID NO: 293703

SEQ ID NO: 491265 - RNA, 64 nt, Homo Sapiens; identical to SEQ ID NO: 293704

SEQ ID NO: 491266 - RNA, 64 nt, Homo Sapiens; identical to SEQ ID NO: 293705

SEQ ID NO: 491267 - RNA, 64 nt, Homo Sapiens; identical to SEQ ID NO: 293706

SEQ ID NO: 491268 - RNA, 64 nt, Homo Sapiens; identical to SEQ ID NO: 293707

SEQ ID NO: 491269 - RNA, 64 nt, Homo Sapiens; identical to SEQ ID NO: 293708

SEQ ID NO: 491270 - RNA, 64 nt, Homo Sapiens; identical to SEQ ID NO: 293709

SEQ ID NO: 491271 - RNA, 64 nt, Homo Sapiens; identical to SEQ ID NO: 293710

SEQ ID NO: 491272 - RNA, 64 nt, Homo Sapiens; identical to SEQ ID NO: 293711

SEQ ID NO: 491273 - RNA, 64 nt, Homo Sapiens; identical to SEQ ID NO: 293712

SEQ ID NO: 491274 - RNA, 64 nt, Homo Sapiens; identical to SEQ ID NO: 293713

SEQ ID NO: 491275 - RNA, 64 nt, Homo Sapiens; identical to SEQ ID NO: 293714

SEQ ID NO: 491276 - RNA, 64 nt, Homo Sapiens; identical to SEQ ID NO: 293715

SEQ ID NO: 491277 - RNA, 64 nt, Homo Sapiens; identical to SEQ ID NO: 293716

SEQ ID NO: 491278 - RNA, 64 nt, Homo Sapiens; identical to SEQ ID NO: 293717

SEQ ID NO: 491279 - RNA, 64 nt, Homo Sapiens; identical to SEQ ID NO: 293718

SEQ ID NO: 491280 - RNA, 64 nt, Homo Sapiens; identical to SEQ ID NO: 293719

SEQ ID NO: 491281 - RNA, 64 nt, Homo Sapiens; identical to SEQ ID NO: 293720

SEQ ID NO: 491282 - RNA, 64 nt, Homo Sapiens; identical to SEQ ID NO: 293721

SEQ ID NO: 491283 - RNA, 64 nt, Homo Sapiens; identical to SEQ ID NO: 293722

SEQ ID NO: 491284 - RNA, 64 nt, Homo Sapiens; identical to SEQ ID NO: 293723

SEQ ID NO: 491285 - RNA, 64 nt, Homo Sapiens; identical to SEQ ID NO: 293724

SEQ ID NO: 491286 - RNA, 64 nt, Homo Sapiens; identical to SEQ ID NO: 293725

SEQ ID NO: 491287 - RNA, 64 nt, Homo Sapiens; identical to SEQ ID NO: 293726

SEQ ID NO: 491288 - RNA, 64 nt, Homo Sapiens; identical to SEQ ID NO: 293727

SEQ ID NO: 491289 - RNA, 64 nt, Homo Sapiens; identical to SEQ ID NO: 96825

SEQ ID NO: 491290 - RNA, 64 nt, Homo Sapiens; identical to SEQ ID NO: 96826

SEQ ID NO: 491291 - RNA, 64 nt, Homo Sapiens; identical to SEQ ID NO: 96827

SEQ ID NO: 491292 - RNA, 64 nt, Homo Sapiens; identical to SEQ ID NO: 96828

SEQ ID NO: 491293 - RNA, 64 nt, Homo Sapiens; identical to SEQ ID NO: 96829

SEQ ID NO: 491294 - RNA, 64 nt, Homo Sapiens; identical to SEQ ID NO: 96830

SEQ ID NO: 491295 - RNA, 64 nt, Homo Sapiens; identical to SEQ ID NO: 96831

SEQ ID NO: 491296 - RNA, 64 nt, Homo Sapiens; identical to SEQ ID NO: 96832

SEQ ID NO: 491297 - RNA, 64 nt, Homo Sapiens; identical to SEQ ID NO: 96833

SEQ ID NO: 491298 - RNA, 64 nt, Homo Sapiens; identical to SEQ ID NO: 96834

SEQ ID NO: 491299 - RNA, 64 nt, Homo Sapiens; identical to SEQ ID NO: 96835

SEQ ID NO: 491300 - RNA, 64 nt, Homo Sapiens
guccuucccauuuccagcccccagaauaaaucuuagaccccacaaaggcaaagucaaaugggga

SEQ ID NO: 491301 - RNA, 64 nt, Homo Sapiens
uccagucugcagauccuaccccuucugacuuuccagaccccaggcucccugcuugccuccacuc

SEQ ID NO: 491302 - RNA, 64 nt, Homo Sapiens
cagauccccugcugaacagauacacagaguucucagaccccacccccacccucaggugggcugg

SEQ ID NO: 491303 - RNA, 64 nt, Homo Sapiens
gauggacccccagcaaaucaggaccuaucuaggcagaccccagccagacccccgccagacagac

SEQ ID NO: 491304 - RNA, 64 nt, Homo Sapiens
ucauagcugccgucccgacgugugggcacaccccagaccccauggcuuguacauaugugauugc

SEQ ID NO: 491305 - RNA, 64 nt, Homo Sapiens
cccaugccugggggagagacgacaugagccucagagaccccaauaggcugucccacgugaugcu

SEQ ID NO: 491306 - RNA, 64 nt, Homo Sapiens
uuaguggcacggugcuugggggcuuugccucugcagaccccaucagugggagaggcugcagcaa

SEQ ID NO: 491307 - RNA, 64 nt, Homo Sapiens
ccuggaucccaggagaaaggaccacagggagcucagaccccaacgugugaggggcuuaaugacc

SEQ ID NO: 491308 - RNA, 64 nt, Homo Sapiens
agaaaagaugucuuaaucauaugccagcugcuguagaccccaugaacuaaagccuuuuuaagaa

SEQ ID NO: 491309 - RNA, 64 nt, Homo Sapiens
cccucuuuaucuaucaacucgcacugcugcuggaagaccccauugagugcaccuccaucuccaa

SEQ ID NO: 491310 - RNA, 64 nt, Homo Sapiens
aauccuguauacaucaaagauguauguucuuuuuagaccccauaaaauaugaacacuuuauaau

SEQ ID NO: 491311 - RNA, 64 nt, Homo Sapiens
acaauuuuucuguuucaguuaucagacgucuuuuagaccccaaggacugaacagacaucagcac

SEQ ID NO: 491312 - RNA, 64 nt, Homo Sapiens
uuaauagcagcaguccucccccuaccccgccccgagaccccaccccgagaccccaccccggacc

SEQ ID NO: 491313 - RNA, 64 nt, Homo Sapiens
uccucccccuaccccgccccgagaccccaccccgagaccccaccccggaccaguuacauucguu

SEQ ID NO: 491314 - RNA, 64 nt, Homo Sapiens
ugcaccacugcacuccagccugggugauagagcaagaccccaacucaaaaaaaaaaaaaaggau

SEQ ID NO: 491315 - RNA, 64 nt, Homo Sapiens
cgaggcugacaaugacuccuguuuucacgcugagagaccccacuccccugcugagaucgcgcca

SEQ ID NO: 491316 - RNA, 64 nt, Homo Sapiens
ccaggaguuugagaccagccugggcaacauagcgagaccccaucucuacaaaagauuaaaaauu

SEQ ID NO: 491317 - RNA, 64 nt, Homo Sapiens
ucugcagugagcuaugaucgcaccacugcauuccagaccccaucucgaaaaaaaaaaaaaaaaa

SEQ ID NO: 491318 - RNA, 64 nt, Homo Sapiens
uucagugcggccccucggcucagguggacgcugcagaccccaggcauguggagcgagagggagg

SEQ ID NO: 491319 - RNA, 64 nt, Homo Sapiens
uggggcgcgaugucaaagguauugguggcaucacagaccccagcugaaugucuuguuccugugc

SEQ ID NO: 491320 - RNA, 64 nt, Homo Sapiens
acuacuaaaaauacauaaauugggcaauguagugagaccccaucccagaaguucgagaccagcc

SEQ ID NO: 491321 - RNA, 64 nt, Homo Sapiens
caugcauaggagagacucuaaaugcaaacaucacagaccccacccuggaugauuuugcaggucc

SEQ ID NO: 491322 - RNA, 64 nt, Homo Sapiens
accagcccuggggcucagggggggaaggacugacagaccccaggcuucuggaccuggaaagccu

SEQ ID NO: 491323 - RNA, 64 nt, Homo Sapiens
aagccuucuggaccuggaaaccugacacagccccagaccccacaaccaaggcagcuuuccuuac

SEQ ID NO: 491324 - RNA, 64 nt, Homo Sapiens
gccaggaaccucucagccgaugggggcacagcacagaccccagacaccaaccaaccacacccgg

SEQ ID NO: 491325 - RNA, 64 nt, Homo Sapiens
ggcaggaaccucucagccgaugggggcacagcacagaccccagacaccaaccagccacacccgg

SEQ ID NO: 491326 - RNA, 64 nt, Homo Sapiens
gccaggaaccucucagccgaugggggcacagcacagaccccagacaccaaccagccacacccag

SEQ ID NO: 491327 - RNA, 64 nt, Homo Sapiens
gccaggaaccucucagccgauggggacacagcacagaccccaaacaccaaccagccacucccgg

SEQ ID NO: 491328 - RNA, 64 nt, Homo Sapiens
ccacagcucugggcuuccucaccccugagugcccagaccccauuuccacgggcucuccugggcc

SEQ ID NO: 491329 - RNA, 64 nt, Homo Sapiens
uccacgggcucuccugggcccaucuguuuuggcaagaccccaccccucccuuagcucacucugc

SEQ ID NO: 491330 - RNA, 64 nt, Homo Sapiens
uccucacuccccagccuccucuggauagggaugaagaccccacugggguuggaagugcagaggc

SEQ ID NO: 491331 - RNA, 64 nt, Homo Sapiens
aagaaaugaaaggugacaaaaggcagaaggagggagaccccaaaaagagguaaauuugguaucu

SEQ ID NO: 491332 - RNA, 64 nt, Homo Sapiens
cccgaagucuugccugcaggaucccggccgugggagaccccagucaugauccauggacaaggcc

SEQ ID NO: 491333 - RNA, 64 nt, Homo Sapiens
uccauucucacccaguuccuucuuuuguccucugagaccccaucauaugcaagcacugagcucc

SEQ ID NO: 491334 - RNA, 64 nt, Homo Sapiens
gccguaacuccuaggacccccuacagccccuagaagaccccaaucuccccugugcccucaaguc

SEQ ID NO: 491335 - RNA, 64 nt, Homo Sapiens
ucacccagaaagagauucccuaacccccaaauacagaccccaugauuaacagauacucccauaa

SEQ ID NO: 491336 - RNA, 64 nt, Homo Sapiens
ucuacuuaaaauaaagaagaugggcaacauagugagaccccaucccaggaguucaagaccagcc

SEQ ID NO: 491337 - RNA, 64 nt, Homo Sapiens
cuccucccugcacacugugggaaggaaucuguggagaccccaucggcacccuccauuugggaug

SEQ ID NO: 491338 - RNA, 64 nt, Homo Sapiens
ucuaggggagaagagcccugagguaccacccuucagaccccaguccugguuccuuccuaugccc

SEQ ID NO: 491339 - RNA, 64 nt, Homo Sapiens
gcagggugggcagccuauggccuucuugggccccagaccccagggcuagugagcaaaauaugcc

SEQ ID NO: 491340 - RNA, 64 nt, Homo Sapiens
gagcugccuugcccuucugcagugcccuuauaagagaccccaaagaccccucaugaaugaaacc

SEQ ID NO: 491341 - RNA, 64 nt, Homo Sapiens
gacgguacuuucccucucuagucacaaaaaguccagaccccagguuccccaaaaagagggaaga

SEQ ID NO: 491342 - RNA, 64 nt, Homo Sapiens
ucuggcagagccacauuaccccucauggcccaggagaccccaccgagcagcccuaagguagagg

SEQ ID NO: 491343 - RNA, 64 nt, Homo Sapiens
aggccaaagggcugcagucaagggaaggggacaaagaccccaggcuuucccagcuccagccugg

SEQ ID NO: 491344 - RNA, 64 nt, Homo Sapiens
aguccccaugauucccuccucgucagucucucaaagaccccaugguccauccccugaggguggu

SEQ ID NO: 491345 - RNA, 64 nt, Homo Sapiens
ggagcugucugcggagccagcgccugcccgagagagaccccaccgccaccgugugccuuucccg

SEQ ID NO: 491346 - RNA, 64 nt, Homo Sapiens
gcuccacucuguagccaggucuuaauacuguuaaagaccccaaguuguaacugugaaacuaugg

SEQ ID NO: 491347 - RNA, 64 nt, Homo Sapiens
ucuauauaaaaaaaaagaugugggcagcauagcgagaccccauccuaggaguucgagaccgacc

SEQ ID NO: 491348 - RNA, 64 nt, Homo Sapiens
augccagagagcuaagagaagaaaacggggucuguggcgguacucugaacaauuuccucagaac

SEQ ID NO: 491349 - RNA, 64 nt, Homo Sapiens
uaccuguacauaccugcgguuuaaugaccaaauguggcgguacacccaucucuacaauuuuuuu

SEQ ID NO: 491350 - RNA, 64 nt, Homo Sapiens
agcuacccuggaaugguggccccacuccuguuucuggcgguaccgugccugcaacaggacaaga

SEQ ID NO: 491351 - RNA, 64 nt, Homo Sapiens
augguuuggcuuuuauauucaucauaguauacauuggcgguaucuagcccuuucucuguaaaau

SEQ ID NO: 491352 - RNA, 64 nt, Homo Sapiens
cuugcccggggcuccagguagccugcagguuaacuggcgguaagugcuagacuguaagcccgac

SEQ ID NO: 491353 - RNA, 64 nt, Homo Sapiens
cucuagcccccagcccgaggcccccaccagcaguuggcgguagcagcuacuccgagcgccguuu

SEQ ID NO: 491354 - RNA, 64 nt, Homo Sapiens
uuugugaugucacagugcaagggggcgggcaagcuggcgguagaaccgaucucugcgccuuucu

SEQ ID NO: 491355 - RNA, 64 nt, Homo Sapiens
caaaguaaaauguuauaaauucauugucauuuauuggcgguauauuguauuuaugaaaauaguu

SEQ ID NO: 491356 - RNA, 64 nt, Homo Sapiens
uguguuucccuucgaaagccaaacucaucggaaauggcgguacccauuuuucuagcauuuucag

SEQ ID NO: 491357 - RNA, 64 nt, Homo Sapiens
ggaugcuuucugguauucuaucggggaggguccuuggcgguaaccagagggcagcguaguguca

SEQ ID NO: 491358 - RNA, 64 nt, Homo Sapiens
uaaugaaaggcccuuuugaucacuccucaaaaaguggcgguaugguuaacaagcaguaacacug

SEQ ID NO: 491359 - RNA, 64 nt, Homo Sapiens
accgacaucacguggcucaacucccccagucagguggcgguagugcccuggggguugcgcaaag

SEQ ID NO: 491360 - RNA, 64 nt, Homo Sapiens
cacccagcccaagggagucaguaggagggugggcuggcgguaccagguggaaggcgcggcgggc

SEQ ID NO: 491361 - RNA, 64 nt, Homo Sapiens
guucuucccagacugcgaggaccgccucggcagguggcgguaaaagcgcccccaucaagucaca

SEQ ID NO: 491362 - RNA, 64 nt, Homo Sapiens
acagauguggugaacaaugagcuucucagccaaguggcgguagcggauccuuugguccuuggau

SEQ ID NO: 491363 - RNA, 64 nt, Homo Sapiens
uggugauacuucuuugaaugagaauuggaauggguggcgguaauuugagaagguagcacuggag

SEQ ID NO: 491364 - RNA, 64 nt, Homo Sapiens
agagaaaagugaagaggcguggcugaaggaaagauggcgguagggccccggccucaauuaccuu

SEQ ID NO: 491365 - RNA, 64 nt, Homo Sapiens
uggcgguguggagcccucgcugcgaaaggugguguggcgguaccugcugaacguguauccagau

SEQ ID NO: 491366 - RNA, 64 nt, Homo Sapiens
uuuaagaaagcugccuuuucauuuuuagacaaaaucuuuucaacgcugaaauguaccuaaucug

SEQ ID NO: 491367 - RNA, 64 nt, Homo Sapiens
cuccaacauguauaauuuuauuugaaauacauaaucuuuucacuaugcuuuugugggguuuuuu

SEQ ID NO: 491368 - RNA, 64 nt, Homo Sapiens
gaaaauccagaaccagaaacauaaaucuugaguuucuuuucauguacauaaaaagcaauagccu

SEQ ID NO: 491369 - RNA, 64 nt, Homo Sapiens
aaguaaguuauuuuaguguguuauucccuuaguuucuuuucauacuagaaaagagcuuguucac

SEQ ID NO: 491370 - RNA, 64 nt, Homo Sapiens
gccacccaccuaaucacuaguugacuccaaaggcucuuuucagaucgcucgagucgccggcugc

SEQ ID NO: 491371 - RNA, 64 nt, Homo Sapiens
ucaaagugggaaagcuccaguucuuuuguuuaccucuuuucaucuucuuuuaccuuugagucuu

SEQ ID NO: 491372 - RNA, 64 nt, Homo Sapiens
guauauacuucuaagacagcagauguuaccauugucuuuucacuuucacaaaugaaaaggaggc

SEQ ID NO: 491373 - RNA, 64 nt, Homo Sapiens
cucaaaucuucacugucugugaaauccccuucagucuuuucagauugcauugacuguccucuug

SEQ ID NO: 491374 - RNA, 64 nt, Homo Sapiens
ucuggcuuuuguuaacauuuuggggcuuuuuuaaucuuuucaaucuggcguauugcuguuugac

SEQ ID NO: 491375 - RNA, 64 nt, Homo Sapiens
aaccaaaauaucacugacucaucccuacccauauucuuuucauaaaacccacucaccagguaca

SEQ ID NO: 491376 - RNA, 64 nt, Homo Sapiens
guucauguuccccacacaccugaaggugguagaaucuuuucagccucuuagccagugagcuaaa

SEQ ID NO: 491377 - RNA, 64 nt, Homo Sapiens
aggagcuauagauuugaaucuaauguugcauuagucuuuucaguuaucuucuaccuccuguauu

SEQ ID NO: 491378 - RNA, 64 nt, Homo Sapiens
aguuucuaucuuuccaggcaaaacaaauggguauucuuuucauacaaccauuuucaaaugaacc

SEQ ID NO: 491379 - RNA, 64 nt, Homo Sapiens
uaccuuuuuugagcaaacugagacuaaacuucucucuuuucaaaauuguguuaucuuccuuaau

SEQ ID NO: 491380 - RNA, 64 nt, Homo Sapiens
cccuuaaauaucuuucacaugcauuuuaggauauucuuuucaaauauuuguaggacaacuuuga

SEQ ID NO: 491381 - RNA, 64 nt, Homo Sapiens
accucccccccauuuuaauuagccaauuuuagacucuuuucaaucaauguaucucauuauuugu

SEQ ID NO: 491382 - RNA, 64 nt, Homo Sapiens
cagaaagugccauauagacgcuguaaggcaaaugucuuuucacguugcaaguccaguuucaucc

SEQ ID NO: 491383 - RNA, 64 nt, Homo Sapiens
ucaggaaagauuagaaaaggcuagauacauggauucuuuucaaauugaaguuaccucuuuuagc

SEQ ID NO: 491384 - RNA, 64 nt, Homo Sapiens
auuaacgcaaaaauccacagcccaaagucuuaacucuuuucagcucaugccuuccuaacagucc

SEQ ID NO: 491385 - RNA, 64 nt, Homo Sapiens
caaguauaaauucaauuguucaauuugauguaguucuuuucauguuacuaauugcccaaaaugu

SEQ ID NO: 491386 - RNA, 64 nt, Homo Sapiens
auuguugaccuaagaauauaaauauucauuucaaucuuuucauauaaaugagucaaaguucaaa

SEQ ID NO: 491387 - RNA, 64 nt, Homo Sapiens
uuugaugucaguuccaauuagagucauguggcucucuuuucaucaguugucagucuuuaauccu

SEQ ID NO: 491388 - RNA, 64 nt, Homo Sapiens
aaauuguacaguauucuacuuaucugaacuuuggucuuuucacuuauuuuccuuccuaucaauu

SEQ ID NO: 491389 - RNA, 64 nt, Homo Sapiens
uggcaacaccucuuaguugauuucuguuuucuucucuuuucacuuuuuguuucuaccaggguag

SEQ ID NO: 491390 - RNA, 64 nt, Homo Sapiens
uuucuaccaggguagaggccauguugaacuggccucuuuucaggacuuuuauuucccccuggau

SEQ ID NO: 491391 - RNA, 64 nt, Homo Sapiens
gcaaaucugcaccuauguagcucugcaucuccugucuuuucagguuugucaucagauggaaaua

SEQ ID NO: 491392 - RNA, 64 nt, Homo Sapiens
uugugagauuccucuguauugugcugauuguggaucuuuucauucucauugcagaauaauguuc

SEQ ID NO: 491393 - RNA, 64 nt, Homo Sapiens
ugaaucccagaaaaaaauuuccuguuuuuaauguucuuuucaaucccaucuagauaauuuauag

SEQ ID NO: 491394 - RNA, 64 nt, Homo Sapiens
ucucugacaaacuaacugcaguaacagaaaccuuucuuuucaguuacucuuuuucaagaaugaa

SEQ ID NO: 491395 - RNA, 64 nt, Homo Sapiens
uuauguaaugauguugacacaauuucuaaaacugucuuuucaacgugucuuaacaguuugugau

SEQ ID NO: 491396 - RNA, 64 nt, Homo Sapiens
auuucuaaugcuacaagaaucaccuugacgcucuucuuuucauuccaaauuugguguuuguuuu

SEQ ID NO: 491397 - RNA, 64 nt, Homo Sapiens
agucuaccauuaguucauauguuuuuguagcacaucuuuucauaacauacugaaauuuuaaugu

SEQ ID NO: 491398 - RNA, 64 nt, Homo Sapiens
uuucugguaaaauuucaguaacugauaacugcccucuuuucaguuuuuucacuuccuuauuuua

SEQ ID NO: 491399 - RNA, 64 nt, Homo Sapiens
aaacacauaagcuuugcucuuuaggcaggaaugaucuuuucaaaucauuagcacaauauuuaaa

SEQ ID NO: 491400 - RNA, 64 nt, Homo Sapiens
accucuuuaugccaauaaugauuuuaaugaaggcucuuuucagauguaaccuuaugaaggaaau

SEQ ID NO: 491401 - RNA, 64 nt, Homo Sapiens
gagcuuguagcacaagggcuucagcugggcauugucuuuucagauuagccuaugcacauuuguc

SEQ ID NO: 491402 - RNA, 64 nt, Homo Sapiens
ugaagacauugauaauauuacacaguacaauucuucuuuucaaagaaacacacacagauaugga

SEQ ID NO: 491403 - RNA, 64 nt, Homo Sapiens
aucacagaaaguucuauuggggucagaaguagaaucuuuucaucagugguuacccuauugaaua

SEQ ID NO: 491404 - RNA, 64 nt, Homo Sapiens
uuaggcuguugguucaaacucuuucagugcaguuucuuuucacaaucaccauuuccuccuuuac

SEQ ID NO: 491405 - RNA, 64 nt, Homo Sapiens
aguuauaguuguuauauauacauaaagauaauuuucuuuucauuuuugagacaauucuuuuuau

SEQ ID NO: 491406 - RNA, 64 nt, Homo Sapiens
acauauaauuuuguuuuccuuuuuaagagaggauucuuuucauccuaaaucuuuuaccuuucaa

SEQ ID NO: 491407 - RNA, 64 nt, Homo Sapiens
gucuccucucaagccugguuguaguucagaugagucuuuucaacauggucuucaacauggucua

SEQ ID NO: 491408 - RNA, 64 nt, Homo Sapiens
uauuuauuauuguaauuagaucuucacaaaguugucuuuucacuguguuuugucaacgugaaau

SEQ ID NO: 491409 - RNA, 64 nt, Homo Sapiens
agcuuauuggccauuugcauaaugauauugagcaucuuuucauguuugcauuucccugauggcg

SEQ ID NO: 491410 - RNA, 64 nt, Homo Sapiens
guucuuauaagcaaaguucauucuuuuggcauuuucuuuucaauauuugagcuaaaacucauuu

SEQ ID NO: 491411 - RNA, 64 nt, Homo Sapiens
agguuuuacaaugguuuauuagaaucagugugugucuuuucauaaucaauuugcuauauugcac

SEQ ID NO: 491412 - RNA, 64 nt, Homo Sapiens
uaauaauaguaauaguguauuucuuaacaugcuaucuuuucauuuauuuugucguguuucaucc

SEQ ID NO: 491413 - RNA, 64 nt, Homo Sapiens
aacauguagagcugcuauuuaagaaauugaaauuucuuuucaucuaugaguaaaaacaaauagg

SEQ ID NO: 491414 - RNA, 64 nt, Homo Sapiens
uuggcuuauaucaauucuuggguucuaguugacuucuuuucacuguuugaaugugaccaaaugu

SEQ ID NO: 491415 - RNA, 64 nt, Homo Sapiens
ccucaggaccuaccugaagaaggaaaacucauuuucuuuucaaguuuacgugaagcaugugauu

SEQ ID NO: 491416 - RNA, 64 nt, Homo Sapiens
cuucccucuccucaaaccuuauaaagacaaggggucuuuucaguuauccaaagaucuccugauc

SEQ ID NO: 491417 - RNA, 64 nt, Homo Sapiens
guccuucuauuguuuugucuuaccucaucauuaaucuuuucaagcaaaucaugaauuaaucaca

SEQ ID NO: 491418 - RNA, 64 nt, Homo Sapiens
agaugcuaugagcguuuccaaaaaccugucaaguucuuuucaaaucacuaugucuuauuaaaau

SEQ ID NO: 491419 - RNA, 64 nt, Homo Sapiens
ugcugcuuucccauguaauagaauaggaaauagaucuuuucagacagggcuuggaaaugaacua

SEQ ID NO: 491420 - RNA, 64 nt, Homo Sapiens
gaucucaaaauaaacugguuucuguggccuagacucuuuucacugcauuaaagagcuguucuuu

SEQ ID NO: 491421 - RNA, 64 nt, Homo Sapiens
ccagccauguuuaucagaucuucccucucaguuuucuuuucaucuugcacugugaaaagcacuc

SEQ ID NO: 491422 - RNA, 64 nt, Homo Sapiens
guauucuuuauauguugccuuguuuaacuacaguucuuuucauuccaucacuuuaggugauggg

SEQ ID NO: 491423 - RNA, 64 nt, Homo Sapiens
uuguuuucucucaguccuuuugcuacauucacuuucuuuucaaagaaauguuaauuauuacaaa

SEQ ID NO: 491424 - RNA, 64 nt, Homo Sapiens
uggaagcccccaccacuuuggggaucucuuuauuucuuuucagccagggaccuguccacucccu

SEQ ID NO: 491425 - RNA, 64 nt, Homo Sapiens
ccucgugcccacauggaagguaucuuuaauagggucuuuucaaaccuuaguggaggagggucag

SEQ ID NO: 491426 - RNA, 64 nt, Homo Sapiens
agcuggcccuucccggagucaccccgaugauuacucuuuucagacacagcgguuuuuguuucca

SEQ ID NO: 491427 - RNA, 64 nt, Homo Sapiens
ucuuaaauauuucccaauuguguuuuucauuauuucuuuucaauauauaacuuuuauaacaaau

SEQ ID NO: 491428 - RNA, 64 nt, Homo Sapiens
cuuucuuucugcauaauguugauuauaaauccucucuuuucaggcuaaugauuaccucuuauuc

SEQ ID NO: 491429 - RNA, 64 nt, Homo Sapiens
guaugcaaauauuauuuucuucauacauucauuuucuuuucaggggaaaauuuugggauggggg

SEQ ID NO: 491430 - RNA, 64 nt, Homo Sapiens
uucaguauaaaaguguccuaagcauauuagccaaucuuuucacaguagagcauacuuaaggcug

SEQ ID NO: 491431 - RNA, 64 nt, Homo Sapiens
cuaccacuucuugauuuuuacagauuuaaaaaaaucuuuucagugaccuuucuuuuuaauguaa

SEQ ID NO: 491432 - RNA, 64 nt, Homo Sapiens
agucaggguccugguguuggccuuuuugguuuucucuuuucaggcuguuuaacuuaggcacagg

SEQ ID NO: 491433 - RNA, 64 nt, Homo Sapiens
cccaguuccaaacuugcuuucauauuuuuggcuaucuuuucagcaaugccccacucuacuguua

SEQ ID NO: 491434 - RNA, 64 nt, Homo Sapiens
gguguugcagcccccagaugugcuuagaaagcugucuuuucaguugcuuuuugccuuacacuaa

SEQ ID NO: 491435 - RNA, 64 nt, Homo Sapiens
gcuuguacacgccucagcucggccguggggcagcucuuuucauggaaggacagugaugugggga

SEQ ID NO: 491436 - RNA, 64 nt, Homo Sapiens
uggccugggagagucaaauggugaagaugcaccgucuuuucaaacgacacaaaaaaaaugguau

SEQ ID NO: 491437 - RNA, 64 nt, Homo Sapiens
agugauaccuacgaaaaucauaggcagcuuuccuucuuuucaacuguuuguuuaacaucuguga

SEQ ID NO: 491438 - RNA, 64 nt, Homo Sapiens
cucuuucuaaugcuucccacgccuuuuuuauuuuucuuuucacuaacccaaugcugcgugugag

SEQ ID NO: 491439 - RNA, 64 nt, Homo Sapiens
uuagauucucuuuagguucaagguucauuccuggucuuuucacugcucuggacauagaauaggu

SEQ ID NO: 491440 - RNA, 64 nt, Homo Sapiens
gucaaauaucuucccuauaugaaaauauauuuuuucuuuucauuuuauuuuuauuuauuagaaa

SEQ ID NO: 491441 - RNA, 64 nt, Homo Sapiens
uucugauaacuuaugaagccaggguguucuaaacucuuuucaugucauguuuugauuauaggcu

SEQ ID NO: 491442 - RNA, 64 nt, Homo Sapiens
ucuuuucaugucauguuuugauuauaggcuuuggucuuuucaucugcaaagccuuuuuuuuuug

SEQ ID NO: 491443 - RNA, 64 nt, Homo Sapiens
ccaccuucaaucaacaagucagaaaccugugucaucuuuucaccaugcuuuuuccaaccaagcc

SEQ ID NO: 491444 - RNA, 64 nt, Homo Sapiens
caggcuuuuccaaaggguuggcaucucaucuuucucuuuucaauuuuugaaugccucucccucc

SEQ ID NO: 491445 - RNA, 64 nt, Homo Sapiens
ucucuggauuauuuugcaaaguucaauaccagguucuuuucauuaauuuuuauuacuacuuuau

SEQ ID NO: 491446 - RNA, 64 nt, Homo Sapiens
ccuuuuagauaaaauuguucaccuuguauuuaacucuuuucaaugcuugucauguaaauuaaaa

SEQ ID NO: 491447 - RNA, 64 nt, Homo Sapiens
gaaucguccauuagaaauguugucuguuaaguggucuuuucauaaugucaauaaaagggaguug

SEQ ID NO: 491448 - RNA, 64 nt, Homo Sapiens
aauucagagaaucgucauguuuagguacauguguucuuuucaaaucacuggucgauuuugaacu

SEQ ID NO: 491449 - RNA, 64 nt, Homo Sapiens
cugccuggguaucuggccccuuuccauaaacauuucuuuucaguucauguaguucuuuaauaga

SEQ ID NO: 491450 - RNA, 64 nt, Homo Sapiens
cucuucuucacuuuuucugacuuuggguccauuuucuuuucauugccuccuuuuccaggcagcu

SEQ ID NO: 491451 - RNA, 64 nt, Homo Sapiens
ccugaggugcucuugacuguuugggagaagcuguucuuuucagguuaauuggugaucugaaauc

SEQ ID NO: 491452 - RNA, 64 nt, Homo Sapiens
gaaggaaaauaaaaaggauuaacauauuuuauucucuuuucagaucauaacuuccuucuugcug

SEQ ID NO: 491453 - RNA, 64 nt, Homo Sapiens
uucucagcuauuucuucuacacaauaacaguacaucuuuucaaggagaagacauugguuuguug

SEQ ID NO: 491454 - RNA, 64 nt, Homo Sapiens
aacccgguccaguacugggauauucgggugugagucuuuucagcacaacaccaaaaaggcuucu

SEQ ID NO: 491455 - RNA, 64 nt, Homo Sapiens
acguauauaauuggcauggaaacuuaauuugcagucuuuucaagccuuuaggauagugugaugu

SEQ ID NO: 491456 - RNA, 64 nt, Homo Sapiens
uaaaaacuaaggaauauacuuagcacuuacuuaaucuuuucaguuuuccaguuuacgucucagg

SEQ ID NO: 491457 - RNA, 64 nt, Homo Sapiens
aguccuacaaccuugacaaacaaagcuaguucugucuuuucagacuguccuucgugaaacgcaa

SEQ ID NO: 491458 - RNA, 64 nt, Homo Sapiens
gguaucugaagccucuaaguuacccugauuuuuuucuuuucaugaaccucagccuauguguuuc

SEQ ID NO: 491459 - RNA, 64 nt, Homo Sapiens
cccuaauaacuauagagagacuguguuucaacucucuuuucauugcuguuuccagaagagugga

SEQ ID NO: 491460 - RNA, 64 nt, Homo Sapiens
cauguaaccuguaauugcugcucuccaguaauugucuuuucauuuugaugguaggggccagacu

SEQ ID NO: 491461 - RNA, 64 nt, Homo Sapiens
caagcaauguggcaaagcuuucacuucuuccaguucuuuucaauaucaugaaagaacacacuag

SEQ ID NO: 491462 - RNA, 64 nt, Homo Sapiens
uaagcaaugugcaaaagccuuuauuucuuccacuucuuuucaauaucaugaaaggacucacaug

SEQ ID NO: 491463 - RNA, 64 nt, Homo Sapiens
uaagaaauguggaaaagcguuccauaauuucucuucuuuucaaauacaugaaaguugcacagag

SEQ ID NO: 491464 - RNA, 64 nt, Homo Sapiens
aagcaauguggcaaaagcuuucacuucuuccaguucuuuucaauaucaugaaaggacucacacu

SEQ ID NO: 491465 - RNA, 64 nt, Homo Sapiens
aggggacauagaaaaaaugaaaugcaagcacacaucuuuucaggcuucucugccaagccuaugg

SEQ ID NO: 491466 - RNA, 64 nt, Homo Sapiens
ucuuucuugaaaucccaaaccuucuauuaacauuucuuuucaguuauacacugaacuuuacugu

SEQ ID NO: 491467 - RNA, 64 nt, Homo Sapiens
ccaaggcaggguuuccagccaggccucggggucaucuuuucaccaggagcaaacccaagucuua

SEQ ID NO: 491468 - RNA, 64 nt, Homo Sapiens
acguggcuggccuggcuccuccguagaccccuguucuuuucaaccucugcccacccgugcaugu

SEQ ID NO: 491469 - RNA, 64 nt, Homo Sapiens
uuccuuccccaccccccagccuuagaugccucgcucuuuucaaucucuuaaucuaaaugcuuuu

SEQ ID NO: 491470 - RNA, 64 nt, Homo Sapiens
ucaaaccuugguaucuguugggugaacaguauaaucuuuucaucugcuuuuagaaugugggaua

SEQ ID NO: 491471 - RNA, 64 nt, Homo Sapiens
cuuggcuuuccuuuuaaaggcuauuuugaaauggucuuuucacuuucauucagucaucaccccc

SEQ ID NO: 491472 - RNA, 64 nt, Homo Sapiens
auggaugacaguugcucauucugagaaacuucacucuuuucacuuaugcaucacgaggaaauaa

SEQ ID NO: 491473 - RNA, 64 nt, Homo Sapiens
aaaaaaauuaauaaacuuuaauaacaaucugaagucuuuucauacugaaagggaucauuuauga

SEQ ID NO: 491474 - RNA, 64 nt, Homo Sapiens
cauuagguuaguuuguaaugaaucacacuuggacucuuuucaaauucuauuauuauuuuuaaau

SEQ ID NO: 491475 - RNA, 64 nt, Homo Sapiens
ugauauccaguacuauguaaagaucagugucugcucuuuucacuuuuauacauguaauguacuu

SEQ ID NO: 491476 - RNA, 64 nt, Homo Sapiens
gucguauuuugccaccguaauuuugauaucauguucuuuucauauguggcuauuuuuauacuga

SEQ ID NO: 491477 - RNA, 64 nt, Homo Sapiens; identical to SEQ ID NO: 138762

SEQ ID NO: 491478 - RNA, 64 nt, Homo Sapiens; identical to SEQ ID NO: 138763

SEQ ID NO: 491479 - RNA, 64 nt, Homo Sapiens; identical to SEQ ID NO: 138764

SEQ ID NO: 491480 - RNA, 64 nt, Homo Sapiens; identical to SEQ ID NO: 138765

SEQ ID NO: 491481 - RNA, 64 nt, Homo Sapiens
aucuuuucacaauauuacucaaagguaugaagucuuuccauaaacagaaacauugacucagaaa

SEQ ID NO: 491482 - RNA, 64 nt, Homo Sapiens
aagacauuuugacuggcugguccaguccauugcauuuccauaaguguuuguuuuauauuuguca

SEQ ID NO: 491483 - RNA, 64 nt, Homo Sapiens
guucuagucacuucuguugguguugaacaguacuuuuccauaaaaccuuuguuuguagauuuaa

SEQ ID NO: 491484 - RNA, 64 nt, Homo Sapiens
cuguuacacaaaauauaaacuuuuucauuucaguuuuccauaaauuuuuagucagaaaaaauaa

SEQ ID NO: 491485 - RNA, 64 nt, Homo Sapiens
uacuuugauauuuuaacucagagccagcauguuguuuccauaacuuggcaagcuggauuucuca

SEQ ID NO: 491486 - RNA, 64 nt, Homo Sapiens
auuuguaguauuggucacaagagcuugguuaaucuuuccauauuacauuuagaguuuaucuaga

SEQ ID NO: 491487 - RNA, 64 nt, Homo Sapiens
gauguacauauucauuauacggucacacaaacaguuuccauaaaccacaggggaagauaaagau

SEQ ID NO: 491488 - RNA, 64 nt, Homo Sapiens
guucauguucaaauguucacguugagauauuuauuuuccauaugcaagaaagcauaugucgaug

SEQ ID NO: 491489 - RNA, 64 nt, Homo Sapiens
gaauguguuuggacuaaacaaaguauucuuugaguuuccauauuguuuaauuguuucaggugga

SEQ ID NO: 491490 - RNA, 64 nt, Homo Sapiens
uauauauauauauauaauuuuucuuguauuucuguuuccauauauuuuuucccccaagcauauu

SEQ ID NO: 491491 - RNA, 64 nt, Homo Sapiens
aacucggaucuuuuaaaaagcaucauagaucauuuuuccauaugacacugguuccgauuuuaaa

SEQ ID NO: 491492 - RNA, 64 nt, Homo Sapiens
gaaaugugugcuuucuguacaaugaaguuauugcuuuccauauauccuugaaucuucagauuaa

SEQ ID NO: 491493 - RNA, 64 nt, Homo Sapiens
cuuaucagaagacucacuuuaaaaacacaaaauuuuuccauaaaccaagucucaaaccuugaug

SEQ ID NO: 491494 - RNA, 64 nt, Homo Sapiens
uuaccaauaucacugauucagguuuuuaaucuacuuuccauaaaacuaugaauaaggauucagg

SEQ ID NO: 491495 - RNA, 64 nt, Homo Sapiens
cagaguggugggccauuaaccccaacauggaauuuuuccauauaaaucucaaugaauucccuuu

SEQ ID NO: 491496 - RNA, 64 nt, Homo Sapiens
ggcuggguaaaagcagcuggagugaagcacucauuuuccauaaagguaacaaagggcagcucag

SEQ ID NO: 491497 - RNA, 64 nt, Homo Sapiens
caaacaaaacgaaugaaaaacuggaaauaauucguuuccauaucuuuccauacauccauuucug

SEQ ID NO: 491498 - RNA, 64 nt, Homo Sapiens
gaaugaaaaacuggaaauaauucguuuccauaucuuuccauacauccauuucugaaguauucag

SEQ ID NO: 491499 - RNA, 64 nt, Homo Sapiens
acaggugaagauaacgagacaaguggcuacaaacuuuccauacaagccaaucggggaugcagac

SEQ ID NO: 491500 - RNA, 64 nt, Homo Sapiens
uucuuuaagccuuccuuuguuuuguggcuagguauuuccauaauuccuccacucuaaaguguuc

SEQ ID NO: 491501 - RNA, 64 nt, Homo Sapiens
cagggaguaacuuuaaacaaaggcuucaaauaaguuuccauaugggaggauguuuacagcuuug

SEQ ID NO: 491502 - RNA, 64 nt, Homo Sapiens
aauuuuaugaaaguuaagauaauacauuuaugauuuuccauaauaugacacauggaacuaaugg

SEQ ID NO: 491503 - RNA, 64 nt, Homo Sapiens
gugucagcaacagcacuaaauccaaauaaaacaguuuccauaaguuaaaaaucuaauuagaauu

SEQ ID NO: 491504 - RNA, 64 nt, Homo Sapiens
aacuaaucauagugacccaauccauaggagguaauuuccauagcacagugacauuggaaucauu

SEQ ID NO: 491505 - RNA, 64 nt, Homo Sapiens
agguaauuuccauagcaacuugacauuggaaucauuuccauaggaugucauauucuuacaacag

SEQ ID NO: 491506 - RNA, 64 nt, Homo Sapiens
gucauuucccuucuaaguuauuucucuguuccacuuuccauacugaguuugaaacccugagcug

SEQ ID NO: 491507 - RNA, 64 nt, Homo Sapiens
ugcugagaaucaaagcacaauuugccaggaaguauuuccauaguuuuguuguucuguuuccuau

SEQ ID NO: 491508 - RNA, 64 nt, Homo Sapiens
ugugaaggaucuaaggagacacaugcaccggaaauuuccauaagccaguugcaguuuucaggcu

SEQ ID NO: 491509 - RNA, 64 nt, Homo Sapiens
auuuuauuuuaggagcuuauaaggcaugagacaauuuccauauaaauauauuaauuauugccac

SEQ ID NO: 491510 - RNA, 64 nt, Homo Sapiens
cugagguuaacacuugauuuagccccuacauaucuuuccauauauccuauuauuucugaauaua

SEQ ID NO: 491511 - RNA, 64 nt, Homo Sapiens
gauagucacgaaaauacugaaaguuugauuuuucuuuccauauuugaauuaauuuuuucuguuu

SEQ ID NO: 491512 - RNA, 64 nt, Homo Sapiens
caguacuuuauauuuauaaauaaauagcuucauguuuccauaauccuuuaggggaaaaaacccc

SEQ ID NO: 491513 - RNA, 64 nt, Homo Sapiens
aaagauuacuuuccauuccuuaaauaauugucuuuuuccauaaaacagaaaacaauuuauuuuu

SEQ ID NO: 491514 - RNA, 64 nt, Homo Sapiens
augaaaggcucgauguaauauagcuguaauuuacuuuccauaugaauacaguggcuagguucau

SEQ ID NO: 491515 - RNA, 64 nt, Homo Sapiens
uguauuuuaugaugcccagcuuggaaauaguugcuuuccauagucucaacuguauugugucauc

SEQ ID NO: 491516 - RNA, 64 nt, Homo Sapiens
ugcuguggcaggccuaauuugucuuguucuuuccuuuccauaucccaguauaaucucuguuaau

SEQ ID NO: 491517 - RNA, 64 nt, Homo Sapiens
ucuagcugacagugguacuuagcaaaggccacuguuuccauagugaccagcugauaccucuucc

SEQ ID NO: 491518 - RNA, 64 nt, Homo Sapiens
uuacugaaucugaaaaacauaugauuauccucaauuuccauaugagaguucaauagcuguuucu

SEQ ID NO: 491519 - RNA, 64 nt, Homo Sapiens
auuuuuuuauuuuagaguucugaaauaccuuuuauuuccauauagugaugagccauuuuucaaa

SEQ ID NO: 491520 - RNA, 64 nt, Homo Sapiens
ucguguucuguucuauagaguuuuaaaaagaaccuuuccauacuuuguuccaaaagacaagugu

SEQ ID NO: 491521 - RNA, 64 nt, Homo Sapiens
cucuaaaacuccccaaauugaauagcacuuccauuuuccauagaaacauucaaucuaaguuaca

SEQ ID NO: 491522 - RNA, 64 nt, Homo Sapiens
gggaaguucucuguccuaugaaucuguagauugguuuccauacacucuucaggggauaugaaac

SEQ ID NO: 491523 - RNA, 64 nt, Homo Sapiens
uucacuacgcuuggacauuuuauuauuuuaaaacuuuccauauuaauuuuuucagugaaauucc

SEQ ID NO: 491524 - RNA, 64 nt, Homo Sapiens
acaaaauacuugucuguuuuaaaaaccuguucaagucuaccaaccuguucaagucuaccaauua

SEQ ID NO: 491525 - RNA, 64 nt, Homo Sapiens
uuaaaaaccuguucaagucuaccaaccuguucaagucuaccaauuauaagggcaaauuggagaa

SEQ ID NO: 491526 - RNA, 64 nt, Homo Sapiens
agucuguaaacauaaccuuaugaacaauucacaugucuaccacacaauucacauuauauuggaa

SEQ ID NO: 491527 - RNA, 64 nt, Homo Sapiens
gaacacacugcauguaaaagcacucaacgauuaagucuaccaaacuuugcaaauucuguaauuu

SEQ ID NO: 491528 - RNA, 64 nt, Homo Sapiens; identical to SEQ ID NO: 147960

SEQ ID NO: 491529 - RNA, 64 nt, Homo Sapiens; identical to SEQ ID NO: 147961

SEQ ID NO: 491530 - RNA, 64 nt, Homo Sapiens; identical to SEQ ID NO: 147962

SEQ ID NO: 491531 - RNA, 64 nt, Homo Sapiens; identical to SEQ ID NO: 147963

SEQ ID NO: 491532 - RNA, 64 nt, Homo Sapiens
aagagcaggaagagguugcuaugagggcuugagucgccugaaccuuaagcccaugugcaagaaa

SEQ ID NO: 491533 - RNA, 64 nt, Homo Sapiens
aagagcaggaagagguugcuaugagggcuugagucgccugaacguuaagcccaaguggaagaaa

SEQ ID NO: 491534 - RNA, 64 nt, Homo Sapiens
caggaggcggagcuugcaguugaggcaggagaaucgccugaacccacacaccuguaaucguagc

SEQ ID NO: 491535 - RNA, 64 nt, Homo Sapiens
cccagcuacucaagaggcugggugugguggcaggcgccugaaauuaaaauacauaaauuagccg

SEQ ID NO: 491536 - RNA, 64 nt, Homo Sapiens; identical to SEQ ID NO: 173420

SEQ ID NO: 491537 - RNA, 64 nt, Homo Sapiens; identical to SEQ ID NO: 173421

SEQ ID NO: 491538 - RNA, 64 nt, Homo Sapiens; identical to SEQ ID NO: 173422

SEQ ID NO: 491539 - RNA, 64 nt, Homo Sapiens; identical to SEQ ID NO: 173423

SEQ ID NO: 491540 - RNA, 64 nt, Homo Sapiens; identical to SEQ ID NO: 173424

SEQ ID NO: 491541 - RNA, 64 nt, Homo Sapiens; identical to SEQ ID NO: 173425

SEQ ID NO: 491542 - RNA, 64 nt, Homo Sapiens; identical to SEQ ID NO: 173426

SEQ ID NO: 491543 - RNA, 64 nt, Homo Sapiens; identical to SEQ ID NO: 173427

SEQ ID NO: 491544 - RNA, 64 nt, Homo Sapiens; identical to SEQ ID NO: 173428

SEQ ID NO: 491545 - RNA, 64 nt, Homo Sapiens; identical to SEQ ID NO: 173429

SEQ ID NO: 491546 - RNA, 64 nt, Homo Sapiens; identical to SEQ ID NO: 23154

SEQ ID NO: 491547 - RNA, 64 nt, Homo Sapiens; identical to SEQ ID NO: 23155

SEQ ID NO: 491548 - RNA, 64 nt, Homo Sapiens; identical to SEQ ID NO: 23156

SEQ ID NO: 491549 - RNA, 64 nt, Homo Sapiens; identical to SEQ ID NO: 23157

SEQ ID NO: 491550 - RNA, 64 nt, Homo Sapiens; identical to SEQ ID NO: 68768

SEQ ID NO: 491551 - RNA, 64 nt, Homo Sapiens; identical to SEQ ID NO: 68769

SEQ ID NO: 491552 - RNA, 64 nt, Homo Sapiens; identical to SEQ ID NO: 68770

SEQ ID NO: 491553 - RNA, 64 nt, Homo Sapiens; identical to SEQ ID NO: 68771

SEQ ID NO: 491554 - RNA, 64 nt, Homo Sapiens; identical to SEQ ID NO: 68772

SEQ ID NO: 491555 - RNA, 64 nt, Homo Sapiens; identical to SEQ ID NO: 68773

SEQ ID NO: 491556 - RNA, 64 nt, Homo Sapiens; identical to SEQ ID NO: 68774

SEQ ID NO: 491557 - RNA, 64 nt, Homo Sapiens; identical to SEQ ID NO: 68775

SEQ ID NO: 491558 - RNA, 64 nt, Homo Sapiens; identical to SEQ ID NO: 68776

SEQ ID NO: 491559 - RNA, 64 nt, Homo Sapiens; identical to SEQ ID NO: 68777

SEQ ID NO: 491560 - RNA, 64 nt, Homo Sapiens; identical to SEQ ID NO: 68778

SEQ ID NO: 491561 - RNA, 64 nt, Homo Sapiens; identical to SEQ ID NO: 68779

SEQ ID NO: 491562 - RNA, 64 nt, Homo Sapiens; identical to SEQ ID NO: 68780

SEQ ID NO: 491563 - RNA, 64 nt, Homo Sapiens; identical to SEQ ID NO: 68781

SEQ ID NO: 491564 - RNA, 64 nt, Homo Sapiens; identical to SEQ ID NO: 68782

SEQ ID NO: 491565 - RNA, 64 nt, Homo Sapiens; identical to SEQ ID NO: 68783

SEQ ID NO: 491566 - RNA, 64 nt, Homo Sapiens; identical to SEQ ID NO: 68784

SEQ ID NO: 491567 - RNA, 64 nt, Homo Sapiens; identical to SEQ ID NO: 68785

SEQ ID NO: 491568 - RNA, 64 nt, Homo Sapiens; identical to SEQ ID NO: 68786

SEQ ID NO: 491569 - RNA, 64 nt, Homo Sapiens; identical to SEQ ID NO: 68787

SEQ ID NO: 491570 - RNA, 64 nt, Homo Sapiens; identical to SEQ ID NO: 68788

SEQ ID NO: 491571 - RNA, 64 nt, Homo Sapiens; identical to SEQ ID NO: 68789

SEQ ID NO: 491572 - RNA, 64 nt, Homo Sapiens; identical to SEQ ID NO: 68790

SEQ ID NO: 491573 - RNA, 64 nt, Homo Sapiens; identical to SEQ ID NO: 68791

SEQ ID NO: 491574 - RNA, 64 nt, Homo Sapiens; identical to SEQ ID NO: 68792

SEQ ID NO: 491575 - RNA, 64 nt, Homo Sapiens; identical to SEQ ID NO: 68793

SEQ ID NO: 491576 - RNA, 64 nt, Homo Sapiens; identical to SEQ ID NO: 68794

SEQ ID NO: 491577 - RNA, 64 nt, Homo Sapiens; identical to SEQ ID NO: 68795

SEQ ID NO: 491578 - RNA, 64 nt, Homo Sapiens; identical to SEQ ID NO: 68796

SEQ ID NO: 491579 - RNA, 64 nt, Homo Sapiens; identical to SEQ ID NO: 68797

SEQ ID NO: 491580 - RNA, 64 nt, Homo Sapiens; identical to SEQ ID NO: 68798

SEQ ID NO: 491581 - RNA, 64 nt, Homo Sapiens; identical to SEQ ID NO: 68799

SEQ ID NO: 491582 - RNA, 64 nt, Homo Sapiens; identical to SEQ ID NO: 68800

SEQ ID NO: 491583 - RNA, 64 nt, Homo Sapiens; identical to SEQ ID NO: 68801

SEQ ID NO: 491584 - RNA, 59 nt, Homo Sapiens; identical to SEQ ID NO: 68802

SEQ ID NO: 491585 - RNA, 64 nt, Homo Sapiens; identical to SEQ ID NO: 68803

SEQ ID NO: 491586 - RNA, 64 nt, Homo Sapiens; identical to SEQ ID NO: 68804

SEQ ID NO: 491587 - RNA, 64 nt, Homo Sapiens; identical to SEQ ID NO: 68805

SEQ ID NO: 491588 - RNA, 64 nt, Homo Sapiens; identical to SEQ ID NO: 68806

SEQ ID NO: 491589 - RNA, 64 nt, Homo Sapiens; identical to SEQ ID NO: 68807

SEQ ID NO: 491590 - RNA, 64 nt, Homo Sapiens; identical to SEQ ID NO: 68808

SEQ ID NO: 491591 - RNA, 64 nt, Homo Sapiens; identical to SEQ ID NO: 68809

SEQ ID NO: 491592 - RNA, 64 nt, Homo Sapiens; identical to SEQ ID NO: 68810

SEQ ID NO: 491593 - RNA, 64 nt, Homo Sapiens; identical to SEQ ID NO: 68811

SEQ ID NO: 491594 - RNA, 64 nt, Homo Sapiens; identical to SEQ ID NO: 68812

SEQ ID NO: 491595 - RNA, 64 nt, Homo Sapiens; identical to SEQ ID NO: 480284

SEQ ID NO: 491596 - RNA, 64 nt, Homo Sapiens; identical to SEQ ID NO: 480285

SEQ ID NO: 491597 - RNA, 64 nt, Homo Sapiens; identical to SEQ ID NO: 480286

SEQ ID NO: 491598 - RNA, 64 nt, Homo Sapiens; identical to SEQ ID NO: 480287

SEQ ID NO: 491599 - RNA, 64 nt, Homo Sapiens; identical to SEQ ID NO: 480288

SEQ ID NO: 491600 - RNA, 64 nt, Homo Sapiens; identical to SEQ ID NO: 480289

SEQ ID NO: 491601 - RNA, 64 nt, Homo Sapiens; identical to SEQ ID NO: 480290

SEQ ID NO: 491602 - RNA, 64 nt, Homo Sapiens; identical to SEQ ID NO: 480291

SEQ ID NO: 491603 - RNA, 64 nt, Homo Sapiens; identical to SEQ ID NO: 480292

SEQ ID NO: 491604 - RNA, 64 nt, Homo Sapiens; identical to SEQ ID NO: 480293

SEQ ID NO: 491605 - RNA, 64 nt, Homo Sapiens; identical to SEQ ID NO: 480294

SEQ ID NO: 491606 - RNA, 64 nt, Homo Sapiens; identical to SEQ ID NO: 480295

SEQ ID NO: 491607 - RNA, 64 nt, Homo Sapiens; identical to SEQ ID NO: 480296

SEQ ID NO: 491608 - RNA, 64 nt, Homo Sapiens; identical to SEQ ID NO: 480297

SEQ ID NO: 491609 - RNA, 64 nt, Homo Sapiens; identical to SEQ ID NO: 480298

SEQ ID NO: 491610 - RNA, 64 nt, Homo Sapiens; identical to SEQ ID NO: 480299

SEQ ID NO: 491611 - RNA, 64 nt, Homo Sapiens; identical to SEQ ID NO: 480300

SEQ ID NO: 491612 - RNA, 64 nt, Homo Sapiens; identical to SEQ ID NO: 480301

SEQ ID NO: 491613 - RNA, 64 nt, Homo Sapiens; identical to SEQ ID NO: 480302

SEQ ID NO: 491614 - RNA, 64 nt, Homo Sapiens; identical to SEQ ID NO: 480303

SEQ ID NO: 491615 - RNA, 64 nt, Homo Sapiens; identical to SEQ ID NO: 480304

SEQ ID NO: 491616 - RNA, 64 nt, Homo Sapiens
cacaaaaacaccugaaaaaacucaagcugacuuccacugcgaagggaaauuauugguuugugua

SEQ ID NO: 491617 - RNA, 59 nt, Homo Sapiens
acauugcugauugguguuaaguugcuagacacugcgaaaccaagcugacucacaagaag

SEQ ID NO: 491618 - RNA, 64 nt, Homo Sapiens
gaugggcugggggaguugagagugugcuuauuuucacugcgaucaugagaccacaguucugggu

SEQ ID NO: 491619 - RNA, 64 nt, Homo Sapiens
uccccaucggccuccagcacugccucccuccucccacugcgacucugggaucuccaggugcugc

SEQ ID NO: 491620 - RNA, 64 nt, Homo Sapiens
uuccgggaggcagagaggagugaccgggcacuggcacugcgaucaggaagacuggacccccagc

SEQ ID NO: 491621 - RNA, 64 nt, Homo Sapiens
gccuccuaaaaguucugggauuacaagugugagucacugcgacuggccaacauuaugugauuua

SEQ ID NO: 491622 - RNA, 64 nt, Homo Sapiens
cacuuaccauguagauacggcuacggccccaggucacugcgaggcugugcuuuaaaugguaacg

SEQ ID NO: 491623 - RNA, 64 nt, Homo Sapiens
uccaccuccuggguucaagcgcgugaccucagcucacugcgaccacccaggcuggagugcaaug

SEQ ID NO: 491624 - RNA, 64 nt, Homo Sapiens
gagcagccagccaagagccgcuccgcugccgcgacacugcgagggggucugcagggggcccggc

SEQ ID NO: 491625 - RNA, 64 nt, Homo Sapiens
ucucauuauucaagguaguuacguucuauaaagucacugcgaacacugaauuagcaaauauaga

SEQ ID NO: 491626 - RNA, 64 nt, Homo Sapiens
ccugagcccacaagggcagacccagugugaccaccacugcgaccggugggcagcagaggcaggc

SEQ ID NO: 491627 - RNA, 64 nt, Homo Sapiens
ugccacgcuggaaugcaguaacgugaucuuggcucacugcgaccuccaccuccccaguucaagc

SEQ ID NO: 491628 - RNA, 64 nt, Homo Sapiens
aacaacaacaaaaugaaacgcaaccaccaccaaccacugcgaccacaagaaggaugauucaaca

SEQ ID NO: 491629 - RNA, 64 nt, Homo Sapiens
accuugccgcuuuucaucacuuguuuacauuguacacugcgaccuuguucauuuccaaagcuac

SEQ ID NO: 491630 - RNA, 64 nt, Homo Sapiens
cuuaaacccucugccuuugaaagcaggucauguucacugcgaugcuggacacuacagguaucug

SEQ ID NO: 491631 - RNA, 64 nt, Homo Sapiens
augugaagaagaaaaaaaugccauguuuuaaaaccacugcgaaaauuuccccaaagcauaggug

SEQ ID NO: 491632 - RNA, 64 nt, Homo Sapiens
ccuuaaaaccaaaaaaauaauggaaugauugcaucacugcgaggaaguauacuuaauuaagaaa

SEQ ID NO: 491633 - RNA, 64 nt, Homo Sapiens
acauuccuuaacccgcugcccugugcuuuccugacacugcgaauugcaauucacucuggcgacc

SEQ ID NO: 491634 - RNA, 64 nt, Homo Sapiens
uccagcugcgguuaauccagcuugggccugucugcacugcgauccucuugggcucuccuaggau

SEQ ID NO: 491635 - RNA, 64 nt, Homo Sapiens
gcacggcucugccccauggggggccuuuuuuacacacugcgaggcccagcuuucuaggggacuu

SEQ ID NO: 491636 - RNA, 64 nt, Homo Sapiens
cugagcaaaaggcaaugaaaagucuugguucccacacugcgauauauuggaauuuucaccucag

SEQ ID NO: 491637 - RNA, 64 nt, Homo Sapiens
ucugccucccagguucaagcgugcaaucucggcucacugcgaccacccaggcuggagugcaaug

SEQ ID NO: 491638 - RNA, 64 nt, Homo Sapiens
acugugcucgaaguagagguuuuacucuacucaucacugcgauuugcacauugcuccguggaca

SEQ ID NO: 491639 - RNA, 64 nt, Homo Sapiens
cccuggcucccuccuccaggccugccucccacuucacugcgaagacccucuugcccauccugac

SEQ ID NO: 491640 - RNA, 64 nt, Homo Sapiens
auucauuccgcuguaauguugcauuugaccuaaccacugcgaaaacuguugcuaugauguaacu

SEQ ID NO: 491641 - RNA, 64 nt, Homo Sapiens
uuccuuucuaucucaggguuuuguugaucaggcccacugcgacccaggaauaucagaaacgaag

SEQ ID NO: 491642 - RNA, 64 nt, Homo Sapiens
aguaacuucuaaaauauaacaauacuaaauaucacacugcgauggaggucccaaauaugugguc

SEQ ID NO: 491643 - RNA, 64 nt, Homo Sapiens
uuguuuuaaagucagauuuguaucuuuuuucccccacugcgaggaaauguugacuggccaaaaa

SEQ ID NO: 491644 - RNA, 64 nt, Homo Sapiens
ucagugaaauugcuaaaugucaauguauuuuuggcacugcgauuuuaaccauuuauuaaauaaa

SEQ ID NO: 491645 - RNA, 64 nt, Homo Sapiens
agcuugacgcguggucacaggacgauuucacugacacugcgaacucucaggacuaccguuacca

SEQ ID NO: 491646 - RNA, 64 nt, Homo Sapiens
ucuuucagcccagcgcugcggccccgggaagggccacugcgaauagagaggaagcuggaaaagu

SEQ ID NO: 491647 - RNA, 64 nt, Homo Sapiens
auaccuucaaguacaguauugugugagccuucagcacugcgagaucaccucuggaaauacacua

SEQ ID NO: 491648 - RNA, 64 nt, Homo Sapiens
gggcuuccaugguaagggggccugcgucccugcacacugcgaggacugccuuggccacaggccc

SEQ ID NO: 491649 - RNA, 64 nt, Homo Sapiens
uccgucucccgggcucacgcgcgugaucucggcucacugcgaccacccaggcuggagugcagug

SEQ ID NO: 491650 - RNA, 64 nt, Homo Sapiens
cagggagccuggccaggccugagacacagaggcccacugcgagggggacaguggcggugggacu

SEQ ID NO: 491651 - RNA, 64 nt, Homo Sapiens
uugugaagcugaggacaauguggaaaacccagggcacugcgacuccccuagccuugcuaugcag

SEQ ID NO: 491652 - RNA, 57 nt, Homo Sapiens
ccgagccgcaggucugcugaggccuggcacugcgacugcccagucuggccugcgcuc

SEQ ID NO: 491653 - RNA, 64 nt, Homo Sapiens
gggugauuuuaggcagcaagaauuggagaacucacacugcgaaaagaaaaccuuggguggcagu

SEQ ID NO: 491654 - RNA, 64 nt, Homo Sapiens
ccuccagaagacaucuguccugcagaggcccuaccacugcgaggccugcgggaaggacuuccuc

SEQ ID NO: 491655 - RNA, 64 nt, Homo Sapiens
auggagaucuuggucaucucaagacugacaucugcacugcgaggcguucguuacgcggugugug

SEQ ID NO: 491656 - RNA, 64 nt, Homo Sapiens
ggggucaccaggugaccagucuuggggcggaacucacugcgaugugcuauaggcugggcuuccc

SEQ ID NO: 491657 - RNA, 64 nt, Homo Sapiens
aaagugccccuugaugagggaaaaugucccacugcacugcgaauuucucaguuccauuuuaccu

SEQ ID NO: 491658 - RNA, 64 nt, Homo Sapiens
cgggguggcagagugaguugucucaggaccccgucacugcgacguugacacuccucucccuucc

SEQ ID NO: 491659 - RNA, 64 nt, Homo Sapiens
uauauuaguaggagggcuucacaccagcacugcucacugcgacuccuggaaauguguggggaau

SEQ ID NO: 491660 - RNA, 64 nt, Homo Sapiens
aacuaucaggaauaucugaagacauuggcuucuccacugcgagagauugauccagaccaaccca

SEQ ID NO: 491661 - RNA, 64 nt, Homo Sapiens
ggggcugggccagugcaccugcugcagccagggccacugcgaggaagagggagucugagcauga

SEQ ID NO: 491662 - RNA, 64 nt, Homo Sapiens
gcgucaagaaagaaugaaugggagcgaccggggagcgagcgagugaagaagcgguaaugcgccc

SEQ ID NO: 491663 - RNA, 64 nt, Homo Sapiens
uuacguuuucaaagaaaucaaguauaugaggagagcgagcgagcgugagagaacacccgugaga

SEQ ID NO: 491664 - RNA, 64 nt, Homo Sapiens
cuaugagaagauguuuggcagggcgugcccuauugcgagcgagaagggccuucuacauggagga

SEQ ID NO: 491665 - RNA, 64 nt, Homo Sapiens
caucacuaugcaucuguuccaggaaagaagaaaagcgagcgaggaagacggaaaagacugccug

SEQ ID NO: 491666 - RNA, 64 nt, Homo Sapiens
uccgcuggaaaaacguuucgaagcacaguggccagcgagcgagcacguggcuacucccuguugc

SEQ ID NO: 491667 - RNA, 64 nt, Homo Sapiens
gagaggagggagagggggaggggcggccgggagggcgagcgaggcggcgcugggguaucaguga

SEQ ID NO: 491668 - RNA, 64 nt, Homo Sapiens
gcccccggacuggaggcuugggagagcgggcggagcgagcgagggcauccagagaggaguccug

SEQ ID NO: 491669 - RNA, 64 nt, Homo Sapiens
gucugcucacuggcucugggcucuagggagaugggcgagcgagcgugucagcugcacagcggga

SEQ ID NO: 491670 - RNA, 64 nt, Homo Sapiens
cugucccugccucagguuggguuucugcaugucagcgagcgacaaucaucucugcuacagucau

SEQ ID NO: 491671 - RNA, 64 nt, Homo Sapiens
gccccugcccuucaccuagcucccuuggccaggagcgagcgaagcuguggccuuggugaagcug

SEQ ID NO: 491672 - RNA, 64 nt, Homo Sapiens
ggucccuggggcagcuguccccaucaggccaagagcgagcgagaggcgcugccccagccaggcc

SEQ ID NO: 491673 - RNA, 64 nt, Homo Sapiens
gagagagcgagagagagagcaaaaaaaaaaaaaagcgagcgagaugaaaaguugaaaagacaaa

SEQ ID NO: 491674 - RNA, 64 nt, Homo Sapiens
gagauuuccuuggaaauuucggaaaacggagagagcgagcgagacucccccagaagcucacaaa

SEQ ID NO: 491675 - RNA, 64 nt, Homo Sapiens
gcgaguaugagcagcucaagagcgagugggcccagcgagcgaacccugaggaccuggaauucau

SEQ ID NO: 491676 - RNA, 64 nt, Homo Sapiens
aauuuaauuugcuuaagauuuaguacauuucagaacuuuugaacuuuugacaaauugcauugga

SEQ ID NO: 491677 - RNA, 64 nt, Homo Sapiens
uugcuuaagauuuaguacauuucagaacuuuugaacuuuugacaaauugcauuggaaaaagaag

SEQ ID NO: 491678 - RNA, 64 nt, Homo Sapiens
ucauuuacuuggcugauagauaauuaaacaugcuacuuuugauuaguuguaacucaaugaaauu

SEQ ID NO: 491679 - RNA, 64 nt, Homo Sapiens
uacucaaagccagaaagcuuucauuauccuuuggacuuuugauaucauacauaauuuuagguua

SEQ ID NO: 491680 - RNA, 64 nt, Homo Sapiens
uucuccagcuuguccauuuccccacuugaagaaaacuuuugauauauaugccuuacugaguaca

SEQ ID NO: 491681 - RNA, 64 nt, Homo Sapiens
gccagggggaacaaaguaagcuugaugggcuggaacuuuugacuuuggguccccaaacagccaa

SEQ ID NO: 491682 - RNA, 64 nt, Homo Sapiens
aacagaugacaaaucucugaaagagguuuuuaaaacuuuugauccaacugcuucaccauuuugu

SEQ ID NO: 491683 - RNA, 64 nt, Homo Sapiens
ugguuguuuaguuucaagcaauaugauguacauuacuuuugagaaacaguauuuugacuaggac

SEQ ID NO: 491684 - RNA, 64 nt, Homo Sapiens
uuucuuaauaaaggcguugauggaccuguaaucaacuuuugauagaacuuuguaaaacugcaua

SEQ ID NO: 491685 - RNA, 64 nt, Homo Sapiens
acuugugacuggaguucaguuuguucucggucauacuuuugaccgcugauguuccugcauccag

SEQ ID NO: 491686 - RNA, 64 nt, Homo Sapiens
uucuuucauugugguuguuccugcccauccuguuacuuuugaguauucuuugcuguaccuuuug

SEQ ID NO: 491687 - RNA, 64 nt, Homo Sapiens
cugccccuuaaccuugacgacuggaaguaugaucacuuuugaacguuggccacuuacgcuaauc

SEQ ID NO: 491688 - RNA, 64 nt, Homo Sapiens
aaugguuugaaguacucaaaaucuguuacgcuaaacuuuugauucuuuaacacaauuauuuuua

SEQ ID NO: 491689 - RNA, 64 nt, Homo Sapiens
uguagacuguuuaaugacuggauaucuuccuucaacuuuugaaauacaaaaccaguguuuuuua

SEQ ID NO: 491690 - RNA, 64 nt, Homo Sapiens
aaugaaaccaggccauagcugucauaaaucuuugacuuuugaauauuuacauucuucaguauaa

SEQ ID NO: 491691 - RNA, 64 nt, Homo Sapiens
gauuuucuccuuugguuuguagaauuaggacugaacuuuugacucaaauugcuacaguugccau

SEQ ID NO: 491692 - RNA, 64 nt, Homo Sapiens
gguuuccaccuuggacugacuuugauccuguuccacuuuugaaauuuuauuuguuccuuuucca

SEQ ID NO: 491693 - RNA, 64 nt, Homo Sapiens
agaaaagagaggauguccgugcuuaauucuagauacuuuugagacaacaccuucagaaaacaca

SEQ ID NO: 491694 - RNA, 64 nt, Homo Sapiens
agauaaaauugugcauucaaaugaugguacuuugacuuuugaggguuuuuauuucuguuauuca

SEQ ID NO: 491695 - RNA, 64 nt, Homo Sapiens
uuauuugauacuguacaaacauuguguuuuuuagacuuuugauaauuuauaaacauaaaagcuc

SEQ ID NO: 491696 - RNA, 64 nt, Homo Sapiens
uuuuuuaugguauaaaaacauuuuuuuaaacugcacuuuugacucaagaauaacaacuuccacu

SEQ ID NO: 491697 - RNA, 64 nt, Homo Sapiens
uuuuugaucuguauugggcuaaccagagccaaauacuuuugaagaguuucccagggacuaguca

SEQ ID NO: 491698 - RNA, 64 nt, Homo Sapiens
ucucuagcccauuauaaccugcuaucuuggggcaacuuuugauguaugacaugucacccuuccc

SEQ ID NO: 491699 - RNA, 64 nt, Homo Sapiens
uauguaaugcuucacccugauggagaaaaagaacacuuuugaacccaucuagguuucuuuuauc

SEQ ID NO: 491700 - RNA, 64 nt, Homo Sapiens
uuucagucaucuuuuucgugugccuacacuuaggacuuuugaacaaauuucccauaaacuuaag

SEQ ID NO: 491701 - RNA, 64 nt, Homo Sapiens
guuaccgauuggauguaaaagaaauauuggugugacuuuugaauaaguaaaacacaaugcugaa

SEQ ID NO: 491702 - RNA, 64 nt, Homo Sapiens
cuccagugagacgcuguuuucagaagauucauacacuuuugagauuaucccauccuugcacuac

SEQ ID NO: 491703 - RNA, 64 nt, Homo Sapiens; identical to SEQ ID NO: 22256

SEQ ID NO: 491704 - RNA, 64 nt, Homo Sapiens; identical to SEQ ID NO: 22257

SEQ ID NO: 491705 - RNA, 64 nt, Homo Sapiens; identical to SEQ ID NO: 22258

SEQ ID NO: 491706 - RNA, 64 nt, Homo Sapiens; identical to SEQ ID NO: 22259

SEQ ID NO: 491707 - RNA, 64 nt, Homo Sapiens; identical to SEQ ID NO: 22260

SEQ ID NO: 491708 - RNA, 64 nt, Homo Sapiens; identical to SEQ ID NO: 22261

SEQ ID NO: 491709 - RNA, 64 nt, Homo Sapiens; identical to SEQ ID NO: 22262

SEQ ID NO: 491710 - RNA, 64 nt, Homo Sapiens; identical to SEQ ID NO: 22263

SEQ ID NO: 491711 - RNA, 64 nt, Homo Sapiens; identical to SEQ ID NO: 22264

SEQ ID NO: 491712 - RNA, 64 nt, Homo Sapiens; identical to SEQ ID NO: 22265

SEQ ID NO: 491713 - RNA, 64 nt, Homo Sapiens
uuucccaacuacccaaccccggaagcugucaaucccggagcaacgcugcuguggcuucagcuuu

SEQ ID NO: 491714 - RNA, 64 nt, Homo Sapiens
guggggaggugcaguggcacccaccacugagggcccggagcagggcccggaaggaaggccauga

SEQ ID NO: 491715 - RNA, 64 nt, Homo Sapiens
uuccuauauucuucugcaaaucaaacguucuuucccaauccaauccagccuugguuuuauuuua

SEQ ID NO: 491716 - RNA, 64 nt, Homo Sapiens
auauucuucugcaaaucaaacguucuuucccaauccaauccagccuugguuuuauuuuaaauua

SEQ ID NO: 491717 - RNA, 64 nt, Homo Sapiens
ugggaacuugacucucucauauaugaaguauguuccaauccaugauuuaauuaaaaucagucuu

SEQ ID NO: 491718 - RNA, 64 nt, Homo Sapiens
gcaacgcuggugcuugauacaggguuauuugaaaccaauccaugaaauauaaaauuauauauaa

SEQ ID NO: 491719 - RNA, 64 nt, Homo Sapiens
cagugaggaauccugaaacauaugcguuccaucuccaauccagggcagggucagggccaaaguc

SEQ ID NO: 491720 - RNA, 64 nt, Homo Sapiens
cagacccgcguccaccugggugggagcuggggagccaauccacccccuggggcucccagggaag

SEQ ID NO: 491721 - RNA, 64 nt, Homo Sapiens
agugccaaacuagccaacggaaacgccacaucccccaauccaucaagacacaggggacacccag

SEQ ID NO: 491722 - RNA, 64 nt, Homo Sapiens
acuggcaaggacgcuucacagccccacaccagccccaauccaaacccgugguggcucaagucug

SEQ ID NO: 491723 - RNA, 64 nt, Homo Sapiens; identical to SEQ ID NO: 218812

SEQ ID NO: 491724 - RNA, 64 nt, Homo Sapiens; identical to SEQ ID NO: 218813

SEQ ID NO: 491725 - RNA, 64 nt, Homo Sapiens; identical to SEQ ID NO: 218814

SEQ ID NO: 491726 - RNA, 64 nt, Homo Sapiens; identical to SEQ ID NO: 218815

SEQ ID NO: 491727 - RNA, 64 nt, Homo Sapiens; identical to SEQ ID NO: 218816

SEQ ID NO: 491728 - RNA, 64 nt, Homo Sapiens; identical to SEQ ID NO: 218817

SEQ ID NO: 491729 - RNA, 64 nt, Homo Sapiens; identical to SEQ ID NO: 218818

SEQ ID NO: 491730 - RNA, 64 nt, Homo Sapiens; identical to SEQ ID NO: 218819

SEQ ID NO: 491731 - RNA, 64 nt, Homo Sapiens; identical to SEQ ID NO: 218820

SEQ ID NO: 491732 - RNA, 64 nt, Homo Sapiens; identical to SEQ ID NO: 218821

SEQ ID NO: 491733 - RNA, 64 nt, Homo Sapiens; identical to SEQ ID NO: 218822

SEQ ID NO: 491734 - RNA, 64 nt, Homo Sapiens; identical to SEQ ID NO: 218823

SEQ ID NO: 491735 - RNA, 64 nt, Homo Sapiens; identical to SEQ ID NO: 218824

SEQ ID NO: 491736 - RNA, 64 nt, Homo Sapiens; identical to SEQ ID NO: 218825

SEQ ID NO: 491737 - RNA, 64 nt, Homo Sapiens; identical to SEQ ID NO: 218826

SEQ ID NO: 491738 - RNA, 64 nt, Homo Sapiens; identical to SEQ ID NO: 218827

SEQ ID NO: 491739 - RNA, 64 nt, Homo Sapiens; identical to SEQ ID NO: 218828

SEQ ID NO: 491740 - RNA, 64 nt, Homo Sapiens; identical to SEQ ID NO: 218829

SEQ ID NO: 491741 - RNA, 64 nt, Homo Sapiens; identical to SEQ ID NO: 218830

SEQ ID NO: 491742 - RNA, 64 nt, Homo Sapiens; identical to SEQ ID NO: 218831

SEQ ID NO: 491743 - RNA, 64 nt, Homo Sapiens; identical to SEQ ID NO: 218832

SEQ ID NO: 491744 - RNA, 64 nt, Homo Sapiens; identical to SEQ ID NO: 218833

SEQ ID NO: 491745 - RNA, 64 nt, Homo Sapiens; identical to SEQ ID NO: 218834

SEQ ID NO: 491746 - RNA, 64 nt, Homo Sapiens; identical to SEQ ID NO: 218835

SEQ ID NO: 491747 - RNA, 64 nt, Homo Sapiens; identical to SEQ ID NO: 218836

SEQ ID NO: 491748 - RNA, 64 nt, Homo Sapiens; identical to SEQ ID NO: 168067

SEQ ID NO: 491749 - RNA, 64 nt, Homo Sapiens; identical to SEQ ID NO: 168068

SEQ ID NO: 491750 - RNA, 64 nt, Homo Sapiens; identical to SEQ ID NO: 168069

SEQ ID NO: 491751 - RNA, 64 nt, Homo Sapiens; identical to SEQ ID NO: 168070

SEQ ID NO: 491752 - RNA, 64 nt, Homo Sapiens; identical to SEQ ID NO: 168071

SEQ ID NO: 491753 - RNA, 64 nt, Homo Sapiens; identical to SEQ ID NO: 168072

SEQ ID NO: 491754 - RNA, 64 nt, Homo Sapiens; identical to SEQ ID NO: 168073

SEQ ID NO: 491755 - RNA, 64 nt, Homo Sapiens; identical to SEQ ID NO: 168074

SEQ ID NO: 491756 - RNA, 64 nt, Homo Sapiens; identical to SEQ ID NO: 168075

SEQ ID NO: 491757 - RNA, 64 nt, Homo Sapiens; identical to SEQ ID NO: 168076

SEQ ID NO: 491758 - RNA, 64 nt, Homo Sapiens; identical to SEQ ID NO: 168077

SEQ ID NO: 491759 - RNA, 64 nt, Homo Sapiens; identical to SEQ ID NO: 168078

SEQ ID NO: 491760 - RNA, 64 nt, Homo Sapiens; identical to SEQ ID NO: 168079

SEQ ID NO: 491761 - RNA, 64 nt, Homo Sapiens; identical to SEQ ID NO: 168080

SEQ ID NO: 491762 - RNA, 64 nt, Homo Sapiens
aagcuauaaauuaccuggucauuuugugaucacaagagucuaugcaaaaaaaaaaauuucuuua

SEQ ID NO: 491763 - RNA, 64 nt, Homo Sapiens
uuaugaauguugauuuucauaccaaagaagauggagagucuaaaauuuggauaugauucuuaug

SEQ ID NO: 491764 - RNA, 64 nt, Homo Sapiens
uuuuagagaguuggcaccuucuucaaagcugcacagagucuacggguagguauugucuuccagg

SEQ ID NO: 491765 - RNA, 64 nt, Homo Sapiens
gaccuguucaggacaccugaaggcugcccaauguagagucuaguuuacaaagaaucauauuuaa

SEQ ID NO: 491766 - RNA, 64 nt, Homo Sapiens
uuaacauuccaagacucuagaguccaagguuuaaagagucuagauucaaagguucuagguuuca

SEQ ID NO: 491767 - RNA, 64 nt, Homo Sapiens
cuaggauucuaaaaugugauguucuaaggcucugagagucuagauucucuggcuguaaggcucu

SEQ ID NO: 491768 - RNA, 64 nt, Homo Sapiens
cgaaagcucuagaaucugcaauucaaaaguuccaagagucuaaagauggaguuucuaagguccg

SEQ ID NO: 491769 - RNA, 64 nt, Homo Sapiens; identical to SEQ ID NO: 106172

SEQ ID NO: 491770 - RNA, 64 nt, Homo Sapiens; identical to SEQ ID NO: 106173

SEQ ID NO: 491771 - RNA, 64 nt, Homo Sapiens; identical to SEQ ID NO: 106174

SEQ ID NO: 491772 - RNA, 64 nt, Homo Sapiens; identical to SEQ ID NO: 106175

SEQ ID NO: 491773 - RNA, 64 nt, Homo Sapiens; identical to SEQ ID NO: 106176

SEQ ID NO: 491774 - RNA, 64 nt, Homo Sapiens; identical to SEQ ID NO: 106177

SEQ ID NO: 491775 - RNA, 64 nt, Homo Sapiens; identical to SEQ ID NO: 106178

SEQ ID NO: 491776 - RNA, 64 nt, Homo Sapiens; identical to SEQ ID NO: 106179

SEQ ID NO: 491777 - RNA, 64 nt, Homo Sapiens; identical to SEQ ID NO: 106180

SEQ ID NO: 491778 - RNA, 64 nt, Homo Sapiens; identical to SEQ ID NO: 106181

SEQ ID NO: 491779 - RNA, 64 nt, Homo Sapiens; identical to SEQ ID NO: 106182

SEQ ID NO: 491780 - RNA, 64 nt, Homo Sapiens; identical to SEQ ID NO: 106183

SEQ ID NO: 491781 - RNA, 64 nt, Homo Sapiens; identical to SEQ ID NO: 106184

SEQ ID NO: 491782 - RNA, 64 nt, Homo Sapiens; identical to SEQ ID NO: 106185

SEQ ID NO: 491783 - RNA, 64 nt, Homo Sapiens; identical to SEQ ID NO: 106186

SEQ ID NO: 491784 - RNA, 64 nt, Homo Sapiens; identical to SEQ ID NO: 106187

SEQ ID NO: 491785 - RNA, 64 nt, Homo Sapiens; identical to SEQ ID NO: 106188

SEQ ID NO: 491786 - RNA, 64 nt, Homo Sapiens; identical to SEQ ID NO: 106189

SEQ ID NO: 491787 - RNA, 64 nt, Homo Sapiens; identical to SEQ ID NO: 181517

SEQ ID NO: 491788 - RNA, 64 nt, Homo Sapiens; identical to SEQ ID NO: 181518

SEQ ID NO: 491789 - RNA, 64 nt, Homo Sapiens; identical to SEQ ID NO: 181519

SEQ ID NO: 491790 - RNA, 64 nt, Homo Sapiens; identical to SEQ ID NO: 181520

SEQ ID NO: 491791 - RNA, 64 nt, Homo Sapiens; identical to SEQ ID NO: 181521

SEQ ID NO: 491792 - RNA, 64 nt, Homo Sapiens; identical to SEQ ID NO: 181522

SEQ ID NO: 491793 - RNA, 64 nt, Homo Sapiens; identical to SEQ ID NO: 181523

SEQ ID NO: 491794 - RNA, 64 nt, Homo Sapiens; identical to SEQ ID NO: 181524

SEQ ID NO: 491795 - RNA, 64 nt, Homo Sapiens; identical to SEQ ID NO: 181525

SEQ ID NO: 491796 - RNA, 64 nt, Homo Sapiens; identical to SEQ ID NO: 181526

SEQ ID NO: 491797 - RNA, 64 nt, Homo Sapiens; identical to SEQ ID NO: 181527

SEQ ID NO: 491798 - RNA, 64 nt, Homo Sapiens; identical to SEQ ID NO: 181528

SEQ ID NO: 491799 - RNA, 64 nt, Homo Sapiens; identical to SEQ ID NO: 181529

SEQ ID NO: 491800 - RNA, 64 nt, Homo Sapiens; identical to SEQ ID NO: 181530

SEQ ID NO: 491801 - RNA, 64 nt, Homo Sapiens; identical to SEQ ID NO: 181531

SEQ ID NO: 491802 - RNA, 64 nt, Homo Sapiens; identical to SEQ ID NO: 181532

SEQ ID NO: 491803 - RNA, 64 nt, Homo Sapiens; identical to SEQ ID NO: 181533

SEQ ID NO: 491804 - RNA, 64 nt, Homo Sapiens; identical to SEQ ID NO: 181534

SEQ ID NO: 491805 - RNA, 64 nt, Homo Sapiens; identical to SEQ ID NO: 181535

SEQ ID NO: 491806 - RNA, 64 nt, Homo Sapiens; identical to SEQ ID NO: 181536

SEQ ID NO: 491807 - RNA, 64 nt, Homo Sapiens; identical to SEQ ID NO: 181537

SEQ ID NO: 491808 - RNA, 64 nt, Homo Sapiens; identical to SEQ ID NO: 181538

SEQ ID NO: 491809 - RNA, 64 nt, Homo Sapiens; identical to SEQ ID NO: 181539

SEQ ID NO: 491810 - RNA, 64 nt, Homo Sapiens; identical to SEQ ID NO: 181540

SEQ ID NO: 491811 - RNA, 64 nt, Homo Sapiens; identical to SEQ ID NO: 181541

SEQ ID NO: 491812 - RNA, 64 nt, Homo Sapiens; identical to SEQ ID NO: 181542

SEQ ID NO: 491813 - RNA, 64 nt, Homo Sapiens; identical to SEQ ID NO: 181543

SEQ ID NO: 491814 - RNA, 64 nt, Homo Sapiens; identical to SEQ ID NO: 181544

SEQ ID NO: 491815 - RNA, 64 nt, Homo Sapiens; identical to SEQ ID NO: 181545

SEQ ID NO: 491816 - RNA, 64 nt, Homo Sapiens; identical to SEQ ID NO: 181546

SEQ ID NO: 491817 - RNA, 64 nt, Homo Sapiens; identical to SEQ ID NO: 181547

SEQ ID NO: 491818 - RNA, 64 nt, Homo Sapiens; identical to SEQ ID NO: 181548

SEQ ID NO: 491819 - RNA, 53 nt, Homo Sapiens; identical to SEQ ID NO: 181549

SEQ ID NO: 491820 - RNA, 59 nt, Homo Sapiens; identical to SEQ ID NO: 181550

SEQ ID NO: 491821 - RNA, 64 nt, Homo Sapiens; identical to SEQ ID NO: 181551

SEQ ID NO: 491822 - RNA, 64 nt, Homo Sapiens; identical to SEQ ID NO: 181552

SEQ ID NO: 491823 - RNA, 64 nt, Homo Sapiens; identical to SEQ ID NO: 181553

SEQ ID NO: 491824 - RNA, 64 nt, Homo Sapiens; identical to SEQ ID NO: 181554

SEQ ID NO: 491825 - RNA, 64 nt, Homo Sapiens; identical to SEQ ID NO: 181555

SEQ ID NO: 491826 - RNA, 64 nt, Homo Sapiens; identical to SEQ ID NO: 181556

SEQ ID NO: 491827 - RNA, 64 nt, Homo Sapiens; identical to SEQ ID NO: 181557

SEQ ID NO: 491828 - RNA, 64 nt, Homo Sapiens; identical to SEQ ID NO: 181558

SEQ ID NO: 491829 - RNA, 64 nt, Homo Sapiens; identical to SEQ ID NO: 181559

SEQ ID NO: 491830 - RNA, 64 nt, Homo Sapiens; identical to SEQ ID NO: 181560

SEQ ID NO: 491831 - RNA, 64 nt, Homo Sapiens; identical to SEQ ID NO: 181561

SEQ ID NO: 491832 - RNA, 64 nt, Homo Sapiens; identical to SEQ ID NO: 181562

SEQ ID NO: 491833 - RNA, 64 nt, Homo Sapiens; identical to SEQ ID NO: 181563

SEQ ID NO: 491834 - RNA, 64 nt, Homo Sapiens; identical to SEQ ID NO: 181564

SEQ ID NO: 491835 - RNA, 64 nt, Homo Sapiens; identical to SEQ ID NO: 181565

SEQ ID NO: 491836 - RNA, 64 nt, Homo Sapiens; identical to SEQ ID NO: 181566

SEQ ID NO: 491837 - RNA, 64 nt, Homo Sapiens; identical to SEQ ID NO: 181567

SEQ ID NO: 491838 - RNA, 64 nt, Homo Sapiens; identical to SEQ ID NO: 181568

SEQ ID NO: 491839 - RNA, 64 nt, Homo Sapiens; identical to SEQ ID NO: 485179

SEQ ID NO: 491840 - RNA, 64 nt, Homo Sapiens; identical to SEQ ID NO: 485180

SEQ ID NO: 491841 - RNA, 64 nt, Homo Sapiens; identical to SEQ ID NO: 485181

SEQ ID NO: 491842 - RNA, 64 nt, Homo Sapiens; identical to SEQ ID NO: 485182

SEQ ID NO: 491843 - RNA, 64 nt, Homo Sapiens; identical to SEQ ID NO: 485183

SEQ ID NO: 491844 - RNA, 64 nt, Homo Sapiens; identical to SEQ ID NO: 485184

SEQ ID NO: 491845 - RNA, 64 nt, Homo Sapiens; identical to SEQ ID NO: 485185

SEQ ID NO: 491846 - RNA, 64 nt, Homo Sapiens; identical to SEQ ID NO: 485186

SEQ ID NO: 491847 - RNA, 64 nt, Homo Sapiens; identical to SEQ ID NO: 485187

SEQ ID NO: 491848 - RNA, 64 nt, Homo Sapiens; identical to SEQ ID NO: 485188

SEQ ID NO: 491849 - RNA, 64 nt, Homo Sapiens; identical to SEQ ID NO: 485189

SEQ ID NO: 491850 - RNA, 64 nt, Homo Sapiens; identical to SEQ ID NO: 485190

SEQ ID NO: 491851 - RNA, 64 nt, Homo Sapiens; identical to SEQ ID NO: 485191

SEQ ID NO: 491852 - RNA, 64 nt, Homo Sapiens; identical to SEQ ID NO: 485192

SEQ ID NO: 491853 - RNA, 64 nt, Homo Sapiens; identical to SEQ ID NO: 485193

SEQ ID NO: 491854 - RNA, 64 nt, Homo Sapiens; identical to SEQ ID NO: 485194

SEQ ID NO: 491855 - RNA, 64 nt, Homo Sapiens; identical to SEQ ID NO: 485195

SEQ ID NO: 491856 - RNA, 64 nt, Homo Sapiens; identical to SEQ ID NO: 485196

SEQ ID NO: 491857 - RNA, 64 nt, Homo Sapiens; identical to SEQ ID NO: 485197

SEQ ID NO: 491858 - RNA, 64 nt, Homo Sapiens; identical to SEQ ID NO: 485198

SEQ ID NO: 491859 - RNA, 64 nt, Homo Sapiens; identical to SEQ ID NO: 485199

SEQ ID NO: 491860 - RNA, 64 nt, Homo Sapiens; identical to SEQ ID NO: 485200

SEQ ID NO: 491861 - RNA, 64 nt, Homo Sapiens; identical to SEQ ID NO: 485201

SEQ ID NO: 491862 - RNA, 64 nt, Homo Sapiens; identical to SEQ ID NO: 485202

SEQ ID NO: 491863 - RNA, 64 nt, Homo Sapiens; identical to SEQ ID NO: 485203

SEQ ID NO: 491864 - RNA, 64 nt, Homo Sapiens; identical to SEQ ID NO: 485204

SEQ ID NO: 491865 - RNA, 64 nt, Homo Sapiens; identical to SEQ ID NO: 485205

SEQ ID NO: 491866 - RNA, 64 nt, Homo Sapiens; identical to SEQ ID NO: 485206

SEQ ID NO: 491867 - RNA, 64 nt, Homo Sapiens; identical to SEQ ID NO: 485207

SEQ ID NO: 491868 - RNA, 64 nt, Homo Sapiens; identical to SEQ ID NO: 485208

SEQ ID NO: 491869 - RNA, 64 nt, Homo Sapiens; identical to SEQ ID NO: 485209

SEQ ID NO: 491870 - RNA, 64 nt, Homo Sapiens; identical to SEQ ID NO: 485210

SEQ ID NO: 491871 - RNA, 64 nt, Homo Sapiens; identical to SEQ ID NO: 485211

SEQ ID NO: 491872 - RNA, 64 nt, Homo Sapiens; identical to SEQ ID NO: 485212

SEQ ID NO: 491873 - RNA, 64 nt, Homo Sapiens; identical to SEQ ID NO: 485213

SEQ ID NO: 491874 - RNA, 64 nt, Homo Sapiens; identical to SEQ ID NO: 485214

SEQ ID NO: 491875 - RNA, 64 nt, Homo Sapiens; identical to SEQ ID NO: 485215

SEQ ID NO: 491876 - RNA, 64 nt, Homo Sapiens; identical to SEQ ID NO: 485216

SEQ ID NO: 491877 - RNA, 64 nt, Homo Sapiens; identical to SEQ ID NO: 485217

SEQ ID NO: 491878 - RNA, 64 nt, Homo Sapiens; identical to SEQ ID NO: 485218

SEQ ID NO: 491879 - RNA, 64 nt, Homo Sapiens; identical to SEQ ID NO: 485219

SEQ ID NO: 491880 - RNA, 64 nt, Homo Sapiens; identical to SEQ ID NO: 485220

SEQ ID NO: 491881 - RNA, 64 nt, Homo Sapiens; identical to SEQ ID NO: 485221

SEQ ID NO: 491882 - RNA, 64 nt, Homo Sapiens; identical to SEQ ID NO: 485222

SEQ ID NO: 491883 - RNA, 64 nt, Homo Sapiens; identical to SEQ ID NO: 485223

SEQ ID NO: 491884 - RNA, 64 nt, Homo Sapiens; identical to SEQ ID NO: 485224

SEQ ID NO: 491885 - RNA, 64 nt, Homo Sapiens; identical to SEQ ID NO: 485225

SEQ ID NO: 491886 - RNA, 64 nt, Homo Sapiens; identical to SEQ ID NO: 485226

SEQ ID NO: 491887 - RNA, 64 nt, Homo Sapiens; identical to SEQ ID NO: 485227

SEQ ID NO: 491888 - RNA, 64 nt, Homo Sapiens; identical to SEQ ID NO: 485228

SEQ ID NO: 491889 - RNA, 64 nt, Homo Sapiens; identical to SEQ ID NO: 485229

SEQ ID NO: 491890 - RNA, 64 nt, Homo Sapiens; identical to SEQ ID NO: 485230

SEQ ID NO: 491891 - RNA, 64 nt, Homo Sapiens; identical to SEQ ID NO: 485231

SEQ ID NO: 491892 - RNA, 64 nt, Homo Sapiens; identical to SEQ ID NO: 485232

SEQ ID NO: 491893 - RNA, 64 nt, Homo Sapiens; identical to SEQ ID NO: 485233

SEQ ID NO: 491894 - RNA, 64 nt, Homo Sapiens; identical to SEQ ID NO: 485234

SEQ ID NO: 491895 - RNA, 64 nt, Homo Sapiens; identical to SEQ ID NO: 485235

SEQ ID NO: 491896 - RNA, 64 nt, Homo Sapiens; identical to SEQ ID NO: 485236

SEQ ID NO: 491897 - RNA, 64 nt, Homo Sapiens; identical to SEQ ID NO: 485237

SEQ ID NO: 491898 - RNA, 64 nt, Homo Sapiens; identical to SEQ ID NO: 485238

SEQ ID NO: 491899 - RNA, 64 nt, Homo Sapiens; identical to SEQ ID NO: 485239

SEQ ID NO: 491900 - RNA, 64 nt, Homo Sapiens; identical to SEQ ID NO: 415046

SEQ ID NO: 491901 - RNA, 64 nt, Homo Sapiens; identical to SEQ ID NO: 415047

SEQ ID NO: 491902 - RNA, 64 nt, Homo Sapiens
aaagagcaucgacuugauuugauucucaccguggggcuggaagaccacccucauguuucuguag

SEQ ID NO: 491903 - RNA, 64 nt, Homo Sapiens
augaaggggauacgcuggagcugugcacagccauggcuggaaugaaggcuccacauuaggucac

SEQ ID NO: 491904 - RNA, 64 nt, Homo Sapiens
guguuuuugaaacggaguuuugcucugucacccaggcuggaaugcaauggcaccaucuuggcuc

SEQ ID NO: 491905 - RNA, 64 nt, Homo Sapiens
gccccagacccaucucuuggauugagggugugugggcuggaaccagugggucacuguggcagcu

SEQ ID NO: 491906 - RNA, 64 nt, Homo Sapiens
aggaauauuuuccaaagagucacccugggcccugggcuggaaucuccguuagcuccuguggccc

SEQ ID NO: 491907 - RNA, 64 nt, Homo Sapiens
uccugcggguggggcuugggaaauggccucauguggcuggaagagauccgacugcuuuggaccu

SEQ ID NO: 491908 - RNA, 64 nt, Homo Sapiens
uguggcucacaccuguaaucaagauuuauauuaaggcuggaagcagaauaaagaaugcugaguc

SEQ ID NO: 491909 - RNA, 64 nt, Homo Sapiens
caauggcgugaucuuggcucgcacaggagucagaggcuggaaugauggugggaggauggguuga

SEQ ID NO: 491910 - RNA, 64 nt, Homo Sapiens
gaccaccauccaggcugagacugaaaggagcagaggcuggaacuacaguauucuuuccccugcu

SEQ ID NO: 491911 - RNA, 64 nt, Homo Sapiens
ccauccugacuguggaguugggauguggaaguggggcuggaacaaagcuucugccuagggagga

SEQ ID NO: 491912 - RNA, 64 nt, Homo Sapiens
uccccacaggggggaggcacuaagucaugguccuggcuggaagguacugaaggcuucugcagcu

SEQ ID NO: 491913 - RNA, 64 nt, Homo Sapiens
cggcagaugcuguuguuguuacuucccuccaagaggcuggaaaagggcucagagcugcugagca

SEQ ID NO: 491914 - RNA, 64 nt, Homo Sapiens
acaccacaccacccuccaggccccccugcccuccggcuggaaacugcagcucuguaaaugccuc

SEQ ID NO: 491915 - RNA, 64 nt, Homo Sapiens
uggaaaccaagcugggagaggcugaggauggcagggcuggaagggccaucagcgugacccucau

SEQ ID NO: 491916 - RNA, 64 nt, Homo Sapiens
gguuuuguuuaaaugggcaagaaguaaauaauguggcuggaauacaaguugaacaaacuagaag

SEQ ID NO: 491917 - RNA, 64 nt, Homo Sapiens
ucauacucuuccagguuuuuuuuuuuuggucuaaggcuggaacuuuuuucuuuuuuuucagcug

SEQ ID NO: 491918 - RNA, 64 nt, Homo Sapiens
aggugccaccagucaguugugccuaugucccuuuggcuggaaaugcagaauaugaauugauuag

SEQ ID NO: 491919 - RNA, 64 nt, Homo Sapiens
uguggacauugaagcuugagcucucaaagcaguuggcuggaauacuuuugucagaauacgguac

SEQ ID NO: 491920 - RNA, 64 nt, Homo Sapiens
agcuccauuucaguaucuuuccuccuugcuuggaggcuggaaagcuggagacuggcugcugggg

SEQ ID NO: 491921 - RNA, 64 nt, Homo Sapiens
acagcucaggcuucguuacugauucacacaccucggcuggaagucaacuccagcuggcuguacu

SEQ ID NO: 491922 - RNA, 64 nt, Homo Sapiens
ccugggugggggguuggggggugugcucgggguuggcuggaagcggguggggggagaugaucau

SEQ ID NO: 491923 - RNA, 64 nt, Homo Sapiens
ccagcagcugugguacuccaguggugauaauaggggcuggaaagcaccaaucuggauugagcgg

SEQ ID NO: 491924 - RNA, 64 nt, Homo Sapiens
uucccugcccugggacgcucaccccugggcaagaggcuggaaguucacaccauccaaaauuuau

SEQ ID NO: 491925 - RNA, 64 nt, Homo Sapiens
agaaggugagcgcugaagaaccaggaugggacggggcuggaacagcuggguucagcuuuugcag

SEQ ID NO: 491926 - RNA, 64 nt, Homo Sapiens
ccugagcuagaagcuggaggacuagaaccuggagggcuggaaucuggagagcuagaaccuggag

SEQ ID NO: 491927 - RNA, 64 nt, Homo Sapiens
gagagcuagaaccuagaagggcuagaaccuggagggcuggaaucuggagagcuagaaccuggag

SEQ ID NO: 491928 - RNA, 64 nt, Homo Sapiens
gagggcuagaaccuagaagggcuagaaccuggagggcuggaaucuggagagcuagaaccuggag

SEQ ID NO: 491929 - RNA, 64 nt, Homo Sapiens
agcucugugugugaaggugaucagugcuggccugggcuggaaaccucugcaggccuucugcaaa

SEQ ID NO: 491930 - RNA, 64 nt, Homo Sapiens
cagcuuguguucugcucacucugcagcuaauggaggcuggaauuuguucacugcacaagggcac

SEQ ID NO: 491931 - RNA, 64 nt, Homo Sapiens
ggugucgggaaaugugugacuuaaccguggugagggcuggaaauccaaacucaccaccaugauc

SEQ ID NO: 491932 - RNA, 64 nt, Homo Sapiens
cuuugggaaugagggguucccuugaacaugcguaggcuggaaccccgucugagaggucucccug

SEQ ID NO: 491933 - RNA, 64 nt, Homo Sapiens
ucaagggccccacccaccgaaauguggcccagccggcuggaaccuucccgcccaguggggcugg

SEQ ID NO: 491934 - RNA, 64 nt, Homo Sapiens
uggcccagccggcuggaaccuucccgcccaguggggcuggaaugcccccuucuccacccucuac

SEQ ID NO: 491935 - RNA, 64 nt, Homo Sapiens
agcuuuuaugaagagucaccguagcagcccccacggcuggaaagaggccuguacguucuggacg

SEQ ID NO: 491936 - RNA, 64 nt, Homo Sapiens
cugugccuuaccagcccuggggaggggggcauuuggcuggaagacuggaauuuaauugccaucg

SEQ ID NO: 491937 - RNA, 64 nt, Homo Sapiens
auggaacgggcaugggccucucugggggaggcagggcuggaaugggagaccuguuggccugugg

SEQ ID NO: 491938 - RNA, 64 nt, Homo Sapiens
cccccagucuccagggacccuugccugccuccuaggcuggaagccauggucccgaaguguaggg

SEQ ID NO: 491939 - RNA, 64 nt, Homo Sapiens
ccuugguggggacagcuggggagauggcagugcaggcuggaaccugggcugccccagaacacag

SEQ ID NO: 491940 - RNA, 64 nt, Homo Sapiens
guggagcugugccuggcccuguaggcccaggguuggcuggaaggugacaucuguguuucguuuu

SEQ ID NO: 491941 - RNA, 64 nt, Homo Sapiens
gaaucuucuuuguucauugggugguuuuucagucggcuggaauucuaucuucugggggccuucc

SEQ ID NO: 491942 - RNA, 64 nt, Homo Sapiens
cucugcagccagugagggagguccccgccaugccggcuggaagaagaaccucgcaucuuuuggu

SEQ ID NO: 491943 - RNA, 64 nt, Homo Sapiens
ggguccaggagacugugugucagugaugcugcaaggcuggaacgagcuccuuaacccaaugacc

SEQ ID NO: 491944 - RNA, 64 nt, Homo Sapiens
cugagcugucaaaagaaucaaaucccacuuuguaggcuggaaaaggccaguagcaggaauaaua

SEQ ID NO: 491945 - RNA, 64 nt, Homo Sapiens
auggacagaggcccaaugggauauuggguccccaggcuggaaaggccugggccuuguggggcaa

SEQ ID NO: 491946 - RNA, 64 nt, Homo Sapiens
aagccacaucaggaggacgcccaggggugguagaggcuggaaggcugcuccuuggaggaggccc

SEQ ID NO: 491947 - RNA, 64 nt, Homo Sapiens; identical to SEQ ID NO: 415046

SEQ ID NO: 491948 - RNA, 64 nt, Homo Sapiens; identical to SEQ ID NO: 415047

SEQ ID NO: 491949 - RNA, 64 nt, Homo Sapiens; identical to SEQ ID NO: 491902

SEQ ID NO: 491950 - RNA, 64 nt, Homo Sapiens; identical to SEQ ID NO: 491903

SEQ ID NO: 491951 - RNA, 64 nt, Homo Sapiens; identical to SEQ ID NO: 491904

SEQ ID NO: 491952 - RNA, 64 nt, Homo Sapiens; identical to SEQ ID NO: 491905

SEQ ID NO: 491953 - RNA, 64 nt, Homo Sapiens; identical to SEQ ID NO: 491906

SEQ ID NO: 491954 - RNA, 64 nt, Homo Sapiens; identical to SEQ ID NO: 491907

SEQ ID NO: 491955 - RNA, 64 nt, Homo Sapiens; identical to SEQ ID NO: 491908

SEQ ID NO: 491956 - RNA, 64 nt, Homo Sapiens; identical to SEQ ID NO: 491909

SEQ ID NO: 491957 - RNA, 64 nt, Homo Sapiens; identical to SEQ ID NO: 491910

SEQ ID NO: 491958 - RNA, 64 nt, Homo Sapiens; identical to SEQ ID NO: 491911

SEQ ID NO: 491959 - RNA, 64 nt, Homo Sapiens; identical to SEQ ID NO: 491912

SEQ ID NO: 491960 - RNA, 64 nt, Homo Sapiens; identical to SEQ ID NO: 491913

SEQ ID NO: 491961 - RNA, 64 nt, Homo Sapiens; identical to SEQ ID NO: 491914

SEQ ID NO: 491962 - RNA, 64 nt, Homo Sapiens; identical to SEQ ID NO: 491915

SEQ ID NO: 491963 - RNA, 64 nt, Homo Sapiens; identical to SEQ ID NO: 491916

SEQ ID NO: 491964 - RNA, 64 nt, Homo Sapiens; identical to SEQ ID NO: 491917

SEQ ID NO: 491965 - RNA, 64 nt, Homo Sapiens; identical to SEQ ID NO: 491918

SEQ ID NO: 491966 - RNA, 64 nt, Homo Sapiens; identical to SEQ ID NO: 491919

SEQ ID NO: 491967 - RNA, 64 nt, Homo Sapiens; identical to SEQ ID NO: 491920

SEQ ID NO: 491968 - RNA, 64 nt, Homo Sapiens; identical to SEQ ID NO: 491921

SEQ ID NO: 491969 - RNA, 64 nt, Homo Sapiens; identical to SEQ ID NO: 491922

SEQ ID NO: 491970 - RNA, 64 nt, Homo Sapiens; identical to SEQ ID NO: 491923

SEQ ID NO: 491971 - RNA, 64 nt, Homo Sapiens; identical to SEQ ID NO: 491924

SEQ ID NO: 491972 - RNA, 64 nt, Homo Sapiens; identical to SEQ ID NO: 491925

SEQ ID NO: 491973 - RNA, 64 nt, Homo Sapiens; identical to SEQ ID NO: 491926

SEQ ID NO: 491974 - RNA, 64 nt, Homo Sapiens; identical to SEQ ID NO: 491927

SEQ ID NO: 491975 - RNA, 64 nt, Homo Sapiens; identical to SEQ ID NO: 491928

SEQ ID NO: 491976 - RNA, 64 nt, Homo Sapiens; identical to SEQ ID NO: 491929

SEQ ID NO: 491977 - RNA, 64 nt, Homo Sapiens; identical to SEQ ID NO: 491930

SEQ ID NO: 491978 - RNA, 64 nt, Homo Sapiens; identical to SEQ ID NO: 491931

SEQ ID NO: 491979 - RNA, 64 nt, Homo Sapiens; identical to SEQ ID NO: 491932

SEQ ID NO: 491980 - RNA, 64 nt, Homo Sapiens; identical to SEQ ID NO: 491933

SEQ ID NO: 491981 - RNA, 64 nt, Homo Sapiens; identical to SEQ ID NO: 491934

SEQ ID NO: 491982 - RNA, 64 nt, Homo Sapiens; identical to SEQ ID NO: 491935

SEQ ID NO: 491983 - RNA, 64 nt, Homo Sapiens; identical to SEQ ID NO: 491936

SEQ ID NO: 491984 - RNA, 64 nt, Homo Sapiens; identical to SEQ ID NO: 491937

SEQ ID NO: 491985 - RNA, 64 nt, Homo Sapiens; identical to SEQ ID NO: 491938

SEQ ID NO: 491986 - RNA, 64 nt, Homo Sapiens; identical to SEQ ID NO: 491939

SEQ ID NO: 491987 - RNA, 64 nt, Homo Sapiens; identical to SEQ ID NO: 491940

SEQ ID NO: 491988 - RNA, 64 nt, Homo Sapiens; identical to SEQ ID NO: 491941

SEQ ID NO: 491989 - RNA, 64 nt, Homo Sapiens; identical to SEQ ID NO: 491942

SEQ ID NO: 491990 - RNA, 64 nt, Homo Sapiens; identical to SEQ ID NO: 491943

SEQ ID NO: 491991 - RNA, 64 nt, Homo Sapiens; identical to SEQ ID NO: 491944

SEQ ID NO: 491992 - RNA, 64 nt, Homo Sapiens; identical to SEQ ID NO: 491945

SEQ ID NO: 491993 - RNA, 64 nt, Homo Sapiens; identical to SEQ ID NO: 491946

SEQ ID NO: 491994 - RNA, 64 nt, Homo Sapiens; identical to SEQ ID NO: 326636

SEQ ID NO: 491995 - RNA, 64 nt, Homo Sapiens; identical to SEQ ID NO: 326637

SEQ ID NO: 491996 - RNA, 64 nt, Homo Sapiens; identical to SEQ ID NO: 326638

SEQ ID NO: 491997 - RNA, 64 nt, Homo Sapiens; identical to SEQ ID NO: 326639

SEQ ID NO: 491998 - RNA, 64 nt, Homo Sapiens; identical to SEQ ID NO: 326640

SEQ ID NO: 491999 - RNA, 64 nt, Homo Sapiens; identical to SEQ ID NO: 266283

SEQ ID NO: 492000 - RNA, 64 nt, Homo Sapiens; identical to SEQ ID NO: 266284

SEQ ID NO: 492001 - RNA, 64 nt, Homo Sapiens; identical to SEQ ID NO: 266285

SEQ ID NO: 492002 - RNA, 64 nt, Homo Sapiens; identical to SEQ ID NO: 266286

SEQ ID NO: 492003 - RNA, 64 nt, Homo Sapiens; identical to SEQ ID NO: 266287

SEQ ID NO: 492004 - RNA, 64 nt, Homo Sapiens; identical to SEQ ID NO: 266288

SEQ ID NO: 492005 - RNA, 64 nt, Homo Sapiens; identical to SEQ ID NO: 266289

SEQ ID NO: 492006 - RNA, 64 nt, Homo Sapiens; identical to SEQ ID NO: 266290

SEQ ID NO: 492007 - RNA, 64 nt, Homo Sapiens; identical to SEQ ID NO: 266291

SEQ ID NO: 492008 - RNA, 64 nt, Homo Sapiens; identical to SEQ ID NO: 266292

SEQ ID NO: 492009 - RNA, 64 nt, Homo Sapiens; identical to SEQ ID NO: 266293

SEQ ID NO: 492010 - RNA, 64 nt, Homo Sapiens; identical to SEQ ID NO: 266294

SEQ ID NO: 492011 - RNA, 64 nt, Homo Sapiens; identical to SEQ ID NO: 266295

SEQ ID NO: 492012 - RNA, 64 nt, Homo Sapiens; identical to SEQ ID NO: 266296

SEQ ID NO: 492013 - RNA, 64 nt, Homo Sapiens; identical to SEQ ID NO: 266297

SEQ ID NO: 492014 - RNA, 64 nt, Homo Sapiens; identical to SEQ ID NO: 266298

SEQ ID NO: 492015 - RNA, 64 nt, Homo Sapiens; identical to SEQ ID NO: 266299

SEQ ID NO: 492016 - RNA, 64 nt, Homo Sapiens; identical to SEQ ID NO: 266300

SEQ ID NO: 492017 - RNA, 64 nt, Homo Sapiens; identical to SEQ ID NO: 266301

SEQ ID NO: 492018 - RNA, 64 nt, Homo Sapiens; identical to SEQ ID NO: 266302

SEQ ID NO: 492019 - RNA, 64 nt, Homo Sapiens; identical to SEQ ID NO: 266303

SEQ ID NO: 492020 - RNA, 64 nt, Homo Sapiens; identical to SEQ ID NO: 266304

SEQ ID NO: 492021 - RNA, 64 nt, Homo Sapiens; identical to SEQ ID NO: 266305

SEQ ID NO: 492022 - RNA, 64 nt, Homo Sapiens; identical to SEQ ID NO: 266306

SEQ ID NO: 492023 - RNA, 64 nt, Homo Sapiens; identical to SEQ ID NO: 266307

SEQ ID NO: 492024 - RNA, 64 nt, Homo Sapiens; identical to SEQ ID NO: 266308

SEQ ID NO: 492025 - RNA, 64 nt, Homo Sapiens; identical to SEQ ID NO: 266309

SEQ ID NO: 492026 - RNA, 64 nt, Homo Sapiens; identical to SEQ ID NO: 266310

SEQ ID NO: 492027 - RNA, 64 nt, Homo Sapiens; identical to SEQ ID NO: 266311

SEQ ID NO: 492028 - RNA, 64 nt, Homo Sapiens; identical to SEQ ID NO: 266312

SEQ ID NO: 492029 - RNA, 64 nt, Homo Sapiens; identical to SEQ ID NO: 266313

SEQ ID NO: 492030 - RNA, 64 nt, Homo Sapiens; identical to SEQ ID NO: 266314

SEQ ID NO: 492031 - RNA, 64 nt, Homo Sapiens; identical to SEQ ID NO: 266315

SEQ ID NO: 492032 - RNA, 64 nt, Homo Sapiens; identical to SEQ ID NO: 266316

SEQ ID NO: 492033 - RNA, 64 nt, Homo Sapiens; identical to SEQ ID NO: 266317

SEQ ID NO: 492034 - RNA, 64 nt, Homo Sapiens; identical to SEQ ID NO: 266318

SEQ ID NO: 492035 - RNA, 64 nt, Homo Sapiens; identical to SEQ ID NO: 266319

SEQ ID NO: 492036 - RNA, 64 nt, Homo Sapiens; identical to SEQ ID NO: 266320

SEQ ID NO: 492037 - RNA, 64 nt, Homo Sapiens; identical to SEQ ID NO: 266321

SEQ ID NO: 492038 - RNA, 64 nt, Homo Sapiens; identical to SEQ ID NO: 266322

SEQ ID NO: 492039 - RNA, 64 nt, Homo Sapiens; identical to SEQ ID NO: 266323

SEQ ID NO: 492040 - RNA, 64 nt, Homo Sapiens; identical to SEQ ID NO: 266324

SEQ ID NO: 492041 - RNA, 64 nt, Homo Sapiens; identical to SEQ ID NO: 266325

SEQ ID NO: 492042 - RNA, 64 nt, Homo Sapiens; identical to SEQ ID NO: 266326

SEQ ID NO: 492043 - RNA, 64 nt, Homo Sapiens; identical to SEQ ID NO: 266327

SEQ ID NO: 492044 - RNA, 64 nt, Homo Sapiens; identical to SEQ ID NO: 266328

SEQ ID NO: 492045 - RNA, 64 nt, Homo Sapiens; identical to SEQ ID NO: 266329

SEQ ID NO: 492046 - RNA, 64 nt, Homo Sapiens; identical to SEQ ID NO: 266330

SEQ ID NO: 492047 - RNA, 64 nt, Homo Sapiens; identical to SEQ ID NO: 349054

SEQ ID NO: 492048 - RNA, 64 nt, Homo Sapiens; identical to SEQ ID NO: 349055

SEQ ID NO: 492049 - RNA, 64 nt, Homo Sapiens; identical to SEQ ID NO: 349056

SEQ ID NO: 492050 - RNA, 64 nt, Homo Sapiens; identical to SEQ ID NO: 349057

SEQ ID NO: 492051 - RNA, 64 nt, Homo Sapiens; identical to SEQ ID NO: 349058

SEQ ID NO: 492052 - RNA, 64 nt, Homo Sapiens; identical to SEQ ID NO: 349059

SEQ ID NO: 492053 - RNA, 64 nt, Homo Sapiens; identical to SEQ ID NO: 349060

SEQ ID NO: 492054 - RNA, 64 nt, Homo Sapiens; identical to SEQ ID NO: 349061

SEQ ID NO: 492055 - RNA, 64 nt, Homo Sapiens; identical to SEQ ID NO: 349062

SEQ ID NO: 492056 - RNA, 64 nt, Homo Sapiens; identical to SEQ ID NO: 349063

SEQ ID NO: 492057 - RNA, 64 nt, Homo Sapiens; identical to SEQ ID NO: 349064

SEQ ID NO: 492058 - RNA, 64 nt, Homo Sapiens; identical to SEQ ID NO: 349065

SEQ ID NO: 492059 - RNA, 64 nt, Homo Sapiens; identical to SEQ ID NO: 349066

SEQ ID NO: 492060 - RNA, 64 nt, Homo Sapiens; identical to SEQ ID NO: 349067

SEQ ID NO: 492061 - RNA, 64 nt, Homo Sapiens; identical to SEQ ID NO: 349068

SEQ ID NO: 492062 - RNA, 64 nt, Homo Sapiens; identical to SEQ ID NO: 349069

SEQ ID NO: 492063 - RNA, 64 nt, Homo Sapiens; identical to SEQ ID NO: 189531

SEQ ID NO: 492064 - RNA, 64 nt, Homo Sapiens; identical to SEQ ID NO: 189532

SEQ ID NO: 492065 - RNA, 64 nt, Homo Sapiens; identical to SEQ ID NO: 189533

SEQ ID NO: 492066 - RNA, 64 nt, Homo Sapiens; identical to SEQ ID NO: 189534

SEQ ID NO: 492067 - RNA, 64 nt, Homo Sapiens; identical to SEQ ID NO: 189535

SEQ ID NO: 492068 - RNA, 64 nt, Homo Sapiens; identical to SEQ ID NO: 189536

SEQ ID NO: 492069 - RNA, 64 nt, Homo Sapiens; identical to SEQ ID NO: 189537

SEQ ID NO: 492070 - RNA, 64 nt, Homo Sapiens; identical to SEQ ID NO: 189538

SEQ ID NO: 492071 - RNA, 64 nt, Homo Sapiens; identical to SEQ ID NO: 189539

SEQ ID NO: 492072 - RNA, 64 nt, Homo Sapiens; identical to SEQ ID NO: 189540

SEQ ID NO: 492073 - RNA, 64 nt, Homo Sapiens; identical to SEQ ID NO: 189541

SEQ ID NO: 492074 - RNA, 64 nt, Homo Sapiens; identical to SEQ ID NO: 189542

SEQ ID NO: 492075 - RNA, 64 nt, Homo Sapiens; identical to SEQ ID NO: 189543

SEQ ID NO: 492076 - RNA, 64 nt, Homo Sapiens; identical to SEQ ID NO: 189544

SEQ ID NO: 492077 - RNA, 64 nt, Homo Sapiens; identical to SEQ ID NO: 189545

SEQ ID NO: 492078 - RNA, 64 nt, Homo Sapiens; identical to SEQ ID NO: 189546

SEQ ID NO: 492079 - RNA, 64 nt, Homo Sapiens; identical to SEQ ID NO: 189547

SEQ ID NO: 492080 - RNA, 64 nt, Homo Sapiens; identical to SEQ ID NO: 189548

SEQ ID NO: 492081 - RNA, 64 nt, Homo Sapiens; identical to SEQ ID NO: 189549

SEQ ID NO: 492082 - RNA, 64 nt, Homo Sapiens; identical to SEQ ID NO: 189550

SEQ ID NO: 492083 - RNA, 64 nt, Homo Sapiens; identical to SEQ ID NO: 189551

SEQ ID NO: 492084 - RNA, 64 nt, Homo Sapiens; identical to SEQ ID NO: 189552

SEQ ID NO: 492085 - RNA, 64 nt, Homo Sapiens; identical to SEQ ID NO: 189553

SEQ ID NO: 492086 - RNA, 64 nt, Homo Sapiens; identical to SEQ ID NO: 189554

SEQ ID NO: 492087 - RNA, 64 nt, Homo Sapiens; identical to SEQ ID NO: 189555

SEQ ID NO: 492088 - RNA, 64 nt, Homo Sapiens; identical to SEQ ID NO: 189556

SEQ ID NO: 492089 - RNA, 64 nt, Homo Sapiens; identical to SEQ ID NO: 189557

SEQ ID NO: 492090 - RNA, 64 nt, Homo Sapiens; identical to SEQ ID NO: 189558

SEQ ID NO: 492091 - RNA, 64 nt, Homo Sapiens; identical to SEQ ID NO: 189559

SEQ ID NO: 492092 - RNA, 53 nt, Homo Sapiens; identical to SEQ ID NO: 189560

SEQ ID NO: 492093 - RNA, 64 nt, Homo Sapiens; identical to SEQ ID NO: 189561

SEQ ID NO: 492094 - RNA, 64 nt, Homo Sapiens; identical to SEQ ID NO: 189562

SEQ ID NO: 492095 - RNA, 63 nt, Homo Sapiens; identical to SEQ ID NO: 189563

SEQ ID NO: 492096 - RNA, 64 nt, Homo Sapiens; identical to SEQ ID NO: 189564

SEQ ID NO: 492097 - RNA, 64 nt, Homo Sapiens; identical to SEQ ID NO: 189565

SEQ ID NO: 492098 - RNA, 64 nt, Homo Sapiens; identical to SEQ ID NO: 189566

SEQ ID NO: 492099 - RNA, 64 nt, Homo Sapiens; identical to SEQ ID NO: 189567

SEQ ID NO: 492100 - RNA, 64 nt, Homo Sapiens; identical to SEQ ID NO: 189568

SEQ ID NO: 492101 - RNA, 64 nt, Homo Sapiens; identical to SEQ ID NO: 189569

SEQ ID NO: 492102 - RNA, 64 nt, Homo Sapiens; identical to SEQ ID NO: 189570

SEQ ID NO: 492103 - RNA, 64 nt, Homo Sapiens; identical to SEQ ID NO: 189571

SEQ ID NO: 492104 - RNA, 64 nt, Homo Sapiens; identical to SEQ ID NO: 189572

SEQ ID NO: 492105 - RNA, 64 nt, Homo Sapiens; identical to SEQ ID NO: 189573

SEQ ID NO: 492106 - RNA, 64 nt, Homo Sapiens; identical to SEQ ID NO: 189574

SEQ ID NO: 492107 - RNA, 64 nt, Homo Sapiens; identical to SEQ ID NO: 189575

SEQ ID NO: 492108 - RNA, 64 nt, Homo Sapiens; identical to SEQ ID NO: 189576

SEQ ID NO: 492109 - RNA, 64 nt, Homo Sapiens; identical to SEQ ID NO: 189577

SEQ ID NO: 492110 - RNA, 64 nt, Homo Sapiens; identical to SEQ ID NO: 189578

SEQ ID NO: 492111 - RNA, 64 nt, Homo Sapiens; identical to SEQ ID NO: 189579

SEQ ID NO: 492112 - RNA, 64 nt, Homo Sapiens; identical to SEQ ID NO: 189580

SEQ ID NO: 492113 - RNA, 64 nt, Homo Sapiens; identical to SEQ ID NO: 189581

SEQ ID NO: 492114 - RNA, 64 nt, Homo Sapiens; identical to SEQ ID NO: 189582

SEQ ID NO: 492115 - RNA, 64 nt, Homo Sapiens; identical to SEQ ID NO: 189583

SEQ ID NO: 492116 - RNA, 64 nt, Homo Sapiens; identical to SEQ ID NO: 189584

SEQ ID NO: 492117 - RNA, 64 nt, Homo Sapiens; identical to SEQ ID NO: 189585

SEQ ID NO: 492118 - RNA, 64 nt, Homo Sapiens; identical to SEQ ID NO: 189586

SEQ ID NO: 492119 - RNA, 64 nt, Homo Sapiens; identical to SEQ ID NO: 189587

SEQ ID NO: 492120 - RNA, 64 nt, Homo Sapiens; identical to SEQ ID NO: 189588

SEQ ID NO: 492121 - RNA, 64 nt, Homo Sapiens; identical to SEQ ID NO: 189589

SEQ ID NO: 492122 - RNA, 64 nt, Homo Sapiens; identical to SEQ ID NO: 189590

SEQ ID NO: 492123 - RNA, 64 nt, Homo Sapiens; identical to SEQ ID NO: 189591

SEQ ID NO: 492124 - RNA, 64 nt, Homo Sapiens; identical to SEQ ID NO: 189592

SEQ ID NO: 492125 - RNA, 64 nt, Homo Sapiens; identical to SEQ ID NO: 189593

SEQ ID NO: 492126 - RNA, 64 nt, Homo Sapiens; identical to SEQ ID NO: 189594

SEQ ID NO: 492127 - RNA, 64 nt, Homo Sapiens; identical to SEQ ID NO: 189595

SEQ ID NO: 492128 - RNA, 64 nt, Homo Sapiens; identical to SEQ ID NO: 189596

SEQ ID NO: 492129 - RNA, 64 nt, Homo Sapiens; identical to SEQ ID NO: 189597

SEQ ID NO: 492130 - RNA, 64 nt, Homo Sapiens; identical to SEQ ID NO: 189598

SEQ ID NO: 492131 - RNA, 64 nt, Homo Sapiens; identical to SEQ ID NO: 364943

SEQ ID NO: 492132 - RNA, 64 nt, Homo Sapiens; identical to SEQ ID NO: 364944

SEQ ID NO: 492133 - RNA, 64 nt, Homo Sapiens; identical to SEQ ID NO: 364945

SEQ ID NO: 492134 - RNA, 64 nt, Homo Sapiens; identical to SEQ ID NO: 364946

SEQ ID NO: 492135 - RNA, 64 nt, Homo Sapiens; identical to SEQ ID NO: 364947

SEQ ID NO: 492136 - RNA, 64 nt, Homo Sapiens; identical to SEQ ID NO: 364948

SEQ ID NO: 492137 - RNA, 64 nt, Homo Sapiens; identical to SEQ ID NO: 364949

SEQ ID NO: 492138 - RNA, 64 nt, Homo Sapiens; identical to SEQ ID NO: 364950

SEQ ID NO: 492139 - RNA, 64 nt, Homo Sapiens; identical to SEQ ID NO: 364951

SEQ ID NO: 492140 - RNA, 64 nt, Homo Sapiens; identical to SEQ ID NO: 364952

SEQ ID NO: 492141 - RNA, 64 nt, Homo Sapiens; identical to SEQ ID NO: 364953

SEQ ID NO: 492142 - RNA, 64 nt, Homo Sapiens; identical to SEQ ID NO: 364954

SEQ ID NO: 492143 - RNA, 64 nt, Homo Sapiens; identical to SEQ ID NO: 364955

SEQ ID NO: 492144 - RNA, 64 nt, Homo Sapiens; identical to SEQ ID NO: 364956

SEQ ID NO: 492145 - RNA, 64 nt, Homo Sapiens; identical to SEQ ID NO: 364957

SEQ ID NO: 492146 - RNA, 64 nt, Homo Sapiens; identical to SEQ ID NO: 364958

SEQ ID NO: 492147 - RNA, 64 nt, Homo Sapiens; identical to SEQ ID NO: 364959

SEQ ID NO: 492148 - RNA, 64 nt, Homo Sapiens; identical to SEQ ID NO: 364960

SEQ ID NO: 492149 - RNA, 64 nt, Homo Sapiens; identical to SEQ ID NO: 364961

SEQ ID NO: 492150 - RNA, 64 nt, Homo Sapiens; identical to SEQ ID NO: 364962

SEQ ID NO: 492151 - RNA, 64 nt, Homo Sapiens; identical to SEQ ID NO: 364963

SEQ ID NO: 492152 - RNA, 64 nt, Homo Sapiens; identical to SEQ ID NO: 364964

SEQ ID NO: 492153 - RNA, 64 nt, Homo Sapiens
uauauccauuucuuccuuuuccaauuucauugguuuucucuaaacagugcuccauuuuauuuug

SEQ ID NO: 492154 - RNA, 64 nt, Homo Sapiens
agaacaugauuaaugaaagugacaaauuuuaaauuuucucuaauaguccucaucauaaacuuuu

SEQ ID NO: 492155 - RNA, 64 nt, Homo Sapiens
ccuuaacuaaaguguaggauccauagggacacauuuucucuaacuaguuuaaaagcuuccuccu

SEQ ID NO: 492156 - RNA, 64 nt, Homo Sapiens
uacauaugcaucucuccuauacaaaagcccaacuuuucucuauuauugaauaaaucuuuagacu

SEQ ID NO: 492157 - RNA, 64 nt, Homo Sapiens
aauggauuuuucuuagugcccuaauugugaaggguuucucuagcuuugguuauguguaauguuc

SEQ ID NO: 492158 - RNA, 64 nt, Homo Sapiens
uuacucauagaacugguguuguuugcuguuuuuauuucucuaauuguugcagaguucugccugu

SEQ ID NO: 492159 - RNA, 64 nt, Homo Sapiens
uauaaagcaaacuguuugggcuguagacgaacuguuucucuaauguguuuucucuacuauugag

SEQ ID NO: 492160 - RNA, 64 nt, Homo Sapiens
auugagcuguagacgaacugccucauuccuguguuuucucuacugcuuccgcuaaguaagagca

SEQ ID NO: 492161 - RNA, 64 nt, Homo Sapiens
auaaucugaguuuuuuggaaauaacagucuguguuuucucuaaauaguuuaagauaagcuaaca

SEQ ID NO: 492162 - RNA, 64 nt, Homo Sapiens
ugguucauuuugaaaggggauuuucugacuugcuuuucucuagguccaacuggagggcagacaa

SEQ ID NO: 492163 - RNA, 64 nt, Homo Sapiens
gccuuuuuugacuggggaagcaauuuaaaguguuuuucucuauaaacaaauuuguauuagagua

SEQ ID NO: 492164 - RNA, 64 nt, Homo Sapiens
gauauggaaguaaguggagaaguacauauaucuauuucucuaggguuugauuuuuuuugacaac

SEQ ID NO: 492165 - RNA, 64 nt, Homo Sapiens
guugaucucaggguacuuucugggauugcucacauuucucuaauguacugcacuugaugccagu

SEQ ID NO: 492166 - RNA, 64 nt, Homo Sapiens
aaggauuuaaccuggugccaagguuaaaauaacauuucucuacugccuauuguuuauguuaaac

SEQ ID NO: 492167 - RNA, 64 nt, Homo Sapiens
cacaucauguguauacaaggaacaaacagccuuguuucucuaguguuucucuaacaaacaaaca

SEQ ID NO: 492168 - RNA, 64 nt, Homo Sapiens
aaacaaacaaacaaacagcccagggccagccuuguuucucuaacgccccuauggggcggggccg

SEQ ID NO: 492169 - RNA, 64 nt, Homo Sapiens
cuuugucucugugucuuauuugggcccacuguucuuucucuauacacaugcugagcgccggucc

SEQ ID NO: 492170 - RNA, 64 nt, Homo Sapiens
gucucugacgguggguccagccccaaagggauccuuucucuaagagaagaucuuugucugggac

SEQ ID NO: 492171 - RNA, 64 nt, Homo Sapiens
acucaaaaaaaaaaaaaaaauauuaaaaggacuauuucucuaaagaaaagcaguuucuaaguca

SEQ ID NO: 492172 - RNA, 64 nt, Homo Sapiens
accauucgcgauuuagaagucauguaaaacccuauuucucuaagcuguugcugaggaaaagccu

SEQ ID NO: 492173 - RNA, 64 nt, Homo Sapiens
uaccagaaucuaguauguaaacucaggcaucuucuuucucuaaaaacauaaucaaagacaacuc

SEQ ID NO: 492174 - RNA, 64 nt, Homo Sapiens
acugaccuuucuauucucuaauacccaucaguaauuucucuaauuuuguaacaucaaagaaaac

SEQ ID NO: 492175 - RNA, 64 nt, Homo Sapiens
uuacgaauccaaagaacugggguuuguuagguucuuucucuaauguagaggcccagaucccauc

SEQ ID NO: 492176 - RNA, 64 nt, Homo Sapiens
caauccccacagauuacuuucagaaauagauguauuucucuacguaagggccagguuuauuuuc

SEQ ID NO: 492177 - RNA, 64 nt, Homo Sapiens
ucuuuucugugaucucuguccuuguuucugagacuuucucuaccauuaagcucuauuuuagcuu

SEQ ID NO: 492178 - RNA, 64 nt, Homo Sapiens
ucgaguucugugauccuuauuguucuuaauuguguuucucuacguauuguuacagaugagccau

SEQ ID NO: 492179 - RNA, 64 nt, Homo Sapiens
uuauguugugacuuaaccuauagcauuuaucuuauuucucuauuaaguaugaauauuaauaaaa

SEQ ID NO: 492180 - RNA, 64 nt, Homo Sapiens
auaagccacacauuauauuuuacguugcuaaagauuucucuauaugacacuuacugguuaaacu

SEQ ID NO: 492181 - RNA, 64 nt, Homo Sapiens
uuggggggugagcguguguggguguuucucuauguuucucuaaguguguguguguguagaccau

SEQ ID NO: 492182 - RNA, 64 nt, Homo Sapiens
uuucucuaaguugggggguguguagaccaugguguuucucuaugggagugugugugugugugug

SEQ ID NO: 492183 - RNA, 64 nt, Homo Sapiens
guauguggcuccagucugugaggauacauaacauuuucucuacaaugaaucugugcuaauauuu

SEQ ID NO: 492184 - RNA, 64 nt, Homo Sapiens
acauacuccugcaaagcuuuuaugcugcuucgcuuuucucuaaacagaucugauauugcugcuc

SEQ ID NO: 492185 - RNA, 64 nt, Homo Sapiens
auuuugacauuucagacucaaaauuacucccucuuuucucuagcucuucuuucuggguaguuaa

SEQ ID NO: 492186 - RNA, 64 nt, Homo Sapiens
cauuuuuuuuuuccuggaguaauuuguuuuuaauuuucucuacaagaccauauucuuugaauua

SEQ ID NO: 492187 - RNA, 64 nt, Homo Sapiens
gugguaaaauauauaaauacuuuaaagacuugauuuucucuauuaaaacauaggggcuaucauu

SEQ ID NO: 492188 - RNA, 64 nt, Homo Sapiens
ucacccugugacuauucagccucccugaauaugcuuucucuauagaaccacuaacauauggcua

SEQ ID NO: 492189 - RNA, 64 nt, Homo Sapiens
aaggcauggaagaacucuugaauguguuggccauuuucucuaacuaacaugugguauguauggu

SEQ ID NO: 492190 - RNA, 64 nt, Homo Sapiens
auuguggaaggcuguuuuauaguuuauuuaauuuuuucucuaugauuuauuacaacucucacgg

SEQ ID NO: 492191 - RNA, 64 nt, Homo Sapiens
auggaaauaaagcuacuacauauauaugccaguauuucucuaguaagauuauguuucucuuacu

SEQ ID NO: 492192 - RNA, 64 nt, Homo Sapiens
auggcaaccauuauaaccuucuaaucuuauucauuuucucuaauaauuuuuauuuuugcugaga

SEQ ID NO: 492193 - RNA, 64 nt, Homo Sapiens
aaauauacuuuuacaaguaaaccacugcugauauuuucucuaggacuuacuuuuucuggucucu

SEQ ID NO: 492194 - RNA, 64 nt, Homo Sapiens
gauuccgcagcucagacccuacugagaccaaggcuuucucuacuggguugaaagccaaggaguc

SEQ ID NO: 492195 - RNA, 64 nt, Homo Sapiens
ccucuugcugaaagccaaggcagcucuucuggaguuucucuaaagucacuagugaacaauucgg

SEQ ID NO: 492196 - RNA, 64 nt, Homo Sapiens
ugguauuuauguaaaaggauuauuacuaauucuauuucucuauguuuauucuaguuaaggaaau

SEQ ID NO: 492197 - RNA, 64 nt, Homo Sapiens
uuccccuguucuuuuugugugugacauaaaauauuuucucuauuuggaucuggccuauagauua

SEQ ID NO: 492198 - RNA, 64 nt, Homo Sapiens
ggagauacugacucccuggugaauauagaaagucuuucucuaaaccugaugagaaucuacuuga

SEQ ID NO: 492199 - RNA, 64 nt, Homo Sapiens
agugauauaaauggcuauuuuuuucucuaaaauauuucucuaauaggccacuagugaaaguaug

SEQ ID NO: 492200 - RNA, 64 nt, Homo Sapiens
auauuucucuaauagugauauagugaaaguauguuuucucuaaaaugauggcauuugaggccac

SEQ ID NO: 492201 - RNA, 64 nt, Homo Sapiens
ccguaugguauuuuguuagacaguguugcagagauuucucuacccugauucacugaccaaaagu

SEQ ID NO: 492202 - RNA, 64 nt, Homo Sapiens
cccugccucaaaccaccccucuaccacuccaugcuuucucuacuaacccccaccccacccccac

SEQ ID NO: 492203 - RNA, 64 nt, Homo Sapiens
aauucugacucuccagacuuaaauuucucucuuuuuucucuauaaaaggaacuuucagauuaag

SEQ ID NO: 492204 - RNA, 64 nt, Homo Sapiens
ucaggguuucuagcuuugacaucaaauccugaguuuucucuacuuaaguggaaacuuuccuugu

SEQ ID NO: 492205 - RNA, 64 nt, Homo Sapiens
uugggagauguuuauuuacauaaaauuuuguuuuuuucucuacuauuuuuauuucuucuuguau

SEQ ID NO: 492206 - RNA, 64 nt, Homo Sapiens
ugaauauucugugacaaaaaauucuauuugcauguuucucuaucuuugugauuagaacagaaca

SEQ ID NO: 492207 - RNA, 64 nt, Homo Sapiens
ccggcauucuaauuucucuuaaaauauuauuuauuuucucuaucuucuauaaacuaccuuguau

SEQ ID NO: 492208 - RNA, 64 nt, Homo Sapiens
guaauaacucccaaccugacgcagugcuugccaauuucucuagugaaaaaccaaaagcuguuuu

SEQ ID NO: 492209 - RNA, 64 nt, Homo Sapiens
guuuuauaaaagccuuggguuacauagagcucuauuucucuacgcaacauguauauuuucucua

SEQ ID NO: 492210 - RNA, 64 nt, Homo Sapiens
cauagagcucuauuucucuaaucaacauguauauuuucucuauaaggaaagagucacacaauua

SEQ ID NO: 492211 - RNA, 64 nt, Homo Sapiens
gaaccugacccaagaguaaaugucugcagagagauggauggauggauggauagauggauggaug

SEQ ID NO: 492212 - RNA, 64 nt, Homo Sapiens
cugacccaagaguaaaugucugcagagagauggauggauggauggauagauggauggauggguu

SEQ ID NO: 492213 - RNA, 64 nt, Homo Sapiens
cccaagaguaaaugucugcagagagauggauggauggauggauagauggauggauggguugggg

SEQ ID NO: 492214 - RNA, 64 nt, Homo Sapiens
ugucugcagagagauggauggauggauggauagauggauggauggguuggggagugggggugga

SEQ ID NO: 492215 - RNA, 64 nt, Homo Sapiens
uggauagauggauggauggguuggggaguggggguggauggauggauagauggauggauggaug

SEQ ID NO: 492216 - RNA, 64 nt, Homo Sapiens
uagauggauggauggguuggggaguggggguggauggauggauagauggauggauggauggaug

SEQ ID NO: 492217 - RNA, 64 nt, Homo Sapiens
uggguuggggaguggggguggauggauggauagauggauggauggauggauggauggguugggg

SEQ ID NO: 492218 - RNA, 64 nt, Homo Sapiens
uuggggaguggggguggauggauggauagauggauggauggauggauggauggguuggggggug

SEQ ID NO: 492219 - RNA, 64 nt, Homo Sapiens
ggaguggggguggauggauggauagauggauggauggauggauggauggguugggggguggggg

SEQ ID NO: 492220 - RNA, 64 nt, Homo Sapiens
uggggguggauggauggauagauggauggauggauggauggauggguuggggggugggggugga

SEQ ID NO: 492221 - RNA, 64 nt, Homo Sapiens
uggauggauggauggauggguugggggguggggguggauggauagauggauggauggauggacg

SEQ ID NO: 492222 - RNA, 64 nt, Homo Sapiens
uggauggguugggggguggggguggauggauagauggauggauggauggacggauggggugggg

SEQ ID NO: 492223 - RNA, 64 nt, Homo Sapiens
uggguugggggguggggguggauggauagauggauggauggauggacggauggggugggggaag

SEQ ID NO: 492224 - RNA, 64 nt, Homo Sapiens
uugggggguggggguggauggauagauggauggauggauggacggauggggugggggaaggaag

SEQ ID NO: 492225 - RNA, 64 nt, Homo Sapiens
cagucuguguuugaccuucacauuuguucaugaguggauggauggacagaaugauggacuuuug

SEQ ID NO: 492226 - RNA, 64 nt, Homo Sapiens
cuguguuugaccuucacauuuguucaugaguggauggauggacagaaugauggacuuuuggggg

SEQ ID NO: 492227 - RNA, 64 nt, Homo Sapiens
gcaagaacccuccugacaguacuggcuagaaguuuggauggauuauuuacaauauaggaaagaa

SEQ ID NO: 492228 - RNA, 64 nt, Homo Sapiens
uacaugcagaaauauauauguguguguguaucuguggauggauauauguauaucucuuccuaua

SEQ ID NO: 492229 - RNA, 64 nt, Homo Sapiens
uuucaaugaaccaaaagauaacugucaauuuauuuggauggauggauggagggauggaaggagg

SEQ ID NO: 492230 - RNA, 64 nt, Homo Sapiens
aaugaaccaaaagauaacugucaauuuauuuggauggauggauggagggauggaaggagggagg

SEQ ID NO: 492231 - RNA, 64 nt, Homo Sapiens
aaccaaaagauaacugucaauuuauuuggauggauggauggagggauggaaggagggagggaag

SEQ ID NO: 492232 - RNA, 64 nt, Homo Sapiens
aauagauugggaccaucagaccauaaauguuggauggauggauacuuggcacauaguaggccuu

SEQ ID NO: 492233 - RNA, 64 nt, Homo Sapiens
gauaaauagauugggaccauccuuccauaaauguuggauggaugccuccuuggcacauaguagg

SEQ ID NO: 492234 - RNA, 64 nt, Homo Sapiens
aggggagagcaucuaggcaggcccugaccgcuuguggauggagacaggagucugccuaccuguc

SEQ ID NO: 492235 - RNA, 64 nt, Homo Sapiens
cucacuuggacacucaggggaccacacagagaaguggauggacacuucgccauccaggcagaac

SEQ ID NO: 492236 - RNA, 64 nt, Homo Sapiens
gccagccggccagacucucaucuugaugucuugauggauggaccccagcuagucagacaugauc

SEQ ID NO: 492237 - RNA, 64 nt, Homo Sapiens
ggacccacccagcgcguccuuucuuauccccgaguggauggauggauggauggaugguagggau

SEQ ID NO: 492238 - RNA, 64 nt, Homo Sapiens
ccacccagcgcguccuuucuuauccccgaguggauggauggauggauggaugguagggauguua

SEQ ID NO: 492239 - RNA, 64 nt, Homo Sapiens
ccagcgcguccuuucuuauccccgaguggauggauggauggauggaugguagggauguuaauaa

SEQ ID NO: 492240 - RNA, 64 nt, Homo Sapiens
cgcguccuuucuuauccccgaguggauggauggauggauggaugguagggauguuaauaauuuu

SEQ ID NO: 492241 - RNA, 64 nt, Homo Sapiens
agcuauaagaggugguaggcaaccucuugaaugauggauggaagacccugagcuuucuucaugg

SEQ ID NO: 492242 - RNA, 64 nt, Homo Sapiens
uaucucuacauuuaaaaaucaauccaaucuccuguggauggagcaagguccauuucuucccagg

SEQ ID NO: 492243 - RNA, 64 nt, Homo Sapiens
agcgagaacccgcgcccgcgguuggauggauggauggauggaugaaugaauggauggauggaug

SEQ ID NO: 492244 - RNA, 64 nt, Homo Sapiens
gaugagcgagaacccgcgccgaugguuggauggauggauggaugaaagaaugaauggauggaug

SEQ ID NO: 492245 - RNA, 64 nt, Homo Sapiens
gauggaugagcgagaacccggauggaugguuggauggauggaugcaagaaagaaugaauggaug

SEQ ID NO: 492246 - RNA, 64 nt, Homo Sapiens
gauggauggaugagcgagaagauggauggaugguuggauggauggcgucaagaaagaaugaaug

SEQ ID NO: 492247 - RNA, 64 nt, Homo Sapiens
guuggauggauggauggaugaaagaaugaauggauggauggauggagcgagcgagugcgucaag

SEQ ID NO: 492248 - RNA, 64 nt, Homo Sapiens
gaugguuggauggauggaugcaagaaagaaugaauggauggaugcggggagcgagcgagugcgu

SEQ ID NO: 492249 - RNA, 64 nt, Homo Sapiens
cugaguauuacugagaagcaacagaaaagagccauggauggagcccuugggcucucugggaaau

SEQ ID NO: 492250 - RNA, 64 nt, Homo Sapiens
ugagugugcuucuuggaagagccuagaagauuccuggauggagaccccauugguucagccucaa

SEQ ID NO: 492251 - RNA, 64 nt, Homo Sapiens
gcacagugccucacacaaagaacuauuggguggguggauggauggauggaggaauggagacagu

SEQ ID NO: 492252 - RNA, 64 nt, Homo Sapiens
agugccucacacaaagaacuauuggguggguggauggauggauggaggaauggagacaguuggc

SEQ ID NO: 492253 - RNA, 64 nt, Homo Sapiens
ccucacacaaagaacuauuggguggguggauggauggauggaggaauggagacaguuggcuuaa

SEQ ID NO: 492254 - RNA, 64 nt, Homo Sapiens
gguacucaaacaaguuacuucccaagugucuggauggauggagauauuacccuguguuguauuu

SEQ ID NO: 492255 - RNA, 64 nt, Homo Sapiens
gagagguacucaaacaaguuauuucccaagugucuggauggaugcaacuauuacccuguguugu

SEQ ID NO: 492256 - RNA, 64 nt, Homo Sapiens
auaauugagucaucugguaguaggauuccauggauggauggaauaauguccuuuuaugauuguc

SEQ ID NO: 492257 - RNA, 64 nt, Homo Sapiens
gaauauaauugagucaucugugucuaggauuccauggauggaugcauaaauguccuuuuaugau

SEQ ID NO: 492258 - RNA, 54 nt, Homo Sapiens
gauaacuccggaagaaugacuggauggauggacuucaaagcucuucuccaguga

SEQ ID NO: 492259 - RNA, 50 nt, Homo Sapiens
gacugauaacuccggaagaauggauggaugucaaagcucuucuccaguga

SEQ ID NO: 492260 - RNA, 64 nt, Homo Sapiens
guaacgcgaucucuauuuaacggauuuccuucuuuggauggaaugacgcaucccucaccacguc

SEQ ID NO: 492261 - RNA, 64 nt, Homo Sapiens
gacaggccauggaggcagcaagccagaggcagaauggauggacaggggccuggagccagcccug

SEQ ID NO: 492262 - RNA, 64 nt, Homo Sapiens
uggggcucccugccuucuggacuccugaaggucguggauggauggaaggcacacagcccgugcc

SEQ ID NO: 492263 - RNA, 64 nt, Homo Sapiens
gcucccugccuucuggacuccugaaggucguggauggauggaaggcacacagcccgugccggcu

SEQ ID NO: 492264 - RNA, 64 nt, Homo Sapiens
ugauuugggccucucuuccagggggcaaguuuacuggauggagaaugcccucccuucuaugcag

SEQ ID NO: 492265 - RNA, 64 nt, Homo Sapiens
caagucauagaggggaauguccaaggguucuccauggauggauccuugccuuugggauugggau

SEQ ID NO: 492266 - RNA, 64 nt, Homo Sapiens
ugcgagccugcggccugcuggagccugcgcagcuuggauggagacuccaugagaagccgugggu

SEQ ID NO: 492267 - RNA, 64 nt, Homo Sapiens
auucauuuauuauuucaaugugacuuuaauuuuuuggauggauaagcuugucuaugguacaaaa

SEQ ID NO: 492268 - RNA, 64 nt, Homo Sapiens
uacgacuucacaggcauuguagggggagcaaauuuggauggauuuucccgaguauaaccacuca

SEQ ID NO: 492269 - RNA, 64 nt, Homo Sapiens
cuuaaugcugugaaacaugacagacugauuucauuggauggauaagccuuuaaggguuucuuug

SEQ ID NO: 492270 - RNA, 64 nt, Homo Sapiens
agggcuuuuggccacaggugcugcccuggaaacauggauggacaggucacgcaggacucggaca

SEQ ID NO: 492271 - RNA, 64 nt, Homo Sapiens
uaacuuuccuggacuguguuauuuggcagccaaguggauggaacucccagcacagcccaagauu

SEQ ID NO: 492272 - RNA, 64 nt, Homo Sapiens
cagaaaaaucugggcugagcaauuacuagaugaguggauggaugacccuuugugaaaaccaauc

SEQ ID NO: 492273 - RNA, 64 nt, Homo Sapiens
guagacagcaacaagauuuuaggcauuuaccuguuggauggaaguaauauaaaccaccgucgug

SEQ ID NO: 492274 - RNA, 64 nt, Homo Sapiens
aauagauagaugguguuugcgauggauggauggauggauggauggauggauggauggauggaug

SEQ ID NO: 492275 - RNA, 64 nt, Homo Sapiens
gaugaauagauagauggugugauggauggauggauggauggauggauggauggauggauggaug

SEQ ID NO: 492276 - RNA, 64 nt, Homo Sapiens
gauggaugaauagauagauggauggauggauggauggauggauggcaggauggauggauggaug

SEQ ID NO: 492277 - RNA, 64 nt, Homo Sapiens
gauggauggaugaauagauagauggauggauggauggauggaugacaagcaggauggauggaug

SEQ ID NO: 492278 - RNA, 64 nt, Homo Sapiens
gauggauggauggaugaauagauggauggauggauggauggaugggagacaagcaggauggaug

SEQ ID NO: 492279 - RNA, 64 nt, Homo Sapiens
gauggauggauggauggauggauggauggauggauggauggaugcaaaggagacaagcaggaug

SEQ ID NO: 492280 - RNA, 64 nt, Homo Sapiens
gauggauggauggauggauggauggauggauggauggauggauguggucaaaggagacaagcag

SEQ ID NO: 492281 - RNA, 64 nt, Homo Sapiens
gauggauggauggauggauggcaggauggauggauggauggauguggcuggucaaaggagacaa

SEQ ID NO: 492282 - RNA, 64 nt, Homo Sapiens
gauggauggauggauggaugacaagcaggauggauggauggaugggcuuggcuggucaaaggag

SEQ ID NO: 492283 - RNA, 64 nt, Homo Sapiens
gauggauggauggauggaugggagacaagcaggauggauggaugauagggcuuggcuggucaaa

SEQ ID NO: 492284 - RNA, 64 nt, Homo Sapiens
aagagggagaggaaaaaaauucagcugguaauuauggauggaggaugaagaacauugagaacaa

SEQ ID NO: 492285 - RNA, 64 nt, Homo Sapiens
gacugcucagaacuugcugcugucuuguugcggauggauggaagguuggauggauggguggaug

SEQ ID NO: 492286 - RNA, 64 nt, Homo Sapiens
cuugcugcugucuuguugcggauggauggaagguuggauggauggguggauggccguggauggc

SEQ ID NO: 492287 - RNA, 55 nt, Homo Sapiens
caggucacgaugaacucugaguguguggauggauggguggauggaggguggcagg

SEQ ID NO: 492288 - RNA, 64 nt, Homo Sapiens
gucacgaugaacucugaguguguggauggauggguggauggaggguggcagguggggcgucugc

SEQ ID NO: 492289 - RNA, 64 nt, Homo Sapiens
cccaauucuccaugaugugaaauaaauacuugaguggauggauaauuggauuguuuguaacaca

SEQ ID NO: 492290 - RNA, 64 nt, Homo Sapiens
uagaggucacuauauuaagucaguuaaggagucauggauggaacuagugucaaaaauucagggg

SEQ ID NO: 492291 - RNA, 64 nt, Homo Sapiens
auuucaggggagucaaaaaccuugcaacuuccuucuccacuaacccaggacuaaaaauggacag

SEQ ID NO: 492292 - RNA, 64 nt, Homo Sapiens
ucuuucuaugauaagaggguuguguugguggcaccuccacuacucuuuucuguuuguugaguuu

SEQ ID NO: 492293 - RNA, 64 nt, Homo Sapiens
agaguuacccuguauuagacaugcuucucaaguucuccacuaugggacucaauuugaaguacua

SEQ ID NO: 492294 - RNA, 64 nt, Homo Sapiens
aagccuuggcugaccauaauaguucagguagcagcuccacuagguccuaccccucuuaaaacuc

SEQ ID NO: 492295 - RNA, 64 nt, Homo Sapiens
caagaccagccugaccaacguggagaaacuccgucuccacuaaaauacaaaauuagcugggugu

SEQ ID NO: 492296 - RNA, 64 nt, Homo Sapiens
uugcuguuaacaauaauucucccggccaucuccacuccacuacucaaaaaugccugaauccuug

SEQ ID NO: 492297 - RNA, 64 nt, Homo Sapiens; identical to SEQ ID NO: 247175

SEQ ID NO: 492298 - RNA, 64 nt, Homo Sapiens; identical to SEQ ID NO: 247176

SEQ ID NO: 492299 - RNA, 64 nt, Homo Sapiens; identical to SEQ ID NO: 247177

SEQ ID NO: 492300 - RNA, 64 nt, Homo Sapiens; identical to SEQ ID NO: 247178

SEQ ID NO: 492301 - RNA, 64 nt, Homo Sapiens; identical to SEQ ID NO: 247179

SEQ ID NO: 492302 - RNA, 64 nt, Homo Sapiens; identical to SEQ ID NO: 247180

SEQ ID NO: 492303 - RNA, 64 nt, Homo Sapiens; identical to SEQ ID NO: 247181

SEQ ID NO: 492304 - RNA, 64 nt, Homo Sapiens; identical to SEQ ID NO: 247182

SEQ ID NO: 492305 - RNA, 64 nt, Homo Sapiens; identical to SEQ ID NO: 247183

SEQ ID NO: 492306 - RNA, 64 nt, Homo Sapiens; identical to SEQ ID NO: 247184

SEQ ID NO: 492307 - RNA, 64 nt, Homo Sapiens; identical to SEQ ID NO: 247185

SEQ ID NO: 492308 - RNA, 64 nt, Homo Sapiens; identical to SEQ ID NO: 247186

SEQ ID NO: 492309 - RNA, 64 nt, Homo Sapiens; identical to SEQ ID NO: 247187

SEQ ID NO: 492310 - RNA, 64 nt, Homo Sapiens; identical to SEQ ID NO: 247188

SEQ ID NO: 492311 - RNA, 64 nt, Homo Sapiens; identical to SEQ ID NO: 247189

SEQ ID NO: 492312 - RNA, 64 nt, Homo Sapiens; identical to SEQ ID NO: 247190

SEQ ID NO: 492313 - RNA, 64 nt, Homo Sapiens; identical to SEQ ID NO: 247191

SEQ ID NO: 492314 - RNA, 64 nt, Homo Sapiens; identical to SEQ ID NO: 247192

SEQ ID NO: 492315 - RNA, 64 nt, Homo Sapiens; identical to SEQ ID NO: 247193

SEQ ID NO: 492316 - RNA, 64 nt, Homo Sapiens; identical to SEQ ID NO: 247194

SEQ ID NO: 492317 - RNA, 64 nt, Homo Sapiens; identical to SEQ ID NO: 247195

SEQ ID NO: 492318 - RNA, 64 nt, Homo Sapiens; identical to SEQ ID NO: 247196

SEQ ID NO: 492319 - RNA, 64 nt, Homo Sapiens; identical to SEQ ID NO: 247197

SEQ ID NO: 492320 - RNA, 64 nt, Homo Sapiens; identical to SEQ ID NO: 247198

SEQ ID NO: 492321 - RNA, 64 nt, Homo Sapiens; identical to SEQ ID NO: 247199

SEQ ID NO: 492322 - RNA, 64 nt, Homo Sapiens; identical to SEQ ID NO: 247200

SEQ ID NO: 492323 - RNA, 64 nt, Homo Sapiens; identical to SEQ ID NO: 247201

SEQ ID NO: 492324 - RNA, 61 nt, Homo Sapiens; identical to SEQ ID NO: 247202

SEQ ID NO: 492325 - RNA, 64 nt, Homo Sapiens; identical to SEQ ID NO: 247203

SEQ ID NO: 492326 - RNA, 64 nt, Homo Sapiens; identical to SEQ ID NO: 247204

SEQ ID NO: 492327 - RNA, 64 nt, Homo Sapiens; identical to SEQ ID NO: 247205

SEQ ID NO: 492328 - RNA, 64 nt, Homo Sapiens; identical to SEQ ID NO: 247206

SEQ ID NO: 492329 - RNA, 64 nt, Homo Sapiens; identical to SEQ ID NO: 247207

SEQ ID NO: 492330 - RNA, 64 nt, Homo Sapiens; identical to SEQ ID NO: 247208

SEQ ID NO: 492331 - RNA, 64 nt, Homo Sapiens; identical to SEQ ID NO: 247209

SEQ ID NO: 492332 - RNA, 64 nt, Homo Sapiens; identical to SEQ ID NO: 247210

SEQ ID NO: 492333 - RNA, 64 nt, Homo Sapiens; identical to SEQ ID NO: 247211

SEQ ID NO: 492334 - RNA, 64 nt, Homo Sapiens; identical to SEQ ID NO: 247212

SEQ ID NO: 492335 - RNA, 64 nt, Homo Sapiens; identical to SEQ ID NO: 247213

SEQ ID NO: 492336 - RNA, 64 nt, Homo Sapiens; identical to SEQ ID NO: 247214

SEQ ID NO: 492337 - RNA, 64 nt, Homo Sapiens; identical to SEQ ID NO: 247215

SEQ ID NO: 492338 - RNA, 64 nt, Homo Sapiens; identical to SEQ ID NO: 247216

SEQ ID NO: 492339 - RNA, 64 nt, Homo Sapiens; identical to SEQ ID NO: 247217

SEQ ID NO: 492340 - RNA, 64 nt, Homo Sapiens; identical to SEQ ID NO: 247218

SEQ ID NO: 492341 - RNA, 64 nt, Homo Sapiens; identical to SEQ ID NO: 247219

SEQ ID NO: 492342 - RNA, 64 nt, Homo Sapiens; identical to SEQ ID NO: 247220

SEQ ID NO: 492343 - RNA, 64 nt, Homo Sapiens; identical to SEQ ID NO: 247221

SEQ ID NO: 492344 - RNA, 64 nt, Homo Sapiens; identical to SEQ ID NO: 247222

SEQ ID NO: 492345 - RNA, 64 nt, Homo Sapiens; identical to SEQ ID NO: 247223

SEQ ID NO: 492346 - RNA, 64 nt, Homo Sapiens; identical to SEQ ID NO: 247224

SEQ ID NO: 492347 - RNA, 64 nt, Homo Sapiens; identical to SEQ ID NO: 247225

SEQ ID NO: 492348 - RNA, 64 nt, Homo Sapiens; identical to SEQ ID NO: 247226

SEQ ID NO: 492349 - RNA, 64 nt, Homo Sapiens; identical to SEQ ID NO: 247227

SEQ ID NO: 492350 - RNA, 64 nt, Homo Sapiens; identical to SEQ ID NO: 247228

SEQ ID NO: 492351 - RNA, 64 nt, Homo Sapiens; identical to SEQ ID NO: 247229

SEQ ID NO: 492352 - RNA, 64 nt, Homo Sapiens; identical to SEQ ID NO: 247230

SEQ ID NO: 492353 - RNA, 64 nt, Homo Sapiens; identical to SEQ ID NO: 247231

SEQ ID NO: 492354 - RNA, 64 nt, Homo Sapiens; identical to SEQ ID NO: 247232

SEQ ID NO: 492355 - RNA, 64 nt, Homo Sapiens; identical to SEQ ID NO: 247233

SEQ ID NO: 492356 - RNA, 64 nt, Homo Sapiens; identical to SEQ ID NO: 247234

SEQ ID NO: 492357 - RNA, 64 nt, Homo Sapiens; identical to SEQ ID NO: 247235

SEQ ID NO: 492358 - RNA, 64 nt, Homo Sapiens; identical to SEQ ID NO: 247236

SEQ ID NO: 492359 - RNA, 64 nt, Homo Sapiens; identical to SEQ ID NO: 247237

SEQ ID NO: 492360 - RNA, 64 nt, Homo Sapiens; identical to SEQ ID NO: 247238

SEQ ID NO: 492361 - RNA, 64 nt, Homo Sapiens; identical to SEQ ID NO: 247239

SEQ ID NO: 492362 - RNA, 64 nt, Homo Sapiens; identical to SEQ ID NO: 247240

SEQ ID NO: 492363 - RNA, 64 nt, Homo Sapiens; identical to SEQ ID NO: 247241

SEQ ID NO: 492364 - RNA, 64 nt, Homo Sapiens; identical to SEQ ID NO: 247242

SEQ ID NO: 492365 - RNA, 64 nt, Homo Sapiens; identical to SEQ ID NO: 247243

SEQ ID NO: 492366 - RNA, 64 nt, Homo Sapiens; identical to SEQ ID NO: 247244

SEQ ID NO: 492367 - RNA, 64 nt, Homo Sapiens; identical to SEQ ID NO: 247245

SEQ ID NO: 492368 - RNA, 64 nt, Homo Sapiens; identical to SEQ ID NO: 247246

SEQ ID NO: 492369 - RNA, 64 nt, Homo Sapiens; identical to SEQ ID NO: 247247

SEQ ID NO: 492370 - RNA, 64 nt, Homo Sapiens; identical to SEQ ID NO: 247248

SEQ ID NO: 492371 - RNA, 64 nt, Homo Sapiens; identical to SEQ ID NO: 247249

SEQ ID NO: 492372 - RNA, 64 nt, Homo Sapiens; identical to SEQ ID NO: 247250

SEQ ID NO: 492373 - RNA, 64 nt, Homo Sapiens; identical to SEQ ID NO: 247251

SEQ ID NO: 492374 - RNA, 64 nt, Homo Sapiens; identical to SEQ ID NO: 247252

SEQ ID NO: 492375 - RNA, 64 nt, Homo Sapiens
gcuucagguucagcgcccuuggggcuaugaaugggaggcucagcagugcccugaggaugggcuu

SEQ ID NO: 492376 - RNA, 64 nt, Homo Sapiens
auguucugugcagccgcucuuaguauucuuccuugaggcucacaucaugugucccuaucacucu

SEQ ID NO: 492377 - RNA, 64 nt, Homo Sapiens
uggacagcacuuuuuagaaagcuagguuuucucagaggcucagcugccauccaccccucaggga

SEQ ID NO: 492378 - RNA, 64 nt, Homo Sapiens
gguuggucugagaggccugcaugacuucuggagagaggcucaggcucugggcugaaccaaggcu

SEQ ID NO: 492379 - RNA, 64 nt, Homo Sapiens
uugguccccgagugccgccuccuccugccagggggaggcucaggucucuguccccugcccuucc

SEQ ID NO: 492380 - RNA, 64 nt, Homo Sapiens
aaaugcccagcccuuccucaucacgugccccucugaggcucagagccagcuccccagggcagac

SEQ ID NO: 492381 - RNA, 64 nt, Homo Sapiens
aaaaacacaaagaucagaagcuuucaacuccuuugaggcucaaacguucagcucugccucuguu

SEQ ID NO: 492382 - RNA, 64 nt, Homo Sapiens
gauacugauauggaugugggcccuggaguggagggaggcucagaugauuaauuggcugagaaaa

SEQ ID NO: 492383 - RNA, 64 nt, Homo Sapiens
aacuccuggcuuagauugaagcagauugacaggcgaggcucagaagugugggggaaggauagcu

SEQ ID NO: 492384 - RNA, 64 nt, Homo Sapiens
gcagccuuuugucccagcucagagcucacccagagaggcucaaaucugggguccugguuccuga

SEQ ID NO: 492385 - RNA, 64 nt, Homo Sapiens
aagcagaggguaucccaguccucuggcugcccaugaggcucaugcuccuagagucccccuaggu

SEQ ID NO: 492386 - RNA, 64 nt, Homo Sapiens
guggggcuggggccccagagagguuaggaaagcggaggcucauguuucaagcuagcagccacau

SEQ ID NO: 492387 - RNA, 64 nt, Homo Sapiens
uggguguccccucucucacucagagguggauggugaggcucaugaacacuucccugucugcagc

SEQ ID NO: 492388 - RNA, 64 nt, Homo Sapiens
cagcccggcuggccgccgccgagaaguggccgaagaggcucagggcugccucggcugcguguac

SEQ ID NO: 492389 - RNA, 64 nt, Homo Sapiens; identical to SEQ ID NO: 183750

SEQ ID NO: 492390 - RNA, 64 nt, Homo Sapiens; identical to SEQ ID NO: 183751

SEQ ID NO: 492391 - RNA, 64 nt, Homo Sapiens; identical to SEQ ID NO: 183752

SEQ ID NO: 492392 - RNA, 64 nt, Homo Sapiens; identical to SEQ ID NO: 183753

SEQ ID NO: 492393 - RNA, 64 nt, Homo Sapiens; identical to SEQ ID NO: 183754

SEQ ID NO: 492394 - RNA, 64 nt, Homo Sapiens; identical to SEQ ID NO: 183755

SEQ ID NO: 492395 - RNA, 64 nt, Homo Sapiens; identical to SEQ ID NO: 183756

SEQ ID NO: 492396 - RNA, 64 nt, Homo Sapiens; identical to SEQ ID NO: 183757

SEQ ID NO: 492397 - RNA, 64 nt, Homo Sapiens; identical to SEQ ID NO: 183758

SEQ ID NO: 492398 - RNA, 64 nt, Homo Sapiens; identical to SEQ ID NO: 183759

SEQ ID NO: 492399 - RNA, 64 nt, Homo Sapiens; identical to SEQ ID NO: 234645

SEQ ID NO: 492400 - RNA, 64 nt, Homo Sapiens; identical to SEQ ID NO: 234646

SEQ ID NO: 492401 - RNA, 64 nt, Homo Sapiens; identical to SEQ ID NO: 234647

SEQ ID NO: 492402 - RNA, 64 nt, Homo Sapiens; identical to SEQ ID NO: 234648

SEQ ID NO: 492403 - RNA, 64 nt, Homo Sapiens; identical to SEQ ID NO: 234649

SEQ ID NO: 492404 - RNA, 64 nt, Homo Sapiens; identical to SEQ ID NO: 234650

SEQ ID NO: 492405 - RNA, 64 nt, Homo Sapiens; identical to SEQ ID NO: 234651

SEQ ID NO: 492406 - RNA, 64 nt, Homo Sapiens; identical to SEQ ID NO: 234652

SEQ ID NO: 492407 - RNA, 64 nt, Homo Sapiens; identical to SEQ ID NO: 234653

SEQ ID NO: 492408 - RNA, 64 nt, Homo Sapiens; identical to SEQ ID NO: 234654

SEQ ID NO: 492409 - RNA, 64 nt, Homo Sapiens; identical to SEQ ID NO: 234655

SEQ ID NO: 492410 - RNA, 64 nt, Homo Sapiens; identical to SEQ ID NO: 234656

SEQ ID NO: 492411 - RNA, 64 nt, Homo Sapiens; identical to SEQ ID NO: 234657

SEQ ID NO: 492412 - RNA, 64 nt, Homo Sapiens; identical to SEQ ID NO: 234658

SEQ ID NO: 492413 - RNA, 64 nt, Homo Sapiens; identical to SEQ ID NO: 234659

SEQ ID NO: 492414 - RNA, 64 nt, Homo Sapiens; identical to SEQ ID NO: 234660

SEQ ID NO: 492415 - RNA, 64 nt, Homo Sapiens; identical to SEQ ID NO: 234661

SEQ ID NO: 492416 - RNA, 64 nt, Homo Sapiens; identical to SEQ ID NO: 234662

SEQ ID NO: 492417 - RNA, 64 nt, Homo Sapiens; identical to SEQ ID NO: 234663

SEQ ID NO: 492418 - RNA, 64 nt, Homo Sapiens; identical to SEQ ID NO: 234664

SEQ ID NO: 492419 - RNA, 64 nt, Homo Sapiens; identical to SEQ ID NO: 234665

SEQ ID NO: 492420 - RNA, 63 nt, Homo Sapiens; identical to SEQ ID NO: 234666

SEQ ID NO: 492421 - RNA, 64 nt, Homo Sapiens; identical to SEQ ID NO: 234667

SEQ ID NO: 492422 - RNA, 64 nt, Homo Sapiens; identical to SEQ ID NO: 234668

SEQ ID NO: 492423 - RNA, 64 nt, Homo Sapiens; identical to SEQ ID NO: 234669

SEQ ID NO: 492424 - RNA, 64 nt, Homo Sapiens; identical to SEQ ID NO: 234670

SEQ ID NO: 492425 - RNA, 64 nt, Homo Sapiens; identical to SEQ ID NO: 234671

SEQ ID NO: 492426 - RNA, 64 nt, Homo Sapiens; identical to SEQ ID NO: 234672

SEQ ID NO: 492427 - RNA, 64 nt, Homo Sapiens; identical to SEQ ID NO: 234673

SEQ ID NO: 492428 - RNA, 64 nt, Homo Sapiens; identical to SEQ ID NO: 234674

SEQ ID NO: 492429 - RNA, 64 nt, Homo Sapiens; identical to SEQ ID NO: 234675

SEQ ID NO: 492430 - RNA, 64 nt, Homo Sapiens; identical to SEQ ID NO: 234676

SEQ ID NO: 492431 - RNA, 64 nt, Homo Sapiens; identical to SEQ ID NO: 234677

SEQ ID NO: 492432 - RNA, 64 nt, Homo Sapiens; identical to SEQ ID NO: 234678

SEQ ID NO: 492433 - RNA, 64 nt, Homo Sapiens; identical to SEQ ID NO: 234679

SEQ ID NO: 492434 - RNA, 64 nt, Homo Sapiens; identical to SEQ ID NO: 234680

SEQ ID NO: 492435 - RNA, 64 nt, Homo Sapiens; identical to SEQ ID NO: 234681

SEQ ID NO: 492436 - RNA, 64 nt, Homo Sapiens; identical to SEQ ID NO: 234682

SEQ ID NO: 492437 - RNA, 64 nt, Homo Sapiens; identical to SEQ ID NO: 234683

SEQ ID NO: 492438 - RNA, 64 nt, Homo Sapiens; identical to SEQ ID NO: 234684

SEQ ID NO: 492439 - RNA, 64 nt, Homo Sapiens; identical to SEQ ID NO: 234685

SEQ ID NO: 492440 - RNA, 64 nt, Homo Sapiens; identical to SEQ ID NO: 234686

SEQ ID NO: 492441 - RNA, 64 nt, Homo Sapiens; identical to SEQ ID NO: 234687

SEQ ID NO: 492442 - RNA, 64 nt, Homo Sapiens; identical to SEQ ID NO: 234688

SEQ ID NO: 492443 - RNA, 64 nt, Homo Sapiens; identical to SEQ ID NO: 234689

SEQ ID NO: 492444 - RNA, 64 nt, Homo Sapiens; identical to SEQ ID NO: 234690

SEQ ID NO: 492445 - RNA, 64 nt, Homo Sapiens; identical to SEQ ID NO: 234691

SEQ ID NO: 492446 - RNA, 64 nt, Homo Sapiens; identical to SEQ ID NO: 234692

SEQ ID NO: 492447 - RNA, 64 nt, Homo Sapiens; identical to SEQ ID NO: 234693

SEQ ID NO: 492448 - RNA, 64 nt, Homo Sapiens; identical to SEQ ID NO: 234694

SEQ ID NO: 492449 - RNA, 64 nt, Homo Sapiens; identical to SEQ ID NO: 234695

SEQ ID NO: 492450 - RNA, 64 nt, Homo Sapiens; identical to SEQ ID NO: 234696

SEQ ID NO: 492451 - RNA, 64 nt, Homo Sapiens
uugcacaaauugggccaaagaaacauugccuugaggaagauaugauuggaaaaucaagagugua

SEQ ID NO: 492452 - RNA, 64 nt, Homo Sapiens
uccuuuccuuuguagucucuggcaagaugcuuuaggaagauaaaaguuugaggagaacaaacag

SEQ ID NO: 492453 - RNA, 64 nt, Homo Sapiens
agugguaaagagugaaugauugauuagacagcagggaagauauugacaggagggaagauauuag

SEQ ID NO: 492454 - RNA, 64 nt, Homo Sapiens
agugauuagacagcagggaaugauuagacaggagggaagauauugacaggaaggaagacauuag

SEQ ID NO: 492455 - RNA, 64 nt, Homo Sapiens
cgugaagcacaugguuacaucagacuucuaagcaggaagauagagacucagccucuguggguga

SEQ ID NO: 492456 - RNA, 64 nt, Homo Sapiens
aaauguuuguuagauacaccaagaguccaguuucggaagauaauucaagugcuucaaaugaauu

SEQ ID NO: 492457 - RNA, 64 nt, Homo Sapiens
gcaccuuuuugacagugaacauggucuaaaaaagggaagauauuguagaagauuucacacacac

SEQ ID NO: 492458 - RNA, 64 nt, Homo Sapiens
aguagucaggaacuggucacuuugaaugugggagggaagauauucacgacaagguuuucuacga

SEQ ID NO: 492459 - RNA, 64 nt, Homo Sapiens
uuaccauugucaaagaaagcgaggaugaagauaaggaagauacgaugaugaugaagaugaugau

SEQ ID NO: 492460 - RNA, 64 nt, Homo Sapiens
aaaucauuaacugcucaugugaauuuauuagaguggaagauauacugccauaauagagauguuu

SEQ ID NO: 492461 - RNA, 64 nt, Homo Sapiens
acccccauaccccuucuuccacccccagacuaaaggaagauacuuacucucugccccucuccau

SEQ ID NO: 492462 - RNA, 64 nt, Homo Sapiens
gugucucuccaccagcccccaugcaguagggacuggaagauaugucaucugcugguuguguuau

SEQ ID NO: 492463 - RNA, 64 nt, Homo Sapiens
agugcaucgcugaagcuuuuggagacuuuuggauggaagauaagauagggaagauuaaguucca

SEQ ID NO: 492464 - RNA, 64 nt, Homo Sapiens
cauggcuaguguggcguugaaagaguagcgacugggaagauacaacuuacacaguggggccuau

SEQ ID NO: 492465 - RNA, 64 nt, Homo Sapiens
ggguccaggugggccacacaggggccaggauggcggaagauacggguggggagggaagauaucc

SEQ ID NO: 492466 - RNA, 64 nt, Homo Sapiens
aggggccaggauggcggaagauacggguggggagggaagauauccagaaaggagccacagcuga

SEQ ID NO: 492467 - RNA, 64 nt, Homo Sapiens
gaaacuggcucugaaauaggcagaccuagcaagaggaagauacaggguaucgggcguuugagug

SEQ ID NO: 492468 - RNA, 64 nt, Homo Sapiens
guaucgggcguuugaguguuucagaagucauucgggaagauaaauccagugcgcuggccgcagc

SEQ ID NO: 492469 - RNA, 64 nt, Homo Sapiens; identical to SEQ ID NO: 154357

SEQ ID NO: 492470 - RNA, 64 nt, Homo Sapiens; identical to SEQ ID NO: 154358

SEQ ID NO: 492471 - RNA, 64 nt, Homo Sapiens; identical to SEQ ID NO: 154359

SEQ ID NO: 492472 - RNA, 64 nt, Homo Sapiens; identical to SEQ ID NO: 154360

SEQ ID NO: 492473 - RNA, 64 nt, Homo Sapiens; identical to SEQ ID NO: 154361

SEQ ID NO: 492474 - RNA, 64 nt, Homo Sapiens; identical to SEQ ID NO: 154362

SEQ ID NO: 492475 - RNA, 64 nt, Homo Sapiens; identical to SEQ ID NO: 154363

SEQ ID NO: 492476 - RNA, 64 nt, Homo Sapiens; identical to SEQ ID NO: 154364

SEQ ID NO: 492477 - RNA, 64 nt, Homo Sapiens; identical to SEQ ID NO: 154365

SEQ ID NO: 492478 - RNA, 64 nt, Homo Sapiens; identical to SEQ ID NO: 154366

SEQ ID NO: 492479 - RNA, 64 nt, Homo Sapiens; identical to SEQ ID NO: 154367

SEQ ID NO: 492480 - RNA, 64 nt, Homo Sapiens; identical to SEQ ID NO: 154368

SEQ ID NO: 492481 - RNA, 64 nt, Homo Sapiens; identical to SEQ ID NO: 154369

SEQ ID NO: 492482 - RNA, 64 nt, Homo Sapiens; identical to SEQ ID NO: 154370

SEQ ID NO: 492483 - RNA, 64 nt, Homo Sapiens; identical to SEQ ID NO: 154371

SEQ ID NO: 492484 - RNA, 64 nt, Homo Sapiens; identical to SEQ ID NO: 154372

SEQ ID NO: 492485 - RNA, 64 nt, Homo Sapiens; identical to SEQ ID NO: 154373

SEQ ID NO: 492486 - RNA, 64 nt, Homo Sapiens; identical to SEQ ID NO: 154374

SEQ ID NO: 492487 - RNA, 64 nt, Homo Sapiens; identical to SEQ ID NO: 154375

SEQ ID NO: 492488 - RNA, 64 nt, Homo Sapiens; identical to SEQ ID NO: 154376

SEQ ID NO: 492489 - RNA, 64 nt, Homo Sapiens; identical to SEQ ID NO: 154377

SEQ ID NO: 492490 - RNA, 64 nt, Homo Sapiens; identical to SEQ ID NO: 154378

SEQ ID NO: 492491 - RNA, 64 nt, Homo Sapiens; identical to SEQ ID NO: 154379

SEQ ID NO: 492492 - RNA, 64 nt, Homo Sapiens; identical to SEQ ID NO: 154380

SEQ ID NO: 492493 - RNA, 64 nt, Homo Sapiens; identical to SEQ ID NO: 154381

SEQ ID NO: 492494 - RNA, 64 nt, Homo Sapiens; identical to SEQ ID NO: 154382

SEQ ID NO: 492495 - RNA, 64 nt, Homo Sapiens; identical to SEQ ID NO: 154383

SEQ ID NO: 492496 - RNA, 64 nt, Homo Sapiens; identical to SEQ ID NO: 154384

SEQ ID NO: 492497 - RNA, 64 nt, Homo Sapiens; identical to SEQ ID NO: 154385

SEQ ID NO: 492498 - RNA, 64 nt, Homo Sapiens; identical to SEQ ID NO: 154386

SEQ ID NO: 492499 - RNA, 64 nt, Homo Sapiens; identical to SEQ ID NO: 154387

SEQ ID NO: 492500 - RNA, 64 nt, Homo Sapiens; identical to SEQ ID NO: 154388

SEQ ID NO: 492501 - RNA, 64 nt, Homo Sapiens; identical to SEQ ID NO: 154389

SEQ ID NO: 492502 - RNA, 64 nt, Homo Sapiens; identical to SEQ ID NO: 154390

SEQ ID NO: 492503 - RNA, 64 nt, Homo Sapiens; identical to SEQ ID NO: 194715

SEQ ID NO: 492504 - RNA, 64 nt, Homo Sapiens; identical to SEQ ID NO: 194716

SEQ ID NO: 492505 - RNA, 64 nt, Homo Sapiens; identical to SEQ ID NO: 194717

SEQ ID NO: 492506 - RNA, 64 nt, Homo Sapiens; identical to SEQ ID NO: 194718

SEQ ID NO: 492507 - RNA, 64 nt, Homo Sapiens; identical to SEQ ID NO: 194719

SEQ ID NO: 492508 - RNA, 64 nt, Homo Sapiens; identical to SEQ ID NO: 194720

SEQ ID NO: 492509 - RNA, 64 nt, Homo Sapiens; identical to SEQ ID NO: 194721

SEQ ID NO: 492510 - RNA, 64 nt, Homo Sapiens; identical to SEQ ID NO: 194722

SEQ ID NO: 492511 - RNA, 64 nt, Homo Sapiens; identical to SEQ ID NO: 194723

SEQ ID NO: 492512 - RNA, 64 nt, Homo Sapiens; identical to SEQ ID NO: 194724

SEQ ID NO: 492513 - RNA, 64 nt, Homo Sapiens; identical to SEQ ID NO: 194725

SEQ ID NO: 492514 - RNA, 64 nt, Homo Sapiens; identical to SEQ ID NO: 194726

SEQ ID NO: 492515 - RNA, 64 nt, Homo Sapiens; identical to SEQ ID NO: 194727

SEQ ID NO: 492516 - RNA, 64 nt, Homo Sapiens; identical to SEQ ID NO: 194728

SEQ ID NO: 492517 - RNA, 64 nt, Homo Sapiens; identical to SEQ ID NO: 194729

SEQ ID NO: 492518 - RNA, 64 nt, Homo Sapiens; identical to SEQ ID NO: 194730

SEQ ID NO: 492519 - RNA, 64 nt, Homo Sapiens; identical to SEQ ID NO: 194731

SEQ ID NO: 492520 - RNA, 64 nt, Homo Sapiens; identical to SEQ ID NO: 194732

SEQ ID NO: 492521 - RNA, 64 nt, Homo Sapiens; identical to SEQ ID NO: 194733

SEQ ID NO: 492522 - RNA, 64 nt, Homo Sapiens; identical to SEQ ID NO: 194734

SEQ ID NO: 492523 - RNA, 64 nt, Homo Sapiens; identical to SEQ ID NO: 194735

SEQ ID NO: 492524 - RNA, 64 nt, Homo Sapiens; identical to SEQ ID NO: 194736

SEQ ID NO: 492525 - RNA, 64 nt, Homo Sapiens; identical to SEQ ID NO: 194737

SEQ ID NO: 492526 - RNA, 64 nt, Homo Sapiens; identical to SEQ ID NO: 194738

SEQ ID NO: 492527 - RNA, 64 nt, Homo Sapiens; identical to SEQ ID NO: 194739

SEQ ID NO: 492528 - RNA, 64 nt, Homo Sapiens; identical to SEQ ID NO: 194740

SEQ ID NO: 492529 - RNA, 64 nt, Homo Sapiens; identical to SEQ ID NO: 194741

SEQ ID NO: 492530 - RNA, 64 nt, Homo Sapiens; identical to SEQ ID NO: 194742

SEQ ID NO: 492531 - RNA, 64 nt, Homo Sapiens; identical to SEQ ID NO: 194743

SEQ ID NO: 492532 - RNA, 64 nt, Homo Sapiens; identical to SEQ ID NO: 194744

SEQ ID NO: 492533 - RNA, 64 nt, Homo Sapiens; identical to SEQ ID NO: 194745

SEQ ID NO: 492534 - RNA, 64 nt, Homo Sapiens; identical to SEQ ID NO: 194746

SEQ ID NO: 492535 - RNA, 64 nt, Homo Sapiens; identical to SEQ ID NO: 194747

SEQ ID NO: 492536 - RNA, 64 nt, Homo Sapiens
aagagaaaaagaaaugcaaaaaucucugcgugcagggacaaagaggccuuuaaccauggugcuu

SEQ ID NO: 492537 - RNA, 64 nt, Homo Sapiens
agaaaggggcaguuuaaagcacaaugucucacaugggacaaaguuccaaaaugccaaauucuua

SEQ ID NO: 492538 - RNA, 64 nt, Homo Sapiens
acuucuguccuuauuucacuugcugaaaagcugugggacaaaauguauggaauagacaaggcca

SEQ ID NO: 492539 - RNA, 64 nt, Homo Sapiens
cuauaagaggaaauaagagagaaaguggaggagagggacaaaaggaguaauuauuugguauaga

SEQ ID NO: 492540 - RNA, 64 nt, Homo Sapiens
gaaugagaagacauggaugagagagagagcuagagggacaaagaucuugguggggaugagaagg

SEQ ID NO: 492541 - RNA, 64 nt, Homo Sapiens
gggacaggaaggaucaaguucaccuuacaacucggggacaaaugaugacaaaaccuuuaaucug

SEQ ID NO: 492542 - RNA, 64 nt, Homo Sapiens
aggaaugcauguguucuuagugauucacauccacgggacaaaaacucaagaagaaauaagagcu

SEQ ID NO: 492543 - RNA, 64 nt, Homo Sapiens
gucuaaaguguggcaagacauagugcacaacacagggacaaaggcagguuuccugcagcucgcu

SEQ ID NO: 492544 - RNA, 64 nt, Homo Sapiens
uugaaaaaagugcagauaaaacccucaucucccugggacaaagcacgugggggaaagggguggc

SEQ ID NO: 492545 - RNA, 64 nt, Homo Sapiens
agagcucuggcuggcaucuggugggugccccucugggacaaagcuuccagaggaaggaacaggc

SEQ ID NO: 492546 - RNA, 64 nt, Homo Sapiens; identical to SEQ ID NO: 437603

SEQ ID NO: 492547 - RNA, 64 nt, Homo Sapiens; identical to SEQ ID NO: 437604

SEQ ID NO: 492548 - RNA, 64 nt, Homo Sapiens; identical to SEQ ID NO: 437605

SEQ ID NO: 492549 - RNA, 64 nt, Homo Sapiens; identical to SEQ ID NO: 437606

SEQ ID NO: 492550 - RNA, 64 nt, Homo Sapiens
ccccggccccuccccaccuuucccaccccagcccucuugcaagaggagaggcacgguagggaaa

SEQ ID NO: 492551 - RNA, 64 nt, Homo Sapiens
uaaccuuuaucccaccuuugacacuacccuccaaucuugcaacacuauccuguuucucagaaca

SEQ ID NO: 492552 - RNA, 64 nt, Homo Sapiens
cgugguggcggcggcacuucaagcaaagacaguuucuugcaagcuccaguagcuccgcgugucu

SEQ ID NO: 492553 - RNA, 64 nt, Homo Sapiens
gucauucucauccaaaagugaccagcauaccaguucuugcaauaagauauuacccucagaauau

SEQ ID NO: 492554 - RNA, 64 nt, Homo Sapiens
cagaaguuggagcuuuuuaaauuuuucuugaacuucuugcaauaguaacugaauguccuccauu

SEQ ID NO: 492555 - RNA, 64 nt, Homo Sapiens
uggaggauagguuaagaaaggaaagggacagaagucuugcaauaggcugcagacauuuuaauac

SEQ ID NO: 492556 - RNA, 64 nt, Homo Sapiens
uccccgugcugccaguacuuuucaugucccugucucuugcaagccgugccagagacgccacaac

SEQ ID NO: 492557 - RNA, 64 nt, Homo Sapiens
uuucugucugauuuuuacaacuauuuucaccuuaucuugcaauucugcuuuuccuuuuuacuuc

SEQ ID NO: 492558 - RNA, 64 nt, Homo Sapiens
gggggagggggcguuucgcuacagccgaaaccugucuugcaaugccugugaugcuccgucucaa

SEQ ID NO: 492559 - RNA, 64 nt, Homo Sapiens
acugcccuaccaaaccuguguauguguugccaauucuugcaaccauugccaacaauuuaauguu

SEQ ID NO: 492560 - RNA, 64 nt, Homo Sapiens
ccuuuugcccuuuaaaaagcuguguuuuauauuaucuugcaaauauacguaaaggugugcuuuc

SEQ ID NO: 492561 - RNA, 64 nt, Homo Sapiens
acagugcccucugcugcuagcuagacuuuuuguuucuugcaacauuaagcacaugggaaagauu

SEQ ID NO: 492562 - RNA, 64 nt, Homo Sapiens
guaauuuaagcacaugggaaaagaauguuaucuuucuugcaagauaaaauacuuaaguuauuca

SEQ ID NO: 492563 - RNA, 64 nt, Homo Sapiens
uaaggcuucccccuuuacuacugccgaagaauugucuugcaaguuaaaaaguauguuguacaua

SEQ ID NO: 492564 - RNA, 64 nt, Homo Sapiens
cgacagauucauaaaguaauucugaugaugucggucuugcaaagcugagugaauuguaccuauu

SEQ ID NO: 492565 - RNA, 64 nt, Homo Sapiens; identical to SEQ ID NO: 275005

SEQ ID NO: 492566 - RNA, 64 nt, Homo Sapiens; identical to SEQ ID NO: 275006

SEQ ID NO: 492567 - RNA, 64 nt, Homo Sapiens; identical to SEQ ID NO: 275007

SEQ ID NO: 492568 - RNA, 64 nt, Homo Sapiens; identical to SEQ ID NO: 275008

SEQ ID NO: 492569 - RNA, 64 nt, Homo Sapiens; identical to SEQ ID NO: 275009

SEQ ID NO: 492570 - RNA, 64 nt, Homo Sapiens; identical to SEQ ID NO: 275010

SEQ ID NO: 492571 - RNA, 64 nt, Homo Sapiens; identical to SEQ ID NO: 275011

SEQ ID NO: 492572 - RNA, 64 nt, Homo Sapiens; identical to SEQ ID NO: 275012

SEQ ID NO: 492573 - RNA, 64 nt, Homo Sapiens; identical to SEQ ID NO: 275013

SEQ ID NO: 492574 - RNA, 64 nt, Homo Sapiens; identical to SEQ ID NO: 275014

SEQ ID NO: 492575 - RNA, 64 nt, Homo Sapiens; identical to SEQ ID NO: 275015

SEQ ID NO: 492576 - RNA, 64 nt, Homo Sapiens; identical to SEQ ID NO: 275016

SEQ ID NO: 492577 - RNA, 51 nt, Homo Sapiens; identical to SEQ ID NO: 275017

SEQ ID NO: 492578 - RNA, 64 nt, Homo Sapiens; identical to SEQ ID NO: 275018

SEQ ID NO: 492579 - RNA, 64 nt, Homo Sapiens; identical to SEQ ID NO: 275019

SEQ ID NO: 492580 - RNA, 64 nt, Homo Sapiens; identical to SEQ ID NO: 275020

SEQ ID NO: 492581 - RNA, 64 nt, Homo Sapiens; identical to SEQ ID NO: 275021

SEQ ID NO: 492582 - RNA, 64 nt, Homo Sapiens; identical to SEQ ID NO: 275022

SEQ ID NO: 492583 - RNA, 64 nt, Homo Sapiens; identical to SEQ ID NO: 275023

SEQ ID NO: 492584 - RNA, 64 nt, Homo Sapiens; identical to SEQ ID NO: 275024

SEQ ID NO: 492585 - RNA, 64 nt, Homo Sapiens; identical to SEQ ID NO: 275025

SEQ ID NO: 492586 - RNA, 64 nt, Homo Sapiens; identical to SEQ ID NO: 275026

SEQ ID NO: 492587 - RNA, 64 nt, Homo Sapiens; identical to SEQ ID NO: 275027

SEQ ID NO: 492588 - RNA, 64 nt, Homo Sapiens; identical to SEQ ID NO: 275028

SEQ ID NO: 492589 - RNA, 64 nt, Homo Sapiens; identical to SEQ ID NO: 275029

SEQ ID NO: 492590 - RNA, 64 nt, Homo Sapiens; identical to SEQ ID NO: 275030

SEQ ID NO: 492591 - RNA, 64 nt, Homo Sapiens; identical to SEQ ID NO: 275031

SEQ ID NO: 492592 - RNA, 64 nt, Homo Sapiens; identical to SEQ ID NO: 275032

SEQ ID NO: 492593 - RNA, 64 nt, Homo Sapiens; identical to SEQ ID NO: 275033

SEQ ID NO: 492594 - RNA, 64 nt, Homo Sapiens; identical to SEQ ID NO: 275034

SEQ ID NO: 492595 - RNA, 64 nt, Homo Sapiens; identical to SEQ ID NO: 275035

SEQ ID NO: 492596 - RNA, 64 nt, Homo Sapiens; identical to SEQ ID NO: 275036

SEQ ID NO: 492597 - RNA, 64 nt, Homo Sapiens; identical to SEQ ID NO: 275037

SEQ ID NO: 492598 - RNA, 64 nt, Homo Sapiens; identical to SEQ ID NO: 275038

SEQ ID NO: 492599 - RNA, 64 nt, Homo Sapiens; identical to SEQ ID NO: 275038

SEQ ID NO: 492600 - RNA, 64 nt, Homo Sapiens; identical to SEQ ID NO: 275040

SEQ ID NO: 492601 - RNA, 64 nt, Homo Sapiens; identical to SEQ ID NO: 275041

SEQ ID NO: 492602 - RNA, 64 nt, Homo Sapiens; identical to SEQ ID NO: 275042

SEQ ID NO: 492603 - RNA, 64 nt, Homo Sapiens; identical to SEQ ID NO: 275043

SEQ ID NO: 492604 - RNA, 64 nt, Homo Sapiens; identical to SEQ ID NO: 275044

SEQ ID NO: 492605 - RNA, 64 nt, Homo Sapiens; identical to SEQ ID NO: 275045

SEQ ID NO: 492606 - RNA, 64 nt, Homo Sapiens; identical to SEQ ID NO: 275046

SEQ ID NO: 492607 - RNA, 64 nt, Homo Sapiens; identical to SEQ ID NO: 275047

SEQ ID NO: 492608 - RNA, 64 nt, Homo Sapiens; identical to SEQ ID NO: 275048

SEQ ID NO: 492609 - RNA, 64 nt, Homo Sapiens; identical to SEQ ID NO: 275049

SEQ ID NO: 492610 - RNA, 64 nt, Homo Sapiens; identical to SEQ ID NO: 275050

SEQ ID NO: 492611 - RNA, 64 nt, Homo Sapiens; identical to SEQ ID NO: 275051

SEQ ID NO: 492612 - RNA, 64 nt, Homo Sapiens
caggagugcuuuggaaauugagagguggagcaaucucagguaaaggcaaaauagaggguaugac

SEQ ID NO: 492613 - RNA, 64 nt, Homo Sapiens
ugacccuuuauggcacugcuaacagaccccuucccucagguaauucuggauccagaacucauua

SEQ ID NO: 492614 - RNA, 64 nt, Homo Sapiens
guguagauuguacuucucugccccugcuuuacaucucagguaauaggcauuuuggguuuuaaga

SEQ ID NO: 492615 - RNA, 64 nt, Homo Sapiens
ugauucugccuuccaagagucuguugucauuguucucagguaggacccacacaauguaagggua

SEQ ID NO: 492616 - RNA, 64 nt, Homo Sapiens
agaaugaguugugaucauugucacccuaugucuucucagguagcagggcgcguuuccacuuaag

SEQ ID NO: 492617 - RNA, 64 nt, Homo Sapiens
uccacagaggcugaccugugggggaaaagaagugcucagguaagguugucuccucuccuguccu

SEQ ID NO: 492618 - RNA, 64 nt, Homo Sapiens; identical to SEQ ID NO: 275005

SEQ ID NO: 492619 - RNA, 64 nt, Homo Sapiens; identical to SEQ ID NO: 275006

SEQ ID NO: 492620 - RNA, 64 nt, Homo Sapiens; identical to SEQ ID NO: 275007

SEQ ID NO: 492621 - RNA, 64 nt, Homo Sapiens; identical to SEQ ID NO: 275008

SEQ ID NO: 492622 - RNA, 64 nt, Homo Sapiens; identical to SEQ ID NO: 275009

SEQ ID NO: 492623 - RNA, 64 nt, Homo Sapiens; identical to SEQ ID NO: 275010

SEQ ID NO: 492624 - RNA, 64 nt, Homo Sapiens; identical to SEQ ID NO: 275011

SEQ ID NO: 492625 - RNA, 64 nt, Homo Sapiens; identical to SEQ ID NO: 275012

SEQ ID NO: 492626 - RNA, 64 nt, Homo Sapiens; identical to SEQ ID NO: 275013

SEQ ID NO: 492627 - RNA, 64 nt, Homo Sapiens; identical to SEQ ID NO: 275014

SEQ ID NO: 492628 - RNA, 64 nt, Homo Sapiens; identical to SEQ ID NO: 275015

SEQ ID NO: 492629 - RNA, 64 nt, Homo Sapiens; identical to SEQ ID NO: 275016

SEQ ID NO: 492630 - RNA, 51 nt, Homo Sapiens; identical to SEQ ID NO: 275017

SEQ ID NO: 492631 - RNA, 64 nt, Homo Sapiens; identical to SEQ ID NO: 275018

SEQ ID NO: 492632 - RNA, 64 nt, Homo Sapiens; identical to SEQ ID NO: 275019

SEQ ID NO: 492633 - RNA, 64 nt, Homo Sapiens; identical to SEQ ID NO: 275020

SEQ ID NO: 492634 - RNA, 64 nt, Homo Sapiens; identical to SEQ ID NO: 275021

SEQ ID NO: 492635 - RNA, 64 nt, Homo Sapiens; identical to SEQ ID NO: 275022

SEQ ID NO: 492636 - RNA, 64 nt, Homo Sapiens; identical to SEQ ID NO: 275023

SEQ ID NO: 492637 - RNA, 64 nt, Homo Sapiens; identical to SEQ ID NO: 275024

SEQ ID NO: 492638 - RNA, 64 nt, Homo Sapiens; identical to SEQ ID NO: 275025

SEQ ID NO: 492639 - RNA, 64 nt, Homo Sapiens; identical to SEQ ID NO: 275026

SEQ ID NO: 492640 - RNA, 64 nt, Homo Sapiens; identical to SEQ ID NO: 275027

SEQ ID NO: 492641 - RNA, 64 nt, Homo Sapiens; identical to SEQ ID NO: 275028

SEQ ID NO: 492642 - RNA, 64 nt, Homo Sapiens; identical to SEQ ID NO: 275029

SEQ ID NO: 492643 - RNA, 64 nt, Homo Sapiens; identical to SEQ ID NO: 275030

SEQ ID NO: 492644 - RNA, 64 nt, Homo Sapiens; identical to SEQ ID NO: 275031

SEQ ID NO: 492645 - RNA, 64 nt, Homo Sapiens; identical to SEQ ID NO: 275032

SEQ ID NO: 492646 - RNA, 64 nt, Homo Sapiens; identical to SEQ ID NO: 275033

SEQ ID NO: 492647 - RNA, 64 nt, Homo Sapiens; identical to SEQ ID NO: 275034

SEQ ID NO: 492648 - RNA, 64 nt, Homo Sapiens; identical to SEQ ID NO: 275035

SEQ ID NO: 492649 - RNA, 64 nt, Homo Sapiens; identical to SEQ ID NO: 275036

SEQ ID NO: 492650 - RNA, 64 nt, Homo Sapiens; identical to SEQ ID NO: 275037

SEQ ID NO: 492651 - RNA, 64 nt, Homo Sapiens; identical to SEQ ID NO: 275038

SEQ ID NO: 492652 - RNA, 64 nt, Homo Sapiens; identical to SEQ ID NO: 275038

SEQ ID NO: 492653 - RNA, 64 nt, Homo Sapiens; identical to SEQ ID NO: 275040

SEQ ID NO: 492654 - RNA, 64 nt, Homo Sapiens; identical to SEQ ID NO: 275041

SEQ ID NO: 492655 - RNA, 64 nt, Homo Sapiens; identical to SEQ ID NO: 275042

SEQ ID NO: 492656 - RNA, 64 nt, Homo Sapiens; identical to SEQ ID NO: 275043

SEQ ID NO: 492657 - RNA, 64 nt, Homo Sapiens; identical to SEQ ID NO: 275044

SEQ ID NO: 492658 - RNA, 64 nt, Homo Sapiens; identical to SEQ ID NO: 275045

SEQ ID NO: 492659 - RNA, 64 nt, Homo Sapiens; identical to SEQ ID NO: 275046

SEQ ID NO: 492660 - RNA, 64 nt, Homo Sapiens; identical to SEQ ID NO: 275047

SEQ ID NO: 492661 - RNA, 64 nt, Homo Sapiens; identical to SEQ ID NO: 275048

SEQ ID NO: 492662 - RNA, 64 nt, Homo Sapiens; identical to SEQ ID NO: 275049

SEQ ID NO: 492663 - RNA, 64 nt, Homo Sapiens; identical to SEQ ID NO: 275050

SEQ ID NO: 492664 - RNA, 64 nt, Homo Sapiens; identical to SEQ ID NO: 275051

SEQ ID NO: 492665 - RNA, 64 nt, Homo Sapiens
uuguuuacaauuaaaauggacuuaaguagucuggcucaaguacuuaaguuauuuugcucaagua

SEQ ID NO: 492666 - RNA, 64 nt, Homo Sapiens
uaaguagucuggcucaaguauuuaaguuauuuugcucaaguacuccuccuccucuuaagauuuu

SEQ ID NO: 492667 - RNA, 64 nt, Homo Sapiens; identical to SEQ ID NO: 77020

SEQ ID NO: 492668 - RNA, 64 nt, Homo Sapiens; identical to SEQ ID NO: 77021

SEQ ID NO: 492669 - RNA, 64 nt, Homo Sapiens; identical to SEQ ID NO: 77022

SEQ ID NO: 492670 - RNA, 64 nt, Homo Sapiens; identical to SEQ ID NO: 77023

SEQ ID NO: 492671 - RNA, 64 nt, Homo Sapiens; identical to SEQ ID NO: 77024

SEQ ID NO: 492672 - RNA, 64 nt, Homo Sapiens; identical to SEQ ID NO: 77025

SEQ ID NO: 492673 - RNA, 64 nt, Homo Sapiens; identical to SEQ ID NO: 77026

SEQ ID NO: 492674 - RNA, 64 nt, Homo Sapiens; identical to SEQ ID NO: 77027

SEQ ID NO: 492675 - RNA, 64 nt, Homo Sapiens; identical to SEQ ID NO: 77028

SEQ ID NO: 492676 - RNA, 64 nt, Homo Sapiens; identical to SEQ ID NO: 77029

SEQ ID NO: 492677 - RNA, 64 nt, Homo Sapiens; identical to SEQ ID NO: 77030

SEQ ID NO: 492678 - RNA, 64 nt, Homo Sapiens; identical to SEQ ID NO: 77031

SEQ ID NO: 492679 - RNA, 64 nt, Homo Sapiens
cucccgcaaugggcagagagagcagagacagguggaccaacagacagcuggccccuggaggcag

SEQ ID NO: 492680 - RNA, 64 nt, Homo Sapiens
gaauguagggcccccagccucaccucugccccaggaccaacaacacccugguuuggagcuggga

SEQ ID NO: 492681 - RNA, 64 nt, Homo Sapiens
gagaaaccucgucucuacuauucuagaccagccugaccaacaugggaucaccugaggucaggag

SEQ ID NO: 492682 - RNA, 57 nt, Homo Sapiens
acugaggaagauagagugguacaagcagaccaacaacacauuguugaguggcacuga

SEQ ID NO: 492683 - RNA, 61 nt, Homo Sapiens
ugcggagcuggagccguagauuccgugccugccgccgcagcgccgccgacaacgcgggugc

SEQ ID NO: 492684 - RNA, 61 nt, Homo Sapiens
ugccaacucacugagccgccugccgcuggggccgccgcacccugcaccuuggaccggcauc

SEQ ID NO: 492685 - RNA, 61 nt, Homo Sapiens
acugaccccaucuccugccgccgcccuggggccgccgcagggaugccuugccuuuucagga

SEQ ID NO: 492686 - RNA, 61 nt, Homo Sapiens
ccuguccagcuguugagcugccccgucuccgccgccgcaccuuccuuccccuccacccucg

SEQ ID NO: 492687 - RNA, 61 nt, Homo Sapiens
ugugcucagaggugguuguuggcggagaacgccgccgcaguguuugaccucuagcggugaa

SEQ ID NO: 492688 - RNA, 61 nt, Homo Sapiens
caggggcugccccggaaucagcuccccggggccgccgcaacgaagguggauccgcaucuug

SEQ ID NO: 492689 - RNA, 61 nt, Homo Sapiens
ggcugccuagcccuccccccagcucccugcaccgccgcagaagcagccccucgaggccuac

SEQ ID NO: 492690 - RNA, 61 nt, Homo Sapiens
cgcccuauucagcaccagcuccuugaagcgcccgccgcacauccggucccgcuuccaguuu

SEQ ID NO: 492691 - RNA, 61 nt, Homo Sapiens
caugcguguggaguguccgguggugcucgggccgccgcagugcagcgacugcccggcccuc

SEQ ID NO: 492692 - RNA, 61 nt, Homo Sapiens
caguguguuccuucaggcuacccgggguuucccgccgcacucuggaacccacugagcccuu

SEQ ID NO: 492693 - RNA, 61 nt, Homo Sapiens
ugcguuugcuuuggaccuuggccgguggcucccgccgcagucuccaccgcccgaggccugc

SEQ ID NO: 492694 - RNA, 61 nt, Homo Sapiens
agccaccccaaagcccuccuggccgcuguguccgccgcaccaagcccugugcuccggccau

SEQ ID NO: 492695 - RNA, 61 nt, Homo Sapiens
cuaaaaagcagacccaaguuuccuuucuccuccgccgcaaaggagaggcuucccagccccg

SEQ ID NO: 492696 - RNA, 61 nt, Homo Sapiens
auguauauagcgaccagagcauucuuaauucccgccgcagaccuggcgcccccgccuuggc

SEQ ID NO: 492697 - RNA, 61 nt, Homo Sapiens
uguuuucuguucuguuguuuuaaaacaaaucccgccgcaacuaccuacuuguacguacaug

SEQ ID NO: 492698 - RNA, 55 nt, Homo Sapiens
acgcgggccggcggccggagccgccccgccgcacccgugccaguacaacagcuga

SEQ ID NO: 492699 - RNA, 61 nt, Homo Sapiens
cuugcuggagccgggucgggugaggaggucuccgccgcagcgucugaggaaaccuccaggc

SEQ ID NO: 492700 - RNA, 61 nt, Homo Sapiens
agcugauuugcugcagggauggagaggaccaccgccgcaggguucuuuuaccugugccacc

SEQ ID NO: 492701 - RNA, 60 nt, Homo Sapiens
ccgaggccgccaauuguccggcgcccgcacccgccgcaccugcucuggcccagccgcuga

SEQ ID NO: 492702 - RNA, 61 nt, Homo Sapiens
cacgcgcgccugcgugcggggagcuugcugcccgccgcacgaaggagcgcaccaaagcgca

SEQ ID NO: 492703 - RNA, 61 nt, Homo Sapiens
gugaggagcucacagguccucccugguggucccgccgcaccucugcaucuccugggcguca

SEQ ID NO: 492704 - RNA, 61 nt, Homo Sapiens
cuuauggagccccucccauggagcucucuucccgccgcacuuucuaccccgggcagaggcg

SEQ ID NO: 492705 - RNA, 61 nt, Homo Sapiens
uccugugacggcggcgaggcuugggaggaaaccgccgcaaugggggugucuucccucgggg

SEQ ID NO: 492706 - RNA, 61 nt, Homo Sapiens
ugggcucaggaagccccaggccaggguggggccgccgcagaagcugcacucagcaccuagg

SEQ ID NO: 492707 - RNA, 50 nt, Homo Sapiens
ccaagcucgacgccaaguagccgccgcacuuuccagcagggaucggagga

SEQ ID NO: 492708 - RNA, 61 nt, Homo Sapiens
acucgcagccccaucggacgcucucccgggaccgccgcaggaccaguuuccauagacugcg

SEQ ID NO: 492709 - RNA, 61 nt, Homo Sapiens
gcccgcgccuccgaggggacugcgccgcuucccgccgcagcuugggggggaagacccucgc

SEQ ID NO: 492710 - RNA, 61 nt, Homo Sapiens
aaaagcauaacuggcuaagucaccgccccacccgccgcauuacauuuccuaaaacauacug

SEQ ID NO: 492711 - RNA, 61 nt, Homo Sapiens
cgagcgcccgaacuggccaggacccccgcgcccgccgcacagcgcgcagccgggcgcucaa

SEQ ID NO: 492712 - RNA, 61 nt, Homo Sapiens
gacaucaccgccaagcucugauggacaucugccgccgcaucagaaagccaugaagguggau

SEQ ID NO: 492713 - RNA, 61 nt, Homo Sapiens
cuucacagcuggccacaacgggggcuucagcccgccgcagacuggugcagcggcagaugcu

SEQ ID NO: 492714 - RNA, 61 nt, Homo Sapiens
cucccugugcgugugcgucucugccuuccguccgccgcacacccgccugccuggccgcagg

SEQ ID NO: 492715 - RNA, 61 nt, Homo Sapiens
aaggagcaguccccugcuauacuccaccugcccgccgcaggaaugacgaagcugcucagca

SEQ ID NO: 492716 - RNA, 55 nt, Homo Sapiens
ucaagccuugcgugaugugaggcugccgccgcaggcccuccuggugcaggcaggc

SEQ ID NO: 492717 - RNA, 61 nt, Homo Sapiens
ugguugggggcaccaucuggcccagaucaugccgccgcagccccaugcccuggaccagccg

SEQ ID NO: 492718 - RNA, 61 nt, Homo Sapiens
cuacauuucuagaguuagaguuuuagacuuuccgccgcagauccugcuacagcuagugugc

SEQ ID NO: 492719 - RNA, 61 nt, Homo Sapiens
ggaaccagcccuacauccgcgcagacacaggccgccgcagugcccgucggcgucccccggg

SEQ ID NO: 492720 - RNA, 61 nt, Homo Sapiens
ucaccuggagcugggcacuaaccauuccaagccgccgcaucgcuuguuuccaccuccuggg

SEQ ID NO: 492721 - RNA, 61 nt, Homo Sapiens
cucacacugacgggggcucccuucaguggcuccgccgcaucgaguucagcugugacguuag

SEQ ID NO: 492722 - RNA, 61 nt, Homo Sapiens
uuuaaacacugaagugccgaaguggcccgugccgccgcacagagaccccgacuuuaguuug

SEQ ID NO: 492723 - RNA, 61 nt, Homo Sapiens
acuguccccaugcccacggaugcucagcagcccgccgcacuggggcagaugucuccccugc

SEQ ID NO: 492724 - RNA, 61 nt, Homo Sapiens
uccgcagggcgcccagcgccguccggcggccccgccgcagaccagcuggcggguguggaga

SEQ ID NO: 492725 - RNA, 61 nt, Homo Sapiens
cgcagggacagcgcuggggaggugacggcgcccgccgcagguggggcgaggcugggggagg

SEQ ID NO: 492726 - RNA, 61 nt, Homo Sapiens
ggccuucagaggcuccuccugggacugggaaccgccgcagggccaggcggacggcgugagg

SEQ ID NO: 492727 - RNA, 61 nt, Homo Sapiens
cuccuaggaaucacagcuccccguacuggugccgccgcaguggccaaguugcgacacugcc

SEQ ID NO: 492728 - RNA, 61 nt, Homo Sapiens
ggggcccugacgcccaccuccagcuauguucccgccgcagucaagcacugcggccacucag

SEQ ID NO: 492729 - RNA, 61 nt, Homo Sapiens
ccaagauggugucucacucuccuuuuuuuccccgccgcaccgugugagccacagcacccaa

SEQ ID NO: 492730 - RNA, 61 nt, Homo Sapiens
aaggucccugcggccaccacggaagaugccaccgccgcagcucucuggucaucgccuggga

SEQ ID NO: 492731 - RNA, 61 nt, Homo Sapiens
ugggcuggcugcgcggguuuuacgcccgcuaccgccgcaccuccuugccucccacaacaac

SEQ ID NO: 492732 - RNA, 61 nt, Homo Sapiens
gacggggacuggcccucccuugcugcggcgaccgccgcaggccgcugccuuuugcugcugc

SEQ ID NO: 492733 - RNA, 61 nt, Homo Sapiens
cacgcugucugcgcuggcuccacccgggaacccgccgcacgcuguguucuaggcccgccca

SEQ ID NO: 492734 - RNA, 61 nt, Homo Sapiens
cugacggaccacgagggcuggcacagggacuccgccgcacgacuaccgcucugcuacuuag

SEQ ID NO: 492735 - RNA, 64 nt, Homo Sapiens; identical to SEQ ID NO: 60398

SEQ ID NO: 492736 - RNA, 64 nt, Homo Sapiens; identical to SEQ ID NO: 60399

SEQ ID NO: 492737 - RNA, 64 nt, Homo Sapiens; identical to SEQ ID NO: 60400

SEQ ID NO: 492738 - RNA, 64 nt, Homo Sapiens; identical to SEQ ID NO: 60401

SEQ ID NO: 492739 - RNA, 64 nt, Homo Sapiens; identical to SEQ ID NO: 60402

SEQ ID NO: 492740 - RNA, 64 nt, Homo Sapiens; identical to SEQ ID NO: 60403

SEQ ID NO: 492741 - RNA, 64 nt, Homo Sapiens; identical to SEQ ID NO: 60404

SEQ ID NO: 492742 - RNA, 64 nt, Homo Sapiens; identical to SEQ ID NO: 60405

SEQ ID NO: 492743 - RNA, 64 nt, Homo Sapiens; identical to SEQ ID NO: 60406

SEQ ID NO: 492744 - RNA, 64 nt, Homo Sapiens; identical to SEQ ID NO: 60407

SEQ ID NO: 492745 - RNA, 64 nt, Homo Sapiens; identical to SEQ ID NO: 60408

SEQ ID NO: 492746 - RNA, 64 nt, Homo Sapiens; identical to SEQ ID NO: 60409

SEQ ID NO: 492747 - RNA, 64 nt, Homo Sapiens; identical to SEQ ID NO: 60410

SEQ ID NO: 492748 - RNA, 64 nt, Homo Sapiens; identical to SEQ ID NO: 60411

SEQ ID NO: 492749 - RNA, 64 nt, Homo Sapiens; identical to SEQ ID NO: 60412

SEQ ID NO: 492750 - RNA, 64 nt, Homo Sapiens; identical to SEQ ID NO: 60413

SEQ ID NO: 492751 - RNA, 64 nt, Homo Sapiens; identical to SEQ ID NO: 60414

SEQ ID NO: 492752 - RNA, 64 nt, Homo Sapiens; identical to SEQ ID NO: 60415

SEQ ID NO: 492753 - RNA, 64 nt, Homo Sapiens; identical to SEQ ID NO: 60416

SEQ ID NO: 492754 - RNA, 64 nt, Homo Sapiens; identical to SEQ ID NO: 60417

SEQ ID NO: 492755 - RNA, 64 nt, Homo Sapiens; identical to SEQ ID NO: 60418

SEQ ID NO: 492756 - RNA, 64 nt, Homo Sapiens; identical to SEQ ID NO: 60419

SEQ ID NO: 492757 - RNA, 64 nt, Homo Sapiens; identical to SEQ ID NO: 60420

SEQ ID NO: 492758 - RNA, 64 nt, Homo Sapiens; identical to SEQ ID NO: 60421

SEQ ID NO: 492759 - RNA, 64 nt, Homo Sapiens; identical to SEQ ID NO: 60422

SEQ ID NO: 492760 - RNA, 64 nt, Homo Sapiens; identical to SEQ ID NO: 60423

SEQ ID NO: 492761 - RNA, 64 nt, Homo Sapiens; identical to SEQ ID NO: 60424

SEQ ID NO: 492762 - RNA, 64 nt, Homo Sapiens; identical to SEQ ID NO: 60425

SEQ ID NO: 492763 - RNA, 64 nt, Homo Sapiens; identical to SEQ ID NO: 60426

SEQ ID NO: 492764 - RNA, 64 nt, Homo Sapiens; identical to SEQ ID NO: 60427

SEQ ID NO: 492765 - RNA, 64 nt, Homo Sapiens; identical to SEQ ID NO: 60428

SEQ ID NO: 492766 - RNA, 64 nt, Homo Sapiens; identical to SEQ ID NO: 60429

SEQ ID NO: 492767 - RNA, 64 nt, Homo Sapiens; identical to SEQ ID NO: 60430

SEQ ID NO: 492768 - RNA, 64 nt, Homo Sapiens; identical to SEQ ID NO: 60431

SEQ ID NO: 492769 - RNA, 64 nt, Homo Sapiens; identical to SEQ ID NO: 60432

SEQ ID NO: 492770 - RNA, 64 nt, Homo Sapiens; identical to SEQ ID NO: 60433

SEQ ID NO: 492771 - RNA, 64 nt, Homo Sapiens; identical to SEQ ID NO: 60434

SEQ ID NO: 492772 - RNA, 64 nt, Homo Sapiens; identical to SEQ ID NO: 60435

SEQ ID NO: 492773 - RNA, 64 nt, Homo Sapiens; identical to SEQ ID NO: 60436

SEQ ID NO: 492774 - RNA, 64 nt, Homo Sapiens; identical to SEQ ID NO: 60437

SEQ ID NO: 492775 - RNA, 64 nt, Homo Sapiens; identical to SEQ ID NO: 60438

SEQ ID NO: 492776 - RNA, 64 nt, Homo Sapiens; identical to SEQ ID NO: 60439

SEQ ID NO: 492777 - RNA, 64 nt, Homo Sapiens; identical to SEQ ID NO: 60440

SEQ ID NO: 492778 - RNA, 64 nt, Homo Sapiens; identical to SEQ ID NO: 60441

SEQ ID NO: 492779 - RNA, 64 nt, Homo Sapiens; identical to SEQ ID NO: 60442

SEQ ID NO: 492780 - RNA, 64 nt, Homo Sapiens; identical to SEQ ID NO: 60443

SEQ ID NO: 492781 - RNA, 64 nt, Homo Sapiens; identical to SEQ ID NO: 60444

SEQ ID NO: 492782 - RNA, 64 nt, Homo Sapiens; identical to SEQ ID NO: 60445

SEQ ID NO: 492783 - RNA, 64 nt, Homo Sapiens; identical to SEQ ID NO: 60446

SEQ ID NO: 492784 - RNA, 64 nt, Homo Sapiens; identical to SEQ ID NO: 60447

SEQ ID NO: 492785 - RNA, 64 nt, Homo Sapiens; identical to SEQ ID NO: 55930

SEQ ID NO: 492786 - RNA, 64 nt, Homo Sapiens; identical to SEQ ID NO: 55931

SEQ ID NO: 492787 - RNA, 64 nt, Homo Sapiens; identical to SEQ ID NO: 55932

SEQ ID NO: 492788 - RNA, 64 nt, Homo Sapiens; identical to SEQ ID NO: 55933

SEQ ID NO: 492789 - RNA, 64 nt, Homo Sapiens; identical to SEQ ID NO: 55934

SEQ ID NO: 492790 - RNA, 64 nt, Homo Sapiens; identical to SEQ ID NO: 55935

SEQ ID NO: 492791 - RNA, 64 nt, Homo Sapiens; identical to SEQ ID NO: 55936

SEQ ID NO: 492792 - RNA, 64 nt, Homo Sapiens; identical to SEQ ID NO: 55937

SEQ ID NO: 492793 - RNA, 64 nt, Homo Sapiens; identical to SEQ ID NO: 55938

SEQ ID NO: 492794 - RNA, 64 nt, Homo Sapiens; identical to SEQ ID NO: 55939

SEQ ID NO: 492795 - RNA, 64 nt, Homo Sapiens; identical to SEQ ID NO: 55940

SEQ ID NO: 492796 - RNA, 64 nt, Homo Sapiens; identical to SEQ ID NO: 55941

SEQ ID NO: 492797 - RNA, 64 nt, Homo Sapiens; identical to SEQ ID NO: 55942

SEQ ID NO: 492798 - RNA, 64 nt, Homo Sapiens; identical to SEQ ID NO: 55943

SEQ ID NO: 492799 - RNA, 64 nt, Homo Sapiens; identical to SEQ ID NO: 55944

SEQ ID NO: 492800 - RNA, 64 nt, Homo Sapiens; identical to SEQ ID NO: 55945

SEQ ID NO: 492801 - RNA, 64 nt, Homo Sapiens; identical to SEQ ID NO: 55946

SEQ ID NO: 492802 - RNA, 64 nt, Homo Sapiens; identical to SEQ ID NO: 55947

SEQ ID NO: 492803 - RNA, 64 nt, Homo Sapiens; identical to SEQ ID NO: 55948

SEQ ID NO: 492804 - RNA, 64 nt, Homo Sapiens; identical to SEQ ID NO: 55949

SEQ ID NO: 492805 - RNA, 64 nt, Homo Sapiens; identical to SEQ ID NO: 55950

SEQ ID NO: 492806 - RNA, 64 nt, Homo Sapiens; identical to SEQ ID NO: 55951

SEQ ID NO: 492807 - RNA, 64 nt, Homo Sapiens; identical to SEQ ID NO: 55952

SEQ ID NO: 492808 - RNA, 64 nt, Homo Sapiens; identical to SEQ ID NO: 55953

SEQ ID NO: 492809 - RNA, 64 nt, Homo Sapiens; identical to SEQ ID NO: 55954

SEQ ID NO: 492810 - RNA, 64 nt, Homo Sapiens; identical to SEQ ID NO: 55955

SEQ ID NO: 492811 - RNA, 64 nt, Homo Sapiens; identical to SEQ ID NO: 55956

SEQ ID NO: 492812 - RNA, 64 nt, Homo Sapiens; identical to SEQ ID NO: 55957

SEQ ID NO: 492813 - RNA, 64 nt, Homo Sapiens; identical to SEQ ID NO: 55958

SEQ ID NO: 492814 - RNA, 64 nt, Homo Sapiens; identical to SEQ ID NO: 55959

SEQ ID NO: 492815 - RNA, 64 nt, Homo Sapiens; identical to SEQ ID NO: 55960

SEQ ID NO: 492816 - RNA, 64 nt, Homo Sapiens; identical to SEQ ID NO: 295086

SEQ ID NO: 492817 - RNA, 64 nt, Homo Sapiens; identical to SEQ ID NO: 295087

SEQ ID NO: 492818 - RNA, 64 nt, Homo Sapiens; identical to SEQ ID NO: 295088

SEQ ID NO: 492819 - RNA, 64 nt, Homo Sapiens; identical to SEQ ID NO: 295089

SEQ ID NO: 492820 - RNA, 64 nt, Homo Sapiens; identical to SEQ ID NO: 295090

SEQ ID NO: 492821 - RNA, 64 nt, Homo Sapiens; identical to SEQ ID NO: 295091

SEQ ID NO: 492822 - RNA, 64 nt, Homo Sapiens; identical to SEQ ID NO: 295092

SEQ ID NO: 492823 - RNA, 64 nt, Homo Sapiens; identical to SEQ ID NO: 295093

SEQ ID NO: 492824 - RNA, 64 nt, Homo Sapiens; identical to SEQ ID NO: 295094

SEQ ID NO: 492825 - RNA, 64 nt, Homo Sapiens; identical to SEQ ID NO: 295095

SEQ ID NO: 492826 - RNA, 64 nt, Homo Sapiens; identical to SEQ ID NO: 295096

SEQ ID NO: 492827 - RNA, 64 nt, Homo Sapiens; identical to SEQ ID NO: 295097

SEQ ID NO: 492828 - RNA, 64 nt, Homo Sapiens; identical to SEQ ID NO: 295098

SEQ ID NO: 492829 - RNA, 64 nt, Homo Sapiens; identical to SEQ ID NO: 295099

SEQ ID NO: 492830 - RNA, 64 nt, Homo Sapiens; identical to SEQ ID NO: 295100

SEQ ID NO: 492831 - RNA, 64 nt, Homo Sapiens; identical to SEQ ID NO: 295101

SEQ ID NO: 492832 - RNA, 64 nt, Homo Sapiens; identical to SEQ ID NO: 295102

SEQ ID NO: 492833 - RNA, 64 nt, Homo Sapiens; identical to SEQ ID NO: 295103

SEQ ID NO: 492834 - RNA, 64 nt, Homo Sapiens; identical to SEQ ID NO: 295104

SEQ ID NO: 492835 - RNA, 64 nt, Homo Sapiens; identical to SEQ ID NO: 295105

SEQ ID NO: 492836 - RNA, 64 nt, Homo Sapiens; identical to SEQ ID NO: 295106

SEQ ID NO: 492837 - RNA, 64 nt, Homo Sapiens; identical to SEQ ID NO: 295107

SEQ ID NO: 492838 - RNA, 64 nt, Homo Sapiens; identical to SEQ ID NO: 295108

SEQ ID NO: 492839 - RNA, 64 nt, Homo Sapiens; identical to SEQ ID NO: 295109

SEQ ID NO: 492840 - RNA, 64 nt, Homo Sapiens; identical to SEQ ID NO: 295110

SEQ ID NO: 492841 - RNA, 64 nt, Homo Sapiens; identical to SEQ ID NO: 295111

SEQ ID NO: 492842 - RNA, 64 nt, Homo Sapiens; identical to SEQ ID NO: 295112

SEQ ID NO: 492843 - RNA, 64 nt, Homo Sapiens; identical to SEQ ID NO: 295113

SEQ ID NO: 492844 - RNA, 64 nt, Homo Sapiens; identical to SEQ ID NO: 295114

SEQ ID NO: 492845 - RNA, 64 nt, Homo Sapiens; identical to SEQ ID NO: 295115

SEQ ID NO: 492846 - RNA, 64 nt, Homo Sapiens; identical to SEQ ID NO: 295116

SEQ ID NO: 492847 - RNA, 64 nt, Homo Sapiens; identical to SEQ ID NO: 295117

SEQ ID NO: 492848 - RNA, 64 nt, Homo Sapiens; identical to SEQ ID NO: 295118

SEQ ID NO: 492849 - RNA, 64 nt, Homo Sapiens; identical to SEQ ID NO: 295119

SEQ ID NO: 492850 - RNA, 64 nt, Homo Sapiens
aauacaagccuuggguccauacaaguuuguggaaaugcaagauggauuauucuaaucuaauaag

SEQ ID NO: 492851 - RNA, 64 nt, Homo Sapiens
agcaauucgucaguuucacuuucuuauucagauaaugcaagagagagguaggaaagagaagaug

SEQ ID NO: 492852 - RNA, 64 nt, Homo Sapiens
uuggcaggcucguuguaccucuuggaaaaccucaaugcaagauaguguuucagugcuggcauau

SEQ ID NO: 492853 - RNA, 64 nt, Homo Sapiens
auguccaguuuauacaguuuacaaaauauagcagaugcaagauuaugggggaaauccuauauuc

SEQ ID NO: 492854 - RNA, 64 nt, Homo Sapiens
aucuucuggugaaggaaauuaaugauguaagaaaaugcaagaggcucaacuucucuuccaaaaa

SEQ ID NO: 492855 - RNA, 64 nt, Homo Sapiens
uucucacauucuagacaaugauggacaaagacgcaugcaagacucagacccggggaauggugug

SEQ ID NO: 492856 - RNA, 64 nt, Homo Sapiens
uggaaauuuuucuaugguagguuuuuacaucauaaugcaagaaucaaaaucuguacaaaaaucu

SEQ ID NO: 492857 - RNA, 64 nt, Homo Sapiens
gauuuucuguuacauucaaucuugaaaaaaaaaaaugcaagaguuguagggggcauagaggauu

SEQ ID NO: 492858 - RNA, 64 nt, Homo Sapiens
ccugccaugaugagugugaagaaaucauuucucuaugcaagacuggcauccugggacugcacga

SEQ ID NO: 492859 - RNA, 64 nt, Homo Sapiens
cugccauaagcgugcuuucauuuucaaguagcauaugcaagaguccaaacaggcuacccaaugu

SEQ ID NO: 492860 - RNA, 64 nt, Homo Sapiens
auuacuuuuauuauauuguuuacaaauauauuucaugcaagaaacagaaaaaaaaaaaaacccu

SEQ ID NO: 492861 - RNA, 64 nt, Homo Sapiens
agauaaacuauaggauagauagaaugguuauuuuaugcaagaaauauuguaccgcaaggguggu

SEQ ID NO: 492862 - RNA, 64 nt, Homo Sapiens
cuauuugcuguaaugucaagaaaauguucaccagaugcaagaauguaccuuuucuuuuuagaaa

SEQ ID NO: 492863 - RNA, 64 nt, Homo Sapiens; identical to SEQ ID NO: 247253

SEQ ID NO: 492864 - RNA, 64 nt, Homo Sapiens; identical to SEQ ID NO: 247254

SEQ ID NO: 492865 - RNA, 64 nt, Homo Sapiens; identical to SEQ ID NO: 247255

SEQ ID NO: 492866 - RNA, 64 nt, Homo Sapiens; identical to SEQ ID NO: 247256

SEQ ID NO: 492867 - RNA, 64 nt, Homo Sapiens; identical to SEQ ID NO: 247257

SEQ ID NO: 492868 - RNA, 64 nt, Homo Sapiens; identical to SEQ ID NO: 247258

SEQ ID NO: 492869 - RNA, 64 nt, Homo Sapiens; identical to SEQ ID NO: 247259

SEQ ID NO: 492870 - RNA, 64 nt, Homo Sapiens; identical to SEQ ID NO: 247260

SEQ ID NO: 492871 - RNA, 64 nt, Homo Sapiens; identical to SEQ ID NO: 247261

SEQ ID NO: 492872 - RNA, 64 nt, Homo Sapiens; identical to SEQ ID NO: 247262

SEQ ID NO: 492873 - RNA, 64 nt, Homo Sapiens; identical to SEQ ID NO: 247263

SEQ ID NO: 492874 - RNA, 64 nt, Homo Sapiens; identical to SEQ ID NO: 247264

SEQ ID NO: 492875 - RNA, 64 nt, Homo Sapiens; identical to SEQ ID NO: 247265

SEQ ID NO: 492876 - RNA, 64 nt, Homo Sapiens; identical to SEQ ID NO: 247266

SEQ ID NO: 492877 - RNA, 64 nt, Homo Sapiens; identical to SEQ ID NO: 247267

SEQ ID NO: 492878 - RNA, 58 nt, Homo Sapiens; identical to SEQ ID NO: 199452

SEQ ID NO: 492879 - RNA, 64 nt, Homo Sapiens; identical to SEQ ID NO: 247269

SEQ ID NO: 492880 - RNA, 64 nt, Homo Sapiens; identical to SEQ ID NO: 247270

SEQ ID NO: 492881 - RNA, 64 nt, Homo Sapiens; identical to SEQ ID NO: 247271

SEQ ID NO: 492882 - RNA, 64 nt, Homo Sapiens; identical to SEQ ID NO: 247272

SEQ ID NO: 492883 - RNA, 55 nt, Homo Sapiens; identical to SEQ ID NO: 199457

SEQ ID NO: 492884 - RNA, 64 nt, Homo Sapiens; identical to SEQ ID NO: 247274

SEQ ID NO: 492885 - RNA, 64 nt, Homo Sapiens
uagaccgcuuuauaggcuucaagguacauaaacacauaaacaugaauauauucaaauguauuac

SEQ ID NO: 492886 - RNA, 64 nt, Homo Sapiens
uaaacauguagaccgcuuuauguauuacaagguacauaaacacaaaaauuaaaauauauucaaa

SEQ ID NO: 492887 - RNA, 64 nt, Homo Sapiens
uaaacuagagccuuaagucaaucucagaagguagcauaaacaaauaaaaauuaacuguauggca

SEQ ID NO: 492888 - RNA, 64 nt, Homo Sapiens
uucuuacaagaggcagaaacaagacaggcuaguucauaaacaaacuguguaacuucucaaaaug

SEQ ID NO: 492889 - RNA, 64 nt, Homo Sapiens
aucuaucaaauggguuaccuuauucuaucguauucauaaacaaucaguuuaaaaaguaaauaua

SEQ ID NO: 492890 - RNA, 64 nt, Homo Sapiens
guguauugcagugcauuucgcgguuguuuuuaggcauaaacaauuuuuacaucauuucuauguu

SEQ ID NO: 492891 - RNA, 64 nt, Homo Sapiens
cgguuugaccccugaccuauaagccaagauaccccauaaacacacucagaaagcagagaaaaag

SEQ ID NO: 492892 - RNA, 64 nt, Homo Sapiens
ccccagguugugacaggugcagguagacaacgcccauaaacagagaugguccugaacucuggag

SEQ ID NO: 492893 - RNA, 64 nt, Homo Sapiens
gauaucaugaucacaggugauucacacguacacacauaaacacacccaccagugcagccugaag

SEQ ID NO: 492894 - RNA, 64 nt, Homo Sapiens
uaacauucaauagguaaacaucuaaagagcucuacauaaacaggaaggcuuuucuuuuauuaca

SEQ ID NO: 492895 - RNA, 64 nt, Homo Sapiens
gaguguagagugaaaacacuucaggcuauucauucauaaacacaaacagauauagugacauagc

SEQ ID NO: 492896 - RNA, 64 nt, Homo Sapiens
aaugacucucugacccucuguuauuacucucacccauaaacaguuguacuuguuucaucugguu

SEQ ID NO: 492897 - RNA, 64 nt, Homo Sapiens
ucaugccuuucauaguuuauggucucauguaacacauaaacaauuaaccaacaauauaaaccgu

SEQ ID NO: 492898 - RNA, 64 nt, Homo Sapiens; identical to SEQ ID NO: 132617

SEQ ID NO: 492899 - RNA, 64 nt, Homo Sapiens; identical to SEQ ID NO: 132618

SEQ ID NO: 492900 - RNA, 64 nt, Homo Sapiens; identical to SEQ ID NO: 132619

SEQ ID NO: 492901 - RNA, 64 nt, Homo Sapiens; identical to SEQ ID NO: 132620

SEQ ID NO: 492902 - RNA, 64 nt, Homo Sapiens; identical to SEQ ID NO: 132621

SEQ ID NO: 492903 - RNA, 64 nt, Homo Sapiens; identical to SEQ ID NO: 132622

SEQ ID NO: 492904 - RNA, 64 nt, Homo Sapiens; identical to SEQ ID NO: 132623

SEQ ID NO: 492905 - RNA, 64 nt, Homo Sapiens; identical to SEQ ID NO: 132624

SEQ ID NO: 492906 - RNA, 64 nt, Homo Sapiens; identical to SEQ ID NO: 132625

SEQ ID NO: 492907 - RNA, 64 nt, Homo Sapiens; identical to SEQ ID NO: 132626

SEQ ID NO: 492908 - RNA, 64 nt, Homo Sapiens; identical to SEQ ID NO: 132627

SEQ ID NO: 492909 - RNA, 64 nt, Homo Sapiens; identical to SEQ ID NO: 132628

SEQ ID NO: 492910 - RNA, 64 nt, Homo Sapiens; identical to SEQ ID NO: 132629

SEQ ID NO: 492911 - RNA, 64 nt, Homo Sapiens; identical to SEQ ID NO: 132630

SEQ ID NO: 492912 - RNA, 64 nt, Homo Sapiens; identical to SEQ ID NO: 132631

SEQ ID NO: 492913 - RNA, 64 nt, Homo Sapiens; identical to SEQ ID NO: 132632

SEQ ID NO: 492914 - RNA, 64 nt, Homo Sapiens; identical to SEQ ID NO: 132633

SEQ ID NO: 492915 - RNA, 64 nt, Homo Sapiens; identical to SEQ ID NO: 132634

SEQ ID NO: 492916 - RNA, 64 nt, Homo Sapiens; identical to SEQ ID NO: 132635

SEQ ID NO: 492917 - RNA, 64 nt, Homo Sapiens; identical to SEQ ID NO: 132636

SEQ ID NO: 492918 - RNA, 64 nt, Homo Sapiens; identical to SEQ ID NO: 132637

SEQ ID NO: 492919 - RNA, 64 nt, Homo Sapiens; identical to SEQ ID NO: 132638

SEQ ID NO: 492920 - RNA, 64 nt, Homo Sapiens; identical to SEQ ID NO: 132639

SEQ ID NO: 492921 - RNA, 64 nt, Homo Sapiens; identical to SEQ ID NO: 132640

SEQ ID NO: 492922 - RNA, 64 nt, Homo Sapiens; identical to SEQ ID NO: 132641

SEQ ID NO: 492923 - RNA, 64 nt, Homo Sapiens; identical to SEQ ID NO: 132642

SEQ ID NO: 492924 - RNA, 64 nt, Homo Sapiens; identical to SEQ ID NO: 132643

SEQ ID NO: 492925 - RNA, 64 nt, Homo Sapiens; identical to SEQ ID NO: 132644

SEQ ID NO: 492926 - RNA, 64 nt, Homo Sapiens; identical to SEQ ID NO: 132645

SEQ ID NO: 492927 - RNA, 64 nt, Homo Sapiens; identical to SEQ ID NO: 132646

SEQ ID NO: 492928 - RNA, 64 nt, Homo Sapiens; identical to SEQ ID NO: 132647

SEQ ID NO: 492929 - RNA, 64 nt, Homo Sapiens; identical to SEQ ID NO: 132648

SEQ ID NO: 492930 - RNA, 64 nt, Homo Sapiens; identical to SEQ ID NO: 132649

SEQ ID NO: 492931 - RNA, 64 nt, Homo Sapiens; identical to SEQ ID NO: 132650

SEQ ID NO: 492932 - RNA, 64 nt, Homo Sapiens; identical to SEQ ID NO: 132651

SEQ ID NO: 492933 - RNA, 64 nt, Homo Sapiens; identical to SEQ ID NO: 132652

SEQ ID NO: 492934 - RNA, 64 nt, Homo Sapiens; identical to SEQ ID NO: 132653

SEQ ID NO: 492935 - RNA, 64 nt, Homo Sapiens; identical to SEQ ID NO: 132654

SEQ ID NO: 492936 - RNA, 64 nt, Homo Sapiens; identical to SEQ ID NO: 132655

SEQ ID NO: 492937 - RNA, 64 nt, Homo Sapiens; identical to SEQ ID NO: 132656

SEQ ID NO: 492938 - RNA, 64 nt, Homo Sapiens; identical to SEQ ID NO: 132657

SEQ ID NO: 492939 - RNA, 64 nt, Homo Sapiens; identical to SEQ ID NO: 132658

SEQ ID NO: 492940 - RNA, 64 nt, Homo Sapiens; identical to SEQ ID NO: 132659

SEQ ID NO: 492941 - RNA, 64 nt, Homo Sapiens; identical to SEQ ID NO: 132660

SEQ ID NO: 492942 - RNA, 64 nt, Homo Sapiens; identical to SEQ ID NO: 132661

SEQ ID NO: 492943 - RNA, 64 nt, Homo Sapiens; identical to SEQ ID NO: 132662

SEQ ID NO: 492944 - RNA, 64 nt, Homo Sapiens; identical to SEQ ID NO: 132663

SEQ ID NO: 492945 - RNA, 64 nt, Homo Sapiens; identical to SEQ ID NO: 132664

SEQ ID NO: 492946 - RNA, 64 nt, Homo Sapiens; identical to SEQ ID NO: 132665

SEQ ID NO: 492947 - RNA, 64 nt, Homo Sapiens; identical to SEQ ID NO: 132666

SEQ ID NO: 492948 - RNA, 64 nt, Homo Sapiens; identical to SEQ ID NO: 132667

SEQ ID NO: 492949 - RNA, 64 nt, Homo Sapiens; identical to SEQ ID NO: 132668

SEQ ID NO: 492950 - RNA, 64 nt, Homo Sapiens; identical to SEQ ID NO: 132669

SEQ ID NO: 492951 - RNA, 64 nt, Homo Sapiens; identical to SEQ ID NO: 132670

SEQ ID NO: 492952 - RNA, 64 nt, Homo Sapiens; identical to SEQ ID NO: 132671

SEQ ID NO: 492953 - RNA, 64 nt, Homo Sapiens; identical to SEQ ID NO: 132672

SEQ ID NO: 492954 - RNA, 64 nt, Homo Sapiens; identical to SEQ ID NO: 132673

SEQ ID NO: 492955 - RNA, 64 nt, Homo Sapiens; identical to SEQ ID NO: 132674

SEQ ID NO: 492956 - RNA, 64 nt, Homo Sapiens; identical to SEQ ID NO: 132675

SEQ ID NO: 492957 - RNA, 64 nt, Homo Sapiens; identical to SEQ ID NO: 132676

SEQ ID NO: 492958 - RNA, 64 nt, Homo Sapiens; identical to SEQ ID NO: 132677

SEQ ID NO: 492959 - RNA, 57 nt, Homo Sapiens; identical to SEQ ID NO: 132678

SEQ ID NO: 492960 - RNA, 64 nt, Homo Sapiens; identical to SEQ ID NO: 132679

SEQ ID NO: 492961 - RNA, 64 nt, Homo Sapiens; identical to SEQ ID NO: 132680

SEQ ID NO: 492962 - RNA, 64 nt, Homo Sapiens; identical to SEQ ID NO: 132681

SEQ ID NO: 492963 - RNA, 64 nt, Homo Sapiens; identical to SEQ ID NO: 132682

SEQ ID NO: 492964 - RNA, 64 nt, Homo Sapiens; identical to SEQ ID NO: 132683

SEQ ID NO: 492965 - RNA, 64 nt, Homo Sapiens; identical to SEQ ID NO: 132684

SEQ ID NO: 492966 - RNA, 64 nt, Homo Sapiens; identical to SEQ ID NO: 132685

SEQ ID NO: 492967 - RNA, 64 nt, Homo Sapiens; identical to SEQ ID NO: 132686

SEQ ID NO: 492968 - RNA, 64 nt, Homo Sapiens; identical to SEQ ID NO: 132687

SEQ ID NO: 492969 - RNA, 64 nt, Homo Sapiens; identical to SEQ ID NO: 132688

SEQ ID NO: 492970 - RNA, 64 nt, Homo Sapiens; identical to SEQ ID NO: 132689

SEQ ID NO: 492971 - RNA, 64 nt, Homo Sapiens; identical to SEQ ID NO: 132690

SEQ ID NO: 492972 - RNA, 55 nt, Homo Sapiens; identical to SEQ ID NO: 132691

SEQ ID NO: 492973 - RNA, 64 nt, Homo Sapiens; identical to SEQ ID NO: 132692

SEQ ID NO: 492974 - RNA, 64 nt, Homo Sapiens; identical to SEQ ID NO: 132693

SEQ ID NO: 492975 - RNA, 64 nt, Homo Sapiens; identical to SEQ ID NO: 132694

SEQ ID NO: 492976 - RNA, 64 nt, Homo Sapiens; identical to SEQ ID NO: 132695

SEQ ID NO: 492977 - RNA, 64 nt, Homo Sapiens; identical to SEQ ID NO: 132696

SEQ ID NO: 492978 - RNA, 64 nt, Homo Sapiens; identical to SEQ ID NO: 132697

SEQ ID NO: 492979 - RNA, 64 nt, Homo Sapiens; identical to SEQ ID NO: 132698

SEQ ID NO: 492980 - RNA, 64 nt, Homo Sapiens; identical to SEQ ID NO: 132699

SEQ ID NO: 492981 - RNA, 64 nt, Homo Sapiens; identical to SEQ ID NO: 132700

SEQ ID NO: 492982 - RNA, 64 nt, Homo Sapiens; identical to SEQ ID NO: 132701

SEQ ID NO: 492983 - RNA, 64 nt, Homo Sapiens; identical to SEQ ID NO: 132702

SEQ ID NO: 492984 - RNA, 64 nt, Homo Sapiens; identical to SEQ ID NO: 132703

SEQ ID NO: 492985 - RNA, 64 nt, Homo Sapiens; identical to SEQ ID NO: 132704

SEQ ID NO: 492986 - RNA, 64 nt, Homo Sapiens; identical to SEQ ID NO: 132705

SEQ ID NO: 492987 - RNA, 64 nt, Homo Sapiens; identical to SEQ ID NO: 132706

SEQ ID NO: 492988 - RNA, 64 nt, Homo Sapiens; identical to SEQ ID NO: 132707

SEQ ID NO: 492989 - RNA, 64 nt, Homo Sapiens; identical to SEQ ID NO: 132708

SEQ ID NO: 492990 - RNA, 64 nt, Homo Sapiens; identical to SEQ ID NO: 132709

SEQ ID NO: 492991 - RNA, 64 nt, Homo Sapiens; identical to SEQ ID NO: 132710

SEQ ID NO: 492992 - RNA, 64 nt, Homo Sapiens; identical to SEQ ID NO: 132711

SEQ ID NO: 492993 - RNA, 64 nt, Homo Sapiens; identical to SEQ ID NO: 132712

SEQ ID NO: 492994 - RNA, 64 nt, Homo Sapiens
gccugagccacugugcccagccuuguuugcuuuuuuaacagauaacagugugcucauagaaacu

SEQ ID NO: 492995 - RNA, 64 nt, Homo Sapiens
uggaaaaugaauaagcgguuuucuuaggcacuucuuaacagacaauuggucaaaaugaacucca

SEQ ID NO: 492996 - RNA, 64 nt, Homo Sapiens
uacaagauaaaauuggacuucauuuaguaucuuuuuaacagaauuacuuggaauaaugagauac

SEQ ID NO: 492997 - RNA, 64 nt, Homo Sapiens
cauuuuggaaauuuuuuuaauuuuacaaguacauuuaacagaucauuuauaaagcaggagucca

SEQ ID NO: 492998 - RNA, 64 nt, Homo Sapiens
uuucuguugcauuacgauaauuacgguguacaguuuaacagaguguuguuuuaacagaugccaa

SEQ ID NO: 492999 - RNA, 64 nt, Homo Sapiens
ccaauuacgguguacaguuuaaaguggaguuguuuuaacagaugagagaaaugcuguucguuca

SEQ ID NO: 493000 - RNA, 64 nt, Homo Sapiens
gagcuuuuaccacuagacucaaggaagaauaauuuuaacagacauguauacuccauagaaacua

SEQ ID NO: 493001 - RNA, 64 nt, Homo Sapiens
gguauuuuugaagucuccuuuugucugauagaguuuaacagauauuuaaauuuagugcucagaa

SEQ ID NO: 493002 - RNA, 64 nt, Homo Sapiens
uucuuuuuuuuuuaauugggggaaauaagcacuauuaacagauucagcacuacaaguauuuuga

SEQ ID NO: 493003 - RNA, 64 nt, Homo Sapiens
cacaucugccuuaaaagugcuauguagagauacauuaacagaguuauaauaaaacaguguuuua

SEQ ID NO: 493004 - RNA, 64 nt, Homo Sapiens
uauguguugaaguaacagcuugugcccgagaaacuuaacagaugaguucuugaaucugggauga

SEQ ID NO: 493005 - RNA, 64 nt, Homo Sapiens
caggcagucuguggccuccuguagcagggcgcucuuaacagacucagguguaagguuuggaucc

SEQ ID NO: 493006 - RNA, 64 nt, Homo Sapiens
gaaaaaaaaaagucuuguugugcauauuuaagaguuaacagaauccuccauuuuugccuucgaa

SEQ ID NO: 493007 - RNA, 64 nt, Homo Sapiens
uuucuacagauacauuuuuugacauauuuucuguuuaacagaacuuagaugaaucagugcccaa

SEQ ID NO: 493008 - RNA, 64 nt, Homo Sapiens
uuuguccuaacucagauuuugugagcagugaaguuuaacagagcagugacauuuaacaaagcag

SEQ ID NO: 493009 - RNA, 64 nt, Homo Sapiens
aacagagcagugacauuuaacaaagcagugaaguuuaacagaguucugagaauaccaugaaaga

SEQ ID NO: 493010 - RNA, 64 nt, Homo Sapiens
agcaagauccaaauugauuuugggauauuaaaaguuaacagaacacugaacaaggaaagaaugg

SEQ ID NO: 493011 - RNA, 64 nt, Homo Sapiens
aauaucuuuuauguccucuagauaaaacacccgauuaacagauguuaaaccuuuuaauguuuug

SEQ ID NO: 493012 - RNA, 64 nt, Homo Sapiens
aaauguaaguuauguguuaaauuuagugcaagcuuuaacagacuaaguugcuaaccucaauuua

SEQ ID NO: 493013 - RNA, 64 nt, Homo Sapiens
cuuuaacagacuaaguugcuaaccucaauuuauguuaacagaugauccauuugaacaguuggcu

SEQ ID NO: 493014 - RNA, 64 nt, Homo Sapiens
caaaaauauauauauauauuaaauaccaccauccuuaacagaaacaggaaaaccaguauuaagc

SEQ ID NO: 493015 - RNA, 64 nt, Homo Sapiens
auauuuauccagacucaguauguauugauuacacuuaacagaucaggcugaacagaagggcuag

SEQ ID NO: 493016 - RNA, 64 nt, Homo Sapiens
uccauaucaccccaaaugauagcagauucccagauuaacagauucccuauccccaaccccucag

SEQ ID NO: 493017 - RNA, 64 nt, Homo Sapiens
cucccauaauaacccccaaauugaggccccauuauuaacagauauguuagccagcccucgauca

SEQ ID NO: 493018 - RNA, 64 nt, Homo Sapiens
acaucacaggugauguccuguucacauaccugcuuguauuuaaagcccucagucuguccuguug

SEQ ID NO: 493019 - RNA, 64 nt, Homo Sapiens
cgcaagacgugcugacacagugaguuuucucugauguauuuaaggugauguauuugcuugaguu

SEQ ID NO: 493020 - RNA, 64 nt, Homo Sapiens
uuccuuugggacuaaguuauaguuauggugaguguguauuuacuguaguuuugccugaucucac

SEQ ID NO: 493021 - RNA, 64 nt, Homo Sapiens
ggaggaugaacuugcugaaaauaaaacuuugcuauguauuuacucuuuuuuaaaagacaaaagc

SEQ ID NO: 493022 - RNA, 64 nt, Homo Sapiens
cuuaagaaaaccaauguucuaaaucauaauuguuuguauuuauguaaaguauggucucuuacuu

SEQ ID NO: 493023 - RNA, 64 nt, Homo Sapiens
uagggcauuuaacaaagaucgcuaugugcaauacuguauuuaguguuucuauuucaauuuuucu

SEQ ID NO: 493024 - RNA, 64 nt, Homo Sapiens
agucagcacacaagugauuuuauuguuauuuuguuguauuuacuugcauuuguuguauuuacuu

SEQ ID NO: 493025 - RNA, 64 nt, Homo Sapiens
uuauuguuauuuuguuguauuuacuugcauuuguuguauuuacuuucaucugcagcauuuggag

SEQ ID NO: 493026 - RNA, 64 nt, Homo Sapiens
ugauuguuuuauauaagauguuuuaauguauuuauguauuuauugccuuugaagugacucauuu

SEQ ID NO: 493027 - RNA, 64 nt, Homo Sapiens
uauuuauuugauuguuuuauacucauuuuuuuaauguauuuaugcuguggccgccuuugaagug

SEQ ID NO: 493028 - RNA, 64 nt, Homo Sapiens
aaaaguguuuucacaacaaaauaucuuuuaauuguguauuuaagcauccuguaagugcuuaauc

SEQ ID NO: 493029 - RNA, 64 nt, Homo Sapiens
guaaggccuuuaguaaugaaaaaauguagcaugauguauuuaaauggcauuugaagaggagaac

SEQ ID NO: 493030 - RNA, 64 nt, Homo Sapiens
ugcauuuuaauuaauugccaaaggcuugcaaaucuguauuuaauaauguuuacauaauggccag

SEQ ID NO: 493031 - RNA, 64 nt, Homo Sapiens
cucuguugguaauacugaauuugccuuuuguuguuguauuuaucggacugccaaaucauggguu

SEQ ID NO: 493032 - RNA, 64 nt, Homo Sapiens
ugugugugugguugcacgggcacggguguacuuuuguauuuauguguguguguaugucugauug

SEQ ID NO: 493033 - RNA, 64 nt, Homo Sapiens
uguguguguguguguaugucucugaguguagcuuuguauuuauggggcaucugguguuuaugug

SEQ ID NO: 493034 - RNA, 64 nt, Homo Sapiens
uuauauuguauauauuguuauccauuuguguaaauguauuuauuacugugugcuccagcaaaug

SEQ ID NO: 493035 - RNA, 64 nt, Homo Sapiens
ccacuauuuugcauuuaaauucagaucagauuguuguauuuauuuaguuacacuuguguuucaa

SEQ ID NO: 493036 - RNA, 64 nt, Homo Sapiens
uuugaguuucucugcaucuguuucauccuucaguuguauuuagcuggcccuguaagauggacuc

SEQ ID NO: 493037 - RNA, 64 nt, Homo Sapiens
gugcuaguucucuucuacacuuuuucucuuuuuuuguauuuaccgguuuuuguuuucuguuuuu

SEQ ID NO: 493038 - RNA, 64 nt, Homo Sapiens
agacuacaggugcacaccaccaagccuggcuuuauguauuuauuucuguucaugcggaaugauu

SEQ ID NO: 493039 - RNA, 64 nt, Homo Sapiens
agcauuucuuuaaggaugaccggauguugccguauguauuuauggcacaagcagguguugucua

SEQ ID NO: 493040 - RNA, 64 nt, Homo Sapiens
uggcuuuugaaugaguguaaauuguuuucuuuuguguauuuauacuuguauguaugauuugcau

SEQ ID NO: 493041 - RNA, 64 nt, Homo Sapiens
aaaaaagaaaagauuacugacugugcauuguaccuguauuuauaguuuaugguuaucaggaagc

SEQ ID NO: 493042 - RNA, 64 nt, Homo Sapiens
cugugccguaaggauugcaucggacuaaacuaucuguauuuauuauuugaagcgagucauuucg

SEQ ID NO: 493043 - RNA, 64 nt, Homo Sapiens
cauuucguucccugauuauuuauccuugucugaauguauuuauguguauauuuguagauuuauc

SEQ ID NO: 493044 - RNA, 64 nt, Homo Sapiens
uuucuguagaagaaaaagguuuaaauuuaaaauguguauuuagagcauggagagaaucauuuaa

SEQ ID NO: 493045 - RNA, 64 nt, Homo Sapiens
cacuggauaagccuucuccuuucauaagaaaggauguauuuaaauacauuuuauuuugcuaaau

SEQ ID NO: 493046 - RNA, 64 nt, Homo Sapiens
uuuaugaauuauuuaugauuuauuuuuuagugaauguauuuaaucauuuuuuuacuuuguaguu

SEQ ID NO: 493047 - RNA, 64 nt, Homo Sapiens
uaaacgugcaaggcacauacccagcaaugugaacuguauuuacacuaaacaaggacaaaugaga

SEQ ID NO: 493048 - RNA, 64 nt, Homo Sapiens
guguguagacccuccucugugauguguuuccauuuguauuuaaugcuaaugacuugugugugcu

SEQ ID NO: 493049 - RNA, 64 nt, Homo Sapiens
uccuaguuuguuuuccauucgcaucaauauuggauguauuuaauuggugacuuauggaaauaaa

SEQ ID NO: 493050 - RNA, 64 nt, Homo Sapiens
caacaaccagcauaagcaaaugaaagaaaggaauuguauuuaccuuuuauaauuauuauuagug

SEQ ID NO: 493051 - RNA, 64 nt, Homo Sapiens
agauuauagauuuaaaaguauaugacauguauuuuguauuuaaaacuagaauagccaguauuua

SEQ ID NO: 493052 - RNA, 64 nt, Homo Sapiens
uggacugugcacgugacacuuaaauaauuuucuauguauuuaaagaaaaaugcaccaggauggu

SEQ ID NO: 493053 - RNA, 64 nt, Homo Sapiens
gaugauauuuuauguuuaaucuguaaauaagaaauguauuuaaauuaaaagggaucuuuuugua

SEQ ID NO: 493054 - RNA, 64 nt, Homo Sapiens
guucuaugcuuacuguuguguguuaauuacauuguguauuuauaguaacaauuuuguuuucuac

SEQ ID NO: 493055 - RNA, 64 nt, Homo Sapiens
aauaucaaauucacuuaugagaaugaugcuuuuuuguauuuauuuuuguuuauaucuuuguugu

SEQ ID NO: 493056 - RNA, 64 nt, Homo Sapiens
auuuugguacaauauauaaauaucacugcugagcuguauuuaaacagguauuguuauuaguacc

SEQ ID NO: 493057 - RNA, 64 nt, Homo Sapiens
guuuacuuaaggucaggaaauuuugccuugucaauguauuuaaauauauuugaucauauuuuuu

SEQ ID NO: 493058 - RNA, 64 nt, Homo Sapiens
cucaguaaauggcuucuucuagaauguaaaguuauguauuuaaaguuguaucuugacacaggaa

SEQ ID NO: 493059 - RNA, 64 nt, Homo Sapiens
gggaaucaguccccuguggauaccaagguacaacuguauuuauuaacgcuuacuagaugugagg

SEQ ID NO: 493060 - RNA, 64 nt, Homo Sapiens
agagcauuugaauauugguaacuuuuguuauauauguauuuauuucacuauaguuacuuuuuuc

SEQ ID NO: 493061 - RNA, 64 nt, Homo Sapiens
cuguauccggcacugcuaagaaggcccugugaguuguauuuaucauuuucagugacacuuaugu

SEQ ID NO: 493062 - RNA, 64 nt, Homo Sapiens
auuauaaacauuuuucauuacuuacauggguugcuguauuuagagaucagauacaugaacaugu

SEQ ID NO: 493063 - RNA, 64 nt, Homo Sapiens
uagauuugauuauuuuaauugucagcaugauucauguauuuauacgaaaaaucaguccuguguu

SEQ ID NO: 493064 - RNA, 64 nt, Homo Sapiens
auuguguuuaauuauuuugccauguauuacuaauuguauuuaaaauuucuacuucccuuaggca

SEQ ID NO: 493065 - RNA, 64 nt, Homo Sapiens
ugaacagaaaauugagacuaugaagaggucaacuuguauuuaccaacuuuacucauuuucccau

SEQ ID NO: 493066 - RNA, 64 nt, Homo Sapiens
uggcuacacuagauauuuugugauuggcaagacauguauuuaaacaauaaacuaaaaggaaaua

SEQ ID NO: 493067 - RNA, 64 nt, Homo Sapiens
gaguuaucuguaguacuuggaaacagaaaauguguguauuuaaagacgaugccuaugcaguaua

SEQ ID NO: 493068 - RNA, 64 nt, Homo Sapiens
aggaauaugaccauuugacuguucaaugauuauuuguauuuacaguuuccagaguuugucauua

SEQ ID NO: 493069 - RNA, 64 nt, Homo Sapiens
acauacgacuuauuuuguugaaauugucaaagacuguauuuagaucucauaaugcuuuguuaaa

SEQ ID NO: 493070 - RNA, 64 nt, Homo Sapiens
uuuaucccauugagacuauuuauuuauguauguauguauuuauuuauuuauugccuggagugug

SEQ ID NO: 493071 - RNA, 64 nt, Homo Sapiens
auguauuuauuuauuuauugccuggagugugaacuguauuuauuuuagcagaggagccaugucc

SEQ ID NO: 493072 - RNA, 54 nt, Homo Sapiens
auagcuugguauucaguuaaguauuguauuuaguucagugaaccgcccguuagu

SEQ ID NO: 493073 - RNA, 64 nt, Homo Sapiens
uuaauguuugcaaggccagaguguuugaaaguuuuguauuuaacuuuauaauuaccuuguccuu

SEQ ID NO: 493074 - RNA, 64 nt, Homo Sapiens
ugccauuugcaucaugguuucaggcucuguuuuguguauuuauccuugagcuaugucucuacuc

SEQ ID NO: 493075 - RNA, 64 nt, Homo Sapiens
guauauuuauugugcccuaaagugagccacuuuguguauuuacuaccccgaagucuucccagcc

SEQ ID NO: 493076 - RNA, 64 nt, Homo Sapiens
aaaccuuaaaguugugcuguggcauggaguaauuuguauuuaaagaggagcgggcauuugaggg

SEQ ID NO: 493077 - RNA, 64 nt, Homo Sapiens
auuugacugggacagaaugaggaauggagauuuuuguauuuaucuuugggacuuuaugccuuac

SEQ ID NO: 493078 - RNA, 64 nt, Homo Sapiens
uuauaaaugaaggacaaggaggagauggaaaauguguauuuauuguuaauucuuaaaauagugu

SEQ ID NO: 493079 - RNA, 64 nt, Homo Sapiens
cuuguuuacuuuuuuaagggcuuuaaguuauuuauguauuuaauaugcccugagauaacuuugg

SEQ ID NO: 493080 - RNA, 64 nt, Homo Sapiens
ggcuugggaauuuuauuauuuaaaagguaaaaccuguauuuauuugagcuauuuaaggaucuau

SEQ ID NO: 493081 - RNA, 64 nt, Homo Sapiens
ggagguguuauaauuaauuauucagaaaaaugcauguauuuaccucuucaaccaaaagggcagu

SEQ ID NO: 493082 - RNA, 64 nt, Homo Sapiens
auggagcucaggagaaugcaccaagacuuugaauuguauuuacauucacugucaguaaagaccu

SEQ ID NO: 493083 - RNA, 64 nt, Homo Sapiens
auaaucugugacuaauaaagacauauuccacauauguauuuaguguuguguaaguuauguaugu

SEQ ID NO: 493084 - RNA, 64 nt, Homo Sapiens
uuuauacauacaaguuggauaauuucuuucuauguguauuuauaauuguuguaugacauuuaaa

SEQ ID NO: 493085 - RNA, 64 nt, Homo Sapiens
uucaccugaguuuuaauguuagaugaaccaaaaauguauuuauauuucuauauggacauagcac

SEQ ID NO: 493086 - RNA, 64 nt, Homo Sapiens
acaaauuuucauggucugaaauguuuuaaguaaauguauuuaaaguauuuauuuuuagagguac

SEQ ID NO: 493087 - RNA, 64 nt, Homo Sapiens
uuuagagguacauguuuuaauaaauggaggcuaguguauuuauuaaagaacucugagaauuagc

SEQ ID NO: 493088 - RNA, 64 nt, Homo Sapiens
agaauaucuuuaaguguuuuacacacagcuuauauguauuuacauugcauaguacugaauguug

SEQ ID NO: 493089 - RNA, 64 nt, Homo Sapiens
uugucauuuuuuaaaggaauuagcauuaucacacuguauuuaaauuacuacuuuaaaucaaaug

SEQ ID NO: 493090 - RNA, 64 nt, Homo Sapiens
gagcacuuugcuccaaauauauuauuuuucaguguguauuuaaacgaggcaguuuauuuugaua

SEQ ID NO: 493091 - RNA, 64 nt, Homo Sapiens
cagagaauguuaauggauaccagaauuuuauuuuuguauuuauguucauaguacuuuuccucuu

SEQ ID NO: 493092 - RNA, 64 nt, Homo Sapiens
ggguauucagaugccaccuaaaacaagggccagauguauuuaagggcuagguugguagaaucaa

SEQ ID NO: 493093 - RNA, 64 nt, Homo Sapiens
augguuucuuuuacuuauuguaauuauaauucccuguauuuaaauggccuuaacuaugccaauc

SEQ ID NO: 493094 - RNA, 64 nt, Homo Sapiens
uacguguuuugagugucuaucaauaauguccugcuguauuuaccacuacaaggcagcuguuuuu

SEQ ID NO: 493095 - RNA, 64 nt, Homo Sapiens
gggaaaugaguaauauacaacuauacaaucuuuuuguauuuauuuuauuuugguauuauucaau

SEQ ID NO: 493096 - RNA, 64 nt, Homo Sapiens
caauaaaaccuuuauguuagcacgugacagugcauguauuuauuccuuucuguucaacuaauuu

SEQ ID NO: 493097 - RNA, 64 nt, Homo Sapiens
augauaauauauucugcacgagcagccuuguaacuguauuuacccaaaaaauaaauaaaauaga

SEQ ID NO: 493098 - RNA, 64 nt, Homo Sapiens
gaaaacaguuguggaauucuuacuucauuaugaauguauuuaaaaaacaaacaccaaauaauug

SEQ ID NO: 493099 - RNA, 64 nt, Homo Sapiens
ugccaaagaucaacagacagaaaauaucauccuguguauuuacuugucauacuuuaacuuugug

SEQ ID NO: 493100 - RNA, 64 nt, Homo Sapiens
aaaauaguuucauugucauuauuucauguguuuuuguauuuauggugguuaccaugacacccua

SEQ ID NO: 493101 - RNA, 64 nt, Homo Sapiens
ucagaccuguguaucacguaguagaucagaccuguguauuuagacgguagcaccacaugguugu

SEQ ID NO: 493102 - RNA, 64 nt, Homo Sapiens
guaaccauuuuccuuuggacaacaguuugccugcuguauuuauaacuauguucuaggucagucu

SEQ ID NO: 493103 - RNA, 64 nt, Homo Sapiens
aacaaaaagcaacaguaauccuuuuuaaaauauauguauuuaaaguauguggaaguauaccugg

SEQ ID NO: 493104 - RNA, 64 nt, Homo Sapiens
ugccuacuuuguacuugauguugugaaguauguuuguauuuauucauaguuugagcaggauguu

SEQ ID NO: 493105 - RNA, 64 nt, Homo Sapiens
aaugaauuugcgguaaggugcuuucacugauuuuuguauuuauauugcacacuucuucccccac

SEQ ID NO: 493106 - RNA, 64 nt, Homo Sapiens
guucucuggaaauaaauauacugcuugcaauuucuguauuuauuaaauauuacuguuacauaua

SEQ ID NO: 493107 - RNA, 64 nt, Homo Sapiens
gaaaauauuacuguuacauaaaaguaggugauucuguauuuaaauuugccuguuaaguuguaua

SEQ ID NO: 493108 - RNA, 64 nt, Homo Sapiens
gacacacccagugcgugaagaccguggacagcgcuguauuuacagggauggaagcaggacagac

SEQ ID NO: 493109 - RNA, 64 nt, Homo Sapiens
gagaaccaugcucuuguucuuguauuuaaauguauguauuuaagcauacccaugucagauugaa

SEQ ID NO: 493110 - RNA, 64 nt, Homo Sapiens
uguauguauuuaaggagaaccaugucagauugaauguauuuaaaugacaggcaaauuucauacc

SEQ ID NO: 493111 - RNA, 64 nt, Homo Sapiens
uuuuuuuuaggauuuuugcuaaaacaaaaacccauguauuuaacuguauaucaagcacagcagu

SEQ ID NO: 493112 - RNA, 64 nt, Homo Sapiens
uguuuuaggcaaccuaagaaacacucauuuuauuuguauuuaaauagcuuucauuauuuuugcu

SEQ ID NO: 493113 - RNA, 64 nt, Homo Sapiens
uguauuugccucuagagaaacacaguguucucuuuguauuuauggauuccuuuuuaccguguca

SEQ ID NO: 493114 - RNA, 64 nt, Homo Sapiens
cuuuuuaccgugucacauuuacuuugguccucuauguauuuaaauguuugaagugccuuagacu

SEQ ID NO: 493115 - RNA, 64 nt, Homo Sapiens
aaacucuuucuggggaauccaauuauaguugcuuuguauuuaaaaacaagaacagccaaggguu

SEQ ID NO: 493116 - RNA, 64 nt, Homo Sapiens
auuuguaugcacguuauauuguaauagcuuugccuguauuuauugcaagaccaccagcuccugg

SEQ ID NO: 493117 - RNA, 64 nt, Homo Sapiens
ucuuccugagaacagaagagaaauuccaugauuuuguauuuaauaaagaucauuuccaggucua

SEQ ID NO: 493118 - RNA, 64 nt, Homo Sapiens
uucuauugaagcccuucuguuguagaauuucuacuguauuuaaucucuaguuaacuuagcuuua

SEQ ID NO: 493119 - RNA, 64 nt, Homo Sapiens
ucagauuaauagagaaugaauauaauuauuuauuuguauuuauaauuuauauuuacaaguuguc

SEQ ID NO: 493120 - RNA, 64 nt, Homo Sapiens
uaaaauaaauaaaaaaagauauaguauuaaugccuguauuuaugaagacagggccauugcacug

SEQ ID NO: 493121 - RNA, 64 nt, Homo Sapiens
cagauggcauaugccuuaaagaugcauuuuucuauguauuuaauauuuuguguacaguaaaagu

SEQ ID NO: 493122 - RNA, 64 nt, Homo Sapiens
cagcugauguuaucagaaaaauccuguuauccuguguauuuacuaguccucaugaucuagacuu

SEQ ID NO: 493123 - RNA, 64 nt, Homo Sapiens
cccaugcugccuccagucuuugucuguauucuucuguauuuaaccuucagauuguaagccuuuu

SEQ ID NO: 493124 - RNA, 64 nt, Homo Sapiens
ugucaaacuugccuggcaguguuuguucaaaacuuguauuuaauaaaugaacaucugacuuaca

SEQ ID NO: 493125 - RNA, 64 nt, Homo Sapiens
cgcuccccaccaacucuccccuaaucacacacucuguauuuaucacuggcacaauugauguguu

SEQ ID NO: 493126 - RNA, 64 nt, Homo Sapiens
ccucugccccagcaaaugcccagcccaggcaaauuguauuuaaagaauccugggggucauuaug

SEQ ID NO: 493127 - RNA, 64 nt, Homo Sapiens
cugugugaagauuuuuagcuguauuuguggucucuguauuuauauuuauguuuagcaccgucag

SEQ ID NO: 493128 - RNA, 64 nt, Homo Sapiens
uuggcagauauuggaaaaauauuuugugaaaagcuguauuuauuauaaauacuagggccaugac

SEQ ID NO: 493129 - RNA, 64 nt, Homo Sapiens
uaugugaaacagcuggaauuguacaaauuuugguuguauuuaaagcucaguuuccuuuuuguuu

SEQ ID NO: 493130 - RNA, 64 nt, Homo Sapiens
agaauuuggaagaaauugguauuuuaauacugucuguauuuauuacuguuaugcaggcugugcc

SEQ ID NO: 493131 - RNA, 64 nt, Homo Sapiens
uacauuauaugucucuuguauguuuugaaacucuuguauuuaugauauagcuuauaugauuuuu

SEQ ID NO: 493132 - RNA, 64 nt, Homo Sapiens
ugacauuuauuuuaauguucauuauauauuuuucuguauuuaccuaaaaugcugagaacuagug

SEQ ID NO: 493133 - RNA, 64 nt, Homo Sapiens
agcuauuuuaaaugagcuguauauuuaugcuuucuguauuuaccucaguguuuaaacuuacugu

SEQ ID NO: 493134 - RNA, 64 nt, Homo Sapiens
gagaauauuuaaauguaauacauugugauaaugcuguauuuaaauuuccccuuuagguucuuua

SEQ ID NO: 493135 - RNA, 64 nt, Homo Sapiens
acacauaacauuuuuuaguuagccugaaaagauuuguauuuaauccugaagucucuaaacucug

SEQ ID NO: 493136 - RNA, 64 nt, Homo Sapiens
cucuauuauugggcauaaagucauuggguauauauguauuuacuauuacagagcacaaugauug

SEQ ID NO: 493137 - RNA, 64 nt, Homo Sapiens
gucccuccuaucaaacaauuuuaccuauuaaauguguauuuauaggaaaugugucuugauaaua

SEQ ID NO: 493138 - RNA, 64 nt, Homo Sapiens
gauucacuugagacuuuuuagucagacuuaaaaauguauuuacagccucauguaccgauuugaa

SEQ ID NO: 493139 - RNA, 64 nt, Homo Sapiens
uauuuaagucacuuguccaaaaugcuauuugauuuguauuuagauuuauaguugaaguuaggaa

SEQ ID NO: 493140 - RNA, 62 nt, Homo Sapiens
ugaugucugcaccuucugcacaaguuagggucuauguauuuaucuguuugaugcuauuuaug

SEQ ID NO: 493141 - RNA, 64 nt, Homo Sapiens
cccccaggaaacuagcuuuuucuagaagcacauguguauuuauaguuugacacgaagccuuauu

SEQ ID NO: 493142 - RNA, 64 nt, Homo Sapiens
auuucuaaggagauauaauauuucagauuccaaguguauuuaaauuguuuauuuuuaaugggua

SEQ ID NO: 493143 - RNA, 64 nt, Homo Sapiens
acugaaaauacuccugaguauuccugauaauaaauguauuuagguuauuuuccauuuuucuugu

SEQ ID NO: 493144 - RNA, 64 nt, Homo Sapiens
uuaauguauuguucucaugugagaauuuuuucuuuguauuuauuuugaaucuaguauuugcugg

SEQ ID NO: 493145 - RNA, 64 nt, Homo Sapiens
guagaauauugcuuuuuaaaugucaauaucuuaauguauuuaauaaugauuguauuuauaaaau

SEQ ID NO: 493146 - RNA, 64 nt, Homo Sapiens
aaauugucaauaucuuaaugcuguuuaaaaugauuguauuuauaucagaaauuuaucauguuua

SEQ ID NO: 493147 - RNA, 64 nt, Homo Sapiens
ccuguuacaguuuugacuuuuuggaaagaauuuuuguauuuauuccaaagaauauuagguaugu

SEQ ID NO: 493148 - RNA, 64 nt, Homo Sapiens
cauagauggagaaacaaagcugguuagagugauauguauuuagcuuauuuuaaaccuuuuuauu

SEQ ID NO: 493149 - RNA, 64 nt, Homo Sapiens
auuggucuuuagaaugguaguaauaaaguuucaguguauuuaucuucuauauacccugaccuuu

SEQ ID NO: 493150 - RNA, 64 nt, Homo Sapiens
uguauauaaaauguacaaugauuuccuauaaauuuguauuuaugagguguagguuaauuuguuu

SEQ ID NO: 493151 - RNA, 64 nt, Homo Sapiens
ugauaugugucaaguuacuccuaaguaccuguaguguauuuaugaggcuaaggacaaaaauaaa

SEQ ID NO: 493152 - RNA, 64 nt, Homo Sapiens
aaguauuccagcaaaagaggcuuacuuuuuaauauguauuuauaggacuguuuggaguuguugc

SEQ ID NO: 493153 - RNA, 64 nt, Homo Sapiens
guaaaggaagaaaaaaagacgcuaagcuguuaaauguauuuauauaaauuuagcuugucuuucu

SEQ ID NO: 493154 - RNA, 64 nt, Homo Sapiens
gaaaugcaguauaaagguuguuguaaauguauuuuguauuuaauaacaccaugguagacucuuu

SEQ ID NO: 493155 - RNA, 64 nt, Homo Sapiens
ucagaugaauuuauaaauuaacuucuuuucaaaauguauuuaacgaaaaaguaaaucaaagaug

SEQ ID NO: 493156 - RNA, 64 nt, Homo Sapiens
ccaaaaauagaaaaguucuucuaagguuaaauuuuguauuuaaaaguuaguuggccauuugauc

SEQ ID NO: 493157 - RNA, 64 nt, Homo Sapiens
uugcuuucgugugugugucuuuaaacagguaauguguauuuaaguguugucuaaacaguugauu

SEQ ID NO: 493158 - RNA, 64 nt, Homo Sapiens
aguguaucucauagauacagguauaaagcuuauuuguauuuaguuuuuuauuuggaagggagca

SEQ ID NO: 493159 - RNA, 64 nt, Homo Sapiens
guguucagugaugauaucacaaaauuuuccucaguguauuuagucuuuugguuaaauggcaguc

SEQ ID NO: 493160 - RNA, 64 nt, Homo Sapiens
guaagaaugauuauaaugaacuguuuagcacuucuguauuuauucaggccacugugauaauggu

SEQ ID NO: 493161 - RNA, 64 nt, Homo Sapiens
ggcaaguaauaauggaaugcgggggcuggcaucauguauuuaggagcaggagguuaucugugca

SEQ ID NO: 493162 - RNA, 64 nt, Homo Sapiens
uauaaauauaccgacaugaucagugauacaguuuuguauuuacauguucauauucaauaucuua

SEQ ID NO: 493163 - RNA, 64 nt, Homo Sapiens
aucaauggacugagucugaucaaucauuucauuuuguauuuaauguguauauuauuauuuuuua

SEQ ID NO: 493164 - RNA, 64 nt, Homo Sapiens
aauguguguuucauuuuuuuggaaagcuauauuuuguauuuaggaaaugguauacuauuuugcu

SEQ ID NO: 493165 - RNA, 64 nt, Homo Sapiens
ccagcaaaggccauagaaacaacaauuuauuaaauguauuuauggcagaaggaccuaaauaaac

SEQ ID NO: 493166 - RNA, 64 nt, Homo Sapiens
aaaauaaaaauagaagaagaccaggaccguggauuguauuuaaagaaaaguccugaaaucuagu

SEQ ID NO: 493167 - RNA, 64 nt, Homo Sapiens
auuuauuuuucuacuuuccccaggucucuauuuauguauuuauuaguucacuguucaucauuua

SEQ ID NO: 493168 - RNA, 64 nt, Homo Sapiens
uucccuguguuugucucuaggaucccagagccccuguauuuauuauuaguagcuucuguggggg

SEQ ID NO: 493169 - RNA, 64 nt, Homo Sapiens
uuuuuauguuuuuuaaacuacaguuacucuugaguguauuuaccuguucagaacuguuuaauag

SEQ ID NO: 493170 - RNA, 64 nt, Homo Sapiens
gccuuggugugcuguauccauccauggggcugauuguauuuaccuucuaccucuuggcugccuu

SEQ ID NO: 493171 - RNA, 64 nt, Homo Sapiens
uauaugaagaaacuguaucaaagggggaagaaaauguauuuaacaggugaaucaaaucaggaau

SEQ ID NO: 493172 - RNA, 64 nt, Homo Sapiens
aaacuaacacccagucuguuguuauuuaugccucuguauuuaaaauuuaacugccuuguguaca

SEQ ID NO: 493173 - RNA, 64 nt, Homo Sapiens
ugccuuguguacaguuauuucuaucgcaccacuguguauuuaaccaagugaccaccaggaggug

SEQ ID NO: 493174 - RNA, 64 nt, Homo Sapiens
cagcugauuugucugucuguugucuuauguucucuguauuuauggaaagcugugaaaugucuug

SEQ ID NO: 493175 - RNA, 64 nt, Homo Sapiens
auauggaagcaucuaaguacgcucugcuaccugcuguauuuauuaagccaauauuugugacuuu

SEQ ID NO: 493176 - RNA, 64 nt, Homo Sapiens
gaaauuggugguuuuaggaauaggaguucauaaguguauuuaauacaaaacacaucccagacau

SEQ ID NO: 493177 - RNA, 64 nt, Homo Sapiens
uuugagacacaaccagucauuuuguuuuugccguuguauuuauguuucuuugucuuucuugcuu

SEQ ID NO: 493178 - RNA, 64 nt, Homo Sapiens
gguuccugagacacccgauuccugcccaaacagcuguauuuauauaagucuguuauuuauuauu

SEQ ID NO: 493179 - RNA, 64 nt, Homo Sapiens
ucuuggggacucgggggcuggucugauggaacuguguauuuauuuaaaacucuggugauaaaaa

SEQ ID NO: 493180 - RNA, 64 nt, Homo Sapiens
uauugaagugugaaauugaguuuauaccuauuuauguauuuauuuggcuguauuuaucuguuua

SEQ ID NO: 493181 - RNA, 64 nt, Homo Sapiens
uguuuauuuauaccuauuuacaugagaugauggcuguauuuaucuguuuuuuaguuauugcucu

SEQ ID NO: 493182 - RNA, 64 nt, Homo Sapiens
uccacccaguugagacacaccaugcuuguucacuuguauuuauugaaacuguggauucuugccc

SEQ ID NO: 493183 - RNA, 64 nt, Homo Sapiens
auugaaacuguggauucuugcccgugcugucccuuguauuuacuuuaagcacugaucacuuauc

SEQ ID NO: 493184 - RNA, 64 nt, Homo Sapiens
ucauuccaguuugauuuauuuggauuuuuguuuauguauuuauuauaauagagguacaauucgu

SEQ ID NO: 493185 - RNA, 64 nt, Homo Sapiens
aaaaagaaucaccaaaucuacuggaauuuaaaccuguauuuaaaggguaugugauaauagaggg

SEQ ID NO: 493186 - RNA, 64 nt, Homo Sapiens
aaucuuauaauuguucucagaaucccuuaacaguuguauuuaacagaaauuguauauuguaauu

SEQ ID NO: 493187 - RNA, 64 nt, Homo Sapiens
auacauaagcacaggauguuuuucucaagagggauguauuuaucacuuggacaucuguuuauaa

SEQ ID NO: 493188 - RNA, 64 nt, Homo Sapiens
auuuaugugugugugaauguguauuuuaauuauguguauuuaacucuuuaaaaucucuuagauu

SEQ ID NO: 493189 - RNA, 64 nt, Homo Sapiens
uuuguuuuccuuugaaacccagcccuauuguauuuguauuuaaaauuuguacacauuuguauaa

SEQ ID NO: 493190 - RNA, 64 nt, Homo Sapiens
aaauacuuaauuguauuaaguucuuuaaaauguauguauuuaacguguguggauaugaugacgu

SEQ ID NO: 493191 - RNA, 64 nt, Homo Sapiens
aguaauacaggaagcauggcaaaggccugccccauguauuuaacuuaaaacauugggauccucc

SEQ ID NO: 493192 - RNA, 64 nt, Homo Sapiens
auuucuguuuacauccagaaaacaauguuaaggauguauuuauuccccuacccugaagaaagug

SEQ ID NO: 493193 - RNA, 64 nt, Homo Sapiens
cauucuauuguccuaauuguacuguuuucugauuuguauuuaugucuugagacaguaacuuuuu

SEQ ID NO: 493194 - RNA, 64 nt, Homo Sapiens
ucgauaugccucuuuccacauuuuuuccuugcaauguauuuauuauuuauuuguauuuagguga

SEQ ID NO: 493195 - RNA, 64 nt, Homo Sapiens
acauuuuuuccuugcaauguauuuauuauuuauuuguauuuaggugaaauucacauaacauaaa

SEQ ID NO: 493196 - RNA, 64 nt, Homo Sapiens
uguuaaaaucaaaaauguuauuauuuaauuuucuuguauuuauaugcaauauuucuuuucugau

SEQ ID NO: 493197 - RNA, 64 nt, Homo Sapiens
uucuacuguguaaauguauucuucuacauuuuuuuguauuuauucccaugugucaaaaaucuua

SEQ ID NO: 493198 - RNA, 64 nt, Homo Sapiens
guggaaauuguauaguuucauucuucuacuaauuuguauuuaauugcaauacuacuuggaggaa

SEQ ID NO: 493199 - RNA, 64 nt, Homo Sapiens
ggugauuguucuugcugaggauaaccccaguucauguauuuacugaguuucuaaaaauucagcu

SEQ ID NO: 493200 - RNA, 64 nt, Homo Sapiens; identical to SEQ ID NO: 198342

SEQ ID NO: 493201 - RNA, 64 nt, Homo Sapiens; identical to SEQ ID NO: 198343

SEQ ID NO: 493202 - RNA, 64 nt, Homo Sapiens; identical to SEQ ID NO: 198344

SEQ ID NO: 493203 - RNA, 64 nt, Homo Sapiens; identical to SEQ ID NO: 198345

SEQ ID NO: 493204 - RNA, 64 nt, Homo Sapiens; identical to SEQ ID NO: 198346

SEQ ID NO: 493205 - RNA, 64 nt, Homo Sapiens; identical to SEQ ID NO: 198347

SEQ ID NO: 493206 - RNA, 64 nt, Homo Sapiens; identical to SEQ ID NO: 198348

SEQ ID NO: 493207 - RNA, 64 nt, Homo Sapiens; identical to SEQ ID NO: 198349

SEQ ID NO: 493208 - RNA, 64 nt, Homo Sapiens; identical to SEQ ID NO: 198350

SEQ ID NO: 493209 - RNA, 64 nt, Homo Sapiens; identical to SEQ ID NO: 198351

SEQ ID NO: 493210 - RNA, 64 nt, Homo Sapiens; identical to SEQ ID NO: 198352

SEQ ID NO: 493211 - RNA, 64 nt, Homo Sapiens; identical to SEQ ID NO: 198353

SEQ ID NO: 493212 - RNA, 64 nt, Homo Sapiens; identical to SEQ ID NO: 198354

SEQ ID NO: 493213 - RNA, 64 nt, Homo Sapiens; identical to SEQ ID NO: 198355

SEQ ID NO: 493214 - RNA, 64 nt, Homo Sapiens; identical to SEQ ID NO: 198356

SEQ ID NO: 493215 - RNA, 64 nt, Homo Sapiens; identical to SEQ ID NO: 198357

SEQ ID NO: 493216 - RNA, 64 nt, Homo Sapiens; identical to SEQ ID NO: 198358

SEQ ID NO: 493217 - RNA, 64 nt, Homo Sapiens; identical to SEQ ID NO: 198359

SEQ ID NO: 493218 - RNA, 64 nt, Homo Sapiens; identical to SEQ ID NO: 198360

SEQ ID NO: 493219 - RNA, 64 nt, Homo Sapiens; identical to SEQ ID NO: 198361

SEQ ID NO: 493220 - RNA, 64 nt, Homo Sapiens; identical to SEQ ID NO: 198362

SEQ ID NO: 493221 - RNA, 64 nt, Homo Sapiens; identical to SEQ ID NO: 198363

SEQ ID NO: 493222 - RNA, 64 nt, Homo Sapiens; identical to SEQ ID NO: 198364

SEQ ID NO: 493223 - RNA, 64 nt, Homo Sapiens; identical to SEQ ID NO: 198365

SEQ ID NO: 493224 - RNA, 64 nt, Homo Sapiens; identical to SEQ ID NO: 198366

SEQ ID NO: 493225 - RNA, 64 nt, Homo Sapiens; identical to SEQ ID NO: 198367

SEQ ID NO: 493226 - RNA, 64 nt, Homo Sapiens; identical to SEQ ID NO: 198368

SEQ ID NO: 493227 - RNA, 64 nt, Homo Sapiens; identical to SEQ ID NO: 198369

SEQ ID NO: 493228 - RNA, 64 nt, Homo Sapiens; identical to SEQ ID NO: 198370

SEQ ID NO: 493229 - RNA, 64 nt, Homo Sapiens; identical to SEQ ID NO: 198371

SEQ ID NO: 493230 - RNA, 64 nt, Homo Sapiens; identical to SEQ ID NO: 198372

SEQ ID NO: 493231 - RNA, 64 nt, Homo Sapiens; identical to SEQ ID NO: 198373

SEQ ID NO: 493232 - RNA, 64 nt, Homo Sapiens; identical to SEQ ID NO: 198374

SEQ ID NO: 493233 - RNA, 64 nt, Homo Sapiens; identical to SEQ ID NO: 198375

SEQ ID NO: 493234 - RNA, 64 nt, Homo Sapiens; identical to SEQ ID NO: 198376

SEQ ID NO: 493235 - RNA, 64 nt, Homo Sapiens; identical to SEQ ID NO: 198377

SEQ ID NO: 493236 - RNA, 64 nt, Homo Sapiens; identical to SEQ ID NO: 198378

SEQ ID NO: 493237 - RNA, 64 nt, Homo Sapiens; identical to SEQ ID NO: 198379

SEQ ID NO: 493238 - RNA, 64 nt, Homo Sapiens; identical to SEQ ID NO: 198380

SEQ ID NO: 493239 - RNA, 64 nt, Homo Sapiens; identical to SEQ ID NO: 198381

SEQ ID NO: 493240 - RNA, 64 nt, Homo Sapiens; identical to SEQ ID NO: 198382

SEQ ID NO: 493241 - RNA, 64 nt, Homo Sapiens; identical to SEQ ID NO: 198383

SEQ ID NO: 493242 - RNA, 64 nt, Homo Sapiens; identical to SEQ ID NO: 198384

SEQ ID NO: 493243 - RNA, 64 nt, Homo Sapiens; identical to SEQ ID NO: 198385

SEQ ID NO: 493244 - RNA, 64 nt, Homo Sapiens; identical to SEQ ID NO: 198386

SEQ ID NO: 493245 - RNA, 64 nt, Homo Sapiens; identical to SEQ ID NO: 198387

SEQ ID NO: 493246 - RNA, 64 nt, Homo Sapiens; identical to SEQ ID NO: 198388

SEQ ID NO: 493247 - RNA, 64 nt, Homo Sapiens; identical to SEQ ID NO: 198389

SEQ ID NO: 493248 - RNA, 64 nt, Homo Sapiens; identical to SEQ ID NO: 198390

SEQ ID NO: 493249 - RNA, 64 nt, Homo Sapiens; identical to SEQ ID NO: 198391

SEQ ID NO: 493250 - RNA, 64 nt, Homo Sapiens; identical to SEQ ID NO: 198392

SEQ ID NO: 493251 - RNA, 64 nt, Homo Sapiens; identical to SEQ ID NO: 198393

SEQ ID NO: 493252 - RNA, 64 nt, Homo Sapiens; identical to SEQ ID NO: 198394

SEQ ID NO: 493253 - RNA, 64 nt, Homo Sapiens; identical to SEQ ID NO: 198395

SEQ ID NO: 493254 - RNA, 64 nt, Homo Sapiens; identical to SEQ ID NO: 198396

SEQ ID NO: 493255 - RNA, 64 nt, Homo Sapiens; identical to SEQ ID NO: 198397

SEQ ID NO: 493256 - RNA, 64 nt, Homo Sapiens; identical to SEQ ID NO: 198398

SEQ ID NO: 493257 - RNA, 64 nt, Homo Sapiens; identical to SEQ ID NO: 198399

SEQ ID NO: 493258 - RNA, 64 nt, Homo Sapiens; identical to SEQ ID NO: 198400

SEQ ID NO: 493259 - RNA, 64 nt, Homo Sapiens; identical to SEQ ID NO: 198401

SEQ ID NO: 493260 - RNA, 64 nt, Homo Sapiens; identical to SEQ ID NO: 198402

SEQ ID NO: 493261 - RNA, 64 nt, Homo Sapiens; identical to SEQ ID NO: 198403

SEQ ID NO: 493262 - RNA, 64 nt, Homo Sapiens; identical to SEQ ID NO: 198404

SEQ ID NO: 493263 - RNA, 64 nt, Homo Sapiens; identical to SEQ ID NO: 198405

SEQ ID NO: 493264 - RNA, 64 nt, Homo Sapiens; identical to SEQ ID NO: 198406

SEQ ID NO: 493265 - RNA, 64 nt, Homo Sapiens; identical to SEQ ID NO: 198407

SEQ ID NO: 493266 - RNA, 64 nt, Homo Sapiens; identical to SEQ ID NO: 198408

SEQ ID NO: 493267 - RNA, 64 nt, Homo Sapiens; identical to SEQ ID NO: 198409

SEQ ID NO: 493268 - RNA, 64 nt, Homo Sapiens; identical to SEQ ID NO: 198410

SEQ ID NO: 493269 - RNA, 64 nt, Homo Sapiens; identical to SEQ ID NO: 198411

SEQ ID NO: 493270 - RNA, 64 nt, Homo Sapiens; identical to SEQ ID NO: 198412

SEQ ID NO: 493271 - RNA, 64 nt, Homo Sapiens; identical to SEQ ID NO: 198413

SEQ ID NO: 493272 - RNA, 64 nt, Homo Sapiens; identical to SEQ ID NO: 198414

SEQ ID NO: 493273 - RNA, 64 nt, Homo Sapiens; identical to SEQ ID NO: 198415

SEQ ID NO: 493274 - RNA, 64 nt, Homo Sapiens; identical to SEQ ID NO: 198416

SEQ ID NO: 493275 - RNA, 64 nt, Homo Sapiens; identical to SEQ ID NO: 198417

SEQ ID NO: 493276 - RNA, 64 nt, Homo Sapiens; identical to SEQ ID NO: 198418

SEQ ID NO: 493277 - RNA, 64 nt, Homo Sapiens; identical to SEQ ID NO: 198419

SEQ ID NO: 493278 - RNA, 64 nt, Homo Sapiens; identical to SEQ ID NO: 198420

SEQ ID NO: 493279 - RNA, 64 nt, Homo Sapiens; identical to SEQ ID NO: 198421

SEQ ID NO: 493280 - RNA, 64 nt, Homo Sapiens; identical to SEQ ID NO: 198422

SEQ ID NO: 493281 - RNA, 64 nt, Homo Sapiens; identical to SEQ ID NO: 198423

SEQ ID NO: 493282 - RNA, 64 nt, Homo Sapiens; identical to SEQ ID NO: 198424

SEQ ID NO: 493283 - RNA, 64 nt, Homo Sapiens; identical to SEQ ID NO: 198425

SEQ ID NO: 493284 - RNA, 64 nt, Homo Sapiens; identical to SEQ ID NO: 198426

SEQ ID NO: 493285 - RNA, 64 nt, Homo Sapiens; identical to SEQ ID NO: 327831

SEQ ID NO: 493286 - RNA, 64 nt, Homo Sapiens; identical to SEQ ID NO: 327832

SEQ ID NO: 493287 - RNA, 64 nt, Homo Sapiens; identical to SEQ ID NO: 327833

SEQ ID NO: 493288 - RNA, 64 nt, Homo Sapiens; identical to SEQ ID NO: 327834

SEQ ID NO: 493289 - RNA, 64 nt, Homo Sapiens
aauauuuuucaccugagagaggaagagaaauuucucuaguaacacaaagagugaguucuaaaag

SEQ ID NO: 493290 - RNA, 64 nt, Homo Sapiens
uaauggaaugauacgguaccugaaagccuuguuuucuaguaagaaaaugcuaccuugcuguaca

SEQ ID NO: 493291 - RNA, 64 nt, Homo Sapiens
aagaaguggucagguuuucgcacuucuuggcugguccagggacugcagaaaccaaagcugcuau

SEQ ID NO: 493292 - RNA, 64 nt, Homo Sapiens
ugaaaaacuggguuccuguaaguuaugaauggcauccagggauauuuggguuacuuuuaagaaa

SEQ ID NO: 493293 - RNA, 64 nt, Homo Sapiens
gcugcauggagaauuucaccugcggugauuuugauccagggacugcaucuccucuuuccucauc

SEQ ID NO: 493294 - RNA, 64 nt, Homo Sapiens
ucucuccagcucuacuuuauccucaggcccuccuuccagggaugugccuuguucccucccuggc

SEQ ID NO: 493295 - RNA, 64 nt, Homo Sapiens
aggcucugucccugccgccagggacacauggguguccagggagaccuuggacagggugggagag

SEQ ID NO: 493296 - RNA, 64 nt, Homo Sapiens
acgcuucgucuucggccagcgacuuguucccaccuccagggagggaggagguguggucagaggu

SEQ ID NO: 493297 - RNA, 64 nt, Homo Sapiens
ggagcaaauugcaccacagcuccgcccacagaccuccagggacaguccaccugugcccacagcu

SEQ ID NO: 493298 - RNA, 64 nt, Homo Sapiens
ucugguagccuggccuuucccuggccacuggcacuccagggagccaugaggcugcaccgcuuac

SEQ ID NO: 493299 - RNA, 64 nt, Homo Sapiens
ccucaugcgucugcuccuaguggggccugccguguccagggagggugacuggcgcaggucuccu

SEQ ID NO: 493300 - RNA, 64 nt, Homo Sapiens
caagaccuguaccugggguucacaaaagccgguguccagggacucguucccacccccucucagg

SEQ ID NO: 493301 - RNA, 64 nt, Homo Sapiens
ccccagccccuuccaggcggugccugagcgcagcuccagggaagcaugagacccacagacuugg

SEQ ID NO: 493302 - RNA, 64 nt, Homo Sapiens
uguccagugcccuggguucugcagguugcugcuuuccagggauggguuugcuuuaccuguggca

SEQ ID NO: 493303 - RNA, 64 nt, Homo Sapiens
uccuucccugagucacagagagcaagccaagacauccagggaaagaggaagaaaggccuuagug

SEQ ID NO: 493304 - RNA, 64 nt, Homo Sapiens
cucacagaggccugguuugcucagucuucugaacuccagggaccagcccuggugggcauggggu

SEQ ID NO: 493305 - RNA, 64 nt, Homo Sapiens
uuguggucucgggccuggguaugggcuguguccuuccagggaaaucucgaagcaugucuuugcc

SEQ ID NO: 493306 - RNA, 64 nt, Homo Sapiens
acccgcaggagcugggccccaccucagacaucacuccagggagccaccagcuuggauggccguc

SEQ ID NO: 493307 - RNA, 64 nt, Homo Sapiens
gccguuuuuccucuuguccaggcucacgaguuaguccagggauuccauacucccuauucccugg

SEQ ID NO: 493308 - RNA, 64 nt, Homo Sapiens
uacgucugaaacugaguagggaaaggcauacuuuuccagggacuuagggggauaggcuuuggaa

SEQ ID NO: 493309 - RNA, 64 nt, Homo Sapiens
ggucacugccucaggaccccaaucuuaccuguucuccagggacucuccuuggaacuuauggccc

SEQ ID NO: 493310 - RNA, 64 nt, Homo Sapiens
ugcucgucuuguuuaccccuuuggcucccugcauuccagggacucuuauccucggcugcccuuc

SEQ ID NO: 493311 - RNA, 64 nt, Homo Sapiens
uagagaaugggagggagaacccaggggucuggccuccagggaccacugcuaggaugggccgcac

SEQ ID NO: 493312 - RNA, 64 nt, Homo Sapiens
cuccucuccugcccaggacagccaucacugccucuccagggaccagcucccuacagacgcugua

SEQ ID NO: 493313 - RNA, 64 nt, Homo Sapiens
cggggcugugagaggaucaucuuccccuccucucuccagggagcggccaccccacagcucuuuc

SEQ ID NO: 493314 - RNA, 64 nt, Homo Sapiens
cuggggcccuuugguggggcucuuccucucuuccuccagggacuccacuugccugaagcucccc

SEQ ID NO: 493315 - RNA, 64 nt, Homo Sapiens
cauugugcaauggggcuacgaggcugcaucuggcuccagggaagcguguugcaauccaugagug

SEQ ID NO: 493316 - RNA, 64 nt, Homo Sapiens
ccucccaaccaauucaguauuuuucuccccauuuuccagggagaaaucuaaggcgucagaaugu

SEQ ID NO: 493317 - RNA, 64 nt, Homo Sapiens
cuaaggagcagaaaacccaagggcagguggagaguccagggaggcaggauggaucaccagacac

SEQ ID NO: 493318 - RNA, 64 nt, Homo Sapiens
ucaaaauugauaagucacuuggcucucggccuuguccagggagguugggcuaaggagagaugga

SEQ ID NO: 493319 - RNA, 64 nt, Homo Sapiens
ugagcuccugccuuagggccucauuugcucuucauccagggaacugagcacagggggccuccag

SEQ ID NO: 493320 - RNA, 64 nt, Homo Sapiens
ugcuucaaaggccagagucacaggaaggacuucuuccagggagauuaguggugauggagaggag

SEQ ID NO: 493321 - RNA, 64 nt, Homo Sapiens
cucccagccaagaucugucuuccuucauggugccuccagggagccuuccuggucccaggaccuc

SEQ ID NO: 493322 - RNA, 64 nt, Homo Sapiens
acguauccucuguauucaguaaacaggcugccucuccagggagggcugccauucauuccaacag

SEQ ID NO: 493323 - RNA, 64 nt, Homo Sapiens
gcuuuaugugagauaccccacuccacaucaacauuccagggaugagccaaaccagcagggaguu

SEQ ID NO: 493324 - RNA, 64 nt, Homo Sapiens
aucuuugagaccauccauucuccucaguggcuucuccagggaauucuuacagccaaguugugac

SEQ ID NO: 493325 - RNA, 64 nt, Homo Sapiens
uccgcagccccuuuccccacgcccacccccagucuccagggacccuugccugccuccuaggcug

SEQ ID NO: 493326 - RNA, 64 nt, Homo Sapiens
agcacugccuccuguuuucucccucucaugucccuccagggaaaaugacuuuauugcuuaauuu

SEQ ID NO: 493327 - RNA, 64 nt, Homo Sapiens
gcugcuuccugauacacgugagggcagccagugguccagggaugcuacuggaagagcacagggc

SEQ ID NO: 493328 - RNA, 64 nt, Homo Sapiens
cacacaagguaugccugauguugcagugacaucauccagggagaaugaacucaauggacauccg

SEQ ID NO: 493329 - RNA, 64 nt, Homo Sapiens
cuuuuuuuuaaagcucauaagaacuuuccagggauccagggacaaugguacagcuucuggagca

SEQ ID NO: 493330 - RNA, 64 nt, Homo Sapiens
cagggacacuuuuuuuuaaacuggagcagaacuuuccagggauccugccaaaaugguacagcuu

SEQ ID NO: 493331 - RNA, 64 nt, Homo Sapiens
gauucucaccagcguuucugcucguccccgccauuccagggauucagauugguuuaaccaauua

SEQ ID NO: 493332 - RNA, 64 nt, Homo Sapiens
cucaggcuaaccuuugagaucgcuuuccuuuaucuccagggacuuuugaggcacccacaccccc

SEQ ID NO: 493333 - RNA, 64 nt, Homo Sapiens
cuuuugcauaggaaauacuugauuuaauuacagguccagggaugagcugaugguugcuggagga

SEQ ID NO: 493334 - RNA, 64 nt, Homo Sapiens
uuuauucuugcacgauuuaggcaauuaucucucuuccagggaguaccuuuuuuucuaguugaga

SEQ ID NO: 493335 - RNA, 64 nt, Homo Sapiens
cuccucuuggcuuuggaaaagcaaagcucgcuucuccagggagcggcuccgggccugagcauuc

SEQ ID NO: 493336 - RNA, 64 nt, Homo Sapiens
gaaugauauaauuuucaugaaauagucacaguuuuccagggaggauaacauuucuacccaggau

SEQ ID NO: 493337 - RNA, 64 nt, Homo Sapiens
gugacggacccaaggggcaaauagggucccaggguccagggaggggcgccugcugagcacuucc

SEQ ID NO: 493338 - RNA, 64 nt, Homo Sapiens
gaccccucacuuaggcuuuccucugccaccccgguccagggaagaggcucgcucccgcccaugg

SEQ ID NO: 493339 - RNA, 64 nt, Homo Sapiens
uuagaucuggacuggaacugccaggaccaccgccuccagggagucgcugggcaccuggagguau

SEQ ID NO: 493340 - RNA, 64 nt, Homo Sapiens
gagcauuuugguuuccuuaaggcccagcaagacuuccagggacaucucuggugaagccagaaug

SEQ ID NO: 493341 - RNA, 64 nt, Homo Sapiens
gggaaacagccuuccuggagcguugucuggagguuccagggacagggcagccucccagagccga

SEQ ID NO: 493342 - RNA, 64 nt, Homo Sapiens; identical to SEQ ID NO: 55280

SEQ ID NO: 493343 - RNA, 64 nt, Homo Sapiens; identical to SEQ ID NO: 55281

SEQ ID NO: 493344 - RNA, 64 nt, Homo Sapiens; identical to SEQ ID NO: 55282

SEQ ID NO: 493345 - RNA, 64 nt, Homo Sapiens; identical to SEQ ID NO: 55283

SEQ ID NO: 493346 - RNA, 64 nt, Homo Sapiens; identical to SEQ ID NO: 55284

SEQ ID NO: 493347 - RNA, 64 nt, Homo Sapiens; identical to SEQ ID NO: 55285

SEQ ID NO: 493348 - RNA, 64 nt, Homo Sapiens; identical to SEQ ID NO: 55286

SEQ ID NO: 493349 - RNA, 64 nt, Homo Sapiens; identical to SEQ ID NO: 55287

SEQ ID NO: 493350 - RNA, 64 nt, Homo Sapiens; identical to SEQ ID NO: 55288

SEQ ID NO: 493351 - RNA, 64 nt, Homo Sapiens; identical to SEQ ID NO: 55289

SEQ ID NO: 493352 - RNA, 64 nt, Homo Sapiens; identical to SEQ ID NO: 55290

SEQ ID NO: 493353 - RNA, 64 nt, Homo Sapiens; identical to SEQ ID NO: 55291

SEQ ID NO: 493354 - RNA, 64 nt, Homo Sapiens; identical to SEQ ID NO: 55292

SEQ ID NO: 493355 - RNA, 64 nt, Homo Sapiens; identical to SEQ ID NO: 55293

SEQ ID NO: 493356 - RNA, 64 nt, Homo Sapiens; identical to SEQ ID NO: 55294

SEQ ID NO: 493357 - RNA, 64 nt, Homo Sapiens; identical to SEQ ID NO: 55295

SEQ ID NO: 493358 - RNA, 64 nt, Homo Sapiens; identical to SEQ ID NO: 55296

SEQ ID NO: 493359 - RNA, 64 nt, Homo Sapiens; identical to SEQ ID NO: 55297

SEQ ID NO: 493360 - RNA, 64 nt, Homo Sapiens; identical to SEQ ID NO: 55298

SEQ ID NO: 493361 - RNA, 64 nt, Homo Sapiens; identical to SEQ ID NO: 55299

SEQ ID NO: 493362 - RNA, 64 nt, Homo Sapiens; identical to SEQ ID NO: 55300

SEQ ID NO: 493363 - RNA, 64 nt, Homo Sapiens; identical to SEQ ID NO: 55301

SEQ ID NO: 493364 - RNA, 64 nt, Homo Sapiens; identical to SEQ ID NO: 55302

SEQ ID NO: 493365 - RNA, 64 nt, Homo Sapiens; identical to SEQ ID NO: 55303

SEQ ID NO: 493366 - RNA, 64 nt, Homo Sapiens; identical to SEQ ID NO: 55304

SEQ ID NO: 493367 - RNA, 64 nt, Homo Sapiens; identical to SEQ ID NO: 55305

SEQ ID NO: 493368 - RNA, 64 nt, Homo Sapiens; identical to SEQ ID NO: 55306

SEQ ID NO: 493369 - RNA, 64 nt, Homo Sapiens; identical to SEQ ID NO: 55307

SEQ ID NO: 493370 - RNA, 64 nt, Homo Sapiens; identical to SEQ ID NO: 55308

SEQ ID NO: 493371 - RNA, 64 nt, Homo Sapiens; identical to SEQ ID NO: 55309

SEQ ID NO: 493372 - RNA, 64 nt, Homo Sapiens; identical to SEQ ID NO: 55310

SEQ ID NO: 493373 - RNA, 64 nt, Homo Sapiens; identical to SEQ ID NO: 55311

SEQ ID NO: 493374 - RNA, 64 nt, Homo Sapiens; identical to SEQ ID NO: 55312

SEQ ID NO: 493375 - RNA, 64 nt, Homo Sapiens; identical to SEQ ID NO: 55313

SEQ ID NO: 493376 - RNA, 64 nt, Homo Sapiens; identical to SEQ ID NO: 55314

SEQ ID NO: 493377 - RNA, 64 nt, Homo Sapiens; identical to SEQ ID NO: 55315

SEQ ID NO: 493378 - RNA, 64 nt, Homo Sapiens; identical to SEQ ID NO: 55316

SEQ ID NO: 493379 - RNA, 64 nt, Homo Sapiens; identical to SEQ ID NO: 55317

SEQ ID NO: 493380 - RNA, 64 nt, Homo Sapiens; identical to SEQ ID NO: 55318

SEQ ID NO: 493381 - RNA, 64 nt, Homo Sapiens; identical to SEQ ID NO: 55319

SEQ ID NO: 493382 - RNA, 64 nt, Homo Sapiens; identical to SEQ ID NO: 55320

SEQ ID NO: 493383 - RNA, 64 nt, Homo Sapiens; identical to SEQ ID NO: 55321

SEQ ID NO: 493384 - RNA, 64 nt, Homo Sapiens; identical to SEQ ID NO: 55322

SEQ ID NO: 493385 - RNA, 64 nt, Homo Sapiens; identical to SEQ ID NO: 55323

SEQ ID NO: 493386 - RNA, 64 nt, Homo Sapiens; identical to SEQ ID NO: 55324

SEQ ID NO: 493387 - RNA, 64 nt, Homo Sapiens; identical to SEQ ID NO: 55325

SEQ ID NO: 493388 - RNA, 64 nt, Homo Sapiens; identical to SEQ ID NO: 55326

SEQ ID NO: 493389 - RNA, 64 nt, Homo Sapiens; identical to SEQ ID NO: 55327

SEQ ID NO: 493390 - RNA, 64 nt, Homo Sapiens; identical to SEQ ID NO: 55328

SEQ ID NO: 493391 - RNA, 64 nt, Homo Sapiens; identical to SEQ ID NO: 55329

SEQ ID NO: 493392 - RNA, 64 nt, Homo Sapiens; identical to SEQ ID NO: 55330

SEQ ID NO: 493393 - RNA, 64 nt, Homo Sapiens; identical to SEQ ID NO: 55331

SEQ ID NO: 493394 - RNA, 64 nt, Homo Sapiens; identical to SEQ ID NO: 55332

SEQ ID NO: 493395 - RNA, 64 nt, Homo Sapiens; identical to SEQ ID NO: 55333

SEQ ID NO: 493396 - RNA, 64 nt, Homo Sapiens; identical to SEQ ID NO: 55334

SEQ ID NO: 493397 - RNA, 64 nt, Homo Sapiens; identical to SEQ ID NO: 55335

SEQ ID NO: 493398 - RNA, 64 nt, Homo Sapiens; identical to SEQ ID NO: 103925

SEQ ID NO: 493399 - RNA, 64 nt, Homo Sapiens; identical to SEQ ID NO: 103926

SEQ ID NO: 493400 - RNA, 64 nt, Homo Sapiens; identical to SEQ ID NO: 103927

SEQ ID NO: 493401 - RNA, 64 nt, Homo Sapiens; identical to SEQ ID NO: 103928

SEQ ID NO: 493402 - RNA, 64 nt, Homo Sapiens; identical to SEQ ID NO: 103929

SEQ ID NO: 493403 - RNA, 64 nt, Homo Sapiens; identical to SEQ ID NO: 103930

SEQ ID NO: 493404 - RNA, 64 nt, Homo Sapiens; identical to SEQ ID NO: 103931

SEQ ID NO: 493405 - RNA, 64 nt, Homo Sapiens; identical to SEQ ID NO: 103932

SEQ ID NO: 493406 - RNA, 64 nt, Homo Sapiens; identical to SEQ ID NO: 103933

SEQ ID NO: 493407 - RNA, 64 nt, Homo Sapiens; identical to SEQ ID NO: 103934

SEQ ID NO: 493408 - RNA, 64 nt, Homo Sapiens; identical to SEQ ID NO: 103935

SEQ ID NO: 493409 - RNA, 64 nt, Homo Sapiens; identical to SEQ ID NO: 103936

SEQ ID NO: 493410 - RNA, 64 nt, Homo Sapiens; identical to SEQ ID NO: 103937

SEQ ID NO: 493411 - RNA, 64 nt, Homo Sapiens; identical to SEQ ID NO: 103938

SEQ ID NO: 493412 - RNA, 64 nt, Homo Sapiens; identical to SEQ ID NO: 103939

SEQ ID NO: 493413 - RNA, 64 nt, Homo Sapiens; identical to SEQ ID NO: 311765

SEQ ID NO: 493414 - RNA, 64 nt, Homo Sapiens; identical to SEQ ID NO: 311766

SEQ ID NO: 493415 - RNA, 64 nt, Homo Sapiens; identical to SEQ ID NO: 311767

SEQ ID NO: 493416 - RNA, 64 nt, Homo Sapiens; identical to SEQ ID NO: 311768

SEQ ID NO: 493417 - RNA, 64 nt, Homo Sapiens; identical to SEQ ID NO: 311769

SEQ ID NO: 493418 - RNA, 64 nt, Homo Sapiens; identical to SEQ ID NO: 311770

SEQ ID NO: 493419 - RNA, 64 nt, Homo Sapiens; identical to SEQ ID NO: 311771

SEQ ID NO: 493420 - RNA, 64 nt, Homo Sapiens; identical to SEQ ID NO: 311772

SEQ ID NO: 493421 - RNA, 64 nt, Homo Sapiens; identical to SEQ ID NO: 311773

SEQ ID NO: 493422 - RNA, 64 nt, Homo Sapiens; identical to SEQ ID NO: 311774

SEQ ID NO: 493423 - RNA, 64 nt, Homo Sapiens; identical to SEQ ID NO: 311775

SEQ ID NO: 493424 - RNA, 64 nt, Homo Sapiens; identical to SEQ ID NO: 311776

SEQ ID NO: 493425 - RNA, 64 nt, Homo Sapiens; identical to SEQ ID NO: 311777

SEQ ID NO: 493426 - RNA, 64 nt, Homo Sapiens; identical to SEQ ID NO: 311778

SEQ ID NO: 493427 - RNA, 64 nt, Homo Sapiens; identical to SEQ ID NO: 311779

SEQ ID NO: 493428 - RNA, 64 nt, Homo Sapiens; identical to SEQ ID NO: 311780

SEQ ID NO: 493429 - RNA, 64 nt, Homo Sapiens; identical to SEQ ID NO: 311781

SEQ ID NO: 493430 - RNA, 64 nt, Homo Sapiens; identical to SEQ ID NO: 311782

SEQ ID NO: 493431 - RNA, 64 nt, Homo Sapiens; identical to SEQ ID NO: 311783

SEQ ID NO: 493432 - RNA, 64 nt, Homo Sapiens; identical to SEQ ID NO: 311784

SEQ ID NO: 493433 - RNA, 64 nt, Homo Sapiens; identical to SEQ ID NO: 311785

SEQ ID NO: 493434 - RNA, 64 nt, Homo Sapiens; identical to SEQ ID NO: 311786

SEQ ID NO: 493435 - RNA, 64 nt, Homo Sapiens; identical to SEQ ID NO: 311787

SEQ ID NO: 493436 - RNA, 64 nt, Homo Sapiens; identical to SEQ ID NO: 311788

SEQ ID NO: 493437 - RNA, 64 nt, Homo Sapiens; identical to SEQ ID NO: 311789

SEQ ID NO: 493438 - RNA, 64 nt, Homo Sapiens; identical to SEQ ID NO: 311790

SEQ ID NO: 493439 - RNA, 64 nt, Homo Sapiens; identical to SEQ ID NO: 311791

SEQ ID NO: 493440 - RNA, 64 nt, Homo Sapiens; identical to SEQ ID NO: 311792

SEQ ID NO: 493441 - RNA, 64 nt, Homo Sapiens; identical to SEQ ID NO: 311793

SEQ ID NO: 493442 - RNA, 64 nt, Homo Sapiens; identical to SEQ ID NO: 311794

SEQ ID NO: 493443 - RNA, 64 nt, Homo Sapiens; identical to SEQ ID NO: 311795

SEQ ID NO: 493444 - RNA, 64 nt, Homo Sapiens; identical to SEQ ID NO: 311796

SEQ ID NO: 493445 - RNA, 64 nt, Homo Sapiens; identical to SEQ ID NO: 311797

SEQ ID NO: 493446 - RNA, 64 nt, Homo Sapiens; identical to SEQ ID NO: 311798

SEQ ID NO: 493447 - RNA, 64 nt, Homo Sapiens; identical to SEQ ID NO: 311799

SEQ ID NO: 493448 - RNA, 64 nt, Homo Sapiens; identical to SEQ ID NO: 311800

SEQ ID NO: 493449 - RNA, 64 nt, Homo Sapiens; identical to SEQ ID NO: 311801

SEQ ID NO: 493450 - RNA, 64 nt, Homo Sapiens; identical to SEQ ID NO: 311802

SEQ ID NO: 493451 - RNA, 64 nt, Homo Sapiens
cuugauuagauccaaagucaaagcaaccauacuucaccuagagaagacaguauuggcaaucaug

SEQ ID NO: 493452 - RNA, 64 nt, Homo Sapiens
caccucuuguuagacucugugcauuaauaaaacacaccuagagucuguugucauuucacuaaua

SEQ ID NO: 493453 - RNA, 64 nt, Homo Sapiens
uggccgcggccgcccagucuaagcuggagcagcccaccuagagcagucuaaugagaacuccaga

SEQ ID NO: 493454 - RNA, 64 nt, Homo Sapiens
gcacgcagcgugagggugugggcugugccgagugcaccuagaggcuccuggcagcuggaacccu

SEQ ID NO: 493455 - RNA, 64 nt, Homo Sapiens
gcgagagcugaauuuagaaaccuggaauuaagaccaccuagauuaccuucagcacacugaccaa

SEQ ID NO: 493456 - RNA, 64 nt, Homo Sapiens
gcacgugggcaaaguaaucagaacacacauucggcaccuagaagugucaacgucaauaucacag

SEQ ID NO: 493457 - RNA, 64 nt, Homo Sapiens
ucuuauccuuccugugguuuuguuccucccucugcaccuagaacccauuggcuuggccucucuc

SEQ ID NO: 493458 - RNA, 64 nt, Homo Sapiens
ugaucagggucuauuuggaacuucuaccuucugucaccuagauuagaguccccaacccccuugu

SEQ ID NO: 493459 - RNA, 64 nt, Homo Sapiens; identical to SEQ ID NO: 97683

SEQ ID NO: 493460 - RNA, 64 nt, Homo Sapiens; identical to SEQ ID NO: 97684

SEQ ID NO: 493461 - RNA, 64 nt, Homo Sapiens; identical to SEQ ID NO: 97685

SEQ ID NO: 493462 - RNA, 64 nt, Homo Sapiens; identical to SEQ ID NO: 97686

SEQ ID NO: 493463 - RNA, 64 nt, Homo Sapiens; identical to SEQ ID NO: 97687

SEQ ID NO: 493464 - RNA, 64 nt, Homo Sapiens; identical to SEQ ID NO: 97688

SEQ ID NO: 493465 - RNA, 64 nt, Homo Sapiens; identical to SEQ ID NO: 97689

SEQ ID NO: 493466 - RNA, 64 nt, Homo Sapiens; identical to SEQ ID NO: 97690

SEQ ID NO: 493467 - RNA, 64 nt, Homo Sapiens; identical to SEQ ID NO: 97691

SEQ ID NO: 493468 - RNA, 64 nt, Homo Sapiens; identical to SEQ ID NO: 97692

SEQ ID NO: 493469 - RNA, 56 nt, Homo Sapiens; identical to SEQ ID NO: 97693

SEQ ID NO: 493470 - RNA, 64 nt, Homo Sapiens; identical to SEQ ID NO: 97694

SEQ ID NO: 493471 - RNA, 64 nt, Homo Sapiens; identical to SEQ ID NO: 97695

SEQ ID NO: 493472 - RNA, 64 nt, Homo Sapiens; identical to SEQ ID NO: 97696

SEQ ID NO: 493473 - RNA, 64 nt, Homo Sapiens; identical to SEQ ID NO: 97697

SEQ ID NO: 493474 - RNA, 64 nt, Homo Sapiens; identical to SEQ ID NO: 97698

SEQ ID NO: 493475 - RNA, 64 nt, Homo Sapiens; identical to SEQ ID NO: 97699

SEQ ID NO: 493476 - RNA, 64 nt, Homo Sapiens; identical to SEQ ID NO: 97700

SEQ ID NO: 493477 - RNA, 64 nt, Homo Sapiens; identical to SEQ ID NO: 97701

SEQ ID NO: 493478 - RNA, 64 nt, Homo Sapiens; identical to SEQ ID NO: 97702

SEQ ID NO: 493479 - RNA, 64 nt, Homo Sapiens; identical to SEQ ID NO: 97703

SEQ ID NO: 493480 - RNA, 64 nt, Homo Sapiens; identical to SEQ ID NO: 97704

SEQ ID NO: 493481 - RNA, 64 nt, Homo Sapiens; identical to SEQ ID NO: 97705

SEQ ID NO: 493482 - RNA, 64 nt, Homo Sapiens; identical to SEQ ID NO: 97706

SEQ ID NO: 493483 - RNA, 64 nt, Homo Sapiens; identical to SEQ ID NO: 97707

SEQ ID NO: 493484 - RNA, 64 nt, Homo Sapiens; identical to SEQ ID NO: 97708

SEQ ID NO: 493485 - RNA, 64 nt, Homo Sapiens; identical to SEQ ID NO: 97709

SEQ ID NO: 493486 - RNA, 64 nt, Homo Sapiens; identical to SEQ ID NO: 97710

SEQ ID NO: 493487 - RNA, 64 nt, Homo Sapiens; identical to SEQ ID NO: 97711

SEQ ID NO: 493488 - RNA, 64 nt, Homo Sapiens; identical to SEQ ID NO: 97712

SEQ ID NO: 493489 - RNA, 64 nt, Homo Sapiens; identical to SEQ ID NO: 97713

SEQ ID NO: 493490 - RNA, 64 nt, Homo Sapiens; identical to SEQ ID NO: 97714

SEQ ID NO: 493491 - RNA, 64 nt, Homo Sapiens; identical to SEQ ID NO: 97715

SEQ ID NO: 493492 - RNA, 64 nt, Homo Sapiens; identical to SEQ ID NO: 97716

SEQ ID NO: 493493 - RNA, 64 nt, Homo Sapiens; identical to SEQ ID NO: 97717

SEQ ID NO: 493494 - RNA, 64 nt, Homo Sapiens; identical to SEQ ID NO: 97718

SEQ ID NO: 493495 - RNA, 64 nt, Homo Sapiens; identical to SEQ ID NO: 97719

SEQ ID NO: 493496 - RNA, 64 nt, Homo Sapiens; identical to SEQ ID NO: 97720

SEQ ID NO: 493497 - RNA, 64 nt, Homo Sapiens; identical to SEQ ID NO: 97721

SEQ ID NO: 493498 - RNA, 64 nt, Homo Sapiens; identical to SEQ ID NO: 97722

SEQ ID NO: 493499 - RNA, 64 nt, Homo Sapiens; identical to SEQ ID NO: 97723

SEQ ID NO: 493500 - RNA, 64 nt, Homo Sapiens; identical to SEQ ID NO: 97724

SEQ ID NO: 493501 - RNA, 64 nt, Homo Sapiens; identical to SEQ ID NO: 97725

SEQ ID NO: 493502 - RNA, 64 nt, Homo Sapiens; identical to SEQ ID NO: 97726

SEQ ID NO: 493503 - RNA, 64 nt, Homo Sapiens; identical to SEQ ID NO: 97727

SEQ ID NO: 493504 - RNA, 64 nt, Homo Sapiens; identical to SEQ ID NO: 97728

SEQ ID NO: 493505 - RNA, 64 nt, Homo Sapiens; identical to SEQ ID NO: 97729

SEQ ID NO: 493506 - RNA, 64 nt, Homo Sapiens; identical to SEQ ID NO: 97730

SEQ ID NO: 493507 - RNA, 64 nt, Homo Sapiens; identical to SEQ ID NO: 97731

SEQ ID NO: 493508 - RNA, 64 nt, Homo Sapiens; identical to SEQ ID NO: 97732

SEQ ID NO: 493509 - RNA, 64 nt, Homo Sapiens; identical to SEQ ID NO: 97733

SEQ ID NO: 493510 - RNA, 64 nt, Homo Sapiens; identical to SEQ ID NO: 97734

SEQ ID NO: 493511 - RNA, 64 nt, Homo Sapiens
uauuucucauuuaacuuuacuguuaagacaucacugaaaugaacuucaguaagcuuucaauuuu

SEQ ID NO: 493512 - RNA, 64 nt, Homo Sapiens
cacuuaaccucucuuugccucaauuuccucaucuugaaaugaggauaauaauaccugcuguacc

SEQ ID NO: 493513 - RNA, 64 nt, Homo Sapiens
cuuucugauuucuuggagcaggaauuuuagagauugaaaugaaugaucauuuagucagauuuau

SEQ ID NO: 493514 - RNA, 64 nt, Homo Sapiens
cucuagggagaaaaauuaauuuacuagaaaggcaugaaaugaucaugggaagagugguuaagac

SEQ ID NO: 493515 - RNA, 64 nt, Homo Sapiens
gugcuguguucuauauaaaaaacauaauaaaaauugaaaugaaagaauaauuguuauuauaaaa

SEQ ID NO: 493516 - RNA, 56 nt, Homo Sapiens
uuaccauggaaacugagugaaugguuugaaaugaagacuuugucguguacuuagga

SEQ ID NO: 493517 - RNA, 64 nt, Homo Sapiens
ucaccaccuaaauguaauguugauuccucaagaaugaaaugaaggcacuacauugaaauauguu

SEQ ID NO: 493518 - RNA, 64 nt, Homo Sapiens
guuuuggaaaauagaguaauuuaaaaaauauauuugaaaugaaaaucuccaacacauuagaaga

SEQ ID NO: 493519 - RNA, 64 nt, Homo Sapiens
uccacccaauacauuauuagacugaacugugaccugaaaugagcaauaaacucuguauuaauuc

SEQ ID NO: 493520 - RNA, 64 nt, Homo Sapiens
cggaaagacagcuaucaggaguguuaaugaguagugaaaugauguugccuauauauuuaugacu

SEQ ID NO: 493521 - RNA, 64 nt, Homo Sapiens
uuguucacuugagggauuagacuaaauuacuggaugaaaugaaauuugaggcccagcaagcacc

SEQ ID NO: 493522 - RNA, 64 nt, Homo Sapiens
uuuuauucacauagauacuauguccuugacauauugaaaugauucuuuucugaaaguauucaug

SEQ ID NO: 493523 - RNA, 64 nt, Homo Sapiens
uaucccuucauuguaaaaaguaccuaaacauucgugaaaugauuuuuuuuagcugaaaaaugcu

SEQ ID NO: 493524 - RNA, 64 nt, Homo Sapiens
gacuagaccaaauaucaagaucauuuugagacucugaaaugaaguaaaagagauuuccugugac

SEQ ID NO: 493525 - RNA, 64 nt, Homo Sapiens
auuuaaaaaccauuaaaacacugucucccacucaugaaaugagccacguaguuccuauuuaaug

SEQ ID NO: 493526 - RNA, 64 nt, Homo Sapiens
cagaguucuuaagggacuggguaaggccugacccugaaaugaccauggauauuuuucuaccuac

SEQ ID NO: 493527 - RNA, 64 nt, Homo Sapiens
gaacugacugauaaagcugugugggccaaaauauugaaaugaugacauguuucaaaguggugug

SEQ ID NO: 493528 - RNA, 64 nt, Homo Sapiens
uuucucuauagccauauuuaaacaauuguaauaaugaaaugagccccauguuacaaggaaguua

SEQ ID NO: 493529 - RNA, 64 nt, Homo Sapiens
ccuuguuuaaacauuaaaauuggaauuuuugaaaugaaaugaaacaucuuuaugcuaauagauu

SEQ ID NO: 493530 - RNA, 64 nt, Homo Sapiens
ugaaaccuuguuuaaacauuagauuuggaauuuuugaaaugaaauguuacaucuuuaugcuaau

SEQ ID NO: 493531 - RNA, 64 nt, Homo Sapiens
aaaacaaauuguguuuuauuuuuuuuuuuuuuugugaaaugaaaacaaagcacaauuucccgcc

SEQ ID NO: 493532 - RNA, 64 nt, Homo Sapiens
ucuuaaagaaaagacuuguugaaagaauagacugugaaaugaguggacagagacuuugcaaucc

SEQ ID NO: 493533 - RNA, 64 nt, Homo Sapiens
caauucaucaagccaguuauuacugaaaaaucauugaaaugagacaguuuacagucauuucugc

SEQ ID NO: 493534 - RNA, 64 nt, Homo Sapiens
uaauagauugaguucuguaagggcaaaaacggauugaaaugaacauagcguuuugcacuaauga

SEQ ID NO: 493535 - RNA, 64 nt, Homo Sapiens
guuucuuauauuuauguauuucuauucugauuucugaaaugauaaccuaguagugucugaugaa

SEQ ID NO: 493536 - RNA, 64 nt, Homo Sapiens
auguaagugucagauacuaggcagguguuagggaugaaaugaugaaugaggcauggaccuguuc

SEQ ID NO: 493537 - RNA, 64 nt, Homo Sapiens
uuuaguuaggaaaaagcuggauauaaagguuuggugaaaugaacuacuuggauauucauguaau

SEQ ID NO: 493538 - RNA, 64 nt, Homo Sapiens
gguaaggagaagcuggauuaaaauuauuaauuuaugaaaugauacuuuggauuaugauuuuaag

SEQ ID NO: 493539 - RNA, 64 nt, Homo Sapiens
cuguuuaauaagagcaaauauaggggaaaaucuuugaaaugaaagcuacaaauacaugugagaa

SEQ ID NO: 493540 - RNA, 64 nt, Homo Sapiens
ccuggggcuggcuaggccuccacuuguccaucugugaaaugaaaggaucagccuggacagcccu

SEQ ID NO: 493541 - RNA, 64 nt, Homo Sapiens
uucucuuuauaaauauuuuugcucccucagauuuugaaaugauuuuaucaguuuuagagaggca

SEQ ID NO: 493542 - RNA, 64 nt, Homo Sapiens
ugaauggauacaauagguuaaggcccaagauguuugaaaugaaugcaauauuaauagaugcaua

SEQ ID NO: 493543 - RNA, 64 nt, Homo Sapiens
uaguggcuaaagcccugaaaugucugcuuuuccaugaaaugaaaucacucuguuuguuaggaga

SEQ ID NO: 493544 - RNA, 64 nt, Homo Sapiens
gugggccagaugaguauguuuuuuugccuaaauuugaaaugaggauaaagccucagggaggcca

SEQ ID NO: 493545 - RNA, 64 nt, Homo Sapiens
caauggcuugaaacuuguguaucauaugugauuuugaaaugaacaccuugaauagcacuaauuu

SEQ ID NO: 493546 - RNA, 64 nt, Homo Sapiens
caauuuugugacuguuaccaugugaaaguccuguugaaaugaacaauugucugccccacaauca

SEQ ID NO: 493547 - RNA, 64 nt, Homo Sapiens
cgugugaccauaagauacugauagcauugagucuugaaaugauuuaauaauaugagugaggauu

SEQ ID NO: 493548 - RNA, 64 nt, Homo Sapiens
ccuuacugcuuauuaaucuguauuguacacaugaugaaaugaagcagaagcugggagucggccu

SEQ ID NO: 493549 - RNA, 64 nt, Homo Sapiens
cacaccuagcuaauuuuuuucaucauaaaguggaugaaaugagcaaguaccuaaaaauuuuauu

SEQ ID NO: 493550 - RNA, 64 nt, Homo Sapiens
aaaacagacauguaggagacauucaacaggaguaugaaaugagaguuagaccauaugggcugac

SEQ ID NO: 493551 - RNA, 64 nt, Homo Sapiens
uucuuauaacauauccagccauuucaauuuugauugaaaugaacuacaaagaauaguguuuguc

SEQ ID NO: 493552 - RNA, 64 nt, Homo Sapiens
ugguagccucagucucuuuaucacuaacuuggauugaaaugagugaggccaacucacauuccca

SEQ ID NO: 493553 - RNA, 64 nt, Homo Sapiens
gaaggcaagaaagaaccaugcaaauauacaaauaugaaaugaggggauguucacuauggaaaaa

SEQ ID NO: 493554 - RNA, 64 nt, Homo Sapiens
auaaaaaggauauaauuucugaacuuuguauacuugaaaugauaacaaaauucuaaucuauguu

SEQ ID NO: 493555 - RNA, 64 nt, Homo Sapiens
uccuauuugaccccuuuucuuuuuugaaauucccugaaaugauguuauucuagagaacuucuau

SEQ ID NO: 493556 - RNA, 64 nt, Homo Sapiens
uggauuagcuuaaucaccaaguccugucaacuucugaaaugaaucucaaauuucuucccuucuc

SEQ ID NO: 493557 - RNA, 64 nt, Homo Sapiens
uuucgauccuguuuauucaaaugugugauuuugcugaaaugaaagggauaaaaugaauacuuag

SEQ ID NO: 493558 - RNA, 64 nt, Homo Sapiens
aaaagcauacuuaguacuccuguauuuguucuuaugaaaugacuaucugccuucuuguaucuag

SEQ ID NO: 493559 - RNA, 64 nt, Homo Sapiens
auauucuguagauugauugcagauuucuuaaaucugaaaugaucuuuacacuguaauucucagc

SEQ ID NO: 493560 - RNA, 64 nt, Homo Sapiens
gauuauaucuaaauggauuauuuguuaaaaguacugaaaugaguauaaggcaguaucacccauc

SEQ ID NO: 493561 - RNA, 64 nt, Homo Sapiens
acuuuauuccacauaaacaaaacuuuugaugaaaugaaaugacacacauacuggaugcucaaua

SEQ ID NO: 493562 - RNA, 64 nt, Homo Sapiens
ugacaacuuuauuccacauacaauaaacuuuugaugaaaugaaaccuagcacauacuggaugcu

SEQ ID NO: 493563 - RNA, 64 nt, Homo Sapiens
gacaucagguauuuggaaggugccagaagguaccugaaaugaguagaagaaacagacccaaagu

SEQ ID NO: 493564 - RNA, 64 nt, Homo Sapiens
aggaacggagaaugaaguauagucaagcuguggaugaaaugaccaaggaaccaugauugacaac

SEQ ID NO: 493565 - RNA, 64 nt, Homo Sapiens
gaauagaaauccaauaaaagaugaaaauuuggaaugaaaugaagggaaccacauuuuuaucuag

SEQ ID NO: 493566 - RNA, 64 nt, Homo Sapiens
cuggaugggacucuacacauuuucucgggaaaucugaaaugaugucuugaucuuccuuuacaca

SEQ ID NO: 493567 - RNA, 64 nt, Homo Sapiens
gaaaaacaaucauuggacggagcuacuguaaguaugaaaugaaacugaaauauauauuuuaaac

SEQ ID NO: 493568 - RNA, 64 nt, Homo Sapiens
ggcugcuuuuagggcccuccgagggucaaggggaugaaaugagguuauuucacaagaggagugu

SEQ ID NO: 493569 - RNA, 64 nt, Homo Sapiens
aucugguaauguacauugugagguagacugauaaugaaaugacaguguaacaucuuaaccaaga

SEQ ID NO: 493570 - RNA, 64 nt, Homo Sapiens
uuaauaacaaauaggcguaaaaaaauuuucacauugaaaugauagaaacauuugauguaauaaa

SEQ ID NO: 493571 - RNA, 64 nt, Homo Sapiens
ccaaaugcugugagucugaaguaugugccuggugugaaaugaucuauggccuguuucuuacaca

SEQ ID NO: 493572 - RNA, 64 nt, Homo Sapiens
cuauacuuuggcagguuaugaacuuugaaugugaugaaaugacacguuuggcugcauuuggaug

SEQ ID NO: 493573 - RNA, 64 nt, Homo Sapiens
cuuugacaagcuugccaauuguaaaauguuagacugaaaugauugacaaauauuuauccacuaa

SEQ ID NO: 493574 - RNA, 64 nt, Homo Sapiens
cuuugaaaugcauauugauuuaaaauauuuugacugaaaugauuauaaauauuugucuaccaag

SEQ ID NO: 493575 - RNA, 64 nt, Homo Sapiens
cugggguauaguuuguccuaaaaugguaaaaacuugaaaugaggugaaaugagaacaaagagga

SEQ ID NO: 493576 - RNA, 64 nt, Homo Sapiens
acaaagaggaaaaugguaaaugcaauauuuaaaaugaaaugagauguauauuauuauuaaucaa

SEQ ID NO: 493577 - RNA, 64 nt, Homo Sapiens
gucccugacaugaagcuccccugcccaaagucugugaaaugaaaugcaccucccagaggugcag

SEQ ID NO: 493578 - RNA, 64 nt, Homo Sapiens
ggcaagaaguggggaugaugcugggcacucauggugaaaugacacuagauggcugccugcuuuc

SEQ ID NO: 493579 - RNA, 64 nt, Homo Sapiens
cucaauauucucagaauaauuuucaauguauuaaugaaaugaaaugauaauuuggcuucauauc

SEQ ID NO: 493580 - RNA, 64 nt, Homo Sapiens
uauucucagaauaauuuucaauguauuaaugaaaugaaaugauaauuuggcuucauaucuagac

SEQ ID NO: 493581 - RNA, 64 nt, Homo Sapiens
auggcaguaauggggcaaacaauaaaaugcaaugugaaaugauuugaugauuugggaaauaaga

SEQ ID NO: 493582 - RNA, 64 nt, Homo Sapiens
uauaaauacagucuuaaaccuuuaugucugagucugaaaugaaccuguucacuuagacuagauu

SEQ ID NO: 493583 - RNA, 64 nt, Homo Sapiens
augggcaguaauaugugacaacagcaacacccccuaccaccaggacguagcucccagggagcuc

SEQ ID NO: 493584 - RNA, 64 nt, Homo Sapiens
uggaucccagcugccuuccuuggacauuccagacuaccaccaacacccggccaucaacccaaau

SEQ ID NO: 493585 - RNA, 64 nt, Homo Sapiens
cccuucucuauuugggaaacuauuugagaaucucuaccaccauuucuaccaccauucccuucuc

SEQ ID NO: 493586 - RNA, 64 nt, Homo Sapiens
cccuucucuauuugagaaucaggcugagaaucucuaccaccauuucuguuacagcucaaaaugg

SEQ ID NO: 493587 - RNA, 64 nt, Homo Sapiens
uaagagauauuacuuuauugaauaugguuggcauuaaauuuagcauuucauuaucuaacaaaau

SEQ ID NO: 493588 - RNA, 64 nt, Homo Sapiens
aauuucaaagucaauaccagcagauucaugaaaguaaauuuaguccuauaauuuucagcuuaau

SEQ ID NO: 493589 - RNA, 64 nt, Homo Sapiens
gacaaaaugagacauugucucuaaaauacauaaguaaauuuaaaaaaaaaagaauaauaauuug

SEQ ID NO: 493590 - RNA, 64 nt, Homo Sapiens
aaaaacuaguaagcaaauaaaugauaaacauaaguaaauuuaaacuguuguuuguauaaaacaa

SEQ ID NO: 493591 - RNA, 64 nt, Homo Sapiens
uaggcauguuuggaggcuuuccuauucuagcauuuaaauuuaaauuuuauuaaaauuaaauaau

SEQ ID NO: 493592 - RNA, 64 nt, Homo Sapiens
uuuuauuaaaauuaaauaauuuaaaucuagcauuuaaauuuaaauaauuuaagucuagcauuua

SEQ ID NO: 493593 - RNA, 64 nt, Homo Sapiens
uucacacaguccacaaggggcaaauacauaaagauaaauuuauugcacaucuauggcuacuguu

SEQ ID NO: 493594 - RNA, 64 nt, Homo Sapiens
uugcggaaagguaaccacaaugugauuuuuuuuuuaaauuuaugugugugaguguaugugugug

SEQ ID NO: 493595 - RNA, 64 nt, Homo Sapiens
uacauacuguucuaauuuugaaaagaaacauugguaaauuuaaaguguguuaaaauguuccugu

SEQ ID NO: 493596 - RNA, 64 nt, Homo Sapiens
uauaaauugaccauugaugacagaauuugaguuauaaauuuaaauaacauuaaugcaaaucaug

SEQ ID NO: 493597 - RNA, 64 nt, Homo Sapiens
ucaaggauugaaaaauuaaccacauuuguugacuuaaauuuaaucauagagaaaauacuuaaua

SEQ ID NO: 493598 - RNA, 64 nt, Homo Sapiens
uauacuuucagugccauuguuuuuaugucucuuguaaauuuauauaaauuuaccuagcuacaac

SEQ ID NO: 493599 - RNA, 64 nt, Homo Sapiens
uagcuacaacuuuuaugucuacaugauaaucuuuuaaauuuaccauucaaaaaugaguuaagua

SEQ ID NO: 493600 - RNA, 64 nt, Homo Sapiens
uaguaaucauugcuuucuguagaagaaaaagguuuaaauuuaaaauguguauuuagagcaugga

SEQ ID NO: 493601 - RNA, 64 nt, Homo Sapiens
uaaugagucaauaccuuuauaagcaaaaccaugauaaauuuaaaaacaacagaaauguggcaug

SEQ ID NO: 493602 - RNA, 64 nt, Homo Sapiens
gguguuggcuuuguuuggauguaauuuaggguacuaaauuuaaauuuaaagauauuguucaaac

SEQ ID NO: 493603 - RNA, 64 nt, Homo Sapiens
ggcuuuguuuggauguaauuuaggguacuaaauuuaaauuuaaagauauuguucaaacaauauc

SEQ ID NO: 493604 - RNA, 64 nt, Homo Sapiens
aggaaauguaagagguuuuguugucuguuuuaaauaaauuuaauucggaacacaugauccaaca

SEQ ID NO: 493605 - RNA, 64 nt, Homo Sapiens
gauucuggaguucuuugaaaugugcuggaagacuuaaauuuauuaaucuuaaaucauguacuuu

SEQ ID NO: 493606 - RNA, 64 nt, Homo Sapiens
guugccaaucacauagcuuucuauuuguuaaguauaaauuuaaauuuaaaaucacuuuuuuaac

SEQ ID NO: 493607 - RNA, 64 nt, Homo Sapiens
aaucacauagcuuucuauuuguuaaguauaaauuuaaauuuaaaaucacuuuuuuaacgaaugg

SEQ ID NO: 493608 - RNA, 64 nt, Homo Sapiens
ucucaaaaccacuauuuuuaauccaaaauauuaauaaauuuagagcuuuuggcugagaaaagga

SEQ ID NO: 493609 - RNA, 64 nt, Homo Sapiens
uauuauucuuuuacucauuuuaaccuguagcuuauaaauuuacuugguuguaauaugugauggu

SEQ ID NO: 493610 - RNA, 64 nt, Homo Sapiens
uugagccccagucucagaaacuaaacccuuaaccuaaauuuaacgcuaucuuagcuaacuuauc

SEQ ID NO: 493611 - RNA, 64 nt, Homo Sapiens
aguguuaauaaaauuuaucuguauccaaaauauuuaaauuuaugaucuaacugauaaaggucua

SEQ ID NO: 493612 - RNA, 64 nt, Homo Sapiens
auuauucaagaaagugaaaaauuuugucaaaaacuaaauuuauguagauuucuauaaaagcaag

SEQ ID NO: 493613 - RNA, 64 nt, Homo Sapiens
caguauuuauuuuuucaaaaaauacuguuauaucuaaauuuaaauaaaauaaauuuuuauaagg

SEQ ID NO: 493614 - RNA, 64 nt, Homo Sapiens
agguaaugauacagagauuguuaagaauggcagauaaauuuaacgccagaaggaagaagagacg

SEQ ID NO: 493615 - RNA, 64 nt, Homo Sapiens
gucaaguuacaacaacugaaagaugguuucuguuuaaauuuaugauuagaauguaugucucaga

SEQ ID NO: 493616 - RNA, 64 nt, Homo Sapiens
uuugaguuguuuguugcuaauauugugaguaaauuaaauuuacauuaaaaagucaaggguucua

SEQ ID NO: 493617 - RNA, 64 nt, Homo Sapiens
auuccuaacccgaaugaaaugaaaagaaacuaguuaaauuuacuucugaaauguucguuuugug

SEQ ID NO: 493618 - RNA, 64 nt, Homo Sapiens
uaggcuucuugguacaccagauuauuuauaacauuaaauuuaugaguauuuuacucugaauucu

SEQ ID NO: 493619 - RNA, 64 nt, Homo Sapiens
acaaugaagcaccuaaaaacacugcuugauauuauaaauuuaaaacacaagugaaaguuuagcc

SEQ ID NO: 493620 - RNA, 64 nt, Homo Sapiens
uuguaauugcuuuuuuaaauauuaguuaauggauuaaauuuaauucuucagcguaaaaugguga

SEQ ID NO: 493621 - RNA, 64 nt, Homo Sapiens
ucauuuuauuaauauuuuucuccuugaccucucauaaauuuacuuuacacaauucuuacccugu

SEQ ID NO: 493622 - RNA, 64 nt, Homo Sapiens
gagucuaugauacuguauaacaggggcuucuaauuaaauuuaggggauccugaugccacuuagc

SEQ ID NO: 493623 - RNA, 64 nt, Homo Sapiens
caagcugauuuuaagugauauucagauggccuuuuaaauuuaauuauuauguauuuaaaauuua

SEQ ID NO: 493624 - RNA, 64 nt, Homo Sapiens
acuuaacuaaauaaaaaacuaagcagauaugaguuaaauuuaaaaguuucaauuuauugcucag

SEQ ID NO: 493625 - RNA, 64 nt, Homo Sapiens
uuauuguauaugaugaacaaaacuuaaaauuuuuuaaauuuaauuuuuaaauacuguuucagag

SEQ ID NO: 493626 - RNA, 64 nt, Homo Sapiens
ggcaaaaauaauggucuaagccucccaauagggauaaauuuagggugacuguguggcugacuau

SEQ ID NO: 493627 - RNA, 64 nt, Homo Sapiens
gaacuuuuguauuuuucauuuuucauuugauuuguaaauuuacuuauguuaaaaauaaaccauu

SEQ ID NO: 493628 - RNA, 64 nt, Homo Sapiens
accguuuugaacagacauucauuguguuuaagacuaaauuuacuguauggucgcaguaaaugaa

SEQ ID NO: 493629 - RNA, 64 nt, Homo Sapiens
ggucagaaauguauuugaagaauuaguaucuacuuaaauuuaguuuguuaauauggcaguaauu

SEQ ID NO: 493630 - RNA, 64 nt, Homo Sapiens
cugcucuguaaauaaagcuaauuaaacgucuguguaaauuuaaaaaggggaaauacuuuaauuu

SEQ ID NO: 493631 - RNA, 64 nt, Homo Sapiens
uaccuucucuuguacauagucagacuauuuguauuaaauuuacauuucauucuaaguucaaaag

SEQ ID NO: 493632 - RNA, 64 nt, Homo Sapiens
uaauuuuuacucugaugugcaauacauuuguuauuaaauuuauuauuuaagaugguagcacuag

SEQ ID NO: 493633 - RNA, 64 nt, Homo Sapiens
gaaaaauaauuauggggaaauacauguuuguuauuaaauuuauuauuaaagauaguagcacuag

SEQ ID NO: 493634 - RNA, 64 nt, Homo Sapiens
acugguaaagaauaacuauaaaauaugaaagcucuaaauuuaaaauaaauuuagagauagaauc

SEQ ID NO: 493635 - RNA, 64 nt, Homo Sapiens
auaacuauaaaauaugaaagcucuaaauuuaaaauaaauuuagagauagaaucaugguacauua

SEQ ID NO: 493636 - RNA, 64 nt, Homo Sapiens
ugccuuuuacuuuuaugucaacaauauuaauuauuaaauuuaguaagacgcacuuuccuuucuu

SEQ ID NO: 493637 - RNA, 64 nt, Homo Sapiens
cuucaaucauuauaauccugucuuuuguuaagaauaaauuuagguuaauaguuuuaaaaauguc

SEQ ID NO: 493638 - RNA, 64 nt, Homo Sapiens
augcagagagaccaaugguuaguaacuugaaguuuaaauuuaaaaguagaaucuuuugugcuuc

SEQ ID NO: 493639 - RNA, 64 nt, Homo Sapiens
gccucauaccauuuuuuguguuaaaucaauguaauaaauuuauuauguuuacaguguagaauga

SEQ ID NO: 493640 - RNA, 64 nt, Homo Sapiens
aaguacuaaagagccaacaugucaugcaucaaaauaaauuuacuuaaauuucccuuuuauuuug

SEQ ID NO: 493641 - RNA, 64 nt, Homo Sapiens
uaccaacaucuauugucaacuucuguguuccauguaaauuuauuaauuauuucucuggauaucu

SEQ ID NO: 493642 - RNA, 64 nt, Homo Sapiens
ucuuuauuuaccuggguuugugccuuacgcuuacuaaauuuaaaaaauagaaaggcugcuuuag

SEQ ID NO: 493643 - RNA, 64 nt, Homo Sapiens
uuggguacuuagaggauaaagcuucguggucguauaaauuuagaucauuuggauugauuuuuau

SEQ ID NO: 493644 - RNA, 64 nt, Homo Sapiens
gaacaucuuuuggcauuccacuaaguauauauuguaaauuuaaugaacaaucaagguucacaau

SEQ ID NO: 493645 - RNA, 64 nt, Homo Sapiens
uuuguuauucaguaguuuugcagacuuaaaaguguaaauuuagaauuagaagaugaagcuauag

SEQ ID NO: 493646 - RNA, 64 nt, Homo Sapiens
aacaauuuuuaaaauucagaauguaaaaauuggguaaauuuacuacugaggggagugcacuuau

SEQ ID NO: 493647 - RNA, 64 nt, Homo Sapiens
aaggcguuauguguugaacaguaugcuucagggguaaauuuaaaauagucucuugaagcccuag

SEQ ID NO: 493648 - RNA, 64 nt, Homo Sapiens
aaugaaccaauuacacucuugaaccacagaugaguaaauuuaauuuaaauuuguguuauuuuuu

SEQ ID NO: 493649 - RNA, 64 nt, Homo Sapiens
uucaaaguucaucacacagcguagagaauuugcuuaaauuuaacugcugauggugugauuaggu

SEQ ID NO: 493650 - RNA, 64 nt, Homo Sapiens
guagacauuuuuauuuauauuugaauauuuagcauaaauuuaaucugccuauaaauuuacucug

SEQ ID NO: 493651 - RNA, 64 nt, Homo Sapiens
cuguugaauauuuagcauaaguuauuucugccuauaaauuuacuuggggcuaguuuaagacuua

SEQ ID NO: 493652 - RNA, 64 nt, Homo Sapiens
cauuucuguuucuaaauauuggugauucuucagcuaaauuuaguauguguuuuaauggcaccug

SEQ ID NO: 493653 - RNA, 64 nt, Homo Sapiens
uuacacuaauaaccaauuauuuggacuugguugcuaaauuuaacuuugacaacuccuagugaac

SEQ ID NO: 493654 - RNA, 64 nt, Homo Sapiens
gucccaagaauucagcuacaugaugacucgaauuuaaauuuagauuaaucaaauggucuccugu

SEQ ID NO: 493655 - RNA, 64 nt, Homo Sapiens
uggagcauauacaguucucauuauacucuuauuuuaaauuuauauuugaacacagucaaaucug

SEQ ID NO: 493656 - RNA, 64 nt, Homo Sapiens
uuuguccuccaacuguuugcauuuuugauagaauuaaauuuaaauaaauuuauccuccaacuaa

SEQ ID NO: 493657 - RNA, 64 nt, Homo Sapiens
cuccaacuaaauuuuugauagauagaauuaaauuuaaauuuaucuuuaaauuugauaaauuuuu

SEQ ID NO: 493658 - RNA, 64 nt, Homo Sapiens
uuuauccuccaacuaaauuuauuuuugauagaauuaaauuuaaagcacaauuuaaauuugauaa

SEQ ID NO: 493659 - RNA, 64 nt, Homo Sapiens
aauuuaguaguacuaaaugguuucaaaaguggaauaaauuuauuagguggauuuuuggcuguca

SEQ ID NO: 493660 - RNA, 64 nt, Homo Sapiens
aauuuuaauuuagugaacagggcucuuggcaguuuaaauuuaguucuugugcagacaacaucau

SEQ ID NO: 493661 - RNA, 64 nt, Homo Sapiens
aaaauuaaaauccaguuccuuuaaaaauuuauauuaaauuuauugaauugaaauaaguaucagu

SEQ ID NO: 493662 - RNA, 64 nt, Homo Sapiens
uauuuuucaacagaaggcuauuuucugagaaacauaaauuuacacuuaaaauucugaauucguc

SEQ ID NO: 493663 - RNA, 64 nt, Homo Sapiens
cuucuuauuuccacacuggaaaauucauuguuuuuaaauuuagauuuuauaguuaugcuuuuua

SEQ ID NO: 493664 - RNA, 64 nt, Homo Sapiens
gucacuguguauauaauguuauauuacaacuagcuaaauuuauuaaacuuuauuaauguauuaa

SEQ ID NO: 493665 - RNA, 64 nt, Homo Sapiens
uuucaaagucaagaacauuaacuuagccaaggcuuaaauuuauucaaaaaagaucccugggauu

SEQ ID NO: 493666 - RNA, 64 nt, Homo Sapiens
uuucuaucucuuguaagucacccccaugagcucuuaaauuuagacauuuucuuccccaccccaa

SEQ ID NO: 493667 - RNA, 64 nt, Homo Sapiens
acuuaaaucagaggaaggauuuuauaaagauuaauaaauuuaauuuuaccaauaaauauuccca

SEQ ID NO: 493668 - RNA, 64 nt, Homo Sapiens
agcuaagaaaacugagaacuaacauuaaaaaaauuaaauuuagaauaagaaugauuucuuuaau

SEQ ID NO: 493669 - RNA, 64 nt, Homo Sapiens
uuugaauacucuauugcugauauaaugcaagauuuaaauuuauacauauaacuaauuucaaaug

SEQ ID NO: 493670 - RNA, 64 nt, Homo Sapiens
cuuuauucuguguaauuguguuaauaaauccuaauaaauuuaaauuuuuaaaauuuuacaaacc

SEQ ID NO: 493671 - RNA, 64 nt, Homo Sapiens
caacauggcuuguuagaaaauaauaucauuaauauaaauuuaaacauacucuucaagaucauaa

SEQ ID NO: 493672 - RNA, 64 nt, Homo Sapiens
gaaacaaaaaauuccuaagaacuguacuuuuguuuaaauuuaauugggccuggcaacauuuucu

SEQ ID NO: 493673 - RNA, 64 nt, Homo Sapiens
guaucaugcgaguuuuuuuuauuucauagcauuuuaaauuuaguuuuuuagagaguaauguaua

SEQ ID NO: 493674 - RNA, 64 nt, Homo Sapiens
acuggccugguuugccuuuuauguuucuguuucuuaaauuuaaaugauacaagaagcacugaca

SEQ ID NO: 493675 - RNA, 64 nt, Homo Sapiens
uaugcaaaauguuuaagucagcuaaaacucuauguaaauuuaagcagucaugccuuauuuucuu

SEQ ID NO: 493676 - RNA, 64 nt, Homo Sapiens
auuugcuauacugaacugauuuguaggcaccuaauaaauuuauucggcuuucaguauuuuguac

SEQ ID NO: 493677 - RNA, 64 nt, Homo Sapiens
guguauggaucaaaagugaaagagacaguauuaguaaauuuauuuaaugguaaggauugacuca

SEQ ID NO: 493678 - RNA, 64 nt, Homo Sapiens
ucaccuacaaaaggcuuuuucaaggaaaucccuguaaauuuaacauaggaaacuaugugugucc

SEQ ID NO: 493679 - RNA, 64 nt, Homo Sapiens
auacugcauauccuggugucguguaaucucugauuaaauuuaaugcuguuuuaugucauacucu

SEQ ID NO: 493680 - RNA, 64 nt, Homo Sapiens
ugcauauagauaauuauccauucuuuuauaucuguaaauuuaacauaagggaguaggcuguauu

SEQ ID NO: 493681 - RNA, 64 nt, Homo Sapiens
aacauucauuuggcuucauuguuaaauaaauuuauaaauuuaauauuccaagaagaucuggaaa

SEQ ID NO: 493682 - RNA, 64 nt, Homo Sapiens
aauuuaauaacauucauuugucuggaaaguuaaauaaauuuauaugacauuuauuccaagaaga

SEQ ID NO: 493683 - RNA, 64 nt, Homo Sapiens
gaaaaugcuaagguugucaagcucacaauaagcuuaaauuuauagaaguguuugaaauguucaa

SEQ ID NO: 493684 - RNA, 64 nt, Homo Sapiens
gucuguaucacuagugccuagaggacaaggaaacuaaauuuaaucucuggacugugaagucacu

SEQ ID NO: 493685 - RNA, 64 nt, Homo Sapiens
ucuaucauuugguacuaucacauuaauuuaucauuaaauuuaguccuuuuaaauuuaguucuau

SEQ ID NO: 493686 - RNA, 64 nt, Homo Sapiens
ucuaucauuaauuuaucauuugacuuuuuccuuuuaaauuuaguucugcuuaacaaacuuagaa

SEQ ID NO: 493687 - RNA, 64 nt, Homo Sapiens
aauuuuuuagauucacuugauauuuaccauaaacuaaauuuagacuauuuuagguauuuugagg

SEQ ID NO: 493688 - RNA, 64 nt, Homo Sapiens
augugacccuucagguauuggaaaaacuaaaaaauaaauuuaaaaaucauuuguugacaaaaaa

SEQ ID NO: 493689 - RNA, 64 nt, Homo Sapiens
auaugguacaguucuuuguaaaguuuacuagcaguaaauuuauggaaagauuucugguggcuua

SEQ ID NO: 493690 - RNA, 64 nt, Homo Sapiens
guaucgagagcaccaccuucagaaaaccaaaaacuaaauuuauguguuagcaaauauuaauggc

SEQ ID NO: 493691 - RNA, 64 nt, Homo Sapiens
gcuuucacuacuuuugaauucagauuugagucacuaaauuuauuucugaaaagucuccauuuac

SEQ ID NO: 493692 - RNA, 64 nt, Homo Sapiens
acuagcuccaaaagagcaguaaaauuagaagaauuaaauuuaaacguacaauuucugucucaac

SEQ ID NO: 493693 - RNA, 64 nt, Homo Sapiens
aaguaauacuuauuggcugaaaucauuuugaauauaaauuuaagacaaagcuguaaauuuaaag

SEQ ID NO: 493694 - RNA, 64 nt, Homo Sapiens
gaaucauuuugaauauaaaucauagacaaagcuguaaauuuaaacaagcuuguucuuuaaaaua

SEQ ID NO: 493695 - RNA, 64 nt, Homo Sapiens
uuuauuuaucaacccaaaaauaccuacagauuuuuaaauuuagcuuuaugccacuacaguguau

SEQ ID NO: 493696 - RNA, 64 nt, Homo Sapiens
cugcaguugguuuguauuuuuggaguuuggguucuaaauuuagagguugaacaugcauuuuuca

SEQ ID NO: 493697 - RNA, 64 nt, Homo Sapiens
uaaaacuuaaccguagaaguuuuacauuguguuuuaaauuuaguauacuaauacacuuaccuau

SEQ ID NO: 493698 - RNA, 64 nt, Homo Sapiens
uuugcuuaauaguaaaauaauguuuccuggaauguaaauuuagcuuuuuaaaauuaaacugcag

SEQ ID NO: 493699 - RNA, 64 nt, Homo Sapiens
gaaacaacuagaaaggaaagugugacacaguuuuuaaauuuagauguagaaaauaaugaauuaa

SEQ ID NO: 493700 - RNA, 64 nt, Homo Sapiens
aaaaugguguucugaauuuugcuacagggcugcuuaaauuuaugauuaccuguagacacuugau

SEQ ID NO: 493701 - RNA, 64 nt, Homo Sapiens
aaaaauuagucauaacccuuuuggguuauccacuuaaauuuagguauuuucauauuacucaggu

SEQ ID NO: 493702 - RNA, 64 nt, Homo Sapiens
acagauccuuucaaaagaagaguuuuagagaaaauaaauuuaacuuuaaccacagugaaaguug

SEQ ID NO: 493703 - RNA, 64 nt, Homo Sapiens
aguuuguaccauuuaugaagguuuguuccuuuguuaaauuuagcagccuguacuagcuuuugaa

SEQ ID NO: 493704 - RNA, 64 nt, Homo Sapiens
auucugggggaaaaaaggccuucuacguuuuuaguaaauuuaauagccauacuagaauuuuuau

SEQ ID NO: 493705 - RNA, 64 nt, Homo Sapiens
ugagguugccucaagaacucaaucuuagaguucauaaauuuacuuguagguuuucugucucuca

SEQ ID NO: 493706 - RNA, 64 nt, Homo Sapiens
guagaaaauaucauauuuuaaaacuauguauauuuaaauuuaguaauuuucuaaucucuagaaa

SEQ ID NO: 493707 - RNA, 64 nt, Homo Sapiens
uauguacuuuaauuauuuguuuuucuccuauuuuuaaauuuauuaugcaaauuuuagaaaauaa

SEQ ID NO: 493708 - RNA, 64 nt, Homo Sapiens
aagauaagacaaauuauaaauaaguucuaaaacauaaauuuaauucaucucugcauagugauuu

SEQ ID NO: 493709 - RNA, 64 nt, Homo Sapiens
ugaagauuguuuucuccaauuuucugugccauuuuaaauuuaacuuugacauccagcuauagac

SEQ ID NO: 493710 - RNA, 64 nt, Homo Sapiens
acacauauacugccucagaggaaaauugugaccuuaaauuuaauauguguuuucucagauuagu

SEQ ID NO: 493711 - RNA, 64 nt, Homo Sapiens
uuguuuuauaagccuaucguauuuuuccuuucucuaaauuuaauuuuuucuuuacauuccuuuu

SEQ ID NO: 493712 - RNA, 64 nt, Homo Sapiens
aaucagaagagaaaucccccuggcuuugguuucguaaauuuagcuauauguagcuugcgugcuu

SEQ ID NO: 493713 - RNA, 64 nt, Homo Sapiens
aaucugagaacaauuaaauucauuuuaguuauaauaaauuuaauauuuguaaauguaacauagu

SEQ ID NO: 493714 - RNA, 64 nt, Homo Sapiens
uaggcgaguggaaaguggcuacaauccaaaauuuuaaauuuaacucugccucggccauucaaaa

SEQ ID NO: 493715 - RNA, 64 nt, Homo Sapiens
agggacaccaagccuuggcucuacccugaguucauaaauuuaugguucucaggccugacucuca

SEQ ID NO: 493716 - RNA, 64 nt, Homo Sapiens
gaacauguauauaaacaugcuugcauuauauuuguaaauuuaugugauggcaaagaaggagagc

SEQ ID NO: 493717 - RNA, 64 nt, Homo Sapiens
gaaaacaaaauuggaguugacaguaagucacuucuaaauuuaaaguuuguuuaaaauaguaaau

SEQ ID NO: 493718 - RNA, 64 nt, Homo Sapiens
uaacuccauacucuucagacuagacaggauuguuuaaauuuaguuuguauuuuaagugauguca

SEQ ID NO: 493719 - RNA, 64 nt, Homo Sapiens
gaaagucacucuguuaccauaacaaacucccuaauaaauuuagauguaaagcccaaacauuugu

SEQ ID NO: 493720 - RNA, 64 nt, Homo Sapiens
ccauaacuuuuauagagaaacuuauaaaacaacauaaauuuagaagaaauguauauacaguugc

SEQ ID NO: 493721 - RNA, 64 nt, Homo Sapiens
agcaguuacagugugacucaugugcaaugaacacuaaauuuaagauacauuucaaaaaauguua

SEQ ID NO: 493722 - RNA, 64 nt, Homo Sapiens
auuccuacacuuuauuucugcuuaaguaguugccuaaauuuaagggaaggaaauauuuucugga

SEQ ID NO: 493723 - RNA, 64 nt, Homo Sapiens
cuauggguuaaauuuuuauucuuauuuucacauuuaaauuuauuuuucuuaauuuuuguggaua

SEQ ID NO: 493724 - RNA, 64 nt, Homo Sapiens
acaagcaauucaauuguacacuuuuaguuauuuuuaaauuuacaauguuauugauuacaggguc

SEQ ID NO: 493725 - RNA, 64 nt, Homo Sapiens
auucauugaaaaauuauuuuauuuauugcaagucuaaauuuauccuuuuuuucuuuccugauua

SEQ ID NO: 493726 - RNA, 64 nt, Homo Sapiens
augagccaccaugccuggcccaguguuuguuuuuuaaauuuauauauauguaucuaugucucau

SEQ ID NO: 493727 - RNA, 64 nt, Homo Sapiens
cugucagcccccucaccugcagccuguugcccaauaaauuuaagagagucccccccuccccaau

SEQ ID NO: 493728 - RNA, 64 nt, Homo Sapiens
acacuggacucuaagccacuucuuacuccaguaguaaauuuauucaauaaacaaucauugaccc

SEQ ID NO: 493729 - RNA, 64 nt, Homo Sapiens
uguacauaacuuuaaaaggaaaacuaacgguagauaaauuuauuugacuguuaaaaaugauccc

SEQ ID NO: 493730 - RNA, 64 nt, Homo Sapiens
uacugucaaaaaguauuucauaaaaaaaguauuauaaauuuaauacucaacaucagagaguacu

SEQ ID NO: 493731 - RNA, 64 nt, Homo Sapiens
uuuuauuauguaacauacuuuaagugaacaauuuuaaauuuauuaaauuuuuaagaguuaaugg

SEQ ID NO: 493732 - RNA, 64 nt, Homo Sapiens
uauugagucaauuuguucagauaguugacauaaguaaauuuauuuauuuuucuuuucacuuuuu

SEQ ID NO: 493733 - RNA, 64 nt, Homo Sapiens
uuucuuaauuauuugggguaauguuuauuuuauuuaaauuuauugagccaccgugcccagccaa

SEQ ID NO: 493734 - RNA, 64 nt, Homo Sapiens
acauuuuuaaaauagcaaaugaaggcggaguuuuuaaauuuaaacuugggcaaaaacgcaugca

SEQ ID NO: 493735 - RNA, 64 nt, Homo Sapiens
aauuggcauugcauugaauuaauuauuaauuaaauaaauuuauuaucugauuggcauugcauug

SEQ ID NO: 493736 - RNA, 64 nt, Homo Sapiens
acaaguccuaguuguuguuguuguuguugaauacuaaauuuaagauaugucagcuugcuuucaa

SEQ ID NO: 493737 - RNA, 64 nt, Homo Sapiens
agccaauagaauauuaugaauaauuuuaugcuaauaaauuuaacaacuucaacaucauaaacaa

SEQ ID NO: 493738 - RNA, 64 nt, Homo Sapiens
ggauuuucuuuaagagguugauuauaaaguuuucuaaauuuaucaguaccuaaguaagauguag

SEQ ID NO: 493739 - RNA, 64 nt, Homo Sapiens
guuacauauuauauguucuagaaacauguaauccuaaauuuacccucuugaauauaaucccugg

SEQ ID NO: 493740 - RNA, 64 nt, Homo Sapiens
guaacaacagcuagauuguuauggaggugagaaauaaauuuaauccaaagcaaaaacccuuuua

SEQ ID NO: 493741 - RNA, 64 nt, Homo Sapiens
acauauugugaagagacagguucuuaaguaaguuuaaauuuacuuccuuaguuagggacugacu

SEQ ID NO: 493742 - RNA, 64 nt, Homo Sapiens
ucuuaaaauagaaaguuuauuuagauucagaauauaaauuuagaaauggcaugcaucacacauu

SEQ ID NO: 493743 - RNA, 64 nt, Homo Sapiens
guuugucuuacucaguucagucuuuuuuugcucauaaauuuaaaaguuacauaccugguuugcu

SEQ ID NO: 493744 - RNA, 64 nt, Homo Sapiens
gacuuauauuccuacaucaaguuacuacugagaguaaauuuauuuugaguuuuaucccguaagu

SEQ ID NO: 493745 - RNA, 64 nt, Homo Sapiens
ucuccugacuuaauguuuuuuaaacccaccaauauaaauuuaauuaaagauauauguuguaagg

SEQ ID NO: 493746 - RNA, 64 nt, Homo Sapiens
aagaaaauagaugaaaaauuuuaugaaauguaauuaaauuuauuuuagcacguuaucucagggc

SEQ ID NO: 493747 - RNA, 64 nt, Homo Sapiens
aauauggcaugacaugaaaaaugcuagcaaaaaauaaauuuagaguuuaaauaggaaaaauuua

SEQ ID NO: 493748 - RNA, 64 nt, Homo Sapiens
uaggauggauuuagcauugacuaaggaugugauuuaaauuuacuuuugagaauggacagugugu

SEQ ID NO: 493749 - RNA, 64 nt, Homo Sapiens
auucuguuuuauacuauaaaccguuugccaguaauaaauuuaaucaaaggaaauaaaucagugu

SEQ ID NO: 493750 - RNA, 64 nt, Homo Sapiens
cauguacaauuuugguuacugcaaaaaugaccuauaaauuuauuuuuuuucuuaauccaguucu

SEQ ID NO: 493751 - RNA, 64 nt, Homo Sapiens
aaagaauaaagauuuauauaugucauaaaauuaauaaauuuagggcuuuuagcaaccauaaaau

SEQ ID NO: 493752 - RNA, 64 nt, Homo Sapiens
uuggugguauugcaggaauuaacuuagguauggguaaauuuacauuacacaaaguccuuguuuu

SEQ ID NO: 493753 - RNA, 64 nt, Homo Sapiens
auguaguuucaauuuaauaaaagcagacugauacuaaauuuaaaaaucuugauuauuuuucaga

SEQ ID NO: 493754 - RNA, 64 nt, Homo Sapiens
uugugugugauguucaaauaggguguggcaauuuuaaauuuauaugcagugaugguuuaugaaa

SEQ ID NO: 493755 - RNA, 64 nt, Homo Sapiens
uaugaccuauuuagcaaugcuuucugugaaguucuaaauuuaguuugcggcaguaacauuuucc

SEQ ID NO: 493756 - RNA, 64 nt, Homo Sapiens
guugagaaucgggaaaacuagaccccugccacuaacaggcuaggagacuuugggcaguaauggg

SEQ ID NO: 493757 - RNA, 64 nt, Homo Sapiens
cugaaugguuggccugcauauucuuuuuuaggccacaggcuacagcugagcaauggcuuagucu

SEQ ID NO: 493758 - RNA, 64 nt, Homo Sapiens
ggguuuagagauucuuacuaauauguugaacuaaaauagaaagaaaauguugcugucauguaau

SEQ ID NO: 493759 - RNA, 64 nt, Homo Sapiens
aaauucaguuuauguguaaaauaauucagucauuaauagaaauggagugauuucacagugugua

SEQ ID NO: 493760 - RNA, 64 nt, Homo Sapiens
uuucugcauaaaagucauacuuucuaccuuuguaaauagaaacauaucuugcacugcuaacuuu

SEQ ID NO: 493761 - RNA, 64 nt, Homo Sapiens
gugauguguuuuauaucauauuucacugaauacaaauagaaaaauuuacuugaaauguaaaaac

SEQ ID NO: 493762 - RNA, 64 nt, Homo Sapiens
augaaaaaaaauuagguguuccacauuuacagucaauagaaauaugugugagcaguagaagaga

SEQ ID NO: 493763 - RNA, 64 nt, Homo Sapiens
aaagacaaaaggacaucacuucaaguugugagcaaauagaaauaggaaaaccuuuauuuuaaag

SEQ ID NO: 493764 - RNA, 64 nt, Homo Sapiens
gugaagagugacuauuuacacuagcuacuuuagaaauagaaaauuuacgaugcccugccuuuua

SEQ ID NO: 493765 - RNA, 64 nt, Homo Sapiens
cuuuuuauugaggagguauuuaaacuaagcauuuaauagaaaugaauaacuugaacaaaaacac

SEQ ID NO: 493766 - RNA, 64 nt, Homo Sapiens
agcuuaauccaggccgcagaggaauggguugcaaaauagaaaugaggaaagagaggaaaauggg

SEQ ID NO: 493767 - RNA, 64 nt, Homo Sapiens
uccuuagcuuccccaccauaaagggggaaaagccaauagaaauucuuuggcacaaagcagcaga

SEQ ID NO: 493768 - RNA, 64 nt, Homo Sapiens
aucucuuaaacauuuauuacaacaauuguuuuaaaauagaaaaaauaaaaugcuucuauuuuac

SEQ ID NO: 493769 - RNA, 64 nt, Homo Sapiens
auuauucuguuuauuaacagugucccaucuacugaauagaaaacuuugagaauaauauauauau

SEQ ID NO: 493770 - RNA, 64 nt, Homo Sapiens
ucagaaaaaggcuuucuuucauaagacuauuuuaaauagaaauuauuucaacaauuaaaguaau

SEQ ID NO: 493771 - RNA, 64 nt, Homo Sapiens
uuuuuuauuucuuuuaggucuagggacaggagugaauagaaagggaggagagcucuauuauguu

SEQ ID NO: 493772 - RNA, 64 nt, Homo Sapiens
guugcuuuugcguuucucaugccuaggcaaguguaauagaaauuauguagcuccuuauguuggc

SEQ ID NO: 493773 - RNA, 64 nt, Homo Sapiens
ggauggauuaugauaaagaagaugcuaccaaugaaauagaaaaccaacgagaugagaagacugu

SEQ ID NO: 493774 - RNA, 64 nt, Homo Sapiens
auugcucuuacgaacuuuaauaaaauaguuagcuaauagaaaaacagguaagaauaaagcaaug

SEQ ID NO: 493775 - RNA, 64 nt, Homo Sapiens
aaauggaaauauucaauugagacuugaggggaauaauagaaaauuaagguagauccccaauauu

SEQ ID NO: 493776 - RNA, 64 nt, Homo Sapiens
uaagauuucuuuauguggaacaucuauagagauaaauagaaauuuucaauaagauguaguaaca

SEQ ID NO: 493777 - RNA, 64 nt, Homo Sapiens
cugguagguaaauuucuuauuaaaucaaucuugaaauagaaaauguaauaacuuucuuaccauu

SEQ ID NO: 493778 - RNA, 64 nt, Homo Sapiens
cauuuucuggcuagcagaaaucaaagcccaaaugaauagaaacagaugugggguacacugaacu

SEQ ID NO: 493779 - RNA, 64 nt, Homo Sapiens
acaaaaaugaaagagacacaacuaaacuggagccaauagaaaaguccuuucuaacuuuauggac

SEQ ID NO: 493780 - RNA, 64 nt, Homo Sapiens
guuuucuuggcucaaaguaucaauuuauuauuauaauagaaauuuauaaguugcuagaaagucu

SEQ ID NO: 493781 - RNA, 64 nt, Homo Sapiens
aaaguacggaauaaaaauauguuuucuauuaagcaauagaaauauuuuuguguauaauuuuucu

SEQ ID NO: 493782 - RNA, 64 nt, Homo Sapiens
aaugcacaguguccucaggacacuuugaauugcuaauagaaaauaguuccguaggcagagugcu

SEQ ID NO: 493783 - RNA, 64 nt, Homo Sapiens
gccuggcacgaacagucuaugugaggccaucagaaauagaaaauaacuagaaaaccaaugaaaa

SEQ ID NO: 493784 - RNA, 64 nt, Homo Sapiens
uaaacuaugaccuagggguuuuugcuuuaaugagaauagaaacguuucuuuuuccaguguucua

SEQ ID NO: 493785 - RNA, 64 nt, Homo Sapiens
agauuugugcaaacauggagauuagugaaccaaaaauagaaauugcauuuuuauaaacuaccaa

SEQ ID NO: 493786 - RNA, 64 nt, Homo Sapiens
gaacuucaagagaaguuguaaagcuagugaccuaaauagaaagcccaggguuggcuuuauuuaa

SEQ ID NO: 493787 - RNA, 64 nt, Homo Sapiens
uauugaauauacauucuuuuauuagauugaauuaaauagaaacuuuaaauuucuaauugagcag

SEQ ID NO: 493788 - RNA, 64 nt, Homo Sapiens
uguauguguauagauucacauuggaggguuaaaaaauagaaagguuaaaaaaauaaacauuguc

SEQ ID NO: 493789 - RNA, 64 nt, Homo Sapiens
auuuuuuuagguauuggggagacuuguguuuguuaauagaaauaccccaccaccccacccccaa

SEQ ID NO: 493790 - RNA, 64 nt, Homo Sapiens
uggguggauaaaguuuucaauuguaaguaauguaaauagaaagggcuaauauggaaccaaacuc

SEQ ID NO: 493791 - RNA, 64 nt, Homo Sapiens
caagacugguaaacaugccuuuuuaaaaagcagaaauagaaauaguacauauguaccuauuuuu

SEQ ID NO: 493792 - RNA, 64 nt, Homo Sapiens
ugauaaaaccgcaacaaaaacauguaagaaauaaaauagaaaugcuuuauauaauuuaguuuaa

SEQ ID NO: 493793 - RNA, 64 nt, Homo Sapiens
gaaucuuuuuguguuuggaguguaguccauuugcaauagaaauaaaaaaauccgucaccaaauu

SEQ ID NO: 493794 - RNA, 64 nt, Homo Sapiens
ugucauguuucaaauaaagagaacugaaguagaaaauagaaaugccaguaaacaacauaauguu

SEQ ID NO: 493795 - RNA, 64 nt, Homo Sapiens
auuuaaaguuuuugcuuguguccuccucagucagaauagaaaaguaacugaaauacuuuuaccu

SEQ ID NO: 493796 - RNA, 64 nt, Homo Sapiens
gagaaauuggagcaggaaaagaaauuaucaaagcaauagaaauagcuuggugguccuauggugu

SEQ ID NO: 493797 - RNA, 64 nt, Homo Sapiens
gucuaaaauuuggauaugauucuuauguuuuuuuaauagaaaaccuucuucaaguuuauuuucc

SEQ ID NO: 493798 - RNA, 64 nt, Homo Sapiens
uagaaaucauuguguuaaaguuucauuaaagacuaauagaaauucaacacaacuaaugucaucu

SEQ ID NO: 493799 - RNA, 64 nt, Homo Sapiens
cuauugauucacugguguuauuuugcuugagaaaaauagaaauaauauuugaugagucuauacu

SEQ ID NO: 493800 - RNA, 64 nt, Homo Sapiens
ugcaaaacacagauucauuccagucacuagggacaauagaaacccauuucacugaucuucacuc

SEQ ID NO: 493801 - RNA, 64 nt, Homo Sapiens
auguggaaguggucugaggcgcuauaauuagcugaauagaaagaccuucaccaguggcuacuaa

SEQ ID NO: 493802 - RNA, 64 nt, Homo Sapiens
aucaacaaccccuuuggcuauaaacaaacaaauaaauagaaaaggaaaaaaaauaauagaaagg

SEQ ID NO: 493803 - RNA, 64 nt, Homo Sapiens
uaaacaaacaaauaaauagaaaaagaaaaaaaauaauagaaaggacuucuuguuguggaggcug

SEQ ID NO: 493804 - RNA, 64 nt, Homo Sapiens
agaacaguucuggacuauugccccucagcccuaaaauagaaaaaacauguagacuaaauagaaa

SEQ ID NO: 493805 - RNA, 64 nt, Homo Sapiens
ccucagcccuaaaauagaaaacacauguagacuaaauagaaaccuucucacguugcucagacug

SEQ ID NO: 493806 - RNA, 64 nt, Homo Sapiens
aagaaauuuauaaugaaaagucuuauuaaggagaaauagaaaagucaauuuaaugcccuaacuc

SEQ ID NO: 493807 - RNA, 64 nt, Homo Sapiens
caucuucuuuauuauccuccuuuucuaaacgacaaauagaaauaaugggcauuucugccuuuuu

SEQ ID NO: 493808 - RNA, 64 nt, Homo Sapiens
aguuuuuaauuacacugagauaauuuugaaaagaaauagaaauuaagcuacuauauaaaacaau

SEQ ID NO: 493809 - RNA, 64 nt, Homo Sapiens
gauuuguacauagagaaacaauuugauaauacuuaauagaaaucuguucaauuaaaaaugcuua

SEQ ID NO: 493810 - RNA, 64 nt, Homo Sapiens
auauuaaaaugugaauaaauaaauguucugauaaaauagaaaagaaaguaaauuacagugauuu

SEQ ID NO: 493811 - RNA, 64 nt, Homo Sapiens
augugcagaacgaaguuaccagcaggauggaccuaauagaaaaagaagucgaugguaauuuaag

SEQ ID NO: 493812 - RNA, 64 nt, Homo Sapiens
guagaaagaaauaugguauauuuguauaguuuuuaauagaaagaucuauguuuauaaaccagca

SEQ ID NO: 493813 - RNA, 64 nt, Homo Sapiens
acaaauagcaaguguggaagaaaaccuauuuuuaaauagaaaucuggugacagagcacaaauag

SEQ ID NO: 493814 - RNA, 64 nt, Homo Sapiens
cuauuuuuaaauagaaaucaggugacagagcacaaauagaaaaccauauaaaaggaaaaaaauu

SEQ ID NO: 493815 - RNA, 64 nt, Homo Sapiens
agcuuuuaaacugagcuuuguuaagccaguauaaaauagaaacuuuguauaauacaaauuuuca

SEQ ID NO: 493816 - RNA, 64 nt, Homo Sapiens
aaagauacaauuaaucugauauuauauuuguugaaauagaaauuugauuguacuauaaaugauu

SEQ ID NO: 493817 - RNA, 64 nt, Homo Sapiens
cuagccaacaugacgaaaccccaucucuacugaaaauagaaaaaaaaaauuagccaggcuugca

SEQ ID NO: 493818 - RNA, 64 nt, Homo Sapiens
uggguaugcguuucauguaggacucacuguuaagaauagaaaacucugagaccacagaggcuca

SEQ ID NO: 493819 - RNA, 64 nt, Homo Sapiens
aaacaaacccaaagguaggaaacacguggucaugaauagaaaaaguuauuaugggauuggaaga

SEQ ID NO: 493820 - RNA, 64 nt, Homo Sapiens
ggaaacaacuacuguguuucaacauaauaaauauaauagaaaaauauuuuauuuguauuguugu

SEQ ID NO: 493821 - RNA, 64 nt, Homo Sapiens
aauuucuucaacaucauacuuaaacauuacagaaaauagaaauacaaacaagguugguacauga

SEQ ID NO: 493822 - RNA, 64 nt, Homo Sapiens
guauccuacguuacaacaauaauaucaugggagaaauagaaauagccuaguuugcuuccaauag

SEQ ID NO: 493823 - RNA, 64 nt, Homo Sapiens
caugggagaaauagaaauagccuaguuugcuuccaauagaaacugcuuuuaacaugggcuguau

SEQ ID NO: 493824 - RNA, 64 nt, Homo Sapiens
agcuaaucaaaauaauucagccaagucuauuugaaauagaaaacugucuauuuaauauaguaaa

SEQ ID NO: 493825 - RNA, 64 nt, Homo Sapiens
auuaggaaaaaaaucuggagaacaauaugguugaaauagaaacaagagaaugcaccuagguuaa

SEQ ID NO: 493826 - RNA, 64 nt, Homo Sapiens
acccuguauaguaugggaauuauuuuuuauguuaaauagaaacugaauguacuggguugaaugg

SEQ ID NO: 493827 - RNA, 64 nt, Homo Sapiens
uagugccaacugcagugagugagagggcuguggcaauagaaaauacuccaggcccuccuggcug

SEQ ID NO: 493828 - RNA, 64 nt, Homo Sapiens
ugcuuaucaaaacuuagcauccugaacauaggaaaauagaaacuuucuucuguugaugccguuc

SEQ ID NO: 493829 - RNA, 64 nt, Homo Sapiens
cauaaacauuucuuuucaguucauguaguucuuuaauagaaagcugcuauuauguauauuguca

SEQ ID NO: 493830 - RNA, 64 nt, Homo Sapiens
cuugcagagccauagcaggacauguuaaaauuccaauagaaaacacuaaaaggaaagucugugg

SEQ ID NO: 493831 - RNA, 64 nt, Homo Sapiens
uucaagagauaauguacaauugaaaguuaaugccaauagaaaaaggaggauaaaaguaaauaag

SEQ ID NO: 493832 - RNA, 64 nt, Homo Sapiens
caauaaaagaguugaagggagaaugaaaugaaggaauagaaaucuuuaucuagaugaaaauuug

SEQ ID NO: 493833 - RNA, 64 nt, Homo Sapiens
aagguuuuauuuuuauuaaacuuuuguauuauacaauagaaauacagaagaauauucuuaaaac

SEQ ID NO: 493834 - RNA, 64 nt, Homo Sapiens
uguuagaauuuguuagauuuugaguuuuacauaaaauagaaauuuucaugcacaauccauaauu

SEQ ID NO: 493835 - RNA, 64 nt, Homo Sapiens
ugcaucauaucauuucuguccauaauuguacugaaauagaaaagugaccgcucuugcucuuggu

SEQ ID NO: 493836 - RNA, 64 nt, Homo Sapiens
ggugcuuuaucugaauaggccuggaucgaaguaaaauagaaaugggacuggcuuuccacaggaa

SEQ ID NO: 493837 - RNA, 64 nt, Homo Sapiens
aggccguccauuagagauuuaacuagauauguucaauagaaagagucugaggcaaguggaaaug

SEQ ID NO: 493838 - RNA, 64 nt, Homo Sapiens
auauuaacguuugaaauuaauauguccaauauaaaauagaaaauaaugagggguuacagaugca

SEQ ID NO: 493839 - RNA, 64 nt, Homo Sapiens
ugggauagucuuugcuguuuaucuuggcacuguuaauagaaaggcaaccaacuaaacaguuaua

SEQ ID NO: 493840 - RNA, 64 nt, Homo Sapiens
cauuucuuguggcaaguaauaucugaaugaccauaauagaaauaauaggcuuaauucuuuguaa

SEQ ID NO: 493841 - RNA, 64 nt, Homo Sapiens
uugcaauuauauaggccaugaauagugaagaaaaaauagaaaggacuugacaauuauaaauagu

SEQ ID NO: 493842 - RNA, 64 nt, Homo Sapiens
gaccaaauauuuuguacuauuugauaauuuucacaauagaaagaauuuuauauacuuuuccagc

SEQ ID NO: 493843 - RNA, 64 nt, Homo Sapiens
ugucuaucacaaaucuuuauuuaaguuuguaccuaauagaaauaguggucaugaaauuuuaaug

SEQ ID NO: 493844 - RNA, 64 nt, Homo Sapiens
ucaguauuuuaugauaaucaauuaaaugagcuuaaauagaaaaugguccauccuaauucacaga

SEQ ID NO: 493845 - RNA, 64 nt, Homo Sapiens
uacauuuuggcaggaauaaucaaaaaacuucagaaauagaaaaccuuuguaagcuacuuaucuc

SEQ ID NO: 493846 - RNA, 64 nt, Homo Sapiens
cuugaaaacauaaaugaacgucaagacugaaggcaauagaaauuaaagaaugugagaaaguucu

SEQ ID NO: 493847 - RNA, 64 nt, Homo Sapiens
auugauuuuucuuucaaucagcauguucaccaaaaauagaaaaguucuucuaagguuaaauuuu

SEQ ID NO: 493848 - RNA, 64 nt, Homo Sapiens
acaauguuagaagguuauuuuuuauuucagagaaaauagaaaaaauuuugcaaguuuaauuuga

SEQ ID NO: 493849 - RNA, 64 nt, Homo Sapiens
caacauagagcauacaagaacagucauuuaguagaauagaaaagaaaucucauuguaaagcuau

SEQ ID NO: 493850 - RNA, 64 nt, Homo Sapiens
uugaauguauaaaagaaaaaaaaauaauagaagaaauagaaauugcuuucuccagagaaauuuu

SEQ ID NO: 493851 - RNA, 64 nt, Homo Sapiens
agagagagcuuccuaggccuauaguuuguccuacaauagaaaaaacuugaaaugaggcuggggu

SEQ ID NO: 493852 - RNA, 64 nt, Homo Sapiens
uuuucauuuguugauuuagguaacuuugaucagaaauagaaacgauugcuuuguuuggcuugau

SEQ ID NO: 493853 - RNA, 64 nt, Homo Sapiens
uugcuggagaaagcguccacuuuaguuauucuaaaauagaaaguuuuagacaugaacccuacua

SEQ ID NO: 493854 - RNA, 64 nt, Homo Sapiens
aauaugaacagacucagcuuauuaguaagaaaaaaauagaaaaagggcagggagaagagaaggc

SEQ ID NO: 493855 - RNA, 64 nt, Homo Sapiens
uccgcuugaccuuuggugcaucaccuuuucuuccaauagaaaaugcagucucuuccccaaaguc

SEQ ID NO: 493856 - RNA, 64 nt, Homo Sapiens
uaucaaaaacaagagaaaaguaccuguauuuaaaaauagaaacaaaugccauuuuaaggaaaac

SEQ ID NO: 493857 - RNA, 64 nt, Homo Sapiens
acacaguuuugaccuaacaugaugaaacuaaagcaauagaaacaaucccacuaaugcaaacugg

SEQ ID NO: 493858 - RNA, 64 nt, Homo Sapiens
ggaggaagccuggucuaagaagauacugucuuucaauagaaaugauuucuaaacugcuacagau

SEQ ID NO: 493859 - RNA, 64 nt, Homo Sapiens
gguaugugggcuuuaaaagugauucuaaaucuugaauagaaaacacaugaauuggcuuuaauaa

SEQ ID NO: 493860 - RNA, 64 nt, Homo Sapiens
aucucuuuguuguauuuuccaugauguuucuuaaaauagaaaguuuauuuagauucagaauaua

SEQ ID NO: 493861 - RNA, 64 nt, Homo Sapiens
gguuuagugauaauaauuuuguuuuugaaauacaaauagaaaauccugaaauaauuuuugugau

SEQ ID NO: 493862 - RNA, 64 nt, Homo Sapiens
gucacccccaccaaaaacaaaagagaagaaaaagaauagaaagaauuauccagugucagcuucc

SEQ ID NO: 493863 - RNA, 64 nt, Homo Sapiens
uccagugucagcuuccaaucccuaguacauauauaauagaaaagggccaagaaaaauaugcauc

SEQ ID NO: 493864 - RNA, 64 nt, Homo Sapiens
auuauacuucuuuaaaaagcucugaagcugcuacaauagaaaaaucaaaaaggguaacaguauc

SEQ ID NO: 493865 - RNA, 60 nt, Homo Sapiens
uucgagaaauuaaaucuuaaaaucuguguaaauagaaaacuugaaccauuaguaauaaca

SEQ ID NO: 493866 - RNA, 64 nt, Homo Sapiens
cuucuugaaaugucuauuuaagcugcuuuaaguuaauagaaaagauuaaagcaaaauauucauu

SEQ ID NO: 493867 - RNA, 64 nt, Homo Sapiens; identical to SEQ ID NO: 420116

SEQ ID NO: 493868 - RNA, 64 nt, Homo Sapiens; identical to SEQ ID NO: 420117

SEQ ID NO: 493869 - RNA, 64 nt, Homo Sapiens; identical to SEQ ID NO: 420118

SEQ ID NO: 493870 - RNA, 64 nt, Homo Sapiens; identical to SEQ ID NO: 420119

SEQ ID NO: 493871 - RNA, 64 nt, Homo Sapiens; identical to SEQ ID NO: 420120

SEQ ID NO: 493872 - RNA, 64 nt, Homo Sapiens; identical to SEQ ID NO: 420121

SEQ ID NO: 493873 - RNA, 64 nt, Homo Sapiens; identical to SEQ ID NO: 420122

SEQ ID NO: 493874 - RNA, 64 nt, Homo Sapiens; identical to SEQ ID NO: 420123

SEQ ID NO: 493875 - RNA, 64 nt, Homo Sapiens; identical to SEQ ID NO: 420124

SEQ ID NO: 493876 - RNA, 64 nt, Homo Sapiens; identical to SEQ ID NO: 420125

SEQ ID NO: 493877 - RNA, 64 nt, Homo Sapiens; identical to SEQ ID NO: 420126

SEQ ID NO: 493878 - RNA, 64 nt, Homo Sapiens; identical to SEQ ID NO: 420127

SEQ ID NO: 493879 - RNA, 64 nt, Homo Sapiens; identical to SEQ ID NO: 420128

SEQ ID NO: 493880 - RNA, 64 nt, Homo Sapiens; identical to SEQ ID NO: 420129

SEQ ID NO: 493881 - RNA, 64 nt, Homo Sapiens; identical to SEQ ID NO: 420130

SEQ ID NO: 493882 - RNA, 64 nt, Homo Sapiens; identical to SEQ ID NO: 420131

SEQ ID NO: 493883 - RNA, 64 nt, Homo Sapiens; identical to SEQ ID NO: 420132

SEQ ID NO: 493884 - RNA, 64 nt, Homo Sapiens; identical to SEQ ID NO: 420133

SEQ ID NO: 493885 - RNA, 64 nt, Homo Sapiens; identical to SEQ ID NO: 420134

SEQ ID NO: 493886 - RNA, 64 nt, Homo Sapiens; identical to SEQ ID NO: 420135

SEQ ID NO: 493887 - RNA, 64 nt, Homo Sapiens; identical to SEQ ID NO: 420136

SEQ ID NO: 493888 - RNA, 64 nt, Homo Sapiens; identical to SEQ ID NO: 420137

SEQ ID NO: 493889 - RNA, 64 nt, Homo Sapiens; identical to SEQ ID NO: 420138

SEQ ID NO: 493890 - RNA, 64 nt, Homo Sapiens; identical to SEQ ID NO: 420139

SEQ ID NO: 493891 - RNA, 64 nt, Homo Sapiens; identical to SEQ ID NO: 420140

SEQ ID NO: 493892 - RNA, 64 nt, Homo Sapiens
auauggaaaugugaaguuugaguaauagcguaaaguaaaguaugaaaugcccaggagcccauga

SEQ ID NO: 493893 - RNA, 64 nt, Homo Sapiens
guaugauauggaaaugugaacaugaaguaauagcguaaaguaaaagaccaaaugcccaggagcc

SEQ ID NO: 493894 - RNA, 64 nt, Homo Sapiens
uaagcauuguuucaaaaguucuauuucagggauuguaaaguaguuucuauaguaaaggcaaugu

SEQ ID NO: 493895 - RNA, 64 nt, Homo Sapiens
uguaaaauaaaugugacauucucuuuuuuuuuuuguaaaguauaucuuuuauuucuucauugua

SEQ ID NO: 493896 - RNA, 64 nt, Homo Sapiens
acaaaccuaucuugguuaacuagaggguaacaaaguaaaguaaauugcaaauaaguugaguuug

SEQ ID NO: 493897 - RNA, 64 nt, Homo Sapiens
agcauaucgcuuauaucauuuggacuuuuuagaaguaaaguaaacuguagccaggguuaaaaac

SEQ ID NO: 493898 - RNA, 64 nt, Homo Sapiens
ugaaucuuucauacauauauauauuuguaacauuguaaaguaugugaguagucuuauguaaagu

SEQ ID NO: 493899 - RNA, 64 nt, Homo Sapiens
uuuguaacauuguaaaguaugugaguagucuuauguaaaguauguuuuuacauuaugcaaauaa

SEQ ID NO: 493900 - RNA, 64 nt, Homo Sapiens
uuguuacagauaguuuuaugccuaagaccaagauguaaaguaccaucugcccuuaaaaaaaauu

SEQ ID NO: 493901 - RNA, 64 nt, Homo Sapiens
acuuuuauaagucuagaugacguuugccuuagggguaaaguaaaagaacaauuggcaccuuaag

SEQ ID NO: 493902 - RNA, 64 nt, Homo Sapiens
uguuaaaugcuuuuaucacuaauuuguuuauacuguaaaguauaaagcaaaaugcauaguacuu

SEQ ID NO: 493903 - RNA, 64 nt, Homo Sapiens
gaaugcuuuacuaguucuccuugaggcacuguauguaaaguaaguguuauuauguauguggcac

SEQ ID NO: 493904 - RNA, 64 nt, Homo Sapiens
gauuuaaucugccaagggccgacuaagagaaguuguaaaguauguauuauuuacauuuaauaga

SEQ ID NO: 493905 - RNA, 64 nt, Homo Sapiens
ggcuuauaucuggccucugcuuucuccuuuaauuguaaaguaaaagcuauaaagcaguauuuuu

SEQ ID NO: 493906 - RNA, 64 nt, Homo Sapiens
ggauuuuuuuaaagggaacaacaacgaaaguaaaguaaaguauuuuuuaaacaacuuuccacug

SEQ ID NO: 493907 - RNA, 64 nt, Homo Sapiens
guauuggauuuuuuuaaaggcacugacaacgaaaguaaaguaaaucucauuuuaaacaacuuuc

SEQ ID NO: 493908 - RNA, 64 nt, Homo Sapiens
augcuuagaacugagaaaacaugcauuaaaaauuguaaaguaccuccaaugcacuguuguauga

SEQ ID NO: 493909 - RNA, 64 nt, Homo Sapiens
aaccugaauugagucauugcagugguacuuaaauguaaaguaacgcuuuuauguccacuuuuug

SEQ ID NO: 493910 - RNA, 64 nt, Homo Sapiens; identical to SEQ ID NO: 301390

SEQ ID NO: 493911 - RNA, 64 nt, Homo Sapiens; identical to SEQ ID NO: 301391

SEQ ID NO: 493912 - RNA, 64 nt, Homo Sapiens; identical to SEQ ID NO: 301392

SEQ ID NO: 493913 - RNA, 64 nt, Homo Sapiens; identical to SEQ ID NO: 301393

SEQ ID NO: 493914 - RNA, 64 nt, Homo Sapiens; identical to SEQ ID NO: 301394

SEQ ID NO: 493915 - RNA, 64 nt, Homo Sapiens; identical to SEQ ID NO: 301395

SEQ ID NO: 493916 - RNA, 64 nt, Homo Sapiens; identical to SEQ ID NO: 301396

SEQ ID NO: 493917 - RNA, 64 nt, Homo Sapiens; identical to SEQ ID NO: 301397

SEQ ID NO: 493918 - RNA, 64 nt, Homo Sapiens; identical to SEQ ID NO: 301398

SEQ ID NO: 493919 - RNA, 64 nt, Homo Sapiens; identical to SEQ ID NO: 301399

SEQ ID NO: 493920 - RNA, 64 nt, Homo Sapiens; identical to SEQ ID NO: 301400

SEQ ID NO: 493921 - RNA, 64 nt, Homo Sapiens; identical to SEQ ID NO: 301401

SEQ ID NO: 493922 - RNA, 64 nt, Homo Sapiens; identical to SEQ ID NO: 301402

SEQ ID NO: 493923 - RNA, 64 nt, Homo Sapiens; identical to SEQ ID NO: 301403

SEQ ID NO: 493924 - RNA, 64 nt, Homo Sapiens; identical to SEQ ID NO: 301404

SEQ ID NO: 493925 - RNA, 64 nt, Homo Sapiens; identical to SEQ ID NO: 301405

SEQ ID NO: 493926 - RNA, 64 nt, Homo Sapiens; identical to SEQ ID NO: 301406

SEQ ID NO: 493927 - RNA, 64 nt, Homo Sapiens; identical to SEQ ID NO: 301407

SEQ ID NO: 493928 - RNA, 64 nt, Homo Sapiens
guuaaaaacugaaggcagaagacacacacauucacauauaaauuuauaaacgugaaauauauuu

SEQ ID NO: 493929 - RNA, 64 nt, Homo Sapiens
uagaaagggacuuuuuuuccaacaacaaaaaauacauauaaaacgacauugaguuuaauucagc

SEQ ID NO: 493930 - RNA, 64 nt, Homo Sapiens
aaaaauauaaacaauguucaggagaguaaaaauucauauaaagugcaauugcacaaauacaagc

SEQ ID NO: 493931 - RNA, 64 nt, Homo Sapiens
uauauaaaguuuugccccaugauaaaauaaguaacauauaaauuaauacauaaguuaauauugg

SEQ ID NO: 493932 - RNA, 64 nt, Homo Sapiens
guuauaccacuauuuaguaauauguucguaaagucauauaaaaguugucuugaauagagaaguc

SEQ ID NO: 493933 - RNA, 64 nt, Homo Sapiens
aacauugagaaugacaacuagaacuuaaugcagacauauaaagucuuggguuuaaaauacauua

SEQ ID NO: 493934 - RNA, 64 nt, Homo Sapiens
gcuaucuggucaaccuccuggacauuuuuucagucauauaaaagcuauggugagaugcagcugg

SEQ ID NO: 493935 - RNA, 64 nt, Homo Sapiens
aaugaagaucauauacgugaaaauuauuugaaaacauauaaagcacuauacagauucgaaacuc

SEQ ID NO: 493936 - RNA, 64 nt, Homo Sapiens
aguuugaucuaagaggauuccagaaaauuugcaacauauaaagugcaugcagucaugagaauua

SEQ ID NO: 493937 - RNA, 64 nt, Homo Sapiens
uucagggaaaacagaagcaaaaaaacucccauaucauauaaaauaacuguuguugacagugagg

SEQ ID NO: 493938 - RNA, 64 nt, Homo Sapiens
gccuguauauuuuuuaaaaauuuucagauccaagcauauaaaaaugucauuguggauguuaccu

SEQ ID NO: 493939 - RNA, 64 nt, Homo Sapiens
cuggaacagaaauuguuuauaaacguuagcucuacauauaaaucucaauguuuuauucugaagu

SEQ ID NO: 493940 - RNA, 64 nt, Homo Sapiens
uuuuauuuauaguuaauaauccuaauccaaauaucauauaaacaaacagauauuguaccaugua

SEQ ID NO: 493941 - RNA, 64 nt, Homo Sapiens
uauuuaacuuaacccagauuugguccucauggugcauauaaauagacuagcacuagacauguca

SEQ ID NO: 493942 - RNA, 64 nt, Homo Sapiens
aucuugaaaagguaguuguuauuuacuccauuuacauauaaaaguguuugaguucagccucuuc

SEQ ID NO: 493943 - RNA, 64 nt, Homo Sapiens
gaaucuuauaguacguuccccuuuucuggacugucauauaaacacuccgucacuauuauuuugc

SEQ ID NO: 493944 - RNA, 64 nt, Homo Sapiens
cuuuaaugaauuaggauaacguauaaaauccaaucauauaaaaaucucuagguaauugauuuaa

SEQ ID NO: 493945 - RNA, 64 nt, Homo Sapiens
agucaaaaaucaaaaucaaaaggacccacuggggcauauaaaaaccaguugagcucccaagacc

SEQ ID NO: 493946 - RNA, 64 nt, Homo Sapiens
cucugcuguauccuuucggcaggacccacuggggcauauaaaauccaguugagcucccaagacc

SEQ ID NO: 493947 - RNA, 64 nt, Homo Sapiens
ugguaaacauuucuguauaaaguuaccugacacacauauaaacacaaggaacauuccauaucau

SEQ ID NO: 493948 - RNA, 64 nt, Homo Sapiens
aaaaaccuuuggucauuuguaagacaucucaugucauauaaaaguuaaauguaaaaagauacag

SEQ ID NO: 493949 - RNA, 64 nt, Homo Sapiens
guuauuuuuauccuauuauaucuuaaaugauauacauauaaacagagacagucacucuuuuuuu

SEQ ID NO: 493950 - RNA, 64 nt, Homo Sapiens
uagaaaauagagaaaaggcugcaugaauuauuuucauauaaauaaauaauguauuuagcaugaa

SEQ ID NO: 493951 - RNA, 64 nt, Homo Sapiens
uagaguagauauuugauauaccacucugauaacucauauaaaaauaucaucauaaaaagcuuaa

SEQ ID NO: 493952 - RNA, 64 nt, Homo Sapiens
aguuuauguuuauuguauuuuauaugaucuacaacauauaaaauuguguauuuuucuuugguug

SEQ ID NO: 493953 - RNA, 64 nt, Homo Sapiens
gucuggauugucaguaguaucgugaaucagaucacauauaaaaacaauuccuaggauaugugau

SEQ ID NO: 493954 - RNA, 64 nt, Homo Sapiens
gcuacuuggauaauaucuacgaguuaccggcaagcauauaaaauagauuauucauucuaucuca

SEQ ID NO: 493955 - RNA, 64 nt, Homo Sapiens
acuguacaucagagaauucauacuggagaaaagccauauaaauguagugagugugggaaagcuu

SEQ ID NO: 493956 - RNA, 64 nt, Homo Sapiens
gaaugguagagcaaccugaaggauuuagaaauuacauauaaaucuuugcaguuaugcuauuugu

SEQ ID NO: 493957 - RNA, 64 nt, Homo Sapiens
gcaguauucuacaaguuuccagaaagagaauagccauauaaauuauuuuccuuucugcuauuau

SEQ ID NO: 493958 - RNA, 64 nt, Homo Sapiens
guuuuauuuauucagauuuagaguaaaaaauaagcauauaaacuuuuauuaugugcucuuaaca

SEQ ID NO: 493959 - RNA, 64 nt, Homo Sapiens
ugaauguaacauacugucaauuuugcauuuugucuacuuguaaguguacagaagaugaacugua

SEQ ID NO: 493960 - RNA, 64 nt, Homo Sapiens
uagguaaccaauguacauggacugguguauaggauacuuguacaacuaauugcccugcuguuuu

SEQ ID NO: 493961 - RNA, 64 nt, Homo Sapiens
uguguguguguuuuuuuuuuaagguaaacauuacuacuuguaacuuuuuuucuuagucauauuu

SEQ ID NO: 493962 - RNA, 64 nt, Homo Sapiens
uuguuauauucccagcauuucaauauuuauuaguuacuuguaaauuacuguggcuguguaguuu

SEQ ID NO: 493963 - RNA, 64 nt, Homo Sapiens
cagaauacuguauuaaaauuaucuagugguauucuacuuguauucuuagguaaauacaauucuu

SEQ ID NO: 493964 - RNA, 64 nt, Homo Sapiens
ugauguagucaccuuaacuauucaaacuauguuuuacuuguauauagcagaaaugacuguuuau

SEQ ID NO: 493965 - RNA, 64 nt, Homo Sapiens
gccuguucugaauggcagcacgaagcaggccuguuacuuguaugucgcuuuggacagaggaaag

SEQ ID NO: 493966 - RNA, 64 nt, Homo Sapiens
gcuuagagggaggaccugaugacugauuccaggauacuuguacuucuaauaacauuuuucauga

SEQ ID NO: 493967 - RNA, 64 nt, Homo Sapiens
caccuaauaaauuuauuauucuuucaguauuuuguacuuguagguuuauaauccccugcagcgg

SEQ ID NO: 493968 - RNA, 64 nt, Homo Sapiens
uauaccucagauauucuuuuuauuauuuaagauauacuuguauuagauaaagcaugauaaagau

SEQ ID NO: 493969 - RNA, 64 nt, Homo Sapiens
uuuucauggauaauuuuuaacuucauuauuucuguacuuguacaaacucaacacuaacuuuuuu

SEQ ID NO: 493970 - RNA, 64 nt, Homo Sapiens
ccuucaacuuuugaaauacaaaaccaguguuuuuuacuuguacacuguuuuaaagucuauuaaa

SEQ ID NO: 493971 - RNA, 64 nt, Homo Sapiens
cccuaaauuuauuuuuaaaaauguaucuaaacuguacuuguaccuacgacuacacaauauauuc

SEQ ID NO: 493972 - RNA, 64 nt, Homo Sapiens
uugugguggcaaauguuuggauaaagaauaaaaauacuuguauuuaucacucaccauaauuuaa

SEQ ID NO: 493973 - RNA, 64 nt, Homo Sapiens
uaugcuuuugauaaaauguaaauguguacccaaauacuuguauuuugguuaaguccuaacuuuc

SEQ ID NO: 493974 - RNA, 64 nt, Homo Sapiens
gaugagguuaggaauauucaaagguguccuuaaauacuuguagguccugcagugccaaguauca

SEQ ID NO: 493975 - RNA, 64 nt, Homo Sapiens; identical to SEQ ID NO: 164780

SEQ ID NO: 493976 - RNA, 64 nt, Homo Sapiens; identical to SEQ ID NO: 164781

SEQ ID NO: 493977 - RNA, 64 nt, Homo Sapiens; identical to SEQ ID NO: 164782

SEQ ID NO: 493978 - RNA, 64 nt, Homo Sapiens; identical to SEQ ID NO: 164783

SEQ ID NO: 493979 - RNA, 64 nt, Homo Sapiens; identical to SEQ ID NO: 164784

SEQ ID NO: 493980 - RNA, 64 nt, Homo Sapiens; identical to SEQ ID NO: 164785

SEQ ID NO: 493981 - RNA, 64 nt, Homo Sapiens; identical to SEQ ID NO: 164786

SEQ ID NO: 493982 - RNA, 64 nt, Homo Sapiens; identical to SEQ ID NO: 164787

SEQ ID NO: 493983 - RNA, 64 nt, Homo Sapiens; identical to SEQ ID NO: 164788

SEQ ID NO: 493984 - RNA, 64 nt, Homo Sapiens; identical to SEQ ID NO: 164789

SEQ ID NO: 493985 - RNA, 64 nt, Homo Sapiens; identical to SEQ ID NO: 164790

SEQ ID NO: 493986 - RNA, 64 nt, Homo Sapiens; identical to SEQ ID NO: 164791

SEQ ID NO: 493987 - RNA, 64 nt, Homo Sapiens; identical to SEQ ID NO: 164792

SEQ ID NO: 493988 - RNA, 64 nt, Homo Sapiens; identical to SEQ ID NO: 164793

SEQ ID NO: 493989 - RNA, 64 nt, Homo Sapiens; identical to SEQ ID NO: 293300

SEQ ID NO: 493990 - RNA, 64 nt, Homo Sapiens; identical to SEQ ID NO: 293301

SEQ ID NO: 493991 - RNA, 64 nt, Homo Sapiens; identical to SEQ ID NO: 293302

SEQ ID NO: 493992 - RNA, 64 nt, Homo Sapiens; identical to SEQ ID NO: 293303

SEQ ID NO: 493993 - RNA, 64 nt, Homo Sapiens; identical to SEQ ID NO: 293304

SEQ ID NO: 493994 - RNA, 64 nt, Homo Sapiens; identical to SEQ ID NO: 293305

SEQ ID NO: 493995 - RNA, 64 nt, Homo Sapiens; identical to SEQ ID NO: 127496

SEQ ID NO: 493996 - RNA, 64 nt, Homo Sapiens; identical to SEQ ID NO: 127497

SEQ ID NO: 493997 - RNA, 64 nt, Homo Sapiens; identical to SEQ ID NO: 127498

SEQ ID NO: 493998 - RNA, 64 nt, Homo Sapiens; identical to SEQ ID NO: 127499

SEQ ID NO: 493999 - RNA, 64 nt, Homo Sapiens; identical to SEQ ID NO: 127500

SEQ ID NO: 494000 - RNA, 64 nt, Homo Sapiens; identical to SEQ ID NO: 127501

SEQ ID NO: 494001 - RNA, 64 nt, Homo Sapiens; identical to SEQ ID NO: 127502

SEQ ID NO: 494002 - RNA, 64 nt, Homo Sapiens; identical to SEQ ID NO: 127503

SEQ ID NO: 494003 - RNA, 59 nt, Homo Sapiens
agugccugucagagcccugagggguguccaccggggacagacccaggggcgggcagaga

SEQ ID NO: 494004 - RNA, 64 nt, Homo Sapiens
cuccccacaccagucaaggcuucucagcuggagaaccggggagcagcuggacacccagccaagg

SEQ ID NO: 494005 - RNA, 64 nt, Homo Sapiens
auguuccuaaaccaggaagcgggggauugauacgaccggggaaauucuguucauuuaccaaccu

SEQ ID NO: 494006 - RNA, 64 nt, Homo Sapiens
cagaaguugcagugagccgaggagaauugcuugaaccggggaggcuacucgggaggcugaggca

SEQ ID NO: 494007 - RNA, 64 nt, Homo Sapiens
caguuucagacaguucucuaggugguaaggggagaccggggagugaaaaugggguggggguggg

SEQ ID NO: 494008 - RNA, 64 nt, Homo Sapiens
ugucagucuuuccugcucagccaggggggaugauaccggggacucuccagagccaugacuagau

SEQ ID NO: 494009 - RNA, 64 nt, Homo Sapiens
cuacaccugaggcugaggcaggagaauugcuugaaccggggagacggagguugcagugagccga

SEQ ID NO: 494010 - RNA, 64 nt, Homo Sapiens
ccuccugcggacaccagcuccucucuccgccgucaccggggaggccggggauccuugcagggcu

SEQ ID NO: 494011 - RNA, 64 nt, Homo Sapiens
ggcuugcggacgccggcuguaccucguggagaccaccggggacaccuagcauaguacaaucaga

SEQ ID NO: 494012 - RNA, 64 nt, Homo Sapiens
gaggguuuuuucuuuuucuuaacauuauuuccuuaccggggaaucguuacagaaaaauagugua

SEQ ID NO: 494013 - RNA, 64 nt, Homo Sapiens
gggauagaggaagggugagcaucucugaggaucgaccggggacuauugccauccucuccuauuu

SEQ ID NO: 494014 - RNA, 63 nt, Homo Sapiens
gagcgagugcgucaagaaagugcgcccggagcgaccggggagcagcagaagaagaagcgguaa

SEQ ID NO: 494015 - RNA, 64 nt, Homo Sapiens
uggggggauacugaaccucuagacugaaguacuuaccggggagcacaguggacuaggggaugcc

SEQ ID NO: 494016 - RNA, 64 nt, Homo Sapiens
gggcuuccagcaggauugagucacccugacgaugaccggggagaagccgugugcucuucauuau

SEQ ID NO: 494017 - RNA, 64 nt, Homo Sapiens
uauuguggccuuggaguuugaaauucaccgggcaaccggggaagaaaaaaaaaaaaaggaaaaa

SEQ ID NO: 494018 - RNA, 64 nt, Homo Sapiens
cccaacugggaaaggaggccgcugcccuggggaaaccggggaacagcugcacucuugugccaca

SEQ ID NO: 494019 - RNA, 64 nt, Homo Sapiens
gacaggcagaagccggacaggggcccuuccccacaccggggagagcugcucggacaggcccccu

SEQ ID NO: 494020 - RNA, 64 nt, Homo Sapiens
aaauggugauggagggcaacgcacugugcuuugcaccggggagaaagugucugcuccacgucag

SEQ ID NO: 494021 - RNA, 64 nt, Homo Sapiens
gagggaggcugaaauguuuauguggggggcggggaccggggaaauuaagacaaagccuugucua

SEQ ID NO: 494022 - RNA, 64 nt, Homo Sapiens
gaugaaguaacugaggcuuagaaagguuaauagcaccggggaacaauuucucugggugagaauu

SEQ ID NO: 494023 - RNA, 64 nt, Homo Sapiens
ucugccaugcccagagaaucagggcaggcuugccaccggggaacccagcccugggguaugagcu

SEQ ID NO: 494024 - RNA, 64 nt, Homo Sapiens
cccucccgagccucaaggcaaguccaggacucagaccggggaggcccgggccagcagcucccag

SEQ ID NO: 494025 - RNA, 64 nt, Homo Sapiens
gccauuucuguacuaacuguucucuuguuccgguaccggggagaaggaugaccccuccuuauuc

SEQ ID NO: 494026 - RNA, 64 nt, Homo Sapiens
aagccucaacuaacaaacccuucaggaagcauauaccggggaauguguagccuucaggaaaaaa

SEQ ID NO: 494027 - RNA, 64 nt, Homo Sapiens
auucgcaugaaccacagaugcuggagaucaccagaccggggagagaagaggggcaccugggcug

SEQ ID NO: 494028 - RNA, 64 nt, Homo Sapiens
ugcccuguggugaccaggagcagugaccgucaagaccggggaagggacacaggugccaguucag

SEQ ID NO: 494029 - RNA, 64 nt, Homo Sapiens
aaggaccagggagcccugacucccagaggcugccaccggggagaagcagcgguccuccauccag

SEQ ID NO: 494030 - RNA, 64 nt, Homo Sapiens
cagcugcccagcugucaaggucaggcaagugagcaccggggacugaggaucagggcgggacccc

SEQ ID NO: 494031 - RNA, 64 nt, Homo Sapiens
gaaggacauuugacuuuuauaacaagucccgcaaaccggggacgggcugggaauuccaccugag

SEQ ID NO: 494032 - RNA, 64 nt, Homo Sapiens
cgcgggcuucugcugggucccaucccggcggggcaccggggacuguccugccggcccacaggcc

SEQ ID NO: 494033 - RNA, 64 nt, Homo Sapiens
cuguacaugcauugagcucuggacugcauaaauaaccggggauugaagaugggcuucauccaau

SEQ ID NO: 494034 - RNA, 64 nt, Homo Sapiens
agggccucucaugggaaagcgugggugucuucacaccggggaggggagccagaaagguaugcau

SEQ ID NO: 494035 - RNA, 64 nt, Homo Sapiens
gauggaugguuggauacaggggcagaucuucccuaccggggaggcaccugauguggagguacag

SEQ ID NO: 494036 - RNA, 64 nt, Homo Sapiens
aaagaggcgaggcaaugacuguuggccaguucucaccggggaaaaacccacuguuaggauggca

SEQ ID NO: 494037 - RNA, 64 nt, Homo Sapiens
acucugacaaggggagcugucaaucaaacaccaaaccggggagacaagaugauuggcagguauu

SEQ ID NO: 494038 - RNA, 64 nt, Homo Sapiens
gggaccugaccuggggcuggggaagcaccugaggaccggggauccuccugccucaagccugagu

SEQ ID NO: 494039 - RNA, 64 nt, Homo Sapiens
gccucaucccuagcuccaaucccuuccccacgugaccggggauucugguugcaauaaaacaugc

SEQ ID NO: 494040 - RNA, 64 nt, Homo Sapiens
gaggaggcucccgaggggaaggggcggugcccacaccggggacaggccgcagcuccauuuucuu

SEQ ID NO: 494041 - RNA, 64 nt, Homo Sapiens
cugaggcaggagaaucgcuacuguaaucccagcuaccggggaggccgggugcgguggcacacac

SEQ ID NO: 494042 - RNA, 64 nt, Homo Sapiens
uggagguugcagugagcugaggagaaucgcuugaaccggggaggcuacccaggaggcugaggca

SEQ ID NO: 494043 - RNA, 64 nt, Homo Sapiens
cucuucugcuuacuuuccacaugagaugcuuuguaccggggagcugugagcaggccucacgaug

SEQ ID NO: 494044 - RNA, 64 nt, Homo Sapiens
ucuggguugccaaagcagccaggcuuaugcugaaaccggggaagucugacauaugcaggaaacu

SEQ ID NO: 494045 - RNA, 64 nt, Homo Sapiens
cauccgcugcguggaggugucggacgaucaggacaccggggacacucugggcagcguccuccgg

SEQ ID NO: 494046 - RNA, 64 nt, Homo Sapiens
cgugucucauccccagaacaugccgucuguccccaccggggagugggccuugauggccgggccu

SEQ ID NO: 494047 - RNA, 64 nt, Homo Sapiens
gucuccuugggccaccaaaggugguggccaugguaccggggacuugggagagugagacccagug

SEQ ID NO: 494048 - RNA, 64 nt, Homo Sapiens
uuguaaccccuauuuaagccgggaccugaagagcaccggggaaugacccuuugaaaagugccug

SEQ ID NO: 494049 - RNA, 61 nt, Homo Sapiens
ggacacaaacaggaaugucuacugauuucccaccggggacucuaagaggcaugcugaguaa

SEQ ID NO: 494050 - RNA, 64 nt, Homo Sapiens
accaggacugccugggacucccuggcaacccagcaccggggaagccgucagcugcugugacaau

SEQ ID NO: 494051 - RNA, 64 nt, Homo Sapiens
gccuggccgggggcuccaaggggccggggcgcccaccggggacccaacuccggccccuggaccc

SEQ ID NO: 494052 - RNA, 64 nt, Homo Sapiens
aggcuacgugguccccuuggcaaacucacuguguaccggggaggcaaggguaucccaucugggg

SEQ ID NO: 494053 - RNA, 64 nt, Homo Sapiens
cugucucugucuuccaacccccaauaauauuuccaccggggaugcaucauuuuuacucccaaua

SEQ ID NO: 494054 - RNA, 55 nt, Homo Sapiens
cugccacauccccggugugagcccaaccggggagcccccgccccgccccacauuc

SEQ ID NO: 494055 - RNA, 64 nt, Homo Sapiens
uuagguccugcaguacagucuuccccugaaugccaccggggacccagggggacuccaccccccu

SEQ ID NO: 494056 - RNA, 64 nt, Homo Sapiens
gaccauucugugaaaggagcggcucgagggcaugaccggggacuccacacugucucccuggagg

SEQ ID NO: 494057 - RNA, 64 nt, Homo Sapiens
ggcaugggcuagaagaggagugcucccucccuccaccggggaagcguggagagugagggcuccc

SEQ ID NO: 494058 - RNA, 64 nt, Homo Sapiens
ccucacuagcaggacuggugccaaccuuacccucaccggggaacugugaagcgcugcaccccca

SEQ ID NO: 494059 - RNA, 64 nt, Homo Sapiens
aacagggcagacuggguaagagcaccagugggugaccggggagacucuggugcccagcgagcug

SEQ ID NO: 494060 - RNA, 64 nt, Homo Sapiens
ugagguccaggacugggaaggaccgggugagugcaccggggacccaggccaggugccccccgga

SEQ ID NO: 494061 - RNA, 64 nt, Homo Sapiens
ccaagaaggcggauuaggggguggcccaaggggcaccggggagaggacccggacccaggacccu

SEQ ID NO: 494062 - RNA, 64 nt, Homo Sapiens
gacucaggcguggaagagaaucuucuccuuauucaccggggaggcugugucuugugcaaacaag

SEQ ID NO: 494063 - RNA, 58 nt, Homo Sapiens
ggcccucucggcagcuguagggguggggaccggggagcaccugccuguagcccccauc

SEQ ID NO: 494064 - RNA, 64 nt, Homo Sapiens
caggaagagccaccaucccugcccccguuuucccaccggggagucuguacagagauuuuucuac

SEQ ID NO: 494065 - RNA, 64 nt, Homo Sapiens
ggucggccucuaagcucaugcaucucaacguucaaccggggaugugucuccugggcuguggucu

SEQ ID NO: 494066 - RNA, 64 nt, Homo Sapiens
uuggagagcuaggaaaaauaaacaaccuuaugccaccggggaaaaaaucacaauaaauauuuau

SEQ ID NO: 494067 - RNA, 64 nt, Homo Sapiens
cagagguugcagugagccgaugagaaucgcuugaaccggggaggcuacucaggaggcugaggca

SEQ ID NO: 494068 - RNA, 64 nt, Homo Sapiens
gaaggugaacauacaccucugugugugugcauguaccggggaaugggugaaugugugugagcau

SEQ ID NO: 494069 - RNA, 64 nt, Homo Sapiens
ggaggcgguggggcaugggaggaaggaggcacagaccggggaaauaugacagccgucauuucca

SEQ ID NO: 494070 - RNA, 64 nt, Homo Sapiens
gccacugugguuugagaagaggcuggauccgcugaccggggagauggccuguguguacaagggc

SEQ ID NO: 494071 - RNA, 64 nt, Homo Sapiens
cuaccacccucccuucuagagagcacaucgccugaccggggagaaguggggccgugguucgagg

SEQ ID NO: 494072 - RNA, 64 nt, Homo Sapiens
cgccggcuccccgaggacccaggcuugacgauucaccggggaucuccugggcugggcucuccuu

SEQ ID NO: 494073 - RNA, 64 nt, Homo Sapiens
uuuucagugaugaaaauacauuauuuuauuagucaccggggaacucauguagcuugugacacuu

SEQ ID NO: 494074 - RNA, 64 nt, Homo Sapiens; identical to SEQ ID NO: 134009

SEQ ID NO: 494075 - RNA, 64 nt, Homo Sapiens; identical to SEQ ID NO: 134010

SEQ ID NO: 494076 - RNA, 64 nt, Homo Sapiens; identical to SEQ ID NO: 134011

SEQ ID NO: 494077 - RNA, 64 nt, Homo Sapiens; identical to SEQ ID NO: 134012

SEQ ID NO: 494078 - RNA, 64 nt, Homo Sapiens; identical to SEQ ID NO: 134013

SEQ ID NO: 494079 - RNA, 64 nt, Homo Sapiens; identical to SEQ ID NO: 134014

SEQ ID NO: 494080 - RNA, 64 nt, Homo Sapiens; identical to SEQ ID NO: 134015

SEQ ID NO: 494081 - RNA, 64 nt, Homo Sapiens; identical to SEQ ID NO: 134016

SEQ ID NO: 494082 - RNA, 64 nt, Homo Sapiens; identical to SEQ ID NO: 134017

SEQ ID NO: 494083 - RNA, 64 nt, Homo Sapiens; identical to SEQ ID NO: 134018

SEQ ID NO: 494084 - RNA, 64 nt, Homo Sapiens; identical to SEQ ID NO: 134019

SEQ ID NO: 494085 - RNA, 64 nt, Homo Sapiens; identical to SEQ ID NO: 134020

SEQ ID NO: 494086 - RNA, 64 nt, Homo Sapiens; identical to SEQ ID NO: 134021

SEQ ID NO: 494087 - RNA, 64 nt, Homo Sapiens; identical to SEQ ID NO: 134022

SEQ ID NO: 494088 - RNA, 64 nt, Homo Sapiens; identical to SEQ ID NO: 134023

SEQ ID NO: 494089 - RNA, 64 nt, Homo Sapiens; identical to SEQ ID NO: 134024

SEQ ID NO: 494090 - RNA, 64 nt, Homo Sapiens; identical to SEQ ID NO: 134025

SEQ ID NO: 494091 - RNA, 64 nt, Homo Sapiens; identical to SEQ ID NO: 134026

SEQ ID NO: 494092 - RNA, 64 nt, Homo Sapiens; identical to SEQ ID NO: 134027

SEQ ID NO: 494093 - RNA, 64 nt, Homo Sapiens; identical to SEQ ID NO: 134028

SEQ ID NO: 494094 - RNA, 64 nt, Homo Sapiens; identical to SEQ ID NO: 134029

SEQ ID NO: 494095 - RNA, 64 nt, Homo Sapiens; identical to SEQ ID NO: 134030

SEQ ID NO: 494096 - RNA, 64 nt, Homo Sapiens; identical to SEQ ID NO: 134031

SEQ ID NO: 494097 - RNA, 64 nt, Homo Sapiens; identical to SEQ ID NO: 134032

SEQ ID NO: 494098 - RNA, 64 nt, Homo Sapiens; identical to SEQ ID NO: 134033

SEQ ID NO: 494099 - RNA, 64 nt, Homo Sapiens; identical to SEQ ID NO: 134034

SEQ ID NO: 494100 - RNA, 64 nt, Homo Sapiens; identical to SEQ ID NO: 134035

SEQ ID NO: 494101 - RNA, 64 nt, Homo Sapiens; identical to SEQ ID NO: 134036

SEQ ID NO: 494102 - RNA, 64 nt, Homo Sapiens; identical to SEQ ID NO: 134037

SEQ ID NO: 494103 - RNA, 64 nt, Homo Sapiens; identical to SEQ ID NO: 134038

SEQ ID NO: 494104 - RNA, 64 nt, Homo Sapiens; identical to SEQ ID NO: 134039

SEQ ID NO: 494105 - RNA, 64 nt, Homo Sapiens; identical to SEQ ID NO: 134040

SEQ ID NO: 494106 - RNA, 64 nt, Homo Sapiens; identical to SEQ ID NO: 134041

SEQ ID NO: 494107 - RNA, 64 nt, Homo Sapiens; identical to SEQ ID NO: 134042

SEQ ID NO: 494108 - RNA, 64 nt, Homo Sapiens; identical to SEQ ID NO: 134043

SEQ ID NO: 494109 - RNA, 64 nt, Homo Sapiens; identical to SEQ ID NO: 134044

SEQ ID NO: 494110 - RNA, 64 nt, Homo Sapiens; identical to SEQ ID NO: 134045

SEQ ID NO: 494111 - RNA, 64 nt, Homo Sapiens; identical to SEQ ID NO: 134046

SEQ ID NO: 494112 - RNA, 64 nt, Homo Sapiens; identical to SEQ ID NO: 283773

SEQ ID NO: 494113 - RNA, 64 nt, Homo Sapiens; identical to SEQ ID NO: 283774

SEQ ID NO: 494114 - RNA, 64 nt, Homo Sapiens; identical to SEQ ID NO: 283775

SEQ ID NO: 494115 - RNA, 64 nt, Homo Sapiens; identical to SEQ ID NO: 283776

SEQ ID NO: 494116 - RNA, 64 nt, Homo Sapiens; identical to SEQ ID NO: 283777

SEQ ID NO: 494117 - RNA, 64 nt, Homo Sapiens; identical to SEQ ID NO: 283778

SEQ ID NO: 494118 - RNA, 64 nt, Homo Sapiens; identical to SEQ ID NO: 283779

SEQ ID NO: 494119 - RNA, 64 nt, Homo Sapiens; identical to SEQ ID NO: 283780

SEQ ID NO: 494120 - RNA, 64 nt, Homo Sapiens; identical to SEQ ID NO: 283781

SEQ ID NO: 494121 - RNA, 64 nt, Homo Sapiens; identical to SEQ ID NO: 283782

SEQ ID NO: 494122 - RNA, 64 nt, Homo Sapiens; identical to SEQ ID NO: 283783

SEQ ID NO: 494123 - RNA, 64 nt, Homo Sapiens; identical to SEQ ID NO: 283784

SEQ ID NO: 494124 - RNA, 64 nt, Homo Sapiens; identical to SEQ ID NO: 283785

SEQ ID NO: 494125 - RNA, 64 nt, Homo Sapiens; identical to SEQ ID NO: 283786

SEQ ID NO: 494126 - RNA, 64 nt, Homo Sapiens; identical to SEQ ID NO: 283787

SEQ ID NO: 494127 - RNA, 64 nt, Homo Sapiens; identical to SEQ ID NO: 283788

SEQ ID NO: 494128 - RNA, 64 nt, Homo Sapiens; identical to SEQ ID NO: 283789

SEQ ID NO: 494129 - RNA, 64 nt, Homo Sapiens; identical to SEQ ID NO: 283790

SEQ ID NO: 494130 - RNA, 64 nt, Homo Sapiens; identical to SEQ ID NO: 283791

SEQ ID NO: 494131 - RNA, 64 nt, Homo Sapiens; identical to SEQ ID NO: 283792

SEQ ID NO: 494132 - RNA, 64 nt, Homo Sapiens; identical to SEQ ID NO: 283793

SEQ ID NO: 494133 - RNA, 64 nt, Homo Sapiens; identical to SEQ ID NO: 283794

SEQ ID NO: 494134 - RNA, 64 nt, Homo Sapiens; identical to SEQ ID NO: 283795

SEQ ID NO: 494135 - RNA, 64 nt, Homo Sapiens; identical to SEQ ID NO: 283796

SEQ ID NO: 494136 - RNA, 64 nt, Homo Sapiens; identical to SEQ ID NO: 283797

SEQ ID NO: 494137 - RNA, 64 nt, Homo Sapiens; identical to SEQ ID NO: 283798

SEQ ID NO: 494138 - RNA, 64 nt, Homo Sapiens; identical to SEQ ID NO: 283799

SEQ ID NO: 494139 - RNA, 64 nt, Homo Sapiens; identical to SEQ ID NO: 283800

SEQ ID NO: 494140 - RNA, 64 nt, Homo Sapiens; identical to SEQ ID NO: 283801

SEQ ID NO: 494141 - RNA, 64 nt, Homo Sapiens; identical to SEQ ID NO: 283802

SEQ ID NO: 494142 - RNA, 64 nt, Homo Sapiens; identical to SEQ ID NO: 283803

SEQ ID NO: 494143 - RNA, 64 nt, Homo Sapiens; identical to SEQ ID NO: 283804

SEQ ID NO: 494144 - RNA, 64 nt, Homo Sapiens; identical to SEQ ID NO: 283805

SEQ ID NO: 494145 - RNA, 64 nt, Homo Sapiens; identical to SEQ ID NO: 283806

SEQ ID NO: 494146 - RNA, 64 nt, Homo Sapiens; identical to SEQ ID NO: 283807

SEQ ID NO: 494147 - RNA, 64 nt, Homo Sapiens; identical to SEQ ID NO: 283808

SEQ ID NO: 494148 - RNA, 64 nt, Homo Sapiens; identical to SEQ ID NO: 80933

SEQ ID NO: 494149 - RNA, 64 nt, Homo Sapiens; identical to SEQ ID NO: 80934

SEQ ID NO: 494150 - RNA, 64 nt, Homo Sapiens; identical to SEQ ID NO: 80935

SEQ ID NO: 494151 - RNA, 64 nt, Homo Sapiens; identical to SEQ ID NO: 80936

SEQ ID NO: 494152 - RNA, 64 nt, Homo Sapiens; identical to SEQ ID NO: 80937

SEQ ID NO: 494153 - RNA, 64 nt, Homo Sapiens; identical to SEQ ID NO: 80938

SEQ ID NO: 494154 - RNA, 64 nt, Homo Sapiens; identical to SEQ ID NO: 80939

SEQ ID NO: 494155 - RNA, 64 nt, Homo Sapiens; identical to SEQ ID NO: 80940

SEQ ID NO: 494156 - RNA, 64 nt, Homo Sapiens; identical to SEQ ID NO: 80941

SEQ ID NO: 494157 - RNA, 64 nt, Homo Sapiens; identical to SEQ ID NO: 80942

SEQ ID NO: 494158 - RNA, 64 nt, Homo Sapiens; identical to SEQ ID NO: 80943

SEQ ID NO: 494159 - RNA, 64 nt, Homo Sapiens; identical to SEQ ID NO: 80944

SEQ ID NO: 494160 - RNA, 64 nt, Homo Sapiens; identical to SEQ ID NO: 80945

SEQ ID NO: 494161 - RNA, 64 nt, Homo Sapiens; identical to SEQ ID NO: 80946

SEQ ID NO: 494162 - RNA, 64 nt, Homo Sapiens; identical to SEQ ID NO: 80947

SEQ ID NO: 494163 - RNA, 64 nt, Homo Sapiens; identical to SEQ ID NO: 80948

SEQ ID NO: 494164 - RNA, 64 nt, Homo Sapiens; identical to SEQ ID NO: 80949

SEQ ID NO: 494165 - RNA, 64 nt, Homo Sapiens; identical to SEQ ID NO: 80950

SEQ ID NO: 494166 - RNA, 64 nt, Homo Sapiens; identical to SEQ ID NO: 80951

SEQ ID NO: 494167 - RNA, 64 nt, Homo Sapiens; identical to SEQ ID NO: 80952

SEQ ID NO: 494168 - RNA, 64 nt, Homo Sapiens; identical to SEQ ID NO: 80953

SEQ ID NO: 494169 - RNA, 64 nt, Homo Sapiens; identical to SEQ ID NO: 80954

SEQ ID NO: 494170 - RNA, 63 nt, Homo Sapiens; identical to SEQ ID NO: 80955

SEQ ID NO: 494171 - RNA, 64 nt, Homo Sapiens; identical to SEQ ID NO: 80956

SEQ ID NO: 494172 - RNA, 64 nt, Homo Sapiens; identical to SEQ ID NO: 80957

SEQ ID NO: 494173 - RNA, 64 nt, Homo Sapiens; identical to SEQ ID NO: 80958

SEQ ID NO: 494174 - RNA, 64 nt, Homo Sapiens; identical to SEQ ID NO: 80959

SEQ ID NO: 494175 - RNA, 64 nt, Homo Sapiens; identical to SEQ ID NO: 80960

SEQ ID NO: 494176 - RNA, 64 nt, Homo Sapiens; identical to SEQ ID NO: 80961

SEQ ID NO: 494177 - RNA, 64 nt, Homo Sapiens; identical to SEQ ID NO: 80962

SEQ ID NO: 494178 - RNA, 64 nt, Homo Sapiens; identical to SEQ ID NO: 80963

SEQ ID NO: 494179 - RNA, 64 nt, Homo Sapiens; identical to SEQ ID NO: 80964

SEQ ID NO: 494180 - RNA, 64 nt, Homo Sapiens; identical to SEQ ID NO: 80965

SEQ ID NO: 494181 - RNA, 64 nt, Homo Sapiens; identical to SEQ ID NO: 80966

SEQ ID NO: 494182 - RNA, 64 nt, Homo Sapiens; identical to SEQ ID NO: 80967

SEQ ID NO: 494183 - RNA, 64 nt, Homo Sapiens; identical to SEQ ID NO: 80968

SEQ ID NO: 494184 - RNA, 64 nt, Homo Sapiens; identical to SEQ ID NO: 80969

SEQ ID NO: 494185 - RNA, 64 nt, Homo Sapiens; identical to SEQ ID NO: 80970

SEQ ID NO: 494186 - RNA, 64 nt, Homo Sapiens; identical to SEQ ID NO: 80971

SEQ ID NO: 494187 - RNA, 64 nt, Homo Sapiens; identical to SEQ ID NO: 80972

SEQ ID NO: 494188 - RNA, 64 nt, Homo Sapiens; identical to SEQ ID NO: 80973

SEQ ID NO: 494189 - RNA, 64 nt, Homo Sapiens; identical to SEQ ID NO: 80974

SEQ ID NO: 494190 - RNA, 64 nt, Homo Sapiens; identical to SEQ ID NO: 80975

SEQ ID NO: 494191 - RNA, 64 nt, Homo Sapiens; identical to SEQ ID NO: 80976

SEQ ID NO: 494192 - RNA, 64 nt, Homo Sapiens; identical to SEQ ID NO: 80977

SEQ ID NO: 494193 - RNA, 64 nt, Homo Sapiens; identical to SEQ ID NO: 80978

SEQ ID NO: 494194 - RNA, 64 nt, Homo Sapiens; identical to SEQ ID NO: 80979

SEQ ID NO: 494195 - RNA, 64 nt, Homo Sapiens; identical to SEQ ID NO: 80980

SEQ ID NO: 494196 - RNA, 64 nt, Homo Sapiens; identical to SEQ ID NO: 80981

SEQ ID NO: 494197 - RNA, 64 nt, Homo Sapiens; identical to SEQ ID NO: 80982

SEQ ID NO: 494198 - RNA, 64 nt, Homo Sapiens; identical to SEQ ID NO: 80983

SEQ ID NO: 494199 - RNA, 64 nt, Homo Sapiens; identical to SEQ ID NO: 80984

SEQ ID NO: 494200 - RNA, 64 nt, Homo Sapiens; identical to SEQ ID NO: 80985

SEQ ID NO: 494201 - RNA, 64 nt, Homo Sapiens; identical to SEQ ID NO: 80986

SEQ ID NO: 494202 - RNA, 64 nt, Homo Sapiens; identical to SEQ ID NO: 80987

SEQ ID NO: 494203 - RNA, 64 nt, Homo Sapiens; identical to SEQ ID NO: 80988

SEQ ID NO: 494204 - RNA, 64 nt, Homo Sapiens; identical to SEQ ID NO: 80989

SEQ ID NO: 494205 - RNA, 64 nt, Homo Sapiens; identical to SEQ ID NO: 80990

SEQ ID NO: 494206 - RNA, 64 nt, Homo Sapiens; identical to SEQ ID NO: 80991

SEQ ID NO: 494207 - RNA, 64 nt, Homo Sapiens; identical to SEQ ID NO: 80992

SEQ ID NO: 494208 - RNA, 64 nt, Homo Sapiens; identical to SEQ ID NO: 80993

SEQ ID NO: 494209 - RNA, 64 nt, Homo Sapiens; identical to SEQ ID NO: 80994

SEQ ID NO: 494210 - RNA, 64 nt, Homo Sapiens; identical to SEQ ID NO: 80995

SEQ ID NO: 494211 - RNA, 64 nt, Homo Sapiens; identical to SEQ ID NO: 80996

SEQ ID NO: 494212 - RNA, 64 nt, Homo Sapiens; identical to SEQ ID NO: 80997

SEQ ID NO: 494213 - RNA, 64 nt, Homo Sapiens; identical to SEQ ID NO: 80998

SEQ ID NO: 494214 - RNA, 64 nt, Homo Sapiens; identical to SEQ ID NO: 80999

SEQ ID NO: 494215 - RNA, 64 nt, Homo Sapiens; identical to SEQ ID NO: 81000

SEQ ID NO: 494216 - RNA, 64 nt, Homo Sapiens; identical to SEQ ID NO: 81001

SEQ ID NO: 494217 - RNA, 64 nt, Homo Sapiens; identical to SEQ ID NO: 81002

SEQ ID NO: 494218 - RNA, 64 nt, Homo Sapiens; identical to SEQ ID NO: 81003

SEQ ID NO: 494219 - RNA, 64 nt, Homo Sapiens; identical to SEQ ID NO: 81004

SEQ ID NO: 494220 - RNA, 64 nt, Homo Sapiens; identical to SEQ ID NO: 81005

SEQ ID NO: 494221 - RNA, 64 nt, Homo Sapiens; identical to SEQ ID NO: 81006

SEQ ID NO: 494222 - RNA, 64 nt, Homo Sapiens; identical to SEQ ID NO: 81007

SEQ ID NO: 494223 - RNA, 64 nt, Homo Sapiens; identical to SEQ ID NO: 81008

SEQ ID NO: 494224 - RNA, 64 nt, Homo Sapiens; identical to SEQ ID NO: 81009

SEQ ID NO: 494225 - RNA, 64 nt, Homo Sapiens; identical to SEQ ID NO: 81010

SEQ ID NO: 494226 - RNA, 64 nt, Homo Sapiens; identical to SEQ ID NO: 81011

SEQ ID NO: 494227 - RNA, 64 nt, Homo Sapiens; identical to SEQ ID NO: 81012

SEQ ID NO: 494228 - RNA, 64 nt, Homo Sapiens; identical to SEQ ID NO: 81013

SEQ ID NO: 494229 - RNA, 64 nt, Homo Sapiens; identical to SEQ ID NO: 81014

SEQ ID NO: 494230 - RNA, 64 nt, Homo Sapiens; identical to SEQ ID NO: 81015

SEQ ID NO: 494231 - RNA, 64 nt, Homo Sapiens; identical to SEQ ID NO: 81016

SEQ ID NO: 494232 - RNA, 64 nt, Homo Sapiens; identical to SEQ ID NO: 81017

SEQ ID NO: 494233 - RNA, 64 nt, Homo Sapiens; identical to SEQ ID NO: 81018

SEQ ID NO: 494234 - RNA, 64 nt, Homo Sapiens; identical to SEQ ID NO: 81019

SEQ ID NO: 494235 - RNA, 64 nt, Homo Sapiens; identical to SEQ ID NO: 81020

SEQ ID NO: 494236 - RNA, 64 nt, Homo Sapiens; identical to SEQ ID NO: 81021

SEQ ID NO: 494237 - RNA, 64 nt, Homo Sapiens; identical to SEQ ID NO: 81022

SEQ ID NO: 494238 - RNA, 64 nt, Homo Sapiens; identical to SEQ ID NO: 81023

SEQ ID NO: 494239 - RNA, 64 nt, Homo Sapiens; identical to SEQ ID NO: 81024

SEQ ID NO: 494240 - RNA, 64 nt, Homo Sapiens; identical to SEQ ID NO: 81025

SEQ ID NO: 494241 - RNA, 64 nt, Homo Sapiens; identical to SEQ ID NO: 81026

SEQ ID NO: 494242 - RNA, 64 nt, Homo Sapiens; identical to SEQ ID NO: 81027

SEQ ID NO: 494243 - RNA, 64 nt, Homo Sapiens; identical to SEQ ID NO: 81028

SEQ ID NO: 494244 - RNA, 64 nt, Homo Sapiens; identical to SEQ ID NO: 81029

SEQ ID NO: 494245 - RNA, 64 nt, Homo Sapiens; identical to SEQ ID NO: 81030

SEQ ID NO: 494246 - RNA, 64 nt, Homo Sapiens; identical to SEQ ID NO: 81031

SEQ ID NO: 494247 - RNA, 64 nt, Homo Sapiens; identical to SEQ ID NO: 81032

SEQ ID NO: 494248 - RNA, 64 nt, Homo Sapiens; identical to SEQ ID NO: 81033

SEQ ID NO: 494249 - RNA, 64 nt, Homo Sapiens; identical to SEQ ID NO: 81034

SEQ ID NO: 494250 - RNA, 64 nt, Homo Sapiens; identical to SEQ ID NO: 81035

SEQ ID NO: 494251 - RNA, 64 nt, Homo Sapiens; identical to SEQ ID NO: 81036

SEQ ID NO: 494252 - RNA, 64 nt, Homo Sapiens; identical to SEQ ID NO: 81037

SEQ ID NO: 494253 - RNA, 64 nt, Homo Sapiens; identical to SEQ ID NO: 81038

SEQ ID NO: 494254 - RNA, 64 nt, Homo Sapiens; identical to SEQ ID NO: 81039

SEQ ID NO: 494255 - RNA, 64 nt, Homo Sapiens; identical to SEQ ID NO: 81040

SEQ ID NO: 494256 - RNA, 64 nt, Homo Sapiens; identical to SEQ ID NO: 81041

SEQ ID NO: 494257 - RNA, 64 nt, Homo Sapiens; identical to SEQ ID NO: 81042

SEQ ID NO: 494258 - RNA, 64 nt, Homo Sapiens
agacacuuucucugccucauccugcccucaagcuuuagucaagaaguuauggcccccagucccu

SEQ ID NO: 494259 - RNA, 64 nt, Homo Sapiens
ucuguuugucagaaguucuccguuaguuccuguauuagucaagguuuuccagagaaacagaauc

SEQ ID NO: 494260 - RNA, 64 nt, Homo Sapiens
ugccauaucucauuauugcauaccuuuaaggguuuuagucaacaaugucucaguuuuugaauuc

SEQ ID NO: 494261 - RNA, 64 nt, Homo Sapiens
agaggcaaugcaaagauucaugaaacucaucauuuuagucaaguuagcuaaguguguaugauaa

SEQ ID NO: 494262 - RNA, 64 nt, Homo Sapiens
uucucuuccagaggcuuuggcuacucuccugcgcccacgguaccuggaccugcuagucuccagc

SEQ ID NO: 494263 - RNA, 64 nt, Homo Sapiens
cugcccaccucaggcccccacccuccacuccuccccacgguacugugaacgucgugugacucag

SEQ ID NO: 494264 - RNA, 64 nt, Homo Sapiens
gauauauuuauaguucacuuuuggguuuuuauacccacgguaggauucugcauuccagcauuaa

SEQ ID NO: 494265 - RNA, 64 nt, Homo Sapiens
uuuuagggacucaggagaauauacaugaucagcuccacgguaauuccaagacaaagaugaaccc

SEQ ID NO: 494266 - RNA, 64 nt, Homo Sapiens
gcgcuggccccagcauggagggaagcccugugggccacgguaggcuagaagggaauucgagcug

SEQ ID NO: 494267 - RNA, 64 nt, Homo Sapiens
aagguucugcccgggaaggucaccagcaccaacaccacgguagugccugaaauuucaccauugc

SEQ ID NO: 494268 - RNA, 64 nt, Homo Sapiens
cagugacuuaaccugaauuguagaguuucuuuuuccacgguaguaggcucccuaucauuauaua

SEQ ID NO: 494269 - RNA, 64 nt, Homo Sapiens
auguuuaguagcaccccugggcuucucugugcucccacgguaggggcaauucuuugcugcgugg

SEQ ID NO: 494270 - RNA, 64 nt, Homo Sapiens
aaaacgaguuagaccagugauguaccgcgcuucuccacgguagaggcguguucucaguuuagca

SEQ ID NO: 494271 - RNA, 64 nt, Homo Sapiens
ggacagaguuaucgaggcacgagcagcagugcuaccacgguaaucaacagagccaaggccuugg

SEQ ID NO: 494272 - RNA, 64 nt, Homo Sapiens
auucuuccuuagacuuacuuuuguaaaaauguccccacgguacuuacuccccacugauggacca

SEQ ID NO: 494273 - RNA, 64 nt, Homo Sapiens
ugacuagaaauuaguacaugcccacagcuggcucccacgguagccaggagaauuaucuauaggu

SEQ ID NO: 494274 - RNA, 64 nt, Homo Sapiens
cuguggcugguagacaccaagcugcugugacugaccacgguaccacgggcugccacagccccug

SEQ ID NO: 494275 - RNA, 64 nt, Homo Sapiens
uucauuggcagcccccuaggacugcacgcuggccccacgguaacccccccucccccaccaacau

SEQ ID NO: 494276 - RNA, 64 nt, Homo Sapiens
ggcgaggaagucuuggcuggaaacugccccaaugccacgguaaacucuccguagagagccugaa

SEQ ID NO: 494277 - RNA, 64 nt, Homo Sapiens
gaaauaaguuauuggccgcgcgccucccuucaguccacgguacuacccgggccuccccucgucc

SEQ ID NO: 494278 - RNA, 64 nt, Homo Sapiens
cugggauguuuucaaaaguguaaguucaauuucaccacgguaaaccuuuucaucuguuucagag

SEQ ID NO: 494279 - RNA, 64 nt, Homo Sapiens
ucucacaccagcgggccaguugugcuaauuuauuccacgguagcuaagacuuuuuuuccauuuu

SEQ ID NO: 494280 - RNA, 64 nt, Homo Sapiens
uccuggccaggcugcugggaaacacgugccuucuccacgguaucgggacagugaugccaacuca

SEQ ID NO: 494281 - RNA, 64 nt, Homo Sapiens
agccacacuuccuuuagaagaaaauaaguguaauccacgguagccugucccuucuccccgcuuc

SEQ ID NO: 494282 - RNA, 64 nt, Homo Sapiens
acuugaccuuuucgacgcuucucagaugaucucuccacgguagcgucccaccgggagccucccc

SEQ ID NO: 494283 - RNA, 64 nt, Homo Sapiens
auguacuucauggccaguguaugcacauauuucaccacgguaucugggagcauagcaugaagug

SEQ ID NO: 494284 - RNA, 64 nt, Homo Sapiens
cggucccuggcaauucuguuuuagaaaaacauauccacgguaacauugugcagacacugaguuu

SEQ ID NO: 494285 - RNA, 64 nt, Homo Sapiens
uugaucuacuugccucauuucccuaucuucucccccacgguauccuaaacuuuagacuucccac

SEQ ID NO: 494286 - RNA, 64 nt, Homo Sapiens
cagccgccggugcuguugacccaagggccgugguccacgguacuugaagaagccagagcccaca

SEQ ID NO: 494287 - RNA, 64 nt, Homo Sapiens
ccuucucccauagaccccuuucuucuccccuuccccacgguaggaacauagcguguuuauauuu

SEQ ID NO: 494288 - RNA, 64 nt, Homo Sapiens
ugaguucacaccuagaacaccugcuucauaggccccacgguaagacuucgaaggccacacacuc

SEQ ID NO: 494289 - RNA, 64 nt, Homo Sapiens
agccaaagacaucaacccaaugagaccuagguugccacgguaaccgggcuucagccagaccugc

SEQ ID NO: 494290 - RNA, 64 nt, Homo Sapiens
ggcuccucugugacaaaacacuagcuucaagcaugacuguuaauaauuuauuuuaaaacaaggg

SEQ ID NO: 494291 - RNA, 64 nt, Homo Sapiens
cacuacuaaacucuaccaagcuccauaagugcaggacuguuacuuauuaaugaguauuuccuuu

SEQ ID NO: 494292 - RNA, 64 nt, Homo Sapiens
cagguuccaagccuagaggcguggucgcuccuccgacuguuaucaugcucagacagaagggacu

SEQ ID NO: 494293 - RNA, 64 nt, Homo Sapiens
ccgguuccaagccuagaggagcagucgugccucugacuguuaucgcucagacacagaagggacu

SEQ ID NO: 494294 - RNA, 64 nt, Homo Sapiens
uuguuuuaagacuuccacacaccaaggcuacaaugacuguuaaccuggaggaagucucugguau

SEQ ID NO: 494295 - RNA, 64 nt, Homo Sapiens
uauaaauuaagcauaaaauauguaaccaggaaaagacuguuaacauuacauuuaugcaaauuaa

SEQ ID NO: 494296 - RNA, 64 nt, Homo Sapiens; identical to SEQ ID NO: 293628

SEQ ID NO: 494297 - RNA, 64 nt, Homo Sapiens; identical to SEQ ID NO: 293629

SEQ ID NO: 494298 - RNA, 64 nt, Homo Sapiens; identical to SEQ ID NO: 293630

SEQ ID NO: 494299 - RNA, 64 nt, Homo Sapiens; identical to SEQ ID NO: 293631

SEQ ID NO: 494300 - RNA, 64 nt, Homo Sapiens; identical to SEQ ID NO: 293632

SEQ ID NO: 494301 - RNA, 64 nt, Homo Sapiens; identical to SEQ ID NO: 293633

SEQ ID NO: 494302 - RNA, 64 nt, Homo Sapiens; identical to SEQ ID NO: 293634

SEQ ID NO: 494303 - RNA, 64 nt, Homo Sapiens; identical to SEQ ID NO: 293635

SEQ ID NO: 494304 - RNA, 64 nt, Homo Sapiens; identical to SEQ ID NO: 293636

SEQ ID NO: 494305 - RNA, 64 nt, Homo Sapiens; identical to SEQ ID NO: 293637

SEQ ID NO: 494306 - RNA, 64 nt, Homo Sapiens; identical to SEQ ID NO: 293638

SEQ ID NO: 494307 - RNA, 64 nt, Homo Sapiens; identical to SEQ ID NO: 293639

SEQ ID NO: 494308 - RNA, 64 nt, Homo Sapiens; identical to SEQ ID NO: 293640

SEQ ID NO: 494309 - RNA, 64 nt, Homo Sapiens; identical to SEQ ID NO: 293641

SEQ ID NO: 494310 - RNA, 64 nt, Homo Sapiens; identical to SEQ ID NO: 293642

SEQ ID NO: 494311 - RNA, 64 nt, Homo Sapiens; identical to SEQ ID NO: 293643

SEQ ID NO: 494312 - RNA, 64 nt, Homo Sapiens; identical to SEQ ID NO: 293644

SEQ ID NO: 494313 - RNA, 64 nt, Homo Sapiens; identical to SEQ ID NO: 293645

SEQ ID NO: 494314 - RNA, 64 nt, Homo Sapiens; identical to SEQ ID NO: 293646

SEQ ID NO: 494315 - RNA, 64 nt, Homo Sapiens; identical to SEQ ID NO: 293647

SEQ ID NO: 494316 - RNA, 64 nt, Homo Sapiens; identical to SEQ ID NO: 293648

SEQ ID NO: 494317 - RNA, 64 nt, Homo Sapiens; identical to SEQ ID NO: 293643

SEQ ID NO: 494318 - RNA, 64 nt, Homo Sapiens; identical to SEQ ID NO: 293650

SEQ ID NO: 494319 - RNA, 64 nt, Homo Sapiens; identical to SEQ ID NO: 293651

SEQ ID NO: 494320 - RNA, 64 nt, Homo Sapiens; identical to SEQ ID NO: 293652

SEQ ID NO: 494321 - RNA, 64 nt, Homo Sapiens; identical to SEQ ID NO: 293653

SEQ ID NO: 494322 - RNA, 64 nt, Homo Sapiens; identical to SEQ ID NO: 293654

SEQ ID NO: 494323 - RNA, 64 nt, Homo Sapiens; identical to SEQ ID NO: 293655

SEQ ID NO: 494324 - RNA, 64 nt, Homo Sapiens; identical to SEQ ID NO: 293656

SEQ ID NO: 494325 - RNA, 64 nt, Homo Sapiens; identical to SEQ ID NO: 293644

SEQ ID NO: 494326 - RNA, 64 nt, Homo Sapiens; identical to SEQ ID NO: 293658

SEQ ID NO: 494327 - RNA, 64 nt, Homo Sapiens; identical to SEQ ID NO: 293659

SEQ ID NO: 494328 - RNA, 64 nt, Homo Sapiens; identical to SEQ ID NO: 293660

SEQ ID NO: 494329 - RNA, 64 nt, Homo Sapiens; identical to SEQ ID NO: 293661

SEQ ID NO: 494330 - RNA, 64 nt, Homo Sapiens; identical to SEQ ID NO: 293662

SEQ ID NO: 494331 - RNA, 64 nt, Homo Sapiens; identical to SEQ ID NO: 293663

SEQ ID NO: 494332 - RNA, 64 nt, Homo Sapiens; identical to SEQ ID NO: 293664

SEQ ID NO: 494333 - RNA, 64 nt, Homo Sapiens; identical to SEQ ID NO: 293665

SEQ ID NO: 494334 - RNA, 64 nt, Homo Sapiens; identical to SEQ ID NO: 293666

SEQ ID NO: 494335 - RNA, 64 nt, Homo Sapiens; identical to SEQ ID NO: 293667

SEQ ID NO: 494336 - RNA, 64 nt, Homo Sapiens; identical to SEQ ID NO: 293668

SEQ ID NO: 494337 - RNA, 64 nt, Homo Sapiens; identical to SEQ ID NO: 293669

SEQ ID NO: 494338 - RNA, 64 nt, Homo Sapiens; identical to SEQ ID NO: 293670

SEQ ID NO: 494339 - RNA, 64 nt, Homo Sapiens; identical to SEQ ID NO: 293671

SEQ ID NO: 494340 - RNA, 64 nt, Homo Sapiens; identical to SEQ ID NO: 293672

SEQ ID NO: 494341 - RNA, 64 nt, Homo Sapiens; identical to SEQ ID NO: 293673

SEQ ID NO: 494342 - RNA, 64 nt, Homo Sapiens; identical to SEQ ID NO: 293674

SEQ ID NO: 494343 - RNA, 64 nt, Homo Sapiens; identical to SEQ ID NO: 293675

SEQ ID NO: 494344 - RNA, 64 nt, Homo Sapiens; identical to SEQ ID NO: 293676

SEQ ID NO: 494345 - RNA, 64 nt, Homo Sapiens; identical to SEQ ID NO: 293677

SEQ ID NO: 494346 - RNA, 64 nt, Homo Sapiens; identical to SEQ ID NO: 293678

SEQ ID NO: 494347 - RNA, 64 nt, Homo Sapiens; identical to SEQ ID NO: 293679

SEQ ID NO: 494348 - RNA, 64 nt, Homo Sapiens; identical to SEQ ID NO: 293680

SEQ ID NO: 494349 - RNA, 64 nt, Homo Sapiens; identical to SEQ ID NO: 293681

SEQ ID NO: 494350 - RNA, 64 nt, Homo Sapiens; identical to SEQ ID NO: 293682

SEQ ID NO: 494351 - RNA, 64 nt, Homo Sapiens; identical to SEQ ID NO: 293683

SEQ ID NO: 494352 - RNA, 64 nt, Homo Sapiens; identical to SEQ ID NO: 293684

SEQ ID NO: 494353 - RNA, 64 nt, Homo Sapiens; identical to SEQ ID NO: 293685

SEQ ID NO: 494354 - RNA, 64 nt, Homo Sapiens
acucaguucuuggcugccguccuguggcagcuuaauggaacaaaaauuacagacuuuggugaac

SEQ ID NO: 494355 - RNA, 64 nt, Homo Sapiens
aucauuguuaaacuuuguaaaguauuuaagguacauggaacacacgggaagucugguagcucag

SEQ ID NO: 494356 - RNA, 61 nt, Homo Sapiens
uaccagagaguauuguguagugcucucugcaauggaacaugugauuucaggguugccgcag

SEQ ID NO: 494357 - RNA, 64 nt, Homo Sapiens
agggucagugugagcagcuaacauccuaccucaaauggaacaggauuuuuugaugcuuugcucu

SEQ ID NO: 494358 - RNA, 64 nt, Homo Sapiens
acucagaaaugcggaauacccuggaaaucacacaauggaacaaccagucaucccuuaagacgca

SEQ ID NO: 494359 - RNA, 64 nt, Homo Sapiens
uguagaaagccuucagugcugagaauccugaagaauggaacagccccagaagauuauguacuga

SEQ ID NO: 494360 - RNA, 64 nt, Homo Sapiens
gaugguauuggcagaggaacagacacauacgucaauggaacagaugagagaacccagaaauaaa

SEQ ID NO: 494361 - RNA, 64 nt, Homo Sapiens
auaaagggaugacgcaaggaguuccuuugugcugauggaacaguucuauaugauuaugaugauu

SEQ ID NO: 494362 - RNA, 64 nt, Homo Sapiens
auucuucagagcacacgucuguggucuucugaaaauggaacaccagagaaauuaugugugucau

SEQ ID NO: 494363 - RNA, 64 nt, Homo Sapiens
uaauuuaguacaauuaaguaucccagugaacuuuauggaacauuuuauccucuuaaccuucucu

SEQ ID NO: 494364 - RNA, 64 nt, Homo Sapiens
aauauauuguuauguuuucuuacauuauuguuauuaauguuagugguauuauauuuuaaccuuu

SEQ ID NO: 494365 - RNA, 64 nt, Homo Sapiens
uguggccacacugauguucauuccuuucucaaaauaauguuauauuuuggggcaugcacuuucu

SEQ ID NO: 494366 - RNA, 64 nt, Homo Sapiens
gcacaucuauuaggauccuuaaauauucauuacuuaauguuaaauuaacauucuguguagggag

SEQ ID NO: 494367 - RNA, 64 nt, Homo Sapiens
uccuggaaaaaugacaucaucaaaguauaguugauaauguuauaaaggaugauuuuaaaaauag

SEQ ID NO: 494368 - RNA, 64 nt, Homo Sapiens
gcagugacgggaaauacacauuugaaguuuaguuuaauguuaguuagucacaauguuuuugugg

SEQ ID NO: 494369 - RNA, 64 nt, Homo Sapiens
cacaauguuuuugugguuugacagcuugccuuuuuaauguuaguuuauaagcuuugaguaucuu

SEQ ID NO: 494370 - RNA, 64 nt, Homo Sapiens
aggaguauuuugagggagauacuucagaacuuucuaauguuaucggcauuauauaugauuaaac

SEQ ID NO: 494371 - RNA, 64 nt, Homo Sapiens
aagaugauaaaaauucgcuccaaaaagacauucauaauguuaggggcaucccuucuguauguaa

SEQ ID NO: 494372 - RNA, 64 nt, Homo Sapiens
caguccguugcugaaaaugauuauaagcccugcauaauguuaagcuuuauugugauuacgugua

SEQ ID NO: 494373 - RNA, 64 nt, Homo Sapiens
cuaucagagccucucccacaccacuauaguguaauaauguuauuauuacucuacacugaaacgu

SEQ ID NO: 494374 - RNA, 64 nt, Homo Sapiens
uuuauuauguaauugauaaaauggugauguguauuaauguuaguucaaccauauauuuauacug

SEQ ID NO: 494375 - RNA, 64 nt, Homo Sapiens
uaauuuaaauauuaguauuugguacaugaaggcuuaauguuaaguuuccuuuaaugauccacaa

SEQ ID NO: 494376 - RNA, 64 nt, Homo Sapiens
uaaugaaguuccagagauggcugcuuuuugcuuuuaauguuaaccuaucauaaucacaucaggu

SEQ ID NO: 494377 - RNA, 64 nt, Homo Sapiens
uuggaugcuuuauuuuuuugaaccagaaacggaauaauguuacuuuuuauaagccacagagaca

SEQ ID NO: 494378 - RNA, 64 nt, Homo Sapiens
aacauguccuaauucuucuguccugagaagcauguaauguuaauguuauaucauauguauauau

SEQ ID NO: 494379 - RNA, 64 nt, Homo Sapiens
uccuaauucuucuguccugagaagcauguaauguuaauguuauaucauauguauauauauauau

SEQ ID NO: 494380 - RNA, 64 nt, Homo Sapiens
ucaugacaauuuauuuuucuuuugcauagcuguuuaauguuaagugauuuuguguugauccaaa

SEQ ID NO: 494381 - RNA, 64 nt, Homo Sapiens
uccuccccccacccccuucuauuucaaccauucuuaauguuacgauuuaacagaaaaacacaaa

SEQ ID NO: 494382 - RNA, 64 nt, Homo Sapiens
aucuauguauuguagacaauauguuaauacacaguaauguuauuaauaaaaggauaauuacuua

SEQ ID NO: 494383 - RNA, 64 nt, Homo Sapiens
acacaguaauguuauuaucuaaaggauaauuacuuaauguuaaucuaauguaggauaaagaaua

SEQ ID NO: 494384 - RNA, 64 nt, Homo Sapiens
caggugcuauuguuacucuuacgaauauuuucaguaauguuauuuucuucuaagugaaauuucu

SEQ ID NO: 494385 - RNA, 64 nt, Homo Sapiens
caaccauauuuagcagugcaguugaguuguguguuaauguuagacuaucccuuugugagugaca

SEQ ID NO: 494386 - RNA, 64 nt, Homo Sapiens
aauuguaccuugaucaauguuggaauguguauauuaauguuaaaauguuaaauagaugagauua

SEQ ID NO: 494387 - RNA, 64 nt, Homo Sapiens
uagaugagauuauggaauguacaaaggccuguguuaauguuaaagggagaaaaaaauaacaaca

SEQ ID NO: 494388 - RNA, 64 nt, Homo Sapiens
ugaucauggguguggcauucuuucaugauuguaauaauguuacauaaucacgaauguaguaaua

SEQ ID NO: 494389 - RNA, 64 nt, Homo Sapiens
cacgaauguaguaauauuucaugugccuuuuggguaauguuaauucuuaauucaacauuugaag

SEQ ID NO: 494390 - RNA, 64 nt, Homo Sapiens
aguucuggagcuuaauuuucaguaccagcuuugguaauguuagcugcauuucagaauauuagcc

SEQ ID NO: 494391 - RNA, 64 nt, Homo Sapiens
caccauuuuuuuuuucuuuuuugaaacucacuaguaauguuaaacucgagcccagggcuagaag

SEQ ID NO: 494392 - RNA, 64 nt, Homo Sapiens
gaugguaaagcugcacuuacugauaauuauaacuuaauguuagacaguuacaaaggaauuugga

SEQ ID NO: 494393 - RNA, 64 nt, Homo Sapiens
caguuacaaaggaauuuggauagaggauaaaagauaauguuaucauauacuauuauuagaauag

SEQ ID NO: 494394 - RNA, 64 nt, Homo Sapiens
uugagauuuugaggugugcacaaggugguaagauaaagggcauaugagcuucaaaacuaaugcu

SEQ ID NO: 494395 - RNA, 64 nt, Homo Sapiens
uuuccugguugcagauaacgaacuaagguugccuaaagggcagaucugcccucuccaugucuuc

SEQ ID NO: 494396 - RNA, 64 nt, Homo Sapiens
gcaucuguagucagccgacauuccaaaauaaaacaaagggcacaaugguacaaccuuuauucuu

SEQ ID NO: 494397 - RNA, 64 nt, Homo Sapiens
ucuuuaggucuuuguaagaaacaagccugguaggaaagggcaagauguaaugcaacuacccaaa

SEQ ID NO: 494398 - RNA, 64 nt, Homo Sapiens
uagccuggcaacagagcaagacuccgucucaaaaaaagggcaauaaaugcccucucugaauguu

SEQ ID NO: 494399 - RNA, 64 nt, Homo Sapiens
gccaagaaaaggcauggagacagcgaacuagaagaaagggcaagaaggaaauagccaccgucua

SEQ ID NO: 494400 - RNA, 64 nt, Homo Sapiens
augugucagaugcccuaguuagaugauuuuugggaaagggcaaauuauggaaaggguuugagau

SEQ ID NO: 494401 - RNA, 64 nt, Homo Sapiens
aaauucauuugaaccaguuugugaugaauauaagaaagggcaaauaaucugaauaagacaauau

SEQ ID NO: 494402 - RNA, 64 nt, Homo Sapiens
uugccccaagguuacacugacaguggugaacugaaaagggcauacaucuuugccaaaagcuaag

SEQ ID NO: 494403 - RNA, 64 nt, Homo Sapiens
ucagccucucugaacuuugugaugacacagaaugaaagggcaucucguuggcagauuaucuucu

SEQ ID NO: 494404 - RNA, 64 nt, Homo Sapiens
ccagcuggggcaugugcaaauaggcagaaaagaaaaagggcauuggggccucaaagggcagguu

SEQ ID NO: 494405 - RNA, 64 nt, Homo Sapiens
uuuaggcagaaaagaaaaaguggaguggggccucaaagggcaggcacgccccagaggagagaga

SEQ ID NO: 494406 - RNA, 64 nt, Homo Sapiens
ccagcgggggcauguguggauaggcagggaagagaaagggcaccggauguuuggaugcggcugg

SEQ ID NO: 494407 - RNA, 64 nt, Homo Sapiens
caggcagcccuuugcaaucgcauuaccugcaaagaaagggcacuagaagcagauggagaggucc

SEQ ID NO: 494408 - RNA, 64 nt, Homo Sapiens
accaucccacgaugucugaaacaguguuaacacaaaagggcaucagcagggcugaauccccuuc

SEQ ID NO: 494409 - RNA, 64 nt, Homo Sapiens
agacggucucaaucuaaaagcacuucaaggggucaaagggcaaccagcuugggugcuaccucag

SEQ ID NO: 494410 - RNA, 64 nt, Homo Sapiens
ugucuuugcucacccucauccccaaacuacuugaaaagggcauuuggcaccacucucugaaaca

SEQ ID NO: 494411 - RNA, 64 nt, Homo Sapiens
gcuauccuuccccucaccccucagcccaggagggaaagggcauuuucuuuuucaucuuugaaag

SEQ ID NO: 494412 - RNA, 64 nt, Homo Sapiens
augcacagcaggcuccccauagcuuugucaccacaaagggcacuguucuauucacagcaccucc

SEQ ID NO: 494413 - RNA, 64 nt, Homo Sapiens
cauccacagauucacuuuguuaaagaacagugagaaagggcauaauuugaauuuagggugauuu

SEQ ID NO: 494414 - RNA, 64 nt, Homo Sapiens
uauacgugacagaauuguacuaaauaaaaaguacaaagggcacaggcacuaaacucagauugac

SEQ ID NO: 494415 - RNA, 64 nt, Homo Sapiens
agcugcagauaacucaaagccaucccuuuuuucuaaagggcacauugagaaugucacccauuug

SEQ ID NO: 494416 - RNA, 64 nt, Homo Sapiens
uucccugauguccuuguuuaaacgauaauaagaaaaagggcaacuccauuuguugagggucuuu

SEQ ID NO: 494417 - RNA, 64 nt, Homo Sapiens
guuuucuuuuuuuucgucuauuuuucuugguagacaacuggaagcauguaauauccauauuagu

SEQ ID NO: 494418 - RNA, 64 nt, Homo Sapiens
agaagcucugggggugaggcggcuuucucuagaccaacuggaucgcuaaaaaugcagauucuca

SEQ ID NO: 494419 - RNA, 64 nt, Homo Sapiens
aucuaauuuuaggaggaccaaauucaguggauggcaacuggaacauugauuguaaggccaguga

SEQ ID NO: 494420 - RNA, 64 nt, Homo Sapiens
gaacauugauuguaaggccagugaaguuuucacccaacuggaauuugauggaaagaagguuugu

SEQ ID NO: 494421 - RNA, 64 nt, Homo Sapiens
cagauggugaccaggcucugguuacuccuucugccaacuggaagaacaggugcuccccugugcu

SEQ ID NO: 494422 - RNA, 64 nt, Homo Sapiens
gauaaugaugccauugagugaauguaugcuuaagcaacuggaugcagaccaaggauaacuuuca

SEQ ID NO: 494423 - RNA, 64 nt, Homo Sapiens
accugaaggcuugggccagagcucaacagcuacucaacuggaggggugagggggauaaggucug

SEQ ID NO: 494424 - RNA, 64 nt, Homo Sapiens
auuugaaaaguauuauucucucuucucuuuguuucaacuggauuccuuuggaaaaccaaacuag

SEQ ID NO: 494425 - RNA, 64 nt, Homo Sapiens; identical to SEQ ID NO: 154801

SEQ ID NO: 494426 - RNA, 64 nt, Homo Sapiens; identical to SEQ ID NO: 154802

SEQ ID NO: 494427 - RNA, 64 nt, Homo Sapiens; identical to SEQ ID NO: 154803

SEQ ID NO: 494428 - RNA, 64 nt, Homo Sapiens; identical to SEQ ID NO: 154804

SEQ ID NO: 494429 - RNA, 64 nt, Homo Sapiens; identical to SEQ ID NO: 154805

SEQ ID NO: 494430 - RNA, 64 nt, Homo Sapiens; identical to SEQ ID NO: 154806

SEQ ID NO: 494431 - RNA, 64 nt, Homo Sapiens; identical to SEQ ID NO: 154807

SEQ ID NO: 494432 - RNA, 64 nt, Homo Sapiens; identical to SEQ ID NO: 154808

SEQ ID NO: 494433 - RNA, 64 nt, Homo Sapiens; identical to SEQ ID NO: 154809

SEQ ID NO: 494434 - RNA, 64 nt, Homo Sapiens; identical to SEQ ID NO: 154810

SEQ ID NO: 494435 - RNA, 64 nt, Homo Sapiens; identical to SEQ ID NO: 154811

SEQ ID NO: 494436 - RNA, 64 nt, Homo Sapiens; identical to SEQ ID NO: 154812

SEQ ID NO: 494437 - RNA, 64 nt, Homo Sapiens; identical to SEQ ID NO: 154813

SEQ ID NO: 494438 - RNA, 64 nt, Homo Sapiens; identical to SEQ ID NO: 154814

SEQ ID NO: 494439 - RNA, 64 nt, Homo Sapiens; identical to SEQ ID NO: 154815

SEQ ID NO: 494440 - RNA, 64 nt, Homo Sapiens; identical to SEQ ID NO: 154816

SEQ ID NO: 494441 - RNA, 64 nt, Homo Sapiens; identical to SEQ ID NO: 154817

SEQ ID NO: 494442 - RNA, 64 nt, Homo Sapiens; identical to SEQ ID NO: 154818

SEQ ID NO: 494443 - RNA, 64 nt, Homo Sapiens; identical to SEQ ID NO: 154819

SEQ ID NO: 494444 - RNA, 64 nt, Homo Sapiens; identical to SEQ ID NO: 154820

SEQ ID NO: 494445 - RNA, 64 nt, Homo Sapiens; identical to SEQ ID NO: 154821

SEQ ID NO: 494446 - RNA, 64 nt, Homo Sapiens; identical to SEQ ID NO: 154822

SEQ ID NO: 494447 - RNA, 64 nt, Homo Sapiens; identical to SEQ ID NO: 154823

SEQ ID NO: 494448 - RNA, 64 nt, Homo Sapiens; identical to SEQ ID NO: 154824

SEQ ID NO: 494449 - RNA, 64 nt, Homo Sapiens; identical to SEQ ID NO: 154825

SEQ ID NO: 494450 - RNA, 64 nt, Homo Sapiens; identical to SEQ ID NO: 154826

SEQ ID NO: 494451 - RNA, 64 nt, Homo Sapiens; identical to SEQ ID NO: 154827

SEQ ID NO: 494452 - RNA, 64 nt, Homo Sapiens; identical to SEQ ID NO: 154828

SEQ ID NO: 494453 - RNA, 64 nt, Homo Sapiens; identical to SEQ ID NO: 154829

SEQ ID NO: 494454 - RNA, 64 nt, Homo Sapiens; identical to SEQ ID NO: 154830

SEQ ID NO: 494455 - RNA, 64 nt, Homo Sapiens; identical to SEQ ID NO: 154831

SEQ ID NO: 494456 - RNA, 64 nt, Homo Sapiens; identical to SEQ ID NO: 154832

SEQ ID NO: 494457 - RNA, 64 nt, Homo Sapiens; identical to SEQ ID NO: 154833

SEQ ID NO: 494458 - RNA, 64 nt, Homo Sapiens; identical to SEQ ID NO: 154834

SEQ ID NO: 494459 - RNA, 64 nt, Homo Sapiens; identical to SEQ ID NO: 154835

SEQ ID NO: 494460 - RNA, 64 nt, Homo Sapiens; identical to SEQ ID NO: 154836

SEQ ID NO: 494461 - RNA, 64 nt, Homo Sapiens; identical to SEQ ID NO: 154837

SEQ ID NO: 494462 - RNA, 64 nt, Homo Sapiens; identical to SEQ ID NO: 154838

SEQ ID NO: 494463 - RNA, 64 nt, Homo Sapiens; identical to SEQ ID NO: 154839

SEQ ID NO: 494464 - RNA, 64 nt, Homo Sapiens; identical to SEQ ID NO: 154840

SEQ ID NO: 494465 - RNA, 64 nt, Homo Sapiens; identical to SEQ ID NO: 154841

SEQ ID NO: 494466 - RNA, 64 nt, Homo Sapiens; identical to SEQ ID NO: 154842

SEQ ID NO: 494467 - RNA, 64 nt, Homo Sapiens; identical to SEQ ID NO: 154843

SEQ ID NO: 494468 - RNA, 64 nt, Homo Sapiens; identical to SEQ ID NO: 154844

SEQ ID NO: 494469 - RNA, 64 nt, Homo Sapiens; identical to SEQ ID NO: 154845

SEQ ID NO: 494470 - RNA, 64 nt, Homo Sapiens; identical to SEQ ID NO: 154846

SEQ ID NO: 494471 - RNA, 64 nt, Homo Sapiens; identical to SEQ ID NO: 154847

SEQ ID NO: 494472 - RNA, 64 nt, Homo Sapiens; identical to SEQ ID NO: 154848

SEQ ID NO: 494473 - RNA, 64 nt, Homo Sapiens
ucgggacccagaguuggucgagagagcagacagcuagagauaacuccaaacucaggaaguuugc

SEQ ID NO: 494474 - RNA, 64 nt, Homo Sapiens
agaguucuacuuagaacuuuuccuccuuagaauuuagagauacaggcuguauguauauuguucu

SEQ ID NO: 494475 - RNA, 64 nt, Homo Sapiens
augaauauaaaaucuauaauucuauaugaauauauagagauauagaaacaucugaacugguaaa

SEQ ID NO: 494476 - RNA, 64 nt, Homo Sapiens
auaaaauaugaaagcucuaaauuuaaaauaaauuuagagauagaaucaugguacauuauuguuu

SEQ ID NO: 494477 - RNA, 64 nt, Homo Sapiens
augccuggcuaauuuuuuuuuuuuguauuuuuaguagagauaggcuuucaccuuguuagccagg

SEQ ID NO: 494478 - RNA, 64 nt, Homo Sapiens
ggauggucucacguuuuguuuuuuuaacuuuuuguagagauaggguuucauuacauugcucagg

SEQ ID NO: 494479 - RNA, 63 nt, Homo Sapiens
ggaccaaauuucuuagcucauaucauugcuuuaaacauagaaguaaaagaauacugcauguug

SEQ ID NO: 494480 - RNA, 63 nt, Homo Sapiens
gcuugaguccaggaguuugagaugcgccugggcaacauagaaaccugugucuacaaaaaauuu

SEQ ID NO: 494481 - RNA, 63 nt, Homo Sapiens
auaucauugcuacuuugacuccuuauuugcuacaacauagaucacugugaagacuuuguuaua

SEQ ID NO: 494482 - RNA, 63 nt, Homo Sapiens
agaagugacuucauucuuuuacauguauuuuuuaacauagaacauauuaaaaggaagcgggga

SEQ ID NO: 494483 - RNA, 63 nt, Homo Sapiens
aaaaucacuaucucagaaaucauauuggagcaaaacauagaacuuugacucagugacaaucau

SEQ ID NO: 494484 - RNA, 63 nt, Homo Sapiens
aaaguuacuuuggguauccuguaauuuaguuguaacauagaaaaugaaaaaacaguuaaaaaa

SEQ ID NO: 494485 - RNA, 63 nt, Homo Sapiens
gucaaaauggaggcauuugcugucuaauauucaaacauagaaagggagcugcuuuuaaagaau

SEQ ID NO: 494486 - RNA, 63 nt, Homo Sapiens
cugagccacugaggaaccacacugugcugcggaaacauagacgugggggcauaggcucccacu

SEQ ID NO: 494487 - RNA, 63 nt, Homo Sapiens
uuugagguaccaaacauaaccaaucugugcaacaacauagacugaccucaguacccaagagag

SEQ ID NO: 494488 - RNA, 63 nt, Homo Sapiens
gacaugggcuaucagggaggagcagaggaaggaaacauagaaauuagcccaauggagaaauga

SEQ ID NO: 494489 - RNA, 63 nt, Homo Sapiens
cauacacaaggccagaaaaauguuagccacggaaacauagaaauguagagagugggucacauu

SEQ ID NO: 494490 - RNA, 63 nt, Homo Sapiens
uucgcuuuauuuuuguaagucacaaaucuguaaaacauagaccugagauuugaaggaaacaug

SEQ ID NO: 494491 - RNA, 63 nt, Homo Sapiens
ccaugaucuuuuuaaugacacaucaugaggaacaacauagauuaugcaguuuuuuuacuauuc

SEQ ID NO: 494492 - RNA, 63 nt, Homo Sapiens
guauuaucagaauggguauuauuaaaaaaucaaaacauagaugcuagugaggcugcagagaaa

SEQ ID NO: 494493 - RNA, 63 nt, Homo Sapiens
cauaaaaaagaacaagacuguguccuuuacagcaacauagauggagcugaggcucuuauccua

SEQ ID NO: 494494 - RNA, 64 nt, Homo Sapiens; identical to SEQ ID NO: 175154

SEQ ID NO: 494495 - RNA, 64 nt, Homo Sapiens; identical to SEQ ID NO: 175155

SEQ ID NO: 494496 - RNA, 64 nt, Homo Sapiens; identical to SEQ ID NO: 175156

SEQ ID NO: 494497 - RNA, 64 nt, Homo Sapiens; identical to SEQ ID NO: 175157

SEQ ID NO: 494498 - RNA, 64 nt, Homo Sapiens; identical to SEQ ID NO: 175158

SEQ ID NO: 494499 - RNA, 64 nt, Homo Sapiens; identical to SEQ ID NO: 175159

SEQ ID NO: 494500 - RNA, 64 nt, Homo Sapiens; identical to SEQ ID NO: 175160

SEQ ID NO: 494501 - RNA, 64 nt, Homo Sapiens; identical to SEQ ID NO: 175161

SEQ ID NO: 494502 - RNA, 64 nt, Homo Sapiens
uucaauggaaauuccaacagauuuuauugaaugaaacaagcagguguuuauauggaguagcaaa

SEQ ID NO: 494503 - RNA, 64 nt, Homo Sapiens
ccacauggggcguacuauuuuuauugagcccaaaaacaagcaaaaccaaagaauauguagucua

SEQ ID NO: 494504 - RNA, 64 nt, Homo Sapiens
aucuuguuacugugauauuucgcaauacuguaggaacaagcauguuucacuuaagugucuggcc

SEQ ID NO: 494505 - RNA, 64 nt, Homo Sapiens
ucucucugccaagauccaucuuccaauccagaggaacaagcauguucccgagaguaaaucaucu

SEQ ID NO: 494506 - RNA, 64 nt, Homo Sapiens
aagugcuccucaccuguguggcccagauggcuccaacaagcaaaaggaaggaugcagugacucu

SEQ ID NO: 494507 - RNA, 64 nt, Homo Sapiens
uuuuucuuaaaugcaagagcuucuacugacucuuaacaagcaugcuuacccaaauuuuguugca

SEQ ID NO: 494508 - RNA, 64 nt, Homo Sapiens
cuugucuuccauuacaauuaacagucaaggauaaaacaagcacgcgcacaaucaaggagcugga

SEQ ID NO: 494509 - RNA, 64 nt, Homo Sapiens
uccagaccuauugaaucucaaauucuggggcuuaaacaagcacauuccaaguuaagaaccaaug

SEQ ID NO: 494510 - RNA, 64 nt, Homo Sapiens
uccuagaaaauguccuacugcccugcauuugacaaacaagcauccuuuacuaacaagagcagga

SEQ ID NO: 494511 - RNA, 64 nt, Homo Sapiens
ugggcacaggcgaagccauuggaagcacuucaggaacaagcacacagcugugggacuugaacau

SEQ ID NO: 494512 - RNA, 64 nt, Homo Sapiens
aauuuuaacccaaaugaauaacuaagaaauauaaaacaagcacaaaaucuuagggaagucauaa

SEQ ID NO: 494513 - RNA, 64 nt, Homo Sapiens
ugggaagcagaacaacagaaggaacuuuaaaagcaacaagcaauuauguaccauauauacacug

SEQ ID NO: 494514 - RNA, 64 nt, Homo Sapiens
aaacaacuuucacuuugcaagccuguuaaaucguaacaagcaaucaucccuggugucguauuuu

SEQ ID NO: 494515 - RNA, 64 nt, Homo Sapiens
acgauuuguuuucuucaacaaucucauuuuuaagaacaagcaguguguuuagauuuauuuuuuc

SEQ ID NO: 494516 - RNA, 64 nt, Homo Sapiens; identical to SEQ ID NO: 288556

SEQ ID NO: 494517 - RNA, 64 nt, Homo Sapiens; identical to SEQ ID NO: 288557

SEQ ID NO: 494518 - RNA, 64 nt, Homo Sapiens; identical to SEQ ID NO: 288558

SEQ ID NO: 494519 - RNA, 64 nt, Homo Sapiens; identical to SEQ ID NO: 288559

SEQ ID NO: 494520 - RNA, 64 nt, Homo Sapiens; identical to SEQ ID NO: 288560

SEQ ID NO: 494521 - RNA, 64 nt, Homo Sapiens; identical to SEQ ID NO: 288561

SEQ ID NO: 494522 - RNA, 64 nt, Homo Sapiens; identical to SEQ ID NO: 288562

SEQ ID NO: 494523 - RNA, 64 nt, Homo Sapiens; identical to SEQ ID NO: 288563

SEQ ID NO: 494524 - RNA, 64 nt, Homo Sapiens; identical to SEQ ID NO: 288564

SEQ ID NO: 494525 - RNA, 64 nt, Homo Sapiens; identical to SEQ ID NO: 288565

SEQ ID NO: 494526 - RNA, 64 nt, Homo Sapiens
gcaccuggcucucggcugaggauugucaccccaagucuuccagcugguggaucugggcccagca

SEQ ID NO: 494527 - RNA, 64 nt, Homo Sapiens
ggaccugcccggugaugcuguugauuucucaaaggucuuccaaaacucaacagagccagaagua

SEQ ID NO: 494528 - RNA, 64 nt, Homo Sapiens
gcagagaucucaucaauuagcucuucucugcaaggucuuccacuauuucugucugucuuccaua

SEQ ID NO: 494529 - RNA, 64 nt, Homo Sapiens
cucuucucugcaaggucuuccacuauuucugucugucuuccauaucaagccuggaugcagcugc

SEQ ID NO: 494530 - RNA, 64 nt, Homo Sapiens
agcugccccuauggggcgggucaugcugaauuuugucuuccaggucucagggagcagucuucca

SEQ ID NO: 494531 - RNA, 64 nt, Homo Sapiens
augcugaauuuugucuuccaccucucagggagcagucuuccauccggccaauccgcaucucagc

SEQ ID NO: 494532 - RNA, 64 nt, Homo Sapiens
gcaguacccgggaaccccaacaguugguugucuugucuuccagggugcaggucacugagugacu

SEQ ID NO: 494533 - RNA, 64 nt, Homo Sapiens
gggugcguagggacggugguacccagaugcccaagucuuccaggcaauaccuggcucaggccca

SEQ ID NO: 494534 - RNA, 64 nt, Homo Sapiens
auucaugauucaguguagaauguauagacuuuaugucuuccaaguuuaaaaaaagagacagggu

SEQ ID NO: 494535 - RNA, 64 nt, Homo Sapiens
ugggacuacggggucgccacugcacccagccugugucuuccagcucuaaucagaaagcugcuug

SEQ ID NO: 494536 - RNA, 64 nt, Homo Sapiens
aggcccaacugugagcaaggagcacaagccacaagucuuccagaggaugcuugauuccaguggu

SEQ ID NO: 494537 - RNA, 64 nt, Homo Sapiens
gguuuccagucaugagcguuagacugacuuguuugucuuccauuccauuguuuugaaacucagu

SEQ ID NO: 494538 - RNA, 64 nt, Homo Sapiens
guuaaaugaaguguuuggggaauaauaauaaagugucuuccauuguugagagaugauuaaaaau

SEQ ID NO: 494539 - RNA, 64 nt, Homo Sapiens
ggagggccucgcgcccauuccccuggguucuuuagucuuccaagauguagcuauuuauuaaaug

SEQ ID NO: 494540 - RNA, 64 nt, Homo Sapiens
auuguuaucuuuuggugacacccuuaaauuuuaagucuuccagucuuccaugugaacuuuaggc

SEQ ID NO: 494541 - RNA, 64 nt, Homo Sapiens
cuuuuggugacacccuuaaauuuuaagucuuccagucuuccaugugaacuuuaggcccaaaguu

SEQ ID NO: 494542 - RNA, 64 nt, Homo Sapiens; identical to SEQ ID NO: 205933

SEQ ID NO: 494543 - RNA, 64 nt, Homo Sapiens; identical to SEQ ID NO: 205934

SEQ ID NO: 494544 - RNA, 64 nt, Homo Sapiens; identical to SEQ ID NO: 205935

SEQ ID NO: 494545 - RNA, 64 nt, Homo Sapiens; identical to SEQ ID NO: 205936

SEQ ID NO: 494546 - RNA, 64 nt, Homo Sapiens; identical to SEQ ID NO: 205937

SEQ ID NO: 494547 - RNA, 64 nt, Homo Sapiens; identical to SEQ ID NO: 205938

SEQ ID NO: 494548 - RNA, 64 nt, Homo Sapiens; identical to SEQ ID NO: 205939

SEQ ID NO: 494549 - RNA, 64 nt, Homo Sapiens; identical to SEQ ID NO: 205940

SEQ ID NO: 494550 - RNA, 64 nt, Homo Sapiens; identical to SEQ ID NO: 205941

SEQ ID NO: 494551 - RNA, 64 nt, Homo Sapiens; identical to SEQ ID NO: 205942

SEQ ID NO: 494552 - RNA, 64 nt, Homo Sapiens; identical to SEQ ID NO: 205943

SEQ ID NO: 494553 - RNA, 64 nt, Homo Sapiens; identical to SEQ ID NO: 205944

SEQ ID NO: 494554 - RNA, 64 nt, Homo Sapiens; identical to SEQ ID NO: 205945

SEQ ID NO: 494555 - RNA, 64 nt, Homo Sapiens; identical to SEQ ID NO: 205946

SEQ ID NO: 494556 - RNA, 64 nt, Homo Sapiens; identical to SEQ ID NO: 205947

SEQ ID NO: 494557 - RNA, 64 nt, Homo Sapiens; identical to SEQ ID NO: 205948

SEQ ID NO: 494558 - RNA, 64 nt, Homo Sapiens; identical to SEQ ID NO: 205949

SEQ ID NO: 494559 - RNA, 64 nt, Homo Sapiens; identical to SEQ ID NO: 205950

SEQ ID NO: 494560 - RNA, 64 nt, Homo Sapiens; identical to SEQ ID NO: 205951

SEQ ID NO: 494561 - RNA, 64 nt, Homo Sapiens; identical to SEQ ID NO: 205952

SEQ ID NO: 494562 - RNA, 64 nt, Homo Sapiens; identical to SEQ ID NO: 205953

SEQ ID NO: 494563 - RNA, 64 nt, Homo Sapiens; identical to SEQ ID NO: 205954

SEQ ID NO: 494564 - RNA, 64 nt, Homo Sapiens; identical to SEQ ID NO: 205955

SEQ ID NO: 494565 - RNA, 64 nt, Homo Sapiens; identical to SEQ ID NO: 205956

SEQ ID NO: 494566 - RNA, 64 nt, Homo Sapiens; identical to SEQ ID NO: 205957

SEQ ID NO: 494567 - RNA, 64 nt, Homo Sapiens; identical to SEQ ID NO: 205958

SEQ ID NO: 494568 - RNA, 64 nt, Homo Sapiens; identical to SEQ ID NO: 205959

SEQ ID NO: 494569 - RNA, 64 nt, Homo Sapiens; identical to SEQ ID NO: 205960

SEQ ID NO: 494570 - RNA, 64 nt, Homo Sapiens; identical to SEQ ID NO: 205961

SEQ ID NO: 494571 - RNA, 64 nt, Homo Sapiens; identical to SEQ ID NO: 205962

SEQ ID NO: 494572 - RNA, 64 nt, Homo Sapiens; identical to SEQ ID NO: 205963

SEQ ID NO: 494573 - RNA, 64 nt, Homo Sapiens; identical to SEQ ID NO: 205964

SEQ ID NO: 494574 - RNA, 64 nt, Homo Sapiens; identical to SEQ ID NO: 205965

SEQ ID NO: 494575 - RNA, 64 nt, Homo Sapiens; identical to SEQ ID NO: 205966

SEQ ID NO: 494576 - RNA, 64 nt, Homo Sapiens; identical to SEQ ID NO: 205967

SEQ ID NO: 494577 - RNA, 64 nt, Homo Sapiens; identical to SEQ ID NO: 205968

SEQ ID NO: 494578 - RNA, 64 nt, Homo Sapiens; identical to SEQ ID NO: 205969

SEQ ID NO: 494579 - RNA, 64 nt, Homo Sapiens; identical to SEQ ID NO: 205970

SEQ ID NO: 494580 - RNA, 64 nt, Homo Sapiens; identical to SEQ ID NO: 205971

SEQ ID NO: 494581 - RNA, 64 nt, Homo Sapiens; identical to SEQ ID NO: 205972

SEQ ID NO: 494582 - RNA, 64 nt, Homo Sapiens; identical to SEQ ID NO: 205973

SEQ ID NO: 494583 - RNA, 64 nt, Homo Sapiens; identical to SEQ ID NO: 205974

SEQ ID NO: 494584 - RNA, 64 nt, Homo Sapiens; identical to SEQ ID NO: 205975

SEQ ID NO: 494585 - RNA, 64 nt, Homo Sapiens; identical to SEQ ID NO: 205976

SEQ ID NO: 494586 - RNA, 64 nt, Homo Sapiens; identical to SEQ ID NO: 205977

SEQ ID NO: 494587 - RNA, 64 nt, Homo Sapiens; identical to SEQ ID NO: 205978

SEQ ID NO: 494588 - RNA, 64 nt, Homo Sapiens; identical to SEQ ID NO: 205979

SEQ ID NO: 494589 - RNA, 64 nt, Homo Sapiens; identical to SEQ ID NO: 205980

SEQ ID NO: 494590 - RNA, 64 nt, Homo Sapiens; identical to SEQ ID NO: 205981

SEQ ID NO: 494591 - RNA, 64 nt, Homo Sapiens; identical to SEQ ID NO: 205982

SEQ ID NO: 494592 - RNA, 64 nt, Homo Sapiens; identical to SEQ ID NO: 205983

SEQ ID NO: 494593 - RNA, 54 nt, Homo Sapiens; identical to SEQ ID NO: 205984

SEQ ID NO: 494594 - RNA, 64 nt, Homo Sapiens; identical to SEQ ID NO: 205985

SEQ ID NO: 494595 - RNA, 64 nt, Homo Sapiens; identical to SEQ ID NO: 205986

SEQ ID NO: 494596 - RNA, 64 nt, Homo Sapiens; identical to SEQ ID NO: 205987

SEQ ID NO: 494597 - RNA, 64 nt, Homo Sapiens; identical to SEQ ID NO: 205988

SEQ ID NO: 494598 - RNA, 64 nt, Homo Sapiens; identical to SEQ ID NO: 205989

SEQ ID NO: 494599 - RNA, 64 nt, Homo Sapiens
aaagaaauaucauuaccaaugaaauguguuugaguucaguaagaauuauucaaaugccuagaaa

SEQ ID NO: 494600 - RNA, 64 nt, Homo Sapiens
gaaaagauagcuuuuaauugugguauauauaaucuucaguaacaauacauacugaauacgcugu

SEQ ID NO: 494601 - RNA, 64 nt, Homo Sapiens
aauugcuuuccuuccccgccuuugacaugaggccuucaguaaagagcuacagaacaugaguaca

SEQ ID NO: 494602 - RNA, 64 nt, Homo Sapiens
gcccuguauucucaacagggaugcaaauugguucuucaguaaggauaaaaaaaaaucacaagca

SEQ ID NO: 494603 - RNA, 64 nt, Homo Sapiens
aguguuaaagauuuuuaucuuuaagauacucauuuucaguaacugcaguuuuaauguuuacagu

SEQ ID NO: 494604 - RNA, 64 nt, Homo Sapiens
guuaaaguguaauucucugcaaucaugucaucucuucaguaacucauaguuuuucaacugcaaa

SEQ ID NO: 494605 - RNA, 64 nt, Homo Sapiens
agugccgaacccugaauuuaacauaugguagacauucaguaaauguuuguugaaugaaugcaug

SEQ ID NO: 494606 - RNA, 64 nt, Homo Sapiens
uaccaacuaugugacuuuguccaagucauuuaacuucaguaaaccucgguaugacugaaaaggg

SEQ ID NO: 494607 - RNA, 64 nt, Homo Sapiens
cccucuguuacaucacugugcauuugucaaccuuuucaguaaaguuggguuuuagaucucuuuu

SEQ ID NO: 494608 - RNA, 64 nt, Homo Sapiens
ugccuccaugauucuagugccaguaucacaguguuucaguaauuuccagaagccagcaguauuu

SEQ ID NO: 494609 - RNA, 64 nt, Homo Sapiens
uaucacuaaauaugaaacugggccaaggggaaaauucaguaaguuagcguuaaauggaaguaaa

SEQ ID NO: 494610 - RNA, 64 nt, Homo Sapiens
auggcagucacugcauuguacauuauuccaguucuucaguaauucuguuuaaacugugauuuuc

SEQ ID NO: 494611 - RNA, 64 nt, Homo Sapiens
cugugguuccuggggugcccuccacugcccucuguucaguaacagggccuugcuaaucggguug

SEQ ID NO: 494612 - RNA, 64 nt, Homo Sapiens
cacagguguccccagcccacuggaucagaaagaguucaguaagaccggaagcuccugguauggg

SEQ ID NO: 494613 - RNA, 64 nt, Homo Sapiens
ccuggggaauauagcauggaucuuuguuuauauuuucaguaagcaauuaccuacuguauuuguu

SEQ ID NO: 494614 - RNA, 64 nt, Homo Sapiens
gccauauuauauaacaaauucugcauacguaauauucaguaacuagcaguauuauuagcauaag

SEQ ID NO: 494615 - RNA, 64 nt, Homo Sapiens
acuuaacauucgguuuuaucagccagcaguauucuucaguaaauaaagaauggaauugcugaau

SEQ ID NO: 494616 - RNA, 64 nt, Homo Sapiens
aauguaaucauugaaccucgagucacuguaaaaguucaguaauugcuuauuguauuaguuuuag

SEQ ID NO: 494617 - RNA, 64 nt, Homo Sapiens
auuaagaccuaaguucauuuauacuuacaaguuauaguuuaaaauauuauuguaaauacccuag

SEQ ID NO: 494618 - RNA, 64 nt, Homo Sapiens
caaguuauaguuuaaaauauuauuguaaauacccuaguuuaauaaacaccuuucuuuuuagguc

SEQ ID NO: 494619 - RNA, 64 nt, Homo Sapiens
aauacaauguuauguuuuuuaauacuguuuuccuuaguuuaauuacaaaccaauuauaagugag

SEQ ID NO: 494620 - RNA, 64 nt, Homo Sapiens
gacuuuaaauucuuucuugcuaguagguauuaaauaguuuaaaauuaaaugcaccaaagauuuu

SEQ ID NO: 494621 - RNA, 64 nt, Homo Sapiens
uuuauucauucaugcaauacacuuuuucagggaauaguuuaagcguuaguuuagcuacuaugua

SEQ ID NO: 494622 - RNA, 64 nt, Homo Sapiens
aaaaauccucccuucccccuauuugaaauagcuuuaguuuaaaaauccuuccccuuuuuucuaa

SEQ ID NO: 494623 - RNA, 64 nt, Homo Sapiens
gaaaauggugauauagaccucagagcuguuaucuuaguuuaaagauuguauauguacuguacua

SEQ ID NO: 494624 - RNA, 64 nt, Homo Sapiens
cgauuuuuagcaaaaaagaaaaaaaaaaggcacauaguuuaaaaaguuucucauuuugugcaau

SEQ ID NO: 494625 - RNA, 64 nt, Homo Sapiens
aauagugugauuuucaagacuucaaauacaaauuuaguuuaaguguuugaacaacuauaugcac

SEQ ID NO: 494626 - RNA, 64 nt, Homo Sapiens
gauuuuucuauuguguaauucuuggugggcucuguaguuuaauaauaagaaaaaggccauuuca

SEQ ID NO: 494627 - RNA, 64 nt, Homo Sapiens
ucucugugucucaaugccugggacuggagguugauaguuuaaguguguucuuaccgccuccuuu

SEQ ID NO: 494628 - RNA, 64 nt, Homo Sapiens
ugaacuauuaaaauaaaauauuauauuuaacccuuaguuuaagaagaagucaauaugcuuauuu

SEQ ID NO: 494629 - RNA, 64 nt, Homo Sapiens
cugguuuuuaacaagcuguuuguucaucuauauuuaguuuaaaauagguaguauuaucuuucug

SEQ ID NO: 494630 - RNA, 64 nt, Homo Sapiens
auuucuuaaaacauuucccugagccaguaaacaguaguuuaaucauuggucuuuucaaaacuag

SEQ ID NO: 494631 - RNA, 64 nt, Homo Sapiens
auuuuguuuguucuaagaggauugaaaaucaguuuaguuuaaaugucuuucuguuaggccuuuc

SEQ ID NO: 494632 - RNA, 64 nt, Homo Sapiens
caguucuuuuuaauggggucaauaauggacauucuaguuuaaggugguugauggauuuagccau

SEQ ID NO: 494633 - RNA, 64 nt, Homo Sapiens
uauucacagaccccuuauaagugaaagcagcuuuuaguuuaacuggaggccuaauuuguagauu

SEQ ID NO: 494634 - RNA, 64 nt, Homo Sapiens
aaaucuuuccucuuucauauaaaaguaacuuuuguaguuuaaaauuuguuuuuuuuuuaugguu

SEQ ID NO: 494635 - RNA, 64 nt, Homo Sapiens
auuaugaaaaauguaucuguacugucuguuuuaguaguuuaaugugcgguuuauuuauucuuua

SEQ ID NO: 494636 - RNA, 64 nt, Homo Sapiens
agaaaaaaugcagggugauuaguuaaacuaguuuuaguuuaaaauuauuauuuuguaacuuuac

SEQ ID NO: 494637 - RNA, 64 nt, Homo Sapiens
cuuuaaacacuuuucgugaagaaauuuugcacaguaguuuaaaucuuuuguuaaugcuccuccg

SEQ ID NO: 494638 - RNA, 64 nt, Homo Sapiens
uaacuuuuauaacaaauuauuagcuuugaucuuguaguuuaaaauugcagggaacugggguaau

SEQ ID NO: 494639 - RNA, 64 nt, Homo Sapiens
accuuguauaucuuguuuuguguuuugacauuuuuaguuuaaaauuucuuuaacuuaauugcua

SEQ ID NO: 494640 - RNA, 64 nt, Homo Sapiens
aaucuguaaugcuuucgauacuacauuaauuaucuaguuuaauugaggcccuaucuuuugcauc

SEQ ID NO: 494641 - RNA, 64 nt, Homo Sapiens
auuacuaaccuuuaauuuaaucaaucauguacuuuaguuuaauguauaaagauccucuagaaaa

SEQ ID NO: 494642 - RNA, 64 nt, Homo Sapiens
aaaggucccaggaucacuuuuaagggauuuuuauuaguuuaaagguaaauaaagucagcugaau

SEQ ID NO: 494643 - RNA, 64 nt, Homo Sapiens
gcagcucuugguguaccuuauuuugugggaaauuuaguuuaaagcauguuuguguugcuacagc

SEQ ID NO: 494644 - RNA, 64 nt, Homo Sapiens
uagagagaaaaauaccuuuaaaauaaaaugagacuaguuuaauaaaguguugaguaaagaggcu

SEQ ID NO: 494645 - RNA, 64 nt, Homo Sapiens
ugagucacuuacuucauaucuacagugguauugcuaguuuaaaaaguuaaucuuugaaaacuca

SEQ ID NO: 494646 - RNA, 64 nt, Homo Sapiens
aucagaaagacauucuuaguuaaguuagauguuuuaguuuaaaaaaaugugucuuguauuauca

SEQ ID NO: 494647 - RNA, 64 nt, Homo Sapiens
ggaagaaauggugggaaggaaaauauaaauccuguaguuuaaaauucugaaauaaaacauuuua

SEQ ID NO: 494648 - RNA, 64 nt, Homo Sapiens
uuauuuguaaaaaguuaaaaguguuucuaauuuauaguuuaaguagagcuacucaugauuauuu

SEQ ID NO: 494649 - RNA, 64 nt, Homo Sapiens
auaugauaaauuauguucugauauccuccuacaguaguuuaaauugacagaaaaauuugaaugu

SEQ ID NO: 494650 - RNA, 64 nt, Homo Sapiens
uuauuuagccaaugcaaaucuguuuuaaaacaaauaguuuaaaaaaagaacaaguuuuuaaggg

SEQ ID NO: 494651 - RNA, 64 nt, Homo Sapiens
gaccuuuuuuggauagucaaauauaagagauaaauaguuuaauuuuuucagaccuuuuuuggau

SEQ ID NO: 494652 - RNA, 64 nt, Homo Sapiens
gaccuuuuuuggauaguccaauauuagagauaaauaguuuaauuuuuucagauauaaugccagu

SEQ ID NO: 494653 - RNA, 64 nt, Homo Sapiens
ggugcuauaaccccuugggacacucauccagacuucucugaagcagaaaaccugagcuccccac

SEQ ID NO: 494654 - RNA, 64 nt, Homo Sapiens
guguaccuaaucucaccaucucuucacuucuagcucucugaaacaagggucacacuacucagag

SEQ ID NO: 494655 - RNA, 64 nt, Homo Sapiens
aacuauaaaagugcaaugacuaagauccuucacuucucugaaaguaaggcccuagaugccucag

SEQ ID NO: 494656 - RNA, 64 nt, Homo Sapiens
ugcuggucuccaggcugacaaggauucaaaguugucucugaaacuccucuuugucauacugcac

SEQ ID NO: 494657 - RNA, 64 nt, Homo Sapiens
ugagucucggucaugacuuacuguucauagagcgucucugaaaucacuguggcuucaagcaccu

SEQ ID NO: 494658 - RNA, 64 nt, Homo Sapiens
auuuuagagcuagguauaguauuagucugcuguuucucugaaaaccuuuauuuaagauucacuu

SEQ ID NO: 494659 - RNA, 64 nt, Homo Sapiens
ccuaugggguuuaugaaaaauacuuggggaucauucucugaauggucuaaggaagcgguagcca

SEQ ID NO: 494660 - RNA, 64 nt, Homo Sapiens
ugucacugugaggcccuacuagguguaagcauucucucugaauuuuaauuuccucucauuaaaa

SEQ ID NO: 494661 - RNA, 64 nt, Homo Sapiens
aaauaauucuguucaucauuucacuccgugcaguucucugaauugagagauguaccucuuaaac

SEQ ID NO: 494662 - RNA, 64 nt, Homo Sapiens
uugcaauaccugucaccaugcagccgcugauaguucucugaacuaaaaggacuaauuguacuuu

SEQ ID NO: 494663 - RNA, 64 nt, Homo Sapiens
caccaggccaggggucaggaacuuuggagucuuuucucugaaguauugcgagcuugggaauuag

SEQ ID NO: 494664 - RNA, 64 nt, Homo Sapiens
gacugauuuuguuuuuuucuaccguguggauuuuucucugaauuauauacauaacaccaaucag

SEQ ID NO: 494665 - RNA, 64 nt, Homo Sapiens
aucuuuaggaaacuugaaauugaaaucacagggaucucugaaauuguguuugaaauuaugucca

SEQ ID NO: 494666 - RNA, 64 nt, Homo Sapiens
gaauagggcugguaguggguccuauuccacugagucucugaaggucuguaaacacucugaucuu

SEQ ID NO: 494667 - RNA, 64 nt, Homo Sapiens
caaguuucuuuuguaguuuuguuuuccuuaauguucucugaaaauuuugaaaaugauuuaaagu

SEQ ID NO: 494668 - RNA, 64 nt, Homo Sapiens
gauuuuuugaguuuuguuugcaaggccacgcugcucucugaauuuguuggguguggguggucuc

SEQ ID NO: 494669 - RNA, 64 nt, Homo Sapiens
guaugacacccagcuuuaaauguauacuuuaugcucucugaaauaacuccugucucugugagaa

SEQ ID NO: 494670 - RNA, 64 nt, Homo Sapiens
aguagcucuaaacuguuaacugagaaauaagaccucucugaauuuuucuuuaaaaugcaagcag

SEQ ID NO: 494671 - RNA, 64 nt, Homo Sapiens
auggccaaaaugcauuuuaugaccuguuaaguauucucugaaacccacaacacagaacgauguu

SEQ ID NO: 494672 - RNA, 64 nt, Homo Sapiens
cugggggucaggacagggccugauuugagccuccucucugaagaugauuuggccgagcggaagg

SEQ ID NO: 494673 - RNA, 64 nt, Homo Sapiens
uuggacaggaggugcugaggcuggcugcaccugcucucugaagacgccuuccucucuagguuca

SEQ ID NO: 494674 - RNA, 64 nt, Homo Sapiens
uucuugauguccaggguagauaaagggucgaaucucucugaagaacugccaccuggucaucagc

SEQ ID NO: 494675 - RNA, 64 nt, Homo Sapiens
cacucacccugcuagcuuugcccuugacucgucuucucugaaccucagccucgugcauugccug

SEQ ID NO: 494676 - RNA, 64 nt, Homo Sapiens
gaaacauuuucuuucauuccaguggccuuagucaucucugaagaaauacuuacuugauuuuuuu

SEQ ID NO: 494677 - RNA, 64 nt, Homo Sapiens
acuuccucgcccuccuccacccgagaugccagagucucugaagaagaagcuuggguuaacucag

SEQ ID NO: 494678 - RNA, 64 nt, Homo Sapiens
uaugcaaaaagaaggccccaaaagacucccuggaucucugaauagaggccaggaaaaaaaaaaa

SEQ ID NO: 494679 - RNA, 64 nt, Homo Sapiens
uuggcugcuggagccauucauugcacuaaauuccucucugaaucuggguguuguauagauccag

SEQ ID NO: 494680 - RNA, 64 nt, Homo Sapiens
gauaaauuuuguagcugguacacucuggccugggucucugaauucagccugucaccgauggcug

SEQ ID NO: 494681 - RNA, 64 nt, Homo Sapiens
agguccuugaucuuuucuuuagauugaaagucugucucugaacacaauuauuuguaaaaguuag

SEQ ID NO: 494682 - RNA, 64 nt, Homo Sapiens
gcuaaucaggaaauaaacuugacuuuucuauuuuucucugaagcuuuacaggacauacucccac

SEQ ID NO: 494683 - RNA, 64 nt, Homo Sapiens
cauuaagaagauaaauccaguuaucagcuuccugucucugaaguuuggaucauuuuauagaucc

SEQ ID NO: 494684 - RNA, 64 nt, Homo Sapiens
cuacauuccgucaguuuccgcuuugcugcuuugcucucugaaacccucuugucuuucuucccug

SEQ ID NO: 494685 - RNA, 64 nt, Homo Sapiens
ccccgaaccuugcaucaaggucguguugggcuucucucugaacguggccuacacagagaaccgu

SEQ ID NO: 494686 - RNA, 64 nt, Homo Sapiens
uguccuggccagcccuggagccucuucacuagccucucugaaggaauucacccuacauuccucu

SEQ ID NO: 494687 - RNA, 64 nt, Homo Sapiens
ugucaaaucgugguuuagauuaucuacuucucucucucugaagacaaccuggaauggagacuuu

SEQ ID NO: 494688 - RNA, 64 nt, Homo Sapiens
aacuacugcuuuagaaugaagucguauaauaaagucucugaaaaggccuuauucagaauaagca

SEQ ID NO: 494689 - RNA, 64 nt, Homo Sapiens
gauucacuuuugcuucuggggcuggcaaaaaccuucucugaacccacacaccaaguucguaguu

SEQ ID NO: 494690 - RNA, 64 nt, Homo Sapiens
cgucuuagccauuccguccugcuccccagcucacucucugaagcacacaucauuggcuuuccua

SEQ ID NO: 494691 - RNA, 64 nt, Homo Sapiens
ggagaggacucagauuuccuggaggcaaagucuaucucugaaacuccaugaagacuuuugcagc

SEQ ID NO: 494692 - RNA, 64 nt, Homo Sapiens
cccucugacuccaacuucuccaacuucucuuugaucucugaaucccagcuccuaccucugaccc

SEQ ID NO: 494693 - RNA, 64 nt, Homo Sapiens
cuagagccccgcuuucccuccgcuaggccccccaucucugaaccgaggcuucugaccuuugauc

SEQ ID NO: 494694 - RNA, 64 nt, Homo Sapiens
aacgagguaauucccugagcugcccacucugguuucucugaaaaaaagaauuuggagaugguuc

SEQ ID NO: 494695 - RNA, 64 nt, Homo Sapiens
uagaaucucauccuuagggcaagcccucaacucaucucugaacucuuccuuggucccuucaggg

SEQ ID NO: 494696 - RNA, 64 nt, Homo Sapiens
caacaaaggcuacccuuugaccaaaugucuuucucugcaacauggcuucggccuaaaauaugca

SEQ ID NO: 494697 - RNA, 64 nt, Homo Sapiens
uuaaccgacugaaaucacuuugggauauuuuuuccugcaacacuggaaaguuuuaguuuuuuaa

SEQ ID NO: 494698 - RNA, 64 nt, Homo Sapiens
uaugcuguuuagcacaauuucuauugagucuuaccugcaacaaugaaccuuaaagauuuuuuua

SEQ ID NO: 494699 - RNA, 64 nt, Homo Sapiens
guucuguguuguuuccuuagaccugugguguccgcugcaacagcuacuagccacguguagcuaa

SEQ ID NO: 494700 - RNA, 64 nt, Homo Sapiens
guccugcaggaaaaguuuuugggucccugacuuccugcaacaauucagccaguccccccguuug

SEQ ID NO: 494701 - RNA, 64 nt, Homo Sapiens
aauauguccuuaaggcacaacucuggcuuguuaucugcaacaggaugagaaagaaagggacagg

SEQ ID NO: 494702 - RNA, 64 nt, Homo Sapiens
cgccucugggguucaagugagggaucucagcucacugcaacaucccaggcuggagugcaguggu

SEQ ID NO: 494703 - RNA, 64 nt, Homo Sapiens
uccaguuggccagaucacuuuagauggggaaauacugcaacaugcacuagcacuacgauagugu

SEQ ID NO: 494704 - RNA, 64 nt, Homo Sapiens
cagguuccuaagacuucaguccuggucugcucaggaauugaagauguaaggaauugaagauagg

SEQ ID NO: 494705 - RNA, 64 nt, Homo Sapiens
caguccuggucugcucaggaauugaagauguaaggaauugaagauaggagagauaccuugaaaa

SEQ ID NO: 494706 - RNA, 64 nt, Homo Sapiens
cagguuuuccuguggaaagugaacaauucggcaugaauugaaacuuuagcuuuuucuuuucuuu

SEQ ID NO: 494707 - RNA, 64 nt, Homo Sapiens
aauuguaaguuucaguugcuucucugcucugacugaauugaaggccuccagacuacuuuaaaug

SEQ ID NO: 494708 - RNA, 64 nt, Homo Sapiens
auugaagguugauauuuuauguggaagaacauuugaauugaauucagaauuuuucugaaggugu

SEQ ID NO: 494709 - RNA, 64 nt, Homo Sapiens
ugucaacgucuuguugaaaacaaaaaucaagaaagaauugaaauacugugccggcuuucacugg

SEQ ID NO: 494710 - RNA, 64 nt, Homo Sapiens
uuggcaaugagaacacagcaagugguguugcauugaauugaacuaaaaacauucuguugcaaac

SEQ ID NO: 494711 - RNA, 64 nt, Homo Sapiens
uuaaaauucugcuucuuaaaaauaaauuauuuuugaauugaacauuuaaugcaggcaggugugu

SEQ ID NO: 494712 - RNA, 64 nt, Homo Sapiens
gcauuugagaauucuuaaauaugaaauuuauucagaauugaagauggugaccuauucagagccu

SEQ ID NO: 494713 - RNA, 64 nt, Homo Sapiens
ucuagcuuucuuuaugauguuucugauaauacgagaauugaaaacuuuaccuucucuuguacau

SEQ ID NO: 494714 - RNA, 64 nt, Homo Sapiens
gucacucaucuaccagauucugccuauguaaaaugaauugaaaaacaauuuucuguaaucuuuu

SEQ ID NO: 494715 - RNA, 64 nt, Homo Sapiens
caagauauuauuaauuuuuauuuauuuuucuugggaauugaaaaaaauugaaauaaauaaaaau

SEQ ID NO: 494716 - RNA, 64 nt, Homo Sapiens
aucucuccuuaaccccaauucugggcuuuucugggaauugaaguauggcaguguuaucucaucu

SEQ ID NO: 494717 - RNA, 64 nt, Homo Sapiens
ggauggaauagguaagcaaacccauuuuuguacagaauugaauguguagauuuucugcauagau

SEQ ID NO: 494718 - RNA, 52 nt, Homo Sapiens
ccaauaaagcagaaacaugacugaauugaauugguagaugaaaaaaaccugg

SEQ ID NO: 494719 - RNA, 64 nt, Homo Sapiens
uaauagauuuuaauguuaauuuauauucauuguagaauugaauuuccagugaccuguaauuuca

SEQ ID NO: 494720 - RNA, 64 nt, Homo Sapiens
cuauuacaauuaauaggguuuugagugacuaacugaauugaaacccaguugcauuuuauaauac

SEQ ID NO: 494721 - RNA, 64 nt, Homo Sapiens
cuguagaauucuguuucuuuaaagacaauauacagaauugaauaagucugauugaaaaaccuua

SEQ ID NO: 494722 - RNA, 64 nt, Homo Sapiens
aucaaugagacagaaaguuaacaaggauauccaggaauugaacacagcucugcaccaagcggac

SEQ ID NO: 494723 - RNA, 64 nt, Homo Sapiens
cauccccaucaagcuaccaaugacuuucuucacagaauugaaaaacacuacuuuaaaguucaua

SEQ ID NO: 494724 - RNA, 64 nt, Homo Sapiens
guagaacacccaauuggugucacccaguuguucagaauugaauugucagaauugaauuauagaa

SEQ ID NO: 494725 - RNA, 64 nt, Homo Sapiens
auagaacacccaguuguucaagaaguuagugucagaauugaauuuggagucugcacuaacuugg

SEQ ID NO: 494726 - RNA, 64 nt, Homo Sapiens
ggggccacauauuuucagucauuucuucccuguugaauugaagcaaaucagauuuucugugggg

SEQ ID NO: 494727 - RNA, 64 nt, Homo Sapiens
acuguuuuauggaauaaagucacuugaucagaaggaauugaaacaauagaucauuuuguuaccu

SEQ ID NO: 494728 - RNA, 64 nt, Homo Sapiens
ccugcaaagaugguuuuauuaguacccuggucauuuuguucaaggaaggguuauauugcauucu

SEQ ID NO: 494729 - RNA, 64 nt, Homo Sapiens
cuugcccaauaaaaacgcuacauuguguguauuuuuuguucagcuaagaauuggaaaaguauuu

SEQ ID NO: 494730 - RNA, 64 nt, Homo Sapiens
cgcugagguuugauuucuuauagcucggugacccuuuguucaacaagcugcuucuugacuagua

SEQ ID NO: 494731 - RNA, 64 nt, Homo Sapiens
ggacgguuaaaccuucccccuuguguguccucccuuuguucaguuauuaccauuuuuaaugaug

SEQ ID NO: 494732 - RNA, 64 nt, Homo Sapiens
gucugacuuaacuacauacaucuucugcugguguuuuguucaaucuggaagaaugacuguauca

SEQ ID NO: 494733 - RNA, 64 nt, Homo Sapiens
uguucuuuucucaaauucaguuaaaaugguuuacuuuguucaaguuagugguaggaaacauugc

SEQ ID NO: 494734 - RNA, 64 nt, Homo Sapiens
aggauuuauucugugaauuguuuguuucuguguguuuguucagcguauucauucacucacucgu

SEQ ID NO: 494735 - RNA, 64 nt, Homo Sapiens
ucuauuuugcauaugaaaguuuguauuuaacuuuuuuguucauuaaaaaccuuacugauauggu

SEQ ID NO: 494736 - RNA, 64 nt, Homo Sapiens
uuaugaaggaaggcuugguuuaauaaagacugauuuuguucaguguuauauguuagcugauaca

SEQ ID NO: 494737 - RNA, 64 nt, Homo Sapiens
auuuuguucaguguuauauguuagcugauacauauuuguucauuuaugugauugcaguacuuua

SEQ ID NO: 494738 - RNA, 64 nt, Homo Sapiens
aaaauuuuaguaacaauuguuuauuuugaggguauuuguucauaacauuaaaacaauaaagggc

SEQ ID NO: 494739 - RNA, 64 nt, Homo Sapiens
augaggucauauuaaagaacagcaacuguuaauguuuguucacaaauucagaaaucuaauagga

SEQ ID NO: 494740 - RNA, 64 nt, Homo Sapiens
gagguaugaugugcugcuggcugugaugucacaguuuguucaguuuuuuuuguucauacuuugg

SEQ ID NO: 494741 - RNA, 64 nt, Homo Sapiens
cuuuggcugugaugucacagggggcacaaguuuuuuuguucauaaguguucuguucacuuuucc

SEQ ID NO: 494742 - RNA, 64 nt, Homo Sapiens
cauguauucuaacauuucuacauccaccuguucauuuguucaucuuguaguuuguucauucauc

SEQ ID NO: 494743 - RNA, 64 nt, Homo Sapiens
cauccauccaccuguucauuccugaucuuuguaguuuguucauuaguaccucauagggcuccug

SEQ ID NO: 494744 - RNA, 64 nt, Homo Sapiens
cggguuucuuuucuuuuugccugugggcaacuguuuuguucaauauuuccucuggcagcuggug

SEQ ID NO: 494745 - RNA, 64 nt, Homo Sapiens
uggcauugcaacuguggcauaguuacaauuucuguuuguucaucacauuuaaaauuggaagaga

SEQ ID NO: 494746 - RNA, 64 nt, Homo Sapiens
aaaguguacugcuuuaugguaaaaguguuuuucauuuguucauuguuuucauuauuugugauca

SEQ ID NO: 494747 - RNA, 64 nt, Homo Sapiens
gaauccaaagaaaaacagaagaauaauucauggauuuguucauuguucuuuccaacugaaggca

SEQ ID NO: 494748 - RNA, 64 nt, Homo Sapiens
ccuccauuuguccacaagaugguguuuaaaacaauuuguucagaagaacugagcaaacuaacag

SEQ ID NO: 494749 - RNA, 64 nt, Homo Sapiens
uuacaugaaaguucagauuggaagaacuuaaaaauuuguucacaaacauauucaguuuucagua

SEQ ID NO: 494750 - RNA, 64 nt, Homo Sapiens
ucuauaaagguaagugcauaaaucaccccugccuuuuguucaacgagcucuuaaaaaacugugc

SEQ ID NO: 494751 - RNA, 64 nt, Homo Sapiens
caaguuauauguucuugucuaauccauguagcuuuuuguucaaugacuugaucaucugcuuccu

SEQ ID NO: 494752 - RNA, 64 nt, Homo Sapiens
auaccuguucauuuggaauuuaaugcuugacuucuuuguucauuuuggaucuaaacuucucuuu

SEQ ID NO: 494753 - RNA, 64 nt, Homo Sapiens
auguagcccaggccaauuuauaacuaaaucucuauuuguucagaugaugcuucuaaaacagcau

SEQ ID NO: 494754 - RNA, 64 nt, Homo Sapiens
uuuggagaaagaacacuaacacauguacuugugauuuguucauguuauauuaaaacuugagauu

SEQ ID NO: 494755 - RNA, 64 nt, Homo Sapiens
cucaggcuggaauugggaaaauaugcaggugacauuuguucauucucuaaucccauccucucac

SEQ ID NO: 494756 - RNA, 64 nt, Homo Sapiens
guaaggaucaggggugauaggggagagcaauuacuuuguucacuguaugcacccgcgggggccu

SEQ ID NO: 494757 - RNA, 64 nt, Homo Sapiens
uauuuuccagauaucucccccgccacauguagaguuuguucagcuaacaacugucacuuuguuu

SEQ ID NO: 494758 - RNA, 64 nt, Homo Sapiens
uucaaagagugauaguuucuagcagaaaacauuguuuguucacuauugggaaagaugaauuuuc

SEQ ID NO: 494759 - RNA, 64 nt, Homo Sapiens
guguccucaauauuuuaaaacaauguugacauguuuuguucaagucagcaagcucuaugugagu

SEQ ID NO: 494760 - RNA, 64 nt, Homo Sapiens
uagaucgcuucaagccuauacugauggccuuagcuuuguucagucauuguaacugggauuguug

SEQ ID NO: 494761 - RNA, 64 nt, Homo Sapiens
uuaauuucuugggagcaaaugaguauuuguugcauuuguucaauuuguuguauauggugaauau

SEQ ID NO: 494762 - RNA, 64 nt, Homo Sapiens
aacucccaauugaugugaccacacucuucuuaauuuuguucacaguaaaaacacuuuuuugagu

SEQ ID NO: 494763 - RNA, 64 nt, Homo Sapiens
cugugagcauuuugccguauauccugcccugccauuuguucacuuuuuaaacuaaaauaggaac

SEQ ID NO: 494764 - RNA, 64 nt, Homo Sapiens
agaugccuggaagugguauuuugaggugaaagaguuuguucauuuugaagauauuucugucucu

SEQ ID NO: 494765 - RNA, 64 nt, Homo Sapiens
auaaaccaauauugugaaaaauagcaacuauucauuuguucacaacaugcguauuuauagagua

SEQ ID NO: 494766 - RNA, 64 nt, Homo Sapiens
ucaaagggagucagucccuaauuuacagguuuccuuuguucacuuucuagauguguacuuuuga

SEQ ID NO: 494767 - RNA, 64 nt, Homo Sapiens
auugacuuuuauaauucccaucuaaaaguagaauuuuguucagcauauuuuaagauacauacua

SEQ ID NO: 494768 - RNA, 64 nt, Homo Sapiens
augucaagcugaauuucagaagauguggaugauauuuguucaaugccagcaagagacaguguuc

SEQ ID NO: 494769 - RNA, 64 nt, Homo Sapiens
uaaguacuagggaagcuuuaauuuauugagucaauuuguucagguaguugacauaaguaaauuu

SEQ ID NO: 494770 - RNA, 64 nt, Homo Sapiens
aucagggaauuuauauugaagcaguugcucaaacuuuguucaauuauuagaggaaaccucugaa

SEQ ID NO: 494771 - RNA, 64 nt, Homo Sapiens
uugcaguuugagaagugaauuaaccuuacaucccuuuguucagauaccuuaaaaguuacuuuau

SEQ ID NO: 494772 - RNA, 64 nt, Homo Sapiens
cguucccauuccuguguuaccaccuuccucccgauuuguucaccuauuuugugcuuuaaaucuc

SEQ ID NO: 494773 - RNA, 64 nt, Homo Sapiens
ccuucuuccauuuauucauuguuuuguucauuacuuuguucacucuuccucugaucuggggucu

SEQ ID NO: 494774 - RNA, 64 nt, Homo Sapiens
acuuuguucacuccuucuucgaucuggggucuguuuuguucauuagaaagccaucucuuccucu

SEQ ID NO: 494775 - RNA, 64 nt, Homo Sapiens
agaaaugacucagaaucucagacaaaauguauuauuuguucaauuuuaauuuugcuacuacauu

SEQ ID NO: 494776 - RNA, 64 nt, Homo Sapiens
ucuggcagugucgaaaauaguaggagccuaaaacuuuguucaaugaguaagauguagauuugga

SEQ ID NO: 494777 - RNA, 64 nt, Homo Sapiens; identical to SEQ ID NO: 49935

SEQ ID NO: 494778 - RNA, 64 nt, Homo Sapiens; identical to SEQ ID NO: 49936

SEQ ID NO: 494779 - RNA, 64 nt, Homo Sapiens; identical to SEQ ID NO: 49937

SEQ ID NO: 494780 - RNA, 64 nt, Homo Sapiens; identical to SEQ ID NO: 49938

SEQ ID NO: 494781 - RNA, 64 nt, Homo Sapiens; identical to SEQ ID NO: 49939

SEQ ID NO: 494782 - RNA, 64 nt, Homo Sapiens; identical to SEQ ID NO: 49940

SEQ ID NO: 494783 - RNA, 64 nt, Homo Sapiens; identical to SEQ ID NO: 49941

SEQ ID NO: 494784 - RNA, 64 nt, Homo Sapiens; identical to SEQ ID NO: 49942

SEQ ID NO: 494785 - RNA, 64 nt, Homo Sapiens; identical to SEQ ID NO: 49943

SEQ ID NO: 494786 - RNA, 64 nt, Homo Sapiens; identical to SEQ ID NO: 49944

SEQ ID NO: 494787 - RNA, 64 nt, Homo Sapiens; identical to SEQ ID NO: 49945

SEQ ID NO: 494788 - RNA, 64 nt, Homo Sapiens; identical to SEQ ID NO: 49946

SEQ ID NO: 494789 - RNA, 64 nt, Homo Sapiens; identical to SEQ ID NO: 49947

SEQ ID NO: 494790 - RNA, 64 nt, Homo Sapiens; identical to SEQ ID NO: 49948

SEQ ID NO: 494791 - RNA, 64 nt, Homo Sapiens; identical to SEQ ID NO: 49949

SEQ ID NO: 494792 - RNA, 64 nt, Homo Sapiens; identical to SEQ ID NO: 49950

SEQ ID NO: 494793 - RNA, 64 nt, Homo Sapiens; identical to SEQ ID NO: 49951

SEQ ID NO: 494794 - RNA, 64 nt, Homo Sapiens; identical to SEQ ID NO: 49952

SEQ ID NO: 494795 - RNA, 64 nt, Homo Sapiens; identical to SEQ ID NO: 49953

SEQ ID NO: 494796 - RNA, 64 nt, Homo Sapiens; identical to SEQ ID NO: 49954

SEQ ID NO: 494797 - RNA, 64 nt, Homo Sapiens; identical to SEQ ID NO: 49955

SEQ ID NO: 494798 - RNA, 64 nt, Homo Sapiens; identical to SEQ ID NO: 49956

SEQ ID NO: 494799 - RNA, 64 nt, Homo Sapiens; identical to SEQ ID NO: 49957

SEQ ID NO: 494800 - RNA, 64 nt, Homo Sapiens; identical to SEQ ID NO: 49958

SEQ ID NO: 494801 - RNA, 64 nt, Homo Sapiens; identical to SEQ ID NO: 49959

SEQ ID NO: 494802 - RNA, 64 nt, Homo Sapiens; identical to SEQ ID NO: 49960

SEQ ID NO: 494803 - RNA, 64 nt, Homo Sapiens; identical to SEQ ID NO: 49961

SEQ ID NO: 494804 - RNA, 64 nt, Homo Sapiens; identical to SEQ ID NO: 49962

SEQ ID NO: 494805 - RNA, 64 nt, Homo Sapiens; identical to SEQ ID NO: 49963

SEQ ID NO: 494806 - RNA, 64 nt, Homo Sapiens; identical to SEQ ID NO: 49964

SEQ ID NO: 494807 - RNA, 64 nt, Homo Sapiens; identical to SEQ ID NO: 49965

SEQ ID NO: 494808 - RNA, 64 nt, Homo Sapiens; identical to SEQ ID NO: 49966

SEQ ID NO: 494809 - RNA, 64 nt, Homo Sapiens; identical to SEQ ID NO: 49967

SEQ ID NO: 494810 - RNA, 64 nt, Homo Sapiens; identical to SEQ ID NO: 49968

SEQ ID NO: 494811 - RNA, 64 nt, Homo Sapiens; identical to SEQ ID NO: 49969

SEQ ID NO: 494812 - RNA, 64 nt, Homo Sapiens; identical to SEQ ID NO: 49970

SEQ ID NO: 494813 - RNA, 64 nt, Homo Sapiens; identical to SEQ ID NO: 49971

SEQ ID NO: 494814 - RNA, 64 nt, Homo Sapiens; identical to SEQ ID NO: 49972

SEQ ID NO: 494815 - RNA, 64 nt, Homo Sapiens; identical to SEQ ID NO: 49973

SEQ ID NO: 494816 - RNA, 64 nt, Homo Sapiens; identical to SEQ ID NO: 49974

SEQ ID NO: 494817 - RNA, 64 nt, Homo Sapiens; identical to SEQ ID NO: 49975

SEQ ID NO: 494818 - RNA, 64 nt, Homo Sapiens; identical to SEQ ID NO: 49976

SEQ ID NO: 494819 - RNA, 64 nt, Homo Sapiens; identical to SEQ ID NO: 49977

SEQ ID NO: 494820 - RNA, 64 nt, Homo Sapiens; identical to SEQ ID NO: 49978

SEQ ID NO: 494821 - RNA, 64 nt, Homo Sapiens; identical to SEQ ID NO: 49979

SEQ ID NO: 494822 - RNA, 64 nt, Homo Sapiens; identical to SEQ ID NO: 49980

SEQ ID NO: 494823 - RNA, 64 nt, Homo Sapiens; identical to SEQ ID NO: 49981

SEQ ID NO: 494824 - RNA, 64 nt, Homo Sapiens; identical to SEQ ID NO: 49982

SEQ ID NO: 494825 - RNA, 64 nt, Homo Sapiens; identical to SEQ ID NO: 49983

SEQ ID NO: 494826 - RNA, 64 nt, Homo Sapiens; identical to SEQ ID NO: 49984

SEQ ID NO: 494827 - RNA, 64 nt, Homo Sapiens; identical to SEQ ID NO: 49985

SEQ ID NO: 494828 - RNA, 64 nt, Homo Sapiens; identical to SEQ ID NO: 49986

SEQ ID NO: 494829 - RNA, 64 nt, Homo Sapiens; identical to SEQ ID NO: 49987

SEQ ID NO: 494830 - RNA, 64 nt, Homo Sapiens; identical to SEQ ID NO: 49988

SEQ ID NO: 494831 - RNA, 64 nt, Homo Sapiens; identical to SEQ ID NO: 49989

SEQ ID NO: 494832 - RNA, 64 nt, Homo Sapiens; identical to SEQ ID NO: 49990

SEQ ID NO: 494833 - RNA, 64 nt, Homo Sapiens; identical to SEQ ID NO: 49991

SEQ ID NO: 494834 - RNA, 64 nt, Homo Sapiens; identical to SEQ ID NO: 49992

SEQ ID NO: 494835 - RNA, 64 nt, Homo Sapiens; identical to SEQ ID NO: 49993

SEQ ID NO: 494836 - RNA, 64 nt, Homo Sapiens; identical to SEQ ID NO: 49994

SEQ ID NO: 494837 - RNA, 64 nt, Homo Sapiens; identical to SEQ ID NO: 49995

SEQ ID NO: 494838 - RNA, 64 nt, Homo Sapiens; identical to SEQ ID NO: 49996

SEQ ID NO: 494839 - RNA, 58 nt, Homo Sapiens; identical to SEQ ID NO: 49997

SEQ ID NO: 494840 - RNA, 50 nt, Homo Sapiens; identical to SEQ ID NO: 49998

SEQ ID NO: 494841 - RNA, 64 nt, Homo Sapiens; identical to SEQ ID NO: 49999

SEQ ID NO: 494842 - RNA, 64 nt, Homo Sapiens; identical to SEQ ID NO: 50000

SEQ ID NO: 494843 - RNA, 64 nt, Homo Sapiens; identical to SEQ ID NO: 50001

SEQ ID NO: 494844 - RNA, 64 nt, Homo Sapiens; identical to SEQ ID NO: 50002

SEQ ID NO: 494845 - RNA, 64 nt, Homo Sapiens; identical to SEQ ID NO: 50003

SEQ ID NO: 494846 - RNA, 64 nt, Homo Sapiens; identical to SEQ ID NO: 50004

SEQ ID NO: 494847 - RNA, 64 nt, Homo Sapiens; identical to SEQ ID NO: 50005

SEQ ID NO: 494848 - RNA, 64 nt, Homo Sapiens; identical to SEQ ID NO: 50006

SEQ ID NO: 494849 - RNA, 64 nt, Homo Sapiens; identical to SEQ ID NO: 50007

SEQ ID NO: 494850 - RNA, 64 nt, Homo Sapiens; identical to SEQ ID NO: 50008

SEQ ID NO: 494851 - RNA, 64 nt, Homo Sapiens; identical to SEQ ID NO: 50009

SEQ ID NO: 494852 - RNA, 64 nt, Homo Sapiens; identical to SEQ ID NO: 50010

SEQ ID NO: 494853 - RNA, 64 nt, Homo Sapiens; identical to SEQ ID NO: 50011

SEQ ID NO: 494854 - RNA, 64 nt, Homo Sapiens; identical to SEQ ID NO: 50012

SEQ ID NO: 494855 - RNA, 64 nt, Homo Sapiens; identical to SEQ ID NO: 50013

SEQ ID NO: 494856 - RNA, 64 nt, Homo Sapiens; identical to SEQ ID NO: 50014

SEQ ID NO: 494857 - RNA, 64 nt, Homo Sapiens; identical to SEQ ID NO: 50015

SEQ ID NO: 494858 - RNA, 64 nt, Homo Sapiens; identical to SEQ ID NO: 50016

SEQ ID NO: 494859 - RNA, 64 nt, Homo Sapiens; identical to SEQ ID NO: 50017

SEQ ID NO: 494860 - RNA, 64 nt, Homo Sapiens; identical to SEQ ID NO: 50018

SEQ ID NO: 494861 - RNA, 64 nt, Homo Sapiens; identical to SEQ ID NO: 50019

SEQ ID NO: 494862 - RNA, 64 nt, Homo Sapiens; identical to SEQ ID NO: 50020

SEQ ID NO: 494863 - RNA, 64 nt, Homo Sapiens; identical to SEQ ID NO: 50021

SEQ ID NO: 494864 - RNA, 64 nt, Homo Sapiens; identical to SEQ ID NO: 50022

SEQ ID NO: 494865 - RNA, 64 nt, Homo Sapiens; identical to SEQ ID NO: 50023

SEQ ID NO: 494866 - RNA, 64 nt, Homo Sapiens; identical to SEQ ID NO: 50024

SEQ ID NO: 494867 - RNA, 64 nt, Homo Sapiens; identical to SEQ ID NO: 50025

SEQ ID NO: 494868 - RNA, 64 nt, Homo Sapiens; identical to SEQ ID NO: 50026

SEQ ID NO: 494869 - RNA, 64 nt, Homo Sapiens; identical to SEQ ID NO: 50027

SEQ ID NO: 494870 - RNA, 64 nt, Homo Sapiens; identical to SEQ ID NO: 50028

SEQ ID NO: 494871 - RNA, 64 nt, Homo Sapiens; identical to SEQ ID NO: 50029

SEQ ID NO: 494872 - RNA, 64 nt, Homo Sapiens; identical to SEQ ID NO: 50030

SEQ ID NO: 494873 - RNA, 64 nt, Homo Sapiens; identical to SEQ ID NO: 50031

SEQ ID NO: 494874 - RNA, 64 nt, Homo Sapiens; identical to SEQ ID NO: 50032

SEQ ID NO: 494875 - RNA, 64 nt, Homo Sapiens; identical to SEQ ID NO: 50033

SEQ ID NO: 494876 - RNA, 64 nt, Homo Sapiens; identical to SEQ ID NO: 50034

SEQ ID NO: 494877 - RNA, 64 nt, Homo Sapiens; identical to SEQ ID NO: 50035

SEQ ID NO: 494878 - RNA, 64 nt, Homo Sapiens; identical to SEQ ID NO: 50036

SEQ ID NO: 494879 - RNA, 64 nt, Homo Sapiens; identical to SEQ ID NO: 50037

SEQ ID NO: 494880 - RNA, 64 nt, Homo Sapiens; identical to SEQ ID NO: 50038

SEQ ID NO: 494881 - RNA, 64 nt, Homo Sapiens; identical to SEQ ID NO: 50039

SEQ ID NO: 494882 - RNA, 64 nt, Homo Sapiens; identical to SEQ ID NO: 50040

SEQ ID NO: 494883 - RNA, 64 nt, Homo Sapiens; identical to SEQ ID NO: 50041

SEQ ID NO: 494884 - RNA, 64 nt, Homo Sapiens; identical to SEQ ID NO: 50042

SEQ ID NO: 494885 - RNA, 64 nt, Homo Sapiens; identical to SEQ ID NO: 50043

SEQ ID NO: 494886 - RNA, 64 nt, Homo Sapiens; identical to SEQ ID NO: 50044

SEQ ID NO: 494887 - RNA, 64 nt, Homo Sapiens; identical to SEQ ID NO: 50045

SEQ ID NO: 494888 - RNA, 64 nt, Homo Sapiens; identical to SEQ ID NO: 50046

SEQ ID NO: 494889 - RNA, 64 nt, Homo Sapiens; identical to SEQ ID NO: 50047

SEQ ID NO: 494890 - RNA, 64 nt, Homo Sapiens; identical to SEQ ID NO: 50048

SEQ ID NO: 494891 - RNA, 64 nt, Homo Sapiens; identical to SEQ ID NO: 50049

SEQ ID NO: 494892 - RNA, 64 nt, Homo Sapiens; identical to SEQ ID NO: 50050

SEQ ID NO: 494893 - RNA, 64 nt, Homo Sapiens; identical to SEQ ID NO: 50051

SEQ ID NO: 494894 - RNA, 64 nt, Homo Sapiens; identical to SEQ ID NO: 50052

SEQ ID NO: 494895 - RNA, 64 nt, Homo Sapiens; identical to SEQ ID NO: 50053

SEQ ID NO: 494896 - RNA, 64 nt, Homo Sapiens; identical to SEQ ID NO: 50054

SEQ ID NO: 494897 - RNA, 64 nt, Homo Sapiens; identical to SEQ ID NO: 50055

SEQ ID NO: 494898 - RNA, 64 nt, Homo Sapiens; identical to SEQ ID NO: 50056

SEQ ID NO: 494899 - RNA, 64 nt, Homo Sapiens; identical to SEQ ID NO: 50057

SEQ ID NO: 494900 - RNA, 64 nt, Homo Sapiens; identical to SEQ ID NO: 50058

SEQ ID NO: 494901 - RNA, 64 nt, Homo Sapiens; identical to SEQ ID NO: 50059

SEQ ID NO: 494902 - RNA, 64 nt, Homo Sapiens; identical to SEQ ID NO: 50060

SEQ ID NO: 494903 - RNA, 64 nt, Homo Sapiens; identical to SEQ ID NO: 50061

SEQ ID NO: 494904 - RNA, 64 nt, Homo Sapiens; identical to SEQ ID NO: 50062

SEQ ID NO: 494905 - RNA, 64 nt, Homo Sapiens; identical to SEQ ID NO: 50063

SEQ ID NO: 494906 - RNA, 64 nt, Homo Sapiens; identical to SEQ ID NO: 50064

SEQ ID NO: 494907 - RNA, 64 nt, Homo Sapiens; identical to SEQ ID NO: 50065

SEQ ID NO: 494908 - RNA, 64 nt, Homo Sapiens; identical to SEQ ID NO: 50066

SEQ ID NO: 494909 - RNA, 64 nt, Homo Sapiens; identical to SEQ ID NO: 50067

SEQ ID NO: 494910 - RNA, 64 nt, Homo Sapiens; identical to SEQ ID NO: 50068

SEQ ID NO: 494911 - RNA, 64 nt, Homo Sapiens; identical to SEQ ID NO: 50069

SEQ ID NO: 494912 - RNA, 64 nt, Homo Sapiens; identical to SEQ ID NO: 50070

SEQ ID NO: 494913 - RNA, 64 nt, Homo Sapiens; identical to SEQ ID NO: 50071

SEQ ID NO: 494914 - RNA, 64 nt, Homo Sapiens; identical to SEQ ID NO: 50072

SEQ ID NO: 494915 - RNA, 64 nt, Homo Sapiens; identical to SEQ ID NO: 50073

SEQ ID NO: 494916 - RNA, 64 nt, Homo Sapiens; identical to SEQ ID NO: 50074

SEQ ID NO: 494917 - RNA, 64 nt, Homo Sapiens; identical to SEQ ID NO: 50075

SEQ ID NO: 494918 - RNA, 64 nt, Homo Sapiens; identical to SEQ ID NO: 50076

SEQ ID NO: 494919 - RNA, 64 nt, Homo Sapiens; identical to SEQ ID NO: 50077

SEQ ID NO: 494920 - RNA, 64 nt, Homo Sapiens; identical to SEQ ID NO: 50078

SEQ ID NO: 494921 - RNA, 64 nt, Homo Sapiens; identical to SEQ ID NO: 50079

SEQ ID NO: 494922 - RNA, 64 nt, Homo Sapiens; identical to SEQ ID NO: 50080

SEQ ID NO: 494923 - RNA, 64 nt, Homo Sapiens; identical to SEQ ID NO: 50081

SEQ ID NO: 494924 - RNA, 64 nt, Homo Sapiens; identical to SEQ ID NO: 50082

SEQ ID NO: 494925 - RNA, 64 nt, Homo Sapiens; identical to SEQ ID NO: 50083

SEQ ID NO: 494926 - RNA, 64 nt, Homo Sapiens; identical to SEQ ID NO: 50084

SEQ ID NO: 494927 - RNA, 64 nt, Homo Sapiens; identical to SEQ ID NO: 50085

SEQ ID NO: 494928 - RNA, 64 nt, Homo Sapiens; identical to SEQ ID NO: 50086

SEQ ID NO: 494929 - RNA, 64 nt, Homo Sapiens; identical to SEQ ID NO: 50087

SEQ ID NO: 494930 - RNA, 64 nt, Homo Sapiens; identical to SEQ ID NO: 50088

SEQ ID NO: 494931 - RNA, 64 nt, Homo Sapiens; identical to SEQ ID NO: 50089

SEQ ID NO: 494932 - RNA, 64 nt, Homo Sapiens; identical to SEQ ID NO: 50090

SEQ ID NO: 494933 - RNA, 64 nt, Homo Sapiens; identical to SEQ ID NO: 50091

SEQ ID NO: 494934 - RNA, 64 nt, Homo Sapiens; identical to SEQ ID NO: 50092

SEQ ID NO: 494935 - RNA, 63 nt, Homo Sapiens; identical to SEQ ID NO: 50093

SEQ ID NO: 494936 - RNA, 64 nt, Homo Sapiens; identical to SEQ ID NO: 50094

SEQ ID NO: 494937 - RNA, 64 nt, Homo Sapiens; identical to SEQ ID NO: 50095

SEQ ID NO: 494938 - RNA, 64 nt, Homo Sapiens; identical to SEQ ID NO: 50096

SEQ ID NO: 494939 - RNA, 64 nt, Homo Sapiens; identical to SEQ ID NO: 50097

SEQ ID NO: 494940 - RNA, 64 nt, Homo Sapiens; identical to SEQ ID NO: 50098

SEQ ID NO: 494941 - RNA, 64 nt, Homo Sapiens; identical to SEQ ID NO: 50099

SEQ ID NO: 494942 - RNA, 64 nt, Homo Sapiens; identical to SEQ ID NO: 50100

SEQ ID NO: 494943 - RNA, 64 nt, Homo Sapiens; identical to SEQ ID NO: 50101

SEQ ID NO: 494944 - RNA, 64 nt, Homo Sapiens; identical to SEQ ID NO: 50102

SEQ ID NO: 494945 - RNA, 64 nt, Homo Sapiens; identical to SEQ ID NO: 50103

SEQ ID NO: 494946 - RNA, 64 nt, Homo Sapiens; identical to SEQ ID NO: 50104

SEQ ID NO: 494947 - RNA, 64 nt, Homo Sapiens; identical to SEQ ID NO: 50105

SEQ ID NO: 494948 - RNA, 64 nt, Homo Sapiens; identical to SEQ ID NO: 50106

SEQ ID NO: 494949 - RNA, 64 nt, Homo Sapiens; identical to SEQ ID NO: 50107

SEQ ID NO: 494950 - RNA, 64 nt, Homo Sapiens; identical to SEQ ID NO: 50108

SEQ ID NO: 494951 - RNA, 64 nt, Homo Sapiens; identical to SEQ ID NO: 50109

SEQ ID NO: 494952 - RNA, 64 nt, Homo Sapiens; identical to SEQ ID NO: 50110

SEQ ID NO: 494953 - RNA, 64 nt, Homo Sapiens; identical to SEQ ID NO: 50111

SEQ ID NO: 494954 - RNA, 64 nt, Homo Sapiens; identical to SEQ ID NO: 50112

SEQ ID NO: 494955 - RNA, 64 nt, Homo Sapiens; identical to SEQ ID NO: 50113

SEQ ID NO: 494956 - RNA, 64 nt, Homo Sapiens; identical to SEQ ID NO: 50114

SEQ ID NO: 494957 - RNA, 64 nt, Homo Sapiens; identical to SEQ ID NO: 50115

SEQ ID NO: 494958 - RNA, 64 nt, Homo Sapiens; identical to SEQ ID NO: 50116

SEQ ID NO: 494959 - RNA, 64 nt, Homo Sapiens; identical to SEQ ID NO: 50117

SEQ ID NO: 494960 - RNA, 64 nt, Homo Sapiens; identical to SEQ ID NO: 50118

SEQ ID NO: 494961 - RNA, 64 nt, Homo Sapiens; identical to SEQ ID NO: 50119

SEQ ID NO: 494962 - RNA, 64 nt, Homo Sapiens; identical to SEQ ID NO: 50120

SEQ ID NO: 494963 - RNA, 64 nt, Homo Sapiens; identical to SEQ ID NO: 50121

SEQ ID NO: 494964 - RNA, 64 nt, Homo Sapiens; identical to SEQ ID NO: 382199

SEQ ID NO: 494965 - RNA, 64 nt, Homo Sapiens; identical to SEQ ID NO: 382200

SEQ ID NO: 494966 - RNA, 64 nt, Homo Sapiens; identical to SEQ ID NO: 382201

SEQ ID NO: 494967 - RNA, 57 nt, Homo Sapiens; identical to SEQ ID NO: 382202

SEQ ID NO: 494968 - RNA, 64 nt, Homo Sapiens; identical to SEQ ID NO: 382203

SEQ ID NO: 494969 - RNA, 64 nt, Homo Sapiens; identical to SEQ ID NO: 382204

SEQ ID NO: 494970 - RNA, 64 nt, Homo Sapiens; identical to SEQ ID NO: 382205

SEQ ID NO: 494971 - RNA, 64 nt, Homo Sapiens; identical to SEQ ID NO: 382206

SEQ ID NO: 494972 - RNA, 64 nt, Homo Sapiens; identical to SEQ ID NO: 382207

SEQ ID NO: 494973 - RNA, 64 nt, Homo Sapiens; identical to SEQ ID NO: 382208

SEQ ID NO: 494974 - RNA, 64 nt, Homo Sapiens; identical to SEQ ID NO: 382209

SEQ ID NO: 494975 - RNA, 64 nt, Homo Sapiens; identical to SEQ ID NO: 382210

SEQ ID NO: 494976 - RNA, 64 nt, Homo Sapiens; identical to SEQ ID NO: 382211

SEQ ID NO: 494977 - RNA, 64 nt, Homo Sapiens; identical to SEQ ID NO: 382212

SEQ ID NO: 494978 - RNA, 64 nt, Homo Sapiens; identical to SEQ ID NO: 382213

SEQ ID NO: 494979 - RNA, 64 nt, Homo Sapiens; identical to SEQ ID NO: 382214

SEQ ID NO: 494980 - RNA, 64 nt, Homo Sapiens; identical to SEQ ID NO: 382215

SEQ ID NO: 494981 - RNA, 64 nt, Homo Sapiens; identical to SEQ ID NO: 382216

SEQ ID NO: 494982 - RNA, 64 nt, Homo Sapiens; identical to SEQ ID NO: 382217

SEQ ID NO: 494983 - RNA, 64 nt, Homo Sapiens; identical to SEQ ID NO: 382218

SEQ ID NO: 494984 - RNA, 64 nt, Homo Sapiens; identical to SEQ ID NO: 382219

SEQ ID NO: 494985 - RNA, 64 nt, Homo Sapiens; identical to SEQ ID NO: 382220

SEQ ID NO: 494986 - RNA, 64 nt, Homo Sapiens; identical to SEQ ID NO: 382221

SEQ ID NO: 494987 - RNA, 64 nt, Homo Sapiens; identical to SEQ ID NO: 382222

SEQ ID NO: 494988 - RNA, 63 nt, Homo Sapiens; identical to SEQ ID NO: 382223

SEQ ID NO: 494989 - RNA, 64 nt, Homo Sapiens; identical to SEQ ID NO: 382224

SEQ ID NO: 494990 - RNA, 64 nt, Homo Sapiens; identical to SEQ ID NO: 382225

SEQ ID NO: 494991 - RNA, 64 nt, Homo Sapiens; identical to SEQ ID NO: 382226

SEQ ID NO: 494992 - RNA, 64 nt, Homo Sapiens; identical to SEQ ID NO: 382227

SEQ ID NO: 494993 - RNA, 64 nt, Homo Sapiens; identical to SEQ ID NO: 382228

SEQ ID NO: 494994 - RNA, 64 nt, Homo Sapiens; identical to SEQ ID NO: 382229

SEQ ID NO: 494995 - RNA, 64 nt, Homo Sapiens; identical to SEQ ID NO: 382230

SEQ ID NO: 494996 - RNA, 64 nt, Homo Sapiens; identical to SEQ ID NO: 382231

SEQ ID NO: 494997 - RNA, 64 nt, Homo Sapiens; identical to SEQ ID NO: 382232

SEQ ID NO: 494998 - RNA, 64 nt, Homo Sapiens; identical to SEQ ID NO: 382233

SEQ ID NO: 494999 - RNA, 64 nt, Homo Sapiens; identical to SEQ ID NO: 382234

SEQ ID NO: 495000 - RNA, 64 nt, Homo Sapiens; identical to SEQ ID NO: 382235

SEQ ID NO: 495001 - RNA, 64 nt, Homo Sapiens; identical to SEQ ID NO: 382236

SEQ ID NO: 495002 - RNA, 64 nt, Homo Sapiens; identical to SEQ ID NO: 382237

SEQ ID NO: 495003 - RNA, 64 nt, Homo Sapiens
uaucugugcucuacagucucauaaauuguguuaaacucuucaccgucgauuauuuaagcauaaa

SEQ ID NO: 495004 - RNA, 64 nt, Homo Sapiens
gauucuuguauauuagcaauucugggugggggugacucuucacucuagaagaggagggagggau

SEQ ID NO: 495005 - RNA, 64 nt, Homo Sapiens
ugccugacuagggagccaugcccuugaacucuucacucuucaaaaugcuggcuugggcagcauc

SEQ ID NO: 495006 - RNA, 64 nt, Homo Sapiens
cuucaaaugccugacuagggcagcauccccuugaacucuucacuuuaugagaugcuggcuuggg

SEQ ID NO: 495007 - RNA, 64 nt, Homo Sapiens
uuuuuuauaagccauugagggagaaaacugugucacucuucaauaaauuagccacuuuuaaaau

SEQ ID NO: 495008 - RNA, 64 nt, Homo Sapiens
uggaaaaauaauaucucccauuaaaaauuaauugacucuucauaguggggaaaucauggauuac

SEQ ID NO: 495009 - RNA, 64 nt, Homo Sapiens
ucuggaaguuguggacaaacgauguccuugagcuacucuucagcccuaggggccucugcccuuu

SEQ ID NO: 495010 - RNA, 64 nt, Homo Sapiens
cccaaccugcgcugugauuuaaaggaaaucagcaacucuucaaucacacugcugggggaaaggg

SEQ ID NO: 495011 - RNA, 64 nt, Homo Sapiens
cuccuuuuuuauaaacugguuauuucaggagcaaacucuucagguuuauaaaaauucaugucug

SEQ ID NO: 495012 - RNA, 64 nt, Homo Sapiens
ccugauugaggcccggguuuagcuccccagccucacucuucacucccuggaaggacagcaaggc

SEQ ID NO: 495013 - RNA, 64 nt, Homo Sapiens
ccugugaaaguuuguuauuuucugaguagacauucuuauagaguauugucuuuaaaaucagauu

SEQ ID NO: 495014 - RNA, 64 nt, Homo Sapiens
uuuuuauguuuucuaauuuaaaaauuaauauuuucuuauagauauugugcaauaaagcugaagu

SEQ ID NO: 495015 - RNA, 64 nt, Homo Sapiens
ucuaaccucaccucauucucagccagugguaagggaaacacagcuacugugccaggcacugaua

SEQ ID NO: 495016 - RNA, 64 nt, Homo Sapiens
uggccugagauaagcaguacuagcaagaauuugggaaacacagauacauugagccaaguuugua

SEQ ID NO: 495017 - RNA, 64 nt, Homo Sapiens
guagccuugacaaauuuuaccuuaaaaccaaaaugaaacacaaaaauuaauccuuaauaaugau

SEQ ID NO: 495018 - RNA, 64 nt, Homo Sapiens
uuuuauuggaagaguauuaacuggugccucuucugaaacacaccaacccauauuccucugcucc

SEQ ID NO: 495019 - RNA, 64 nt, Homo Sapiens
uauguuucucuaagauuuccuuugguuguauuuagaaacacaaauaguuuuauaaucaggauug

SEQ ID NO: 495020 - RNA, 64 nt, Homo Sapiens
cauaugcuucuaaauaucuaaacucauuaacauggaaacacacacacaggagcuacaguacaua

SEQ ID NO: 495021 - RNA, 64 nt, Homo Sapiens
uauaguaauucaggcucuaauuagcugagggaaugaaacacacaaaaaucacugaauuccuaag

SEQ ID NO: 495022 - RNA, 64 nt, Homo Sapiens
ggcuauaacaugucuuucagcauuaggcuuuuaagaaacacaggguuuuguauucuuuacuaaa

SEQ ID NO: 495023 - RNA, 64 nt, Homo Sapiens
uacaagcaagacugggaccuuagaaaucauuguagaaacacaguuuugaaagaaaaauaccaug

SEQ ID NO: 495024 - RNA, 64 nt, Homo Sapiens
cagcucuuucugcaugugcucaacuuuguacagagaaacacaaucucggacaucuacaacccug

SEQ ID NO: 495025 - RNA, 64 nt, Homo Sapiens
cacucgcacucucgcucacgcugguuugugggcagaaacacacaugaaaucagacaccaaugga

SEQ ID NO: 495026 - RNA, 64 nt, Homo Sapiens
uggagucuguucuguguugauuugacugccaugagaaacacaggggaaaccugaugaggagaag

SEQ ID NO: 495027 - RNA, 64 nt, Homo Sapiens
ugugcuguccccauguucccgcugugauuuggcagaaacacaauaggcuucuccuugugugauc

SEQ ID NO: 495028 - RNA, 64 nt, Homo Sapiens
acucacagccauguauaucuaaaagacuuucacagaaacacauuaaaguucauuauuuucaucc

SEQ ID NO: 495029 - RNA, 64 nt, Homo Sapiens
cucaccucuuggagcugcuucaaaacagaaaagagaaacacaagaaagaugaccacaaggggcc

SEQ ID NO: 495030 - RNA, 64 nt, Homo Sapiens
cgaccugauuauuuagguauuuguaugugaaagagaaacacauauuuagaaacacagcaaggga

SEQ ID NO: 495031 - RNA, 64 nt, Homo Sapiens
agguauuuguaugugaaagagaaacacauauuuagaaacacagcaagggagauuuugaauaaag

SEQ ID NO: 495032 - RNA, 64 nt, Homo Sapiens
agaauucuaagaaauauaguaaauuuuaaaagcugaaacacaacuuaugcacuuaggaagugcu

SEQ ID NO: 495033 - RNA, 64 nt, Homo Sapiens
uguugcaucucaaggaaaaggguccuggccggacgaaacacacguauagucaucuaccaccugc

SEQ ID NO: 495034 - RNA, 64 nt, Homo Sapiens
uuaaguauuaauacaggaugacaucauggcaauggaaacacaauccagcucuaucuuuguguuu

SEQ ID NO: 495035 - RNA, 64 nt, Homo Sapiens
cgaagcccaggccaggucgcaaauccauugccaagaaacacaguucuuggaggagccgaucuug

SEQ ID NO: 495036 - RNA, 64 nt, Homo Sapiens
gguagcaccacuucugaugaaaacacaaaaacaugaaacacaguaaccaccgacagaaagaaag

SEQ ID NO: 495037 - RNA, 64 nt, Homo Sapiens
aacaugaaacacagugguagccgacagaaagaaagaaacacaaagucacaacccucaggaacca

SEQ ID NO: 495038 - RNA, 64 nt, Homo Sapiens
uuucucuaaaacauuuaugcccuugcuuuggcuagaaacacauuaacugguuuacucauugaga

SEQ ID NO: 495039 - RNA, 64 nt, Homo Sapiens
cccauucuucauaucaauuuuguauaaauauauagaaacacacacacagccucagacuuacaaa

SEQ ID NO: 495040 - RNA, 64 nt, Homo Sapiens
caguuuaauaguaacuuuauuuauuuaaaaaaaagaaacacaauuaguuacuguuaaacugaua

SEQ ID NO: 495041 - RNA, 64 nt, Homo Sapiens
augcucuuguugacuuccagcagaugggaugggggaaacacagcaguucuugguaaaguccuuu

SEQ ID NO: 495042 - RNA, 64 nt, Homo Sapiens
aagaaguucucugaaaugucagcaaguaaguucugaaacacaucaugcaugaguaggaauaaaa

SEQ ID NO: 495043 - RNA, 64 nt, Homo Sapiens
ugccacugcccgagcuggugcauuacagagaggagaaacacaucuucccuagaggguuccugua

SEQ ID NO: 495044 - RNA, 64 nt, Homo Sapiens
uccuguagaccuagggaggaccuuaucugugcgugaaacacaccaggcugugggccucaaggac

SEQ ID NO: 495045 - RNA, 64 nt, Homo Sapiens
aaaugauuuuagccuuugcaaauguuaaccaugugaaacacauuuucaguauaaguaugcguua

SEQ ID NO: 495046 - RNA, 64 nt, Homo Sapiens
aaaccucuugcuugugugcaaaaguuccuaaaaggaaacacaaguaaugccuauccauuacuag

SEQ ID NO: 495047 - RNA, 64 nt, Homo Sapiens
uuuuugucauguaauuuauuaacuaacuauuacagaaacacagcuaagaauaucaaguauuucu

SEQ ID NO: 495048 - RNA, 64 nt, Homo Sapiens
cagguguuaugcacuccauccaucauaacuguaugaaacacauuucauauguaaauaaacgugg

SEQ ID NO: 495049 - RNA, 64 nt, Homo Sapiens
uggacaugugucccagccacaugcccacguaugugaaacacacaacaugacccuuguggcacag

SEQ ID NO: 495050 - RNA, 64 nt, Homo Sapiens
ugaugaacuguggugccacacagggcaggaaggggaaacacagcuccaaccuguggcgcugcag

SEQ ID NO: 495051 - RNA, 64 nt, Homo Sapiens
ucuagaggugaagauagagacauagagaggcugugaaacacacauacagcccuguuaggucuuu

SEQ ID NO: 495052 - RNA, 64 nt, Homo Sapiens
uuagucuagguaaagaaaaaaaaaaaaaggucaugaaacacaaauguccucaacugucaucauu

SEQ ID NO: 495053 - RNA, 64 nt, Homo Sapiens; identical to SEQ ID NO: 299149

SEQ ID NO: 495054 - RNA, 64 nt, Homo Sapiens; identical to SEQ ID NO: 299150

SEQ ID NO: 495055 - RNA, 64 nt, Homo Sapiens; identical to SEQ ID NO: 299151

SEQ ID NO: 495056 - RNA, 64 nt, Homo Sapiens; identical to SEQ ID NO: 299152

SEQ ID NO: 495057 - RNA, 64 nt, Homo Sapiens; identical to SEQ ID NO: 299153

SEQ ID NO: 495058 - RNA, 64 nt, Homo Sapiens; identical to SEQ ID NO: 299154

SEQ ID NO: 495059 - RNA, 64 nt, Homo Sapiens; identical to SEQ ID NO: 299155

SEQ ID NO: 495060 - RNA, 64 nt, Homo Sapiens; identical to SEQ ID NO: 299156

SEQ ID NO: 495061 - RNA, 64 nt, Homo Sapiens; identical to SEQ ID NO: 299157

SEQ ID NO: 495062 - RNA, 64 nt, Homo Sapiens; identical to SEQ ID NO: 299158

SEQ ID NO: 495063 - RNA, 64 nt, Homo Sapiens; identical to SEQ ID NO: 299159

SEQ ID NO: 495064 - RNA, 64 nt, Homo Sapiens; identical to SEQ ID NO: 299160

SEQ ID NO: 495065 - RNA, 64 nt, Homo Sapiens; identical to SEQ ID NO: 299161

SEQ ID NO: 495066 - RNA, 64 nt, Homo Sapiens; identical to SEQ ID NO: 299162

SEQ ID NO: 495067 - RNA, 64 nt, Homo Sapiens; identical to SEQ ID NO: 299163

SEQ ID NO: 495068 - RNA, 64 nt, Homo Sapiens; identical to SEQ ID NO: 299164

SEQ ID NO: 495069 - RNA, 64 nt, Homo Sapiens; identical to SEQ ID NO: 299165

SEQ ID NO: 495070 - RNA, 64 nt, Homo Sapiens; identical to SEQ ID NO: 299166

SEQ ID NO: 495071 - RNA, 64 nt, Homo Sapiens; identical to SEQ ID NO: 299167

SEQ ID NO: 495072 - RNA, 64 nt, Homo Sapiens; identical to SEQ ID NO: 299168

SEQ ID NO: 495073 - RNA, 64 nt, Homo Sapiens; identical to SEQ ID NO: 299169

SEQ ID NO: 495074 - RNA, 64 nt, Homo Sapiens; identical to SEQ ID NO: 299170

SEQ ID NO: 495075 - RNA, 64 nt, Homo Sapiens; identical to SEQ ID NO: 299171

SEQ ID NO: 495076 - RNA, 64 nt, Homo Sapiens; identical to SEQ ID NO: 299172

SEQ ID NO: 495077 - RNA, 64 nt, Homo Sapiens; identical to SEQ ID NO: 299173

SEQ ID NO: 495078 - RNA, 64 nt, Homo Sapiens; identical to SEQ ID NO: 299174

SEQ ID NO: 495079 - RNA, 64 nt, Homo Sapiens; identical to SEQ ID NO: 299175

SEQ ID NO: 495080 - RNA, 64 nt, Homo Sapiens; identical to SEQ ID NO: 299176

SEQ ID NO: 495081 - RNA, 64 nt, Homo Sapiens; identical to SEQ ID NO: 299177

SEQ ID NO: 495082 - RNA, 64 nt, Homo Sapiens; identical to SEQ ID NO: 299178

SEQ ID NO: 495083 - RNA, 64 nt, Homo Sapiens; identical to SEQ ID NO: 299179

SEQ ID NO: 495084 - RNA, 64 nt, Homo Sapiens; identical to SEQ ID NO: 299180

SEQ ID NO: 495085 - RNA, 64 nt, Homo Sapiens; identical to SEQ ID NO: 299181

SEQ ID NO: 495086 - RNA, 64 nt, Homo Sapiens; identical to SEQ ID NO: 299182

SEQ ID NO: 495087 - RNA, 64 nt, Homo Sapiens; identical to SEQ ID NO: 299183

SEQ ID NO: 495088 - RNA, 64 nt, Homo Sapiens; identical to SEQ ID NO: 299184

SEQ ID NO: 495089 - RNA, 64 nt, Homo Sapiens; identical to SEQ ID NO: 299185

SEQ ID NO: 495090 - RNA, 64 nt, Homo Sapiens; identical to SEQ ID NO: 299186

SEQ ID NO: 495091 - RNA, 64 nt, Homo Sapiens; identical to SEQ ID NO: 299187

SEQ ID NO: 495092 - RNA, 64 nt, Homo Sapiens; identical to SEQ ID NO: 299188

SEQ ID NO: 495093 - RNA, 64 nt, Homo Sapiens; identical to SEQ ID NO: 299189

SEQ ID NO: 495094 - RNA, 64 nt, Homo Sapiens; identical to SEQ ID NO: 299190

SEQ ID NO: 495095 - RNA, 64 nt, Homo Sapiens; identical to SEQ ID NO: 299191

SEQ ID NO: 495096 - RNA, 64 nt, Homo Sapiens; identical to SEQ ID NO: 299192

SEQ ID NO: 495097 - RNA, 64 nt, Homo Sapiens; identical to SEQ ID NO: 299193

SEQ ID NO: 495098 - RNA, 64 nt, Homo Sapiens; identical to SEQ ID NO: 299194

SEQ ID NO: 495099 - RNA, 64 nt, Homo Sapiens; identical to SEQ ID NO: 299195

SEQ ID NO: 495100 - RNA, 64 nt, Homo Sapiens; identical to SEQ ID NO: 299196

SEQ ID NO: 495101 - RNA, 64 nt, Homo Sapiens; identical to SEQ ID NO: 299197

SEQ ID NO: 495102 - RNA, 64 nt, Homo Sapiens; identical to SEQ ID NO: 299198

SEQ ID NO: 495103 - RNA, 64 nt, Homo Sapiens; identical to SEQ ID NO: 299199

SEQ ID NO: 495104 - RNA, 64 nt, Homo Sapiens; identical to SEQ ID NO: 299200

SEQ ID NO: 495105 - RNA, 64 nt, Homo Sapiens; identical to SEQ ID NO: 299201

SEQ ID NO: 495106 - RNA, 64 nt, Homo Sapiens; identical to SEQ ID NO: 299202

SEQ ID NO: 495107 - RNA, 64 nt, Homo Sapiens; identical to SEQ ID NO: 299203

SEQ ID NO: 495108 - RNA, 64 nt, Homo Sapiens; identical to SEQ ID NO: 299204

SEQ ID NO: 495109 - RNA, 64 nt, Homo Sapiens; identical to SEQ ID NO: 299205

SEQ ID NO: 495110 - RNA, 64 nt, Homo Sapiens; identical to SEQ ID NO: 299206

SEQ ID NO: 495111 - RNA, 64 nt, Homo Sapiens; identical to SEQ ID NO: 299207

SEQ ID NO: 495112 - RNA, 64 nt, Homo Sapiens; identical to SEQ ID NO: 299208

SEQ ID NO: 495113 - RNA, 64 nt, Homo Sapiens; identical to SEQ ID NO: 299209

SEQ ID NO: 495114 - RNA, 62 nt, Homo Sapiens
uuccuuucaacuuaguugacauacgugccuuaaaaaggaaaacuaguguugcuauugugcau

SEQ ID NO: 495115 - RNA, 62 nt, Homo Sapiens
aaacuaguguugcuauugugcauuuacuagaaaaaaggaauugguuguuuagggcacacugu

SEQ ID NO: 495116 - RNA, 62 nt, Homo Sapiens
auuuuaagaugccuuaaaaaucuuaaagucacaaaaggaaaaagguuuuuaacauuuacaug

SEQ ID NO: 495117 - RNA, 62 nt, Homo Sapiens
ucaauauauacccuucucuaaacugugcggguaaaaggaaugacuguccuugagagaaccau

SEQ ID NO: 495118 - RNA, 62 nt, Homo Sapiens
uuugcacuguguucauauuaauccucuuuuaaaaaaggaaauauacagaagacaaacauugu

SEQ ID NO: 495119 - RNA, 62 nt, Homo Sapiens
ggaagggaaguuagacaagcuuuggggaagagaaaaggaauauaguccauuuccaaaggagc

SEQ ID NO: 495120 - RNA, 62 nt, Homo Sapiens
ugagugacagagcaagacuguaucucaaaggaaaaaggaaacuaggccaggcgugguggcuc

SEQ ID NO: 495121 - RNA, 62 nt, Homo Sapiens
gguuuuuagcucauuugccuaaaaaaaagaaaaaaaggaaaaacaaaaaaaaaaagcuuuaa

SEQ ID NO: 495122 - RNA, 62 nt, Homo Sapiens
aaauccacgaguggaaaagcucccuccuccaaaaaaggaaucagugguugcuccaggauuac

SEQ ID NO: 495123 - RNA, 62 nt, Homo Sapiens
acuccuguguacagaugcgaagaauuaaauguaaaaggaagcaaggaaacuucaaacaauau

SEQ ID NO: 495124 - RNA, 62 nt, Homo Sapiens
uucaaacaauauagaauuaagagggagaaaggaaaaggaaaccagagggaaagggguacacu

SEQ ID NO: 495125 - RNA, 62 nt, Homo Sapiens
ccagaagcccugcugucuguaaggaaaaaaaaaaaaggaaaaaaaaaaaaaaaaaaaggaaa

SEQ ID NO: 495126 - RNA, 62 nt, Homo Sapiens
aaaaaaaaggaaaaccagaaaaaaaaaaaggaaaaaggaaaauaugcuuucuucuuaaaaaa

SEQ ID NO: 495127 - RNA, 62 nt, Homo Sapiens
aggaaaaaaaaaaaaggaaauaaaaaaaaaaaaaaaggaaaacaaccucuaugcuuucuucu

SEQ ID NO: 495128 - RNA, 62 nt, Homo Sapiens
agcaaguuugcucagucaaguguguuuuaaauaaaaggaaaguaguucaggaaguuuuguuu

SEQ ID NO: 495129 - RNA, 62 nt, Homo Sapiens
aaaaaauguuuuacuauguggacugauuuuuaaaaaggaaaaguagggaaaaacuuuugccc

SEQ ID NO: 495130 - RNA, 62 nt, Homo Sapiens
guacauuguguagaaaaaaacuugauccauuuaaaaggaauuuucauguauauaagcuauuu

SEQ ID NO: 495131 - RNA, 62 nt, Homo Sapiens
agcuauagaacugcuuuguaccuuuccccuuuaaaaggaauuuuccugcuuugguuaccuuu

SEQ ID NO: 495132 - RNA, 62 nt, Homo Sapiens
ugugggucuuguuuggauccgacaugucgaccaaaaggaaugauauaaauuaaaugagacga

SEQ ID NO: 495133 - RNA, 62 nt, Homo Sapiens
uguuuaaauaacauuaugggaaaugcauggagaaaaggaauucugaauacuuguuuuauaga

SEQ ID NO: 495134 - RNA, 62 nt, Homo Sapiens
aucagaaguugcaaaagauguaagaaauugagaaaaggaacaucaguaucacagauuauuca

SEQ ID NO: 495135 - RNA, 62 nt, Homo Sapiens
augaagugccccaggagaagguaacuuagaccaaaaggaaaacuuaaaauagcuuccaauaa

SEQ ID NO: 495136 - RNA, 62 nt, Homo Sapiens
gggccaaauagaguuuuuauauuuguuaugauaaaaggaaguagaugugaaaaagccuaaga

SEQ ID NO: 495137 - RNA, 62 nt, Homo Sapiens
auaaaaggaaguagaugugaaaaagccuaagaaaaaggaaauuggacaguuuugauacaaac

SEQ ID NO: 495138 - RNA, 62 nt, Homo Sapiens
gguuuuaaacgacuuuuguuugcggggcuuuuaaaaggaaaaccgaauuagguccacuucaa

SEQ ID NO: 495139 - RNA, 62 nt, Homo Sapiens
cuguuuguguuauuucagaugauucaaauaucaaaaggaagauucuuccauuaaauugccuu

SEQ ID NO: 495140 - RNA, 62 nt, Homo Sapiens
gucauagcucauuacucuaccaccaagaaccuaaaaggaauuagaauacagcagaauuggcc

SEQ ID NO: 495141 - RNA, 62 nt, Homo Sapiens
ucauuuggaagacuuuagacucuauuaauuuuaaaaggaauauuuauuagccauaugcagaa

SEQ ID NO: 495142 - RNA, 62 nt, Homo Sapiens
uugauggugauuguauuguauuccuuuaaucaaaaaggaaacacaauauucuaaguaucuuu

SEQ ID NO: 495143 - RNA, 62 nt, Homo Sapiens
uagagacauuuuuauuuaugaauauuuauacaaaaaggaauucugucaagaugacugcucua

SEQ ID NO: 495144 - RNA, 57 nt, Homo Sapiens; identical to SEQ ID NO: 210489

SEQ ID NO: 495145 - RNA, 62 nt, Homo Sapiens
aaggcccugcuuuuuuucuuaaaaguacuuuaaaaaggaaauuuguuuguauuuuuuauuua

SEQ ID NO: 495146 - RNA, 62 nt, Homo Sapiens
gccucugcucuccugggagacaaagcaauaauaaaaggaaguguuuguaaucccagcacuuu

SEQ ID NO: 495147 - RNA, 62 nt, Homo Sapiens
aaacaaauaaauuuuaaaaauaaauaaauaauaaaaggaaguguuagacaauguaaugccag

SEQ ID NO: 495148 - RNA, 62 nt, Homo Sapiens
ucuauagaaaucuauauauugggagagaggaaaaaaggaaauauaccuugcagaggaaaggu

SEQ ID NO: 495149 - RNA, 62 nt, Homo Sapiens
uaaaacaaaaaccacagaggacccagaagagaaaaaggaauuggauggagagaaguaucagc

SEQ ID NO: 495150 - RNA, 62 nt, Homo Sapiens
ugaaggaauggucuaaagaauaggaagcuaggaaaaggaaaggucucccuucugacauuucc

SEQ ID NO: 495151 - RNA, 62 nt, Homo Sapiens
ugucucccuucugacauuucugccggcaugguaaaaggaagcugugacugagaaaaguuuaa

SEQ ID NO: 495152 - RNA, 62 nt, Homo Sapiens
agcuagaauaugaccauuaagaaugucaaauaaaaaggaauuauuugggucugccauugaca

SEQ ID NO: 495153 - RNA, 62 nt, Homo Sapiens
aguuuucucaaccauuuaaagguuauuccaguaaaaggaaauaguuaccaucgcaaaggaaa

SEQ ID NO: 495154 - RNA, 62 nt, Homo Sapiens
agcaugacauuguguaucgaaaaaaaaaaaggaaaaggaaaagcugagcugcuuguuuaaaa

SEQ ID NO: 495155 - RNA, 62 nt, Homo Sapiens
ggaaaaagcaugacauuguguuaaaaaaaaaaaaaaggaaaacaaaucgcugagcugcuugu

SEQ ID NO: 495156 - RNA, 62 nt, Homo Sapiens
uaaaaguguauugcacaauggacugcaaagguaaaaggaaaacacaacgauuacucgaagau

SEQ ID NO: 495157 - RNA, 62 nt, Homo Sapiens
uucuauccagaagccuauuuuuuauuggcaacaaaaggaauuaauacacucagguggucuua

SEQ ID NO: 495158 - RNA, 62 nt, Homo Sapiens
accauauagccaaccuguggaaaaggaaauauaaaaggaacagaaaguuugucaucauuuga

SEQ ID NO: 495159 - RNA, 62 nt, Homo Sapiens
auaaaaggaacaaccauauagucaucauuugaaaaaggaaaucaauuuaauugggaaaguuu

SEQ ID NO: 495160 - RNA, 62 nt, Homo Sapiens
aaaaauuuuacaauuaggaguuaaaaaaauaaaaaaggaagugaauaaggaucacugagaau

SEQ ID NO: 495161 - RNA, 62 nt, Homo Sapiens
agaauaaggaucacugagaaauugucaaaaccaaaaggaaucaccagcuuucauaauuuuua

SEQ ID NO: 495162 - RNA, 62 nt, Homo Sapiens
agaccauaagcaaacugguuauuuaaaauguaaaaaggaauaugaaagucuuauuaaaacac

SEQ ID NO: 495163 - RNA, 62 nt, Homo Sapiens
acuauuuggcaacuacugggacucuucagcacaaaaggaauagaucuaugauugacccugau

SEQ ID NO: 495164 - RNA, 62 nt, Homo Sapiens
ggaccauacagugauuuaccauuuugauaauuaaaaggaaaaaaaaaggaagacucucacug

SEQ ID NO: 495165 - RNA, 62 nt, Homo Sapiens
ugauuuaccauuuugauaauuaaaaggaaaaaaaaaggaagacucucacuguaaaaacagcu

SEQ ID NO: 495166 - RNA, 62 nt, Homo Sapiens
ccacaaaaucaauaaaagauguuuuugagaaaaaaaggaagaaaccaacucauucagaaggc

SEQ ID NO: 495167 - RNA, 62 nt, Homo Sapiens
uuucugaucaccuuagaaauggcaguaagcccaaaaggaagaauuaugcugguaguaaaugg

SEQ ID NO: 495168 - RNA, 62 nt, Homo Sapiens
aauagauguguguuuaauggaauugaagucugaaaaggaaguaguuauuuuagcagaaaauu

SEQ ID NO: 495169 - RNA, 62 nt, Homo Sapiens
ugaauuauuuuucuccaaauugagacucucagaaaaggaagauugaauuagcguguuuuuug

SEQ ID NO: 495170 - RNA, 62 nt, Homo Sapiens
cuaugaggaugugcugguuuguugaaucaaacaaaaggaaauguuguggaauauuuuuccaa

SEQ ID NO: 495171 - RNA, 62 nt, Homo Sapiens
acaaggucaaaaaauagaugcaggcugaaaagaaaaggaagugggcuaagaugggaaaaaua

SEQ ID NO: 495172 - RNA, 62 nt, Homo Sapiens
ggucaacauagugagacacugucucuaccaaaaaaaggaaggaagggacacauaucaaacug

SEQ ID NO: 495173 - RNA, 62 nt, Homo Sapiens
gagagugugguuacgaaauacguuaggaggacaaaaggaauguguaagucuuuaaugccgau

SEQ ID NO: 495174 - RNA, 62 nt, Homo Sapiens
agcauggagaaaacccgguacgcucaaaaagaaaaaggaaaaaaaaaaaucccaucacccac

SEQ ID NO: 495175 - RNA, 62 nt, Homo Sapiens
auuuggacauuuuaauuguuuaaaaauuguacaaaaggaaaaaauuagaauaaguacuggcg

SEQ ID NO: 495176 - RNA, 62 nt, Homo Sapiens
aaugcauacaccuguuugucauauuguuccuaaaaaggaauagagggcgguucuuuuuuuag

SEQ ID NO: 495177 - RNA, 62 nt, Homo Sapiens
uguacucugugcauuggaugcuuuuuguugaaaaaaggaauugaguauuuuugauuuuucua

SEQ ID NO: 495178 - RNA, 62 nt, Homo Sapiens
aaaaaaaaacacgucaaaagaugaagauuggaaaaaggaaaaggggcgggccaaccccgaga

SEQ ID NO: 495179 - RNA, 62 nt, Homo Sapiens
uauauauguuagaguuuugauuaagugguggaaaaaggaaagagccgaugggggcaguggcg

SEQ ID NO: 495180 - RNA, 62 nt, Homo Sapiens
agaaaacaggaccuagguguagauccugucucaaaaggaaaaccagcuugggcaacagagca

SEQ ID NO: 495181 - RNA, 62 nt, Homo Sapiens
uaguuauuccuagcuccauuccaaugaagaggaaaaggaaaggaucauucaguuggauuuuc

SEQ ID NO: 495182 - RNA, 62 nt, Homo Sapiens
uucauucauauuuauccucuucauuugacuuuaaaaggaagucacagggcuugagcuuucug

SEQ ID NO: 495183 - RNA, 62 nt, Homo Sapiens
uuagaugggcugugacacaauaaaaaauaccuaaaaggaagcguguuuucucuuggacauac

SEQ ID NO: 495184 - RNA, 62 nt, Homo Sapiens
aagaaaaacuguuucaucauagcaggaggaagaaaaggaagacaugacaguugcccuuucaa

SEQ ID NO: 495185 - RNA, 62 nt, Homo Sapiens
ccaagggcucucuaaauuuauugagccacaccaaaaggaauggauucagcuuguaauaaucu

SEQ ID NO: 495186 - RNA, 62 nt, Homo Sapiens
uagcaagcaugaauuuuucacccaagagugaaaaaaggaaaaucuaccauggcuugaaguua

SEQ ID NO: 495187 - RNA, 62 nt, Homo Sapiens
guggcagguacuaugaauguaauucauaauuuaaaaggaaaacuaaaaacuauuuugauuug

SEQ ID NO: 495188 - RNA, 62 nt, Homo Sapiens
uuaucacacugauguguucaacuguuuaugggaaaaggaaacuaggaugguuuuauuuguga

SEQ ID NO: 495189 - RNA, 62 nt, Homo Sapiens
gcgcagagcagagugcugaguaaagaugucagaaaaggaaagcaauggucugguacaagucu

SEQ ID NO: 495190 - RNA, 62 nt, Homo Sapiens
cuuuucaugccuuuagaugugggucaguugauaaaaggaaacacuauugggguaugauguuu

SEQ ID NO: 495191 - RNA, 62 nt, Homo Sapiens
aaaacuaacaaccaaccaacauauauaaauuaaaaaggaaagauauauauauauauauauau

SEQ ID NO: 495192 - RNA, 62 nt, Homo Sapiens
auauauauauauauauauaucguauucuauucaaaaggaaauaccuagaacuucaaaauguu

SEQ ID NO: 495193 - RNA, 62 nt, Homo Sapiens
ggaauaguauaaacacugauuuaaacauuggcaaaaggaaauaaaggaauuuuccuguuaaa

SEQ ID NO: 495194 - RNA, 62 nt, Homo Sapiens
uuccuguuaaauuaaacauuaggaacuucaagaaaaggaauuugaccuuuggugaucuucuu

SEQ ID NO: 495195 - RNA, 62 nt, Homo Sapiens
ugaguauuuaugaagaauauuuuaaaaauaauaaaaggaagauucguaaaacuugcgugucu

SEQ ID NO: 495196 - RNA, 62 nt, Homo Sapiens
gcagugcaacaaaguacgugguaaaagaauaaaaaaggaauugguaaaacuuagauguccuu

SEQ ID NO: 495197 - RNA, 62 nt, Homo Sapiens
guuccacagagucaaucuaagacuccuuguaaaaaaggaaaucuauuauaauaaaaggugag

SEQ ID NO: 495198 - RNA, 62 nt, Homo Sapiens
cuggagagaaaacuacagcuugcuugauacacaaaaggaacucaaaugcacaagcaaaaaga

SEQ ID NO: 495199 - RNA, 62 nt, Homo Sapiens
aagaaagguuuuuugguuuuacccaagagaagaaaaggaagauauuacauaagaaacaaugg

SEQ ID NO: 495200 - RNA, 62 nt, Homo Sapiens
guacuggcuauuacauaagaagcuaacacaggaaaaggaacuauuuuaggcucaaaaauuaa

SEQ ID NO: 495201 - RNA, 62 nt, Homo Sapiens
uaaaaugacuguuuucucucucuauggaaauaaaaaggaaaaaaaaaaaggaaacuuuuuuu

SEQ ID NO: 495202 - RNA, 62 nt, Homo Sapiens
uucucucucuauggaaauaaaaaggaaaaaaaaaaaggaaacuuuuuuuguuugcucuugca

SEQ ID NO: 495203 - RNA, 62 nt, Homo Sapiens
gauuggcaagacauguauuuaaacaauaaacuaaaaggaaauaaucuccacguacuaccauc

SEQ ID NO: 495204 - RNA, 62 nt, Homo Sapiens
uuucuucaaaggcuuguuaaaccaaucauguuaaaaggaaauucuugguuuugguuuguugu

SEQ ID NO: 495205 - RNA, 62 nt, Homo Sapiens
uuuuguuuggccuugcauugccuugguaaaguaaaaggaaacaguacacuuggagcuaggaa

SEQ ID NO: 495206 - RNA, 62 nt, Homo Sapiens
ccuugaaccacauauaccaauuauaauuuuggaaaaggaauuaagccucacggaacaaugga

SEQ ID NO: 495207 - RNA, 62 nt, Homo Sapiens
aaaacugacaaugcaugcuacuguucucuuucaaaaggaagagcaaccguguugaauacuaa

SEQ ID NO: 495208 - RNA, 62 nt, Homo Sapiens
gucagcuguagguggcaaaggugcccuuauaaaaaaggaaacuggcuuuucaaaaugggcua

SEQ ID NO: 495209 - RNA, 62 nt, Homo Sapiens
caaaagugcagcaggagaacucuuuucccugaaaaaggaaaaauauugaacucaaugauagc

SEQ ID NO: 495210 - RNA, 62 nt, Homo Sapiens
cggucaguuaugucaauguuucauggucaauaaaaaggaaguugcaaauugugauuuaagca

SEQ ID NO: 495211 - RNA, 62 nt, Homo Sapiens
uauauccucuguauaaaaugagguuucaguacaaaaggaaccaugggugacccugcgauauc

SEQ ID NO: 495212 - RNA, 62 nt, Homo Sapiens
cgugauugguugguuuguagcacuaaggucuaaaaaggaaaaccauaaaagacaucagauua

SEQ ID NO: 495213 - RNA, 62 nt, Homo Sapiens
cagggaggaugggauuaguggaagcuuaauggaaaaggaaaguuaugauccuccaagacccu

SEQ ID NO: 495214 - RNA, 62 nt, Homo Sapiens
aagauaaauggguauguaggacaaaagggagaaaaaggaagccaaucucuuauacuaguggg

SEQ ID NO: 495215 - RNA, 62 nt, Homo Sapiens
auacgaagagucaucaacuuugcccauauggaaaaaggaaauugauacuuuaaaagccaagg

SEQ ID NO: 495216 - RNA, 62 nt, Homo Sapiens
guaaauguacccuaaugauuaaguccuacuaaaaaaggaacgcaguaucugccacugggaua

SEQ ID NO: 495217 - RNA, 62 nt, Homo Sapiens
cagacccucagacaccaaaauaggcuuuuuccaaaaggaagacaugaucuaaugcagaugac

SEQ ID NO: 495218 - RNA, 62 nt, Homo Sapiens
guaaaaauauuaaucgguuagagcuagcuuuaaaaaggaacacaggcaauauuccagcuaug

SEQ ID NO: 495219 - RNA, 62 nt, Homo Sapiens
ugaaaacaauggaaccaugcgaccuugucucgaaaaggaaucccagccggggugacagaaga

SEQ ID NO: 495220 - RNA, 62 nt, Homo Sapiens
uuuaggcuuucuuuguccuuccagaaaaaaggaaaaggaaagaugcugcuuccuauuggagc

SEQ ID NO: 495221 - RNA, 62 nt, Homo Sapiens
ggaaaguuuaggcuuucuuuuggagcccagaaaaaaggaaaauuguaaaugcugcuuccuau

SEQ ID NO: 495222 - RNA, 62 nt, Homo Sapiens
cuaaagaagacuaugauaccaaucucucuggaaaaaggaaaguaagaaccagaaaaauaauu

SEQ ID NO: 495223 - RNA, 62 nt, Homo Sapiens
gcagauuuugaaaucugacuaggugagggauuaaaaggaaagguaacuugaaggcagcacag

SEQ ID NO: 495224 - RNA, 62 nt, Homo Sapiens
agugacaucugauuggcagaugagcuuauuucaaaaggaaggguggcuuugcauuucuugug

SEQ ID NO: 495225 - RNA, 62 nt, Homo Sapiens
uuaggaauccuagcacuugucucaggacucugaaaaggaacggcuuccucauuccuugucuu

SEQ ID NO: 495226 - RNA, 62 nt, Homo Sapiens
agcauccuuaagauuuaaaaaaaaaaaaaaaaaaaaggaaaaaaaagugauggaagccguaa

SEQ ID NO: 495227 - RNA, 62 nt, Homo Sapiens
ucuugucuauuuuuucucuucauguuguaacaaaaaggaaaaaagaaaaaaaaaucccaucc

SEQ ID NO: 495228 - RNA, 61 nt, Homo Sapiens; identical to SEQ ID NO: 210573

SEQ ID NO: 495229 - RNA, 62 nt, Homo Sapiens
aaaaagucuguacuaauuucaauauggcucuuaaaaggaaugacagagaaauaggauacaag

SEQ ID NO: 495230 - RNA, 62 nt, Homo Sapiens
ccaaaggauuuaagaguuuuguuguuguuaauaaaaggaauacuccuuuuccuuuuggauca

SEQ ID NO: 495231 - RNA, 62 nt, Homo Sapiens
guuaguguaucaguaagaaacagaccuaguuuaaaaggaauaaucaacaauuuuauaaagga

SEQ ID NO: 495232 - RNA, 62 nt, Homo Sapiens
cccgucccuuaaaaagacaaaaaaaauaaggcaaaaggaaagcaacuaagacacuggacuau

SEQ ID NO: 495233 - RNA, 62 nt, Homo Sapiens
auaaauaccuggcaaaacuaaauaaauuaccaaaaaggaaaaaaaauccaccaaaccaugau

SEQ ID NO: 495234 - RNA, 62 nt, Homo Sapiens
gaggugccuccgaauuagaaaucagaauaaguaaaaggaacguucacucacaggguacgcuc

SEQ ID NO: 495235 - RNA, 62 nt, Homo Sapiens
aaaagaagagaaaaaauuaagaaaaaaaucaaaaaaggaagaaaacuaaaaaaaaaaaaaau

SEQ ID NO: 495236 - RNA, 62 nt, Homo Sapiens
agcaccuuuuaaaccugcugcacauuggacucaaaaggaaaacuggaccaacaauaauugag

SEQ ID NO: 495237 - RNA, 62 nt, Homo Sapiens
uuuggauuuuauuccaaaccuugcuguaauauaaaaggaaguuuacaagacaugauauugcu

SEQ ID NO: 495238 - RNA, 62 nt, Homo Sapiens
ucaccuguguggcccagauggcuccaacaagcaaaaggaaggaugcagugacucuugcugcc

SEQ ID NO: 495239 - RNA, 62 nt, Homo Sapiens
aguauguuauugaaaguuucuauuugguugauaaaaggaacaauuuuuucccacuuuugaug

SEQ ID NO: 495240 - RNA, 62 nt, Homo Sapiens
augucauugguauaugguggcuguuuaccaauaaaaggaaaaaauucauuaaccgguugcuu

SEQ ID NO: 495241 - RNA, 62 nt, Homo Sapiens
cuuccuugucucaugaaaaccuaaauauaaaaaaaaggaaaauacuggaguuuuuauuucuc

SEQ ID NO: 495242 - RNA, 62 nt, Homo Sapiens
agacaguuauuccauaaagcauuuguauaauuaaaaggaaaacagaaaaaggaaaaguaggc

SEQ ID NO: 495243 - RNA, 62 nt, Homo Sapiens
uaaagcauuuguauaauuaaaaggaaaacagaaaaaggaaaaguaggcaaaugugaaaauag

SEQ ID NO: 495244 - RNA, 62 nt, Homo Sapiens
aaacuaccuuuuuauaaugccugacuuaaaacaaaaggaaaguuuuaaaaaucuaccuguuc

SEQ ID NO: 495245 - RNA, 62 nt, Homo Sapiens
guugaggggggggcauuaguuuuucuauaagaaaaaggaaaagagguauuguaagcuuucca

SEQ ID NO: 495246 - RNA, 62 nt, Homo Sapiens
cuaaacagaaaccagaacuggaaaaaagaaaaaaaaggaagagaaaaauaauuuuaaguaaa

SEQ ID NO: 495247 - RNA, 62 nt, Homo Sapiens
auaauuuuaaguaaagaaaaggugaacuuucuaaaaggaaaagggaggggagcugguuuccu

SEQ ID NO: 495248 - RNA, 62 nt, Homo Sapiens
gagaggagagucuuacggagggcugggagcuuaaaaggaaaacaauguccuuacuuguaaac

SEQ ID NO: 495249 - RNA, 62 nt, Homo Sapiens
uuuaugauaccaaaaaaauuacaguuuuguuuaaaaggaaauguugauguuuucaacuccaa

SEQ ID NO: 495250 - RNA, 55 nt, Homo Sapiens; identical to SEQ ID NO: 210595

SEQ ID NO: 495251 - RNA, 62 nt, Homo Sapiens
cgucucgugaguccgacccagacauccaaacuaaaaggaagucauccagucuauucacagaa

SEQ ID NO: 495252 - RNA, 62 nt, Homo Sapiens
acauggcauuuucuagcuguguccuuauacauaaaaggaaaaagguagcucucucgagucuc

SEQ ID NO: 495253 - RNA, 62 nt, Homo Sapiens
uuuuauauacugaacugccauagaugcuggaaaaaaggaacugauguuuucagcauauuuuc

SEQ ID NO: 495254 - RNA, 62 nt, Homo Sapiens
uccuguuuuucccccuuugaaaaacucaggaaaaaaggaagauugaacuaauaaaauuuuau

SEQ ID NO: 495255 - RNA, 62 nt, Homo Sapiens
cacauacacauauauacuggaaccuauaguagaaaaggaaacuaguagggccaaaaaaaaaa

SEQ ID NO: 495256 - RNA, 62 nt, Homo Sapiens
guagaauaacuuagcucagcauuagagcucuaaaaaggaauacuuuuggauuaggguacaau

SEQ ID NO: 495257 - RNA, 62 nt, Homo Sapiens
guagacucacuuagcucagcuuagagcuuuuaaaaaggaaggcuuuugguuaggggacaaua

SEQ ID NO: 495258 - RNA, 62 nt, Homo Sapiens
gcagugccaaauaugagaggauuuaccuaauuaaaaggaaaggaugaagauuauaacuguuu

SEQ ID NO: 495259 - RNA, 62 nt, Homo Sapiens
gaacuacugggaaauuaugcuuaaggcucauuaaaaggaaaguuuuaauuagucaaacuaaa

SEQ ID NO: 495260 - RNA, 62 nt, Homo Sapiens
uagcucaacuugugauaaaaacucuauaaaggaaaaggaaugucaccccugccuuuuguuca

SEQ ID NO: 495261 - RNA, 62 nt, Homo Sapiens
ucauuuauauuaaagaauuuuguucuuauuguaaaaggaaagaaaaagugggaaggugaugc

SEQ ID NO: 495262 - RNA, 62 nt, Homo Sapiens
uaaugcuccucuuucaggguaauaaaguggggaaaaggaacgucuucucaaugcaagaacau

SEQ ID NO: 495263 - RNA, 62 nt, Homo Sapiens
caugagcuuguucagagugaggggcauagugaaaaaggaacagccaugccucaaaaucaaau

SEQ ID NO: 495264 - RNA, 62 nt, Homo Sapiens
caaggacuguuucagugugagucagaaugugaaaaaggaauaaaaaauacuguugggcucaa

SEQ ID NO: 495265 - RNA, 62 nt, Homo Sapiens
acauguauugacaacaguuuuauaauuuaauaaaaaggaauacauugcaauccguaauuuuc

SEQ ID NO: 495266 - RNA, 62 nt, Homo Sapiens
gguuugaggggcuggggagugggaggggggagaaaaggaauguauuuaaacaauuuccgaug

SEQ ID NO: 495267 - RNA, 62 nt, Homo Sapiens
caagaaauuuaaagaaucaaaacgaugguuugaaaaggaaaccuaugauacaugcaggagaa

SEQ ID NO: 495268 - RNA, 62 nt, Homo Sapiens
uuuaagaacuauuuuaaaguguuccagacccaaaaaggaaaaauaaaaaaaaaggaauauuu

SEQ ID NO: 495269 - RNA, 62 nt, Homo Sapiens
aguguuccagacccaaaaaggaaaaauaaaaaaaaaggaauauuuguacccaacagcuagaa

SEQ ID NO: 495270 - RNA, 62 nt, Homo Sapiens
aaacaguuugaacacaaaggggaaaaaaagaaaaaaggaaaaaagaaaaaaugaaaaaaaaa

SEQ ID NO: 495271 - RNA, 62 nt, Homo Sapiens
aaagaaaaaaggaaaaaaacaaaaaugaaaaaaaaaggaaaauuugaaaucuuaaaaaaaga

SEQ ID NO: 495272 - RNA, 62 nt, Homo Sapiens
gaggaagacuggacaaaacauuuaaauaaaaaaaaaggaaaaauaguuuaagaaauuuuuuu

SEQ ID NO: 495273 - RNA, 62 nt, Homo Sapiens
caaaauuauguggugugaaaguuaaguuacauaaaaggaaaaugcauccuucuugcuuauac

SEQ ID NO: 495274 - RNA, 62 nt, Homo Sapiens
ucuuauaguugucuuuugugaaaaaagaaacaaaaaggaacuaaauaaaagggaaaaaaaag

SEQ ID NO: 495275 - RNA, 62 nt, Homo Sapiens
augucgucuacugcagucuauuauaaaaaggaaaaaggaagauuucauugagaauuaugaug

SEQ ID NO: 495276 - RNA, 62 nt, Homo Sapiens
aggaagaaugucgucuacuguaugauguuauaaaaaggaaaacaaagcauuucauugagaau

SEQ ID NO: 495277 - RNA, 62 nt, Homo Sapiens
ggaaggagaaauuaauugagggcagagcauggaaaaggaauauucaauuucugagaaaauga

SEQ ID NO: 495278 - RNA, 62 nt, Homo Sapiens
auuauaauaauauaaaugacuuccuucuccaaaaaaggaaaauggaggaagaaaaacugucc

SEQ ID NO: 495279 - RNA, 62 nt, Homo Sapiens
ccaaaacauauauacagauuguuggcauuugcaaaaggaagcaucaauaguggacccagagg

SEQ ID NO: 495280 - RNA, 62 nt, Homo Sapiens
ugcaugcacuaauaaaacugguuguuuaauuuaaaaggaauauauaagacuuuacccauguu

SEQ ID NO: 495281 - RNA, 62 nt, Homo Sapiens
caaaacaaacuuguucuuugauucuaaauuuaaaaaggaaaagcuaauguguuguaaacaag

SEQ ID NO: 495282 - RNA, 62 nt, Homo Sapiens
uaugcuggucaucacaggaaugaaaauuccucaaaaggaaauauccugaggcugaugaauug

SEQ ID NO: 495283 - RNA, 62 nt, Homo Sapiens
aucaccuacuuucaugcagguguauaaucuugaaaaggaaaaaugcuuccauguugaagcca

SEQ ID NO: 495284 - RNA, 62 nt, Homo Sapiens
aaacuuuccaaacuuuugcaugagaaacuagaaaaaggaauguaugccacguaacuggauua

SEQ ID NO: 495285 - RNA, 62 nt, Homo Sapiens
ugugagguuuauacuauuucugguuuuuaaccaaaaggaaaucaucuggaagcaggaggcaa

SEQ ID NO: 495286 - RNA, 62 nt, Homo Sapiens
aaagguugacauauuccaaaacccuucuuuuuaaaaggaaaaaggauggagagaaggaugga

SEQ ID NO: 495287 - RNA, 62 nt, Homo Sapiens
ugaauaagaugauagacgagaauuuuuuuuaaaaaaggaauuuaaaggaaucuugugcaacu

SEQ ID NO: 495288 - RNA, 62 nt, Homo Sapiens
agguguugccuauugcugugcuuauaaaaugaaaaaggaaauugaggacacuuuugcaaaug

SEQ ID NO: 495289 - RNA, 61 nt, Homo Sapiens
guggcaagauuccaucagcuuaaagucuauucaaaaggaaauuuuucacuuugcucucaau

SEQ ID NO: 495290 - RNA, 62 nt, Homo Sapiens
uucaguugaucuucuucaucuccuccucacuaaaaaggaaacuuucaagucugacucuccac

SEQ ID NO: 495291 - RNA, 62 nt, Homo Sapiens
uaaaagauauugaggucuucuuuuuuaaauuaaaaaggaaaauaucuggggaaaaaaaacuu

SEQ ID NO: 495292 - RNA, 62 nt, Homo Sapiens
gagauuucaccaaccccaguuauaaaaccaaaaaaaggaauuuguuucuaaacuuucgcuac

SEQ ID NO: 495293 - RNA, 62 nt, Homo Sapiens
ggaaagaaugaggaaggaccaucucauaaacaaaaaggaagaccacagcagaagagccauuc

SEQ ID NO: 495294 - RNA, 62 nt, Homo Sapiens
caccacugaugccucccacuauuucacagucgaaaaggaagcggcugaccagcuggcccagg

SEQ ID NO: 495295 - RNA, 62 nt, Homo Sapiens
uuuuguuuucauaaagaggaaguuuuauaaagaaaaggaauacuugauaaauuugccuauaa

SEQ ID NO: 495296 - RNA, 62 nt, Homo Sapiens
aaguuuuuuuccuuaaaaaaaguuccuaggaaaaaaggaauagucacuaaaguauccugaca

SEQ ID NO: 495297 - RNA, 62 nt, Homo Sapiens
cagauuucuucagugacuuugccuugaaaguuaaaaggaaagagaacuacauuuuucuuauu

SEQ ID NO: 495298 - RNA, 62 nt, Homo Sapiens
auaugguuuccagagaaaagguugauuauuaaaaaaggaaaauuucuuacauauacaucuua

SEQ ID NO: 495299 - RNA, 62 nt, Homo Sapiens
uaucuagggucuguaaccguuuugguuugagaaaaaggaaaggccccuugucacauccucua

SEQ ID NO: 495300 - RNA, 62 nt, Homo Sapiens
cauauuuuagugggagccagacuauaaggaauaaaaggaaaaacuuucuuccucucucucca

SEQ ID NO: 495301 - RNA, 62 nt, Homo Sapiens
uacuauauacagccaguaaauacaugcuuaacaaaaggaaugagccugaaguucauaaagaa

SEQ ID NO: 495302 - RNA, 62 nt, Homo Sapiens
aguucauaaagaauacauaucaauauucuuauaaaaggaauauaugaagauggcuuugauac

SEQ ID NO: 495303 - RNA, 62 nt, Homo Sapiens
gaaacuucagccuuucuaagugaaaacauuuaaaaaggaagaauaguggauaauagacaaag

SEQ ID NO: 495304 - RNA, 62 nt, Homo Sapiens
aacuagcaaaaagaauagccaagaaaaaagugaaaaggaaacgaaaaaagauaaaguagaaa

SEQ ID NO: 495305 - RNA, 62 nt, Homo Sapiens
caguaguuaaggauaccugaaagauaguuucuaaaaggaaauauuaugaaaaucuaacacuc

SEQ ID NO: 495306 - RNA, 62 nt, Homo Sapiens
uuuauuuucaaaaaccuaaugaccauuuuccaaaaaggaaaccuaagacauuucugaaugua

SEQ ID NO: 495307 - RNA, 62 nt, Homo Sapiens
ugaggccagguauggggugugaaugaagauaaaaaaggaauuuuaauauuuguucaaguaga

SEQ ID NO: 495308 - RNA, 62 nt, Homo Sapiens
uggagugaauaucaucuuuguauaguuugccuaaaaggaaguaauaucaaaaauugcuauug

SEQ ID NO: 495309 - RNA, 62 nt, Homo Sapiens
gagaaaaaucacgacuacugacugauauuuaaaaaaggaaaguguuuguuuuugugugguaa

SEQ ID NO: 495310 - RNA, 62 nt, Homo Sapiens
acugucuugaacaagaugaaauacccuaucccaaaaggaagagaguagcaacagcuggucau

SEQ ID NO: 495311 - RNA, 62 nt, Homo Sapiens
guucuauucauaaucagggugacaaguuauuaaaaaggaaagcauuggaauuuauauuaaaa

SEQ ID NO: 495312 - RNA, 62 nt, Homo Sapiens
gaauaaguauucuugcaucuugucuucuauuuaaaaggaaaacuuucauaaauuuuauggca

SEQ ID NO: 495313 - RNA, 62 nt, Homo Sapiens
ugauugucaggggaaaaacugcuuaagugggaaaaaggaagacacuuuucauucacuugaaa

SEQ ID NO: 495314 - RNA, 62 nt, Homo Sapiens
uuuuaaaacauuaagcaacauggaugguauucaaaaggaauugaaacaaggacaauuugugu

SEQ ID NO: 495315 - RNA, 62 nt, Homo Sapiens
uucaauuauuagcuuuguuucacauuuuagaaaaaaggaaccauuugcaaauugcaauaaaa

SEQ ID NO: 495316 - RNA, 62 nt, Homo Sapiens
aggcacugcuccuauuuucccacaguuuacaaaaaaggaaaaccacucgcuuggauuucuga

SEQ ID NO: 495317 - RNA, 62 nt, Homo Sapiens
caauuggcagccucucacuacucuuucuggcuaaaaggaaucuaaucuuguugaggguagag

SEQ ID NO: 495318 - RNA, 62 nt, Homo Sapiens
gcagaacagccagagggggcaggaggggaccaaaaaggaaaaugaggacgugcagcagcauu

SEQ ID NO: 495319 - RNA, 62 nt, Homo Sapiens
aaacuaauuuagucaucagagauacuuuccuaaaaaggaaaaauaaaaaacaaaauggugcc

SEQ ID NO: 495320 - RNA, 62 nt, Homo Sapiens
ugggaaauauuaugacaguugacuuuaagaucaaaaggaagggaagaccugaaagucauuug

SEQ ID NO: 495321 - RNA, 62 nt, Homo Sapiens
ggggacagauucgcagcacaguuugugguauaaaaaggaaguaagaccagauccuuagagaa

SEQ ID NO: 495322 - RNA, 62 nt, Homo Sapiens
gcaaguaaccaccuggguuagaagaugcaaguaaaaggaaauacuucucuuccucccucaug

SEQ ID NO: 495323 - RNA, 62 nt, Homo Sapiens
uauuuucuuauuucacuuuuacaccuaucuuuaaaaggaauuuaaauuuuguuuauauacau

SEQ ID NO: 495324 - RNA, 62 nt, Homo Sapiens
uacauuaacuaaaucaguacaaguuuggggugaaaaggaaauuuuuaauccaucucaaaugu

SEQ ID NO: 495325 - RNA, 62 nt, Homo Sapiens; identical to SEQ ID NO: 210670

SEQ ID NO: 495326 - RNA, 62 nt, Homo Sapiens
uaagucaagugcaaggacuuaacuugcguuugaaaaggaauuagagggucagaaacacccag

SEQ ID NO: 495327 - RNA, 62 nt, Homo Sapiens
cccgcuuagccuuuacauuccucuccaccgacaaaaggaaggggaaacucaaucagcaggac

SEQ ID NO: 495328 - RNA, 62 nt, Homo Sapiens
acauucacugcacacguguacagcggaguacgaaaaggaacguuguccacaggggauuuaug

SEQ ID NO: 495329 - RNA, 62 nt, Homo Sapiens
aauggugggaaggaaaaguaauccuguaguuuaaaaggaagauaaaacauuuuaaaauauaa

SEQ ID NO: 495330 - RNA, 62 nt, Homo Sapiens
uuaguagacaguauuauauuuuaguugaaacaaaaaggaauuacuaauauaugugagaguac

SEQ ID NO: 495331 - RNA, 62 nt, Homo Sapiens
ucugcaugcuauuuuaaucuaaaggaaacaauaaaaggaaugccacagacacaguuaaagca

SEQ ID NO: 495332 - RNA, 62 nt, Homo Sapiens
aauaaaaggaaugucugcaucacaguuaaagcaaaaggaaacgcacuuaaaaauaccacaga

SEQ ID NO: 495333 - RNA, 62 nt, Homo Sapiens
aaugugucaugcuuuuuaaagccaucucaaguaaaaggaauagguaccuugaaaauccaaaa

SEQ ID NO: 495334 - RNA, 62 nt, Homo Sapiens
ucauuuggagaugugaagauggaauuucacuuaaaaggaagguugcuaugcagacagggaag

SEQ ID NO: 495335 - RNA, 62 nt, Homo Sapiens
auuacccccccacuaugcccucauuuuuuuaaaaaaggaaaaaaaaaagaaacuggguucca

SEQ ID NO: 495336 - RNA, 62 nt, Homo Sapiens
aauaaaaaaauaaauaaaaauaaaaaaaauaaaaaaggaaaaaaaaaaaagaagaaacaaga

SEQ ID NO: 495337 - RNA, 62 nt, Homo Sapiens
ccugcucacacuccagaauuaaauucuauugaaaaaggaaaaucagcaauucagcaaaaaau

SEQ ID NO: 495338 - RNA, 62 nt, Homo Sapiens
uaaugacagauguucuguuuuuauaaccuaccaaaaggaaacuagaggcuucuuggugaaga

SEQ ID NO: 495339 - RNA, 62 nt, Homo Sapiens
aauccuucccuagagcuaguauacgcuguuuaaaaaggaaaaccauccuaggcaacagagug

SEQ ID NO: 495340 - RNA, 62 nt, Homo Sapiens
uaggagaagguggaaaugggacagaaggaaaaaaaaggaaaacagagugagacuccaucuca

SEQ ID NO: 495341 - RNA, 62 nt, Homo Sapiens
aaaucaaggaaagaaugaguuugaaugugaacaaaaggaagaacaaaguccaaaagucacuu

SEQ ID NO: 495342 - RNA, 62 nt, Homo Sapiens
uaacucuccugaacaucuaaauaauuuugcaaaaaaggaaaauuuuacagaugcaaacagcu

SEQ ID NO: 495343 - RNA, 62 nt, Homo Sapiens
uuaauguccguuguaucacauuuuuucuuuuuaaaaggaaguagggagagcuaccaaauugu

SEQ ID NO: 495344 - RNA, 62 nt, Homo Sapiens
gagguucagaaugauuaaggccuuuuuuaaaaaaaaggaacuagcuuguucuuguauuguga

SEQ ID NO: 495345 - RNA, 62 nt, Homo Sapiens
aagaaaagauuuuugcagaauuaacagaagggaaaaggaaagaaaagaaaggacauugaguu

SEQ ID NO: 495346 - RNA, 62 nt, Homo Sapiens
aaaaaaaagaaaggacauuggugccuggagcaaaaaggaaaaugagcagaacaaaucgucag

SEQ ID NO: 495347 - RNA, 62 nt, Homo Sapiens
uggcucuuuuuuuaaaagaugcgcucuaccugaaaaggaaauuggauuuuagaacuggaugu

SEQ ID NO: 495348 - RNA, 62 nt, Homo Sapiens
auaaaaccucuugcuugugugcaaaaguuccuaaaaggaaacacaaguaaugccuauccauu

SEQ ID NO: 495349 - RNA, 62 nt, Homo Sapiens
cgacagccccaaucuucccgucuuuaugagagaaaaggaaaaaggaaucaaagguggaagaa

SEQ ID NO: 495350 - RNA, 62 nt, Homo Sapiens
cccaaucuucccgucuuuaugagagaaaaggaaaaaggaaucaaagguggaagaaaaaaaaa

SEQ ID NO: 495351 - RNA, 62 nt, Homo Sapiens
uggcaaaaacagccuucuagaacccuuaccaaaaaaggaaguagugucuuaauguggaaguu

SEQ ID NO: 495352 - RNA, 62 nt, Homo Sapiens
uaaacaggaucucaaacuuggccagguuuuucaaaaggaauauuucuuuugcauggacaugg

SEQ ID NO: 495353 - RNA, 62 nt, Homo Sapiens
cuucauuuucucaagaaaugaacauucuuccuaaaaggaagacaugguaagccuuagcagca

SEQ ID NO: 495354 - RNA, 62 nt, Homo Sapiens
acgaguaauuuauaaaauugagaaacacuaacaaaaggaacauuuuuguauauuguugagaa

SEQ ID NO: 495355 - RNA, 62 nt, Homo Sapiens
ugagaccgaaaacuuaggguaucuaucaaaggaaaaggaaacuguucauacagugaauaaag

SEQ ID NO: 495356 - RNA, 62 nt, Homo Sapiens
auucaaaagacuuaggacaacugcucucuuucaaaaggaauaugauuuuuccccccuaauau

SEQ ID NO: 495357 - RNA, 62 nt, Homo Sapiens
ccauccauacaauggaguauuacacagccauaaaaaggaaugaagcagugauccccacuaca

SEQ ID NO: 495358 - RNA, 62 nt, Homo Sapiens
cuagauucucucucucaaaaaaaaaaaaaaaaaaaaggaaagaaagaaagaaaagaaaagaa

SEQ ID NO: 495359 - RNA, 62 nt, Homo Sapiens
ucagacuaggaacaaguugauaccaaaaccugaaaaggaaacuacagaaugggaaagucaua

SEQ ID NO: 495360 - RNA, 62 nt, Homo Sapiens
aaaacucaaucaauguaauucaguauuuuaacaaaaggaaugaaaaauuaucaucucaauag

SEQ ID NO: 495361 - RNA, 62 nt, Homo Sapiens
aacaaaauaaaaccaacccauuuccgucaagaaaaaggaaacguugagggaaugaauaagua

SEQ ID NO: 495362 - RNA, 62 nt, Homo Sapiens
ucuguagacauaauaaaugugugaauucacguaaaaggaagauauuauugucauuaguauua

SEQ ID NO: 495363 - RNA, 62 nt, Homo Sapiens
agggacuacaucguuggcuuuugaccuugcugaaaaggaacauauaauuguauggaugguag

SEQ ID NO: 495364 - RNA, 62 nt, Homo Sapiens
ucauauguucuaaaaugacuagcaaugguuuaaaaaggaagaagaguggaagugaagaaggu

SEQ ID NO: 495365 - RNA, 62 nt, Homo Sapiens
aaggcauaaaaugaccuucuuuaucacugcuaaaaaggaaaaauuaauagguugcuaauuau

SEQ ID NO: 495366 - RNA, 62 nt, Homo Sapiens
acagaacaugcaaaaggccuauucaggagaacaaaaggaaacuagaugaggacaugagaaua

SEQ ID NO: 495367 - RNA, 62 nt, Homo Sapiens
gccucaaagcaaaggcaagccuuuagagguucaaaaggaaguugaucaaggaagggcuguca

SEQ ID NO: 495368 - RNA, 62 nt, Homo Sapiens
ucaggcaaagggauccauauauaaaaaggaaaaaaaggaaacccugcugggucuuaacaagc

SEQ ID NO: 495369 - RNA, 62 nt, Homo Sapiens
aaaggaaacucaggcaaagguuaacaagcauaaaaaggaaaaacguccauuccugcuggguc

SEQ ID NO: 495370 - RNA, 62 nt, Homo Sapiens
uuugaggaaaaaagccuucucaaaguaagccuaaaaggaaucuaauuggagauccugaacac

SEQ ID NO: 495371 - RNA, 62 nt, Homo Sapiens
aacaccuuuacauugcucaauguuguguugguaaaaggaaucauggaucacagaccugaauc

SEQ ID NO: 495372 - RNA, 62 nt, Homo Sapiens
uuccacugaaacauuuggaugcucauguuuggaaaaggaaucauuaaaaacccaaagaacca

SEQ ID NO: 495373 - RNA, 62 nt, Homo Sapiens
cuccaucaaagaggaccccccaagacuuggagaaaaggaaagcuuuuccucaggaaauucgg

SEQ ID NO: 495374 - RNA, 62 nt, Homo Sapiens
uuaagcauaugugcuuucgcagcugauaauauaaaaggaaaucccacagucuagauauagcc

SEQ ID NO: 495375 - RNA, 62 nt, Homo Sapiens
uauuaugagugggggacuggugacuuuauaugaaaaggaaggaagagugaccuaagcuagca

SEQ ID NO: 495376 - RNA, 62 nt, Homo Sapiens
cuguuacagaaaagacaagaagaacauaagagaaaaggaaacaagaacauaagaacucaagg

SEQ ID NO: 495377 - RNA, 62 nt, Homo Sapiens
ccugaugaagaaaaggagaguauggauuuagaaaaaggaacaugaaaaaaaaaaacagucaa

SEQ ID NO: 495378 - RNA, 62 nt, Homo Sapiens
agaguuaugaagauacagaucaguccaagcauaaaaggaaaaaagaaaggccagagaaagag

SEQ ID NO: 495379 - RNA, 62 nt, Homo Sapiens
uaaaaacuguggcugaccaauucauagaaaugaaaaggaaaaaaagucaacugaaucuuuua

SEQ ID NO: 495380 - RNA, 62 nt, Homo Sapiens
cuguauuuucuauuagccauaacucucuuaugaaaaggaacuaaauacuguuucuucuaucc

SEQ ID NO: 495381 - RNA, 62 nt, Homo Sapiens
acgggagaaauccacguaacuuaagucuguggaaaaggaagcuccuuacguccugagccggu

SEQ ID NO: 495382 - RNA, 62 nt, Homo Sapiens
agauuugagaagugagagagcuagaagguggaaaaaggaaagccauccacugucuuugacac

SEQ ID NO: 495383 - RNA, 64 nt, Homo Sapiens; identical to SEQ ID NO: 212638

SEQ ID NO: 495384 - RNA, 64 nt, Homo Sapiens; identical to SEQ ID NO: 212639

SEQ ID NO: 495385 - RNA, 64 nt, Homo Sapiens; identical to SEQ ID NO: 212640

SEQ ID NO: 495386 - RNA, 64 nt, Homo Sapiens; identical to SEQ ID NO: 212641

SEQ ID NO: 495387 - RNA, 64 nt, Homo Sapiens; identical to SEQ ID NO: 212642

SEQ ID NO: 495388 - RNA, 64 nt, Homo Sapiens; identical to SEQ ID NO: 212643

SEQ ID NO: 495389 - RNA, 64 nt, Homo Sapiens; identical to SEQ ID NO: 212644

SEQ ID NO: 495390 - RNA, 64 nt, Homo Sapiens; identical to SEQ ID NO: 212645

SEQ ID NO: 495391 - RNA, 64 nt, Homo Sapiens; identical to SEQ ID NO: 212646

SEQ ID NO: 495392 - RNA, 64 nt, Homo Sapiens; identical to SEQ ID NO: 212647

SEQ ID NO: 495393 - RNA, 64 nt, Homo Sapiens; identical to SEQ ID NO: 212648

SEQ ID NO: 495394 - RNA, 64 nt, Homo Sapiens; identical to SEQ ID NO: 212649

SEQ ID NO: 495395 - RNA, 64 nt, Homo Sapiens; identical to SEQ ID NO: 212650

SEQ ID NO: 495396 - RNA, 64 nt, Homo Sapiens; identical to SEQ ID NO: 212651

SEQ ID NO: 495397 - RNA, 64 nt, Homo Sapiens; identical to SEQ ID NO: 212652

SEQ ID NO: 495398 - RNA, 64 nt, Homo Sapiens; identical to SEQ ID NO: 212653

SEQ ID NO: 495399 - RNA, 64 nt, Homo Sapiens; identical to SEQ ID NO: 212654

SEQ ID NO: 495400 - RNA, 64 nt, Homo Sapiens; identical to SEQ ID NO: 212655

SEQ ID NO: 495401 - RNA, 64 nt, Homo Sapiens; identical to SEQ ID NO: 212656

SEQ ID NO: 495402 - RNA, 64 nt, Homo Sapiens; identical to SEQ ID NO: 212657

SEQ ID NO: 495403 - RNA, 64 nt, Homo Sapiens; identical to SEQ ID NO: 212658

SEQ ID NO: 495404 - RNA, 64 nt, Homo Sapiens; identical to SEQ ID NO: 212659

SEQ ID NO: 495405 - RNA, 64 nt, Homo Sapiens; identical to SEQ ID NO: 212660

SEQ ID NO: 495406 - RNA, 64 nt, Homo Sapiens; identical to SEQ ID NO: 212661

SEQ ID NO: 495407 - RNA, 64 nt, Homo Sapiens; identical to SEQ ID NO: 212662

SEQ ID NO: 495408 - RNA, 64 nt, Homo Sapiens; identical to SEQ ID NO: 212663

SEQ ID NO: 495409 - RNA, 64 nt, Homo Sapiens; identical to SEQ ID NO: 212664

SEQ ID NO: 495410 - RNA, 64 nt, Homo Sapiens; identical to SEQ ID NO: 212665

SEQ ID NO: 495411 - RNA, 64 nt, Homo Sapiens; identical to SEQ ID NO: 212666

SEQ ID NO: 495412 - RNA, 62 nt, Homo Sapiens; identical to SEQ ID NO: 212667

SEQ ID NO: 495413 - RNA, 64 nt, Homo Sapiens; identical to SEQ ID NO: 212668

SEQ ID NO: 495414 - RNA, 64 nt, Homo Sapiens; identical to SEQ ID NO: 212669

SEQ ID NO: 495415 - RNA, 64 nt, Homo Sapiens; identical to SEQ ID NO: 212670

SEQ ID NO: 495416 - RNA, 64 nt, Homo Sapiens; identical to SEQ ID NO: 212671

SEQ ID NO: 495417 - RNA, 64 nt, Homo Sapiens; identical to SEQ ID NO: 212672

SEQ ID NO: 495418 - RNA, 64 nt, Homo Sapiens; identical to SEQ ID NO: 212673

SEQ ID NO: 495419 - RNA, 64 nt, Homo Sapiens; identical to SEQ ID NO: 212674

SEQ ID NO: 495420 - RNA, 64 nt, Homo Sapiens; identical to SEQ ID NO: 212675

SEQ ID NO: 495421 - RNA, 64 nt, Homo Sapiens; identical to SEQ ID NO: 212676

SEQ ID NO: 495422 - RNA, 64 nt, Homo Sapiens; identical to SEQ ID NO: 212677

SEQ ID NO: 495423 - RNA, 64 nt, Homo Sapiens; identical to SEQ ID NO: 212678

SEQ ID NO: 495424 - RNA, 64 nt, Homo Sapiens; identical to SEQ ID NO: 212679

SEQ ID NO: 495425 - RNA, 64 nt, Homo Sapiens; identical to SEQ ID NO: 53018

SEQ ID NO: 495426 - RNA, 64 nt, Homo Sapiens; identical to SEQ ID NO: 53019

SEQ ID NO: 495427 - RNA, 64 nt, Homo Sapiens; identical to SEQ ID NO: 53020

SEQ ID NO: 495428 - RNA, 64 nt, Homo Sapiens; identical to SEQ ID NO: 53021

SEQ ID NO: 495429 - RNA, 64 nt, Homo Sapiens; identical to SEQ ID NO: 53022

SEQ ID NO: 495430 - RNA, 64 nt, Homo Sapiens; identical to SEQ ID NO: 53023

SEQ ID NO: 495431 - RNA, 64 nt, Homo Sapiens; identical to SEQ ID NO: 53024

SEQ ID NO: 495432 - RNA, 64 nt, Homo Sapiens; identical to SEQ ID NO: 53025

SEQ ID NO: 495433 - RNA, 64 nt, Homo Sapiens; identical to SEQ ID NO: 53026

SEQ ID NO: 495434 - RNA, 64 nt, Homo Sapiens; identical to SEQ ID NO: 53027

SEQ ID NO: 495435 - RNA, 64 nt, Homo Sapiens; identical to SEQ ID NO: 53028

SEQ ID NO: 495436 - RNA, 64 nt, Homo Sapiens; identical to SEQ ID NO: 53029

SEQ ID NO: 495437 - RNA, 64 nt, Homo Sapiens; identical to SEQ ID NO: 53030

SEQ ID NO: 495438 - RNA, 64 nt, Homo Sapiens; identical to SEQ ID NO: 53031

SEQ ID NO: 495439 - RNA, 64 nt, Homo Sapiens; identical to SEQ ID NO: 53032

SEQ ID NO: 495440 - RNA, 64 nt, Homo Sapiens; identical to SEQ ID NO: 53033

SEQ ID NO: 495441 - RNA, 64 nt, Homo Sapiens; identical to SEQ ID NO: 53034

SEQ ID NO: 495442 - RNA, 64 nt, Homo Sapiens; identical to SEQ ID NO: 53035

SEQ ID NO: 495443 - RNA, 64 nt, Homo Sapiens; identical to SEQ ID NO: 53036

SEQ ID NO: 495444 - RNA, 64 nt, Homo Sapiens; identical to SEQ ID NO: 53037

SEQ ID NO: 495445 - RNA, 64 nt, Homo Sapiens; identical to SEQ ID NO: 53038

SEQ ID NO: 495446 - RNA, 64 nt, Homo Sapiens; identical to SEQ ID NO: 53039

SEQ ID NO: 495447 - RNA, 64 nt, Homo Sapiens; identical to SEQ ID NO: 53040

SEQ ID NO: 495448 - RNA, 64 nt, Homo Sapiens; identical to SEQ ID NO: 53041

SEQ ID NO: 495449 - RNA, 64 nt, Homo Sapiens; identical to SEQ ID NO: 53042

SEQ ID NO: 495450 - RNA, 64 nt, Homo Sapiens; identical to SEQ ID NO: 53043

SEQ ID NO: 495451 - RNA, 64 nt, Homo Sapiens; identical to SEQ ID NO: 53044

SEQ ID NO: 495452 - RNA, 64 nt, Homo Sapiens; identical to SEQ ID NO: 53045

SEQ ID NO: 495453 - RNA, 64 nt, Homo Sapiens; identical to SEQ ID NO: 53046

SEQ ID NO: 495454 - RNA, 64 nt, Homo Sapiens; identical to SEQ ID NO: 53047

SEQ ID NO: 495455 - RNA, 64 nt, Homo Sapiens; identical to SEQ ID NO: 53048

SEQ ID NO: 495456 - RNA, 64 nt, Homo Sapiens; identical to SEQ ID NO: 53049

SEQ ID NO: 495457 - RNA, 64 nt, Homo Sapiens; identical to SEQ ID NO: 53050

SEQ ID NO: 495458 - RNA, 64 nt, Homo Sapiens; identical to SEQ ID NO: 53051

SEQ ID NO: 495459 - RNA, 64 nt, Homo Sapiens; identical to SEQ ID NO: 53052

SEQ ID NO: 495460 - RNA, 64 nt, Homo Sapiens; identical to SEQ ID NO: 53053

SEQ ID NO: 495461 - RNA, 64 nt, Homo Sapiens; identical to SEQ ID NO: 53054

SEQ ID NO: 495462 - RNA, 64 nt, Homo Sapiens; identical to SEQ ID NO: 53055

SEQ ID NO: 495463 - RNA, 64 nt, Homo Sapiens; identical to SEQ ID NO: 53056

SEQ ID NO: 495464 - RNA, 64 nt, Homo Sapiens; identical to SEQ ID NO: 53057

SEQ ID NO: 495465 - RNA, 64 nt, Homo Sapiens; identical to SEQ ID NO: 53058

SEQ ID NO: 495466 - RNA, 64 nt, Homo Sapiens; identical to SEQ ID NO: 53059

SEQ ID NO: 495467 - RNA, 64 nt, Homo Sapiens
uaaaauguuagaggaaacuuucacaugaauaauuuuugucaaauuuuaucaugguauaauuugu

SEQ ID NO: 495468 - RNA, 64 nt, Homo Sapiens
aaaaauaaaaagaaauuacaaaagaaauuauggauuugucaauguaaguauuugucauaucuga

SEQ ID NO: 495469 - RNA, 64 nt, Homo Sapiens
guagaucaguuaauaaacaugccccuaucuuuguuuugucaaauuuugucaaacagcucuuugu

SEQ ID NO: 495470 - RNA, 64 nt, Homo Sapiens
agcucuuugugccccuaucuaccugggauuugacuuugucaaacggggaauacuauuguucgau

SEQ ID NO: 495471 - RNA, 64 nt, Homo Sapiens
uuugugaaauagugguugugacuuuuauuaaaguuuugucaaucuuaagaugucuguaaauuua

SEQ ID NO: 495472 - RNA, 64 nt, Homo Sapiens
gcauaaauauaucauucauaucacacaugucaucuuugucaaggcuuucuuagucacaacaaaa

SEQ ID NO: 495473 - RNA, 64 nt, Homo Sapiens
aaacugcuggaaguucuuccacagucaggucaauuuugucaaacccuucucuguacccauacag

SEQ ID NO: 495474 - RNA, 64 nt, Homo Sapiens
uguuccaauacucguuuugccucuauuuuucuuguuugucaaauaguaaaugauauuugcccuu

SEQ ID NO: 495475 - RNA, 64 nt, Homo Sapiens
cugccagugguaauacgauuuuuuaagaaggcaguuugucaauuuuaaucuuguggauaccuuu

SEQ ID NO: 495476 - RNA, 64 nt, Homo Sapiens
uaacuguuguugaacguuauucacaaaauaaguuuuugucaaaaaaauguuuucacuguaggaa

SEQ ID NO: 495477 - RNA, 64 nt, Homo Sapiens
agcauguuucccauucacagguugaucauagcuuuuugucaaguauauguacagaagaaaaaaa

SEQ ID NO: 495478 - RNA, 64 nt, Homo Sapiens
acaguuucuuuuuucuuacuaaaaugagcucgcauuugucaaugggagauuucuuguugcucaa

SEQ ID NO: 495479 - RNA, 64 nt, Homo Sapiens
uguagaaaugaugauguggacuguguauucuaguuuugucaaacgauauuccccccacuuaaga

SEQ ID NO: 495480 - RNA, 64 nt, Homo Sapiens
aagcugaaaacuuuuguaaauauguuugccauaauuugucaauaggaaaccacaauuugucaaa

SEQ ID NO: 495481 - RNA, 64 nt, Homo Sapiens
auguuugccauaauuugucaauaggaaaccacaauuugucaaauccauguguaagcuucucuaa

SEQ ID NO: 495482 - RNA, 64 nt, Homo Sapiens
uguuaaaacauaaacacauuuccauucauggauauuugucaacagauuuaaagaaaaccacagu

SEQ ID NO: 495483 - RNA, 64 nt, Homo Sapiens
ucucagguucaaggcuacaacaaaaaucaccaucuuugucaaacuuuggagagggaaaaucuuc

SEQ ID NO: 495484 - RNA, 64 nt, Homo Sapiens
cuaagguaaccauuuggaccggccgcuggcugccuuugucaaaacucgucggaguugggcaagg

SEQ ID NO: 495485 - RNA, 64 nt, Homo Sapiens
aucgaggggcacaggagauuagaggauggacaaguuugucaagaccucgugggagaccugcgcc

SEQ ID NO: 495486 - RNA, 64 nt, Homo Sapiens
guacaaaauguaaaauguauaagucaucucacuuuuugucaagacauuaaaccaucuuagaucg

SEQ ID NO: 495487 - RNA, 64 nt, Homo Sapiens
aaaaaguuacauggagcuuuacaucuuaacuuucuuugucaauuuaaaugcaauguauaaaaag

SEQ ID NO: 495488 - RNA, 64 nt, Homo Sapiens
caaagacacaggaagaaugguggaagauuagagguuugucaacagguuugucaacacaaagaca

SEQ ID NO: 495489 - RNA, 64 nt, Homo Sapiens
caaagacauggaagauuagacauggaagguuagguuugucaacagagguuugucaacaaaaaga

SEQ ID NO: 495490 - RNA, 64 nt, Homo Sapiens
aaaagacauggaagguuagguggaagguuagagguuugucaacagguuugucaacacaaagaca

SEQ ID NO: 495491 - RNA, 64 nt, Homo Sapiens
caaagacauggaagguuagacacccauggagagguuugucaacaugggauagggucagaugcac

SEQ ID NO: 495492 - RNA, 64 nt, Homo Sapiens
aguaaugauuucuugauaauucugaagauuuccauuugucaaaauuuuuagacagcaaaaacua

SEQ ID NO: 495493 - RNA, 64 nt, Homo Sapiens
ucagcacaaucuguaaauuuuaaggauacacuuauuugucaagcuaauuuauauuccauuuaca

SEQ ID NO: 495494 - RNA, 64 nt, Homo Sapiens
agcaggacuucagaaagggccuuguguuuauagcuuugucaaguaaauuuggacgcagcuggag

SEQ ID NO: 495495 - RNA, 64 nt, Homo Sapiens
cauaugcacacacaugugcaaacauagccacuuuuuugucaagaguuacccuuuggggcuccuu

SEQ ID NO: 495496 - RNA, 64 nt, Homo Sapiens
cuaggugagaaaauagagcaagagaaggaauaaauuugucaaaaucuuauccuaguauuuggga

SEQ ID NO: 495497 - RNA, 64 nt, Homo Sapiens
aggcaguaguuucuaaccccaguuauuuucugaauuugucaaagcauggcagcaagugucaugc

SEQ ID NO: 495498 - RNA, 64 nt, Homo Sapiens
uagacauauagugaaaugaucuccucuugcugacuuugucaacacuugcaagcacuugauaucu

SEQ ID NO: 495499 - RNA, 64 nt, Homo Sapiens
gaaauggaaaauaagaguaccucauuuuuuacucuuugucaagaugauagucaaggcucuuagu

SEQ ID NO: 495500 - RNA, 64 nt, Homo Sapiens; identical to SEQ ID NO: 105615

SEQ ID NO: 495501 - RNA, 64 nt, Homo Sapiens; identical to SEQ ID NO: 105616

SEQ ID NO: 495502 - RNA, 64 nt, Homo Sapiens; identical to SEQ ID NO: 105617

SEQ ID NO: 495503 - RNA, 64 nt, Homo Sapiens; identical to SEQ ID NO: 105618

SEQ ID NO: 495504 - RNA, 64 nt, Homo Sapiens; identical to SEQ ID NO: 105619

SEQ ID NO: 495505 - RNA, 64 nt, Homo Sapiens; identical to SEQ ID NO: 105620

SEQ ID NO: 495506 - RNA, 64 nt, Homo Sapiens; identical to SEQ ID NO: 105621

SEQ ID NO: 495507 - RNA, 64 nt, Homo Sapiens; identical to SEQ ID NO: 105622

SEQ ID NO: 495508 - RNA, 64 nt, Homo Sapiens; identical to SEQ ID NO: 105623

SEQ ID NO: 495509 - RNA, 64 nt, Homo Sapiens; identical to SEQ ID NO: 105624

SEQ ID NO: 495510 - RNA, 64 nt, Homo Sapiens
uauuuugaaaaagcucugucugggguuuacuucugaggauaaaauuuuuuucuuucuaugguag

SEQ ID NO: 495511 - RNA, 64 nt, Homo Sapiens
ugauuaaagggaacaugcuuuggaaguaaugguggaggauaauauacugugagccaaugccuuu

SEQ ID NO: 495512 - RNA, 62 nt, Homo Sapiens
gaucuguugccuaaacuaaagcuuaaaaguuuaguaaaaaucgucugggcacaguggcucac

SEQ ID NO: 495513 - RNA, 62 nt, Homo Sapiens
caagacucugucucaaaaaaaaaaaaaaauuuaguaaaaaucaaugguaagcuaaaauaagu

SEQ ID NO: 495514 - RNA, 62 nt, Homo Sapiens
aauggaaauugguaaauggacaaaagcuagcuaguaaaaaggacgacccagcaacaugcuuu

SEQ ID NO: 495515 - RNA, 62 nt, Homo Sapiens
ugcccuuaaacccauuuagaaaauaacuacaaaguaaaaauguagaggaaauagaaauguau

SEQ ID NO: 495516 - RNA, 62 nt, Homo Sapiens
cuaaagguauuugauuugaucuguuagcuuccaguaaaaauauuuguuuuuaguaaaaacaa

SEQ ID NO: 495517 - RNA, 62 nt, Homo Sapiens
ucuguuagcuuccaguaaaaauauuuguuuuuaguaaaaacaaauuuaaauauauuuacaug

SEQ ID NO: 495518 - RNA, 62 nt, Homo Sapiens
uuacacccagagcagauacucauaaaguauaaaguaaaaacuuuuaaccauuauuaaacaga

SEQ ID NO: 495519 - RNA, 62 nt, Homo Sapiens
gauauacauagucauuuuuccucuaugguagaaguaaaaaaaaaaaaaaaggacauagcaac

SEQ ID NO: 495520 - RNA, 62 nt, Homo Sapiens
gcaaaucuuuucaccucugggugcaauuauguaguaaaaaaggaaaauagauaccaugguuu

SEQ ID NO: 495521 - RNA, 62 nt, Homo Sapiens
aaaaaaaaacacuucaacucuccaucaacauaaguaaaaaaaaugauuaugcuuuguggcua

SEQ ID NO: 495522 - RNA, 62 nt, Homo Sapiens
guaucuuauacaugcaugaaguuaaaguagaaaguaaaaagaguuuucuauccuccuucagu

SEQ ID NO: 495523 - RNA, 62 nt, Homo Sapiens
ugguuuuauaaucuucuggguagaaaagggacaguaaaaauacaaugguaaguaucuaaaca

SEQ ID NO: 495524 - RNA, 62 nt, Homo Sapiens
uuuaauauuucuaaagacauacuuguaaacagaguaaaaaucggcauaaccaaaaaagcaaa

SEQ ID NO: 495525 - RNA, 62 nt, Homo Sapiens
cagauauuuaagaggcauaauuuuauagacaaaguaaaaagaggaauacuaaggacaauuau

SEQ ID NO: 495526 - RNA, 62 nt, Homo Sapiens
guaauugaauauguuuaaauuaagauuugucuaguaaaaauucagagaaggcauguggauua

SEQ ID NO: 495527 - RNA, 62 nt, Homo Sapiens
uucauuucauaauuuuggcacuuugucugcuuaguaaaaaauuuuaaauauaaugcaucuuc

SEQ ID NO: 495528 - RNA, 62 nt, Homo Sapiens
uugcagcugauuccaguuuauaauagaucccuaguaaaaagcuuugauucaacacaauuguu

SEQ ID NO: 495529 - RNA, 62 nt, Homo Sapiens
aaaccaaguuuacuucaguauguuaaugauguaguaaaaauauuuauugaaaggugaauucg

SEQ ID NO: 495530 - RNA, 62 nt, Homo Sapiens
aauauauuaaaaauauaaacaauguucaggagaguaaaaauucauauaaagugcaauugcac

SEQ ID NO: 495531 - RNA, 62 nt, Homo Sapiens
cacuuaaauccaguggggaaaaaaagguuaacaguaaaaauuucuuccacguaauucaauuu

SEQ ID NO: 495532 - RNA, 62 nt, Homo Sapiens
auauggcguauuaugugaacaacuacaggcacaguaaaaaaaaauuguaccacuccuugaag

SEQ ID NO: 495533 - RNA, 62 nt, Homo Sapiens
uggucuacuaaggaaacacuuagaaaagguacaguaaaaauaaauauuuguguaucuaaaua

SEQ ID NO: 495534 - RNA, 62 nt, Homo Sapiens
ugaaaaagcugaaacgaguaaaucauuuggggaguaaaaaaacauuuuaagaaaaaggugaa

SEQ ID NO: 495535 - RNA, 62 nt, Homo Sapiens
uacaucugugaaaaagauaaugugaaauaaacaguaaaaaaaaaaaguauguugauggcagu

SEQ ID NO: 495536 - RNA, 62 nt, Homo Sapiens
uggaccaccaggaaggucguuucacauucuguaguaaaaauaccccuacaaucauuuuggua

SEQ ID NO: 495537 - RNA, 62 nt, Homo Sapiens
uugauuggugauuagguggugguagagaagcaaguaaaaaggcuaaauggaagggcaaguuu

SEQ ID NO: 495538 - RNA, 62 nt, Homo Sapiens
uuuuaaaauacauuguauauauguguaugcacaguaaaaauggaaacuauauugaccuaaau

SEQ ID NO: 495539 - RNA, 62 nt, Homo Sapiens
gaaguucuauaacaauuauguuucaugcuuaaaguaaaaauucccagaguuuaguuuagaaa

SEQ ID NO: 495540 - RNA, 62 nt, Homo Sapiens
auuuacugaugcuuuauguuaccaaaacauacaguaaaaaaguagaaauuuaugaaauacuu

SEQ ID NO: 495541 - RNA, 62 nt, Homo Sapiens
ccauuguaguaaauaaguucgaaauaaauaggaguaaaaagauuucuuuucuauuguagaag

SEQ ID NO: 495542 - RNA, 62 nt, Homo Sapiens
agauuguuuuguaacacauauuguugaugucaaguaaaaaaaguguuuauacugcaccuugg

SEQ ID NO: 495543 - RNA, 62 nt, Homo Sapiens
ggucagcagagauuucaguuuuuuuagaucaaaguaaaaauauaaagaauuguauugaauuc

SEQ ID NO: 495544 - RNA, 62 nt, Homo Sapiens
gguuggcagagauuucaguuuuuuuagaucacaguaaaaauauaaagaauuguacugaauuc

SEQ ID NO: 495545 - RNA, 62 nt, Homo Sapiens
cuuuugcaaagagccagucaagagguacaucaaguaaaaacauucuaucuucccaauaaccc

SEQ ID NO: 495546 - RNA, 62 nt, Homo Sapiens
agggcaauauaagacuuaauuauguacuugaaaguaaaaaucguucuauaagugaaaagcau

SEQ ID NO: 495547 - RNA, 62 nt, Homo Sapiens
aaaacagaggauacuacaggugauaucauagaaguaaaaaauuauguggaagcuaaaaaaau

SEQ ID NO: 495548 - RNA, 62 nt, Homo Sapiens
agcugggcgugguggcacauaaaauuuuaaaaaguaaaaauuugagacucugucucuacaaa

SEQ ID NO: 495549 - RNA, 62 nt, Homo Sapiens
uaaaauaguaaaauuucacuguauauacacugaguaaaaauaccaacaauucaugagcaaca

SEQ ID NO: 495550 - RNA, 62 nt, Homo Sapiens
uucaucuaccauuacuguuaucagugaaacagaguaaaaauauuuaacauuuuguccucuuu

SEQ ID NO: 495551 - RNA, 62 nt, Homo Sapiens
aaaucuucugcugcacauuuucagguccuuugaguaaaaaaaaaaggacaugcccacugaau

SEQ ID NO: 495552 - RNA, 62 nt, Homo Sapiens
guugcuucuguuuuguuuuaacacuguagaaaaguaaaaauuaacgaauccuccuacuugag

SEQ ID NO: 495553 - RNA, 62 nt, Homo Sapiens
uaguacuccauuguuuuugcccgacagugguaaguaaaaaugguugggaauaaagggguagc

SEQ ID NO: 495554 - RNA, 62 nt, Homo Sapiens
aaaaaaaaaaaaacaaggggagauaaagcaaaaguaaaaaaauuuggaaagaaguucauuga

SEQ ID NO: 495555 - RNA, 62 nt, Homo Sapiens
uuaaucgguuagcugggugguuaaaaaggaacaguaaaaauauuccagcuauggagcuagcu

SEQ ID NO: 495556 - RNA, 62 nt, Homo Sapiens
auaaggccacacaugguuuauucuuuuuauguaguaaaaaguccacacccggcacaucuuca

SEQ ID NO: 495557 - RNA, 62 nt, Homo Sapiens
uuuaguuuggugcuguuaauauaccacuauuuaguaaaaaguguaaagucauauaaaagguu

SEQ ID NO: 495558 - RNA, 62 nt, Homo Sapiens
uacuauauauuguuguuuguucagagugcuucaguaaaaagccaaagcuuuaaauauaaauu

SEQ ID NO: 495559 - RNA, 62 nt, Homo Sapiens
gauaacuuagaacucagucucauuuuugcaccaguaaaaauaguaaggauuucuuuaaauag

SEQ ID NO: 495560 - RNA, 62 nt, Homo Sapiens
uuguaaugaggaguaguaaaucaucuuuagucaguaaaaacccagucacauuagguauguca

SEQ ID NO: 495561 - RNA, 62 nt, Homo Sapiens
cugcuguccuuuuaggaauauguucaaugcaaaguaaaaaaauaugaauuguccccaauccc

SEQ ID NO: 495562 - RNA, 62 nt, Homo Sapiens
aauaacuaaugcuaagaaaugcugaaaaucaaaguaaaaaauuaaagcccauaaggccagaa

SEQ ID NO: 495563 - RNA, 62 nt, Homo Sapiens
gagaugaaagacauuuguuuuagauaaugcugaguaaaaaaugggacauccagucccuuuga

SEQ ID NO: 495564 - RNA, 62 nt, Homo Sapiens
ccauucaacccuuaaagcucucuaccucuaacaguaaaaauuucuuuaugauauuguauuuc

SEQ ID NO: 495565 - RNA, 62 nt, Homo Sapiens
uaaaucauccaacuucuuugggaaaguaaaaaaguaaaaaaacuuuugaagaauuuauauuu

SEQ ID NO: 495566 - RNA, 62 nt, Homo Sapiens
uaaaaaaauaaaucauccaauuauauuuggaaaguaaaaaagucuacugucuuuugaagaau

SEQ ID NO: 495567 - RNA, 62 nt, Homo Sapiens
auuacugguauuuauuugguuaugaagagaacaguaaaaaaaccucuaucucuguacuccua

SEQ ID NO: 495568 - RNA, 62 nt, Homo Sapiens
caagcagauuccucuacugaagcagaagaacuaguaaaaauagcaaagcaaaacaauaaacu

SEQ ID NO: 495569 - RNA, 62 nt, Homo Sapiens
guuuggaagaagaacaagaauuccacaugagaaguaaaaacaguuuacaguacucagcaaaa

SEQ ID NO: 495570 - RNA, 62 nt, Homo Sapiens
uugugggguaauugcuuaaauuuacauaucaaaguaaaaaaguagugccuguauuccaugug

SEQ ID NO: 495571 - RNA, 62 nt, Homo Sapiens
aauguaaauaaaagaaaacaaauaccaaauacaguaaaaacagguagagaguguugaaauuc

SEQ ID NO: 495572 - RNA, 62 nt, Homo Sapiens
ucacuugcauuaagucuaaaauauuaugauaaaguaaaaauuacuaaugucuuuuauuuauu

SEQ ID NO: 495573 - RNA, 62 nt, Homo Sapiens
aucccuauucuuggaaaauaauacuuugauuaaguaaaaaaacagucaaucagauaagaagu

SEQ ID NO: 495574 - RNA, 62 nt, Homo Sapiens
ccugacaacuaaacauaguaagauuaaaugauaguaaaaacaaaagguuguggaaauguuuc

SEQ ID NO: 495575 - RNA, 62 nt, Homo Sapiens
gauaauuuauagacagauaauauagacaguuaaguaaaaaugaauuuauagacaguuaaauu

SEQ ID NO: 495576 - RNA, 62 nt, Homo Sapiens
acauauuagugacuugaaucuucauaaguuaaaguaaaaaacagcaaaaaaccuagaucuuu

SEQ ID NO: 495577 - RNA, 62 nt, Homo Sapiens
aaaaaacacuguggauaaugacaaaaagcauaaguaaaaauauuugagaaaaauaaaguaca

SEQ ID NO: 495578 - RNA, 62 nt, Homo Sapiens
uguguaaaacugucccugcagauugagcaggaaguaaaaacaaauggaaaugcuucggauag

SEQ ID NO: 495579 - RNA, 62 nt, Homo Sapiens
uuuggaacuuucuguaucucuuaggaggaacaaguaaaaaccaaaugguuacauugugcugc

SEQ ID NO: 495580 - RNA, 62 nt, Homo Sapiens
aaaucagaggugagaauauuuaucuuauaugaaguaaaaaauaguaaaaaugaauuacacug

SEQ ID NO: 495581 - RNA, 62 nt, Homo Sapiens
aauuacacuguaucuuauauaccucuagagagaguaaaaaugguacuguuuagaugggagaa

SEQ ID NO: 495582 - RNA, 62 nt, Homo Sapiens
gugucucaggauagcacaggccaagguaggggaguaaaaaggaggucaggcaaaagggagga

SEQ ID NO: 495583 - RNA, 62 nt, Homo Sapiens
gcgacugcugauuuaccgauguauuuaauguaaguaaaaaaaggaaaaaaagaaaagggcau

SEQ ID NO: 495584 - RNA, 62 nt, Homo Sapiens
aaucuugaaugauacgauuaugcccaauauuaaguaaaaaauauaagaaaagguuaucuuaa

SEQ ID NO: 495585 - RNA, 62 nt, Homo Sapiens
augccuucaucuguucagucaucuccaaaaacaguaaaaauaaccacuuuuuguugggcaau

SEQ ID NO: 495586 - RNA, 62 nt, Homo Sapiens
cauauuguaagaacuguuaauaaaaguugucaaguaaaaagcgcuauaucuaaaaagacuuu

SEQ ID NO: 495587 - RNA, 62 nt, Homo Sapiens
aaauaaguguaucagcagguuuuaucaugaucaguaaaaauguuccaaaugcuucugcucca

SEQ ID NO: 495588 - RNA, 62 nt, Homo Sapiens
ucuuucuagauuuuugaaaucaaaaaguuuucaguaaaaaguuucuuacuuuauuuuauuau

SEQ ID NO: 495589 - RNA, 62 nt, Homo Sapiens
aaaguuucuuacuuuauuuuauuauauuagguaguaaaaaauguaggguuauuuaccauaac

SEQ ID NO: 495590 - RNA, 62 nt, Homo Sapiens
aacguguuuauauugaaugguaguuuuaagacaguaaaaauauucccuuuguguuaauaauu

SEQ ID NO: 495591 - RNA, 62 nt, Homo Sapiens
aggugugaaaauaggaaaauaaauccuacuagaguaaaaauuguauaaauguuuuuaaguau

SEQ ID NO: 495592 - RNA, 62 nt, Homo Sapiens
caaaaauauaugaaaucucaaaucuugucucuaguaaaaauacagccuggucaacaugguga

SEQ ID NO: 495593 - RNA, 62 nt, Homo Sapiens
aggcaacauagugucagccaagccauguguacaguaaaaagccaaguucccuucucuuugcc

SEQ ID NO: 495594 - RNA, 61 nt, Homo Sapiens
gaaaagagaacauaagcaaacauuauauacccaguaaaaaagacuaauacucuuuuugucg

SEQ ID NO: 495595 - RNA, 62 nt, Homo Sapiens
auaaaaugggggauaauuaucaugcgugucucaguaaaaauucauuuuucuguucauauaua

SEQ ID NO: 495596 - RNA, 62 nt, Homo Sapiens
uguauaaaaaccaaaauuauuuuuucuuuuuuaguaaaaaccaaaaccaaaauuauaggauu

SEQ ID NO: 495597 - RNA, 62 nt, Homo Sapiens
uauaugaaaaccaaaauuauuuuuucuuuuuuaguaaaaaccaaaaaccaaaauuauaggau

SEQ ID NO: 495598 - RNA, 62 nt, Homo Sapiens
uauauaaaaaccaaaauuauuuuuucuuuuuuaguaaaaaccaaaaccaaaauuauaggauu

SEQ ID NO: 495599 - RNA, 62 nt, Homo Sapiens
gguaucaaaaccaaaauuauuuuuucuuuuuuaguaaaaaccaaaaaccaaaauuauaggau

SEQ ID NO: 495600 - RNA, 62 nt, Homo Sapiens
uauauaaaaaccaaaauuaugagccacuggugaguaaaaaccuaaauauuucggggguaaua

SEQ ID NO: 495601 - RNA, 62 nt, Homo Sapiens
aauuagguauaauuccaaauuugaaguuucuuaguaaaaaguacuucaggaaguaaaauuau

SEQ ID NO: 495602 - RNA, 62 nt, Homo Sapiens
aaaaauauuuuugaucuaaaauauuguuaaucaguaaaaaaaucgaagauuuuuuaaaaaua

SEQ ID NO: 495603 - RNA, 62 nt, Homo Sapiens
augaggcuguucaucccagcacugucuaagcuaguaaaaauuggaaacaauuuaaguaucua

SEQ ID NO: 495604 - RNA, 62 nt, Homo Sapiens
aaagcuauucauuaugcguugugaagucagaaaguaaaaaaggguagauagaaguauucgaa

SEQ ID NO: 495605 - RNA, 64 nt, Homo Sapiens
uuuuauaacaaagucacggguaucuuuagguucagggaacuagacuaggucauucguguaaaug

SEQ ID NO: 495606 - RNA, 64 nt, Homo Sapiens
uacagucuuagguuaaaguauucuaaugaaguaugggaacuaaauugcugguuuucuaagauaa

SEQ ID NO: 495607 - RNA, 64 nt, Homo Sapiens
ugcaucaauuauaccagggauguauaguaagucagggaacuaauauaaaugaugacagucaugg

SEQ ID NO: 495608 - RNA, 64 nt, Homo Sapiens
augaagucucuuauuucaauuaccuaguguuguugggaacuaauugaacagcuacaguaaaaga

SEQ ID NO: 495609 - RNA, 64 nt, Homo Sapiens
gcaauauuuaaagaugcuuugggagggggaaacggggaacuauacauacucacacggggcaggg

SEQ ID NO: 495610 - RNA, 64 nt, Homo Sapiens
uggugcauuccccacacuuaucagcccggacagugggaacuaacgagguaaugucagagcucca

SEQ ID NO: 495611 - RNA, 64 nt, Homo Sapiens; identical to SEQ ID NO: 167727

SEQ ID NO: 495612 - RNA, 64 nt, Homo Sapiens; identical to SEQ ID NO: 167728

SEQ ID NO: 495613 - RNA, 64 nt, Homo Sapiens; identical to SEQ ID NO: 167729

SEQ ID NO: 495614 - RNA, 64 nt, Homo Sapiens; identical to SEQ ID NO: 167730

SEQ ID NO: 495615 - RNA, 64 nt, Homo Sapiens; identical to SEQ ID NO: 167731

SEQ ID NO: 495616 - RNA, 64 nt, Homo Sapiens; identical to SEQ ID NO: 167732

SEQ ID NO: 495617 - RNA, 64 nt, Homo Sapiens; identical to SEQ ID NO: 167733

SEQ ID NO: 495618 - RNA, 55 nt, Homo Sapiens; identical to SEQ ID NO: 167734

SEQ ID NO: 495619 - RNA, 64 nt, Homo Sapiens; identical to SEQ ID NO: 167735

SEQ ID NO: 495620 - RNA, 64 nt, Homo Sapiens; identical to SEQ ID NO: 167736

SEQ ID NO: 495621 - RNA, 64 nt, Homo Sapiens; identical to SEQ ID NO: 167737

SEQ ID NO: 495622 - RNA, 64 nt, Homo Sapiens; identical to SEQ ID NO: 167738

SEQ ID NO: 495623 - RNA, 64 nt, Homo Sapiens; identical to SEQ ID NO: 167739

SEQ ID NO: 495624 - RNA, 64 nt, Homo Sapiens; identical to SEQ ID NO: 167740

SEQ ID NO: 495625 - RNA, 64 nt, Homo Sapiens; identical to SEQ ID NO: 167741

SEQ ID NO: 495626 - RNA, 64 nt, Homo Sapiens; identical to SEQ ID NO: 167742

SEQ ID NO: 495627 - RNA, 64 nt, Homo Sapiens; identical to SEQ ID NO: 167743

SEQ ID NO: 495628 - RNA, 64 nt, Homo Sapiens; identical to SEQ ID NO: 167744

SEQ ID NO: 495629 - RNA, 64 nt, Homo Sapiens; identical to SEQ ID NO: 167745

SEQ ID NO: 495630 - RNA, 64 nt, Homo Sapiens; identical to SEQ ID NO: 167746

SEQ ID NO: 495631 - RNA, 64 nt, Homo Sapiens; identical to SEQ ID NO: 167747

SEQ ID NO: 495632 - RNA, 64 nt, Homo Sapiens; identical to SEQ ID NO: 167748

SEQ ID NO: 495633 - RNA, 64 nt, Homo Sapiens; identical to SEQ ID NO: 167749

SEQ ID NO: 495634 - RNA, 64 nt, Homo Sapiens; identical to SEQ ID NO: 167749

SEQ ID NO: 495635 - RNA, 64 nt, Homo Sapiens; identical to SEQ ID NO: 167751

SEQ ID NO: 495636 - RNA, 64 nt, Homo Sapiens; identical to SEQ ID NO: 167752

SEQ ID NO: 495637 - RNA, 64 nt, Homo Sapiens; identical to SEQ ID NO: 165166

SEQ ID NO: 495638 - RNA, 64 nt, Homo Sapiens; identical to SEQ ID NO: 165167

SEQ ID NO: 495639 - RNA, 64 nt, Homo Sapiens; identical to SEQ ID NO: 165168

SEQ ID NO: 495640 - RNA, 64 nt, Homo Sapiens; identical to SEQ ID NO: 165169

SEQ ID NO: 495641 - RNA, 64 nt, Homo Sapiens; identical to SEQ ID NO: 165170

SEQ ID NO: 495642 - RNA, 64 nt, Homo Sapiens; identical to SEQ ID NO: 165171

SEQ ID NO: 495643 - RNA, 64 nt, Homo Sapiens; identical to SEQ ID NO: 165172

SEQ ID NO: 495644 - RNA, 64 nt, Homo Sapiens; identical to SEQ ID NO: 165173

SEQ ID NO: 495645 - RNA, 64 nt, Homo Sapiens; identical to SEQ ID NO: 165174

SEQ ID NO: 495646 - RNA, 64 nt, Homo Sapiens; identical to SEQ ID NO: 165175

SEQ ID NO: 495647 - RNA, 64 nt, Homo Sapiens; identical to SEQ ID NO: 165176

SEQ ID NO: 495648 - RNA, 64 nt, Homo Sapiens; identical to SEQ ID NO: 165177

SEQ ID NO: 495649 - RNA, 64 nt, Homo Sapiens; identical to SEQ ID NO: 165178

SEQ ID NO: 495650 - RNA, 64 nt, Homo Sapiens; identical to SEQ ID NO: 165179

SEQ ID NO: 495651 - RNA, 64 nt, Homo Sapiens; identical to SEQ ID NO: 165180

SEQ ID NO: 495652 - RNA, 64 nt, Homo Sapiens; identical to SEQ ID NO: 165181

SEQ ID NO: 495653 - RNA, 64 nt, Homo Sapiens; identical to SEQ ID NO: 165182

SEQ ID NO: 495654 - RNA, 64 nt, Homo Sapiens; identical to SEQ ID NO: 165183

SEQ ID NO: 495655 - RNA, 64 nt, Homo Sapiens; identical to SEQ ID NO: 347916

SEQ ID NO: 495656 - RNA, 64 nt, Homo Sapiens; identical to SEQ ID NO: 347917

SEQ ID NO: 495657 - RNA, 64 nt, Homo Sapiens; identical to SEQ ID NO: 347918

SEQ ID NO: 495658 - RNA, 64 nt, Homo Sapiens; identical to SEQ ID NO: 347919

SEQ ID NO: 495659 - RNA, 64 nt, Homo Sapiens; identical to SEQ ID NO: 347920

SEQ ID NO: 495660 - RNA, 64 nt, Homo Sapiens; identical to SEQ ID NO: 347921

SEQ ID NO: 495661 - RNA, 64 nt, Homo Sapiens; identical to SEQ ID NO: 347922

SEQ ID NO: 495662 - RNA, 64 nt, Homo Sapiens; identical to SEQ ID NO: 347923

SEQ ID NO: 495663 - RNA, 64 nt, Homo Sapiens; identical to SEQ ID NO: 347924

SEQ ID NO: 495664 - RNA, 64 nt, Homo Sapiens; identical to SEQ ID NO: 347925

SEQ ID NO: 495665 - RNA, 64 nt, Homo Sapiens; identical to SEQ ID NO: 107849

SEQ ID NO: 495666 - RNA, 64 nt, Homo Sapiens; identical to SEQ ID NO: 107850

SEQ ID NO: 495667 - RNA, 64 nt, Homo Sapiens; identical to SEQ ID NO: 107851

SEQ ID NO: 495668 - RNA, 64 nt, Homo Sapiens; identical to SEQ ID NO: 107852

SEQ ID NO: 495669 - RNA, 64 nt, Homo Sapiens; identical to SEQ ID NO: 107853

SEQ ID NO: 495670 - RNA, 64 nt, Homo Sapiens; identical to SEQ ID NO: 107854

SEQ ID NO: 495671 - RNA, 64 nt, Homo Sapiens; identical to SEQ ID NO: 107855

SEQ ID NO: 495672 - RNA, 64 nt, Homo Sapiens; identical to SEQ ID NO: 107856

SEQ ID NO: 495673 - RNA, 64 nt, Homo Sapiens; identical to SEQ ID NO: 107857

SEQ ID NO: 495674 - RNA, 64 nt, Homo Sapiens; identical to SEQ ID NO: 107858

SEQ ID NO: 495675 - RNA, 64 nt, Homo Sapiens; identical to SEQ ID NO: 107859

SEQ ID NO: 495676 - RNA, 64 nt, Homo Sapiens; identical to SEQ ID NO: 107860

SEQ ID NO: 495677 - RNA, 64 nt, Homo Sapiens; identical to SEQ ID NO: 107861

SEQ ID NO: 495678 - RNA, 64 nt, Homo Sapiens; identical to SEQ ID NO: 107862

SEQ ID NO: 495679 - RNA, 64 nt, Homo Sapiens; identical to SEQ ID NO: 107863

SEQ ID NO: 495680 - RNA, 63 nt, Homo Sapiens; identical to SEQ ID NO: 107864

SEQ ID NO: 495681 - RNA, 64 nt, Homo Sapiens; identical to SEQ ID NO: 107865

SEQ ID NO: 495682 - RNA, 64 nt, Homo Sapiens; identical to SEQ ID NO: 107866

SEQ ID NO: 495683 - RNA, 64 nt, Homo Sapiens; identical to SEQ ID NO: 107867

SEQ ID NO: 495684 - RNA, 64 nt, Homo Sapiens; identical to SEQ ID NO: 107868

SEQ ID NO: 495685 - RNA, 64 nt, Homo Sapiens; identical to SEQ ID NO: 107869

SEQ ID NO: 495686 - RNA, 64 nt, Homo Sapiens; identical to SEQ ID NO: 107870

SEQ ID NO: 495687 - RNA, 64 nt, Homo Sapiens; identical to SEQ ID NO: 107871

SEQ ID NO: 495688 - RNA, 64 nt, Homo Sapiens; identical to SEQ ID NO: 107872

SEQ ID NO: 495689 - RNA, 64 nt, Homo Sapiens; identical to SEQ ID NO: 107873

SEQ ID NO: 495690 - RNA, 64 nt, Homo Sapiens; identical to SEQ ID NO: 107874

SEQ ID NO: 495691 - RNA, 64 nt, Homo Sapiens; identical to SEQ ID NO: 107875

SEQ ID NO: 495692 - RNA, 64 nt, Homo Sapiens; identical to SEQ ID NO: 107876

SEQ ID NO: 495693 - RNA, 64 nt, Homo Sapiens; identical to SEQ ID NO: 107877

SEQ ID NO: 495694 - RNA, 64 nt, Homo Sapiens; identical to SEQ ID NO: 107878

SEQ ID NO: 495695 - RNA, 64 nt, Homo Sapiens; identical to SEQ ID NO: 107879

SEQ ID NO: 495696 - RNA, 64 nt, Homo Sapiens; identical to SEQ ID NO: 107880

SEQ ID NO: 495697 - RNA, 64 nt, Homo Sapiens; identical to SEQ ID NO: 107881

SEQ ID NO: 495698 - RNA, 64 nt, Homo Sapiens; identical to SEQ ID NO: 107882

SEQ ID NO: 495699 - RNA, 64 nt, Homo Sapiens; identical to SEQ ID NO: 107883

SEQ ID NO: 495700 - RNA, 64 nt, Homo Sapiens; identical to SEQ ID NO: 107884

SEQ ID NO: 495701 - RNA, 64 nt, Homo Sapiens; identical to SEQ ID NO: 107885

SEQ ID NO: 495702 - RNA, 64 nt, Homo Sapiens; identical to SEQ ID NO: 107886

SEQ ID NO: 495703 - RNA, 64 nt, Homo Sapiens; identical to SEQ ID NO: 107887

SEQ ID NO: 495704 - RNA, 64 nt, Homo Sapiens; identical to SEQ ID NO: 107888

SEQ ID NO: 495705 - RNA, 64 nt, Homo Sapiens; identical to SEQ ID NO: 107889

SEQ ID NO: 495706 - RNA, 64 nt, Homo Sapiens; identical to SEQ ID NO: 107890

SEQ ID NO: 495707 - RNA, 64 nt, Homo Sapiens; identical to SEQ ID NO: 107891

SEQ ID NO: 495708 - RNA, 64 nt, Homo Sapiens; identical to SEQ ID NO: 107892

SEQ ID NO: 495709 - RNA, 64 nt, Homo Sapiens; identical to SEQ ID NO: 107893

SEQ ID NO: 495710 - RNA, 64 nt, Homo Sapiens; identical to SEQ ID NO: 107894

SEQ ID NO: 495711 - RNA, 64 nt, Homo Sapiens; identical to SEQ ID NO: 107895

SEQ ID NO: 495712 - RNA, 64 nt, Homo Sapiens; identical to SEQ ID NO: 107896

SEQ ID NO: 495713 - RNA, 64 nt, Homo Sapiens; identical to SEQ ID NO: 107897

SEQ ID NO: 495714 - RNA, 64 nt, Homo Sapiens; identical to SEQ ID NO: 107898

SEQ ID NO: 495715 - RNA, 64 nt, Homo Sapiens; identical to SEQ ID NO: 107899

SEQ ID NO: 495716 - RNA, 64 nt, Homo Sapiens; identical to SEQ ID NO: 107900

SEQ ID NO: 495717 - RNA, 64 nt, Homo Sapiens; identical to SEQ ID NO: 107901

SEQ ID NO: 495718 - RNA, 64 nt, Homo Sapiens; identical to SEQ ID NO: 107902

SEQ ID NO: 495719 - RNA, 64 nt, Homo Sapiens; identical to SEQ ID NO: 107903

SEQ ID NO: 495720 - RNA, 64 nt, Homo Sapiens; identical to SEQ ID NO: 107904

SEQ ID NO: 495721 - RNA, 64 nt, Homo Sapiens; identical to SEQ ID NO: 107905

SEQ ID NO: 495722 - RNA, 64 nt, Homo Sapiens; identical to SEQ ID NO: 107906

SEQ ID NO: 495723 - RNA, 64 nt, Homo Sapiens; identical to SEQ ID NO: 107907

SEQ ID NO: 495724 - RNA, 64 nt, Homo Sapiens; identical to SEQ ID NO: 107908

SEQ ID NO: 495725 - RNA, 64 nt, Homo Sapiens; identical to SEQ ID NO: 107909

SEQ ID NO: 495726 - RNA, 64 nt, Homo Sapiens; identical to SEQ ID NO: 107910

SEQ ID NO: 495727 - RNA, 64 nt, Homo Sapiens; identical to SEQ ID NO: 107911

SEQ ID NO: 495728 - RNA, 64 nt, Homo Sapiens; identical to SEQ ID NO: 107912

SEQ ID NO: 495729 - RNA, 64 nt, Homo Sapiens; identical to SEQ ID NO: 107913

SEQ ID NO: 495730 - RNA, 64 nt, Homo Sapiens; identical to SEQ ID NO: 107914

SEQ ID NO: 495731 - RNA, 64 nt, Homo Sapiens; identical to SEQ ID NO: 107915

SEQ ID NO: 495732 - RNA, 64 nt, Homo Sapiens; identical to SEQ ID NO: 107916

SEQ ID NO: 495733 - RNA, 64 nt, Homo Sapiens; identical to SEQ ID NO: 107917

SEQ ID NO: 495734 - RNA, 64 nt, Homo Sapiens; identical to SEQ ID NO: 107918

SEQ ID NO: 495735 - RNA, 64 nt, Homo Sapiens; identical to SEQ ID NO: 107919

SEQ ID NO: 495736 - RNA, 64 nt, Homo Sapiens; identical to SEQ ID NO: 107920

SEQ ID NO: 495737 - RNA, 64 nt, Homo Sapiens; identical to SEQ ID NO: 107921

SEQ ID NO: 495738 - RNA, 64 nt, Homo Sapiens; identical to SEQ ID NO: 107922

SEQ ID NO: 495739 - RNA, 64 nt, Homo Sapiens; identical to SEQ ID NO: 107923

SEQ ID NO: 495740 - RNA, 64 nt, Homo Sapiens; identical to SEQ ID NO: 107924

SEQ ID NO: 495741 - RNA, 64 nt, Homo Sapiens; identical to SEQ ID NO: 107925

SEQ ID NO: 495742 - RNA, 64 nt, Homo Sapiens; identical to SEQ ID NO: 107926

SEQ ID NO: 495743 - RNA, 64 nt, Homo Sapiens; identical to SEQ ID NO: 107927

SEQ ID NO: 495744 - RNA, 64 nt, Homo Sapiens; identical to SEQ ID NO: 107928

SEQ ID NO: 495745 - RNA, 64 nt, Homo Sapiens; identical to SEQ ID NO: 107929

SEQ ID NO: 495746 - RNA, 64 nt, Homo Sapiens; identical to SEQ ID NO: 107930

SEQ ID NO: 495747 - RNA, 64 nt, Homo Sapiens; identical to SEQ ID NO: 107931

SEQ ID NO: 495748 - RNA, 64 nt, Homo Sapiens; identical to SEQ ID NO: 107932

SEQ ID NO: 495749 - RNA, 64 nt, Homo Sapiens; identical to SEQ ID NO: 107933

SEQ ID NO: 495750 - RNA, 64 nt, Homo Sapiens; identical to SEQ ID NO: 266283

SEQ ID NO: 495751 - RNA, 64 nt, Homo Sapiens; identical to SEQ ID NO: 266284

SEQ ID NO: 495752 - RNA, 64 nt, Homo Sapiens; identical to SEQ ID NO: 266285

SEQ ID NO: 495753 - RNA, 64 nt, Homo Sapiens; identical to SEQ ID NO: 266286

SEQ ID NO: 495754 - RNA, 64 nt, Homo Sapiens; identical to SEQ ID NO: 266287

SEQ ID NO: 495755 - RNA, 64 nt, Homo Sapiens; identical to SEQ ID NO: 266288

SEQ ID NO: 495756 - RNA, 64 nt, Homo Sapiens; identical to SEQ ID NO: 266289

SEQ ID NO: 495757 - RNA, 64 nt, Homo Sapiens; identical to SEQ ID NO: 266290

SEQ ID NO: 495758 - RNA, 64 nt, Homo Sapiens; identical to SEQ ID NO: 266291

SEQ ID NO: 495759 - RNA, 64 nt, Homo Sapiens; identical to SEQ ID NO: 266292

SEQ ID NO: 495760 - RNA, 64 nt, Homo Sapiens; identical to SEQ ID NO: 266293

SEQ ID NO: 495761 - RNA, 64 nt, Homo Sapiens; identical to SEQ ID NO: 266294

SEQ ID NO: 495762 - RNA, 64 nt, Homo Sapiens; identical to SEQ ID NO: 266295

SEQ ID NO: 495763 - RNA, 64 nt, Homo Sapiens; identical to SEQ ID NO: 266296

SEQ ID NO: 495764 - RNA, 64 nt, Homo Sapiens; identical to SEQ ID NO: 266297

SEQ ID NO: 495765 - RNA, 64 nt, Homo Sapiens; identical to SEQ ID NO: 266298

SEQ ID NO: 495766 - RNA, 64 nt, Homo Sapiens; identical to SEQ ID NO: 266299

SEQ ID NO: 495767 - RNA, 64 nt, Homo Sapiens; identical to SEQ ID NO: 266300

SEQ ID NO: 495768 - RNA, 64 nt, Homo Sapiens; identical to SEQ ID NO: 266301

SEQ ID NO: 495769 - RNA, 64 nt, Homo Sapiens; identical to SEQ ID NO: 266302

SEQ ID NO: 495770 - RNA, 64 nt, Homo Sapiens; identical to SEQ ID NO: 266303

SEQ ID NO: 495771 - RNA, 64 nt, Homo Sapiens; identical to SEQ ID NO: 266304

SEQ ID NO: 495772 - RNA, 64 nt, Homo Sapiens; identical to SEQ ID NO: 266305

SEQ ID NO: 495773 - RNA, 64 nt, Homo Sapiens; identical to SEQ ID NO: 266306

SEQ ID NO: 495774 - RNA, 64 nt, Homo Sapiens; identical to SEQ ID NO: 266307

SEQ ID NO: 495775 - RNA, 64 nt, Homo Sapiens; identical to SEQ ID NO: 266308

SEQ ID NO: 495776 - RNA, 64 nt, Homo Sapiens; identical to SEQ ID NO: 266309

SEQ ID NO: 495777 - RNA, 64 nt, Homo Sapiens; identical to SEQ ID NO: 266310

SEQ ID NO: 495778 - RNA, 64 nt, Homo Sapiens; identical to SEQ ID NO: 266311

SEQ ID NO: 495779 - RNA, 64 nt, Homo Sapiens; identical to SEQ ID NO: 266312

SEQ ID NO: 495780 - RNA, 64 nt, Homo Sapiens; identical to SEQ ID NO: 266313

SEQ ID NO: 495781 - RNA, 64 nt, Homo Sapiens; identical to SEQ ID NO: 266314

SEQ ID NO: 495782 - RNA, 64 nt, Homo Sapiens; identical to SEQ ID NO: 266315

SEQ ID NO: 495783 - RNA, 64 nt, Homo Sapiens; identical to SEQ ID NO: 266316

SEQ ID NO: 495784 - RNA, 64 nt, Homo Sapiens; identical to SEQ ID NO: 266317

SEQ ID NO: 495785 - RNA, 64 nt, Homo Sapiens; identical to SEQ ID NO: 266318

SEQ ID NO: 495786 - RNA, 64 nt, Homo Sapiens; identical to SEQ ID NO: 266319

SEQ ID NO: 495787 - RNA, 64 nt, Homo Sapiens; identical to SEQ ID NO: 266320

SEQ ID NO: 495788 - RNA, 64 nt, Homo Sapiens; identical to SEQ ID NO: 266321

SEQ ID NO: 495789 - RNA, 64 nt, Homo Sapiens; identical to SEQ ID NO: 266322

SEQ ID NO: 495790 - RNA, 64 nt, Homo Sapiens; identical to SEQ ID NO: 266323

SEQ ID NO: 495791 - RNA, 64 nt, Homo Sapiens; identical to SEQ ID NO: 266324

SEQ ID NO: 495792 - RNA, 64 nt, Homo Sapiens; identical to SEQ ID NO: 266325

SEQ ID NO: 495793 - RNA, 64 nt, Homo Sapiens; identical to SEQ ID NO: 266326

SEQ ID NO: 495794 - RNA, 64 nt, Homo Sapiens; identical to SEQ ID NO: 266327

SEQ ID NO: 495795 - RNA, 64 nt, Homo Sapiens; identical to SEQ ID NO: 266328

SEQ ID NO: 495796 - RNA, 64 nt, Homo Sapiens; identical to SEQ ID NO: 266329

SEQ ID NO: 495797 - RNA, 64 nt, Homo Sapiens; identical to SEQ ID NO: 266330

SEQ ID NO: 495798 - RNA, 64 nt, Homo Sapiens
gugaggggccccgccagcccaggaggacaccucccugucggagaggagcgcaaggcugccgucg

SEQ ID NO: 495799 - RNA, 64 nt, Homo Sapiens
uggacaccaagauccaggagucaugaguaacaaccugucggagcgcugguggucuucaaggggc

SEQ ID NO: 495800 - RNA, 64 nt, Homo Sapiens; identical to SEQ ID NO: 235935

SEQ ID NO: 495801 - RNA, 64 nt, Homo Sapiens; identical to SEQ ID NO: 235936

SEQ ID NO: 495802 - RNA, 64 nt, Homo Sapiens; identical to SEQ ID NO: 235937

SEQ ID NO: 495803 - RNA, 64 nt, Homo Sapiens; identical to SEQ ID NO: 235938

SEQ ID NO: 495804 - RNA, 64 nt, Homo Sapiens; identical to SEQ ID NO: 235939

SEQ ID NO: 495805 - RNA, 64 nt, Homo Sapiens; identical to SEQ ID NO: 235940

SEQ ID NO: 495806 - RNA, 64 nt, Homo Sapiens; identical to SEQ ID NO: 235941

SEQ ID NO: 495807 - RNA, 64 nt, Homo Sapiens; identical to SEQ ID NO: 235942

SEQ ID NO: 495808 - RNA, 64 nt, Homo Sapiens; identical to SEQ ID NO: 235943

SEQ ID NO: 495809 - RNA, 64 nt, Homo Sapiens; identical to SEQ ID NO: 235944

SEQ ID NO: 495810 - RNA, 64 nt, Homo Sapiens; identical to SEQ ID NO: 235945

SEQ ID NO: 495811 - RNA, 64 nt, Homo Sapiens; identical to SEQ ID NO: 235946

SEQ ID NO: 495812 - RNA, 64 nt, Homo Sapiens; identical to SEQ ID NO: 235947

SEQ ID NO: 495813 - RNA, 64 nt, Homo Sapiens; identical to SEQ ID NO: 235948

SEQ ID NO: 495814 - RNA, 64 nt, Homo Sapiens; identical to SEQ ID NO: 235949

SEQ ID NO: 495815 - RNA, 64 nt, Homo Sapiens; identical to SEQ ID NO: 235950

SEQ ID NO: 495816 - RNA, 64 nt, Homo Sapiens; identical to SEQ ID NO: 235951

SEQ ID NO: 495817 - RNA, 64 nt, Homo Sapiens; identical to SEQ ID NO: 235952

SEQ ID NO: 495818 - RNA, 64 nt, Homo Sapiens; identical to SEQ ID NO: 235953

SEQ ID NO: 495819 - RNA, 64 nt, Homo Sapiens; identical to SEQ ID NO: 235954

SEQ ID NO: 495820 - RNA, 64 nt, Homo Sapiens; identical to SEQ ID NO: 235955

SEQ ID NO: 495821 - RNA, 64 nt, Homo Sapiens; identical to SEQ ID NO: 235956

SEQ ID NO: 495822 - RNA, 64 nt, Homo Sapiens; identical to SEQ ID NO: 235957

SEQ ID NO: 495823 - RNA, 64 nt, Homo Sapiens; identical to SEQ ID NO: 235958

SEQ ID NO: 495824 - RNA, 64 nt, Homo Sapiens; identical to SEQ ID NO: 235959

SEQ ID NO: 495825 - RNA, 64 nt, Homo Sapiens; identical to SEQ ID NO: 235960

SEQ ID NO: 495826 - RNA, 64 nt, Homo Sapiens; identical to SEQ ID NO: 235961

SEQ ID NO: 495827 - RNA, 64 nt, Homo Sapiens; identical to SEQ ID NO: 235962

SEQ ID NO: 495828 - RNA, 64 nt, Homo Sapiens; identical to SEQ ID NO: 235963

SEQ ID NO: 495829 - RNA, 64 nt, Homo Sapiens; identical to SEQ ID NO: 235964

SEQ ID NO: 495830 - RNA, 64 nt, Homo Sapiens; identical to SEQ ID NO: 235965

SEQ ID NO: 495831 - RNA, 64 nt, Homo Sapiens; identical to SEQ ID NO: 235966

SEQ ID NO: 495832 - RNA, 64 nt, Homo Sapiens; identical to SEQ ID NO: 235967

SEQ ID NO: 495833 - RNA, 64 nt, Homo Sapiens; identical to SEQ ID NO: 235968

SEQ ID NO: 495834 - RNA, 64 nt, Homo Sapiens; identical to SEQ ID NO: 235969

SEQ ID NO: 495835 - RNA, 64 nt, Homo Sapiens; identical to SEQ ID NO: 235970

SEQ ID NO: 495836 - RNA, 64 nt, Homo Sapiens; identical to SEQ ID NO: 235971

SEQ ID NO: 495837 - RNA, 64 nt, Homo Sapiens; identical to SEQ ID NO: 235972

SEQ ID NO: 495838 - RNA, 64 nt, Homo Sapiens; identical to SEQ ID NO: 235973

SEQ ID NO: 495839 - RNA, 64 nt, Homo Sapiens; identical to SEQ ID NO: 235974

SEQ ID NO: 495840 - RNA, 58 nt, Homo Sapiens; identical to SEQ ID NO: 235975

SEQ ID NO: 495841 - RNA, 64 nt, Homo Sapiens; identical to SEQ ID NO: 235976

SEQ ID NO: 495842 - RNA, 64 nt, Homo Sapiens; identical to SEQ ID NO: 235977

SEQ ID NO: 495843 - RNA, 64 nt, Homo Sapiens; identical to SEQ ID NO: 235978

SEQ ID NO: 495844 - RNA, 64 nt, Homo Sapiens; identical to SEQ ID NO: 235979

SEQ ID NO: 495845 - RNA, 64 nt, Homo Sapiens; identical to SEQ ID NO: 235980

SEQ ID NO: 495846 - RNA, 64 nt, Homo Sapiens; identical to SEQ ID NO: 235981

SEQ ID NO: 495847 - RNA, 64 nt, Homo Sapiens; identical to SEQ ID NO: 235981

SEQ ID NO: 495848 - RNA, 64 nt, Homo Sapiens; identical to SEQ ID NO: 235983

SEQ ID NO: 495849 - RNA, 64 nt, Homo Sapiens; identical to SEQ ID NO: 235984

SEQ ID NO: 495850 - RNA, 64 nt, Homo Sapiens; identical to SEQ ID NO: 235985

SEQ ID NO: 495851 - RNA, 64 nt, Homo Sapiens; identical to SEQ ID NO: 235986

SEQ ID NO: 495852 - RNA, 64 nt, Homo Sapiens; identical to SEQ ID NO: 235987

SEQ ID NO: 495853 - RNA, 64 nt, Homo Sapiens; identical to SEQ ID NO: 235988

SEQ ID NO: 495854 - RNA, 64 nt, Homo Sapiens; identical to SEQ ID NO: 235989

SEQ ID NO: 495855 - RNA, 64 nt, Homo Sapiens; identical to SEQ ID NO: 235990

SEQ ID NO: 495856 - RNA, 64 nt, Homo Sapiens; identical to SEQ ID NO: 235991

SEQ ID NO: 495857 - RNA, 64 nt, Homo Sapiens; identical to SEQ ID NO: 235992

SEQ ID NO: 495858 - RNA, 64 nt, Homo Sapiens
uuuaucguuuuuguauuuucaugaaaauaccauuuaguaagaauaccacaucaaauaagaaaua

SEQ ID NO: 495859 - RNA, 64 nt, Homo Sapiens
auuaaggggaagaaugaaagcuguuccuugguccuaguaagaagacaaacugcuucccuuacuu

SEQ ID NO: 495860 - RNA, 64 nt, Homo Sapiens
gccuuauacaguaguacacuguacuuguuuuuaguaguaagaccuacuuucccacuauauguag

SEQ ID NO: 495861 - RNA, 64 nt, Homo Sapiens
auaaaagguugauuugguugguucccaugaaaguuaguaagaugcccuuuuaaauauaaggauc

SEQ ID NO: 495862 - RNA, 64 nt, Homo Sapiens
ugaaucuugagggaguaauguugcccaggacuccuaguaagaaucugccaggacacuuuugugu

SEQ ID NO: 495863 - RNA, 64 nt, Homo Sapiens
ugaugucugcuagugguauuagauuuccuuuuccuaguaagaguucuuuuuuaaaauuuuaauu

SEQ ID NO: 495864 - RNA, 64 nt, Homo Sapiens; identical to SEQ ID NO: 43762

SEQ ID NO: 495865 - RNA, 64 nt, Homo Sapiens; identical to SEQ ID NO: 43763

SEQ ID NO: 495866 - RNA, 64 nt, Homo Sapiens; identical to SEQ ID NO: 43764

SEQ ID NO: 495867 - RNA, 64 nt, Homo Sapiens; identical to SEQ ID NO: 43765

SEQ ID NO: 495868 - RNA, 64 nt, Homo Sapiens; identical to SEQ ID NO: 43766

SEQ ID NO: 495869 - RNA, 64 nt, Homo Sapiens; identical to SEQ ID NO: 43767

SEQ ID NO: 495870 - RNA, 64 nt, Homo Sapiens; identical to SEQ ID NO: 43768

SEQ ID NO: 495871 - RNA, 64 nt, Homo Sapiens; identical to SEQ ID NO: 43769

SEQ ID NO: 495872 - RNA, 64 nt, Homo Sapiens; identical to SEQ ID NO: 43770

SEQ ID NO: 495873 - RNA, 64 nt, Homo Sapiens; identical to SEQ ID NO: 43771

SEQ ID NO: 495874 - RNA, 64 nt, Homo Sapiens; identical to SEQ ID NO: 43772

SEQ ID NO: 495875 - RNA, 64 nt, Homo Sapiens; identical to SEQ ID NO: 43773

SEQ ID NO: 495876 - RNA, 64 nt, Homo Sapiens; identical to SEQ ID NO: 43774

SEQ ID NO: 495877 - RNA, 64 nt, Homo Sapiens; identical to SEQ ID NO: 43775

SEQ ID NO: 495878 - RNA, 64 nt, Homo Sapiens; identical to SEQ ID NO: 43776

SEQ ID NO: 495879 - RNA, 64 nt, Homo Sapiens; identical to SEQ ID NO: 43777

SEQ ID NO: 495880 - RNA, 64 nt, Homo Sapiens; identical to SEQ ID NO: 43778

SEQ ID NO: 495881 - RNA, 64 nt, Homo Sapiens; identical to SEQ ID NO: 43779

SEQ ID NO: 495882 - RNA, 64 nt, Homo Sapiens; identical to SEQ ID NO: 43780

SEQ ID NO: 495883 - RNA, 64 nt, Homo Sapiens; identical to SEQ ID NO: 43781

SEQ ID NO: 495884 - RNA, 64 nt, Homo Sapiens; identical to SEQ ID NO: 43782

SEQ ID NO: 495885 - RNA, 63 nt, Homo Sapiens
ucuuacgacacagauccacccacauguugcucuuaucuggaauuugggacaaagcaaugcaca

SEQ ID NO: 495886 - RNA, 63 nt, Homo Sapiens
uggggggagucaugcccaggggaggagacuuuuuaucuggaggggagagaaggauucuagggg

SEQ ID NO: 495887 - RNA, 63 nt, Homo Sapiens
gaaaacuagacagaaacucaucuauauauucuguaucuggaguuccguuuugaauauuaacug

SEQ ID NO: 495888 - RNA, 63 nt, Homo Sapiens
aaacaaaugaaacaaguaaaggaagaaagaagguaucuggaaagaaauagagaagaacuagua

SEQ ID NO: 495889 - RNA, 63 nt, Homo Sapiens
acaggguacaacccccugcugcacacgcuagcauaucuggaaccuacuaugaaaaugaaagga

SEQ ID NO: 495890 - RNA, 63 nt, Homo Sapiens
aggucaguguuccuugugcugucauuucccuuauaucuggaauuugucagcauuccugaaaac

SEQ ID NO: 495891 - RNA, 63 nt, Homo Sapiens
aauauuuuguucuuauuugccagagccaaauuuuaucuggaaguugagacuuaaaaaauacuu

SEQ ID NO: 495892 - RNA, 63 nt, Homo Sapiens
gaacacccggaaagacugaaagaauacauuuuauaucuggauuuuuacaaauaaagauggcua

SEQ ID NO: 495893 - RNA, 63 nt, Homo Sapiens
gcagaacaaacagugaaacuuucuaaaauauucuaucuggaauagggacaggggaucuuuuau

SEQ ID NO: 495894 - RNA, 63 nt, Homo Sapiens
gaauagaagaaaaaaguugcagguugaauuaucuaucuggauauuacuagaguuguaaaacac

SEQ ID NO: 495895 - RNA, 63 nt, Homo Sapiens
ggcaucgcaaacugcccccgggcgcaucuggcuuaucuggagaccugggagcuugaggcucau

SEQ ID NO: 495896 - RNA, 63 nt, Homo Sapiens
ccaaggacuaagcuuccauagaaauacacuuuguaucuggaccucaaaauuaugggaacauuu

SEQ ID NO: 495897 - RNA, 63 nt, Homo Sapiens
aaagccucuucauccaggucaguucaggaaguauaucuggaguaccugcucuguuuuuggcug

SEQ ID NO: 495898 - RNA, 63 nt, Homo Sapiens
caaaguugccuaguugauguaacaguggaaaguuaucuggaaauaguauuuugaacuuuaagc

SEQ ID NO: 495899 - RNA, 58 nt, Homo Sapiens
auuuuguaugaguucuugaaauuucauuuaucuggaaaaggaggaagacgaggauuaa

SEQ ID NO: 495900 - RNA, 63 nt, Homo Sapiens
agccaacuuguaaauacacccuaaguuauaguauaucuggacagucaauauuaaauacagaca

SEQ ID NO: 495901 - RNA, 63 nt, Homo Sapiens
uagagaauuuuagaucaacauuuuaaaaagauuuaucuggauugccucaugugugaaauaaau

SEQ ID NO: 495902 - RNA, 63 nt, Homo Sapiens
gaaaaccuaggaguuucucaacuacucaacucauaucuggagaccccuccuuuuacucaacua

SEQ ID NO: 495903 - RNA, 63 nt, Homo Sapiens
uuuucuaauggacaaaucaccauaacuuuaggcuaucuggaauaaguucagaguaugcaggcu

SEQ ID NO: 495904 - RNA, 63 nt, Homo Sapiens
aucugcaaacauuaccuaaaggugcucucaccuuaucuggaaggcuggguuacugcugcuuuu

SEQ ID NO: 495905 - RNA, 63 nt, Homo Sapiens
auaguuggauaguuacgugucuccccagcucccuaucuggaggcagaggagcccaucucccau

SEQ ID NO: 495906 - RNA, 63 nt, Homo Sapiens
uguguauuugauuuuguacuuauaugguucacauaucuggaucaaugguuguauagauaugua

SEQ ID NO: 495907 - RNA, 63 nt, Homo Sapiens
gcaaggauugagaggcccugauaggcauagacauaucuggagcaggauggagcaagggcgaau

SEQ ID NO: 495908 - RNA, 63 nt, Homo Sapiens
cacccacugaaagggcugcagaaaggacaacacuaucuggagcccucaccgcucccagcaacu

SEQ ID NO: 495909 - RNA, 63 nt, Homo Sapiens
gacuagagggagccaagaggcccgaggucuuccuaucuggaauacuuuauguccugaagcuga

SEQ ID NO: 495910 - RNA, 63 nt, Homo Sapiens
uauucuuauuuuuguaaucagucauuggcuucuuaucuggaugaaggcuuuuggaggagaacc

SEQ ID NO: 495911 - RNA, 63 nt, Homo Sapiens
uguuguuagauuaauguauuuguugcuucccuuuaucuggaauguggcauuagcuuuuuuauu

SEQ ID NO: 495912 - RNA, 63 nt, Homo Sapiens
uauccugagacuuugacaccagauguagauauuuaucuggagcuggaaagaaaaauucuuuuu

SEQ ID NO: 495913 - RNA, 63 nt, Homo Sapiens
ggauguauuaguuauuuacuuaaauguuuauaauaucuggauuuuuuuuguuuuguuacucau

SEQ ID NO: 495914 - RNA, 63 nt, Homo Sapiens
uuuaaaauaauaaaucugccauaaaaugcauuauaucuggagacuugcacuuguauggaugaa

SEQ ID NO: 495915 - RNA, 63 nt, Homo Sapiens
aaacucugaagaaagcucugacucucaggaaguuaucuggaaagauaccuggauguuuacugc

SEQ ID NO: 495916 - RNA, 63 nt, Homo Sapiens
cagaaugaggcuaaacauggguuauacaaaggguaucuggaaacugaagagcaacuuguuaga

SEQ ID NO: 495917 - RNA, 63 nt, Homo Sapiens
gguuaacuuuuacacaguucugaguacuguuaauaucuggaaaguaucuugagauaucagugg

SEQ ID NO: 495918 - RNA, 63 nt, Homo Sapiens
ucauugaaaguuaauuuucuuugcauuuuaaaauaucuggauuaugaagaaaaagugaugaaa

SEQ ID NO: 495919 - RNA, 63 nt, Homo Sapiens
auagcacagauuccuuugccccuuuuaucuccuuaucuggauaugauaagugguuaugagggu

SEQ ID NO: 495920 - RNA, 63 nt, Homo Sapiens
aaucacguuaaugguauaauuuuuuuuuuuuaauaucuggagaacauuaauaacaaguuaaau

SEQ ID NO: 495921 - RNA, 50 nt, Homo Sapiens
aauuugaaaugcaagcauaauaucuggaaaauuugcugccugccuucuac

SEQ ID NO: 495922 - RNA, 63 nt, Homo Sapiens
uguaauacuuaauuaaaauaaugauggaagagcuaucuggagauuaugaguaagcugauuuga

SEQ ID NO: 495923 - RNA, 63 nt, Homo Sapiens
gucucuucauuuauuacugcuugucuguuguuauaucuggauuaucaaaagcaauagugcacc

SEQ ID NO: 495924 - RNA, 63 nt, Homo Sapiens
cuguugugagugcccuuuccuggaagguguuuuuaucuggaagauagaauccaaguauuuaua

SEQ ID NO: 495925 - RNA, 63 nt, Homo Sapiens
gcaugccuaauugugcauuuugauugugcauuguaucuggauagguguucaauaagggaauac

SEQ ID NO: 495926 - RNA, 63 nt, Homo Sapiens
cagaaaccuaaugggaagugauucccugauugguaucuggagaaguuccaguccuggccaguc

SEQ ID NO: 495927 - RNA, 63 nt, Homo Sapiens
agggucgggaaggguuuguguguuuuaaucauguaucuggaauaauuaggaucauuuucuguc

SEQ ID NO: 495928 - RNA, 63 nt, Homo Sapiens
guuuuaaagucaauuauuuuugggcuuugcagauaucuggaguuucuccuuccccuagccuau

SEQ ID NO: 495929 - RNA, 63 nt, Homo Sapiens
cuacuuauuuauaauuuaaguuuaucuaugcccuaucuggauuucuguucuauuauagagacu

SEQ ID NO: 495930 - RNA, 63 nt, Homo Sapiens
gguaaaaucuugaugaggcugacuucuugaauauaucuggacuuauaccaagauggagaucuu

SEQ ID NO: 495931 - RNA, 63 nt, Homo Sapiens
uuucuagaguggaucucuuauugccuuucuugauaucuggagaggggguacaacgucuauuuu

SEQ ID NO: 495932 - RNA, 63 nt, Homo Sapiens
aaauaaagaagcuuauuaaacuauucuguucacuaucuggagugcuuacuucacuauugaaca

SEQ ID NO: 495933 - RNA, 63 nt, Homo Sapiens
caugugauaucucuuuuguguggacauuucauauaucuggaauuauguaagauuaaccuacuc

SEQ ID NO: 495934 - RNA, 63 nt, Homo Sapiens
gcuuuguaauacuugcaugccucugucauacuguaucuggaauccaaugcuuguucacuguuc

SEQ ID NO: 495935 - RNA, 63 nt, Homo Sapiens
uaauguggaugaucaggauuaaaucaagauauauaucuggaaccucuuauaaauggagcacuu

SEQ ID NO: 495936 - RNA, 63 nt, Homo Sapiens
aagacaauucaucucauugugaguggaaguaguuaucuggaauaaaaaaagaagauaccuauu

SEQ ID NO: 495937 - RNA, 63 nt, Homo Sapiens
uacaccuuuuuuauagaugauuuguuuaaauuauaucuggaaaauagaguugauuuacuuuca

SEQ ID NO: 495938 - RNA, 63 nt, Homo Sapiens
aaggaacagaaauuauugcaucuguggaacauauaucuggaguuacuauacuuuacugaagag

SEQ ID NO: 495939 - RNA, 63 nt, Homo Sapiens
guuucaaguguucagcagaccucucugguaacauaucuggaauauuguuguuguuuuuuaacc

SEQ ID NO: 495940 - RNA, 63 nt, Homo Sapiens
auauaaauaacucuuauaacgauaaggggcuuguaucuggaauuauuugcgagucauauauau

SEQ ID NO: 495941 - RNA, 63 nt, Homo Sapiens
uugugcuuagaaccuuaaauccauaacaugacauaucuggauuaucaucuucaggaagcaagu

SEQ ID NO: 495942 - RNA, 63 nt, Homo Sapiens
cagaauaaauguaauauuuaacaguuuagaaaguaucuggacucaaauccauccugcacuucu

SEQ ID NO: 495943 - RNA, 63 nt, Homo Sapiens
ccauguuguauugcagauaaucaagugccagucuaucuggaauuaacaucauagccacagaaa

SEQ ID NO: 495944 - RNA, 63 nt, Homo Sapiens
acccaggaagguugagcugcuuaguaaccagaguaucuggauuaagaguccaguguaaccagc

SEQ ID NO: 495945 - RNA, 63 nt, Homo Sapiens
uuuacagaagacguuugcugacacaaaacaaaauaucuggaccauauccaucagaaaaaugac

SEQ ID NO: 495946 - RNA, 63 nt, Homo Sapiens
guagccccacucuuugagugugauuaaaaagaauaucuggaauaagcucuaaaacagugucau

SEQ ID NO: 495947 - RNA, 63 nt, Homo Sapiens
ucagccucaaucaugucuuaaaagaauauaucuuaucuggagcaauaaguauguguguaccgu

SEQ ID NO: 495948 - RNA, 63 nt, Homo Sapiens
gaaguugggcuggaugaucugugagaggcgugauaucuggaugaauucagaagacuacuauau

SEQ ID NO: 495949 - RNA, 63 nt, Homo Sapiens
aaucaaugcuacagccuauauucuccauugauauaucuggagaaacagugucauacauauuug

SEQ ID NO: 495950 - RNA, 63 nt, Homo Sapiens
acccaagcugucucuggauugcccuuugaguauuaucuggagauuugguuguuccuaaagcuu

SEQ ID NO: 495951 - RNA, 58 nt, Homo Sapiens
ggggguuuuguaaauaaugacgugaauauaucuggaugaguuaucucagaauuguuaa

SEQ ID NO: 495952 - RNA, 63 nt, Homo Sapiens
cccugagagacccugagaccggagauuuuauuauaucuggagagggagacuguggccugaaca

SEQ ID NO: 495953 - RNA, 63 nt, Homo Sapiens
aggaagaaacaccccagcaccacuugugauuuuuaucuggaaaaagagccgucaucagugucu

SEQ ID NO: 495954 - RNA, 63 nt, Homo Sapiens
uuucuuagacuacauuuagagaacuguggccguuaucuggaaguaaccauuugcacuggaguu

SEQ ID NO: 495955 - RNA, 63 nt, Homo Sapiens
auuauuauucuuauuaauaacauguuggccuauuaucuggaugucccuugccuagagcaggaa

SEQ ID NO: 495956 - RNA, 63 nt, Homo Sapiens
gaguguauuggggauuuuguuauauuuuguuuuuaucuggauuguuuuuguccuagguuuggg

SEQ ID NO: 495957 - RNA, 63 nt, Homo Sapiens
ggggauagaaaacaaaguaccuaugaaacgggauaucuggauuuuacuugcaguggcuuccac

SEQ ID NO: 495958 - RNA, 63 nt, Homo Sapiens
uuaaaugcguaauacaccauuccaguuccugccuaucuggagucaaauugcuuaacacuuggu

SEQ ID NO: 495959 - RNA, 63 nt, Homo Sapiens
auggucuccuuccgcaagucuuuuuaauccucauaucuggaguacaaggguagaccucuggcu

SEQ ID NO: 495960 - RNA, 63 nt, Homo Sapiens
uguuugcaaugcauggaacugucaaaggauucguaucuggaauacauuaaagaagcaaaagaa

SEQ ID NO: 495961 - RNA, 63 nt, Homo Sapiens
acacagaugagauauucuacacauuaaucuacuuaucuggaaucacuuugccucuaaaggcca

SEQ ID NO: 495962 - RNA, 63 nt, Homo Sapiens
accacuugcuaagcagaagauccugcagacccuuaucuggaggaggaagagaagcaggagaga

SEQ ID NO: 495963 - RNA, 63 nt, Homo Sapiens
ucccaccaucaaagaucuugacaguggggauuuuaucuggacauacuagauacacugcaaacu

SEQ ID NO: 495964 - RNA, 63 nt, Homo Sapiens
gugaacacaacucuuugguuuuccacguagacuuaucuggaaucuaguaaauucugaaugcuu

SEQ ID NO: 495965 - RNA, 63 nt, Homo Sapiens
uaaaaugaagugaguaaaauacugggaugacguuaucuggagcccaagaaagauggcucauuu

SEQ ID NO: 495966 - RNA, 63 nt, Homo Sapiens
ggauauggagccacauccacuuccaccccuugguaucuggacccacguguucuuccuacugag

SEQ ID NO: 495967 - RNA, 63 nt, Homo Sapiens
acaccggcugcagaugggacagccagcccugccuaucuggacaggccccugcagccucugucc

SEQ ID NO: 495968 - RNA, 63 nt, Homo Sapiens
cugacacuuaagacuugggaagccugacauuucuaucuggacagugugacuaucuuaugucag

SEQ ID NO: 495969 - RNA, 63 nt, Homo Sapiens
uaauugcccuguauuccgaaggguaauauaauuuaucuggauggaaauuuuaaagaugaaucc

SEQ ID NO: 495970 - RNA, 63 nt, Homo Sapiens
aagccucagccugaaugugaguggcaaguggcuuaucuggagccaccugcccaagucuuacua

SEQ ID NO: 495971 - RNA, 63 nt, Homo Sapiens
agauagagcucauuuuacuccaccuaaucguuauaucuggauauacccauuuucugcaucuuc

SEQ ID NO: 495972 - RNA, 63 nt, Homo Sapiens
uaaauuguuauggaggggcuaggcaccaaaucuuaucuggaaauuucuuaugauuuccuuuaa

SEQ ID NO: 495973 - RNA, 63 nt, Homo Sapiens
acagcaaaaaaacugaaaaugguuuuuauuaauuaucuggauaggacccaguuuugcgugguu

SEQ ID NO: 495974 - RNA, 63 nt, Homo Sapiens
cuucugggcuauagaucucaaacuuccugggcuuaucuggauuauauccaagagggagaauga

SEQ ID NO: 495975 - RNA, 63 nt, Homo Sapiens
uaauugggacauuguaacuuauuaucaccaaauuaucuggaaaaagugccauuucauuauuug

SEQ ID NO: 495976 - RNA, 63 nt, Homo Sapiens
caaauuuauuuccaauguuuaaaccuuuucuuguaucuggauuaucagaguucccaagaaagg

SEQ ID NO: 495977 - RNA, 63 nt, Homo Sapiens
cagcgaauacagcaaacagaguaauuacagcccuaucuggagaaccuuucuuccucauguggu

SEQ ID NO: 495978 - RNA, 63 nt, Homo Sapiens
cuuugcagggagucguggguguggccacacagcuaucuggagggccgucuguccccagcuccc

SEQ ID NO: 495979 - RNA, 63 nt, Homo Sapiens
aagcuccauuugccaguuuaaggaaggaaacacuaucuggaaaaguaccuuauugauagugga

SEQ ID NO: 495980 - RNA, 63 nt, Homo Sapiens
ugaguaucuguuuuuccucaggcacaucauuuuuaucuggaaagacuuuucuagcugcaauuu

SEQ ID NO: 495981 - RNA, 63 nt, Homo Sapiens
uaccuuugugugucucuagaagagaaaagcaucuaucuggagauauaaauguguauguaaaua

SEQ ID NO: 495982 - RNA, 63 nt, Homo Sapiens
ggaccacgcuucagucaaaggcauacaaguaucuaucuggacuucccugcuagcacuuccaaa

SEQ ID NO: 495983 - RNA, 63 nt, Homo Sapiens
aaaguauagacuuagaaauaucaaaguaagagcuaucuggauaaauauauagauauugagugc

SEQ ID NO: 495984 - RNA, 63 nt, Homo Sapiens
uccuccaaccucuuaccuuagaugcauccugguuaucuggaagcaugggaaagaaggcuacuu

SEQ ID NO: 495985 - RNA, 63 nt, Homo Sapiens
uagcaugugaagaucccuuuuuuugaaguguuuuaucuggauugauugcugguagguguguug

SEQ ID NO: 495986 - RNA, 63 nt, Homo Sapiens
gcagcacuaccauuuauucugagcagugccuaguaucuggagaaucaaauguucaaaaauacg

SEQ ID NO: 495987 - RNA, 63 nt, Homo Sapiens
ccuagcagucacuacauuaugauucuaguuaaauaucuggaaugaagaacucuugacuauuua

SEQ ID NO: 495988 - RNA, 63 nt, Homo Sapiens
agguguacaacuuucaaacaccacaaagacccauaucuggagauucuccuucuucuccuucuu

SEQ ID NO: 495989 - RNA, 63 nt, Homo Sapiens
acugugcaaugcugugugcuucaaugaagagcauaucuggacgucuuugcaaaugucuuucuc

SEQ ID NO: 495990 - RNA, 63 nt, Homo Sapiens
ccuuccagcugcugucuucuuguggaggauugcuaucuggaggcucagcaagcccuacagagc

SEQ ID NO: 495991 - RNA, 63 nt, Homo Sapiens
uucugggauucagguuguuaggaguguggacaguaucuggaagcucuccucugcccaggggag

SEQ ID NO: 495992 - RNA, 63 nt, Homo Sapiens
acaggcaaagaaaaccacuacaguauccagcaguaucuggaccggcccaaccacaggagcugc

SEQ ID NO: 495993 - RNA, 63 nt, Homo Sapiens
uuaauuaaucgaaaugaauuaauuacuucucucuaucuggaauagcuaucauuucuuuuccaa

SEQ ID NO: 495994 - RNA, 63 nt, Homo Sapiens
uagauugagcgccacgacagcugugccuacgacuaucuggaggugcgcgacgggcacagugag

SEQ ID NO: 495995 - RNA, 63 nt, Homo Sapiens
uuuugaaugcuggauucaaaaaaaaaaaaaaguuaucuggacagcuucuuugagacuauuuaa

SEQ ID NO: 495996 - RNA, 63 nt, Homo Sapiens
auggguugugucuagaauuaaguggagggcagcuaucuggaguuaacuugcaagcauauuggu

SEQ ID NO: 495997 - RNA, 63 nt, Homo Sapiens
uaaagaugugaagaccacagucuuggguuuucauaucuggagaagacuauuugccaugacguu

SEQ ID NO: 495998 - RNA, 63 nt, Homo Sapiens
auaaaacaucagaaccagcuaagggaaaagaaauaucuggaguacauuaaaagugugaaagaa

SEQ ID NO: 495999 - RNA, 63 nt, Homo Sapiens
ugaucagaucuauauaagugggaauacagcauauaucuggauauucuuauaguuaucuuuuua

SEQ ID NO: 496000 - RNA, 63 nt, Homo Sapiens
ugaaaugauaauuuguaaaauaacacuuagugauaucuggaaauaauaauucaauuaagcaac

SEQ ID NO: 496001 - RNA, 63 nt, Homo Sapiens
accacaccugaaaaugucucaaaucuccaggaguaucuggaaugcauuuguuuccaugaguga

SEQ ID NO: 496002 - RNA, 63 nt, Homo Sapiens
ugugacauuaaaacaacaacaauaagaucuuccuaucuggaggguacagaggugaauggcuuu

SEQ ID NO: 496003 - RNA, 63 nt, Homo Sapiens
uguacuaaucaaauaauaaucaaaaucugaauauaucuggauacucugcuguguauuaaaugu

SEQ ID NO: 496004 - RNA, 63 nt, Homo Sapiens
uugagguguguugcacccaaacugaaagaccacuaucuggaguaaggacgucgaugaguacaa

SEQ ID NO: 496005 - RNA, 63 nt, Homo Sapiens
uuuauuuuuucaaguaaaauugucucaccugaguaucuggaauaagcaggaacaguggguuug

SEQ ID NO: 496006 - RNA, 63 nt, Homo Sapiens
auuaagaaaacggauuuuguagaauuggcaaaauaucuggaccgacaguucuguugaguugga

SEQ ID NO: 496007 - RNA, 63 nt, Homo Sapiens
agaauuuucaaucaauguguacuccuauucuguuaucuggacuaucuggagaccacaaguacc

SEQ ID NO: 496008 - RNA, 63 nt, Homo Sapiens
ccacaaguaccacuccuauuugacaguggaauauaucuggagaugaagaaaaguauuuuuguc

SEQ ID NO: 496009 - RNA, 63 nt, Homo Sapiens
caucugagagaauauuuuuauagacuuagcaguuaucuggagaaagacauugaaggaccaauu

SEQ ID NO: 496010 - RNA, 63 nt, Homo Sapiens
cucucuccuagguuguauuuaaauuugacugaauaucuggauggcuaagaacagacauuuauc

SEQ ID NO: 496011 - RNA, 63 nt, Homo Sapiens
gugaaggaugcuggaaggguaaggauuuaggaauaucuggagagaaagagagccugcaguuau

SEQ ID NO: 496012 - RNA, 63 nt, Homo Sapiens
gaauucagaauucuuaggcaaccuucauaccuuuaucuggaaaaugccuucucuccagacaau

SEQ ID NO: 496013 - RNA, 63 nt, Homo Sapiens
ggguugacauuuagaacuuuaagucucacccauuaucuggaauauugugauucuguuuauucu

SEQ ID NO: 496014 - RNA, 63 nt, Homo Sapiens
gcaggugguucagcgagccacggcagcccccuguaucuggauuguaaugugaaucuuuagggu

SEQ ID NO: 496015 - RNA, 63 nt, Homo Sapiens
gcagaaacucagggaggggcuuggggcccauuguaucuggagagccuggauuccucuuggcag

SEQ ID NO: 496016 - RNA, 63 nt, Homo Sapiens
gccaguaaaacaaauguguauuauauacuuguuuaucuggacuauaaaaauuuacuauuuccu

SEQ ID NO: 496017 - RNA, 63 nt, Homo Sapiens
ccagggcuugaacuaggauuugcuggcacugucuaucuggaucucuuuagauauuauuugaaa

SEQ ID NO: 496018 - RNA, 63 nt, Homo Sapiens
uagcacuugaaagaucuaacaacugagagccuguaucuggauugcuuuguggcaaugaccuug

SEQ ID NO: 496019 - RNA, 63 nt, Homo Sapiens
uauuucuuuuugugaagccaugucucucugacuuaucuggaagauuugcucaagacguccaac

SEQ ID NO: 496020 - RNA, 63 nt, Homo Sapiens
aguuuugaacuuuuaacccuuucuacccagagcuaucuggaauguugaugacuuuuuauacug

SEQ ID NO: 496021 - RNA, 63 nt, Homo Sapiens
uauaauaugcuuguaaaggcugagggugagcuguaucuggaugccuuuuuacaauuugauuuu

SEQ ID NO: 496022 - RNA, 63 nt, Homo Sapiens
uauuaccuaaugaaagugaugacauauuuuuuauaucuggaaugagccuguugggaucgcauu

SEQ ID NO: 496023 - RNA, 63 nt, Homo Sapiens
cacaucuuccaccagcaccuuacugcccaggccuaucuggaagccaccucaccaaggaccuug

SEQ ID NO: 496024 - RNA, 63 nt, Homo Sapiens
uuuaugugcaaaaucuguuauagcuuuaaaauauaucuggaacuuuuuagauuauuccaagcc

SEQ ID NO: 496025 - RNA, 63 nt, Homo Sapiens
uuauguuguuuaguguuauauggugaaaauauuuaucuggaauuucuauucaucuaaguaaua

SEQ ID NO: 496026 - RNA, 63 nt, Homo Sapiens
ccacauaguguggaacaaaaccuuaagauuguuuaucuggagcgucacaagcacacugaugcu

SEQ ID NO: 496027 - RNA, 63 nt, Homo Sapiens
cacgaggaaaaggaaagaguccguaugucaguguaucuggauaugugacacuuuuaaaaucau

SEQ ID NO: 496028 - RNA, 63 nt, Homo Sapiens
aggaaaaugaucuggauaaagaggagaaugggguaucuggaaacugcccucugaauauauggu

SEQ ID NO: 496029 - RNA, 63 nt, Homo Sapiens
gugauaacucaugagaaguacugauaggaccuuuaucuggauaugguccuauagguuauucug

SEQ ID NO: 496030 - RNA, 63 nt, Homo Sapiens
aucaaguuguacuguauuagauaaucagcaguguaucuggaguauguuuaaagagaacaguuc

SEQ ID NO: 496031 - RNA, 63 nt, Homo Sapiens
aucagaggaguaggagagaggaaacauuugacuuaucuggaaaagcaaaauguacuuaagaau

SEQ ID NO: 496032 - RNA, 63 nt, Homo Sapiens
aacucuuuaugcaacuugguuaauagaaucuacuaucuggaagauaaaugaaggauuuuaaua

SEQ ID NO: 496033 - RNA, 63 nt, Homo Sapiens
guauucugaaagucacauagcacacaguaauguuaucuggaagcucuguuuuuguuuacauuu

SEQ ID NO: 496034 - RNA, 63 nt, Homo Sapiens
augaucccgccucuguaggggcauggcugcuauuaucuggaaauuaggaauuggaugcaucau

SEQ ID NO: 496035 - RNA, 63 nt, Homo Sapiens
uugaugccaguuaucaugcugccacuacaucguuaucuggaggcaacuucuggugguuuuuuu

SEQ ID NO: 496036 - RNA, 63 nt, Homo Sapiens
auguacucuuuaacagaaauugcuuuuaaaaaauaucuggaacuaucuuuaaaaaaacuuuau

SEQ ID NO: 496037 - RNA, 63 nt, Homo Sapiens
uuuccaugcuggccaagaucccccugcccccacuaucuggagucguaauaaagaugaccugga

SEQ ID NO: 496038 - RNA, 63 nt, Homo Sapiens
uuggccuuguuaaccuaguaaaagcuguuggccuaucuggaguugucaggaauauugguuuga

SEQ ID NO: 496039 - RNA, 63 nt, Homo Sapiens
uucaauaagucauauuaaaaagaaaaucacacuuaucuggaaaagucucgugagaauauacuu

SEQ ID NO: 496040 - RNA, 63 nt, Homo Sapiens
augaagaagaggaggaugugaaacucuuaaguauaucuggaaagcagucugccccuggaggug

SEQ ID NO: 496041 - RNA, 63 nt, Homo Sapiens
cucaaaguuuaagagcauuuagccaucgcuuuuuaucuggaaccucucagauaccucuaaaac

SEQ ID NO: 496042 - RNA, 63 nt, Homo Sapiens
uacucccacauacuuacccacauguacacagaguaucuggagaauaaaacccaaauucaaaaa

SEQ ID NO: 496043 - RNA, 63 nt, Homo Sapiens
uuucagauauuuauuuuugcacagaaaacacauuaucuggagagaaagaaaggagaauuuuug

SEQ ID NO: 496044 - RNA, 63 nt, Homo Sapiens
uuucucacuguagcugcuggcagcccugugccauaucuggacucuaguugucaguaucugagu

SEQ ID NO: 496045 - RNA, 63 nt, Homo Sapiens
uauuuuuccuuuaggucaaaauaaugucacugcuaucuggauaaauuauaaguucauauauuu

SEQ ID NO: 496046 - RNA, 63 nt, Homo Sapiens
uauuuccuggagcaccagggcuaaauggggagcuaucuggaaacucuagauuuucugucauac

SEQ ID NO: 496047 - RNA, 63 nt, Homo Sapiens
gccagugcaucuugggggaaagggcuccaguguuaucuggaccaguuccuucauuuucaggug

SEQ ID NO: 496048 - RNA, 63 nt, Homo Sapiens
ggagauuaaaaaaaaagaaagaaaaugcuuccuuaucuggaagccuuucuggauuaauccagu

SEQ ID NO: 496049 - RNA, 63 nt, Homo Sapiens
acuagagaugggauuugggggugaauuugucaauaucuggauuuuaauccagacaucucugcu

SEQ ID NO: 496050 - RNA, 63 nt, Homo Sapiens
cuuuccccuuuguuuaggggagagcaggaguaguaucuggaaacuuuccugagcuagccaaca

SEQ ID NO: 496051 - RNA, 63 nt, Homo Sapiens
gaugacauauuugugccaugacaggcugcuugcuaucuggaaaggccaaaggaggcagcggga

SEQ ID NO: 496052 - RNA, 63 nt, Homo Sapiens
gauaacacauacuccagccaagucuguauguacuaucuggaaacuuccuguuucugcaugauc

SEQ ID NO: 496053 - RNA, 63 nt, Homo Sapiens
uccugggaaggcuggcugcugggcccuguccuguaucuggaauggagccgaggaggacggcgu

SEQ ID NO: 496054 - RNA, 63 nt, Homo Sapiens
gccauuaugacccacuacauuuuguguccccuguaucuggaauaguucauaaacacagagcug

SEQ ID NO: 496055 - RNA, 63 nt, Homo Sapiens
augcaguagaaauuauaacauauuuucuaucuguaucuggacauuccccacacuacauaucag

SEQ ID NO: 496056 - RNA, 63 nt, Homo Sapiens
uaguaggaagaauuacaauuucuuuaaaucauuuaucuggauuuuuauguuuuauuagcauuu

SEQ ID NO: 496057 - RNA, 63 nt, Homo Sapiens
uuguugcuugaggcacagaguuauaaaguaacauaucuggaauuugaaaucagaucuguuuag

SEQ ID NO: 496058 - RNA, 63 nt, Homo Sapiens
gaagaaaccuggggacuuaguuagguagauuaauaucuggagcuccucgagggaccaaaucuc

SEQ ID NO: 496059 - RNA, 63 nt, Homo Sapiens
cagaauaaaauauuuacauaaacuucaauguucuaucuggaagugucuuuaaaauaacaugua

SEQ ID NO: 496060 - RNA, 63 nt, Homo Sapiens
aaaaaaaauaugagauuggagcaaguuuucaccuaucuggaaaaacuguggaaggcacacuga

SEQ ID NO: 496061 - RNA, 63 nt, Homo Sapiens
uacaccuuuaaagacugauauuuguuuuuugcauaucuggaaucaugcuaaaguuaccuucuc

SEQ ID NO: 496062 - RNA, 63 nt, Homo Sapiens
guuuaaauuuuuagaucucuuggaaauuaguguuaucuggaaguagaaauggcuguugcguau

SEQ ID NO: 496063 - RNA, 63 nt, Homo Sapiens
gaaguugaaccaguugguucuagaugaaccaauuaucuggaaaaugaaagaaccagaguugga

SEQ ID NO: 496064 - RNA, 63 nt, Homo Sapiens
uucuccccugugagaaauaaugcaauuucuaauuaucuggauguucguugaaaauauauuaga

SEQ ID NO: 496065 - RNA, 63 nt, Homo Sapiens
ucugcagaagaaauuuauuuuaaauuguuuaaauaucuggaaauacuuuuagcuaucauuuau

SEQ ID NO: 496066 - RNA, 63 nt, Homo Sapiens
uucccaccacccacucuccucugccucaguaaguaucuggaggaagaaaacaggugaaagaag

SEQ ID NO: 496067 - RNA, 63 nt, Homo Sapiens
gacggccagagaguaugcugucuucucaagaucuaucuggacauugagcaaaacauugaugua

SEQ ID NO: 496068 - RNA, 63 nt, Homo Sapiens
ggacaagucaugccuugggcgagucaacauuuauaucuggaagauguagaggaaggcucaaag

SEQ ID NO: 496069 - RNA, 63 nt, Homo Sapiens
aagagguagaaacucuggacggucccgcaccuauaucuggaugacacauggugucagauaugg

SEQ ID NO: 496070 - RNA, 63 nt, Homo Sapiens
ucucagcacuguaaaauaguucauguuuggaccuaucuggaccaagcacucauuuaaaaauca

SEQ ID NO: 496071 - RNA, 63 nt, Homo Sapiens
aaucgcauucauaaaacaauuuaguuugaaagauaucuggagacuaucuagugaauaaaaaaa

SEQ ID NO: 496072 - RNA, 63 nt, Homo Sapiens
ugugacugcagcuauggccuuguuugcuuaguuuaucuggaauucuguuauaauuucugaacu

SEQ ID NO: 496073 - RNA, 63 nt, Homo Sapiens
ccaccaacuucugugccuccucagauggggauuuaucuggaucucugugguuccuucucagcc

SEQ ID NO: 496074 - RNA, 63 nt, Homo Sapiens
aaaaacccugcacuuugaacaaucagcuguugcuaucuggaacuaaacagaacuaugaguaaa

SEQ ID NO: 496075 - RNA, 63 nt, Homo Sapiens
uugccuugacuccauuucauuuuaaucuugaguuaucuggauaaaauguuuuuuguuuuuuuu

SEQ ID NO: 496076 - RNA, 63 nt, Homo Sapiens
uucaaagaagauggcauuauccuggccuggaauuaucuggacuuacagacgugagccaccgug

SEQ ID NO: 496077 - RNA, 63 nt, Homo Sapiens
uuuuuuuuuuuuuuuuuuuuauuuacaaggaauuaucuggacuuguaauuuauuaaaaaccuu

SEQ ID NO: 496078 - RNA, 63 nt, Homo Sapiens
aaaauaucaaguacuuccuuauuuucauucagcuaucuggaguaaguacaagggagaauaccc

SEQ ID NO: 496079 - RNA, 63 nt, Homo Sapiens
ccauggggcacugacagagaaaugaaauaguuuuaucuggaaaauuccagagcuauuauuuac

SEQ ID NO: 496080 - RNA, 63 nt, Homo Sapiens
ucaaggaacauagcuuacaaaugcaucaguguguaucuggagagcauccuaacugcauuucaa

SEQ ID NO: 496081 - RNA, 63 nt, Homo Sapiens
cacagacaaagugacaucagaaggcugagcacuuaucuggaucauuuggucaguuugguaauu

SEQ ID NO: 496082 - RNA, 63 nt, Homo Sapiens
guuuugcaagauguuuguggaaauguucauuuguaucuggaucucuguuaugugccauuuuuc

SEQ ID NO: 496083 - RNA, 63 nt, Homo Sapiens
auuuagcggauuguggacuuaagauucaaccucuaucuggagaggugaaaacacaaaggcuua

SEQ ID NO: 496084 - RNA, 63 nt, Homo Sapiens
ugaguggccccacauggggcucugagcaggcuguaucuggauucuggcaauaaaaguacucug

SEQ ID NO: 496085 - RNA, 63 nt, Homo Sapiens
guuucccagguggagcucauguuugugauccucuaucuggacagcucuccagaauccuguguu

SEQ ID NO: 496086 - RNA, 63 nt, Homo Sapiens
uguguucuggugaaagaaccgugcaaagaugcuuaucuggaacggauucauacuugagaaaua

SEQ ID NO: 496087 - RNA, 63 nt, Homo Sapiens
caggaccugaacucgcaccuagcagcuuaacuguaucuggagcugggucccccugguuguugu

SEQ ID NO: 496088 - RNA, 63 nt, Homo Sapiens
uuuugugugcauacauauucaagccugucuuccuaucuggauuaccuuacuuucauuguaaau

SEQ ID NO: 496089 - RNA, 63 nt, Homo Sapiens
cuaaaauguuacggaaguagguuucugcuguacuaucuggauacacccauugccccgggaacc

SEQ ID NO: 496090 - RNA, 63 nt, Homo Sapiens
uuccacuguugcuucagucucagggguuaucuguaucuggaggcagaucguauuucagucugu

SEQ ID NO: 496091 - RNA, 63 nt, Homo Sapiens
cuggacugcagugcaggagauaucccggaaaucuaucuggacccuggaggugugaaggugcug

SEQ ID NO: 496092 - RNA, 63 nt, Homo Sapiens
ucagagaccauguugugccaccuacccucagaguaucuggaccggaggcagagagagccagcc

SEQ ID NO: 496093 - RNA, 63 nt, Homo Sapiens
aucaaaaaacuaccuaucugguacuaugcuuuuuaucuggaugaugaaauaaucuguacaaca

SEQ ID NO: 496094 - RNA, 63 nt, Homo Sapiens
gccuccuggaggcugugggugugggggauucuguaucuggauuccguaucacuccaaguggag

SEQ ID NO: 496095 - RNA, 63 nt, Homo Sapiens
caaaguuuacagauguuuuuaauucuaguauuuuaucuggaacaacuuguagcagcuauauau

SEQ ID NO: 496096 - RNA, 63 nt, Homo Sapiens
ccucauggcccaccuccaacccacuuuccucaguaucuggagagggaagggaagucaggcuug

SEQ ID NO: 496097 - RNA, 63 nt, Homo Sapiens
cggauuuauucccuuuuaaagaauuuuugcccauaucuggaagggcacuauauuuuugggagg

SEQ ID NO: 496098 - RNA, 63 nt, Homo Sapiens
uuccaaguccuuuaaaaggagacuuaaaacuaguaucuggagaaacucccaguucccagaaaa

SEQ ID NO: 496099 - RNA, 63 nt, Homo Sapiens
cucuaagaugagagcaaaugcaaauuaugugauuaucuggaagucuuuauaaaugucauuuua

SEQ ID NO: 496100 - RNA, 63 nt, Homo Sapiens
guggacugaacggaaucaagucgcauucggcguuaucuggaaauaacuuuccuggacuguguu

SEQ ID NO: 496101 - RNA, 63 nt, Homo Sapiens
aaaagaacacuuuugaacuaucuagguuucuuuuaucuggagaaggggagagcuugaccucca

SEQ ID NO: 496102 - RNA, 63 nt, Homo Sapiens
ggagaggcauaagguugaaaugguggcucagaauaucuggauuggcuggauugcagccaccca

SEQ ID NO: 496103 - RNA, 63 nt, Homo Sapiens
gggcacuggauugcucugcaauuucaauuuuauuaucuggaaaaauauuaaauugaaaucuuc

SEQ ID NO: 496104 - RNA, 63 nt, Homo Sapiens
ggaaagcacaugccuucacguggcuuuguaacuuaucuggaagagggccuggcuuccgugcuc

SEQ ID NO: 496105 - RNA, 63 nt, Homo Sapiens
ucauauuuuguaauauuucauuuguuaaguuuauaucuggauauaauguucuuuuuaaacaag

SEQ ID NO: 496106 - RNA, 63 nt, Homo Sapiens
gguaauuuuugauuuccuaaagugcacugagguuaucuggaagauuggguguauuuuuuggug

SEQ ID NO: 496107 - RNA, 63 nt, Homo Sapiens
aguagguaucccuccaugcccuucuguaauaaauaucuggaaaaaacauuaaacaauaggcaa

SEQ ID NO: 496108 - RNA, 63 nt, Homo Sapiens
uacauuuucccuuccauuuaaaaugucuugggauaucuggaucaguaauaaaauauuucaaag

SEQ ID NO: 496109 - RNA, 63 nt, Homo Sapiens
ucacgcugacgcuggccgauacucaggguaugcuaucuggaggccuggacacugucacacuca

SEQ ID NO: 496110 - RNA, 63 nt, Homo Sapiens
uuaaccugcacuugauauaauguuuuuggaggcuaucuggauuauauccuuuaucacaggauu

SEQ ID NO: 496111 - RNA, 63 nt, Homo Sapiens
uaauaucauuuauaaagggaguuucaacuuucuuaucuggaaaaggagacuuuacaaaccuuu

SEQ ID NO: 496112 - RNA, 63 nt, Homo Sapiens
aaaggagcuucuuuuuuuuucgaauugacagguuaucuggaacgaaaaugguauuuggaauuc

SEQ ID NO: 496113 - RNA, 63 nt, Homo Sapiens
gcagguaagugacacucccuguccuagucggucuaucuggacuugcccuugucuguucguggu

SEQ ID NO: 496114 - RNA, 63 nt, Homo Sapiens
aaauagcauuuggcaagucuauaggauucuuccuaucuggaaauucuauuuuguuagagugcg

SEQ ID NO: 496115 - RNA, 63 nt, Homo Sapiens
uggggacagggagggaugggggucccugaugaauaucuggagaccucgacagccugcccuagg

SEQ ID NO: 496116 - RNA, 63 nt, Homo Sapiens
aggaggcucuggaggacaaucuaggaccuacauuaucuggacuguaugcuggucauuucuaga

SEQ ID NO: 496117 - RNA, 63 nt, Homo Sapiens
aggagguuccgggagacaauuuagggcugaugcuaucuggacugucugccaaucauuuuuaga

SEQ ID NO: 496118 - RNA, 63 nt, Homo Sapiens
aggaucuuuucaugugcuuguuaggcauuuguguaucuggaaaaauauucaagucuuuuuuuu

SEQ ID NO: 496119 - RNA, 63 nt, Homo Sapiens
augggcucaaugcaaagguggccgcauuuucacuaucuggaaaccuagugacuuccccuggga

SEQ ID NO: 496120 - RNA, 63 nt, Homo Sapiens
cuggaagucugagaucagaguuauauucucacauaucuggaggaucuggcccaaaacacaaau

SEQ ID NO: 496121 - RNA, 63 nt, Homo Sapiens
guccuuuuguucauacaaaaacaggagaugauauaucuggaauauaauuucugaagucuauac

SEQ ID NO: 496122 - RNA, 63 nt, Homo Sapiens
cccugacagguugcccugggagucccugcugaauaucuggagauggggacagggagggauggg

SEQ ID NO: 496123 - RNA, 63 nt, Homo Sapiens
guuggacauguuuuauugagaaaaugucaccacuaucuggagacacguuaccauaucaagcug

SEQ ID NO: 496124 - RNA, 63 nt, Homo Sapiens
uuuccagggccccucgccgccuuccagcuuugguaucuggagaacuggagaagacuccacgcc

SEQ ID NO: 496125 - RNA, 63 nt, Homo Sapiens
uuuuuaaaauuauguuauuaauuuguuagucuguaucuggagcaaaauuuaaggaaauauauu

SEQ ID NO: 496126 - RNA, 63 nt, Homo Sapiens
gaacacauaaaugauuuuggguuacaguaaagcuaucuggagacaggauaaacauugcuguau

SEQ ID NO: 496127 - RNA, 63 nt, Homo Sapiens
cucuuguauuauaggauuuucacguaagauauauaucuggacuaucuugcaacagaggccagc

SEQ ID NO: 496128 - RNA, 63 nt, Homo Sapiens
cagaggcagauuuuucuucaugaaauucauuucuaucuggauaagagaugccucuuuaacacu

SEQ ID NO: 496129 - RNA, 63 nt, Homo Sapiens
caugcucugaaauccuauaugcuugucuuaagauaucuggagggacacuaagcuauuaauacg

SEQ ID NO: 496130 - RNA, 63 nt, Homo Sapiens
cugaugucuuaacgaauaaaugcugaaaguucauaucuggagcuugcucccggcaagcgcuuc

SEQ ID NO: 496131 - RNA, 63 nt, Homo Sapiens
uuuugugucuggcuugcugaguguaaaaguuguuaucuggacgaucugucucucugcuccaaa

SEQ ID NO: 496132 - RNA, 63 nt, Homo Sapiens
ccgucucgcucaucaucaccgacauguccuucuuaucuggaaagagcacggaaaugcagcggc

SEQ ID NO: 496133 - RNA, 63 nt, Homo Sapiens
uugugugugccuccucagguggaagcauuugacuaucuggaacgggcugggcgggccagcugg

SEQ ID NO: 496134 - RNA, 63 nt, Homo Sapiens
ugguacacugaauucucuggcaagcugauuucuuaucuggaaagccuccccgagccucagccc

SEQ ID NO: 496135 - RNA, 63 nt, Homo Sapiens
gggugguggagaagcagaaggagcaaucaagcuuaucuggauauuucuuucuuuauuuauuuu

SEQ ID NO: 496136 - RNA, 63 nt, Homo Sapiens
uuuucaguuuuuuuuuaaaaaacguacucuuauuaucuggaacauagaaauauaaaagguaac

SEQ ID NO: 496137 - RNA, 63 nt, Homo Sapiens
uauugaguuacuagggagguucuuaaauccucauaucuggaaacuugugacguuuugacaccu

SEQ ID NO: 496138 - RNA, 63 nt, Homo Sapiens
gagaggcccccacccuuggguuuuccagaccuauaucuggaguuaugaaauuucauggaugaa

SEQ ID NO: 496139 - RNA, 63 nt, Homo Sapiens
uuucgacguguuuuccucucaaaaugucaccacuaucuggagacauguuaccauaucaagcug

SEQ ID NO: 496140 - RNA, 63 nt, Homo Sapiens
gacguggaggugauuuucuuauuuuaguugccuuaucuggagaaauuuccauuucucccuguu

SEQ ID NO: 496141 - RNA, 63 nt, Homo Sapiens
uauugaguuacuagggagguucuuaaauccucauaucuggaaacuugugaaguuuugacaccu

SEQ ID NO: 496142 - RNA, 63 nt, Homo Sapiens
acugaacccauuguuucuuucugaagagacuuuccuuucaaggcuucccauggguccgcgcca

SEQ ID NO: 496143 - RNA, 63 nt, Homo Sapiens
cauccaugaugaccauccucauagcucagaucuccuuucaaaguaguggcuuucuggauggua

SEQ ID NO: 496144 - RNA, 63 nt, Homo Sapiens
ggacaaacagcauugggaggccuuaguccugcuccuuucaauuccauccuguaaagaacagga

SEQ ID NO: 496145 - RNA, 63 nt, Homo Sapiens
cccaggucuccucacucaaagucccuucgccaaccuuucaaugcccagcccugacaccugccc

SEQ ID NO: 496146 - RNA, 63 nt, Homo Sapiens
cccugccuguuuuccccaaaguggaaaggaaggccuuucaaaccagagugucucacuccccuc

SEQ ID NO: 496147 - RNA, 63 nt, Homo Sapiens
ggauggauauaugaaguaaggugagauccuuaaccuuucaaaauuuucggguuccagggagac

SEQ ID NO: 496148 - RNA, 63 nt, Homo Sapiens
ggggcaaaacaacacuuugucagugcuuuugaaccuuucaauauuguagcaugcuugaggagu

SEQ ID NO: 496149 - RNA, 63 nt, Homo Sapiens
guucauagccaggaaacccagcucagcaaacucccuuucaaagcugugugaccggcugggcau

SEQ ID NO: 496150 - RNA, 63 nt, Homo Sapiens
aguagaaagaguucaugaagaggcccuccucugccuuucaaaaggcuggucaccuacacaugu

SEQ ID NO: 496151 - RNA, 63 nt, Homo Sapiens
guuuaauuuugcuuuuuuuuuuuuuuuuuuuuuccuuucaacuuaguugacauacgugccuua

SEQ ID NO: 496152 - RNA, 63 nt, Homo Sapiens
acucaauauuccaaauguuuuuuuuuccuuccuccuuucaaaagaguucuuaacccaauuagg

SEQ ID NO: 496153 - RNA, 63 nt, Homo Sapiens
cagaccauuaguuacuauggauuuauuuuuuuuccuuucaaacacgguaaggaaacaaucuau

SEQ ID NO: 496154 - RNA, 63 nt, Homo Sapiens
aguaauuuucuucucauucuucuaaaacuacugccuuucaaagugcacacacacgcguccaca

SEQ ID NO: 496155 - RNA, 63 nt, Homo Sapiens
ggguuacagagagccuccucagaucuguuugugccuuucaaaaguacugggggcagauucuca

SEQ ID NO: 496156 - RNA, 63 nt, Homo Sapiens
agaaguauuuggauauagggaaagaaugaagugccuuucaaguacauuaaaaaucaguuaaga

SEQ ID NO: 496157 - RNA, 63 nt, Homo Sapiens
cugaaaaugaaacccuaucuuucacuuuacauuccuuucaauccaacugaucaaaacugguac

SEQ ID NO: 496158 - RNA, 63 nt, Homo Sapiens
uugguaagacaacaaccucccagugauaugccaccuuucaauuuuccuuuuguggcaaugauu

SEQ ID NO: 496159 - RNA, 63 nt, Homo Sapiens
aggauuucuaugcauucauuauaauuuguuauuccuuucaauauccuuguauuucaaaucuuc

SEQ ID NO: 496160 - RNA, 63 nt, Homo Sapiens
cucccaguaucuauaugaucucccagagaauuuccuuucaaacuaucauggaaaacuaauuuu

SEQ ID NO: 496161 - RNA, 63 nt, Homo Sapiens
aacaagacuuguagaaaauaacgcuuuucagauccuuucaauaaugucauugaaagccuuauu

SEQ ID NO: 496162 - RNA, 63 nt, Homo Sapiens
ccauuuaaaaaacaaaaaccgccaaggcuaguuccuuucaauuaugugugaauucugcaacua

SEQ ID NO: 496163 - RNA, 63 nt, Homo Sapiens
aaguggauaagagggaggaguggggaaaagggcccuuucaaagaagugaguuugcagaaaccu

SEQ ID NO: 496164 - RNA, 63 nt, Homo Sapiens
gguuaaauguaaccauauggucuuggaugcagaccuuucaaagaaggaagaaaugcguuuaga

SEQ ID NO: 496165 - RNA, 63 nt, Homo Sapiens
uccugccuucccccucccuuaggagacguuuauccuuucaaauuuccugauuccucggcgcaa

SEQ ID NO: 496166 - RNA, 63 nt, Homo Sapiens
uuauuuauugaauauguauuucgguuugauggaccuuucaacgaauucguaguaaaugaugcu

SEQ ID NO: 496167 - RNA, 63 nt, Homo Sapiens
uuuuuacugaucucuuagaugaggacaacacugccuuucaaaccaacagguuucagugaugag

SEQ ID NO: 496168 - RNA, 63 nt, Homo Sapiens
auguuguuucuuuggaaaauuucucagcacaaaccuuucaagucaagguuuacuuugguaugg

SEQ ID NO: 496169 - RNA, 63 nt, Homo Sapiens
uggacuugcccaggucuucuucucuccuguaccccuuucaaucucccacacccccuccuaccc

SEQ ID NO: 496170 - RNA, 63 nt, Homo Sapiens
aggaaaccagacaccugagaucugcugccccaaccuuucaaggcccagauagacagggcuggc

SEQ ID NO: 496171 - RNA, 63 nt, Homo Sapiens
uaacuguacugggccauguugucaccuucaccuccuuucaaggcuguaaauuuggcuucuguu

SEQ ID NO: 496172 - RNA, 63 nt, Homo Sapiens
auguucucuaguuucaagcuucagcuuggccagccuuucaacagagacgccguucuuccuguc

SEQ ID NO: 496173 - RNA, 63 nt, Homo Sapiens
ccauuucagugauguuuauaagaaguguuucauccuuucaaaaagaagaaauuguguuaaaau

SEQ ID NO: 496174 - RNA, 63 nt, Homo Sapiens
uauguuuugucuuuuuuacuuuuuucaaaaaucccuuucaaguauguggauaauauuaugaca

SEQ ID NO: 496175 - RNA, 63 nt, Homo Sapiens
caacuuuucauauuuaguuuaauaaugugaugcccuuucaauguucuacacgauccuauuaag

SEQ ID NO: 496176 - RNA, 63 nt, Homo Sapiens
auaaguccaaauagacucuccgaccuucccuucccuuucaagcaauuauggaagaagaguaua

SEQ ID NO: 496177 - RNA, 63 nt, Homo Sapiens
uuguugagauaaauaagugaaaaauaauaccacccuuucaagaucuucaccuauaagacgggg

SEQ ID NO: 496178 - RNA, 63 nt, Homo Sapiens
ucgaggacuggaauuccgagaauggucuugucaccuuucaacuuucaccugauugaaauugga

SEQ ID NO: 496179 - RNA, 63 nt, Homo Sapiens
cauaguuacagaaauuccugcaugaugaauggcccuuucaaugcuagaaucuggaacugucac

SEQ ID NO: 496180 - RNA, 63 nt, Homo Sapiens
uauuuagauaaccacuugauguaguauaucaauccuuucaaacauuuauuuuugacguauaau

SEQ ID NO: 496181 - RNA, 63 nt, Homo Sapiens
uguuuuaugauguuguauagcaaucgcuuuuuaccuuucaaaguuccggguaaaaauguguua

SEQ ID NO: 496182 - RNA, 63 nt, Homo Sapiens
uaaacucagacuucgcuuuuuuugugagacuauccuuucaauauuuuuauaaacuuuugugug

SEQ ID NO: 496183 - RNA, 63 nt, Homo Sapiens
acuaagacauauuuccuuucacuuggcaggauuccuuucaaaauggaaucugaguauuagaca

SEQ ID NO: 496184 - RNA, 63 nt, Homo Sapiens
cauguaaaauauguaaauucuaguaccugaaauccuuucaacagauuuuuauauagcaacugc

SEQ ID NO: 496185 - RNA, 63 nt, Homo Sapiens
uuguugauuguaguaauuucuauuugcacugugccuuucaacuccagaaacauucugaagaug

SEQ ID NO: 496186 - RNA, 63 nt, Homo Sapiens
cauucggcuaacgagggauuacuuuggccaaaaccuuucaaaggauaugcagaaagaugguag

SEQ ID NO: 496187 - RNA, 63 nt, Homo Sapiens
auuucuguaaacauauuucugaaauauuuuuugccuuucaagcgacagaugccucauuuugug

SEQ ID NO: 496188 - RNA, 63 nt, Homo Sapiens
uagcaaacacggaagaauuuuaaaaugagcucuccuuucaacccuuguuaacaagugccuaaa

SEQ ID NO: 496189 - RNA, 63 nt, Homo Sapiens
acuaaucaauuuuuauuauuggaauaguuuuaaccuuucaaauacauguucuguccuggagca

SEQ ID NO: 496190 - RNA, 63 nt, Homo Sapiens
guugacaugugcuuuggggcuuuuacaccaguuccuuucaaugguuugcaaggaagccacagc

SEQ ID NO: 496191 - RNA, 63 nt, Homo Sapiens
gaccgcugacguucccaagugacagauccagggccuuucaaacauccccaaagucauggccau

SEQ ID NO: 496192 - RNA, 63 nt, Homo Sapiens
uucacauccaccucugacuuuuaggaaauaaaaccuuucaaauccucuuaaagcugccuguag

SEQ ID NO: 496193 - RNA, 63 nt, Homo Sapiens
uuacaucauguccugaacaaauagcaauaugcaccuuucaacuguaaaggcagccuuuaaaac

SEQ ID NO: 496194 - RNA, 63 nt, Homo Sapiens
ugagacaagguggacaccaauuuuguuugucugccuuucaaagaaaaauaauuccuuuuuugu

SEQ ID NO: 496195 - RNA, 63 nt, Homo Sapiens
auauuagauaauuggagcugaccauaucagcauccuuucaagauuguggggggacacaaccaa

SEQ ID NO: 496196 - RNA, 63 nt, Homo Sapiens
uaguuaccaaaucauaaacaugauaauauaaugccuuucaaaugagcuaaucugauacacuuu

SEQ ID NO: 496197 - RNA, 63 nt, Homo Sapiens
augcuuaccucgagugacccucuuugauucagcccuuucaaacuuguggacuuccugccuugu

SEQ ID NO: 496198 - RNA, 63 nt, Homo Sapiens
caauaaaagcuuauuguccauucacugcaaugaccuuucaaugcagcaagcaauccccaaccu

SEQ ID NO: 496199 - RNA, 63 nt, Homo Sapiens
cacuuaaguguuagaucuaagauuuuuuacugcccuuucaaagcaauucuugaauuccuuggg

SEQ ID NO: 496200 - RNA, 63 nt, Homo Sapiens
ugaaagguuuguaguugagaucauguuagagacccuuucaacacuucauaauaauaaaacaac

SEQ ID NO: 496201 - RNA, 63 nt, Homo Sapiens
uauggcccauuaaaagcucuuggcagacauuucccuuucaauuaaaugcccggagauuccaag

SEQ ID NO: 496202 - RNA, 63 nt, Homo Sapiens
acuccauguuuuauuuaauaacauuacuucuagccuuucaauucuauugguuauguuaguauc

SEQ ID NO: 496203 - RNA, 63 nt, Homo Sapiens
uagcuuauuucacaaauauccggauugugguguccuuucaaauaggaagaaagucgcuuuuga

SEQ ID NO: 496204 - RNA, 63 nt, Homo Sapiens
gccuuugagaagaauagaagucauaaaaguaucccuuucaaauuuguucuacagcaagaauau

SEQ ID NO: 496205 - RNA, 63 nt, Homo Sapiens
gagaaugaaucaugauggcaagcguuaacaguuccuuucaaagaaaaaaaaauucacacugcc

SEQ ID NO: 496206 - RNA, 63 nt, Homo Sapiens
uauaccuuccaagugaauauaaaacaucauuugccuuucaauucuacucauagucugagucau

SEQ ID NO: 496207 - RNA, 63 nt, Homo Sapiens
ccacaacaaaaccucaguuuggauuccaauggaccuuucaaaauugacaugcuuugcaaaucu

SEQ ID NO: 496208 - RNA, 63 nt, Homo Sapiens
acaguuaagccaaaagguacgucugggaaaguaccuuucaacacgugacuaucacagcacuug

SEQ ID NO: 496209 - RNA, 63 nt, Homo Sapiens
guuuuuaauuauuuuuguuuacauuuuuuuuuaccuuucaaagcuuucugaauucuugcuugu

SEQ ID NO: 496210 - RNA, 63 nt, Homo Sapiens
ccauuucccuucucuuucccauagauucccccaccuuucaaacugguuuguauuuauuucaaa

SEQ ID NO: 496211 - RNA, 63 nt, Homo Sapiens
gguugucucugaaccaggagagaagguacuauaccuuucaaauccccagggcagacacacccc

SEQ ID NO: 496212 - RNA, 63 nt, Homo Sapiens
ucuuacaguuuuuacucaugauaaaucuuaucaccuuucaaaaauugauuguggugccucagg

SEQ ID NO: 496213 - RNA, 63 nt, Homo Sapiens
agaacuaauaaaugcaccuuaauggucaguguuccuuucaaacaugugaguucuuuaacaaaa

SEQ ID NO: 496214 - RNA, 63 nt, Homo Sapiens
gaagcuggugagccaguggccauuagauaaauaccuuucaagugugagcuuagacgucaaccc

SEQ ID NO: 496215 - RNA, 63 nt, Homo Sapiens
aaaaaaaaaaaaagcuugaucucuaucagacuuccuuucaacuguccuccccuccaagcagac

SEQ ID NO: 496216 - RNA, 63 nt, Homo Sapiens
ggaaaaaaauaaaaaauauauaguggacaguaaccuuucaaucaaaacucaguaucauaagua

SEQ ID NO: 496217 - RNA, 63 nt, Homo Sapiens
gugaagcugaugccuaggaacuuuuaaagggauccuuucaaaaggaucacuuagcaaacacau

SEQ ID NO: 496218 - RNA, 63 nt, Homo Sapiens
uuuuuuuuuaaguucaguucucccuuauggcugccuuucaaacaaguaccuuuuaucugaugc

SEQ ID NO: 496219 - RNA, 63 nt, Homo Sapiens
gccaggauuuuuucagcuggaaagauacgccauccuuucaaacccucaugacugacaaaaacu

SEQ ID NO: 496220 - RNA, 63 nt, Homo Sapiens
uaaaacaaaaauuucuagguauuugcuuuauuaccuuucaaauauuuacuguugcuuggcccc

SEQ ID NO: 496221 - RNA, 63 nt, Homo Sapiens
cuuacaaagcuaagacuuuuuguguguuuuuuuccuuucaaguuuuuauguaggaguuuuaaa

SEQ ID NO: 496222 - RNA, 63 nt, Homo Sapiens
uggaaaauuaauucuaaacuauaaaguccugaaccuuucaaaaaaagaguaaggguaaaaaag

SEQ ID NO: 496223 - RNA, 63 nt, Homo Sapiens
uuguuucauaauuguuagaugugaaucauccugccuuucaaaugccucuacugggucuauauu

SEQ ID NO: 496224 - RNA, 63 nt, Homo Sapiens
cccaaacacugaguccucugccugggaccacccccuuucaaguacuggaagggacccuggagc

SEQ ID NO: 496225 - RNA, 63 nt, Homo Sapiens
uugacauauggccaucccauucacaguccccacccuuucaaagaccaugaugcugggguuacc

SEQ ID NO: 496226 - RNA, 63 nt, Homo Sapiens
agguugcccagagaaaagcuacagggaauagaaccuuucaaaguuuuaagcaaggcaugggga

SEQ ID NO: 496227 - RNA, 63 nt, Homo Sapiens
ccucagguuugccucuaacccaauugagauuugccuuucaaacaaagcaaaaaaauaaaacca

SEQ ID NO: 496228 - RNA, 63 nt, Homo Sapiens
ucaaucuuuggaaaauauuguuagaaaugacucccuuucaaaggcuaucuuuuuuagaaacua

SEQ ID NO: 496229 - RNA, 63 nt, Homo Sapiens
ugcuucaaucuuaucaacgcuucccuguacuuaccuuucaacacagucauucugaaaggaccu

SEQ ID NO: 496230 - RNA, 63 nt, Homo Sapiens
caggaggaagaaaaggaagaucaugacaguugcccuuucaaagacauucuguuaagauauccc

SEQ ID NO: 496231 - RNA, 63 nt, Homo Sapiens
ucacacacauaguauugaucauucauuuugacuccuuucaauguaaaugcagcuaagucauac

SEQ ID NO: 496232 - RNA, 63 nt, Homo Sapiens
gauugcuuugaaaacaugacucaauaaaaguuuccuuucaauuuaaacacugaagccgcucug

SEQ ID NO: 496233 - RNA, 63 nt, Homo Sapiens
aaugcuucuagaguuuuauagccuggacugcuaccuuucaaagcuuggagggaagccgugaau

SEQ ID NO: 496234 - RNA, 63 nt, Homo Sapiens
acuguccacccucauuucugccagcgcauguguccuuucaaggggaaaaugugaagcugaacc

SEQ ID NO: 496235 - RNA, 63 nt, Homo Sapiens
auuuuuuaaaaaagaaauagucaguguuuuccuccuuucaaccgagacuauuucuggauugug

SEQ ID NO: 496236 - RNA, 63 nt, Homo Sapiens
acuguuuguugcauuucaguaaaagcagaauaaccuuucaaaauaauaacaggcugggugcaa

SEQ ID NO: 496237 - RNA, 63 nt, Homo Sapiens
uuauucuguauaaaacugucuuuuaagaauuauccuuucaaaauaaaaauguuauuguuucac

SEQ ID NO: 496238 - RNA, 63 nt, Homo Sapiens
aguauagagagaauagugaaaaauuaaucuugcccuuucaagccuuauacaguaguacacugu

SEQ ID NO: 496239 - RNA, 63 nt, Homo Sapiens
ucaaguaucugugguuucaugccccucucuauaccuuucaaagaacuccugaagcaacuuaac

SEQ ID NO: 496240 - RNA, 63 nt, Homo Sapiens
uuacauuugcuaaacagacaguuaauaucaaauccuuucaauauucugggaacccagggaagu

SEQ ID NO: 496241 - RNA, 63 nt, Homo Sapiens
ugggugcccuggaggggccugugguccauggagccuuucaaaaaaacguuaacaaaccccauc

SEQ ID NO: 496242 - RNA, 63 nt, Homo Sapiens
aguuuugcuauuuaauuuauuugaauuauaauuccuuucaaauuaucaguaagucaaaucugu

SEQ ID NO: 496243 - RNA, 63 nt, Homo Sapiens
ugccuuucuugaccuuaugcauuguucuucuccccuuucaaauuuguggaauauggcaauagc

SEQ ID NO: 496244 - RNA, 63 nt, Homo Sapiens
ucagccugugugccugauguguggucuuuuuuuccuuucaagcaauccccaaagacauuaucu

SEQ ID NO: 496245 - RNA, 63 nt, Homo Sapiens
cuuuuuacugcaacuagaguuuugauaugaccaccuuucaacaguacaaaagaaaaccaagau

SEQ ID NO: 496246 - RNA, 63 nt, Homo Sapiens
uuuuccuaaugauuugcagauuuugauuuuuaaccuuucaacagggaucaccacuauauuuug

SEQ ID NO: 496247 - RNA, 63 nt, Homo Sapiens
uuaaagagaaaaaucucauauaauuugucauaaccuuucaauaaauaaaacuguuaaaucaug

SEQ ID NO: 496248 - RNA, 63 nt, Homo Sapiens
uauuuccuauguuacauuucuuuugucuauuuuccuuucaaaauugguauuuuuguugggcuc

SEQ ID NO: 496249 - RNA, 63 nt, Homo Sapiens
gcaaggagcaucgaaauuugagauacccaggacccuuucaagcaagaauggccaaaaagccuu

SEQ ID NO: 496250 - RNA, 63 nt, Homo Sapiens
aacuaccauuauguuuuaguacuaagggauauaccuuucaauaaaguuaaugaaauucaaucc

SEQ ID NO: 496251 - RNA, 63 nt, Homo Sapiens
cuccauucaguuuuaucuccaucaauaaaguggccuuucaaaaagaaucuuccucuugcucuc

SEQ ID NO: 496252 - RNA, 63 nt, Homo Sapiens
ccacauccgugcugugucauuguugcucugcuuccuuucaaugugucagugccuggggggagg

SEQ ID NO: 496253 - RNA, 63 nt, Homo Sapiens
cacauggcagcauuucccuuuuccccuccuuugccuuucaagagcagggccugggcaaggcca

SEQ ID NO: 496254 - RNA, 63 nt, Homo Sapiens
aagagguguggcuuuccucaccaggaguaaaaaccuuucaaaaggcagcagggcagaggugca

SEQ ID NO: 496255 - RNA, 63 nt, Homo Sapiens
ggaaguuggaccucaggccuggaggcuagaaaaccuuucaauuccuuggauguaggauuucag

SEQ ID NO: 496256 - RNA, 63 nt, Homo Sapiens
uguuugguacugacagcugaugagaagcucgcuccuuucaacuaaggagaaaaaaaaauaugg

SEQ ID NO: 496257 - RNA, 63 nt, Homo Sapiens
auugccuuuuuauaaaauuguucugagccagauccuuucaaagguuguguaauguuuguauau

SEQ ID NO: 496258 - RNA, 63 nt, Homo Sapiens
ucaagaacuuuggaaaugcaacuggaauuuuauccuuucaacuauacauccuuuuagcaaaag

SEQ ID NO: 496259 - RNA, 63 nt, Homo Sapiens
ucugagugugguaauugugccucuagcacccagccuuucaaagcccaccugaaaccugggggu

SEQ ID NO: 496260 - RNA, 63 nt, Homo Sapiens
aauucuuuuggcacacuauuaaaugcaaaaacuccuuucaaaacaaaaaagaacuaccuuaua

SEQ ID NO: 496261 - RNA, 63 nt, Homo Sapiens
ccccugcucauugguggauguuaaaccaauauuccuuucaacugcugccugcuagggaaaaac

SEQ ID NO: 496262 - RNA, 63 nt, Homo Sapiens
cuccuggucauugguggauguuaaacccauauuccuuucaacugcugccugcuagggaaaacu

SEQ ID NO: 496263 - RNA, 63 nt, Homo Sapiens
aaaaugcaggcucuauuguuuucaauuuagcagccuuucaaauguauaugguucuggccacau

SEQ ID NO: 496264 - RNA, 63 nt, Homo Sapiens
uaaggugcuauauucccucagagcucacaaaugccuuucaauucuuucccugaccuccuuucc

SEQ ID NO: 496265 - RNA, 63 nt, Homo Sapiens
uuuggcugcaggauuaaguaaugaugagucuucccuuucaacuguuguuaaaucugagacauc

SEQ ID NO: 496266 - RNA, 63 nt, Homo Sapiens
ugauggcgauucccucucacccgggacucucccccuuucaaggaaagugaaccuuuaaaguaa

SEQ ID NO: 496267 - RNA, 63 nt, Homo Sapiens
ucacuaccaaacucagcccuucuuggaauacagccuuucaagcagaggacagaaggguccuuc

SEQ ID NO: 496268 - RNA, 63 nt, Homo Sapiens
gaacaggaagguauguccugucaguaucuuaacccuuucaacaagacauuuaccuauuugucu

SEQ ID NO: 496269 - RNA, 63 nt, Homo Sapiens
cuaacacauuacauuucaaaaacuauuuugguaccuuucaaauacaguguuuaaauuaaaaua

SEQ ID NO: 496270 - RNA, 63 nt, Homo Sapiens
uuauaugcuuguguaacaggaacaaaguaacagccuuucaauucauauacugccuuguguuca

SEQ ID NO: 496271 - RNA, 63 nt, Homo Sapiens
uggaaaaccguuauagacccaauaacaacuaaaccuuucaaaagaaaauauuuucuauuauga

SEQ ID NO: 496272 - RNA, 63 nt, Homo Sapiens
ccagccagaagagggaccaccuguaaagcaaguccuuucaaguuucacugcacaucccaaacc

SEQ ID NO: 496273 - RNA, 63 nt, Homo Sapiens
uaaacagaagugaaucagacuuuucuccagcuaccuuucaaaauaauaaauuauuugucucaa

SEQ ID NO: 496274 - RNA, 63 nt, Homo Sapiens
gccgcauccccaaccaauccacagccuggaguaccuuucaaggucaaagugcauggccagcuc

SEQ ID NO: 496275 - RNA, 63 nt, Homo Sapiens
aaaguuaugcacaaaugugaccuacccugucagccuuucaauaacaccccuccguuccgcuag

SEQ ID NO: 496276 - RNA, 63 nt, Homo Sapiens
cuuucuuuucugccguuaaacuuuggaaauaacccuuucaagacgggucggaggagacaaacu

SEQ ID NO: 496277 - RNA, 63 nt, Homo Sapiens
uuaaccaaguauuuucuuugccucuaacuagguccuuucaacuaauuagaaaccaccaucuaa

SEQ ID NO: 496278 - RNA, 63 nt, Homo Sapiens
cugacucuucucaaucaucucugcagcauccagccuuucaaagcgcuauucagaugcagagca

SEQ ID NO: 496279 - RNA, 63 nt, Homo Sapiens
auuuaguugaaugacucccucucagggccuuccccuuucaacaaccaagaacaguugagcucu

SEQ ID NO: 496280 - RNA, 63 nt, Homo Sapiens
uaccugguuuuuacagcauuccuauaaauaaccccuuucaauaaucaauggcuuuauuuuuaa

SEQ ID NO: 496281 - RNA, 63 nt, Homo Sapiens
auagugacauagaguaguuguaauuuauucuuuccuuucaauuuuagcaggacuuaauuuucu

SEQ ID NO: 496282 - RNA, 63 nt, Homo Sapiens
gaguuacgugaaaagagcauaugguaauuguaaccuuucaaauuuaauggaguuaaaauguuu

SEQ ID NO: 496283 - RNA, 63 nt, Homo Sapiens
acugcauugugaauaaacuucaacuguuuuauuccuuucaacacagaagcgagaugccauugc

SEQ ID NO: 496284 - RNA, 63 nt, Homo Sapiens
aggggaugguacauuuauuuaggcuuauugaaaccuuucaaguguacaaccugaaaaauguua

SEQ ID NO: 496285 - RNA, 63 nt, Homo Sapiens
ugaaaaucaagcaguaugaguagauuauuguaaccuuucaaccugccauguaauugaaauaua

SEQ ID NO: 496286 - RNA, 63 nt, Homo Sapiens
guaaacuccuuuaguaccaucauauuuccccagccuuucaacuccuuuggcuuuucgugaaga

SEQ ID NO: 496287 - RNA, 63 nt, Homo Sapiens
auccaauuaaauguggguagcacuucaacguguccuuucaaucguagcaaaaaucaugaaaaa

SEQ ID NO: 496288 - RNA, 63 nt, Homo Sapiens
ucaaauuuucauuuuaacugaucagcaugcuacccuuucaaacugucuuuuuccucuuaaugu

SEQ ID NO: 496289 - RNA, 63 nt, Homo Sapiens
ggugggcuccagggcgggaggcaagcccccuugccuuucaaacuggaaaccccagagaaaacg

SEQ ID NO: 496290 - RNA, 63 nt, Homo Sapiens
ucuuauggaaacugauuuauaucuuuuuuaugaccuuucaaaaguaaaauacuaugcauaauc

SEQ ID NO: 496291 - RNA, 63 nt, Homo Sapiens
cagcuuugaaggcuggauucuaucuacauaaguccuuucaauuccaccagggccagagcagcu

SEQ ID NO: 496292 - RNA, 63 nt, Homo Sapiens
uaagagaggauucuuuucauccuaaaucuuuuaccuuucaaucuuuguaucuauuauuacacg

SEQ ID NO: 496293 - RNA, 63 nt, Homo Sapiens
agauuaaaaauuagcugcguguaguagcauaugccuuucaacguagcuacucaggaggcugag

SEQ ID NO: 496294 - RNA, 63 nt, Homo Sapiens
uuuuuaaaucaaacugaaaacaaaaagcuuuaaccuuucaacagaauuuuuaaaaaggcaguu

SEQ ID NO: 496295 - RNA, 63 nt, Homo Sapiens
auaaaauaucuauuugaauaaauuaugagcuauccuuucaaacagcuauuggcaaguuuuaaa

SEQ ID NO: 496296 - RNA, 63 nt, Homo Sapiens
gggaaagcauuuucuauaucaauuguguuuaaaccuuucaagaagguuauuuagcuagcuuag

SEQ ID NO: 496297 - RNA, 63 nt, Homo Sapiens
cuguugacccucugucugguucaauuauuuucuccuuucaacuuaaaaacuuggaccucaucc

SEQ ID NO: 496298 - RNA, 63 nt, Homo Sapiens
auuaagguauaauaggcugugcaugugaagaucccuuucaauuaaguguuuuaucuggauuua

SEQ ID NO: 496299 - RNA, 63 nt, Homo Sapiens
uguuuucuauuucuaaauuagguuuuuuuuuuuccuuucaagaauuugccuguauguuuugug

SEQ ID NO: 496300 - RNA, 63 nt, Homo Sapiens
cagacuuuucauuuuagagacuuaggaugugucccuuucaacuuacccuauaaaucucaacag

SEQ ID NO: 496301 - RNA, 63 nt, Homo Sapiens
ccauggaccugauuuuuccaugaguuaucaccaccuuucaauuuacuuuagcauaaaaaaugu

SEQ ID NO: 496302 - RNA, 63 nt, Homo Sapiens
uuuuacugagaauaucgaaagaucucugacuuuccuuucaaaucuacugauuucuguuuuugu

SEQ ID NO: 496303 - RNA, 63 nt, Homo Sapiens
uagccaaguuuucugcgagcgagaucgaugccuccuuucaagccugcuagcaaccacacugaa

SEQ ID NO: 496304 - RNA, 63 nt, Homo Sapiens
accauaagguacaucaguuaaguauugagucuuccuuucaaggaauuaacuuugacuccugga

SEQ ID NO: 496305 - RNA, 63 nt, Homo Sapiens
accucccggguuccagggauucuccugccucacccuuucaaguagcugggauuacagguaccu

SEQ ID NO: 496306 - RNA, 63 nt, Homo Sapiens
uuuuaaaaaccugaagcuuuuuugguggcaggaccuuucaauaaauauuuauuuggucaaaau

SEQ ID NO: 496307 - RNA, 63 nt, Homo Sapiens
agcucaaguugaauuuucuuuccagccaguuacccuuucaaccuacccauacuuuguacaacu

SEQ ID NO: 496308 - RNA, 63 nt, Homo Sapiens
uauucacgcaguuacucgcuuccauuuuuaugaccuuucaacuauagguaauaacucuuagag

SEQ ID NO: 496309 - RNA, 63 nt, Homo Sapiens
guauuucucuauacguauugguacuugaagauuccuuucaaaagaaauccagcguuuuccuaa

SEQ ID NO: 496310 - RNA, 63 nt, Homo Sapiens
caaucgucugggcucguggauguugcugagaugccuuucaaugcucagacuuucauauuucug

SEQ ID NO: 496311 - RNA, 63 nt, Homo Sapiens
ucaggcucauuuucuucucaggcaagaacuuucccuuucaacuuuauucccagcacuguuuca

SEQ ID NO: 496312 - RNA, 63 nt, Homo Sapiens
aauagauguaaauuacccuuacucauaaugagcccuuucaagguaauaauuaguugcugcagu

SEQ ID NO: 496313 - RNA, 63 nt, Homo Sapiens
agaaaauucuaaugauuggcuggcugaucuaugccuuucaacuacuuguugguguggaucuau

SEQ ID NO: 496314 - RNA, 63 nt, Homo Sapiens
ccagaggguugcugguccuggauucggggcugaccuuucaaacgagcaggcuuguggcagccu

SEQ ID NO: 496315 - RNA, 63 nt, Homo Sapiens
guguuuguaaaccaaguucaauguuucucuaacccuuucaaaaucuucucagguugccaggaa

SEQ ID NO: 496316 - RNA, 63 nt, Homo Sapiens
uauuuauaugaggaagucacaaaacuuaaguacccuuucaaacguauaucacaauuuggguga

SEQ ID NO: 496317 - RNA, 63 nt, Homo Sapiens
auggauaacucugugaacagcuuuguuguugucccuuucaaauucauguacccaguguuaacu

SEQ ID NO: 496318 - RNA, 63 nt, Homo Sapiens
aauguucccucaaauagcacggggaagcaacugccuuucaaggguaauugaggcugaaugaau

SEQ ID NO: 496319 - RNA, 63 nt, Homo Sapiens
ucauucaaucuguuuuuuuaaauguuauuuuugccuuucaauguaaucaauuggauuaacaau

SEQ ID NO: 496320 - RNA, 63 nt, Homo Sapiens
uucuucauuggaugugaucugaacuuuuuuucuccuuucaacauacuuaggcuguggagugca

SEQ ID NO: 496321 - RNA, 63 nt, Homo Sapiens
agauaaaguugaaaucauagaagaugcaaaugaccuuucaaaaucaacacaauguguucugaa

SEQ ID NO: 496322 - RNA, 63 nt, Homo Sapiens
gggcuuaauaagcagccguuugcuaaugugcuuccuuucaaaggguuggaccuuuaaauugcu

SEQ ID NO: 496323 - RNA, 63 nt, Homo Sapiens
ccacaccuccagagcagugggacuuccuccugcccuuucaaagaauaaccacagcucagaaga

SEQ ID NO: 496324 - RNA, 63 nt, Homo Sapiens
aaagaccuugagaaaacagcuauuguauacauuccuuucaaaugauaucaguugaaugccuua

SEQ ID NO: 496325 - RNA, 63 nt, Homo Sapiens
uauaugacauaaacuuauuuauauaccaaugauccuuucaaauuaccaaacuuaacuggauua

SEQ ID NO: 496326 - RNA, 63 nt, Homo Sapiens
caguuucuacauguuuaaguaauuucuuuuaucccuuucaaauuucuacugauuguaagucag

SEQ ID NO: 496327 - RNA, 63 nt, Homo Sapiens
aaauagguggcagcuucacuugagcagcaaaugccuuucaagauucuggugguagacugguag

SEQ ID NO: 496328 - RNA, 63 nt, Homo Sapiens
cagcccggcaaaagcuagacacauccaccuaauccuuucaaaucuggugagggcuggcccuaa

SEQ ID NO: 496329 - RNA, 63 nt, Homo Sapiens
uaaugaaauugauaguaccaguggaaaagacauccuuucaaugucaaauaugaucagagaauu

SEQ ID NO: 496330 - RNA, 63 nt, Homo Sapiens
gcagcaucaaccuacgugguaacaguuuguaagccuuucaacaugagcuuuaaaaacuugaaa

SEQ ID NO: 496331 - RNA, 63 nt, Homo Sapiens
ugcugggauuacagacaugaucgccugccucggccuuucaaagaacuccugaccucaggugau

SEQ ID NO: 496332 - RNA, 63 nt, Homo Sapiens
aggcucucauuuccugugucuuguauauucaguccuuucaauacguccaccuggaggcucacc

SEQ ID NO: 496333 - RNA, 63 nt, Homo Sapiens
acagauuucuauuuuugucaaaacuucaugguuccuuucaagaucuuuuuugccaaaacauuu

SEQ ID NO: 496334 - RNA, 63 nt, Homo Sapiens
ugacuuuuacacacauucacacaagaaaaaaauccuuucaaaauucuuaaaucuucuguuccu

SEQ ID NO: 496335 - RNA, 63 nt, Homo Sapiens
uccuuugaaagagcuccaaauugguggcauuauccuuucaaaaucucagggauuugggaugaa

SEQ ID NO: 496336 - RNA, 63 nt, Homo Sapiens
aggcuccacuuggucugugagaugcuagaacucccuuucaacagaauucacuuguggcuauug

SEQ ID NO: 496337 - RNA, 63 nt, Homo Sapiens
gaugacucuucuuaucacacuugcaaaugaaugccuuucaaacauugagacugcuagaaccaa

SEQ ID NO: 496338 - RNA, 63 nt, Homo Sapiens
aaaucuagauuuauaccauuuuuuaaagucccaccuuucaauguuuaauaaaacaaaaagaga

SEQ ID NO: 496339 - RNA, 63 nt, Homo Sapiens
aagauuuaagauguacgacauuauacuccaccuccuuucaaaauucacuauucauuuagguuu

SEQ ID NO: 496340 - RNA, 63 nt, Homo Sapiens
ugaaggaacauuguucucuagucagcaucucugccuuucaaaacuaacugggaccuugaacaa

SEQ ID NO: 496341 - RNA, 63 nt, Homo Sapiens
caacaagggcccuucccugccuucugaucauggccuuucaaccgguggccuuuucuggguuau

SEQ ID NO: 496342 - RNA, 63 nt, Homo Sapiens
cccuggucagguauuauuauucagagccauuacccuuucaagcuucuuauugcaaagcuucag

SEQ ID NO: 496343 - RNA, 63 nt, Homo Sapiens
aucuaaaugaaaacacacaaguuguuagcaaacccuuucaaccaaagccuaaauugggaaaca

SEQ ID NO: 496344 - RNA, 63 nt, Homo Sapiens
uccacugcagagcuuuuaucuaaaugaguguuuccuuucaaagaaaacaggauaaucguggug

SEQ ID NO: 496345 - RNA, 63 nt, Homo Sapiens
gaauucacuuguggcuauuagaugcuagaacucccuuucaacaaggauccacuuggucuguga

SEQ ID NO: 496346 - RNA, 63 nt, Homo Sapiens
gaauggguuugaaaaaccucguggauuaaaaggccuuucaaaauuaaauugguuuacaugaaa

SEQ ID NO: 496347 - RNA, 63 nt, Homo Sapiens
ccauggguucuguguccguggaaauacagucagccuuucaaauggaaaaacaaaccuaaaaua

SEQ ID NO: 496348 - RNA, 63 nt, Homo Sapiens
cugggguugucuauacccaccccugacuuuaccccuuucaagcagauuguggguuucccaucc

SEQ ID NO: 496349 - RNA, 63 nt, Homo Sapiens
auuuuaaauaugacaauauuuggagaauucaugccuuucaagcgcaaacugcuuuuccauuaa

SEQ ID NO: 496350 - RNA, 63 nt, Homo Sapiens
ucuucuugagguauguauuguaaguaauugaguccuuucaauggcuauguuaaguugucuuau

SEQ ID NO: 496351 - RNA, 63 nt, Homo Sapiens
caacacuacucacucaguagcuagcagccccuuccuuucaacugggaguguuauuagaaugaa

SEQ ID NO: 496352 - RNA, 63 nt, Homo Sapiens
caccugccccuuucuuucaaucccacgcuguuuccuuucaaaguucugggaggacgaacucac

SEQ ID NO: 496353 - RNA, 63 nt, Homo Sapiens
uuacuuuuucauguauauccaggcuauaaauauccuuucaaaucauguucuuauaccuaauuu

SEQ ID NO: 496354 - RNA, 63 nt, Homo Sapiens
gauggacaaugcaugggguggucuuuauuuuucccuuucaaauaaaacacuagucagguaccg

SEQ ID NO: 496355 - RNA, 63 nt, Homo Sapiens
gcucuuaaaggagaucaccucuuaaaggacccaccuuucaaugccauuacacuggcaauuuaa

SEQ ID NO: 496356 - RNA, 63 nt, Homo Sapiens
acaguauaacuaaacaugauauaucagcuuuugccuuucaauuuaucaaucucuuaaagagaa

SEQ ID NO: 496357 - RNA, 63 nt, Homo Sapiens
acuugugucaauauuaaagauagcugagaagcaccuuucaaauggcacagucccucuucaaga

SEQ ID NO: 496358 - RNA, 63 nt, Homo Sapiens
aguuauuuaacaaugagcccccagaauccuucaccuuucaaggauagccaaugauuuuauccc

SEQ ID NO: 496359 - RNA, 63 nt, Homo Sapiens
auauauuuaaaaucuuugaaaguuuaucaauacccuuucaaaaugaucaaaucugcuuuucaa

SEQ ID NO: 496360 - RNA, 63 nt, Homo Sapiens
uacauugcccacccugaaggacaagugaggcuaccuuucaaacaagcacccaccaggcaggcu

SEQ ID NO: 496361 - RNA, 63 nt, Homo Sapiens
cccuuacaccaugucaaacuauccgcguuuaccccuuucaacuggucaaguaaucugcucuuu

SEQ ID NO: 496362 - RNA, 63 nt, Homo Sapiens
ggccacuggccauuuuuuucuaauuuuaauauaccuuucaaucuucagaauuaaaacugcccu

SEQ ID NO: 496363 - RNA, 63 nt, Homo Sapiens
cagaaagagacaggagacaugugacaaacauauccuuucaagagaucccagagagcagcuuca

SEQ ID NO: 496364 - RNA, 63 nt, Homo Sapiens
auggcaugggcauucuguaucacaaaagcaaauccuuucaagauuuucuuugcaaaaccccuc

SEQ ID NO: 496365 - RNA, 63 nt, Homo Sapiens
guaucucugccuaggaacaucccauuucaguacccuuucaaaggagaaagaagaaaauggcug

SEQ ID NO: 496366 - RNA, 63 nt, Homo Sapiens
aaucauuguccucaggaaagcuuacaaaacaagccuuucaaaccauauauuccuccuggcuuc

SEQ ID NO: 496367 - RNA, 63 nt, Homo Sapiens
aaacucuuaagauaucuagggacuuggaaguauccuuucaaaauuuugaucuucuuguuuucu

SEQ ID NO: 496368 - RNA, 63 nt, Homo Sapiens
uuuagacaaugaaaauuaucaagagauaauuuaccuuucaauuaugauaaauagaugugauug

SEQ ID NO: 496369 - RNA, 63 nt, Homo Sapiens
uauauaacuaaucuguuaacgguuuuugaaaaaccuuucaaauuauuugaauaaucuucauau

SEQ ID NO: 496370 - RNA, 63 nt, Homo Sapiens
aucaaaagagcucuaaauuuguaauuucuuucuccuuucaaaaaaugucuacuuuguuuuggu

SEQ ID NO: 496371 - RNA, 63 nt, Homo Sapiens
aacuccuguccucaagugauccucccaccucagccuuucaaagugcuggaauuacagguguga

SEQ ID NO: 496372 - RNA, 63 nt, Homo Sapiens
agguugguucuuccuguuauucucucuggcuuuccuuucaacccacuuauuuucagaggccuc

SEQ ID NO: 496373 - RNA, 63 nt, Homo Sapiens
uguucuguucugcugccuuuuacguuuucuuguccuuucaaaaguguucuugaaagaaacaaa

SEQ ID NO: 496374 - RNA, 63 nt, Homo Sapiens
cugcaggcagauggaccggaggguuuucugcuuccuuucaaccagauaacuuccuaaguggag

SEQ ID NO: 496375 - RNA, 63 nt, Homo Sapiens
aagaccuuuuuucaccguuaccuaauuuuuuccccuuucaagaauuuuuuuuuuuuuuggugu

SEQ ID NO: 496376 - RNA, 63 nt, Homo Sapiens
cagcguugacacagccgugacuuacaauuaaacccuuucaauuacaguacagauucugugugc

SEQ ID NO: 496377 - RNA, 63 nt, Homo Sapiens
ucuuucugauagauuuccuccaguuucccaguuccuuucaaccauugaccacgagucucacuu

SEQ ID NO: 496378 - RNA, 63 nt, Homo Sapiens
auaaaacaaaauauugcauuccccuucuguuccccuuucaaaaaacuaauuggaaacacucuu

SEQ ID NO: 496379 - RNA, 63 nt, Homo Sapiens
aucaaacuugauaauaaugaaaagaaagaaaggccuuucaagaugugauggugguaagccuuc

SEQ ID NO: 496380 - RNA, 63 nt, Homo Sapiens
cuaaaaauugacccuaucaauaucuugaagaacccuuucaacuccuaaauaagggugguggac

SEQ ID NO: 496381 - RNA, 63 nt, Homo Sapiens
auuaauuuuaauagccugugaguuuggacaguaccuuucaaugauuuuaagugacagugccau

SEQ ID NO: 496382 - RNA, 63 nt, Homo Sapiens
aaaugauugguucaaaaggacagagaaagaaaaccuuucaaccuuauauguaaucaccuaugu

SEQ ID NO: 496383 - RNA, 63 nt, Homo Sapiens
uuuuaucacucacaaguagucuagccaccaccaccuuucaacuuaaaauagcauuaggucuau

SEQ ID NO: 496384 - RNA, 63 nt, Homo Sapiens
aaaaacuugcaauagagggaugguguugacuguccuuucaaggacauccucugauucuaggug

SEQ ID NO: 496385 - RNA, 63 nt, Homo Sapiens
gaguugucugcaacauuuuuccaacaccaauacccuuucaaaauagaaaacacacuuccugca

SEQ ID NO: 496386 - RNA, 63 nt, Homo Sapiens
aaguuguugcauucccaauuuucauugcacuuuccuuucaauacuuuuaagguuucaacaaau

SEQ ID NO: 496387 - RNA, 63 nt, Homo Sapiens
uuuucaauaccuguuuucauauacaauuacaaaccuuucaaaccuguauuccuucuuuauacu

SEQ ID NO: 496388 - RNA, 63 nt, Homo Sapiens
gacucauccugugacuuuguaaccacacucauuccuuucaaacacagaggaggaauuauugcu

SEQ ID NO: 496389 - RNA, 63 nt, Homo Sapiens
uugaauaauaagcaggauguuggccaccaggugccuuucaaauuuagaaacuaauugacuuua

SEQ ID NO: 496390 - RNA, 63 nt, Homo Sapiens
uugucaaaguguggucugggggggccucaagagccuuucaaggguauucuaggucaaagcugu

SEQ ID NO: 496391 - RNA, 63 nt, Homo Sapiens
guuucucccauuuagaauaucuagcauguaaggccuuucaauauuaauauaagcccaauauca

SEQ ID NO: 496392 - RNA, 63 nt, Homo Sapiens
cagauauauaagcagauaagcacagauuauuguccuuucaaguuaagaguauauaaucuggac

SEQ ID NO: 496393 - RNA, 63 nt, Homo Sapiens
cacuauauaaaacccaacagcuucaacuauugcccuuucaacaguuuugccacugaccggaua

SEQ ID NO: 496394 - RNA, 63 nt, Homo Sapiens
uuguuauguauucuacugguuuaaaaauuuuucccuuucaaugauuccuugaagaugugagau

SEQ ID NO: 496395 - RNA, 63 nt, Homo Sapiens
gacgagcugcagagaacucaaguuaaguggaauccuuucaaaucuuucaugcaguuuguuuga

SEQ ID NO: 496396 - RNA, 63 nt, Homo Sapiens
aacaaccaaacaaaaagaaagguccugguagaaccuuucaacauuuguguuuauacugggcca

SEQ ID NO: 496397 - RNA, 63 nt, Homo Sapiens
aaauuaaaaauacuacucacuuauucuugggugccuuucaagaguuuugguucacaaaaguaa

SEQ ID NO: 496398 - RNA, 63 nt, Homo Sapiens
aguggggccugccuggucucuagaggguugcugccuuucaagcggugccuaagaaguuauuuu

SEQ ID NO: 496399 - RNA, 63 nt, Homo Sapiens
gguucaguauuuucuuuuuaguauaacuuacauccuuucaaauaagucuuugcccucaugaag

SEQ ID NO: 496400 - RNA, 63 nt, Homo Sapiens
ggagcaggugaauaaaggaucucuauaacagauccuuucaaaagaagaguuuuagagaaaaua

SEQ ID NO: 496401 - RNA, 63 nt, Homo Sapiens
cagaugguuucuuuuuguaaagaguuccguuugccuuucaauuuuuagagaaaauaaagacug

SEQ ID NO: 496402 - RNA, 63 nt, Homo Sapiens
uaggaucuguuuuuucaucgaggucucggguauccuuucaaagauagugagaagcagacacug

SEQ ID NO: 496403 - RNA, 63 nt, Homo Sapiens
ucuccuccgcugucaugccucucugcccuuuucccuuucaaccugcagucuuuacacccacag

SEQ ID NO: 496404 - RNA, 63 nt, Homo Sapiens
gucuggaaggacugaaaccuggucauacccaguccuuucaaggggccucuuuucuacuaauaa

SEQ ID NO: 496405 - RNA, 63 nt, Homo Sapiens
gagacaggaauguaaggauuggcaacuguguuaccuuucaaguuuaucucaauaaccagguca

SEQ ID NO: 496406 - RNA, 63 nt, Homo Sapiens
gccccuggugaugugagcagggaccugccugccccuuucaaccuuuccccucaccuuuuuuga

SEQ ID NO: 496407 - RNA, 63 nt, Homo Sapiens
caugugagugaauuccuggauaaagcaagauuuccuuucaauaaacgcugucacccaauggga

SEQ ID NO: 496408 - RNA, 63 nt, Homo Sapiens
ugaucaguauaaauuuucuugguguauccuuuuccuuucaacacagugcagauaagaguugaa

SEQ ID NO: 496409 - RNA, 63 nt, Homo Sapiens
ucugcucuucuggaaacaaagggcucaagcaccccuuucaacccugugacugggguccucccu

SEQ ID NO: 496410 - RNA, 63 nt, Homo Sapiens
gugggaguugccacacugccccaacagugauucccuuucaaagagcugugcuuccuaaacauu

SEQ ID NO: 496411 - RNA, 63 nt, Homo Sapiens
agggcagggaguuugggcuugguuuugaacuuuccuuucaauguagcaaagcauuccuaguua

SEQ ID NO: 496412 - RNA, 63 nt, Homo Sapiens
gaugucuggccagacgaagaguccuguauccagccuuucaacagauggaaagauggguacguu

SEQ ID NO: 496413 - RNA, 63 nt, Homo Sapiens
ugauaauuugggggacauuugcagugguaugugccuuucaacuaacuugaaugaacugcuggg

SEQ ID NO: 496414 - RNA, 63 nt, Homo Sapiens
auggaaggagccugcgguuuccgugaguccggcccuuucaagcuguauugauuuuauuaacua

SEQ ID NO: 496415 - RNA, 63 nt, Homo Sapiens
gagcaacaccacaaugacuguuugguucucuccccuuucaaguaaauuuucugcuuggaccuc

SEQ ID NO: 496416 - RNA, 63 nt, Homo Sapiens
cucacugggccucucugggaaacaaggaagaugccuuucaagcaugcacucacacacugaaga

SEQ ID NO: 496417 - RNA, 63 nt, Homo Sapiens
uaaaaauacaaagaaugguguggccaccuccucccuuucaagcuagggcagcagguagcucuu

SEQ ID NO: 496418 - RNA, 63 nt, Homo Sapiens
gggaggggaagggaucagguguguuguccugggccuuucaaccuugcgggcugugcugaguuc

SEQ ID NO: 496419 - RNA, 63 nt, Homo Sapiens
ccaucuguggccuuuguccauuaccgcuucucaccuuucaacccgccgucugucuccucuagc

SEQ ID NO: 496420 - RNA, 63 nt, Homo Sapiens
auauuuuucucaguuauacuauaugauuuauuaccuuucaauuucugugagaaauaauagaug

SEQ ID NO: 496421 - RNA, 63 nt, Homo Sapiens
ucuagagagaccagcugccuggccaggggcuuaccuuucaaccuguccuccccagcaccuuag

SEQ ID NO: 496422 - RNA, 63 nt, Homo Sapiens
acuuagucauuuuccugaaaagaacauacugacccuuucaaguacuuccucaucugaaaacac

SEQ ID NO: 496423 - RNA, 63 nt, Homo Sapiens
aagugguaguuuaaaaaguggauuuuuaaagugccuuucaauugucugugaacgucuaaagga

SEQ ID NO: 496424 - RNA, 63 nt, Homo Sapiens
cccauauuuguguccucgccagcucuuuggccaccuuucaagccccaguguucaagcucagag

SEQ ID NO: 496425 - RNA, 63 nt, Homo Sapiens
acauauggaaaagcccaugcguggaguuccccuccuuucaacauugcaacaacaguaacaaca

SEQ ID NO: 496426 - RNA, 63 nt, Homo Sapiens
gguaacagcacugggauccauaaagguacaguuccuuucaagacaggccuuuguuucuucggc

SEQ ID NO: 496427 - RNA, 63 nt, Homo Sapiens
ccagaaagaccuuacucuucgaauuaucugauuccuuucaauuuaccaaauauuuuggccuca

SEQ ID NO: 496428 - RNA, 63 nt, Homo Sapiens
gacuuucuaaggaugauauucaaacacgauaaaccuuucaaaaggugguagagcaaaaaaacc

SEQ ID NO: 496429 - RNA, 63 nt, Homo Sapiens
uguuuaguucaacucaagccaauuccccuggucccuuucaaccgaaguguggguugcgccaac

SEQ ID NO: 496430 - RNA, 63 nt, Homo Sapiens
cuucugugaaugacuugaauagaaauccucaugccuuucaagagccuuuuucuaggaacuguc

SEQ ID NO: 496431 - RNA, 63 nt, Homo Sapiens
gcuuuggauuuggggcgacucgaggccauaccuccuuucaagaagaagaggcuucuggaguuu

SEQ ID NO: 496432 - RNA, 63 nt, Homo Sapiens
uugcauuauuuuaaaaaguucagaguugaaaugccuuucaaccauuuccuucuguggucauuu

SEQ ID NO: 496433 - RNA, 63 nt, Homo Sapiens
uuuuuuaacauuuuaaguuuaacagauuguauuccuuucaaguuucuauacuugcuuaagcaa

SEQ ID NO: 496434 - RNA, 63 nt, Homo Sapiens
gcacgugaaguuugcaaaaugcuuuaaggccuuccuuucaaagcauaguccuuuuggagccgu

SEQ ID NO: 496435 - RNA, 63 nt, Homo Sapiens
cuguaaucuguucuuaugcucauuuuguauuuuccuuucaacuccaggaauauccuugagcau

SEQ ID NO: 496436 - RNA, 63 nt, Homo Sapiens
uguucaaaagaauugacuaguuaucccugaggcccuuucaaacaugaucaaagauuucccaau

SEQ ID NO: 496437 - RNA, 63 nt, Homo Sapiens
aaucauuacauuucuauuucugugaagcauuuaccuuucaaaauacccaagaagacuguuuau

SEQ ID NO: 496438 - RNA, 63 nt, Homo Sapiens
gcaaugugggaaagucuucagaucugucaagaaccuuucaauuuaugaaaggacacacacugg

SEQ ID NO: 496439 - RNA, 63 nt, Homo Sapiens
aguaacaugggaaagcuuucaaucauuuuaguuccuuucaaauacaugaaagaacucaucaug

SEQ ID NO: 496440 - RNA, 63 nt, Homo Sapiens
cggacuucauuuuguacugugggcugugcuggcccuuucaagguuuuucaagaguugguuuug

SEQ ID NO: 496441 - RNA, 63 nt, Homo Sapiens
agaacuuugaauguuugcauacuuguggauguaccuuucaaauauguuugucuuguguaucau

SEQ ID NO: 496442 - RNA, 63 nt, Homo Sapiens
ugggccccugcuggccgccacucuccgggcucuccuuucaaaaagccacgucgugcugcugcu

SEQ ID NO: 496443 - RNA, 63 nt, Homo Sapiens
ugcuacacauccagccaucacaugcagauaauuccuuucaaaaacagcagaaagaggcucguu

SEQ ID NO: 496444 - RNA, 63 nt, Homo Sapiens
gucccuuucgaguuaacauuacagccacagugaccuuucaaaaaugcaaauuaaguuacucuu

SEQ ID NO: 496445 - RNA, 63 nt, Homo Sapiens
ucaugaaauaucucacacugcauaauuuuuauuccuuucaaaaguaaaugugggaaagccuuu

SEQ ID NO: 496446 - RNA, 63 nt, Homo Sapiens
uccaaaauaucacugccuaauuucaguaaaaacccuuucaauucaucauccccccauggaucc

SEQ ID NO: 496447 - RNA, 63 nt, Homo Sapiens
ugcugggauuacagacaugaccucccaccuuggccuuucaagaaacucuuggauucaagcgau

SEQ ID NO: 496448 - RNA, 63 nt, Homo Sapiens
ccagcaauggccaaucagucugguuuggggccuccuuucaaaauagaagcugcccaaauucug

SEQ ID NO: 496449 - RNA, 63 nt, Homo Sapiens
guagagaggaagggaacuccacugugugacaguccuuucaaucugccccuuuucagcccuacu

SEQ ID NO: 496450 - RNA, 63 nt, Homo Sapiens
agcagaacauuccagaacccguuguggaaaaacccuuucaagaagcuguuuuaagaggcucgg

SEQ ID NO: 496451 - RNA, 63 nt, Homo Sapiens
aacauaacucuaucagaagaaaacuguuguuugccuuucaaccuuguuuuacaguucugcagu

SEQ ID NO: 496452 - RNA, 63 nt, Homo Sapiens
aauuuugcucuaccaggaaaucgcaacugggccccuuucaagauguuuaaacgcugcuuaaag

SEQ ID NO: 496453 - RNA, 63 nt, Homo Sapiens
ccuguuggagugagaguuucaaggaagcccuacccuuucaacucuguaggccuucacacaggg

SEQ ID NO: 496454 - RNA, 63 nt, Homo Sapiens
ucauuugcuuccuuaucuacaaauuaaugggcaccuuucaacaaauuccuaugaugaaauuuu

SEQ ID NO: 496455 - RNA, 63 nt, Homo Sapiens
aaugaagacuuuaaaucagucaguaguacuuuaccuuucaaggcauuaguaaauuacuugcaa

SEQ ID NO: 496456 - RNA, 63 nt, Homo Sapiens
guggagggggucugggcccacccuucacaacugccuuucaaggacaguucagacaaagggccc

SEQ ID NO: 496457 - RNA, 63 nt, Homo Sapiens
cggacagccccuugaacauuuaauuccuuuucaccuuucaaaaaugaguggaccuaaauaugu

SEQ ID NO: 496458 - RNA, 63 nt, Homo Sapiens
aguagagcugcaccuaaagacaacagaaagguuccuuucaaauuacucacagcuuguaaauua

SEQ ID NO: 496459 - RNA, 63 nt, Homo Sapiens
gcgucauccacaccaaaggcccuggaaugaggcccuuucaaaacugcuggcguuggcugugau

SEQ ID NO: 496460 - RNA, 63 nt, Homo Sapiens
cuaauguuagggcuuaauuuucucaaagccugaccuuucaaauccaugaugaaugccaucagu

SEQ ID NO: 496461 - RNA, 63 nt, Homo Sapiens
gucaagcuccacuugaagcucacucaguaauauccuuucaauguguuuuauauuguuuugacu

SEQ ID NO: 496462 - RNA, 63 nt, Homo Sapiens
gcucugucuucacggcaugugcuuucucaggaaccuuucaagcggccagaaccccugcgaauc

SEQ ID NO: 496463 - RNA, 63 nt, Homo Sapiens
acgggaagaugccaguugacugaaaauucaaagccuuucaauuugaagugaccuaggugggag

SEQ ID NO: 496464 - RNA, 63 nt, Homo Sapiens
ggccagaaccccugcgaaucacuuucucaggaaccuuucaagcgcucuguccucauggcaugu

SEQ ID NO: 496465 - RNA, 63 nt, Homo Sapiens
augugacagagaucucacagggcuugcaguuucccuuucaaaugaggagaacugacaggguuu

SEQ ID NO: 496466 - RNA, 63 nt, Homo Sapiens
gggugcagacuucucguuaguuauucuccuaacccuuucaaguucuuuaaagaaugcugcuuu

SEQ ID NO: 496467 - RNA, 63 nt, Homo Sapiens
gggugguccuguugcguggagaucuccucugguccuuucaaagggaaacgcuguugaaccuug

SEQ ID NO: 496468 - RNA, 63 nt, Homo Sapiens
agaggccagugcgguagccuuugucccuucaugccuuucaauucugagugggaggaaaagcaa

SEQ ID NO: 496469 - RNA, 63 nt, Homo Sapiens
gaaaagacagucaaaugggguggggguucuuuaccuuucaaaugaauagaaacuucuuauaag

SEQ ID NO: 496470 - RNA, 63 nt, Homo Sapiens
acagaaaaaccagaggcagcuucuuugccaagaccuuucaaagccauuuuaggcuguuagggg

SEQ ID NO: 496471 - RNA, 63 nt, Homo Sapiens
cauguucuguuccuccuccucaugcauuuccagccuuucaacccuccccgacucugcggcucc

SEQ ID NO: 496472 - RNA, 63 nt, Homo Sapiens
uugcacugagaccccugccagagaggagaaaacccuuucaagggaaauuuuaaucuaaaagga

SEQ ID NO: 496473 - RNA, 63 nt, Homo Sapiens
cagacgaugagacuagaaggauauauauuuuuuccuuucaaaucuuuuuauauaauguuuuau

SEQ ID NO: 496474 - RNA, 63 nt, Homo Sapiens
gaugauguuaaaugaagguaguuuuguaucuucccuuucaaguuaugaauuacacuaccaugu

SEQ ID NO: 496475 - RNA, 63 nt, Homo Sapiens
ucccuggaguugggagggagggguacaaaggacccuuucaaugccccccaauuuccugcgggc

SEQ ID NO: 496476 - RNA, 63 nt, Homo Sapiens
gaaaggugauuccuaucacuccaacuucacuuaccuuucaaaaccagaaguggccuagaaaug

SEQ ID NO: 496477 - RNA, 63 nt, Homo Sapiens
aaaguuacuuuaauauuuuuagcuucuaaaauuccuuucaaauucacaacuucucugcacaca

SEQ ID NO: 496478 - RNA, 63 nt, Homo Sapiens
gagucagcugcuaacugauucagagaggaaaucccuuucaacauguguggaaggaguguauag

SEQ ID NO: 496479 - RNA, 63 nt, Homo Sapiens
ugaaguguagauugauuuaauugugaaacagagccuuucaaaugguaagagacaagguucuga

SEQ ID NO: 496480 - RNA, 63 nt, Homo Sapiens
gaaagcuuaggugccugcguugcuaguccaugaccuuucaaugcauuccagggaugcaaaaug

SEQ ID NO: 496481 - RNA, 63 nt, Homo Sapiens
gcagcgugcagcagaauuugugcagugaaauugccuuucaaggugauuacuuucaauucagua

SEQ ID NO: 496482 - RNA, 63 nt, Homo Sapiens
caguguuauacuguguguaggccuuuacaguugccuuucaauuuaaaaaaaaguuuagauguu

SEQ ID NO: 496483 - RNA, 63 nt, Homo Sapiens
gggaucugaacagguguuuugucauccugucucccuuucaauacugcagacacaaaaugagua

SEQ ID NO: 496484 - RNA, 63 nt, Homo Sapiens
ccuuuauuggaaugcauguuuucauugccuucuccuuucaaaguguacguuuguguguucauc

SEQ ID NO: 496485 - RNA, 63 nt, Homo Sapiens
uuuaauagaguaagguaaagaagauauuaagucccuuucaaaauggaaaauuaauucuaaacu

SEQ ID NO: 496486 - RNA, 63 nt, Homo Sapiens; identical to SEQ ID NO: 496485

SEQ ID NO: 496487 - RNA, 63 nt, Homo Sapiens
aucuggcucaugguaccuguucuucuauccaaaccuuucaauucaugcuaccugauucauuua

SEQ ID NO: 496488 - RNA, 64 nt, Homo Sapiens
cccauccucuuacuccuuucaugucccauuucagacagaguaaccauuaacaaaaaagaagaga

SEQ ID NO: 496489 - RNA, 64 nt, Homo Sapiens
uccucccucaccuucuccaaaucuaggugaaaucacagaguacaaaacgugagaaugcugaaug

SEQ ID NO: 496490 - RNA, 64 nt, Homo Sapiens
ucucugccagccaggcuggauuuuuuuuuuugagacagaguagcucuggccgauuuuuuuuuuu

SEQ ID NO: 496491 - RNA, 64 nt, Homo Sapiens
caccaaaguccuaaucuaaauuauacucaacuauacagaguaucucuaacucauuguagggauu

SEQ ID NO: 496492 - RNA, 64 nt, Homo Sapiens
uuaaaagcaaaaagauguauauguauaaauuaauacagaguacgaaaugcuuaugcuuguguau

SEQ ID NO: 496493 - RNA, 64 nt, Homo Sapiens
ucuggcagcugugguacaaauacaaacauggaaaacagaguauuaguauuguucuauuuuuguu

SEQ ID NO: 496494 - RNA, 64 nt, Homo Sapiens
uauaucugcacagcguguauuuuuguggauuuuuacagaguauuucuuuggggccccuggaugu

SEQ ID NO: 496495 - RNA, 64 nt, Homo Sapiens
aauguguugcucuggacauuaaaucacugaguuuacagaguaauuggauauuauuucuccaccu

SEQ ID NO: 496496 - RNA, 64 nt, Homo Sapiens; identical to SEQ ID NO: 233668

SEQ ID NO: 496497 - RNA, 64 nt, Homo Sapiens; identical to SEQ ID NO: 233669

SEQ ID NO: 496498 - RNA, 64 nt, Homo Sapiens; identical to SEQ ID NO: 233670

SEQ ID NO: 496499 - RNA, 64 nt, Homo Sapiens; identical to SEQ ID NO: 233671

SEQ ID NO: 496500 - RNA, 64 nt, Homo Sapiens; identical to SEQ ID NO: 233672

SEQ ID NO: 496501 - RNA, 64 nt, Homo Sapiens; identical to SEQ ID NO: 233673

SEQ ID NO: 496502 - RNA, 64 nt, Homo Sapiens
cuugauuaacuuauaaaauguuagaggaaacuuucacaugaauaauuuuugucaaauuuuauca

SEQ ID NO: 496503 - RNA, 64 nt, Homo Sapiens
agacucuccucaaagaaaugacuugcugucaucccacaugaacuccugauguuuuuucuacaaa

SEQ ID NO: 496504 - RNA, 64 nt, Homo Sapiens
gagcugauuuuaauggccacaucuaaucucauuucacaugaaagaagaaguauauuuuagaaau

SEQ ID NO: 496505 - RNA, 64 nt, Homo Sapiens
aguacagcugaaauucagaggacccauaagaguucacaugaaaaaaaucaauuuauuugaaaag

SEQ ID NO: 496506 - RNA, 64 nt, Homo Sapiens
ucgacauuacagaugacugcagcuguucagcucucacaugaauacgaguucaggcagaccugga

SEQ ID NO: 496507 - RNA, 64 nt, Homo Sapiens
caaaccugaaggcuaugaauauuccugauccguucacaugaaugcuacaaaaauacaacaugca

SEQ ID NO: 496508 - RNA, 64 nt, Homo Sapiens
ucuggguccuagccuuuuuuauucccuauuuaaacacaugaagcaaaggggacuagaguggaag

SEQ ID NO: 496509 - RNA, 64 nt, Homo Sapiens
cuacuguaacugaucauguaucacuccuuaaauccacaugaaaaaguauguacaaagguaacca

SEQ ID NO: 496510 - RNA, 64 nt, Homo Sapiens
ucuuaaaaaaaucaauuuaaacaaucuacuuacacacaugaauuugaaaugacucauagauaau

SEQ ID NO: 496511 - RNA, 64 nt, Homo Sapiens
uguuccucucucaggaucugccaucuaccucccucacaugaaccuauguccaaaguggaacucu

SEQ ID NO: 496512 - RNA, 64 nt, Homo Sapiens
ucaugugggcuuaauuuucuucuguguaaauguacacaugaacuauuucaugugcagacgugcc

SEQ ID NO: 496513 - RNA, 64 nt, Homo Sapiens
aaugcuacuccaaucugaauggaaaauauaguaacacaugaaaauggguugacuggaaaggaau

SEQ ID NO: 496514 - RNA, 64 nt, Homo Sapiens
aauccaaucuuauaaccuuguucuuucaacacuacacaugaauguaauuaauuguuugaguaca

SEQ ID NO: 496515 - RNA, 64 nt, Homo Sapiens
uguggccugcacuauauucuaacaauugauugaccacaugaaagaucaugcuguauaaagcaau

SEQ ID NO: 496516 - RNA, 64 nt, Homo Sapiens
aggccaaucaagaccagaagaacauggcagcuaacacaugaauggaagucauacuagcccaacc

SEQ ID NO: 496517 - RNA, 64 nt, Homo Sapiens
agaaacaugcuuuccuagcuggagaaugagagaccacaugaagcacauguugagugagcaugcu

SEQ ID NO: 496518 - RNA, 64 nt, Homo Sapiens
gaaagccuucaaccagaagagugcgcugcaggugcacaugaagaagcacacgggggagcggccc

SEQ ID NO: 496519 - RNA, 64 nt, Homo Sapiens
caugggcuucacgcagaagagcaacaugaagcugcacaugaagcgggcgcacagcuaugcuggu

SEQ ID NO: 496520 - RNA, 64 nt, Homo Sapiens
uacucacacuggagauaaacuuuagguuuucaagcacaugaaaggggaaaacuuacuugucucc

SEQ ID NO: 496521 - RNA, 64 nt, Homo Sapiens
aacucacacuggagaaaaacuguagguuuucaagcacaugaaagggaaaaaccuacauaucuuc

SEQ ID NO: 496522 - RNA, 64 nt, Homo Sapiens
gaaucacacuguacagaaacccauucugcucgagcacaugaaaggggaaacccuucauuuaccg

SEQ ID NO: 496523 - RNA, 64 nt, Homo Sapiens
cauucgaacuucgaaggccaacacgcuacacacccacaugaacauuuuuuuccauguccgauuc

SEQ ID NO: 496524 - RNA, 64 nt, Homo Sapiens
caucacuucuuuuuuauguuuuguccacggccagcacaugaaaguacgcuucaguuuuuccaca

SEQ ID NO: 496525 - RNA, 64 nt, Homo Sapiens
ugggugggacuuuccuuccaugccaaucacuuuacacaugaagguagauuuagauuugaguaaa

SEQ ID NO: 496526 - RNA, 62 nt, Homo Sapiens
uuugcuaauuauaaccccucagaaagggagagcacaugaagcaacggaagcaggaugaauaa

SEQ ID NO: 496527 - RNA, 64 nt, Homo Sapiens
uaagugaagaaagacucuauaggcuuuuacacagcacaugaagcaguaauccagaaagaaggaa

SEQ ID NO: 496528 - RNA, 64 nt, Homo Sapiens
uaaauaugugaaauauuaugaucugaacuuagcacacaugaagcaacauuucuuugcuacacag

SEQ ID NO: 496529 - RNA, 64 nt, Homo Sapiens
cccuucuugucuuggcacauggccaggacaugugcaaugccagccaacuacccaaccccaccau

SEQ ID NO: 496530 - RNA, 64 nt, Homo Sapiens
cuccacaacaacaaugaaaauauuuccaaucagucaaugccacuuggugcaggagcaguucugc

SEQ ID NO: 496531 - RNA, 62 nt, Homo Sapiens
uguccgcgcccagcugcaugagaugaaagcugcccaaugccaauaugaaaaaaaauaaacac

SEQ ID NO: 496532 - RNA, 64 nt, Homo Sapiens
gccaugcugcagccucagaaaucuguagcacaggcaaugccaguugagacucgcaggagucccc

SEQ ID NO: 496533 - RNA, 64 nt, Homo Sapiens
acccacuguggccuggcaucgcaucguggugugucaaugccacaaaaucguguguccguggaac

SEQ ID NO: 496534 - RNA, 64 nt, Homo Sapiens
gucuccauuuggauaaaaggaaccaaccaacaaacaaugccaucacuggaauuucccaccgcuu

SEQ ID NO: 496535 - RNA, 64 nt, Homo Sapiens
auuggggaagagcauuccagagggugagccaucaagcuaagacaacauuugagccuagaccuga

SEQ ID NO: 496536 - RNA, 64 nt, Homo Sapiens
aaaacaaagaaauaaagcagagaauuggggagacagcuaagaaguucauagaaauuauacaaag

SEQ ID NO: 496537 - RNA, 64 nt, Homo Sapiens
agccaagugguucccaugcccacugagcccagcaagcuaagauccacuggcuuggaauucuccc

SEQ ID NO: 496538 - RNA, 64 nt, Homo Sapiens
agcuaaaggagcauguucuaacccaaugcaaggaagcuaagaaccuugaaaaaagguuagagga

SEQ ID NO: 496539 - RNA, 64 nt, Homo Sapiens
acauacaauacacuaacauuaacaauagcugaugagcuaagaaaaaaaaaaagucugugcauag

SEQ ID NO: 496540 - RNA, 64 nt, Homo Sapiens; identical to SEQ ID NO: 396681

SEQ ID NO: 496541 - RNA, 64 nt, Homo Sapiens; identical to SEQ ID NO: 396682

SEQ ID NO: 496542 - RNA, 64 nt, Homo Sapiens; identical to SEQ ID NO: 396683

SEQ ID NO: 496543 - RNA, 64 nt, Homo Sapiens; identical to SEQ ID NO: 396684

SEQ ID NO: 496544 - RNA, 64 nt, Homo Sapiens
cuuuuuuuuuguaacuuguucccuuauaccuccuugauugaauaccagacagccuagaccucag

SEQ ID NO: 496545 - RNA, 64 nt, Homo Sapiens
ugcggcgcccgcagcggaggagguuuucaguggcugauugaaacucacugcaaaaucaccacga

SEQ ID NO: 496546 - RNA, 64 nt, Homo Sapiens
ggaaaaagagacuacaaaauaaaaccugaaacgaugauugaaugugauggacguucuguaauag

SEQ ID NO: 496547 - RNA, 64 nt, Homo Sapiens
cuuuaguaaugcaaaauaacgacccgugauaaugugauugaacauccugguuauauacaaaugu

SEQ ID NO: 496548 - RNA, 64 nt, Homo Sapiens
cacugucagaucacuguucuuuucuuucuuuuugugauugaaaagccuauacuacaauuugaag

SEQ ID NO: 496549 - RNA, 64 nt, Homo Sapiens
guuuugcuuugcauuuuagguucagauuaugacuugauugaaauaaaugugccuauacauucau

SEQ ID NO: 496550 - RNA, 64 nt, Homo Sapiens
ugccuuuaggcuguucuuugagguaucaaugaagugauugaauuucaauaccuuaauucagugc

SEQ ID NO: 496551 - RNA, 64 nt, Homo Sapiens
ugcauuaaaugccaaaaaaaaaauacauuaucagugauugaaacguuuacauguacccaaaaac

SEQ ID NO: 496552 - RNA, 64 nt, Homo Sapiens
ugguuuaauauauauuuuuaaaacauuucacuagugauugaauucuacuuuugccaucugaauu

SEQ ID NO: 496553 - RNA, 64 nt, Homo Sapiens
gaucuuauuagaggucagugcuaaguacccaucuugauugaaguuagcucagauguggagauuc

SEQ ID NO: 496554 - RNA, 64 nt, Homo Sapiens
ugauuggacauuuucuucagguaaaugcuuugugugauugaaucugggcaagugauugaaaaua

SEQ ID NO: 496555 - RNA, 64 nt, Homo Sapiens
uaguaaaugcuuugugugauuguuauugggcaagugauugaaaauaauuucuuacuaaacauuu

SEQ ID NO: 496556 - RNA, 64 nt, Homo Sapiens
uuggaaugaaucuguuguguuugagcuucugagaugauugaauguuaggaacuuugaggcugag

SEQ ID NO: 496557 - RNA, 64 nt, Homo Sapiens
uguuaggaacuuugaggcugaggauuugaacaggugauugaauaugagauaggaaucuguugga

SEQ ID NO: 496558 - RNA, 64 nt, Homo Sapiens
guuucuuguuucuacuugucaguuuuguuaaaggugauugaauauaaguaaccaugacuuguaa

SEQ ID NO: 496559 - RNA, 64 nt, Homo Sapiens
cuacuuccaguccuuagguuagaugaaaaguaggugauugaaggagaggauugaggguggaagg

SEQ ID NO: 496560 - RNA, 64 nt, Homo Sapiens
ggaaaaacuccggguauaugugguuuacugcuuuguaaauaaaauuuauguucacacaggaauu

SEQ ID NO: 496561 - RNA, 64 nt, Homo Sapiens
ugauuaugcuuuguggcuauggcauuuguuuuuuguaaauaagaggggcuuuuuuagguuuugg

SEQ ID NO: 496562 - RNA, 57 nt, Homo Sapiens
acuucugcauggaacucugagcaagauguaaauaaaauuaaaagguggauggcaaga

SEQ ID NO: 496563 - RNA, 64 nt, Homo Sapiens
guauaugagcuucaaauaagcaccuuuuuauuauguaaauaaauaaaaguuaucuguaucccca

SEQ ID NO: 496564 - RNA, 64 nt, Homo Sapiens
caaguauauuuuuauuuuuacuuuuagaaaauugguaaauaaagucuuuuuaugaccuguuugc

SEQ ID NO: 496565 - RNA, 64 nt, Homo Sapiens
ucucagaguuucugugaugaucccgaagagauauguaaauaagcgagccuucuuuuuaauauau

SEQ ID NO: 496566 - RNA, 64 nt, Homo Sapiens
agaauucagauauacuuuaucuuuuuaaaaaaguguaaauaaaaucaaagaauguaaagucuau

SEQ ID NO: 496567 - RNA, 64 nt, Homo Sapiens
aauaggguaaguaaauauagccaccuguuaacauguaaauaagcauaauuuguuccaaagaugg

SEQ ID NO: 496568 - RNA, 64 nt, Homo Sapiens
cagcugauauuaguagcuuugcaacccugauagaguaaauaaauuuuaugggcgggugccaaau

SEQ ID NO: 496569 - RNA, 64 nt, Homo Sapiens
acauuuuaaaagcaauuguauuaguaagaacuuuguaaauaaauaccuaaaacccaaguguauu

SEQ ID NO: 496570 - RNA, 64 nt, Homo Sapiens
aacucaccaucucuguucauaucuagacaauaauguaaauaaagcuguuuuuaugaauuuuuuu

SEQ ID NO: 496571 - RNA, 64 nt, Homo Sapiens
uaugaccauucaucuguuuucacuccauuaggggguaaauaauuaugggguacguuuggcaguu

SEQ ID NO: 496572 - RNA, 64 nt, Homo Sapiens
ggcaccugccuucuuucuccucuucuuuaccugaguaaauaauuaaccuuuggugccuuuucuc

SEQ ID NO: 496573 - RNA, 64 nt, Homo Sapiens
aauauaacagaaguguuaacauuguuuucuucugguaaauaauauuuuaaacauuugcuuuauu

SEQ ID NO: 496574 - RNA, 64 nt, Homo Sapiens
auuugcuauugaugaaagaaauucuauagccauuguaaauaagaaaagaugguaaaaugacuuc

SEQ ID NO: 496575 - RNA, 64 nt, Homo Sapiens
uauuuuucauauggcuaaaggaauguuuuuauaaguaaauaacuuuguaaccaauaauaaaaau

SEQ ID NO: 496576 - RNA, 64 nt, Homo Sapiens
ucaaaagaacuauuuaaaacucuugaaaacucauguaaauaaaaaucauagggugaaaauugua

SEQ ID NO: 496577 - RNA, 64 nt, Homo Sapiens
aaagguggaggcauuguaaaaaggaaauagugauguaaauaaacauguucucuuucaaguaugc

SEQ ID NO: 496578 - RNA, 64 nt, Homo Sapiens
uuuucucuccucaugauguaccuuauuuucuuagguaaauaauuccaaacucucaucgggucau

SEQ ID NO: 496579 - RNA, 64 nt, Homo Sapiens
uuaacuggucagucauucacaauaagcuaugaggguaaauaaauauguguuauaacaaguaaac

SEQ ID NO: 496580 - RNA, 64 nt, Homo Sapiens
aaauguaauauuucauccuuauuaugggcaauauguaaauaaauuaaaaaaaaagccuaucagu

SEQ ID NO: 496581 - RNA, 64 nt, Homo Sapiens
augugugcucuuuacuguuuauucaguguugugaguaaauaaaaucaaaaaguuuacauuaauu

SEQ ID NO: 496582 - RNA, 64 nt, Homo Sapiens
aguacccucuugagguaggaaaugcucugugaugguaaauaaaauuggagcagacagaaaagau

SEQ ID NO: 496583 - RNA, 64 nt, Homo Sapiens
aauguguauuuauuguuaauucuuaaaauaguguguaaauaaaauaacaucagugugcuuuaaa

SEQ ID NO: 496584 - RNA, 64 nt, Homo Sapiens
ggugauguaaaugaaugcuggaguuuagaauauaguaaauaaaaagaaauguuaaauauuuuau

SEQ ID NO: 496585 - RNA, 64 nt, Homo Sapiens
aaugaaguagagaaauguuaugagccucuguacuguaaauaagaaaccauauugugacaagaga

SEQ ID NO: 496586 - RNA, 64 nt, Homo Sapiens
gaaauggcaggacucauauugcugagucaagaguguaaauaaaaggacuucugucauaauucuu

SEQ ID NO: 496587 - RNA, 64 nt, Homo Sapiens
acugauauuacuaaaguacauuauguuuacucaaguaaauaauuuucuccccaugguacacucu

SEQ ID NO: 496588 - RNA, 64 nt, Homo Sapiens
uuaccauauuuuaagaacuuuaagacgauuaauuguaaauaauuuauuugauuggugcaguucu

SEQ ID NO: 496589 - RNA, 64 nt, Homo Sapiens
gcuucaaaauguuuucuuauuuuuuaaagcuuuuguaaauaaagaaaacagaggguauuauuug

SEQ ID NO: 496590 - RNA, 64 nt, Homo Sapiens
gagagauuugguacaaaacauaguugcuacaaagguaaauaaugagacaaaaauugugcuuuca

SEQ ID NO: 496591 - RNA, 64 nt, Homo Sapiens
gaaaugaguagugauaugaaucaaagaugaauugguaaauaauguuaauuguuuccaaguugca

SEQ ID NO: 496592 - RNA, 64 nt, Homo Sapiens
uuuuaaaauuguuuuuaaucucaaucaauaauugguaaauaauaacguaccccaguaaaaccau

SEQ ID NO: 496593 - RNA, 64 nt, Homo Sapiens
aguuuauuauagucuguacuucaguucucaucuuguaaauaaugcuuaacauaaacuuguacuu

SEQ ID NO: 496594 - RNA, 64 nt, Homo Sapiens
augauacugaauuguuauguaaacaucauaaauaguaaauaaugauucaaugugaauuuuaaaa

SEQ ID NO: 496595 - RNA, 64 nt, Homo Sapiens
aaccaacccugaggaacaucaaguaaauaaauaaguaaauaaccucuaaaaaaugaaguguauu

SEQ ID NO: 496596 - RNA, 64 nt, Homo Sapiens
aaguaaauaaccaaccaaccaugaaguguauuaaguaaauaaaucccuaaagcugcucuaaaaa

SEQ ID NO: 496597 - RNA, 64 nt, Homo Sapiens
uuaacucaaauaaaauugcugucuuuggguuuuuguaaauaauuguaccaguuucaugaaguau

SEQ ID NO: 496598 - RNA, 64 nt, Homo Sapiens
cuuuuaauaauuuugugaaugaaugauuccaaucguaaauaaaguuugcuuuugcuuuuuuguu

SEQ ID NO: 496599 - RNA, 64 nt, Homo Sapiens
uuuuaauucagaucuagaagauggaugaauugggguaaauaaggcacugaacguaucagaauac

SEQ ID NO: 496600 - RNA, 64 nt, Homo Sapiens
uauuacaguuuacucuaucgcaaacuaggugcuuguaaauaauuggcuuccacauaagguuaaa

SEQ ID NO: 496601 - RNA, 64 nt, Homo Sapiens
augaaaaauggucuguucauuaugccacauagugguaaauaauuggguuauaugccuaaacccu

SEQ ID NO: 496602 - RNA, 64 nt, Homo Sapiens
aauuuccaacagggucagcuaaaaccuugcagugguaaauaaaauggugugacacuuuggagca

SEQ ID NO: 496603 - RNA, 64 nt, Homo Sapiens
agcagcuagguuuugaauucuuucacuugaauggguaaauaacccugugccucccucugucugu

SEQ ID NO: 496604 - RNA, 64 nt, Homo Sapiens
acaaauguugcauagagauaauagaacauugcuuguaaauaauucagcagauuuguaauauauu

SEQ ID NO: 496605 - RNA, 64 nt, Homo Sapiens
aaagauacaucugauauuuucuauauagagcacaguaaauaaguuuuuucauuguguagaaaua

SEQ ID NO: 496606 - RNA, 64 nt, Homo Sapiens
ccuaccccuuccuguccugccuccucaucaguguguaaauaauuugcacugaaacguggauaca

SEQ ID NO: 496607 - RNA, 64 nt, Homo Sapiens
gaaacguggauacagagccacgaguuuggauguuguaaauaaaacuauuuauugugcugggucc

SEQ ID NO: 496608 - RNA, 64 nt, Homo Sapiens
gucauuauuauuugaguuaugcuguuguuuagggguaaauaacaguaaauaauuaauaauaaua

SEQ ID NO: 496609 - RNA, 64 nt, Homo Sapiens
uuugaguuaugcuguuguuuagggguaaauaacaguaaauaauuaauaauaauaauaauaauaa

SEQ ID NO: 496610 - RNA, 64 nt, Homo Sapiens
aauugccaaggcaaauaaauaucaaucaucaauuguaaauaaauuuuuuaccucaauuguugau

SEQ ID NO: 496611 - RNA, 64 nt, Homo Sapiens
guauguauagcauauguacagcguauaccuaacuguaaauaaauuauuuaaaggcuucuaagaa

SEQ ID NO: 496612 - RNA, 64 nt, Homo Sapiens
gcacugcuaccuucuuugaugaugacaauaaaaaguaaauaaaaaaauuccuagaaaacugcuu

SEQ ID NO: 496613 - RNA, 64 nt, Homo Sapiens
acugaaagcuuuugcuauuuaccuucuauauacuguaaauaaagcaccuaaaaugaaaacagua

SEQ ID NO: 496614 - RNA, 64 nt, Homo Sapiens
acaaaaugcacacuuuauaguuucaagauuuucaguaaauaaaaucuguccauuccuaccugga

SEQ ID NO: 496615 - RNA, 64 nt, Homo Sapiens
acuuuagaaagauguuaauguacauaaauagaguguaaauaaaauaguguugauguacugaaau

SEQ ID NO: 496616 - RNA, 64 nt, Homo Sapiens
auaaaagaaccccaagcaugcaucuuucauguguguaaauaauucauuucugggcuaauuucaa

SEQ ID NO: 496617 - RNA, 64 nt, Homo Sapiens
ggcaaagcugugggagucuugaaaugucacaguaguaaauaacuuauuacuuuuugacaaguuc

SEQ ID NO: 496618 - RNA, 64 nt, Homo Sapiens
aagguugccuuuuucaaauuuggaaacaggagaaguaaauaaaucucuuggaguaacaagaauu

SEQ ID NO: 496619 - RNA, 64 nt, Homo Sapiens
gucuguacucuuggaguaacguuuugcauuuuagguaaauaacuaccgugugaacucuuuggag

SEQ ID NO: 496620 - RNA, 64 nt, Homo Sapiens
aaauguagcuuauuuuuaggauuuaaaucacuaaguaaauaaguauccuugccaagugaucaug

SEQ ID NO: 496621 - RNA, 64 nt, Homo Sapiens
caaaaugcuuaacuuuaucucuuaauuucuaaagguaaauaaccuagguucagcuuuugcuuaa

SEQ ID NO: 496622 - RNA, 64 nt, Homo Sapiens
aauuucagggguaggggagauugucauagagggaaccucuaaauagcuaaaaaaaagcaagggu

SEQ ID NO: 496623 - RNA, 64 nt, Homo Sapiens
gcaugcuuagaggucaaggauucugugaauucuaaccucuaaagguuugacaauugaauuuguu

SEQ ID NO: 496624 - RNA, 64 nt, Homo Sapiens
augaacuuuccacucuaaccuuuauggucaguuaaccucuaaaugacuaaccucuaacaagaga

SEQ ID NO: 496625 - RNA, 64 nt, Homo Sapiens
agagauuuauggucaguuaagaaacuaccgacuaaccucuaacaaacuucagcuuaaccaguca

SEQ ID NO: 496626 - RNA, 64 nt, Homo Sapiens
gcuggauccuauuuuucuacuuugauuuccccugaccucuaauggguucacauuuccaaaccuu

SEQ ID NO: 496627 - RNA, 64 nt, Homo Sapiens
cugucuaacacgcguuucauugaagcaugcuuuaaccucuaagaccucuggaugguggugaacc

SEQ ID NO: 496628 - RNA, 64 nt, Homo Sapiens; identical to SEQ ID NO: 81671

SEQ ID NO: 496629 - RNA, 64 nt, Homo Sapiens; identical to SEQ ID NO: 81672

SEQ ID NO: 496630 - RNA, 64 nt, Homo Sapiens; identical to SEQ ID NO: 81673

SEQ ID NO: 496631 - RNA, 64 nt, Homo Sapiens; identical to SEQ ID NO: 81674

SEQ ID NO: 496632 - RNA, 64 nt, Homo Sapiens; identical to SEQ ID NO: 81675

SEQ ID NO: 496633 - RNA, 64 nt, Homo Sapiens; identical to SEQ ID NO: 81676

SEQ ID NO: 496634 - RNA, 64 nt, Homo Sapiens; identical to SEQ ID NO: 284841

SEQ ID NO: 496635 - RNA, 64 nt, Homo Sapiens; identical to SEQ ID NO: 284842

SEQ ID NO: 496636 - RNA, 64 nt, Homo Sapiens; identical to SEQ ID NO: 284843

SEQ ID NO: 496637 - RNA, 64 nt, Homo Sapiens; identical to SEQ ID NO: 284844

SEQ ID NO: 496638 - RNA, 64 nt, Homo Sapiens; identical to SEQ ID NO: 284845

SEQ ID NO: 496639 - RNA, 64 nt, Homo Sapiens; identical to SEQ ID NO: 284846

SEQ ID NO: 496640 - RNA, 64 nt, Homo Sapiens
uguacuugcuauauugaggaugaaguuuucuauggugggacacuaaauauaaagcuauauagag

SEQ ID NO: 496641 - RNA, 64 nt, Homo Sapiens
aaagcgucaguuaggcacaccugcaggccccucggugggacagcggcggccuuggaguuaggag

SEQ ID NO: 496642 - RNA, 64 nt, Homo Sapiens
gggcugcagggguccugccacuugggagugugcagugggacaggggugcuccucgcggggugga

SEQ ID NO: 496643 - RNA, 64 nt, Homo Sapiens
auggacacugggccacccucauguggcagcaucagugggacaagucugagacaugagccuuggg

SEQ ID NO: 496644 - RNA, 64 nt, Homo Sapiens
uaagguccucuguaaacaguuaagagcaauuauagugggacaucauucauuuguuaaaaauacc

SEQ ID NO: 496645 - RNA, 64 nt, Homo Sapiens
cugugaauuuagauuacaaaauuacuuugggcuggugggacaugaguauaaugacauuuagaag

SEQ ID NO: 496646 - RNA, 64 nt, Homo Sapiens
ucuucaguggcuccucugacaagaccaucaaggugugggacacauguaccaccuacaaguguca

SEQ ID NO: 496647 - RNA, 64 nt, Homo Sapiens
ucuacagcggcucugcagacugcaccaucauugugugggacauccagaaccugcagaaggugaa

SEQ ID NO: 496648 - RNA, 64 nt, Homo Sapiens
uugucuguggcaccuacgagaaccucauccacgugugggacauugaguccaaggagcaggugcg

SEQ ID NO: 496649 - RNA, 64 nt, Homo Sapiens
aggagggaggcgucgggggcagcaagggcccugugugggacagcggcuguuuggugugugaccc

SEQ ID NO: 496650 - RNA, 64 nt, Homo Sapiens
ugcccccgacggcggcaccgcuccacuggcaacagugggacaauaaaggcacuccaagugcauc

SEQ ID NO: 496651 - RNA, 64 nt, Homo Sapiens
gugguaacccaaauucauaacuaggaguaggaugaugauucaaaauucucuauaccaagauaug

SEQ ID NO: 496652 - RNA, 64 nt, Homo Sapiens
uuauacuuucucuuaguuaauuuagaauguuaacaugauucacaugguccuaacuuucuguuau

SEQ ID NO: 496653 - RNA, 64 nt, Homo Sapiens
guacucuuauauguaccauugguugauaauuauaaugauucauuuggacuugaagaaagauugu

SEQ ID NO: 496654 - RNA, 64 nt, Homo Sapiens
guccccaggcacaguaucugaaucacuggggauuaugauucacccucuuuggagaacaugcucu

SEQ ID NO: 496655 - RNA, 64 nt, Homo Sapiens
uaccucccccugggucugucaaagacuggcccccaugauucaauugucacgagaauagcacggg

SEQ ID NO: 496656 - RNA, 64 nt, Homo Sapiens
uaccuccccuugggucucucaaagacuggcccccaugauucaauuaucacaagaauagcauggg

SEQ ID NO: 496657 - RNA, 64 nt, Homo Sapiens
cuaugauugacccugauuuuaauugugaaauuauaugauucauauauuuuaugaaucagaauaa

SEQ ID NO: 496658 - RNA, 64 nt, Homo Sapiens
ugaaacccuaaauauguuuacauaccauuaagauaugauucauguaacaauguuaaauuaauua

SEQ ID NO: 496659 - RNA, 64 nt, Homo Sapiens
caaaaaguaauguauaucuguaauauauaaucaaaugauucauuuuucuguuagacuaggcaaa

SEQ ID NO: 496660 - RNA, 64 nt, Homo Sapiens
cauguuguauuaguaaauuauuagaauccaauuaaugauucaauuaacauauaucuuauccaau

SEQ ID NO: 496661 - RNA, 64 nt, Homo Sapiens
uuucagaaauaaaaguaugauugauaauuuugaaaugauucaucuuaagaaaauauucuaacau

SEQ ID NO: 496662 - RNA, 64 nt, Homo Sapiens
agguccaauguuguucaccauaguggugguagaaaugauucaccucccuuuggacaaaugcauu

SEQ ID NO: 496663 - RNA, 64 nt, Homo Sapiens
uuaugugauucaucuuauucccccccuggaggauaugauucacucaaaucuugauugugauaag

SEQ ID NO: 496664 - RNA, 64 nt, Homo Sapiens
gaaugaagaaucacaggcuuaagcaaggauaugcaugauucagguuuucugugaguccuauaaa

SEQ ID NO: 496665 - RNA, 64 nt, Homo Sapiens
agaccgucucagacacgcacagugggccugcugcaugauucacacccagucccugccacagacc

SEQ ID NO: 496666 - RNA, 64 nt, Homo Sapiens; identical to SEQ ID NO: 496665

SEQ ID NO: 496667 - RNA, 64 nt, Homo Sapiens
uauggcaaauggauaaaauauuguggcaucaacuacuuuuaaaguagaaaagcuauccauuuua

SEQ ID NO: 496668 - RNA, 64 nt, Homo Sapiens
uugaaauaaagccucuuaaaaugaaaaaucauauacuuuuaacaucacuuuuaagcuaauaaau

SEQ ID NO: 496669 - RNA, 64 nt, Homo Sapiens
cucuuaaaaugaaaaaucauauacuuuuaacaucacuuuuaagcuaauaaauauaagaauucuu

SEQ ID NO: 496670 - RNA, 64 nt, Homo Sapiens
auauaauagaguaagauacacuuuuuagcagugaacuuuuaaaaaauucuuuuacuuuuaacuu

SEQ ID NO: 496671 - RNA, 64 nt, Homo Sapiens
acuuuuuagcagugaacuuuuaaaaaauucuuuuacuuuuaacuucuugucaaucaaaguaucc

SEQ ID NO: 496672 - RNA, 64 nt, Homo Sapiens
cacugcaugaauaaaauuauuccuuuguauuuuuacuuuuaaaugucuucuguauucacuuaua

SEQ ID NO: 496673 - RNA, 64 nt, Homo Sapiens
caauauuuccucaugugaucacaauuugcaguaaacuuuuaauuaaaugcucaucugguaacuc

SEQ ID NO: 496674 - RNA, 64 nt, Homo Sapiens
cccagagcagauacucauaaaguauaaaguaaaaacuuuuaaccauuauuaaacagagaacuug

SEQ ID NO: 496675 - RNA, 64 nt, Homo Sapiens
cagaaaauacaagauuuacauaaaggucauuucaacuuuuaagguuaccagugauuguauaaaa

SEQ ID NO: 496676 - RNA, 64 nt, Homo Sapiens
aaaucucaacuauaaccaguuuagcuuuuuccuuacuuuuaaaauaaaauuuuuuacuuuuaac

SEQ ID NO: 496677 - RNA, 64 nt, Homo Sapiens
uagcuuuuuccuuacuuuuaaaauaaaauuuuuuacuuuuaacuauuuuuuuaguuaauauuuu

SEQ ID NO: 496678 - RNA, 64 nt, Homo Sapiens
uaauauuuuauaccaaagccucuaaaaauucuuaacuuuuaacaccuuuuaagccagguuacau

SEQ ID NO: 496679 - RNA, 64 nt, Homo Sapiens
gaacagacagaugaggacagcaaaauaaugcaccacuuuuaacacaugaacugccaggcccggc

SEQ ID NO: 496680 - RNA, 64 nt, Homo Sapiens
cuugguacuacuacuaaaucaucuguaucaguggacuuuuaaaauaguuuuauuaugcaguuaa

SEQ ID NO: 496681 - RNA, 64 nt, Homo Sapiens
ucaacaccugaaaaucaugacuuucauugguaaaacuuuuaaauaauacuaauucauuuuauca

SEQ ID NO: 496682 - RNA, 64 nt, Homo Sapiens
cuguauuucaugauuauaaguuugguagguuuaaacuuuuaauuaaauaauaggccauaggacu

SEQ ID NO: 496683 - RNA, 64 nt, Homo Sapiens
uacacugcauuuugcaaaaacuucuaggugagacacuuuuaaggaugugauuacagguagaggc

SEQ ID NO: 496684 - RNA, 64 nt, Homo Sapiens
auacauaucuuuaugauuuuagucuuucaaauugacuuuuaaaaugagguacuguuagucuguu

SEQ ID NO: 496685 - RNA, 64 nt, Homo Sapiens
guuucuuaaauuuuuugcaaauuauuuagugcuaacuuuuaaugcauuuuugugauuuuuaaag

SEQ ID NO: 496686 - RNA, 64 nt, Homo Sapiens
aaaguuauauaacuacauaguuaauauauaugagacuuuuaaaguuaaaaaguguguuugguua

SEQ ID NO: 496687 - RNA, 64 nt, Homo Sapiens
auauaguaaaagucauauuucauggauuguauugacuuuuaaaacuuacuuaaaguagcaaagu

SEQ ID NO: 496688 - RNA, 64 nt, Homo Sapiens
ucugagaauaaauaggcauaugauacccacuuggacuuuuaacaaaaguaaaggaauaaauuug

SEQ ID NO: 496689 - RNA, 64 nt, Homo Sapiens
guuaacuagucauuugacuggaaaaaaauaaaauacuuuuaaauggacaugguuuuauuuuuaa

SEQ ID NO: 496690 - RNA, 64 nt, Homo Sapiens
uagacuuucaaaaugagugauuuguuagcuugguacuuuuaaguuugugguacagauccuccaa

SEQ ID NO: 496691 - RNA, 64 nt, Homo Sapiens
caaaugaucuguucugcacugagccaagcaaguuacuuuuaaaacugguggcaccacucauuug

SEQ ID NO: 496692 - RNA, 64 nt, Homo Sapiens
cuuccuuaacauuuauacauuguuuuaagaaaaaacuuuuaaaaauauuucuuauagucuccua

SEQ ID NO: 496693 - RNA, 64 nt, Homo Sapiens
ucucagcucugagggucuuugugaguucccaccaacuuuuaauuauucaugcccuugaccaugu

SEQ ID NO: 496694 - RNA, 64 nt, Homo Sapiens
ggguaucagauuaaacaccgaauucagccacuggacuuuuaaaaguacuuaagaugguuuaucu

SEQ ID NO: 496695 - RNA, 64 nt, Homo Sapiens
aauugcugcugccuucauuuuagguucagcaguuacuuuuaacuaccuuaauuuauugccagaa

SEQ ID NO: 496696 - RNA, 64 nt, Homo Sapiens
uuuguuuggaagaagugaacuggacuacuuuaaaacuuuuaaggguuuucuauguucuuccuac

SEQ ID NO: 496697 - RNA, 64 nt, Homo Sapiens
acuaauuuauacuuaucugaagguuacaaauuagacuuuuaaauuuucuuuguaguugguggug

SEQ ID NO: 496698 - RNA, 64 nt, Homo Sapiens
uuauagaaauuugugauccuauauacaauauaggacuuuuaaaguugugacauucuggcuuuuu

SEQ ID NO: 496699 - RNA, 64 nt, Homo Sapiens
accuguuugucaaagcuuguuuaaauuauaaaacacuuuuaauuauauauaugaggcaaaagaa

SEQ ID NO: 496700 - RNA, 64 nt, Homo Sapiens
agaaaaaagucucuccccaagggcagccuuuguuacuuuuaaauauuuucuguuauuacaagug

SEQ ID NO: 496701 - RNA, 64 nt, Homo Sapiens
auauuuucuguuauuacaagugcucuaauugugaacuuuuaaauaaaauacuauuaagagguaa

SEQ ID NO: 496702 - RNA, 64 nt, Homo Sapiens
aauaccauuugaauuuguaugcauauuccaauucacuuuuaaaacccugcuguuuaaauuuccc

SEQ ID NO: 496703 - RNA, 64 nt, Homo Sapiens
ggcaaaaugugaguaaauugggugggagggauuuacuuuuaagaaaaaaaacaacuggguagag

SEQ ID NO: 496704 - RNA, 64 nt, Homo Sapiens
agcauugaaacuuuuguagcaaucuggucuauagacuuuuaacucaagaagcuaaggcuagacu

SEQ ID NO: 496705 - RNA, 64 nt, Homo Sapiens
aauuguuaucuuauucuuuuuaucuuuaguagacacuuuuaaaagaaaagacaaguuuguugug

SEQ ID NO: 496706 - RNA, 64 nt, Homo Sapiens
acauuuuccugugcauuaaccucugcaugugaaaacuuuuaacaguuacugaacuauguaaaua

SEQ ID NO: 496707 - RNA, 64 nt, Homo Sapiens
aauggggucugugggcuaguuaaaauagaaauaaacuuuuaaaauauccacagaauugauauug

SEQ ID NO: 496708 - RNA, 64 nt, Homo Sapiens
gucauugaauuguagguuuccuuuuuuuuucuuuacuuuuaaauuuuaacuuuuaaaaucuauu

SEQ ID NO: 496709 - RNA, 64 nt, Homo Sapiens
gguuuccuuuuuuuuucuuuacuuuuaaauuuuaacuuuuaaaaucuauuucauuucuuaguua

SEQ ID NO: 496710 - RNA, 64 nt, Homo Sapiens
cauuugcucaagaauuuuuuccgucaaauugugaacuuuuaauucuugcauuguaauuggcugu

SEQ ID NO: 496711 - RNA, 64 nt, Homo Sapiens
guuuauguuaaaccuuaauuuuuuuucuguaaucacuuuuaacacugcuaauagaaauuauguu

SEQ ID NO: 496712 - RNA, 64 nt, Homo Sapiens
uauuggguaaagacgucuaaacuuguuugaugugacuuuuaauuuuaaauacggguaacaaucu

SEQ ID NO: 496713 - RNA, 64 nt, Homo Sapiens
uucugcacagagcauaaugugaaguuuuauaccuacuuuuaaaauucugcuuuccagaaacaaa

SEQ ID NO: 496714 - RNA, 64 nt, Homo Sapiens
cauaccagauugucagugaagcugaugccuaggaacuuuuaaagggauccuuucaaaaggauca

SEQ ID NO: 496715 - RNA, 64 nt, Homo Sapiens
ccuuucaaaaggaucacuuagcaaacacauguugacuuuuaacugauguaugaauauuaauacu

SEQ ID NO: 496716 - RNA, 64 nt, Homo Sapiens
uauauguguuguggaagugaguacacuaucauccacuuuuaaugacagaaaguuauaaacuuac

SEQ ID NO: 496717 - RNA, 64 nt, Homo Sapiens
uaaauagaagaaaucaugaguaaaauuggaaaacacuuuuaacugaaaaaaacaaaagcacaac

SEQ ID NO: 496718 - RNA, 64 nt, Homo Sapiens
uucaugcguuuaaucauugucucuucauuuuaagacuuuuaauacaaaugucauuuuuaaagaa

SEQ ID NO: 496719 - RNA, 64 nt, Homo Sapiens
gaaaguaaccauccuucuggcaaaguaggauggcacuuuuaaguuuuucuuccuuuuuucccuc

SEQ ID NO: 496720 - RNA, 64 nt, Homo Sapiens
ggaaaggagucuuuaucuuggggagcaaaagcugacuuuuaaacuugaccccugcuguuuuuaa

SEQ ID NO: 496721 - RNA, 64 nt, Homo Sapiens
uaugcuccaucccauucacuucugcauuccuguaacuuuuaaucccuauguuugucucacuuuu

SEQ ID NO: 496722 - RNA, 64 nt, Homo Sapiens
cuuaaaucuuucuucaaaucucccacaaguauauacuuuuaaauuauggaguauuuuaagucua

SEQ ID NO: 496723 - RNA, 64 nt, Homo Sapiens
uauuuauuuuuuuuaaaguaucacuguaagcuauacuuuuaaaaaggucuaaaauacuacauug

SEQ ID NO: 496724 - RNA, 64 nt, Homo Sapiens
uuuaauccaguuuaucuguucaaauagaaagaagacuuuuaagucaaaauagucauuaugggcu

SEQ ID NO: 496725 - RNA, 64 nt, Homo Sapiens
uacauauuucugucuugcguagccuuuauucuguacuuuuaaugagauauuauguauaucuucu

SEQ ID NO: 496726 - RNA, 64 nt, Homo Sapiens
uauguauuuuaaaauaaggggaagagucauuuucacuuuuaaacuacuauuuuucuuuccaagu

SEQ ID NO: 496727 - RNA, 64 nt, Homo Sapiens
auguaauaaucauuuuagaauuaaaauuuauucuacuuuuaaauaaauuaugaauauuaaaggu

SEQ ID NO: 496728 - RNA, 64 nt, Homo Sapiens
agugauuuuuaguaaccuuuaaaaauguauaaugacuuuuaaaauuuguagaauugaaaagacg

SEQ ID NO: 496729 - RNA, 64 nt, Homo Sapiens
aguaaauauuaauaaauggauacacauucaaaauacuuuuaaaaaaaagaaaauguuaccaguu

SEQ ID NO: 496730 - RNA, 64 nt, Homo Sapiens
uugguugaauuuuuggauauauuauguugauuuaacuuuuaaaauguuguuuaaaagugugaag

SEQ ID NO: 496731 - RNA, 64 nt, Homo Sapiens
aguaauuugaauauuaauaaaaacaauugccuucacuuuuaagguauuuuaauucugcuauaga

SEQ ID NO: 496732 - RNA, 64 nt, Homo Sapiens
guuacagcaauaaagaauagaucucaggaauuaaacuuuuaacaaacuuuuaccgacuccaaaa

SEQ ID NO: 496733 - RNA, 64 nt, Homo Sapiens
cuagccuaaccuucaacauaaaauaaugaagagaacuuuuaaacuuuuuuaugaauuccuaaac

SEQ ID NO: 496734 - RNA, 64 nt, Homo Sapiens
acaaagggauuaaagaccuaaauaugaagacaaaacuuuuaaaugagaaucuauaagguuauuu

SEQ ID NO: 496735 - RNA, 64 nt, Homo Sapiens
uuuccauucuugcuagucagaguaaguaggcagcacuuuuaaaaauaugugaacucaaauauug

SEQ ID NO: 496736 - RNA, 64 nt, Homo Sapiens
uuuuauugauuucagauuuucacaggcacauucuacuuuuaaucagaaauauauuuaauaagua

SEQ ID NO: 496737 - RNA, 64 nt, Homo Sapiens
cauuuuguuaaaaaaaaaaaaaaaaaagcacauaacuuuuaacacuagaaucagcccgcaagau

SEQ ID NO: 496738 - RNA, 64 nt, Homo Sapiens
ggaucuaaauauucagguuuuaagccugcugcaaacuuuuaaaauauuaugauagauucuguac

SEQ ID NO: 496739 - RNA, 64 nt, Homo Sapiens
uguccuaauuuagaauuucccucaaaucugagggacuuuuaagaaaugcuaacagauuuuucug

SEQ ID NO: 496740 - RNA, 64 nt, Homo Sapiens
guagaaauauuauucaguaaacaauaaugugugaacuuuuaagauggauaauagggcauggacu

SEQ ID NO: 496741 - RNA, 64 nt, Homo Sapiens
uaucuauacauguuguauguacaaauauccuacuacuuuuaaucugauuuuucuucaggauuau

SEQ ID NO: 496742 - RNA, 64 nt, Homo Sapiens
uuacuuuguuaguacauuuuuuagugucacacugacuuuuaaaauuugaaugauauauagacuu

SEQ ID NO: 496743 - RNA, 64 nt, Homo Sapiens
cauuaagcuuuaaagugcuaaagccucaaaacauacuuuuaaagagauccauaaacuuuuaaag

SEQ ID NO: 496744 - RNA, 64 nt, Homo Sapiens
aagccucaaaacauacuuuuggcaagauccauaaacuuuuaaaggggcuccgacuccagcucug

SEQ ID NO: 496745 - RNA, 64 nt, Homo Sapiens
aagcaagaagaaaaacucagagaauauaaaaucaacuuuuaaaauugugugcucucuucuucac

SEQ ID NO: 496746 - RNA, 64 nt, Homo Sapiens
uacuaaccgugacuacaacaaaaauucuugauugacuuuuaaaguuauuuccuggcauucuggu

SEQ ID NO: 496747 - RNA, 64 nt, Homo Sapiens
aaguuuccuacuggcagcagauuuuguaagaauuacuuuuaagaauuucauucuuuuuguaugg

SEQ ID NO: 496748 - RNA, 64 nt, Homo Sapiens
uggaaggcaaacagguuuacaaaucaauucugugacuuuuaaaaaguugacaauguugucagau

SEQ ID NO: 496749 - RNA, 64 nt, Homo Sapiens
uuuacgucuccuucacugaagggcuagaguuuuaacuuuuaauuuuuuauauuuaaauguagac

SEQ ID NO: 496750 - RNA, 64 nt, Homo Sapiens
uuuaauuuuuuauauuuaaauguagacuuuugacacuuuuaaaaaacaaaaaaagacaagagag

SEQ ID NO: 496751 - RNA, 64 nt, Homo Sapiens
aaccuugcgauuugcacauaucuuuuuaagaugaacuuuuaaagucauuuuuguccaguguuuu

SEQ ID NO: 496752 - RNA, 64 nt, Homo Sapiens
guauagauauauauuuccccuuacaauaaaagcaacuuuuaauuauuuuucucuccaacauauu

SEQ ID NO: 496753 - RNA, 64 nt, Homo Sapiens
uuuuuguuacaugcauuguauaucaacuuuuaaaacuuuuaacguuacguaccauauuuguaac

SEQ ID NO: 496754 - RNA, 64 nt, Homo Sapiens
cuuuuaacguuuuuguuacaauuuguaacuaucaacuuuuaaaaagaaaauuguuacguaccau

SEQ ID NO: 496755 - RNA, 64 nt, Homo Sapiens
gcugucauaguuaauugaccauaauuagcaauauacuuuuaaagugggaaagcugaaugacacu

SEQ ID NO: 496756 - RNA, 64 nt, Homo Sapiens
gcaauauacuuuuaaagugggaaagcugaaugacacuuuuaagacaaugaacauuaucaaaaca

SEQ ID NO: 496757 - RNA, 64 nt, Homo Sapiens
cacuuuuggguucacuaguguaauaaugauuuuuacuuuuaaguuuauguucuuaaucucuugc

SEQ ID NO: 496758 - RNA, 64 nt, Homo Sapiens
aacuguucucuuaacauugacuuuuuaaacagaaacuuuuaaugcuauuugggccuuuccuuuu

SEQ ID NO: 496759 - RNA, 64 nt, Homo Sapiens
auuaagcuacuauauaaaacaauuguuuacguguacuuuuaacuuuuaaaaguacuuaauuaac

SEQ ID NO: 496760 - RNA, 64 nt, Homo Sapiens
uacuauauaaaacaauuguuuacguguacuuuuaacuuuuaaaaguacuuaauuaacauauguu

SEQ ID NO: 496761 - RNA, 64 nt, Homo Sapiens
gugugcuaacagaaauaaguugcaguauggucguacuuuuaacucuaguauccuuugcuugcuu

SEQ ID NO: 496762 - RNA, 64 nt, Homo Sapiens
cuaucaugggggggcauguuuugacauuaaauugacuuuuaagaaaaacaugucacuaaccuga

SEQ ID NO: 496763 - RNA, 64 nt, Homo Sapiens
acaugucacuaaccugaagcucagccacacagugacuuuuaagguuuuauuuagacuuuacugu

SEQ ID NO: 496764 - RNA, 64 nt, Homo Sapiens
uagugauguucuguucuaaaauuuuuuuuaaucaacuuuuaagaucucuacaugacauauugag

SEQ ID NO: 496765 - RNA, 64 nt, Homo Sapiens
cuuaaggcuuuguaaaaacuuauguccucauagaacuuuuaauauuaaauaggauucuuagaag

SEQ ID NO: 496766 - RNA, 64 nt, Homo Sapiens
cucuucugggcauuuaagcugguauguuagugcuacuuuuaagauuguggagucugaguuaaua

SEQ ID NO: 496767 - RNA, 64 nt, Homo Sapiens
gagacuagaguaucuaguuuuuaguauuuaaacuacuuuuaauuauuuauauugauacucucug

SEQ ID NO: 496768 - RNA, 64 nt, Homo Sapiens
gcugauauucagcaaauuucuaaguuuauggugaacuuuuaacucaauguguaaauagaucugg

SEQ ID NO: 496769 - RNA, 64 nt, Homo Sapiens
uaguguuuuucaaaucuuuaacaucauuuuuucaacuuuuaagauauaauaucaacuauucuaa

SEQ ID NO: 496770 - RNA, 64 nt, Homo Sapiens
gguucugaaaacaaagcugugaacaguuugauacacuuuuaaaaaagccugacagaagcacaag

SEQ ID NO: 496771 - RNA, 64 nt, Homo Sapiens
caacuuggccauuauuuuacaaaagauagaagauacuuuuaagaaucccaaaccuaaucuuuuu

SEQ ID NO: 496772 - RNA, 64 nt, Homo Sapiens
acauauugguaaaugauaccuagcuuagcaaaauacuuuuaaaauuugcccugaguauuaaagc

SEQ ID NO: 496773 - RNA, 64 nt, Homo Sapiens
accuuucagguaguuacaucucuuuuucauuaauacuuuuaaaugaauacaggcuuucuagaga

SEQ ID NO: 496774 - RNA, 64 nt, Homo Sapiens
aauuuuuauggguuauaugcgaggaaaaaccaugacuuuuaacaauuuauggauuuuuagcuuu

SEQ ID NO: 496775 - RNA, 64 nt, Homo Sapiens
acuaauuacugugauggacaacauuuuaaguacaacuuuuaagguuugaguuuauuaaagauug

SEQ ID NO: 496776 - RNA, 64 nt, Homo Sapiens
guguucuccucccuuuauaaauuuuauucauaggacuuuuaaaaggcuugugcuaucuuuccag

SEQ ID NO: 496777 - RNA, 64 nt, Homo Sapiens
gcuuccauguugaagccagauuuucuguaguaaaacuuuuaaauauuauuuuaaaagaaauaug

SEQ ID NO: 496778 - RNA, 64 nt, Homo Sapiens
auuugaauugacaguuacauuuuacacaagcaaaacuuuuaaauauacuagcccuuuuuauaua

SEQ ID NO: 496779 - RNA, 64 nt, Homo Sapiens
uuuguucuuguccaaaguugagaaauuccaacugacuuuuaaaccccuuggucuuuuaauuaaa

SEQ ID NO: 496780 - RNA, 64 nt, Homo Sapiens
auggugacacucuuaucguacuuaaauuccucugacuuuuaaaauucuguccucuugccuuuua

SEQ ID NO: 496781 - RNA, 64 nt, Homo Sapiens
ugcccuugugucucccaguguguuuuggggacagacuuuuaaaaacucugguuggaaaugccau

SEQ ID NO: 496782 - RNA, 64 nt, Homo Sapiens
ucagaguaaguauguucuuacagauacuuguaagacuuuuaaaauaagguucuaaacuguguua

SEQ ID NO: 496783 - RNA, 64 nt, Homo Sapiens
caagauacuuaauauuuuuaaaaaauauuucucuacuuuuaaaaugaaauagaaauaguucuuu

SEQ ID NO: 496784 - RNA, 64 nt, Homo Sapiens
ccauuugguuugaaacuaauaguguaagcaugugacuuuuaacauuguuacuccuguauguagu

SEQ ID NO: 496785 - RNA, 64 nt, Homo Sapiens
guuaauuuccaaaauguauauaauguuuugcugaacuuuuaaaacauacauguuguuaaguacc

SEQ ID NO: 496786 - RNA, 64 nt, Homo Sapiens
cuacuacauuggcgcuauucuuaggacuucugcaacuuuuaaagucuuacuugucuuucuuguu

SEQ ID NO: 496787 - RNA, 64 nt, Homo Sapiens
agauuauguacaaguaacaucuaaauaaaauuacacuuuuaacccuaagagguuuugcuuauua

SEQ ID NO: 496788 - RNA, 64 nt, Homo Sapiens
aagucuuuugacauggauauugugaaugguaugaacuuuuaaaccauauuauugaugaugaaaa

SEQ ID NO: 496789 - RNA, 64 nt, Homo Sapiens
ugccuucuacugauaccggggcaccuccucugguacuuuuaaguguuuuguuaauuauauuuac

SEQ ID NO: 496790 - RNA, 64 nt, Homo Sapiens
accagcuuuuaaugguggaccuauagaauccaguacuuuuaauggugggaauuuacaguagaag

SEQ ID NO: 496791 - RNA, 64 nt, Homo Sapiens
gaagugcugaugaguuauauuuauugaaaacccaacuuuuaaggaagugcuaagaucagucacc

SEQ ID NO: 496792 - RNA, 64 nt, Homo Sapiens
auucuuaguuccagugauaacuguucuaguuacuacuuuuaaguauguaaauacuagaaaggua

SEQ ID NO: 496793 - RNA, 64 nt, Homo Sapiens
ucuuuggagaauguauuuuuguauuuauaaaucaacuuuuaaaaacugucucauucaaaaggga

SEQ ID NO: 496794 - RNA, 64 nt, Homo Sapiens
uacaucacacacacacucacugugcccagcccuaacuuuuaaugggauuacaggcgugagccac

SEQ ID NO: 496795 - RNA, 64 nt, Homo Sapiens
uacaacacacacacacacaccgcaccuggcccuaacuuuuaauaggauuacaggugugauccac

SEQ ID NO: 496796 - RNA, 64 nt, Homo Sapiens
uaaagaaauaaguaguuucaguuuccuuuuauuaacuuuuaaaauucuuccuaaaaauugagag

SEQ ID NO: 496797 - RNA, 64 nt, Homo Sapiens
ucaaaauuggauuugugucaaucuauguauguugacuuuuaacaucugucaacaugagggaccu

SEQ ID NO: 496798 - RNA, 64 nt, Homo Sapiens
agaaaauuauuacauccuuuauuuaaaauauaauacuuuuaaaacuggcacaugugccagcuga

SEQ ID NO: 496799 - RNA, 64 nt, Homo Sapiens
gaagcuuaaauuacucaauucacuguaaaacagaacuuuuaaaugauauaaaggaagaauaagu

SEQ ID NO: 496800 - RNA, 64 nt, Homo Sapiens
augacauaguuagauuauuuaauaaguugcuuugacuuuuaaaaauauuguaacuuucauuaga

SEQ ID NO: 496801 - RNA, 64 nt, Homo Sapiens
ucaugaaaaagcauuaaccuaaauacauuuagaaacuuuuaaaguuuuuacuuagauacuaaua

SEQ ID NO: 496802 - RNA, 64 nt, Homo Sapiens
uugaaaagacaauagcccaaaaacaauaauuuuaacuuuuaaggaaguaucauuacauauagga

SEQ ID NO: 496803 - RNA, 64 nt, Homo Sapiens
ucacuggggggaggggggaaggugaauuaugguaacuuuuaaugaucuauucaggcaguagagc

SEQ ID NO: 496804 - RNA, 64 nt, Homo Sapiens
ccuaaaagacacuaccagucaccuuugauucgcgacuuuuaauuuaugauuauacuuagccucc

SEQ ID NO: 496805 - RNA, 64 nt, Homo Sapiens
uaaacuguuuucuuuuggaaacuuuuaaauguagacuuuuaaaaggaaaccagacaaagcauug

SEQ ID NO: 496806 - RNA, 64 nt, Homo Sapiens
guagacuuuuaaaauaaacucagacaaagcauugacuuuuaaaugcaacagcccuaugggaaac

SEQ ID NO: 496807 - RNA, 64 nt, Homo Sapiens
cuguccaacacuaaugguuuauauaugaaaauagacuuuuaaaaacuccuuguuugucccauuc

SEQ ID NO: 496808 - RNA, 64 nt, Homo Sapiens
ucuggcauucggaauggaaauaccaucuucaggcacuuuuaacauuauuccucacuagcugggu

SEQ ID NO: 496809 - RNA, 64 nt, Homo Sapiens
uauggaguguaguaguaguguguacagguagaaaacuuuuaaauacagcaugcagguguuucag

SEQ ID NO: 496810 - RNA, 64 nt, Homo Sapiens
cauugcuuaauguuuuaagcuuaauagccuuugcacuuuuaaaauaaaaaccaaguaugcaaau

SEQ ID NO: 496811 - RNA, 64 nt, Homo Sapiens
uuuugaaauaccuggaaaugcaguuuuaauaugaacuuuuaagacagaugucucuuacaugauc

SEQ ID NO: 496812 - RNA, 64 nt, Homo Sapiens
aaguucaaauucgagaagauuuaacucaaguggaacuuuuaacucguuugaccuccaaaccauu

SEQ ID NO: 496813 - RNA, 64 nt, Homo Sapiens
gguuuauauguugaaaaacuucauagugcccucuacuuuuaaaguuuugauacuugucuauccu

SEQ ID NO: 496814 - RNA, 64 nt, Homo Sapiens
uaaauggcaacuuggcacacuucauucugguuucacuuuuaaaaccuccuagauucauuauucu

SEQ ID NO: 496815 - RNA, 64 nt, Homo Sapiens
gaaagaugugacagugcuuuugacaacaccuaaaacuuuuaaacauaaaaaaucauacugguga

SEQ ID NO: 496816 - RNA, 64 nt, Homo Sapiens
agaaaacuucuacaagugugaacaguguggcaaaacuuuuaaugaaugcucacaccuuauugca

SEQ ID NO: 496817 - RNA, 64 nt, Homo Sapiens
cuuagaguggucuguuacguuuuuuaaaaauaaaacuuuuaauuaagggagacuauguuauuuu

SEQ ID NO: 496818 - RNA, 64 nt, Homo Sapiens
caaagugcacuuucucuggggccuuuuaggccauacuuuuaauuuuguuauuugauacuacugg

SEQ ID NO: 496819 - RNA, 64 nt, Homo Sapiens
ugcagacuaaauuucuuucuuggauuucagcuucacuuuuaaccuugaggaaaacauuaacucc

SEQ ID NO: 496820 - RNA, 64 nt, Homo Sapiens
ugagaaaacugugucacucuauuagaaauuagccacuuuuaaaaucugcauaaccaguauuagc

SEQ ID NO: 496821 - RNA, 64 nt, Homo Sapiens
uguuuugaacuguauuuacaugacaaauauuuauacuuuuaaauagcacuggaggaaaaauaau

SEQ ID NO: 496822 - RNA, 64 nt, Homo Sapiens
uagcaaaacaguuauuucucgggaaaagcuucagacuuuuaaacacauuaacagcuggggagga

SEQ ID NO: 496823 - RNA, 64 nt, Homo Sapiens
aacuaaaaauuagaacagcucccuagaauugugaacuuuuaagagucugacuagaaauuugcaa

SEQ ID NO: 496824 - RNA, 64 nt, Homo Sapiens
gucugacuagaaauuugcaacuuauaaaaaaguuacuuuuaaaaauauaaguuagggcuaggca

SEQ ID NO: 496825 - RNA, 64 nt, Homo Sapiens
agcuuaaaauggcauucucuagcaaagagauuagacuuuuaaauaacucuuauaaaacagguug

SEQ ID NO: 496826 - RNA, 64 nt, Homo Sapiens
cagcaaaaaguagaaguaucaaauaaaaagggcaacuuuuaaaauauuaagccugaagacuucu

SEQ ID NO: 496827 - RNA, 64 nt, Homo Sapiens
ucauauuugacugggcgugcagaauaacuucuuaacuuuuaacuaucagaguuugauuaauaaa

SEQ ID NO: 496828 - RNA, 64 nt, Homo Sapiens
guaauuuuguguauucuuauuuacuuaacauuuuacuuuuaauuauguaaauuugguuagaaaa

SEQ ID NO: 496829 - RNA, 64 nt, Homo Sapiens
guaauggaagaccuuugagauaaugaaauaaaaugugaucuaguaaucaaaaugugaucuagug

SEQ ID NO: 496830 - RNA, 64 nt, Homo Sapiens
guaaugaaauaaaaugugaugcaguaaucaaaaugugaucuaguaaggaauacauuuucaaaau

SEQ ID NO: 496831 - RNA, 64 nt, Homo Sapiens
ugaaagcuuaagaaaacuuggaaaauucuauuuugugaucuagucaagccacaguuaucaaagg

SEQ ID NO: 496832 - RNA, 64 nt, Homo Sapiens
uuguacauguaucuugaucauuuauaaagccacugugaucuauaaaucaagaaaauccauuguc

SEQ ID NO: 496833 - RNA, 64 nt, Homo Sapiens
aauggcuagacacccauuuuaaacuaaaucucuaauauggcaaaucucacuaaacuuuacccaa

SEQ ID NO: 496834 - RNA, 64 nt, Homo Sapiens
aaagcugguaaacuauuuguuuuuugcaauggcuauauggcaagugucuguaccuaacgcccua

SEQ ID NO: 496835 - RNA, 64 nt, Homo Sapiens
gcauuuuauauaaaaaugcacaccuuuaaucucuauauggcagcauauacauauauauauauaa

SEQ ID NO: 496836 - RNA, 64 nt, Homo Sapiens
auauauauauauaaaaugcacacuuuuaaucucuauauggcagcauuuuugaggcuuuauaucu

SEQ ID NO: 496837 - RNA, 64 nt, Homo Sapiens
uuuugauacaagaauacaguuauauucaugcaauauauggcauaugggguacauaauaugagua

SEQ ID NO: 496838 - RNA, 64 nt, Homo Sapiens
gccuuuaauaaauucucaauugugacugugaagaauauggcaaauucauacuggagggaacucc

SEQ ID NO: 496839 - RNA, 64 nt, Homo Sapiens
guuuauaauauaagcaacauuuagcuaguuguuuugaagacacccaguacuaaguaauauuguu

SEQ ID NO: 496840 - RNA, 64 nt, Homo Sapiens
ugucugaaguuucuuuggaaacucugcaaugcacugaagacaucuguaauaugauguuaccaaa

SEQ ID NO: 496841 - RNA, 64 nt, Homo Sapiens
aacacucaccugggacguugugcacagauaucuuugaagacacaagaguuucuguggauauauu

SEQ ID NO: 496842 - RNA, 64 nt, Homo Sapiens
ccauaucuaugauaucgcaugagcaucuuguaacugaagacacaaaauguauauaauucaaaca

SEQ ID NO: 496843 - RNA, 64 nt, Homo Sapiens
uuaguggaggagggagaaccauauuuauuuauaaugaagacaucuaagaucccuaugaugaaug

SEQ ID NO: 496844 - RNA, 64 nt, Homo Sapiens
guguucuguuggcaagccacagugcucccuugacugaagacauuuccagguagauuucucagcc

SEQ ID NO: 496845 - RNA, 64 nt, Homo Sapiens
gguguuuuaaagaaaugcagggaggcaauguuucugaagacauuuucuguuuauaagagaguag

SEQ ID NO: 496846 - RNA, 64 nt, Homo Sapiens
uuucuauuaaauaucaauuaguaaguauagcuaaugaagacauauaaugaaaguaauuuuaugc

SEQ ID NO: 496847 - RNA, 64 nt, Homo Sapiens
ugagauccuauccaagauuuucugaguuagccaaugaagacaucgagucucuaagauugagagg

SEQ ID NO: 496848 - RNA, 64 nt, Homo Sapiens
agaugaugagaaaagcucaccgacagaucugaagugaagacaggaggaauccccucacaguggg

SEQ ID NO: 496849 - RNA, 64 nt, Homo Sapiens
cugccugcacucccuggccuugcccgucgugugcugaagacauguuucaagaaccgcauuucgg

SEQ ID NO: 496850 - RNA, 64 nt, Homo Sapiens
gccggagggaggcacuagucaccgacagcggccuugaagacagagcaaagcgcccacccagguc

SEQ ID NO: 496851 - RNA, 64 nt, Homo Sapiens
auaaaaaaagauauaguauuaaugccuguauuuaugaagacagggccauugcacugcugcuaug

SEQ ID NO: 496852 - RNA, 64 nt, Homo Sapiens
cucagaggccaaaucuguaaaaucaaaaugagguugaagacaauuagugaaaguaauguuauag

SEQ ID NO: 496853 - RNA, 64 nt, Homo Sapiens
uaucaaccacguggagaaaacacuuagcagcaacugaagacaauauaaaugaaauuugcaaaau

SEQ ID NO: 496854 - RNA, 64 nt, Homo Sapiens
gauauugacacugucccucuagccguccuucuaaugaagacaauguguucucacaguguggggc

SEQ ID NO: 496855 - RNA, 64 nt, Homo Sapiens
gaaggaauuguggauggaagacaagcagaaaagcugaagacaauaguuccucagacagaccuca

SEQ ID NO: 496856 - RNA, 64 nt, Homo Sapiens
agauggcucugcacgaaggagaaccacgcauuuaugaagacauccaggacuacgaggcggccaa

SEQ ID NO: 496857 - RNA, 64 nt, Homo Sapiens
ggcucuaucagccccuguaccccacacugcccucugaagacaacacaggcuccugcuuccaccu

SEQ ID NO: 496858 - RNA, 64 nt, Homo Sapiens
uuaccucacugggaauguguuuugaaaaugaauuugaagacaagccaacaaacccugcacucca

SEQ ID NO: 496859 - RNA, 64 nt, Homo Sapiens
ucaguaugggguuucccucuggaaaaagaaaaucugaagacauuacaguugccuauugccucuu

SEQ ID NO: 496860 - RNA, 64 nt, Homo Sapiens
ccaguugcacaaauggguaacuaucaggaauaucugaagacauuggcuucuccacugcgagaga

SEQ ID NO: 496861 - RNA, 64 nt, Homo Sapiens
gcugggauuacaggugugagccuccaguuuccaucucccuaagaaacuccuggccucaagugau

SEQ ID NO: 496862 - RNA, 64 nt, Homo Sapiens
caaugucaaagccaguccugggaagggugccuggcucccuaaaagggggcuucugcccugacug

SEQ ID NO: 496863 - RNA, 64 nt, Homo Sapiens
uagguuagcuagcucucccccaauaaaaauaccacuaucagaguagaaacaagguagacauuuc

SEQ ID NO: 496864 - RNA, 64 nt, Homo Sapiens
aguuagaagcauguugucaacuaaagacaacaaacuaucagauucauucauucagugaagcagc

SEQ ID NO: 496865 - RNA, 64 nt, Homo Sapiens
aaaacaggaaaggcucgaaaaauguacaccuacucuaucagagaucuuaucacuuauaguuagu

SEQ ID NO: 496866 - RNA, 64 nt, Homo Sapiens
gacauggugaaggcugggaagcccugggcccuuccuaucagaaguguagagggaaggaacagag

SEQ ID NO: 496867 - RNA, 64 nt, Homo Sapiens; identical to SEQ ID NO: 358626

SEQ ID NO: 496868 - RNA, 64 nt, Homo Sapiens; identical to SEQ ID NO: 358627

SEQ ID NO: 496869 - RNA, 64 nt, Homo Sapiens; identical to SEQ ID NO: 358628

SEQ ID NO: 496870 - RNA, 64 nt, Homo Sapiens; identical to SEQ ID NO: 358629

SEQ ID NO: 496871 - RNA, 64 nt, Homo Sapiens; identical to SEQ ID NO: 134304

SEQ ID NO: 496872 - RNA, 64 nt, Homo Sapiens; identical to SEQ ID NO: 134305

SEQ ID NO: 496873 - RNA, 64 nt, Homo Sapiens; identical to SEQ ID NO: 134306

SEQ ID NO: 496874 - RNA, 64 nt, Homo Sapiens; identical to SEQ ID NO: 134307

SEQ ID NO: 496875 - RNA, 64 nt, Homo Sapiens; identical to SEQ ID NO: 134308

SEQ ID NO: 496876 - RNA, 64 nt, Homo Sapiens; identical to SEQ ID NO: 134309

SEQ ID NO: 496877 - RNA, 64 nt, Homo Sapiens; identical to SEQ ID NO: 134310

SEQ ID NO: 496878 - RNA, 64 nt, Homo Sapiens; identical to SEQ ID NO: 134311

SEQ ID NO: 496879 - RNA, 64 nt, Homo Sapiens; identical to SEQ ID NO: 134312

SEQ ID NO: 496880 - RNA, 64 nt, Homo Sapiens; identical to SEQ ID NO: 134313

SEQ ID NO: 496881 - RNA, 64 nt, Homo Sapiens; identical to SEQ ID NO: 134314

SEQ ID NO: 496882 - RNA, 64 nt, Homo Sapiens; identical to SEQ ID NO: 134315

SEQ ID NO: 496883 - RNA, 64 nt, Homo Sapiens; identical to SEQ ID NO: 134316

SEQ ID NO: 496884 - RNA, 64 nt, Homo Sapiens; identical to SEQ ID NO: 134317

SEQ ID NO: 496885 - RNA, 64 nt, Homo Sapiens; identical to SEQ ID NO: 134318

SEQ ID NO: 496886 - RNA, 64 nt, Homo Sapiens; identical to SEQ ID NO: 134319

SEQ ID NO: 496887 - RNA, 64 nt, Homo Sapiens; identical to SEQ ID NO: 134320

SEQ ID NO: 496888 - RNA, 64 nt, Homo Sapiens; identical to SEQ ID NO: 134321

SEQ ID NO: 496889 - RNA, 64 nt, Homo Sapiens; identical to SEQ ID NO: 134322

SEQ ID NO: 496890 - RNA, 64 nt, Homo Sapiens; identical to SEQ ID NO: 134323

SEQ ID NO: 496891 - RNA, 64 nt, Homo Sapiens; identical to SEQ ID NO: 134324

SEQ ID NO: 496892 - RNA, 64 nt, Homo Sapiens; identical to SEQ ID NO: 134325

SEQ ID NO: 496893 - RNA, 64 nt, Homo Sapiens; identical to SEQ ID NO: 134326

SEQ ID NO: 496894 - RNA, 64 nt, Homo Sapiens; identical to SEQ ID NO: 134327

SEQ ID NO: 496895 - RNA, 64 nt, Homo Sapiens; identical to SEQ ID NO: 134328

SEQ ID NO: 496896 - RNA, 64 nt, Homo Sapiens; identical to SEQ ID NO: 134329

SEQ ID NO: 496897 - RNA, 64 nt, Homo Sapiens; identical to SEQ ID NO: 134330

SEQ ID NO: 496898 - RNA, 64 nt, Homo Sapiens; identical to SEQ ID NO: 134331

SEQ ID NO: 496899 - RNA, 64 nt, Homo Sapiens; identical to SEQ ID NO: 134332

SEQ ID NO: 496900 - RNA, 64 nt, Homo Sapiens; identical to SEQ ID NO: 134333

SEQ ID NO: 496901 - RNA, 64 nt, Homo Sapiens; identical to SEQ ID NO: 134334

SEQ ID NO: 496902 - RNA, 64 nt, Homo Sapiens; identical to SEQ ID NO: 134335

SEQ ID NO: 496903 - RNA, 64 nt, Homo Sapiens; identical to SEQ ID NO: 134336

SEQ ID NO: 496904 - RNA, 64 nt, Homo Sapiens; identical to SEQ ID NO: 134337

SEQ ID NO: 496905 - RNA, 64 nt, Homo Sapiens; identical to SEQ ID NO: 134338

SEQ ID NO: 496906 - RNA, 64 nt, Homo Sapiens; identical to SEQ ID NO: 134339

SEQ ID NO: 496907 - RNA, 64 nt, Homo Sapiens; identical to SEQ ID NO: 134340

SEQ ID NO: 496908 - RNA, 64 nt, Homo Sapiens; identical to SEQ ID NO: 134341

SEQ ID NO: 496909 - RNA, 64 nt, Homo Sapiens; identical to SEQ ID NO: 134342

SEQ ID NO: 496910 - RNA, 64 nt, Homo Sapiens; identical to SEQ ID NO: 134343

SEQ ID NO: 496911 - RNA, 64 nt, Homo Sapiens; identical to SEQ ID NO: 134344

SEQ ID NO: 496912 - RNA, 64 nt, Homo Sapiens; identical to SEQ ID NO: 134345

SEQ ID NO: 496913 - RNA, 64 nt, Homo Sapiens; identical to SEQ ID NO: 134346

SEQ ID NO: 496914 - RNA, 64 nt, Homo Sapiens; identical to SEQ ID NO: 134347

SEQ ID NO: 496915 - RNA, 64 nt, Homo Sapiens; identical to SEQ ID NO: 134348

SEQ ID NO: 496916 - RNA, 64 nt, Homo Sapiens; identical to SEQ ID NO: 134349

SEQ ID NO: 496917 - RNA, 64 nt, Homo Sapiens; identical to SEQ ID NO: 134350

SEQ ID NO: 496918 - RNA, 64 nt, Homo Sapiens; identical to SEQ ID NO: 134351

SEQ ID NO: 496919 - RNA, 64 nt, Homo Sapiens; identical to SEQ ID NO: 134352

SEQ ID NO: 496920 - RNA, 64 nt, Homo Sapiens; identical to SEQ ID NO: 134353

SEQ ID NO: 496921 - RNA, 64 nt, Homo Sapiens; identical to SEQ ID NO: 134354

SEQ ID NO: 496922 - RNA, 64 nt, Homo Sapiens; identical to SEQ ID NO: 134355

SEQ ID NO: 496923 - RNA, 64 nt, Homo Sapiens; identical to SEQ ID NO: 134356

SEQ ID NO: 496924 - RNA, 64 nt, Homo Sapiens; identical to SEQ ID NO: 134357

SEQ ID NO: 496925 - RNA, 64 nt, Homo Sapiens; identical to SEQ ID NO: 134358

SEQ ID NO: 496926 - RNA, 64 nt, Homo Sapiens; identical to SEQ ID NO: 134359

SEQ ID NO: 496927 - RNA, 64 nt, Homo Sapiens; identical to SEQ ID NO: 134360

SEQ ID NO: 496928 - RNA, 64 nt, Homo Sapiens; identical to SEQ ID NO: 134361

SEQ ID NO: 496929 - RNA, 64 nt, Homo Sapiens; identical to SEQ ID NO: 134362

SEQ ID NO: 496930 - RNA, 64 nt, Homo Sapiens; identical to SEQ ID NO: 134363

SEQ ID NO: 496931 - RNA, 64 nt, Homo Sapiens; identical to SEQ ID NO: 134364

SEQ ID NO: 496932 - RNA, 64 nt, Homo Sapiens; identical to SEQ ID NO: 134365

SEQ ID NO: 496933 - RNA, 64 nt, Homo Sapiens; identical to SEQ ID NO: 134366

SEQ ID NO: 496934 - RNA, 64 nt, Homo Sapiens; identical to SEQ ID NO: 134367

SEQ ID NO: 496935 - RNA, 64 nt, Homo Sapiens; identical to SEQ ID NO: 134368

SEQ ID NO: 496936 - RNA, 64 nt, Homo Sapiens; identical to SEQ ID NO: 134369

SEQ ID NO: 496937 - RNA, 64 nt, Homo Sapiens; identical to SEQ ID NO: 134370

SEQ ID NO: 496938 - RNA, 64 nt, Homo Sapiens; identical to SEQ ID NO: 134371

SEQ ID NO: 496939 - RNA, 64 nt, Homo Sapiens; identical to SEQ ID NO: 134372

SEQ ID NO: 496940 - RNA, 64 nt, Homo Sapiens; identical to SEQ ID NO: 134373

SEQ ID NO: 496941 - RNA, 64 nt, Homo Sapiens; identical to SEQ ID NO: 134374

SEQ ID NO: 496942 - RNA, 64 nt, Homo Sapiens; identical to SEQ ID NO: 134375

SEQ ID NO: 496943 - RNA, 64 nt, Homo Sapiens; identical to SEQ ID NO: 134376

SEQ ID NO: 496944 - RNA, 64 nt, Homo Sapiens; identical to SEQ ID NO: 134377

SEQ ID NO: 496945 - RNA, 64 nt, Homo Sapiens; identical to SEQ ID NO: 134378

SEQ ID NO: 496946 - RNA, 64 nt, Homo Sapiens; identical to SEQ ID NO: 134379

SEQ ID NO: 496947 - RNA, 64 nt, Homo Sapiens; identical to SEQ ID NO: 134380

SEQ ID NO: 496948 - RNA, 64 nt, Homo Sapiens; identical to SEQ ID NO: 134381

SEQ ID NO: 496949 - RNA, 64 nt, Homo Sapiens; identical to SEQ ID NO: 134382

SEQ ID NO: 496950 - RNA, 64 nt, Homo Sapiens; identical to SEQ ID NO: 134383

SEQ ID NO: 496951 - RNA, 64 nt, Homo Sapiens; identical to SEQ ID NO: 134384

SEQ ID NO: 496952 - RNA, 64 nt, Homo Sapiens; identical to SEQ ID NO: 134385

SEQ ID NO: 496953 - RNA, 64 nt, Homo Sapiens; identical to SEQ ID NO: 134386

SEQ ID NO: 496954 - RNA, 64 nt, Homo Sapiens; identical to SEQ ID NO: 134387

SEQ ID NO: 496955 - RNA, 64 nt, Homo Sapiens; identical to SEQ ID NO: 134388

SEQ ID NO: 496956 - RNA, 64 nt, Homo Sapiens; identical to SEQ ID NO: 134389

SEQ ID NO: 496957 - RNA, 64 nt, Homo Sapiens; identical to SEQ ID NO: 134390

SEQ ID NO: 496958 - RNA, 64 nt, Homo Sapiens; identical to SEQ ID NO: 134391

SEQ ID NO: 496959 - RNA, 64 nt, Homo Sapiens; identical to SEQ ID NO: 134392

SEQ ID NO: 496960 - RNA, 64 nt, Homo Sapiens; identical to SEQ ID NO: 134393

SEQ ID NO: 496961 - RNA, 64 nt, Homo Sapiens; identical to SEQ ID NO: 134394

SEQ ID NO: 496962 - RNA, 64 nt, Homo Sapiens; identical to SEQ ID NO: 134395

SEQ ID NO: 496963 - RNA, 64 nt, Homo Sapiens; identical to SEQ ID NO: 134396

SEQ ID NO: 496964 - RNA, 64 nt, Homo Sapiens; identical to SEQ ID NO: 134397

SEQ ID NO: 496965 - RNA, 64 nt, Homo Sapiens; identical to SEQ ID NO: 134398

SEQ ID NO: 496966 - RNA, 64 nt, Homo Sapiens; identical to SEQ ID NO: 134399

SEQ ID NO: 496967 - RNA, 64 nt, Homo Sapiens; identical to SEQ ID NO: 134400

SEQ ID NO: 496968 - RNA, 64 nt, Homo Sapiens; identical to SEQ ID NO: 134401

SEQ ID NO: 496969 - RNA, 64 nt, Homo Sapiens; identical to SEQ ID NO: 134402

SEQ ID NO: 496970 - RNA, 64 nt, Homo Sapiens; identical to SEQ ID NO: 134403

SEQ ID NO: 496971 - RNA, 64 nt, Homo Sapiens; identical to SEQ ID NO: 134404

SEQ ID NO: 496972 - RNA, 64 nt, Homo Sapiens; identical to SEQ ID NO: 134405

SEQ ID NO: 496973 - RNA, 64 nt, Homo Sapiens; identical to SEQ ID NO: 134406

SEQ ID NO: 496974 - RNA, 64 nt, Homo Sapiens; identical to SEQ ID NO: 134407

SEQ ID NO: 496975 - RNA, 64 nt, Homo Sapiens; identical to SEQ ID NO: 134408

SEQ ID NO: 496976 - RNA, 64 nt, Homo Sapiens; identical to SEQ ID NO: 134409

SEQ ID NO: 496977 - RNA, 64 nt, Homo Sapiens; identical to SEQ ID NO: 134410

SEQ ID NO: 496978 - RNA, 64 nt, Homo Sapiens; identical to SEQ ID NO: 134411

SEQ ID NO: 496979 - RNA, 64 nt, Homo Sapiens; identical to SEQ ID NO: 134412

SEQ ID NO: 496980 - RNA, 64 nt, Homo Sapiens; identical to SEQ ID NO: 134413

SEQ ID NO: 496981 - RNA, 64 nt, Homo Sapiens; identical to SEQ ID NO: 134414

SEQ ID NO: 496982 - RNA, 64 nt, Homo Sapiens; identical to SEQ ID NO: 134415

SEQ ID NO: 496983 - RNA, 64 nt, Homo Sapiens; identical to SEQ ID NO: 134416

SEQ ID NO: 496984 - RNA, 64 nt, Homo Sapiens; identical to SEQ ID NO: 134417

SEQ ID NO: 496985 - RNA, 64 nt, Homo Sapiens; identical to SEQ ID NO: 134418

SEQ ID NO: 496986 - RNA, 64 nt, Homo Sapiens; identical to SEQ ID NO: 134419

SEQ ID NO: 496987 - RNA, 64 nt, Homo Sapiens; identical to SEQ ID NO: 134420

SEQ ID NO: 496988 - RNA, 64 nt, Homo Sapiens; identical to SEQ ID NO: 134421

SEQ ID NO: 496989 - RNA, 64 nt, Homo Sapiens; identical to SEQ ID NO: 134422

SEQ ID NO: 496990 - RNA, 64 nt, Homo Sapiens; identical to SEQ ID NO: 134423

SEQ ID NO: 496991 - RNA, 64 nt, Homo Sapiens; identical to SEQ ID NO: 134424

SEQ ID NO: 496992 - RNA, 64 nt, Homo Sapiens; identical to SEQ ID NO: 134425

SEQ ID NO: 496993 - RNA, 64 nt, Homo Sapiens; identical to SEQ ID NO: 134426

SEQ ID NO: 496994 - RNA, 64 nt, Homo Sapiens; identical to SEQ ID NO: 134427

SEQ ID NO: 496995 - RNA, 64 nt, Homo Sapiens; identical to SEQ ID NO: 134428

SEQ ID NO: 496996 - RNA, 64 nt, Homo Sapiens; identical to SEQ ID NO: 134429

SEQ ID NO: 496997 - RNA, 64 nt, Homo Sapiens; identical to SEQ ID NO: 134430

SEQ ID NO: 496998 - RNA, 64 nt, Homo Sapiens; identical to SEQ ID NO: 134431

SEQ ID NO: 496999 - RNA, 64 nt, Homo Sapiens; identical to SEQ ID NO: 134432

SEQ ID NO: 497000 - RNA, 64 nt, Homo Sapiens; identical to SEQ ID NO: 134433

SEQ ID NO: 497001 - RNA, 64 nt, Homo Sapiens; identical to SEQ ID NO: 134434

SEQ ID NO: 497002 - RNA, 64 nt, Homo Sapiens; identical to SEQ ID NO: 134435

SEQ ID NO: 497003 - RNA, 64 nt, Homo Sapiens; identical to SEQ ID NO: 134436

SEQ ID NO: 497004 - RNA, 64 nt, Homo Sapiens; identical to SEQ ID NO: 134437

SEQ ID NO: 497005 - RNA, 64 nt, Homo Sapiens; identical to SEQ ID NO: 134438

SEQ ID NO: 497006 - RNA, 64 nt, Homo Sapiens; identical to SEQ ID NO: 134439

SEQ ID NO: 497007 - RNA, 64 nt, Homo Sapiens; identical to SEQ ID NO: 134440

SEQ ID NO: 497008 - RNA, 64 nt, Homo Sapiens; identical to SEQ ID NO: 134441

SEQ ID NO: 497009 - RNA, 64 nt, Homo Sapiens; identical to SEQ ID NO: 134442

SEQ ID NO: 497010 - RNA, 64 nt, Homo Sapiens; identical to SEQ ID NO: 134443

SEQ ID NO: 497011 - RNA, 64 nt, Homo Sapiens; identical to SEQ ID NO: 134444

SEQ ID NO: 497012 - RNA, 64 nt, Homo Sapiens; identical to SEQ ID NO: 134445

SEQ ID NO: 497013 - RNA, 64 nt, Homo Sapiens; identical to SEQ ID NO: 134446

SEQ ID NO: 497014 - RNA, 64 nt, Homo Sapiens; identical to SEQ ID NO: 134447

SEQ ID NO: 497015 - RNA, 64 nt, Homo Sapiens; identical to SEQ ID NO: 134448

SEQ ID NO: 497016 - RNA, 64 nt, Homo Sapiens; identical to SEQ ID NO: 134449

SEQ ID NO: 497017 - RNA, 64 nt, Homo Sapiens; identical to SEQ ID NO: 134450

SEQ ID NO: 497018 - RNA, 64 nt, Homo Sapiens; identical to SEQ ID NO: 134451

SEQ ID NO: 497019 - RNA, 64 nt, Homo Sapiens; identical to SEQ ID NO: 134452

SEQ ID NO: 497020 - RNA, 64 nt, Homo Sapiens; identical to SEQ ID NO: 134453

SEQ ID NO: 497021 - RNA, 64 nt, Homo Sapiens; identical to SEQ ID NO: 134454

SEQ ID NO: 497022 - RNA, 64 nt, Homo Sapiens; identical to SEQ ID NO: 134455

SEQ ID NO: 497023 - RNA, 64 nt, Homo Sapiens; identical to SEQ ID NO: 134456

SEQ ID NO: 497024 - RNA, 64 nt, Homo Sapiens; identical to SEQ ID NO: 134457

SEQ ID NO: 497025 - RNA, 64 nt, Homo Sapiens; identical to SEQ ID NO: 151176

SEQ ID NO: 497026 - RNA, 64 nt, Homo Sapiens; identical to SEQ ID NO: 151177

SEQ ID NO: 497027 - RNA, 64 nt, Homo Sapiens; identical to SEQ ID NO: 151178

SEQ ID NO: 497028 - RNA, 64 nt, Homo Sapiens; identical to SEQ ID NO: 151179

SEQ ID NO: 497029 - RNA, 64 nt, Homo Sapiens; identical to SEQ ID NO: 151180

SEQ ID NO: 497030 - RNA, 64 nt, Homo Sapiens; identical to SEQ ID NO: 151181

SEQ ID NO: 497031 - RNA, 64 nt, Homo Sapiens; identical to SEQ ID NO: 151182

SEQ ID NO: 497032 - RNA, 64 nt, Homo Sapiens; identical to SEQ ID NO: 151183

SEQ ID NO: 497033 - RNA, 64 nt, Homo Sapiens; identical to SEQ ID NO: 151184

SEQ ID NO: 497034 - RNA, 64 nt, Homo Sapiens; identical to SEQ ID NO: 151185

SEQ ID NO: 497035 - RNA, 64 nt, Homo Sapiens; identical to SEQ ID NO: 151186

SEQ ID NO: 497036 - RNA, 64 nt, Homo Sapiens; identical to SEQ ID NO: 151187

SEQ ID NO: 497037 - RNA, 64 nt, Homo Sapiens; identical to SEQ ID NO: 238553

SEQ ID NO: 497038 - RNA, 64 nt, Homo Sapiens; identical to SEQ ID NO: 238554

SEQ ID NO: 497039 - RNA, 64 nt, Homo Sapiens; identical to SEQ ID NO: 238555

SEQ ID NO: 497040 - RNA, 64 nt, Homo Sapiens; identical to SEQ ID NO: 238556

SEQ ID NO: 497041 - RNA, 61 nt, Homo Sapiens; identical to SEQ ID NO: 238557

SEQ ID NO: 497042 - RNA, 64 nt, Homo Sapiens; identical to SEQ ID NO: 238558

SEQ ID NO: 497043 - RNA, 64 nt, Homo Sapiens; identical to SEQ ID NO: 238559

SEQ ID NO: 497044 - RNA, 64 nt, Homo Sapiens; identical to SEQ ID NO: 238560

SEQ ID NO: 497045 - RNA, 64 nt, Homo Sapiens; identical to SEQ ID NO: 238561

SEQ ID NO: 497046 - RNA, 64 nt, Homo Sapiens; identical to SEQ ID NO: 238562

SEQ ID NO: 497047 - RNA, 64 nt, Homo Sapiens; identical to SEQ ID NO: 238563

SEQ ID NO: 497048 - RNA, 64 nt, Homo Sapiens; identical to SEQ ID NO: 238564

SEQ ID NO: 497049 - RNA, 64 nt, Homo Sapiens; identical to SEQ ID NO: 238565

SEQ ID NO: 497050 - RNA, 64 nt, Homo Sapiens; identical to SEQ ID NO: 238566

SEQ ID NO: 497051 - RNA, 64 nt, Homo Sapiens; identical to SEQ ID NO: 238567

SEQ ID NO: 497052 - RNA, 64 nt, Homo Sapiens; identical to SEQ ID NO: 238568

SEQ ID NO: 497053 - RNA, 64 nt, Homo Sapiens; identical to SEQ ID NO: 238569

SEQ ID NO: 497054 - RNA, 64 nt, Homo Sapiens; identical to SEQ ID NO: 238570

SEQ ID NO: 497055 - RNA, 64 nt, Homo Sapiens; identical to SEQ ID NO: 238571

SEQ ID NO: 497056 - RNA, 64 nt, Homo Sapiens; identical to SEQ ID NO: 238572

SEQ ID NO: 497057 - RNA, 64 nt, Homo Sapiens; identical to SEQ ID NO: 238573

SEQ ID NO: 497058 - RNA, 64 nt, Homo Sapiens; identical to SEQ ID NO: 238574

SEQ ID NO: 497059 - RNA, 64 nt, Homo Sapiens; identical to SEQ ID NO: 238575

SEQ ID NO: 497060 - RNA, 64 nt, Homo Sapiens; identical to SEQ ID NO: 238576

SEQ ID NO: 497061 - RNA, 64 nt, Homo Sapiens; identical to SEQ ID NO: 238577

SEQ ID NO: 497062 - RNA, 64 nt, Homo Sapiens; identical to SEQ ID NO: 238578

SEQ ID NO: 497063 - RNA, 64 nt, Homo Sapiens; identical to SEQ ID NO: 238579

SEQ ID NO: 497064 - RNA, 64 nt, Homo Sapiens; identical to SEQ ID NO: 238580

SEQ ID NO: 497065 - RNA, 64 nt, Homo Sapiens; identical to SEQ ID NO: 238581

SEQ ID NO: 497066 - RNA, 64 nt, Homo Sapiens; identical to SEQ ID NO: 238582

SEQ ID NO: 497067 - RNA, 64 nt, Homo Sapiens; identical to SEQ ID NO: 238583

SEQ ID NO: 497068 - RNA, 64 nt, Homo Sapiens; identical to SEQ ID NO: 238584

SEQ ID NO: 497069 - RNA, 64 nt, Homo Sapiens; identical to SEQ ID NO: 238585

SEQ ID NO: 497070 - RNA, 64 nt, Homo Sapiens; identical to SEQ ID NO: 238586

SEQ ID NO: 497071 - RNA, 64 nt, Homo Sapiens; identical to SEQ ID NO: 238587

SEQ ID NO: 497072 - RNA, 64 nt, Homo Sapiens; identical to SEQ ID NO: 238588

SEQ ID NO: 497073 - RNA, 64 nt, Homo Sapiens; identical to SEQ ID NO: 238589

SEQ ID NO: 497074 - RNA, 64 nt, Homo Sapiens; identical to SEQ ID NO: 238590

SEQ ID NO: 497075 - RNA, 64 nt, Homo Sapiens; identical to SEQ ID NO: 238591

SEQ ID NO: 497076 - RNA, 64 nt, Homo Sapiens; identical to SEQ ID NO: 238592

SEQ ID NO: 497077 - RNA, 64 nt, Homo Sapiens; identical to SEQ ID NO: 238593

SEQ ID NO: 497078 - RNA, 51 nt, Homo Sapiens; identical to SEQ ID NO: 238594

SEQ ID NO: 497079 - RNA, 64 nt, Homo Sapiens; identical to SEQ ID NO: 238595

SEQ ID NO: 497080 - RNA, 64 nt, Homo Sapiens; identical to SEQ ID NO: 238596

SEQ ID NO: 497081 - RNA, 64 nt, Homo Sapiens; identical to SEQ ID NO: 238597

SEQ ID NO: 497082 - RNA, 64 nt, Homo Sapiens; identical to SEQ ID NO: 238598

SEQ ID NO: 497083 - RNA, 64 nt, Homo Sapiens; identical to SEQ ID NO: 238599

SEQ ID NO: 497084 - RNA, 64 nt, Homo Sapiens; identical to SEQ ID NO: 238600

SEQ ID NO: 497085 - RNA, 64 nt, Homo Sapiens; identical to SEQ ID NO: 238601

SEQ ID NO: 497086 - RNA, 64 nt, Homo Sapiens; identical to SEQ ID NO: 238602

SEQ ID NO: 497087 - RNA, 64 nt, Homo Sapiens; identical to SEQ ID NO: 238603

SEQ ID NO: 497088 - RNA, 64 nt, Homo Sapiens; identical to SEQ ID NO: 238604

SEQ ID NO: 497089 - RNA, 64 nt, Homo Sapiens; identical to SEQ ID NO: 238605

SEQ ID NO: 497090 - RNA, 64 nt, Homo Sapiens; identical to SEQ ID NO: 238606

SEQ ID NO: 497091 - RNA, 64 nt, Homo Sapiens; identical to SEQ ID NO: 238607

SEQ ID NO: 497092 - RNA, 64 nt, Homo Sapiens; identical to SEQ ID NO: 238608

SEQ ID NO: 497093 - RNA, 64 nt, Homo Sapiens; identical to SEQ ID NO: 238609

SEQ ID NO: 497094 - RNA, 64 nt, Homo Sapiens; identical to SEQ ID NO: 238610

SEQ ID NO: 497095 - RNA, 64 nt, Homo Sapiens; identical to SEQ ID NO: 238611

SEQ ID NO: 497096 - RNA, 64 nt, Homo Sapiens; identical to SEQ ID NO: 238612

SEQ ID NO: 497097 - RNA, 64 nt, Homo Sapiens; identical to SEQ ID NO: 238613

SEQ ID NO: 497098 - RNA, 64 nt, Homo Sapiens; identical to SEQ ID NO: 238614

SEQ ID NO: 497099 - RNA, 64 nt, Homo Sapiens; identical to SEQ ID NO: 238615

SEQ ID NO: 497100 - RNA, 64 nt, Homo Sapiens; identical to SEQ ID NO: 238616

SEQ ID NO: 497101 - RNA, 64 nt, Homo Sapiens; identical to SEQ ID NO: 238617

SEQ ID NO: 497102 - RNA, 64 nt, Homo Sapiens; identical to SEQ ID NO: 238618

SEQ ID NO: 497103 - RNA, 64 nt, Homo Sapiens; identical to SEQ ID NO: 238619

SEQ ID NO: 497104 - RNA, 64 nt, Homo Sapiens; identical to SEQ ID NO: 238620

SEQ ID NO: 497105 - RNA, 64 nt, Homo Sapiens; identical to SEQ ID NO: 238621

SEQ ID NO: 497106 - RNA, 64 nt, Homo Sapiens; identical to SEQ ID NO: 238622

SEQ ID NO: 497107 - RNA, 64 nt, Homo Sapiens; identical to SEQ ID NO: 238623

SEQ ID NO: 497108 - RNA, 64 nt, Homo Sapiens; identical to SEQ ID NO: 238624

SEQ ID NO: 497109 - RNA, 64 nt, Homo Sapiens; identical to SEQ ID NO: 238625

SEQ ID NO: 497110 - RNA, 64 nt, Homo Sapiens; identical to SEQ ID NO: 238626

SEQ ID NO: 497111 - RNA, 64 nt, Homo Sapiens; identical to SEQ ID NO: 238627

SEQ ID NO: 497112 - RNA, 64 nt, Homo Sapiens; identical to SEQ ID NO: 238628

SEQ ID NO: 497113 - RNA, 64 nt, Homo Sapiens; identical to SEQ ID NO: 238629

SEQ ID NO: 497114 - RNA, 64 nt, Homo Sapiens
gugagcucuuccuaucccucuccuaacugccagcccccuaaaagcacuccugcuuaaucuucaa

SEQ ID NO: 497115 - RNA, 64 nt, Homo Sapiens
uuaaauccuuuuaccuuuuuuuuuucuugguaauccccuaaaauaacaguaugugggauauuga

SEQ ID NO: 497116 - RNA, 64 nt, Homo Sapiens
uugccuaaaauucaguauguucuaugucccgauuccccuaaauuucgccaaaauguguuuucca

SEQ ID NO: 497117 - RNA, 64 nt, Homo Sapiens
cacauuuacucaauauuggaauucuacaugugugccccuaaagagcccauuuaaguggauuaau

SEQ ID NO: 497118 - RNA, 64 nt, Homo Sapiens
uaauaaucucuucuauuuauagcuauugguaguuccccuaaauucugacgauagaaauuuuuau

SEQ ID NO: 497119 - RNA, 64 nt, Homo Sapiens
acauauauauuacauuuauagcuauguaguaguuccccuaaauucuuguaaaaauaaauuuuua

SEQ ID NO: 497120 - RNA, 64 nt, Homo Sapiens
aacugaaggcuaaaaagcaagguugagcaauuucccccuaaaccgaauuugagcaggucucaua

SEQ ID NO: 497121 - RNA, 64 nt, Homo Sapiens
ccaggggggacaauaugugcaaagcuuucugccaccccuaaacuuuuacuuuuuugguacuaua

SEQ ID NO: 497122 - RNA, 64 nt, Homo Sapiens
gcaaguuuacuuucauuccuuccuauguuuuaauccccuaaaauucucccuguagucaauguuc

SEQ ID NO: 497123 - RNA, 64 nt, Homo Sapiens
uggggaggaugcuacuuuacuggaguugagacacccccuaaaauucucacccucagcuauuuug

SEQ ID NO: 497124 - RNA, 64 nt, Homo Sapiens
gcagagcauugucaccgcaggugcucaugcugcuccccuaaagccaggcucaggagaagccagu

SEQ ID NO: 497125 - RNA, 64 nt, Homo Sapiens
gaucugcccccuaguucagguccaaauucaccuuccccuaaaccccaagcuucccaacagauca

SEQ ID NO: 497126 - RNA, 64 nt, Homo Sapiens
ugaggagagaggaggaaaagucuuccuaauugugccccuaaagagcauccugauaccauucuau

SEQ ID NO: 497127 - RNA, 64 nt, Homo Sapiens
aauagcuuucuaguucauuuaggaacuaaacuaugccauaaaacaauuugaugaaauuuacugu

SEQ ID NO: 497128 - RNA, 64 nt, Homo Sapiens
accugggaugaaagaaguuuccccuuugaucccagccauaaagucugugcaaacaagugaguca

SEQ ID NO: 497129 - RNA, 64 nt, Homo Sapiens
cugacaaaugagaaacaauaaauacugauuauuggccauaaagugguauuaaaacuggaucucu

SEQ ID NO: 497130 - RNA, 64 nt, Homo Sapiens
agguuguuuauucauucagauuagauagacuggagccauaaaguuaauuugcaccuagcuuuuu

SEQ ID NO: 497131 - RNA, 64 nt, Homo Sapiens
aaauaucugcagcacugugauggccccaaaacuggccauaaacaccccaaaucuggccauaaac

SEQ ID NO: 497132 - RNA, 64 nt, Homo Sapiens
ggccccaaaacuggccauaaggcccccaaaucuggccauaaacuaaucucugguguugggaaca

SEQ ID NO: 497133 - RNA, 64 nt, Homo Sapiens
auagaaaaaggcuugcguguucguugaguaaucauuguuucauuuucauuuuuacgagaguuug

SEQ ID NO: 497134 - RNA, 64 nt, Homo Sapiens
aaauguacuguauucaaaaggaugugaauguguauuguuucagaaccuaauaaauacaaugacg

SEQ ID NO: 497135 - RNA, 64 nt, Homo Sapiens
uuuuuaaaacccacacaaaggcaacgccuuguguuuguuucauuagcaugucccagucacugca

SEQ ID NO: 497136 - RNA, 64 nt, Homo Sapiens
guuuauuauaaaagccuugcuuugaaaggaaaucuuguuucaauuaauagauguaaguuuacac

SEQ ID NO: 497137 - RNA, 64 nt, Homo Sapiens
auaauugcauuuucuuagaaguauccacucauguuuguuucauauccgucauuuugcauuacuu

SEQ ID NO: 497138 - RNA, 64 nt, Homo Sapiens
aauauguacacaaauguacauuucauguauuuuuuuguuucauuuuagaaaaagauaaguauua

SEQ ID NO: 497139 - RNA, 64 nt, Homo Sapiens
uauaauuugcccaaauacauuugauuugauaugauuguuucauuucuauacuuugguccauaau

SEQ ID NO: 497140 - RNA, 64 nt, Homo Sapiens
uugauuuuuuuuuuuagccaauauagcuaaguuuuuguuucauuguuaucuugcuuuuaucaau

SEQ ID NO: 497141 - RNA, 64 nt, Homo Sapiens
aguauaaucugaguccggugugcuuauauuaaaguuguuucaucauugcugcaauguauuuucu

SEQ ID NO: 497142 - RNA, 64 nt, Homo Sapiens
gcagaauguaccagccagucuaaaacucugugaguuguuucagggauaaaugcuucuaccaaag

SEQ ID NO: 497143 - RNA, 64 nt, Homo Sapiens
auucuauguuaauuacaacugcuauauagacauuuuguuucaaaugaaacuuuaaaagacugaa

SEQ ID NO: 497144 - RNA, 64 nt, Homo Sapiens
acuguuacugaaauugguauuuguuugaagggucuuguuucacauuuguauuaauaauuguuua

SEQ ID NO: 497145 - RNA, 64 nt, Homo Sapiens
aaugugacacugauaaagccucuuuuagggaaaauuguuucauaaauugucccugauuuuauuu

SEQ ID NO: 497146 - RNA, 64 nt, Homo Sapiens
aaugagcacuguugugauaacgaauugguaacaguuguuucauaauuuuagcacuguuaaagca

SEQ ID NO: 497147 - RNA, 64 nt, Homo Sapiens
cuucacaagucagcauuaaucuuucuuuuaaaacuuguuucauuuaugaucauguagagagcca

SEQ ID NO: 497148 - RNA, 64 nt, Homo Sapiens
auaaaaaagggaaacuguuuucacaagcuguucuuuguuucauaauuggauucaucaaucccgu

SEQ ID NO: 497149 - RNA, 64 nt, Homo Sapiens
uccuuuuuauuacagaggugggucacuguuuaccuuguuucaggggugggagaaacuccuuucc

SEQ ID NO: 497150 - RNA, 64 nt, Homo Sapiens
uacagcagggcucuggggaacuggaaaaggggguuuguuucauuaucugguuuuauuaagcaga

SEQ ID NO: 497151 - RNA, 64 nt, Homo Sapiens
auuguuuaaaugccuaaaaguuuugagauaaguuuuguuucaauuagaaaaggaaauagguuuu

SEQ ID NO: 497152 - RNA, 64 nt, Homo Sapiens
caauagugauuuuuguaucagaaucuuguccaaguuguuucauugauuuaguaaguguucugcu

SEQ ID NO: 497153 - RNA, 64 nt, Homo Sapiens
ggaaaauagauccccuuaaauggcuuuccagcaauuguuucaaauccuauuaccuuucugaggc

SEQ ID NO: 497154 - RNA, 64 nt, Homo Sapiens
auacaggaaaaacauuccuacuauggaaaauuuuuuguuucaaacuauaauugaauggauauuc

SEQ ID NO: 497155 - RNA, 64 nt, Homo Sapiens
uuauaacuuacacuuugaacagcagauuuugauuuuguuucaaugucuacccacccucccuucu

SEQ ID NO: 497156 - RNA, 64 nt, Homo Sapiens
gaacuauacaacuuguggguuuggagcuuuuagcuuguuucaugguauagcuuuguaauuuaaa

SEQ ID NO: 497157 - RNA, 64 nt, Homo Sapiens
gaggaaauuugaacaaguuggaaaaaaacaauuuuuguuucaauucuaagaaacacuugcagcu

SEQ ID NO: 497158 - RNA, 64 nt, Homo Sapiens
auuaccauggaacgccuaauaaagcaaaaugugguuguuucaggggugugucuguauugagaug

SEQ ID NO: 497159 - RNA, 64 nt, Homo Sapiens
uuuuauguguagaucuaauaguaauuuguuaauauuguuucaugaauaaaaacuuaauacaaau

SEQ ID NO: 497160 - RNA, 64 nt, Homo Sapiens
uuuuaaggacaagaucaggauaugcuauuuugcuuuguuucauucuuagguaaacuuauuuauu

SEQ ID NO: 497161 - RNA, 64 nt, Homo Sapiens
uaaacugaccccaugaccaacugagaauuuauuuuuguuucauugguuguuucacagaauuaga

SEQ ID NO: 497162 - RNA, 64 nt, Homo Sapiens
augaccaacugagaauuuauuuuuguuucauugguuguuucacagaauuagaacacacacgacu

SEQ ID NO: 497163 - RNA, 64 nt, Homo Sapiens
guuuguaauauuuaagaaauguaagcuaguauauuuguuucacugucauaaauuguacauaucu

SEQ ID NO: 497164 - RNA, 64 nt, Homo Sapiens
uggcagaacauuuacuggccguuagaucuccuguuuguuucaguaacucccacugauagugccu

SEQ ID NO: 497165 - RNA, 64 nt, Homo Sapiens
agaaggaaggcaggugaauaccugaggaugcaucuuguuucauaugcuaccaagaagaugugaa

SEQ ID NO: 497166 - RNA, 64 nt, Homo Sapiens
gugagauugcaguucuguauaauaagcaguauguuuguuucauucuuuaacuguagugccuccu

SEQ ID NO: 497167 - RNA, 64 nt, Homo Sapiens
uuaaugcagcugcugagaaguuuaaucaagaccauuguuucauguuuguuuuuuguuuuuuuuu

SEQ ID NO: 497168 - RNA, 64 nt, Homo Sapiens
uuguuuaauuuucuggggugcuuaucuagaauuuuuguuucauugauauccugccaaaugcccu

SEQ ID NO: 497169 - RNA, 64 nt, Homo Sapiens
caaaacagcuguuauaaaugaauauuauguguaauuguuucaaacauccauuuucuuugugaac

SEQ ID NO: 497170 - RNA, 64 nt, Homo Sapiens
uaauuguuguaacauugucuuucuuuuuuuucuuuuguuucaugauuuugauuuuuaaaauuau

SEQ ID NO: 497171 - RNA, 64 nt, Homo Sapiens
aaaacaaaucacaaaagcagcauuagacauugccuuguuucauuaaucuuguuucagagcuuua

SEQ ID NO: 497172 - RNA, 64 nt, Homo Sapiens
aagcagcauuagacauugccuuguuucauuaaucuuguuucagagcuuuagcugccugaggaga

SEQ ID NO: 497173 - RNA, 64 nt, Homo Sapiens
cuuuacaauagcauucuucaaaaauguuuagaucuuguuucaaaagacauuaaauguaaacuua

SEQ ID NO: 497174 - RNA, 64 nt, Homo Sapiens
uaaaacuguggauuggccuagcuuucacagaaaauuguuucacuugacuacuuguauggcauua

SEQ ID NO: 497175 - RNA, 64 nt, Homo Sapiens
aacuaagaugcacuguaacauguuuuguauauuuuuguuucaucaucauuuuuacugugucuca

SEQ ID NO: 497176 - RNA, 64 nt, Homo Sapiens
gaaacaucucaauacacuuaaaaauuaaauauuuuuguuucaaaaggcuguuuaucacaugcau

SEQ ID NO: 497177 - RNA, 64 nt, Homo Sapiens
cuuauauuggaaugauuauaauuucauacuuauauuguuucaucugugccaagacuguauuuau

SEQ ID NO: 497178 - RNA, 64 nt, Homo Sapiens
cugucuuuagaguuaggugcuugcauuuacacaguuguuucaugaaucacuuuuaaauaaugug

SEQ ID NO: 497179 - RNA, 64 nt, Homo Sapiens
uguacagacauacauuuaugcacauucacgcuguuuguuucauauauacaggcauaaaauagag

SEQ ID NO: 497180 - RNA, 64 nt, Homo Sapiens
ugaaauuauacagauagaguuccauauauuguauuuguuucaaugguaaauccuuuuggaacau

SEQ ID NO: 497181 - RNA, 64 nt, Homo Sapiens
cuguacaguuuguagccagguuaagcauuugguauuguuucauuuacaauuugggacuaagaug

SEQ ID NO: 497182 - RNA, 64 nt, Homo Sapiens
uuuuguuuuguuugguguuuuguuccugucuucauuguuucagguauuucuuuaccccucugga

SEQ ID NO: 497183 - RNA, 64 nt, Homo Sapiens
aaauauguaauuuuagaaaauaauuuaaaagguuuuguuucaguuuguaagauuucuuuucugg

SEQ ID NO: 497184 - RNA, 64 nt, Homo Sapiens
ccaaauaauuagcaguccuucguagugucaguuuuuguuucagccuuccuuauggguaugcugu

SEQ ID NO: 497185 - RNA, 64 nt, Homo Sapiens
ugguuugacuguuuucuuguauauggauauccaauuguuucacacaauuuuuuugaaaagaaua

SEQ ID NO: 497186 - RNA, 64 nt, Homo Sapiens
cacagccugcaaaugacuucauuuggaagucugauuguuucaguugccugacaaauacuacacu

SEQ ID NO: 497187 - RNA, 64 nt, Homo Sapiens
auuccacagccuggucaggagggaaggaccucacuuguuucaucaaauggagugguuuaaaacu

SEQ ID NO: 497188 - RNA, 64 nt, Homo Sapiens
ccaggcgcaggugcugagaauaagaaugcucaguuuguuucagccuuaguuggugccuccuuag

SEQ ID NO: 497189 - RNA, 64 nt, Homo Sapiens
ugugaaauguauuuuauuuucuuuauuuguauucuuguuucauuuuuuaauauguugugaacau

SEQ ID NO: 497190 - RNA, 64 nt, Homo Sapiens
uuuugaaauucaggaauacagguucuguuuucauuuguuucauuucuagagaaacaaguuuuau

SEQ ID NO: 497191 - RNA, 64 nt, Homo Sapiens
aggcagcagggguguucaguucugugacagucccuuguuucaacuguuuauaggugauuaucau

SEQ ID NO: 497192 - RNA, 64 nt, Homo Sapiens
aagauaggagauagcucugucuagagccaaaaacuuguuucagaaagugcagaaagccagagga

SEQ ID NO: 497193 - RNA, 64 nt, Homo Sapiens
aagaugagagagaacucugucuagauccaaagacuuguuucagaaaguacagaaagccagagga

SEQ ID NO: 497194 - RNA, 64 nt, Homo Sapiens
aagauggaagagaguucuuucuagaggccaagacuuguuucagaaugugcagaaagccagagga

SEQ ID NO: 497195 - RNA, 64 nt, Homo Sapiens
ggaaagagcauaguuuaacaucuugagaaauuugggacauaaaguuuucaugguagacaguuca

SEQ ID NO: 497196 - RNA, 64 nt, Homo Sapiens
cccaggaagggaugaucaggagaggcuucccugaggacauaauguguaagagaggugagaagug

SEQ ID NO: 497197 - RNA, 64 nt, Homo Sapiens
uauuuggguauccuggguuugaguguuaggggauggacauaaaggaaaaagagugaugagaaga

SEQ ID NO: 497198 - RNA, 64 nt, Homo Sapiens
caguaaccccacugcacaggcacacgaugcucugggacauaacuggugccuggaaaucaccaug

SEQ ID NO: 497199 - RNA, 64 nt, Homo Sapiens
caccccuguacccagccaccuuccugacugggaaggacauaaaagguuuaaugucagggucaaa

SEQ ID NO: 497200 - RNA, 64 nt, Homo Sapiens
aaaaccaagcuacacuacaauuugaaauauuuguggacauaaauuuugaguauuuuguaauuuu

SEQ ID NO: 497201 - RNA, 64 nt, Homo Sapiens
aagacggagacuguucaggaguugccuugaacugggacauaaagaagaccccaaagcacuggcu

SEQ ID NO: 497202 - RNA, 64 nt, Homo Sapiens
cacgagagugacagucaucuccauugacucaaggggacauaaaccaguuuaauuccagccuuac

SEQ ID NO: 497203 - RNA, 64 nt, Homo Sapiens
aauauuauaguaagcugcaucaaaaaaucaucuuggacauaauugaauucuaguauucuguauu

SEQ ID NO: 497204 - RNA, 64 nt, Homo Sapiens
gagucaagugacaacaggagcccacaaguuggguggacauaaaucaaggcuguuugcugggugu

SEQ ID NO: 497205 - RNA, 64 nt, Homo Sapiens
ggaaaauucauuccauagaguugagauaaagacgggacauaagggcuaauaaaacaugcugagg

SEQ ID NO: 497206 - RNA, 64 nt, Homo Sapiens
uuuucugcuuucagacgcaaccugcuuugggcugggacauaaguuccucaaguaagggggaacu

SEQ ID NO: 497207 - RNA, 64 nt, Homo Sapiens
acuuggucaccuuggacccugccauuucuccugaggacauaaucaccacaggugucucauugcu

SEQ ID NO: 497208 - RNA, 64 nt, Homo Sapiens
uagaggucuccaaaaucggacucuauagacucuaggacauaaaucugagacaucaggguggcga

SEQ ID NO: 497209 - RNA, 64 nt, Homo Sapiens
gcucuuuucagagccaccuaggggccccuuugauggacauaaagugaggccgcccgccgccccc

SEQ ID NO: 497210 - RNA, 64 nt, Homo Sapiens
aaaagaggaaggguuucuugucccgggaagcaacggacauaaucuguucccagccauggccuuc

SEQ ID NO: 497211 - RNA, 64 nt, Homo Sapiens
ugcauagaauuuaagugauugauuuaaaaaaacuggacauaaacuaagucuaagaagagggcuu

SEQ ID NO: 497212 - RNA, 64 nt, Homo Sapiens
cauaacaguaacacgauguaacauuuuuuccucuggacauaagaaagagcaaaucuguaugaua

SEQ ID NO: 497213 - RNA, 64 nt, Homo Sapiens
aaauacaugguuguuaaagcuuggguagaggagaggacauaaauugaugguaacaguaagugau

SEQ ID NO: 497214 - RNA, 64 nt, Homo Sapiens
gaguuuuuaaaucaguuuauaagugauccauguuggacauaauucauuaacaaucaagauguaa

SEQ ID NO: 497215 - RNA, 64 nt, Homo Sapiens
aucuggucccugaugaagaauaauuuugauuucaggacauaaaguaaauccagcauguuuuauu

SEQ ID NO: 497216 - RNA, 64 nt, Homo Sapiens
uuggacagcuuucacaaguaacaggauuagggaaggacauaauguauuuaagaauaagugaagg

SEQ ID NO: 497217 - RNA, 64 nt, Homo Sapiens
uaacuuagaaggauugaacuucuuugaauuuacuggacauaacauuuucagaauaguuggucau

SEQ ID NO: 497218 - RNA, 64 nt, Homo Sapiens
ugaaacaagcaacagauggauagucuguccaaauggacauaagacagacagcaguuucccuggu

SEQ ID NO: 497219 - RNA, 64 nt, Homo Sapiens
uacacuauuggcucaagaauguuauaaugcuaagggacauaaguuggcaaccacuugguuuuug

SEQ ID NO: 497220 - RNA, 64 nt, Homo Sapiens
gcuugauugcuucuuuauaguagucccuguaaguggacauaaauguggcuauuugauguuaaug

SEQ ID NO: 497221 - RNA, 64 nt, Homo Sapiens
ccucaccgaagauggaugcucgggcuccccgaugggacauaaaacacugcccaggaggcagugg

SEQ ID NO: 497222 - RNA, 64 nt, Homo Sapiens
uagaggcugaccuuaaaagggcaagaauguauuaggacauaaaaucauccagugcaaguuugau

SEQ ID NO: 497223 - RNA, 64 nt, Homo Sapiens
auagcuugaguaaacuguucucuuuuuucuuccuggacauaaaguuacugcgagcagcauguaa

SEQ ID NO: 497224 - RNA, 64 nt, Homo Sapiens
uuuacgucuaacagaccuuuaggcuuuucauuaaggacauaauagccaagccuggagcccgucc

SEQ ID NO: 497225 - RNA, 64 nt, Homo Sapiens
cgggguuaugcaauguggcugcuuugacuguacuggacauaaaaauaaguaaaauguucuucau

SEQ ID NO: 497226 - RNA, 64 nt, Homo Sapiens
aaucuguacaaaaugguccuauuuuugugaagagggacauaagauaaaaugauguuauacauca

SEQ ID NO: 497227 - RNA, 64 nt, Homo Sapiens
cacacucuucuuaugacucuuguuagcgauucaaggacauaaaucuucauucuuuucuggcaca

SEQ ID NO: 497228 - RNA, 64 nt, Homo Sapiens
auggcauuuaauuucaaccuaaauacugacugcuggacauaaaucacagaaaauuuaacuuaag

SEQ ID NO: 497229 - RNA, 64 nt, Homo Sapiens
uguaaaacucagauauugucaugauguuucacuuggacauaagacuuauuaauguggucacuua

SEQ ID NO: 497230 - RNA, 64 nt, Homo Sapiens
gcaguguucuuuuugacaauuugucaagauuuagggacauaaaaugaucuugcaggucguaaac

SEQ ID NO: 497231 - RNA, 64 nt, Homo Sapiens
acuccuucuuucagccccaccuuccauaucacaaggacauaaacauuuccagauggcccacucu

SEQ ID NO: 497232 - RNA, 64 nt, Homo Sapiens
uuaaaggauuccaccuccauuaaagcaaauaacuggacauaaucaaggguaacuucuucuuuau

SEQ ID NO: 497233 - RNA, 64 nt, Homo Sapiens
uucuguugaagcuguucuuucccucuuccccuuuggacauaacuucauuuuucuuuuuuucuuu

SEQ ID NO: 497234 - RNA, 64 nt, Homo Sapiens
auaggcccagaaagguauaagagacucuuugaauggacauaaaaauucugcuuguuaagaacaa

SEQ ID NO: 497235 - RNA, 64 nt, Homo Sapiens
ucaucaaaaccuugugacauucccuugguacauaggacauaaaacacagaggcauugcuauuug

SEQ ID NO: 497236 - RNA, 64 nt, Homo Sapiens
uuccuuugugccacugagucguucccuggccagaggacauaaauggugcugguaggagguuauc

SEQ ID NO: 497237 - RNA, 64 nt, Homo Sapiens
ggaggggugugaacuuugguuacaugcguguaagggacauaaauaugcaaguuaauguacauua

SEQ ID NO: 497238 - RNA, 64 nt, Homo Sapiens
guucacuuacaaaugugauuguaugugcaaacauggacauaauaugaucacacacaguggacga

SEQ ID NO: 497239 - RNA, 64 nt, Homo Sapiens
ugauacccuccucugggagcagaccuucuugccaggacauaaaauuggcagcuucaagaagaga

SEQ ID NO: 497240 - RNA, 64 nt, Homo Sapiens
gccuccuuguucacuuuuuauggagggagucaggggacauaauggagauuccagcagguggcgc

SEQ ID NO: 497241 - RNA, 64 nt, Homo Sapiens
ccaaguugaagaagaucaacuuugcacgaaucauggacauaaauuguccaucccuggauagcua

SEQ ID NO: 497242 - RNA, 64 nt, Homo Sapiens
cacagaugaggaaagggcuucaguagacauuucuggacauaaaagugaagcaaaucuucaaaau

SEQ ID NO: 497243 - RNA, 64 nt, Homo Sapiens
guaagaaauuuauaaaguuuugcuuuuaaaacguggacauaacucauuuuucuaguuuuugaca

SEQ ID NO: 497244 - RNA, 64 nt, Homo Sapiens
ggugguuuaggauuucaacauaugaauuuuggaaggacauaagcauucaacccccugcacaugu

SEQ ID NO: 497245 - RNA, 64 nt, Homo Sapiens
ucaccagcugccucagaugacaaaugaggcuaauggacauaaucuacaguguccuuuuucacuu

SEQ ID NO: 497246 - RNA, 64 nt, Homo Sapiens
ggugauguccuguaaacacucagcuguucagauuggacauaacugacuuaguucuucccuucuc

SEQ ID NO: 497247 - RNA, 63 nt, Homo Sapiens
gcagugugcaugcaggcaggaagacaauccaggggacauaauaacaacaaugaggauuuuuga

SEQ ID NO: 497248 - RNA, 64 nt, Homo Sapiens
aucacauauaucauguuucaguauugguacccuaggacauaaaauuuuuggucugaguaggcuu

SEQ ID NO: 497249 - RNA, 64 nt, Homo Sapiens
uauagccauaaaucauaaccgccugggggcaggaggacauaagggggugagauuaaggugcagg

SEQ ID NO: 497250 - RNA, 64 nt, Homo Sapiens
ggguccuggccaucccacaagcacaacuuuaagaggacauaauguaauuuauuaauugcuuuga

SEQ ID NO: 497251 - RNA, 64 nt, Homo Sapiens
uuugucacuugggacaguagguaaucaugugucaggacauaaauuuuacaaaaugauuuaauau

SEQ ID NO: 497252 - RNA, 64 nt, Homo Sapiens
agggcaauccacuucuuuauucuuuuuacuaucaggacauaaauuuauguuucaauggugugug

SEQ ID NO: 497253 - RNA, 64 nt, Homo Sapiens
guaccugcuggaagaauucuagcaugcuacuuggggacauaauuucagugggaaauaugccacu

SEQ ID NO: 497254 - RNA, 64 nt, Homo Sapiens
uaagagcauuuuuguggguaaaaaaaaaaccuguggacauaaugaauuuugagacauugauugg

SEQ ID NO: 497255 - RNA, 64 nt, Homo Sapiens
cacacuuuuuacuuguauagaugauuuuuggcuuggacauaaaagccaagccacccauuugcuu

SEQ ID NO: 497256 - RNA, 64 nt, Homo Sapiens
acuuaaacauaaagaaauaggcacuauacaauggggacauaaaaaaagaaaaucaaagaaggau

SEQ ID NO: 497257 - RNA, 64 nt, Homo Sapiens
ucauuaacagugccuuacugugcaaggcaccaaaggacauaaauacguacuugcaaagauucca

SEQ ID NO: 497258 - RNA, 64 nt, Homo Sapiens
aaaauccuacuuauagaaaaaccaaguccuauuuggacauaaagagggguaaauuauccuaguu

SEQ ID NO: 497259 - RNA, 64 nt, Homo Sapiens
gaauucauacuggagagaaacuucaacccuuauuggacauaagauggcaaagccuuuaaccgau

SEQ ID NO: 497260 - RNA, 64 nt, Homo Sapiens
ccaggcuggaaagggaccagccccaauucucuggggacauaaaacugagucugguccauugcua

SEQ ID NO: 497261 - RNA, 64 nt, Homo Sapiens
uuuaucuguauaaguguuuuauaugcauauuuuuggacauaaacaguuuauguaaaauuaguaa

SEQ ID NO: 497262 - RNA, 64 nt, Homo Sapiens
guacuaaaacaguauuaucuuuugaauaucguagggacauaaguauauacauguuauccaauca

SEQ ID NO: 497263 - RNA, 64 nt, Homo Sapiens
aaaugguauucacacuguauaaguggccauguuuggacauaaauaaauuaaacuuaguggggaa

SEQ ID NO: 497264 - RNA, 64 nt, Homo Sapiens
gaaaaugucaguguuuacauaaacagaagagcagggacauaaagggcgagggaggcucuguaug

SEQ ID NO: 497265 - RNA, 64 nt, Homo Sapiens
ucuuagaauauauauauacaugggucagaucaugggacauaacuuauauuuuaaaucagaagua

SEQ ID NO: 497266 - RNA, 64 nt, Homo Sapiens
gagguuaauguaauauuacauagaggugaugucaggacauaaauaaaauguccauucuguagau

SEQ ID NO: 497267 - RNA, 64 nt, Homo Sapiens
gaggcuguuagucuaauccaacaugguguccuuuggacauaagagauaccagcaaugugugcac

SEQ ID NO: 497268 - RNA, 64 nt, Homo Sapiens
agcucugcugggcuugaggguccuuuguguuaggggacauaacacucgaggagccacauuuucc

SEQ ID NO: 497269 - RNA, 64 nt, Homo Sapiens
aauuuagguuuccccuaagauguuauuauguuagggacauaacacuuuugggagguuguugugg

SEQ ID NO: 497270 - RNA, 64 nt, Homo Sapiens
uaaccauuguuuggauuuggaaguacucugcaguggacauaagcauugggccauaguuuguuaa

SEQ ID NO: 497271 - RNA, 64 nt, Homo Sapiens
uaaauaggccucagauucagcagugacauaacaaggacauaauguaagauaauaaaguagguuu

SEQ ID NO: 497272 - RNA, 64 nt, Homo Sapiens
cuuggcggagcuaaggagaucuuauucuaccaugggacauaaggagcauccacugcacaaaccc

SEQ ID NO: 497273 - RNA, 64 nt, Homo Sapiens
gcaauaauagaagauuaugaaggauuucuauggaggacauaaaugcugcaucuuucauaaucuc

SEQ ID NO: 497274 - RNA, 64 nt, Homo Sapiens
cgcggccuccgcgaagcguuggcggggagcccaaggacauaacaaauuaaaagcaugaaggaga

SEQ ID NO: 497275 - RNA, 64 nt, Homo Sapiens
ccuacaagcucaagccauacauaaaaggaccuugggacauaagaaccaaugauugugcauaagu

SEQ ID NO: 497276 - RNA, 64 nt, Homo Sapiens
uuuaaaaacuuaaauauuguuaauguaucuuaaaggacauaaaaugugucuuuuuuuuuuuuuu

SEQ ID NO: 497277 - RNA, 64 nt, Homo Sapiens
gccugagugcuuggguuaccagcgaggaggugugggacauaauaagaguugacagaagcaggcc

SEQ ID NO: 497278 - RNA, 64 nt, Homo Sapiens
gccuuagcuucuggcuuuuaauuuugccagcuaaggacauaaaacaaaaauaaacaaacaaaaa

SEQ ID NO: 497279 - RNA, 64 nt, Homo Sapiens
aucaagggugacaccugcgacgcaaguaccaggaggacauaaccgcuguggccuguuggagaac

SEQ ID NO: 497280 - RNA, 64 nt, Homo Sapiens
augaaagacauuaugccugccuaaacaaaaagcaggacauaaccuagcucugaauacaugccac

SEQ ID NO: 497281 - RNA, 64 nt, Homo Sapiens
gucuggaaacuagguuuaaaauaagugugcacuuggacauaaagacuggagaaauaaacacuga

SEQ ID NO: 497282 - RNA, 64 nt, Homo Sapiens
gaaaacuagccagaagucucacccccacugacuuggacauaagucagugaaucacaaugcauuu

SEQ ID NO: 497283 - RNA, 64 nt, Homo Sapiens
aaagaugcccaauuguacuucaccccugaucccaggacauaaggugaucaauguuaaauguaag

SEQ ID NO: 497284 - RNA, 64 nt, Homo Sapiens
ccucugacucaaacuccuccgggguuggguuuggggacauaaagcuauaguuuaauacucagag

SEQ ID NO: 497285 - RNA, 64 nt, Homo Sapiens
agaggaucgagccauugaaagcucauuaccaguaggacauaauuuuuggcucucccuauucaca

SEQ ID NO: 497286 - RNA, 64 nt, Homo Sapiens
cugcccucuacugaugagacuuccugcugccuuuggacauaacuaagccaggaaacuuuaaaag

SEQ ID NO: 497287 - RNA, 64 nt, Homo Sapiens
aaauauccaaguuguccuugaauugucuaaccauggacauaaacaguugucucccuucuacugu

SEQ ID NO: 497288 - RNA, 64 nt, Homo Sapiens
agagcccuagggugcucugagcucauuuucuuuaggacauaaagcaacccauaaucauguaaau

SEQ ID NO: 497289 - RNA, 64 nt, Homo Sapiens
gacuaggccagacauagcauuaaaaugaucauuaggacauaacauuuuugaaaaagaaaacacu

SEQ ID NO: 497290 - RNA, 64 nt, Homo Sapiens
acagagaagggaaagcagucuguucugaacauagggacauaaguucauucaugccaaguaucuu

SEQ ID NO: 497291 - RNA, 64 nt, Homo Sapiens
guuuaguuaguauuaaauuuuacgucaugucccuggacauaaaaacaacauuaauuaacaauuu

SEQ ID NO: 497292 - RNA, 64 nt, Homo Sapiens
guuguuccguaacuagaagcaguagaauccuaaaggacauaacaaucaugagcaacagaaaagc

SEQ ID NO: 497293 - RNA, 64 nt, Homo Sapiens
cauuuucucuaccuucccagcaguuugcugccauggacauaaauccccaaacccugaauuacaa

SEQ ID NO: 497294 - RNA, 64 nt, Homo Sapiens
guuguuuucaguuuuuugccauucacccacuaaaggacauaagaguaccacaguuugcuuaacc

SEQ ID NO: 497295 - RNA, 64 nt, Homo Sapiens
uggccccugagucgauugccuucucagaaaccugggacauaaaucccuccuuccccagggcucc

SEQ ID NO: 497296 - RNA, 64 nt, Homo Sapiens
gauguauuagcuguucaucugcuacugguuggauggacauaacuauuguaacuauucaguauuu

SEQ ID NO: 497297 - RNA, 64 nt, Homo Sapiens
uacuuuucaucauggaagccugucacuguauguaggacauaauagaacuugaucacuugaagcu

SEQ ID NO: 497298 - RNA, 64 nt, Homo Sapiens
guaguauuuaauauauuagaugaaggacaacuuuggacauaacacugacuaggaguugagagcu

SEQ ID NO: 497299 - RNA, 64 nt, Homo Sapiens
ggguucauggagugagugugcagagagugagugaggacauaaggaaggacaugucccacuccau

SEQ ID NO: 497300 - RNA, 64 nt, Homo Sapiens
gcccaaaagaucaaggagucagccaggacccuguggacauaaagaaguuggaugccugguccca

SEQ ID NO: 497301 - RNA, 64 nt, Homo Sapiens
aaaauacccaaagccaaaugcaguuccaaauaguggacauaaucucccagggaaaucugggcuc

SEQ ID NO: 497302 - RNA, 64 nt, Homo Sapiens
cuuuauauauauuuaaaacaauuaguacugaauuggacauaaaaauauugacauucuaaggaga

SEQ ID NO: 497303 - RNA, 64 nt, Homo Sapiens
acagcaaguaugggacagcagugucccagguaaaggacauaaauguuacaagugucugguccuu

SEQ ID NO: 497304 - RNA, 64 nt, Homo Sapiens
gauaagagcaaguguaggcaaagguuuagaaaauggacauaaagucaaagaaugauggcaggua

SEQ ID NO: 497305 - RNA, 64 nt, Homo Sapiens
gggaauuugaaauucuuguccucugugauaauuaggacauaacaagauuuuccauacuaaacau

SEQ ID NO: 497306 - RNA, 64 nt, Homo Sapiens
gggccuggcagccucggcucucuagagacaugagggacauaaaugaggcugggugacgagaaaa

SEQ ID NO: 497307 - RNA, 64 nt, Homo Sapiens
gccuacaauaaugaaaaccuuuuguaagugauguggacauaauuuggacagauuuggcaauagc

SEQ ID NO: 497308 - RNA, 64 nt, Homo Sapiens
ucuuucuuuccuuuuguuacgaccuuggaaauguggacauaagcacgcuauaacuuauuguaaa

SEQ ID NO: 497309 - RNA, 64 nt, Homo Sapiens
cuuugccccacaagcugugggcagcucaccuuugggacauaagcgggcucucugucccaguugg

SEQ ID NO: 497310 - RNA, 64 nt, Homo Sapiens
agcuguggucugggguaacacgaggucuuggccaggacauaacagucaucuuguggccuggagu

SEQ ID NO: 497311 - RNA, 64 nt, Homo Sapiens
uguucaaauuuauuuuaagagauagggagggaggggacauaaagggaaugcauacauugcuagu

SEQ ID NO: 497312 - RNA, 64 nt, Homo Sapiens
ggugaaagcauuguuacuuacuuguggaagucggggacauaagaugauuuucacaucccagagc

SEQ ID NO: 497313 - RNA, 64 nt, Homo Sapiens
cuaggaaaauaaaauacuaugcuuucucacagcuggacauaauuaggauuuaaauuugaaccug

SEQ ID NO: 497314 - RNA, 64 nt, Homo Sapiens
gcgccuccggagccgcccuggcgccugggaaccaggacauaaaagcugucuggacacguccuua

SEQ ID NO: 497315 - RNA, 64 nt, Homo Sapiens
guggagauuaaauaaagggauaaaaagauccaggggacauaaauucccuucuucuaacuaaaua

SEQ ID NO: 497316 - RNA, 64 nt, Homo Sapiens
aaagugggucaccacguggucccagcaauacaaaggacauaagaacagaagaaaaaggcuaagu

SEQ ID NO: 497317 - RNA, 64 nt, Homo Sapiens
ugcgggcuaggaggcuggaaagccauuuauccuaggacauaaacucagauuuugggggucaguu

SEQ ID NO: 497318 - RNA, 64 nt, Homo Sapiens
aucaguugcaucugugauaauacaguacauauguggacauaaacagggaucaaauaaaggaggu

SEQ ID NO: 497319 - RNA, 64 nt, Homo Sapiens
aauuccuagaagaaaacccaggaaaugccauucuggacauaagugcuggaaaagacuuaaugau

SEQ ID NO: 497320 - RNA, 64 nt, Homo Sapiens
ggggcggcugggccagggcgccucuggccucuggggacauaaaccacagauagcucagcugcga

SEQ ID NO: 497321 - RNA, 64 nt, Homo Sapiens
aauuuuuccuugugcauuuaauugcuugcuacuuggacauaacucauguugguuuaaaaauauu

SEQ ID NO: 497322 - RNA, 64 nt, Homo Sapiens
uuuguggcaguguuuguuuuacugaauuguagaaggacauaaccguguuuucaguguuucuaug

SEQ ID NO: 497323 - RNA, 64 nt, Homo Sapiens
auguuuguauacacauuugcauauacccacauggggacauaagcuaauuuuuuuacaggacaca

SEQ ID NO: 497324 - RNA, 64 nt, Homo Sapiens
uaauuuuagguuauguuuuauauuaggcuacuggggacauaaacggucauaacuaaugacugua

SEQ ID NO: 497325 - RNA, 64 nt, Homo Sapiens
auuaucauacugaaggaaauuuuccagaucauuaggacauaauacauguugagagugucucaac

SEQ ID NO: 497326 - RNA, 64 nt, Homo Sapiens
aaauucaaaccuaaguugcuggacccuggugugaggacauaaaucuuccaaaguuuugccuauc

SEQ ID NO: 497327 - RNA, 64 nt, Homo Sapiens
gcucaguaauuuugaacacugaaacauucaucuaggacauaauaacaaaguucaguauugacca

SEQ ID NO: 497328 - RNA, 64 nt, Homo Sapiens
aaagguaaaaaguacauuuguauauuacauauauggacauaacuugugaaggaugaaagaaagu

SEQ ID NO: 497329 - RNA, 64 nt, Homo Sapiens
gagagcccaaucucugcaugaauaacagaaagguggacauaaggaauuguaaaguauuuagaau

SEQ ID NO: 497330 - RNA, 64 nt, Homo Sapiens
agccaagcaagaaguugaaguugccuagaccagaggacauaaguaucaugucuccuuuaacuag

SEQ ID NO: 497331 - RNA, 64 nt, Homo Sapiens
cagauugggaaauccguucuauuuugugaauuugggacauaauaacagcaguggaguaaguauu

SEQ ID NO: 497332 - RNA, 64 nt, Homo Sapiens
cucagguguacuguuaacauuguaaguuuagauuggacauaauuaaaauacaguuaaaaaaaug

SEQ ID NO: 497333 - RNA, 64 nt, Homo Sapiens
auacucacuacugggaaaaauucagcauauccugggacauaaaauuaaauucaguacugauugg

SEQ ID NO: 497334 - RNA, 64 nt, Homo Sapiens
ccuguccugucucuauucuagagggaggaaugggggacauaaaguucaaugucccuggaguugg

SEQ ID NO: 497335 - RNA, 64 nt, Homo Sapiens
ccuugccaggucccuuucauagugaaaaauguuaggacauaaacuucuugaauauuugccacca

SEQ ID NO: 497336 - RNA, 64 nt, Homo Sapiens
uuuauugaacauaauaaccagaagaucaaauucaggacauaaacaaagcaccacagcuacucaa

SEQ ID NO: 497337 - RNA, 64 nt, Homo Sapiens
uucccugagacugcauggcucaggcguuaauaauggacauaaaaagucauaaaacguuagagcu

SEQ ID NO: 497338 - RNA, 63 nt, Homo Sapiens
agagugaggaagacccccaagucuugguugugacuccaagagcgacuucguugguuuuuugga

SEQ ID NO: 497339 - RNA, 63 nt, Homo Sapiens
agagcagggaagagcccaagguguuggucaugacuccaagagcggacuuuguuggcuuuuaga

SEQ ID NO: 497340 - RNA, 63 nt, Homo Sapiens
cuccugaaugugacuggcguuguauaagucaagcuccaagaggauauugcgccugugugcgug

SEQ ID NO: 497341 - RNA, 63 nt, Homo Sapiens
gauaaccugcaccccucccucccagcccuccugcuccaagaggcuagguuuuccuuccaagca

SEQ ID NO: 497342 - RNA, 63 nt, Homo Sapiens
aaauagaaaggcugcuuuagaugauaacuaggucuccaagagaacaaauuuguucuuccugau

SEQ ID NO: 497343 - RNA, 63 nt, Homo Sapiens
aaaauccucacuuauuaacuugacaguagcugucuccaagagacgaccuccaguucucccuga

SEQ ID NO: 497344 - RNA, 63 nt, Homo Sapiens
ugucaugcaguguugucccuuccuaccuucuuccuccaagagaguaucaugaaguaaacuaca

SEQ ID NO: 497345 - RNA, 63 nt, Homo Sapiens
ggcucccuugggaaagcccugcuuugcuccaggcuccaagaucuccuggcuaagucagcaagu

SEQ ID NO: 497346 - RNA, 63 nt, Homo Sapiens
cugcaucagccccugugagccuggcuucagugucuccaagaacuguaaccucggcaagugcca

SEQ ID NO: 497347 - RNA, 63 nt, Homo Sapiens
cauccugguagcucuccugaugcucguuuuccgcuccaagagagaggugaaacggugagcgag

SEQ ID NO: 497348 - RNA, 63 nt, Homo Sapiens
cccuuugagccuuacaucucauucacugucuuucuccaagaaaaguauuuugggcggacaguc

SEQ ID NO: 497349 - RNA, 63 nt, Homo Sapiens
aaaaacuuuacaauacauuuauguugaauggaacuccaagaucucaccucuccauccaggaau

SEQ ID NO: 497350 - RNA, 63 nt, Homo Sapiens
agaauggccccgagagaacuuuugcucccugagcuccaagauacucuugcguuuuggccccca

SEQ ID NO: 497351 - RNA, 63 nt, Homo Sapiens
aggagcagcugugagcuggaagaccacgcugcccuccaagaccacugggggcuucuccccagg

SEQ ID NO: 497352 - RNA, 63 nt, Homo Sapiens
uuccucuucuuugccgcggacucccuuuccugccuccaagaccuggugucucccacugugagc

SEQ ID NO: 497353 - RNA, 63 nt, Homo Sapiens
aucauggaggagcggugagaacauggaaccggacuccaagaugacgaucuaaagacccgggag

SEQ ID NO: 497354 - RNA, 63 nt, Homo Sapiens
agcugcuucggaacaccgucccuccuaugcacccuccaagacgugcagcagaugcaaaggguu

SEQ ID NO: 497355 - RNA, 63 nt, Homo Sapiens
agcagccgggacccucuggagagcuuguuuucccuccaagaagagguuugagacaggcggcau

SEQ ID NO: 497356 - RNA, 63 nt, Homo Sapiens
guuuagagaaaaaaaauuaaaaagaaacaaagucuccaagaaauaugggacuaugugaaaaga

SEQ ID NO: 497357 - RNA, 63 nt, Homo Sapiens
gaacgccacaaagauacuccuugagaagagcaacuccaagacacauaauugucagauucacca

SEQ ID NO: 497358 - RNA, 63 nt, Homo Sapiens
agugaauuuacuuuuuggguccagaaugacuuucuccaagaauuauaagaugaaaauuauaua

SEQ ID NO: 497359 - RNA, 63 nt, Homo Sapiens
uaucuaauggagcaauuugucuuuugcuauauucuccaagauuaucucuuaagaccauaugcc

SEQ ID NO: 497360 - RNA, 63 nt, Homo Sapiens
cucagauccagguuaggaaaaaauaauuuuuuccuccaagauuugacaggagggagccuggga

SEQ ID NO: 497361 - RNA, 63 nt, Homo Sapiens
cugucugaaacuuguacagcuguauucuuuauucuccaagaauaaaacaaguuccuuagaggu

SEQ ID NO: 497362 - RNA, 64 nt, Homo Sapiens
ucacuccugagaaugggcuccuguuagaugggcacgggcggauuaauuuuagcaaaauguucug

SEQ ID NO: 497363 - RNA, 64 nt, Homo Sapiens
acgccuguaaucccaacacuuugggaggccgaggcgggcggaucacgaggucagaucaagaaca

SEQ ID NO: 497364 - RNA, 64 nt, Homo Sapiens
acgaggucaggaguucgagauugggaggccgaggcgggcggaucacaccuguaaucccagcacu

SEQ ID NO: 497365 - RNA, 64 nt, Homo Sapiens
acaagguccagaguucaagauugggaggcugaggcgggcggaucacgccuguaaucucagcacu

SEQ ID NO: 497366 - RNA, 64 nt, Homo Sapiens
aaagugcaucccccagagcugucacagggggugucgggcggaggccauaaaggaugagccuggg

SEQ ID NO: 497367 - RNA, 64 nt, Homo Sapiens
augccuguaaucccagcacuuugggaggcugaggcgggcggaucaccugaggucgggaguucga

SEQ ID NO: 497368 - RNA, 64 nt, Homo Sapiens
acgccuguaaucccagcacuuugagagaccgaggcgggcggaucacgaggucaggagaucgaga

SEQ ID NO: 497369 - RNA, 64 nt, Homo Sapiens
accugaggugaggaguucaauugggaggccaagacgggcggaucacgccuguaauccuagcacu

SEQ ID NO: 497370 - RNA, 64 nt, Homo Sapiens
augccuguaaucccagcacuuugggaggccgaggcgggcggaucacgaggucaggagauugaga

SEQ ID NO: 497371 - RNA, 64 nt, Homo Sapiens
acgacuauguguaaugcucuaagaccucucagcacgggcggaagaaacucccggagagcucacc

SEQ ID NO: 497372 - RNA, 64 nt, Homo Sapiens
acggcuguaaucccaacacuuugggagucugaggcgggcggaucaugaggucaggagauuaaga

SEQ ID NO: 497373 - RNA, 64 nt, Homo Sapiens
acgccugugaucccagcacuuugggaggccaagacgggcggaucaugaggucaagagaucaaga

SEQ ID NO: 497374 - RNA, 64 nt, Homo Sapiens
acgccuguaaucccagcacuuugggaggccgaggcgggcggaucacgaggucaggagaucgaga

SEQ ID NO: 497375 - RNA, 64 nt, Homo Sapiens
acaccugcaaucccagcacuuugggaggccgaggcgggcggaucaccugaggucagcaguucaa

SEQ ID NO: 497376 - RNA, 64 nt, Homo Sapiens
acgccuauaaucccagcacuuugggaggccgaggcgggcggaucacgaggucaggagauugaga

SEQ ID NO: 497377 - RNA, 64 nt, Homo Sapiens
acaaggucaggagaucgagauugggaggccgaggcgggcggaucacgccuguaaucccagcacu

SEQ ID NO: 497378 - RNA, 64 nt, Homo Sapiens
accugagucaggaguucgaguugagaggcugaggcgggcggauccacgccuguaauccaacacu

SEQ ID NO: 497379 - RNA, 64 nt, Homo Sapiens
gcccgggcauccacguagggggcaggggcaggggcgggcggagggaggggaggggugaaaucca

SEQ ID NO: 497380 - RNA, 64 nt, Homo Sapiens
aguugaggucgggaguuugauugggaggccgaggcgggcggaugccgccuguaaucccagcacu

SEQ ID NO: 497381 - RNA, 64 nt, Homo Sapiens
accugagguugggaguucgauugggaggcugaggcgggcggaucaugccuguaaucccagcacu

SEQ ID NO: 497382 - RNA, 64 nt, Homo Sapiens
ugagucgggcagccgcucucgggcugauccuggucgggcggaccaccucaagaggggaggagcg

SEQ ID NO: 497383 - RNA, 64 nt, Homo Sapiens
accugaggucaggaguucaauugggaggccgaggcgggcggaugacgccuguaaucccagcacu

SEQ ID NO: 497384 - RNA, 64 nt, Homo Sapiens
acgccuguaaucccagcacuuugggaggccaaggcgggcggaucaugaggucaggagaucgaga

SEQ ID NO: 497385 - RNA, 64 nt, Homo Sapiens
aagccuguaaucccagcacuuugggaggccgaggcgggcggaucaugaggucaggaguucgaga

SEQ ID NO: 497386 - RNA, 64 nt, Homo Sapiens
augaggucaggagaucgagauugggaggccgaggcgggcggaucacgccuguaaucccagcacu

SEQ ID NO: 497387 - RNA, 64 nt, Homo Sapiens
cgcacacacucgugucauccgcccccucgagcuccgggcggacuaagcccugguccagcugggu

SEQ ID NO: 497388 - RNA, 64 nt, Homo Sapiens
acgaggucaggagaucgagauugggaggcccaggcgggcggaucacgccuguaaucccaacacu

SEQ ID NO: 497389 - RNA, 64 nt, Homo Sapiens
acgaggucaggagaucgagauugggaggccgaggcgggcggaucacgccuguaaucccagcacu

SEQ ID NO: 497390 - RNA, 64 nt, Homo Sapiens
augccuguaaucccagcacguugggaggccaagucgggcggaucacaaggucaggagaucaagg

SEQ ID NO: 497391 - RNA, 64 nt, Homo Sapiens
agaauacuucuggcagcacuuugggaggccaaggcgggcggaucacgaggucaggagaucgaga

SEQ ID NO: 497392 - RNA, 64 nt, Homo Sapiens
gccuccggugcuguaaaacgcaggcgcugggccgcgggcggagcugaggacaggccuuggcugg

SEQ ID NO: 497393 - RNA, 64 nt, Homo Sapiens
acgaggucaggagaucgagauugggaggccgaggcgggcggaucacgccgguaaucccagcacu

SEQ ID NO: 497394 - RNA, 64 nt, Homo Sapiens
acaccuguaaucccagcacuuuggggagcugaggcgggcggaucacgaggucaagagaucgaga

SEQ ID NO: 497395 - RNA, 64 nt, Homo Sapiens
accaggucaggagaucaagauugggaggccgaggcgggcggaucacuccuguaaucccagcacu

SEQ ID NO: 497396 - RNA, 64 nt, Homo Sapiens
acuugagaccaggaguucgauugggaggccgaggcgggcggaucaagccuguaaucccagcacu

SEQ ID NO: 497397 - RNA, 64 nt, Homo Sapiens
gaggagagcagguuucagauguggggagcagggacgggcggaggguuuguuucuguuuucuugg

SEQ ID NO: 497398 - RNA, 64 nt, Homo Sapiens
acaaagucaggacgagaccauugggaggccgaggcgggcggaucacgccuguaaucccagcacu

SEQ ID NO: 497399 - RNA, 64 nt, Homo Sapiens
acccccaaagugcagauuccggagcagacacauccgggcggagagacucagcagacaagugcug

SEQ ID NO: 497400 - RNA, 64 nt, Homo Sapiens
acaccuguaaucccagcacuuugggagaccaaggcgggcggaucacuuaaagucaggaguccaa

SEQ ID NO: 497401 - RNA, 64 nt, Homo Sapiens
accuguggucaggaguuugauugggaggccgagccgggcggaucacgccuguaaucccagcacu

SEQ ID NO: 497402 - RNA, 64 nt, Homo Sapiens
gcuggacagacgcacccacugggcacgaccacaccgggcggacccccccauccccacgcgggcc

SEQ ID NO: 497403 - RNA, 64 nt, Homo Sapiens
acuugaggucaggagcucaauugggaggccaaggcgggcggaucaugccuguaaucccagcauu

SEQ ID NO: 497404 - RNA, 64 nt, Homo Sapiens
acgccuguaaucccaacacuuuaggaguccaaggcgggcggaucacuugaggucaggaguucaa

SEQ ID NO: 497405 - RNA, 64 nt, Homo Sapiens
ggauccagccacuucccccugggaaggccggcagcgggcggagggccgccacggccuggcuggu

SEQ ID NO: 497406 - RNA, 64 nt, Homo Sapiens
acaccuguaaucccagcacuuugggaggccgaggcgggcggaucaccugaagucaggaguuuga

SEQ ID NO: 497407 - RNA, 64 nt, Homo Sapiens
augccuguaaucccagcacuuugggaggccgaggcgggcggaucacaaggucaggagaucgaga

SEQ ID NO: 497408 - RNA, 64 nt, Homo Sapiens
acgaggucaggaguucgagauugggaggccgaggcgggcggaucacgcuuguaaucccagcacu

SEQ ID NO: 497409 - RNA, 64 nt, Homo Sapiens
acgccuguaaucccagcacuuugggaggccgaggcgggcggaucaccugagguggggaguauga

SEQ ID NO: 497410 - RNA, 64 nt, Homo Sapiens
augccuauaaucccagcacguugggaggcugaggcgggcggaucgguugagcucaggcguucgg

SEQ ID NO: 497411 - RNA, 64 nt, Homo Sapiens
augccuguaaucccagcacuuugggaggccgaggcgggcggaucaccugaggccaggaguugga

SEQ ID NO: 497412 - RNA, 64 nt, Homo Sapiens
gagcgagggcccccggacuggaguccugggagagcgggcggagcgagagcgggcauccagagag

SEQ ID NO: 497413 - RNA, 64 nt, Homo Sapiens
augagguuaggagagcgagauugggaggccgaggcgggcggaucacgccuguaaucccagcacu

SEQ ID NO: 497414 - RNA, 64 nt, Homo Sapiens
augaagucaagaguucgagauugggaggccuaggcgggcggaucccacugucaaucccagcacu

SEQ ID NO: 497415 - RNA, 64 nt, Homo Sapiens
uucuguuucucccagccaauaucugcgcugcggucgggcggagcaccggccgggccuggcacca

SEQ ID NO: 497416 - RNA, 64 nt, Homo Sapiens
accugaggucaggaguucgauugggaggccgagacgggcggaucacgccuguaaucccagcacu

SEQ ID NO: 497417 - RNA, 64 nt, Homo Sapiens
acgccuguaaucccagcacuuugggaggccaaggcgggcggaucaccugaggucgggaguuuga

SEQ ID NO: 497418 - RNA, 64 nt, Homo Sapiens
uggucacucagccgucgugagcgcaggcgcggggcgggcggagcgggaccccuggggcucuccc

SEQ ID NO: 497419 - RNA, 64 nt, Homo Sapiens
acgccuguaaucccagcacuuugggaggcugaggcgggcggaucacgaggucaggagaucgaga

SEQ ID NO: 497420 - RNA, 64 nt, Homo Sapiens
acaccuguaaucccagcacuuugggaggccgaggcgggcggaucacaaggucaggaguucgaga

SEQ ID NO: 497421 - RNA, 64 nt, Homo Sapiens
acaccuguaaucccagcacuuugggaggccaaggcgggcggaucagcugaggucaggaguugga

SEQ ID NO: 497422 - RNA, 64 nt, Homo Sapiens
ucgccuguaaucccagcacuuugggaggccgaggcgggcggaucagaccauccuggcuaacacg

SEQ ID NO: 497423 - RNA, 64 nt, Homo Sapiens
cgugugggacugagucagcgguggcgaggagaggcgggcggauuuggggagggcccugaggacc

SEQ ID NO: 497424 - RNA, 51 nt, Homo Sapiens
uucucgucagcugguguuagccgggcggaguguguuagucucuccagaggg

SEQ ID NO: 497425 - RNA, 64 nt, Homo Sapiens
cugcugggacccuccugggcccccucccaaggaucgggcggaaggggaccugcuccucacagag

SEQ ID NO: 497426 - RNA, 64 nt, Homo Sapiens
cuguauauauguauauacucccccagcgggcaggcgggcggagcauuuuauuggagccccaucu

SEQ ID NO: 497427 - RNA, 64 nt, Homo Sapiens
cggcagugcacgcggcuuguugacuucgcagccccgggcggagccuucccgggcgggcguggga

SEQ ID NO: 497428 - RNA, 64 nt, Homo Sapiens
cagcccugaggucgcgcgcagcgcgugcacagcgcgggcggaggcggcuccagguccggagggg

SEQ ID NO: 497429 - RNA, 64 nt, Homo Sapiens
acgccuauaaucccagcacuuugggaggccgaggcgggcggaucacuaggucaggaaauggaga

SEQ ID NO: 497430 - RNA, 64 nt, Homo Sapiens
augccuguaaucccagcacuuugggaggccaagacgggcggaucuuuugaggucgggaguugga

SEQ ID NO: 497431 - RNA, 64 nt, Homo Sapiens
acgccuguaaucccaacacuuugggagcccgaggcgggcggaucacaaggucaggaguucgaga

SEQ ID NO: 497432 - RNA, 64 nt, Homo Sapiens
caugguguaauccuaacacuuugggaggccaaggcgggcggauugccugagcucaggaguucaa

SEQ ID NO: 497433 - RNA, 64 nt, Homo Sapiens
accugagguugggaguucaauugggaggcugaggcgggcggaucacgucuguaaucccagcacu

SEQ ID NO: 497434 - RNA, 64 nt, Homo Sapiens
accugaggucagguguucgauugggaggcugaggcgggcggaacacaccuguaaucccagcacu

SEQ ID NO: 497435 - RNA, 64 nt, Homo Sapiens
uccugaggccuggacccccagccucugccccucccgggcggacccgacaccacuggccccggau

SEQ ID NO: 497436 - RNA, 63 nt, Homo Sapiens
ccgcguggccgaagcuggaacccgagcucggggcgggcggagcgcggcgggggcgccccguga

SEQ ID NO: 497437 - RNA, 64 nt, Homo Sapiens
acuggaggucaggaguuuaauugagaggccaaggcgggcggaucaccccugucaucccagcacu

SEQ ID NO: 497438 - RNA, 64 nt, Homo Sapiens
acgaggucaggagaucgagauugggaggccgaggcgggcggaucaugccuguaaucccagcacu

SEQ ID NO: 497439 - RNA, 64 nt, Homo Sapiens
gggacgcgggcugugccuuaaaugccuuccgggccgggcggaagcugcgccggccuccgucaug

SEQ ID NO: 497440 - RNA, 64 nt, Homo Sapiens
acuugaggucaggaguuccauugggaggccgaggcgggcggaucacgccuguaauccuagcacc

SEQ ID NO: 497441 - RNA, 64 nt, Homo Sapiens
acgaggucaggagacugagaaugggaggccgagacgggcggaucaugccuguaaucccagcacu

SEQ ID NO: 497442 - RNA, 64 nt, Homo Sapiens
gaucccuaacagggcggcuucccagggcugcaggcgggcggagguuccaggagaugggacuuca

SEQ ID NO: 497443 - RNA, 64 nt, Homo Sapiens
acgccuguaaucccagcacuuugggaggccgaagcgggcggaucaccugaggucgggaguucga

SEQ ID NO: 497444 - RNA, 64 nt, Homo Sapiens
aauaggucaggaaauccagauugggaggccgaggcgggcggaucacgccuguaaucccagcacu

SEQ ID NO: 497445 - RNA, 64 nt, Homo Sapiens
uucagaccguucuccuguaaguucauuacaaacacgggcggaaggcacucaggcuuucguugga

SEQ ID NO: 497446 - RNA, 64 nt, Homo Sapiens
augaggucaggagaucgcgauugggagacugaggcgggcggaucacgccugcaaucccagcacu

SEQ ID NO: 497447 - RNA, 63 nt, Homo Sapiens
acgcauguaaucccagcacuuugggaggccaaggcgggcggaucacgaggucaggaguucgag

SEQ ID NO: 497448 - RNA, 64 nt, Homo Sapiens
augccuguaauccgagcacuuugggaggccaaggcgggcggaucacgaggucaggagaucgaga

SEQ ID NO: 497449 - RNA, 64 nt, Homo Sapiens
acgccuguaaucccagcacuuugggaggccgaggcgggcggaucacgaggucaggaguucgaga

SEQ ID NO: 497450 - RNA, 64 nt, Homo Sapiens
acgccuguaaucccagcaauuugggaguccgaggcgggcggaucacucgaggucaggaguucca

SEQ ID NO: 497451 - RNA, 64 nt, Homo Sapiens
gcccuucagugcccugccuguacucgagcggcuccgggcggagaacaagucggcugugaguuuc

SEQ ID NO: 497452 - RNA, 64 nt, Homo Sapiens
gaggcugaggcucacaccccggcacgcgcgcugccgggcggacaagggaggccagaccaaggga

SEQ ID NO: 497453 - RNA, 64 nt, Homo Sapiens; identical to SEQ ID NO: 134242

SEQ ID NO: 497454 - RNA, 64 nt, Homo Sapiens; identical to SEQ ID NO: 134243

SEQ ID NO: 497455 - RNA, 64 nt, Homo Sapiens; identical to SEQ ID NO: 134244

SEQ ID NO: 497456 - RNA, 64 nt, Homo Sapiens; identical to SEQ ID NO: 134245

SEQ ID NO: 497457 - RNA, 52 nt, Homo Sapiens; identical to SEQ ID NO: 134246

SEQ ID NO: 497458 - RNA, 64 nt, Homo Sapiens; identical to SEQ ID NO: 134247

SEQ ID NO: 497459 - RNA, 64 nt, Homo Sapiens; identical to SEQ ID NO: 134248

SEQ ID NO: 497460 - RNA, 64 nt, Homo Sapiens; identical to SEQ ID NO: 134249

SEQ ID NO: 497461 - RNA, 64 nt, Homo Sapiens; identical to SEQ ID NO: 134250

SEQ ID NO: 497462 - RNA, 64 nt, Homo Sapiens; identical to SEQ ID NO: 134251

SEQ ID NO: 497463 - RNA, 64 nt, Homo Sapiens; identical to SEQ ID NO: 134252

SEQ ID NO: 497464 - RNA, 64 nt, Homo Sapiens; identical to SEQ ID NO: 134253

SEQ ID NO: 497465 - RNA, 64 nt, Homo Sapiens; identical to SEQ ID NO: 134254

SEQ ID NO: 497466 - RNA, 64 nt, Homo Sapiens; identical to SEQ ID NO: 134255

SEQ ID NO: 497467 - RNA, 64 nt, Homo Sapiens; identical to SEQ ID NO: 134256

SEQ ID NO: 497468 - RNA, 64 nt, Homo Sapiens; identical to SEQ ID NO: 134257

SEQ ID NO: 497469 - RNA, 64 nt, Homo Sapiens; identical to SEQ ID NO: 134258

SEQ ID NO: 497470 - RNA, 64 nt, Homo Sapiens; identical to SEQ ID NO: 134259

SEQ ID NO: 497471 - RNA, 64 nt, Homo Sapiens; identical to SEQ ID NO: 134260

SEQ ID NO: 497472 - RNA, 64 nt, Homo Sapiens; identical to SEQ ID NO: 134261

SEQ ID NO: 497473 - RNA, 64 nt, Homo Sapiens; identical to SEQ ID NO: 134262

SEQ ID NO: 497474 - RNA, 64 nt, Homo Sapiens; identical to SEQ ID NO: 134263

SEQ ID NO: 497475 - RNA, 64 nt, Homo Sapiens; identical to SEQ ID NO: 134264

SEQ ID NO: 497476 - RNA, 64 nt, Homo Sapiens; identical to SEQ ID NO: 134265

SEQ ID NO: 497477 - RNA, 64 nt, Homo Sapiens; identical to SEQ ID NO: 134266

SEQ ID NO: 497478 - RNA, 64 nt, Homo Sapiens; identical to SEQ ID NO: 134267

SEQ ID NO: 497479 - RNA, 64 nt, Homo Sapiens; identical to SEQ ID NO: 134268

SEQ ID NO: 497480 - RNA, 64 nt, Homo Sapiens; identical to SEQ ID NO: 134269

SEQ ID NO: 497481 - RNA, 64 nt, Homo Sapiens; identical to SEQ ID NO: 97063

SEQ ID NO: 497482 - RNA, 64 nt, Homo Sapiens; identical to SEQ ID NO: 97064

SEQ ID NO: 497483 - RNA, 64 nt, Homo Sapiens; identical to SEQ ID NO: 97065

SEQ ID NO: 497484 - RNA, 64 nt, Homo Sapiens; identical to SEQ ID NO: 97066

SEQ ID NO: 497485 - RNA, 64 nt, Homo Sapiens; identical to SEQ ID NO: 97067

SEQ ID NO: 497486 - RNA, 64 nt, Homo Sapiens; identical to SEQ ID NO: 97068

SEQ ID NO: 497487 - RNA, 64 nt, Homo Sapiens; identical to SEQ ID NO: 97069

SEQ ID NO: 497488 - RNA, 64 nt, Homo Sapiens; identical to SEQ ID NO: 97070

SEQ ID NO: 497489 - RNA, 64 nt, Homo Sapiens; identical to SEQ ID NO: 97071

SEQ ID NO: 497490 - RNA, 64 nt, Homo Sapiens; identical to SEQ ID NO: 97072

SEQ ID NO: 497491 - RNA, 64 nt, Homo Sapiens; identical to SEQ ID NO: 97073

SEQ ID NO: 497492 - RNA, 64 nt, Homo Sapiens; identical to SEQ ID NO: 97074

SEQ ID NO: 497493 - RNA, 64 nt, Homo Sapiens; identical to SEQ ID NO: 97075

SEQ ID NO: 497494 - RNA, 64 nt, Homo Sapiens; identical to SEQ ID NO: 97076

SEQ ID NO: 497495 - RNA, 64 nt, Homo Sapiens; identical to SEQ ID NO: 97077

SEQ ID NO: 497496 - RNA, 64 nt, Homo Sapiens; identical to SEQ ID NO: 97078

SEQ ID NO: 497497 - RNA, 64 nt, Homo Sapiens; identical to SEQ ID NO: 97079

SEQ ID NO: 497498 - RNA, 64 nt, Homo Sapiens; identical to SEQ ID NO: 97080

SEQ ID NO: 497499 - RNA, 64 nt, Homo Sapiens; identical to SEQ ID NO: 97081

SEQ ID NO: 497500 - RNA, 64 nt, Homo Sapiens; identical to SEQ ID NO: 97082

SEQ ID NO: 497501 - RNA, 64 nt, Homo Sapiens; identical to SEQ ID NO: 97083

SEQ ID NO: 497502 - RNA, 64 nt, Homo Sapiens; identical to SEQ ID NO: 97084

SEQ ID NO: 497503 - RNA, 64 nt, Homo Sapiens; identical to SEQ ID NO: 97085

SEQ ID NO: 497504 - RNA, 64 nt, Homo Sapiens; identical to SEQ ID NO: 97086

SEQ ID NO: 497505 - RNA, 64 nt, Homo Sapiens; identical to SEQ ID NO: 97087

SEQ ID NO: 497506 - RNA, 64 nt, Homo Sapiens; identical to SEQ ID NO: 326250

SEQ ID NO: 497507 - RNA, 64 nt, Homo Sapiens; identical to SEQ ID NO: 326251

SEQ ID NO: 497508 - RNA, 64 nt, Homo Sapiens; identical to SEQ ID NO: 326252

SEQ ID NO: 497509 - RNA, 64 nt, Homo Sapiens; identical to SEQ ID NO: 326253

SEQ ID NO: 497510 - RNA, 64 nt, Homo Sapiens; identical to SEQ ID NO: 326254

SEQ ID NO: 497511 - RNA, 64 nt, Homo Sapiens; identical to SEQ ID NO: 326255

SEQ ID NO: 497512 - RNA, 64 nt, Homo Sapiens; identical to SEQ ID NO: 326256

SEQ ID NO: 497513 - RNA, 64 nt, Homo Sapiens; identical to SEQ ID NO: 326257

SEQ ID NO: 497514 - RNA, 64 nt, Homo Sapiens; identical to SEQ ID NO: 326258

SEQ ID NO: 497515 - RNA, 64 nt, Homo Sapiens; identical to SEQ ID NO: 326259

SEQ ID NO: 497516 - RNA, 64 nt, Homo Sapiens; identical to SEQ ID NO: 326260

SEQ ID NO: 497517 - RNA, 64 nt, Homo Sapiens; identical to SEQ ID NO: 326261

SEQ ID NO: 497518 - RNA, 64 nt, Homo Sapiens; identical to SEQ ID NO: 326262

SEQ ID NO: 497519 - RNA, 64 nt, Homo Sapiens; identical to SEQ ID NO: 326263

SEQ ID NO: 497520 - RNA, 64 nt, Homo Sapiens; identical to SEQ ID NO: 326264

SEQ ID NO: 497521 - RNA, 64 nt, Homo Sapiens; identical to SEQ ID NO: 326265

SEQ ID NO: 497522 - RNA, 64 nt, Homo Sapiens; identical to SEQ ID NO: 326266

SEQ ID NO: 497523 - RNA, 64 nt, Homo Sapiens; identical to SEQ ID NO: 326267

SEQ ID NO: 497524 - RNA, 64 nt, Homo Sapiens; identical to SEQ ID NO: 326268

SEQ ID NO: 497525 - RNA, 64 nt, Homo Sapiens; identical to SEQ ID NO: 326269

SEQ ID NO: 497526 - RNA, 64 nt, Homo Sapiens; identical to SEQ ID NO: 326270

SEQ ID NO: 497527 - RNA, 64 nt, Homo Sapiens; identical to SEQ ID NO: 326271

SEQ ID NO: 497528 - RNA, 64 nt, Homo Sapiens; identical to SEQ ID NO: 326272

SEQ ID NO: 497529 - RNA, 64 nt, Homo Sapiens; identical to SEQ ID NO: 326273

SEQ ID NO: 497530 - RNA, 64 nt, Homo Sapiens; identical to SEQ ID NO: 326274

SEQ ID NO: 497531 - RNA, 64 nt, Homo Sapiens; identical to SEQ ID NO: 326275

SEQ ID NO: 497532 - RNA, 64 nt, Homo Sapiens; identical to SEQ ID NO: 326276

SEQ ID NO: 497533 - RNA, 64 nt, Homo Sapiens; identical to SEQ ID NO: 326277

SEQ ID NO: 497534 - RNA, 64 nt, Homo Sapiens; identical to SEQ ID NO: 326278

SEQ ID NO: 497535 - RNA, 64 nt, Homo Sapiens; identical to SEQ ID NO: 326279

SEQ ID NO: 497536 - RNA, 64 nt, Homo Sapiens; identical to SEQ ID NO: 326280

SEQ ID NO: 497537 - RNA, 64 nt, Homo Sapiens; identical to SEQ ID NO: 326281

SEQ ID NO: 497538 - RNA, 64 nt, Homo Sapiens; identical to SEQ ID NO: 326282

SEQ ID NO: 497539 - RNA, 64 nt, Homo Sapiens; identical to SEQ ID NO: 326283

SEQ ID NO: 497540 - RNA, 64 nt, Homo Sapiens; identical to SEQ ID NO: 326284

SEQ ID NO: 497541 - RNA, 64 nt, Homo Sapiens; identical to SEQ ID NO: 326285

SEQ ID NO: 497542 - RNA, 64 nt, Homo Sapiens; identical to SEQ ID NO: 326286

SEQ ID NO: 497543 - RNA, 64 nt, Homo Sapiens; identical to SEQ ID NO: 326287

SEQ ID NO: 497544 - RNA, 64 nt, Homo Sapiens; identical to SEQ ID NO: 326288

SEQ ID NO: 497545 - RNA, 64 nt, Homo Sapiens; identical to SEQ ID NO: 326289

SEQ ID NO: 497546 - RNA, 64 nt, Homo Sapiens; identical to SEQ ID NO: 326290

SEQ ID NO: 497547 - RNA, 64 nt, Homo Sapiens; identical to SEQ ID NO: 326291

SEQ ID NO: 497548 - RNA, 64 nt, Homo Sapiens; identical to SEQ ID NO: 326292

SEQ ID NO: 497549 - RNA, 64 nt, Homo Sapiens; identical to SEQ ID NO: 326293

SEQ ID NO: 497550 - RNA, 64 nt, Homo Sapiens
ccuuccaccuggaggcucccuugucucccagccccauguacaaagcucaccaagccccugccca

SEQ ID NO: 497551 - RNA, 64 nt, Homo Sapiens
cagccccauguacaaagcucaccaagccccugcccauguacagcccccagacccucugcaauau

SEQ ID NO: 497552 - RNA, 64 nt, Homo Sapiens
ugcaaacuacucuucuagugguuaaugcacuugacauguacaguauguuucccaugccguugug

SEQ ID NO: 497553 - RNA, 64 nt, Homo Sapiens
guacaguauguuucccaugccguugugauuuugacauguacaguauguuuucaugccguuguga

SEQ ID NO: 497554 - RNA, 64 nt, Homo Sapiens
uuacagcaugacaagcucaaauaguaucuauagccauguacauaucagcuaugaauuacucuau

SEQ ID NO: 497555 - RNA, 64 nt, Homo Sapiens
auguauauagugacauagcuaauuugugauccaacauguacagucagucugacuaauaacugcu

SEQ ID NO: 497556 - RNA, 64 nt, Homo Sapiens
cugugccugggguccacagagccgggaggucacacauguacauccuggaagcugcccaaggugu

SEQ ID NO: 497557 - RNA, 64 nt, Homo Sapiens
aaaacuguauuauauugccuuauuuauuuuuaaucauguacaauauucauguacaaauguuaga

SEQ ID NO: 497558 - RNA, 64 nt, Homo Sapiens
auugccuuauuuauuuuuaaucauguacaauauucauguacaaauguuagagccauucggguag

SEQ ID NO: 497559 - RNA, 64 nt, Homo Sapiens
ugaagauuaugcuguuuaugcaauaauuugugaacauguacagaguuuuauauaaauuuaaacc

SEQ ID NO: 497560 - RNA, 64 nt, Homo Sapiens
guaucuuuguaacuauaaauagugcaugcucagccauguacacuguaaauagccuuuaccaaac

SEQ ID NO: 497561 - RNA, 64 nt, Homo Sapiens
ccuuuuuuauacacauaauuaaaguguccauugacauguacagagaacuaacacuauuuuaugc

SEQ ID NO: 497562 - RNA, 64 nt, Homo Sapiens
auuuuaugcaaauauuuuuuuguagaugaaaaagcauguacaguguucuguuuaauacucaucc

SEQ ID NO: 497563 - RNA, 64 nt, Homo Sapiens
aaguuccuacacacggacgugugauacacacaugcauguacagguaagcacacauguacaagcu

SEQ ID NO: 497564 - RNA, 64 nt, Homo Sapiens
gugugauacacacaugcauguacagguaagcacacauguacaagcuccuacaggcuugcucuca

SEQ ID NO: 497565 - RNA, 64 nt, Homo Sapiens
aaacagugaaaaugagauccuuggcauuuuaggacauguacauguuaaaaguuguuuaauuuac

SEQ ID NO: 497566 - RNA, 64 nt, Homo Sapiens
uuccagaauugucacugugcuucugugauucuaucauguacaguauuccgguuauuuaagucau

SEQ ID NO: 497567 - RNA, 64 nt, Homo Sapiens
uauaugcagugaauuguuacugugcacauguacacauguacauugucaugaaauacuuaacaca

SEQ ID NO: 497568 - RNA, 64 nt, Homo Sapiens
uguacauuuauaugcagugauuaacacaugugcacauguacacaaggcuugagucaugaaauac

SEQ ID NO: 497569 - RNA, 64 nt, Homo Sapiens
gcacaauuucccgccuuuuuucucuuguagugccucuugacaaacuauuuggaagaagaaacuu

SEQ ID NO: 497570 - RNA, 64 nt, Homo Sapiens
agcgucauauaccuuugcaaauguuuaaaaauuaucuugacauacuguacuuuuucaaauaaug

SEQ ID NO: 497571 - RNA, 64 nt, Homo Sapiens
uacacugaaaaaaauggggguugaggucuugacaucuugacauauauuuugaugaucagagguc

SEQ ID NO: 497572 - RNA, 64 nt, Homo Sapiens
uugacauauacacugaaaaacagaggucuugaggucuugacaucaaauaacuuauuuugaugau

SEQ ID NO: 497573 - RNA, 64 nt, Homo Sapiens
uauuauagaagguucuuucauucaagaucaucauucuugacagacccauaaauauuuccuauaa

SEQ ID NO: 497574 - RNA, 64 nt, Homo Sapiens
uucuuagcuuugguacugacaguuuucuuuugccucuugacauaauugguauauggaucugaua

SEQ ID NO: 497575 - RNA, 64 nt, Homo Sapiens; identical to SEQ ID NO: 460733

SEQ ID NO: 497576 - RNA, 64 nt, Homo Sapiens; identical to SEQ ID NO: 460734

SEQ ID NO: 497577 - RNA, 64 nt, Homo Sapiens; identical to SEQ ID NO: 460735

SEQ ID NO: 497578 - RNA, 64 nt, Homo Sapiens; identical to SEQ ID NO: 460736

SEQ ID NO: 497579 - RNA, 64 nt, Homo Sapiens; identical to SEQ ID NO: 460737

SEQ ID NO: 497580 - RNA, 64 nt, Homo Sapiens; identical to SEQ ID NO: 460738

SEQ ID NO: 497581 - RNA, 64 nt, Homo Sapiens; identical to SEQ ID NO: 460739

SEQ ID NO: 497582 - RNA, 64 nt, Homo Sapiens; identical to SEQ ID NO: 460740

SEQ ID NO: 497583 - RNA, 64 nt, Homo Sapiens; identical to SEQ ID NO: 460741

SEQ ID NO: 497584 - RNA, 64 nt, Homo Sapiens; identical to SEQ ID NO: 460742

SEQ ID NO: 497585 - RNA, 64 nt, Homo Sapiens; identical to SEQ ID NO: 460743

SEQ ID NO: 497586 - RNA, 64 nt, Homo Sapiens; identical to SEQ ID NO: 460744

SEQ ID NO: 497587 - RNA, 64 nt, Homo Sapiens; identical to SEQ ID NO: 460745

SEQ ID NO: 497588 - RNA, 64 nt, Homo Sapiens; identical to SEQ ID NO: 460746

SEQ ID NO: 497589 - RNA, 64 nt, Homo Sapiens; identical to SEQ ID NO: 460747

SEQ ID NO: 497590 - RNA, 64 nt, Homo Sapiens; identical to SEQ ID NO: 460748

SEQ ID NO: 497591 - RNA, 64 nt, Homo Sapiens; identical to SEQ ID NO: 460749

SEQ ID NO: 497592 - RNA, 64 nt, Homo Sapiens; identical to SEQ ID NO: 460750

SEQ ID NO: 497593 - RNA, 64 nt, Homo Sapiens; identical to SEQ ID NO: 460751

SEQ ID NO: 497594 - RNA, 64 nt, Homo Sapiens; identical to SEQ ID NO: 460752

SEQ ID NO: 497595 - RNA, 64 nt, Homo Sapiens; identical to SEQ ID NO: 460753

SEQ ID NO: 497596 - RNA, 64 nt, Homo Sapiens; identical to SEQ ID NO: 460754

SEQ ID NO: 497597 - RNA, 64 nt, Homo Sapiens
cguauaaaaucuggauuuuuagcuccauguccugggccuaaaauguugccuugcuuaacucuaa

SEQ ID NO: 497598 - RNA, 64 nt, Homo Sapiens
acaggagaaaaggucuucaacucuuuugagaggaggccuaaaggaauuaggaguugugcaacag

SEQ ID NO: 497599 - RNA, 64 nt, Homo Sapiens; identical to SEQ ID NO: 73772

SEQ ID NO: 497600 - RNA, 64 nt, Homo Sapiens; identical to SEQ ID NO: 73773

SEQ ID NO: 497601 - RNA, 64 nt, Homo Sapiens; identical to SEQ ID NO: 73774

SEQ ID NO: 497602 - RNA, 64 nt, Homo Sapiens; identical to SEQ ID NO: 73775

SEQ ID NO: 497603 - RNA, 64 nt, Homo Sapiens; identical to SEQ ID NO: 73776

SEQ ID NO: 497604 - RNA, 64 nt, Homo Sapiens; identical to SEQ ID NO: 73777

SEQ ID NO: 497605 - RNA, 64 nt, Homo Sapiens; identical to SEQ ID NO: 73778

SEQ ID NO: 497606 - RNA, 64 nt, Homo Sapiens; identical to SEQ ID NO: 73779

SEQ ID NO: 497607 - RNA, 64 nt, Homo Sapiens; identical to SEQ ID NO: 73780

SEQ ID NO: 497608 - RNA, 64 nt, Homo Sapiens; identical to SEQ ID NO: 73781

SEQ ID NO: 497609 - RNA, 64 nt, Homo Sapiens; identical to SEQ ID NO: 73782

SEQ ID NO: 497610 - RNA, 64 nt, Homo Sapiens; identical to SEQ ID NO: 73783

SEQ ID NO: 497611 - RNA, 64 nt, Homo Sapiens; identical to SEQ ID NO: 73784

SEQ ID NO: 497612 - RNA, 64 nt, Homo Sapiens; identical to SEQ ID NO: 73785

SEQ ID NO: 497613 - RNA, 64 nt, Homo Sapiens; identical to SEQ ID NO: 73786

SEQ ID NO: 497614 - RNA, 64 nt, Homo Sapiens; identical to SEQ ID NO: 73787

SEQ ID NO: 497615 - RNA, 64 nt, Homo Sapiens; identical to SEQ ID NO: 73788

SEQ ID NO: 497616 - RNA, 64 nt, Homo Sapiens; identical to SEQ ID NO: 73789

SEQ ID NO: 497617 - RNA, 64 nt, Homo Sapiens; identical to SEQ ID NO: 73790

SEQ ID NO: 497618 - RNA, 64 nt, Homo Sapiens; identical to SEQ ID NO: 73791

SEQ ID NO: 497619 - RNA, 64 nt, Homo Sapiens; identical to SEQ ID NO: 73792

SEQ ID NO: 497620 - RNA, 64 nt, Homo Sapiens; identical to SEQ ID NO: 73793

SEQ ID NO: 497621 - RNA, 64 nt, Homo Sapiens; identical to SEQ ID NO: 73794

SEQ ID NO: 497622 - RNA, 64 nt, Homo Sapiens; identical to SEQ ID NO: 73795

SEQ ID NO: 497623 - RNA, 64 nt, Homo Sapiens; identical to SEQ ID NO: 73796

SEQ ID NO: 497624 - RNA, 64 nt, Homo Sapiens; identical to SEQ ID NO: 73797

SEQ ID NO: 497625 - RNA, 64 nt, Homo Sapiens; identical to SEQ ID NO: 73798

SEQ ID NO: 497626 - RNA, 64 nt, Homo Sapiens; identical to SEQ ID NO: 73799

SEQ ID NO: 497627 - RNA, 64 nt, Homo Sapiens; identical to SEQ ID NO: 73800

SEQ ID NO: 497628 - RNA, 64 nt, Homo Sapiens; identical to SEQ ID NO: 73801

SEQ ID NO: 497629 - RNA, 64 nt, Homo Sapiens; identical to SEQ ID NO: 73802

SEQ ID NO: 497630 - RNA, 64 nt, Homo Sapiens; identical to SEQ ID NO: 73803

SEQ ID NO: 497631 - RNA, 64 nt, Homo Sapiens; identical to SEQ ID NO: 73804

SEQ ID NO: 497632 - RNA, 64 nt, Homo Sapiens; identical to SEQ ID NO: 73805

SEQ ID NO: 497633 - RNA, 64 nt, Homo Sapiens; identical to SEQ ID NO: 73806

SEQ ID NO: 497634 - RNA, 64 nt, Homo Sapiens; identical to SEQ ID NO: 73807

SEQ ID NO: 497635 - RNA, 64 nt, Homo Sapiens; identical to SEQ ID NO: 73808

SEQ ID NO: 497636 - RNA, 64 nt, Homo Sapiens; identical to SEQ ID NO: 73809

SEQ ID NO: 497637 - RNA, 64 nt, Homo Sapiens; identical to SEQ ID NO: 73810

SEQ ID NO: 497638 - RNA, 64 nt, Homo Sapiens; identical to SEQ ID NO: 73811

SEQ ID NO: 497639 - RNA, 64 nt, Homo Sapiens; identical to SEQ ID NO: 73812

SEQ ID NO: 497640 - RNA, 64 nt, Homo Sapiens; identical to SEQ ID NO: 73813

SEQ ID NO: 497641 - RNA, 64 nt, Homo Sapiens; identical to SEQ ID NO: 73814

SEQ ID NO: 497642 - RNA, 64 nt, Homo Sapiens; identical to SEQ ID NO: 73815

SEQ ID NO: 497643 - RNA, 64 nt, Homo Sapiens; identical to SEQ ID NO: 73816

SEQ ID NO: 497644 - RNA, 64 nt, Homo Sapiens; identical to SEQ ID NO: 73817

SEQ ID NO: 497645 - RNA, 64 nt, Homo Sapiens; identical to SEQ ID NO: 73818

SEQ ID NO: 497646 - RNA, 64 nt, Homo Sapiens; identical to SEQ ID NO: 73819

SEQ ID NO: 497647 - RNA, 64 nt, Homo Sapiens; identical to SEQ ID NO: 73820

SEQ ID NO: 497648 - RNA, 64 nt, Homo Sapiens; identical to SEQ ID NO: 73821

SEQ ID NO: 497649 - RNA, 64 nt, Homo Sapiens; identical to SEQ ID NO: 73822

SEQ ID NO: 497650 - RNA, 64 nt, Homo Sapiens; identical to SEQ ID NO: 73823

SEQ ID NO: 497651 - RNA, 64 nt, Homo Sapiens; identical to SEQ ID NO: 73824

SEQ ID NO: 497652 - RNA, 64 nt, Homo Sapiens; identical to SEQ ID NO: 73825

SEQ ID NO: 497653 - RNA, 64 nt, Homo Sapiens; identical to SEQ ID NO: 73826

SEQ ID NO: 497654 - RNA, 64 nt, Homo Sapiens; identical to SEQ ID NO: 73827

SEQ ID NO: 497655 - RNA, 64 nt, Homo Sapiens; identical to SEQ ID NO: 73828

SEQ ID NO: 497656 - RNA, 64 nt, Homo Sapiens; identical to SEQ ID NO: 73829

SEQ ID NO: 497657 - RNA, 64 nt, Homo Sapiens; identical to SEQ ID NO: 73830

SEQ ID NO: 497658 - RNA, 64 nt, Homo Sapiens
uucaaucuuaaacauuucuaccaguuuuaaaaauauuggacauccuaccuguauaugguaaugu

SEQ ID NO: 497659 - RNA, 64 nt, Homo Sapiens
cugguuuuaauaccugcuuuaacugguuuuaaauauuggacauauagaaguucccccaauuaca

SEQ ID NO: 497660 - RNA, 64 nt, Homo Sapiens
cccugcugcgagucacuccauuuaucuuaaagaaauuggacagcauaugaagauuggacaucac

SEQ ID NO: 497661 - RNA, 64 nt, Homo Sapiens
cauuuaucuuaaagaaauuggacagcauaugaagauuggacaucacaugugaaugcaugauaug

SEQ ID NO: 497662 - RNA, 64 nt, Homo Sapiens
augggccaccuguuucuaaccuaguggcugcuauauuggacagcugcuugauaagcacaugugg

SEQ ID NO: 497663 - RNA, 64 nt, Homo Sapiens
cuugaucuguauuuagauuuggaugcuaauguucauuggacauacuuucugcacaucuccauuu

SEQ ID NO: 497664 - RNA, 64 nt, Homo Sapiens
uauuuuuaguucagauggugucuggguaauagacauuggacagaauuuaaucaugcuucuuuug

SEQ ID NO: 497665 - RNA, 64 nt, Homo Sapiens
ucagaaugaaaguucauguuuacaaguaacauaaauuggacaccaggaauguuuugcagcuuug

SEQ ID NO: 497666 - RNA, 64 nt, Homo Sapiens
aggccuggucagggccuuuaccagggcauggggguggcgugaagcaggucacaugcacguaugu

SEQ ID NO: 497667 - RNA, 64 nt, Homo Sapiens
gggacggcucacgaggcuuggugcccggcagacguggcgugagagcucggaccugccguggagg

SEQ ID NO: 497668 - RNA, 64 nt, Homo Sapiens
gccaauauucucuagaaugagcacaaaacaaaucgaauaacagcuaaacaaaucgaauaacagc

SEQ ID NO: 497669 - RNA, 64 nt, Homo Sapiens
gcacaaaacaaaucgaauaacagcuaaacaaaucgaauaacagcuaaacgaaucgaauaacagc

SEQ ID NO: 497670 - RNA, 64 nt, Homo Sapiens
cagcuaaacaaaucgaauaacagcuaaacgaaucgaauaacagcuuuuguacaucaacaucaag

SEQ ID NO: 497671 - RNA, 64 nt, Homo Sapiens
cauuugauuuauguuucccuuaacagccaaaaaugaauaacagcaacugguauucaaaaaugaa

SEQ ID NO: 497672 - RNA, 64 nt, Homo Sapiens
caaaaaugaauaacagccauugguauucaaaaaugaauaacagcuugaaagcaguaauauuaac

SEQ ID NO: 497673 - RNA, 64 nt, Homo Sapiens
auuaucugugaaccauaauuuaaaaaucuuucuagaauaacaacagcagacuccacucuuguuu

SEQ ID NO: 497674 - RNA, 64 nt, Homo Sapiens
ccucuuaguaaaagauaggcccacuuuauuccaagaauaacacuuagcacauaaacucuucuuc

SEQ ID NO: 497675 - RNA, 64 nt, Homo Sapiens
uuuuuguuuuuaaaauuguuaaauacauuaaaaugaauaacacuuagauauauugguucaaaua

SEQ ID NO: 497676 - RNA, 64 nt, Homo Sapiens
uuuggcaaaaugaugguaacagaaaaaugaggaugaauaacaaguguccuuuuguucauacaaa

SEQ ID NO: 497677 - RNA, 64 nt, Homo Sapiens
uuccaaaguucagccaguuaucaguagauacaauaucuuuaaaugaacacacgaguguaugucu

SEQ ID NO: 497678 - RNA, 64 nt, Homo Sapiens
uauacacaagugugcauauacaguuaaugaaacuaucuuuaaauguuauucaugcuauaaagag

SEQ ID NO: 497679 - RNA, 64 nt, Homo Sapiens
ccugcccaucuuggaggugcauggcccaucagggaucuuuaaagugggagcaggaaaggcugcu

SEQ ID NO: 497680 - RNA, 64 nt, Homo Sapiens
gaguucuuuggggcuuauuuucuggguaaggcucaucuuuaaaaacuggcuucagaggggagag

SEQ ID NO: 497681 - RNA, 64 nt, Homo Sapiens
gaguauaaguacuugcugugaagaaaaaagcauaaucuuuaaccuaagcauguuuugguugcua

SEQ ID NO: 497682 - RNA, 61 nt, Homo Sapiens
aauuuuaucuuuugaaacacaugccaugcguaucuuuaagaguauagguuuaaagcccuaa

SEQ ID NO: 497683 - RNA, 64 nt, Homo Sapiens
guaaguaauuugaauuggcagcuuucuuugcuaaaucuuuaaauucuguuaagauccucaagua

SEQ ID NO: 497684 - RNA, 64 nt, Homo Sapiens
gaggcucccaucaugccauuuuuuguucauuuuaaucuuuaaaaaauaaaaauuaggcauauua

SEQ ID NO: 497685 - RNA, 64 nt, Homo Sapiens
aauucugugagcaaaguuuguuauuuuuacaugaaucuuuaaacuaagucugggacgacaucuu

SEQ ID NO: 497686 - RNA, 64 nt, Homo Sapiens
ucaguaaaauggacuagcauauaaaaauugcaguaucuuuaaaauugaaaaaucaucgaaaugu

SEQ ID NO: 497687 - RNA, 64 nt, Homo Sapiens
acagucaacuuacggugcacuaauuuauaggcagaucuuuaaauaauuugcaauuucaggaauu

SEQ ID NO: 497688 - RNA, 64 nt, Homo Sapiens
guuaauaggaugaaugggaacacauacaaaaaaaaucuuuaaugaggaucuuuuguaaaugaga

SEQ ID NO: 497689 - RNA, 64 nt, Homo Sapiens
cugguggucuugccuucugauugaucuaaguugcaucuuuaaucccauuuacuuuggucaauau

SEQ ID NO: 497690 - RNA, 64 nt, Homo Sapiens
agcucuguggguuuuaacauguaagguuuuuuuuaucuuuaaauucuuugaaaaauaaaguuau

SEQ ID NO: 497691 - RNA, 64 nt, Homo Sapiens
cgguugcauuuuuuucuguuuguuucaaucucuaaucuuuaagucagaaccuaauuguacagug

SEQ ID NO: 497692 - RNA, 64 nt, Homo Sapiens
cuggccaucuuuuccucauguggaagaauuuucuaucuuuaauaaacuuuuucuuuguuuuuuu

SEQ ID NO: 497693 - RNA, 64 nt, Homo Sapiens
ccucugcuuguauuuugcgaugaagaugugauacaucuuuaaaugaaaauauaccaaaauuuag

SEQ ID NO: 497694 - RNA, 64 nt, Homo Sapiens
ucaucaguacgugagacaagcaguuaauaguaugaucuuuaaaguuuugacaauauaaaauaaa

SEQ ID NO: 497695 - RNA, 64 nt, Homo Sapiens
auauauguuguauauuuuuaguuguaaagcaguaaucuuuaacuguagcauuccucuaauuaua

SEQ ID NO: 497696 - RNA, 64 nt, Homo Sapiens
gucaacuuguaauuucuuugaagucauauguuuuaucuuuaaaauuauucuuauuuuaccugug

SEQ ID NO: 497697 - RNA, 64 nt, Homo Sapiens
uguacauucucuuuguuuucauuuuccaaauauaaucuuuaauaaacuugauuuaguuucuugg

SEQ ID NO: 497698 - RNA, 64 nt, Homo Sapiens
guuuauauaauauuuccacugugugacucuagugaucuuuaacauacacagaaugaucuacagu

SEQ ID NO: 497699 - RNA, 64 nt, Homo Sapiens
gugaucuuuaacauacacagaaugaucuacagugaucuuuaacauacucagaaauaugaaaaau

SEQ ID NO: 497700 - RNA, 64 nt, Homo Sapiens
ugcuuuaaaaaaaaguuuuauggguuuugaaugcaucuuuaaaggagauccgaaauaucauuug

SEQ ID NO: 497701 - RNA, 64 nt, Homo Sapiens
auuuaaaaauacuguucacagagcauauauuacuaucuuuaagcaggaauuagauuuugaagau

SEQ ID NO: 497702 - RNA, 64 nt, Homo Sapiens
uaugucuugaaugauaauuauaaaugcuugauaaaucuuuaagaagacaugguaagguggagag

SEQ ID NO: 497703 - RNA, 64 nt, Homo Sapiens
uaauugacacaauugcaaaauacuuaauaaugguaucuuuaaaaacacaaacuaauuuaaaguu

SEQ ID NO: 497704 - RNA, 64 nt, Homo Sapiens
uaauauucuuaguaccacaagauaugucauagguaucuuuaaaugaaauucuuagcuggaaaag

SEQ ID NO: 497705 - RNA, 64 nt, Homo Sapiens
ucaugaaagucauugguaggccauuagcauugauaucuuuaaaacaucuacccuaaaccaucug

SEQ ID NO: 497706 - RNA, 64 nt, Homo Sapiens
uguuaucucaaaccagucuguauuaagcaggucuaucuuuaauugucuauaucaucuaucaauu

SEQ ID NO: 497707 - RNA, 64 nt, Homo Sapiens
aaaaaaucacaucaguauaguagcaaaaacaauuaucuuuaaaagcaagucaaguaaguguggg

SEQ ID NO: 497708 - RNA, 64 nt, Homo Sapiens
ucuaguuuuucuuuaaaaggauaguuuaugaguaaucuuuaaaaccauuuccauaccaucugua

SEQ ID NO: 497709 - RNA, 64 nt, Homo Sapiens
guuauuaccacauaguauuuuuauguuacccaucaucuuuaaaaacauuauaggcugggcaugg

SEQ ID NO: 497710 - RNA, 64 nt, Homo Sapiens
agggaaggucaagcaaagaaucuuuaacauagagaucuuuaaaauucagaauaccuaagcugcu

SEQ ID NO: 497711 - RNA, 64 nt, Homo Sapiens
cuagauucuugcuucugauagcaauagugguaaaaucuuuaaaagguaauaugaucaaaguuaa

SEQ ID NO: 497712 - RNA, 64 nt, Homo Sapiens
aaggacaaauccuguuaaagaaauauuguuaaaaaucuuuaaacccuguguauugaaagcacuc

SEQ ID NO: 497713 - RNA, 64 nt, Homo Sapiens
cuagaauuaaaaccaaauuaugaccuuaugauaaaucuuuaaguauuggugugaauguuauuua

SEQ ID NO: 497714 - RNA, 64 nt, Homo Sapiens
uuuggguggagaggggccuucuuuguguaaauacaucuuuaacaaacugcacuguugaucggug

SEQ ID NO: 497715 - RNA, 64 nt, Homo Sapiens
uuaaugucuagccaagaguuuaaggggaaauaguaucuuuaaagaugaucauauaccuuuuaaa

SEQ ID NO: 497716 - RNA, 64 nt, Homo Sapiens
cuuuggcaauguuauuguauuaacacaucuaaauaucuuuaagugaauuugugaauauacuugu

SEQ ID NO: 497717 - RNA, 64 nt, Homo Sapiens
uuuuugugaauacuuaaaagcuuauuucaacaagaucuuuaaaaaagguuaauuauaaucuuuc

SEQ ID NO: 497718 - RNA, 64 nt, Homo Sapiens
uacagcuuauuuuguaacuauuuuauaucucaauaucuuuaauauaaaucuuuuuacugagaga

SEQ ID NO: 497719 - RNA, 64 nt, Homo Sapiens
uaaaauuuuuucuaagucuauacguuuuuaauucaucuuuaagauugagcuaaauuaucuacca

SEQ ID NO: 497720 - RNA, 64 nt, Homo Sapiens
aaacguguaacagcucccuaugugaagaaacauuaucuuuaaagucaucugggaggugcaggua

SEQ ID NO: 497721 - RNA, 64 nt, Homo Sapiens
uaauguauuaaguauuuaaguacuuucuaauaaaaucuuuaacaauaauaauguaaauuucaga

SEQ ID NO: 497722 - RNA, 64 nt, Homo Sapiens
guugaagaucaaauucgugauaucucuauaucuaaucuuuaaaaaucagaaugcuaaugcugac

SEQ ID NO: 497723 - RNA, 64 nt, Homo Sapiens
gaggacauggggaagaaucaaucuucaacagauaaucuuuaaguacagacccaggaauaucaga

SEQ ID NO: 497724 - RNA, 64 nt, Homo Sapiens
auucaguaaaaugaugguuaacauguuuuaaaaaaucuuuaauggagaaguuaaauauuuggug

SEQ ID NO: 497725 - RNA, 64 nt, Homo Sapiens
uauaagacagugcuaucuaguuguguuuuucagaaucuuuaaaagacuacauaagcguuaaaaa

SEQ ID NO: 497726 - RNA, 64 nt, Homo Sapiens
uuguuaguaaguaguaaacaucguaaauauuugcaucuuuaauauaaagugagaaaaauauguu

SEQ ID NO: 497727 - RNA, 64 nt, Homo Sapiens
uuuaugaugcauugcacacccucuggggaaauugaucuuuaaauuuugagacaguauaaggaaa

SEQ ID NO: 497728 - RNA, 64 nt, Homo Sapiens
uagaaugaagucuugaaaaaaacuuuauaaagacaucuuuaaucauuccaaaauuguguccguu

SEQ ID NO: 497729 - RNA, 64 nt, Homo Sapiens
uauggacuauuccuauaaacugcugggucagcuuaucuuuaauaggaugggauuuucguuauuu

SEQ ID NO: 497730 - RNA, 64 nt, Homo Sapiens
aauuaagccauuuacauguuuggcuaaaagaaucaucuuuaagaauucuaccuuuguaaacaau

SEQ ID NO: 497731 - RNA, 64 nt, Homo Sapiens
aggaggcacugccccccuuuccugcccccuccucaucuuuaauaaagaccuggcuucucaucuu

SEQ ID NO: 497732 - RNA, 64 nt, Homo Sapiens
ccccuccucaucuuuaauaaagaccuggcuucucaucuuuaauaaagaccuguuuguaacagaa

SEQ ID NO: 497733 - RNA, 64 nt, Homo Sapiens
cacaugacaacauuagaaaagacauuucauacauaucuuuaaaggauauauuauuucauccaca

SEQ ID NO: 497734 - RNA, 64 nt, Homo Sapiens
uaaauuccuagaaguggaaauacauguguaauauaucuuuaaggcuugcacguaaauuauuuug

SEQ ID NO: 497735 - RNA, 64 nt, Homo Sapiens
acugcuggcugcuuuaaaaaaaaaaaaaaaggauccauuguaccguugucuucaucacugggaa

SEQ ID NO: 497736 - RNA, 64 nt, Homo Sapiens
ggaaaagacauuuucauguuaaugagaauuuccaccauuguagagaauuuccuuccuacugaga

SEQ ID NO: 497737 - RNA, 64 nt, Homo Sapiens
cacagauuugcuuuugguuaccgauuagaucuauccauuguagaauucauguaaauagaauacu

SEQ ID NO: 497738 - RNA, 64 nt, Homo Sapiens
ccagguuacuugccaauauauagucauauugcugccauuguacuuaauuucuaaauauauaaaa

SEQ ID NO: 497739 - RNA, 64 nt, Homo Sapiens
ugucuuacacauaaaagccacugcuuuuaacaucccauuguacauuuaacacauaaaugguguu

SEQ ID NO: 497740 - RNA, 64 nt, Homo Sapiens
auuguacauuuaacacauaaaugguguuaacaucccauuguacauuuaacacauaaauggccau

SEQ ID NO: 497741 - RNA, 64 nt, Homo Sapiens
ccagccugggugaagaaguggagccgggauugcgccauuguacuugggaggcagagguugcagu

SEQ ID NO: 497742 - RNA, 64 nt, Homo Sapiens
ccagcuugggcaacagaguagagccgagauagugccauuguacucuagaggcggaguuugcagu

SEQ ID NO: 497743 - RNA, 64 nt, Homo Sapiens
uuuuuuuuuugccacauucugcccuucccugaccccauuguaauaaccaacuccauauccaaag

SEQ ID NO: 497744 - RNA, 64 nt, Homo Sapiens
caacuccauauccaaagggagguggugcucucagccauuguagaagaugguggcuuuaaccuga

SEQ ID NO: 497745 - RNA, 64 nt, Homo Sapiens
aauuuuuugaguaacuuuuauuuuccuuuccacuccauuguaucggugcuuacgaucuuuuuug

SEQ ID NO: 497746 - RNA, 64 nt, Homo Sapiens
ggauuuaaccaaaaucuugcagaucuccugguuuccauuguaaguauaaucugucuucugucca

SEQ ID NO: 497747 - RNA, 64 nt, Homo Sapiens
ggcuuccucuccagaauguggcuuugccugagcacagacagagucagcauggaaugcucuuggc

SEQ ID NO: 497748 - RNA, 64 nt, Homo Sapiens
gcggauugaggcugcugggucagccuugaucgcacagacagagcuugugccggauuuggcccug

SEQ ID NO: 497749 - RNA, 64 nt, Homo Sapiens
ucucuuaaagcggcaccaacgugagagagacaggcagacagacagaaagccagaggcuuaggga

SEQ ID NO: 497750 - RNA, 64 nt, Homo Sapiens
uuaaagcggcaccaacgugagagagacaggcagacagacagaaagccagaggcuuagggaaacu

SEQ ID NO: 497751 - RNA, 64 nt, Homo Sapiens
cauguacagacucuauaucucuauauauaauguacagacagacagagucccuucccucuuuaac

SEQ ID NO: 497752 - RNA, 64 nt, Homo Sapiens
uacagacucuauaucucuauauauaauguacagacagacagagucccuucccucuuuaaccccc

SEQ ID NO: 497753 - RNA, 64 nt, Homo Sapiens
ccugugcaaauuuuaaaaaggaacccuuuuccuccagacagauacagccccaaaccagggugca

SEQ ID NO: 497754 - RNA, 64 nt, Homo Sapiens
gaagcugagaagaagcugaggauccucacaggagcagacagagaaaugugaagggugggguuuu

SEQ ID NO: 497755 - RNA, 64 nt, Homo Sapiens
aacccucugaucuaugaagucucugcaggacagacagacagacacagcaggacauaugggcaag

SEQ ID NO: 497756 - RNA, 64 nt, Homo Sapiens
gacaaacccucugaucuaugcaagcucugcaggacagacagacaggaccagcaggacauauggg

SEQ ID NO: 497757 - RNA, 64 nt, Homo Sapiens
gggguucaaaucccagcucuuacgguuuuagugucagacagaccucuuuggagucauggcacug

SEQ ID NO: 497758 - RNA, 64 nt, Homo Sapiens
cugggccagcacuguggacuugcuugggauucuucagacagaaggucccaagcgaaggcuccuc

SEQ ID NO: 497759 - RNA, 64 nt, Homo Sapiens
gaccuccuaggccugauuguccugccagggugggcagacagacagauggaccggcccacacucc

SEQ ID NO: 497760 - RNA, 64 nt, Homo Sapiens
uccuaggccugauuguccugccagggugggcagacagacagauggaccggcccacacucccaga

SEQ ID NO: 497761 - RNA, 64 nt, Homo Sapiens
cccaggcagaccgauaaaaagaccuccagauaggcagacagacagauggaccaccaaccuggac

SEQ ID NO: 497762 - RNA, 64 nt, Homo Sapiens
ggcagaccgauaaaaagaccuccagauaggcagacagacagauggaccaccaaccuggacagac

SEQ ID NO: 497763 - RNA, 64 nt, Homo Sapiens
ucaggugggcuggcuggcugacagaccuucuggccagacagacuccuaaccaaccagauggacu

SEQ ID NO: 497764 - RNA, 64 nt, Homo Sapiens
aagucccccaaaugaguacacaucuccagcuauucagacagauggacccccagcaaaucaggac

SEQ ID NO: 497765 - RNA, 64 nt, Homo Sapiens
gaccuaucuaggcagaccccagccagacccccgccagacagacucccaaccagacugaccccuu

SEQ ID NO: 497766 - RNA, 64 nt, Homo Sapiens
uauuccccaaaaagggauacgaaaggaguucagacagacagacgaucacagugccauuugaagg

SEQ ID NO: 497767 - RNA, 64 nt, Homo Sapiens
gacguauuccccaaaaagggaagggaaaggaguucagacagacauuuuaucacagugccauuug

SEQ ID NO: 497768 - RNA, 64 nt, Homo Sapiens
uggcacuggccaggcuuggguggagccugugucccagacagauccccuaggccuaucugagacc

SEQ ID NO: 497769 - RNA, 64 nt, Homo Sapiens
cggaaaagagaacagaagagaauccagaaguguucagacagaacuagggacaacagaggggccu

SEQ ID NO: 497770 - RNA, 64 nt, Homo Sapiens
auuggaaaacuaaagaaguugagcaacuugaaugcagacagaaauaaauuaguguccuuaccaa

SEQ ID NO: 497771 - RNA, 64 nt, Homo Sapiens
aucugacaaccagucccagccccugcuuacauuccagacagacacagacuacaccacaggagag

SEQ ID NO: 497772 - RNA, 64 nt, Homo Sapiens
cgcacacacacccaucucuggacagacagacagacagacagacaacggcucuggacccaggaca

SEQ ID NO: 497773 - RNA, 64 nt, Homo Sapiens
gacagacagacagacacgcagacagacagacagacagacagacaauugacggcucuggacccag

SEQ ID NO: 497774 - RNA, 64 nt, Homo Sapiens
gacagacagacagacagacaccaggacagacagacagacagacaaagaauugacggcucuggac

SEQ ID NO: 497775 - RNA, 64 nt, Homo Sapiens
gacagacagacagacagacaggacccaggacagacagacagacagcugaagaauugacggcucu

SEQ ID NO: 497776 - RNA, 64 nt, Homo Sapiens
gacagacagacagacagacacucuggacccaggacagacagacaugaggcugaagaauugacgg

SEQ ID NO: 497777 - RNA, 64 nt, Homo Sapiens
acuccccgcccgcccuccucugcccccucccccgcagacagacagacagacggacgggacagcg

SEQ ID NO: 497778 - RNA, 64 nt, Homo Sapiens
cccgcccgcccuccucugcccccucccccgcagacagacagacagacggacgggacagcggccc

SEQ ID NO: 497779 - RNA, 64 nt, Homo Sapiens
cccgcccuccucugcccccucccccgcagacagacagacagacggacgggacagcggcccggcc

SEQ ID NO: 497780 - RNA, 64 nt, Homo Sapiens
gcuaaauugaucccaauuaaguuuuucugcuuagcagacagaagguauaauuuuuugacacccu

SEQ ID NO: 497781 - RNA, 64 nt, Homo Sapiens
aaaggcuacuuauggccggucacaauccagcacucagacagagccaaggcaauauccucuugcc

SEQ ID NO: 497782 - RNA, 64 nt, Homo Sapiens
cuucaaaugcugauggagggguggugauggccaucagacagagaaaggacaaggacaugagaca

SEQ ID NO: 497783 - RNA, 64 nt, Homo Sapiens
ugaagcaguggugaaggccagggcacagagguagcagacagaugugagcagugcaguggaaguc

SEQ ID NO: 497784 - RNA, 64 nt, Homo Sapiens
cuucuaagcccacagggaucugacuuucauugggcagacagagucugaauuaugggcaaaacca

SEQ ID NO: 497785 - RNA, 64 nt, Homo Sapiens
ugcccccuauuguagacaguagccugucaccacgcagacagaacgugagaagaucccaagguga

SEQ ID NO: 497786 - RNA, 64 nt, Homo Sapiens
cacacacacacacacacacauacggacagacagacagacagacacaucuccagacucuaccacu

SEQ ID NO: 497787 - RNA, 64 nt, Homo Sapiens
gacacacacacacacacacacacuuacggacagacagacagacagguccaucuccagacucuac

SEQ ID NO: 497788 - RNA, 64 nt, Homo Sapiens
gacagacacacacacacacacuaccacuuacggacagacagacacugugguccaucuccagacu

SEQ ID NO: 497789 - RNA, 64 nt, Homo Sapiens
cuuuuuccaaacagggauauagaagugguggaagcagacagaagagguaagggaggcuaagugg

SEQ ID NO: 497790 - RNA, 64 nt, Homo Sapiens
accauuaccucacucagugugaccuggagggggucagacagacgggagaguccagaaacagacc

SEQ ID NO: 497791 - RNA, 64 nt, Homo Sapiens
uugguucuguguccauuuuccucugugccaaagacagacagacagaggcugagagaggcuguuc

SEQ ID NO: 497792 - RNA, 64 nt, Homo Sapiens
uucuguguccauuuuccucugugccaaagacagacagacagaggcugagagaggcuguuccuga

SEQ ID NO: 497793 - RNA, 64 nt, Homo Sapiens
gcuagcugaccuggagaugcugccugguggggaucagacagagauuggagagaagguacagagu

SEQ ID NO: 497794 - RNA, 64 nt, Homo Sapiens
agugcuggugacgcacggcauuagcuuccugccccagacagacuucaucauugugcuagcugau

SEQ ID NO: 497795 - RNA, 64 nt, Homo Sapiens
caagauguuggggcugccuggcgcccacuggagacagacagacagacgccugucccccgggacc

SEQ ID NO: 497796 - RNA, 64 nt, Homo Sapiens
auguuggggcugccuggcgcccacuggagacagacagacagacgccugucccccgggaccgagg

SEQ ID NO: 497797 - RNA, 64 nt, Homo Sapiens
agcagacacacauacagccugaaacagaccuggacagacagacacagccugaaacagacccgga

SEQ ID NO: 497798 - RNA, 64 nt, Homo Sapiens
uggacagacagacacagccugaaacagacccggacagacagacacagccugaaacagacccaga

SEQ ID NO: 497799 - RNA, 64 nt, Homo Sapiens
cagacagacacagccugaaacagacccagacaaacagacagacagacacagccugaaacagacc

SEQ ID NO: 497800 - RNA, 64 nt, Homo Sapiens
cagacacagccugaaacagacccagacaaacagacagacagacacagccugaaacagacccaga

SEQ ID NO: 497801 - RNA, 64 nt, Homo Sapiens
caaacagacagacagacacagccugaaacagacccagacagacagacagacagccugaaacaga

SEQ ID NO: 497802 - RNA, 64 nt, Homo Sapiens
cagacagacagacacagccugaaacagacccagacagacagacagacagccugaaacagaccca

SEQ ID NO: 497803 - RNA, 64 nt, Homo Sapiens
cagacagacacagccugaaacagacccagacagacagacagacagccugaaacagacccagaca

SEQ ID NO: 497804 - RNA, 64 nt, Homo Sapiens
aacagacccagacacagccugaaacagauccggacagacagacagaaacagccugaaacagacc

SEQ ID NO: 497805 - RNA, 64 nt, Homo Sapiens
gacccagacacagccugaaacagauccggacagacagacagaaacagccugaaacagacccaga

SEQ ID NO: 497806 - RNA, 64 nt, Homo Sapiens
cggacagacagacagaaacagccugaaacagacccagacagacagacagacacagccugaaaca

SEQ ID NO: 497807 - RNA, 64 nt, Homo Sapiens
cagacagacagaaacagccugaaacagacccagacagacagacagacacagccugaaacagacc

SEQ ID NO: 497808 - RNA, 64 nt, Homo Sapiens
cagacagaaacagccugaaacagacccagacagacagacagacacagccugaaacagacccgga

SEQ ID NO: 497809 - RNA, 64 nt, Homo Sapiens
cagacagacagacacagccugaaacagacccggacagacagacagacacagccugaaacagacc

SEQ ID NO: 497810 - RNA, 64 nt, Homo Sapiens
cagacagacacagccugaaacagacccggacagacagacagacacagccugaaacagacccgga

SEQ ID NO: 497811 - RNA, 64 nt, Homo Sapiens; identical to SEQ ID NO: 497809

SEQ ID NO: 497812 - RNA, 64 nt, Homo Sapiens; identical to SEQ ID NO: 497810

SEQ ID NO: 497813 - RNA, 64 nt, Homo Sapiens; identical to SEQ ID NO: 497809

SEQ ID NO: 497814 - RNA, 64 nt, Homo Sapiens
cagacagacacagccugaaacagacccggacagacagacagacacagccugaaacagaccuaga

SEQ ID NO: 497815 - RNA, 64 nt, Homo Sapiens
cagacagacagacacagccugaaacagaccuagacagacagacacagauugaaacagacccaga

SEQ ID NO: 497816 - RNA, 64 nt, Homo Sapiens
cagacagacacagauugaaacagacccagacaaacagacagacacagccugaaacagacccaga

SEQ ID NO: 497817 - RNA, 64 nt, Homo Sapiens
aacagacccagacacagccugaaacagacccggacagacagacagacacagccugaaacagacc

SEQ ID NO: 497818 - RNA, 64 nt, Homo Sapiens
gacccagacacagccugaaacagacccggacagacagacagacacagccugaaacagacccaga

SEQ ID NO: 497819 - RNA, 64 nt, Homo Sapiens
cggacagacagacagacacagccugaaacagacccagacagacagacagacacagccugaaaca

SEQ ID NO: 497820 - RNA, 64 nt, Homo Sapiens
cagacagacagacacagccugaaacagacccagacagacagacagacacagccugaaacagacc

SEQ ID NO: 497821 - RNA, 64 nt, Homo Sapiens
cagacagacacagccugaaacagacccagacagacagacagacacagccugaaacagacccaga

SEQ ID NO: 497822 - RNA, 64 nt, Homo Sapiens
cagacagacagacagacacagccugaaacagacccagacagacagaccgacgcagccugaaaga

SEQ ID NO: 497823 - RNA, 64 nt, Homo Sapiens
cagacagacagacacagccugaaacagacccagacagacagaccgacgcagccugaaagagacc

SEQ ID NO: 497824 - RNA, 64 nt, Homo Sapiens
cagacagacagaccgacgcagccugaaagagacccagacagagagacaggcagacacagccuaa

SEQ ID NO: 497825 - RNA, 64 nt, Homo Sapiens
cagacaggcagacguagucugaaacagaccugaacagacagacagacgcacacacacaacagau

SEQ ID NO: 497826 - RNA, 64 nt, Homo Sapiens
caggcagacguagucugaaacagaccugaacagacagacagacgcacacacacaacagaugcgc

SEQ ID NO: 497827 - RNA, 64 nt, Homo Sapiens
uaaagccaucucagugaagauaugcgugcacgcacagacagacagacacacacacacacacaca

SEQ ID NO: 497828 - RNA, 64 nt, Homo Sapiens
gccaucucagugaagauaugcgugcacgcacagacagacagacacacacacacacacacacaca

SEQ ID NO: 497829 - RNA, 64 nt, Homo Sapiens
caggaggagccuggccauggguccuugcccccgacagacagagcagcccccacccgggagccuu

SEQ ID NO: 497830 - RNA, 64 nt, Homo Sapiens
uggaugagacuguccuggaggauccaccccggaacagacagaauggugucucucaggauggugc

SEQ ID NO: 497831 - RNA, 64 nt, Homo Sapiens
aaaugugucucccuccaaggacugugcaggagaacagacagaggccugugggcuuuuuaccacc

SEQ ID NO: 497832 - RNA, 64 nt, Homo Sapiens
aagcccugcagaaaguuccacagugcuccgagcucagacagaggcuucauccugcccggaaugc

SEQ ID NO: 497833 - RNA, 64 nt, Homo Sapiens
guuugcuuucugcugagauagggaaggggcuuuucagacagacuguuacacaguuccaaaucuu

SEQ ID NO: 497834 - RNA, 64 nt, Homo Sapiens
guauugcuggagggugagaggagggagucacagccagacagagaccucaugucuacuguuaggu

SEQ ID NO: 497835 - RNA, 64 nt, Homo Sapiens
gccauuguccacauaacugaucacccauggcugccucuccuauuaucuauuaucacugaaacuu

SEQ ID NO: 497836 - RNA, 64 nt, Homo Sapiens
guacuuauuauuggccauugaucuugaauuugcccucuccuagugcugcagucccacuucaaag

SEQ ID NO: 497837 - RNA, 64 nt, Homo Sapiens
ucucccuuuucccccgaucccucuuuuuuccuuccucuccuacaguuggugguauauuuuuccc

SEQ ID NO: 497838 - RNA, 64 nt, Homo Sapiens
gauuggaacaaaagcaaacaguacuccucaaccacucuccuaauucaaaguagugauggauuca

SEQ ID NO: 497839 - RNA, 64 nt, Homo Sapiens
aaucuccugagaaaugaaccaugaaugaauaaaacucuccuaagccccuguaaauacuggauca

SEQ ID NO: 497840 - RNA, 64 nt, Homo Sapiens
agcuguccuggugggcccagccugacuaugcuuucucuccuaggcauguugacauaaguuccua

SEQ ID NO: 497841 - RNA, 64 nt, Homo Sapiens
cucuaucucucucucuaucuccucucucucucuccucuccuaucucuccucucucucucuccua

SEQ ID NO: 497842 - RNA, 64 nt, Homo Sapiens
ucucucucucuccucuccuaucucuccucucucucucuccuauacuaacuuguuucaaauugga

SEQ ID NO: 497843 - RNA, 64 nt, Homo Sapiens
guacugggaccacuguaaacuauuuuauuuaauucucuccuacauuaauuaucuacagcuauuu

SEQ ID NO: 497844 - RNA, 64 nt, Homo Sapiens
ggaagaauaucacaggcuaaucuaaucuugacaucucuccuaggcuggcuaugauagaaucuca

SEQ ID NO: 497845 - RNA, 64 nt, Homo Sapiens
ccacuuuccagccuguuuccccaauuccucugugcucuccuagagcucugucugaauccucgca

SEQ ID NO: 497846 - RNA, 64 nt, Homo Sapiens
uccuuggauuaggagaacagguguuccuccuccccucuccuagcagcccuaaugucugaccuag

SEQ ID NO: 497847 - RNA, 64 nt, Homo Sapiens
cugacacaucugggucucaaucgauuaguuaaaacucuccuaggucugcagcagcaguggcucu

SEQ ID NO: 497848 - RNA, 64 nt, Homo Sapiens
aggcauuuaauuaaggcucugaaauaaauuccaacucuccuaagagaauuugcuuuucaaaaug

SEQ ID NO: 497849 - RNA, 64 nt, Homo Sapiens
ucucugucagaauugagcuugaagaaagaggucucucuccuaaguuggcauaauuggugauccu

SEQ ID NO: 497850 - RNA, 64 nt, Homo Sapiens
uugcucacugccuuaaucagaaucuguuucagagcucuccuaccccuuguacuucguuaacacg

SEQ ID NO: 497851 - RNA, 64 nt, Homo Sapiens; identical to SEQ ID NO: 245168

SEQ ID NO: 497852 - RNA, 64 nt, Homo Sapiens; identical to SEQ ID NO: 245169

SEQ ID NO: 497853 - RNA, 64 nt, Homo Sapiens; identical to SEQ ID NO: 245170

SEQ ID NO: 497854 - RNA, 64 nt, Homo Sapiens; identical to SEQ ID NO: 245171

SEQ ID NO: 497855 - RNA, 64 nt, Homo Sapiens; identical to SEQ ID NO: 245172

SEQ ID NO: 497856 - RNA, 55 nt, Homo Sapiens; identical to SEQ ID NO: 245173

SEQ ID NO: 497857 - RNA, 64 nt, Homo Sapiens; identical to SEQ ID NO: 245174

SEQ ID NO: 497858 - RNA, 64 nt, Homo Sapiens; identical to SEQ ID NO: 245175

SEQ ID NO: 497859 - RNA, 64 nt, Homo Sapiens; identical to SEQ ID NO: 245176

SEQ ID NO: 497860 - RNA, 64 nt, Homo Sapiens; identical to SEQ ID NO: 245177

SEQ ID NO: 497861 - RNA, 64 nt, Homo Sapiens; identical to SEQ ID NO: 245178

SEQ ID NO: 497862 - RNA, 64 nt, Homo Sapiens; identical to SEQ ID NO: 245179

SEQ ID NO: 497863 - RNA, 64 nt, Homo Sapiens; identical to SEQ ID NO: 245180

SEQ ID NO: 497864 - RNA, 64 nt, Homo Sapiens; identical to SEQ ID NO: 245181

SEQ ID NO: 497865 - RNA, 64 nt, Homo Sapiens; identical to SEQ ID NO: 245182

SEQ ID NO: 497866 - RNA, 64 nt, Homo Sapiens; identical to SEQ ID NO: 245183

SEQ ID NO: 497867 - RNA, 64 nt, Homo Sapiens; identical to SEQ ID NO: 245184

SEQ ID NO: 497868 - RNA, 64 nt, Homo Sapiens; identical to SEQ ID NO: 245185

SEQ ID NO: 497869 - RNA, 64 nt, Homo Sapiens; identical to SEQ ID NO: 245186

SEQ ID NO: 497870 - RNA, 64 nt, Homo Sapiens; identical to SEQ ID NO: 245187

SEQ ID NO: 497871 - RNA, 64 nt, Homo Sapiens; identical to SEQ ID NO: 245188

SEQ ID NO: 497872 - RNA, 62 nt, Homo Sapiens; identical to SEQ ID NO: 245189

SEQ ID NO: 497873 - RNA, 64 nt, Homo Sapiens; identical to SEQ ID NO: 245190

SEQ ID NO: 497874 - RNA, 64 nt, Homo Sapiens; identical to SEQ ID NO: 245191

SEQ ID NO: 497875 - RNA, 64 nt, Homo Sapiens; identical to SEQ ID NO: 245192

SEQ ID NO: 497876 - RNA, 64 nt, Homo Sapiens; identical to SEQ ID NO: 245193

SEQ ID NO: 497877 - RNA, 64 nt, Homo Sapiens; identical to SEQ ID NO: 245194

SEQ ID NO: 497878 - RNA, 64 nt, Homo Sapiens; identical to SEQ ID NO: 245195

SEQ ID NO: 497879 - RNA, 64 nt, Homo Sapiens; identical to SEQ ID NO: 245196

SEQ ID NO: 497880 - RNA, 64 nt, Homo Sapiens; identical to SEQ ID NO: 245197

SEQ ID NO: 497881 - RNA, 64 nt, Homo Sapiens; identical to SEQ ID NO: 245198

SEQ ID NO: 497882 - RNA, 64 nt, Homo Sapiens; identical to SEQ ID NO: 245199

SEQ ID NO: 497883 - RNA, 64 nt, Homo Sapiens; identical to SEQ ID NO: 245200

SEQ ID NO: 497884 - RNA, 64 nt, Homo Sapiens; identical to SEQ ID NO: 245201

SEQ ID NO: 497885 - RNA, 64 nt, Homo Sapiens; identical to SEQ ID NO: 245202

SEQ ID NO: 497886 - RNA, 64 nt, Homo Sapiens; identical to SEQ ID NO: 245203

SEQ ID NO: 497887 - RNA, 64 nt, Homo Sapiens; identical to SEQ ID NO: 245204

SEQ ID NO: 497888 - RNA, 64 nt, Homo Sapiens; identical to SEQ ID NO: 245205

SEQ ID NO: 497889 - RNA, 64 nt, Homo Sapiens; identical to SEQ ID NO: 245206

SEQ ID NO: 497890 - RNA, 64 nt, Homo Sapiens; identical to SEQ ID NO: 245207

SEQ ID NO: 497891 - RNA, 64 nt, Homo Sapiens; identical to SEQ ID NO: 245208

SEQ ID NO: 497892 - RNA, 64 nt, Homo Sapiens; identical to SEQ ID NO: 245209

SEQ ID NO: 497893 - RNA, 64 nt, Homo Sapiens; identical to SEQ ID NO: 245210

SEQ ID NO: 497894 - RNA, 64 nt, Homo Sapiens; identical to SEQ ID NO: 245211

SEQ ID NO: 497895 - RNA, 64 nt, Homo Sapiens; identical to SEQ ID NO: 24125

SEQ ID NO: 497896 - RNA, 64 nt, Homo Sapiens; identical to SEQ ID NO: 24126

SEQ ID NO: 497897 - RNA, 64 nt, Homo Sapiens; identical to SEQ ID NO: 24127

SEQ ID NO: 497898 - RNA, 64 nt, Homo Sapiens; identical to SEQ ID NO: 24128

SEQ ID NO: 497899 - RNA, 64 nt, Homo Sapiens; identical to SEQ ID NO: 24129

SEQ ID NO: 497900 - RNA, 64 nt, Homo Sapiens; identical to SEQ ID NO: 24130

SEQ ID NO: 497901 - RNA, 64 nt, Homo Sapiens; identical to SEQ ID NO: 24131

SEQ ID NO: 497902 - RNA, 64 nt, Homo Sapiens; identical to SEQ ID NO: 24132

SEQ ID NO: 497903 - RNA, 64 nt, Homo Sapiens; identical to SEQ ID NO: 24133

SEQ ID NO: 497904 - RNA, 64 nt, Homo Sapiens; identical to SEQ ID NO: 24134

SEQ ID NO: 497905 - RNA, 64 nt, Homo Sapiens; identical to SEQ ID NO: 24135

SEQ ID NO: 497906 - RNA, 64 nt, Homo Sapiens; identical to SEQ ID NO: 24136

SEQ ID NO: 497907 - RNA, 64 nt, Homo Sapiens; identical to SEQ ID NO: 24137

SEQ ID NO: 497908 - RNA, 64 nt, Homo Sapiens; identical to SEQ ID NO: 24138

SEQ ID NO: 497909 - RNA, 64 nt, Homo Sapiens; identical to SEQ ID NO: 24139

SEQ ID NO: 497910 - RNA, 64 nt, Homo Sapiens; identical to SEQ ID NO: 24140

SEQ ID NO: 497911 - RNA, 64 nt, Homo Sapiens; identical to SEQ ID NO: 24141

SEQ ID NO: 497912 - RNA, 64 nt, Homo Sapiens; identical to SEQ ID NO: 24142

SEQ ID NO: 497913 - RNA, 64 nt, Homo Sapiens; identical to SEQ ID NO: 24143

SEQ ID NO: 497914 - RNA, 64 nt, Homo Sapiens; identical to SEQ ID NO: 24144

SEQ ID NO: 497915 - RNA, 64 nt, Homo Sapiens; identical to SEQ ID NO: 24145

SEQ ID NO: 497916 - RNA, 64 nt, Homo Sapiens; identical to SEQ ID NO: 24146

SEQ ID NO: 497917 - RNA, 64 nt, Homo Sapiens; identical to SEQ ID NO: 24147

SEQ ID NO: 497918 - RNA, 64 nt, Homo Sapiens; identical to SEQ ID NO: 24148

SEQ ID NO: 497919 - RNA, 64 nt, Homo Sapiens; identical to SEQ ID NO: 24149

SEQ ID NO: 497920 - RNA, 64 nt, Homo Sapiens; identical to SEQ ID NO: 24150

SEQ ID NO: 497921 - RNA, 64 nt, Homo Sapiens; identical to SEQ ID NO: 24151

SEQ ID NO: 497922 - RNA, 64 nt, Homo Sapiens; identical to SEQ ID NO: 24152

SEQ ID NO: 497923 - RNA, 64 nt, Homo Sapiens; identical to SEQ ID NO: 24153

SEQ ID NO: 497924 - RNA, 64 nt, Homo Sapiens; identical to SEQ ID NO: 24154

SEQ ID NO: 497925 - RNA, 64 nt, Homo Sapiens; identical to SEQ ID NO: 24155

SEQ ID NO: 497926 - RNA, 64 nt, Homo Sapiens; identical to SEQ ID NO: 24156

SEQ ID NO: 497927 - RNA, 64 nt, Homo Sapiens; identical to SEQ ID NO: 24157

SEQ ID NO: 497928 - RNA, 64 nt, Homo Sapiens; identical to SEQ ID NO: 24158

SEQ ID NO: 497929 - RNA, 64 nt, Homo Sapiens; identical to SEQ ID NO: 24159

SEQ ID NO: 497930 - RNA, 64 nt, Homo Sapiens; identical to SEQ ID NO: 24160

SEQ ID NO: 497931 - RNA, 64 nt, Homo Sapiens; identical to SEQ ID NO: 352337

SEQ ID NO: 497932 - RNA, 64 nt, Homo Sapiens; identical to SEQ ID NO: 352338

SEQ ID NO: 497933 - RNA, 60 nt, Homo Sapiens
gcacaguggaagugggagccugguccuuccccugcccauggagagcucuuuaagggaucc

SEQ ID NO: 497934 - RNA, 60 nt, Homo Sapiens
ccagcccccaggugaggcuuccagcugggaccugcccagacaggcugagccugggcgugg

SEQ ID NO: 497935 - RNA, 60 nt, Homo Sapiens
agcccugcccgccucuccccccacgcucaaccugcccacuuguccaggccuggccucuuu

SEQ ID NO: 497936 - RNA, 60 nt, Homo Sapiens
gcucacucugccaugagaacaggacaccauccugcccagcccagacgggguugcuccugg

SEQ ID NO: 497937 - RNA, 60 nt, Homo Sapiens
cggcucuggcccacugagccaccgcgcccuccugcccacgggaggacaagcaauaacucu

SEQ ID NO: 497938 - RNA, 60 nt, Homo Sapiens
cuuaggaaccuucucccuucuugggucugcccugcccauacugagccugccaaagugccu

SEQ ID NO: 497939 - RNA, 60 nt, Homo Sapiens
gcuuugggaggccaaggcaggcguaaugggccugcccaauagcaggugugguggcucaug

SEQ ID NO: 497940 - RNA, 60 nt, Homo Sapiens
uagccguccauggcaccagccacugcccugccugcccacuuugugacugaaggggcacac

SEQ ID NO: 497941 - RNA, 60 nt, Homo Sapiens
ggugggaacuggaggagugguggcucuaucccugcccagaucuaggguuguccugccccu

SEQ ID NO: 497942 - RNA, 60 nt, Homo Sapiens
ggccgagggacagggugaggccaccaccuuccugcccacaccacacauuauagucaugug

SEQ ID NO: 497943 - RNA, 60 nt, Homo Sapiens
ccucauccccaucuucucagcagggcaaccccugcccaacgaugugacauggcuucuccu

SEQ ID NO: 497944 - RNA, 60 nt, Homo Sapiens
agauagaagaccuggacucccugcaagagcccugcccaggccuccugggaccacugccac

SEQ ID NO: 497945 - RNA, 60 nt, Homo Sapiens
aguggaugaugugggaguugccgaugccuuccugcccagagugaaaggagggugaggcug

SEQ ID NO: 497946 - RNA, 60 nt, Homo Sapiens
gagcuuuaccuuucccaagcccacagggaaccugcccagaaacuguccaagcucucagcc

SEQ ID NO: 497947 - RNA, 60 nt, Homo Sapiens
ccucgucaccacagggacucgaagaccgugccugcccagcaccccugcccuggcagccug

SEQ ID NO: 497948 - RNA, 60 nt, Homo Sapiens
ggacauguacauuuccccuugaacugucaaccugcccacgaccaccccggggucucuggg

SEQ ID NO: 497949 - RNA, 60 nt, Homo Sapiens
ccauuccuuucuaaguguguuuuauggcauccugcccacaaagaacucacagucugauua

SEQ ID NO: 497950 - RNA, 60 nt, Homo Sapiens
cacagguugacuaguaucuguggguaccucccugcccagguuauucacucacaagccacc

SEQ ID NO: 497951 - RNA, 56 nt, Homo Sapiens; identical to SEQ ID NO: 77590

SEQ ID NO: 497952 - RNA, 60 nt, Homo Sapiens
cacaacggucagcacuccucucccagccccccugcccacuguucucaauaaaaugugagu

SEQ ID NO: 497953 - RNA, 60 nt, Homo Sapiens
guuucugggccucacggugcagggaugccgccugcccaguggguuggggaccgaaaggac

SEQ ID NO: 497954 - RNA, 60 nt, Homo Sapiens
cccucucagaggaacgggguacccguccagccugcccagaauccccccggccaccucucu

SEQ ID NO: 497955 - RNA, 60 nt, Homo Sapiens
gcaaggggcaaggcugggccccuagcuuguccugcccauuccuccagguguugaucuuga

SEQ ID NO: 497956 - RNA, 60 nt, Homo Sapiens
ucccuggcaacaggaaccugggcagcuuauccugcccacagguaagccccugggagcauc

SEQ ID NO: 497957 - RNA, 60 nt, Homo Sapiens
uucccuguguggucccucccuucgugugccccugcccagccucuuggcaccuccuguuua

SEQ ID NO: 497958 - RNA, 60 nt, Homo Sapiens
ggguuucaaacaagacaaaaggcauuccucccugcccaaucccagugcagucaaggccaa

SEQ ID NO: 497959 - RNA, 60 nt, Homo Sapiens
gacccuuggccuugugagccaagucugguuccugcccaguauggcaccuuucccuucuga

SEQ ID NO: 497960 - RNA, 60 nt, Homo Sapiens
aacuguggacuuuugcuuccauaccaauuaccugcccaguccagccccacacccucauuu

SEQ ID NO: 497961 - RNA, 60 nt, Homo Sapiens
agggaccauggagcaguggccagugcucuuccugcccaccccuuuccuaugggcaaggcc

SEQ ID NO: 497962 - RNA, 60 nt, Homo Sapiens
cuucgcucacgccccagcgcgcgccuccuuccugcccaccccagacugcaauaacuggag

SEQ ID NO: 497963 - RNA, 60 nt, Homo Sapiens
acccugccaggucccgcgcaccaucccugcccugcccacgugguauugcugggcuccugg

SEQ ID NO: 497964 - RNA, 60 nt, Homo Sapiens
uccugaucagcccguaucaucugaggccugccugcccacccugccacccuccccucccuu

SEQ ID NO: 497965 - RNA, 60 nt, Homo Sapiens
uagaugccaacuggagggccagaccuguguccugcccauguccuccuugguggacguuuc

SEQ ID NO: 497966 - RNA, 60 nt, Homo Sapiens
uucuguuuacucagagcugcuagagaccauccugcccauccgaguucugagauugggacu

SEQ ID NO: 497967 - RNA, 60 nt, Homo Sapiens
cugcuaugauggugguauccgaggccuuucccugcccagucuggugccugccccacauug

SEQ ID NO: 497968 - RNA, 60 nt, Homo Sapiens
ggggauccaagaccugagauaaagcaacagccugcccagaucccucuguucauccuaucc

SEQ ID NO: 497969 - RNA, 60 nt, Homo Sapiens
aaguauuaccugcggcgacuauugcagacgccugcccaucccugccauugccuccucucc

SEQ ID NO: 497970 - RNA, 60 nt, Homo Sapiens
gcuccauuuuggaggcaggccauucucauaccugcccacaggcucaacuucaccaagaug

SEQ ID NO: 497971 - RNA, 60 nt, Homo Sapiens
cuuccucaccucucagccuccagaucccuuccugcccaucccuucccuacaaugcccacu

SEQ ID NO: 497972 - RNA, 60 nt, Homo Sapiens
ugugaguggcaaguggcuuaucuggagccaccugcccaagucuuacuaaaaugcagcugu

SEQ ID NO: 497973 - RNA, 60 nt, Homo Sapiens
aguucuggaaagguggccuugcauaguuuaccugcccacgugaaagaaagcacauccaaa

SEQ ID NO: 497974 - RNA, 60 nt, Homo Sapiens
ucccgcacccugcguuuaggggucaccucuccugcccagcacuuuaggaacacaguugga

SEQ ID NO: 497975 - RNA, 60 nt, Homo Sapiens
caguaguacaagcuccccucagccagccugccugcccagcgaggcccccagguucaaggu

SEQ ID NO: 497976 - RNA, 60 nt, Homo Sapiens
caccugguacagguagguggcgcucacguuccugcccaaaugcagcccaucggggaguca

SEQ ID NO: 497977 - RNA, 60 nt, Homo Sapiens
cagacuguggcuccuuccucuccuuaccguccugcccauauaauaccauccugcccauug

SEQ ID NO: 497978 - RNA, 60 nt, Homo Sapiens
guccuuaccguccugcccaucuaauaccauccugcccauuggagauggcauagagaagau

SEQ ID NO: 497979 - RNA, 60 nt, Homo Sapiens
gggacacucccccugcucucuccuucuccaccugcccacccugcaugggagagcuguccc

SEQ ID NO: 497980 - RNA, 60 nt, Homo Sapiens
uccugggcucucccagggaacucccaaagaccugcccaccugccucguccaggucucuau

SEQ ID NO: 497981 - RNA, 60 nt, Homo Sapiens
auacugacccauugaacccccccugugcuuccugcccaagcgcacacaagacgggaguca

SEQ ID NO: 497982 - RNA, 60 nt, Homo Sapiens
uggaggguccuggggacggccugcuggccuccugcccaggccucucuggccauugcagag

SEQ ID NO: 497983 - RNA, 60 nt, Homo Sapiens
agcccugagcucagcugcagagcuccuaccccugcccagcagccccaaggcuggggccac

SEQ ID NO: 497984 - RNA, 60 nt, Homo Sapiens
acauccagccuguggcuuuggagcccccagccugcccacucccgaguagagggcaucccg

SEQ ID NO: 497985 - RNA, 60 nt, Homo Sapiens
cuaggaggcagcggggauaggagauggaggccugcccagacugagaggccuaauagggca

SEQ ID NO: 497986 - RNA, 60 nt, Homo Sapiens
accaggucgguucccgaggccguccgccauccugcccacccccaccuccgcauccacccc

SEQ ID NO: 497987 - RNA, 60 nt, Homo Sapiens
aagggcuucgggggagugguuacccugcucccugcccagugacaagcccuccuuuccccu

SEQ ID NO: 497988 - RNA, 60 nt, Homo Sapiens
uuccccugggggcccuccuuuccccugcucccugcccagcuacggggcccuccuuucagc

SEQ ID NO: 497989 - RNA, 60 nt, Homo Sapiens
gaagggaaggccugcagaggccuccagcccccugcccacauuguccuggugcccaggagc

SEQ ID NO: 497990 - RNA, 60 nt, Homo Sapiens
cccuccuuugccuguguccugugugggugcccugcccaccagcagugaagguucuucucu

SEQ ID NO: 497991 - RNA, 60 nt, Homo Sapiens
agaguggaucucacagcccagugcuaaccaccugcccagaaagugagggaaaaacguuag

SEQ ID NO: 497992 - RNA, 60 nt, Homo Sapiens
ggccguggugacucacgggcgcuccccucgccugcccaggcaggaacccaagccaccccg

SEQ ID NO: 497993 - RNA, 60 nt, Homo Sapiens
ccgccucagccugccaccuccauccaccguccugcccacgggcugucccuguggacccgc

SEQ ID NO: 497994 - RNA, 60 nt, Homo Sapiens
acuggguucucuccuucuucuuccugcuguccugcccaagaacugagggucuccccggcc

SEQ ID NO: 497995 - RNA, 60 nt, Homo Sapiens
cugcccugccagagacagacccaugcgcugccugcccaccgugccccuuuguccccaugu

SEQ ID NO: 497996 - RNA, 60 nt, Homo Sapiens
caaugucuaccucugaagccuccuucccugccugcccaccccuccaugcuccacgcaggc

SEQ ID NO: 497997 - RNA, 60 nt, Homo Sapiens
ugagacuauuugcugugggcucuccuccagccugcccagggcccacccagaugccucugg

SEQ ID NO: 497998 - RNA, 60 nt, Homo Sapiens
cccuucccagucagggcuccuccugcccagccugcccaucccgggcacaagaaaccagag

SEQ ID NO: 497999 - RNA, 60 nt, Homo Sapiens
cugcccauccccuucccaguaaaccagaguccugcccagcguagucuuuccgggcacaag

SEQ ID NO: 498000 - RNA, 60 nt, Homo Sapiens
cagcuguggcauccacuguggcaucuccguccugcccaccuucuuaagaggcgagaugga

SEQ ID NO: 498001 - RNA, 60 nt, Homo Sapiens
caauuuaaaaugauccauggccacagggcuccugcccaggggcuugucaccuuccccucc

SEQ ID NO: 498002 - RNA, 60 nt, Homo Sapiens
ccauaccgggccucuggcccagaccuaagcccugcccacaaagacuaauggaugccagug

SEQ ID NO: 498003 - RNA, 60 nt, Homo Sapiens
caaguacagccacuguaaauaacccucgucccugcccaggaacccagacuggacuucagu

SEQ ID NO: 498004 - RNA, 60 nt, Homo Sapiens
ccuacugccucccgcugccggcacuccuccccugcccaaguuugccuccugaggcgcagc

SEQ ID NO: 498005 - RNA, 60 nt, Homo Sapiens
cuggggcaccuuugccuccuugguccagggccugcccaggcggcgcugcucagcuugggc

SEQ ID NO: 498006 - RNA, 60 nt, Homo Sapiens
gagcggacccuccucuuuggcguuguagggccugcccaugcagcugccccauucuuuuaa

SEQ ID NO: 498007 - RNA, 60 nt, Homo Sapiens
ugcaacucccccccaacaaucagaacccugccugcccaccuuuuuaggccucacucccau

SEQ ID NO: 498008 - RNA, 60 nt, Homo Sapiens
uggccuccuggcccgcccucggacgccugcccugcccaggcugccgggcacaugcccggg

SEQ ID NO: 498009 - RNA, 60 nt, Homo Sapiens
cuaccagcuccuccagcccucacauaguguccugcccacccggccggccggaccucugag

SEQ ID NO: 498010 - RNA, 60 nt, Homo Sapiens
cagggugaggaaagggcucccucacccgccccugcccagauguugcacgggagaacuuuc

SEQ ID NO: 498011 - RNA, 60 nt, Homo Sapiens
ugcccgugugccuacccacuugcugcgggaccugcccagcaaucaaguaucugagccaga

SEQ ID NO: 498012 - RNA, 60 nt, Homo Sapiens
ugggaaguagagauguggcggcuuucccacccugcccacagcaggcccuccugcccagcu

SEQ ID NO: 498013 - RNA, 60 nt, Homo Sapiens
ggcuuucccacccugcccacagcaggcccuccugcccagcugcucuugucagcccucugg

SEQ ID NO: 498014 - RNA, 60 nt, Homo Sapiens
ugcccagagugaccaagcagcaccagcaggccugcccaggaugcugaaagcagauuucuu

SEQ ID NO: 498015 - RNA, 60 nt, Homo Sapiens
uugccccacuggugagaggaggaccuugugccugcccagagccugcaggacagcacgccu

SEQ ID NO: 498016 - RNA, 60 nt, Homo Sapiens
ugcugcuugcucagaaacaacccgugcaucccugcccauggauucugcaggaccuagaag

SEQ ID NO: 498017 - RNA, 60 nt, Homo Sapiens
cucaggcccaugagguauggacuccagaccccugcccaggccugccugggggcuaugugc

SEQ ID NO: 498018 - RNA, 60 nt, Homo Sapiens
accuggcucaucccucaggcuggugugucaccugcccaccgcagaggccaggaggggacc

SEQ ID NO: 498019 - RNA, 60 nt, Homo Sapiens
cuauccugucuguccccaccccagcuguccccugcccagggagcuggcauaaaagcacga

SEQ ID NO: 498020 - RNA, 60 nt, Homo Sapiens
gcugcuugagaacagagacugcuaccccauccugcccaugcaggcaggcucuugccagcc

SEQ ID NO: 498021 - RNA, 60 nt, Homo Sapiens
agagggcagacgccacccuggacugcucucccugcccagcugggccucucuggccuauuc

SEQ ID NO: 498022 - RNA, 60 nt, Homo Sapiens
ccuguccccgggacugagcugccaugccagccugcccacagcagccuccuagaguuagca

SEQ ID NO: 498023 - RNA, 60 nt, Homo Sapiens
aguagugacacucaggauccaaaagcuagcccugcccaccccagccccuggaccugcuua

SEQ ID NO: 498024 - RNA, 60 nt, Homo Sapiens
gagcucgccugcccugcuuggcucugaggaccugcccagcgcucaaagggaacggaagcc

SEQ ID NO: 498025 - RNA, 60 nt, Homo Sapiens
acuugcccuagcaugaggcucugagagccaccugcccaccaaucuggugaggauaauggu

SEQ ID NO: 498026 - RNA, 60 nt, Homo Sapiens
cccuccauuccggaccccaugggcccagccccugcccaucuaguugguuuggggacccug

SEQ ID NO: 498027 - RNA, 60 nt, Homo Sapiens
cacccugugacugagccuguguccugucugccugcccagccaugcuccaucggcugugag

SEQ ID NO: 498028 - RNA, 60 nt, Homo Sapiens
uggcagccgccaggcgagcaggcugcuuucccugcccagucaugcaccucccccucuggg

SEQ ID NO: 498029 - RNA, 60 nt, Homo Sapiens
cuggcaaucagggccgcaguguguucugcgccugcccagagcugacuccugauuuaaccg

SEQ ID NO: 498030 - RNA, 60 nt, Homo Sapiens
ucuuccuucgugagcuggccccugauccucccugcccaagguggauccuugccaggcguc

SEQ ID NO: 498031 - RNA, 60 nt, Homo Sapiens
aggaauggguccaggugugggcaagcccucccugcccagagcacagccucccucccucca

SEQ ID NO: 498032 - RNA, 60 nt, Homo Sapiens
aaagcuugacaagacacucgaaaaaagucaccugcccaauaagcccacaagaucugagug

SEQ ID NO: 498033 - RNA, 60 nt, Homo Sapiens
aaacaccgagugaggccauagagaaagucaccugcccaagagcccccagcuggaaguuaa

SEQ ID NO: 498034 - RNA, 60 nt, Homo Sapiens
accugacccuggcgugugcucacaauuccaccugcccaggcugcagacgcagggggacug

SEQ ID NO: 498035 - RNA, 60 nt, Homo Sapiens
ccagacagacagcaccugcacucccccaacccugcccaagggauggcucuggccucgguc

SEQ ID NO: 498036 - RNA, 60 nt, Homo Sapiens
cucccuccacuccucucaacauccuccagcccugcccaccuaucagacgugcucccuccc

SEQ ID NO: 498037 - RNA, 60 nt, Homo Sapiens
caccccucagaugcguucgccccuggugcuccugcccagcgacccugaccguguacauag

SEQ ID NO: 498038 - RNA, 60 nt, Homo Sapiens
cugccccucuguucucuccccucacauccuccugcccagcuccucacauacccacacauu

SEQ ID NO: 498039 - RNA, 60 nt, Homo Sapiens
gcguuccuucgcacacugugauuuugcccuccugcccacgcagaccugcagcgggcaaag

SEQ ID NO: 498040 - RNA, 60 nt, Homo Sapiens
gguuggcuucuucccaggccuugcaugggcccugcccacaagcacacccucaggccgagg

SEQ ID NO: 498041 - RNA, 60 nt, Homo Sapiens
cagugggguuugaagcagaguucagggaacccugcccaagguccuccuguucagacauuc

SEQ ID NO: 498042 - RNA, 60 nt, Homo Sapiens
gacugggccgggcccagggccucuggcuucccugcccaauccucccuggagaagggacau

SEQ ID NO: 498043 - RNA, 60 nt, Homo Sapiens
accacuagcuaagcaagccaggagaagaccccugcccaaguggcucuugggacaacgugc

SEQ ID NO: 498044 - RNA, 60 nt, Homo Sapiens
cagguguggaccggccgcagcccccacugaccugcccauguccagagggacuggacagcc

SEQ ID NO: 498045 - RNA, 57 nt, Homo Sapiens; identical to SEQ ID NO: 77684

SEQ ID NO: 498046 - RNA, 60 nt, Homo Sapiens
ucagaguggcgugagcugcccggcgccugcccugcccaagugaccagggaagugugugug

SEQ ID NO: 498047 - RNA, 60 nt, Homo Sapiens
guggccagcgccagggcccaggccauguggccugcccagccucaaugucacuugguggcg

SEQ ID NO: 498048 - RNA, 60 nt, Homo Sapiens
ugcaucuuuugcagcccacuugucucccugccugcccaucugucuuucugucuguuuacc

SEQ ID NO: 498049 - RNA, 60 nt, Homo Sapiens
ccucucuugagggagcagcaucucccaccuccugcccaucaccccgaagcccaccugcaa

SEQ ID NO: 498050 - RNA, 60 nt, Homo Sapiens
ucacucucucccuugaugauccacaucgucccugcccaucagaggccugaagcggaagca

SEQ ID NO: 498051 - RNA, 60 nt, Homo Sapiens
uuggggugguggcaccagagagggggguacccugcccaccgccacaggcauaugguggag

SEQ ID NO: 498052 - RNA, 60 nt, Homo Sapiens
cuggucauuugcuguccgcucagaagcagcccugcccagcugggaaggucucugaucaca

SEQ ID NO: 498053 - RNA, 60 nt, Homo Sapiens
gcagguggcucuuacagcucaggcacacacccugcccauugcagggaagugaaagguccc

SEQ ID NO: 498054 - RNA, 60 nt, Homo Sapiens
ugaacacagcggcugccaguugggugcacaccugcccaggcauaauccagugggggugac

SEQ ID NO: 498055 - RNA, 60 nt, Homo Sapiens
agacuuuuauuuauuuuuuuaucaguaauuccugcccagacauugguuauaauaacaguu

SEQ ID NO: 498056 - RNA, 60 nt, Homo Sapiens
gagaggcuuggucggucuccaccccucaguccugcccacaacaucuggagauacaggccc

SEQ ID NO: 498057 - RNA, 60 nt, Homo Sapiens
gugcucuaaacccugcucagcccucccccuccugcccacuaggcccugcugaaguccaga

SEQ ID NO: 498058 - RNA, 60 nt, Homo Sapiens
gcugcauucccuggagacucacugcaaguuccugcccaggaggcugagggcaccccaucc

SEQ ID NO: 498059 - RNA, 60 nt, Homo Sapiens
gucguacacggagacuggcagcgccgacguccugcccaccacgcacucccggagagcacg

SEQ ID NO: 498060 - RNA, 60 nt, Homo Sapiens
gaagcagcacgugugagcugggccaggagcccugcccaccuccgugcagcugaccugccc

SEQ ID NO: 498061 - RNA, 60 nt, Homo Sapiens
augcugauacacacuguuguuaggccugcaccugcccauccagaaagcagcagcugccuu

SEQ ID NO: 498062 - RNA, 60 nt, Homo Sapiens
cuccggcucacacacgcccugccugcccucccugcccagcuguaaggaccgggggucucc

SEQ ID NO: 498063 - RNA, 60 nt, Homo Sapiens
auaaacagacccccuucugcuccgcuuccuccugcccagccaggcaacacccucaaccgg

SEQ ID NO: 498064 - RNA, 60 nt, Homo Sapiens
caaaugcugagcccugauccaaaguugucuccugcccaugagcaccacagucaggccuug

SEQ ID NO: 498065 - RNA, 60 nt, Homo Sapiens
uuagcccacaauucuccauuucacuugaccccugcccaccucuccaaccuaacuggcuua

SEQ ID NO: 498066 - RNA, 60 nt, Homo Sapiens
uccaggccucucccaccucauccuuggggcccugcccacccacacccugauagcacaauc

SEQ ID NO: 498067 - RNA, 60 nt, Homo Sapiens
ccgaggcagggcuggggcuucuccgcugccccugcccaccaccgaggccaccgccccccc

SEQ ID NO: 498068 - RNA, 60 nt, Homo Sapiens
gcccuggcaccagagacgcccucgagucgcccugcccagaaccaguccucccagggaguc

SEQ ID NO: 498069 - RNA, 60 nt, Homo Sapiens
gcacucuuugguucucugcugagaagagccccugcccacuacaaacaaaccaaccagagg

SEQ ID NO: 498070 - RNA, 60 nt, Homo Sapiens
cccggccagaucccuggagcuugaauucugccugcccacccgcuuguugaagaugaauuc

SEQ ID NO: 498071 - RNA, 60 nt, Homo Sapiens
uggccuauaccccagccgugccugccccugccugcccaucugcugcaggcauggcugucu

SEQ ID NO: 498072 - RNA, 60 nt, Homo Sapiens
ccuucugugaccccgcugugguaaguccagccugcccagggcugcugagggcugccucuu

SEQ ID NO: 498073 - RNA, 60 nt, Homo Sapiens
uggcucaggcuguaaaaguagcugagccauccugcccauuccuggagguccuacagguga

SEQ ID NO: 498074 - RNA, 60 nt, Homo Sapiens
uauagacguauccaaugggaaaacagcggaccugcccagagcagggaggugucguggaac

SEQ ID NO: 498075 - RNA, 60 nt, Homo Sapiens
caucgucucaacaccaccaaguuuguaggaccugcccaaguucuaguaguauucaaaacu

SEQ ID NO: 498076 - RNA, 60 nt, Homo Sapiens
cuugccugguuccauauggcuccuuccagcccugcccaccaagugcagcucccacuuucc

SEQ ID NO: 498077 - RNA, 60 nt, Homo Sapiens
ugcccaccaagugcagcucccacuuuccauccugcccauacgccccucuucccccgacau

SEQ ID NO: 498078 - RNA, 60 nt, Homo Sapiens
cagagcuucagugagguuuccgagccucucccugcccauccucaccacugaggccacgac

SEQ ID NO: 498079 - RNA, 60 nt, Homo Sapiens
accgcucuccaaggugugcuagcagugggcccugcccaacuucaggcagaacagggaggc

SEQ ID NO: 498080 - RNA, 60 nt, Homo Sapiens
ggccugggagucgggcggccccggucaggcccugcccagagagcuccugguuccugaacu

SEQ ID NO: 498081 - RNA, 60 nt, Homo Sapiens
acccacccgaggcucugcccaccgccuggaccugcccaccccugaaagacuggccccugg

SEQ ID NO: 498082 - RNA, 60 nt, Homo Sapiens
guaggccuggcaugagggguuggcucagcaccugcccaggagguuccuggcgcccugagg

SEQ ID NO: 498083 - RNA, 60 nt, Homo Sapiens
cccucccccaacaagaucucgagagggcuaccugcccagccagauggccugccuuuggcu

SEQ ID NO: 498084 - RNA, 60 nt, Homo Sapiens
agccagggcuacacuacaaaagauguuagcccugcccaaccccugguauguuuuucuuau

SEQ ID NO: 498085 - RNA, 60 nt, Homo Sapiens
accaagcaagcagcaagcaacuacccucggccugcccaccagacagcccagagccugccg

SEQ ID NO: 498086 - RNA, 60 nt, Homo Sapiens
acccaggcccgccucccccucucaggccacccugcccaggguuuuguaccagucccugcu

SEQ ID NO: 498087 - RNA, 60 nt, Homo Sapiens
cuuaccgagcaaggugggugagcggugagcccugcccacugggccaagcgcuggccccuc

SEQ ID NO: 498088 - RNA, 60 nt, Homo Sapiens
gaggacagagugcccuggggcauccaccuuccugcccaggggacguggcgcugucggugu

SEQ ID NO: 498089 - RNA, 60 nt, Homo Sapiens
gccccuggcccugccucacugugaccugcuccugcccacgugcagcaccugucaccuuuu

SEQ ID NO: 498090 - RNA, 60 nt, Homo Sapiens
ggcugcucucggacuccugaucucaggugaccugcccaccucggccucccgaagugcugg

SEQ ID NO: 498091 - RNA, 60 nt, Homo Sapiens
gcugggcauaagcuucacaggacgggagaaccugcccaugguggacugucguucuccaca

SEQ ID NO: 498092 - RNA, 60 nt, Homo Sapiens
ucuccgagccccaggcagcggugauucagcccugcccaaccugauucugaugacugcgga

SEQ ID NO: 498093 - RNA, 60 nt, Homo Sapiens
gggcgccugcugagcacuuccgccccucacccugcccagccccugccaugagcucugggc

SEQ ID NO: 498094 - RNA, 60 nt, Homo Sapiens
uguccccucucuccacacccagccccugcuccugcccaggcugcccugcccagcgccuca

SEQ ID NO: 498095 - RNA, 60 nt, Homo Sapiens
acacccagccccugcuccugcccaggcugcccugcccagcgccucaucagccucugccuu

SEQ ID NO: 498096 - RNA, 60 nt, Homo Sapiens
cuuccccaucaggcugggcucuggcagggaccugcccaggauggagaugagagaggguga

SEQ ID NO: 498097 - RNA, 50 nt, Homo Sapiens; identical to SEQ ID NO: 77736

SEQ ID NO: 498098 - RNA, 60 nt, Homo Sapiens
ccacgcacgccccgugcuguguuccugggcccugcccauggccucaauaaacucucugcu

SEQ ID NO: 498099 - RNA, 60 nt, Homo Sapiens
ugggaaucugaggcagaggauucacccccaccugcccacuaggugcuacccggagcccca

SEQ ID NO: 498100 - RNA, 60 nt, Homo Sapiens
auaggccucugcuaccugccuugggcaaguccugcccaccauccuggccccaccagggcc

SEQ ID NO: 498101 - RNA, 60 nt, Homo Sapiens
aacuguaucugauuucacuaccccacccucccugcccaucugcacuggaguugucucuua

SEQ ID NO: 498102 - RNA, 60 nt, Homo Sapiens
uggcacugcacuggaguuguacagugggagccugcccaccgggaggagcgucucaaguga

SEQ ID NO: 498103 - RNA, 60 nt, Homo Sapiens
cacuggccuucccuccugcccccuccucagccugcccacggacuugaggggggucauauu

SEQ ID NO: 498104 - RNA, 60 nt, Homo Sapiens
cucucugccuaccugccugagccauguucaccugcccacuuguccccugcugccugccca

SEQ ID NO: 498105 - RNA, 60 nt, Homo Sapiens
cauguucaccugcccacuuguccccugcugccugcccaaacaccccaccauuggccuguc

SEQ ID NO: 498106 - RNA, 64 nt, Homo Sapiens; identical to SEQ ID NO: 272692

SEQ ID NO: 498107 - RNA, 64 nt, Homo Sapiens; identical to SEQ ID NO: 272693

SEQ ID NO: 498108 - RNA, 64 nt, Homo Sapiens; identical to SEQ ID NO: 272694

SEQ ID NO: 498109 - RNA, 64 nt, Homo Sapiens; identical to SEQ ID NO: 272695

SEQ ID NO: 498110 - RNA, 57 nt, Homo Sapiens; identical to SEQ ID NO: 272696

SEQ ID NO: 498111 - RNA, 64 nt, Homo Sapiens; identical to SEQ ID NO: 272697

SEQ ID NO: 498112 - RNA, 64 nt, Homo Sapiens; identical to SEQ ID NO: 272698

SEQ ID NO: 498113 - RNA, 64 nt, Homo Sapiens; identical to SEQ ID NO: 272699

SEQ ID NO: 498114 - RNA, 64 nt, Homo Sapiens; identical to SEQ ID NO: 272700

SEQ ID NO: 498115 - RNA, 64 nt, Homo Sapiens; identical to SEQ ID NO: 272701

SEQ ID NO: 498116 - RNA, 64 nt, Homo Sapiens; identical to SEQ ID NO: 272702

SEQ ID NO: 498117 - RNA, 64 nt, Homo Sapiens; identical to SEQ ID NO: 272703

SEQ ID NO: 498118 - RNA, 64 nt, Homo Sapiens; identical to SEQ ID NO: 272704

SEQ ID NO: 498119 - RNA, 64 nt, Homo Sapiens; identical to SEQ ID NO: 272705

SEQ ID NO: 498120 - RNA, 64 nt, Homo Sapiens; identical to SEQ ID NO: 272706

SEQ ID NO: 498121 - RNA, 64 nt, Homo Sapiens; identical to SEQ ID NO: 272707

SEQ ID NO: 498122 - RNA, 64 nt, Homo Sapiens; identical to SEQ ID NO: 272708

SEQ ID NO: 498123 - RNA, 64 nt, Homo Sapiens; identical to SEQ ID NO: 272709

SEQ ID NO: 498124 - RNA, 64 nt, Homo Sapiens; identical to SEQ ID NO: 272710

SEQ ID NO: 498125 - RNA, 64 nt, Homo Sapiens; identical to SEQ ID NO: 272711

SEQ ID NO: 498126 - RNA, 64 nt, Homo Sapiens; identical to SEQ ID NO: 272712

SEQ ID NO: 498127 - RNA, 64 nt, Homo Sapiens; identical to SEQ ID NO: 272713

SEQ ID NO: 498128 - RNA, 64 nt, Homo Sapiens; identical to SEQ ID NO: 61300

SEQ ID NO: 498129 - RNA, 64 nt, Homo Sapiens; identical to SEQ ID NO: 61301

SEQ ID NO: 498130 - RNA, 64 nt, Homo Sapiens; identical to SEQ ID NO: 61302

SEQ ID NO: 498131 - RNA, 64 nt, Homo Sapiens; identical to SEQ ID NO: 61303

SEQ ID NO: 498132 - RNA, 64 nt, Homo Sapiens; identical to SEQ ID NO: 61304

SEQ ID NO: 498133 - RNA, 64 nt, Homo Sapiens; identical to SEQ ID NO: 61305

SEQ ID NO: 498134 - RNA, 64 nt, Homo Sapiens; identical to SEQ ID NO: 61306

SEQ ID NO: 498135 - RNA, 64 nt, Homo Sapiens; identical to SEQ ID NO: 61307

SEQ ID NO: 498136 - RNA, 64 nt, Homo Sapiens; identical to SEQ ID NO: 61308

SEQ ID NO: 498137 - RNA, 64 nt, Homo Sapiens; identical to SEQ ID NO: 61309

SEQ ID NO: 498138 - RNA, 64 nt, Homo Sapiens; identical to SEQ ID NO: 61310

SEQ ID NO: 498139 - RNA, 56 nt, Homo Sapiens; identical to SEQ ID NO: 61311

SEQ ID NO: 498140 - RNA, 64 nt, Homo Sapiens; identical to SEQ ID NO: 61312

SEQ ID NO: 498141 - RNA, 64 nt, Homo Sapiens; identical to SEQ ID NO: 61313

SEQ ID NO: 498142 - RNA, 64 nt, Homo Sapiens; identical to SEQ ID NO: 61314

SEQ ID NO: 498143 - RNA, 64 nt, Homo Sapiens; identical to SEQ ID NO: 61315

SEQ ID NO: 498144 - RNA, 64 nt, Homo Sapiens; identical to SEQ ID NO: 61316

SEQ ID NO: 498145 - RNA, 64 nt, Homo Sapiens; identical to SEQ ID NO: 61317

SEQ ID NO: 498146 - RNA, 64 nt, Homo Sapiens; identical to SEQ ID NO: 158971

SEQ ID NO: 498147 - RNA, 64 nt, Homo Sapiens; identical to SEQ ID NO: 158972

SEQ ID NO: 498148 - RNA, 64 nt, Homo Sapiens; identical to SEQ ID NO: 158973

SEQ ID NO: 498149 - RNA, 64 nt, Homo Sapiens; identical to SEQ ID NO: 158974

SEQ ID NO: 498150 - RNA, 64 nt, Homo Sapiens; identical to SEQ ID NO: 158975

SEQ ID NO: 498151 - RNA, 64 nt, Homo Sapiens; identical to SEQ ID NO: 158976

SEQ ID NO: 498152 - RNA, 64 nt, Homo Sapiens; identical to SEQ ID NO: 158977

SEQ ID NO: 498153 - RNA, 64 nt, Homo Sapiens; identical to SEQ ID NO: 158978

SEQ ID NO: 498154 - RNA, 64 nt, Homo Sapiens; identical to SEQ ID NO: 158979

SEQ ID NO: 498155 - RNA, 64 nt, Homo Sapiens; identical to SEQ ID NO: 158980

SEQ ID NO: 498156 - RNA, 64 nt, Homo Sapiens; identical to SEQ ID NO: 158981

SEQ ID NO: 498157 - RNA, 64 nt, Homo Sapiens; identical to SEQ ID NO: 158982

SEQ ID NO: 498158 - RNA, 64 nt, Homo Sapiens; identical to SEQ ID NO: 158983

SEQ ID NO: 498159 - RNA, 64 nt, Homo Sapiens; identical to SEQ ID NO: 158984

SEQ ID NO: 498160 - RNA, 64 nt, Homo Sapiens; identical to SEQ ID NO: 158985

SEQ ID NO: 498161 - RNA, 64 nt, Homo Sapiens; identical to SEQ ID NO: 158986

SEQ ID NO: 498162 - RNA, 64 nt, Homo Sapiens; identical to SEQ ID NO: 158987

SEQ ID NO: 498163 - RNA, 64 nt, Homo Sapiens; identical to SEQ ID NO: 158988

SEQ ID NO: 498164 - RNA, 64 nt, Homo Sapiens; identical to SEQ ID NO: 158989

SEQ ID NO: 498165 - RNA, 64 nt, Homo Sapiens; identical to SEQ ID NO: 158990

SEQ ID NO: 498166 - RNA, 64 nt, Homo Sapiens; identical to SEQ ID NO: 158991

SEQ ID NO: 498167 - RNA, 64 nt, Homo Sapiens; identical to SEQ ID NO: 158992

SEQ ID NO: 498168 - RNA, 64 nt, Homo Sapiens; identical to SEQ ID NO: 158993

SEQ ID NO: 498169 - RNA, 64 nt, Homo Sapiens; identical to SEQ ID NO: 158994

SEQ ID NO: 498170 - RNA, 64 nt, Homo Sapiens; identical to SEQ ID NO: 158995

SEQ ID NO: 498171 - RNA, 64 nt, Homo Sapiens; identical to SEQ ID NO: 158996

SEQ ID NO: 498172 - RNA, 64 nt, Homo Sapiens; identical to SEQ ID NO: 158997

SEQ ID NO: 498173 - RNA, 64 nt, Homo Sapiens; identical to SEQ ID NO: 158998

SEQ ID NO: 498174 - RNA, 64 nt, Homo Sapiens; identical to SEQ ID NO: 158999

SEQ ID NO: 498175 - RNA, 64 nt, Homo Sapiens; identical to SEQ ID NO: 159000

SEQ ID NO: 498176 - RNA, 64 nt, Homo Sapiens; identical to SEQ ID NO: 159001

SEQ ID NO: 498177 - RNA, 64 nt, Homo Sapiens; identical to SEQ ID NO: 159002

SEQ ID NO: 498178 - RNA, 64 nt, Homo Sapiens; identical to SEQ ID NO: 159003

SEQ ID NO: 498179 - RNA, 64 nt, Homo Sapiens; identical to SEQ ID NO: 159004

SEQ ID NO: 498180 - RNA, 64 nt, Homo Sapiens; identical to SEQ ID NO: 159005

SEQ ID NO: 498181 - RNA, 64 nt, Homo Sapiens; identical to SEQ ID NO: 159006

SEQ ID NO: 498182 - RNA, 64 nt, Homo Sapiens; identical to SEQ ID NO: 159007

SEQ ID NO: 498183 - RNA, 64 nt, Homo Sapiens; identical to SEQ ID NO: 159008

SEQ ID NO: 498184 - RNA, 63 nt, Homo Sapiens
cugggaacagucacaagggauggcaguguaccucuagaucaaccaccugcucuuuggcuaagg

SEQ ID NO: 498185 - RNA, 63 nt, Homo Sapiens
gucacagcacugccuacaccucaaaaagaggcgcuagaucaaggcacagaggacaaaguuaau

SEQ ID NO: 498186 - RNA, 63 nt, Homo Sapiens
uuauaccuuccguaugacgugcuuuaauguguucuagaucaauuuuuaaagggggaggggaag

SEQ ID NO: 498187 - RNA, 63 nt, Homo Sapiens
auaucuuagcuuuuagcacucaaaguuuaaguucuagaucacaagaaagaugggguuguuuuc

SEQ ID NO: 498188 - RNA, 63 nt, Homo Sapiens
cucugagagucuagauucucuggcuguaaggcucuagaucauaaggcuucaaaauguuaucuu

SEQ ID NO: 498189 - RNA, 63 nt, Homo Sapiens
cucuaagaucuuagauucucugugucuaagauucuagaucagaugcuccaagauucuagauga

SEQ ID NO: 498190 - RNA, 64 nt, Homo Sapiens
cgucaaaagccgugacaauuccuacaaaauuuguuuggcuuaaacacaccuuuuugaaaucugc

SEQ ID NO: 498191 - RNA, 64 nt, Homo Sapiens
uguuucaucuuuaaguagcauucaaaaaaaaaaauuggcuuaacuuggcucuagaucuacauuc

SEQ ID NO: 498192 - RNA, 64 nt, Homo Sapiens
uguauauuauaugccacccgaacauccuguaacauuggcuuaccaagaauaggaauaguuccac

SEQ ID NO: 498193 - RNA, 64 nt, Homo Sapiens
uugacuggcuacuaagggaccuguagcuacuaacuuggcuuacguguaauugugugccugacgg

SEQ ID NO: 498194 - RNA, 64 nt, Homo Sapiens
gcaaccuccaccuccugggugcaguggcacuaucuuggcuuacuucuuguguccaggcuggagu

SEQ ID NO: 498195 - RNA, 64 nt, Homo Sapiens
agguuugucuuuuguuuuugucacuuugcugugguuggcuuaagccaaaugguuuaguaguucu

SEQ ID NO: 498196 - RNA, 64 nt, Homo Sapiens
uuuaaaaaauaaaaaauaagcuuaccuuggauucuuggcuuagaguagagguuuuuuuuaaguu

SEQ ID NO: 498197 - RNA, 64 nt, Homo Sapiens
aagaaaucacagaagcauuucucaccaauacucuuuggcuuaaaauguucagcagaauugggca

SEQ ID NO: 498198 - RNA, 64 nt, Homo Sapiens
cccugggagagaaaaacaugcuaaaggagguaucuuggcuuaauaauuccuuauagccaauauc

SEQ ID NO: 498199 - RNA, 64 nt, Homo Sapiens
agcuuuccuucauaaaauagaaagaaaaaaacauuuggcuuauuuuucacuguagcuagucuuu

SEQ ID NO: 498200 - RNA, 64 nt, Homo Sapiens
ggggagagauuuuucuuuuaagcccugcucuuucucugagaaccaaaagaugccuugaauauuu

SEQ ID NO: 498201 - RNA, 64 nt, Homo Sapiens
acaggccagccuuggcacgaggggggccagggguucugagaagcgcugcccugugagagccacg

SEQ ID NO: 498202 - RNA, 64 nt, Homo Sapiens
ccuugggagaggccaaagagccauucuagcaugaucugagaaaaccuuccugcagaggccagaa

SEQ ID NO: 498203 - RNA, 64 nt, Homo Sapiens
cuaauuuuugccacgugucacaacuuuuccagucucugagaaggucccagccuuucucaaauau

SEQ ID NO: 498204 - RNA, 64 nt, Homo Sapiens
ucacaauuucuuaccagauauugcccagggaaauucugagaaaugauucucuggucacagguuu

SEQ ID NO: 498205 - RNA, 64 nt, Homo Sapiens
acacuuguaacugcaucuuuaugaaugcuccuguucugagaagcaagccagaguaugaagugga

SEQ ID NO: 498206 - RNA, 64 nt, Homo Sapiens
uggcaaagacuuacugguugguguccugagugggucugagaauuguuaagccauguagagacuc

SEQ ID NO: 498207 - RNA, 64 nt, Homo Sapiens
cucaauucacuguagcaacuagaaaauaauagcuucugagaaaguauaccugccaaucacccaa

SEQ ID NO: 498208 - RNA, 64 nt, Homo Sapiens
ugucuucucagaaaccaccaaccuugaagugucuucugagaaaccaccaggcuugaagguaaug

SEQ ID NO: 498209 - RNA, 64 nt, Homo Sapiens
aaacaaggauggagaaaaaucuaggacagugucuucugagaaaccaccaggcuugaagguaaug

SEQ ID NO: 498210 - RNA, 64 nt, Homo Sapiens
gggaggugaggagcaacucugcccagccgccccgucugagaagugaggagacccuccgccuggc

SEQ ID NO: 498211 - RNA, 64 nt, Homo Sapiens
aaguaaggagccccucugcccagcagccgccccgucugagaagugaggagccccucugcccagc

SEQ ID NO: 498212 - RNA, 53 nt, Homo Sapiens
gucaagaaucauggaaguaaacaucugagaaaccuguugaagauuauuucauu

SEQ ID NO: 498213 - RNA, 64 nt, Homo Sapiens
aaacucuucaguuaauucuuagauacacuaaaaaucugagaaacucuacauguaacuauuucuu

SEQ ID NO: 498214 - RNA, 64 nt, Homo Sapiens
cagucucuucccugacagggcagcucagggaacuucugagaaguuaucugcagagagccccacc

SEQ ID NO: 498215 - RNA, 64 nt, Homo Sapiens
gagcccucauccugcaggcagagccccucagugcucugagaaaccugcccugaacucaccgccu

SEQ ID NO: 498216 - RNA, 64 nt, Homo Sapiens
uucuucagauucauugagaggggcucuuagaaacucugagaauuacaaaaagccaggucuuagc

SEQ ID NO: 498217 - RNA, 64 nt, Homo Sapiens
aguucaaggcauaugcagaguuuucacuuugaugucugagaaucuacuaccugacgggaggcac

SEQ ID NO: 498218 - RNA, 64 nt, Homo Sapiens
auagacacaucggcuguucacacguuccccgcaaucugagaacgaacaggaauggagagaggac

SEQ ID NO: 498219 - RNA, 64 nt, Homo Sapiens
cugcucugguugaccugggcugguuuucccugucucugagaacuugagaccuagcuccgaguug

SEQ ID NO: 498220 - RNA, 64 nt, Homo Sapiens
gagcuucuaguaauugaacccgaauguuuggccuucugagaaaaacagugucaucuaaauauuc

SEQ ID NO: 498221 - RNA, 64 nt, Homo Sapiens
gguacucucaguguguucuguuuucagcugaggcucugagaacuguaaugugcauucaggugaa

SEQ ID NO: 498222 - RNA, 64 nt, Homo Sapiens
gugucccucuucagguucccccaauauucauguuucugagaauugucccaucucccagcgacuu

SEQ ID NO: 498223 - RNA, 64 nt, Homo Sapiens
agcuuaauaacaacacuuauugcaccugucucucucugagaacacggugugucucgacacguac

SEQ ID NO: 498224 - RNA, 64 nt, Homo Sapiens
uuguuuagaauuacaaaauaguuuuuaaauauugucugagaaaagccaaaguuaaugcaaccua

SEQ ID NO: 498225 - RNA, 64 nt, Homo Sapiens
caaauuuacaucaaagauaccugaaguguugguaucugagaauaucugucacuccucuuaucug

SEQ ID NO: 498226 - RNA, 64 nt, Homo Sapiens
uguugguaucugagaauaucugucacuccucuuaucugagaagugaccuuuuauuuuuaagaug

SEQ ID NO: 498227 - RNA, 64 nt, Homo Sapiens
ccucuucuucccccaccccucagaagguuuagccucugagaagcuucugcuggggccaugaagg

SEQ ID NO: 498228 - RNA, 64 nt, Homo Sapiens
aggcggcauccccuaggccaguaguacccccagcucugagaaagcucucugucugcaccaggga

SEQ ID NO: 498229 - RNA, 64 nt, Homo Sapiens
agcccugucugucuccaccccauccccucuugucucugagaaccauucucccaccccaaguucc

SEQ ID NO: 498230 - RNA, 64 nt, Homo Sapiens
cuccccuggugucuguacuguguacacacaucccucugagaagcacaaggagacgacacgcgca

SEQ ID NO: 498231 - RNA, 64 nt, Homo Sapiens
ucuucauauccuucaucagguguuuuaagaugucucugagaagccaucaaggcaaaagagaacu

SEQ ID NO: 498232 - RNA, 64 nt, Homo Sapiens
gggggguguugugguuuuuuguuuuuguuuugcuucugagaaagcauuugccuuucuuccucuc

SEQ ID NO: 498233 - RNA, 64 nt, Homo Sapiens
aauacaugaauauuaagacuauaaguuuguauguucugagaauaguuuucuauucucugagaag

SEQ ID NO: 498234 - RNA, 64 nt, Homo Sapiens
uaaguuuguauguucugagaucuguuuucuauucucugagaagacuuugucacugagugaaauc

SEQ ID NO: 498235 - RNA, 64 nt, Homo Sapiens
gccugauguugauguacuuaucuuguuccgauacucugagaaguuaacagugcagauuccacgu

SEQ ID NO: 498236 - RNA, 64 nt, Homo Sapiens
gugaaguccagggaaaggcaauccuugguagcucucugagaacaguguugaaauccugucauga

SEQ ID NO: 498237 - RNA, 64 nt, Homo Sapiens
uuaauaagcccuugagauauagucacugucagcaucugagaacucuugaguaugaguuauguuu

SEQ ID NO: 498238 - RNA, 64 nt, Homo Sapiens
ucugaacacauagaucucuuauuuuuuauuuuuuucugagaaauuagggucugccugucuacau

SEQ ID NO: 498239 - RNA, 64 nt, Homo Sapiens
gggaggugaggagcgucucugucuggccaccccgucugagaagugaggagaccuccgcccggca

SEQ ID NO: 498240 - RNA, 64 nt, Homo Sapiens
gaagugaggagaccuccgcccggcagccgcccugucugagaagugaggagccccuccgcccggc

SEQ ID NO: 498241 - RNA, 64 nt, Homo Sapiens
gguccuugguugggucaaggcagcagcaccuuucucugagaagacugcccggggagcugcagag

SEQ ID NO: 498242 - RNA, 64 nt, Homo Sapiens
ugcgagacucugauggaaugcuugguaagaugacucugagaaaagccacccugcugcacuagga

SEQ ID NO: 498243 - RNA, 64 nt, Homo Sapiens
aauauaaaguaggcauggcuucccaauggaaaucucugagaaugacaguggaguugugcaagca

SEQ ID NO: 498244 - RNA, 64 nt, Homo Sapiens
aagggcugugccccaauggaaacugaguucauuuucugagaaagguuuggaugacugaaauauu

SEQ ID NO: 498245 - RNA, 64 nt, Homo Sapiens
cagugaacagaaaggagcagagagcaagauuagaucugagaagaugcucuggggacugagccca

SEQ ID NO: 498246 - RNA, 64 nt, Homo Sapiens
uggggcacucccagaccugccaugcaguuuauccucugagaauggaauuggaaaugaagaccua

SEQ ID NO: 498247 - RNA, 64 nt, Homo Sapiens
cuuuagagagaaaaaacucaguuacugaacugauucugagaaauacucaucuuuuuaaaguaua

SEQ ID NO: 498248 - RNA, 64 nt, Homo Sapiens
agcugugcucaauagccaacaggggaaccaggaaucugagaaucaguaaguaaaaggaccauag

SEQ ID NO: 498249 - RNA, 64 nt, Homo Sapiens
uccucggcccucccagucccaaaggagaagaacaucugagaaccgggcucuaaaaaaagcccca

SEQ ID NO: 498250 - RNA, 64 nt, Homo Sapiens
ugagauaagcccugagucucuucuucaaaagcauucugagaagguugagauuuuuaucucuuga

SEQ ID NO: 498251 - RNA, 64 nt, Homo Sapiens
gaauucuguaggcuaaaaauauucauguagcaaaucugagaauugaaaacugcagauaaccggc

SEQ ID NO: 498252 - RNA, 64 nt, Homo Sapiens
ccucccucacugaauguagaaucguugccaaguuucugagaagugucgauucccuguuaacaug

SEQ ID NO: 498253 - RNA, 64 nt, Homo Sapiens
aaccaaguaaaagucucguucauccuggagaguaucugagaaccggugucucugagaauccaaa

SEQ ID NO: 498254 - RNA, 64 nt, Homo Sapiens
caaacauccuggagaguaucgaggaccaggugucucugagaauccauuuccauggugcccagcu

SEQ ID NO: 498255 - RNA, 64 nt, Homo Sapiens
uaaagaucacaccaauuuagaaugaauauuaaagucugagaaauuuacaaaagggacucuaugg

SEQ ID NO: 498256 - RNA, 64 nt, Homo Sapiens
acacauggcacuuggaagaaaaagacccacugaaucugagaaaguacuuucugguggcaaauga

SEQ ID NO: 498257 - RNA, 64 nt, Homo Sapiens; identical to SEQ ID NO: 141261

SEQ ID NO: 498258 - RNA, 64 nt, Homo Sapiens; identical to SEQ ID NO: 141262

SEQ ID NO: 498259 - RNA, 64 nt, Homo Sapiens; identical to SEQ ID NO: 141263

SEQ ID NO: 498260 - RNA, 64 nt, Homo Sapiens; identical to SEQ ID NO: 141264

SEQ ID NO: 498261 - RNA, 64 nt, Homo Sapiens; identical to SEQ ID NO: 141265

SEQ ID NO: 498262 - RNA, 64 nt, Homo Sapiens; identical to SEQ ID NO: 141266

SEQ ID NO: 498263 - RNA, 64 nt, Homo Sapiens; identical to SEQ ID NO: 141267

SEQ ID NO: 498264 - RNA, 64 nt, Homo Sapiens; identical to SEQ ID NO: 141268

SEQ ID NO: 498265 - RNA, 64 nt, Homo Sapiens; identical to SEQ ID NO: 141269

SEQ ID NO: 498266 - RNA, 64 nt, Homo Sapiens; identical to SEQ ID NO: 141270

SEQ ID NO: 498267 - RNA, 64 nt, Homo Sapiens; identical to SEQ ID NO: 141271

SEQ ID NO: 498268 - RNA, 64 nt, Homo Sapiens; identical to SEQ ID NO: 141272

SEQ ID NO: 498269 - RNA, 64 nt, Homo Sapiens; identical to SEQ ID NO: 141273

SEQ ID NO: 498270 - RNA, 64 nt, Homo Sapiens; identical to SEQ ID NO: 141274

SEQ ID NO: 498271 - RNA, 64 nt, Homo Sapiens; identical to SEQ ID NO: 141275

SEQ ID NO: 498272 - RNA, 64 nt, Homo Sapiens; identical to SEQ ID NO: 141276

SEQ ID NO: 498273 - RNA, 64 nt, Homo Sapiens; identical to SEQ ID NO: 141277

SEQ ID NO: 498274 - RNA, 64 nt, Homo Sapiens; identical to SEQ ID NO: 141278

SEQ ID NO: 498275 - RNA, 64 nt, Homo Sapiens; identical to SEQ ID NO: 141279

SEQ ID NO: 498276 - RNA, 56 nt, Homo Sapiens; identical to SEQ ID NO: 141280

SEQ ID NO: 498277 - RNA, 64 nt, Homo Sapiens; identical to SEQ ID NO: 141281

SEQ ID NO: 498278 - RNA, 64 nt, Homo Sapiens; identical to SEQ ID NO: 141282

SEQ ID NO: 498279 - RNA, 64 nt, Homo Sapiens; identical to SEQ ID NO: 141283

SEQ ID NO: 498280 - RNA, 64 nt, Homo Sapiens; identical to SEQ ID NO: 141284

SEQ ID NO: 498281 - RNA, 64 nt, Homo Sapiens; identical to SEQ ID NO: 141285

SEQ ID NO: 498282 - RNA, 64 nt, Homo Sapiens; identical to SEQ ID NO: 141286

SEQ ID NO: 498283 - RNA, 64 nt, Homo Sapiens; identical to SEQ ID NO: 141287

SEQ ID NO: 498284 - RNA, 64 nt, Homo Sapiens; identical to SEQ ID NO: 141288

SEQ ID NO: 498285 - RNA, 64 nt, Homo Sapiens; identical to SEQ ID NO: 141289

SEQ ID NO: 498286 - RNA, 64 nt, Homo Sapiens; identical to SEQ ID NO: 141290

SEQ ID NO: 498287 - RNA, 64 nt, Homo Sapiens; identical to SEQ ID NO: 141291

SEQ ID NO: 498288 - RNA, 64 nt, Homo Sapiens; identical to SEQ ID NO: 141292

SEQ ID NO: 498289 - RNA, 64 nt, Homo Sapiens; identical to SEQ ID NO: 141293

SEQ ID NO: 498290 - RNA, 64 nt, Homo Sapiens; identical to SEQ ID NO: 141294

SEQ ID NO: 498291 - RNA, 64 nt, Homo Sapiens; identical to SEQ ID NO: 141295

SEQ ID NO: 498292 - RNA, 64 nt, Homo Sapiens; identical to SEQ ID NO: 141296

SEQ ID NO: 498293 - RNA, 64 nt, Homo Sapiens; identical to SEQ ID NO: 141297

SEQ ID NO: 498294 - RNA, 64 nt, Homo Sapiens; identical to SEQ ID NO: 141298

SEQ ID NO: 498295 - RNA, 64 nt, Homo Sapiens; identical to SEQ ID NO: 141299

SEQ ID NO: 498296 - RNA, 50 nt, Homo Sapiens; identical to SEQ ID NO: 141300

SEQ ID NO: 498297 - RNA, 64 nt, Homo Sapiens; identical to SEQ ID NO: 141301

SEQ ID NO: 498298 - RNA, 64 nt, Homo Sapiens; identical to SEQ ID NO: 141302

SEQ ID NO: 498299 - RNA, 64 nt, Homo Sapiens; identical to SEQ ID NO: 141303

SEQ ID NO: 498300 - RNA, 64 nt, Homo Sapiens; identical to SEQ ID NO: 141304

SEQ ID NO: 498301 - RNA, 64 nt, Homo Sapiens; identical to SEQ ID NO: 141305

SEQ ID NO: 498302 - RNA, 64 nt, Homo Sapiens; identical to SEQ ID NO: 141306

SEQ ID NO: 498303 - RNA, 64 nt, Homo Sapiens; identical to SEQ ID NO: 141307

SEQ ID NO: 498304 - RNA, 64 nt, Homo Sapiens; identical to SEQ ID NO: 141308

SEQ ID NO: 498305 - RNA, 64 nt, Homo Sapiens; identical to SEQ ID NO: 141309

SEQ ID NO: 498306 - RNA, 64 nt, Homo Sapiens; identical to SEQ ID NO: 141310

SEQ ID NO: 498307 - RNA, 64 nt, Homo Sapiens; identical to SEQ ID NO: 141311

SEQ ID NO: 498308 - RNA, 64 nt, Homo Sapiens; identical to SEQ ID NO: 141312

SEQ ID NO: 498309 - RNA, 64 nt, Homo Sapiens; identical to SEQ ID NO: 141313

SEQ ID NO: 498310 - RNA, 64 nt, Homo Sapiens; identical to SEQ ID NO: 141314

SEQ ID NO: 498311 - RNA, 64 nt, Homo Sapiens; identical to SEQ ID NO: 141315

SEQ ID NO: 498312 - RNA, 64 nt, Homo Sapiens; identical to SEQ ID NO: 141316

SEQ ID NO: 498313 - RNA, 64 nt, Homo Sapiens; identical to SEQ ID NO: 141317

SEQ ID NO: 498314 - RNA, 64 nt, Homo Sapiens; identical to SEQ ID NO: 141318

SEQ ID NO: 498315 - RNA, 64 nt, Homo Sapiens; identical to SEQ ID NO: 141319

SEQ ID NO: 498316 - RNA, 64 nt, Homo Sapiens; identical to SEQ ID NO: 141320

SEQ ID NO: 498317 - RNA, 64 nt, Homo Sapiens
agaugggcgcucccgacacagcgcagacccaccaggaggaaagaggcccagcucucagcugacg

SEQ ID NO: 498318 - RNA, 64 nt, Homo Sapiens
uccugguucucaccaggaaaacauccaaagcuuuggaggaaacaggcccugccccuggcuccuu

SEQ ID NO: 498319 - RNA, 64 nt, Homo Sapiens
gagcuauuuauauauauuauuuuuuuuuaagaaaggaggaaaagaaaccaaaaguuuuuuuuaa

SEQ ID NO: 498320 - RNA, 64 nt, Homo Sapiens
ugugcaauaugcccccugggucccaggagggucuggaggaaaacuggcuaucagaaccuccuga

SEQ ID NO: 498321 - RNA, 64 nt, Homo Sapiens
augguguuuggaauguuagaaaugacugaaucaaggaggaaaauaaaucauuaugucauuccau

SEQ ID NO: 498322 - RNA, 64 nt, Homo Sapiens
aaacuaaagaacaguuagagagcaguacauccugggaggaaaugacacgcccuauuuaaaaaag

SEQ ID NO: 498323 - RNA, 64 nt, Homo Sapiens
cccucuguuuggagcauuauaugcccuaaggacaggaggaaagaccguguagacacuaaaccuc

SEQ ID NO: 498324 - RNA, 64 nt, Homo Sapiens
gacuuagacgaaagaaaggagucaagugacaacaggaggaaauaaguuggguggacauaaauga

SEQ ID NO: 498325 - RNA, 64 nt, Homo Sapiens
ugcagguggguugggcaggguccuagccacacuuggaggaaaguguccuuguugauguuucuuc

SEQ ID NO: 498326 - RNA, 64 nt, Homo Sapiens
cccuguaacguuaccuaccuggagcgccacacauggaggaaagcugcugccaggauggagcaga

SEQ ID NO: 498327 - RNA, 64 nt, Homo Sapiens
agugcuagagcuugaagccacucaagccaguuggggaggaaagggaugcggagguacccucuag

SEQ ID NO: 498328 - RNA, 64 nt, Homo Sapiens
aaguaaggaagguacugcggacagugugggccagggaggaaaaccagagcacacaguuuuguca

SEQ ID NO: 498329 - RNA, 64 nt, Homo Sapiens
uaauuacagucaaaauauuuaaguggggaggaagggaggaaaaaaaucugcagcaugcuauaga

SEQ ID NO: 498330 - RNA, 64 nt, Homo Sapiens
gaagacuaaagccugcauacaagggaaugucacaggaggaaaaguuauaauauuuugugccuug

SEQ ID NO: 498331 - RNA, 64 nt, Homo Sapiens
ccucacuacaggggggccucuuggaaagccacugggaggaaaugcagagguucaugggacacag

SEQ ID NO: 498332 - RNA, 64 nt, Homo Sapiens
ucccaccaacuaccagaccaucucugagccuaaaggaggaaaagagccccugacagaaaaagga

SEQ ID NO: 498333 - RNA, 64 nt, Homo Sapiens
ccuucaucagaacgacuucaggcugaaaaaauagggaggaaauuagcuaagaggaggaaaaaaa

SEQ ID NO: 498334 - RNA, 64 nt, Homo Sapiens
aaggcugaaaaaauagggagcuucuuagcuaagaggaggaaaaagggcaguaucuuccugaugu

SEQ ID NO: 498335 - RNA, 64 nt, Homo Sapiens
augguagauucuguuaacuccccuagccugacccggaggaaagguguaaaguggcccccugcgg

SEQ ID NO: 498336 - RNA, 64 nt, Homo Sapiens
ugcaaguccauuauguaauaagugauaagugcagggaggaaaagaauuaaggucaagcccagaa

SEQ ID NO: 498337 - RNA, 64 nt, Homo Sapiens
aagcaugcauucuagcacaaugaauuccucauuuggaggaaaaaaaagaaauuccuauuugaaa

SEQ ID NO: 498338 - RNA, 64 nt, Homo Sapiens
uggggaagccuuggaaugcccugucuccguaaauggaggaaauggcugcaaguuagugaaacag

SEQ ID NO: 498339 - RNA, 64 nt, Homo Sapiens
agaugaggauugcauacaugaugaaugacagagaggaggaaaaaaacuaaauuuuaaugaacga

SEQ ID NO: 498340 - RNA, 64 nt, Homo Sapiens
cuagagaacagcaggucuaaugagucuacauggaggaggaaaugauuuaaguggauugaauaac

SEQ ID NO: 498341 - RNA, 64 nt, Homo Sapiens
gacauagauaaagaagauaucauuuuuccuuuuuggaggaaauguaauguacaacugacacugc

SEQ ID NO: 498342 - RNA, 64 nt, Homo Sapiens
cuucauuuguuggaaaugaaauauucaaagaaaaggaggaaaauaaauuuguaaaauguaauua

SEQ ID NO: 498343 - RNA, 64 nt, Homo Sapiens
ucacccuagauuacucaauuucaggguuccuaguggaggaaagcccauuccagcuguugccugu

SEQ ID NO: 498344 - RNA, 64 nt, Homo Sapiens
aaagaaaaggugcauuucaagaacuuggggggcaggaggaaagcacaauguuucuuagccagga

SEQ ID NO: 498345 - RNA, 64 nt, Homo Sapiens
cagaucggacuaaaaaaggagcucugacccaucuggaggaaaacgaggagggagggggccuagg

SEQ ID NO: 498346 - RNA, 64 nt, Homo Sapiens
cccucccucacccugcucccguguuuucuauagaggaggaaaggggucccuggacuggggguug

SEQ ID NO: 498347 - RNA, 64 nt, Homo Sapiens
gccucacccugggcccacagaccggccuuccuuuggaggaaaguguggccuggacugagggagg

SEQ ID NO: 498348 - RNA, 64 nt, Homo Sapiens
ccuuccuuuggaggaaaguguggccuggacugagggaggaaaugagcgaguucccucugacacc

SEQ ID NO: 498349 - RNA, 64 nt, Homo Sapiens
ccaggugacaggggcccugcuccucucugugguuggaggaaagaugagugaagggaucaacuuc

SEQ ID NO: 498350 - RNA, 64 nt, Homo Sapiens
gaucuucugccaccaucagggacaaacgggggcaggaggaaagucacugaugcccagauguuug

SEQ ID NO: 498351 - RNA, 64 nt, Homo Sapiens
aaaagaggggaaaaugaguuaagucuaggagcugggaggaaaagcuaggccacuccuccaaagg

SEQ ID NO: 498352 - RNA, 64 nt, Homo Sapiens
cagacaaaaacagccucacagcugagagacccaaggaggaaaaacaccaggcacgaacccaccu

SEQ ID NO: 498353 - RNA, 64 nt, Homo Sapiens
ccccugggggcuucuggcucccugccucccagagggaggaaaagaggugccccuaguucuuugu

SEQ ID NO: 498354 - RNA, 64 nt, Homo Sapiens
aaagaaaaccauuuucagggaggccagggaacggggaggaaacccuguccaaaccugugacccc

SEQ ID NO: 498355 - RNA, 64 nt, Homo Sapiens
uugugaaauacaguauaccgcaguggcucuagguggaggaaaggaggaaaaagugcuuauuaug

SEQ ID NO: 498356 - RNA, 64 nt, Homo Sapiens
uacaguauaccgcaguggcucuagguggaggaaaggaggaaaaagugcuuauuaugugcaacau

SEQ ID NO: 498357 - RNA, 64 nt, Homo Sapiens
ggucaauaaggucaagggaaaaacgagggcugauggaggaaaaagaggaguuuucuccauauca

SEQ ID NO: 498358 - RNA, 64 nt, Homo Sapiens
gaaaaaaagcaaaaagcaagccuaagacaugugaggaggaaaagcucgggaguccucuagcagg

SEQ ID NO: 498359 - RNA, 64 nt, Homo Sapiens
acagccucccugagccugcaguacugcccaaauaggaggaaaacuguguggcuuggaggaaaug

SEQ ID NO: 498360 - RNA, 64 nt, Homo Sapiens
guacugcccaaauaggaggagccuuguguggcuuggaggaaaugauucaugugacuagcgccug

SEQ ID NO: 498361 - RNA, 64 nt, Homo Sapiens
agaaaaugacacauugauaacaagguacaguuauggaggaaagagcaggucagcaguaagguuu

SEQ ID NO: 498362 - RNA, 64 nt, Homo Sapiens
gcccccaugauccaguuacccacaggaacagcauggaggaaaccucaugagaccggcucacuau

SEQ ID NO: 498363 - RNA, 64 nt, Homo Sapiens
agacuugaguagucuuugguaacuugugucaguuggaggaaaauccuccauacacugaggcaga

SEQ ID NO: 498364 - RNA, 64 nt, Homo Sapiens
cuguuaaaugucaaccuagaccuggaccugggugggaggaaacuguagccugaguguccacagg

SEQ ID NO: 498365 - RNA, 64 nt, Homo Sapiens
gccacagggcuagaagcacaggcccgucaccccaggaggaaaagcccagggucuggggcagcag

SEQ ID NO: 498366 - RNA, 64 nt, Homo Sapiens
guggggcaggaacaggaagugacgggaaccuugaggaggaaacgccuguguuagggagagagug
